United States Patent 7,691,997 (FUNCTIONAL AND HYPERFUNCTIONAL SIRNA) - sequence listing, part 18

SEQ ID NO: 711835 - RNA, 19 nt, Homo sapiens
uagaggacuuguuaaauga

SEQ ID NO: 711836 - RNA, 19 nt, Homo sapiens
gaaggacgcucaguuaaaa

SEQ ID NO: 711837 - RNA, 19 nt, Homo sapiens
ccaagugaauucaaugaug

SEQ ID NO: 711838 - RNA, 19 nt, Homo sapiens
cacauuaggugauauggaa

SEQ ID NO: 711839 - RNA, 19 nt, Homo sapiens
ugacauaaauuagccaaug

SEQ ID NO: 711840 - RNA, 19 nt, Homo sapiens
ugaaugaaguuagagauga

SEQ ID NO: 711841 - RNA, 19 nt, Homo sapiens
uaacucacccuaaagauau

SEQ ID NO: 711842 - RNA, 19 nt, Homo sapiens
caacagaauccaauuagga

SEQ ID NO: 711843 - RNA, 19 nt, Homo sapiens
cagcaaacauaauggagaa

SEQ ID NO: 711844 - RNA, 19 nt, Homo sapiens
cuuaaagacuuaccgaauu

SEQ ID NO: 711845 - RNA, 19 nt, Homo sapiens
caauagaggacuuguuaaa

SEQ ID NO: 711846 - RNA, 19 nt, Homo sapiens
ucacaucucagguaucuaa

SEQ ID NO: 711847 - RNA, 19 nt, Homo sapiens
gagaaggacgcucaguuaa

SEQ ID NO: 711848 - RNA, 19 nt, Homo sapiens
caguacagcugaauacaga

SEQ ID NO: 711849 - RNA, 19 nt, Homo sapiens
ucacaagaaucacuaaugg

SEQ ID NO: 711850 - RNA, 19 nt, Homo sapiens
cagcuaaaguuccaucaga

SEQ ID NO: 711851 - RNA, 19 nt, Homo sapiens
ggucaacagaauccaauua

SEQ ID NO: 711852 - RNA, 19 nt, Homo sapiens
gaacagcaaacauaaugga

SEQ ID NO: 711853 - RNA, 19 nt, Homo sapiens
auagaggacuuguuaaaug

SEQ ID NO: 711854 - RNA, 19 nt, Homo sapiens
caggaugggucuccaaaug

SEQ ID NO: 711855 - RNA, 19 nt, Homo sapiens
ucauggagaucauuuacuu

SEQ ID NO: 711856 - RNA, 19 nt, Homo sapiens
ggaaagcccuguguuugca

SEQ ID NO: 711857 - RNA, 19 nt, Homo sapiens
gaacaaaaugcaagguuua

SEQ ID NO: 711858 - RNA, 19 nt, Homo sapiens
gauuuacaaccuucaguua

SEQ ID NO: 711859 - RNA, 19 nt, Homo sapiens
aaaaguaucucccauauuc

SEQ ID NO: 711860 - RNA, 19 nt, Homo sapiens
ccuaauuucuccugauuug

SEQ ID NO: 711861 - RNA, 19 nt, Homo sapiens
ggcucuaaaucacuuaaua

SEQ ID NO: 711862 - RNA, 19 nt, Homo sapiens
caucugaacaggaccauaa

SEQ ID NO: 711863 - RNA, 19 nt, Homo sapiens
ccacaguucuuaugggaau

SEQ ID NO: 711864 - RNA, 19 nt, Homo sapiens
gaaaugguuugccagugau

SEQ ID NO: 711865 - RNA, 19 nt, Homo sapiens
ucucagguaucuaauuuga

SEQ ID NO: 711866 - RNA, 19 nt, Homo sapiens
ugaagucaguagaaauuga

SEQ ID NO: 711867 - RNA, 19 nt, Homo sapiens
ccaacacgcucucaguaau

SEQ ID NO: 711868 - RNA, 19 nt, Homo sapiens
ucagaaauauuugcagaga

SEQ ID NO: 711869 - RNA, 19 nt, Homo sapiens
gagagaagggaaaguuaaa

SEQ ID NO: 711870 - RNA, 19 nt, Homo sapiens
ggagaaguauaugacgaaa

SEQ ID NO: 711871 - RNA, 19 nt, Homo sapiens
ggaugggucuccaaaugau

SEQ ID NO: 711872 - RNA, 19 nt, Homo sapiens
uagcugcucuuaugucuuc

SEQ ID NO: 711873 - RNA, 19 nt, Homo sapiens
cuaaagguauaaaccagaa

SEQ ID NO: 711874 - RNA, 19 nt, Homo sapiens
caguagaaauugagaagga

SEQ ID NO: 711875 - RNA, 19 nt, Homo sapiens
gauggaaguuggcuggaau

SEQ ID NO: 711876 - RNA, 19 nt, Homo sapiens
ugaagagucuggucaccuu

SEQ ID NO: 711877 - RNA, 19 nt, Homo sapiens
cugaacaggaccauaauua

SEQ ID NO: 711878 - RNA, 19 nt, Homo sapiens
uucugaagcuuuccuguua

SEQ ID NO: 711879 - RNA, 19 nt, Homo sapiens
gaaacagccucaguaacuc

SEQ ID NO: 711880 - RNA, 19 nt, Homo sapiens
ccaagugacagauaaagaa

SEQ ID NO: 711881 - RNA, 19 nt, Homo sapiens
gcacuuuguagaaggcuua

SEQ ID NO: 711882 - RNA, 19 nt, Homo sapiens
aauaaugccugcguuagaa

SEQ ID NO: 711883 - RNA, 19 nt, Homo sapiens
ucagguaucuaauuugaag

SEQ ID NO: 711884 - RNA, 19 nt, Homo sapiens
gaauaauacugaugcuacu

SEQ ID NO: 711885 - RNA, 19 nt, Homo sapiens
guuaaauucugaagcuuuc

SEQ ID NO: 711886 - RNA, 19 nt, Homo sapiens
gaccaacacgcucucagua

SEQ ID NO: 711887 - RNA, 19 nt, Homo sapiens
agaaugacuugcagcacua

SEQ ID NO: 711888 - RNA, 19 nt, Homo sapiens
ucaagcaaauacacuucua

SEQ ID NO: 711889 - RNA, 19 nt, Homo sapiens
gaugaagacugauauuuuc

SEQ ID NO: 711890 - RNA, 19 nt, Homo sapiens
cagaagauacuguaaauac

SEQ ID NO: 711891 - RNA, 19 nt, Homo sapiens
guaauucaguaucgagcaa

SEQ ID NO: 711892 - RNA, 19 nt, Homo sapiens
uguaacaauugcaacagua

SEQ ID NO: 711893 - RNA, 19 nt, Homo sapiens
cuagaaacccacauugaaa

SEQ ID NO: 711894 - RNA, 19 nt, Homo sapiens
ugacauggcuacuacaaaa

SEQ ID NO: 711895 - RNA, 19 nt, Homo sapiens
acaaauaaugccugcguua

SEQ ID NO: 711896 - RNA, 19 nt, Homo sapiens
ggaaggugacuuuagguau

SEQ ID NO: 711897 - RNA, 19 nt, Homo sapiens
ccagaaggccagccacgua

SEQ ID NO: 711898 - RNA, 19 nt, Homo sapiens
gaacaaaucucaaacugau

SEQ ID NO: 711899 - RNA, 19 nt, Homo sapiens
gcccagagcccuaagauua

SEQ ID NO: 711900 - RNA, 19 nt, Homo sapiens
ggaagacccuuacuacugu

SEQ ID NO: 711901 - RNA, 19 nt, Homo sapiens
ccucacagcuuguauaaug

SEQ ID NO: 711902 - RNA, 19 nt, Homo sapiens
cuguagagcuugcaacuua

SEQ ID NO: 711903 - RNA, 19 nt, Homo sapiens
gaaaaggaaucguaucgua

SEQ ID NO: 711904 - RNA, 19 nt, Homo sapiens
gcaauaccgucauguuuca

SEQ ID NO: 711905 - RNA, 19 nt, Homo sapiens
gcuaagggauguccaaaca

SEQ ID NO: 711906 - RNA, 19 nt, Homo sapiens
gcccuaagauuacaaacaa

SEQ ID NO: 711907 - RNA, 19 nt, Homo sapiens
ccagacauauccuagcuaa

SEQ ID NO: 711908 - RNA, 19 nt, Homo sapiens
uaauugagcauccggaaua

SEQ ID NO: 711909 - RNA, 19 nt, Homo sapiens
gaacaguccucggugaauc

SEQ ID NO: 711910 - RNA, 19 nt, Homo sapiens
ggaauauggagaaguaauu

SEQ ID NO: 711911 - RNA, 19 nt, Homo sapiens
gcaagaacauaugccaguu

SEQ ID NO: 711912 - RNA, 19 nt, Homo sapiens
ccaaugccaugugaaguaa

SEQ ID NO: 711913 - RNA, 19 nt, Homo sapiens
ggaacaaaucucaaacuga

SEQ ID NO: 711914 - RNA, 19 nt, Homo sapiens
gggaacaaaucucaaacug

SEQ ID NO: 711915 - RNA, 19 nt, Homo sapiens
gcagaguucccuacccuaa

SEQ ID NO: 711916 - RNA, 19 nt, Homo sapiens
uccagaaccuccacucuuu

SEQ ID NO: 711917 - RNA, 19 nt, Homo sapiens
caagggaacaaaucucaaa

SEQ ID NO: 711918 - RNA, 19 nt, Homo sapiens
gcaggaagacccuuacuac

SEQ ID NO: 711919 - RNA, 19 nt, Homo sapiens
ucauguagcuagcuguaga

SEQ ID NO: 711920 - RNA, 19 nt, Homo sapiens
aaagagccaugcugucuag

SEQ ID NO: 711921 - RNA, 19 nt, Homo sapiens
gagaaguaauucagcuaca

SEQ ID NO: 711922 - RNA, 19 nt, Homo sapiens
gccaugcugucuagucuug

SEQ ID NO: 711923 - RNA, 19 nt, Homo sapiens
gaccaacgcaagaacauau

SEQ ID NO: 711924 - RNA, 19 nt, Homo sapiens
gagccaugcugucuagucu

SEQ ID NO: 711925 - RNA, 19 nt, Homo sapiens
ggcagaagcaccagcugua

SEQ ID NO: 711926 - RNA, 19 nt, Homo sapiens
agaguucccuacccuaaga

SEQ ID NO: 711927 - RNA, 19 nt, Homo sapiens
uccggaauauggagaagua

SEQ ID NO: 711928 - RNA, 19 nt, Homo sapiens
uccaagggaucgcugauga

SEQ ID NO: 711929 - RNA, 19 nt, Homo sapiens
gacaagggaacaaaucuca

SEQ ID NO: 711930 - RNA, 19 nt, Homo sapiens
guggcucacugaagcuuaa

SEQ ID NO: 711931 - RNA, 19 nt, Homo sapiens
caagggaucgcugaugauu

SEQ ID NO: 711932 - RNA, 19 nt, Homo sapiens
gaagcuuaagugaggauuu

SEQ ID NO: 711933 - RNA, 19 nt, Homo sapiens
gaccagacauauccuagcu

SEQ ID NO: 711934 - RNA, 19 nt, Homo sapiens
aagcaauaccgucauguuu

SEQ ID NO: 711935 - RNA, 19 nt, Homo sapiens
ucacagcuuguauaaugua

SEQ ID NO: 711936 - RNA, 19 nt, Homo sapiens
aaaccucacagcuuguaua

SEQ ID NO: 711937 - RNA, 19 nt, Homo sapiens
cugcaaugguacuguaauu

SEQ ID NO: 711938 - RNA, 19 nt, Homo sapiens
caagcaauaccgucauguu

SEQ ID NO: 711939 - RNA, 19 nt, Homo sapiens
cagagaaacggcaggaaga

SEQ ID NO: 711940 - RNA, 19 nt, Homo sapiens
caugugaaguaacaaacug

SEQ ID NO: 711941 - RNA, 19 nt, Homo sapiens
aggccaaccuucuaucaga

SEQ ID NO: 711942 - RNA, 19 nt, Homo sapiens
ggauuuccuugcaaugagu

SEQ ID NO: 711943 - RNA, 19 nt, Homo sapiens
cccaaugccaugugaagua

SEQ ID NO: 711944 - RNA, 19 nt, Homo sapiens
agaagcaccagcuguacua

SEQ ID NO: 711945 - RNA, 19 nt, Homo sapiens
aaaggaaucguaucguaug

SEQ ID NO: 711946 - RNA, 19 nt, Homo sapiens
uguagagcuugcaacuuaa

SEQ ID NO: 711947 - RNA, 19 nt, Homo sapiens
caaccuucuaucagaguua

SEQ ID NO: 711948 - RNA, 19 nt, Homo sapiens
agcaccagcuguacuacua

SEQ ID NO: 711949 - RNA, 19 nt, Homo sapiens
ccagagcccuaagauuaca

SEQ ID NO: 711950 - RNA, 19 nt, Homo sapiens
aagcuuaagugaggauuuc

SEQ ID NO: 711951 - RNA, 19 nt, Homo sapiens
gaagguucauggguuuuaa

SEQ ID NO: 711952 - RNA, 19 nt, Homo sapiens
uaaggacgaucagcugaag

SEQ ID NO: 711953 - RNA, 19 nt, Homo sapiens
uagugaaggcguuuaagaa

SEQ ID NO: 711954 - RNA, 19 nt, Homo sapiens
agggaucgcugaugauuac

SEQ ID NO: 711955 - RNA, 19 nt, Homo sapiens
gugaaggcguuuaagaaaa

SEQ ID NO: 711956 - RNA, 19 nt, Homo sapiens
ucgcugaugauuacgauaa

SEQ ID NO: 711957 - RNA, 19 nt, Homo sapiens
ggcaggaagacccuuacua

SEQ ID NO: 711958 - RNA, 19 nt, Homo sapiens
agacauauccuagcuaagg

SEQ ID NO: 711959 - RNA, 19 nt, Homo sapiens
caugcugucuagucuugaa

SEQ ID NO: 711960 - RNA, 19 nt, Homo sapiens
gaaaagagccaugcugucu

SEQ ID NO: 711961 - RNA, 19 nt, Homo sapiens
agugaaggcguuuaagaaa

SEQ ID NO: 711962 - RNA, 19 nt, Homo sapiens
cauaugccaguuccucgua

SEQ ID NO: 711963 - RNA, 19 nt, Homo sapiens
cuagugaaggcguuuaaga

SEQ ID NO: 711964 - RNA, 19 nt, Homo sapiens
gagaauguuaccaccugaa

SEQ ID NO: 711965 - RNA, 19 nt, Homo sapiens
gggguccgcuuuuaacuug

SEQ ID NO: 711966 - RNA, 19 nt, Homo sapiens
cugcuggcacugaggauua

SEQ ID NO: 711967 - RNA, 19 nt, Homo sapiens
gccaguuccucguagagau

SEQ ID NO: 711968 - RNA, 19 nt, Homo sapiens
ccaaccuucuaucagaguu

SEQ ID NO: 711969 - RNA, 19 nt, Homo sapiens
caccagcuguacuacuaga

SEQ ID NO: 711970 - RNA, 19 nt, Homo sapiens
ucccuucucucccuuguca

SEQ ID NO: 711971 - RNA, 19 nt, Homo sapiens
aggaagacccuuacuacug

SEQ ID NO: 711972 - RNA, 19 nt, Homo sapiens
gcugcccaaugccauguga

SEQ ID NO: 711973 - RNA, 19 nt, Homo sapiens
cacagcuuguauaauguaa

SEQ ID NO: 711974 - RNA, 19 nt, Homo sapiens
agccugaaaccaagcaaua

SEQ ID NO: 711975 - RNA, 19 nt, Homo sapiens
ccaguuccucguagagauu

SEQ ID NO: 711976 - RNA, 19 nt, Homo sapiens
ugaccaacgcaagaacaua

SEQ ID NO: 711977 - RNA, 19 nt, Homo sapiens
guagagcuugcaacuuaau

SEQ ID NO: 711978 - RNA, 19 nt, Homo sapiens
cguaucguauguccgcuau

SEQ ID NO: 711979 - RNA, 19 nt, Homo sapiens
aaccuucuaucagaguuaa

SEQ ID NO: 711980 - RNA, 19 nt, Homo sapiens
ugccugcaaugguacugua

SEQ ID NO: 711981 - RNA, 19 nt, Homo sapiens
guauguccgcuauccagaa

SEQ ID NO: 711982 - RNA, 19 nt, Homo sapiens
gacccuuacuacuguccaa

SEQ ID NO: 711983 - RNA, 19 nt, Homo sapiens
guaauugagcauccggaau

SEQ ID NO: 711984 - RNA, 19 nt, Homo sapiens
gcagaagcaccagcuguac

SEQ ID NO: 711985 - RNA, 19 nt, Homo sapiens
aaccucacagcuuguauaa

SEQ ID NO: 711986 - RNA, 19 nt, Homo sapiens
aagggaucgcugaugauua

SEQ ID NO: 711987 - RNA, 19 nt, Homo sapiens
gguggacagagcucaaaga

SEQ ID NO: 711988 - RNA, 19 nt, Homo sapiens
cuaaggacgaucagcugaa

SEQ ID NO: 711989 - RNA, 19 nt, Homo sapiens
uagagcuugcaacuuaaua

SEQ ID NO: 711990 - RNA, 19 nt, Homo sapiens
ggcagugucaagccugaaa

SEQ ID NO: 711991 - RNA, 19 nt, Homo sapiens
uuaacuuggacuaguguaa

SEQ ID NO: 711992 - RNA, 19 nt, Homo sapiens
aaggaaucguaucguaugu

SEQ ID NO: 711993 - RNA, 19 nt, Homo sapiens
gaagagagcaccuuuguuu

SEQ ID NO: 711994 - RNA, 19 nt, Homo sapiens
gaaacgaucuacaucauug

SEQ ID NO: 711995 - RNA, 19 nt, Homo sapiens
ggaaauguguuauaagcua

SEQ ID NO: 711996 - RNA, 19 nt, Homo sapiens
cccaagagcuggauauuaa

SEQ ID NO: 711997 - RNA, 19 nt, Homo sapiens
gagccuaaguguagagaua

SEQ ID NO: 711998 - RNA, 19 nt, Homo sapiens
caaggagccugucuaguaa

SEQ ID NO: 711999 - RNA, 19 nt, Homo sapiens
gcucauggaucuuuaguga

SEQ ID NO: 712000 - RNA, 19 nt, Homo sapiens
uuagaucgcugcuuacaua

SEQ ID NO: 712001 - RNA, 19 nt, Homo sapiens
uuacuuagaucgcugcuua

SEQ ID NO: 712002 - RNA, 19 nt, Homo sapiens
uggaaaggaugaacaaaua

SEQ ID NO: 712003 - RNA, 19 nt, Homo sapiens
ucaaggagccugucuagua

SEQ ID NO: 712004 - RNA, 19 nt, Homo sapiens
caaacucugucucuaagua

SEQ ID NO: 712005 - RNA, 19 nt, Homo sapiens
ggacuuagguucuuaugag

SEQ ID NO: 712006 - RNA, 19 nt, Homo sapiens
ggaagaaugucgucuacug

SEQ ID NO: 712007 - RNA, 19 nt, Homo sapiens
ugauaaggauucugaagua

SEQ ID NO: 712008 - RNA, 19 nt, Homo sapiens
guaaacagcccuuugauuc

SEQ ID NO: 712009 - RNA, 19 nt, Homo sapiens
ggacaaggaaugugauauu

SEQ ID NO: 712010 - RNA, 19 nt, Homo sapiens
gaaaguagcagaccuagag

SEQ ID NO: 712011 - RNA, 19 nt, Homo sapiens
gaaacaccauggagauaau

SEQ ID NO: 712012 - RNA, 19 nt, Homo sapiens
ccagaaaccugaacucauc

SEQ ID NO: 712013 - RNA, 19 nt, Homo sapiens
gauaaggauucugaaguaa

SEQ ID NO: 712014 - RNA, 19 nt, Homo sapiens
ggacagggauggguacgaa

SEQ ID NO: 712015 - RNA, 19 nt, Homo sapiens
gcaccuuuguuucugauuu

SEQ ID NO: 712016 - RNA, 19 nt, Homo sapiens
gcagaaauagagaucguua

SEQ ID NO: 712017 - RNA, 19 nt, Homo sapiens
gaaggcagccauucugauu

SEQ ID NO: 712018 - RNA, 19 nt, Homo sapiens
gauaaugugucuuacuuag

SEQ ID NO: 712019 - RNA, 19 nt, Homo sapiens
gauauugccacacuuagua

SEQ ID NO: 712020 - RNA, 19 nt, Homo sapiens
ggacugaccgggugagaaa

SEQ ID NO: 712021 - RNA, 19 nt, Homo sapiens
gagaaacgaucuacaucau

SEQ ID NO: 712022 - RNA, 19 nt, Homo sapiens
gcuagcagcuuauuuaaaa

SEQ ID NO: 712023 - RNA, 19 nt, Homo sapiens
caaagcauuucauugagaa

SEQ ID NO: 712024 - RNA, 19 nt, Homo sapiens
acaaaugggaguauacuua

SEQ ID NO: 712025 - RNA, 19 nt, Homo sapiens
gaagagaaacgaucuacau

SEQ ID NO: 712026 - RNA, 19 nt, Homo sapiens
aaacagcccuuugauucua

SEQ ID NO: 712027 - RNA, 19 nt, Homo sapiens
gacaaggaaugugauauug

SEQ ID NO: 712028 - RNA, 19 nt, Homo sapiens
gaagaaacauaagaagaag

SEQ ID NO: 712029 - RNA, 19 nt, Homo sapiens
guguagagauaguuuauga

SEQ ID NO: 712030 - RNA, 19 nt, Homo sapiens
ucagccaucucgugaauuu

SEQ ID NO: 712031 - RNA, 19 nt, Homo sapiens
gaagugggcaugaucagaa

SEQ ID NO: 712032 - RNA, 19 nt, Homo sapiens
aaccugaacucaucuguaa

SEQ ID NO: 712033 - RNA, 19 nt, Homo sapiens
ccaaugacgaccuaaauaa

SEQ ID NO: 712034 - RNA, 19 nt, Homo sapiens
guuacuaugucuucucuuu

SEQ ID NO: 712035 - RNA, 19 nt, Homo sapiens
gaaauuccucaguuuauga

SEQ ID NO: 712036 - RNA, 19 nt, Homo sapiens
ggauagauuugauaaugug

SEQ ID NO: 712037 - RNA, 19 nt, Homo sapiens
gauacagaaugugacaaua

SEQ ID NO: 712038 - RNA, 19 nt, Homo sapiens
agagauaguuuaugaagga

SEQ ID NO: 712039 - RNA, 19 nt, Homo sapiens
gaaaggcacagaucaagga

SEQ ID NO: 712040 - RNA, 19 nt, Homo sapiens
acagugagaggaaguauua

SEQ ID NO: 712041 - RNA, 19 nt, Homo sapiens
cagcuugccuucacagauu

SEQ ID NO: 712042 - RNA, 19 nt, Homo sapiens
gaaaugcuucuguguauuc

SEQ ID NO: 712043 - RNA, 19 nt, Homo sapiens
ccaaagcauuucauugaga

SEQ ID NO: 712044 - RNA, 19 nt, Homo sapiens
gauagcaguugguccagaa

SEQ ID NO: 712045 - RNA, 19 nt, Homo sapiens
ggaaaggaugaacaaauaa

SEQ ID NO: 712046 - RNA, 19 nt, Homo sapiens
ggaaccauuugaaacuaaa

SEQ ID NO: 712047 - RNA, 19 nt, Homo sapiens
gauucuaaguguccuauau

SEQ ID NO: 712048 - RNA, 19 nt, Homo sapiens
ggaguauacuuauuacagu

SEQ ID NO: 712049 - RNA, 19 nt, Homo sapiens
ggcaucagcugcuaaggaa

SEQ ID NO: 712050 - RNA, 19 nt, Homo sapiens
gcauuugugucugauuuaa

SEQ ID NO: 712051 - RNA, 19 nt, Homo sapiens
gcaguaaggaggccaacua

SEQ ID NO: 712052 - RNA, 19 nt, Homo sapiens
cuacugcagucuauuuaaa

SEQ ID NO: 712053 - RNA, 19 nt, Homo sapiens
guccagagcucauuauucu

SEQ ID NO: 712054 - RNA, 19 nt, Homo sapiens
gcugaugcaucuccugauu

SEQ ID NO: 712055 - RNA, 19 nt, Homo sapiens
gaaagcaucaugggaagaa

SEQ ID NO: 712056 - RNA, 19 nt, Homo sapiens
ggagcaaucuuacaguucu

SEQ ID NO: 712057 - RNA, 19 nt, Homo sapiens
gaaccagcccaguaacauu

SEQ ID NO: 712058 - RNA, 19 nt, Homo sapiens
gagaagagagcaccuuugu

SEQ ID NO: 712059 - RNA, 19 nt, Homo sapiens
gaucagaagaaucauagaa

SEQ ID NO: 712060 - RNA, 19 nt, Homo sapiens
ucauggaucuuuagugaau

SEQ ID NO: 712061 - RNA, 19 nt, Homo sapiens
caguuuaucuucugccaaa

SEQ ID NO: 712062 - RNA, 19 nt, Homo sapiens
gagaaucccuuuggacagu

SEQ ID NO: 712063 - RNA, 19 nt, Homo sapiens
gguagagacugugauaugu

SEQ ID NO: 712064 - RNA, 19 nt, Homo sapiens
uaauuaccauugacaguga

SEQ ID NO: 712065 - RNA, 19 nt, Homo sapiens
gaagaucacggagcagaaa

SEQ ID NO: 712066 - RNA, 19 nt, Homo sapiens
aauagaagcugaauuuggu

SEQ ID NO: 712067 - RNA, 19 nt, Homo sapiens
cagguuaaauugaggcauu

SEQ ID NO: 712068 - RNA, 19 nt, Homo sapiens
uaaaggaggauacagaaug

SEQ ID NO: 712069 - RNA, 19 nt, Homo sapiens
gcucagccaucucgugaau

SEQ ID NO: 712070 - RNA, 19 nt, Homo sapiens
uaaggauucugaaguaaag

SEQ ID NO: 712071 - RNA, 19 nt, Homo sapiens
gaacgaaaugcuucugugu

SEQ ID NO: 712072 - RNA, 19 nt, Homo sapiens
agaagaagcauaagaaaca

SEQ ID NO: 712073 - RNA, 19 nt, Homo sapiens
ggugauagcgauguuagua

SEQ ID NO: 712074 - RNA, 19 nt, Homo sapiens
gaacaggagcaaucuuaca

SEQ ID NO: 712075 - RNA, 19 nt, Homo sapiens
ucagauaauugugucauug

SEQ ID NO: 712076 - RNA, 19 nt, Homo sapiens
ugacagugaugauucuuca

SEQ ID NO: 712077 - RNA, 19 nt, Homo sapiens
gcugaaugcccacuaugua

SEQ ID NO: 712078 - RNA, 19 nt, Homo sapiens
aaaggaggauacagaaugu

SEQ ID NO: 712079 - RNA, 19 nt, Homo sapiens
aagaacaaaugcuaggaaa

SEQ ID NO: 712080 - RNA, 19 nt, Homo sapiens
caaaugggaguauacuuau

SEQ ID NO: 712081 - RNA, 19 nt, Homo sapiens
guugaacuguccucugauu

SEQ ID NO: 712082 - RNA, 19 nt, Homo sapiens
gaacugagcauuuuauaca

SEQ ID NO: 712083 - RNA, 19 nt, Homo sapiens
aagaugacuucaaggagua

SEQ ID NO: 712084 - RNA, 19 nt, Homo sapiens
guaacaacuugaauaaugc

SEQ ID NO: 712085 - RNA, 19 nt, Homo sapiens
uagcagugaucaugguaaa

SEQ ID NO: 712086 - RNA, 19 nt, Homo sapiens
gaacuguccucugauucug

SEQ ID NO: 712087 - RNA, 19 nt, Homo sapiens
ugaaauuccucaguuuaug

SEQ ID NO: 712088 - RNA, 19 nt, Homo sapiens
guugaaauuccucaguuua

SEQ ID NO: 712089 - RNA, 19 nt, Homo sapiens
caacaagaccuagagaugu

SEQ ID NO: 712090 - RNA, 19 nt, Homo sapiens
acgaaaugcuucuguguau

SEQ ID NO: 712091 - RNA, 19 nt, Homo sapiens
gcagucuauuuaaagauga

SEQ ID NO: 712092 - RNA, 19 nt, Homo sapiens
ccaguaacauugugucucu

SEQ ID NO: 712093 - RNA, 19 nt, Homo sapiens
gcagagaagucccaacuaa

SEQ ID NO: 712094 - RNA, 19 nt, Homo sapiens
gagaagucccaacuaauua

SEQ ID NO: 712095 - RNA, 19 nt, Homo sapiens
ccaaauaaauugcuguaag

SEQ ID NO: 712096 - RNA, 19 nt, Homo sapiens
gaggaucucucucaacaca

SEQ ID NO: 712097 - RNA, 19 nt, Homo sapiens
gugguuagcuacacucuga

SEQ ID NO: 712098 - RNA, 19 nt, Homo sapiens
caucucuccuugccaaaua

SEQ ID NO: 712099 - RNA, 19 nt, Homo sapiens
ccuguugucuagaauauuu

SEQ ID NO: 712100 - RNA, 19 nt, Homo sapiens
acagagagauuacgaacug

SEQ ID NO: 712101 - RNA, 19 nt, Homo sapiens
agacuaagcagcagauuga

SEQ ID NO: 712102 - RNA, 19 nt, Homo sapiens
gaaguacuggacauucuaa

SEQ ID NO: 712103 - RNA, 19 nt, Homo sapiens
uggaggagaucuauaagga

SEQ ID NO: 712104 - RNA, 19 nt, Homo sapiens
gaagacggaggcugagauu

SEQ ID NO: 712105 - RNA, 19 nt, Homo sapiens
agagaagucccaacuaauu

SEQ ID NO: 712106 - RNA, 19 nt, Homo sapiens
ucgaacagcucaaguccaa

SEQ ID NO: 712107 - RNA, 19 nt, Homo sapiens
ggaaguacuggacauucua

SEQ ID NO: 712108 - RNA, 19 nt, Homo sapiens
ucacaagccuuugagaaca

SEQ ID NO: 712109 - RNA, 19 nt, Homo sapiens
ccaaggcacagagagauua

SEQ ID NO: 712110 - RNA, 19 nt, Homo sapiens
uagcugaaguugccugaau

SEQ ID NO: 712111 - RNA, 19 nt, Homo sapiens
caaagugacuggggaagua

SEQ ID NO: 712112 - RNA, 19 nt, Homo sapiens
gggaaguacuggacauucu

SEQ ID NO: 712113 - RNA, 19 nt, Homo sapiens
gcaucagugugguuagcua

SEQ ID NO: 712114 - RNA, 19 nt, Homo sapiens
gagauuacgaacugaagaa

SEQ ID NO: 712115 - RNA, 19 nt, Homo sapiens
gaaugauccuccuguugca

SEQ ID NO: 712116 - RNA, 19 nt, Homo sapiens
gcuccagccugaaccaugu

SEQ ID NO: 712117 - RNA, 19 nt, Homo sapiens
gaucaguggucccuugacu

SEQ ID NO: 712118 - RNA, 19 nt, Homo sapiens
aaaggugucugcucaguac

SEQ ID NO: 712119 - RNA, 19 nt, Homo sapiens
gggaugggcuggagguuuu

SEQ ID NO: 712120 - RNA, 19 nt, Homo sapiens
caccucaacuuauuuaacu

SEQ ID NO: 712121 - RNA, 19 nt, Homo sapiens
gcugaggccuuugccauag

SEQ ID NO: 712122 - RNA, 19 nt, Homo sapiens
cugagcagauggccaagaa

SEQ ID NO: 712123 - RNA, 19 nt, Homo sapiens
gaacagcucaaguccaaaa

SEQ ID NO: 712124 - RNA, 19 nt, Homo sapiens
acagaugcccagccucaua

SEQ ID NO: 712125 - RNA, 19 nt, Homo sapiens
guuugugccuugucuugaa

SEQ ID NO: 712126 - RNA, 19 nt, Homo sapiens
gaagucccaacuaauuaug

SEQ ID NO: 712127 - RNA, 19 nt, Homo sapiens
gaaggacauucacgaugac

SEQ ID NO: 712128 - RNA, 19 nt, Homo sapiens
caaccucacacugcuauga

SEQ ID NO: 712129 - RNA, 19 nt, Homo sapiens
ucaacacacugacccucaa

SEQ ID NO: 712130 - RNA, 19 nt, Homo sapiens
gcuacacucugaaggacau

SEQ ID NO: 712131 - RNA, 19 nt, Homo sapiens
ucacuuguggcccaaauga

SEQ ID NO: 712132 - RNA, 19 nt, Homo sapiens
ggaagacggaggcugagau

SEQ ID NO: 712133 - RNA, 19 nt, Homo sapiens
gagccuguugucuagaaua

SEQ ID NO: 712134 - RNA, 19 nt, Homo sapiens
ggaucucucucaacacacu

SEQ ID NO: 712135 - RNA, 19 nt, Homo sapiens
gcuaaagccaagcaggaaa

SEQ ID NO: 712136 - RNA, 19 nt, Homo sapiens
cagaacagguuuucaaagu

SEQ ID NO: 712137 - RNA, 19 nt, Homo sapiens
ugaaguugccugaaugauc

SEQ ID NO: 712138 - RNA, 19 nt, Homo sapiens
gccagagaguguggaaaga

SEQ ID NO: 712139 - RNA, 19 nt, Homo sapiens
gaaaaggugucugcucagu

SEQ ID NO: 712140 - RNA, 19 nt, Homo sapiens
ucaaaguggccuccucaga

SEQ ID NO: 712141 - RNA, 19 nt, Homo sapiens
auaaggacaggcagaaauu

SEQ ID NO: 712142 - RNA, 19 nt, Homo sapiens
acauugcccuggagacguu

SEQ ID NO: 712143 - RNA, 19 nt, Homo sapiens
guuugagccuguugucuag

SEQ ID NO: 712144 - RNA, 19 nt, Homo sapiens
guacuggacauucuaacuc

SEQ ID NO: 712145 - RNA, 19 nt, Homo sapiens
ugacuucagccaauaagau

SEQ ID NO: 712146 - RNA, 19 nt, Homo sapiens
gagaucaguggucccuuga

SEQ ID NO: 712147 - RNA, 19 nt, Homo sapiens
uauaaggacaggcagaaau

SEQ ID NO: 712148 - RNA, 19 nt, Homo sapiens
gcuggagguuuucaacuuu

SEQ ID NO: 712149 - RNA, 19 nt, Homo sapiens
gcugaaguugccugaauga

SEQ ID NO: 712150 - RNA, 19 nt, Homo sapiens
cuaacucgccugccagaga

SEQ ID NO: 712151 - RNA, 19 nt, Homo sapiens
gcugagauugcccacauug

SEQ ID NO: 712152 - RNA, 19 nt, Homo sapiens
ucaguggucccuugacuuc

SEQ ID NO: 712153 - RNA, 19 nt, Homo sapiens
ggacaugcugcuagagaag

SEQ ID NO: 712154 - RNA, 19 nt, Homo sapiens
uggacaugcugcuagagaa

SEQ ID NO: 712155 - RNA, 19 nt, Homo sapiens
ugaccuggccuaucagcuu

SEQ ID NO: 712156 - RNA, 19 nt, Homo sapiens
aaucacaagccuuugagaa

SEQ ID NO: 712157 - RNA, 19 nt, Homo sapiens
cagagaagucccaacuaau

SEQ ID NO: 712158 - RNA, 19 nt, Homo sapiens
ccugaaugauccuccuguu

SEQ ID NO: 712159 - RNA, 19 nt, Homo sapiens
ccuuccagcuguaccaaga

SEQ ID NO: 712160 - RNA, 19 nt, Homo sapiens
gcugggauccgggaagcua

SEQ ID NO: 712161 - RNA, 19 nt, Homo sapiens
ucccugagcauguccauug

SEQ ID NO: 712162 - RNA, 19 nt, Homo sapiens
cagagaguguggaaagacu

SEQ ID NO: 712163 - RNA, 19 nt, Homo sapiens
agaagucccaacuaauuau

SEQ ID NO: 712164 - RNA, 19 nt, Homo sapiens
ggacuauuugcacucuuug

SEQ ID NO: 712165 - RNA, 19 nt, Homo sapiens
gccaaggcacagagagauu

SEQ ID NO: 712166 - RNA, 19 nt, Homo sapiens
gagaagcagaggccaagag

SEQ ID NO: 712167 - RNA, 19 nt, Homo sapiens
uguuugagccuguugucua

SEQ ID NO: 712168 - RNA, 19 nt, Homo sapiens
cuccagcggucccauguca

SEQ ID NO: 712169 - RNA, 19 nt, Homo sapiens
gggcagaacaaggagaugu

SEQ ID NO: 712170 - RNA, 19 nt, Homo sapiens
aggcugagauugcccacau

SEQ ID NO: 712171 - RNA, 19 nt, Homo sapiens
cagagagauuacgaacuga

SEQ ID NO: 712172 - RNA, 19 nt, Homo sapiens
cuguggaggagaucuauaa

SEQ ID NO: 712173 - RNA, 19 nt, Homo sapiens
ggcagagaagucccaacua

SEQ ID NO: 712174 - RNA, 19 nt, Homo sapiens
gagagauuacgaacugaag

SEQ ID NO: 712175 - RNA, 19 nt, Homo sapiens
agaagcagaggccaagaga

SEQ ID NO: 712176 - RNA, 19 nt, Homo sapiens
ucccuugacuucagccaau

SEQ ID NO: 712177 - RNA, 19 nt, Homo sapiens
acacacugacccucaaugu

SEQ ID NO: 712178 - RNA, 19 nt, Homo sapiens
caacacacugacccucaau

SEQ ID NO: 712179 - RNA, 19 nt, Homo sapiens
ggcuggagggcgugucuuu

SEQ ID NO: 712180 - RNA, 19 nt, Homo sapiens
ugacuguggaggagaucua

SEQ ID NO: 712181 - RNA, 19 nt, Homo sapiens
uugagccuguugucuagaa

SEQ ID NO: 712182 - RNA, 19 nt, Homo sapiens
cagaugcccagccucauag

SEQ ID NO: 712183 - RNA, 19 nt, Homo sapiens
agacggaggcugagauugc

SEQ ID NO: 712184 - RNA, 19 nt, Homo sapiens
gacuucagccaauaagauc

SEQ ID NO: 712185 - RNA, 19 nt, Homo sapiens
gaagaaguguugaagaaga

SEQ ID NO: 712186 - RNA, 19 nt, Homo sapiens
caagaaggaugaagaagug

SEQ ID NO: 712187 - RNA, 19 nt, Homo sapiens
uaaagaaugugaagcacuu

SEQ ID NO: 712188 - RNA, 19 nt, Homo sapiens
ggacgagugugacaagaug

SEQ ID NO: 712189 - RNA, 19 nt, Homo sapiens
gagaagcagugcaugaugu

SEQ ID NO: 712190 - RNA, 19 nt, Homo sapiens
ggauuacgaugaagaggaa

SEQ ID NO: 712191 - RNA, 19 nt, Homo sapiens
gaagcuagagauuguauga

SEQ ID NO: 712192 - RNA, 19 nt, Homo sapiens
gagucaacaucgucuuuaa

SEQ ID NO: 712193 - RNA, 19 nt, Homo sapiens
caaggaauaugagcgcuuu

SEQ ID NO: 712194 - RNA, 19 nt, Homo sapiens
aaaucgacaucuccacaua

SEQ ID NO: 712195 - RNA, 19 nt, Homo sapiens
caggaccgguuugaaguua

SEQ ID NO: 712196 - RNA, 19 nt, Homo sapiens
uggaugugcuggaguuuaa

SEQ ID NO: 712197 - RNA, 19 nt, Homo sapiens
gguggucucuccaucaaga

SEQ ID NO: 712198 - RNA, 19 nt, Homo sapiens
ugacgagaaugaugccaaa

SEQ ID NO: 712199 - RNA, 19 nt, Homo sapiens
uaucagcaguucaaggauu

SEQ ID NO: 712200 - RNA, 19 nt, Homo sapiens
ucaaagacagugagaagaa

SEQ ID NO: 712201 - RNA, 19 nt, Homo sapiens
caaggugucuguguucuuc

SEQ ID NO: 712202 - RNA, 19 nt, Homo sapiens
gcuagagauuguaugagaa

SEQ ID NO: 712203 - RNA, 19 nt, Homo sapiens
cuucugagguccagcauga

SEQ ID NO: 712204 - RNA, 19 nt, Homo sapiens
ggaccgguuugaaguuaau

SEQ ID NO: 712205 - RNA, 19 nt, Homo sapiens
gaaggaugaagaaguguug

SEQ ID NO: 712206 - RNA, 19 nt, Homo sapiens
caacaucgucuuuaacuac

SEQ ID NO: 712207 - RNA, 19 nt, Homo sapiens
augaagaaguguugaagaa

SEQ ID NO: 712208 - RNA, 19 nt, Homo sapiens
ucaacaucgucuuuaacua

SEQ ID NO: 712209 - RNA, 19 nt, Homo sapiens
gcuaucagcaguucaagga

SEQ ID NO: 712210 - RNA, 19 nt, Homo sapiens
gauaaucuucgucaaguca

SEQ ID NO: 712211 - RNA, 19 nt, Homo sapiens
gugauaaucuucgucaagu

SEQ ID NO: 712212 - RNA, 19 nt, Homo sapiens
aagaaguguugaagaagaa

SEQ ID NO: 712213 - RNA, 19 nt, Homo sapiens
gcuuugagcauccuucuga

SEQ ID NO: 712214 - RNA, 19 nt, Homo sapiens
guacuacgucaaacucaaa

SEQ ID NO: 712215 - RNA, 19 nt, Homo sapiens
gcucuuugaucucuuggau

SEQ ID NO: 712216 - RNA, 19 nt, Homo sapiens
uugagaagcuagagauugu

SEQ ID NO: 712217 - RNA, 19 nt, Homo sapiens
gagaagcuagagauuguau

SEQ ID NO: 712218 - RNA, 19 nt, Homo sapiens
gaguuuaaccaggugauaa

SEQ ID NO: 712219 - RNA, 19 nt, Homo sapiens
gcagcaguacuacgucaaa

SEQ ID NO: 712220 - RNA, 19 nt, Homo sapiens
gagcuucagccuaaagaau

SEQ ID NO: 712221 - RNA, 19 nt, Homo sapiens
gaugaagaaguguugaaga

SEQ ID NO: 712222 - RNA, 19 nt, Homo sapiens
cgcagcaacucgugucuga

SEQ ID NO: 712223 - RNA, 19 nt, Homo sapiens
caucguggacuguggcuuu

SEQ ID NO: 712224 - RNA, 19 nt, Homo sapiens
cgacaucuccacauacauc

SEQ ID NO: 712225 - RNA, 19 nt, Homo sapiens
gauccuacguuuccaucca

SEQ ID NO: 712226 - RNA, 19 nt, Homo sapiens
gaaaucgacaucuccacau

SEQ ID NO: 712227 - RNA, 19 nt, Homo sapiens
ggacaucgagcgagucaac

SEQ ID NO: 712228 - RNA, 19 nt, Homo sapiens
uuaaccaggugauaaucuu

SEQ ID NO: 712229 - RNA, 19 nt, Homo sapiens
ggaguuuaaccaggugaua

SEQ ID NO: 712230 - RNA, 19 nt, Homo sapiens
aaaccgaaguuggaagugu

SEQ ID NO: 712231 - RNA, 19 nt, Homo sapiens
cgagucaacaucgucuuua

SEQ ID NO: 712232 - RNA, 19 nt, Homo sapiens
gcgagucaacaucgucuuu

SEQ ID NO: 712233 - RNA, 19 nt, Homo sapiens
ucuuugaucucuuggaugu

SEQ ID NO: 712234 - RNA, 19 nt, Homo sapiens
caucauggcagaacaggau

SEQ ID NO: 712235 - RNA, 19 nt, Homo sapiens
caaagacagugagaagaac

SEQ ID NO: 712236 - RNA, 19 nt, Homo sapiens
ucaagaaggaugaagaagu

SEQ ID NO: 712237 - RNA, 19 nt, Homo sapiens
cagaggaaaucgacaucuc

SEQ ID NO: 712238 - RNA, 19 nt, Homo sapiens
caucaagggauccuacguu

SEQ ID NO: 712239 - RNA, 19 nt, Homo sapiens
gcgucaaggugucuguguu

SEQ ID NO: 712240 - RNA, 19 nt, Homo sapiens
guacaugcccagcgucaag

SEQ ID NO: 712241 - RNA, 19 nt, Homo sapiens
gcuucagccuaaagaaugu

SEQ ID NO: 712242 - RNA, 19 nt, Homo sapiens
gaagaacuguccccauguc

SEQ ID NO: 712243 - RNA, 19 nt, Homo sapiens
agcuagagauuguaugaga

SEQ ID NO: 712244 - RNA, 19 nt, Homo sapiens
aucaagggauccuacguuu

SEQ ID NO: 712245 - RNA, 19 nt, Homo sapiens
gaaccgcaagcucuuugau

SEQ ID NO: 712246 - RNA, 19 nt, Homo sapiens
ugaaguuaauguggcagaa

SEQ ID NO: 712247 - RNA, 19 nt, Homo sapiens
gcaguacuacgucaaacuc

SEQ ID NO: 712248 - RNA, 19 nt, Homo sapiens
gaaugugaagcacuuugug

SEQ ID NO: 712249 - RNA, 19 nt, Homo sapiens
guugagaagcuagagauug

SEQ ID NO: 712250 - RNA, 19 nt, Homo sapiens
gcaagcucuuugaucucuu

SEQ ID NO: 712251 - RNA, 19 nt, Homo sapiens
ggagaucuuccgccugaca

SEQ ID NO: 712252 - RNA, 19 nt, Homo sapiens
caagggauccuacguuucc

SEQ ID NO: 712253 - RNA, 19 nt, Homo sapiens
ggacuguggcuuugagcau

SEQ ID NO: 712254 - RNA, 19 nt, Homo sapiens
ccaaaggccuagccaucac

SEQ ID NO: 712255 - RNA, 19 nt, Homo sapiens
ggugauaaucuucgucaag

SEQ ID NO: 712256 - RNA, 19 nt, Homo sapiens
gaucagcaaggaauaugag

SEQ ID NO: 712257 - RNA, 19 nt, Homo sapiens
gaaguuggaagugucucuu

SEQ ID NO: 712258 - RNA, 19 nt, Homo sapiens
cgagaagcagugcaugaug

SEQ ID NO: 712259 - RNA, 19 nt, Homo sapiens
ggcgggaugugcaggagau

SEQ ID NO: 712260 - RNA, 19 nt, Homo sapiens
gguccagcaugagugcauu

SEQ ID NO: 712261 - RNA, 19 nt, Homo sapiens
cgagaaugaugccaaaauc

SEQ ID NO: 712262 - RNA, 19 nt, Homo sapiens
ccagaucagcaaggaauau

SEQ ID NO: 712263 - RNA, 19 nt, Homo sapiens
cuagagauuguaugagaau

SEQ ID NO: 712264 - RNA, 19 nt, Homo sapiens
ccaggaccgguuugaaguu

SEQ ID NO: 712265 - RNA, 19 nt, Homo sapiens
ggcagaacaggauguggaa

SEQ ID NO: 712266 - RNA, 19 nt, Homo sapiens
ucgguggucucuccaucaa

SEQ ID NO: 712267 - RNA, 19 nt, Homo sapiens
aucagcaguucaaggauuu

SEQ ID NO: 712268 - RNA, 19 nt, Homo sapiens
ucuuggaugugcuggaguu

SEQ ID NO: 712269 - RNA, 19 nt, Homo sapiens
ggaugaagaaguguugaag

SEQ ID NO: 712270 - RNA, 19 nt, Homo sapiens
cacgagaagcagugcauga

SEQ ID NO: 712271 - RNA, 19 nt, Homo sapiens
gggaugugcaggagaucuu

SEQ ID NO: 712272 - RNA, 19 nt, Homo sapiens
uaugagcgcuuuuccaagu

SEQ ID NO: 712273 - RNA, 19 nt, Homo sapiens
gcagaacaggauguggaaa

SEQ ID NO: 712274 - RNA, 19 nt, Homo sapiens
gaaaaccgaaguuggaagu

SEQ ID NO: 712275 - RNA, 19 nt, Homo sapiens
cgcaagcucuuugaucucu

SEQ ID NO: 712276 - RNA, 19 nt, Homo sapiens
ggagcuucagccuaaagaa

SEQ ID NO: 712277 - RNA, 19 nt, Homo sapiens
gaacggggagccagcauca

SEQ ID NO: 712278 - RNA, 19 nt, Homo sapiens
gaagaaguguugaagaaga

SEQ ID NO: 712279 - RNA, 19 nt, Homo sapiens
caagaaggaugaagaagug

SEQ ID NO: 712280 - RNA, 19 nt, Homo sapiens
uaaagaaugugaagcacuu

SEQ ID NO: 712281 - RNA, 19 nt, Homo sapiens
ggacgagugugacaagaug

SEQ ID NO: 712282 - RNA, 19 nt, Homo sapiens
gagaagcagugcaugaugu

SEQ ID NO: 712283 - RNA, 19 nt, Homo sapiens
ggauuacgaugaagaggaa

SEQ ID NO: 712284 - RNA, 19 nt, Homo sapiens
gaagcuagagauuguauga

SEQ ID NO: 712285 - RNA, 19 nt, Homo sapiens
gagucaacaucgucuuuaa

SEQ ID NO: 712286 - RNA, 19 nt, Homo sapiens
caaggaauaugagcgcuuu

SEQ ID NO: 712287 - RNA, 19 nt, Homo sapiens
aaaucgacaucuccacaua

SEQ ID NO: 712288 - RNA, 19 nt, Homo sapiens
ggaaguucaugcaggaugu

SEQ ID NO: 712289 - RNA, 19 nt, Homo sapiens
caggaccgguuugaaguua

SEQ ID NO: 712290 - RNA, 19 nt, Homo sapiens
uggaugugcuggaguuuaa

SEQ ID NO: 712291 - RNA, 19 nt, Homo sapiens
gguggucucuccaucaaga

SEQ ID NO: 712292 - RNA, 19 nt, Homo sapiens
ugacgagaaugaugccaaa

SEQ ID NO: 712293 - RNA, 19 nt, Homo sapiens
uaucagcaguucaaggauu

SEQ ID NO: 712294 - RNA, 19 nt, Homo sapiens
ucaaagacagugagaagaa

SEQ ID NO: 712295 - RNA, 19 nt, Homo sapiens
ggaagugucgcacaaagga

SEQ ID NO: 712296 - RNA, 19 nt, Homo sapiens
caaggugucuguguucuuc

SEQ ID NO: 712297 - RNA, 19 nt, Homo sapiens
gcuagagauuguaugagaa

SEQ ID NO: 712298 - RNA, 19 nt, Homo sapiens
gggcgagaguggcagcuuu

SEQ ID NO: 712299 - RNA, 19 nt, Homo sapiens
cuucugagguccagcauga

SEQ ID NO: 712300 - RNA, 19 nt, Homo sapiens
ggaccgguuugaaguuaau

SEQ ID NO: 712301 - RNA, 19 nt, Homo sapiens
gaaggaugaagaaguguug

SEQ ID NO: 712302 - RNA, 19 nt, Homo sapiens
caacaucgucuuuaacuac

SEQ ID NO: 712303 - RNA, 19 nt, Homo sapiens
augaagaaguguugaagaa

SEQ ID NO: 712304 - RNA, 19 nt, Homo sapiens
ucaacaucgucuuuaacua

SEQ ID NO: 712305 - RNA, 19 nt, Homo sapiens
gcuaucagcaguucaagga

SEQ ID NO: 712306 - RNA, 19 nt, Homo sapiens
gauaaucuucgucaaguca

SEQ ID NO: 712307 - RNA, 19 nt, Homo sapiens
gugauaaucuucgucaagu

SEQ ID NO: 712308 - RNA, 19 nt, Homo sapiens
aagaaguguugaagaagaa

SEQ ID NO: 712309 - RNA, 19 nt, Homo sapiens
gcuuugagcauccuucuga

SEQ ID NO: 712310 - RNA, 19 nt, Homo sapiens
guacuacgucaaacucaaa

SEQ ID NO: 712311 - RNA, 19 nt, Homo sapiens
gcucuuugaucucuuggau

SEQ ID NO: 712312 - RNA, 19 nt, Homo sapiens
uuugagcgauguuuacuga

SEQ ID NO: 712313 - RNA, 19 nt, Homo sapiens
uugagaagcuagagauugu

SEQ ID NO: 712314 - RNA, 19 nt, Homo sapiens
gagaagcuagagauuguau

SEQ ID NO: 712315 - RNA, 19 nt, Homo sapiens
gaguuuaaccaggugauaa

SEQ ID NO: 712316 - RNA, 19 nt, Homo sapiens
gcagcaguacuacgucaaa

SEQ ID NO: 712317 - RNA, 19 nt, Homo sapiens
gagcuucagccuaaagaau

SEQ ID NO: 712318 - RNA, 19 nt, Homo sapiens
gaugaagaaguguugaaga

SEQ ID NO: 712319 - RNA, 19 nt, Homo sapiens
cgcagcaacucgugucuga

SEQ ID NO: 712320 - RNA, 19 nt, Homo sapiens
ccaccucccuucccacaca

SEQ ID NO: 712321 - RNA, 19 nt, Homo sapiens
caucguggacuguggcuuu

SEQ ID NO: 712322 - RNA, 19 nt, Homo sapiens
cgacaucuccacauacauc

SEQ ID NO: 712323 - RNA, 19 nt, Homo sapiens
gauccuacguuuccaucca

SEQ ID NO: 712324 - RNA, 19 nt, Homo sapiens
gaaaucgacaucuccacau

SEQ ID NO: 712325 - RNA, 19 nt, Homo sapiens
ggacaucgagcgagucaac

SEQ ID NO: 712326 - RNA, 19 nt, Homo sapiens
uuaaccaggugauaaucuu

SEQ ID NO: 712327 - RNA, 19 nt, Homo sapiens
ggaguuuaaccaggugaua

SEQ ID NO: 712328 - RNA, 19 nt, Homo sapiens
aaaccgaaguuggaagugu

SEQ ID NO: 712329 - RNA, 19 nt, Homo sapiens
cgagucaacaucgucuuua

SEQ ID NO: 712330 - RNA, 19 nt, Homo sapiens
gcgagucaacaucgucuuu

SEQ ID NO: 712331 - RNA, 19 nt, Homo sapiens
ucuuugaucucuuggaugu

SEQ ID NO: 712332 - RNA, 19 nt, Homo sapiens
caaagacagugagaagaac

SEQ ID NO: 712333 - RNA, 19 nt, Homo sapiens
ucaagaaggaugaagaagu

SEQ ID NO: 712334 - RNA, 19 nt, Homo sapiens
caucauggcagaacaggau

SEQ ID NO: 712335 - RNA, 19 nt, Homo sapiens
cagaggaaaucgacaucuc

SEQ ID NO: 712336 - RNA, 19 nt, Homo sapiens
caucaagggauccuacguu

SEQ ID NO: 712337 - RNA, 19 nt, Homo sapiens
gcgucaaggugucuguguu

SEQ ID NO: 712338 - RNA, 19 nt, Homo sapiens
guacaugcccagcgucaag

SEQ ID NO: 712339 - RNA, 19 nt, Homo sapiens
gcuucagccuaaagaaugu

SEQ ID NO: 712340 - RNA, 19 nt, Homo sapiens
gaagaacuguccccauguc

SEQ ID NO: 712341 - RNA, 19 nt, Homo sapiens
agcuagagauuguaugaga

SEQ ID NO: 712342 - RNA, 19 nt, Homo sapiens
ugacggccuccacuuguuu

SEQ ID NO: 712343 - RNA, 19 nt, Homo sapiens
aucaagggauccuacguuu

SEQ ID NO: 712344 - RNA, 19 nt, Homo sapiens
gaaccgcaagcucuuugau

SEQ ID NO: 712345 - RNA, 19 nt, Homo sapiens
ugaaguuaauguggcagaa

SEQ ID NO: 712346 - RNA, 19 nt, Homo sapiens
gcaguacuacgucaaacuc

SEQ ID NO: 712347 - RNA, 19 nt, Homo sapiens
gaaugugaagcacuuugug

SEQ ID NO: 712348 - RNA, 19 nt, Homo sapiens
guugagaagcuagagauug

SEQ ID NO: 712349 - RNA, 19 nt, Homo sapiens
ggacuguggcuuugagcau

SEQ ID NO: 712350 - RNA, 19 nt, Homo sapiens
ccaggagcccagugucuga

SEQ ID NO: 712351 - RNA, 19 nt, Homo sapiens
gcaagcucuuugaucucuu

SEQ ID NO: 712352 - RNA, 19 nt, Homo sapiens
ggagaucuuccgccugaca

SEQ ID NO: 712353 - RNA, 19 nt, Homo sapiens
caagggauccuacguuucc

SEQ ID NO: 712354 - RNA, 19 nt, Homo sapiens
ccaaaggccuagccaucac

SEQ ID NO: 712355 - RNA, 19 nt, Homo sapiens
ggugauaaucuucgucaag

SEQ ID NO: 712356 - RNA, 19 nt, Homo sapiens
caaacugggagucaagcuu

SEQ ID NO: 712357 - RNA, 19 nt, Homo sapiens
gaucagcaaggaauaugag

SEQ ID NO: 712358 - RNA, 19 nt, Homo sapiens
gaaguuggaagugucucuu

SEQ ID NO: 712359 - RNA, 19 nt, Homo sapiens
cgagaagcagugcaugaug

SEQ ID NO: 712360 - RNA, 19 nt, Homo sapiens
gguccagcaugagugcauu

SEQ ID NO: 712361 - RNA, 19 nt, Homo sapiens
ggcgggaugugcaggagau

SEQ ID NO: 712362 - RNA, 19 nt, Homo sapiens
cgagaaugaugccaaaauc

SEQ ID NO: 712363 - RNA, 19 nt, Homo sapiens
guucugggcaggcgagaug

SEQ ID NO: 712364 - RNA, 19 nt, Homo sapiens
ccagaucagcaaggaauau

SEQ ID NO: 712365 - RNA, 19 nt, Homo sapiens
cuagagauuguaugagaau

SEQ ID NO: 712366 - RNA, 19 nt, Homo sapiens
ccaggaccgguuugaaguu

SEQ ID NO: 712367 - RNA, 19 nt, Homo sapiens
ggcagaacaggauguggaa

SEQ ID NO: 712368 - RNA, 19 nt, Homo sapiens
ucugggaagugucgcacaa

SEQ ID NO: 712369 - RNA, 19 nt, Homo sapiens
ucgguggucucuccaucaa

SEQ ID NO: 712370 - RNA, 19 nt, Homo sapiens
aucagcaguucaaggauuu

SEQ ID NO: 712371 - RNA, 19 nt, Homo sapiens
ucuuggaugugcuggaguu

SEQ ID NO: 712372 - RNA, 19 nt, Homo sapiens
ggaugaagaaguguugaag

SEQ ID NO: 712373 - RNA, 19 nt, Homo sapiens
cacgagaagcagugcauga

SEQ ID NO: 712374 - RNA, 19 nt, Homo sapiens
gggaugugcaggagaucuu

SEQ ID NO: 712375 - RNA, 19 nt, Homo sapiens
uaugagcgcuuuuccaagu

SEQ ID NO: 712376 - RNA, 19 nt, Homo sapiens
cugacggccuccacuuguu

SEQ ID NO: 712377 - RNA, 19 nt, Homo sapiens
cgcaagcucuuugaucucu

SEQ ID NO: 712378 - RNA, 19 nt, Homo sapiens
caauaaggcuguagaagaa

SEQ ID NO: 712379 - RNA, 19 nt, Homo sapiens
cagaagauguugcuaaauu

SEQ ID NO: 712380 - RNA, 19 nt, Homo sapiens
gaacaagucuauaucucuu

SEQ ID NO: 712381 - RNA, 19 nt, Homo sapiens
ggacuaaacagacauuauu

SEQ ID NO: 712382 - RNA, 19 nt, Homo sapiens
ggacagacuucuuagacuu

SEQ ID NO: 712383 - RNA, 19 nt, Homo sapiens
caaauauuguccaguguuu

SEQ ID NO: 712384 - RNA, 19 nt, Homo sapiens
guacuuaugaccucaaaua

SEQ ID NO: 712385 - RNA, 19 nt, Homo sapiens
cuuaugaccucaaauauug

SEQ ID NO: 712386 - RNA, 19 nt, Homo sapiens
gaacagcuggcaauaaaga

SEQ ID NO: 712387 - RNA, 19 nt, Homo sapiens
ggacuacagugaacauugu

SEQ ID NO: 712388 - RNA, 19 nt, Homo sapiens
ggacaugaaccaagacaaa

SEQ ID NO: 712389 - RNA, 19 nt, Homo sapiens
caauggaaguuauggguuu

SEQ ID NO: 712390 - RNA, 19 nt, Homo sapiens
aaggaaagguuguuauuga

SEQ ID NO: 712391 - RNA, 19 nt, Homo sapiens
cugaacagcuggcaauaaa

SEQ ID NO: 712392 - RNA, 19 nt, Homo sapiens
gaaccaagacaaacaacuu

SEQ ID NO: 712393 - RNA, 19 nt, Homo sapiens
ggacacagcagaacaaguc

SEQ ID NO: 712394 - RNA, 19 nt, Homo sapiens
gaagaagaagauaagauga

SEQ ID NO: 712395 - RNA, 19 nt, Homo sapiens
gaagauguugcuaaauuug

SEQ ID NO: 712396 - RNA, 19 nt, Homo sapiens
cagagugauugauguguuu

SEQ ID NO: 712397 - RNA, 19 nt, Homo sapiens
gauuauaccgucagaguga

SEQ ID NO: 712398 - RNA, 19 nt, Homo sapiens
gauccaguguuccaagcua

SEQ ID NO: 712399 - RNA, 19 nt, Homo sapiens
gauggaagguuugacacuu

SEQ ID NO: 712400 - RNA, 19 nt, Homo sapiens
agaguuggauggaagguuu

SEQ ID NO: 712401 - RNA, 19 nt, Homo sapiens
ggcauuaauucauggacua

SEQ ID NO: 712402 - RNA, 19 nt, Homo sapiens
aaagagauguuggaauuag

SEQ ID NO: 712403 - RNA, 19 nt, Homo sapiens
aaaaugaacuggaacagaa

SEQ ID NO: 712404 - RNA, 19 nt, Homo sapiens
gaaucugggucacuuaaac

SEQ ID NO: 712405 - RNA, 19 nt, Homo sapiens
cagcagaacaagucuauau

SEQ ID NO: 712406 - RNA, 19 nt, Homo sapiens
uaagaguuguaguuacuga

SEQ ID NO: 712407 - RNA, 19 nt, Homo sapiens
uaaagaauguuggcaagca

SEQ ID NO: 712408 - RNA, 19 nt, Homo sapiens
acaauaaggcuguagaaga

SEQ ID NO: 712409 - RNA, 19 nt, Homo sapiens
uaagaagaguuggauggaa

SEQ ID NO: 712410 - RNA, 19 nt, Homo sapiens
gaacuggaacagaagaugu

SEQ ID NO: 712411 - RNA, 19 nt, Homo sapiens
ccagaaauauggacagacu

SEQ ID NO: 712412 - RNA, 19 nt, Homo sapiens
ggaaagguuguuauugaug

SEQ ID NO: 712413 - RNA, 19 nt, Homo sapiens
aauauggacagacuucuua

SEQ ID NO: 712414 - RNA, 19 nt, Homo sapiens
gaccagaaauauggacaga

SEQ ID NO: 712415 - RNA, 19 nt, Homo sapiens
uauguuggauacugucgua

SEQ ID NO: 712416 - RNA, 19 nt, Homo sapiens
gcaagacaaggguccauau

SEQ ID NO: 712417 - RNA, 19 nt, Homo sapiens
ugauugauguguuugcuau

SEQ ID NO: 712418 - RNA, 19 nt, Homo sapiens
ucagagugauugauguguu

SEQ ID NO: 712419 - RNA, 19 nt, Homo sapiens
cacaaugaaucagugguaa

SEQ ID NO: 712420 - RNA, 19 nt, Homo sapiens
gcagaacaagucuauaucu

SEQ ID NO: 712421 - RNA, 19 nt, Homo sapiens
agaagaagaagauaagaug

SEQ ID NO: 712422 - RNA, 19 nt, Homo sapiens
uguaguuacugaccagaaa

SEQ ID NO: 712423 - RNA, 19 nt, Homo sapiens
gcagcuauguuggauacug

SEQ ID NO: 712424 - RNA, 19 nt, Homo sapiens
guuugacacuucaggacua

SEQ ID NO: 712425 - RNA, 19 nt, Homo sapiens
caagacaaacaacuucgaa

SEQ ID NO: 712426 - RNA, 19 nt, Homo sapiens
cuuaggacaugaaccaaga

SEQ ID NO: 712427 - RNA, 19 nt, Homo sapiens
gaugguuguugguugguau

SEQ ID NO: 712428 - RNA, 19 nt, Homo sapiens
acaaacaacuucgaaucug

SEQ ID NO: 712429 - RNA, 19 nt, Homo sapiens
gacaaacaacuucgaaucu

SEQ ID NO: 712430 - RNA, 19 nt, Homo sapiens
agaagaagauaagaugaca

SEQ ID NO: 712431 - RNA, 19 nt, Homo sapiens
guaaacacaaugaaucagu

SEQ ID NO: 712432 - RNA, 19 nt, Homo sapiens
gaaguuguaccugccagaa

SEQ ID NO: 712433 - RNA, 19 nt, Homo sapiens
gcuaaaauguuggauaugu

SEQ ID NO: 712434 - RNA, 19 nt, Homo sapiens
uuugaugcuuggagaauuu

SEQ ID NO: 712435 - RNA, 19 nt, Homo sapiens
cagaacaagucuauaucuc

SEQ ID NO: 712436 - RNA, 19 nt, Homo sapiens
gccaagaauuacaauaagg

SEQ ID NO: 712437 - RNA, 19 nt, Homo sapiens
auugaugccuucagauuga

SEQ ID NO: 712438 - RNA, 19 nt, Homo sapiens
uuggagaauuuguugauga

SEQ ID NO: 712439 - RNA, 19 nt, Homo sapiens
gauaagaugacaccugaac

SEQ ID NO: 712440 - RNA, 19 nt, Homo sapiens
aguuguaccugccagaauu

SEQ ID NO: 712441 - RNA, 19 nt, Homo sapiens
acacaaugaaucaguggua

SEQ ID NO: 712442 - RNA, 19 nt, Homo sapiens
ggcaguugauccaguguuc

SEQ ID NO: 712443 - RNA, 19 nt, Homo sapiens
ccauuacuauuaacuaucg

SEQ ID NO: 712444 - RNA, 19 nt, Homo sapiens
guuccaagcuaaaauguug

SEQ ID NO: 712445 - RNA, 19 nt, Homo sapiens
uuacugaccagaaauaugg

SEQ ID NO: 712446 - RNA, 19 nt, Homo sapiens
cagcuauguuggauacugu

SEQ ID NO: 712447 - RNA, 19 nt, Homo sapiens
cuuaagaguuguaguuacu

SEQ ID NO: 712448 - RNA, 19 nt, Homo sapiens
gcauuaauucauggacuaa

SEQ ID NO: 712449 - RNA, 19 nt, Homo sapiens
aaaggaaagguuguuauug

SEQ ID NO: 712450 - RNA, 19 nt, Homo sapiens
ucaaauauuguccaguguu

SEQ ID NO: 712451 - RNA, 19 nt, Homo sapiens
cagacauuauuacuccauu

SEQ ID NO: 712452 - RNA, 19 nt, Homo sapiens
gacagacuucuuagacuug

SEQ ID NO: 712453 - RNA, 19 nt, Homo sapiens
ugucaaacucaacaaauug

SEQ ID NO: 712454 - RNA, 19 nt, Homo sapiens
uaaacaagccaucuaucca

SEQ ID NO: 712455 - RNA, 19 nt, Homo sapiens
agacaaacaacuucgaauc

SEQ ID NO: 712456 - RNA, 19 nt, Homo sapiens
ggcuuugguuguuggcuuu

SEQ ID NO: 712457 - RNA, 19 nt, Homo sapiens
ucucuucccuggcacuguu

SEQ ID NO: 712458 - RNA, 19 nt, Homo sapiens
guuguaccugccagaauua

SEQ ID NO: 712459 - RNA, 19 nt, Homo sapiens
aggaaagguuguuauugau

SEQ ID NO: 712460 - RNA, 19 nt, Homo sapiens
caccuuaagaguuguaguu

SEQ ID NO: 712461 - RNA, 19 nt, Homo sapiens
agaaauauggacagacuuc

SEQ ID NO: 712462 - RNA, 19 nt, Homo sapiens
gaucccauucagaguguaa

SEQ ID NO: 712463 - RNA, 19 nt, Homo sapiens
ucacagucacccuggcuuu

SEQ ID NO: 712464 - RNA, 19 nt, Homo sapiens
uggagaauuuguugaugau

SEQ ID NO: 712465 - RNA, 19 nt, Homo sapiens
guuugaugcuuggagaauu

SEQ ID NO: 712466 - RNA, 19 nt, Homo sapiens
caagacaaggguccauauc

SEQ ID NO: 712467 - RNA, 19 nt, Homo sapiens
auaaggcuguagaagaaga

SEQ ID NO: 712468 - RNA, 19 nt, Homo sapiens
ggucuuaggacaugaacca

SEQ ID NO: 712469 - RNA, 19 nt, Homo sapiens
guuguugguugguaucaca

SEQ ID NO: 712470 - RNA, 19 nt, Homo sapiens
guaaaaggaaagguuguua

SEQ ID NO: 712471 - RNA, 19 nt, Homo sapiens
acacucagcagagcuuuga

SEQ ID NO: 712472 - RNA, 19 nt, Homo sapiens
cacccuggcuuugguuguu

SEQ ID NO: 712473 - RNA, 19 nt, Homo sapiens
ggcaagacaaggguccaua

SEQ ID NO: 712474 - RNA, 19 nt, Homo sapiens
uaacaccuuaagaguugua

SEQ ID NO: 712475 - RNA, 19 nt, Homo sapiens
cuucgaaucugggucacuu

SEQ ID NO: 712476 - RNA, 19 nt, Homo sapiens
uaagaugacaccugaacag

SEQ ID NO: 712477 - RNA, 19 nt, Homo sapiens
uuauugaugccuucagauu

SEQ ID NO: 712478 - RNA, 19 nt, Homo sapiens
gaaagcagcuggugauuua

SEQ ID NO: 712479 - RNA, 19 nt, Homo sapiens
gaacggagaugacaccuuu

SEQ ID NO: 712480 - RNA, 19 nt, Homo sapiens
ugaggaagaugaugaguaa

SEQ ID NO: 712481 - RNA, 19 nt, Homo sapiens
gauauuagcguuuccauug

SEQ ID NO: 712482 - RNA, 19 nt, Homo sapiens
ccaaauacuucucuaagga

SEQ ID NO: 712483 - RNA, 19 nt, Homo sapiens
caugauaucuggacccaaa

SEQ ID NO: 712484 - RNA, 19 nt, Homo sapiens
gaaagcaaguguucacaac

SEQ ID NO: 712485 - RNA, 19 nt, Homo sapiens
gagcaagacauacuuaaug

SEQ ID NO: 712486 - RNA, 19 nt, Homo sapiens
gggcaguucugaguguuua

SEQ ID NO: 712487 - RNA, 19 nt, Homo sapiens
ucaaauaccagagaagaua

SEQ ID NO: 712488 - RNA, 19 nt, Homo sapiens
gacaguaaauaaaccuuug

SEQ ID NO: 712489 - RNA, 19 nt, Homo sapiens
gaagugugucauucuguua

SEQ ID NO: 712490 - RNA, 19 nt, Homo sapiens
gcagaggaaggaaauguuu

SEQ ID NO: 712491 - RNA, 19 nt, Homo sapiens
caaaaggccuucgaugaua

SEQ ID NO: 712492 - RNA, 19 nt, Homo sapiens
guaauaaacgggucacaga

SEQ ID NO: 712493 - RNA, 19 nt, Homo sapiens
gaugagcaagacauacuua

SEQ ID NO: 712494 - RNA, 19 nt, Homo sapiens
ccaacuaccucugagaaga

SEQ ID NO: 712495 - RNA, 19 nt, Homo sapiens
cgaagaucaugcccaagaa

SEQ ID NO: 712496 - RNA, 19 nt, Homo sapiens
gaaaaucgucuauguguau

SEQ ID NO: 712497 - RNA, 19 nt, Homo sapiens
caucuuucaugcguaauaa

SEQ ID NO: 712498 - RNA, 19 nt, Homo sapiens
ugaagugugucauucuguu

SEQ ID NO: 712499 - RNA, 19 nt, Homo sapiens
uauuagcguuuccauugua

SEQ ID NO: 712500 - RNA, 19 nt, Homo sapiens
cacgguuggugcucaaaua

SEQ ID NO: 712501 - RNA, 19 nt, Homo sapiens
ggagaugacaccuuugcaa

SEQ ID NO: 712502 - RNA, 19 nt, Homo sapiens
ccaugcaccuaccuuagaa

SEQ ID NO: 712503 - RNA, 19 nt, Homo sapiens
caaauacuucucuaaggaa

SEQ ID NO: 712504 - RNA, 19 nt, Homo sapiens
agaagcaucuggcccacaa

SEQ ID NO: 712505 - RNA, 19 nt, Homo sapiens
caagaagccagcagaggaa

SEQ ID NO: 712506 - RNA, 19 nt, Homo sapiens
ccaaguaccaguauaagca

SEQ ID NO: 712507 - RNA, 19 nt, Homo sapiens
cugagaagauuaacaugau

SEQ ID NO: 712508 - RNA, 19 nt, Homo sapiens
gaaggaagugccagaagca

SEQ ID NO: 712509 - RNA, 19 nt, Homo sapiens
gccaaauacuucucuaagg

SEQ ID NO: 712510 - RNA, 19 nt, Homo sapiens
ucaguuaccucugcaugga

SEQ ID NO: 712511 - RNA, 19 nt, Homo sapiens
caagugaaagcaaguguuc

SEQ ID NO: 712512 - RNA, 19 nt, Homo sapiens
ggccaugacuaaacuaggu

SEQ ID NO: 712513 - RNA, 19 nt, Homo sapiens
aguaugaggccaugacuaa

SEQ ID NO: 712514 - RNA, 19 nt, Homo sapiens
gcucaaauaccagagaaga

SEQ ID NO: 712515 - RNA, 19 nt, Homo sapiens
guauaagcaucucccaucu

SEQ ID NO: 712516 - RNA, 19 nt, Homo sapiens
acaccaaguaccaguauaa

SEQ ID NO: 712517 - RNA, 19 nt, Homo sapiens
ugccaagaguacgauauua

SEQ ID NO: 712518 - RNA, 19 nt, Homo sapiens
ggugauuuaugaagagauc

SEQ ID NO: 712519 - RNA, 19 nt, Homo sapiens
gcaccuaccuuagaaaaca

SEQ ID NO: 712520 - RNA, 19 nt, Homo sapiens
gcaagugaaagcaaguguu

SEQ ID NO: 712521 - RNA, 19 nt, Homo sapiens
ucaggugcauagcaaguga

SEQ ID NO: 712522 - RNA, 19 nt, Homo sapiens
gaaaaccaacuaccucuga

SEQ ID NO: 712523 - RNA, 19 nt, Homo sapiens
ggaagugccagaagcaucu

SEQ ID NO: 712524 - RNA, 19 nt, Homo sapiens
guucaacguccucagauga

SEQ ID NO: 712525 - RNA, 19 nt, Homo sapiens
aaauaaaccuuugcaaacg

SEQ ID NO: 712526 - RNA, 19 nt, Homo sapiens
caagacauacuuaaugcau

SEQ ID NO: 712527 - RNA, 19 nt, Homo sapiens
uagcguuuccauuguauuu

SEQ ID NO: 712528 - RNA, 19 nt, Homo sapiens
ccgaagaucaugcccaaga

SEQ ID NO: 712529 - RNA, 19 nt, Homo sapiens
gaaaguaugaggccaugac

SEQ ID NO: 712530 - RNA, 19 nt, Homo sapiens
cacagacacacaccaagua

SEQ ID NO: 712531 - RNA, 19 nt, Homo sapiens
acacaaaccacaccacaca

SEQ ID NO: 712532 - RNA, 19 nt, Homo sapiens
gugcucaaauaccagagaa

SEQ ID NO: 712533 - RNA, 19 nt, Homo sapiens
cccuagaugugacuacuga

SEQ ID NO: 712534 - RNA, 19 nt, Homo sapiens
gagaaaaucgucuaugugu

SEQ ID NO: 712535 - RNA, 19 nt, Homo sapiens
ugagggcaguucugagugu

SEQ ID NO: 712536 - RNA, 19 nt, Homo sapiens
gucaucaggugcauagcaa

SEQ ID NO: 712537 - RNA, 19 nt, Homo sapiens
caacuaccucugagaagau

SEQ ID NO: 712538 - RNA, 19 nt, Homo sapiens
auaaacgggucacagacuu

SEQ ID NO: 712539 - RNA, 19 nt, Homo sapiens
gcagaacguggugaccuuu

SEQ ID NO: 712540 - RNA, 19 nt, Homo sapiens
agaaagcagcuggugauuu

SEQ ID NO: 712541 - RNA, 19 nt, Homo sapiens
gagaaagcagcuggugauu

SEQ ID NO: 712542 - RNA, 19 nt, Homo sapiens
gaagccagcagaggaagga

SEQ ID NO: 712543 - RNA, 19 nt, Homo sapiens
guucugaguguuuaauuuc

SEQ ID NO: 712544 - RNA, 19 nt, Homo sapiens
ccuccucucucccuagaug

SEQ ID NO: 712545 - RNA, 19 nt, Homo sapiens
ccacagacugcgugagaga

SEQ ID NO: 712546 - RNA, 19 nt, Homo sapiens
gaagaucaugcccaagaag

SEQ ID NO: 712547 - RNA, 19 nt, Homo sapiens
gccaagaguacgauauuag

SEQ ID NO: 712548 - RNA, 19 nt, Homo sapiens
gugccaagaguacgauauu

SEQ ID NO: 712549 - RNA, 19 nt, Homo sapiens
gguucaacguccucagaug

SEQ ID NO: 712550 - RNA, 19 nt, Homo sapiens
gcauagcaagugaaagcaa

SEQ ID NO: 712551 - RNA, 19 nt, Homo sapiens
ucccaucuuucaugcguaa

SEQ ID NO: 712552 - RNA, 19 nt, Homo sapiens
auaaaccuuugcaaacguu

SEQ ID NO: 712553 - RNA, 19 nt, Homo sapiens
uauccaugcaccuaccuua

SEQ ID NO: 712554 - RNA, 19 nt, Homo sapiens
ucugagaagauuaacauga

SEQ ID NO: 712555 - RNA, 19 nt, Homo sapiens
cacaccaaguaccaguaua

SEQ ID NO: 712556 - RNA, 19 nt, Homo sapiens
gcauuuacacacacacaca

SEQ ID NO: 712557 - RNA, 19 nt, Homo sapiens
gagggcaguucugaguguu

SEQ ID NO: 712558 - RNA, 19 nt, Homo sapiens
gcuggugauuuaugaagag

SEQ ID NO: 712559 - RNA, 19 nt, Homo sapiens
guacuccccucauccgauu

SEQ ID NO: 712560 - RNA, 19 nt, Homo sapiens
agaacguggugaccuuuca

SEQ ID NO: 712561 - RNA, 19 nt, Homo sapiens
agagaaagcagcuggugau

SEQ ID NO: 712562 - RNA, 19 nt, Homo sapiens
ccaucuuucaugcguaaua

SEQ ID NO: 712563 - RNA, 19 nt, Homo sapiens
aaucgucuauguguauaug

SEQ ID NO: 712564 - RNA, 19 nt, Homo sapiens
aggcuucccucacucuguu

SEQ ID NO: 712565 - RNA, 19 nt, Homo sapiens
cuaccucugagaagauuaa

SEQ ID NO: 712566 - RNA, 19 nt, Homo sapiens
acacacagacacacaccaa

SEQ ID NO: 712567 - RNA, 19 nt, Homo sapiens
gcaagacauacuuaaugca

SEQ ID NO: 712568 - RNA, 19 nt, Homo sapiens
ugagcaagacauacuuaau

SEQ ID NO: 712569 - RNA, 19 nt, Homo sapiens
gugucauucuguuagauau

SEQ ID NO: 712570 - RNA, 19 nt, Homo sapiens
gaguacgcacggucugauu

SEQ ID NO: 712571 - RNA, 19 nt, Homo sapiens
gugcauagcaagugaaagc

SEQ ID NO: 712572 - RNA, 19 nt, Homo sapiens
cucuuucgauucuuccaua

SEQ ID NO: 712573 - RNA, 19 nt, Homo sapiens
aauaaaccuuugcaaacgu

SEQ ID NO: 712574 - RNA, 19 nt, Homo sapiens
ccacacacacacacacaca

SEQ ID NO: 712575 - RNA, 19 nt, Homo sapiens
ccucugagaagauuaacau

SEQ ID NO: 712576 - RNA, 19 nt, Homo sapiens
cggagaaaaucgucuaugu

SEQ ID NO: 712577 - RNA, 19 nt, Homo sapiens
cagcagaggaaggaaaugu

SEQ ID NO: 712578 - RNA, 19 nt, Homo sapiens
gaacggagaugacaccuuu

SEQ ID NO: 712579 - RNA, 19 nt, Homo sapiens
ccacugcaauaaagaaaua

SEQ ID NO: 712580 - RNA, 19 nt, Homo sapiens
ccaaauacuucucuaagga

SEQ ID NO: 712581 - RNA, 19 nt, Homo sapiens
caugauaucugguguccuu

SEQ ID NO: 712582 - RNA, 19 nt, Homo sapiens
ucaaauaccagagaagaua

SEQ ID NO: 712583 - RNA, 19 nt, Homo sapiens
gcagaggaaggaaauguuu

SEQ ID NO: 712584 - RNA, 19 nt, Homo sapiens
caaaaggccuucgaugaua

SEQ ID NO: 712585 - RNA, 19 nt, Homo sapiens
gaaauagggaggcccaaga

SEQ ID NO: 712586 - RNA, 19 nt, Homo sapiens
guaauaaacgggucacaga

SEQ ID NO: 712587 - RNA, 19 nt, Homo sapiens
ccaacuaccucugagaaga

SEQ ID NO: 712588 - RNA, 19 nt, Homo sapiens
ccagaccacugcaauaaag

SEQ ID NO: 712589 - RNA, 19 nt, Homo sapiens
cgaagaucaugcccaagaa

SEQ ID NO: 712590 - RNA, 19 nt, Homo sapiens
gaaaaucgucuauguguau

SEQ ID NO: 712591 - RNA, 19 nt, Homo sapiens
caucuuucaugcguaauaa

SEQ ID NO: 712592 - RNA, 19 nt, Homo sapiens
cacgguuggugcucaaaua

SEQ ID NO: 712593 - RNA, 19 nt, Homo sapiens
ggagaugacaccuuugcaa

SEQ ID NO: 712594 - RNA, 19 nt, Homo sapiens
acacacaacagggugauua

SEQ ID NO: 712595 - RNA, 19 nt, Homo sapiens
caaauacuucucuaaggaa

SEQ ID NO: 712596 - RNA, 19 nt, Homo sapiens
agaagcaucuggcccacaa

SEQ ID NO: 712597 - RNA, 19 nt, Homo sapiens
caagaagccagcagaggaa

SEQ ID NO: 712598 - RNA, 19 nt, Homo sapiens
cugagaagauuaacaugau

SEQ ID NO: 712599 - RNA, 19 nt, Homo sapiens
gaaggaagugccagaagca

SEQ ID NO: 712600 - RNA, 19 nt, Homo sapiens
gccaaauacuucucuaagg

SEQ ID NO: 712601 - RNA, 19 nt, Homo sapiens
gaagagagacgcggaacag

SEQ ID NO: 712602 - RNA, 19 nt, Homo sapiens
ggccaugacuaaacuaggu

SEQ ID NO: 712603 - RNA, 19 nt, Homo sapiens
aguaugaggccaugacuaa

SEQ ID NO: 712604 - RNA, 19 nt, Homo sapiens
gcucaaauaccagagaaga

SEQ ID NO: 712605 - RNA, 19 nt, Homo sapiens
gaaaaccaacuaccucuga

SEQ ID NO: 712606 - RNA, 19 nt, Homo sapiens
ggaagugccagaagcaucu

SEQ ID NO: 712607 - RNA, 19 nt, Homo sapiens
guucaacguccucagauga

SEQ ID NO: 712608 - RNA, 19 nt, Homo sapiens
cagaagacacaaaacauua

SEQ ID NO: 712609 - RNA, 19 nt, Homo sapiens
acaacagggugauuauagu

SEQ ID NO: 712610 - RNA, 19 nt, Homo sapiens
ccaaaacaauuacacacaa

SEQ ID NO: 712611 - RNA, 19 nt, Homo sapiens
ccgaagaucaugcccaaga

SEQ ID NO: 712612 - RNA, 19 nt, Homo sapiens
gaaaguaugaggccaugac

SEQ ID NO: 712613 - RNA, 19 nt, Homo sapiens
gagaaaaucgucuaugugu

SEQ ID NO: 712614 - RNA, 19 nt, Homo sapiens
gugcucaaauaccagagaa

SEQ ID NO: 712615 - RNA, 19 nt, Homo sapiens
cugguguccuucagagaua

SEQ ID NO: 712616 - RNA, 19 nt, Homo sapiens
caacuaccucugagaagau

SEQ ID NO: 712617 - RNA, 19 nt, Homo sapiens
auaaacgggucacagacuu

SEQ ID NO: 712618 - RNA, 19 nt, Homo sapiens
gaagccagcagaggaagga

SEQ ID NO: 712619 - RNA, 19 nt, Homo sapiens
gaagaucaugcccaagaag

SEQ ID NO: 712620 - RNA, 19 nt, Homo sapiens
cacaacagggugauuauag

SEQ ID NO: 712621 - RNA, 19 nt, Homo sapiens
acacaacagggugauuaua

SEQ ID NO: 712622 - RNA, 19 nt, Homo sapiens
gaccacugcaauaaagaaa

SEQ ID NO: 712623 - RNA, 19 nt, Homo sapiens
gguucaacguccucagaug

SEQ ID NO: 712624 - RNA, 19 nt, Homo sapiens
caacagggugauuauaguc

SEQ ID NO: 712625 - RNA, 19 nt, Homo sapiens
guuccagaccacugcaaua

SEQ ID NO: 712626 - RNA, 19 nt, Homo sapiens
ucccaucuuucaugcguaa

SEQ ID NO: 712627 - RNA, 19 nt, Homo sapiens
aaauagggaggcccaagaa

SEQ ID NO: 712628 - RNA, 19 nt, Homo sapiens
ucugagaagauuaacauga

SEQ ID NO: 712629 - RNA, 19 nt, Homo sapiens
ggaagagagacgcggaaca

SEQ ID NO: 712630 - RNA, 19 nt, Homo sapiens
ccaucuuucaugcguaaua

SEQ ID NO: 712631 - RNA, 19 nt, Homo sapiens
aaucgucuauguguauaug

SEQ ID NO: 712632 - RNA, 19 nt, Homo sapiens
cuaccucugagaagauuaa

SEQ ID NO: 712633 - RNA, 19 nt, Homo sapiens
acagggugauuauagucaa

SEQ ID NO: 712634 - RNA, 19 nt, Homo sapiens
ggagcagucagaagacaca

SEQ ID NO: 712635 - RNA, 19 nt, Homo sapiens
gaguacgcacggucugauu

SEQ ID NO: 712636 - RNA, 19 nt, Homo sapiens
cucuuucgauucuuccaua

SEQ ID NO: 712637 - RNA, 19 nt, Homo sapiens
gcagucagaagacacaaaa

SEQ ID NO: 712638 - RNA, 19 nt, Homo sapiens
gauaucugguguccuucag

SEQ ID NO: 712639 - RNA, 19 nt, Homo sapiens
ccucugagaagauuaacau

SEQ ID NO: 712640 - RNA, 19 nt, Homo sapiens
cagcagaggaaggaaaugu

SEQ ID NO: 712641 - RNA, 19 nt, Homo sapiens
ggggaaugauuuugauaau

SEQ ID NO: 712642 - RNA, 19 nt, Homo sapiens
aggccauccucccaucuuu

SEQ ID NO: 712643 - RNA, 19 nt, Homo sapiens
cggagaaaaucgucuaugu

SEQ ID NO: 712644 - RNA, 19 nt, Homo sapiens
gggaaugauuuugauaaug

SEQ ID NO: 712645 - RNA, 19 nt, Homo sapiens
caaauaccagagaagauac

SEQ ID NO: 712646 - RNA, 19 nt, Homo sapiens
guaugaggccaugacuaaa

SEQ ID NO: 712647 - RNA, 19 nt, Homo sapiens
gucuauguguauaugaaga

SEQ ID NO: 712648 - RNA, 19 nt, Homo sapiens
ucgucuauguguauaugaa

SEQ ID NO: 712649 - RNA, 19 nt, Homo sapiens
agaaaaucgucuaugugua

SEQ ID NO: 712650 - RNA, 19 nt, Homo sapiens
cagggugauuauagucaau

SEQ ID NO: 712651 - RNA, 19 nt, Homo sapiens
aaaaggccuucgaugauau

SEQ ID NO: 712652 - RNA, 19 nt, Homo sapiens
cuucgaugauauugccaaa

SEQ ID NO: 712653 - RNA, 19 nt, Homo sapiens
uuccagaccacugcaauaa

SEQ ID NO: 712654 - RNA, 19 nt, Homo sapiens
gccauccucccaucuuuca

SEQ ID NO: 712655 - RNA, 19 nt, Homo sapiens
gaagagugggaaaagauga

SEQ ID NO: 712656 - RNA, 19 nt, Homo sapiens
gagaguguaucaucuguuu

SEQ ID NO: 712657 - RNA, 19 nt, Homo sapiens
gagcaaguuuauagacauu

SEQ ID NO: 712658 - RNA, 19 nt, Homo sapiens
uaacacaaaugguaaacuc

SEQ ID NO: 712659 - RNA, 19 nt, Homo sapiens
gcgcaaugcuaagcuguuu

SEQ ID NO: 712660 - RNA, 19 nt, Homo sapiens
gaaggaggacccugcgaaa

SEQ ID NO: 712661 - RNA, 19 nt, Homo sapiens
gcaaguuuauagacauuca

SEQ ID NO: 712662 - RNA, 19 nt, Homo sapiens
ggucauauccaaucucaau

SEQ ID NO: 712663 - RNA, 19 nt, Homo sapiens
gguaagugcgcaaugcuaa

SEQ ID NO: 712664 - RNA, 19 nt, Homo sapiens
ugagaacguaacagaauua

SEQ ID NO: 712665 - RNA, 19 nt, Homo sapiens
ccaacucgcuggaggagau

SEQ ID NO: 712666 - RNA, 19 nt, Homo sapiens
auaaaugacugaguguuga

SEQ ID NO: 712667 - RNA, 19 nt, Homo sapiens
cagaagcgcugauggucau

SEQ ID NO: 712668 - RNA, 19 nt, Homo sapiens
ggacaagaagcaaaugaca

SEQ ID NO: 712669 - RNA, 19 nt, Homo sapiens
cgacucaucuuuccuucuc

SEQ ID NO: 712670 - RNA, 19 nt, Homo sapiens
cgaaagcugcgacgacuau

SEQ ID NO: 712671 - RNA, 19 nt, Homo sapiens
uauccaaucucaauaucug

SEQ ID NO: 712672 - RNA, 19 nt, Homo sapiens
gcaacuacauccucaugcu

SEQ ID NO: 712673 - RNA, 19 nt, Homo sapiens
guaacacccuuccucugau

SEQ ID NO: 712674 - RNA, 19 nt, Homo sapiens
aaaggcaguugcuguggaa

SEQ ID NO: 712675 - RNA, 19 nt, Homo sapiens
uuauagacauucagaguag

SEQ ID NO: 712676 - RNA, 19 nt, Homo sapiens
ccaccaagaaggacaagaa

SEQ ID NO: 712677 - RNA, 19 nt, Homo sapiens
uguagcgucugccguguaa

SEQ ID NO: 712678 - RNA, 19 nt, Homo sapiens
gcgcaagcuuuccaagauc

SEQ ID NO: 712679 - RNA, 19 nt, Homo sapiens
acaagaagcaaaugacaga

SEQ ID NO: 712680 - RNA, 19 nt, Homo sapiens
gcgggugcauuguaguuau

SEQ ID NO: 712681 - RNA, 19 nt, Homo sapiens
gcagcugcgucucaagauc

SEQ ID NO: 712682 - RNA, 19 nt, Homo sapiens
gaauaaaugacugaguguu

SEQ ID NO: 712683 - RNA, 19 nt, Homo sapiens
uaacacccuuccucugauc

SEQ ID NO: 712684 - RNA, 19 nt, Homo sapiens
uguaacacccuuccucuga

SEQ ID NO: 712685 - RNA, 19 nt, Homo sapiens
gagaacguaacagaauuaa

SEQ ID NO: 712686 - RNA, 19 nt, Homo sapiens
cugagaacguaacagaauu

SEQ ID NO: 712687 - RNA, 19 nt, Homo sapiens
ccaagaaggacaagaagca

SEQ ID NO: 712688 - RNA, 19 nt, Homo sapiens
ggaauaaaugacugagugu

SEQ ID NO: 712689 - RNA, 19 nt, Homo sapiens
gaguguaucaucuguuuua

SEQ ID NO: 712690 - RNA, 19 nt, Homo sapiens
ggccacaaguuaguuggaa

SEQ ID NO: 712691 - RNA, 19 nt, Homo sapiens
gagcguggccugacuugca

SEQ ID NO: 712692 - RNA, 19 nt, Homo sapiens
ugacugaguguugagauuu

SEQ ID NO: 712693 - RNA, 19 nt, Homo sapiens
ucaacaguaugagcaaguu

SEQ ID NO: 712694 - RNA, 19 nt, Homo sapiens
aauaaaugacugaguguug

SEQ ID NO: 712695 - RNA, 19 nt, Homo sapiens
gucaauccacacccucuua

SEQ ID NO: 712696 - RNA, 19 nt, Homo sapiens
cgagcgcugucuggcuuua

SEQ ID NO: 712697 - RNA, 19 nt, Homo sapiens
cccugucucucguugauuu

SEQ ID NO: 712698 - RNA, 19 nt, Homo sapiens
uuugguaccugagaacgua

SEQ ID NO: 712699 - RNA, 19 nt, Homo sapiens
ugagcaaguuuauagacau

SEQ ID NO: 712700 - RNA, 19 nt, Homo sapiens
caacaguaugagcaaguuu

SEQ ID NO: 712701 - RNA, 19 nt, Homo sapiens
cuaauaaaucuguggaugu

SEQ ID NO: 712702 - RNA, 19 nt, Homo sapiens
ggcaguugcuguggaaaca

SEQ ID NO: 712703 - RNA, 19 nt, Homo sapiens
ggaggacccugcgaaagcu

SEQ ID NO: 712704 - RNA, 19 nt, Homo sapiens
gugcauuccucacuagaac

SEQ ID NO: 712705 - RNA, 19 nt, Homo sapiens
aaacggaauaaaugacuga

SEQ ID NO: 712706 - RNA, 19 nt, Homo sapiens
gcuguuugcucacgugacu

SEQ ID NO: 712707 - RNA, 19 nt, Homo sapiens
ccugagaacguaacagaau

SEQ ID NO: 712708 - RNA, 19 nt, Homo sapiens
caucuuuccuucucuaagc

SEQ ID NO: 712709 - RNA, 19 nt, Homo sapiens
aacaguaugagcaaguuua

SEQ ID NO: 712710 - RNA, 19 nt, Homo sapiens
cagaguagaaccacuugug

SEQ ID NO: 712711 - RNA, 19 nt, Homo sapiens
ccucaaaucgcauccagau

SEQ ID NO: 712712 - RNA, 19 nt, Homo sapiens
cgggugcauuguaguuauu

SEQ ID NO: 712713 - RNA, 19 nt, Homo sapiens
aguaugagcaaguuuauag

SEQ ID NO: 712714 - RNA, 19 nt, Homo sapiens
gaaggacaagaagcaaaug

SEQ ID NO: 712715 - RNA, 19 nt, Homo sapiens
gcgcaacuacauccucaug

SEQ ID NO: 712716 - RNA, 19 nt, Homo sapiens
ugcgcaagcuuuccaagau

SEQ ID NO: 712717 - RNA, 19 nt, Homo sapiens
cucaauaucugggucaauc

SEQ ID NO: 712718 - RNA, 19 nt, Homo sapiens
uugcuccucuuccuccuuu

SEQ ID NO: 712719 - RNA, 19 nt, Homo sapiens
agaaggacaagaagcaaau

SEQ ID NO: 712720 - RNA, 19 nt, Homo sapiens
acucaucuuuccuucucua

SEQ ID NO: 712721 - RNA, 19 nt, Homo sapiens
caagaaggacaagaagcaa

SEQ ID NO: 712722 - RNA, 19 nt, Homo sapiens
uagccgcacugcagaagca

SEQ ID NO: 712723 - RNA, 19 nt, Homo sapiens
agccggcuuuccucuauuu

SEQ ID NO: 712724 - RNA, 19 nt, Homo sapiens
aauccacacccucuuagaa

SEQ ID NO: 712725 - RNA, 19 nt, Homo sapiens
ucgcagagaguguaucauc

SEQ ID NO: 712726 - RNA, 19 nt, Homo sapiens
ugagguaagugcgcaaugc

SEQ ID NO: 712727 - RNA, 19 nt, Homo sapiens
uaccugagaacguaacaga

SEQ ID NO: 712728 - RNA, 19 nt, Homo sapiens
ggugcauuguaguuauuau

SEQ ID NO: 712729 - RNA, 19 nt, Homo sapiens
uugccacguuuaacacaaa

SEQ ID NO: 712730 - RNA, 19 nt, Homo sapiens
guaugagcaaguuuauaga

SEQ ID NO: 712731 - RNA, 19 nt, Homo sapiens
cagcugcgucucaagauca

SEQ ID NO: 712732 - RNA, 19 nt, Homo sapiens
ucguugauuugggagaaua

SEQ ID NO: 712733 - RNA, 19 nt, Homo sapiens
uccagcaccucgucgucua

SEQ ID NO: 712734 - RNA, 19 nt, Homo sapiens
gcgaaagcugcgacgacua

SEQ ID NO: 712735 - RNA, 19 nt, Homo sapiens
guagacaucguuuuaugaa

SEQ ID NO: 712736 - RNA, 19 nt, Homo sapiens
ucucuaagcacaaagugau

SEQ ID NO: 712737 - RNA, 19 nt, Homo sapiens
ggcgggugcauuguaguua

SEQ ID NO: 712738 - RNA, 19 nt, Homo sapiens
gaagcgcugauggucauau

SEQ ID NO: 712739 - RNA, 19 nt, Homo sapiens
gagagcguggccugacuug

SEQ ID NO: 712740 - RNA, 19 nt, Homo sapiens
gacugaguguugagauuuu

SEQ ID NO: 712741 - RNA, 19 nt, Homo sapiens
gggugcauuguaguuauua

SEQ ID NO: 712742 - RNA, 19 nt, Homo sapiens
guuuauagacauucagagu

SEQ ID NO: 712743 - RNA, 19 nt, Homo sapiens
gauuugggagaauaugguu

SEQ ID NO: 712744 - RNA, 19 nt, Homo sapiens
gugcgcaagcuuuccaaga

SEQ ID NO: 712745 - RNA, 19 nt, Homo sapiens
aagaaggacaagaagcaaa

SEQ ID NO: 712746 - RNA, 19 nt, Homo sapiens
caguagacaucguuuuaug

SEQ ID NO: 712747 - RNA, 19 nt, Homo sapiens
ggaggcaguggcuucaagu

SEQ ID NO: 712748 - RNA, 19 nt, Homo sapiens
acguuuaacacaaauggua

SEQ ID NO: 712749 - RNA, 19 nt, Homo sapiens
ucuaagcacaaagugauuu

SEQ ID NO: 712750 - RNA, 19 nt, Homo sapiens
guuccuucuucaacaguau

SEQ ID NO: 712751 - RNA, 19 nt, Homo sapiens
gaacaaaccugaagaaaca

SEQ ID NO: 712752 - RNA, 19 nt, Homo sapiens
gaaagagacuuacguacua

SEQ ID NO: 712753 - RNA, 19 nt, Homo sapiens
ggagaggacuuccaaaugu

SEQ ID NO: 712754 - RNA, 19 nt, Homo sapiens
ccacugagauuaugaacaa

SEQ ID NO: 712755 - RNA, 19 nt, Homo sapiens
gaagaagacuaagaaaguu

SEQ ID NO: 712756 - RNA, 19 nt, Homo sapiens
gaagaaggccugcucuaaa

SEQ ID NO: 712757 - RNA, 19 nt, Homo sapiens
caagagagguggcagcauu

SEQ ID NO: 712758 - RNA, 19 nt, Homo sapiens
gaaagcaccuccaccuuca

SEQ ID NO: 712759 - RNA, 19 nt, Homo sapiens
ggagucaacuaaugaagaa

SEQ ID NO: 712760 - RNA, 19 nt, Homo sapiens
gcauucagcaguauauuua

SEQ ID NO: 712761 - RNA, 19 nt, Homo sapiens
guacagaagugcccuggaa

SEQ ID NO: 712762 - RNA, 19 nt, Homo sapiens
gaaggccugcucuaaauua

SEQ ID NO: 712763 - RNA, 19 nt, Homo sapiens
ggagaaaugacacagguua

SEQ ID NO: 712764 - RNA, 19 nt, Homo sapiens
caaaggaggagucaacuaa

SEQ ID NO: 712765 - RNA, 19 nt, Homo sapiens
aaacaacgauggcauggaa

SEQ ID NO: 712766 - RNA, 19 nt, Homo sapiens
auacaaaucugucuacaug

SEQ ID NO: 712767 - RNA, 19 nt, Homo sapiens
ugacacaaguacaaucuaa

SEQ ID NO: 712768 - RNA, 19 nt, Homo sapiens
uauaagaacuggccugaau

SEQ ID NO: 712769 - RNA, 19 nt, Homo sapiens
ggaaauaacagaagaacau

SEQ ID NO: 712770 - RNA, 19 nt, Homo sapiens
gggcagaccuuauccaaag

SEQ ID NO: 712771 - RNA, 19 nt, Homo sapiens
uagauggacugacuacuuu

SEQ ID NO: 712772 - RNA, 19 nt, Homo sapiens
ggaagaaggccugcucuaa

SEQ ID NO: 712773 - RNA, 19 nt, Homo sapiens
cagaagaaacucaaaguaa

SEQ ID NO: 712774 - RNA, 19 nt, Homo sapiens
caaacaagaagaagacuaa

SEQ ID NO: 712775 - RNA, 19 nt, Homo sapiens
cugcggagcuuuccuguaa

SEQ ID NO: 712776 - RNA, 19 nt, Homo sapiens
ccaaggagccuaccacuau

SEQ ID NO: 712777 - RNA, 19 nt, Homo sapiens
caucuaaagugcuggcuaa

SEQ ID NO: 712778 - RNA, 19 nt, Homo sapiens
caacugugauuauaacugu

SEQ ID NO: 712779 - RNA, 19 nt, Homo sapiens
caucaacaaugccagaauu

SEQ ID NO: 712780 - RNA, 19 nt, Homo sapiens
caaguaacaucuaccacaa

SEQ ID NO: 712781 - RNA, 19 nt, Homo sapiens
aaacagacuucaacugaug

SEQ ID NO: 712782 - RNA, 19 nt, Homo sapiens
ggacaauggugacuucaag

SEQ ID NO: 712783 - RNA, 19 nt, Homo sapiens
aggacuaacuggacaaaua

SEQ ID NO: 712784 - RNA, 19 nt, Homo sapiens
guagagauacaacaaauga

SEQ ID NO: 712785 - RNA, 19 nt, Homo sapiens
uauaggaccuucucaaaca

SEQ ID NO: 712786 - RNA, 19 nt, Homo sapiens
agacagagcuacuaauucu

SEQ ID NO: 712787 - RNA, 19 nt, Homo sapiens
ggaaggguauucuagagau

SEQ ID NO: 712788 - RNA, 19 nt, Homo sapiens
gaaggagaaacaccucaua

SEQ ID NO: 712789 - RNA, 19 nt, Homo sapiens
gaagaaacagcuaaaccaa

SEQ ID NO: 712790 - RNA, 19 nt, Homo sapiens
gaaaugacuacaacagcua

SEQ ID NO: 712791 - RNA, 19 nt, Homo sapiens
aaauucagcugcuaauaga

SEQ ID NO: 712792 - RNA, 19 nt, Homo sapiens
gauuauaacugucaacacu

SEQ ID NO: 712793 - RNA, 19 nt, Homo sapiens
agaaacaccucauaugcuu

SEQ ID NO: 712794 - RNA, 19 nt, Homo sapiens
acaaaucugucuacaugaa

SEQ ID NO: 712795 - RNA, 19 nt, Homo sapiens
gacaacagaaagagacuua

SEQ ID NO: 712796 - RNA, 19 nt, Homo sapiens
gaauaaagagacaacaguu

SEQ ID NO: 712797 - RNA, 19 nt, Homo sapiens
gaaguuaaagugaguauac

SEQ ID NO: 712798 - RNA, 19 nt, Homo sapiens
gaacccuaccucaagaaua

SEQ ID NO: 712799 - RNA, 19 nt, Homo sapiens
ugacggcuaugauuacuau

SEQ ID NO: 712800 - RNA, 19 nt, Homo sapiens
ugaaguaaauccaaagagu

SEQ ID NO: 712801 - RNA, 19 nt, Homo sapiens
caagauaccacaccauuca

SEQ ID NO: 712802 - RNA, 19 nt, Homo sapiens
caagugcugucccgauuau

SEQ ID NO: 712803 - RNA, 19 nt, Homo sapiens
aagaaggccugcucuaaau

SEQ ID NO: 712804 - RNA, 19 nt, Homo sapiens
gacacaaaguauagagaaa

SEQ ID NO: 712805 - RNA, 19 nt, Homo sapiens
gacccagucuuccaccuaa

SEQ ID NO: 712806 - RNA, 19 nt, Homo sapiens
gacagcaacuacaacagaa

SEQ ID NO: 712807 - RNA, 19 nt, Homo sapiens
ugaaucaacuccugagcuu

SEQ ID NO: 712808 - RNA, 19 nt, Homo sapiens
gcuaaagagacacaaagua

SEQ ID NO: 712809 - RNA, 19 nt, Homo sapiens
gagaggacuuccaaaugug

SEQ ID NO: 712810 - RNA, 19 nt, Homo sapiens
uaaauuauccaguguaugg

SEQ ID NO: 712811 - RNA, 19 nt, Homo sapiens
cuaaagagacacaaaguau

SEQ ID NO: 712812 - RNA, 19 nt, Homo sapiens
guaaauaucaccugcucaa

SEQ ID NO: 712813 - RNA, 19 nt, Homo sapiens
ggcaauagguagagauaca

SEQ ID NO: 712814 - RNA, 19 nt, Homo sapiens
aaagacagagcuacuaauu

SEQ ID NO: 712815 - RNA, 19 nt, Homo sapiens
ugacaugaguauaccaguu

SEQ ID NO: 712816 - RNA, 19 nt, Homo sapiens
gugguuaccucagcuauau

SEQ ID NO: 712817 - RNA, 19 nt, Homo sapiens
gcuauaggaccuucucaaa

SEQ ID NO: 712818 - RNA, 19 nt, Homo sapiens
gcuacaaccacacaaguaa

SEQ ID NO: 712819 - RNA, 19 nt, Homo sapiens
caagaagccugcuccaacu

SEQ ID NO: 712820 - RNA, 19 nt, Homo sapiens
caacaaauaaacagacuuc

SEQ ID NO: 712821 - RNA, 19 nt, Homo sapiens
cagaggaaauaacagaaga

SEQ ID NO: 712822 - RNA, 19 nt, Homo sapiens
gaaggguauucuagagaug

SEQ ID NO: 712823 - RNA, 19 nt, Homo sapiens
gcucacaccuguaaaagaa

SEQ ID NO: 712824 - RNA, 19 nt, Homo sapiens
gacaugaguauaccaguuu

SEQ ID NO: 712825 - RNA, 19 nt, Homo sapiens
gcaaaggaggagucaacua

SEQ ID NO: 712826 - RNA, 19 nt, Homo sapiens
guacaacuguccuuagacu

SEQ ID NO: 712827 - RNA, 19 nt, Homo sapiens
cauuauuucuggaugcuaa

SEQ ID NO: 712828 - RNA, 19 nt, Homo sapiens
ggagaaacaccucauaugc

SEQ ID NO: 712829 - RNA, 19 nt, Homo sapiens
gcagaagccaugcuccaaa

SEQ ID NO: 712830 - RNA, 19 nt, Homo sapiens
acaugaaguuuacagauug

SEQ ID NO: 712831 - RNA, 19 nt, Homo sapiens
ggacuaacuggacaaauag

SEQ ID NO: 712832 - RNA, 19 nt, Homo sapiens
ccaaacuaguugaaguaaa

SEQ ID NO: 712833 - RNA, 19 nt, Homo sapiens
uaacaucuaccacaacuca

SEQ ID NO: 712834 - RNA, 19 nt, Homo sapiens
ccaaggagccugcaucuac

SEQ ID NO: 712835 - RNA, 19 nt, Homo sapiens
ucugauacaucuaaagaga

SEQ ID NO: 712836 - RNA, 19 nt, Homo sapiens
gaaaugacacagguuagga

SEQ ID NO: 712837 - RNA, 19 nt, Homo sapiens
uaaacagacuucaacugau

SEQ ID NO: 712838 - RNA, 19 nt, Homo sapiens
acaagaagaagacuaagaa

SEQ ID NO: 712839 - RNA, 19 nt, Homo sapiens
cacuuacccuaguucauua

SEQ ID NO: 712840 - RNA, 19 nt, Homo sapiens
ucacuuacccuaguucauu

SEQ ID NO: 712841 - RNA, 19 nt, Homo sapiens
uaggagacgucgcuuugaa

SEQ ID NO: 712842 - RNA, 19 nt, Homo sapiens
cagaauuacugaaguuugg

SEQ ID NO: 712843 - RNA, 19 nt, Homo sapiens
ccaaaguaacuacaacaaa

SEQ ID NO: 712844 - RNA, 19 nt, Homo sapiens
gacuaaaccugaaaugacu

SEQ ID NO: 712845 - RNA, 19 nt, Homo sapiens
uaaagggacugcuccaacu

SEQ ID NO: 712846 - RNA, 19 nt, Homo sapiens
caaauaaacagacuucaac

SEQ ID NO: 712847 - RNA, 19 nt, Homo sapiens
ugaaguuacucccgacaug

SEQ ID NO: 712848 - RNA, 19 nt, Homo sapiens
caaggaaccugguguaccu

SEQ ID NO: 712849 - RNA, 19 nt, Homo sapiens
agaagaagacuaagaaagu

SEQ ID NO: 712850 - RNA, 19 nt, Homo sapiens
guaagaaguaugacaagug

SEQ ID NO: 712851 - RNA, 19 nt, Homo sapiens
gauaaacaauccagcauua

SEQ ID NO: 712852 - RNA, 19 nt, Homo sapiens
gaucaugucuguuccuauu

SEQ ID NO: 712853 - RNA, 19 nt, Homo sapiens
ugaaaucgauggaacuaua

SEQ ID NO: 712854 - RNA, 19 nt, Homo sapiens
gcaaagugaucauuguuga

SEQ ID NO: 712855 - RNA, 19 nt, Homo sapiens
gaauguaucugcaauugug

SEQ ID NO: 712856 - RNA, 19 nt, Homo sapiens
gagcuucucugcagacuga

SEQ ID NO: 712857 - RNA, 19 nt, Homo sapiens
ccauauacuucccauguua

SEQ ID NO: 712858 - RNA, 19 nt, Homo sapiens
uaaauaagcugacuguucu

SEQ ID NO: 712859 - RNA, 19 nt, Homo sapiens
guagagcaguuacaagaaa

SEQ ID NO: 712860 - RNA, 19 nt, Homo sapiens
caacauauuuccagacauc

SEQ ID NO: 712861 - RNA, 19 nt, Homo sapiens
aaacaggucucccagcauu

SEQ ID NO: 712862 - RNA, 19 nt, Homo sapiens
gaagccagcugccaauuac

SEQ ID NO: 712863 - RNA, 19 nt, Homo sapiens
gaacugcccaugccacaaa

SEQ ID NO: 712864 - RNA, 19 nt, Homo sapiens
ccacaugccaauucaaaua

SEQ ID NO: 712865 - RNA, 19 nt, Homo sapiens
agaauaugcucacugcuaa

SEQ ID NO: 712866 - RNA, 19 nt, Homo sapiens
ccagacacuucaccuagua

SEQ ID NO: 712867 - RNA, 19 nt, Homo sapiens
gcaaagaggauggaaauca

SEQ ID NO: 712868 - RNA, 19 nt, Homo sapiens
gaagacacuuggcagacuu

SEQ ID NO: 712869 - RNA, 19 nt, Homo sapiens
gcaauuguguggcucaaca

SEQ ID NO: 712870 - RNA, 19 nt, Homo sapiens
caaagaggauggaaaucau

SEQ ID NO: 712871 - RNA, 19 nt, Homo sapiens
uaacuuugaucaugucugu

SEQ ID NO: 712872 - RNA, 19 nt, Homo sapiens
ugcauuagcuguuuguaaa

SEQ ID NO: 712873 - RNA, 19 nt, Homo sapiens
ggacugcagcccacuauga

SEQ ID NO: 712874 - RNA, 19 nt, Homo sapiens
ucaagugucugucaugugu

SEQ ID NO: 712875 - RNA, 19 nt, Homo sapiens
aaacauuggugcacaguuc

SEQ ID NO: 712876 - RNA, 19 nt, Homo sapiens
gcucaacacuuuaggaaac

SEQ ID NO: 712877 - RNA, 19 nt, Homo sapiens
gcacaggcacucccaaugu

SEQ ID NO: 712878 - RNA, 19 nt, Homo sapiens
uggaaucugugccaccuua

SEQ ID NO: 712879 - RNA, 19 nt, Homo sapiens
ccacuucucugugccauau

SEQ ID NO: 712880 - RNA, 19 nt, Homo sapiens
gcccaugccacaaauauuu

SEQ ID NO: 712881 - RNA, 19 nt, Homo sapiens
ugucaugguugcagcauuu

SEQ ID NO: 712882 - RNA, 19 nt, Homo sapiens
acacgaggaugcccuaaug

SEQ ID NO: 712883 - RNA, 19 nt, Homo sapiens
gauuucugcugacauuuga

SEQ ID NO: 712884 - RNA, 19 nt, Homo sapiens
gcagcccacuaugauguua

SEQ ID NO: 712885 - RNA, 19 nt, Homo sapiens
ggauacacauggagcuguu

SEQ ID NO: 712886 - RNA, 19 nt, Homo sapiens
cauaaagggacaugcauuu

SEQ ID NO: 712887 - RNA, 19 nt, Homo sapiens
cguuuaagccuauuaguaa

SEQ ID NO: 712888 - RNA, 19 nt, Homo sapiens
ucuguaaccuggcaacauu

SEQ ID NO: 712889 - RNA, 19 nt, Homo sapiens
ggaaucgaaccuagggaua

SEQ ID NO: 712890 - RNA, 19 nt, Homo sapiens
aagcacagccuauuucuga

SEQ ID NO: 712891 - RNA, 19 nt, Homo sapiens
ucacagggccuuauuugga

SEQ ID NO: 712892 - RNA, 19 nt, Homo sapiens
cagaauaugcucacugcua

SEQ ID NO: 712893 - RNA, 19 nt, Homo sapiens
gucauugucuccacucauu

SEQ ID NO: 712894 - RNA, 19 nt, Homo sapiens
ucugucagguuuaaaugua

SEQ ID NO: 712895 - RNA, 19 nt, Homo sapiens
ggaagccugucuagaugug

SEQ ID NO: 712896 - RNA, 19 nt, Homo sapiens
gaagaugaacaugacaauu

SEQ ID NO: 712897 - RNA, 19 nt, Homo sapiens
cagaaucucuuuccuacag

SEQ ID NO: 712898 - RNA, 19 nt, Homo sapiens
ugacggugcuugacuaugg

SEQ ID NO: 712899 - RNA, 19 nt, Homo sapiens
cuacuguacuguaacuuug

SEQ ID NO: 712900 - RNA, 19 nt, Homo sapiens
ccuugaaucugcuuuaugu

SEQ ID NO: 712901 - RNA, 19 nt, Homo sapiens
ccuuaaaugucuugaaugu

SEQ ID NO: 712902 - RNA, 19 nt, Homo sapiens
gaagggaaguaguauucag

SEQ ID NO: 712903 - RNA, 19 nt, Homo sapiens
ugaagccagcugccaauua

SEQ ID NO: 712904 - RNA, 19 nt, Homo sapiens
gcagugccauguuccuugu

SEQ ID NO: 712905 - RNA, 19 nt, Homo sapiens
gcuccuuucugucagguuu

SEQ ID NO: 712906 - RNA, 19 nt, Homo sapiens
gcacacggacacagaaugu

SEQ ID NO: 712907 - RNA, 19 nt, Homo sapiens
gggcaaagaggauggaaau

SEQ ID NO: 712908 - RNA, 19 nt, Homo sapiens
ugauauccacacagaauua

SEQ ID NO: 712909 - RNA, 19 nt, Homo sapiens
uuaaagcagugccauguuc

SEQ ID NO: 712910 - RNA, 19 nt, Homo sapiens
cuaaaacccuuggauauaa

SEQ ID NO: 712911 - RNA, 19 nt, Homo sapiens
cacagggccuuauuuggaa

SEQ ID NO: 712912 - RNA, 19 nt, Homo sapiens
gcuugacuauggaaagaaa

SEQ ID NO: 712913 - RNA, 19 nt, Homo sapiens
ggacagggucagaaacaga

SEQ ID NO: 712914 - RNA, 19 nt, Homo sapiens
gagcaccacugcacuaagc

SEQ ID NO: 712915 - RNA, 19 nt, Homo sapiens
aguaucagauccuguuuga

SEQ ID NO: 712916 - RNA, 19 nt, Homo sapiens
cuaccgcgcugccaccaaa

SEQ ID NO: 712917 - RNA, 19 nt, Homo sapiens
gagcaaagugaucauuguu

SEQ ID NO: 712918 - RNA, 19 nt, Homo sapiens
ggucaaacaauccuacguu

SEQ ID NO: 712919 - RNA, 19 nt, Homo sapiens
gacaggacaccuuggguuu

SEQ ID NO: 712920 - RNA, 19 nt, Homo sapiens
uaaauugugggcuuugaaa

SEQ ID NO: 712921 - RNA, 19 nt, Homo sapiens
aaaugaacccacugccuua

SEQ ID NO: 712922 - RNA, 19 nt, Homo sapiens
ggguagagcaguuacaaga

SEQ ID NO: 712923 - RNA, 19 nt, Homo sapiens
acacagcccuauggucaaa

SEQ ID NO: 712924 - RNA, 19 nt, Homo sapiens
guauuaaauugugggcuuu

SEQ ID NO: 712925 - RNA, 19 nt, Homo sapiens
ugaacccacugccuuaaau

SEQ ID NO: 712926 - RNA, 19 nt, Homo sapiens
gacaguacaugguagaacu

SEQ ID NO: 712927 - RNA, 19 nt, Homo sapiens
caucuuccauccugagaau

SEQ ID NO: 712928 - RNA, 19 nt, Homo sapiens
ccagugcaacgucagcuua

SEQ ID NO: 712929 - RNA, 19 nt, Homo sapiens
gccauauacuucccauguu

SEQ ID NO: 712930 - RNA, 19 nt, Homo sapiens
cuagauauuaccacagaua

SEQ ID NO: 712931 - RNA, 19 nt, Homo sapiens
cagaagggaaguaguauuc

SEQ ID NO: 712932 - RNA, 19 nt, Homo sapiens
ugacugcugugugauauuc

SEQ ID NO: 712933 - RNA, 19 nt, Homo sapiens
uggaauguaucugcaauug

SEQ ID NO: 712934 - RNA, 19 nt, Homo sapiens
ggauuucugcugacauuug

SEQ ID NO: 712935 - RNA, 19 nt, Homo sapiens
gaaccacacagcccuaugg

SEQ ID NO: 712936 - RNA, 19 nt, Homo sapiens
gcacucccaauguuguuaa

SEQ ID NO: 712937 - RNA, 19 nt, Homo sapiens
cacaggcacucccaauguu

SEQ ID NO: 712938 - RNA, 19 nt, Homo sapiens
gggagugacuggcauuaac

SEQ ID NO: 712939 - RNA, 19 nt, Homo sapiens
ggcccaagcuccaucucuu

SEQ ID NO: 712940 - RNA, 19 nt, Homo sapiens
acacuacugccauacauuu

SEQ ID NO: 712941 - RNA, 19 nt, Homo sapiens
ugagcaaagugaucauugu

SEQ ID NO: 712942 - RNA, 19 nt, Homo sapiens
ccacuaugauguuauuacu

SEQ ID NO: 712943 - RNA, 19 nt, Homo sapiens
gcuuugaaaccuaaugaaa

SEQ ID NO: 712944 - RNA, 19 nt, Homo sapiens
caucacagggccuuauuug

SEQ ID NO: 712945 - RNA, 19 nt, Homo sapiens
guaauccacaugccaauuc

SEQ ID NO: 712946 - RNA, 19 nt, Homo sapiens
gcauuaacaagacuggaaa

SEQ ID NO: 712947 - RNA, 19 nt, Homo sapiens
cacaacauauuuccagaca

SEQ ID NO: 712948 - RNA, 19 nt, Homo sapiens
ugaaucugcuuuauguaca

SEQ ID NO: 712949 - RNA, 19 nt, Homo sapiens
aaagaggauggaaaucaua

SEQ ID NO: 712950 - RNA, 19 nt, Homo sapiens
gaauguugcagucaagugu

SEQ ID NO: 712951 - RNA, 19 nt, Homo sapiens
gaagguagaugguguuaua

SEQ ID NO: 712952 - RNA, 19 nt, Homo sapiens
gaaauuaucuugagucuac

SEQ ID NO: 712953 - RNA, 19 nt, Homo sapiens
gcaaugaacucaacagcua

SEQ ID NO: 712954 - RNA, 19 nt, Homo sapiens
gcacaaaacugccuuaaaa

SEQ ID NO: 712955 - RNA, 19 nt, Homo sapiens
gaacuacacuggcaaugug

SEQ ID NO: 712956 - RNA, 19 nt, Homo sapiens
gauaggccuuugaguguua

SEQ ID NO: 712957 - RNA, 19 nt, Homo sapiens
gaacgacgcccuccaguau

SEQ ID NO: 712958 - RNA, 19 nt, Homo sapiens
ccuauaaucuccaaagaaa

SEQ ID NO: 712959 - RNA, 19 nt, Homo sapiens
ugagugaacugaacaagaa

SEQ ID NO: 712960 - RNA, 19 nt, Homo sapiens
guacagcacugaaaggaau

SEQ ID NO: 712961 - RNA, 19 nt, Homo sapiens
gaguauagccacuuuguuu

SEQ ID NO: 712962 - RNA, 19 nt, Homo sapiens
caacagcuaucgccucuuc

SEQ ID NO: 712963 - RNA, 19 nt, Homo sapiens
gagaaaggcuagcaaagag

SEQ ID NO: 712964 - RNA, 19 nt, Homo sapiens
caagaucccugacauagca

SEQ ID NO: 712965 - RNA, 19 nt, Homo sapiens
guagaugguguuauaguua

SEQ ID NO: 712966 - RNA, 19 nt, Homo sapiens
ggacaggaagagaguguua

SEQ ID NO: 712967 - RNA, 19 nt, Homo sapiens
ggaagagaguguuagaaag

SEQ ID NO: 712968 - RNA, 19 nt, Homo sapiens
ggaaaugguugaaaacuga

SEQ ID NO: 712969 - RNA, 19 nt, Homo sapiens
uaccaaggauguuacagua

SEQ ID NO: 712970 - RNA, 19 nt, Homo sapiens
gagaugaacaaccaaauug

SEQ ID NO: 712971 - RNA, 19 nt, Homo sapiens
auaagcaucucacuuugua

SEQ ID NO: 712972 - RNA, 19 nt, Homo sapiens
gguagaugguguuauaguu

SEQ ID NO: 712973 - RNA, 19 nt, Homo sapiens
gcucuucccucuaccagaa

SEQ ID NO: 712974 - RNA, 19 nt, Homo sapiens
gcuauaggcuacccauuca

SEQ ID NO: 712975 - RNA, 19 nt, Homo sapiens
caaccaaauugacaucaug

SEQ ID NO: 712976 - RNA, 19 nt, Homo sapiens
gcacggauacagaaacuga

SEQ ID NO: 712977 - RNA, 19 nt, Homo sapiens
gcaaagguggcuacuggua

SEQ ID NO: 712978 - RNA, 19 nt, Homo sapiens
gaaggaggcaggugggaaa

SEQ ID NO: 712979 - RNA, 19 nt, Homo sapiens
aagaauaagucuccaagga

SEQ ID NO: 712980 - RNA, 19 nt, Homo sapiens
guaaacaggaugaacuauu

SEQ ID NO: 712981 - RNA, 19 nt, Homo sapiens
ccgcaucucuggaguguau

SEQ ID NO: 712982 - RNA, 19 nt, Homo sapiens
gcacagacggucacucaga

SEQ ID NO: 712983 - RNA, 19 nt, Homo sapiens
ucaaacggguggagaugaa

SEQ ID NO: 712984 - RNA, 19 nt, Homo sapiens
gaagagaguguuagaaagg

SEQ ID NO: 712985 - RNA, 19 nt, Homo sapiens
uaucuugagucuacacauu

SEQ ID NO: 712986 - RNA, 19 nt, Homo sapiens
ggaacgacgcccuccagua

SEQ ID NO: 712987 - RNA, 19 nt, Homo sapiens
gaaaggguaggacugagaa

SEQ ID NO: 712988 - RNA, 19 nt, Homo sapiens
cagaagaacuaccgcaucu

SEQ ID NO: 712989 - RNA, 19 nt, Homo sapiens
gcaaguacuccgagaugaa

SEQ ID NO: 712990 - RNA, 19 nt, Homo sapiens
ugacauagcaguagcuugu

SEQ ID NO: 712991 - RNA, 19 nt, Homo sapiens
ccaaggacaaggacaauga

SEQ ID NO: 712992 - RNA, 19 nt, Homo sapiens
ugauggagcuggagagcaa

SEQ ID NO: 712993 - RNA, 19 nt, Homo sapiens
guaaauaagcaucucacuu

SEQ ID NO: 712994 - RNA, 19 nt, Homo sapiens
ggauaggccuuugaguguu

SEQ ID NO: 712995 - RNA, 19 nt, Homo sapiens
gcccugaacuggagguguu

SEQ ID NO: 712996 - RNA, 19 nt, Homo sapiens
cgacugcucuucccucuac

SEQ ID NO: 712997 - RNA, 19 nt, Homo sapiens
aaauaagcaucucacuuug

SEQ ID NO: 712998 - RNA, 19 nt, Homo sapiens
ggagcuuccuuuuaaauuu

SEQ ID NO: 712999 - RNA, 19 nt, Homo sapiens
gagaaacagccuauaaucu

SEQ ID NO: 713000 - RNA, 19 nt, Homo sapiens
gagcaaggaaagagagaaa

SEQ ID NO: 713001 - RNA, 19 nt, Homo sapiens
ugucagagacucaagcuuu

SEQ ID NO: 713002 - RNA, 19 nt, Homo sapiens
ggacugagaaacagccuau

SEQ ID NO: 713003 - RNA, 19 nt, Homo sapiens
gaagaacuaccgcaucucu

SEQ ID NO: 713004 - RNA, 19 nt, Homo sapiens
gaacaaccaaauugacauc

SEQ ID NO: 713005 - RNA, 19 nt, Homo sapiens
ccagugaaauuaucuugag

SEQ ID NO: 713006 - RNA, 19 nt, Homo sapiens
gcaaagagcaaggaaagag

SEQ ID NO: 713007 - RNA, 19 nt, Homo sapiens
aaaguggccuugucuccuu

SEQ ID NO: 713008 - RNA, 19 nt, Homo sapiens
gagcaaguacuccgagaug

SEQ ID NO: 713009 - RNA, 19 nt, Homo sapiens
uaagaaacaagcucaagga

SEQ ID NO: 713010 - RNA, 19 nt, Homo sapiens
ggaggcaggugggaaaugg

SEQ ID NO: 713011 - RNA, 19 nt, Homo sapiens
gagcacggauacagaaacu

SEQ ID NO: 713012 - RNA, 19 nt, Homo sapiens
gcacagacuccaaccucaa

SEQ ID NO: 713013 - RNA, 19 nt, Homo sapiens
ugagaaaggcuagcaaaga

SEQ ID NO: 713014 - RNA, 19 nt, Homo sapiens
cgagaugaacaaccaaauu

SEQ ID NO: 713015 - RNA, 19 nt, Homo sapiens
ugauuugucugugaaagaa

SEQ ID NO: 713016 - RNA, 19 nt, Homo sapiens
caaccucaauggaguguac

SEQ ID NO: 713017 - RNA, 19 nt, Homo sapiens
gcaccaaggacaaggacaa

SEQ ID NO: 713018 - RNA, 19 nt, Homo sapiens
gucagagacucaagcuuug

SEQ ID NO: 713019 - RNA, 19 nt, Homo sapiens
ugcagaagcucucuaagca

SEQ ID NO: 713020 - RNA, 19 nt, Homo sapiens
ggacaaggacaaugacaac

SEQ ID NO: 713021 - RNA, 19 nt, Homo sapiens
ggaacuacacuggcaaugu

SEQ ID NO: 713022 - RNA, 19 nt, Homo sapiens
aaucauauguaccaaggau

SEQ ID NO: 713023 - RNA, 19 nt, Homo sapiens
caaagagcaaggaaagaga

SEQ ID NO: 713024 - RNA, 19 nt, Homo sapiens
aggaagagaguguuagaaa

SEQ ID NO: 713025 - RNA, 19 nt, Homo sapiens
gggcagaugaggacaggaa

SEQ ID NO: 713026 - RNA, 19 nt, Homo sapiens
aaagguggcuacugguaca

SEQ ID NO: 713027 - RNA, 19 nt, Homo sapiens
gaagcucucuaagcacaag

SEQ ID NO: 713028 - RNA, 19 nt, Homo sapiens
gcccaagaucccugacaua

SEQ ID NO: 713029 - RNA, 19 nt, Homo sapiens
agaaacagccuauaaucuc

SEQ ID NO: 713030 - RNA, 19 nt, Homo sapiens
ugagaaacagccuauaauc

SEQ ID NO: 713031 - RNA, 19 nt, Homo sapiens
gugcacagcuccgcaaagg

SEQ ID NO: 713032 - RNA, 19 nt, Homo sapiens
cagcacagacggucacuca

SEQ ID NO: 713033 - RNA, 19 nt, Homo sapiens
gugaaauuaucuugagucu

SEQ ID NO: 713034 - RNA, 19 nt, Homo sapiens
gcaaaacacaaaucccuuu

SEQ ID NO: 713035 - RNA, 19 nt, Homo sapiens
caguaaacaggaugaacua

SEQ ID NO: 713036 - RNA, 19 nt, Homo sapiens
caacccggcugcguguaga

SEQ ID NO: 713037 - RNA, 19 nt, Homo sapiens
gagcucaaggcccaaguug

SEQ ID NO: 713038 - RNA, 19 nt, Homo sapiens
guaccaaggauguuacagu

SEQ ID NO: 713039 - RNA, 19 nt, Homo sapiens
ccaaagaaagaauaagucu

SEQ ID NO: 713040 - RNA, 19 nt, Homo sapiens
acucagaccuccgcagaug

SEQ ID NO: 713041 - RNA, 19 nt, Homo sapiens
gcacagccacagcucaaag

SEQ ID NO: 713042 - RNA, 19 nt, Homo sapiens
aagcaucucacuuuguaaa

SEQ ID NO: 713043 - RNA, 19 nt, Homo sapiens
guugaaaacugaagguaga

SEQ ID NO: 713044 - RNA, 19 nt, Homo sapiens
gcaggugggaaaugguauu

SEQ ID NO: 713045 - RNA, 19 nt, Homo sapiens
ucugugacauggagacuuc

SEQ ID NO: 713046 - RNA, 19 nt, Homo sapiens
acugagaaacagccuauaa

SEQ ID NO: 713047 - RNA, 19 nt, Homo sapiens
gcagaugaggacaggaaga

SEQ ID NO: 713048 - RNA, 19 nt, Homo sapiens
ggagguguucugugacaug

SEQ ID NO: 713049 - RNA, 19 nt, Homo sapiens
aacuggagguguucuguga

SEQ ID NO: 713050 - RNA, 19 nt, Homo sapiens
uagcaaagagcaaggaaag

SEQ ID NO: 713051 - RNA, 19 nt, Homo sapiens
gaagauggaucaccucuaa

SEQ ID NO: 713052 - RNA, 19 nt, Homo sapiens
aaacauggacuguaucuua

SEQ ID NO: 713053 - RNA, 19 nt, Homo sapiens
gcauauaugugguugaaug

SEQ ID NO: 713054 - RNA, 19 nt, Homo sapiens
gagcaagacuccaucucua

SEQ ID NO: 713055 - RNA, 19 nt, Homo sapiens
gaaaaggacuggaauucua

SEQ ID NO: 713056 - RNA, 19 nt, Homo sapiens
ucucaaggauuucuucuaa

SEQ ID NO: 713057 - RNA, 19 nt, Homo sapiens
gagagaagguacagugaug

SEQ ID NO: 713058 - RNA, 19 nt, Homo sapiens
ggacauacauaaggagaga

SEQ ID NO: 713059 - RNA, 19 nt, Homo sapiens
ccaaauaccuaagauagug

SEQ ID NO: 713060 - RNA, 19 nt, Homo sapiens
cuaaacuucucaaggauuu

SEQ ID NO: 713061 - RNA, 19 nt, Homo sapiens
gaucaagcuuuauucugaa

SEQ ID NO: 713062 - RNA, 19 nt, Homo sapiens
ccucuaaacuucucaagga

SEQ ID NO: 713063 - RNA, 19 nt, Homo sapiens
gcagugagcuaugauugug

SEQ ID NO: 713064 - RNA, 19 nt, Homo sapiens
agaucaagcuuuauucuga

SEQ ID NO: 713065 - RNA, 19 nt, Homo sapiens
agaggaaaguuuacagaaa

SEQ ID NO: 713066 - RNA, 19 nt, Homo sapiens
ccauaauucuguaguguug

SEQ ID NO: 713067 - RNA, 19 nt, Homo sapiens
ucaauucgauaaggcauuu

SEQ ID NO: 713068 - RNA, 19 nt, Homo sapiens
uguuugaccugcauauuaa

SEQ ID NO: 713069 - RNA, 19 nt, Homo sapiens
gcaagacuccaucucuaaa

SEQ ID NO: 713070 - RNA, 19 nt, Homo sapiens
ugaaugaaccaauguguga

SEQ ID NO: 713071 - RNA, 19 nt, Homo sapiens
ucugagcucuucacacgua

SEQ ID NO: 713072 - RNA, 19 nt, Homo sapiens
ggucuuaacugauuuuguu

SEQ ID NO: 713073 - RNA, 19 nt, Homo sapiens
uguaagaagugucccuuug

SEQ ID NO: 713074 - RNA, 19 nt, Homo sapiens
gaugaaggagaccauaauu

SEQ ID NO: 713075 - RNA, 19 nt, Homo sapiens
ucaguagaguuuggacaua

SEQ ID NO: 713076 - RNA, 19 nt, Homo sapiens
caagauagcagucaauucg

SEQ ID NO: 713077 - RNA, 19 nt, Homo sapiens
ggauuggucugaggaacaa

SEQ ID NO: 713078 - RNA, 19 nt, Homo sapiens
gaccauaauucuguagugu

SEQ ID NO: 713079 - RNA, 19 nt, Homo sapiens
gauagcagucaauucgaua

SEQ ID NO: 713080 - RNA, 19 nt, Homo sapiens
guguguaccuguaguccua

SEQ ID NO: 713081 - RNA, 19 nt, Homo sapiens
gcugugaaguuccuuuaca

SEQ ID NO: 713082 - RNA, 19 nt, Homo sapiens
gauaaggcauuuucauaga

SEQ ID NO: 713083 - RNA, 19 nt, Homo sapiens
caacccaagcccagaauga

SEQ ID NO: 713084 - RNA, 19 nt, Homo sapiens
gacuguaucuuaucuacca

SEQ ID NO: 713085 - RNA, 19 nt, Homo sapiens
uaagaagugucccuuugca

SEQ ID NO: 713086 - RNA, 19 nt, Homo sapiens
uggaucaccucuaaacuuc

SEQ ID NO: 713087 - RNA, 19 nt, Homo sapiens
uacguucagugacuauuaa

SEQ ID NO: 713088 - RNA, 19 nt, Homo sapiens
gagaagguacagugaugaa

SEQ ID NO: 713089 - RNA, 19 nt, Homo sapiens
gauaacggacaaucaggaa

SEQ ID NO: 713090 - RNA, 19 nt, Homo sapiens
gaaggagaccauaauucug

SEQ ID NO: 713091 - RNA, 19 nt, Homo sapiens
ugaaggagaccauaauucu

SEQ ID NO: 713092 - RNA, 19 nt, Homo sapiens
gaucaccucuaaacuucuc

SEQ ID NO: 713093 - RNA, 19 nt, Homo sapiens
cuuugcagaucaagcuuua

SEQ ID NO: 713094 - RNA, 19 nt, Homo sapiens
gaagugucccuuugcagau

SEQ ID NO: 713095 - RNA, 19 nt, Homo sapiens
uaacggacaaucaggaaau

SEQ ID NO: 713096 - RNA, 19 nt, Homo sapiens
aacauggacuguaucuuau

SEQ ID NO: 713097 - RNA, 19 nt, Homo sapiens
uuacguucagugacuauua

SEQ ID NO: 713098 - RNA, 19 nt, Homo sapiens
ggaucaccaaauuaucuua

SEQ ID NO: 713099 - RNA, 19 nt, Homo sapiens
ggagagaagguacagugau

SEQ ID NO: 713100 - RNA, 19 nt, Homo sapiens
caccaaauuaucuuaggua

SEQ ID NO: 713101 - RNA, 19 nt, Homo sapiens
ugaccugcauauuaauuuc

SEQ ID NO: 713102 - RNA, 19 nt, Homo sapiens
cuguuugaccugcauauua

SEQ ID NO: 713103 - RNA, 19 nt, Homo sapiens
uccauuaugugacuguuug

SEQ ID NO: 713104 - RNA, 19 nt, Homo sapiens
ccugggagauagagcaaga

SEQ ID NO: 713105 - RNA, 19 nt, Homo sapiens
gcagaucaagcuuuauucu

SEQ ID NO: 713106 - RNA, 19 nt, Homo sapiens
gacaugcggugccaucaac

SEQ ID NO: 713107 - RNA, 19 nt, Homo sapiens
ggaagauggaucaccucua

SEQ ID NO: 713108 - RNA, 19 nt, Homo sapiens
uauuauuucuccucaguag

SEQ ID NO: 713109 - RNA, 19 nt, Homo sapiens
ugagugugcugcuauacca

SEQ ID NO: 713110 - RNA, 19 nt, Homo sapiens
gugcuuacguucagugacu

SEQ ID NO: 713111 - RNA, 19 nt, Homo sapiens
aacccggucuuaacugauu

SEQ ID NO: 713112 - RNA, 19 nt, Homo sapiens
gugaugaaggagaccauaa

SEQ ID NO: 713113 - RNA, 19 nt, Homo sapiens
uagaggaaaguuuacagaa

SEQ ID NO: 713114 - RNA, 19 nt, Homo sapiens
cugacaguguuauuuauuc

SEQ ID NO: 713115 - RNA, 19 nt, Homo sapiens
gacuauggaccacagcaaa

SEQ ID NO: 713116 - RNA, 19 nt, Homo sapiens
guuuggacauacauaagga

SEQ ID NO: 713117 - RNA, 19 nt, Homo sapiens
cugcaguucuucugagugu

SEQ ID NO: 713118 - RNA, 19 nt, Homo sapiens
gaucaccaaauuaucuuag

SEQ ID NO: 713119 - RNA, 19 nt, Homo sapiens
cauauaugugguugaauga

SEQ ID NO: 713120 - RNA, 19 nt, Homo sapiens
ccuguaguccuagcuauuu

SEQ ID NO: 713121 - RNA, 19 nt, Homo sapiens
gaggugggaagauggauca

SEQ ID NO: 713122 - RNA, 19 nt, Homo sapiens
aaggagaccauaauucugu

SEQ ID NO: 713123 - RNA, 19 nt, Homo sapiens
aagguacagugaugaagga

SEQ ID NO: 713124 - RNA, 19 nt, Homo sapiens
ucaccaaauuaucuuaggu

SEQ ID NO: 713125 - RNA, 19 nt, Homo sapiens
agauagcagucaauucgau

SEQ ID NO: 713126 - RNA, 19 nt, Homo sapiens
uaaauugugggaaaugagu

SEQ ID NO: 713127 - RNA, 19 nt, Homo sapiens
cauggacuguaucuuaucu

SEQ ID NO: 713128 - RNA, 19 nt, Homo sapiens
uauaugugguugaaugaac

SEQ ID NO: 713129 - RNA, 19 nt, Homo sapiens
gagcucuucacacguaaug

SEQ ID NO: 713130 - RNA, 19 nt, Homo sapiens
gccucaagcugugaaguuc

SEQ ID NO: 713131 - RNA, 19 nt, Homo sapiens
caaggauuucuucuaauag

SEQ ID NO: 713132 - RNA, 19 nt, Homo sapiens
gcuucugacugcaguucuu

SEQ ID NO: 713133 - RNA, 19 nt, Homo sapiens
cuaccacuauaucccaaau

SEQ ID NO: 713134 - RNA, 19 nt, Homo sapiens
agaccauaauucuguagug

SEQ ID NO: 713135 - RNA, 19 nt, Homo sapiens
agaguuuggacauacauaa

SEQ ID NO: 713136 - RNA, 19 nt, Homo sapiens
augcauauaugugguugaa

SEQ ID NO: 713137 - RNA, 19 nt, Homo sapiens
guaccuguaguccuagcua

SEQ ID NO: 713138 - RNA, 19 nt, Homo sapiens
ggauuucuucuaauagcuu

SEQ ID NO: 713139 - RNA, 19 nt, Homo sapiens
guaagaagugucccuuugc

SEQ ID NO: 713140 - RNA, 19 nt, Homo sapiens
cuauaucccaaauaccuaa

SEQ ID NO: 713141 - RNA, 19 nt, Homo sapiens
aggagaccauaauucugua

SEQ ID NO: 713142 - RNA, 19 nt, Homo sapiens
caguagaguuuggacauac

SEQ ID NO: 713143 - RNA, 19 nt, Homo sapiens
uugcagaucaagcuuuauu

SEQ ID NO: 713144 - RNA, 19 nt, Homo sapiens
aagcugugaaguuccuuua

SEQ ID NO: 713145 - RNA, 19 nt, Homo sapiens
uaucccaaauaccuaagau

SEQ ID NO: 713146 - RNA, 19 nt, Homo sapiens
ggugguacuuccuccuucu

SEQ ID NO: 713147 - RNA, 19 nt, Homo sapiens
gcuaugauugugccacugu

SEQ ID NO: 713148 - RNA, 19 nt, Homo sapiens
gacugcaguucuucugagu

SEQ ID NO: 713149 - RNA, 19 nt, Homo sapiens
ucccaaauaccuaagauag

SEQ ID NO: 713150 - RNA, 19 nt, Homo sapiens
ugaugaaggagaccauaau

SEQ ID NO: 713151 - RNA, 19 nt, Homo sapiens
agacugaaauggaguaaua

SEQ ID NO: 713152 - RNA, 19 nt, Homo sapiens
cugcagaucuugcgacuaa

SEQ ID NO: 713153 - RNA, 19 nt, Homo sapiens
ggaggcaggugggaauuga

SEQ ID NO: 713154 - RNA, 19 nt, Homo sapiens
acagagagauguagagaca

SEQ ID NO: 713155 - RNA, 19 nt, Homo sapiens
gaccaagccgugugcaaua

SEQ ID NO: 713156 - RNA, 19 nt, Homo sapiens
gagcaucgacuucaagcaa

SEQ ID NO: 713157 - RNA, 19 nt, Homo sapiens
ggagacggacccagcagua

SEQ ID NO: 713158 - RNA, 19 nt, Homo sapiens
agaaagagacugaaaugga

SEQ ID NO: 713159 - RNA, 19 nt, Homo sapiens
caaucaacaugcucuacuu

SEQ ID NO: 713160 - RNA, 19 nt, Homo sapiens
guuugaaguuugcagauga

SEQ ID NO: 713161 - RNA, 19 nt, Homo sapiens
guagagacagugauagaga

SEQ ID NO: 713162 - RNA, 19 nt, Homo sapiens
caacaugcucuacuucaau

SEQ ID NO: 713163 - RNA, 19 nt, Homo sapiens
ucaacaugcucuacuucaa

SEQ ID NO: 713164 - RNA, 19 nt, Homo sapiens
cguauccgcucacugaaga

SEQ ID NO: 713165 - RNA, 19 nt, Homo sapiens
gcaaacugcggcucaagga

SEQ ID NO: 713166 - RNA, 19 nt, Homo sapiens
gaaguuugcagaugagaag

SEQ ID NO: 713167 - RNA, 19 nt, Homo sapiens
ugagaaagagacugaaaug

SEQ ID NO: 713168 - RNA, 19 nt, Homo sapiens
ucgcagaucuugagcaaac

SEQ ID NO: 713169 - RNA, 19 nt, Homo sapiens
gagagaggcagaagagaca

SEQ ID NO: 713170 - RNA, 19 nt, Homo sapiens
agacagugauagagacaga

SEQ ID NO: 713171 - RNA, 19 nt, Homo sapiens
gcagugagaaggcaaagag

SEQ ID NO: 713172 - RNA, 19 nt, Homo sapiens
gagcuucgaguccuagaga

SEQ ID NO: 713173 - RNA, 19 nt, Homo sapiens
gcagcaggccaauccaaga

SEQ ID NO: 713174 - RNA, 19 nt, Homo sapiens
ggacccagcaguacagaca

SEQ ID NO: 713175 - RNA, 19 nt, Homo sapiens
caaagagagaggcagaaga

SEQ ID NO: 713176 - RNA, 19 nt, Homo sapiens
ggacugcgacgagcacuca

SEQ ID NO: 713177 - RNA, 19 nt, Homo sapiens
agagagauguagagacagu

SEQ ID NO: 713178 - RNA, 19 nt, Homo sapiens
caagccgugugcaauacaa

SEQ ID NO: 713179 - RNA, 19 nt, Homo sapiens
ccaccgagaccgucauuag

SEQ ID NO: 713180 - RNA, 19 nt, Homo sapiens
caguggacuuugaggcuuu

SEQ ID NO: 713181 - RNA, 19 nt, Homo sapiens
acacugagaaagagacuga

SEQ ID NO: 713182 - RNA, 19 nt, Homo sapiens
gcaaagagagaggcagaag

SEQ ID NO: 713183 - RNA, 19 nt, Homo sapiens
aaugacaagcagcagauua

SEQ ID NO: 713184 - RNA, 19 nt, Homo sapiens
aauauccgcauacccauuu

SEQ ID NO: 713185 - RNA, 19 nt, Homo sapiens
gacaaaacacugagaaaga

SEQ ID NO: 713186 - RNA, 19 nt, Homo sapiens
aaagagagaggcagaagag

SEQ ID NO: 713187 - RNA, 19 nt, Homo sapiens
gugagaaggcaaagagaga

SEQ ID NO: 713188 - RNA, 19 nt, Homo sapiens
gauagagacagaggaacaa

SEQ ID NO: 713189 - RNA, 19 nt, Homo sapiens
gcuacaaggccaacuacug

SEQ ID NO: 713190 - RNA, 19 nt, Homo sapiens
ggcagagcaucgacuucaa

SEQ ID NO: 713191 - RNA, 19 nt, Homo sapiens
cagaugagaagguuugaca

SEQ ID NO: 713192 - RNA, 19 nt, Homo sapiens
cagucuaccugcagaucuu

SEQ ID NO: 713193 - RNA, 19 nt, Homo sapiens
cagacgaggcagagacaaa

SEQ ID NO: 713194 - RNA, 19 nt, Homo sapiens
agauguagagacagugaua

SEQ ID NO: 713195 - RNA, 19 nt, Homo sapiens
aacaugcucuacuucaaug

SEQ ID NO: 713196 - RNA, 19 nt, Homo sapiens
cauggagcuucgaguccua

SEQ ID NO: 713197 - RNA, 19 nt, Homo sapiens
gcagagcaucgacuucaag

SEQ ID NO: 713198 - RNA, 19 nt, Homo sapiens
agucgcagaucuugagcaa

SEQ ID NO: 713199 - RNA, 19 nt, Homo sapiens
gagaaagagacugaaaugg

SEQ ID NO: 713200 - RNA, 19 nt, Homo sapiens
gggaguguuugaaguuugc

SEQ ID NO: 713201 - RNA, 19 nt, Homo sapiens
cgaccaagccgugugcaau

SEQ ID NO: 713202 - RNA, 19 nt, Homo sapiens
ccagugcgaguacauguuc

SEQ ID NO: 713203 - RNA, 19 nt, Homo sapiens
gcaucaagucgcagaucuu

SEQ ID NO: 713204 - RNA, 19 nt, Homo sapiens
gagggaggcaggugggaau

SEQ ID NO: 713205 - RNA, 19 nt, Homo sapiens
ugauagagacagaggaaca

SEQ ID NO: 713206 - RNA, 19 nt, Homo sapiens
ucaaugacaagcagcagau

SEQ ID NO: 713207 - RNA, 19 nt, Homo sapiens
uaaaugaaagccccacaaa

SEQ ID NO: 713208 - RNA, 19 nt, Homo sapiens
gcagcagugagaaggcaaa

SEQ ID NO: 713209 - RNA, 19 nt, Homo sapiens
agacagagagauguagaga

SEQ ID NO: 713210 - RNA, 19 nt, Homo sapiens
aaagacagagagauguaga

SEQ ID NO: 713211 - RNA, 19 nt, Homo sapiens
gacugaaauggaguaauaa

SEQ ID NO: 713212 - RNA, 19 nt, Homo sapiens
guuugcagaugagaagguu

SEQ ID NO: 713213 - RNA, 19 nt, Homo sapiens
ccaccaagauguccccaau

SEQ ID NO: 713214 - RNA, 19 nt, Homo sapiens
gagaggcagaagagacaga

SEQ ID NO: 713215 - RNA, 19 nt, Homo sapiens
uccgcucacugaagauuga

SEQ ID NO: 713216 - RNA, 19 nt, Homo sapiens
gcagaucuugcgacuaaaa

SEQ ID NO: 713217 - RNA, 19 nt, Homo sapiens
caauaaaucugccaucuuu

SEQ ID NO: 713218 - RNA, 19 nt, Homo sapiens
guaauaaacuugagcauuc

SEQ ID NO: 713219 - RNA, 19 nt, Homo sapiens
guacaucgacucagaaaua

SEQ ID NO: 713220 - RNA, 19 nt, Homo sapiens
agacuaacuuccagaauua

SEQ ID NO: 713221 - RNA, 19 nt, Homo sapiens
gcaaauuuguuucccuuaa

SEQ ID NO: 713222 - RNA, 19 nt, Homo sapiens
cgugaaaugugaaugauua

SEQ ID NO: 713223 - RNA, 19 nt, Homo sapiens
ucaaaugugugguuuauga

SEQ ID NO: 713224 - RNA, 19 nt, Homo sapiens
guauauaugugaacaguga

SEQ ID NO: 713225 - RNA, 19 nt, Homo sapiens
gaugaaagcugcugaacuc

SEQ ID NO: 713226 - RNA, 19 nt, Homo sapiens
gcaagguguuucccauuaa

SEQ ID NO: 713227 - RNA, 19 nt, Homo sapiens
gagcagacauuaaacaucu

SEQ ID NO: 713228 - RNA, 19 nt, Homo sapiens
ccaaauauguuaguaccua

SEQ ID NO: 713229 - RNA, 19 nt, Homo sapiens
gaaaucaggugguuaaacg

SEQ ID NO: 713230 - RNA, 19 nt, Homo sapiens
uaacaugcauugugagaau

SEQ ID NO: 713231 - RNA, 19 nt, Homo sapiens
ggaagaugaugcuuuguca

SEQ ID NO: 713232 - RNA, 19 nt, Homo sapiens
gaagacacacacauaauga

SEQ ID NO: 713233 - RNA, 19 nt, Homo sapiens
cuacuaacaugcauuguga

SEQ ID NO: 713234 - RNA, 19 nt, Homo sapiens
cagacuaacuuccagaauu

SEQ ID NO: 713235 - RNA, 19 nt, Homo sapiens
gcauuuccauuucuaaaga

SEQ ID NO: 713236 - RNA, 19 nt, Homo sapiens
gaacccagcuuagacuaga

SEQ ID NO: 713237 - RNA, 19 nt, Homo sapiens
ggaagaggcugcgggaaga

SEQ ID NO: 713238 - RNA, 19 nt, Homo sapiens
gaccucaucugcacuaaug

SEQ ID NO: 713239 - RNA, 19 nt, Homo sapiens
gaggagagaacccagcuua

SEQ ID NO: 713240 - RNA, 19 nt, Homo sapiens
caacauuacuggcauugug

SEQ ID NO: 713241 - RNA, 19 nt, Homo sapiens
ucagagagacuccagauuu

SEQ ID NO: 713242 - RNA, 19 nt, Homo sapiens
caaugacucugcuccguuu

SEQ ID NO: 713243 - RNA, 19 nt, Homo sapiens
caugguggguuguuaauau

SEQ ID NO: 713244 - RNA, 19 nt, Homo sapiens
caaggccuaugucuucuuu

SEQ ID NO: 713245 - RNA, 19 nt, Homo sapiens
ggagcuuaauggagaaauu

SEQ ID NO: 713246 - RNA, 19 nt, Homo sapiens
uccaaucucuuuccucuuu

SEQ ID NO: 713247 - RNA, 19 nt, Homo sapiens
gguggagcauucugucuaa

SEQ ID NO: 713248 - RNA, 19 nt, Homo sapiens
caagguguuucccauuaaa

SEQ ID NO: 713249 - RNA, 19 nt, Homo sapiens
cagcuucucugaugggaaa

SEQ ID NO: 713250 - RNA, 19 nt, Homo sapiens
gcaaaucgcacaaugacau

SEQ ID NO: 713251 - RNA, 19 nt, Homo sapiens
ugaauaaccugcgugucua

SEQ ID NO: 713252 - RNA, 19 nt, Homo sapiens
ugcaagguguuucccauua

SEQ ID NO: 713253 - RNA, 19 nt, Homo sapiens
ggucaaguguguaauaaac

SEQ ID NO: 713254 - RNA, 19 nt, Homo sapiens
ggagagaacccagcuuaga

SEQ ID NO: 713255 - RNA, 19 nt, Homo sapiens
aaacaggcagucaucuuua

SEQ ID NO: 713256 - RNA, 19 nt, Homo sapiens
gggaauccagccucuguua

SEQ ID NO: 713257 - RNA, 19 nt, Homo sapiens
ccucagaaaccucauaauu

SEQ ID NO: 713258 - RNA, 19 nt, Homo sapiens
uuagauauguccagagaug

SEQ ID NO: 713259 - RNA, 19 nt, Homo sapiens
aaggaacccucaccaacua

SEQ ID NO: 713260 - RNA, 19 nt, Homo sapiens
gaaaggcugcggacguuug

SEQ ID NO: 713261 - RNA, 19 nt, Homo sapiens
gaauccagccucuguuaga

SEQ ID NO: 713262 - RNA, 19 nt, Homo sapiens
aaacaucuuugugcuuuga

SEQ ID NO: 713263 - RNA, 19 nt, Homo sapiens
ggaggacagugacauuagu

SEQ ID NO: 713264 - RNA, 19 nt, Homo sapiens
ugacauuaguuccuucuuc

SEQ ID NO: 713265 - RNA, 19 nt, Homo sapiens
acacuagguucuuccugua

SEQ ID NO: 713266 - RNA, 19 nt, Homo sapiens
gcucgacuguuguaucugu

SEQ ID NO: 713267 - RNA, 19 nt, Homo sapiens
gaauaaccugcgugucuaa

SEQ ID NO: 713268 - RNA, 19 nt, Homo sapiens
gaaacucacuccccuacaa

SEQ ID NO: 713269 - RNA, 19 nt, Homo sapiens
gcagaguauggacaucuua

SEQ ID NO: 713270 - RNA, 19 nt, Homo sapiens
caaauuuguuucccuuaag

SEQ ID NO: 713271 - RNA, 19 nt, Homo sapiens
gugauuggcugcccugcaa

SEQ ID NO: 713272 - RNA, 19 nt, Homo sapiens
gaacuucagaccagauugu

SEQ ID NO: 713273 - RNA, 19 nt, Homo sapiens
ccacccaccucucccaaga

SEQ ID NO: 713274 - RNA, 19 nt, Homo sapiens
uaauuugagugcuuggaaa

SEQ ID NO: 713275 - RNA, 19 nt, Homo sapiens
uaaguuccuuccaaauaug

SEQ ID NO: 713276 - RNA, 19 nt, Homo sapiens
caaaucgcacaaugacaua

SEQ ID NO: 713277 - RNA, 19 nt, Homo sapiens
gacauuaguuccuucuucu

SEQ ID NO: 713278 - RNA, 19 nt, Homo sapiens
cuagaagacacacacauaa

SEQ ID NO: 713279 - RNA, 19 nt, Homo sapiens
gccuaugucuucuuugaga

SEQ ID NO: 713280 - RNA, 19 nt, Homo sapiens
gauggccguuucugacuug

SEQ ID NO: 713281 - RNA, 19 nt, Homo sapiens
gcaauauuaccuugacaga

SEQ ID NO: 713282 - RNA, 19 nt, Homo sapiens
gcaaacuacuaacaugcau

SEQ ID NO: 713283 - RNA, 19 nt, Homo sapiens
cccaagagcagacauuaaa

SEQ ID NO: 713284 - RNA, 19 nt, Homo sapiens
gcuuaacacucacccuuuc

SEQ ID NO: 713285 - RNA, 19 nt, Homo sapiens
gacagaaucaugggacuuu

SEQ ID NO: 713286 - RNA, 19 nt, Homo sapiens
guguauaccucacguacug

SEQ ID NO: 713287 - RNA, 19 nt, Homo sapiens
auggagaaauugcaacuuu

SEQ ID NO: 713288 - RNA, 19 nt, Homo sapiens
gcagacauuaaacaucuuu

SEQ ID NO: 713289 - RNA, 19 nt, Homo sapiens
cuuggaaacuauuagcuuu

SEQ ID NO: 713290 - RNA, 19 nt, Homo sapiens
guggucaaguguguaauaa

SEQ ID NO: 713291 - RNA, 19 nt, Homo sapiens
ccacgugaaaugugaauga

SEQ ID NO: 713292 - RNA, 19 nt, Homo sapiens
gucugugucugucugaaua

SEQ ID NO: 713293 - RNA, 19 nt, Homo sapiens
guuaguaccuacccuuuac

SEQ ID NO: 713294 - RNA, 19 nt, Homo sapiens
uggcugcccugcaaauuug

SEQ ID NO: 713295 - RNA, 19 nt, Homo sapiens
acagugagauggccguuuc

SEQ ID NO: 713296 - RNA, 19 nt, Homo sapiens
ggaacaguaucacaaaaga

SEQ ID NO: 713297 - RNA, 19 nt, Homo sapiens
gguggucaaguguguaaua

SEQ ID NO: 713298 - RNA, 19 nt, Homo sapiens
ucuagaagacacacacaua

SEQ ID NO: 713299 - RNA, 19 nt, Homo sapiens
cacuaacgcucucgugguu

SEQ ID NO: 713300 - RNA, 19 nt, Homo sapiens
gaaauccccucuucagcuu

SEQ ID NO: 713301 - RNA, 19 nt, Homo sapiens
ccagauaugguccgccuuu

SEQ ID NO: 713302 - RNA, 19 nt, Homo sapiens
aacuaucucugcuggauuu

SEQ ID NO: 713303 - RNA, 19 nt, Homo sapiens
ccaacuaucucugcuggau

SEQ ID NO: 713304 - RNA, 19 nt, Homo sapiens
cggaaaggcugcggacguu

SEQ ID NO: 713305 - RNA, 19 nt, Homo sapiens
aacaggcagucaucuuuaa

SEQ ID NO: 713306 - RNA, 19 nt, Homo sapiens
uacaaaagauggagcuuaa

SEQ ID NO: 713307 - RNA, 19 nt, Homo sapiens
ggagcauucugucuaagag

SEQ ID NO: 713308 - RNA, 19 nt, Homo sapiens
cagagagacuccagauuuu

SEQ ID NO: 713309 - RNA, 19 nt, Homo sapiens
gggaugagugacuuuauug

SEQ ID NO: 713310 - RNA, 19 nt, Homo sapiens
ugggaugagugacuuuauu

SEQ ID NO: 713311 - RNA, 19 nt, Homo sapiens
gguaccaaccagauaauga

SEQ ID NO: 713312 - RNA, 19 nt, Homo sapiens
gcucuacacccuucugguu

SEQ ID NO: 713313 - RNA, 19 nt, Homo sapiens
gcacuuaccagccgaacgu

SEQ ID NO: 713314 - RNA, 19 nt, Homo sapiens
caagaccucaucugcacua

SEQ ID NO: 713315 - RNA, 19 nt, Homo sapiens
acaccuggcauuuccauuu

SEQ ID NO: 713316 - RNA, 19 nt, Homo sapiens
gagcuuaauggagaaauug

SEQ ID NO: 713317 - RNA, 19 nt, Homo sapiens
gaacauggcuggccuggua

SEQ ID NO: 713318 - RNA, 19 nt, Homo sapiens
ccaaaugcuuucaguaaua

SEQ ID NO: 713319 - RNA, 19 nt, Homo sapiens
uaagagaacuuuccagaga

SEQ ID NO: 713320 - RNA, 19 nt, Homo sapiens
ccacacaucuuucuugaau

SEQ ID NO: 713321 - RNA, 19 nt, Homo sapiens
gagagggacuuauucaaug

SEQ ID NO: 713322 - RNA, 19 nt, Homo sapiens
ggagguggcugguuuaagg

SEQ ID NO: 713323 - RNA, 19 nt, Homo sapiens
gaaacugcuuugauugguu

SEQ ID NO: 713324 - RNA, 19 nt, Homo sapiens
ugaagaauaucuccacaga

SEQ ID NO: 713325 - RNA, 19 nt, Homo sapiens
acacaucuuucuugaauga

SEQ ID NO: 713326 - RNA, 19 nt, Homo sapiens
cgacaacacugaagacaag

SEQ ID NO: 713327 - RNA, 19 nt, Homo sapiens
gggaagauguggccugugu

SEQ ID NO: 713328 - RNA, 19 nt, Homo sapiens
gguacaacauccugaauca

SEQ ID NO: 713329 - RNA, 19 nt, Homo sapiens
gagcauuucuucuacucuu

SEQ ID NO: 713330 - RNA, 19 nt, Homo sapiens
ccacagacacaucggguua

SEQ ID NO: 713331 - RNA, 19 nt, Homo sapiens
aagaauaucuccacagaca

SEQ ID NO: 713332 - RNA, 19 nt, Homo sapiens
ggacuuauucaaugggaua

SEQ ID NO: 713333 - RNA, 19 nt, Homo sapiens
ggaaggacgacaacacuga

SEQ ID NO: 713334 - RNA, 19 nt, Homo sapiens
gggcagaggugggugagaa

SEQ ID NO: 713335 - RNA, 19 nt, Homo sapiens
uggaguaggugacacauga

SEQ ID NO: 713336 - RNA, 19 nt, Homo sapiens
cagcugaccugccaaucaa

SEQ ID NO: 713337 - RNA, 19 nt, Homo sapiens
ccauaaaucuauugucuac

SEQ ID NO: 713338 - RNA, 19 nt, Homo sapiens
uauccuaauuguccacaua

SEQ ID NO: 713339 - RNA, 19 nt, Homo sapiens
gaagauguggccuguguug

SEQ ID NO: 713340 - RNA, 19 nt, Homo sapiens
gauuuaaagugaacacaca

SEQ ID NO: 713341 - RNA, 19 nt, Homo sapiens
gaacguggcccuguaugug

SEQ ID NO: 713342 - RNA, 19 nt, Homo sapiens
auggugagcuuuauaagaa

SEQ ID NO: 713343 - RNA, 19 nt, Homo sapiens
gggcagagaagaagcaaga

SEQ ID NO: 713344 - RNA, 19 nt, Homo sapiens
cagaauaauuggcaugucu

SEQ ID NO: 713345 - RNA, 19 nt, Homo sapiens
ggaaacugcuuugauuggu

SEQ ID NO: 713346 - RNA, 19 nt, Homo sapiens
gaaagaauaagugaguaug

SEQ ID NO: 713347 - RNA, 19 nt, Homo sapiens
ucagugaguuaaacacgaa

SEQ ID NO: 713348 - RNA, 19 nt, Homo sapiens
ucacaaggauuucucuaac

SEQ ID NO: 713349 - RNA, 19 nt, Homo sapiens
uaaauccuuugcuucauuc

SEQ ID NO: 713350 - RNA, 19 nt, Homo sapiens
caacggcaccuacgagugu

SEQ ID NO: 713351 - RNA, 19 nt, Homo sapiens
ccaugaacguggcccugua

SEQ ID NO: 713352 - RNA, 19 nt, Homo sapiens
gaauaucuccacagacaca

SEQ ID NO: 713353 - RNA, 19 nt, Homo sapiens
cuacauccauggugagcuu

SEQ ID NO: 713354 - RNA, 19 nt, Homo sapiens
gaaggacgacaacacugaa

SEQ ID NO: 713355 - RNA, 19 nt, Homo sapiens
cgagagggacuuauucaau

SEQ ID NO: 713356 - RNA, 19 nt, Homo sapiens
gcaguuuacuauugcuauc

SEQ ID NO: 713357 - RNA, 19 nt, Homo sapiens
ccaaacccacguauucauu

SEQ ID NO: 713358 - RNA, 19 nt, Homo sapiens
gagcucaccugccaaucca

SEQ ID NO: 713359 - RNA, 19 nt, Homo sapiens
caccagagcagcuaagaga

SEQ ID NO: 713360 - RNA, 19 nt, Homo sapiens
ggauuucucuaacccuauc

SEQ ID NO: 713361 - RNA, 19 nt, Homo sapiens
ccacacacuuuccaucucu

SEQ ID NO: 713362 - RNA, 19 nt, Homo sapiens
gaggagcacugggcgugaa

SEQ ID NO: 713363 - RNA, 19 nt, Homo sapiens
gagcagcuaagagaacuuu

SEQ ID NO: 713364 - RNA, 19 nt, Homo sapiens
caucucaaaucacaaggau

SEQ ID NO: 713365 - RNA, 19 nt, Homo sapiens
gggaggaggaggaugacua

SEQ ID NO: 713366 - RNA, 19 nt, Homo sapiens
cagccugucucccugaaga

SEQ ID NO: 713367 - RNA, 19 nt, Homo sapiens
cgagggagagaccauaauu

SEQ ID NO: 713368 - RNA, 19 nt, Homo sapiens
ucagaucucccuccaugaa

SEQ ID NO: 713369 - RNA, 19 nt, Homo sapiens
ccaggcccaucucaaauca

SEQ ID NO: 713370 - RNA, 19 nt, Homo sapiens
ucauuggcaucaucaucua

SEQ ID NO: 713371 - RNA, 19 nt, Homo sapiens
aagaaucgcgucagcauau

SEQ ID NO: 713372 - RNA, 19 nt, Homo sapiens
uaagaaucgcgucagcaua

SEQ ID NO: 713373 - RNA, 19 nt, Homo sapiens
ccacguauucauucaguga

SEQ ID NO: 713374 - RNA, 19 nt, Homo sapiens
ucccguagcugccaguaug

SEQ ID NO: 713375 - RNA, 19 nt, Homo sapiens
agagaacuuuccagagaga

SEQ ID NO: 713376 - RNA, 19 nt, Homo sapiens
gagggagagaccauaauug

SEQ ID NO: 713377 - RNA, 19 nt, Homo sapiens
ccagugacagguuagguuu

SEQ ID NO: 713378 - RNA, 19 nt, Homo sapiens
guauucauucagugaguua

SEQ ID NO: 713379 - RNA, 19 nt, Homo sapiens
caucucugccugucaauau

SEQ ID NO: 713380 - RNA, 19 nt, Homo sapiens
gguuugcacuccacacauc

SEQ ID NO: 713381 - RNA, 19 nt, Homo sapiens
uccaaaugcuuucaguaau

SEQ ID NO: 713382 - RNA, 19 nt, Homo sapiens
aaacccacguauucauuca

SEQ ID NO: 713383 - RNA, 19 nt, Homo sapiens
gucagcauauccaacaaug

SEQ ID NO: 713384 - RNA, 19 nt, Homo sapiens
cggaaaggguggucaucug

SEQ ID NO: 713385 - RNA, 19 nt, Homo sapiens
guucuuguguccugguaau

SEQ ID NO: 713386 - RNA, 19 nt, Homo sapiens
gaguuaaacacgaauugau

SEQ ID NO: 713387 - RNA, 19 nt, Homo sapiens
gccugggccucauggcuuu

SEQ ID NO: 713388 - RNA, 19 nt, Homo sapiens
gaagaagcaagaccauggu

SEQ ID NO: 713389 - RNA, 19 nt, Homo sapiens
acaaggcacagucuucuga

SEQ ID NO: 713390 - RNA, 19 nt, Homo sapiens
caucuuucuugaaugaaug

SEQ ID NO: 713391 - RNA, 19 nt, Homo sapiens
guagacacagggaugauuc

SEQ ID NO: 713392 - RNA, 19 nt, Homo sapiens
gcagcccucauuaucauug

SEQ ID NO: 713393 - RNA, 19 nt, Homo sapiens
ggugagcuuuauaagaauc

SEQ ID NO: 713394 - RNA, 19 nt, Homo sapiens
uuccaaaugcuuucaguaa

SEQ ID NO: 713395 - RNA, 19 nt, Homo sapiens
gcauuucuucuacucuuga

SEQ ID NO: 713396 - RNA, 19 nt, Homo sapiens
gaguucuuguguccuggua

SEQ ID NO: 713397 - RNA, 19 nt, Homo sapiens
gagcuugcuugcagauggu

SEQ ID NO: 713398 - RNA, 19 nt, Homo sapiens
gggaaacugcuuugauugg

SEQ ID NO: 713399 - RNA, 19 nt, Homo sapiens
ggaccaccucgaccaguga

SEQ ID NO: 713400 - RNA, 19 nt, Homo sapiens
gaccauaauugggaacaac

SEQ ID NO: 713401 - RNA, 19 nt, Homo sapiens
cauggugagcuuuauaaga

SEQ ID NO: 713402 - RNA, 19 nt, Homo sapiens
aagcuccuccucacucaua

SEQ ID NO: 713403 - RNA, 19 nt, Homo sapiens
caaacccacguauucauuc

SEQ ID NO: 713404 - RNA, 19 nt, Homo sapiens
cacccaaacccacguauuc

SEQ ID NO: 713405 - RNA, 19 nt, Homo sapiens
gcacuccacacaucuuucu

SEQ ID NO: 713406 - RNA, 19 nt, Homo sapiens
ccucccuucuccuuucuaa

SEQ ID NO: 713407 - RNA, 19 nt, Homo sapiens
ccuccaggcccaucucaaa

SEQ ID NO: 713408 - RNA, 19 nt, Homo sapiens
ccucauggcuuuugcuuuc

SEQ ID NO: 713409 - RNA, 19 nt, Homo sapiens
cuccacacaucuuucuuga

SEQ ID NO: 713410 - RNA, 19 nt, Homo sapiens
ggaggaggaggaugacuac

SEQ ID NO: 713411 - RNA, 19 nt, Homo sapiens
ccagcugaccugccaauca

SEQ ID NO: 713412 - RNA, 19 nt, Homo sapiens
cagcucaccugccaaucca

SEQ ID NO: 713413 - RNA, 19 nt, Homo sapiens
ucucuaacccuauccuaau

SEQ ID NO: 713414 - RNA, 19 nt, Homo sapiens
gccuggcccucacucaaga

SEQ ID NO: 713415 - RNA, 19 nt, Homo sapiens
agagggaggaggaggauga

SEQ ID NO: 713416 - RNA, 19 nt, Homo sapiens
gugguugcagcccucauua

SEQ ID NO: 713417 - RNA, 19 nt, Homo sapiens
gaaccuggauuguguagua

SEQ ID NO: 713418 - RNA, 19 nt, Homo sapiens
gagaaacccuauaaaugua

SEQ ID NO: 713419 - RNA, 19 nt, Homo sapiens
gaaagaaaccauaugauug

SEQ ID NO: 713420 - RNA, 19 nt, Homo sapiens
gagaaacccuauacaugua

SEQ ID NO: 713421 - RNA, 19 nt, Homo sapiens
gggaaagccuucaguguuu

SEQ ID NO: 713422 - RNA, 19 nt, Homo sapiens
ggaaagaaaccauaugauu

SEQ ID NO: 713423 - RNA, 19 nt, Homo sapiens
gaaauggaccucauaaaug

SEQ ID NO: 713424 - RNA, 19 nt, Homo sapiens
ucuaagaugucguauguua

SEQ ID NO: 713425 - RNA, 19 nt, Homo sapiens
ggaaagaccagaacauuga

SEQ ID NO: 713426 - RNA, 19 nt, Homo sapiens
gguaaagccuucacucauu

SEQ ID NO: 713427 - RNA, 19 nt, Homo sapiens
ggaaagccuucggucauua

SEQ ID NO: 713428 - RNA, 19 nt, Homo sapiens
agaagaaucucuacaaaga

SEQ ID NO: 713429 - RNA, 19 nt, Homo sapiens
gcacaaaccacaugaguau

SEQ ID NO: 713430 - RNA, 19 nt, Homo sapiens
ggaaauggaccucauaaau

SEQ ID NO: 713431 - RNA, 19 nt, Homo sapiens
caguauagaugcaguaauu

SEQ ID NO: 713432 - RNA, 19 nt, Homo sapiens
guacagucaucccuugaua

SEQ ID NO: 713433 - RNA, 19 nt, Homo sapiens
ggagaaaccauauaaaugu

SEQ ID NO: 713434 - RNA, 19 nt, Homo sapiens
gagagaaacccuauaaaug

SEQ ID NO: 713435 - RNA, 19 nt, Homo sapiens
gagagaagccguaugaaug

SEQ ID NO: 713436 - RNA, 19 nt, Homo sapiens
gauagacccugugaaugua

SEQ ID NO: 713437 - RNA, 19 nt, Homo sapiens
ggcaaagccuaccguauuu

SEQ ID NO: 713438 - RNA, 19 nt, Homo sapiens
ggagaaaccguaugaaugu

SEQ ID NO: 713439 - RNA, 19 nt, Homo sapiens
guagucagccagaacauua

SEQ ID NO: 713440 - RNA, 19 nt, Homo sapiens
ggagagaaacccuauaaau

SEQ ID NO: 713441 - RNA, 19 nt, Homo sapiens
gcagagaaacccuauaaau

SEQ ID NO: 713442 - RNA, 19 nt, Homo sapiens
ucacuagcauucucucuaa

SEQ ID NO: 713443 - RNA, 19 nt, Homo sapiens
ggagagaacccguaugaau

SEQ ID NO: 713444 - RNA, 19 nt, Homo sapiens
ggagauggaccuuauaaau

SEQ ID NO: 713445 - RNA, 19 nt, Homo sapiens
gaaaccguaugaauguaaa

SEQ ID NO: 713446 - RNA, 19 nt, Homo sapiens
ggagauagacccugugaau

SEQ ID NO: 713447 - RNA, 19 nt, Homo sapiens
agagaaaccuuaugagugu

SEQ ID NO: 713448 - RNA, 19 nt, Homo sapiens
ggucauucaucccuuaauu

SEQ ID NO: 713449 - RNA, 19 nt, Homo sapiens
gaaacacauuggagauaga

SEQ ID NO: 713450 - RNA, 19 nt, Homo sapiens
ggaaagcauucagucguuu

SEQ ID NO: 713451 - RNA, 19 nt, Homo sapiens
ggagauggaccucauaaau

SEQ ID NO: 713452 - RNA, 19 nt, Homo sapiens
gagagaaacccuaugaaug

SEQ ID NO: 713453 - RNA, 19 nt, Homo sapiens
aaauggaccucauaaaugu

SEQ ID NO: 713454 - RNA, 19 nt, Homo sapiens
gagagaaacccuauacaug

SEQ ID NO: 713455 - RNA, 19 nt, Homo sapiens
gaagucauaugauaaugca

SEQ ID NO: 713456 - RNA, 19 nt, Homo sapiens
gagauggaccuuauaaaug

SEQ ID NO: 713457 - RNA, 19 nt, Homo sapiens
ucagaagaaucucuacaaa

SEQ ID NO: 713458 - RNA, 19 nt, Homo sapiens
gagaaaccauaugaaugua

SEQ ID NO: 713459 - RNA, 19 nt, Homo sapiens
ggagagaaaccauaugaau

SEQ ID NO: 713460 - RNA, 19 nt, Homo sapiens
uaccacaacucauuucaaa

SEQ ID NO: 713461 - RNA, 19 nt, Homo sapiens
gagagaacccguaugaaug

SEQ ID NO: 713462 - RNA, 19 nt, Homo sapiens
guaaagccuucacucauuc

SEQ ID NO: 713463 - RNA, 19 nt, Homo sapiens
gagauggaccucauaaaug

SEQ ID NO: 713464 - RNA, 19 nt, Homo sapiens
gggaaagcauucagucguu

SEQ ID NO: 713465 - RNA, 19 nt, Homo sapiens
gagaaacccuauaaaugca

SEQ ID NO: 713466 - RNA, 19 nt, Homo sapiens
ggagagaaacccuaugaau

SEQ ID NO: 713467 - RNA, 19 nt, Homo sapiens
gagaaaccguaugaaugua

SEQ ID NO: 713468 - RNA, 19 nt, Homo sapiens
gaaaccauaugaauguaag

SEQ ID NO: 713469 - RNA, 19 nt, Homo sapiens
cagagaaacccuauaaaug

SEQ ID NO: 713470 - RNA, 19 nt, Homo sapiens
guucuugucuaauacauga

SEQ ID NO: 713471 - RNA, 19 nt, Homo sapiens
ccucauaaaugcaagguau

SEQ ID NO: 713472 - RNA, 19 nt, Homo sapiens
ucuaaagccuucccugauu

SEQ ID NO: 713473 - RNA, 19 nt, Homo sapiens
gagagaaaccauaugaaug

SEQ ID NO: 713474 - RNA, 19 nt, Homo sapiens
agagagaaauccuaugaau

SEQ ID NO: 713475 - RNA, 19 nt, Homo sapiens
gagaagccguaugaaugua

SEQ ID NO: 713476 - RNA, 19 nt, Homo sapiens
ggagagaagccguaugaau

SEQ ID NO: 713477 - RNA, 19 nt, Homo sapiens
gaaacccuauacauguaaa

SEQ ID NO: 713478 - RNA, 19 nt, Homo sapiens
agauggaccuuauaaaugu

SEQ ID NO: 713479 - RNA, 19 nt, Homo sapiens
ggaaaagagucuauguauu

SEQ ID NO: 713480 - RNA, 19 nt, Homo sapiens
agagaaauccuaugaaugu

SEQ ID NO: 713481 - RNA, 19 nt, Homo sapiens
agagaaacccuauaaaugu

SEQ ID NO: 713482 - RNA, 19 nt, Homo sapiens
gggaaagcauuaucucauc

SEQ ID NO: 713483 - RNA, 19 nt, Homo sapiens
gggagaaaccauauaaaug

SEQ ID NO: 713484 - RNA, 19 nt, Homo sapiens
ggaacucaauguggagaaa

SEQ ID NO: 713485 - RNA, 19 nt, Homo sapiens
gaauguaagcacuugguaa

SEQ ID NO: 713486 - RNA, 19 nt, Homo sapiens
ggauguggcugugaacuuc

SEQ ID NO: 713487 - RNA, 19 nt, Homo sapiens
ggagagaaaccuuaugagu

SEQ ID NO: 713488 - RNA, 19 nt, Homo sapiens
gggagaaaccguaugaaug

SEQ ID NO: 713489 - RNA, 19 nt, Homo sapiens
gaagccagauacgcauaaa

SEQ ID NO: 713490 - RNA, 19 nt, Homo sapiens
gaauucacaugagagagaa

SEQ ID NO: 713491 - RNA, 19 nt, Homo sapiens
gcaaagucaugaaagaacu

SEQ ID NO: 713492 - RNA, 19 nt, Homo sapiens
ggagagaaacccuauacau

SEQ ID NO: 713493 - RNA, 19 nt, Homo sapiens
gauuccaguucuugucuaa

SEQ ID NO: 713494 - RNA, 19 nt, Homo sapiens
gauggaccuuauaaaugua

SEQ ID NO: 713495 - RNA, 19 nt, Homo sapiens
gccagaacauuaaaguuuc

SEQ ID NO: 713496 - RNA, 19 nt, Homo sapiens
gagaagccauaugagugua

SEQ ID NO: 713497 - RNA, 19 nt, Homo sapiens
ggagagaagccauaugagu

SEQ ID NO: 713498 - RNA, 19 nt, Homo sapiens
ucucaucgcucaagcuuuc

SEQ ID NO: 713499 - RNA, 19 nt, Homo sapiens
gaauguaagcaguguucua

SEQ ID NO: 713500 - RNA, 19 nt, Homo sapiens
ccacaacucauuucaaaca

SEQ ID NO: 713501 - RNA, 19 nt, Homo sapiens
cgaaacacauuggagauag

SEQ ID NO: 713502 - RNA, 19 nt, Homo sapiens
ugagagagaaauccuauga

SEQ ID NO: 713503 - RNA, 19 nt, Homo sapiens
ggacucacacugcagagaa

SEQ ID NO: 713504 - RNA, 19 nt, Homo sapiens
cuaguucacugcaaaguca

SEQ ID NO: 713505 - RNA, 19 nt, Homo sapiens
gagacgaccuggaaguucu

SEQ ID NO: 713506 - RNA, 19 nt, Homo sapiens
ucuaagacaugaaagaaca

SEQ ID NO: 713507 - RNA, 19 nt, Homo sapiens
uaagaugucguauguuaga

SEQ ID NO: 713508 - RNA, 19 nt, Homo sapiens
ucuaagacaugaaagaaca

SEQ ID NO: 713509 - RNA, 19 nt, Homo sapiens
gagagaaauccuaugaaug

SEQ ID NO: 713510 - RNA, 19 nt, Homo sapiens
uggcaaagccuaccguauu

SEQ ID NO: 713511 - RNA, 19 nt, Homo sapiens
uuccaguucuugucuaaua

SEQ ID NO: 713512 - RNA, 19 nt, Homo sapiens
agacaugaaagaacacaua

SEQ ID NO: 713513 - RNA, 19 nt, Homo sapiens
agacaugaaagaacacaua

SEQ ID NO: 713514 - RNA, 19 nt, Homo sapiens
gugggaaagccuucaguua

SEQ ID NO: 713515 - RNA, 19 nt, Homo sapiens
gagaacccguaugaaugua

SEQ ID NO: 713516 - RNA, 19 nt, Homo sapiens
gaaagaccagaacauugaa

SEQ ID NO: 713517 - RNA, 19 nt, Homo sapiens
gaccagcacugauuaauua

SEQ ID NO: 713518 - RNA, 19 nt, Homo sapiens
ggauuuaccuguucauuua

SEQ ID NO: 713519 - RNA, 19 nt, Homo sapiens
uaacaaggcugccaaguaa

SEQ ID NO: 713520 - RNA, 19 nt, Homo sapiens
gcaaauaucacaugguuua

SEQ ID NO: 713521 - RNA, 19 nt, Homo sapiens
gaacaucuaucaacauugu

SEQ ID NO: 713522 - RNA, 19 nt, Homo sapiens
gaaguucucuugccacauu

SEQ ID NO: 713523 - RNA, 19 nt, Homo sapiens
gaaauacugugcugucuau

SEQ ID NO: 713524 - RNA, 19 nt, Homo sapiens
uaacaaggguacauaguaa

SEQ ID NO: 713525 - RNA, 19 nt, Homo sapiens
gaaggaaacagaauacuuu

SEQ ID NO: 713526 - RNA, 19 nt, Homo sapiens
caucaacacucucaaauga

SEQ ID NO: 713527 - RNA, 19 nt, Homo sapiens
gaauacagaugauuugugu

SEQ ID NO: 713528 - RNA, 19 nt, Homo sapiens
gagaagauuuaccugcuua

SEQ ID NO: 713529 - RNA, 19 nt, Homo sapiens
caucagcaauuccacauua

SEQ ID NO: 713530 - RNA, 19 nt, Homo sapiens
gaacagcaaccauacgaua

SEQ ID NO: 713531 - RNA, 19 nt, Homo sapiens
gguccaaggucaccaauaa

SEQ ID NO: 713532 - RNA, 19 nt, Homo sapiens
gaagagggaucaaagagau

SEQ ID NO: 713533 - RNA, 19 nt, Homo sapiens
gaacucugcuggaauccua

SEQ ID NO: 713534 - RNA, 19 nt, Homo sapiens
ucagacaacuugaccauuu

SEQ ID NO: 713535 - RNA, 19 nt, Homo sapiens
gcaguaugcuuauccuuga

SEQ ID NO: 713536 - RNA, 19 nt, Homo sapiens
uaaagagccucaaaucaga

SEQ ID NO: 713537 - RNA, 19 nt, Homo sapiens
ucaaggaacuaagguauuu

SEQ ID NO: 713538 - RNA, 19 nt, Homo sapiens
caagagugguuucauuuga

SEQ ID NO: 713539 - RNA, 19 nt, Homo sapiens
gagaggauaugucauguuc

SEQ ID NO: 713540 - RNA, 19 nt, Homo sapiens
gaaauaaaguguggaacau

SEQ ID NO: 713541 - RNA, 19 nt, Homo sapiens
caacaaugguuucaacugu

SEQ ID NO: 713542 - RNA, 19 nt, Homo sapiens
ccaaacgccugaagcuuaa

SEQ ID NO: 713543 - RNA, 19 nt, Homo sapiens
ggaauguccuggccaguga

SEQ ID NO: 713544 - RNA, 19 nt, Homo sapiens
cuauacagcucaacaacua

SEQ ID NO: 713545 - RNA, 19 nt, Homo sapiens
gaacuaagguauuuugcua

SEQ ID NO: 713546 - RNA, 19 nt, Homo sapiens
ucucuuagguucugaaauu

SEQ ID NO: 713547 - RNA, 19 nt, Homo sapiens
ccacuggccucuaaaauua

SEQ ID NO: 713548 - RNA, 19 nt, Homo sapiens
uguagcagcuuuacucuuu

SEQ ID NO: 713549 - RNA, 19 nt, Homo sapiens
caaauucuguguggacuuu

SEQ ID NO: 713550 - RNA, 19 nt, Homo sapiens
gcucaacacuucaugacaa

SEQ ID NO: 713551 - RNA, 19 nt, Homo sapiens
agauuuaccugcuuacuaa

SEQ ID NO: 713552 - RNA, 19 nt, Homo sapiens
ccacauuacuuaaagauag

SEQ ID NO: 713553 - RNA, 19 nt, Homo sapiens
ccagucaagucuucagaua

SEQ ID NO: 713554 - RNA, 19 nt, Homo sapiens
gguaggugcuuaacucuug

SEQ ID NO: 713555 - RNA, 19 nt, Homo sapiens
uaaggaauaugucuuguuc

SEQ ID NO: 713556 - RNA, 19 nt, Homo sapiens
gaacugaagucuguuuuaa

SEQ ID NO: 713557 - RNA, 19 nt, Homo sapiens
gaaagaaaucuaccuguca

SEQ ID NO: 713558 - RNA, 19 nt, Homo sapiens
gcccaacccuacuuucuaa

SEQ ID NO: 713559 - RNA, 19 nt, Homo sapiens
aaacuccacuggccucuaa

SEQ ID NO: 713560 - RNA, 19 nt, Homo sapiens
ucaacacucucaaaugauu

SEQ ID NO: 713561 - RNA, 19 nt, Homo sapiens
ggacaacaaugguuucaac

SEQ ID NO: 713562 - RNA, 19 nt, Homo sapiens
aaugcuagcuucauaugua

SEQ ID NO: 713563 - RNA, 19 nt, Homo sapiens
guugacagauagagugaua

SEQ ID NO: 713564 - RNA, 19 nt, Homo sapiens
uaaagcaguugaagcagaa

SEQ ID NO: 713565 - RNA, 19 nt, Homo sapiens
uggaacaucucaucagaaa

SEQ ID NO: 713566 - RNA, 19 nt, Homo sapiens
caacuugccagccauguaa

SEQ ID NO: 713567 - RNA, 19 nt, Homo sapiens
gauaaagagccucaaauca

SEQ ID NO: 713568 - RNA, 19 nt, Homo sapiens
caaggucaccaauaagaua

SEQ ID NO: 713569 - RNA, 19 nt, Homo sapiens
ggaaauaaaguguggaaca

SEQ ID NO: 713570 - RNA, 19 nt, Homo sapiens
aagcaaauaucacaugguu

SEQ ID NO: 713571 - RNA, 19 nt, Homo sapiens
gaauguauuucccaaagca

SEQ ID NO: 713572 - RNA, 19 nt, Homo sapiens
cagagggcauucagacuaa

SEQ ID NO: 713573 - RNA, 19 nt, Homo sapiens
gccaaguaauggagaagua

SEQ ID NO: 713574 - RNA, 19 nt, Homo sapiens
agaagugagugaccuguuu

SEQ ID NO: 713575 - RNA, 19 nt, Homo sapiens
acucugcacuuaaggaaua

SEQ ID NO: 713576 - RNA, 19 nt, Homo sapiens
aaagaaaucuaccugucaa

SEQ ID NO: 713577 - RNA, 19 nt, Homo sapiens
uagagucgguccuaacaaa

SEQ ID NO: 713578 - RNA, 19 nt, Homo sapiens
gcaauuccacauuacuuaa

SEQ ID NO: 713579 - RNA, 19 nt, Homo sapiens
cauggucgguggaggauaa

SEQ ID NO: 713580 - RNA, 19 nt, Homo sapiens
ucaaaugauucacauguuc

SEQ ID NO: 713581 - RNA, 19 nt, Homo sapiens
ucacacuucaguucaauua

SEQ ID NO: 713582 - RNA, 19 nt, Homo sapiens
gcagaguuauuuggagauu

SEQ ID NO: 713583 - RNA, 19 nt, Homo sapiens
cagauguuguugacagaua

SEQ ID NO: 713584 - RNA, 19 nt, Homo sapiens
gcaauaguuugugaaugaa

SEQ ID NO: 713585 - RNA, 19 nt, Homo sapiens
ggaaggaaacagaauacuu

SEQ ID NO: 713586 - RNA, 19 nt, Homo sapiens
uaauggagaaguaugguua

SEQ ID NO: 713587 - RNA, 19 nt, Homo sapiens
gaagguagacauugugcuu

SEQ ID NO: 713588 - RNA, 19 nt, Homo sapiens
ccacggaugucuugguaga

SEQ ID NO: 713589 - RNA, 19 nt, Homo sapiens
gauaauggaacucaggaaa

SEQ ID NO: 713590 - RNA, 19 nt, Homo sapiens
agcaauaguuugugaauga

SEQ ID NO: 713591 - RNA, 19 nt, Homo sapiens
gccugaagcuuaaccaaga

SEQ ID NO: 713592 - RNA, 19 nt, Homo sapiens
aaacuaaucacguccauau

SEQ ID NO: 713593 - RNA, 19 nt, Homo sapiens
ccagcuacaucuucaguga

SEQ ID NO: 713594 - RNA, 19 nt, Homo sapiens
cacagaaacuccugagaau

SEQ ID NO: 713595 - RNA, 19 nt, Homo sapiens
aacaaaugcuagcuucaua

SEQ ID NO: 713596 - RNA, 19 nt, Homo sapiens
caaggcagcccuauugaga

SEQ ID NO: 713597 - RNA, 19 nt, Homo sapiens
guucuugccuccuacuauu

SEQ ID NO: 713598 - RNA, 19 nt, Homo sapiens
caacccuacuuucuaauuc

SEQ ID NO: 713599 - RNA, 19 nt, Homo sapiens
gggaucaaagagauaauua

SEQ ID NO: 713600 - RNA, 19 nt, Homo sapiens
gaaauggaagucagaagug

SEQ ID NO: 713601 - RNA, 19 nt, Homo sapiens
cagcacagccagagcauuu

SEQ ID NO: 713602 - RNA, 19 nt, Homo sapiens
caccauggcugucacacuu

SEQ ID NO: 713603 - RNA, 19 nt, Homo sapiens
gguguaagguguucagaag

SEQ ID NO: 713604 - RNA, 19 nt, Homo sapiens
ggaauccuauugagaaggu

SEQ ID NO: 713605 - RNA, 19 nt, Homo sapiens
ucaauugacuuugugauca

SEQ ID NO: 713606 - RNA, 19 nt, Homo sapiens
ccaauaagauagaccugau

SEQ ID NO: 713607 - RNA, 19 nt, Homo sapiens
ccacauuacuuuccugucu

SEQ ID NO: 713608 - RNA, 19 nt, Homo sapiens
gaaaucuaccugucaagga

SEQ ID NO: 713609 - RNA, 19 nt, Homo sapiens
ggaaauacugugcugucua

SEQ ID NO: 713610 - RNA, 19 nt, Homo sapiens
ccaucaaacuggaaccaaa

SEQ ID NO: 713611 - RNA, 19 nt, Homo sapiens
ccauaucacugguauugug

SEQ ID NO: 713612 - RNA, 19 nt, Homo sapiens
aaucuuagguaggugcuua

SEQ ID NO: 713613 - RNA, 19 nt, Homo sapiens
gggauuuaccuguucauuu

SEQ ID NO: 713614 - RNA, 19 nt, Homo sapiens
cuaacaaggcugccaagua

SEQ ID NO: 713615 - RNA, 19 nt, Homo sapiens
ggagggacaacaaugguuu

SEQ ID NO: 713616 - RNA, 19 nt, Homo sapiens
gauauuguuuggucuugga

SEQ ID NO: 713617 - RNA, 19 nt, Homo sapiens
agagagagauguccagaaa

SEQ ID NO: 713618 - RNA, 19 nt, Homo sapiens
guucauaucccacuucuuu

SEQ ID NO: 713619 - RNA, 19 nt, Homo sapiens
gauggaaacugucaagcaa

SEQ ID NO: 713620 - RNA, 19 nt, Homo sapiens
gguauucaguauugccuua

SEQ ID NO: 713621 - RNA, 19 nt, Homo sapiens
gagccaagaucgcgccauu

SEQ ID NO: 713622 - RNA, 19 nt, Homo sapiens
gguaagccuuguugaaaug

SEQ ID NO: 713623 - RNA, 19 nt, Homo sapiens
acaccgaugucccugaaua

SEQ ID NO: 713624 - RNA, 19 nt, Homo sapiens
gggacaagagugagacuua

SEQ ID NO: 713625 - RNA, 19 nt, Homo sapiens
gguagcaggugucuguuau

SEQ ID NO: 713626 - RNA, 19 nt, Homo sapiens
gcaaggcguugaucagaag

SEQ ID NO: 713627 - RNA, 19 nt, Homo sapiens
ggacaagagugagacuuag

SEQ ID NO: 713628 - RNA, 19 nt, Homo sapiens
gcuaauggacuugggauuu

SEQ ID NO: 713629 - RNA, 19 nt, Homo sapiens
ggaacagagcuacuucgua

SEQ ID NO: 713630 - RNA, 19 nt, Homo sapiens
gcccuaagccugauggaaa

SEQ ID NO: 713631 - RNA, 19 nt, Homo sapiens
uaauaaacuucacccacaa

SEQ ID NO: 713632 - RNA, 19 nt, Homo sapiens
uggaauauguggcccagaa

SEQ ID NO: 713633 - RNA, 19 nt, Homo sapiens
cccaagagauggugucuag

SEQ ID NO: 713634 - RNA, 19 nt, Homo sapiens
aauaucagccuguagcuaa

SEQ ID NO: 713635 - RNA, 19 nt, Homo sapiens
aaacgggcaucacccaguu

SEQ ID NO: 713636 - RNA, 19 nt, Homo sapiens
gagcuugugucgucuaagg

SEQ ID NO: 713637 - RNA, 19 nt, Homo sapiens
uaucccacuucuuuguuua

SEQ ID NO: 713638 - RNA, 19 nt, Homo sapiens
gggcucauuucaaacuuau

SEQ ID NO: 713639 - RNA, 19 nt, Homo sapiens
gaauaucagccuguagcua

SEQ ID NO: 713640 - RNA, 19 nt, Homo sapiens
gaaaccccgucucuacuaa

SEQ ID NO: 713641 - RNA, 19 nt, Homo sapiens
aggagaagcugcaccagau

SEQ ID NO: 713642 - RNA, 19 nt, Homo sapiens
gugguaagccuuguugaaa

SEQ ID NO: 713643 - RNA, 19 nt, Homo sapiens
gagccucauuguagaguag

SEQ ID NO: 713644 - RNA, 19 nt, Homo sapiens
uuacaccgaugucccugaa

SEQ ID NO: 713645 - RNA, 19 nt, Homo sapiens
cuucugugcuguccacuug

SEQ ID NO: 713646 - RNA, 19 nt, Homo sapiens
gccuguagcuaauggacuu

SEQ ID NO: 713647 - RNA, 19 nt, Homo sapiens
ucucugagcuuggaagaag

SEQ ID NO: 713648 - RNA, 19 nt, Homo sapiens
gcccagaacacaccuguca

SEQ ID NO: 713649 - RNA, 19 nt, Homo sapiens
caagacaaaguccguagug

SEQ ID NO: 713650 - RNA, 19 nt, Homo sapiens
ccaguugacccaucucuca

SEQ ID NO: 713651 - RNA, 19 nt, Homo sapiens
ugguaagccuuguugaaau

SEQ ID NO: 713652 - RNA, 19 nt, Homo sapiens
uuaggaggcugaggcaaga

SEQ ID NO: 713653 - RNA, 19 nt, Homo sapiens
caugguagcaggugucugu

SEQ ID NO: 713654 - RNA, 19 nt, Homo sapiens
gaauauguggcccagaaca

SEQ ID NO: 713655 - RNA, 19 nt, Homo sapiens
gagaagcugcaccagaugu

SEQ ID NO: 713656 - RNA, 19 nt, Homo sapiens
gcaggaacagagcuacuuc

SEQ ID NO: 713657 - RNA, 19 nt, Homo sapiens
ggaccuccaggccacguuu

SEQ ID NO: 713658 - RNA, 19 nt, Homo sapiens
uggacaaguuggaggagaa

SEQ ID NO: 713659 - RNA, 19 nt, Homo sapiens
aaucagggauauaguucau

SEQ ID NO: 713660 - RNA, 19 nt, Homo sapiens
ccuguaaucccagcacuuu

SEQ ID NO: 713661 - RNA, 19 nt, Homo sapiens
aagacaaaguccguaguga

SEQ ID NO: 713662 - RNA, 19 nt, Homo sapiens
gagcuacccgcacaucaag

SEQ ID NO: 713663 - RNA, 19 nt, Homo sapiens
ggaagcuaaggcucucaaa

SEQ ID NO: 713664 - RNA, 19 nt, Homo sapiens
agauguggcucagcuggaa

SEQ ID NO: 713665 - RNA, 19 nt, Homo sapiens
ggagaagcugcaccagaug

SEQ ID NO: 713666 - RNA, 19 nt, Homo sapiens
auaucccacuucuuuguuu

SEQ ID NO: 713667 - RNA, 19 nt, Homo sapiens
uaagccugauggaaacugu

SEQ ID NO: 713668 - RNA, 19 nt, Homo sapiens
ucauaucccacuucuuugu

SEQ ID NO: 713669 - RNA, 19 nt, Homo sapiens
gacaagagugagacuuagu

SEQ ID NO: 713670 - RNA, 19 nt, Homo sapiens
gagagcuacccgcacauca

SEQ ID NO: 713671 - RNA, 19 nt, Homo sapiens
ucacccaguugacccaucu

SEQ ID NO: 713672 - RNA, 19 nt, Homo sapiens
gaagcuaaggcucucaaaa

SEQ ID NO: 713673 - RNA, 19 nt, Homo sapiens
agcaaggcguugaucagaa

SEQ ID NO: 713674 - RNA, 19 nt, Homo sapiens
ccgaugucccugaauauca

SEQ ID NO: 713675 - RNA, 19 nt, Homo sapiens
gaccagccaggccaacaug

SEQ ID NO: 713676 - RNA, 19 nt, Homo sapiens
ggggcucauuucaaacuua

SEQ ID NO: 713677 - RNA, 19 nt, Homo sapiens
gacaaccaccugccccuua

SEQ ID NO: 713678 - RNA, 19 nt, Homo sapiens
ggagagcuacccgcacauc

SEQ ID NO: 713679 - RNA, 19 nt, Homo sapiens
cauaucccacuucuuuguu

SEQ ID NO: 713680 - RNA, 19 nt, Homo sapiens
caugguguccgcagccuau

SEQ ID NO: 713681 - RNA, 19 nt, Homo sapiens
cagccucucugagcuugga

SEQ ID NO: 713682 - RNA, 19 nt, Homo sapiens
aagcaaggcguugaucaga

SEQ ID NO: 713683 - RNA, 19 nt, Homo sapiens
ccaggugacaguggaagaa

SEQ ID NO: 713684 - RNA, 19 nt, Homo sapiens
ggaaauggcacccugguuu

SEQ ID NO: 713685 - RNA, 19 nt, Homo sapiens
gaaauaaagcaccuguuug

SEQ ID NO: 713686 - RNA, 19 nt, Homo sapiens
ggaaguugcugccgugaag

SEQ ID NO: 713687 - RNA, 19 nt, Homo sapiens
ugaaauaaagcaccuguuu

SEQ ID NO: 713688 - RNA, 19 nt, Homo sapiens
gaaauggcacccugguuug

SEQ ID NO: 713689 - RNA, 19 nt, Homo sapiens
ugucagggcuucuguuugu

SEQ ID NO: 713690 - RNA, 19 nt, Homo sapiens
auaaagcaccuguuuguuu

SEQ ID NO: 713691 - RNA, 19 nt, Homo sapiens
uaaagcaccuguuuguuuu

SEQ ID NO: 713692 - RNA, 19 nt, Homo sapiens
ccagguuucugaugaugaa

SEQ ID NO: 713693 - RNA, 19 nt, Homo sapiens
gcaccagguuucugaugau

SEQ ID NO: 713694 - RNA, 19 nt, Homo sapiens
ggcagcuccuccagacuua

SEQ ID NO: 713695 - RNA, 19 nt, Homo sapiens
caccagcgcuuccaguuca

SEQ ID NO: 713696 - RNA, 19 nt, Homo sapiens
aaauaaagcaccuguuugu

SEQ ID NO: 713697 - RNA, 19 nt, Homo sapiens
ggucaucguugucuuucuc

SEQ ID NO: 713698 - RNA, 19 nt, Homo sapiens
gcugucagggcuucuguuu

SEQ ID NO: 713699 - RNA, 19 nt, Homo sapiens
ggucagagcagcccaccau

SEQ ID NO: 713700 - RNA, 19 nt, Homo sapiens
gguggccgcuucaguguac

SEQ ID NO: 713701 - RNA, 19 nt, Homo sapiens
ggccaccucucggagcuuu

SEQ ID NO: 713702 - RNA, 19 nt, Homo sapiens
uuacuuacuccuucaguga

SEQ ID NO: 713703 - RNA, 19 nt, Homo sapiens
ggagaagagguacaacagu

SEQ ID NO: 713704 - RNA, 19 nt, Homo sapiens
agacuuacuuacuccuuca

SEQ ID NO: 713705 - RNA, 19 nt, Homo sapiens
gaccugcuguucaucuucu

SEQ ID NO: 713706 - RNA, 19 nt, Homo sapiens
gcuccuccagacuuacuua

SEQ ID NO: 713707 - RNA, 19 nt, Homo sapiens
ucagggcuucuguuuguuu

SEQ ID NO: 713708 - RNA, 19 nt, Homo sapiens
ugcaccagguuucugauga

SEQ ID NO: 713709 - RNA, 19 nt, Homo sapiens
gcagaagggcacggucaug

SEQ ID NO: 713710 - RNA, 19 nt, Homo sapiens
ggaugccaguggagaagag

SEQ ID NO: 713711 - RNA, 19 nt, Homo sapiens
ccuccagacuuacuuacuc

SEQ ID NO: 713712 - RNA, 19 nt, Homo sapiens
cugcugcucuacuccuuug

SEQ ID NO: 713713 - RNA, 19 nt, Homo sapiens
ccuccgaccugcuguucau

SEQ ID NO: 713714 - RNA, 19 nt, Homo sapiens
caccagguuucugaugaug

SEQ ID NO: 713715 - RNA, 19 nt, Homo sapiens
gacccacccucuggagaca

SEQ ID NO: 713716 - RNA, 19 nt, Homo sapiens
gcacggucauggguacacu

SEQ ID NO: 713717 - RNA, 19 nt, Homo sapiens
gcaacugaauugaguauaa

SEQ ID NO: 713718 - RNA, 19 nt, Homo sapiens
ccaacgagcugagaaauaa

SEQ ID NO: 713719 - RNA, 19 nt, Homo sapiens
gaaaggagagguacagaaa

SEQ ID NO: 713720 - RNA, 19 nt, Homo sapiens
gaagauuucucucacgaau

SEQ ID NO: 713721 - RNA, 19 nt, Homo sapiens
ccugagagcugaugauuau

SEQ ID NO: 713722 - RNA, 19 nt, Homo sapiens
gcaaaaguaucucauauga

SEQ ID NO: 713723 - RNA, 19 nt, Homo sapiens
gcaguuauguuggaagauu

SEQ ID NO: 713724 - RNA, 19 nt, Homo sapiens
gcaccgcugucccaucuaa

SEQ ID NO: 713725 - RNA, 19 nt, Homo sapiens
gaaauaaccuccggagcau

SEQ ID NO: 713726 - RNA, 19 nt, Homo sapiens
gaucagaugucaacuucau

SEQ ID NO: 713727 - RNA, 19 nt, Homo sapiens
cagcauaguugaagcaaau

SEQ ID NO: 713728 - RNA, 19 nt, Homo sapiens
gaacaacagauaaauaugg

SEQ ID NO: 713729 - RNA, 19 nt, Homo sapiens
gaaaccaucagcauaguug

SEQ ID NO: 713730 - RNA, 19 nt, Homo sapiens
agggauaaaugcuaagaua

SEQ ID NO: 713731 - RNA, 19 nt, Homo sapiens
gagagcugaugauuauuga

SEQ ID NO: 713732 - RNA, 19 nt, Homo sapiens
gcacuggaacaacagauaa

SEQ ID NO: 713733 - RNA, 19 nt, Homo sapiens
gcccagggauuguuucaga

SEQ ID NO: 713734 - RNA, 19 nt, Homo sapiens
ggcauuagcugaaagaaaa

SEQ ID NO: 713735 - RNA, 19 nt, Homo sapiens
caugaaagaucagauguca

SEQ ID NO: 713736 - RNA, 19 nt, Homo sapiens
agauuucucucacgaauug

SEQ ID NO: 713737 - RNA, 19 nt, Homo sapiens
ggacaugaaagaucagaug

SEQ ID NO: 713738 - RNA, 19 nt, Homo sapiens
uaucucauaugaccaguga

SEQ ID NO: 713739 - RNA, 19 nt, Homo sapiens
ucagggacaugaaagauca

SEQ ID NO: 713740 - RNA, 19 nt, Homo sapiens
gcgaguuccuccugcauau

SEQ ID NO: 713741 - RNA, 19 nt, Homo sapiens
gggauaaaugcuaagauaa

SEQ ID NO: 713742 - RNA, 19 nt, Homo sapiens
gacagaaaaugcaguguuu

SEQ ID NO: 713743 - RNA, 19 nt, Homo sapiens
gacagaaggcucagaaaca

SEQ ID NO: 713744 - RNA, 19 nt, Homo sapiens
caacugaauugaguauaag

SEQ ID NO: 713745 - RNA, 19 nt, Homo sapiens
gcucauuccaugcaucuuu

SEQ ID NO: 713746 - RNA, 19 nt, Homo sapiens
aagaucagaugucaacuuc

SEQ ID NO: 713747 - RNA, 19 nt, Homo sapiens
uagaggaccuugaugaaac

SEQ ID NO: 713748 - RNA, 19 nt, Homo sapiens
gcugucccaucuaaagaaa

SEQ ID NO: 713749 - RNA, 19 nt, Homo sapiens
ugacauugccgucuacuca

SEQ ID NO: 713750 - RNA, 19 nt, Homo sapiens
ggaccgagagcuccagaga

SEQ ID NO: 713751 - RNA, 19 nt, Homo sapiens
uuucagggauaaaugcuaa

SEQ ID NO: 713752 - RNA, 19 nt, Homo sapiens
gaaaagccuucauuacaag

SEQ ID NO: 713753 - RNA, 19 nt, Homo sapiens
uaaccuugaugcaacugaa

SEQ ID NO: 713754 - RNA, 19 nt, Homo sapiens
ugccauagccauccucuuu

SEQ ID NO: 713755 - RNA, 19 nt, Homo sapiens
gugcaggcauuagcugaaa

SEQ ID NO: 713756 - RNA, 19 nt, Homo sapiens
ggacagaaggcucagaaac

SEQ ID NO: 713757 - RNA, 19 nt, Homo sapiens
gggaagaggaaauagaugu

SEQ ID NO: 713758 - RNA, 19 nt, Homo sapiens
ggaggaacaggcaguuaug

SEQ ID NO: 713759 - RNA, 19 nt, Homo sapiens
ggaacaacagauaaauaug

SEQ ID NO: 713760 - RNA, 19 nt, Homo sapiens
agaaaagccuucauuacaa

SEQ ID NO: 713761 - RNA, 19 nt, Homo sapiens
gaggacagaaggcucagaa

SEQ ID NO: 713762 - RNA, 19 nt, Homo sapiens
ugagagcugaugauuauug

SEQ ID NO: 713763 - RNA, 19 nt, Homo sapiens
gcugagcacgugugacauu

SEQ ID NO: 713764 - RNA, 19 nt, Homo sapiens
gugcaccgcugucccaucu

SEQ ID NO: 713765 - RNA, 19 nt, Homo sapiens
gaguuccuccugcauauga

SEQ ID NO: 713766 - RNA, 19 nt, Homo sapiens
gaacuggagcacuggaaca

SEQ ID NO: 713767 - RNA, 19 nt, Homo sapiens
ugaaagaucagaugucaac

SEQ ID NO: 713768 - RNA, 19 nt, Homo sapiens
ccagugggaagaggaaaua

SEQ ID NO: 713769 - RNA, 19 nt, Homo sapiens
caguuauguuggaagauuu

SEQ ID NO: 713770 - RNA, 19 nt, Homo sapiens
ugaugcaacugaauugagu

SEQ ID NO: 713771 - RNA, 19 nt, Homo sapiens
caacacugcccagggauug

SEQ ID NO: 713772 - RNA, 19 nt, Homo sapiens
agccaauucucauuucauu

SEQ ID NO: 713773 - RNA, 19 nt, Homo sapiens
gaggggagcuggaggaaca

SEQ ID NO: 713774 - RNA, 19 nt, Homo sapiens
ggaagauuucucucacgaa

SEQ ID NO: 713775 - RNA, 19 nt, Homo sapiens
cuucaucugugcaggcauu

SEQ ID NO: 713776 - RNA, 19 nt, Homo sapiens
ugaagcaaauccuagaaaa

SEQ ID NO: 713777 - RNA, 19 nt, Homo sapiens
cgugugacauugccgucua

SEQ ID NO: 713778 - RNA, 19 nt, Homo sapiens
gaugauuauugaggacaga

SEQ ID NO: 713779 - RNA, 19 nt, Homo sapiens
gcucauccucuucuuagug

SEQ ID NO: 713780 - RNA, 19 nt, Homo sapiens
gcaggcauuagcugaaaga

SEQ ID NO: 713781 - RNA, 19 nt, Homo sapiens
ugaaaggagagguacagaa

SEQ ID NO: 713782 - RNA, 19 nt, Homo sapiens
caacaagggaagaaaucga

SEQ ID NO: 713783 - RNA, 19 nt, Homo sapiens
cuagaggaccuugaugaaa

SEQ ID NO: 713784 - RNA, 19 nt, Homo sapiens
acagaaggcucagaaacag

SEQ ID NO: 713785 - RNA, 19 nt, Homo sapiens
guacagaaagcagucaaca

SEQ ID NO: 713786 - RNA, 19 nt, Homo sapiens
uauguuucguuucccauug

SEQ ID NO: 713787 - RNA, 19 nt, Homo sapiens
ggaagggccagugggaaga

SEQ ID NO: 713788 - RNA, 19 nt, Homo sapiens
ccaccaacgagcugagaaa

SEQ ID NO: 713789 - RNA, 19 nt, Homo sapiens
acaaguacucggcaaguug

SEQ ID NO: 713790 - RNA, 19 nt, Homo sapiens
gaagaggaaauagaugucu

SEQ ID NO: 713791 - RNA, 19 nt, Homo sapiens
ggaagaggaaauagauguc

SEQ ID NO: 713792 - RNA, 19 nt, Homo sapiens
aaagaucagaugucaacuu

SEQ ID NO: 713793 - RNA, 19 nt, Homo sapiens
uacaaguacucggcaaguu

SEQ ID NO: 713794 - RNA, 19 nt, Homo sapiens
aaacauacugcugcacuga

SEQ ID NO: 713795 - RNA, 19 nt, Homo sapiens
cuggaacaacagauaaaua

SEQ ID NO: 713796 - RNA, 19 nt, Homo sapiens
caaguacucggcaaguugu

SEQ ID NO: 713797 - RNA, 19 nt, Homo sapiens
agaaggcucagaaacaguu

SEQ ID NO: 713798 - RNA, 19 nt, Homo sapiens
gcuguagcauuucuuaucc

SEQ ID NO: 713799 - RNA, 19 nt, Homo sapiens
acagaaagcagucaacacu

SEQ ID NO: 713800 - RNA, 19 nt, Homo sapiens
gaggagggacuuacagacu

SEQ ID NO: 713801 - RNA, 19 nt, Homo sapiens
gagcuucuggguauguuuc

SEQ ID NO: 713802 - RNA, 19 nt, Homo sapiens
cuggagcacuggaacaaca

SEQ ID NO: 713803 - RNA, 19 nt, Homo sapiens
ccauagccauccucuuugc

SEQ ID NO: 713804 - RNA, 19 nt, Homo sapiens
cagcaacaagggaagaaau

SEQ ID NO: 713805 - RNA, 19 nt, Homo sapiens
ucagcauaguugaagcaaa

SEQ ID NO: 713806 - RNA, 19 nt, Homo sapiens
gugggaagaggaaauagau

SEQ ID NO: 713807 - RNA, 19 nt, Homo sapiens
aaggagagguacagaaagc

SEQ ID NO: 713808 - RNA, 19 nt, Homo sapiens
aggcaguuauguuggaaga

SEQ ID NO: 713809 - RNA, 19 nt, Homo sapiens
ggaucuagaggaccuugau

SEQ ID NO: 713810 - RNA, 19 nt, Homo sapiens
ucuagaggaccuugaugaa

SEQ ID NO: 713811 - RNA, 19 nt, Homo sapiens
aagcugagcacgugugaca

SEQ ID NO: 713812 - RNA, 19 nt, Homo sapiens
gugcucauccucuucuuag

SEQ ID NO: 713813 - RNA, 19 nt, Homo sapiens
acagcaggaugagcaguug

SEQ ID NO: 713814 - RNA, 19 nt, Homo sapiens
gaucuagaggaccuugaug

SEQ ID NO: 713815 - RNA, 19 nt, Homo sapiens
gaugcaacugaauugagua

SEQ ID NO: 713816 - RNA, 19 nt, Homo sapiens
gaagcaaauccuagaaaau

SEQ ID NO: 713817 - RNA, 19 nt, Homo sapiens
gaaaggcccuagagagaua

SEQ ID NO: 713818 - RNA, 19 nt, Homo sapiens
agaaacagguguacaguua

SEQ ID NO: 713819 - RNA, 19 nt, Homo sapiens
ggaaugacuuuagacaaua

SEQ ID NO: 713820 - RNA, 19 nt, Homo sapiens
gaaagucuacgaaucauaa

SEQ ID NO: 713821 - RNA, 19 nt, Homo sapiens
caaaggauguacuaaguug

SEQ ID NO: 713822 - RNA, 19 nt, Homo sapiens
gcagaguggcgauauauuu

SEQ ID NO: 713823 - RNA, 19 nt, Homo sapiens
uauaaaguguguccaguuu

SEQ ID NO: 713824 - RNA, 19 nt, Homo sapiens
guacuaaguuguggauuau

SEQ ID NO: 713825 - RNA, 19 nt, Homo sapiens
ucaaguaagucaaagauca

SEQ ID NO: 713826 - RNA, 19 nt, Homo sapiens
caccacagcuggcuaauuc

SEQ ID NO: 713827 - RNA, 19 nt, Homo sapiens
guaauugagugaaagucua

SEQ ID NO: 713828 - RNA, 19 nt, Homo sapiens
uguacuaaguuguggauua

SEQ ID NO: 713829 - RNA, 19 nt, Homo sapiens
acaggaaucuuuaggagaa

SEQ ID NO: 713830 - RNA, 19 nt, Homo sapiens
gugaacacguugauuaaau

SEQ ID NO: 713831 - RNA, 19 nt, Homo sapiens
gaccaagaguuuugauuua

SEQ ID NO: 713832 - RNA, 19 nt, Homo sapiens
gcacuuugaucacggacuu

SEQ ID NO: 713833 - RNA, 19 nt, Homo sapiens
uaaagaaauuucgggauga

SEQ ID NO: 713834 - RNA, 19 nt, Homo sapiens
gaacuucuucagcugauaa

SEQ ID NO: 713835 - RNA, 19 nt, Homo sapiens
gagcauagcacaucacuac

SEQ ID NO: 713836 - RNA, 19 nt, Homo sapiens
gaagaaccagugucagauu

SEQ ID NO: 713837 - RNA, 19 nt, Homo sapiens
ggaagaagaaccaguguca

SEQ ID NO: 713838 - RNA, 19 nt, Homo sapiens
gaagagagcauagcacauc

SEQ ID NO: 713839 - RNA, 19 nt, Homo sapiens
ugagcuagauuauaagaug

SEQ ID NO: 713840 - RNA, 19 nt, Homo sapiens
ccucucagcuuauggaaga

SEQ ID NO: 713841 - RNA, 19 nt, Homo sapiens
gaugcagaguggcgauaua

SEQ ID NO: 713842 - RNA, 19 nt, Homo sapiens
caaaauaaaugcugugugu

SEQ ID NO: 713843 - RNA, 19 nt, Homo sapiens
cagaguggcgauauauuua

SEQ ID NO: 713844 - RNA, 19 nt, Homo sapiens
aaucuucacucucaaguug

SEQ ID NO: 713845 - RNA, 19 nt, Homo sapiens
gcagaacuaugaaguccau

SEQ ID NO: 713846 - RNA, 19 nt, Homo sapiens
caagugacauuugcagaga

SEQ ID NO: 713847 - RNA, 19 nt, Homo sapiens
cgaccaugaugcagaauug

SEQ ID NO: 713848 - RNA, 19 nt, Homo sapiens
guucaggaaugacuuuaga

SEQ ID NO: 713849 - RNA, 19 nt, Homo sapiens
caaagaucaucguuucugu

SEQ ID NO: 713850 - RNA, 19 nt, Homo sapiens
ggcggucccucucagcuua

SEQ ID NO: 713851 - RNA, 19 nt, Homo sapiens
gaaaaggaccauuugaaaa

SEQ ID NO: 713852 - RNA, 19 nt, Homo sapiens
caaccgagagugaauuuau

SEQ ID NO: 713853 - RNA, 19 nt, Homo sapiens
ccagugcccugcauuuaau

SEQ ID NO: 713854 - RNA, 19 nt, Homo sapiens
aaacgaagcugggccuugu

SEQ ID NO: 713855 - RNA, 19 nt, Homo sapiens
gaucagugccuuaugaaag

SEQ ID NO: 713856 - RNA, 19 nt, Homo sapiens
gaucaucguuucuguuuug

SEQ ID NO: 713857 - RNA, 19 nt, Homo sapiens
agucaaagaucaucguuuc

SEQ ID NO: 713858 - RNA, 19 nt, Homo sapiens
ugaaguccaucaaguaagu

SEQ ID NO: 713859 - RNA, 19 nt, Homo sapiens
caccucagccuuccaagua

SEQ ID NO: 713860 - RNA, 19 nt, Homo sapiens
ggccuuguuuggucucaua

SEQ ID NO: 713861 - RNA, 19 nt, Homo sapiens
gaucagaaugguuucagaa

SEQ ID NO: 713862 - RNA, 19 nt, Homo sapiens
ggguguugcuuccaucaaa

SEQ ID NO: 713863 - RNA, 19 nt, Homo sapiens
ggacugugagcaauaaaug

SEQ ID NO: 713864 - RNA, 19 nt, Homo sapiens
aagaaccagugucagauuu

SEQ ID NO: 713865 - RNA, 19 nt, Homo sapiens
aaauaaaugcuguguguga

SEQ ID NO: 713866 - RNA, 19 nt, Homo sapiens
aggaaugacuuuagacaau

SEQ ID NO: 713867 - RNA, 19 nt, Homo sapiens
gagugaaagucuacgaauc

SEQ ID NO: 713868 - RNA, 19 nt, Homo sapiens
ggaaacaugagaguauuug

SEQ ID NO: 713869 - RNA, 19 nt, Homo sapiens
ccaaagugcugggauuaca

SEQ ID NO: 713870 - RNA, 19 nt, Homo sapiens
acauaggccucgaccauga

SEQ ID NO: 713871 - RNA, 19 nt, Homo sapiens
uagauaggauaaagccaaa

SEQ ID NO: 713872 - RNA, 19 nt, Homo sapiens
cgagagugaauuuauguaa

SEQ ID NO: 713873 - RNA, 19 nt, Homo sapiens
cuucaaggacaaaucauua

SEQ ID NO: 713874 - RNA, 19 nt, Homo sapiens
auaagaugcuucugggaaa

SEQ ID NO: 713875 - RNA, 19 nt, Homo sapiens
ggaucagaaugguuucaga

SEQ ID NO: 713876 - RNA, 19 nt, Homo sapiens
gaguggagcccucaugaau

SEQ ID NO: 713877 - RNA, 19 nt, Homo sapiens
gaacuaugaaguccaucaa

SEQ ID NO: 713878 - RNA, 19 nt, Homo sapiens
aaacagguguacaguuauc

SEQ ID NO: 713879 - RNA, 19 nt, Homo sapiens
aaagaaauuucgggaugaa

SEQ ID NO: 713880 - RNA, 19 nt, Homo sapiens
gcauagcacaucacuacaa

SEQ ID NO: 713881 - RNA, 19 nt, Homo sapiens
gaacacguugauuaaauuc

SEQ ID NO: 713882 - RNA, 19 nt, Homo sapiens
gcugggcauuuguuugaaa

SEQ ID NO: 713883 - RNA, 19 nt, Homo sapiens
cuaggacugugagcaauaa

SEQ ID NO: 713884 - RNA, 19 nt, Homo sapiens
ggaacuucuucagcugaua

SEQ ID NO: 713885 - RNA, 19 nt, Homo sapiens
gggcagcuguggaucgaau

SEQ ID NO: 713886 - RNA, 19 nt, Homo sapiens
gaaccacauuuuaggaauu

SEQ ID NO: 713887 - RNA, 19 nt, Homo sapiens
ugggaucagugccuuauga

SEQ ID NO: 713888 - RNA, 19 nt, Homo sapiens
gagaguggagcccucauga

SEQ ID NO: 713889 - RNA, 19 nt, Homo sapiens
gaaacaugagaguauuuga

SEQ ID NO: 713890 - RNA, 19 nt, Homo sapiens
agacagggccucgcucuuu

SEQ ID NO: 713891 - RNA, 19 nt, Homo sapiens
ggagcaaaccgcaucuaug

SEQ ID NO: 713892 - RNA, 19 nt, Homo sapiens
gagaaacagguguacaguu

SEQ ID NO: 713893 - RNA, 19 nt, Homo sapiens
guggagcccucaugaaugg

SEQ ID NO: 713894 - RNA, 19 nt, Homo sapiens
uaugaaguccaucaaguaa

SEQ ID NO: 713895 - RNA, 19 nt, Homo sapiens
gaaacagguguacaguuau

SEQ ID NO: 713896 - RNA, 19 nt, Homo sapiens
ggaaagaaccacauuuuag

SEQ ID NO: 713897 - RNA, 19 nt, Homo sapiens
gcagacccuucacaagcaa

SEQ ID NO: 713898 - RNA, 19 nt, Homo sapiens
caugagaguauuugagauu

SEQ ID NO: 713899 - RNA, 19 nt, Homo sapiens
gaggcgaagucucacuaug

SEQ ID NO: 713900 - RNA, 19 nt, Homo sapiens
gaaaaugugggaucaagaa

SEQ ID NO: 713901 - RNA, 19 nt, Homo sapiens
ggaccaagaguuuugauuu

SEQ ID NO: 713902 - RNA, 19 nt, Homo sapiens
cacccagacugugguauuu

SEQ ID NO: 713903 - RNA, 19 nt, Homo sapiens
gaagugugaggucaugaga

SEQ ID NO: 713904 - RNA, 19 nt, Homo sapiens
gcaguucaggaaugacuuu

SEQ ID NO: 713905 - RNA, 19 nt, Homo sapiens
uaaaugcugugugugaaca

SEQ ID NO: 713906 - RNA, 19 nt, Homo sapiens
gggaaagaaccacauuuua

SEQ ID NO: 713907 - RNA, 19 nt, Homo sapiens
ccccugagcuagauuauaa

SEQ ID NO: 713908 - RNA, 19 nt, Homo sapiens
guuuauggaccaagaguuu

SEQ ID NO: 713909 - RNA, 19 nt, Homo sapiens
gaaugggaucagugccuua

SEQ ID NO: 713910 - RNA, 19 nt, Homo sapiens
cuaugaaguccaucaagua

SEQ ID NO: 713911 - RNA, 19 nt, Homo sapiens
acagcuggcuaauucuauu

SEQ ID NO: 713912 - RNA, 19 nt, Homo sapiens
ccacagcuggcuaauucua

SEQ ID NO: 713913 - RNA, 19 nt, Homo sapiens
uguuuggucucauacuuaa

SEQ ID NO: 713914 - RNA, 19 nt, Homo sapiens
aagaucaucguuucuguuu

SEQ ID NO: 713915 - RNA, 19 nt, Homo sapiens
uaaaguguguccaguuuug

SEQ ID NO: 713916 - RNA, 19 nt, Homo sapiens
aauaaaugcugugugugaa

SEQ ID NO: 713917 - RNA, 19 nt, Homo sapiens
ucaucuggcuguucauuua

SEQ ID NO: 713918 - RNA, 19 nt, Homo sapiens
gaaaggagguagaagucau

SEQ ID NO: 713919 - RNA, 19 nt, Homo sapiens
cagaaucgcuaccuauugu

SEQ ID NO: 713920 - RNA, 19 nt, Homo sapiens
gaaaucagcuguguuugcu

SEQ ID NO: 713921 - RNA, 19 nt, Homo sapiens
gcagcggugucccaaguuu

SEQ ID NO: 713922 - RNA, 19 nt, Homo sapiens
gaucaugccugcgugacaa

SEQ ID NO: 713923 - RNA, 19 nt, Homo sapiens
ccaaagcagucguaagaag

SEQ ID NO: 713924 - RNA, 19 nt, Homo sapiens
gagaucagcgcaauuguca

SEQ ID NO: 713925 - RNA, 19 nt, Homo sapiens
caucuaaggucuggaguuc

SEQ ID NO: 713926 - RNA, 19 nt, Homo sapiens
cagcagcgaaggauaaauu

SEQ ID NO: 713927 - RNA, 19 nt, Homo sapiens
gaggagaucagcgcaauug

SEQ ID NO: 713928 - RNA, 19 nt, Homo sapiens
gcaggugguucaucuaagg

SEQ ID NO: 713929 - RNA, 19 nt, Homo sapiens
cagcuaaaccuccugcaaa

SEQ ID NO: 713930 - RNA, 19 nt, Homo sapiens
caaagcagucguaagaaga

SEQ ID NO: 713931 - RNA, 19 nt, Homo sapiens
guccaaagcagucguaaga

SEQ ID NO: 713932 - RNA, 19 nt, Homo sapiens
ugacaaagccuccagaaaa

SEQ ID NO: 713933 - RNA, 19 nt, Homo sapiens
ggagguagaagucauccuu

SEQ ID NO: 713934 - RNA, 19 nt, Homo sapiens
ccucuagccucuacucuuc

SEQ ID NO: 713935 - RNA, 19 nt, Homo sapiens
cagcgcaauugucagcuaa

SEQ ID NO: 713936 - RNA, 19 nt, Homo sapiens
guaagaagaggucccaauc

SEQ ID NO: 713937 - RNA, 19 nt, Homo sapiens
cagcagcggugucccaagu

SEQ ID NO: 713938 - RNA, 19 nt, Homo sapiens
ggaauuuucugcaugauag

SEQ ID NO: 713939 - RNA, 19 nt, Homo sapiens
ggaaaucagcuguguuugc

SEQ ID NO: 713940 - RNA, 19 nt, Homo sapiens
gcuuauugcaucacaguaa

SEQ ID NO: 713941 - RNA, 19 nt, Homo sapiens
ggucuccaguuucgguaaa

SEQ ID NO: 713942 - RNA, 19 nt, Homo sapiens
guagucacguggaauuugg

SEQ ID NO: 713943 - RNA, 19 nt, Homo sapiens
ggucagaaucgcuaccuau

SEQ ID NO: 713944 - RNA, 19 nt, Homo sapiens
gaagagcccaagaggagau

SEQ ID NO: 713945 - RNA, 19 nt, Homo sapiens
cgaggcaggugguucaucu

SEQ ID NO: 713946 - RNA, 19 nt, Homo sapiens
uaacuaugguuggaagcuu

SEQ ID NO: 713947 - RNA, 19 nt, Homo sapiens
cgaaggggcugccauggaa

SEQ ID NO: 713948 - RNA, 19 nt, Homo sapiens
uuggugggcuccuuauuug

SEQ ID NO: 713949 - RNA, 19 nt, Homo sapiens
ccaucuguguuccuacaaa

SEQ ID NO: 713950 - RNA, 19 nt, Homo sapiens
gaauuuggaauguggaaag

SEQ ID NO: 713951 - RNA, 19 nt, Homo sapiens
ucuaaggucuggaguucga

SEQ ID NO: 713952 - RNA, 19 nt, Homo sapiens
aacuaugguuggaagcuua

SEQ ID NO: 713953 - RNA, 19 nt, Homo sapiens
ggaaaggagguagaaguca

SEQ ID NO: 713954 - RNA, 19 nt, Homo sapiens
ccaggaagcacacaucaag

SEQ ID NO: 713955 - RNA, 19 nt, Homo sapiens
cuggaaaucagcuguguuu

SEQ ID NO: 713956 - RNA, 19 nt, Homo sapiens
gagguagaagucauccuuu

SEQ ID NO: 713957 - RNA, 19 nt, Homo sapiens
ucagcgcaauugucagcua

SEQ ID NO: 713958 - RNA, 19 nt, Homo sapiens
ggagaucagcgcaauuguc

SEQ ID NO: 713959 - RNA, 19 nt, Homo sapiens
gaccucacccuguguaucu

SEQ ID NO: 713960 - RNA, 19 nt, Homo sapiens
ucagaaucgcuaccuauug

SEQ ID NO: 713961 - RNA, 19 nt, Homo sapiens
ggagcguccuuuguucuca

SEQ ID NO: 713962 - RNA, 19 nt, Homo sapiens
guucuaacguuugguccuu

SEQ ID NO: 713963 - RNA, 19 nt, Homo sapiens
ggauaaauuuucagacaca

SEQ ID NO: 713964 - RNA, 19 nt, Homo sapiens
ucacguggaauuuggaaug

SEQ ID NO: 713965 - RNA, 19 nt, Homo sapiens
ggauaauggccucaagauc

SEQ ID NO: 713966 - RNA, 19 nt, Homo sapiens
gcaauugucagcuaaaccu

SEQ ID NO: 713967 - RNA, 19 nt, Homo sapiens
gugacaaagccuccagaaa

SEQ ID NO: 713968 - RNA, 19 nt, Homo sapiens
gguagucacguggaauuug

SEQ ID NO: 713969 - RNA, 19 nt, Homo sapiens
aagaggagaucagcgcaau

SEQ ID NO: 713970 - RNA, 19 nt, Homo sapiens
gucagaaucgcuaccuauu

SEQ ID NO: 713971 - RNA, 19 nt, Homo sapiens
cuuggugggcuccuuauuu

SEQ ID NO: 713972 - RNA, 19 nt, Homo sapiens
gagcguccuuuguucucau

SEQ ID NO: 713973 - RNA, 19 nt, Homo sapiens
cugccaggaugcccaagaa

SEQ ID NO: 713974 - RNA, 19 nt, Homo sapiens
ccagaccucacccugugua

SEQ ID NO: 713975 - RNA, 19 nt, Homo sapiens
ggaauguggaaaggaggua

SEQ ID NO: 713976 - RNA, 19 nt, Homo sapiens
aggcagcagcgaaggauaa

SEQ ID NO: 713977 - RNA, 19 nt, Homo sapiens
uccuaaaucccuuggaauu

SEQ ID NO: 713978 - RNA, 19 nt, Homo sapiens
caccuugguuccugacaca

SEQ ID NO: 713979 - RNA, 19 nt, Homo sapiens
cuuauugcaucacaguaau

SEQ ID NO: 713980 - RNA, 19 nt, Homo sapiens
gcgcaauugucagcuaaac

SEQ ID NO: 713981 - RNA, 19 nt, Homo sapiens
auaauggccucaagaucca

SEQ ID NO: 713982 - RNA, 19 nt, Homo sapiens
ggaugaggaagaugaagag

SEQ ID NO: 713983 - RNA, 19 nt, Homo sapiens
cgguaaaaguuucauuuga

SEQ ID NO: 713984 - RNA, 19 nt, Homo sapiens
guggaaaggagguagaagu

SEQ ID NO: 713985 - RNA, 19 nt, Homo sapiens
ggaauuuggaauguggaaa

SEQ ID NO: 713986 - RNA, 19 nt, Homo sapiens
gcuguacgaaggucagaau

SEQ ID NO: 713987 - RNA, 19 nt, Homo sapiens
gcacaucuuuuguucuaac

SEQ ID NO: 713988 - RNA, 19 nt, Homo sapiens
uugcacaucuuuuguucua

SEQ ID NO: 713989 - RNA, 19 nt, Homo sapiens
agguagaagucauccuuuc

SEQ ID NO: 713990 - RNA, 19 nt, Homo sapiens
ggcaggugguucaucuaag

SEQ ID NO: 713991 - RNA, 19 nt, Homo sapiens
aggcaggugguucaucuaa

SEQ ID NO: 713992 - RNA, 19 nt, Homo sapiens
cacguggaauuuggaaugu

SEQ ID NO: 713993 - RNA, 19 nt, Homo sapiens
gcaaaucucuuuagcacua

SEQ ID NO: 713994 - RNA, 19 nt, Homo sapiens
gaucauaucauacccauua

SEQ ID NO: 713995 - RNA, 19 nt, Homo sapiens
gcaaacagauugagggauu

SEQ ID NO: 713996 - RNA, 19 nt, Homo sapiens
gaggauaucuuauaacuca

SEQ ID NO: 713997 - RNA, 19 nt, Homo sapiens
gaugauagcuacauguaug

SEQ ID NO: 713998 - RNA, 19 nt, Homo sapiens
gagcuuagacuucaaauau

SEQ ID NO: 713999 - RNA, 19 nt, Homo sapiens
gaaaugguguccucuagug

SEQ ID NO: 714000 - RNA, 19 nt, Homo sapiens
ugagauuccuuccuuguua

SEQ ID NO: 714001 - RNA, 19 nt, Homo sapiens
ggauagagcuucaugaaac

SEQ ID NO: 714002 - RNA, 19 nt, Homo sapiens
ccauagcucuguugaaauu

SEQ ID NO: 714003 - RNA, 19 nt, Homo sapiens
gagguugccuaacucuuua

SEQ ID NO: 714004 - RNA, 19 nt, Homo sapiens
ucaaagagcuuagacuuca

SEQ ID NO: 714005 - RNA, 19 nt, Homo sapiens
caaagugcauuacagaaga

SEQ ID NO: 714006 - RNA, 19 nt, Homo sapiens
cagcacagccuauaucuuu

SEQ ID NO: 714007 - RNA, 19 nt, Homo sapiens
caccauagcucuguugaaa

SEQ ID NO: 714008 - RNA, 19 nt, Homo sapiens
gauaagaaauggaaagacu

SEQ ID NO: 714009 - RNA, 19 nt, Homo sapiens
gcaccuguguuguuuguga

SEQ ID NO: 714010 - RNA, 19 nt, Homo sapiens
cagaaucgccucagcauuu

SEQ ID NO: 714011 - RNA, 19 nt, Homo sapiens
caucuacuccuguacauua

SEQ ID NO: 714012 - RNA, 19 nt, Homo sapiens
auaaacgacuacagacuua

SEQ ID NO: 714013 - RNA, 19 nt, Homo sapiens
gaagaggacccaaagacuu

SEQ ID NO: 714014 - RNA, 19 nt, Homo sapiens
ucaaguaauuccuucacua

SEQ ID NO: 714015 - RNA, 19 nt, Homo sapiens
gagaaaugguguccucuag

SEQ ID NO: 714016 - RNA, 19 nt, Homo sapiens
acaaauagcaccuguguug

SEQ ID NO: 714017 - RNA, 19 nt, Homo sapiens
uaauagccgucuccucuuu

SEQ ID NO: 714018 - RNA, 19 nt, Homo sapiens
agagacagauggagacaaa

SEQ ID NO: 714019 - RNA, 19 nt, Homo sapiens
ggaaagacuccuugaagug

SEQ ID NO: 714020 - RNA, 19 nt, Homo sapiens
ugucucagaucaaguaauu

SEQ ID NO: 714021 - RNA, 19 nt, Homo sapiens
gaaggaugauagcuacaug

SEQ ID NO: 714022 - RNA, 19 nt, Homo sapiens
gaagauuuccaccaacuga

SEQ ID NO: 714023 - RNA, 19 nt, Homo sapiens
uaacacagcaaacagauug

SEQ ID NO: 714024 - RNA, 19 nt, Homo sapiens
ugaaauuccuggaggcaaa

SEQ ID NO: 714025 - RNA, 19 nt, Homo sapiens
aaagacacaucugacauuu

SEQ ID NO: 714026 - RNA, 19 nt, Homo sapiens
gaugauaaacgacuacaga

SEQ ID NO: 714027 - RNA, 19 nt, Homo sapiens
gaagauacaccuauagaac

SEQ ID NO: 714028 - RNA, 19 nt, Homo sapiens
caacaucuuugcuaucaag

SEQ ID NO: 714029 - RNA, 19 nt, Homo sapiens
acaauuagcugcuucaaaa

SEQ ID NO: 714030 - RNA, 19 nt, Homo sapiens
cauggugucugaaugauug

SEQ ID NO: 714031 - RNA, 19 nt, Homo sapiens
ccacuuaaauaggaccaua

SEQ ID NO: 714032 - RNA, 19 nt, Homo sapiens
agacaucgguaacaaauag

SEQ ID NO: 714033 - RNA, 19 nt, Homo sapiens
gaugagagaaaguauuuga

SEQ ID NO: 714034 - RNA, 19 nt, Homo sapiens
gauaaacgacuacagacuu

SEQ ID NO: 714035 - RNA, 19 nt, Homo sapiens
ucuuauaacucacagauug

SEQ ID NO: 714036 - RNA, 19 nt, Homo sapiens
cguauaaacuucagcaauc

SEQ ID NO: 714037 - RNA, 19 nt, Homo sapiens
gaaagacuccuugaagugu

SEQ ID NO: 714038 - RNA, 19 nt, Homo sapiens
guaauuccuucacuagguu

SEQ ID NO: 714039 - RNA, 19 nt, Homo sapiens
ucugaggaguguacaauaa

SEQ ID NO: 714040 - RNA, 19 nt, Homo sapiens
uacagaagauacaccuaua

SEQ ID NO: 714041 - RNA, 19 nt, Homo sapiens
ggagaacgauaagaaaugg

SEQ ID NO: 714042 - RNA, 19 nt, Homo sapiens
gccaacaucuuugcuauca

SEQ ID NO: 714043 - RNA, 19 nt, Homo sapiens
ggugauaugucuccugauc

SEQ ID NO: 714044 - RNA, 19 nt, Homo sapiens
cuaaagaaaucuagaugag

SEQ ID NO: 714045 - RNA, 19 nt, Homo sapiens
ggauaaugcugaauuuuga

SEQ ID NO: 714046 - RNA, 19 nt, Homo sapiens
gagauuccuuccuuguuau

SEQ ID NO: 714047 - RNA, 19 nt, Homo sapiens
gcaagugucaguuguagau

SEQ ID NO: 714048 - RNA, 19 nt, Homo sapiens
ggacuuaugaugacugugu

SEQ ID NO: 714049 - RNA, 19 nt, Homo sapiens
uguauggccucuggaguua

SEQ ID NO: 714050 - RNA, 19 nt, Homo sapiens
caacaagucuggguauacu

SEQ ID NO: 714051 - RNA, 19 nt, Homo sapiens
guucucuccuggccacuua

SEQ ID NO: 714052 - RNA, 19 nt, Homo sapiens
ccagagacaucgguaacaa

SEQ ID NO: 714053 - RNA, 19 nt, Homo sapiens
uaucaagccucucggacaa

SEQ ID NO: 714054 - RNA, 19 nt, Homo sapiens
gcacguguauagcucaaag

SEQ ID NO: 714055 - RNA, 19 nt, Homo sapiens
ugacgcacauuaugcaaau

SEQ ID NO: 714056 - RNA, 19 nt, Homo sapiens
ggagaaaugguguccucua

SEQ ID NO: 714057 - RNA, 19 nt, Homo sapiens
uaagguguauguuaguuuc

SEQ ID NO: 714058 - RNA, 19 nt, Homo sapiens
uaacaaauagcaccugugu

SEQ ID NO: 714059 - RNA, 19 nt, Homo sapiens
uuucagacguguccguaua

SEQ ID NO: 714060 - RNA, 19 nt, Homo sapiens
ggaagaagaggacccaaag

SEQ ID NO: 714061 - RNA, 19 nt, Homo sapiens
ccacgccaguccucaacua

SEQ ID NO: 714062 - RNA, 19 nt, Homo sapiens
aauagcaccuguguuguuu

SEQ ID NO: 714063 - RNA, 19 nt, Homo sapiens
gaagaagaggacccaaaga

SEQ ID NO: 714064 - RNA, 19 nt, Homo sapiens
aagugucaguuguagauua

SEQ ID NO: 714065 - RNA, 19 nt, Homo sapiens
caacuaugaccuccucuau

SEQ ID NO: 714066 - RNA, 19 nt, Homo sapiens
ggaguuagucuuaguaaaa

SEQ ID NO: 714067 - RNA, 19 nt, Homo sapiens
aaucaucugugggucauuu

SEQ ID NO: 714068 - RNA, 19 nt, Homo sapiens
ugagguugccuaacucuuu

SEQ ID NO: 714069 - RNA, 19 nt, Homo sapiens
gguguuugguuguuugaga

SEQ ID NO: 714070 - RNA, 19 nt, Homo sapiens
cgccaguccucaacuauga

SEQ ID NO: 714071 - RNA, 19 nt, Homo sapiens
gaaaucuagaugagagaaa

SEQ ID NO: 714072 - RNA, 19 nt, Homo sapiens
gaaccauuaccuucugcua

SEQ ID NO: 714073 - RNA, 19 nt, Homo sapiens
aaaguuucauggugucuga

SEQ ID NO: 714074 - RNA, 19 nt, Homo sapiens
gaccaggagagaaguauga

SEQ ID NO: 714075 - RNA, 19 nt, Homo sapiens
caaagagcuuagacuucaa

SEQ ID NO: 714076 - RNA, 19 nt, Homo sapiens
ggacacaguacuggugaaa

SEQ ID NO: 714077 - RNA, 19 nt, Homo sapiens
caauaacacagcaaacaga

SEQ ID NO: 714078 - RNA, 19 nt, Homo sapiens
ggauuacuuuagaugcaaa

SEQ ID NO: 714079 - RNA, 19 nt, Homo sapiens
gcucuacuuugcacagguu

SEQ ID NO: 714080 - RNA, 19 nt, Homo sapiens
uggaaagacuccuugaagu

SEQ ID NO: 714081 - RNA, 19 nt, Homo sapiens
guuaaccugucucagauca

SEQ ID NO: 714082 - RNA, 19 nt, Homo sapiens
caaaacaucuaaugccaau

SEQ ID NO: 714083 - RNA, 19 nt, Homo sapiens
gauccaagccagagacauc

SEQ ID NO: 714084 - RNA, 19 nt, Homo sapiens
ugacauagaggaagaagag

SEQ ID NO: 714085 - RNA, 19 nt, Homo sapiens
uccaccaacugaaucauuu

SEQ ID NO: 714086 - RNA, 19 nt, Homo sapiens
caaguaauuccuucacuag

SEQ ID NO: 714087 - RNA, 19 nt, Homo sapiens
aaagaaacacaaugaagug

SEQ ID NO: 714088 - RNA, 19 nt, Homo sapiens
ggaguguacaauaagcaua

SEQ ID NO: 714089 - RNA, 19 nt, Homo sapiens
caaacagauugagggauug

SEQ ID NO: 714090 - RNA, 19 nt, Homo sapiens
cagaagauacaccuauaga

SEQ ID NO: 714091 - RNA, 19 nt, Homo sapiens
gacaauuagcugcuucaaa

SEQ ID NO: 714092 - RNA, 19 nt, Homo sapiens
gccauguccuaucuagauu

SEQ ID NO: 714093 - RNA, 19 nt, Homo sapiens
caacaaagggcacgaaaug

SEQ ID NO: 714094 - RNA, 19 nt, Homo sapiens
gaacggguccgaauacuuc

SEQ ID NO: 714095 - RNA, 19 nt, Homo sapiens
gaugagcccugaggacauu

SEQ ID NO: 714096 - RNA, 19 nt, Homo sapiens
gaugagcucuacccacaag

SEQ ID NO: 714097 - RNA, 19 nt, Homo sapiens
gcauggacuuggccacguu

SEQ ID NO: 714098 - RNA, 19 nt, Homo sapiens
cauuggaccugcugcuauu

SEQ ID NO: 714099 - RNA, 19 nt, Homo sapiens
ccuaggaccuggaccuguu

SEQ ID NO: 714100 - RNA, 19 nt, Homo sapiens
uggagacccugaaggcuuu

SEQ ID NO: 714101 - RNA, 19 nt, Homo sapiens
ccugaaggcuuugcuugaa

SEQ ID NO: 714102 - RNA, 19 nt, Homo sapiens
gacccuggcuggagagaca

SEQ ID NO: 714103 - RNA, 19 nt, Homo sapiens
ggacuuggccacguucaug

SEQ ID NO: 714104 - RNA, 19 nt, Homo sapiens
gcaccugggcuaccucuuc

SEQ ID NO: 714105 - RNA, 19 nt, Homo sapiens
gcagcuggacguccucuau

SEQ ID NO: 714106 - RNA, 19 nt, Homo sapiens
gacgagagccucaucuucu

SEQ ID NO: 714107 - RNA, 19 nt, Homo sapiens
gagaacucgcgcucaguaa

SEQ ID NO: 714108 - RNA, 19 nt, Homo sapiens
acgagagccucaucuucua

SEQ ID NO: 714109 - RNA, 19 nt, Homo sapiens
gcuggaagccugcguggau

SEQ ID NO: 714110 - RNA, 19 nt, Homo sapiens
ggccaacccaccuaacauu

SEQ ID NO: 714111 - RNA, 19 nt, Homo sapiens
gaacucgcgcucaguaaac

SEQ ID NO: 714112 - RNA, 19 nt, Homo sapiens
uaaagcauaaacuggauga

SEQ ID NO: 714113 - RNA, 19 nt, Homo sapiens
agagaacucgcgcucagua

SEQ ID NO: 714114 - RNA, 19 nt, Homo sapiens
caaagggcacgaaaugagu

SEQ ID NO: 714115 - RNA, 19 nt, Homo sapiens
uaaacuggaugagcucuac

SEQ ID NO: 714116 - RNA, 19 nt, Homo sapiens
gccaacccaccuaacauuu

SEQ ID NO: 714117 - RNA, 19 nt, Homo sapiens
uggcugaggugcagaaacu

SEQ ID NO: 714118 - RNA, 19 nt, Homo sapiens
gacaaagacacccuagaca

SEQ ID NO: 714119 - RNA, 19 nt, Homo sapiens
ugaaggcuuugcuugaagu

SEQ ID NO: 714120 - RNA, 19 nt, Homo sapiens
gcagcuggacguccuaaag

SEQ ID NO: 714121 - RNA, 19 nt, Homo sapiens
ccuaaagcauaaacuggau

SEQ ID NO: 714122 - RNA, 19 nt, Homo sapiens
ccacucccgucugcuguga

SEQ ID NO: 714123 - RNA, 19 nt, Homo sapiens
ggaccuggaccuguucuca

SEQ ID NO: 714124 - RNA, 19 nt, Homo sapiens
caacggcuaccugguccua

SEQ ID NO: 714125 - RNA, 19 nt, Homo sapiens
gaucgaccgcuuugugaag

SEQ ID NO: 714126 - RNA, 19 nt, Homo sapiens
caacccaccuaacauuucc

SEQ ID NO: 714127 - RNA, 19 nt, Homo sapiens
gaaugucaagcucucaaca

SEQ ID NO: 714128 - RNA, 19 nt, Homo sapiens
gagcucuacccacaagguu

SEQ ID NO: 714129 - RNA, 19 nt, Homo sapiens
ccaacccaccuaacauuuc

SEQ ID NO: 714130 - RNA, 19 nt, Homo sapiens
uggacguccuaaagcauaa

SEQ ID NO: 714131 - RNA, 19 nt, Homo sapiens
agaacucgcgcucaguaaa

SEQ ID NO: 714132 - RNA, 19 nt, Homo sapiens
gaagaaugucaagcucuca

SEQ ID NO: 714133 - RNA, 19 nt, Homo sapiens
acaaagggcacgaaaugag

SEQ ID NO: 714134 - RNA, 19 nt, Homo sapiens
ggccugcacccguuucuuc

SEQ ID NO: 714135 - RNA, 19 nt, Homo sapiens
gaaugugagcauggacuug

SEQ ID NO: 714136 - RNA, 19 nt, Homo sapiens
ucgugaagauccaguccuu

SEQ ID NO: 714137 - RNA, 19 nt, Homo sapiens
acaugaacggguccgaaua

SEQ ID NO: 714138 - RNA, 19 nt, Homo sapiens
cauggucugucuccacgau

SEQ ID NO: 714139 - RNA, 19 nt, Homo sapiens
ccauuggaccugcugcuau

SEQ ID NO: 714140 - RNA, 19 nt, Homo sapiens
agacaaagacacccuagac

SEQ ID NO: 714141 - RNA, 19 nt, Homo sapiens
gcaucacgaaggccaaugu

SEQ ID NO: 714142 - RNA, 19 nt, Homo sapiens
gauagacgagagccucauc

SEQ ID NO: 714143 - RNA, 19 nt, Homo sapiens
gcugaggugcagaaacuuc

SEQ ID NO: 714144 - RNA, 19 nt, Homo sapiens
gacuuggccacguucauga

SEQ ID NO: 714145 - RNA, 19 nt, Homo sapiens
caugaacggguccgaauac

SEQ ID NO: 714146 - RNA, 19 nt, Homo sapiens
ucaacaaagggcacgaaau

SEQ ID NO: 714147 - RNA, 19 nt, Homo sapiens
caagaagugggagcuggaa

SEQ ID NO: 714148 - RNA, 19 nt, Homo sapiens
agacgagagccucaucuuc

SEQ ID NO: 714149 - RNA, 19 nt, Homo sapiens
cugaggacauucgcaagug

SEQ ID NO: 714150 - RNA, 19 nt, Homo sapiens
augucaagcucucaacaga

SEQ ID NO: 714151 - RNA, 19 nt, Homo sapiens
cuggacguccuaaagcaua

SEQ ID NO: 714152 - RNA, 19 nt, Homo sapiens
gagcagcuggacguccuaa

SEQ ID NO: 714153 - RNA, 19 nt, Homo sapiens
ccagauggaccgcgugaac

SEQ ID NO: 714154 - RNA, 19 nt, Homo sapiens
gaacggguccgaauacuuc

SEQ ID NO: 714155 - RNA, 19 nt, Homo sapiens
gaugagcccugaggacauu

SEQ ID NO: 714156 - RNA, 19 nt, Homo sapiens
cgacaaagggcacgaaaug

SEQ ID NO: 714157 - RNA, 19 nt, Homo sapiens
gaugagcucuacccacaag

SEQ ID NO: 714158 - RNA, 19 nt, Homo sapiens
gcauggacuuggccacguu

SEQ ID NO: 714159 - RNA, 19 nt, Homo sapiens
cauuggaccugcugcuauu

SEQ ID NO: 714160 - RNA, 19 nt, Homo sapiens
ccuaggaccuggaccuguu

SEQ ID NO: 714161 - RNA, 19 nt, Homo sapiens
uggagacccugaaggcuuu

SEQ ID NO: 714162 - RNA, 19 nt, Homo sapiens
ccugaaggcuuugcuugaa

SEQ ID NO: 714163 - RNA, 19 nt, Homo sapiens
gacccuggcuggagagaca

SEQ ID NO: 714164 - RNA, 19 nt, Homo sapiens
ggacuuggccacguucaug

SEQ ID NO: 714165 - RNA, 19 nt, Homo sapiens
gcaccugggcuaccucuuc

SEQ ID NO: 714166 - RNA, 19 nt, Homo sapiens
gcagcuggacguccucuau

SEQ ID NO: 714167 - RNA, 19 nt, Homo sapiens
gacgagagccucaucuucu

SEQ ID NO: 714168 - RNA, 19 nt, Homo sapiens
gagaacucgcgcucaguaa

SEQ ID NO: 714169 - RNA, 19 nt, Homo sapiens
gacaaagggcacgaaauga

SEQ ID NO: 714170 - RNA, 19 nt, Homo sapiens
acgagagccucaucuucua

SEQ ID NO: 714171 - RNA, 19 nt, Homo sapiens
gcuggaagccugcguggau

SEQ ID NO: 714172 - RNA, 19 nt, Homo sapiens
gaacucgcgcucaguaaac

SEQ ID NO: 714173 - RNA, 19 nt, Homo sapiens
uaaagcauaaacuggauga

SEQ ID NO: 714174 - RNA, 19 nt, Homo sapiens
agagaacucgcgcucagua

SEQ ID NO: 714175 - RNA, 19 nt, Homo sapiens
caaagggcacgaaaugagu

SEQ ID NO: 714176 - RNA, 19 nt, Homo sapiens
uaaacuggaugagcucuac

SEQ ID NO: 714177 - RNA, 19 nt, Homo sapiens
uggcugaggugcagaaacu

SEQ ID NO: 714178 - RNA, 19 nt, Homo sapiens
gacaaagacacccuagaca

SEQ ID NO: 714179 - RNA, 19 nt, Homo sapiens
ugaaggcuuugcuugaagu

SEQ ID NO: 714180 - RNA, 19 nt, Homo sapiens
gcagcuggacguccuaaag

SEQ ID NO: 714181 - RNA, 19 nt, Homo sapiens
ccuaaagcauaaacuggau

SEQ ID NO: 714182 - RNA, 19 nt, Homo sapiens
ccacucccgucugcuguga

SEQ ID NO: 714183 - RNA, 19 nt, Homo sapiens
ggaccuggaccuguucuca

SEQ ID NO: 714184 - RNA, 19 nt, Homo sapiens
caacggcuaccugguccua

SEQ ID NO: 714185 - RNA, 19 nt, Homo sapiens
gaaugucaagcucucaaca

SEQ ID NO: 714186 - RNA, 19 nt, Homo sapiens
gaucgaccgcuuugugaag

SEQ ID NO: 714187 - RNA, 19 nt, Homo sapiens
gagcucuacccacaagguu

SEQ ID NO: 714188 - RNA, 19 nt, Homo sapiens
uggacguccuaaagcauaa

SEQ ID NO: 714189 - RNA, 19 nt, Homo sapiens
agaacucgcgcucaguaaa

SEQ ID NO: 714190 - RNA, 19 nt, Homo sapiens
acaaagggcacgaaaugag

SEQ ID NO: 714191 - RNA, 19 nt, Homo sapiens
gaagaaugucaagcucuca

SEQ ID NO: 714192 - RNA, 19 nt, Homo sapiens
ggccugcacccguuucuuc

SEQ ID NO: 714193 - RNA, 19 nt, Homo sapiens
gaaugugagcauggacuug

SEQ ID NO: 714194 - RNA, 19 nt, Homo sapiens
ucgugaagauccaguccuu

SEQ ID NO: 714195 - RNA, 19 nt, Homo sapiens
acaugaacggguccgaaua

SEQ ID NO: 714196 - RNA, 19 nt, Homo sapiens
cauggucugucuccacgau

SEQ ID NO: 714197 - RNA, 19 nt, Homo sapiens
agacaaagacacccuagac

SEQ ID NO: 714198 - RNA, 19 nt, Homo sapiens
ccauuggaccugcugcuau

SEQ ID NO: 714199 - RNA, 19 nt, Homo sapiens
gcaucacgaaggccaaugu

SEQ ID NO: 714200 - RNA, 19 nt, Homo sapiens
gauagacgagagccucauc

SEQ ID NO: 714201 - RNA, 19 nt, Homo sapiens
gcugaggugcagaaacuuc

SEQ ID NO: 714202 - RNA, 19 nt, Homo sapiens
gacuuggccacguucauga

SEQ ID NO: 714203 - RNA, 19 nt, Homo sapiens
caugaacggguccgaauac

SEQ ID NO: 714204 - RNA, 19 nt, Homo sapiens
caagaagugggagcuggaa

SEQ ID NO: 714205 - RNA, 19 nt, Homo sapiens
agacgagagccucaucuuc

SEQ ID NO: 714206 - RNA, 19 nt, Homo sapiens
augucaagcucucaacaga

SEQ ID NO: 714207 - RNA, 19 nt, Homo sapiens
cugaggacauucgcaagug

SEQ ID NO: 714208 - RNA, 19 nt, Homo sapiens
cuggacguccuaaagcaua

SEQ ID NO: 714209 - RNA, 19 nt, Homo sapiens
gagcagcuggacguccuaa

SEQ ID NO: 714210 - RNA, 19 nt, Homo sapiens
ccagauggaccgcgugaac

SEQ ID NO: 714211 - RNA, 19 nt, Homo sapiens
gaagaaagaugucagauga

SEQ ID NO: 714212 - RNA, 19 nt, Homo sapiens
ggacugagcuuaucugacu

SEQ ID NO: 714213 - RNA, 19 nt, Homo sapiens
gaagugcccagaugaauga

SEQ ID NO: 714214 - RNA, 19 nt, Homo sapiens
gcucaaggcugauggcaau

SEQ ID NO: 714215 - RNA, 19 nt, Homo sapiens
gaaagaagaggacgagaag

SEQ ID NO: 714216 - RNA, 19 nt, Homo sapiens
gaaucaaucuuccuaagcu

SEQ ID NO: 714217 - RNA, 19 nt, Homo sapiens
gaaagcacccugggaauca

SEQ ID NO: 714218 - RNA, 19 nt, Homo sapiens
gaugucagaugaagaugau

SEQ ID NO: 714219 - RNA, 19 nt, Homo sapiens
ggaagaaagaugucagaug

SEQ ID NO: 714220 - RNA, 19 nt, Homo sapiens
caaagacgcuggccuucag

SEQ ID NO: 714221 - RNA, 19 nt, Homo sapiens
caucugcgcuauguggaua

SEQ ID NO: 714222 - RNA, 19 nt, Homo sapiens
caauaaagaaacagaguga

SEQ ID NO: 714223 - RNA, 19 nt, Homo sapiens
ccagauuacugacacugaa

SEQ ID NO: 714224 - RNA, 19 nt, Homo sapiens
ggcuuucucugcucuguaa

SEQ ID NO: 714225 - RNA, 19 nt, Homo sapiens
guguucggauuuccaauaa

SEQ ID NO: 714226 - RNA, 19 nt, Homo sapiens
gcagccaccacauguauga

SEQ ID NO: 714227 - RNA, 19 nt, Homo sapiens
gaggaggacugagcuuauc

SEQ ID NO: 714228 - RNA, 19 nt, Homo sapiens
ggaggaggacugagcuuau

SEQ ID NO: 714229 - RNA, 19 nt, Homo sapiens
gguguucggauuuccaaua

SEQ ID NO: 714230 - RNA, 19 nt, Homo sapiens
cggaggacaugaugaagga

SEQ ID NO: 714231 - RNA, 19 nt, Homo sapiens
guucggauuuccaauaaag

SEQ ID NO: 714232 - RNA, 19 nt, Homo sapiens
gaaagaugucagaugaaga

SEQ ID NO: 714233 - RNA, 19 nt, Homo sapiens
ggaaagcacccugggaauc

SEQ ID NO: 714234 - RNA, 19 nt, Homo sapiens
ugaaugaacugcccuaccu

SEQ ID NO: 714235 - RNA, 19 nt, Homo sapiens
ugacagacaucuacuugcu

SEQ ID NO: 714236 - RNA, 19 nt, Homo sapiens
agaaagaugucagaugaag

SEQ ID NO: 714237 - RNA, 19 nt, Homo sapiens
ccaggcaacuacugaucaa

SEQ ID NO: 714238 - RNA, 19 nt, Homo sapiens
ggaacagcauccacauggu

SEQ ID NO: 714239 - RNA, 19 nt, Homo sapiens
ucacggaggacaugaugaa

SEQ ID NO: 714240 - RNA, 19 nt, Homo sapiens
gggcagccaccacauguau

SEQ ID NO: 714241 - RNA, 19 nt, Homo sapiens
gagagggaccugacagaca

SEQ ID NO: 714242 - RNA, 19 nt, Homo sapiens
aaagaugucagaugaagau

SEQ ID NO: 714243 - RNA, 19 nt, Homo sapiens
guaaccaggcaacuacuga

SEQ ID NO: 714244 - RNA, 19 nt, Homo sapiens
cuuauaaccagauuacuga

SEQ ID NO: 714245 - RNA, 19 nt, Homo sapiens
agaaagaagaggacgagaa

SEQ ID NO: 714246 - RNA, 19 nt, Homo sapiens
gcugcgaagugcccagaug

SEQ ID NO: 714247 - RNA, 19 nt, Homo sapiens
gcuauguggauauuucuga

SEQ ID NO: 714248 - RNA, 19 nt, Homo sapiens
cuacauccaucugcgcuau

SEQ ID NO: 714249 - RNA, 19 nt, Homo sapiens
agagggaccugacagacau

SEQ ID NO: 714250 - RNA, 19 nt, Homo sapiens
cgaagugcccagaugaaug

SEQ ID NO: 714251 - RNA, 19 nt, Homo sapiens
ccccaaagcuggaaauuca

SEQ ID NO: 714252 - RNA, 19 nt, Homo sapiens
gcuuauaaccagauuacug

SEQ ID NO: 714253 - RNA, 19 nt, Homo sapiens
aagaagaggacgagaagga

SEQ ID NO: 714254 - RNA, 19 nt, Homo sapiens
gcuggaaauucaucacaac

SEQ ID NO: 714255 - RNA, 19 nt, Homo sapiens
uggaggaucugagcaaucu

SEQ ID NO: 714256 - RNA, 19 nt, Homo sapiens
cuugaaacccugaaucuca

SEQ ID NO: 714257 - RNA, 19 nt, Homo sapiens
ggaccugacagacaucuac

SEQ ID NO: 714258 - RNA, 19 nt, Homo sapiens
cgagacaaccagauugaca

SEQ ID NO: 714259 - RNA, 19 nt, Homo sapiens
gaggacugagcuuaucuga

SEQ ID NO: 714260 - RNA, 19 nt, Homo sapiens
gcgaagugcccagaugaau

SEQ ID NO: 714261 - RNA, 19 nt, Homo sapiens
ugaaaucauugcaguaccu

SEQ ID NO: 714262 - RNA, 19 nt, Homo sapiens
cccaaaacaugcugaagaa

SEQ ID NO: 714263 - RNA, 19 nt, Homo sapiens
augucaagcuggagguuaa

SEQ ID NO: 714264 - RNA, 19 nt, Homo sapiens
ugggcuggcucaugcuuau

SEQ ID NO: 714265 - RNA, 19 nt, Homo sapiens
acacugaaggcaucucuca

SEQ ID NO: 714266 - RNA, 19 nt, Homo sapiens
ccugacagacaucuacuug

SEQ ID NO: 714267 - RNA, 19 nt, Homo sapiens
aaccugaggagaucaaaga

SEQ ID NO: 714268 - RNA, 19 nt, Homo sapiens
caggagggaagaaagaugu

SEQ ID NO: 714269 - RNA, 19 nt, Homo sapiens
ccaaagcuggaaauucauc

SEQ ID NO: 714270 - RNA, 19 nt, Homo sapiens
ucaaagacgcuggccuuca

SEQ ID NO: 714271 - RNA, 19 nt, Homo sapiens
aaagcacccugggaaucaa

SEQ ID NO: 714272 - RNA, 19 nt, Homo sapiens
accugcagauugcuaguuu

SEQ ID NO: 714273 - RNA, 19 nt, Homo sapiens
gugcccagaugaaugaacu

SEQ ID NO: 714274 - RNA, 19 nt, Homo sapiens
gagccagaccaggaugauu

SEQ ID NO: 714275 - RNA, 19 nt, Homo sapiens
uaaagagagggaccugaca

SEQ ID NO: 714276 - RNA, 19 nt, Homo sapiens
ggcaacuacugaucaaucc

SEQ ID NO: 714277 - RNA, 19 nt, Homo sapiens
ucucauccucgucuugaaa

SEQ ID NO: 714278 - RNA, 19 nt, Homo sapiens
ugaaggaagggcuuucucu

SEQ ID NO: 714279 - RNA, 19 nt, Homo sapiens
ggagggaagaaagauguca

SEQ ID NO: 714280 - RNA, 19 nt, Homo sapiens
caacaucccuccagauauu

SEQ ID NO: 714281 - RNA, 19 nt, Homo sapiens
gcacuguacuugugagaua

SEQ ID NO: 714282 - RNA, 19 nt, Homo sapiens
gaaacaagauccgcacauu

SEQ ID NO: 714283 - RNA, 19 nt, Homo sapiens
uaacuguguugccuauuua

SEQ ID NO: 714284 - RNA, 19 nt, Homo sapiens
gauaaaaucugaacaguug

SEQ ID NO: 714285 - RNA, 19 nt, Homo sapiens
agacuuacgugaaugauuu

SEQ ID NO: 714286 - RNA, 19 nt, Homo sapiens
gcucacacauuuagaagaa

SEQ ID NO: 714287 - RNA, 19 nt, Homo sapiens
cggaggaaguguucauuua

SEQ ID NO: 714288 - RNA, 19 nt, Homo sapiens
gaagcaaagcguaauaauu

SEQ ID NO: 714289 - RNA, 19 nt, Homo sapiens
ccagagagguccagauaga

SEQ ID NO: 714290 - RNA, 19 nt, Homo sapiens
gcaaagaagcaaagcguaa

SEQ ID NO: 714291 - RNA, 19 nt, Homo sapiens
gaacaguuguguaaugaag

SEQ ID NO: 714292 - RNA, 19 nt, Homo sapiens
gcaaaacgccugaagaaua

SEQ ID NO: 714293 - RNA, 19 nt, Homo sapiens
cagcauauccugagucauu

SEQ ID NO: 714294 - RNA, 19 nt, Homo sapiens
caaggaauuugaagauguu

SEQ ID NO: 714295 - RNA, 19 nt, Homo sapiens
ggaacagcaucuggugaua

SEQ ID NO: 714296 - RNA, 19 nt, Homo sapiens
gcaaagagaagacugaaag

SEQ ID NO: 714297 - RNA, 19 nt, Homo sapiens
gcaguuggguccuaaugau

SEQ ID NO: 714298 - RNA, 19 nt, Homo sapiens
gagauagaaacgcuuauuu

SEQ ID NO: 714299 - RNA, 19 nt, Homo sapiens
gaugaaacccugcaaguag

SEQ ID NO: 714300 - RNA, 19 nt, Homo sapiens
ccaaggaauuugaagaugu

SEQ ID NO: 714301 - RNA, 19 nt, Homo sapiens
caaacucaccacccucuua

SEQ ID NO: 714302 - RNA, 19 nt, Homo sapiens
agacuuggauuucaaagga

SEQ ID NO: 714303 - RNA, 19 nt, Homo sapiens
gaggaaguguucauuuaca

SEQ ID NO: 714304 - RNA, 19 nt, Homo sapiens
uuaacuguguugccuauuu

SEQ ID NO: 714305 - RNA, 19 nt, Homo sapiens
acacaccucucuugagcua

SEQ ID NO: 714306 - RNA, 19 nt, Homo sapiens
cacagaagaugaugaaugg

SEQ ID NO: 714307 - RNA, 19 nt, Homo sapiens
ugagcuaccugcgucuuua

SEQ ID NO: 714308 - RNA, 19 nt, Homo sapiens
caacauguuuuccaaguuu

SEQ ID NO: 714309 - RNA, 19 nt, Homo sapiens
gauuaacuguguugccuau

SEQ ID NO: 714310 - RNA, 19 nt, Homo sapiens
guacacauaucuccaugag

SEQ ID NO: 714311 - RNA, 19 nt, Homo sapiens
agagaagacugaaagacaa

SEQ ID NO: 714312 - RNA, 19 nt, Homo sapiens
ccagauagaugagcuugug

SEQ ID NO: 714313 - RNA, 19 nt, Homo sapiens
gaaguuacuaugaagaaug

SEQ ID NO: 714314 - RNA, 19 nt, Homo sapiens
gaacagcaucuggugauau

SEQ ID NO: 714315 - RNA, 19 nt, Homo sapiens
gcaggguaauccagcuaaa

SEQ ID NO: 714316 - RNA, 19 nt, Homo sapiens
gauccugggucuuugagau

SEQ ID NO: 714317 - RNA, 19 nt, Homo sapiens
gaacuacgccaagugugaa

SEQ ID NO: 714318 - RNA, 19 nt, Homo sapiens
gagaucacaccgcaaagaa

SEQ ID NO: 714319 - RNA, 19 nt, Homo sapiens
uaaagcaccacuacaaugu

SEQ ID NO: 714320 - RNA, 19 nt, Homo sapiens
gagauaacccuuggagaug

SEQ ID NO: 714321 - RNA, 19 nt, Homo sapiens
aaucugaacaguuguguaa

SEQ ID NO: 714322 - RNA, 19 nt, Homo sapiens
gaaaguccacaagaacaaa

SEQ ID NO: 714323 - RNA, 19 nt, Homo sapiens
gugaggcguucuuugguuu

SEQ ID NO: 714324 - RNA, 19 nt, Homo sapiens
gagaaauacuuagauuguc

SEQ ID NO: 714325 - RNA, 19 nt, Homo sapiens
ucaagagaaugcuaucauc

SEQ ID NO: 714326 - RNA, 19 nt, Homo sapiens
gguuaaagcaccacuacaa

SEQ ID NO: 714327 - RNA, 19 nt, Homo sapiens
ucaaacaacagucugcaaa

SEQ ID NO: 714328 - RNA, 19 nt, Homo sapiens
uuaauggccuggaaugcaa

SEQ ID NO: 714329 - RNA, 19 nt, Homo sapiens
ccagauauuguuaaacuug

SEQ ID NO: 714330 - RNA, 19 nt, Homo sapiens
gagaagacugaaagacaaa

SEQ ID NO: 714331 - RNA, 19 nt, Homo sapiens
aaagaagcaaagcguaaua

SEQ ID NO: 714332 - RNA, 19 nt, Homo sapiens
cuuugacuauggcguauua

SEQ ID NO: 714333 - RNA, 19 nt, Homo sapiens
uacaaacacuggacugcaa

SEQ ID NO: 714334 - RNA, 19 nt, Homo sapiens
caacuucgacccaaggaau

SEQ ID NO: 714335 - RNA, 19 nt, Homo sapiens
gaggcguucuuugguuuaa

SEQ ID NO: 714336 - RNA, 19 nt, Homo sapiens
gcagcaaagagaagacuga

SEQ ID NO: 714337 - RNA, 19 nt, Homo sapiens
ccagcugggucucauuguu

SEQ ID NO: 714338 - RNA, 19 nt, Homo sapiens
gauaacccuuggagaugug

SEQ ID NO: 714339 - RNA, 19 nt, Homo sapiens
aacaacaucccuccagaua

SEQ ID NO: 714340 - RNA, 19 nt, Homo sapiens
ucugaacaguuguguaaug

SEQ ID NO: 714341 - RNA, 19 nt, Homo sapiens
gcacauugaagaacaacau

SEQ ID NO: 714342 - RNA, 19 nt, Homo sapiens
aacaagauccgcacauuga

SEQ ID NO: 714343 - RNA, 19 nt, Homo sapiens
aggaauacuuucauuguuc

SEQ ID NO: 714344 - RNA, 19 nt, Homo sapiens
caaaacgccugaagaauac

SEQ ID NO: 714345 - RNA, 19 nt, Homo sapiens
gagaugaaacccugcaagu

SEQ ID NO: 714346 - RNA, 19 nt, Homo sapiens
cgaacuacgccaaguguga

SEQ ID NO: 714347 - RNA, 19 nt, Homo sapiens
cugcuugccuguccauuug

SEQ ID NO: 714348 - RNA, 19 nt, Homo sapiens
gauaagguagaaauuguuc

SEQ ID NO: 714349 - RNA, 19 nt, Homo sapiens
ggauaagguagaaauuguu

SEQ ID NO: 714350 - RNA, 19 nt, Homo sapiens
cguauuagaagacuuguau

SEQ ID NO: 714351 - RNA, 19 nt, Homo sapiens
acaguuguguaaugaagaa

SEQ ID NO: 714352 - RNA, 19 nt, Homo sapiens
cugaacaguuguguaauga

SEQ ID NO: 714353 - RNA, 19 nt, Homo sapiens
aaacaagauccgcacauug

SEQ ID NO: 714354 - RNA, 19 nt, Homo sapiens
gaagaugaugaaugggaaa

SEQ ID NO: 714355 - RNA, 19 nt, Homo sapiens
aagacaaguuaccagcaua

SEQ ID NO: 714356 - RNA, 19 nt, Homo sapiens
aaagacaaguuaccagcau

SEQ ID NO: 714357 - RNA, 19 nt, Homo sapiens
gagagguccagauagauga

SEQ ID NO: 714358 - RNA, 19 nt, Homo sapiens
ugacuauggcguauuagaa

SEQ ID NO: 714359 - RNA, 19 nt, Homo sapiens
caaagagaagacugaaaga

SEQ ID NO: 714360 - RNA, 19 nt, Homo sapiens
aggauaagguagaaauugu

SEQ ID NO: 714361 - RNA, 19 nt, Homo sapiens
acacagaagaugaugaaug

SEQ ID NO: 714362 - RNA, 19 nt, Homo sapiens
guaaucaagagaaugcuau

SEQ ID NO: 714363 - RNA, 19 nt, Homo sapiens
gguaauccagcuaaaggaa

SEQ ID NO: 714364 - RNA, 19 nt, Homo sapiens
agacacagaagaugaugaa

SEQ ID NO: 714365 - RNA, 19 nt, Homo sapiens
agagauaacccuuggagau

SEQ ID NO: 714366 - RNA, 19 nt, Homo sapiens
guuguguaaugaagaagaa

SEQ ID NO: 714367 - RNA, 19 nt, Homo sapiens
ggaggaaguguucauuuac

SEQ ID NO: 714368 - RNA, 19 nt, Homo sapiens
caaagaagcaaagcguaau

SEQ ID NO: 714369 - RNA, 19 nt, Homo sapiens
cuaccucuacuacugguua

SEQ ID NO: 714370 - RNA, 19 nt, Homo sapiens
gcagaaugagaucucuaaa

SEQ ID NO: 714371 - RNA, 19 nt, Homo sapiens
aacagcaucuggugauaug

SEQ ID NO: 714372 - RNA, 19 nt, Homo sapiens
ucuuguggcucagagauaa

SEQ ID NO: 714373 - RNA, 19 nt, Homo sapiens
ggaacaauuggacccgaaa

SEQ ID NO: 714374 - RNA, 19 nt, Homo sapiens
ucuguaacacgaaguaauu

SEQ ID NO: 714375 - RNA, 19 nt, Homo sapiens
gauggucugugggaaaaua

SEQ ID NO: 714376 - RNA, 19 nt, Homo sapiens
gcacaaccagaucaaaguc

SEQ ID NO: 714377 - RNA, 19 nt, Homo sapiens
guaggauaagguagaaauu

SEQ ID NO: 714378 - RNA, 19 nt, Homo sapiens
uuaaagcaccacuacaaug

SEQ ID NO: 714379 - RNA, 19 nt, Homo sapiens
caacauucacuaccucuac

SEQ ID NO: 714380 - RNA, 19 nt, Homo sapiens
ggagaugguuuccuauuuc

SEQ ID NO: 714381 - RNA, 19 nt, Homo sapiens
uguaauagaugcugugguu

SEQ ID NO: 714382 - RNA, 19 nt, Homo sapiens
guacagacucuugugaaua

SEQ ID NO: 714383 - RNA, 19 nt, Homo sapiens
ggaaggacaacuccaauuc

SEQ ID NO: 714384 - RNA, 19 nt, Homo sapiens
uacagacucuugugaauau

SEQ ID NO: 714385 - RNA, 19 nt, Homo sapiens
gacauccacuuguaauaga

SEQ ID NO: 714386 - RNA, 19 nt, Homo sapiens
caagaugucccuguuguuu

SEQ ID NO: 714387 - RNA, 19 nt, Homo sapiens
ccaauucccugcaggugaa

SEQ ID NO: 714388 - RNA, 19 nt, Homo sapiens
ggaguuggcugagcagauc

SEQ ID NO: 714389 - RNA, 19 nt, Homo sapiens
cagcggaguuugacuugaa

SEQ ID NO: 714390 - RNA, 19 nt, Homo sapiens
ugaagcagcucuuuagcau

SEQ ID NO: 714391 - RNA, 19 nt, Homo sapiens
ccaagcugcuccacaucua

SEQ ID NO: 714392 - RNA, 19 nt, Homo sapiens
gugcaaggaucgccuguca

SEQ ID NO: 714393 - RNA, 19 nt, Homo sapiens
gaucauccgugggaacuuc

SEQ ID NO: 714394 - RNA, 19 nt, Homo sapiens
gcaaggaucgccugucagu

SEQ ID NO: 714395 - RNA, 19 nt, Homo sapiens
agaugucccuguuguuuga

SEQ ID NO: 714396 - RNA, 19 nt, Homo sapiens
cggagcaucucaccuacuu

SEQ ID NO: 714397 - RNA, 19 nt, Homo sapiens
ggaagcggcaggugacuca

SEQ ID NO: 714398 - RNA, 19 nt, Homo sapiens
gcagggaggagaugguuuc

SEQ ID NO: 714399 - RNA, 19 nt, Homo sapiens
ccacaucucacaggaagaa

SEQ ID NO: 714400 - RNA, 19 nt, Homo sapiens
uguuugacauccacuugua

SEQ ID NO: 714401 - RNA, 19 nt, Homo sapiens
cggugucucuggaucagua

SEQ ID NO: 714402 - RNA, 19 nt, Homo sapiens
gcaagaugucccuguuguu

SEQ ID NO: 714403 - RNA, 19 nt, Homo sapiens
aaggaucgccugucaguug

SEQ ID NO: 714404 - RNA, 19 nt, Homo sapiens
cgacggcacagcagccuaa

SEQ ID NO: 714405 - RNA, 19 nt, Homo sapiens
agaagaugguggagucugu

SEQ ID NO: 714406 - RNA, 19 nt, Homo sapiens
ucaggacuaucacaguuuc

SEQ ID NO: 714407 - RNA, 19 nt, Homo sapiens
agacucuugugaauauuug

SEQ ID NO: 714408 - RNA, 19 nt, Homo sapiens
gggagggucucacggaacu

SEQ ID NO: 714409 - RNA, 19 nt, Homo sapiens
gagacccacagccacguua

SEQ ID NO: 714410 - RNA, 19 nt, Homo sapiens
gaacuucaacacgcugaug

SEQ ID NO: 714411 - RNA, 19 nt, Homo sapiens
gcugaaggcucugcuagac

SEQ ID NO: 714412 - RNA, 19 nt, Homo sapiens
gcaugggcuucguacacaa

SEQ ID NO: 714413 - RNA, 19 nt, Homo sapiens
agacggaggaugagcugua

SEQ ID NO: 714414 - RNA, 19 nt, Homo sapiens
uggaggagcuggccauggu

SEQ ID NO: 714415 - RNA, 19 nt, Homo sapiens
uuucaggacuaucacaguu

SEQ ID NO: 714416 - RNA, 19 nt, Homo sapiens
uguacagacucuugugaau

SEQ ID NO: 714417 - RNA, 19 nt, Homo sapiens
gggcuggugucccuaaggu

SEQ ID NO: 714418 - RNA, 19 nt, Homo sapiens
gcucaugauccucagcaaa

SEQ ID NO: 714419 - RNA, 19 nt, Homo sapiens
ugacauccacuuguaauag

SEQ ID NO: 714420 - RNA, 19 nt, Homo sapiens
ucugcaagauccuguuuca

SEQ ID NO: 714421 - RNA, 19 nt, Homo sapiens
cgcaagaugucccuguugu

SEQ ID NO: 714422 - RNA, 19 nt, Homo sapiens
gaugguggagucuguguuc

SEQ ID NO: 714423 - RNA, 19 nt, Homo sapiens
cggccaagcugcuccacau

SEQ ID NO: 714424 - RNA, 19 nt, Homo sapiens
uggcggagcaucucaccua

SEQ ID NO: 714425 - RNA, 19 nt, Homo sapiens
cagcgucccuaccuacaag

SEQ ID NO: 714426 - RNA, 19 nt, Homo sapiens
gcagccuaaucgacauaga

SEQ ID NO: 714427 - RNA, 19 nt, Homo sapiens
uggcugagcagaucaagga

SEQ ID NO: 714428 - RNA, 19 nt, Homo sapiens
cuacaagcagggccucaaa

SEQ ID NO: 714429 - RNA, 19 nt, Homo sapiens
ugcuacagcugcagaacuu

SEQ ID NO: 714430 - RNA, 19 nt, Homo sapiens
ggucaucacacacuuuguc

SEQ ID NO: 714431 - RNA, 19 nt, Homo sapiens
uagacagcgucccuaccua

SEQ ID NO: 714432 - RNA, 19 nt, Homo sapiens
gagaugguuuccuauuucc

SEQ ID NO: 714433 - RNA, 19 nt, Homo sapiens
uaucgcuccuucugcaaga

SEQ ID NO: 714434 - RNA, 19 nt, Homo sapiens
cagacucuugugaauauuu

SEQ ID NO: 714435 - RNA, 19 nt, Homo sapiens
acaagcagggccucaaaug

SEQ ID NO: 714436 - RNA, 19 nt, Homo sapiens
caucucacaggaagaauuc

SEQ ID NO: 714437 - RNA, 19 nt, Homo sapiens
uggagcacaucgagaagau

SEQ ID NO: 714438 - RNA, 19 nt, Homo sapiens
ccaaaauauucccaucuug

SEQ ID NO: 714439 - RNA, 19 nt, Homo sapiens
agaugaagcagcucuuuag

SEQ ID NO: 714440 - RNA, 19 nt, Homo sapiens
ccacaucuaccaacaaucc

SEQ ID NO: 714441 - RNA, 19 nt, Homo sapiens
gcgcaagaugucccuguug

SEQ ID NO: 714442 - RNA, 19 nt, Homo sapiens
gaaggacaacuccaauucc

SEQ ID NO: 714443 - RNA, 19 nt, Homo sapiens
cuccacaucuaccaacaau

SEQ ID NO: 714444 - RNA, 19 nt, Homo sapiens
gcuccaggccuccagagau

SEQ ID NO: 714445 - RNA, 19 nt, Homo sapiens
cggaaggacaacuccaauu

SEQ ID NO: 714446 - RNA, 19 nt, Homo sapiens
guucaucucccucuucaac

SEQ ID NO: 714447 - RNA, 19 nt, Homo sapiens
aaaaggcccguguaauuaa

SEQ ID NO: 714448 - RNA, 19 nt, Homo sapiens
aauagaugcugugguugga

SEQ ID NO: 714449 - RNA, 19 nt, Homo sapiens
gaucgccugucaguugagu

SEQ ID NO: 714450 - RNA, 19 nt, Homo sapiens
aggaucgccugucaguuga

SEQ ID NO: 714451 - RNA, 19 nt, Homo sapiens
ccacaagcagugcaaggau

SEQ ID NO: 714452 - RNA, 19 nt, Homo sapiens
cagcagccuaaucgacaua

SEQ ID NO: 714453 - RNA, 19 nt, Homo sapiens
caaaauauucccaucuugu

SEQ ID NO: 714454 - RNA, 19 nt, Homo sapiens
aguaucagacggaggauga

SEQ ID NO: 714455 - RNA, 19 nt, Homo sapiens
aggcaacuauggcaacuac

SEQ ID NO: 714456 - RNA, 19 nt, Homo sapiens
ggagacccacagccacguu

SEQ ID NO: 714457 - RNA, 19 nt, Homo sapiens
ccagcggaguuugacuuga

SEQ ID NO: 714458 - RNA, 19 nt, Homo sapiens
gggcuucguacacaacuuc

SEQ ID NO: 714459 - RNA, 19 nt, Homo sapiens
gcgcuccagcucuguguug

SEQ ID NO: 714460 - RNA, 19 nt, Homo sapiens
ccaaacccaagcuggauca

SEQ ID NO: 714461 - RNA, 19 nt, Homo sapiens
gacggaggaugagcuguac

SEQ ID NO: 714462 - RNA, 19 nt, Homo sapiens
gauaugaggguggcaugca

SEQ ID NO: 714463 - RNA, 19 nt, Homo sapiens
gguguuugacauccacuug

SEQ ID NO: 714464 - RNA, 19 nt, Homo sapiens
cuccaggccuccagagauc

SEQ ID NO: 714465 - RNA, 19 nt, Homo sapiens
ugacuugaacccggaguug

SEQ ID NO: 714466 - RNA, 19 nt, Homo sapiens
caagcagggccucaaaugc

SEQ ID NO: 714467 - RNA, 19 nt, Homo sapiens
cgcaugggcuucguacaca

SEQ ID NO: 714468 - RNA, 19 nt, Homo sapiens
cgguucaucucccucuuca

SEQ ID NO: 714469 - RNA, 19 nt, Homo sapiens
ggagaugguuuccuauuuc

SEQ ID NO: 714470 - RNA, 19 nt, Homo sapiens
uguaauagaugcugugguu

SEQ ID NO: 714471 - RNA, 19 nt, Homo sapiens
guacagacucuugugaaua

SEQ ID NO: 714472 - RNA, 19 nt, Homo sapiens
ggaaggacaacuccaauuc

SEQ ID NO: 714473 - RNA, 19 nt, Homo sapiens
uacagacucuugugaauau

SEQ ID NO: 714474 - RNA, 19 nt, Homo sapiens
gacauccacuuguaauaga

SEQ ID NO: 714475 - RNA, 19 nt, Homo sapiens
caagaugucccuguuguuu

SEQ ID NO: 714476 - RNA, 19 nt, Homo sapiens
ccaauucccugcaggugaa

SEQ ID NO: 714477 - RNA, 19 nt, Homo sapiens
ggaguuggcugagcagauc

SEQ ID NO: 714478 - RNA, 19 nt, Homo sapiens
cagcggaguuugacuugaa

SEQ ID NO: 714479 - RNA, 19 nt, Homo sapiens
ugaagcagcucuuuagcau

SEQ ID NO: 714480 - RNA, 19 nt, Homo sapiens
ccaagcugcuccacaucua

SEQ ID NO: 714481 - RNA, 19 nt, Homo sapiens
gugcaaggaucgccuguca

SEQ ID NO: 714482 - RNA, 19 nt, Homo sapiens
gaucauccgugggaacuuc

SEQ ID NO: 714483 - RNA, 19 nt, Homo sapiens
gcaaggaucgccugucagu

SEQ ID NO: 714484 - RNA, 19 nt, Homo sapiens
agaugucccuguuguuuga

SEQ ID NO: 714485 - RNA, 19 nt, Homo sapiens
cggagcaucucaccuacuu

SEQ ID NO: 714486 - RNA, 19 nt, Homo sapiens
ggaagcggcaggugacuca

SEQ ID NO: 714487 - RNA, 19 nt, Homo sapiens
gcagggaggagaugguuuc

SEQ ID NO: 714488 - RNA, 19 nt, Homo sapiens
ccacaucucacaggaagaa

SEQ ID NO: 714489 - RNA, 19 nt, Homo sapiens
uguuugacauccacuugua

SEQ ID NO: 714490 - RNA, 19 nt, Homo sapiens
cggugucucuggaucagua

SEQ ID NO: 714491 - RNA, 19 nt, Homo sapiens
gcaagaugucccuguuguu

SEQ ID NO: 714492 - RNA, 19 nt, Homo sapiens
aaggaucgccugucaguug

SEQ ID NO: 714493 - RNA, 19 nt, Homo sapiens
cgacggcacagcagccuaa

SEQ ID NO: 714494 - RNA, 19 nt, Homo sapiens
agaagaugguggagucugu

SEQ ID NO: 714495 - RNA, 19 nt, Homo sapiens
ucaggacuaucacaguuuc

SEQ ID NO: 714496 - RNA, 19 nt, Homo sapiens
agacucuugugaauauuug

SEQ ID NO: 714497 - RNA, 19 nt, Homo sapiens
gggagggucucacggaacu

SEQ ID NO: 714498 - RNA, 19 nt, Homo sapiens
gagacccacagccacguua

SEQ ID NO: 714499 - RNA, 19 nt, Homo sapiens
gaacuucaacacgcugaug

SEQ ID NO: 714500 - RNA, 19 nt, Homo sapiens
gcugaaggcucugcuagac

SEQ ID NO: 714501 - RNA, 19 nt, Homo sapiens
gcaugggcuucguacacaa

SEQ ID NO: 714502 - RNA, 19 nt, Homo sapiens
agacggaggaugagcugua

SEQ ID NO: 714503 - RNA, 19 nt, Homo sapiens
uggaggagcuggccauggu

SEQ ID NO: 714504 - RNA, 19 nt, Homo sapiens
uuucaggacuaucacaguu

SEQ ID NO: 714505 - RNA, 19 nt, Homo sapiens
uguacagacucuugugaau

SEQ ID NO: 714506 - RNA, 19 nt, Homo sapiens
gggcuggugucccuaaggu

SEQ ID NO: 714507 - RNA, 19 nt, Homo sapiens
gcucaugauccucagcaaa

SEQ ID NO: 714508 - RNA, 19 nt, Homo sapiens
ugacauccacuuguaauag

SEQ ID NO: 714509 - RNA, 19 nt, Homo sapiens
ucugcaagauccuguuuca

SEQ ID NO: 714510 - RNA, 19 nt, Homo sapiens
cgcaagaugucccuguugu

SEQ ID NO: 714511 - RNA, 19 nt, Homo sapiens
gaugguggagucuguguuc

SEQ ID NO: 714512 - RNA, 19 nt, Homo sapiens
cggccaagcugcuccacau

SEQ ID NO: 714513 - RNA, 19 nt, Homo sapiens
uggcggagcaucucaccua

SEQ ID NO: 714514 - RNA, 19 nt, Homo sapiens
cagcgucccuaccuacaag

SEQ ID NO: 714515 - RNA, 19 nt, Homo sapiens
gcagccuaaucgacauaga

SEQ ID NO: 714516 - RNA, 19 nt, Homo sapiens
uggcugagcagaucaagga

SEQ ID NO: 714517 - RNA, 19 nt, Homo sapiens
cuacaagcagggccucaaa

SEQ ID NO: 714518 - RNA, 19 nt, Homo sapiens
ugcuacagcugcagaacuu

SEQ ID NO: 714519 - RNA, 19 nt, Homo sapiens
ggucaucacacacuuuguc

SEQ ID NO: 714520 - RNA, 19 nt, Homo sapiens
uagacagcgucccuaccua

SEQ ID NO: 714521 - RNA, 19 nt, Homo sapiens
gagaugguuuccuauuucc

SEQ ID NO: 714522 - RNA, 19 nt, Homo sapiens
uaucgcuccuucugcaaga

SEQ ID NO: 714523 - RNA, 19 nt, Homo sapiens
cagacucuugugaauauuu

SEQ ID NO: 714524 - RNA, 19 nt, Homo sapiens
acaagcagggccucaaaug

SEQ ID NO: 714525 - RNA, 19 nt, Homo sapiens
caucucacaggaagaauuc

SEQ ID NO: 714526 - RNA, 19 nt, Homo sapiens
uggagcacaucgagaagau

SEQ ID NO: 714527 - RNA, 19 nt, Homo sapiens
ccacaucuaccaacaaucc

SEQ ID NO: 714528 - RNA, 19 nt, Homo sapiens
ccaaaauauucccaucuug

SEQ ID NO: 714529 - RNA, 19 nt, Homo sapiens
agaugaagcagcucuuuag

SEQ ID NO: 714530 - RNA, 19 nt, Homo sapiens
gcgcaagaugucccuguug

SEQ ID NO: 714531 - RNA, 19 nt, Homo sapiens
gaaggacaacuccaauucc

SEQ ID NO: 714532 - RNA, 19 nt, Homo sapiens
gcuccaggccuccagagau

SEQ ID NO: 714533 - RNA, 19 nt, Homo sapiens
cuccacaucuaccaacaau

SEQ ID NO: 714534 - RNA, 19 nt, Homo sapiens
guucaucucccucuucaac

SEQ ID NO: 714535 - RNA, 19 nt, Homo sapiens
cggaaggacaacuccaauu

SEQ ID NO: 714536 - RNA, 19 nt, Homo sapiens
aaaaggcccguguaauuaa

SEQ ID NO: 714537 - RNA, 19 nt, Homo sapiens
aauagaugcugugguugga

SEQ ID NO: 714538 - RNA, 19 nt, Homo sapiens
gaucgccugucaguugagu

SEQ ID NO: 714539 - RNA, 19 nt, Homo sapiens
aggaucgccugucaguuga

SEQ ID NO: 714540 - RNA, 19 nt, Homo sapiens
ccacaagcagugcaaggau

SEQ ID NO: 714541 - RNA, 19 nt, Homo sapiens
cagcagccuaaucgacaua

SEQ ID NO: 714542 - RNA, 19 nt, Homo sapiens
aguaucagacggaggauga

SEQ ID NO: 714543 - RNA, 19 nt, Homo sapiens
aggcaacuauggcaacuac

SEQ ID NO: 714544 - RNA, 19 nt, Homo sapiens
caaaauauucccaucuugu

SEQ ID NO: 714545 - RNA, 19 nt, Homo sapiens
ggagacccacagccacguu

SEQ ID NO: 714546 - RNA, 19 nt, Homo sapiens
gggcuucguacacaacuuc

SEQ ID NO: 714547 - RNA, 19 nt, Homo sapiens
gcgcuccagcucuguguug

SEQ ID NO: 714548 - RNA, 19 nt, Homo sapiens
ccaaacccaagcuggauca

SEQ ID NO: 714549 - RNA, 19 nt, Homo sapiens
gacggaggaugagcuguac

SEQ ID NO: 714550 - RNA, 19 nt, Homo sapiens
ccagcggaguuugacuuga

SEQ ID NO: 714551 - RNA, 19 nt, Homo sapiens
gauaugaggguggcaugca

SEQ ID NO: 714552 - RNA, 19 nt, Homo sapiens
gguguuugacauccacuug

SEQ ID NO: 714553 - RNA, 19 nt, Homo sapiens
cuccaggccuccagagauc

SEQ ID NO: 714554 - RNA, 19 nt, Homo sapiens
caagcagggccucaaaugc

SEQ ID NO: 714555 - RNA, 19 nt, Homo sapiens
cgcaugggcuucguacaca

SEQ ID NO: 714556 - RNA, 19 nt, Homo sapiens
cgguucaucucccucuuca

SEQ ID NO: 714557 - RNA, 19 nt, Homo sapiens
ugacuugaacccggaguug

SEQ ID NO: 714558 - RNA, 19 nt, Homo sapiens
ggaguaugcuguaaauaaa

SEQ ID NO: 714559 - RNA, 19 nt, Homo sapiens
gcucugcccugcauaauaa

SEQ ID NO: 714560 - RNA, 19 nt, Homo sapiens
gaauagaggguaugcauuu

SEQ ID NO: 714561 - RNA, 19 nt, Homo sapiens
gaagaaaucacuauugugu

SEQ ID NO: 714562 - RNA, 19 nt, Homo sapiens
gaugauggcuaugcaguaa

SEQ ID NO: 714563 - RNA, 19 nt, Homo sapiens
ggaagaaauugaaauaguc

SEQ ID NO: 714564 - RNA, 19 nt, Homo sapiens
aaaggaagcugcacaggaa

SEQ ID NO: 714565 - RNA, 19 nt, Homo sapiens
ugaaaugaauggcaaagaa

SEQ ID NO: 714566 - RNA, 19 nt, Homo sapiens
guaaugcgguacaguuaaa

SEQ ID NO: 714567 - RNA, 19 nt, Homo sapiens
gcacugcguaugaagauua

SEQ ID NO: 714568 - RNA, 19 nt, Homo sapiens
cagaaagacuugaugaaau

SEQ ID NO: 714569 - RNA, 19 nt, Homo sapiens
gcagaaagacuugaugaaa

SEQ ID NO: 714570 - RNA, 19 nt, Homo sapiens
gggaagaaauugaaauagu

SEQ ID NO: 714571 - RNA, 19 nt, Homo sapiens
gaaaugaauggcaaagaaa

SEQ ID NO: 714572 - RNA, 19 nt, Homo sapiens
ggaauuuaaugaagaagga

SEQ ID NO: 714573 - RNA, 19 nt, Homo sapiens
cuaaucaggugaaugguaa

SEQ ID NO: 714574 - RNA, 19 nt, Homo sapiens
gagcagcuguuaaggcuau

SEQ ID NO: 714575 - RNA, 19 nt, Homo sapiens
agaaguagguuaacugugu

SEQ ID NO: 714576 - RNA, 19 nt, Homo sapiens
gcuuaacuguuucaucuuu

SEQ ID NO: 714577 - RNA, 19 nt, Homo sapiens
ggaagaaccagauccagaa

SEQ ID NO: 714578 - RNA, 19 nt, Homo sapiens
guauugggcugaagaaauc

SEQ ID NO: 714579 - RNA, 19 nt, Homo sapiens
agaaggagcucugucugua

SEQ ID NO: 714580 - RNA, 19 nt, Homo sapiens
agacaggauugguagcuua

SEQ ID NO: 714581 - RNA, 19 nt, Homo sapiens
gugagaaacuuggcuacua

SEQ ID NO: 714582 - RNA, 19 nt, Homo sapiens
gcacacuguuaaaucauga

SEQ ID NO: 714583 - RNA, 19 nt, Homo sapiens
gaaguagguuaacuguguu

SEQ ID NO: 714584 - RNA, 19 nt, Homo sapiens
ugacuauucugguaacuau

SEQ ID NO: 714585 - RNA, 19 nt, Homo sapiens
gagaaggccggacccauuu

SEQ ID NO: 714586 - RNA, 19 nt, Homo sapiens
guuauaacuucacaccuuu

SEQ ID NO: 714587 - RNA, 19 nt, Homo sapiens
gaugaaagagcaauugaug

SEQ ID NO: 714588 - RNA, 19 nt, Homo sapiens
aaaugauacuggcaagaua

SEQ ID NO: 714589 - RNA, 19 nt, Homo sapiens
gcuaugaagauuacuauga

SEQ ID NO: 714590 - RNA, 19 nt, Homo sapiens
gaguaaagaaguugaaaga

SEQ ID NO: 714591 - RNA, 19 nt, Homo sapiens
gaagaauucaguaaaguca

SEQ ID NO: 714592 - RNA, 19 nt, Homo sapiens
ugggauagauuacauagga

SEQ ID NO: 714593 - RNA, 19 nt, Homo sapiens
gguggugacuauucuggua

SEQ ID NO: 714594 - RNA, 19 nt, Homo sapiens
cuacagcaguucaaggaaa

SEQ ID NO: 714595 - RNA, 19 nt, Homo sapiens
gcauuucuguggcaaacaa

SEQ ID NO: 714596 - RNA, 19 nt, Homo sapiens
ggaucuacgucuuaugaug

SEQ ID NO: 714597 - RNA, 19 nt, Homo sapiens
ugagagaacugguuauacu

SEQ ID NO: 714598 - RNA, 19 nt, Homo sapiens
uagcuuaugucgaucuuga

SEQ ID NO: 714599 - RNA, 19 nt, Homo sapiens
gaagguggcagaaagacuu

SEQ ID NO: 714600 - RNA, 19 nt, Homo sapiens
gaggaagaaccaauggaua

SEQ ID NO: 714601 - RNA, 19 nt, Homo sapiens
gcaagguggugacuauucu

SEQ ID NO: 714602 - RNA, 19 nt, Homo sapiens
cuacuacggugacagaaga

SEQ ID NO: 714603 - RNA, 19 nt, Homo sapiens
gaagucauggcuaagguaa

SEQ ID NO: 714604 - RNA, 19 nt, Homo sapiens
gaaauucgcccugguaaac

SEQ ID NO: 714605 - RNA, 19 nt, Homo sapiens
ccaauuucuuguucaugua

SEQ ID NO: 714606 - RNA, 19 nt, Homo sapiens
cgaagaauaagacuaaaga

SEQ ID NO: 714607 - RNA, 19 nt, Homo sapiens
ucagcaagguggugacuau

SEQ ID NO: 714608 - RNA, 19 nt, Homo sapiens
ggugacagaagaaauauug

SEQ ID NO: 714609 - RNA, 19 nt, Homo sapiens
ucagggaauuuaaugaaga

SEQ ID NO: 714610 - RNA, 19 nt, Homo sapiens
cuagugcuuugucuuagua

SEQ ID NO: 714611 - RNA, 19 nt, Homo sapiens
uggaguaugcuguaaauaa

SEQ ID NO: 714612 - RNA, 19 nt, Homo sapiens
cauaaaugcucuuggacau

SEQ ID NO: 714613 - RNA, 19 nt, Homo sapiens
acgauuggcucuagaucua

SEQ ID NO: 714614 - RNA, 19 nt, Homo sapiens
cagaagcacugcguaugaa

SEQ ID NO: 714615 - RNA, 19 nt, Homo sapiens
gaaagaguaaagaaguuga

SEQ ID NO: 714616 - RNA, 19 nt, Homo sapiens
ccacaaagggaccugauga

SEQ ID NO: 714617 - RNA, 19 nt, Homo sapiens
cugaagaaaucacuauugu

SEQ ID NO: 714618 - RNA, 19 nt, Homo sapiens
aauagaggguaugcauuua

SEQ ID NO: 714619 - RNA, 19 nt, Homo sapiens
gaauggcaaagaaauagaa

SEQ ID NO: 714620 - RNA, 19 nt, Homo sapiens
gaacacuacaagacacuga

SEQ ID NO: 714621 - RNA, 19 nt, Homo sapiens
gcuaugaagaucccuacua

SEQ ID NO: 714622 - RNA, 19 nt, Homo sapiens
ccagaagcacugcguauga

SEQ ID NO: 714623 - RNA, 19 nt, Homo sapiens
agacaggccuccagaagca

SEQ ID NO: 714624 - RNA, 19 nt, Homo sapiens
gcuaaucaggugaauggua

SEQ ID NO: 714625 - RNA, 19 nt, Homo sapiens
uuugaaaucugcccuacaa

SEQ ID NO: 714626 - RNA, 19 nt, Homo sapiens
caagcugggcacacuguua

SEQ ID NO: 714627 - RNA, 19 nt, Homo sapiens
uugcagaguucccuuauuc

SEQ ID NO: 714628 - RNA, 19 nt, Homo sapiens
gggcugacccuguggaaga

SEQ ID NO: 714629 - RNA, 19 nt, Homo sapiens
ccacaggacagaggaagua

SEQ ID NO: 714630 - RNA, 19 nt, Homo sapiens
uggcuuaacuguuucaucu

SEQ ID NO: 714631 - RNA, 19 nt, Homo sapiens
cagggaauuuaaugaagaa

SEQ ID NO: 714632 - RNA, 19 nt, Homo sapiens
guucuuugaugugauugua

SEQ ID NO: 714633 - RNA, 19 nt, Homo sapiens
uguuauaacuucacaccuu

SEQ ID NO: 714634 - RNA, 19 nt, Homo sapiens
gcugaagaaaucacuauug

SEQ ID NO: 714635 - RNA, 19 nt, Homo sapiens
gaugauuacuaugguuaug

SEQ ID NO: 714636 - RNA, 19 nt, Homo sapiens
ggcuauggaugaaaugaau

SEQ ID NO: 714637 - RNA, 19 nt, Homo sapiens
ucgaaagaguaaagaaguu

SEQ ID NO: 714638 - RNA, 19 nt, Homo sapiens
gguaaugcgguacaguuaa

SEQ ID NO: 714639 - RNA, 19 nt, Homo sapiens
ugagaaggccggacccauu

SEQ ID NO: 714640 - RNA, 19 nt, Homo sapiens
gaauuggaacggagguauu

SEQ ID NO: 714641 - RNA, 19 nt, Homo sapiens
uuauugggcuugcagaguu

SEQ ID NO: 714642 - RNA, 19 nt, Homo sapiens
aguaagggcuugaaaauga

SEQ ID NO: 714643 - RNA, 19 nt, Homo sapiens
agguagagcuggcuauuca

SEQ ID NO: 714644 - RNA, 19 nt, Homo sapiens
gaagcacugcguaugaaga

SEQ ID NO: 714645 - RNA, 19 nt, Homo sapiens
uuaaggcuauggaugaaau

SEQ ID NO: 714646 - RNA, 19 nt, Homo sapiens
ugagaaacuuggcuacuac

SEQ ID NO: 714647 - RNA, 19 nt, Homo sapiens
gcugaugaguggaaaagua

SEQ ID NO: 714648 - RNA, 19 nt, Homo sapiens
gguaugcauuuaucaccuu

SEQ ID NO: 714649 - RNA, 19 nt, Homo sapiens
uauggaguaugcuguaaau

SEQ ID NO: 714650 - RNA, 19 nt, Homo sapiens
gaagaaccaauggauacuu

SEQ ID NO: 714651 - RNA, 19 nt, Homo sapiens
gacagaagaaauauuggaa

SEQ ID NO: 714652 - RNA, 19 nt, Homo sapiens
cacagaagguggcagaaag

SEQ ID NO: 714653 - RNA, 19 nt, Homo sapiens
ggaagaauucaguaaaguc

SEQ ID NO: 714654 - RNA, 19 nt, Homo sapiens
ccacuguccggucagaaua

SEQ ID NO: 714655 - RNA, 19 nt, Homo sapiens
uuucauaaaugcucuugga

SEQ ID NO: 714656 - RNA, 19 nt, Homo sapiens
ugauggcuaugcaguaaga

SEQ ID NO: 714657 - RNA, 19 nt, Homo sapiens
gguggacguuauucucuau

SEQ ID NO: 714658 - RNA, 19 nt, Homo sapiens
ggucagagcuucaucuuua

SEQ ID NO: 714659 - RNA, 19 nt, Homo sapiens
cgaaaguucuucacaauuu

SEQ ID NO: 714660 - RNA, 19 nt, Homo sapiens
caagaaaguuguugggaua

SEQ ID NO: 714661 - RNA, 19 nt, Homo sapiens
caacucagguccuugguaa

SEQ ID NO: 714662 - RNA, 19 nt, Homo sapiens
gaaaggagcuaagaagaca

SEQ ID NO: 714663 - RNA, 19 nt, Homo sapiens
gagcuacucuugcuauuau

SEQ ID NO: 714664 - RNA, 19 nt, Homo sapiens
gaagacaucccacuaggaa

SEQ ID NO: 714665 - RNA, 19 nt, Homo sapiens
gaaaguuguugggauagaa

SEQ ID NO: 714666 - RNA, 19 nt, Homo sapiens
gagacuaccuccacaucaa

SEQ ID NO: 714667 - RNA, 19 nt, Homo sapiens
uaacuuuggucuucauuca

SEQ ID NO: 714668 - RNA, 19 nt, Homo sapiens
guaccugugugugcuguua

SEQ ID NO: 714669 - RNA, 19 nt, Homo sapiens
cgacauugcugcugggaau

SEQ ID NO: 714670 - RNA, 19 nt, Homo sapiens
guacaaacccaagaaaguu

SEQ ID NO: 714671 - RNA, 19 nt, Homo sapiens
gaaaauggacuuaauagga

SEQ ID NO: 714672 - RNA, 19 nt, Homo sapiens
uuaugacgguuguguauuu

SEQ ID NO: 714673 - RNA, 19 nt, Homo sapiens
caauucagcacuacaguuu

SEQ ID NO: 714674 - RNA, 19 nt, Homo sapiens
gccauggucuccagcaauu

SEQ ID NO: 714675 - RNA, 19 nt, Homo sapiens
gacguucaccuuugccuua

SEQ ID NO: 714676 - RNA, 19 nt, Homo sapiens
caggagacguucaccuuug

SEQ ID NO: 714677 - RNA, 19 nt, Homo sapiens
gauaacaagaggaaaguau

SEQ ID NO: 714678 - RNA, 19 nt, Homo sapiens
gcaggagacguucaccuuu

SEQ ID NO: 714679 - RNA, 19 nt, Homo sapiens
ugugaucaaugcuguguuu

SEQ ID NO: 714680 - RNA, 19 nt, Homo sapiens
gaaaagauaacaagaggaa

SEQ ID NO: 714681 - RNA, 19 nt, Homo sapiens
ggacuuaauaggaauaugg

SEQ ID NO: 714682 - RNA, 19 nt, Homo sapiens
gagccaagcaggagacguu

SEQ ID NO: 714683 - RNA, 19 nt, Homo sapiens
uauaacauccugcucuuug

SEQ ID NO: 714684 - RNA, 19 nt, Homo sapiens
gcaauucagcacuacaguu

SEQ ID NO: 714685 - RNA, 19 nt, Homo sapiens
gggaaaggagcuaagaaga

SEQ ID NO: 714686 - RNA, 19 nt, Homo sapiens
ggaaugggaauccuguuca

SEQ ID NO: 714687 - RNA, 19 nt, Homo sapiens
ggaaaggagcuaagaagac

SEQ ID NO: 714688 - RNA, 19 nt, Homo sapiens
cuaagaagacaucccacua

SEQ ID NO: 714689 - RNA, 19 nt, Homo sapiens
gaaagguacccugccauca

SEQ ID NO: 714690 - RNA, 19 nt, Homo sapiens
agugacaucucuugggaaa

SEQ ID NO: 714691 - RNA, 19 nt, Homo sapiens
uaagaagacaucccacuag

SEQ ID NO: 714692 - RNA, 19 nt, Homo sapiens
ccaaccacaugaugcugaa

SEQ ID NO: 714693 - RNA, 19 nt, Homo sapiens
caugcgggcucauuaccaa

SEQ ID NO: 714694 - RNA, 19 nt, Homo sapiens
gcucuaugcugccuguucu

SEQ ID NO: 714695 - RNA, 19 nt, Homo sapiens
acccugccaucaucuauaa

SEQ ID NO: 714696 - RNA, 19 nt, Homo sapiens
caaacagugacaucucuug

SEQ ID NO: 714697 - RNA, 19 nt, Homo sapiens
gaacacacagucggcuaug

SEQ ID NO: 714698 - RNA, 19 nt, Homo sapiens
agacaucccacuaggaaga

SEQ ID NO: 714699 - RNA, 19 nt, Homo sapiens
acucgaaaguucuucacaa

SEQ ID NO: 714700 - RNA, 19 nt, Homo sapiens
gaguggcccuuuucaugua

SEQ ID NO: 714701 - RNA, 19 nt, Homo sapiens
gcaagccaaucccagucau

SEQ ID NO: 714702 - RNA, 19 nt, Homo sapiens
aaagauaacaagaggaaag

SEQ ID NO: 714703 - RNA, 19 nt, Homo sapiens
ucuauaacauccugcucuu

SEQ ID NO: 714704 - RNA, 19 nt, Homo sapiens
ugugugugcuguuaauugu

SEQ ID NO: 714705 - RNA, 19 nt, Homo sapiens
ugacaucucuugggaaaau

SEQ ID NO: 714706 - RNA, 19 nt, Homo sapiens
gagagacuaccuccacauc

SEQ ID NO: 714707 - RNA, 19 nt, Homo sapiens
ggaauaugggacugaguuc

SEQ ID NO: 714708 - RNA, 19 nt, Homo sapiens
ugccuuaacuuuggucuuc

SEQ ID NO: 714709 - RNA, 19 nt, Homo sapiens
gucagagcuucaucuuuau

SEQ ID NO: 714710 - RNA, 19 nt, Homo sapiens
uaacaagaggaaaguaugg

SEQ ID NO: 714711 - RNA, 19 nt, Homo sapiens
agaaaguuguugggauaga

SEQ ID NO: 714712 - RNA, 19 nt, Homo sapiens
ugggaguucuugagcuuug

SEQ ID NO: 714713 - RNA, 19 nt, Homo sapiens
gaaugggaauccuguucac

SEQ ID NO: 714714 - RNA, 19 nt, Homo sapiens
cucgaaaguucuucacaau

SEQ ID NO: 714715 - RNA, 19 nt, Homo sapiens
gggaaugggaauccuguuc

SEQ ID NO: 714716 - RNA, 19 nt, Homo sapiens
cuccagcaauucagcacua

SEQ ID NO: 714717 - RNA, 19 nt, Homo sapiens
uaugcugccuguucuaucu

SEQ ID NO: 714718 - RNA, 19 nt, Homo sapiens
caccuuugccuuaacuuug

SEQ ID NO: 714719 - RNA, 19 nt, Homo sapiens
aaagguacccugccaucau

SEQ ID NO: 714720 - RNA, 19 nt, Homo sapiens
ucaccuuugccuuaacuuu

SEQ ID NO: 714721 - RNA, 19 nt, Homo sapiens
ccuguucuaucuccuaucu

SEQ ID NO: 714722 - RNA, 19 nt, Homo sapiens
ucgaaaguucuucacaauu

SEQ ID NO: 714723 - RNA, 19 nt, Homo sapiens
aagguacccugccaucauc

SEQ ID NO: 714724 - RNA, 19 nt, Homo sapiens
ucugggaguucuugagcuu

SEQ ID NO: 714725 - RNA, 19 nt, Homo sapiens
gaccacaugcgggcucauu

SEQ ID NO: 714726 - RNA, 19 nt, Homo sapiens
agucggcuauggagagcua

SEQ ID NO: 714727 - RNA, 19 nt, Homo sapiens
ggauagaagaacacacagu

SEQ ID NO: 714728 - RNA, 19 nt, Homo sapiens
gacccuggauggacugacu

SEQ ID NO: 714729 - RNA, 19 nt, Homo sapiens
uguacaaacccaagaaagu

SEQ ID NO: 714730 - RNA, 19 nt, Homo sapiens
guaaauccugcaagccaau

SEQ ID NO: 714731 - RNA, 19 nt, Homo sapiens
auucagcacuacaguuugu

SEQ ID NO: 714732 - RNA, 19 nt, Homo sapiens
guuccugggucuuggucuu

SEQ ID NO: 714733 - RNA, 19 nt, Homo sapiens
gauggacugacugguguuu

SEQ ID NO: 714734 - RNA, 19 nt, Homo sapiens
gggugucuuugucugcuau

SEQ ID NO: 714735 - RNA, 19 nt, Homo sapiens
acuuuggucuucauucaau

SEQ ID NO: 714736 - RNA, 19 nt, Homo sapiens
acacacagucggcuaugga

SEQ ID NO: 714737 - RNA, 19 nt, Homo sapiens
uacaaacccaagaaaguug

SEQ ID NO: 714738 - RNA, 19 nt, Homo sapiens
cauguacaaacccaagaaa

SEQ ID NO: 714739 - RNA, 19 nt, Homo sapiens
guacccugccaucaucuau

SEQ ID NO: 714740 - RNA, 19 nt, Homo sapiens
cuacccaacucagguccuu

SEQ ID NO: 714741 - RNA, 19 nt, Homo sapiens
guucaccuuugccuuaacu

SEQ ID NO: 714742 - RNA, 19 nt, Homo sapiens
uucuugagcuuugcugaaa

SEQ ID NO: 714743 - RNA, 19 nt, Homo sapiens
guucuugagcuuugcugaa

SEQ ID NO: 714744 - RNA, 19 nt, Homo sapiens
augcugaacaucaaccuuu

SEQ ID NO: 714745 - RNA, 19 nt, Homo sapiens
ccacaugcgggcucauuac

SEQ ID NO: 714746 - RNA, 19 nt, Homo sapiens
ggaaggagaucuacaagua

SEQ ID NO: 714747 - RNA, 19 nt, Homo sapiens
ggaaugagguggauccuua

SEQ ID NO: 714748 - RNA, 19 nt, Homo sapiens
gaacacagcaccaucauuu

SEQ ID NO: 714749 - RNA, 19 nt, Homo sapiens
acaaagaggucuaugauau

SEQ ID NO: 714750 - RNA, 19 nt, Homo sapiens
gaggagaguucagaguuua

SEQ ID NO: 714751 - RNA, 19 nt, Homo sapiens
ggaacaagcaggacccuaa

SEQ ID NO: 714752 - RNA, 19 nt, Homo sapiens
gccaguaugucuuucauug

SEQ ID NO: 714753 - RNA, 19 nt, Homo sapiens
ggucuaugauauugcauuu

SEQ ID NO: 714754 - RNA, 19 nt, Homo sapiens
aaggagagaucaacaaugu

SEQ ID NO: 714755 - RNA, 19 nt, Homo sapiens
uuagguaccucaagcauug

SEQ ID NO: 714756 - RNA, 19 nt, Homo sapiens
aaagaggucuaugauauug

SEQ ID NO: 714757 - RNA, 19 nt, Homo sapiens
aaacaaccaucgagcaugu

SEQ ID NO: 714758 - RNA, 19 nt, Homo sapiens
caaagaggucuaugauauu

SEQ ID NO: 714759 - RNA, 19 nt, Homo sapiens
gcugaucgcccaugacaaa

SEQ ID NO: 714760 - RNA, 19 nt, Homo sapiens
ggagacagggcagguguua

SEQ ID NO: 714761 - RNA, 19 nt, Homo sapiens
ugaggagaguucagaguuu

SEQ ID NO: 714762 - RNA, 19 nt, Homo sapiens
caacaacugccuggagaua

SEQ ID NO: 714763 - RNA, 19 nt, Homo sapiens
gacaaagaggucuaugaua

SEQ ID NO: 714764 - RNA, 19 nt, Homo sapiens
gcaccaucauuuacgaaga

SEQ ID NO: 714765 - RNA, 19 nt, Homo sapiens
gcaaacggaaggagaucua

SEQ ID NO: 714766 - RNA, 19 nt, Homo sapiens
gggcugaguuuuaagauuu

SEQ ID NO: 714767 - RNA, 19 nt, Homo sapiens
ggcaggggcuuuuguauuu

SEQ ID NO: 714768 - RNA, 19 nt, Homo sapiens
gaaggagaucuacaaguau

SEQ ID NO: 714769 - RNA, 19 nt, Homo sapiens
gaagcgcccuggacagucu

SEQ ID NO: 714770 - RNA, 19 nt, Homo sapiens
guaugucuuucauugcuuu

SEQ ID NO: 714771 - RNA, 19 nt, Homo sapiens
caacucagcccgacuggau

SEQ ID NO: 714772 - RNA, 19 nt, Homo sapiens
gauacgacaugcaccaucu

SEQ ID NO: 714773 - RNA, 19 nt, Homo sapiens
gaaggagagaucaacaaug

SEQ ID NO: 714774 - RNA, 19 nt, Homo sapiens
gcagcuucguggaggagua

SEQ ID NO: 714775 - RNA, 19 nt, Homo sapiens
caaaguaagaagaaacaug

SEQ ID NO: 714776 - RNA, 19 nt, Homo sapiens
ugagguggauccuuaucuu

SEQ ID NO: 714777 - RNA, 19 nt, Homo sapiens
ugacaaagaggucuaugau

SEQ ID NO: 714778 - RNA, 19 nt, Homo sapiens
accagaagcugcucuagga

SEQ ID NO: 714779 - RNA, 19 nt, Homo sapiens
gguggauccuuaucuuuua

SEQ ID NO: 714780 - RNA, 19 nt, Homo sapiens
aaggagaucuacaaguaug

SEQ ID NO: 714781 - RNA, 19 nt, Homo sapiens
agaagcugcucuaggaguu

SEQ ID NO: 714782 - RNA, 19 nt, Homo sapiens
gagguggauccuuaucuuu

SEQ ID NO: 714783 - RNA, 19 nt, Homo sapiens
caacaacaagguucagcuu

SEQ ID NO: 714784 - RNA, 19 nt, Homo sapiens
gagaguucagaguuuauuu

SEQ ID NO: 714785 - RNA, 19 nt, Homo sapiens
uccuuugguuccucaauua

SEQ ID NO: 714786 - RNA, 19 nt, Homo sapiens
caacaagcggugacuaucu

SEQ ID NO: 714787 - RNA, 19 nt, Homo sapiens
ggagaguucagaguuuauu

SEQ ID NO: 714788 - RNA, 19 nt, Homo sapiens
gaucgcccaugacaaagag

SEQ ID NO: 714789 - RNA, 19 nt, Homo sapiens
guggaggguuggugaaaca

SEQ ID NO: 714790 - RNA, 19 nt, Homo sapiens
ggaguacaacaacaagguu

SEQ ID NO: 714791 - RNA, 19 nt, Homo sapiens
agguucagcuuguugguuu

SEQ ID NO: 714792 - RNA, 19 nt, Homo sapiens
cuaacuaccuggccaccau

SEQ ID NO: 714793 - RNA, 19 nt, Homo sapiens
cagaguuuauuugcagaaa

SEQ ID NO: 714794 - RNA, 19 nt, Homo sapiens
gguucagcuuguugguuua

SEQ ID NO: 714795 - RNA, 19 nt, Homo sapiens
gcucggugcggauguuuga

SEQ ID NO: 714796 - RNA, 19 nt, Homo sapiens
acaagcaggacccuaacua

SEQ ID NO: 714797 - RNA, 19 nt, Homo sapiens
ggagaucuacaaguaugaa

SEQ ID NO: 714798 - RNA, 19 nt, Homo sapiens
ugaaggagagaucaacaau

SEQ ID NO: 714799 - RNA, 19 nt, Homo sapiens
gaacaagcaggacccuaac

SEQ ID NO: 714800 - RNA, 19 nt, Homo sapiens
gaaugagguggauccuuau

SEQ ID NO: 714801 - RNA, 19 nt, Homo sapiens
aggcuggaguguuugcuaa

SEQ ID NO: 714802 - RNA, 19 nt, Homo sapiens
gcaacaagcggugacuauc

SEQ ID NO: 714803 - RNA, 19 nt, Homo sapiens
caucgagcaugugucaaug

SEQ ID NO: 714804 - RNA, 19 nt, Homo sapiens
ggcaacaagcggugacuau

SEQ ID NO: 714805 - RNA, 19 nt, Homo sapiens
ugaccuccuuugacuggaa

SEQ ID NO: 714806 - RNA, 19 nt, Homo sapiens
gguguuagggcgagugaau

SEQ ID NO: 714807 - RNA, 19 nt, Homo sapiens
guggaucccugacacaaaa

SEQ ID NO: 714808 - RNA, 19 nt, Homo sapiens
ggacagucuacgcgaugaa

SEQ ID NO: 714809 - RNA, 19 nt, Homo sapiens
caguaugucuuucauugcu

SEQ ID NO: 714810 - RNA, 19 nt, Homo sapiens
cuagaacacagcaccauca

SEQ ID NO: 714811 - RNA, 19 nt, Homo sapiens
ggaucgccaucugcuacaa

SEQ ID NO: 714812 - RNA, 19 nt, Homo sapiens
ccaucgagcaugugucaau

SEQ ID NO: 714813 - RNA, 19 nt, Homo sapiens
agaggucuaugauauugca

SEQ ID NO: 714814 - RNA, 19 nt, Homo sapiens
cagcugaucgcccaugaca

SEQ ID NO: 714815 - RNA, 19 nt, Homo sapiens
gagguggugauucuagaug

SEQ ID NO: 714816 - RNA, 19 nt, Homo sapiens
acacagcaccaucauuuac

SEQ ID NO: 714817 - RNA, 19 nt, Homo sapiens
gggacauguuugccucugu

SEQ ID NO: 714818 - RNA, 19 nt, Homo sapiens
ugacuggaaugagguggau

SEQ ID NO: 714819 - RNA, 19 nt, Homo sapiens
ggaggaguacaacaacaag

SEQ ID NO: 714820 - RNA, 19 nt, Homo sapiens
acaacugccuggagauacu

SEQ ID NO: 714821 - RNA, 19 nt, Homo sapiens
guggaggaguacaacaaca

SEQ ID NO: 714822 - RNA, 19 nt, Homo sapiens
ugaccuccgccaucuagaa

SEQ ID NO: 714823 - RNA, 19 nt, Homo sapiens
cuccuuugguuccucaauu

SEQ ID NO: 714824 - RNA, 19 nt, Homo sapiens
gcacccacuguuaccagaa

SEQ ID NO: 714825 - RNA, 19 nt, Homo sapiens
caagcaggacccuaacuac

SEQ ID NO: 714826 - RNA, 19 nt, Homo sapiens
aacacagcaccaucauuua

SEQ ID NO: 714827 - RNA, 19 nt, Homo sapiens
gaugaggagaguucagagu

SEQ ID NO: 714828 - RNA, 19 nt, Homo sapiens
gguggugauucuagauguc

SEQ ID NO: 714829 - RNA, 19 nt, Homo sapiens
ggagguggugauucuagau

SEQ ID NO: 714830 - RNA, 19 nt, Homo sapiens
uggagguggugauucuaga

SEQ ID NO: 714831 - RNA, 19 nt, Homo sapiens
acagcaccaucauuuacga

SEQ ID NO: 714832 - RNA, 19 nt, Homo sapiens
agaguucagaguuuauuug

SEQ ID NO: 714833 - RNA, 19 nt, Homo sapiens
gaccuccuuugacuggaau

SEQ ID NO: 714834 - RNA, 19 nt, Homo sapiens
ggaggguuggugaaacaga

SEQ ID NO: 714835 - RNA, 19 nt, Homo sapiens
ccuuuccucuucuccuuug

SEQ ID NO: 714836 - RNA, 19 nt, Homo sapiens
ggccuacacagcugaagga

SEQ ID NO: 714837 - RNA, 19 nt, Homo sapiens
ucagcuuguugguuuagau

SEQ ID NO: 714838 - RNA, 19 nt, Homo sapiens
acgaagacccacagcauca

SEQ ID NO: 714839 - RNA, 19 nt, Homo sapiens
uuacgaagacccacagcau

SEQ ID NO: 714840 - RNA, 19 nt, Homo sapiens
caccaucauuuacgaagac

SEQ ID NO: 714841 - RNA, 19 nt, Homo sapiens
agacagggcagguguuagg

SEQ ID NO: 714842 - RNA, 19 nt, Homo sapiens
uagaugaggagaguucaga

SEQ ID NO: 714843 - RNA, 19 nt, Homo sapiens
caacacauuucugcuaaua

SEQ ID NO: 714844 - RNA, 19 nt, Homo sapiens
ucacauuucucucacauuu

SEQ ID NO: 714845 - RNA, 19 nt, Homo sapiens
cuugaaagcuccaugauaa

SEQ ID NO: 714846 - RNA, 19 nt, Homo sapiens
gguuaaagcugacaacaug

SEQ ID NO: 714847 - RNA, 19 nt, Homo sapiens
gcaaguaagggcagaauuu

SEQ ID NO: 714848 - RNA, 19 nt, Homo sapiens
gaucggcguuuauuucgua

SEQ ID NO: 714849 - RNA, 19 nt, Homo sapiens
gcacagagaugggcagugu

SEQ ID NO: 714850 - RNA, 19 nt, Homo sapiens
caacaucuguaacuucuug

SEQ ID NO: 714851 - RNA, 19 nt, Homo sapiens
ggacacaauccaaaucaua

SEQ ID NO: 714852 - RNA, 19 nt, Homo sapiens
caagucauuugcaccuuua

SEQ ID NO: 714853 - RNA, 19 nt, Homo sapiens
gaaauagaguccuuaagac

SEQ ID NO: 714854 - RNA, 19 nt, Homo sapiens
gauuugaucuuccauaugg

SEQ ID NO: 714855 - RNA, 19 nt, Homo sapiens
aaacaucccagaauuauga

SEQ ID NO: 714856 - RNA, 19 nt, Homo sapiens
ugaaauagaguccuuaaga

SEQ ID NO: 714857 - RNA, 19 nt, Homo sapiens
ccaaagugcuggcauuaca

SEQ ID NO: 714858 - RNA, 19 nt, Homo sapiens
gaaauucaacagcagauug

SEQ ID NO: 714859 - RNA, 19 nt, Homo sapiens
gaaugugagaucagaauaa

SEQ ID NO: 714860 - RNA, 19 nt, Homo sapiens
ccauaaauguucuuucugu

SEQ ID NO: 714861 - RNA, 19 nt, Homo sapiens
ggagaucggcguuuauuuc

SEQ ID NO: 714862 - RNA, 19 nt, Homo sapiens
gcagacauuucaguacauu

SEQ ID NO: 714863 - RNA, 19 nt, Homo sapiens
aaguguaggugaauagaua

SEQ ID NO: 714864 - RNA, 19 nt, Homo sapiens
gaucucaggugugguguug

SEQ ID NO: 714865 - RNA, 19 nt, Homo sapiens
ggagagggccugugucugu

SEQ ID NO: 714866 - RNA, 19 nt, Homo sapiens
aguagagucuucauccuua

SEQ ID NO: 714867 - RNA, 19 nt, Homo sapiens
gugaaacaucccagaauua

SEQ ID NO: 714868 - RNA, 19 nt, Homo sapiens
ccaagucauuugcaccuuu

SEQ ID NO: 714869 - RNA, 19 nt, Homo sapiens
gacaacaucuguaacuucu

SEQ ID NO: 714870 - RNA, 19 nt, Homo sapiens
gagagggccugugucugua

SEQ ID NO: 714871 - RNA, 19 nt, Homo sapiens
gcucaugcccaacacauuu

SEQ ID NO: 714872 - RNA, 19 nt, Homo sapiens
gacacaauccaaaucauaa

SEQ ID NO: 714873 - RNA, 19 nt, Homo sapiens
caacaugcccaagucauuu

SEQ ID NO: 714874 - RNA, 19 nt, Homo sapiens
gcacuaugcuacccucuac

SEQ ID NO: 714875 - RNA, 19 nt, Homo sapiens
augaugagcugccuccaua

SEQ ID NO: 714876 - RNA, 19 nt, Homo sapiens
gaagguuuguugcuguguu

SEQ ID NO: 714877 - RNA, 19 nt, Homo sapiens
gcacccaguucucacaugu

SEQ ID NO: 714878 - RNA, 19 nt, Homo sapiens
gcccauaaauguucuuucu

SEQ ID NO: 714879 - RNA, 19 nt, Homo sapiens
gagugaacuuggaaucuug

SEQ ID NO: 714880 - RNA, 19 nt, Homo sapiens
cgagagacuuuccaucuag

SEQ ID NO: 714881 - RNA, 19 nt, Homo sapiens
ugugaaacaucccagaauu

SEQ ID NO: 714882 - RNA, 19 nt, Homo sapiens
ugaauuggauuugaucuuc

SEQ ID NO: 714883 - RNA, 19 nt, Homo sapiens
uggaaacucuggauaagug

SEQ ID NO: 714884 - RNA, 19 nt, Homo sapiens
caaaaccccugaugucauu

SEQ ID NO: 714885 - RNA, 19 nt, Homo sapiens
gcaagcacgucuggaaaca

SEQ ID NO: 714886 - RNA, 19 nt, Homo sapiens
gaucaaguauuggccugaa

SEQ ID NO: 714887 - RNA, 19 nt, Homo sapiens
gaacccauuuugagccuua

SEQ ID NO: 714888 - RNA, 19 nt, Homo sapiens
ggagugcuguggugcaauc

SEQ ID NO: 714889 - RNA, 19 nt, Homo sapiens
gaucucaacaucaaaguuc

SEQ ID NO: 714890 - RNA, 19 nt, Homo sapiens
gagagcagaagguuuguug

SEQ ID NO: 714891 - RNA, 19 nt, Homo sapiens
caugagagcagaagguuug

SEQ ID NO: 714892 - RNA, 19 nt, Homo sapiens
agacaggguuucaccaugu

SEQ ID NO: 714893 - RNA, 19 nt, Homo sapiens
ucgagagacuuuccaucua

SEQ ID NO: 714894 - RNA, 19 nt, Homo sapiens
ccagcuaauuguuguaugu

SEQ ID NO: 714895 - RNA, 19 nt, Homo sapiens
gaagggauuccuauugaca

SEQ ID NO: 714896 - RNA, 19 nt, Homo sapiens
cccaacacauuucugcuaa

SEQ ID NO: 714897 - RNA, 19 nt, Homo sapiens
ccagaauccuuugguauag

SEQ ID NO: 714898 - RNA, 19 nt, Homo sapiens
ugaaacaucccagaauuau

SEQ ID NO: 714899 - RNA, 19 nt, Homo sapiens
ggcccugccuuccucagua

SEQ ID NO: 714900 - RNA, 19 nt, Homo sapiens
gauccucacucuugaaagc

SEQ ID NO: 714901 - RNA, 19 nt, Homo sapiens
ggaaacaaacaugaaugaa

SEQ ID NO: 714902 - RNA, 19 nt, Homo sapiens
guaggugaauagauaucaa

SEQ ID NO: 714903 - RNA, 19 nt, Homo sapiens
gcuguguugugaaugauga

SEQ ID NO: 714904 - RNA, 19 nt, Homo sapiens
gaaacaucccagaauuaug

SEQ ID NO: 714905 - RNA, 19 nt, Homo sapiens
ccagaauccuuuuguguuu

SEQ ID NO: 714906 - RNA, 19 nt, Homo sapiens
cuggauaaguguuucgaaa

SEQ ID NO: 714907 - RNA, 19 nt, Homo sapiens
uuaugacucuucccaaguu

SEQ ID NO: 714908 - RNA, 19 nt, Homo sapiens
aagcauuucuccugucuca

SEQ ID NO: 714909 - RNA, 19 nt, Homo sapiens
uggauaaggugcacuacau

SEQ ID NO: 714910 - RNA, 19 nt, Homo sapiens
ggauaaguguuucgaaaau

SEQ ID NO: 714911 - RNA, 19 nt, Homo sapiens
guugcuguguugugaauga

SEQ ID NO: 714912 - RNA, 19 nt, Homo sapiens
gacaggguuucaccauguu

SEQ ID NO: 714913 - RNA, 19 nt, Homo sapiens
ccaccaccaugcccagcua

SEQ ID NO: 714914 - RNA, 19 nt, Homo sapiens
gaggguggaaguuugauug

SEQ ID NO: 714915 - RNA, 19 nt, Homo sapiens
gcagauuguucgagagacu

SEQ ID NO: 714916 - RNA, 19 nt, Homo sapiens
ugucagggccaccuuguuu

SEQ ID NO: 714917 - RNA, 19 nt, Homo sapiens
guuaccgccucaugaagaa

SEQ ID NO: 714918 - RNA, 19 nt, Homo sapiens
cccagaaccuccucacuag

SEQ ID NO: 714919 - RNA, 19 nt, Homo sapiens
ggcugugucugcugugaaa

SEQ ID NO: 714920 - RNA, 19 nt, Homo sapiens
agagugaacuuggaaucuu

SEQ ID NO: 714921 - RNA, 19 nt, Homo sapiens
gcuacccucuacuuuguau

SEQ ID NO: 714922 - RNA, 19 nt, Homo sapiens
agagggaaguguaggugaa

SEQ ID NO: 714923 - RNA, 19 nt, Homo sapiens
acacauuucugcuaauagg

SEQ ID NO: 714924 - RNA, 19 nt, Homo sapiens
ggaaacagaacccauuuug

SEQ ID NO: 714925 - RNA, 19 nt, Homo sapiens
gucugaggaucaaguauug

SEQ ID NO: 714926 - RNA, 19 nt, Homo sapiens
gaaaaugugugugaauugg

SEQ ID NO: 714927 - RNA, 19 nt, Homo sapiens
ugacucuucccaaguuuaa

SEQ ID NO: 714928 - RNA, 19 nt, Homo sapiens
gcccaacacauuucugcua

SEQ ID NO: 714929 - RNA, 19 nt, Homo sapiens
gagagacuuuccaucuagu

SEQ ID NO: 714930 - RNA, 19 nt, Homo sapiens
gaguagagucuucauccuu

SEQ ID NO: 714931 - RNA, 19 nt, Homo sapiens
uggaugcucccaaggguua

SEQ ID NO: 714932 - RNA, 19 nt, Homo sapiens
ccucggaacaucaacauug

SEQ ID NO: 714933 - RNA, 19 nt, Homo sapiens
uggcagacauuucaguaca

SEQ ID NO: 714934 - RNA, 19 nt, Homo sapiens
gcugacaacaugugaaaca

SEQ ID NO: 714935 - RNA, 19 nt, Homo sapiens
uguggugaguggcaaguaa

SEQ ID NO: 714936 - RNA, 19 nt, Homo sapiens
ucaacaugcccaagucauu

SEQ ID NO: 714937 - RNA, 19 nt, Homo sapiens
gaagacuguuuggcaugga

SEQ ID NO: 714938 - RNA, 19 nt, Homo sapiens
aaccguggcuggcaaagau

SEQ ID NO: 714939 - RNA, 19 nt, Homo sapiens
gagagggacccaccacaca

SEQ ID NO: 714940 - RNA, 19 nt, Homo sapiens
caccaugcccagcuaauug

SEQ ID NO: 714941 - RNA, 19 nt, Homo sapiens
gggcagaauuuuaggagaa

SEQ ID NO: 714942 - RNA, 19 nt, Homo sapiens
ggccugaaauagaguccuu

SEQ ID NO: 714943 - RNA, 19 nt, Homo sapiens
gcaaagcgaccuaaaauua

SEQ ID NO: 714944 - RNA, 19 nt, Homo sapiens
ucgaagagcuacagaauau

SEQ ID NO: 714945 - RNA, 19 nt, Homo sapiens
gaaaguaacauacaguuca

SEQ ID NO: 714946 - RNA, 19 nt, Homo sapiens
gaacacauagagugguuua

SEQ ID NO: 714947 - RNA, 19 nt, Homo sapiens
gaccagagcuucggauuca

SEQ ID NO: 714948 - RNA, 19 nt, Homo sapiens
gcaguuagccacaguaaau

SEQ ID NO: 714949 - RNA, 19 nt, Homo sapiens
gaugaaggcuaugacaauu

SEQ ID NO: 714950 - RNA, 19 nt, Homo sapiens
gggcaugaaaguugaauua

SEQ ID NO: 714951 - RNA, 19 nt, Homo sapiens
acagaagguugaacacaua

SEQ ID NO: 714952 - RNA, 19 nt, Homo sapiens
ucauggagcuggugacuug

SEQ ID NO: 714953 - RNA, 19 nt, Homo sapiens
gaauuaagcacaguaaaug

SEQ ID NO: 714954 - RNA, 19 nt, Homo sapiens
gaacugaggagacuuccaa

SEQ ID NO: 714955 - RNA, 19 nt, Homo sapiens
uaaagaagcaccugaaaca

SEQ ID NO: 714956 - RNA, 19 nt, Homo sapiens
gcaugaaaguugaauuaag

SEQ ID NO: 714957 - RNA, 19 nt, Homo sapiens
ugaaggcuaugacaauuau

SEQ ID NO: 714958 - RNA, 19 nt, Homo sapiens
gauaagcagucuguucgaa

SEQ ID NO: 714959 - RNA, 19 nt, Homo sapiens
cagaauaugcuccaaagaa

SEQ ID NO: 714960 - RNA, 19 nt, Homo sapiens
guaaauguacgaacaacaa

SEQ ID NO: 714961 - RNA, 19 nt, Homo sapiens
ugaugaugguucagaauuu

SEQ ID NO: 714962 - RNA, 19 nt, Homo sapiens
gauggcaguuacuaaagaa

SEQ ID NO: 714963 - RNA, 19 nt, Homo sapiens
agaaacaccuggagagcuu

SEQ ID NO: 714964 - RNA, 19 nt, Homo sapiens
caagaaagauaagcagucu

SEQ ID NO: 714965 - RNA, 19 nt, Homo sapiens
gaugaugguucagaauuuc

SEQ ID NO: 714966 - RNA, 19 nt, Homo sapiens
caauuaagaccauggaaau

SEQ ID NO: 714967 - RNA, 19 nt, Homo sapiens
cacauagagugguuuagaa

SEQ ID NO: 714968 - RNA, 19 nt, Homo sapiens
gaacaaccccuucagaaug

SEQ ID NO: 714969 - RNA, 19 nt, Homo sapiens
gaaacagacacaucaccuu

SEQ ID NO: 714970 - RNA, 19 nt, Homo sapiens
gaauaugcuccaaagaaga

SEQ ID NO: 714971 - RNA, 19 nt, Homo sapiens
caugaaaguugaauuaagc

SEQ ID NO: 714972 - RNA, 19 nt, Homo sapiens
aaagacuuguuaggcauua

SEQ ID NO: 714973 - RNA, 19 nt, Homo sapiens
agaauaugcuccaaagaag

SEQ ID NO: 714974 - RNA, 19 nt, Homo sapiens
acccauaucuuaguguuaa

SEQ ID NO: 714975 - RNA, 19 nt, Homo sapiens
acacaucaccuucacuuug

SEQ ID NO: 714976 - RNA, 19 nt, Homo sapiens
uuaagggcaugaaaguuga

SEQ ID NO: 714977 - RNA, 19 nt, Homo sapiens
ugauggcaguuacuaaaga

SEQ ID NO: 714978 - RNA, 19 nt, Homo sapiens
caugauggcaguuacuaaa

SEQ ID NO: 714979 - RNA, 19 nt, Homo sapiens
cacaguaaauguacgaaca

SEQ ID NO: 714980 - RNA, 19 nt, Homo sapiens
gagauggauauuacaacua

SEQ ID NO: 714981 - RNA, 19 nt, Homo sapiens
aaacccauaucuuaguguu

SEQ ID NO: 714982 - RNA, 19 nt, Homo sapiens
uaugaaaguugccagaucu

SEQ ID NO: 714983 - RNA, 19 nt, Homo sapiens
gaagagcuacagaauaugc

SEQ ID NO: 714984 - RNA, 19 nt, Homo sapiens
gagcuucggauucaguuug

SEQ ID NO: 714985 - RNA, 19 nt, Homo sapiens
agugugaucuguagcaaga

SEQ ID NO: 714986 - RNA, 19 nt, Homo sapiens
ucaaacaauuagagaugga

SEQ ID NO: 714987 - RNA, 19 nt, Homo sapiens
ucaauuaagaccauggaaa

SEQ ID NO: 714988 - RNA, 19 nt, Homo sapiens
ucaguuugaugaaggcuau

SEQ ID NO: 714989 - RNA, 19 nt, Homo sapiens
caaaagaagaccacuuaaa

SEQ ID NO: 714990 - RNA, 19 nt, Homo sapiens
ggaguucccaauuaacaau

SEQ ID NO: 714991 - RNA, 19 nt, Homo sapiens
aaagauaagcagucuguuc

SEQ ID NO: 714992 - RNA, 19 nt, Homo sapiens
cacaucaccuucacuuugg

SEQ ID NO: 714993 - RNA, 19 nt, Homo sapiens
aagaagcaccugaaacaga

SEQ ID NO: 714994 - RNA, 19 nt, Homo sapiens
gauaagcaaacaaccaagu

SEQ ID NO: 714995 - RNA, 19 nt, Homo sapiens
cagauucucucccuuuuga

SEQ ID NO: 714996 - RNA, 19 nt, Homo sapiens
cgauuaugcuacucacugu

SEQ ID NO: 714997 - RNA, 19 nt, Homo sapiens
gccaggagaagacggauga

SEQ ID NO: 714998 - RNA, 19 nt, Homo sapiens
agaaagauaagcagucugu

SEQ ID NO: 714999 - RNA, 19 nt, Homo sapiens
acacauagagugguuuaga

SEQ ID NO: 715000 - RNA, 19 nt, Homo sapiens
ggagagcuuuccaaaacaa

SEQ ID NO: 715001 - RNA, 19 nt, Homo sapiens
ugaugaugaugguucagaa

SEQ ID NO: 715002 - RNA, 19 nt, Homo sapiens
uacagaauaugcuccaaag

SEQ ID NO: 715003 - RNA, 19 nt, Homo sapiens
ugugaucuguagcaagaaa

SEQ ID NO: 715004 - RNA, 19 nt, Homo sapiens
ggcaugaaaguugaauuaa

SEQ ID NO: 715005 - RNA, 19 nt, Homo sapiens
uaagcagucuguucgaacu

SEQ ID NO: 715006 - RNA, 19 nt, Homo sapiens
gaagguugaacacauagag

SEQ ID NO: 715007 - RNA, 19 nt, Homo sapiens
gacaugauggcaguuacua

SEQ ID NO: 715008 - RNA, 19 nt, Homo sapiens
ugaugaaggcuaugacaau

SEQ ID NO: 715009 - RNA, 19 nt, Homo sapiens
aaaguugccagaucugcua

SEQ ID NO: 715010 - RNA, 19 nt, Homo sapiens
cuacagaauaugcuccaaa

SEQ ID NO: 715011 - RNA, 19 nt, Homo sapiens
acacuuggcaggcuucgaa

SEQ ID NO: 715012 - RNA, 19 nt, Homo sapiens
gacuuguuaggcauuauua

SEQ ID NO: 715013 - RNA, 19 nt, Homo sapiens
agagauggauauuacaacu

SEQ ID NO: 715014 - RNA, 19 nt, Homo sapiens
acauagagugguuuagaaa

SEQ ID NO: 715015 - RNA, 19 nt, Homo sapiens
ggaccaauucgccacuuca

SEQ ID NO: 715016 - RNA, 19 nt, Homo sapiens
aacagaagguugaacacau

SEQ ID NO: 715017 - RNA, 19 nt, Homo sapiens
gggcacagagagaugcaaa

SEQ ID NO: 715018 - RNA, 19 nt, Homo sapiens
gcuccaaagaagagaauug

SEQ ID NO: 715019 - RNA, 19 nt, Homo sapiens
acagucagguaccgcaguu

SEQ ID NO: 715020 - RNA, 19 nt, Homo sapiens
caaaagaggggaaacuaug

SEQ ID NO: 715021 - RNA, 19 nt, Homo sapiens
agacacaucaccuucacuu

SEQ ID NO: 715022 - RNA, 19 nt, Homo sapiens
ccaagacagugaaaaggaa

SEQ ID NO: 715023 - RNA, 19 nt, Homo sapiens
uuaaacagaagguugaaca

SEQ ID NO: 715024 - RNA, 19 nt, Homo sapiens
cagaucugcuacagcuaga

SEQ ID NO: 715025 - RNA, 19 nt, Homo sapiens
uggcagauucucucccuuu

SEQ ID NO: 715026 - RNA, 19 nt, Homo sapiens
acaguucaauuaagaccau

SEQ ID NO: 715027 - RNA, 19 nt, Homo sapiens
gaugaugaugguucagaau

SEQ ID NO: 715028 - RNA, 19 nt, Homo sapiens
ggcaguuacuaaagaagca

SEQ ID NO: 715029 - RNA, 19 nt, Homo sapiens
gagaugcaaagcgaccuaa

SEQ ID NO: 715030 - RNA, 19 nt, Homo sapiens
gcacagagagaugcaaagc

SEQ ID NO: 715031 - RNA, 19 nt, Homo sapiens
uaagcaaacaaccaaguca

SEQ ID NO: 715032 - RNA, 19 nt, Homo sapiens
auuaagggcaugaaaguug

SEQ ID NO: 715033 - RNA, 19 nt, Homo sapiens
aaacagaagguugaacaca

SEQ ID NO: 715034 - RNA, 19 nt, Homo sapiens
gaaacaccuggagagcuuu

SEQ ID NO: 715035 - RNA, 19 nt, Homo sapiens
gacacaucaccuucacuuu

SEQ ID NO: 715036 - RNA, 19 nt, Homo sapiens
gauaugaaaguugccagau

SEQ ID NO: 715037 - RNA, 19 nt, Homo sapiens
gaaagauaagcagucuguu

SEQ ID NO: 715038 - RNA, 19 nt, Homo sapiens
cugaggagacuuccaagga

SEQ ID NO: 715039 - RNA, 19 nt, Homo sapiens
guugaauuaagcacaguaa

SEQ ID NO: 715040 - RNA, 19 nt, Homo sapiens
cauagagugguuuagaaau

SEQ ID NO: 715041 - RNA, 19 nt, Homo sapiens
uugaacacauagagugguu

SEQ ID NO: 715042 - RNA, 19 nt, Homo sapiens
augaaggcuaugacaauua

SEQ ID NO: 715043 - RNA, 19 nt, Homo sapiens
caacaggccugacuugaua

SEQ ID NO: 715044 - RNA, 19 nt, Homo sapiens
ggaaggaggugaugaaaca

SEQ ID NO: 715045 - RNA, 19 nt, Homo sapiens
gaagaaacaacaggaauua

SEQ ID NO: 715046 - RNA, 19 nt, Homo sapiens
ccaaagguuucucauguua

SEQ ID NO: 715047 - RNA, 19 nt, Homo sapiens
gacaagaucuucccagcua

SEQ ID NO: 715048 - RNA, 19 nt, Homo sapiens
gaaaugcccuaucugcaaa

SEQ ID NO: 715049 - RNA, 19 nt, Homo sapiens
gaagacauccugguuguua

SEQ ID NO: 715050 - RNA, 19 nt, Homo sapiens
gaaacacgaugucaugaau

SEQ ID NO: 715051 - RNA, 19 nt, Homo sapiens
gaauauggguaaaucagaa

SEQ ID NO: 715052 - RNA, 19 nt, Homo sapiens
gaaugaaacuacugcaaug

SEQ ID NO: 715053 - RNA, 19 nt, Homo sapiens
gcaaagagcucagaaaucc

SEQ ID NO: 715054 - RNA, 19 nt, Homo sapiens
cagaagauguccucagaaa

SEQ ID NO: 715055 - RNA, 19 nt, Homo sapiens
ccaaggaugaugaguauua

SEQ ID NO: 715056 - RNA, 19 nt, Homo sapiens
gaagacaacccgugaguau

SEQ ID NO: 715057 - RNA, 19 nt, Homo sapiens
ucaaugcgcucuauccaaa

SEQ ID NO: 715058 - RNA, 19 nt, Homo sapiens
ggaaacccauauucuggua

SEQ ID NO: 715059 - RNA, 19 nt, Homo sapiens
gaucugaaggucacuguua

SEQ ID NO: 715060 - RNA, 19 nt, Homo sapiens
gaaggaggcgcaagacaaa

SEQ ID NO: 715061 - RNA, 19 nt, Homo sapiens
cuacagagcaucaauaaga

SEQ ID NO: 715062 - RNA, 19 nt, Homo sapiens
agacaacccgugaguauua

SEQ ID NO: 715063 - RNA, 19 nt, Homo sapiens
ucgcauaacucuagcugua

SEQ ID NO: 715064 - RNA, 19 nt, Homo sapiens
gaaacaacaggaauuaaug

SEQ ID NO: 715065 - RNA, 19 nt, Homo sapiens
gcugucaacucaagagaaa

SEQ ID NO: 715066 - RNA, 19 nt, Homo sapiens
guaaauccuuucuuaaugg

SEQ ID NO: 715067 - RNA, 19 nt, Homo sapiens
gguccgagguugagaauuc

SEQ ID NO: 715068 - RNA, 19 nt, Homo sapiens
gacgucacaugucauuaua

SEQ ID NO: 715069 - RNA, 19 nt, Homo sapiens
ggaguuaugucacugaucu

SEQ ID NO: 715070 - RNA, 19 nt, Homo sapiens
gcaggaaguccaauucaaa

SEQ ID NO: 715071 - RNA, 19 nt, Homo sapiens
cuacagagacuuccacaaa

SEQ ID NO: 715072 - RNA, 19 nt, Homo sapiens
ccaaguagcugggauuaca

SEQ ID NO: 715073 - RNA, 19 nt, Homo sapiens
gcccaaggaugaugaguau

SEQ ID NO: 715074 - RNA, 19 nt, Homo sapiens
agacagagcugcuucaacu

SEQ ID NO: 715075 - RNA, 19 nt, Homo sapiens
caaaugaagcagaaugaaa

SEQ ID NO: 715076 - RNA, 19 nt, Homo sapiens
agucacagcuccuugcuuu

SEQ ID NO: 715077 - RNA, 19 nt, Homo sapiens
gagucaagauccugccuaa

SEQ ID NO: 715078 - RNA, 19 nt, Homo sapiens
gaccaccucuuucucaguu

SEQ ID NO: 715079 - RNA, 19 nt, Homo sapiens
ugaaagaacagaaggacua

SEQ ID NO: 715080 - RNA, 19 nt, Homo sapiens
gaaguccaauucaaagcuu

SEQ ID NO: 715081 - RNA, 19 nt, Homo sapiens
ggauuggauuggcaucuuu

SEQ ID NO: 715082 - RNA, 19 nt, Homo sapiens
ggguaaaucagaauaauga

SEQ ID NO: 715083 - RNA, 19 nt, Homo sapiens
uaccaaagguuucucaugu

SEQ ID NO: 715084 - RNA, 19 nt, Homo sapiens
ucucucaggucaucuuuaa

SEQ ID NO: 715085 - RNA, 19 nt, Homo sapiens
gauccugccuaaccugaaa

SEQ ID NO: 715086 - RNA, 19 nt, Homo sapiens
ggacgucacaugucauuau

SEQ ID NO: 715087 - RNA, 19 nt, Homo sapiens
ggaguuaugcccuagacua

SEQ ID NO: 715088 - RNA, 19 nt, Homo sapiens
cagagaagcagaucuuuga

SEQ ID NO: 715089 - RNA, 19 nt, Homo sapiens
gagcaucaauaagaaguug

SEQ ID NO: 715090 - RNA, 19 nt, Homo sapiens
caacaaggagcuuugcaaa

SEQ ID NO: 715091 - RNA, 19 nt, Homo sapiens
agacaggguuucacuaugu

SEQ ID NO: 715092 - RNA, 19 nt, Homo sapiens
gcagauugcucaguuacau

SEQ ID NO: 715093 - RNA, 19 nt, Homo sapiens
ccaccucuuucucaguuua

SEQ ID NO: 715094 - RNA, 19 nt, Homo sapiens
ggacugaacaaauggaaau

SEQ ID NO: 715095 - RNA, 19 nt, Homo sapiens
ugccuaaccugaaauuauu

SEQ ID NO: 715096 - RNA, 19 nt, Homo sapiens
cuaaugugguugggaguua

SEQ ID NO: 715097 - RNA, 19 nt, Homo sapiens
gaacaaauggaaauaacuc

SEQ ID NO: 715098 - RNA, 19 nt, Homo sapiens
gacaggaaguauuguuuca

SEQ ID NO: 715099 - RNA, 19 nt, Homo sapiens
ccacugccauucaaaguca

SEQ ID NO: 715100 - RNA, 19 nt, Homo sapiens
ccauugaccuaaacaacaa

SEQ ID NO: 715101 - RNA, 19 nt, Homo sapiens
cuacugggcuuucccuaau

SEQ ID NO: 715102 - RNA, 19 nt, Homo sapiens
caacaaaucagcuaaacag

SEQ ID NO: 715103 - RNA, 19 nt, Homo sapiens
gagacaggguuucacuaug

SEQ ID NO: 715104 - RNA, 19 nt, Homo sapiens
aagcgauucucaugccuua

SEQ ID NO: 715105 - RNA, 19 nt, Homo sapiens
ucucugauauuuccuaugu

SEQ ID NO: 715106 - RNA, 19 nt, Homo sapiens
gagccaaccuggguauuca

SEQ ID NO: 715107 - RNA, 19 nt, Homo sapiens
aacacgaugucaugaauaa

SEQ ID NO: 715108 - RNA, 19 nt, Homo sapiens
aggaggugaugaaacauua

SEQ ID NO: 715109 - RNA, 19 nt, Homo sapiens
ucagggagaucaagauaag

SEQ ID NO: 715110 - RNA, 19 nt, Homo sapiens
gaacaaaaccagaagaugu

SEQ ID NO: 715111 - RNA, 19 nt, Homo sapiens
gcauaacucuagcuguauc

SEQ ID NO: 715112 - RNA, 19 nt, Homo sapiens
ccucuuggauguauacaga

SEQ ID NO: 715113 - RNA, 19 nt, Homo sapiens
gaacugaaagugaaagaac

SEQ ID NO: 715114 - RNA, 19 nt, Homo sapiens
caaguauuccuuuccaauu

SEQ ID NO: 715115 - RNA, 19 nt, Homo sapiens
ggaaguauuguuucaguca

SEQ ID NO: 715116 - RNA, 19 nt, Homo sapiens
uagcuucuaccaugaguua

SEQ ID NO: 715117 - RNA, 19 nt, Homo sapiens
gaaacuacugcaaugaaga

SEQ ID NO: 715118 - RNA, 19 nt, Homo sapiens
gagcaaguauuccuuucca

SEQ ID NO: 715119 - RNA, 19 nt, Homo sapiens
gaguuaugcccuagacuaa

SEQ ID NO: 715120 - RNA, 19 nt, Homo sapiens
ccaaagugcugggauuaca

SEQ ID NO: 715121 - RNA, 19 nt, Homo sapiens
gagugagaacgaaauuaua

SEQ ID NO: 715122 - RNA, 19 nt, Homo sapiens
cuacugcaaugaagaaaca

SEQ ID NO: 715123 - RNA, 19 nt, Homo sapiens
gaagauguccucagaaaau

SEQ ID NO: 715124 - RNA, 19 nt, Homo sapiens
gaaggacuauugggagaca

SEQ ID NO: 715125 - RNA, 19 nt, Homo sapiens
gcaaguauuccuuuccaau

SEQ ID NO: 715126 - RNA, 19 nt, Homo sapiens
gcaguuagagcagcugaaa

SEQ ID NO: 715127 - RNA, 19 nt, Homo sapiens
agaaagaaauggagaagcu

SEQ ID NO: 715128 - RNA, 19 nt, Homo sapiens
ccgaggcccugacuucuug

SEQ ID NO: 715129 - RNA, 19 nt, Homo sapiens
gaggagaccaucaaagauc

SEQ ID NO: 715130 - RNA, 19 nt, Homo sapiens
agucagcccuugaguguau

SEQ ID NO: 715131 - RNA, 19 nt, Homo sapiens
ugaguuauaugagucaaga

SEQ ID NO: 715132 - RNA, 19 nt, Homo sapiens
ugaagaaacaacaggaauu

SEQ ID NO: 715133 - RNA, 19 nt, Homo sapiens
gaaagaacagaaggacuau

SEQ ID NO: 715134 - RNA, 19 nt, Homo sapiens
gaaagugaaagaacagaag

SEQ ID NO: 715135 - RNA, 19 nt, Homo sapiens
gcccuagacuaacuguauu

SEQ ID NO: 715136 - RNA, 19 nt, Homo sapiens
cacgugaucuguccacuuc

SEQ ID NO: 715137 - RNA, 19 nt, Homo sapiens
ugccuuagccucccaagua

SEQ ID NO: 715138 - RNA, 19 nt, Homo sapiens
ggaagacaacccgugagua

SEQ ID NO: 715139 - RNA, 19 nt, Homo sapiens
ggauuggcaucuuuagagu

SEQ ID NO: 715140 - RNA, 19 nt, Homo sapiens
gcccugacuucuugcugua

SEQ ID NO: 715141 - RNA, 19 nt, Homo sapiens
gguuagcacuuucuacucu

SEQ ID NO: 715142 - RNA, 19 nt, Homo sapiens
gcccuugaguguauuuguu

SEQ ID NO: 715143 - RNA, 19 nt, Homo sapiens
ggaccagauuuccuaauua

SEQ ID NO: 715144 - RNA, 19 nt, Homo sapiens
gaccagauuuccuaauuaa

SEQ ID NO: 715145 - RNA, 19 nt, Homo sapiens
ggaccaacauucucuaaga

SEQ ID NO: 715146 - RNA, 19 nt, Homo sapiens
gaauauugcucuuugugaa

SEQ ID NO: 715147 - RNA, 19 nt, Homo sapiens
gauaaagucuguguucuga

SEQ ID NO: 715148 - RNA, 19 nt, Homo sapiens
ccagagaaauguacugaaa

SEQ ID NO: 715149 - RNA, 19 nt, Homo sapiens
ggaaagaacugagagaaag

SEQ ID NO: 715150 - RNA, 19 nt, Homo sapiens
guugguaggugcuccauua

SEQ ID NO: 715151 - RNA, 19 nt, Homo sapiens
gaacugaauaacagacuua

SEQ ID NO: 715152 - RNA, 19 nt, Homo sapiens
guaaauguguuguggcaaa

SEQ ID NO: 715153 - RNA, 19 nt, Homo sapiens
aaacagggcucaguuauuc

SEQ ID NO: 715154 - RNA, 19 nt, Homo sapiens
ugacaagcauucccuauug

SEQ ID NO: 715155 - RNA, 19 nt, Homo sapiens
gaagagaugauacuuacaa

SEQ ID NO: 715156 - RNA, 19 nt, Homo sapiens
guuaugaguucccuaauau

SEQ ID NO: 715157 - RNA, 19 nt, Homo sapiens
gaaagucuguguuacugau

SEQ ID NO: 715158 - RNA, 19 nt, Homo sapiens
gaagggaccagauuuccua

SEQ ID NO: 715159 - RNA, 19 nt, Homo sapiens
gggaccagauuuccuaauu

SEQ ID NO: 715160 - RNA, 19 nt, Homo sapiens
aaucagaagugcuccuaua

SEQ ID NO: 715161 - RNA, 19 nt, Homo sapiens
ggacuucaaauguguaauu

SEQ ID NO: 715162 - RNA, 19 nt, Homo sapiens
gaagaagacaaacaucuau

SEQ ID NO: 715163 - RNA, 19 nt, Homo sapiens
agacaaacaucuaucuuuc

SEQ ID NO: 715164 - RNA, 19 nt, Homo sapiens
gcaaauuaauguguuggaa

SEQ ID NO: 715165 - RNA, 19 nt, Homo sapiens
ccagaagaguguuauccua

SEQ ID NO: 715166 - RNA, 19 nt, Homo sapiens
caacacuucuccugcuauu

SEQ ID NO: 715167 - RNA, 19 nt, Homo sapiens
caacggaucaauagauaaa

SEQ ID NO: 715168 - RNA, 19 nt, Homo sapiens
gguaggugcuccauuacaa

SEQ ID NO: 715169 - RNA, 19 nt, Homo sapiens
cagaagugcuccuauauac

SEQ ID NO: 715170 - RNA, 19 nt, Homo sapiens
ggacauccaccauaaggaa

SEQ ID NO: 715171 - RNA, 19 nt, Homo sapiens
caaugaauguguaguaucu

SEQ ID NO: 715172 - RNA, 19 nt, Homo sapiens
ggagugucauuaccuguga

SEQ ID NO: 715173 - RNA, 19 nt, Homo sapiens
gagaugauacuuacaagga

SEQ ID NO: 715174 - RNA, 19 nt, Homo sapiens
aaacugagcccuauagcaa

SEQ ID NO: 715175 - RNA, 19 nt, Homo sapiens
gugcuuaagucaaugaaug

SEQ ID NO: 715176 - RNA, 19 nt, Homo sapiens
gugaagagaugauacuuac

SEQ ID NO: 715177 - RNA, 19 nt, Homo sapiens
ggaaaccagaagaguguua

SEQ ID NO: 715178 - RNA, 19 nt, Homo sapiens
gcuaaacaauaccuggaaa

SEQ ID NO: 715179 - RNA, 19 nt, Homo sapiens
gaacugagagaaagagcaa

SEQ ID NO: 715180 - RNA, 19 nt, Homo sapiens
ccugugagcugacugaaug

SEQ ID NO: 715181 - RNA, 19 nt, Homo sapiens
ugaguucccuaauauauuc

SEQ ID NO: 715182 - RNA, 19 nt, Homo sapiens
caaugcaccuugcugaaug

SEQ ID NO: 715183 - RNA, 19 nt, Homo sapiens
gaauauuagucucuucuac

SEQ ID NO: 715184 - RNA, 19 nt, Homo sapiens
gcucuugggucgucucaug

SEQ ID NO: 715185 - RNA, 19 nt, Homo sapiens
gaaagaacugagagaaaga

SEQ ID NO: 715186 - RNA, 19 nt, Homo sapiens
gcuccuauauaccuaaaug

SEQ ID NO: 715187 - RNA, 19 nt, Homo sapiens
gggaaaagcuccuccucua

SEQ ID NO: 715188 - RNA, 19 nt, Homo sapiens
ggaauauugcucuuuguga

SEQ ID NO: 715189 - RNA, 19 nt, Homo sapiens
guaaucaggacuucaaaug

SEQ ID NO: 715190 - RNA, 19 nt, Homo sapiens
ccauaucacuguaaagaag

SEQ ID NO: 715191 - RNA, 19 nt, Homo sapiens
uaaagucuguguucugagu

SEQ ID NO: 715192 - RNA, 19 nt, Homo sapiens
uguuaugaguucccuaaua

SEQ ID NO: 715193 - RNA, 19 nt, Homo sapiens
uguuaaagcucaaauacug

SEQ ID NO: 715194 - RNA, 19 nt, Homo sapiens
gggauuugcuaaacaauac

SEQ ID NO: 715195 - RNA, 19 nt, Homo sapiens
aauguguuguggcaaauua

SEQ ID NO: 715196 - RNA, 19 nt, Homo sapiens
gggcucaguuauucauuug

SEQ ID NO: 715197 - RNA, 19 nt, Homo sapiens
ucagaagugcuccuauaua

SEQ ID NO: 715198 - RNA, 19 nt, Homo sapiens
ucacggaaacauuuaauug

SEQ ID NO: 715199 - RNA, 19 nt, Homo sapiens
gaccaacauucucuaagau

SEQ ID NO: 715200 - RNA, 19 nt, Homo sapiens
aaucaggacuucaaaugug

SEQ ID NO: 715201 - RNA, 19 nt, Homo sapiens
uccaacggaucaauagaua

SEQ ID NO: 715202 - RNA, 19 nt, Homo sapiens
uggugaaacuuacacagua

SEQ ID NO: 715203 - RNA, 19 nt, Homo sapiens
ccaacgugcuguuccauuc

SEQ ID NO: 715204 - RNA, 19 nt, Homo sapiens
cagaagaguguuauccuaa

SEQ ID NO: 715205 - RNA, 19 nt, Homo sapiens
ccacacagaagagacaaua

SEQ ID NO: 715206 - RNA, 19 nt, Homo sapiens
guuggaauauugcucuuug

SEQ ID NO: 715207 - RNA, 19 nt, Homo sapiens
gaugcuacuuguugguaaa

SEQ ID NO: 715208 - RNA, 19 nt, Homo sapiens
ggccggaccucuucaucuu

SEQ ID NO: 715209 - RNA, 19 nt, Homo sapiens
ccaugucccuggugaaugu

SEQ ID NO: 715210 - RNA, 19 nt, Homo sapiens
ggagaggaccgagcuauuc

SEQ ID NO: 715211 - RNA, 19 nt, Homo sapiens
uaacagacuuaaagaaagc

SEQ ID NO: 715212 - RNA, 19 nt, Homo sapiens
acacagaagagacaauaaa

SEQ ID NO: 715213 - RNA, 19 nt, Homo sapiens
ccaguucuauaauaucuuc

SEQ ID NO: 715214 - RNA, 19 nt, Homo sapiens
ugcaaaagcuguucuauau

SEQ ID NO: 715215 - RNA, 19 nt, Homo sapiens
caccaaagaaccuuaaguu

SEQ ID NO: 715216 - RNA, 19 nt, Homo sapiens
gcacagaauauuagucucu

SEQ ID NO: 715217 - RNA, 19 nt, Homo sapiens
gcaccguucuguuuucuuu

SEQ ID NO: 715218 - RNA, 19 nt, Homo sapiens
uacuaaagcuacagccaaa

SEQ ID NO: 715219 - RNA, 19 nt, Homo sapiens
ucacacuccugcgcucaua

SEQ ID NO: 715220 - RNA, 19 nt, Homo sapiens
gauguaaucaggacuucaa

SEQ ID NO: 715221 - RNA, 19 nt, Homo sapiens
agaagaagacaaacaucua

SEQ ID NO: 715222 - RNA, 19 nt, Homo sapiens
aaagcuaugugcacagaau

SEQ ID NO: 715223 - RNA, 19 nt, Homo sapiens
aaacccagccagcuacuuu

SEQ ID NO: 715224 - RNA, 19 nt, Homo sapiens
caagugaagggaccagauu

SEQ ID NO: 715225 - RNA, 19 nt, Homo sapiens
guacuuucuucucucauuc

SEQ ID NO: 715226 - RNA, 19 nt, Homo sapiens
gaacuaguacuuucuucuc

SEQ ID NO: 715227 - RNA, 19 nt, Homo sapiens
guaccucucccuacuaugu

SEQ ID NO: 715228 - RNA, 19 nt, Homo sapiens
gcuguuccauucacucuuc

SEQ ID NO: 715229 - RNA, 19 nt, Homo sapiens
ggugaauguugucauggaa

SEQ ID NO: 715230 - RNA, 19 nt, Homo sapiens
uccaggacauccaccauaa

SEQ ID NO: 715231 - RNA, 19 nt, Homo sapiens
gcuacugugugaagagaug

SEQ ID NO: 715232 - RNA, 19 nt, Homo sapiens
ucauuagccaguucuauaa

SEQ ID NO: 715233 - RNA, 19 nt, Homo sapiens
cuaaucugaugaaauggaa

SEQ ID NO: 715234 - RNA, 19 nt, Homo sapiens
ggaaagucuguguuacuga

SEQ ID NO: 715235 - RNA, 19 nt, Homo sapiens
ucaaugugauaaagucugu

SEQ ID NO: 715236 - RNA, 19 nt, Homo sapiens
ccagauuuccuaauuaaag

SEQ ID NO: 715237 - RNA, 19 nt, Homo sapiens
acaaacaucuaucuuucuc

SEQ ID NO: 715238 - RNA, 19 nt, Homo sapiens
gacaagcauucccuauugg

SEQ ID NO: 715239 - RNA, 19 nt, Homo sapiens
gaagugcuccuauauaccu

SEQ ID NO: 715240 - RNA, 19 nt, Homo sapiens
guccaucacggaaacauuu

SEQ ID NO: 715241 - RNA, 19 nt, Homo sapiens
ggaccgaagagucucaaug

SEQ ID NO: 715242 - RNA, 19 nt, Homo sapiens
uuaaagcuaugugcacaga

SEQ ID NO: 715243 - RNA, 19 nt, Homo sapiens
ggacagaaaucaucaauua

SEQ ID NO: 715244 - RNA, 19 nt, Homo sapiens
ucacagagguugaaguuaa

SEQ ID NO: 715245 - RNA, 19 nt, Homo sapiens
uaaaggaggugcaugauga

SEQ ID NO: 715246 - RNA, 19 nt, Homo sapiens
gauaguaccagaugaaaua

SEQ ID NO: 715247 - RNA, 19 nt, Homo sapiens
caacaacauuugcaacuuu

SEQ ID NO: 715248 - RNA, 19 nt, Homo sapiens
ucaaagaucucguacaaga

SEQ ID NO: 715249 - RNA, 19 nt, Homo sapiens
gauaguuccucaucacaua

SEQ ID NO: 715250 - RNA, 19 nt, Homo sapiens
aaucaaggcugucugcuua

SEQ ID NO: 715251 - RNA, 19 nt, Homo sapiens
ggaaugagcugcuaaaucc

SEQ ID NO: 715252 - RNA, 19 nt, Homo sapiens
ggagaucguuucaucauug

SEQ ID NO: 715253 - RNA, 19 nt, Homo sapiens
ggacaagucaugcggguua

SEQ ID NO: 715254 - RNA, 19 nt, Homo sapiens
gaaaggaucucaggaaugc

SEQ ID NO: 715255 - RNA, 19 nt, Homo sapiens
ggauuucccuucuuaguau

SEQ ID NO: 715256 - RNA, 19 nt, Homo sapiens
ggagaaagcuuugaugcau

SEQ ID NO: 715257 - RNA, 19 nt, Homo sapiens
caaaugagcagccgucuga

SEQ ID NO: 715258 - RNA, 19 nt, Homo sapiens
ggauauugaugguguaaga

SEQ ID NO: 715259 - RNA, 19 nt, Homo sapiens
ccagaugacuuacucaaug

SEQ ID NO: 715260 - RNA, 19 nt, Homo sapiens
gaagaaacaaacugaagaa

SEQ ID NO: 715261 - RNA, 19 nt, Homo sapiens
caacuuggguauuguagga

SEQ ID NO: 715262 - RNA, 19 nt, Homo sapiens
uaccaucgguguauacuaa

SEQ ID NO: 715263 - RNA, 19 nt, Homo sapiens
uacaacaggugcuccaaua

SEQ ID NO: 715264 - RNA, 19 nt, Homo sapiens
ucccuggucucaucaauua

SEQ ID NO: 715265 - RNA, 19 nt, Homo sapiens
gaagaaagacagugguguu

SEQ ID NO: 715266 - RNA, 19 nt, Homo sapiens
acaaaggaguucaauguga

SEQ ID NO: 715267 - RNA, 19 nt, Homo sapiens
gauaguugcuucaggaauc

SEQ ID NO: 715268 - RNA, 19 nt, Homo sapiens
ucucaaagaucucguacaa

SEQ ID NO: 715269 - RNA, 19 nt, Homo sapiens
ucauguaucucguguuuau

SEQ ID NO: 715270 - RNA, 19 nt, Homo sapiens
gaguacagguaaucaaaug

SEQ ID NO: 715271 - RNA, 19 nt, Homo sapiens
ggaggugcaugaugaacuu

SEQ ID NO: 715272 - RNA, 19 nt, Homo sapiens
aaaccaggcuugccaacaa

SEQ ID NO: 715273 - RNA, 19 nt, Homo sapiens
agacaacccagaugacuua

SEQ ID NO: 715274 - RNA, 19 nt, Homo sapiens
gaagauaguuccucaucac

SEQ ID NO: 715275 - RNA, 19 nt, Homo sapiens
gggaaaacgcuuauaauua

SEQ ID NO: 715276 - RNA, 19 nt, Homo sapiens
cauaacugcuuuacagaga

SEQ ID NO: 715277 - RNA, 19 nt, Homo sapiens
guaggugccugcagaacuu

SEQ ID NO: 715278 - RNA, 19 nt, Homo sapiens
caagaaaggaucucaggaa

SEQ ID NO: 715279 - RNA, 19 nt, Homo sapiens
ucucauguaucucguguuu

SEQ ID NO: 715280 - RNA, 19 nt, Homo sapiens
gaagaccgcagugggauaa

SEQ ID NO: 715281 - RNA, 19 nt, Homo sapiens
guacagauauuaguguuac

SEQ ID NO: 715282 - RNA, 19 nt, Homo sapiens
gaugcuaccuccaaagaca

SEQ ID NO: 715283 - RNA, 19 nt, Homo sapiens
gcacuacuccuucagaauc

SEQ ID NO: 715284 - RNA, 19 nt, Homo sapiens
aaggcugucugcuuauuua

SEQ ID NO: 715285 - RNA, 19 nt, Homo sapiens
caucggccaugacauuaaa

SEQ ID NO: 715286 - RNA, 19 nt, Homo sapiens
ggauaaaaguugaucugua

SEQ ID NO: 715287 - RNA, 19 nt, Homo sapiens
aggaaacccugauagauug

SEQ ID NO: 715288 - RNA, 19 nt, Homo sapiens
ccacauaucauugacugua

SEQ ID NO: 715289 - RNA, 19 nt, Homo sapiens
ggacauugaucuucaugcu

SEQ ID NO: 715290 - RNA, 19 nt, Homo sapiens
gaaagacagugguguugcu

SEQ ID NO: 715291 - RNA, 19 nt, Homo sapiens
caagauaguaccagaugaa

SEQ ID NO: 715292 - RNA, 19 nt, Homo sapiens
gcagugggauaaaucucaa

SEQ ID NO: 715293 - RNA, 19 nt, Homo sapiens
guaggcaacacuuggauuu

SEQ ID NO: 715294 - RNA, 19 nt, Homo sapiens
gaaugauccuuacuaacca

SEQ ID NO: 715295 - RNA, 19 nt, Homo sapiens
aaagcaagguuaucaugug

SEQ ID NO: 715296 - RNA, 19 nt, Homo sapiens
agacaaaggaguucaaugu

SEQ ID NO: 715297 - RNA, 19 nt, Homo sapiens
gaugggaucacuuaauguu

SEQ ID NO: 715298 - RNA, 19 nt, Homo sapiens
ggaaugauccuuacuaacc

SEQ ID NO: 715299 - RNA, 19 nt, Homo sapiens
caucaucaaagcaagguua

SEQ ID NO: 715300 - RNA, 19 nt, Homo sapiens
caacccagaugacuuacuc

SEQ ID NO: 715301 - RNA, 19 nt, Homo sapiens
gaucaacuuggguauugua

SEQ ID NO: 715302 - RNA, 19 nt, Homo sapiens
caagguggcuagaagacau

SEQ ID NO: 715303 - RNA, 19 nt, Homo sapiens
caucauuucucgugguguu

SEQ ID NO: 715304 - RNA, 19 nt, Homo sapiens
uagaagaaaucaaggaaac

SEQ ID NO: 715305 - RNA, 19 nt, Homo sapiens
gggcacagaguacagguaa

SEQ ID NO: 715306 - RNA, 19 nt, Homo sapiens
gagggaaugauccuuacua

SEQ ID NO: 715307 - RNA, 19 nt, Homo sapiens
ccaacaacauuugcaacuu

SEQ ID NO: 715308 - RNA, 19 nt, Homo sapiens
uaauaaguuuccagugguu

SEQ ID NO: 715309 - RNA, 19 nt, Homo sapiens
ugaugaacuugaagauuug

SEQ ID NO: 715310 - RNA, 19 nt, Homo sapiens
aaggaaacccugauagauu

SEQ ID NO: 715311 - RNA, 19 nt, Homo sapiens
gcacagaguacagguaauc

SEQ ID NO: 715312 - RNA, 19 nt, Homo sapiens
gcccaucccuggucucauc

SEQ ID NO: 715313 - RNA, 19 nt, Homo sapiens
uaaacagacagaagacaaa

SEQ ID NO: 715314 - RNA, 19 nt, Homo sapiens
aagaaaggaucucaggaau

SEQ ID NO: 715315 - RNA, 19 nt, Homo sapiens
cuucauaacugcuuuacag

SEQ ID NO: 715316 - RNA, 19 nt, Homo sapiens
gcugucugcuuauuuauac

SEQ ID NO: 715317 - RNA, 19 nt, Homo sapiens
agaaagcuuugaugcaugu

SEQ ID NO: 715318 - RNA, 19 nt, Homo sapiens
aagcaagguuaucauguga

SEQ ID NO: 715319 - RNA, 19 nt, Homo sapiens
uagcaacaauucaggaaca

SEQ ID NO: 715320 - RNA, 19 nt, Homo sapiens
caacucuucuagcaacaau

SEQ ID NO: 715321 - RNA, 19 nt, Homo sapiens
guuaaacaauucuguacca

SEQ ID NO: 715322 - RNA, 19 nt, Homo sapiens
gagcaaagacaaaauaaug

SEQ ID NO: 715323 - RNA, 19 nt, Homo sapiens
cuacuuaugcucuuaaauc

SEQ ID NO: 715324 - RNA, 19 nt, Homo sapiens
aaguugaucuguauaguca

SEQ ID NO: 715325 - RNA, 19 nt, Homo sapiens
gcugcuaaauccugaagau

SEQ ID NO: 715326 - RNA, 19 nt, Homo sapiens
ugauggcacugaagaacuu

SEQ ID NO: 715327 - RNA, 19 nt, Homo sapiens
cagcacuacuccuucagaa

SEQ ID NO: 715328 - RNA, 19 nt, Homo sapiens
gacagaagacaaaggaguu

SEQ ID NO: 715329 - RNA, 19 nt, Homo sapiens
ucaaggcugucugcuuauu

SEQ ID NO: 715330 - RNA, 19 nt, Homo sapiens
caacuacuuaugcucuuaa

SEQ ID NO: 715331 - RNA, 19 nt, Homo sapiens
acaacuacuuaugcucuua

SEQ ID NO: 715332 - RNA, 19 nt, Homo sapiens
caucaaagcaagguuauca

SEQ ID NO: 715333 - RNA, 19 nt, Homo sapiens
ugacaucuauggacaaagc

SEQ ID NO: 715334 - RNA, 19 nt, Homo sapiens
caaggaaacccugauagau

SEQ ID NO: 715335 - RNA, 19 nt, Homo sapiens
ucaaggaaacccugauaga

SEQ ID NO: 715336 - RNA, 19 nt, Homo sapiens
ugaagaaacaaacugaaga

SEQ ID NO: 715337 - RNA, 19 nt, Homo sapiens
gcaacggcacagcuaguuu

SEQ ID NO: 715338 - RNA, 19 nt, Homo sapiens
uugacuguauccuguaaua

SEQ ID NO: 715339 - RNA, 19 nt, Homo sapiens
cagaguacagguaaucaaa

SEQ ID NO: 715340 - RNA, 19 nt, Homo sapiens
ggaagaggaagaagagaag

SEQ ID NO: 715341 - RNA, 19 nt, Homo sapiens
agggaaugauccuuacuaa

SEQ ID NO: 715342 - RNA, 19 nt, Homo sapiens
caauucaggaacaugguua

SEQ ID NO: 715343 - RNA, 19 nt, Homo sapiens
ccacagcuguucauauuua

SEQ ID NO: 715344 - RNA, 19 nt, Homo sapiens
gaaagaagauuccaacucu

SEQ ID NO: 715345 - RNA, 19 nt, Homo sapiens
uaacugagcucuggacuuu

SEQ ID NO: 715346 - RNA, 19 nt, Homo sapiens
ggacaaagcucuucaucca

SEQ ID NO: 715347 - RNA, 19 nt, Homo sapiens
ggaccuugcuuaaauuuga

SEQ ID NO: 715348 - RNA, 19 nt, Homo sapiens
ggauucaguugacaaagua

SEQ ID NO: 715349 - RNA, 19 nt, Homo sapiens
ggccacagcuguucauauu

SEQ ID NO: 715350 - RNA, 19 nt, Homo sapiens
gaaaccagcuauaugucuu

SEQ ID NO: 715351 - RNA, 19 nt, Homo sapiens
gaccuccacugcauugaua

SEQ ID NO: 715352 - RNA, 19 nt, Homo sapiens
gaaagaggauucaguugac

SEQ ID NO: 715353 - RNA, 19 nt, Homo sapiens
gaggaaagccagacugcua

SEQ ID NO: 715354 - RNA, 19 nt, Homo sapiens
gagauuugcugggcuggua

SEQ ID NO: 715355 - RNA, 19 nt, Homo sapiens
guacaucuuugguggaaug

SEQ ID NO: 715356 - RNA, 19 nt, Homo sapiens
cauuggaccuugcuuaaau

SEQ ID NO: 715357 - RNA, 19 nt, Homo sapiens
ugaaauggcagaagcuaaa

SEQ ID NO: 715358 - RNA, 19 nt, Homo sapiens
guaccaguaucacacagaa

SEQ ID NO: 715359 - RNA, 19 nt, Homo sapiens
gaacauuccacacaucauc

SEQ ID NO: 715360 - RNA, 19 nt, Homo sapiens
gagcaaauccaaacagaag

SEQ ID NO: 715361 - RNA, 19 nt, Homo sapiens
gggagcaaauccaaacaga

SEQ ID NO: 715362 - RNA, 19 nt, Homo sapiens
gaacaugcuagcuucauuc

SEQ ID NO: 715363 - RNA, 19 nt, Homo sapiens
ccaagaacauuccacacau

SEQ ID NO: 715364 - RNA, 19 nt, Homo sapiens
cugcuacacugcucuguuu

SEQ ID NO: 715365 - RNA, 19 nt, Homo sapiens
ccaacucucucacucugaa

SEQ ID NO: 715366 - RNA, 19 nt, Homo sapiens
caagaacauuccacacauc

SEQ ID NO: 715367 - RNA, 19 nt, Homo sapiens
caggagcacuggacacaau

SEQ ID NO: 715368 - RNA, 19 nt, Homo sapiens
agaaagaggauucaguuga

SEQ ID NO: 715369 - RNA, 19 nt, Homo sapiens
ggacacaauguaccaguau

SEQ ID NO: 715370 - RNA, 19 nt, Homo sapiens
ccacugcauugauauaagu

SEQ ID NO: 715371 - RNA, 19 nt, Homo sapiens
gcaacaugguacaccuuga

SEQ ID NO: 715372 - RNA, 19 nt, Homo sapiens
gaaccaugaagcugagaaa

SEQ ID NO: 715373 - RNA, 19 nt, Homo sapiens
ugagaaagaggauucaguu

SEQ ID NO: 715374 - RNA, 19 nt, Homo sapiens
ggaaaucgaaauugucuac

SEQ ID NO: 715375 - RNA, 19 nt, Homo sapiens
gggacagauucuaugauga

SEQ ID NO: 715376 - RNA, 19 nt, Homo sapiens
ccaugaagcugagaaagag

SEQ ID NO: 715377 - RNA, 19 nt, Homo sapiens
gagaaagaggauucaguug

SEQ ID NO: 715378 - RNA, 19 nt, Homo sapiens
gaagauuccaacucucuca

SEQ ID NO: 715379 - RNA, 19 nt, Homo sapiens
gguaugaacaugcuagcuu

SEQ ID NO: 715380 - RNA, 19 nt, Homo sapiens
ggaaaccagcuauaugucu

SEQ ID NO: 715381 - RNA, 19 nt, Homo sapiens
gcauuggaccuugcuuaaa

SEQ ID NO: 715382 - RNA, 19 nt, Homo sapiens
acacagaagagcagcauug

SEQ ID NO: 715383 - RNA, 19 nt, Homo sapiens
ggacagauucuaugaugac

SEQ ID NO: 715384 - RNA, 19 nt, Homo sapiens
ccaggaaagcaacauggua

SEQ ID NO: 715385 - RNA, 19 nt, Homo sapiens
ggagcaaauccaaacagaa

SEQ ID NO: 715386 - RNA, 19 nt, Homo sapiens
gaccauuccauguguauca

SEQ ID NO: 715387 - RNA, 19 nt, Homo sapiens
gagcacuggacacaaugua

SEQ ID NO: 715388 - RNA, 19 nt, Homo sapiens
uaugacgauuguauuguga

SEQ ID NO: 715389 - RNA, 19 nt, Homo sapiens
gaugaccuccacugcauug

SEQ ID NO: 715390 - RNA, 19 nt, Homo sapiens
caaccaaucaggaaaucga

SEQ ID NO: 715391 - RNA, 19 nt, Homo sapiens
ggagacaagcccaggaaag

SEQ ID NO: 715392 - RNA, 19 nt, Homo sapiens
gaaauggcagaagcuaaau

SEQ ID NO: 715393 - RNA, 19 nt, Homo sapiens
cuaugacgauuguauugug

SEQ ID NO: 715394 - RNA, 19 nt, Homo sapiens
uggacacaauguaccagua

SEQ ID NO: 715395 - RNA, 19 nt, Homo sapiens
guguacaucuuugguggaa

SEQ ID NO: 715396 - RNA, 19 nt, Homo sapiens
gacaagcccaggaaagcaa

SEQ ID NO: 715397 - RNA, 19 nt, Homo sapiens
cgaagcugcauguguuuga

SEQ ID NO: 715398 - RNA, 19 nt, Homo sapiens
ggggacagauucuaugaug

SEQ ID NO: 715399 - RNA, 19 nt, Homo sapiens
ccagagacacuuggaaauc

SEQ ID NO: 715400 - RNA, 19 nt, Homo sapiens
ccacgugaagccagccuaa

SEQ ID NO: 715401 - RNA, 19 nt, Homo sapiens
gcauugauauaagugacau

SEQ ID NO: 715402 - RNA, 19 nt, Homo sapiens
gaccuugcuuaaauuugau

SEQ ID NO: 715403 - RNA, 19 nt, Homo sapiens
gacacaauguaccaguauc

SEQ ID NO: 715404 - RNA, 19 nt, Homo sapiens
ccaaucaggaaaucgaaau

SEQ ID NO: 715405 - RNA, 19 nt, Homo sapiens
ucucagacgugcacaccau

SEQ ID NO: 715406 - RNA, 19 nt, Homo sapiens
acgauuguauugugacugu

SEQ ID NO: 715407 - RNA, 19 nt, Homo sapiens
gugaagccagccuaacuga

SEQ ID NO: 715408 - RNA, 19 nt, Homo sapiens
caaucaggaaaucgaaauu

SEQ ID NO: 715409 - RNA, 19 nt, Homo sapiens
aggauucaguugacaaagu

SEQ ID NO: 715410 - RNA, 19 nt, Homo sapiens
caucuuugguggaaugacu

SEQ ID NO: 715411 - RNA, 19 nt, Homo sapiens
ggucacagccagagacacu

SEQ ID NO: 715412 - RNA, 19 nt, Homo sapiens
aaagaggauucaguugaca

SEQ ID NO: 715413 - RNA, 19 nt, Homo sapiens
caugguacaccuugacugu

SEQ ID NO: 715414 - RNA, 19 nt, Homo sapiens
aaaccagcuauaugucuuu

SEQ ID NO: 715415 - RNA, 19 nt, Homo sapiens
cgaguuggccacagcuguu

SEQ ID NO: 715416 - RNA, 19 nt, Homo sapiens
gccaaccaaucaggaaauc

SEQ ID NO: 715417 - RNA, 19 nt, Homo sapiens
gcaaauccaaacagaagcu

SEQ ID NO: 715418 - RNA, 19 nt, Homo sapiens
uuggugggaugaauacaga

SEQ ID NO: 715419 - RNA, 19 nt, Homo sapiens
gagacaagcccaggaaagc

SEQ ID NO: 715420 - RNA, 19 nt, Homo sapiens
agaaagaagauuccaacuc

SEQ ID NO: 715421 - RNA, 19 nt, Homo sapiens
caucggcagccauuggaaa

SEQ ID NO: 715422 - RNA, 19 nt, Homo sapiens
gguguuuggugggaugaau

SEQ ID NO: 715423 - RNA, 19 nt, Homo sapiens
ggaaagccagacugcuaca

SEQ ID NO: 715424 - RNA, 19 nt, Homo sapiens
ccagugacgugugcuucug

SEQ ID NO: 715425 - RNA, 19 nt, Homo sapiens
cauuccauguguaucauuc

SEQ ID NO: 715426 - RNA, 19 nt, Homo sapiens
gcagggacaaagcucuuca

SEQ ID NO: 715427 - RNA, 19 nt, Homo sapiens
cagagacacuuggaaaucc

SEQ ID NO: 715428 - RNA, 19 nt, Homo sapiens
ucacagccagagacacuug

SEQ ID NO: 715429 - RNA, 19 nt, Homo sapiens
caggaaaucgaaauugucu

SEQ ID NO: 715430 - RNA, 19 nt, Homo sapiens
acugagcucuggacuuugg

SEQ ID NO: 715431 - RNA, 19 nt, Homo sapiens
aggcugugcugcccacuca

SEQ ID NO: 715432 - RNA, 19 nt, Homo sapiens
gaagcugcauguguuugac

SEQ ID NO: 715433 - RNA, 19 nt, Homo sapiens
ccauuggaaaccagcuaua

SEQ ID NO: 715434 - RNA, 19 nt, Homo sapiens
ccuggacgauuggaccauu

SEQ ID NO: 715435 - RNA, 19 nt, Homo sapiens
acacaauguaccaguauca

SEQ ID NO: 715436 - RNA, 19 nt, Homo sapiens
gcaggacaccaugaagcaa

SEQ ID NO: 715437 - RNA, 19 nt, Homo sapiens
caugaaauggcagaagcua

SEQ ID NO: 715438 - RNA, 19 nt, Homo sapiens
gccagagacacuuggaaau

SEQ ID NO: 715439 - RNA, 19 nt, Homo sapiens
uuggaaaccagcuauaugu

SEQ ID NO: 715440 - RNA, 19 nt, Homo sapiens
aaucaggaaaucgaaauug

SEQ ID NO: 715441 - RNA, 19 nt, Homo sapiens
cccaagaacauuccacaca

SEQ ID NO: 715442 - RNA, 19 nt, Homo sapiens
gaaaucgaaauugucuaca

SEQ ID NO: 715443 - RNA, 19 nt, Homo sapiens
ggagguagcuucgcagugu

SEQ ID NO: 715444 - RNA, 19 nt, Homo sapiens
gaggaucccuggaacucua

SEQ ID NO: 715445 - RNA, 19 nt, Homo sapiens
gcacccugaugaguauuua

SEQ ID NO: 715446 - RNA, 19 nt, Homo sapiens
gcaaggaggaucccuggaa

SEQ ID NO: 715447 - RNA, 19 nt, Homo sapiens
caucaaggguuuccgcaau

SEQ ID NO: 715448 - RNA, 19 nt, Homo sapiens
gcccagcaguuccgaaaug

SEQ ID NO: 715449 - RNA, 19 nt, Homo sapiens
cggcaccgguugagaggua

SEQ ID NO: 715450 - RNA, 19 nt, Homo sapiens
gguggagccuucacuaugg

SEQ ID NO: 715451 - RNA, 19 nt, Homo sapiens
ggaauucggcaccgguuga

SEQ ID NO: 715452 - RNA, 19 nt, Homo sapiens
uaucaccaguggagcauug

SEQ ID NO: 715453 - RNA, 19 nt, Homo sapiens
ggccuguucuccaccauug

SEQ ID NO: 715454 - RNA, 19 nt, Homo sapiens
guugagagguagugccaau

SEQ ID NO: 715455 - RNA, 19 nt, Homo sapiens
ccagcgccauggaggagua

SEQ ID NO: 715456 - RNA, 19 nt, Homo sapiens
gagcagagggcagcacuuc

SEQ ID NO: 715457 - RNA, 19 nt, Homo sapiens
ggcgaauuguggaugauug

SEQ ID NO: 715458 - RNA, 19 nt, Homo sapiens
acacucacauguacgaagu

SEQ ID NO: 715459 - RNA, 19 nt, Homo sapiens
cauggcgaauuguggauga

SEQ ID NO: 715460 - RNA, 19 nt, Homo sapiens
guggcacccugaugaguau

SEQ ID NO: 715461 - RNA, 19 nt, Homo sapiens
cuacacagcccagcaguuc

SEQ ID NO: 715462 - RNA, 19 nt, Homo sapiens
ccagagaggguuucuacuc

SEQ ID NO: 715463 - RNA, 19 nt, Homo sapiens
uaaagcccguuuugaaaug

SEQ ID NO: 715464 - RNA, 19 nt, Homo sapiens
ccuccucacucgcuacaca

SEQ ID NO: 715465 - RNA, 19 nt, Homo sapiens
uccaggccaucaaggguuu

SEQ ID NO: 715466 - RNA, 19 nt, Homo sapiens
uguggcacccugaugagua

SEQ ID NO: 715467 - RNA, 19 nt, Homo sapiens
cagcccagcaguuccgaaa

SEQ ID NO: 715468 - RNA, 19 nt, Homo sapiens
auggugggcucagcaauga

SEQ ID NO: 715469 - RNA, 19 nt, Homo sapiens
caaugccccuguuggaauu

SEQ ID NO: 715470 - RNA, 19 nt, Homo sapiens
gcgguggagccuucacuau

SEQ ID NO: 715471 - RNA, 19 nt, Homo sapiens
ggugggcucagcaaugaug

SEQ ID NO: 715472 - RNA, 19 nt, Homo sapiens
cauggugggcucagcaaug

SEQ ID NO: 715473 - RNA, 19 nt, Homo sapiens
gcagagggcagcacuuccu

SEQ ID NO: 715474 - RNA, 19 nt, Homo sapiens
ccagcugcccugacagaug

SEQ ID NO: 715475 - RNA, 19 nt, Homo sapiens
ucacauguacgaaguucuc

SEQ ID NO: 715476 - RNA, 19 nt, Homo sapiens
gagagguagugccaaugcu

SEQ ID NO: 715477 - RNA, 19 nt, Homo sapiens
gcaaugccccuguuggaau

SEQ ID NO: 715478 - RNA, 19 nt, Homo sapiens
gaucagaacuguaaagcua

SEQ ID NO: 715479 - RNA, 19 nt, Homo sapiens
uaacauaccuaccaacgua

SEQ ID NO: 715480 - RNA, 19 nt, Homo sapiens
gcugcaagcuguacaauuu

SEQ ID NO: 715481 - RNA, 19 nt, Homo sapiens
gaggucagcuggcagauuu

SEQ ID NO: 715482 - RNA, 19 nt, Homo sapiens
gagaagaucugcucggaau

SEQ ID NO: 715483 - RNA, 19 nt, Homo sapiens
gcauauccaucaaggaauu

SEQ ID NO: 715484 - RNA, 19 nt, Homo sapiens
caucaacuaugggauaaua

SEQ ID NO: 715485 - RNA, 19 nt, Homo sapiens
gcagaugccuucaauaacu

SEQ ID NO: 715486 - RNA, 19 nt, Homo sapiens
gaagcaagcucaccaccau

SEQ ID NO: 715487 - RNA, 19 nt, Homo sapiens
gaaaagacauuaacagcaa

SEQ ID NO: 715488 - RNA, 19 nt, Homo sapiens
gcaccaucauccuaacaua

SEQ ID NO: 715489 - RNA, 19 nt, Homo sapiens
gcaccgaucagaacuguaa

SEQ ID NO: 715490 - RNA, 19 nt, Homo sapiens
guacucugcuccauguuaa

SEQ ID NO: 715491 - RNA, 19 nt, Homo sapiens
ggacaggucaguuuacuau

SEQ ID NO: 715492 - RNA, 19 nt, Homo sapiens
gacauuaacagcaacauaa

SEQ ID NO: 715493 - RNA, 19 nt, Homo sapiens
gacaacagcuggacaaacu

SEQ ID NO: 715494 - RNA, 19 nt, Homo sapiens
caucagagauaguggaguu

SEQ ID NO: 715495 - RNA, 19 nt, Homo sapiens
uaaaggcgauggucacaug

SEQ ID NO: 715496 - RNA, 19 nt, Homo sapiens
gcuaugggcuggcucuuau

SEQ ID NO: 715497 - RNA, 19 nt, Homo sapiens
gcucggaauuguagccaua

SEQ ID NO: 715498 - RNA, 19 nt, Homo sapiens
gaacaccacucagcagcaa

SEQ ID NO: 715499 - RNA, 19 nt, Homo sapiens
gcauuuggauccuucauca

SEQ ID NO: 715500 - RNA, 19 nt, Homo sapiens
gcagcaaggucuaucuaau

SEQ ID NO: 715501 - RNA, 19 nt, Homo sapiens
gaauuguagccauauguua

SEQ ID NO: 715502 - RNA, 19 nt, Homo sapiens
gaacccagauacuacuaau

SEQ ID NO: 715503 - RNA, 19 nt, Homo sapiens
acaggucaguuuacuauuu

SEQ ID NO: 715504 - RNA, 19 nt, Homo sapiens
gguagaaggauuauuacua

SEQ ID NO: 715505 - RNA, 19 nt, Homo sapiens
caaguuagccuuauagucu

SEQ ID NO: 715506 - RNA, 19 nt, Homo sapiens
gaagaucugcucggaauug

SEQ ID NO: 715507 - RNA, 19 nt, Homo sapiens
gaccauagacucagcaguu

SEQ ID NO: 715508 - RNA, 19 nt, Homo sapiens
ucagaacuguaaagcuaua

SEQ ID NO: 715509 - RNA, 19 nt, Homo sapiens
ucacaugccuaccacuuug

SEQ ID NO: 715510 - RNA, 19 nt, Homo sapiens
ucauguggccuuugaauuu

SEQ ID NO: 715511 - RNA, 19 nt, Homo sapiens
caauucauguggccuuuga

SEQ ID NO: 715512 - RNA, 19 nt, Homo sapiens
gggauaauacugacucuga

SEQ ID NO: 715513 - RNA, 19 nt, Homo sapiens
ggaucuccaucugguaaua

SEQ ID NO: 715514 - RNA, 19 nt, Homo sapiens
uauaagacacugauacuug

SEQ ID NO: 715515 - RNA, 19 nt, Homo sapiens
caacguauaucaguacucu

SEQ ID NO: 715516 - RNA, 19 nt, Homo sapiens
gcauggacaggucaguuua

SEQ ID NO: 715517 - RNA, 19 nt, Homo sapiens
gcagggauauuuggagcaa

SEQ ID NO: 715518 - RNA, 19 nt, Homo sapiens
cuaccaacguauaucagua

SEQ ID NO: 715519 - RNA, 19 nt, Homo sapiens
uuucagccauuucugguua

SEQ ID NO: 715520 - RNA, 19 nt, Homo sapiens
uucaauaacuccagcauau

SEQ ID NO: 715521 - RNA, 19 nt, Homo sapiens
caggucaguuuacuauuug

SEQ ID NO: 715522 - RNA, 19 nt, Homo sapiens
cagcauauccaucaaggaa

SEQ ID NO: 715523 - RNA, 19 nt, Homo sapiens
cagggaaacuccaccacaa

SEQ ID NO: 715524 - RNA, 19 nt, Homo sapiens
cugguaauauugccuaauu

SEQ ID NO: 715525 - RNA, 19 nt, Homo sapiens
ggaauuguagccauauguu

SEQ ID NO: 715526 - RNA, 19 nt, Homo sapiens
aaacuuaaaugugguacug

SEQ ID NO: 715527 - RNA, 19 nt, Homo sapiens
ucaguacucugcuccaugu

SEQ ID NO: 715528 - RNA, 19 nt, Homo sapiens
gaagguaagugcuuuucuu

SEQ ID NO: 715529 - RNA, 19 nt, Homo sapiens
ggauaauacugacucugau

SEQ ID NO: 715530 - RNA, 19 nt, Homo sapiens
uaccaaagguccauuaagg

SEQ ID NO: 715531 - RNA, 19 nt, Homo sapiens
ccauauuccugaccauaga

SEQ ID NO: 715532 - RNA, 19 nt, Homo sapiens
gaacuguaaagcuauaauc

SEQ ID NO: 715533 - RNA, 19 nt, Homo sapiens
auaaaagacugucguagua

SEQ ID NO: 715534 - RNA, 19 nt, Homo sapiens
gccuugagcuggccuuuua

SEQ ID NO: 715535 - RNA, 19 nt, Homo sapiens
uugcagaugccuucaauaa

SEQ ID NO: 715536 - RNA, 19 nt, Homo sapiens
acagaaaacucccuccuuu

SEQ ID NO: 715537 - RNA, 19 nt, Homo sapiens
guuauuggaugcagagaag

SEQ ID NO: 715538 - RNA, 19 nt, Homo sapiens
gggacccacuccagagauu

SEQ ID NO: 715539 - RNA, 19 nt, Homo sapiens
guacugagcaugaacuuuu

SEQ ID NO: 715540 - RNA, 19 nt, Homo sapiens
cagcaaggucuaucuaaug

SEQ ID NO: 715541 - RNA, 19 nt, Homo sapiens
ccaggaaagguccagauuu

SEQ ID NO: 715542 - RNA, 19 nt, Homo sapiens
cacaaagcgugguaccauu

SEQ ID NO: 715543 - RNA, 19 nt, Homo sapiens
gcucaucgcaggaaucauc

SEQ ID NO: 715544 - RNA, 19 nt, Homo sapiens
guaagugcuuuucuucuuu

SEQ ID NO: 715545 - RNA, 19 nt, Homo sapiens
uuggguagaaggauuauua

SEQ ID NO: 715546 - RNA, 19 nt, Homo sapiens
gaucugcucggaauuguag

SEQ ID NO: 715547 - RNA, 19 nt, Homo sapiens
caacagcuggacaaacuug

SEQ ID NO: 715548 - RNA, 19 nt, Homo sapiens
acccagauacuacuaauuu

SEQ ID NO: 715549 - RNA, 19 nt, Homo sapiens
gagcuggccuuuuaucuuc

SEQ ID NO: 715550 - RNA, 19 nt, Homo sapiens
guccaggaaucuucucaga

SEQ ID NO: 715551 - RNA, 19 nt, Homo sapiens
caucacccgugcauaagug

SEQ ID NO: 715552 - RNA, 19 nt, Homo sapiens
ggaucagggucagcauuug

SEQ ID NO: 715553 - RNA, 19 nt, Homo sapiens
caaaggccucuguguauca

SEQ ID NO: 715554 - RNA, 19 nt, Homo sapiens
uaucuaaugccuccacuga

SEQ ID NO: 715555 - RNA, 19 nt, Homo sapiens
ucaaacuucaccaugauaa

SEQ ID NO: 715556 - RNA, 19 nt, Homo sapiens
ggaacccagauacuacuaa

SEQ ID NO: 715557 - RNA, 19 nt, Homo sapiens
gcugaucucuucccuucuc

SEQ ID NO: 715558 - RNA, 19 nt, Homo sapiens
acaaagcgugguaccauuu

SEQ ID NO: 715559 - RNA, 19 nt, Homo sapiens
gaggacauaaaguuacaaa

SEQ ID NO: 715560 - RNA, 19 nt, Homo sapiens
ucgcaggaaucaucucuuc

SEQ ID NO: 715561 - RNA, 19 nt, Homo sapiens
guagccauauguuacagau

SEQ ID NO: 715562 - RNA, 19 nt, Homo sapiens
gccaaagagaggacccuua

SEQ ID NO: 715563 - RNA, 19 nt, Homo sapiens
gccacuggauuccucauca

SEQ ID NO: 715564 - RNA, 19 nt, Homo sapiens
uagauacuccuuagagguu

SEQ ID NO: 715565 - RNA, 19 nt, Homo sapiens
gguaagugcuuuucuucuu

SEQ ID NO: 715566 - RNA, 19 nt, Homo sapiens
ccaaagagaggacccuuac

SEQ ID NO: 715567 - RNA, 19 nt, Homo sapiens
ggcauggacaggucaguuu

SEQ ID NO: 715568 - RNA, 19 nt, Homo sapiens
gcccagaaacucaggguau

SEQ ID NO: 715569 - RNA, 19 nt, Homo sapiens
agacauuaacagcaacaua

SEQ ID NO: 715570 - RNA, 19 nt, Homo sapiens
gggaacaguuuuaggagaa

SEQ ID NO: 715571 - RNA, 19 nt, Homo sapiens
ucucaaacuucaccaugau

SEQ ID NO: 715572 - RNA, 19 nt, Homo sapiens
gguaccauuucccacagaa

SEQ ID NO: 715573 - RNA, 19 nt, Homo sapiens
uuuccaaguuagccuuaua

SEQ ID NO: 715574 - RNA, 19 nt, Homo sapiens
gcugcugacuucggaguga

SEQ ID NO: 715575 - RNA, 19 nt, Homo sapiens
acaaaggccucuguguauc

SEQ ID NO: 715576 - RNA, 19 nt, Homo sapiens
agaagccacugguaccaau

SEQ ID NO: 715577 - RNA, 19 nt, Homo sapiens
cagcaccgaucagaacugu

SEQ ID NO: 715578 - RNA, 19 nt, Homo sapiens
gaaagaagaguuacuauuc

SEQ ID NO: 715579 - RNA, 19 nt, Homo sapiens
gaaggaauccaguuacuuu

SEQ ID NO: 715580 - RNA, 19 nt, Homo sapiens
ggaaagagauacccauuac

SEQ ID NO: 715581 - RNA, 19 nt, Homo sapiens
ggaaagaagaguuacuauu

SEQ ID NO: 715582 - RNA, 19 nt, Homo sapiens
gacaacggcaucacuauaa

SEQ ID NO: 715583 - RNA, 19 nt, Homo sapiens
gacaggaccauuuacauuu

SEQ ID NO: 715584 - RNA, 19 nt, Homo sapiens
ggaaauaccauguaauagg

SEQ ID NO: 715585 - RNA, 19 nt, Homo sapiens
uuaccaaguugcugcuuua

SEQ ID NO: 715586 - RNA, 19 nt, Homo sapiens
aaacaugggugaaauucug

SEQ ID NO: 715587 - RNA, 19 nt, Homo sapiens
gauacccauuacauaguua

SEQ ID NO: 715588 - RNA, 19 nt, Homo sapiens
cgacaggaccauuuacauu

SEQ ID NO: 715589 - RNA, 19 nt, Homo sapiens
ccugagaaauaaucaagaa

SEQ ID NO: 715590 - RNA, 19 nt, Homo sapiens
aaaggcagccgaauugaaa

SEQ ID NO: 715591 - RNA, 19 nt, Homo sapiens
caaacaguauuucaagagu

SEQ ID NO: 715592 - RNA, 19 nt, Homo sapiens
gagaaggaauccaguuacu

SEQ ID NO: 715593 - RNA, 19 nt, Homo sapiens
gagaagauaguggaacaaa

SEQ ID NO: 715594 - RNA, 19 nt, Homo sapiens
gaguuacuauuccugagaa

SEQ ID NO: 715595 - RNA, 19 nt, Homo sapiens
uagagaaggaauccaguua

SEQ ID NO: 715596 - RNA, 19 nt, Homo sapiens
ugacaacggcaucacuaua

SEQ ID NO: 715597 - RNA, 19 nt, Homo sapiens
gagaguugaacaugaauau

SEQ ID NO: 715598 - RNA, 19 nt, Homo sapiens
gaaauugaagcaguagcua

SEQ ID NO: 715599 - RNA, 19 nt, Homo sapiens
uagagcugcuuaccaaguu

SEQ ID NO: 715600 - RNA, 19 nt, Homo sapiens
caaaggcagccgaauugaa

SEQ ID NO: 715601 - RNA, 19 nt, Homo sapiens
ggagaguugaacaugaaua

SEQ ID NO: 715602 - RNA, 19 nt, Homo sapiens
cagucaagcuguauuaguc

SEQ ID NO: 715603 - RNA, 19 nt, Homo sapiens
gaagauaguggaacaaaau

SEQ ID NO: 715604 - RNA, 19 nt, Homo sapiens
ugauguccguuaugugauu

SEQ ID NO: 715605 - RNA, 19 nt, Homo sapiens
uuacauuucaggacagaua

SEQ ID NO: 715606 - RNA, 19 nt, Homo sapiens
uagggagaguugaacauga

SEQ ID NO: 715607 - RNA, 19 nt, Homo sapiens
guuggucaguccaguaaga

SEQ ID NO: 715608 - RNA, 19 nt, Homo sapiens
aaagagauacccauuacau

SEQ ID NO: 715609 - RNA, 19 nt, Homo sapiens
ccugugugcaccuguauua

SEQ ID NO: 715610 - RNA, 19 nt, Homo sapiens
cugaagcuauuauggaaau

SEQ ID NO: 715611 - RNA, 19 nt, Homo sapiens
acaggaccauuuacauuuc

SEQ ID NO: 715612 - RNA, 19 nt, Homo sapiens
gagauacccauuacauagu

SEQ ID NO: 715613 - RNA, 19 nt, Homo sapiens
aagagauacccauuacaua

SEQ ID NO: 715614 - RNA, 19 nt, Homo sapiens
gaaagagauacccauuaca

SEQ ID NO: 715615 - RNA, 19 nt, Homo sapiens
uguguagucuggaauuguu

SEQ ID NO: 715616 - RNA, 19 nt, Homo sapiens
agauacccauuacauaguu

SEQ ID NO: 715617 - RNA, 19 nt, Homo sapiens
agagauacccauuacauag

SEQ ID NO: 715618 - RNA, 19 nt, Homo sapiens
agggagaguugaacaugaa

SEQ ID NO: 715619 - RNA, 19 nt, Homo sapiens
gcagaagaagcuaaacaag

SEQ ID NO: 715620 - RNA, 19 nt, Homo sapiens
agcaguagcuauccaagga

SEQ ID NO: 715621 - RNA, 19 nt, Homo sapiens
uaggaaagaagaguuacua

SEQ ID NO: 715622 - RNA, 19 nt, Homo sapiens
aggaaagagauacccauua

SEQ ID NO: 715623 - RNA, 19 nt, Homo sapiens
gaauauaggaaagagauac

SEQ ID NO: 715624 - RNA, 19 nt, Homo sapiens
cccaaaggcagccgaauug

SEQ ID NO: 715625 - RNA, 19 nt, Homo sapiens
ugcuagagcugcuuaccaa

SEQ ID NO: 715626 - RNA, 19 nt, Homo sapiens
cuacaaacaguauuucaag

SEQ ID NO: 715627 - RNA, 19 nt, Homo sapiens
aaagaagaguuacuauucc

SEQ ID NO: 715628 - RNA, 19 nt, Homo sapiens
cccauuacauaguuacuca

SEQ ID NO: 715629 - RNA, 19 nt, Homo sapiens
uaucugaagcuauuaugga

SEQ ID NO: 715630 - RNA, 19 nt, Homo sapiens
gcuuagccaugucguccuu

SEQ ID NO: 715631 - RNA, 19 nt, Homo sapiens
gcuguguagucuggaauug

SEQ ID NO: 715632 - RNA, 19 nt, Homo sapiens
ugagaucaaggagaagaua

SEQ ID NO: 715633 - RNA, 19 nt, Homo sapiens
gaauauuagagaaggaauc

SEQ ID NO: 715634 - RNA, 19 nt, Homo sapiens
cauguaauagggagaguug

SEQ ID NO: 715635 - RNA, 19 nt, Homo sapiens
caggaccauuuacauuuca

SEQ ID NO: 715636 - RNA, 19 nt, Homo sapiens
ucuucuggcugacauaaau

SEQ ID NO: 715637 - RNA, 19 nt, Homo sapiens
gaucaaggagaagauagug

SEQ ID NO: 715638 - RNA, 19 nt, Homo sapiens
gucuggaauuguuaacauu

SEQ ID NO: 715639 - RNA, 19 nt, Homo sapiens
uggcugacauaaaugacuu

SEQ ID NO: 715640 - RNA, 19 nt, Homo sapiens
aggagaagauaguggaaca

SEQ ID NO: 715641 - RNA, 19 nt, Homo sapiens
ggcauggacccuucaagug

SEQ ID NO: 715642 - RNA, 19 nt, Homo sapiens
gugugcaccuguauuacug

SEQ ID NO: 715643 - RNA, 19 nt, Homo sapiens
uaggaaagagauacccauu

SEQ ID NO: 715644 - RNA, 19 nt, Homo sapiens
gugcaccuguauuacugaa

SEQ ID NO: 715645 - RNA, 19 nt, Homo sapiens
uguaauagggagaguugaa

SEQ ID NO: 715646 - RNA, 19 nt, Homo sapiens
gcccagugcuguguagucu

SEQ ID NO: 715647 - RNA, 19 nt, Homo sapiens
gccaugucguccuugauca

SEQ ID NO: 715648 - RNA, 19 nt, Homo sapiens
ccaaaggcagccgaauuga

SEQ ID NO: 715649 - RNA, 19 nt, Homo sapiens
cuuaccaaguugcugcuuu

SEQ ID NO: 715650 - RNA, 19 nt, Homo sapiens
gcugcaggcugugacuuca

SEQ ID NO: 715651 - RNA, 19 nt, Homo sapiens
uuugauguccguuauguga

SEQ ID NO: 715652 - RNA, 19 nt, Homo sapiens
ccauuggacccuacaguca

SEQ ID NO: 715653 - RNA, 19 nt, Homo sapiens
gcuaaacaagcucuuaaaa

SEQ ID NO: 715654 - RNA, 19 nt, Homo sapiens
caugaauauuagagaagga

SEQ ID NO: 715655 - RNA, 19 nt, Homo sapiens
caacggcaucacuauaagu

SEQ ID NO: 715656 - RNA, 19 nt, Homo sapiens
acaacggcaucacuauaag

SEQ ID NO: 715657 - RNA, 19 nt, Homo sapiens
gagaucaaggagaagauag

SEQ ID NO: 715658 - RNA, 19 nt, Homo sapiens
guuaugugauucugcuuuu

SEQ ID NO: 715659 - RNA, 19 nt, Homo sapiens
cugcaagagggaaggcuua

SEQ ID NO: 715660 - RNA, 19 nt, Homo sapiens
ggagaagauaguggaacaa

SEQ ID NO: 715661 - RNA, 19 nt, Homo sapiens
caaggagaagauaguggaa

SEQ ID NO: 715662 - RNA, 19 nt, Homo sapiens
agucuggaauuguuaacau

SEQ ID NO: 715663 - RNA, 19 nt, Homo sapiens
caggacagauaggcaugga

SEQ ID NO: 715664 - RNA, 19 nt, Homo sapiens
gauguccguuaugugauuc

SEQ ID NO: 715665 - RNA, 19 nt, Homo sapiens
acaaacaguauuucaagag

SEQ ID NO: 715666 - RNA, 19 nt, Homo sapiens
uuagccaugucguccuuga

SEQ ID NO: 715667 - RNA, 19 nt, Homo sapiens
gcuauccaaggaccacuga

SEQ ID NO: 715668 - RNA, 19 nt, Homo sapiens
uagucgacaggaccauuua

SEQ ID NO: 715669 - RNA, 19 nt, Homo sapiens
aaauugaagcaguagcuau

SEQ ID NO: 715670 - RNA, 19 nt, Homo sapiens
caaugaaaucuacaaacag

SEQ ID NO: 715671 - RNA, 19 nt, Homo sapiens
gcucugagaucuacauuca

SEQ ID NO: 715672 - RNA, 19 nt, Homo sapiens
gcacuaguguccugccaaa

SEQ ID NO: 715673 - RNA, 19 nt, Homo sapiens
ccaaaggacucugcauuga

SEQ ID NO: 715674 - RNA, 19 nt, Homo sapiens
ggaauacacccuuaggaaa

SEQ ID NO: 715675 - RNA, 19 nt, Homo sapiens
gcacacagcauggcagaaa

SEQ ID NO: 715676 - RNA, 19 nt, Homo sapiens
ccaguggaauacacccuua

SEQ ID NO: 715677 - RNA, 19 nt, Homo sapiens
ccguggagcuuguugauga

SEQ ID NO: 715678 - RNA, 19 nt, Homo sapiens
gaccagagccauguaagaa

SEQ ID NO: 715679 - RNA, 19 nt, Homo sapiens
gcucuucgcaugcugagua

SEQ ID NO: 715680 - RNA, 19 nt, Homo sapiens
gcacccacauccuucuuuc

SEQ ID NO: 715681 - RNA, 19 nt, Homo sapiens
aaagacacuccuccacuua

SEQ ID NO: 715682 - RNA, 19 nt, Homo sapiens
gaagagaggcacacagcau

SEQ ID NO: 715683 - RNA, 19 nt, Homo sapiens
ggaccagagccauguaaga

SEQ ID NO: 715684 - RNA, 19 nt, Homo sapiens
caacucagccauccacauc

SEQ ID NO: 715685 - RNA, 19 nt, Homo sapiens
acaugaagacggacuuuaa

SEQ ID NO: 715686 - RNA, 19 nt, Homo sapiens
gaauacacccuuaggaaaa

SEQ ID NO: 715687 - RNA, 19 nt, Homo sapiens
cuguaacuauugccauaua

SEQ ID NO: 715688 - RNA, 19 nt, Homo sapiens
gucuguaacuauugccaua

SEQ ID NO: 715689 - RNA, 19 nt, Homo sapiens
ggucacacccaaguaauug

SEQ ID NO: 715690 - RNA, 19 nt, Homo sapiens
uguaugcggucuguaacua

SEQ ID NO: 715691 - RNA, 19 nt, Homo sapiens
gcccaaaggacucugcauu

SEQ ID NO: 715692 - RNA, 19 nt, Homo sapiens
uaugcggucuguaacuauu

SEQ ID NO: 715693 - RNA, 19 nt, Homo sapiens
gaacgcgugcucugagauc

SEQ ID NO: 715694 - RNA, 19 nt, Homo sapiens
caacaugaagacggacuuu

SEQ ID NO: 715695 - RNA, 19 nt, Homo sapiens
gaacgaagagaggcacaca

SEQ ID NO: 715696 - RNA, 19 nt, Homo sapiens
ccagagccauguaagaaaa

SEQ ID NO: 715697 - RNA, 19 nt, Homo sapiens
caaccacgccaucaacauc

SEQ ID NO: 715698 - RNA, 19 nt, Homo sapiens
uggaauacacccuuaggaa

SEQ ID NO: 715699 - RNA, 19 nt, Homo sapiens
agacacuccuccacuuauc

SEQ ID NO: 715700 - RNA, 19 nt, Homo sapiens
ugacucggauccgcaacaa

SEQ ID NO: 715701 - RNA, 19 nt, Homo sapiens
cccaaaggacucugcauug

SEQ ID NO: 715702 - RNA, 19 nt, Homo sapiens
uguggaggcugaacuggau

SEQ ID NO: 715703 - RNA, 19 nt, Homo sapiens
guguguaugcggucuguaa

SEQ ID NO: 715704 - RNA, 19 nt, Homo sapiens
caaaggacucugcauugag

SEQ ID NO: 715705 - RNA, 19 nt, Homo sapiens
aaaagacacuccuccacuu

SEQ ID NO: 715706 - RNA, 19 nt, Homo sapiens
ccaaguaauugaaaagaca

SEQ ID NO: 715707 - RNA, 19 nt, Homo sapiens
ucucuugguggcccaguua

SEQ ID NO: 715708 - RNA, 19 nt, Homo sapiens
ucacacccaaguaauugaa

SEQ ID NO: 715709 - RNA, 19 nt, Homo sapiens
caugaagacggacuuuaag

SEQ ID NO: 715710 - RNA, 19 nt, Homo sapiens
ggaaauccauucaaucuga

SEQ ID NO: 715711 - RNA, 19 nt, Homo sapiens
ggaacugucuuucacauaa

SEQ ID NO: 715712 - RNA, 19 nt, Homo sapiens
gaaacagcauuuacagauu

SEQ ID NO: 715713 - RNA, 19 nt, Homo sapiens
caauagaggucacagcaaa

SEQ ID NO: 715714 - RNA, 19 nt, Homo sapiens
caacuucucucccugcauu

SEQ ID NO: 715715 - RNA, 19 nt, Homo sapiens
cagaugaccuugaucacua

SEQ ID NO: 715716 - RNA, 19 nt, Homo sapiens
gaacugucuuucacauaaa

SEQ ID NO: 715717 - RNA, 19 nt, Homo sapiens
ggaaacaucugcagagacu

SEQ ID NO: 715718 - RNA, 19 nt, Homo sapiens
gcuaagguauccuccauga

SEQ ID NO: 715719 - RNA, 19 nt, Homo sapiens
ggacuucacauuuguuauu

SEQ ID NO: 715720 - RNA, 19 nt, Homo sapiens
gcucugaccuucacucugu

SEQ ID NO: 715721 - RNA, 19 nt, Homo sapiens
ggaaacagcauuuacagau

SEQ ID NO: 715722 - RNA, 19 nt, Homo sapiens
acacaacgcauucucuaua

SEQ ID NO: 715723 - RNA, 19 nt, Homo sapiens
aaacagcauuuacagauuc

SEQ ID NO: 715724 - RNA, 19 nt, Homo sapiens
caccagaacucaucaacug

SEQ ID NO: 715725 - RNA, 19 nt, Homo sapiens
cuugaucacuauaccaaua

SEQ ID NO: 715726 - RNA, 19 nt, Homo sapiens
uaagguauccuccaugaug

SEQ ID NO: 715727 - RNA, 19 nt, Homo sapiens
caaacaaacacaacgcauu

SEQ ID NO: 715728 - RNA, 19 nt, Homo sapiens
ucacauaaaccauggaaau

SEQ ID NO: 715729 - RNA, 19 nt, Homo sapiens
gaaugaggcuauacaaaau

SEQ ID NO: 715730 - RNA, 19 nt, Homo sapiens
caucacaagcucaucuaua

SEQ ID NO: 715731 - RNA, 19 nt, Homo sapiens
gcuaccacuuggaccuuua

SEQ ID NO: 715732 - RNA, 19 nt, Homo sapiens
caacuggaaacagcauuua

SEQ ID NO: 715733 - RNA, 19 nt, Homo sapiens
caacagcucugaccuucac

SEQ ID NO: 715734 - RNA, 19 nt, Homo sapiens
cacaacgcauucucuauau

SEQ ID NO: 715735 - RNA, 19 nt, Homo sapiens
aaacacaacgcauucucua

SEQ ID NO: 715736 - RNA, 19 nt, Homo sapiens
aaacaaacacaacgcauuc

SEQ ID NO: 715737 - RNA, 19 nt, Homo sapiens
gccauuaaguccuucaaag

SEQ ID NO: 715738 - RNA, 19 nt, Homo sapiens
gagccucccagcauccuua

SEQ ID NO: 715739 - RNA, 19 nt, Homo sapiens
caaucaauguuguacaaag

SEQ ID NO: 715740 - RNA, 19 nt, Homo sapiens
guggacaaguggccugauu

SEQ ID NO: 715741 - RNA, 19 nt, Homo sapiens
uaccaaaucuacuccaaag

SEQ ID NO: 715742 - RNA, 19 nt, Homo sapiens
uaccaauacuuaccaaauc

SEQ ID NO: 715743 - RNA, 19 nt, Homo sapiens
uaugacagaugaccuugau

SEQ ID NO: 715744 - RNA, 19 nt, Homo sapiens
aucacaagcucaucuauau

SEQ ID NO: 715745 - RNA, 19 nt, Homo sapiens
ccaucucccuucucaucua

SEQ ID NO: 715746 - RNA, 19 nt, Homo sapiens
uuauugcccuuccugcuuu

SEQ ID NO: 715747 - RNA, 19 nt, Homo sapiens
ugacagaugaccuugauca

SEQ ID NO: 715748 - RNA, 19 nt, Homo sapiens
ggccaugugaguuugauaa

SEQ ID NO: 715749 - RNA, 19 nt, Homo sapiens
ggauaugacagaugaccuu

SEQ ID NO: 715750 - RNA, 19 nt, Homo sapiens
ugaaggcugugguggacaa

SEQ ID NO: 715751 - RNA, 19 nt, Homo sapiens
cacaagcucaucuauauuc

SEQ ID NO: 715752 - RNA, 19 nt, Homo sapiens
ccaaggccaugugaguuug

SEQ ID NO: 715753 - RNA, 19 nt, Homo sapiens
caaagucaaacaaacacaa

SEQ ID NO: 715754 - RNA, 19 nt, Homo sapiens
ccagaaggguguugcucau

SEQ ID NO: 715755 - RNA, 19 nt, Homo sapiens
uuccaggacuucacauuug

SEQ ID NO: 715756 - RNA, 19 nt, Homo sapiens
gguauccuccaugauguua

SEQ ID NO: 715757 - RNA, 19 nt, Homo sapiens
gaacucaucaacuggaaac

SEQ ID NO: 715758 - RNA, 19 nt, Homo sapiens
caaguggccugauuuuaau

SEQ ID NO: 715759 - RNA, 19 nt, Homo sapiens
caggacuucacauuuguua

SEQ ID NO: 715760 - RNA, 19 nt, Homo sapiens
gaaacagccaaggaacuga

SEQ ID NO: 715761 - RNA, 19 nt, Homo sapiens
caacgcauucucuauaugg

SEQ ID NO: 715762 - RNA, 19 nt, Homo sapiens
cagaacucaucaacuggaa

SEQ ID NO: 715763 - RNA, 19 nt, Homo sapiens
agcaggauaugacagauga

SEQ ID NO: 715764 - RNA, 19 nt, Homo sapiens
ugaaugaggcuauacaaaa

SEQ ID NO: 715765 - RNA, 19 nt, Homo sapiens
ggacaaguggccugauuuu

SEQ ID NO: 715766 - RNA, 19 nt, Homo sapiens
ucacaagcucaucuauauu

SEQ ID NO: 715767 - RNA, 19 nt, Homo sapiens
ggguguugcucaucguuuc

SEQ ID NO: 715768 - RNA, 19 nt, Homo sapiens
acaaguggccugauuuuaa

SEQ ID NO: 715769 - RNA, 19 nt, Homo sapiens
ugucuacucugucucucaa

SEQ ID NO: 715770 - RNA, 19 nt, Homo sapiens
guaccacucacacuucuca

SEQ ID NO: 715771 - RNA, 19 nt, Homo sapiens
ccggaaacaucugcagaga

SEQ ID NO: 715772 - RNA, 19 nt, Homo sapiens
gaaggguguugcucaucgu

SEQ ID NO: 715773 - RNA, 19 nt, Homo sapiens
gagcaggauaugacagaug

SEQ ID NO: 715774 - RNA, 19 nt, Homo sapiens
ccauuaaguccuucaaagu

SEQ ID NO: 715775 - RNA, 19 nt, Homo sapiens
gcauuuacagauucaaagu

SEQ ID NO: 715776 - RNA, 19 nt, Homo sapiens
ccaauacuuaccaaaucua

SEQ ID NO: 715777 - RNA, 19 nt, Homo sapiens
auagaggucacagcaaaua

SEQ ID NO: 715778 - RNA, 19 nt, Homo sapiens
aaacaucugcagagacuag

SEQ ID NO: 715779 - RNA, 19 nt, Homo sapiens
gaggucacagcaaauacaa

SEQ ID NO: 715780 - RNA, 19 nt, Homo sapiens
ccacuuggaccuuuauugc

SEQ ID NO: 715781 - RNA, 19 nt, Homo sapiens
cccaaggccaugugaguuu

SEQ ID NO: 715782 - RNA, 19 nt, Homo sapiens
acaacgcauucucuauaug

SEQ ID NO: 715783 - RNA, 19 nt, Homo sapiens
auuaaguccuucaaaguca

SEQ ID NO: 715784 - RNA, 19 nt, Homo sapiens
cagcauuuacagauucaaa

SEQ ID NO: 715785 - RNA, 19 nt, Homo sapiens
ucaacuggaaacagcauuu

SEQ ID NO: 715786 - RNA, 19 nt, Homo sapiens
ccaaaacugucaggaauuc

SEQ ID NO: 715787 - RNA, 19 nt, Homo sapiens
ccaaagauccccaaaacug

SEQ ID NO: 715788 - RNA, 19 nt, Homo sapiens
ucacucuguuccucuuuca

SEQ ID NO: 715789 - RNA, 19 nt, Homo sapiens
cacucuggcuuuccuacaa

SEQ ID NO: 715790 - RNA, 19 nt, Homo sapiens
gcaaacccaaggccaugug

SEQ ID NO: 715791 - RNA, 19 nt, Homo sapiens
cuauauggcagcugaaaca

SEQ ID NO: 715792 - RNA, 19 nt, Homo sapiens
ugcagaugcuggagaaauc

SEQ ID NO: 715793 - RNA, 19 nt, Homo sapiens
ccuccaugauguuaccauu

SEQ ID NO: 715794 - RNA, 19 nt, Homo sapiens
ggagcaggauaugacagau

SEQ ID NO: 715795 - RNA, 19 nt, Homo sapiens
ccauagcaaccaagagaug

SEQ ID NO: 715796 - RNA, 19 nt, Homo sapiens
gauaaaauccagucuguac

SEQ ID NO: 715797 - RNA, 19 nt, Homo sapiens
ugaaacagccaaggaacug

SEQ ID NO: 715798 - RNA, 19 nt, Homo sapiens
cauuaaguccuucaaaguc

SEQ ID NO: 715799 - RNA, 19 nt, Homo sapiens
caccaucucccuucucauc

SEQ ID NO: 715800 - RNA, 19 nt, Homo sapiens
caaacacaacgcauucucu

SEQ ID NO: 715801 - RNA, 19 nt, Homo sapiens
gauguuaccauugcaaggu

SEQ ID NO: 715802 - RNA, 19 nt, Homo sapiens
ucuacucugucucucaaga

SEQ ID NO: 715803 - RNA, 19 nt, Homo sapiens
gccaugugaguuugauaaa

SEQ ID NO: 715804 - RNA, 19 nt, Homo sapiens
uuaaguccuucaaagucaa

SEQ ID NO: 715805 - RNA, 19 nt, Homo sapiens
agaugaccuugaucacuau

SEQ ID NO: 715806 - RNA, 19 nt, Homo sapiens
gugcccagaugcugcagau

SEQ ID NO: 715807 - RNA, 19 nt, Homo sapiens
caucuauauuccaggacuu

SEQ ID NO: 715808 - RNA, 19 nt, Homo sapiens
ggcuaccacuuggaccuuu

SEQ ID NO: 715809 - RNA, 19 nt, Homo sapiens
caucucccuucucaucuag

SEQ ID NO: 715810 - RNA, 19 nt, Homo sapiens
ggaaggagguggaaagaaa

SEQ ID NO: 715811 - RNA, 19 nt, Homo sapiens
gaagauaaccuugaugauu

SEQ ID NO: 715812 - RNA, 19 nt, Homo sapiens
gaguagaucuccaguaaga

SEQ ID NO: 715813 - RNA, 19 nt, Homo sapiens
gauaagauguauucaccua

SEQ ID NO: 715814 - RNA, 19 nt, Homo sapiens
ggaaauguuuguuaugaug

SEQ ID NO: 715815 - RNA, 19 nt, Homo sapiens
gaaggagacugaaagugaa

SEQ ID NO: 715816 - RNA, 19 nt, Homo sapiens
agucuuagcucccauuuaa

SEQ ID NO: 715817 - RNA, 19 nt, Homo sapiens
gauaaucgguucagcaaca

SEQ ID NO: 715818 - RNA, 19 nt, Homo sapiens
gauucgagcucuaggauga

SEQ ID NO: 715819 - RNA, 19 nt, Homo sapiens
aaagacagauugaacaaga

SEQ ID NO: 715820 - RNA, 19 nt, Homo sapiens
aaagcaagaugaagacaaa

SEQ ID NO: 715821 - RNA, 19 nt, Homo sapiens
ggaauagugucuugguuuc

SEQ ID NO: 715822 - RNA, 19 nt, Homo sapiens
aagauacucuccuccaaua

SEQ ID NO: 715823 - RNA, 19 nt, Homo sapiens
caagagacguucaccuuca

SEQ ID NO: 715824 - RNA, 19 nt, Homo sapiens
aaagaaagcagcagagaaa

SEQ ID NO: 715825 - RNA, 19 nt, Homo sapiens
ugucauggcucuguucaua

SEQ ID NO: 715826 - RNA, 19 nt, Homo sapiens
gaaauaagaccacuguuuu

SEQ ID NO: 715827 - RNA, 19 nt, Homo sapiens
gaaaugucauggcucuguu

SEQ ID NO: 715828 - RNA, 19 nt, Homo sapiens
ucccaaaccugaaccuaua

SEQ ID NO: 715829 - RNA, 19 nt, Homo sapiens
caaagaagccucccaagag

SEQ ID NO: 715830 - RNA, 19 nt, Homo sapiens
gccacaaucuuuccuguug

SEQ ID NO: 715831 - RNA, 19 nt, Homo sapiens
gaaagugaagcugaagaua

SEQ ID NO: 715832 - RNA, 19 nt, Homo sapiens
gaagaugaacgacccaaga

SEQ ID NO: 715833 - RNA, 19 nt, Homo sapiens
ugaagaugauguugugauu

SEQ ID NO: 715834 - RNA, 19 nt, Homo sapiens
ggacucucauucuguuauu

SEQ ID NO: 715835 - RNA, 19 nt, Homo sapiens
caaagaagcuccccaguca

SEQ ID NO: 715836 - RNA, 19 nt, Homo sapiens
cccaagagaucccauguga

SEQ ID NO: 715837 - RNA, 19 nt, Homo sapiens
gcagagacgccaauacaga

SEQ ID NO: 715838 - RNA, 19 nt, Homo sapiens
uaagauguauucaccuaga

SEQ ID NO: 715839 - RNA, 19 nt, Homo sapiens
ccaggacacuguggguuua

SEQ ID NO: 715840 - RNA, 19 nt, Homo sapiens
cagcugacauaauucauug

SEQ ID NO: 715841 - RNA, 19 nt, Homo sapiens
guacgcaguucaauuucaa

SEQ ID NO: 715842 - RNA, 19 nt, Homo sapiens
aagaugauguugugauuga

SEQ ID NO: 715843 - RNA, 19 nt, Homo sapiens
ggaaauccuuggguuugaa

SEQ ID NO: 715844 - RNA, 19 nt, Homo sapiens
ggguuuauauugaugugua

SEQ ID NO: 715845 - RNA, 19 nt, Homo sapiens
acauaaagguacugagaaa

SEQ ID NO: 715846 - RNA, 19 nt, Homo sapiens
gaagaacuccgccaagaag

SEQ ID NO: 715847 - RNA, 19 nt, Homo sapiens
gagagaaagcgcagucauu

SEQ ID NO: 715848 - RNA, 19 nt, Homo sapiens
ggacaugagcaaaguaaau

SEQ ID NO: 715849 - RNA, 19 nt, Homo sapiens
aaagugaagcugaagauaa

SEQ ID NO: 715850 - RNA, 19 nt, Homo sapiens
gaaaagcaccugcgugaaa

SEQ ID NO: 715851 - RNA, 19 nt, Homo sapiens
caagagaucccaugugaag

SEQ ID NO: 715852 - RNA, 19 nt, Homo sapiens
agaaauaagaccacuguuu

SEQ ID NO: 715853 - RNA, 19 nt, Homo sapiens
auugacagcugacauaauu

SEQ ID NO: 715854 - RNA, 19 nt, Homo sapiens
uguuugagcuuuagacuau

SEQ ID NO: 715855 - RNA, 19 nt, Homo sapiens
ugaagcagcugaaauuugc

SEQ ID NO: 715856 - RNA, 19 nt, Homo sapiens
gagaagacccgaccacgau

SEQ ID NO: 715857 - RNA, 19 nt, Homo sapiens
agaaggagacugaaaguga

SEQ ID NO: 715858 - RNA, 19 nt, Homo sapiens
ccucagaccuccucaaguc

SEQ ID NO: 715859 - RNA, 19 nt, Homo sapiens
gaagauacucuccuccaau

SEQ ID NO: 715860 - RNA, 19 nt, Homo sapiens
gaagaauccagacuccaaa

SEQ ID NO: 715861 - RNA, 19 nt, Homo sapiens
ucauggcucuguucauauu

SEQ ID NO: 715862 - RNA, 19 nt, Homo sapiens
gggcauggauuuacauugc

SEQ ID NO: 715863 - RNA, 19 nt, Homo sapiens
ccaaguacuaggcccauua

SEQ ID NO: 715864 - RNA, 19 nt, Homo sapiens
ccaaagaagccucccaaga

SEQ ID NO: 715865 - RNA, 19 nt, Homo sapiens
caagaugaagacaaagaua

SEQ ID NO: 715866 - RNA, 19 nt, Homo sapiens
gaacugaagaaagaagaaa

SEQ ID NO: 715867 - RNA, 19 nt, Homo sapiens
ucaaccagcuggaagugaa

SEQ ID NO: 715868 - RNA, 19 nt, Homo sapiens
agaagaaacuacugaagca

SEQ ID NO: 715869 - RNA, 19 nt, Homo sapiens
gcgcucaccuucuccuaga

SEQ ID NO: 715870 - RNA, 19 nt, Homo sapiens
aaacauaaagguacugaga

SEQ ID NO: 715871 - RNA, 19 nt, Homo sapiens
gcugcuaagugcacaagaa

SEQ ID NO: 715872 - RNA, 19 nt, Homo sapiens
gcuuguggauuaaacagaa

SEQ ID NO: 715873 - RNA, 19 nt, Homo sapiens
ccauagauccgauaagaug

SEQ ID NO: 715874 - RNA, 19 nt, Homo sapiens
aaaagaaccuucaguacaa

SEQ ID NO: 715875 - RNA, 19 nt, Homo sapiens
uauaaagccuuggauaaca

SEQ ID NO: 715876 - RNA, 19 nt, Homo sapiens
gaagaaggagacugaaagu

SEQ ID NO: 715877 - RNA, 19 nt, Homo sapiens
gacaugagcaaaguaaauu

SEQ ID NO: 715878 - RNA, 19 nt, Homo sapiens
caacaaacagaagaaacua

SEQ ID NO: 715879 - RNA, 19 nt, Homo sapiens
gcucuaggaugagacagaa

SEQ ID NO: 715880 - RNA, 19 nt, Homo sapiens
gagacguucaccuucauua

SEQ ID NO: 715881 - RNA, 19 nt, Homo sapiens
agggagaacuucagguaaa

SEQ ID NO: 715882 - RNA, 19 nt, Homo sapiens
aagaagaacuccgccaaga

SEQ ID NO: 715883 - RNA, 19 nt, Homo sapiens
cuagugacauucugaaagu

SEQ ID NO: 715884 - RNA, 19 nt, Homo sapiens
caaaucaaccugacuggau

SEQ ID NO: 715885 - RNA, 19 nt, Homo sapiens
uggagucucugcugaaaug

SEQ ID NO: 715886 - RNA, 19 nt, Homo sapiens
aaacagaagaaacuacuga

SEQ ID NO: 715887 - RNA, 19 nt, Homo sapiens
cgccauagauccgauaaga

SEQ ID NO: 715888 - RNA, 19 nt, Homo sapiens
gggcccagacuuuggaaua

SEQ ID NO: 715889 - RNA, 19 nt, Homo sapiens
gggaaauguuuguuaugau

SEQ ID NO: 715890 - RNA, 19 nt, Homo sapiens
gaaggacaagaaacacaaa

SEQ ID NO: 715891 - RNA, 19 nt, Homo sapiens
gaagaggagcgucgucauc

SEQ ID NO: 715892 - RNA, 19 nt, Homo sapiens
gcaacaaacagaagaaacu

SEQ ID NO: 715893 - RNA, 19 nt, Homo sapiens
ccagggagaacuucaggua

SEQ ID NO: 715894 - RNA, 19 nt, Homo sapiens
gggaguagcucaucauccu

SEQ ID NO: 715895 - RNA, 19 nt, Homo sapiens
gcugaaauuugcagaaugc

SEQ ID NO: 715896 - RNA, 19 nt, Homo sapiens
guacaagaggcuacuucua

SEQ ID NO: 715897 - RNA, 19 nt, Homo sapiens
gaacacuggacucucauuc

SEQ ID NO: 715898 - RNA, 19 nt, Homo sapiens
gaaaguucccaaaccugaa

SEQ ID NO: 715899 - RNA, 19 nt, Homo sapiens
guaagcuugcccagaaaua

SEQ ID NO: 715900 - RNA, 19 nt, Homo sapiens
gcagucaaaccguacaaga

SEQ ID NO: 715901 - RNA, 19 nt, Homo sapiens
gauccgauaagauguauuc

SEQ ID NO: 715902 - RNA, 19 nt, Homo sapiens
uccuagaacugaagaaaga

SEQ ID NO: 715903 - RNA, 19 nt, Homo sapiens
aaugaaagcauguuguuug

SEQ ID NO: 715904 - RNA, 19 nt, Homo sapiens
gcauggauuuacauugcaa

SEQ ID NO: 715905 - RNA, 19 nt, Homo sapiens
guaauaauugcuagguuga

SEQ ID NO: 715906 - RNA, 19 nt, Homo sapiens
cagcugaaauuugcagaau

SEQ ID NO: 715907 - RNA, 19 nt, Homo sapiens
gcccaucaccgccaagaaa

SEQ ID NO: 715908 - RNA, 19 nt, Homo sapiens
guaagacgaagaagacguu

SEQ ID NO: 715909 - RNA, 19 nt, Homo sapiens
gaggcuacuucuacuagug

SEQ ID NO: 715910 - RNA, 19 nt, Homo sapiens
gcaguuaaaucaucuguua

SEQ ID NO: 715911 - RNA, 19 nt, Homo sapiens
gaacugaucacuagcaaua

SEQ ID NO: 715912 - RNA, 19 nt, Homo sapiens
gaaaggaggugaauucauc

SEQ ID NO: 715913 - RNA, 19 nt, Homo sapiens
gaacugacuucucucuuaa

SEQ ID NO: 715914 - RNA, 19 nt, Homo sapiens
ggagaaaccuaaagacuga

SEQ ID NO: 715915 - RNA, 19 nt, Homo sapiens
ggaaauacguccaucaaga

SEQ ID NO: 715916 - RNA, 19 nt, Homo sapiens
caaagaaacugcaaggaaa

SEQ ID NO: 715917 - RNA, 19 nt, Homo sapiens
caacuuuacucgugaauuu

SEQ ID NO: 715918 - RNA, 19 nt, Homo sapiens
gcaagggaauuaauguaua

SEQ ID NO: 715919 - RNA, 19 nt, Homo sapiens
guacaagguucuauacaaa

SEQ ID NO: 715920 - RNA, 19 nt, Homo sapiens
ggagaaguguauaguagua

SEQ ID NO: 715921 - RNA, 19 nt, Homo sapiens
guaaugaacugaucacuag

SEQ ID NO: 715922 - RNA, 19 nt, Homo sapiens
gaauagggaucaagaggaa

SEQ ID NO: 715923 - RNA, 19 nt, Homo sapiens
gagauaaccuaccaccuuu

SEQ ID NO: 715924 - RNA, 19 nt, Homo sapiens
gaaugacacugacuaaugu

SEQ ID NO: 715925 - RNA, 19 nt, Homo sapiens
gaaauuaauucccuguuca

SEQ ID NO: 715926 - RNA, 19 nt, Homo sapiens
gcacagagaaguuaaguga

SEQ ID NO: 715927 - RNA, 19 nt, Homo sapiens
ucauacaucuggcuacuua

SEQ ID NO: 715928 - RNA, 19 nt, Homo sapiens
gaauugcuuugcucuauuu

SEQ ID NO: 715929 - RNA, 19 nt, Homo sapiens
gaacaaaguauaacugaga

SEQ ID NO: 715930 - RNA, 19 nt, Homo sapiens
acacagaagugguaaugua

SEQ ID NO: 715931 - RNA, 19 nt, Homo sapiens
aaacugagaugaaagaugu

SEQ ID NO: 715932 - RNA, 19 nt, Homo sapiens
gaagacaacugugcugaug

SEQ ID NO: 715933 - RNA, 19 nt, Homo sapiens
cgaaguaaguuagagauaa

SEQ ID NO: 715934 - RNA, 19 nt, Homo sapiens
gaggcgaaguuaucuuaua

SEQ ID NO: 715935 - RNA, 19 nt, Homo sapiens
gaugggcacuuaaauaugu

SEQ ID NO: 715936 - RNA, 19 nt, Homo sapiens
caacaaauucugccuauug

SEQ ID NO: 715937 - RNA, 19 nt, Homo sapiens
gaauugagacuggaauaua

SEQ ID NO: 715938 - RNA, 19 nt, Homo sapiens
guaacaagauugaacacuu

SEQ ID NO: 715939 - RNA, 19 nt, Homo sapiens
ccacagguauguucucuug

SEQ ID NO: 715940 - RNA, 19 nt, Homo sapiens
ggaaugacacugacuaaug

SEQ ID NO: 715941 - RNA, 19 nt, Homo sapiens
agaagaaauugaaggguua

SEQ ID NO: 715942 - RNA, 19 nt, Homo sapiens
ggagacagcagaagaaaga

SEQ ID NO: 715943 - RNA, 19 nt, Homo sapiens
uaaagaacaucuaguccaa

SEQ ID NO: 715944 - RNA, 19 nt, Homo sapiens
guggguagcuaauuaacua

SEQ ID NO: 715945 - RNA, 19 nt, Homo sapiens
caugguggguagcuaauua

SEQ ID NO: 715946 - RNA, 19 nt, Homo sapiens
caggaaccaugccuaguua

SEQ ID NO: 715947 - RNA, 19 nt, Homo sapiens
ccacuccucuucagucuuu

SEQ ID NO: 715948 - RNA, 19 nt, Homo sapiens
gaacaagacagaacuaucu

SEQ ID NO: 715949 - RNA, 19 nt, Homo sapiens
caaagaggguaagcguuua

SEQ ID NO: 715950 - RNA, 19 nt, Homo sapiens
gaagagagguggagaaacc

SEQ ID NO: 715951 - RNA, 19 nt, Homo sapiens
ggccagaauucuugucuuu

SEQ ID NO: 715952 - RNA, 19 nt, Homo sapiens
gcaaucugcuguugaguca

SEQ ID NO: 715953 - RNA, 19 nt, Homo sapiens
ucaggaugcucauaacuuu

SEQ ID NO: 715954 - RNA, 19 nt, Homo sapiens
guaugugccuuuaaucuga

SEQ ID NO: 715955 - RNA, 19 nt, Homo sapiens
ucaaagugguguuguagaa

SEQ ID NO: 715956 - RNA, 19 nt, Homo sapiens
gaagaaagaaagagagaga

SEQ ID NO: 715957 - RNA, 19 nt, Homo sapiens
guaaugggaaguaauagua

SEQ ID NO: 715958 - RNA, 19 nt, Homo sapiens
acacuuaucuacccugaaa

SEQ ID NO: 715959 - RNA, 19 nt, Homo sapiens
caacauggccuuaguacug

SEQ ID NO: 715960 - RNA, 19 nt, Homo sapiens
gauagcauguaacaagauu

SEQ ID NO: 715961 - RNA, 19 nt, Homo sapiens
ccagaauucuugucuuuau

SEQ ID NO: 715962 - RNA, 19 nt, Homo sapiens
gagauuaguuggcuuaaac

SEQ ID NO: 715963 - RNA, 19 nt, Homo sapiens
gaaauucuuggucccuuua

SEQ ID NO: 715964 - RNA, 19 nt, Homo sapiens
ugacacagacacauuauaa

SEQ ID NO: 715965 - RNA, 19 nt, Homo sapiens
gaaggcacauauguucuuu

SEQ ID NO: 715966 - RNA, 19 nt, Homo sapiens
gcucucaucucauuaguca

SEQ ID NO: 715967 - RNA, 19 nt, Homo sapiens
cuugauagcuccuugauau

SEQ ID NO: 715968 - RNA, 19 nt, Homo sapiens
caaaguauaugccacuaca

SEQ ID NO: 715969 - RNA, 19 nt, Homo sapiens
caacauagguaucauucca

SEQ ID NO: 715970 - RNA, 19 nt, Homo sapiens
ggagcuaaauuauucuaug

SEQ ID NO: 715971 - RNA, 19 nt, Homo sapiens
gaaaagcucugcccaguuc

SEQ ID NO: 715972 - RNA, 19 nt, Homo sapiens
gauaaaccauuuccucaag

SEQ ID NO: 715973 - RNA, 19 nt, Homo sapiens
ccauaguacuuagaucuua

SEQ ID NO: 715974 - RNA, 19 nt, Homo sapiens
gcacagagagggaaaauaa

SEQ ID NO: 715975 - RNA, 19 nt, Homo sapiens
auacguccaucaagauuua

SEQ ID NO: 715976 - RNA, 19 nt, Homo sapiens
cuaaauggccuuacacuug

SEQ ID NO: 715977 - RNA, 19 nt, Homo sapiens
caauaccuguaaccucuua

SEQ ID NO: 715978 - RNA, 19 nt, Homo sapiens
uuccauagauguuuccuua

SEQ ID NO: 715979 - RNA, 19 nt, Homo sapiens
caccaaggcuuaacagaau

SEQ ID NO: 715980 - RNA, 19 nt, Homo sapiens
gaacacagaagugguaaug

SEQ ID NO: 715981 - RNA, 19 nt, Homo sapiens
guaaggaaaggguuaauga

SEQ ID NO: 715982 - RNA, 19 nt, Homo sapiens
ugaguggaauuaugacuuu

SEQ ID NO: 715983 - RNA, 19 nt, Homo sapiens
ccaaagaggguaagcguuu

SEQ ID NO: 715984 - RNA, 19 nt, Homo sapiens
gaaguguacugacauuugg

SEQ ID NO: 715985 - RNA, 19 nt, Homo sapiens
gcccuucucuucuuuauuc

SEQ ID NO: 715986 - RNA, 19 nt, Homo sapiens
gcagugggauaucuggauu

SEQ ID NO: 715987 - RNA, 19 nt, Homo sapiens
gaauaugccacuaacacua

SEQ ID NO: 715988 - RNA, 19 nt, Homo sapiens
gaaauacguccaucaagau

SEQ ID NO: 715989 - RNA, 19 nt, Homo sapiens
ucacauuccuucgaaguaa

SEQ ID NO: 715990 - RNA, 19 nt, Homo sapiens
gaacaaagcaaaggauaca

SEQ ID NO: 715991 - RNA, 19 nt, Homo sapiens
ccauagauguuuccuuaga

SEQ ID NO: 715992 - RNA, 19 nt, Homo sapiens
ccagcaacguggagguuua

SEQ ID NO: 715993 - RNA, 19 nt, Homo sapiens
gcacuugucucugcugugu

SEQ ID NO: 715994 - RNA, 19 nt, Homo sapiens
uacaagggcuccucuuuau

SEQ ID NO: 715995 - RNA, 19 nt, Homo sapiens
ggucguaugugccuuuaau

SEQ ID NO: 715996 - RNA, 19 nt, Homo sapiens
gcuaagagagggaaaguga

SEQ ID NO: 715997 - RNA, 19 nt, Homo sapiens
acagguauguucucuugua

SEQ ID NO: 715998 - RNA, 19 nt, Homo sapiens
gaggugaauucaucugcua

SEQ ID NO: 715999 - RNA, 19 nt, Homo sapiens
agaaagggaugcacagaga

SEQ ID NO: 716000 - RNA, 19 nt, Homo sapiens
ccuguaaccucuuauguug

SEQ ID NO: 716001 - RNA, 19 nt, Homo sapiens
ggaaggaaucuuaacuauu

SEQ ID NO: 716002 - RNA, 19 nt, Homo sapiens
uaaaucaggaugcucauaa

SEQ ID NO: 716003 - RNA, 19 nt, Homo sapiens
cauuaaagcagaagcauuu

SEQ ID NO: 716004 - RNA, 19 nt, Homo sapiens
gagaaucauuaaagcagaa

SEQ ID NO: 716005 - RNA, 19 nt, Homo sapiens
uaaaguucccagaugauua

SEQ ID NO: 716006 - RNA, 19 nt, Homo sapiens
uccuagagguucaaaguua

SEQ ID NO: 716007 - RNA, 19 nt, Homo sapiens
uaacuaaacugcugaacac

SEQ ID NO: 716008 - RNA, 19 nt, Homo sapiens
gauggguccuguugggaua

SEQ ID NO: 716009 - RNA, 19 nt, Homo sapiens
ccuaaagacugcugcuaaa

SEQ ID NO: 716010 - RNA, 19 nt, Homo sapiens
gagagaaugugcuauauuu

SEQ ID NO: 716011 - RNA, 19 nt, Homo sapiens
caacauagcaucauuaauc

SEQ ID NO: 716012 - RNA, 19 nt, Homo sapiens
gaaugugaaucaaucagua

SEQ ID NO: 716013 - RNA, 19 nt, Homo sapiens
ggaagaaugugaaucaauc

SEQ ID NO: 716014 - RNA, 19 nt, Homo sapiens
ugaaaggucucuucuauca

SEQ ID NO: 716015 - RNA, 19 nt, Homo sapiens
gaacagagacugcuaggau

SEQ ID NO: 716016 - RNA, 19 nt, Homo sapiens
agaggcaucuuacaaauuu

SEQ ID NO: 716017 - RNA, 19 nt, Homo sapiens
gcacaucgcagaaagaaga

SEQ ID NO: 716018 - RNA, 19 nt, Homo sapiens
gcacagacacaaaauauua

SEQ ID NO: 716019 - RNA, 19 nt, Homo sapiens
uaauggagcucaaaguaug

SEQ ID NO: 716020 - RNA, 19 nt, Homo sapiens
caucgagacuggauuuauu

SEQ ID NO: 716021 - RNA, 19 nt, Homo sapiens
gggauagucuuugcuguuu

SEQ ID NO: 716022 - RNA, 19 nt, Homo sapiens
gcuaauggagcucaaagua

SEQ ID NO: 716023 - RNA, 19 nt, Homo sapiens
gcagguacaugucuugucu

SEQ ID NO: 716024 - RNA, 19 nt, Homo sapiens
ccagagagaaugugcuaua

SEQ ID NO: 716025 - RNA, 19 nt, Homo sapiens
ggacaacugugcugacaac

SEQ ID NO: 716026 - RNA, 19 nt, Homo sapiens
ugugaaaggucucuucuau

SEQ ID NO: 716027 - RNA, 19 nt, Homo sapiens
gaguucagauguguucuaa

SEQ ID NO: 716028 - RNA, 19 nt, Homo sapiens
aaaccaacauagcaucauu

SEQ ID NO: 716029 - RNA, 19 nt, Homo sapiens
aagcagagguuggaaagaa

SEQ ID NO: 716030 - RNA, 19 nt, Homo sapiens
ggacuucauguauauugua

SEQ ID NO: 716031 - RNA, 19 nt, Homo sapiens
gaacuuggugacccaugua

SEQ ID NO: 716032 - RNA, 19 nt, Homo sapiens
guuauaaucuuggcacugu

SEQ ID NO: 716033 - RNA, 19 nt, Homo sapiens
gagacuggauuuauuugca

SEQ ID NO: 716034 - RNA, 19 nt, Homo sapiens
gaucagagccauccgaaac

SEQ ID NO: 716035 - RNA, 19 nt, Homo sapiens
ugacccauguauugcauaa

SEQ ID NO: 716036 - RNA, 19 nt, Homo sapiens
gcucggaaguuggucuaaa

SEQ ID NO: 716037 - RNA, 19 nt, Homo sapiens
acacauaugcaaccaacua

SEQ ID NO: 716038 - RNA, 19 nt, Homo sapiens
ccuuuggacuucauguaua

SEQ ID NO: 716039 - RNA, 19 nt, Homo sapiens
cagagagaaugugcuauau

SEQ ID NO: 716040 - RNA, 19 nt, Homo sapiens
gaggacaacugugcugaca

SEQ ID NO: 716041 - RNA, 19 nt, Homo sapiens
guucagauguguucuaagc

SEQ ID NO: 716042 - RNA, 19 nt, Homo sapiens
gugaaucaaucaguauguu

SEQ ID NO: 716043 - RNA, 19 nt, Homo sapiens
gaagaaugugaaucaauca

SEQ ID NO: 716044 - RNA, 19 nt, Homo sapiens
uauaaucuuggcacuguua

SEQ ID NO: 716045 - RNA, 19 nt, Homo sapiens
ggacuuguguaugcugugu

SEQ ID NO: 716046 - RNA, 19 nt, Homo sapiens
ggauagucuuugcuguuug

SEQ ID NO: 716047 - RNA, 19 nt, Homo sapiens
cccagaacgugauugacua

SEQ ID NO: 716048 - RNA, 19 nt, Homo sapiens
ucacggaguucagaugugu

SEQ ID NO: 716049 - RNA, 19 nt, Homo sapiens
gguuacagaugcauauguc

SEQ ID NO: 716050 - RNA, 19 nt, Homo sapiens
aaaggucucuucuaucacu

SEQ ID NO: 716051 - RNA, 19 nt, Homo sapiens
gccuguugcugauggcaua

SEQ ID NO: 716052 - RNA, 19 nt, Homo sapiens
ggaguucagauguguucua

SEQ ID NO: 716053 - RNA, 19 nt, Homo sapiens
ucgcucaucugccaggaaa

SEQ ID NO: 716054 - RNA, 19 nt, Homo sapiens
ccacugagcaaggaagauu

SEQ ID NO: 716055 - RNA, 19 nt, Homo sapiens
ugcauaagcuaaagcaaca

SEQ ID NO: 716056 - RNA, 19 nt, Homo sapiens
gcugcaaaguucccacugu

SEQ ID NO: 716057 - RNA, 19 nt, Homo sapiens
gauagucuuugcuguuugc

SEQ ID NO: 716058 - RNA, 19 nt, Homo sapiens
uagcaucauuaaucaggaa

SEQ ID NO: 716059 - RNA, 19 nt, Homo sapiens
gaucacggaguucagaugu

SEQ ID NO: 716060 - RNA, 19 nt, Homo sapiens
gcugacaacccauguucuu

SEQ ID NO: 716061 - RNA, 19 nt, Homo sapiens
gggaaucuggcuccgaauu

SEQ ID NO: 716062 - RNA, 19 nt, Homo sapiens
ucacuguucuaaugaugau

SEQ ID NO: 716063 - RNA, 19 nt, Homo sapiens
uguggcaagugcaaaugua

SEQ ID NO: 716064 - RNA, 19 nt, Homo sapiens
cuaauggagcucaaaguau

SEQ ID NO: 716065 - RNA, 19 nt, Homo sapiens
gaauaguacuugcaaaacu

SEQ ID NO: 716066 - RNA, 19 nt, Homo sapiens
gcgcuucggccucuuguuc

SEQ ID NO: 716067 - RNA, 19 nt, Homo sapiens
gacaacccauguucuugca

SEQ ID NO: 716068 - RNA, 19 nt, Homo sapiens
gcaucgagacuggauuuau

SEQ ID NO: 716069 - RNA, 19 nt, Homo sapiens
agacucugauuucccuuug

SEQ ID NO: 716070 - RNA, 19 nt, Homo sapiens
aaacaccaaugaguacaca

SEQ ID NO: 716071 - RNA, 19 nt, Homo sapiens
cagaugcauauguccaaua

SEQ ID NO: 716072 - RNA, 19 nt, Homo sapiens
uaaagcagagguuggaaag

SEQ ID NO: 716073 - RNA, 19 nt, Homo sapiens
ugauuucccuuuggacuuc

SEQ ID NO: 716074 - RNA, 19 nt, Homo sapiens
agagagaaugugcuauauu

SEQ ID NO: 716075 - RNA, 19 nt, Homo sapiens
acucgcagguccauucuuc

SEQ ID NO: 716076 - RNA, 19 nt, Homo sapiens
uuaugaggaugugauaguu

SEQ ID NO: 716077 - RNA, 19 nt, Homo sapiens
agaacgugauugacuaugg

SEQ ID NO: 716078 - RNA, 19 nt, Homo sapiens
guaaauuagcagaugacuu

SEQ ID NO: 716079 - RNA, 19 nt, Homo sapiens
uaagcuaaagcaacacaga

SEQ ID NO: 716080 - RNA, 19 nt, Homo sapiens
gcaucauuaaucaggaaua

SEQ ID NO: 716081 - RNA, 19 nt, Homo sapiens
gcagaaagaagagaaucca

SEQ ID NO: 716082 - RNA, 19 nt, Homo sapiens
cuaaagcagagguuggaaa

SEQ ID NO: 716083 - RNA, 19 nt, Homo sapiens
gagguuggaaagaaaggaa

SEQ ID NO: 716084 - RNA, 19 nt, Homo sapiens
cuuuggacuucauguauau

SEQ ID NO: 716085 - RNA, 19 nt, Homo sapiens
ggucucuucuaucacuguu

SEQ ID NO: 716086 - RNA, 19 nt, Homo sapiens
cuaugggacuuguguaugc

SEQ ID NO: 716087 - RNA, 19 nt, Homo sapiens
gacuaugggacuuguguau

SEQ ID NO: 716088 - RNA, 19 nt, Homo sapiens
cuuguaaauuagcagauga

SEQ ID NO: 716089 - RNA, 19 nt, Homo sapiens
agaacuuggugacccaugu

SEQ ID NO: 716090 - RNA, 19 nt, Homo sapiens
aaccaacauagcaucauua

SEQ ID NO: 716091 - RNA, 19 nt, Homo sapiens
cuaaugaugaugaggacaa

SEQ ID NO: 716092 - RNA, 19 nt, Homo sapiens
ggugacccauguauugcau

SEQ ID NO: 716093 - RNA, 19 nt, Homo sapiens
cacauaugcaaccaacuaa

SEQ ID NO: 716094 - RNA, 19 nt, Homo sapiens
uucuaucacuguucuaaug

SEQ ID NO: 716095 - RNA, 19 nt, Homo sapiens
uuaagccacugagcaagga

SEQ ID NO: 716096 - RNA, 19 nt, Homo sapiens
uccgaaacaccaaugagua

SEQ ID NO: 716097 - RNA, 19 nt, Homo sapiens
aagccgcgaucacggaguu

SEQ ID NO: 716098 - RNA, 19 nt, Homo sapiens
gcagagguuggaaagaaag

SEQ ID NO: 716099 - RNA, 19 nt, Homo sapiens
agcagagguuggaaagaaa

SEQ ID NO: 716100 - RNA, 19 nt, Homo sapiens
cuacauggcacagacacaa

SEQ ID NO: 716101 - RNA, 19 nt, Homo sapiens
caaguugugccauacuaca

SEQ ID NO: 716102 - RNA, 19 nt, Homo sapiens
gugauugacuaugggacuu

SEQ ID NO: 716103 - RNA, 19 nt, Homo sapiens
ccagaacgugauugacuau

SEQ ID NO: 716104 - RNA, 19 nt, Homo sapiens
gcgacaagcagugccuuug

SEQ ID NO: 716105 - RNA, 19 nt, Homo sapiens
ucacccagcagguacaugu

SEQ ID NO: 716106 - RNA, 19 nt, Homo sapiens
cuuggugacccauguauug

SEQ ID NO: 716107 - RNA, 19 nt, Homo sapiens
cugauaugcuuguuagaac

SEQ ID NO: 716108 - RNA, 19 nt, Homo sapiens
aggguugccuuaaauugug

SEQ ID NO: 716109 - RNA, 19 nt, Homo sapiens
guggcaagugcaaauguaa

SEQ ID NO: 716110 - RNA, 19 nt, Homo sapiens
ggacauaugugacaaaguu

SEQ ID NO: 716111 - RNA, 19 nt, Homo sapiens
gaacucaccuuuaaacaug

SEQ ID NO: 716112 - RNA, 19 nt, Homo sapiens
caaagaggaugaagacaua

SEQ ID NO: 716113 - RNA, 19 nt, Homo sapiens
gaacacuacuuccaauuug

SEQ ID NO: 716114 - RNA, 19 nt, Homo sapiens
acaaugaacucaccuuuaa

SEQ ID NO: 716115 - RNA, 19 nt, Homo sapiens
caugagacauuccuaauaa

SEQ ID NO: 716116 - RNA, 19 nt, Homo sapiens
ggaaacauauucagauugg

SEQ ID NO: 716117 - RNA, 19 nt, Homo sapiens
uugcuaagcugucaacaua

SEQ ID NO: 716118 - RNA, 19 nt, Homo sapiens
uaagagcacugaagaacuu

SEQ ID NO: 716119 - RNA, 19 nt, Homo sapiens
gguacuugaucuacauuua

SEQ ID NO: 716120 - RNA, 19 nt, Homo sapiens
gcauauaauugucuacaga

SEQ ID NO: 716121 - RNA, 19 nt, Homo sapiens
acagauggguccaaugaua

SEQ ID NO: 716122 - RNA, 19 nt, Homo sapiens
uaaggcacauccuaaagua

SEQ ID NO: 716123 - RNA, 19 nt, Homo sapiens
ggcaaacuguggaaagaua

SEQ ID NO: 716124 - RNA, 19 nt, Homo sapiens
guacaacacuacagaagau

SEQ ID NO: 716125 - RNA, 19 nt, Homo sapiens
caacagauggguccaauga

SEQ ID NO: 716126 - RNA, 19 nt, Homo sapiens
ggaguggucagaagaauuu

SEQ ID NO: 716127 - RNA, 19 nt, Homo sapiens
gaaguauguucccgugauu

SEQ ID NO: 716128 - RNA, 19 nt, Homo sapiens
gcagacauauccaguucaa

SEQ ID NO: 716129 - RNA, 19 nt, Homo sapiens
gcagaugugugauaaagca

SEQ ID NO: 716130 - RNA, 19 nt, Homo sapiens
gcauuuagcuugccagcau

SEQ ID NO: 716131 - RNA, 19 nt, Homo sapiens
ugacaaacaguaugagaua

SEQ ID NO: 716132 - RNA, 19 nt, Homo sapiens
gaguauagauccaacagau

SEQ ID NO: 716133 - RNA, 19 nt, Homo sapiens
cuacuuauaugaaccagaa

SEQ ID NO: 716134 - RNA, 19 nt, Homo sapiens
guggacaaauugaauguaa

SEQ ID NO: 716135 - RNA, 19 nt, Homo sapiens
uuaaagaggugauucaagu

SEQ ID NO: 716136 - RNA, 19 nt, Homo sapiens
gugaagaccuuguaaaugc

SEQ ID NO: 716137 - RNA, 19 nt, Homo sapiens
uggaagcucuggaacuaua

SEQ ID NO: 716138 - RNA, 19 nt, Homo sapiens
ggauagagcccugcaggua

SEQ ID NO: 716139 - RNA, 19 nt, Homo sapiens
gacaaugaacucaccuuua

SEQ ID NO: 716140 - RNA, 19 nt, Homo sapiens
gaacagaaacagcaacaca

SEQ ID NO: 716141 - RNA, 19 nt, Homo sapiens
cagaaggacccucaguuua

SEQ ID NO: 716142 - RNA, 19 nt, Homo sapiens
gaucuacauuuaaguggaa

SEQ ID NO: 716143 - RNA, 19 nt, Homo sapiens
gaugugugauaaagcauuu

SEQ ID NO: 716144 - RNA, 19 nt, Homo sapiens
gcacagcagcacacaaauu

SEQ ID NO: 716145 - RNA, 19 nt, Homo sapiens
cagaagaauuucagaagga

SEQ ID NO: 716146 - RNA, 19 nt, Homo sapiens
agaaguacgugcugugauu

SEQ ID NO: 716147 - RNA, 19 nt, Homo sapiens
ggaagcaagauuucuauau

SEQ ID NO: 716148 - RNA, 19 nt, Homo sapiens
gaaggaaugucccacaaaa

SEQ ID NO: 716149 - RNA, 19 nt, Homo sapiens
cacagcagcacacaaauua

SEQ ID NO: 716150 - RNA, 19 nt, Homo sapiens
ugagaucucugccuccaaa

SEQ ID NO: 716151 - RNA, 19 nt, Homo sapiens
caaagcugcucucgauaau

SEQ ID NO: 716152 - RNA, 19 nt, Homo sapiens
acauguaucucugguauuu

SEQ ID NO: 716153 - RNA, 19 nt, Homo sapiens
ucagagcauucaccaagua

SEQ ID NO: 716154 - RNA, 19 nt, Homo sapiens
ucugauaucugcaacuauu

SEQ ID NO: 716155 - RNA, 19 nt, Homo sapiens
ccaaagcugcucucgauaa

SEQ ID NO: 716156 - RNA, 19 nt, Homo sapiens
gcacacuacuucauugucu

SEQ ID NO: 716157 - RNA, 19 nt, Homo sapiens
gcuauucucuaaugaagau

SEQ ID NO: 716158 - RNA, 19 nt, Homo sapiens
gaaagaagaaggaauuacu

SEQ ID NO: 716159 - RNA, 19 nt, Homo sapiens
gcacacaaauuaccaucag

SEQ ID NO: 716160 - RNA, 19 nt, Homo sapiens
ucaaauugguccacugaga

SEQ ID NO: 716161 - RNA, 19 nt, Homo sapiens
aaacauagagacugaggua

SEQ ID NO: 716162 - RNA, 19 nt, Homo sapiens
ggacaaugaacucaccuuu

SEQ ID NO: 716163 - RNA, 19 nt, Homo sapiens
uaccaagcauggaugauaa

SEQ ID NO: 716164 - RNA, 19 nt, Homo sapiens
gaaccagaacucuaaccua

SEQ ID NO: 716165 - RNA, 19 nt, Homo sapiens
gaaggacccucaguuuagu

SEQ ID NO: 716166 - RNA, 19 nt, Homo sapiens
gaaguacgugcugugauua

SEQ ID NO: 716167 - RNA, 19 nt, Homo sapiens
cuacauguaucucugguau

SEQ ID NO: 716168 - RNA, 19 nt, Homo sapiens
uaaaugcagaugugugaua

SEQ ID NO: 716169 - RNA, 19 nt, Homo sapiens
ccaaagcuauagccuagga

SEQ ID NO: 716170 - RNA, 19 nt, Homo sapiens
gccugagccuguuuauaua

SEQ ID NO: 716171 - RNA, 19 nt, Homo sapiens
gaucaaauugguccacuga

SEQ ID NO: 716172 - RNA, 19 nt, Homo sapiens
ggaggaaauuaagaaauca

SEQ ID NO: 716173 - RNA, 19 nt, Homo sapiens
uaauaagguugcacggaaa

SEQ ID NO: 716174 - RNA, 19 nt, Homo sapiens
gaagcagucauucuuucua

SEQ ID NO: 716175 - RNA, 19 nt, Homo sapiens
aagcauggaugauaagugu

SEQ ID NO: 716176 - RNA, 19 nt, Homo sapiens
ucucugguauuuagaauug

SEQ ID NO: 716177 - RNA, 19 nt, Homo sapiens
gaaugaagcaccaguguac

SEQ ID NO: 716178 - RNA, 19 nt, Homo sapiens
ccuggaagcucuggaacua

SEQ ID NO: 716179 - RNA, 19 nt, Homo sapiens
agugagagcuuuauaugau

SEQ ID NO: 716180 - RNA, 19 nt, Homo sapiens
ugucuuaacuucagauaca

SEQ ID NO: 716181 - RNA, 19 nt, Homo sapiens
gcaauguggugugcagaga

SEQ ID NO: 716182 - RNA, 19 nt, Homo sapiens
ccuaggacccgaucaaauu

SEQ ID NO: 716183 - RNA, 19 nt, Homo sapiens
ucagaaggacccucaguuu

SEQ ID NO: 716184 - RNA, 19 nt, Homo sapiens
gcagucauucuuucuacua

SEQ ID NO: 716185 - RNA, 19 nt, Homo sapiens
gaaggcgacagauagauug

SEQ ID NO: 716186 - RNA, 19 nt, Homo sapiens
aaaugcagaugugugauaa

SEQ ID NO: 716187 - RNA, 19 nt, Homo sapiens
caagagcaaucuggaagga

SEQ ID NO: 716188 - RNA, 19 nt, Homo sapiens
gaaauugauaggaagcauu

SEQ ID NO: 716189 - RNA, 19 nt, Homo sapiens
uagcggcuguggacaaauu

SEQ ID NO: 716190 - RNA, 19 nt, Homo sapiens
aagcugcucucgauaauag

SEQ ID NO: 716191 - RNA, 19 nt, Homo sapiens
ccaugagacauuccuaaua

SEQ ID NO: 716192 - RNA, 19 nt, Homo sapiens
uaacagugaagaccuugua

SEQ ID NO: 716193 - RNA, 19 nt, Homo sapiens
gauuaacagugaagaccuu

SEQ ID NO: 716194 - RNA, 19 nt, Homo sapiens
acaagacacuguuuccaau

SEQ ID NO: 716195 - RNA, 19 nt, Homo sapiens
gguagcggcuguggacaaa

SEQ ID NO: 716196 - RNA, 19 nt, Homo sapiens
cgauaauagucaacauuug

SEQ ID NO: 716197 - RNA, 19 nt, Homo sapiens
uuaaauugcgguuguguuu

SEQ ID NO: 716198 - RNA, 19 nt, Homo sapiens
gaguuucucacacacuuua

SEQ ID NO: 716199 - RNA, 19 nt, Homo sapiens
cuguggauaugucaucuua

SEQ ID NO: 716200 - RNA, 19 nt, Homo sapiens
uggaggaaauuaagaaauc

SEQ ID NO: 716201 - RNA, 19 nt, Homo sapiens
ggaugaagacauagcuaaa

SEQ ID NO: 716202 - RNA, 19 nt, Homo sapiens
aagcucaguuuaugucauu

SEQ ID NO: 716203 - RNA, 19 nt, Homo sapiens
guauagauccaacagauuc

SEQ ID NO: 716204 - RNA, 19 nt, Homo sapiens
gugagagcuuuauaugauu

SEQ ID NO: 716205 - RNA, 19 nt, Homo sapiens
ugugagaguuugguaguaa

SEQ ID NO: 716206 - RNA, 19 nt, Homo sapiens
gacaagacacuguuuccaa

SEQ ID NO: 716207 - RNA, 19 nt, Homo sapiens
ugacaaaguuggaaguacu

SEQ ID NO: 716208 - RNA, 19 nt, Homo sapiens
uaaagaggugauucaagua

SEQ ID NO: 716209 - RNA, 19 nt, Homo sapiens
gauuuuggcuauucucuaa

SEQ ID NO: 716210 - RNA, 19 nt, Homo sapiens
gaucuugucucagaaauaa

SEQ ID NO: 716211 - RNA, 19 nt, Homo sapiens
gcuaugaucucaccacuac

SEQ ID NO: 716212 - RNA, 19 nt, Homo sapiens
ucuggaagcugaaggauag

SEQ ID NO: 716213 - RNA, 19 nt, Homo sapiens
ccagggugcaucucaauaa

SEQ ID NO: 716214 - RNA, 19 nt, Homo sapiens
cagggugcaucucaauaaa

SEQ ID NO: 716215 - RNA, 19 nt, Homo sapiens
gagcuucuaccuccagaug

SEQ ID NO: 716216 - RNA, 19 nt, Homo sapiens
gaacccagggacuucagaa

SEQ ID NO: 716217 - RNA, 19 nt, Homo sapiens
ggaggcgaagggauaauga

SEQ ID NO: 716218 - RNA, 19 nt, Homo sapiens
gugcaucucaauaaacuug

SEQ ID NO: 716219 - RNA, 19 nt, Homo sapiens
gggugcaucucaauaaacu

SEQ ID NO: 716220 - RNA, 19 nt, Homo sapiens
gcuucuaccuccagaugug

SEQ ID NO: 716221 - RNA, 19 nt, Homo sapiens
gcaucucaauaaacuugga

SEQ ID NO: 716222 - RNA, 19 nt, Homo sapiens
gaggucaagcugcagagaa

SEQ ID NO: 716223 - RNA, 19 nt, Homo sapiens
gccagggugcaucucaaua

SEQ ID NO: 716224 - RNA, 19 nt, Homo sapiens
gggagcagucgcaggaaga

SEQ ID NO: 716225 - RNA, 19 nt, Homo sapiens
caauaaacuuggauuuugg

SEQ ID NO: 716226 - RNA, 19 nt, Homo sapiens
ggagcagucgcaggaagaa

SEQ ID NO: 716227 - RNA, 19 nt, Homo sapiens
cacaggaacagcccaggaa

SEQ ID NO: 716228 - RNA, 19 nt, Homo sapiens
aggcugcagugagcuauga

SEQ ID NO: 716229 - RNA, 19 nt, Homo sapiens
gugccagggugcaucucaa

SEQ ID NO: 716230 - RNA, 19 nt, Homo sapiens
uggaagggcccucgaaugc

SEQ ID NO: 716231 - RNA, 19 nt, Homo sapiens
aacgggaggcgaagggaua

SEQ ID NO: 716232 - RNA, 19 nt, Homo sapiens
gggaggcgaagggauaaug

SEQ ID NO: 716233 - RNA, 19 nt, Homo sapiens
guacagguguucuuuauuu

SEQ ID NO: 716234 - RNA, 19 nt, Homo sapiens
gaaggcagcucccacaucu

SEQ ID NO: 716235 - RNA, 19 nt, Homo sapiens
guacaaacccuucaucuuc

SEQ ID NO: 716236 - RNA, 19 nt, Homo sapiens
ccaaggagcugcuggaaca

SEQ ID NO: 716237 - RNA, 19 nt, Homo sapiens
gacacacgcucuacuggua

SEQ ID NO: 716238 - RNA, 19 nt, Homo sapiens
ccggaaagguggcaacuug

SEQ ID NO: 716239 - RNA, 19 nt, Homo sapiens
ugacagaucugagcaugug

SEQ ID NO: 716240 - RNA, 19 nt, Homo sapiens
gacaugaucagaagaagaa

SEQ ID NO: 716241 - RNA, 19 nt, Homo sapiens
gagacgagguuguccagau

SEQ ID NO: 716242 - RNA, 19 nt, Homo sapiens
gcugggaucugccacaaca

SEQ ID NO: 716243 - RNA, 19 nt, Homo sapiens
caugagggcuacuuuccaa

SEQ ID NO: 716244 - RNA, 19 nt, Homo sapiens
gcuuagugcugaagaagau

SEQ ID NO: 716245 - RNA, 19 nt, Homo sapiens
gcaauugccagcacuuugu

SEQ ID NO: 716246 - RNA, 19 nt, Homo sapiens
gaucagaagaagaaauaug

SEQ ID NO: 716247 - RNA, 19 nt, Homo sapiens
gaaaguggacaugaucaga

SEQ ID NO: 716248 - RNA, 19 nt, Homo sapiens
uuaccugcaucuccaagua

SEQ ID NO: 716249 - RNA, 19 nt, Homo sapiens
cagaggagcccaucacugu

SEQ ID NO: 716250 - RNA, 19 nt, Homo sapiens
gcuccaggcuacagacaga

SEQ ID NO: 716251 - RNA, 19 nt, Homo sapiens
cagaggacccggacgauga

SEQ ID NO: 716252 - RNA, 19 nt, Homo sapiens
ucaucaaugucuccaacua

SEQ ID NO: 716253 - RNA, 19 nt, Homo sapiens
ggagauccgagacuuguug

SEQ ID NO: 716254 - RNA, 19 nt, Homo sapiens
guaccucuucucccacuua

SEQ ID NO: 716255 - RNA, 19 nt, Homo sapiens
gggcuacuuuccaaccaaa

SEQ ID NO: 716256 - RNA, 19 nt, Homo sapiens
gaacaguggcggagcucuu

SEQ ID NO: 716257 - RNA, 19 nt, Homo sapiens
gcugauacccugacagauc

SEQ ID NO: 716258 - RNA, 19 nt, Homo sapiens
ggacaugaucagaagaaga

SEQ ID NO: 716259 - RNA, 19 nt, Homo sapiens
ugagccaggucuugcauga

SEQ ID NO: 716260 - RNA, 19 nt, Homo sapiens
gaagaggcacuggaaggaa

SEQ ID NO: 716261 - RNA, 19 nt, Homo sapiens
acacccagguucccacuga

SEQ ID NO: 716262 - RNA, 19 nt, Homo sapiens
cuguggagcuguugcauga

SEQ ID NO: 716263 - RNA, 19 nt, Homo sapiens
gcaggacuaucccuuugag

SEQ ID NO: 716264 - RNA, 19 nt, Homo sapiens
gcuacuuuccaaccaaaua

SEQ ID NO: 716265 - RNA, 19 nt, Homo sapiens
aucaaugucuccaacuaua

SEQ ID NO: 716266 - RNA, 19 nt, Homo sapiens
ccaaccaaauaaagucaau

SEQ ID NO: 716267 - RNA, 19 nt, Homo sapiens
uguuucagcucacccauga

SEQ ID NO: 716268 - RNA, 19 nt, Homo sapiens
caacuauagucuggaaagu

SEQ ID NO: 716269 - RNA, 19 nt, Homo sapiens
ugacaagaguccuguuggu

SEQ ID NO: 716270 - RNA, 19 nt, Homo sapiens
gcucacccaugauguguac

SEQ ID NO: 716271 - RNA, 19 nt, Homo sapiens
agagcacacucaaggcaaa

SEQ ID NO: 716272 - RNA, 19 nt, Homo sapiens
gugggugcgucaucucauu

SEQ ID NO: 716273 - RNA, 19 nt, Homo sapiens
gguggcaacuuggcugaga

SEQ ID NO: 716274 - RNA, 19 nt, Homo sapiens
gcagagcugggccauggaa

SEQ ID NO: 716275 - RNA, 19 nt, Homo sapiens
cuacuuuccaaccaaauaa

SEQ ID NO: 716276 - RNA, 19 nt, Homo sapiens
gagacccucagcucaauga

SEQ ID NO: 716277 - RNA, 19 nt, Homo sapiens
ugaagaagaucccgauacc

SEQ ID NO: 716278 - RNA, 19 nt, Homo sapiens
gccaggagauccgagacuu

SEQ ID NO: 716279 - RNA, 19 nt, Homo sapiens
ccucuucucccacuuaaau

SEQ ID NO: 716280 - RNA, 19 nt, Homo sapiens
cuguacagguguucuuuau

SEQ ID NO: 716281 - RNA, 19 nt, Homo sapiens
aagaggcacuggaaggaau

SEQ ID NO: 716282 - RNA, 19 nt, Homo sapiens
cugcaggacuaucccuuug

SEQ ID NO: 716283 - RNA, 19 nt, Homo sapiens
aaaguggacaugaucagaa

SEQ ID NO: 716284 - RNA, 19 nt, Homo sapiens
agacgagguuguccagauc

SEQ ID NO: 716285 - RNA, 19 nt, Homo sapiens
accgggagcuguacucaga

SEQ ID NO: 716286 - RNA, 19 nt, Homo sapiens
cagaagaagaaauaugugu

SEQ ID NO: 716287 - RNA, 19 nt, Homo sapiens
agacagagaaccugcaaag

SEQ ID NO: 716288 - RNA, 19 nt, Homo sapiens
caucaaugucuccaacuau

SEQ ID NO: 716289 - RNA, 19 nt, Homo sapiens
ccauugggccuagaaauuc

SEQ ID NO: 716290 - RNA, 19 nt, Homo sapiens
gaaccgggagcuguacuca

SEQ ID NO: 716291 - RNA, 19 nt, Homo sapiens
gcaugugggugcgucaucu

SEQ ID NO: 716292 - RNA, 19 nt, Homo sapiens
caucuucgcugcugauacc

SEQ ID NO: 716293 - RNA, 19 nt, Homo sapiens
ccaaguggacacccagguu

SEQ ID NO: 716294 - RNA, 19 nt, Homo sapiens
cauugggccuagaaauuca

SEQ ID NO: 716295 - RNA, 19 nt, Homo sapiens
gcuggcuccuguugcgaaa

SEQ ID NO: 716296 - RNA, 19 nt, Homo sapiens
guggagcuguugcaugaag

SEQ ID NO: 716297 - RNA, 19 nt, Homo sapiens
ccaggucuguacagguguu

SEQ ID NO: 716298 - RNA, 19 nt, Homo sapiens
gcucagcagguaccucuuc

SEQ ID NO: 716299 - RNA, 19 nt, Homo sapiens
cacucuagcuccugaccuu

SEQ ID NO: 716300 - RNA, 19 nt, Homo sapiens
uaccucuucucccacuuaa

SEQ ID NO: 716301 - RNA, 19 nt, Homo sapiens
ucuagcuccugaccuuuga

SEQ ID NO: 716302 - RNA, 19 nt, Homo sapiens
ggagcugcagguccuagaa

SEQ ID NO: 716303 - RNA, 19 nt, Homo sapiens
ugacagacagcagugaaga

SEQ ID NO: 716304 - RNA, 19 nt, Homo sapiens
gcugaagaagaucccgaua

SEQ ID NO: 716305 - RNA, 19 nt, Homo sapiens
aggcagcucccacaucuug

SEQ ID NO: 716306 - RNA, 19 nt, Homo sapiens
cugauacccugacagaucu

SEQ ID NO: 716307 - RNA, 19 nt, Homo sapiens
ucaagggacacacgcucua

SEQ ID NO: 716308 - RNA, 19 nt, Homo sapiens
gaggagcccaucacugucu

SEQ ID NO: 716309 - RNA, 19 nt, Homo sapiens
gaacauggugagggaacug

SEQ ID NO: 716310 - RNA, 19 nt, Homo sapiens
uccauugggccuagaaauu

SEQ ID NO: 716311 - RNA, 19 nt, Homo sapiens
ccgagacccucagcucaau

SEQ ID NO: 716312 - RNA, 19 nt, Homo sapiens
ugaagaggcacuggaagga

SEQ ID NO: 716313 - RNA, 19 nt, Homo sapiens
ucuggaaaguggacaugau

SEQ ID NO: 716314 - RNA, 19 nt, Homo sapiens
gagggcuacuuuccaacca

SEQ ID NO: 716315 - RNA, 19 nt, Homo sapiens
guggacaugaucagaagaa

SEQ ID NO: 716316 - RNA, 19 nt, Homo sapiens
ggaaaguggacaugaucag

SEQ ID NO: 716317 - RNA, 19 nt, Homo sapiens
acgacucccugcaggacua

SEQ ID NO: 716318 - RNA, 19 nt, Homo sapiens
ccucucccuugccaaagaa

SEQ ID NO: 716319 - RNA, 19 nt, Homo sapiens
gcagguccuagaagaagug

SEQ ID NO: 716320 - RNA, 19 nt, Homo sapiens
caaugucuccaacuauagu

SEQ ID NO: 716321 - RNA, 19 nt, Homo sapiens
gccagccggacucagcuua

SEQ ID NO: 716322 - RNA, 19 nt, Homo sapiens
cugaagagcacucccaucu

SEQ ID NO: 716323 - RNA, 19 nt, Homo sapiens
ggcacuggaaggaauggua

SEQ ID NO: 716324 - RNA, 19 nt, Homo sapiens
ccaacuauagucuggaaag

SEQ ID NO: 716325 - RNA, 19 nt, Homo sapiens
cagcaauugccagcacuuu

SEQ ID NO: 716326 - RNA, 19 nt, Homo sapiens
ccaggagauccgagacuug

SEQ ID NO: 716327 - RNA, 19 nt, Homo sapiens
uguacaaacccuucaucuu

SEQ ID NO: 716328 - RNA, 19 nt, Homo sapiens
caggagauccgagacuugu

SEQ ID NO: 716329 - RNA, 19 nt, Homo sapiens
aggagcugcuggaacagaa

SEQ ID NO: 716330 - RNA, 19 nt, Homo sapiens
gacccuggccagcacucua

SEQ ID NO: 716331 - RNA, 19 nt, Homo sapiens
gcugcagguccuagaagaa

SEQ ID NO: 716332 - RNA, 19 nt, Homo sapiens
ggaccuccuuuggcucucu

SEQ ID NO: 716333 - RNA, 19 nt, Homo sapiens
ggacagcccucgaccuuaa

SEQ ID NO: 716334 - RNA, 19 nt, Homo sapiens
gauaagaucuugacaacug

SEQ ID NO: 716335 - RNA, 19 nt, Homo sapiens
gaccaugaaugaaguuaua

SEQ ID NO: 716336 - RNA, 19 nt, Homo sapiens
uagaaagggucauugaaua

SEQ ID NO: 716337 - RNA, 19 nt, Homo sapiens
caggaagacugaaagaaua

SEQ ID NO: 716338 - RNA, 19 nt, Homo sapiens
ucugaaagcuccgguauua

SEQ ID NO: 716339 - RNA, 19 nt, Homo sapiens
gagcaaucauaaaguguua

SEQ ID NO: 716340 - RNA, 19 nt, Homo sapiens
gaucuuaacugguacuuag

SEQ ID NO: 716341 - RNA, 19 nt, Homo sapiens
ccaaugaugugaacaaguu

SEQ ID NO: 716342 - RNA, 19 nt, Homo sapiens
gcaagaugcugcccgugua

SEQ ID NO: 716343 - RNA, 19 nt, Homo sapiens
gaaauuggacuucacgauu

SEQ ID NO: 716344 - RNA, 19 nt, Homo sapiens
gaaggagauuuccaagauu

SEQ ID NO: 716345 - RNA, 19 nt, Homo sapiens
gaacacagcguacgccuau

SEQ ID NO: 716346 - RNA, 19 nt, Homo sapiens
ugacagcacucauuaaauc

SEQ ID NO: 716347 - RNA, 19 nt, Homo sapiens
caagaucucuauugguauu

SEQ ID NO: 716348 - RNA, 19 nt, Homo sapiens
ugaggaaagugccaaagua

SEQ ID NO: 716349 - RNA, 19 nt, Homo sapiens
gaaauuauccacauauugg

SEQ ID NO: 716350 - RNA, 19 nt, Homo sapiens
ugucagaccuggcgaauug

SEQ ID NO: 716351 - RNA, 19 nt, Homo sapiens
caagagcaaucauaaagug

SEQ ID NO: 716352 - RNA, 19 nt, Homo sapiens
ccgagaagcuagaucuuaa

SEQ ID NO: 716353 - RNA, 19 nt, Homo sapiens
caagagcaguguaucaaga

SEQ ID NO: 716354 - RNA, 19 nt, Homo sapiens
gugcugaaguugagaauau

SEQ ID NO: 716355 - RNA, 19 nt, Homo sapiens
gcagggaagucaucacugu

SEQ ID NO: 716356 - RNA, 19 nt, Homo sapiens
gggaugagguuacgaguag

SEQ ID NO: 716357 - RNA, 19 nt, Homo sapiens
agaggaagaugauauguau

SEQ ID NO: 716358 - RNA, 19 nt, Homo sapiens
caaagacauuggacacuug

SEQ ID NO: 716359 - RNA, 19 nt, Homo sapiens
gaggaaauguaaccgagaa

SEQ ID NO: 716360 - RNA, 19 nt, Homo sapiens
gauggcaguucuaaucauu

SEQ ID NO: 716361 - RNA, 19 nt, Homo sapiens
agaaggagauuuccaagau

SEQ ID NO: 716362 - RNA, 19 nt, Homo sapiens
ucaaucugcuguccaauga

SEQ ID NO: 716363 - RNA, 19 nt, Homo sapiens
cauaaaguguuacuggaaa

SEQ ID NO: 716364 - RNA, 19 nt, Homo sapiens
acaagaugcuaguucauuu

SEQ ID NO: 716365 - RNA, 19 nt, Homo sapiens
caaaguaugcuaaauguca

SEQ ID NO: 716366 - RNA, 19 nt, Homo sapiens
gaaucaggauccaauuuua

SEQ ID NO: 716367 - RNA, 19 nt, Homo sapiens
uacaagagguacaacuuaa

SEQ ID NO: 716368 - RNA, 19 nt, Homo sapiens
gauaaucuuugacaaugug

SEQ ID NO: 716369 - RNA, 19 nt, Homo sapiens
agcaagaucucuauuggua

SEQ ID NO: 716370 - RNA, 19 nt, Homo sapiens
gaggaaagugccaaaguaa

SEQ ID NO: 716371 - RNA, 19 nt, Homo sapiens
ugaaagcuccgguauuauu

SEQ ID NO: 716372 - RNA, 19 nt, Homo sapiens
aaagaaggauaaugaggaa

SEQ ID NO: 716373 - RNA, 19 nt, Homo sapiens
ggaaagugccaaaguaauc

SEQ ID NO: 716374 - RNA, 19 nt, Homo sapiens
ugauagaaauccaauagga

SEQ ID NO: 716375 - RNA, 19 nt, Homo sapiens
gagccaagauacagagaau

SEQ ID NO: 716376 - RNA, 19 nt, Homo sapiens
gggaagucaucacuguuaa

SEQ ID NO: 716377 - RNA, 19 nt, Homo sapiens
gugauaaucuuugacaaug

SEQ ID NO: 716378 - RNA, 19 nt, Homo sapiens
ggaugaauuuggcuucguu

SEQ ID NO: 716379 - RNA, 19 nt, Homo sapiens
caucugacagcacucauua

SEQ ID NO: 716380 - RNA, 19 nt, Homo sapiens
ccuaugugcuucaagauug

SEQ ID NO: 716381 - RNA, 19 nt, Homo sapiens
caugagaagaucacaauuu

SEQ ID NO: 716382 - RNA, 19 nt, Homo sapiens
guagccaugugccauauga

SEQ ID NO: 716383 - RNA, 19 nt, Homo sapiens
gaucuugacaacugaaauu

SEQ ID NO: 716384 - RNA, 19 nt, Homo sapiens
cagcucagguugccuaugu

SEQ ID NO: 716385 - RNA, 19 nt, Homo sapiens
guagaaagggucauugaau

SEQ ID NO: 716386 - RNA, 19 nt, Homo sapiens
uaaaucguuucuccaaaga

SEQ ID NO: 716387 - RNA, 19 nt, Homo sapiens
gaaaaggaacgauaugaaa

SEQ ID NO: 716388 - RNA, 19 nt, Homo sapiens
cauacaagaugcuaguuca

SEQ ID NO: 716389 - RNA, 19 nt, Homo sapiens
caacuuaaagaaaccauug

SEQ ID NO: 716390 - RNA, 19 nt, Homo sapiens
gauagaaauccaauaggaa

SEQ ID NO: 716391 - RNA, 19 nt, Homo sapiens
uaacugguacuuaggaauu

SEQ ID NO: 716392 - RNA, 19 nt, Homo sapiens
gcacuucgucuuaguaaca

SEQ ID NO: 716393 - RNA, 19 nt, Homo sapiens
gcaaauguggauccaagaa

SEQ ID NO: 716394 - RNA, 19 nt, Homo sapiens
uuacaagagguacaacuua

SEQ ID NO: 716395 - RNA, 19 nt, Homo sapiens
agaagcaccuugggaauau

SEQ ID NO: 716396 - RNA, 19 nt, Homo sapiens
ucacuggauugucuucauu

SEQ ID NO: 716397 - RNA, 19 nt, Homo sapiens
gauuuuggcucccuuuuaa

SEQ ID NO: 716398 - RNA, 19 nt, Homo sapiens
cagcgugcauggaagaauu

SEQ ID NO: 716399 - RNA, 19 nt, Homo sapiens
gaagacugaaagaauauga

SEQ ID NO: 716400 - RNA, 19 nt, Homo sapiens
gcacacggaugaggaacug

SEQ ID NO: 716401 - RNA, 19 nt, Homo sapiens
gaaugucccaguuacacua

SEQ ID NO: 716402 - RNA, 19 nt, Homo sapiens
ggaagaugauauguauuca

SEQ ID NO: 716403 - RNA, 19 nt, Homo sapiens
gauugaacaccauuauuga

SEQ ID NO: 716404 - RNA, 19 nt, Homo sapiens
gagguacaacuuaaagaaa

SEQ ID NO: 716405 - RNA, 19 nt, Homo sapiens
gaaguugagaauaugauga

SEQ ID NO: 716406 - RNA, 19 nt, Homo sapiens
gaaauccaauaggaagaau

SEQ ID NO: 716407 - RNA, 19 nt, Homo sapiens
gaaagcuccgguauuauuc

SEQ ID NO: 716408 - RNA, 19 nt, Homo sapiens
ccaugugccauaugauuua

SEQ ID NO: 716409 - RNA, 19 nt, Homo sapiens
guaaaccacauuguacuuu

SEQ ID NO: 716410 - RNA, 19 nt, Homo sapiens
ggacuucacgauuuaagga

SEQ ID NO: 716411 - RNA, 19 nt, Homo sapiens
ugucagaacccgaagguaa

SEQ ID NO: 716412 - RNA, 19 nt, Homo sapiens
gaaggagugauaaucuuug

SEQ ID NO: 716413 - RNA, 19 nt, Homo sapiens
uuaaggagcacacggauga

SEQ ID NO: 716414 - RNA, 19 nt, Homo sapiens
aauuggacuucacgauuua

SEQ ID NO: 716415 - RNA, 19 nt, Homo sapiens
uugcaaggguucugggaua

SEQ ID NO: 716416 - RNA, 19 nt, Homo sapiens
gagauuagaggaagaugau

SEQ ID NO: 716417 - RNA, 19 nt, Homo sapiens
aaaugucacuguaaaugga

SEQ ID NO: 716418 - RNA, 19 nt, Homo sapiens
aaucguaccuucucagagu

SEQ ID NO: 716419 - RNA, 19 nt, Homo sapiens
gaaggauaaugaggaaagu

SEQ ID NO: 716420 - RNA, 19 nt, Homo sapiens
ggaucaggaccaugaauga

SEQ ID NO: 716421 - RNA, 19 nt, Homo sapiens
ccagggcaauucucaggaa

SEQ ID NO: 716422 - RNA, 19 nt, Homo sapiens
ggaagaaccggagcuggaa

SEQ ID NO: 716423 - RNA, 19 nt, Homo sapiens
acaccaggauuuacauuca

SEQ ID NO: 716424 - RNA, 19 nt, Homo sapiens
gcuccgguauuauucuuug

SEQ ID NO: 716425 - RNA, 19 nt, Homo sapiens
gcaaacaaacaaaguaugc

SEQ ID NO: 716426 - RNA, 19 nt, Homo sapiens
caagauugguggcuuucau

SEQ ID NO: 716427 - RNA, 19 nt, Homo sapiens
ugacucaucaguugcagua

SEQ ID NO: 716428 - RNA, 19 nt, Homo sapiens
gggcagaaagcacggguaa

SEQ ID NO: 716429 - RNA, 19 nt, Homo sapiens
gacaaccacaggccagaua

SEQ ID NO: 716430 - RNA, 19 nt, Homo sapiens
caaaguaauccagcccaua

SEQ ID NO: 716431 - RNA, 19 nt, Homo sapiens
gaauacacagaccuugaaa

SEQ ID NO: 716432 - RNA, 19 nt, Homo sapiens
gaaagggucauugaauaca

SEQ ID NO: 716433 - RNA, 19 nt, Homo sapiens
ggaaauugcucaagaacua

SEQ ID NO: 716434 - RNA, 19 nt, Homo sapiens
gaagaguacuuuccaacua

SEQ ID NO: 716435 - RNA, 19 nt, Homo sapiens
gcaaaccaaucucauucua

SEQ ID NO: 716436 - RNA, 19 nt, Homo sapiens
aaagacaacuggcuacaaa

SEQ ID NO: 716437 - RNA, 19 nt, Homo sapiens
gaaaggccauagaaacguu

SEQ ID NO: 716438 - RNA, 19 nt, Homo sapiens
caacaucgcucgccaucug

SEQ ID NO: 716439 - RNA, 19 nt, Homo sapiens
caagaacuauaccauaaga

SEQ ID NO: 716440 - RNA, 19 nt, Homo sapiens
gaagagugcucggcguauu

SEQ ID NO: 716441 - RNA, 19 nt, Homo sapiens
aaagaaggaugucagaaug

SEQ ID NO: 716442 - RNA, 19 nt, Homo sapiens
ggaaacaaaucagcaaucu

SEQ ID NO: 716443 - RNA, 19 nt, Homo sapiens
gcaaggaacugcggagcuu

SEQ ID NO: 716444 - RNA, 19 nt, Homo sapiens
ccugacagcucuuguauca

SEQ ID NO: 716445 - RNA, 19 nt, Homo sapiens
uaaacagagugacuucaaa

SEQ ID NO: 716446 - RNA, 19 nt, Homo sapiens
cucaagaacuauaccauaa

SEQ ID NO: 716447 - RNA, 19 nt, Homo sapiens
gcucaagaacuauaccaua

SEQ ID NO: 716448 - RNA, 19 nt, Homo sapiens
caaagaaggaugucagaau

SEQ ID NO: 716449 - RNA, 19 nt, Homo sapiens
uaagagacauguggaaaca

SEQ ID NO: 716450 - RNA, 19 nt, Homo sapiens
agagacauguggaaacaaa

SEQ ID NO: 716451 - RNA, 19 nt, Homo sapiens
agaaggaugucagaaugua

SEQ ID NO: 716452 - RNA, 19 nt, Homo sapiens
ucaggaaauugcucaagaa

SEQ ID NO: 716453 - RNA, 19 nt, Homo sapiens
gaagcgagagcuaaacaga

SEQ ID NO: 716454 - RNA, 19 nt, Homo sapiens
cauauaucaucaggucuua

SEQ ID NO: 716455 - RNA, 19 nt, Homo sapiens
caaguuucccucacuguaa

SEQ ID NO: 716456 - RNA, 19 nt, Homo sapiens
ugacagcucuuguaucacu

SEQ ID NO: 716457 - RNA, 19 nt, Homo sapiens
gaaggaugucagaauguaa

SEQ ID NO: 716458 - RNA, 19 nt, Homo sapiens
gcaauuuacaucuguggaa

SEQ ID NO: 716459 - RNA, 19 nt, Homo sapiens
guaaacagagugacuucaa

SEQ ID NO: 716460 - RNA, 19 nt, Homo sapiens
ugagaaagauaacaacacu

SEQ ID NO: 716461 - RNA, 19 nt, Homo sapiens
aaagaagacucacaaaaga

SEQ ID NO: 716462 - RNA, 19 nt, Homo sapiens
caacaugccugugguuucg

SEQ ID NO: 716463 - RNA, 19 nt, Homo sapiens
aagaguacuuuccaacuau

SEQ ID NO: 716464 - RNA, 19 nt, Homo sapiens
gaaaacagaagaguacuuu

SEQ ID NO: 716465 - RNA, 19 nt, Homo sapiens
ucaaugaagucacugaaaa

SEQ ID NO: 716466 - RNA, 19 nt, Homo sapiens
uaucacugcucucugucua

SEQ ID NO: 716467 - RNA, 19 nt, Homo sapiens
uuacaucuguggaauagca

SEQ ID NO: 716468 - RNA, 19 nt, Homo sapiens
gcuauggcaguguuaauga

SEQ ID NO: 716469 - RNA, 19 nt, Homo sapiens
aaagugaggcagacaaguu

SEQ ID NO: 716470 - RNA, 19 nt, Homo sapiens
gaugucagaauguaaggaa

SEQ ID NO: 716471 - RNA, 19 nt, Homo sapiens
caauuuacaucuguggaau

SEQ ID NO: 716472 - RNA, 19 nt, Homo sapiens
acagagugacuucaaauga

SEQ ID NO: 716473 - RNA, 19 nt, Homo sapiens
caugaggccgucaccauaa

SEQ ID NO: 716474 - RNA, 19 nt, Homo sapiens
ccaaguuucccucacugua

SEQ ID NO: 716475 - RNA, 19 nt, Homo sapiens
ucaugaggccgucaccaua

SEQ ID NO: 716476 - RNA, 19 nt, Homo sapiens
gaaauugcucaagaacuau

SEQ ID NO: 716477 - RNA, 19 nt, Homo sapiens
ucacugcucucugucuaug

SEQ ID NO: 716478 - RNA, 19 nt, Homo sapiens
cagaauguaaggaaacuau

SEQ ID NO: 716479 - RNA, 19 nt, Homo sapiens
caaaccaaucucauucuau

SEQ ID NO: 716480 - RNA, 19 nt, Homo sapiens
aauccaacccucuaagaaa

SEQ ID NO: 716481 - RNA, 19 nt, Homo sapiens
gacaacuggcuacaaagaa

SEQ ID NO: 716482 - RNA, 19 nt, Homo sapiens
cauaagagacauguggaaa

SEQ ID NO: 716483 - RNA, 19 nt, Homo sapiens
aaacagagugacuucaaau

SEQ ID NO: 716484 - RNA, 19 nt, Homo sapiens
cggaugcccuucugagcaa

SEQ ID NO: 716485 - RNA, 19 nt, Homo sapiens
gcaaccggaugcccuucug

SEQ ID NO: 716486 - RNA, 19 nt, Homo sapiens
acaacuggcuacaaagaag

SEQ ID NO: 716487 - RNA, 19 nt, Homo sapiens
caggagcuauggcaguguu

SEQ ID NO: 716488 - RNA, 19 nt, Homo sapiens
cagagugacuucaaaugac

SEQ ID NO: 716489 - RNA, 19 nt, Homo sapiens
uuccaaauuugccaagaaa

SEQ ID NO: 716490 - RNA, 19 nt, Homo sapiens
agacaacuggcuacaaaga

SEQ ID NO: 716491 - RNA, 19 nt, Homo sapiens
agaacuauaccauaagaga

SEQ ID NO: 716492 - RNA, 19 nt, Homo sapiens
agagugacuucaaaugaca

SEQ ID NO: 716493 - RNA, 19 nt, Homo sapiens
cuauggcaguguuaaugaa

SEQ ID NO: 716494 - RNA, 19 nt, Homo sapiens
acagaagaguacuuuccaa

SEQ ID NO: 716495 - RNA, 19 nt, Homo sapiens
gaaacaaaucagcaaucug

SEQ ID NO: 716496 - RNA, 19 nt, Homo sapiens
caacaaaaugcaacugaaa

SEQ ID NO: 716497 - RNA, 19 nt, Homo sapiens
auacuccucuccaaaucaa

SEQ ID NO: 716498 - RNA, 19 nt, Homo sapiens
aaguuucccucacuguaaa

SEQ ID NO: 716499 - RNA, 19 nt, Homo sapiens
cuuccaaauuugccaagaa

SEQ ID NO: 716500 - RNA, 19 nt, Homo sapiens
caacacuuaugaaaacaga

SEQ ID NO: 716501 - RNA, 19 nt, Homo sapiens
ucauacuccucuccaaauc

SEQ ID NO: 716502 - RNA, 19 nt, Homo sapiens
ggagcuauggcaguguuaa

SEQ ID NO: 716503 - RNA, 19 nt, Homo sapiens
aaauccaacccucuaagaa

SEQ ID NO: 716504 - RNA, 19 nt, Homo sapiens
caaccgugguaccuagaag

SEQ ID NO: 716505 - RNA, 19 nt, Homo sapiens
gagcuauggcaguguuaau

SEQ ID NO: 716506 - RNA, 19 nt, Homo sapiens
uucaggaaauugcucaaga

SEQ ID NO: 716507 - RNA, 19 nt, Homo sapiens
agcgagagcuaaacagaca

SEQ ID NO: 716508 - RNA, 19 nt, Homo sapiens
acagugcaauuuacaucug

SEQ ID NO: 716509 - RNA, 19 nt, Homo sapiens
ccaacaaaaugcaacugaa

SEQ ID NO: 716510 - RNA, 19 nt, Homo sapiens
aaaagaagacucacaaaag

SEQ ID NO: 716511 - RNA, 19 nt, Homo sapiens
acacuggugguaagagaaa

SEQ ID NO: 716512 - RNA, 19 nt, Homo sapiens
ugacagugcaauuuacauc

SEQ ID NO: 716513 - RNA, 19 nt, Homo sapiens
agaguacuuuccaacuaug

SEQ ID NO: 716514 - RNA, 19 nt, Homo sapiens
cugagaaccugugcuugga

SEQ ID NO: 716515 - RNA, 19 nt, Homo sapiens
ccaacaugccugugguuuc

SEQ ID NO: 716516 - RNA, 19 nt, Homo sapiens
gagaaagauaacaacacuu

SEQ ID NO: 716517 - RNA, 19 nt, Homo sapiens
aagagugcucggcguauuu

SEQ ID NO: 716518 - RNA, 19 nt, Homo sapiens
gugcguggccuucauacuc

SEQ ID NO: 716519 - RNA, 19 nt, Homo sapiens
gccgucaccauaaagugua

SEQ ID NO: 716520 - RNA, 19 nt, Homo sapiens
ccauaagagacauguggaa

SEQ ID NO: 716521 - RNA, 19 nt, Homo sapiens
ggugguaagagaaauuaag

SEQ ID NO: 716522 - RNA, 19 nt, Homo sapiens
gccggaagcgagagcuaaa

SEQ ID NO: 716523 - RNA, 19 nt, Homo sapiens
cagugcaauuuacaucugu

SEQ ID NO: 716524 - RNA, 19 nt, Homo sapiens
cugcaaaccaaucucauuc

SEQ ID NO: 716525 - RNA, 19 nt, Homo sapiens
acauauaucaucaggucuu

SEQ ID NO: 716526 - RNA, 19 nt, Homo sapiens
gaguacuuuccaacuauga

SEQ ID NO: 716527 - RNA, 19 nt, Homo sapiens
aaacagaagaguacuuucc

SEQ ID NO: 716528 - RNA, 19 nt, Homo sapiens
gacauguggaaacaaauca

SEQ ID NO: 716529 - RNA, 19 nt, Homo sapiens
cuucauacuccucuccaaa

SEQ ID NO: 716530 - RNA, 19 nt, Homo sapiens
uuguaucacugcucucugu

SEQ ID NO: 716531 - RNA, 19 nt, Homo sapiens
caucugcaaaccaaucuca

SEQ ID NO: 716532 - RNA, 19 nt, Homo sapiens
caaccggaugcccuucuga

SEQ ID NO: 716533 - RNA, 19 nt, Homo sapiens
gaugagaaguugcuuuaug

SEQ ID NO: 716534 - RNA, 19 nt, Homo sapiens
ugaggaagaugcugacuau

SEQ ID NO: 716535 - RNA, 19 nt, Homo sapiens
gcaccaaggcuauggcuuu

SEQ ID NO: 716536 - RNA, 19 nt, Homo sapiens
gagaaguugcuuuaugaua

SEQ ID NO: 716537 - RNA, 19 nt, Homo sapiens
gaaccuggacccugagauu

SEQ ID NO: 716538 - RNA, 19 nt, Homo sapiens
gaacaugaucaaacucuau

SEQ ID NO: 716539 - RNA, 19 nt, Homo sapiens
gaugcugacuaugccauua

SEQ ID NO: 716540 - RNA, 19 nt, Homo sapiens
ccauuaagaucaugaacau

SEQ ID NO: 716541 - RNA, 19 nt, Homo sapiens
ccacaggagguauuucuuu

SEQ ID NO: 716542 - RNA, 19 nt, Homo sapiens
gcuauggcuuuguggaauu

SEQ ID NO: 716543 - RNA, 19 nt, Homo sapiens
gaaguugcuuuaugauacu

SEQ ID NO: 716544 - RNA, 19 nt, Homo sapiens
agaaguugcuuuaugauac

SEQ ID NO: 716545 - RNA, 19 nt, Homo sapiens
gcaauugaagccaugaaug

SEQ ID NO: 716546 - RNA, 19 nt, Homo sapiens
augagaaguugcuuuauga

SEQ ID NO: 716547 - RNA, 19 nt, Homo sapiens
acaggcaacuccaaagguu

SEQ ID NO: 716548 - RNA, 19 nt, Homo sapiens
ggaaucaggaugccacugu

SEQ ID NO: 716549 - RNA, 19 nt, Homo sapiens
ccaaggcuauggcuuugug

SEQ ID NO: 716550 - RNA, 19 nt, Homo sapiens
ugagauugaugagaaguug

SEQ ID NO: 716551 - RNA, 19 nt, Homo sapiens
agcaucagcucacaacaaa

SEQ ID NO: 716552 - RNA, 19 nt, Homo sapiens
aaucagagaugcuguagcu

SEQ ID NO: 716553 - RNA, 19 nt, Homo sapiens
ccucauggcuuaggacauc

SEQ ID NO: 716554 - RNA, 19 nt, Homo sapiens
ugaacaugaucaaacucua

SEQ ID NO: 716555 - RNA, 19 nt, Homo sapiens
ccaauccugugguaucauc

SEQ ID NO: 716556 - RNA, 19 nt, Homo sapiens
ugacacaggcaacuccaaa

SEQ ID NO: 716557 - RNA, 19 nt, Homo sapiens
acccugagauugaugagaa

SEQ ID NO: 716558 - RNA, 19 nt, Homo sapiens
uugaugagaaguugcuuua

SEQ ID NO: 716559 - RNA, 19 nt, Homo sapiens
caccaaggcuauggcuuug

SEQ ID NO: 716560 - RNA, 19 nt, Homo sapiens
caauacgggugaacaaagc

SEQ ID NO: 716561 - RNA, 19 nt, Homo sapiens
caaaugcacagagaaaaua

SEQ ID NO: 716562 - RNA, 19 nt, Homo sapiens
uggaugagaagguuaguga

SEQ ID NO: 716563 - RNA, 19 nt, Homo sapiens
gggccuggaugagaagguu

SEQ ID NO: 716564 - RNA, 19 nt, Homo sapiens
ggucauggacacucacauc

SEQ ID NO: 716565 - RNA, 19 nt, Homo sapiens
acacccacaugccaaagga

SEQ ID NO: 716566 - RNA, 19 nt, Homo sapiens
gccaaaggauagagucacu

SEQ ID NO: 716567 - RNA, 19 nt, Homo sapiens
gaugagaagguuagugaac

SEQ ID NO: 716568 - RNA, 19 nt, Homo sapiens
caaagcaucagcucacaac

SEQ ID NO: 716569 - RNA, 19 nt, Homo sapiens
gacuaugccauuaagauca

SEQ ID NO: 716570 - RNA, 19 nt, Homo sapiens
ggaauucuugagugaggaa

SEQ ID NO: 716571 - RNA, 19 nt, Homo sapiens
ggcuauggcuuuguggaau

SEQ ID NO: 716572 - RNA, 19 nt, Homo sapiens
gcaaaugcacagagaaaau

SEQ ID NO: 716573 - RNA, 19 nt, Homo sapiens
guccuaucaccguaucuua

SEQ ID NO: 716574 - RNA, 19 nt, Homo sapiens
gaaugggcaguaccucugu

SEQ ID NO: 716575 - RNA, 19 nt, Homo sapiens
caggcaacuccaaagguua

SEQ ID NO: 716576 - RNA, 19 nt, Homo sapiens
ccaauacgggugaacaaag

SEQ ID NO: 716577 - RNA, 19 nt, Homo sapiens
ggaagccaauacgggugaa

SEQ ID NO: 716578 - RNA, 19 nt, Homo sapiens
gugaggaagaugcugacua

SEQ ID NO: 716579 - RNA, 19 nt, Homo sapiens
cacaggagguauuucuuuu

SEQ ID NO: 716580 - RNA, 19 nt, Homo sapiens
gccaauacgggugaacaaa

SEQ ID NO: 716581 - RNA, 19 nt, Homo sapiens
ugacuaugccauuaagauc

SEQ ID NO: 716582 - RNA, 19 nt, Homo sapiens
gcacagagaaaauaaaacu

SEQ ID NO: 716583 - RNA, 19 nt, Homo sapiens
uuauguugguccugaguau

SEQ ID NO: 716584 - RNA, 19 nt, Homo sapiens
acucacauccucacccauu

SEQ ID NO: 716585 - RNA, 19 nt, Homo sapiens
aagcaucagcucacaacaa

SEQ ID NO: 716586 - RNA, 19 nt, Homo sapiens
ccuaucaccguaucuuaug

SEQ ID NO: 716587 - RNA, 19 nt, Homo sapiens
ccacaugccaaaggauaga

SEQ ID NO: 716588 - RNA, 19 nt, Homo sapiens
ggaugagaagguuagugaa

SEQ ID NO: 716589 - RNA, 19 nt, Homo sapiens
ucaacacccacaugccaaa

SEQ ID NO: 716590 - RNA, 19 nt, Homo sapiens
gccauuaagaucaugaaca

SEQ ID NO: 716591 - RNA, 19 nt, Homo sapiens
ccugugguaucaucauugg

SEQ ID NO: 716592 - RNA, 19 nt, Homo sapiens
gaagagagguaucauccau

SEQ ID NO: 716593 - RNA, 19 nt, Homo sapiens
gggcaggucucggccaaua

SEQ ID NO: 716594 - RNA, 19 nt, Homo sapiens
gcaccucccugccuugugu

SEQ ID NO: 716595 - RNA, 19 nt, Homo sapiens
gcagcccgcuugccaauca

SEQ ID NO: 716596 - RNA, 19 nt, Homo sapiens
uaaggaggcucgagugaca

SEQ ID NO: 716597 - RNA, 19 nt, Homo sapiens
ucagaccgcuguuuaacga

SEQ ID NO: 716598 - RNA, 19 nt, Homo sapiens
uagaggagaugggcaaaga

SEQ ID NO: 716599 - RNA, 19 nt, Homo sapiens
acacggaccugcugucagu

SEQ ID NO: 716600 - RNA, 19 nt, Homo sapiens
gaggagaugggcaaagaga

SEQ ID NO: 716601 - RNA, 19 nt, Homo sapiens
ggagaugggcaaagagauc

SEQ ID NO: 716602 - RNA, 19 nt, Homo sapiens
ggaccugcugucagucaua

SEQ ID NO: 716603 - RNA, 19 nt, Homo sapiens
ggccagaccucuauuuacc

SEQ ID NO: 716604 - RNA, 19 nt, Homo sapiens
gcgcaccaaucgggaguga

SEQ ID NO: 716605 - RNA, 19 nt, Homo sapiens
aagaugauuuggaguugug

SEQ ID NO: 716606 - RNA, 19 nt, Homo sapiens
gaccugcugucagucauag

SEQ ID NO: 716607 - RNA, 19 nt, Homo sapiens
cauagugacucuuuuaucu

SEQ ID NO: 716608 - RNA, 19 nt, Homo sapiens
cccaugaccugccgacagu

SEQ ID NO: 716609 - RNA, 19 nt, Homo sapiens
gcagcaagagcgccaugga

SEQ ID NO: 716610 - RNA, 19 nt, Homo sapiens
gcaggucucggccaauaag

SEQ ID NO: 716611 - RNA, 19 nt, Homo sapiens
ccggccagaccucuauuua

SEQ ID NO: 716612 - RNA, 19 nt, Homo sapiens
gagauccggccuaccuaug

SEQ ID NO: 716613 - RNA, 19 nt, Homo sapiens
aaagaugauuuggaguugu

SEQ ID NO: 716614 - RNA, 19 nt, Homo sapiens
ccuuucagaccgcuguuua

SEQ ID NO: 716615 - RNA, 19 nt, Homo sapiens
aaagagauccggccuaccu

SEQ ID NO: 716616 - RNA, 19 nt, Homo sapiens
aauaaggaggcucgaguga

SEQ ID NO: 716617 - RNA, 19 nt, Homo sapiens
ccauggagcgccugaagag

SEQ ID NO: 716618 - RNA, 19 nt, Homo sapiens
gaccgcuguuuaacgacuu

SEQ ID NO: 716619 - RNA, 19 nt, Homo sapiens
ccagguggcagcacuaagg

SEQ ID NO: 716620 - RNA, 19 nt, Homo sapiens
caucuucgcgcaccaaucg

SEQ ID NO: 716621 - RNA, 19 nt, Homo sapiens
aaaagaugauuuggaguug

SEQ ID NO: 716622 - RNA, 19 nt, Homo sapiens
ugagccauagugacucuuu

SEQ ID NO: 716623 - RNA, 19 nt, Homo sapiens
ccuuguguccugagccaua

SEQ ID NO: 716624 - RNA, 19 nt, Homo sapiens
gauccggccuaccuaugcu

SEQ ID NO: 716625 - RNA, 19 nt, Homo sapiens
caaagacucucccuaugaa

SEQ ID NO: 716626 - RNA, 19 nt, Homo sapiens
gcaaagacucucccuauga

SEQ ID NO: 716627 - RNA, 19 nt, Homo sapiens
guaaacaucuccacacaca

SEQ ID NO: 716628 - RNA, 19 nt, Homo sapiens
ggagauggaugacauaaaa

SEQ ID NO: 716629 - RNA, 19 nt, Homo sapiens
agaaggaccugacccagaa

SEQ ID NO: 716630 - RNA, 19 nt, Homo sapiens
gcagagaucgccacauugu

SEQ ID NO: 716631 - RNA, 19 nt, Homo sapiens
acauugaccuggagaagaa

SEQ ID NO: 716632 - RNA, 19 nt, Homo sapiens
gcccugacuucccuuguuu

SEQ ID NO: 716633 - RNA, 19 nt, Homo sapiens
gaccugacccagaaauuga

SEQ ID NO: 716634 - RNA, 19 nt, Homo sapiens
gaagaggaggagaacauug

SEQ ID NO: 716635 - RNA, 19 nt, Homo sapiens
ggaccugacccagaaauug

SEQ ID NO: 716636 - RNA, 19 nt, Homo sapiens
gugcaaagacucucccuau

SEQ ID NO: 716637 - RNA, 19 nt, Homo sapiens
aaacauggccuuggcaguu

SEQ ID NO: 716638 - RNA, 19 nt, Homo sapiens
ggaagaggaggagaacauu

SEQ ID NO: 716639 - RNA, 19 nt, Homo sapiens
aacauggccuuggcaguua

SEQ ID NO: 716640 - RNA, 19 nt, Homo sapiens
gaacauugaccuggagaag

SEQ ID NO: 716641 - RNA, 19 nt, Homo sapiens
uaaaccagaccguguugaa

SEQ ID NO: 716642 - RNA, 19 nt, Homo sapiens
gauuaaaccagaccguguu

SEQ ID NO: 716643 - RNA, 19 nt, Homo sapiens
aaacaucuccacacacaca

SEQ ID NO: 716644 - RNA, 19 nt, Homo sapiens
cgagagagagagacagaga

SEQ ID NO: 716645 - RNA, 19 nt, Homo sapiens
ggcccucgguuauccauuc

SEQ ID NO: 716646 - RNA, 19 nt, Homo sapiens
gcagcgaggacgaggaaga

SEQ ID NO: 716647 - RNA, 19 nt, Homo sapiens
gguccacacucaccucucu

SEQ ID NO: 716648 - RNA, 19 nt, Homo sapiens
ccuaugaauugaagaaagg

SEQ ID NO: 716649 - RNA, 19 nt, Homo sapiens
agagagagacagagagaga

SEQ ID NO: 716650 - RNA, 19 nt, Homo sapiens
aagaggaggagaacauuga

SEQ ID NO: 716651 - RNA, 19 nt, Homo sapiens
aaagggugcuucggucguu

SEQ ID NO: 716652 - RNA, 19 nt, Homo sapiens
ugcaaagacucucccuaug

SEQ ID NO: 716653 - RNA, 19 nt, Homo sapiens
agacagagagagaaaauaa

SEQ ID NO: 716654 - RNA, 19 nt, Homo sapiens
gagagagacagagagagaa

SEQ ID NO: 716655 - RNA, 19 nt, Homo sapiens
gaauugaagaaagguaugu

SEQ ID NO: 716656 - RNA, 19 nt, Homo sapiens
ucaacgagcaccgcaagaa

SEQ ID NO: 716657 - RNA, 19 nt, Homo sapiens
uauaguuuauggagaugga

SEQ ID NO: 716658 - RNA, 19 nt, Homo sapiens
cuaaagacccgaaaauguu

SEQ ID NO: 716659 - RNA, 19 nt, Homo sapiens
gaaggaccugacccagaaa

SEQ ID NO: 716660 - RNA, 19 nt, Homo sapiens
agacucucccuaugaauug

SEQ ID NO: 716661 - RNA, 19 nt, Homo sapiens
gcuaaagacccgaaaaugu

SEQ ID NO: 716662 - RNA, 19 nt, Homo sapiens
uuauggagauggaugacau

SEQ ID NO: 716663 - RNA, 19 nt, Homo sapiens
uaaacuaccccuccuauuc

SEQ ID NO: 716664 - RNA, 19 nt, Homo sapiens
ccaccaagggcgagaagau

SEQ ID NO: 716665 - RNA, 19 nt, Homo sapiens
aagacucucccuaugaauu

SEQ ID NO: 716666 - RNA, 19 nt, Homo sapiens
agagagacagagagagaaa

SEQ ID NO: 716667 - RNA, 19 nt, Homo sapiens
agagagagagacagagaga

SEQ ID NO: 716668 - RNA, 19 nt, Homo sapiens
gaguugcuccuaggucuga

SEQ ID NO: 716669 - RNA, 19 nt, Homo sapiens
cagcuagaccugugcaaag

SEQ ID NO: 716670 - RNA, 19 nt, Homo sapiens
agcccaaacuguggucuuu

SEQ ID NO: 716671 - RNA, 19 nt, Homo sapiens
aggaggagcugagcagaag

SEQ ID NO: 716672 - RNA, 19 nt, Homo sapiens
cccagaagcccgaggacaa

SEQ ID NO: 716673 - RNA, 19 nt, Homo sapiens
gacccagcguaccggaaga

SEQ ID NO: 716674 - RNA, 19 nt, Homo sapiens
ccuccuauucagaaguuua

SEQ ID NO: 716675 - RNA, 19 nt, Homo sapiens
gaucaugcuggccaucauc

SEQ ID NO: 716676 - RNA, 19 nt, Homo sapiens
caacgagcaccgcaagaac

SEQ ID NO: 716677 - RNA, 19 nt, Homo sapiens
ggagccagucucagcuaga

SEQ ID NO: 716678 - RNA, 19 nt, Homo sapiens
caggaggagcugagcagaa

SEQ ID NO: 716679 - RNA, 19 nt, Homo sapiens
gccucaagaaagagaauaa

SEQ ID NO: 716680 - RNA, 19 nt, Homo sapiens
gcggagccagucucagcua

SEQ ID NO: 716681 - RNA, 19 nt, Homo sapiens
gacucucccuaugaauuga

SEQ ID NO: 716682 - RNA, 19 nt, Homo sapiens
ccucaucacucuuguagua

SEQ ID NO: 716683 - RNA, 19 nt, Homo sapiens
ucaaauggauccuaucgaa

SEQ ID NO: 716684 - RNA, 19 nt, Homo sapiens
cagagaggaucaucuuuga

SEQ ID NO: 716685 - RNA, 19 nt, Homo sapiens
gcagagaggaucaucuuug

SEQ ID NO: 716686 - RNA, 19 nt, Homo sapiens
gagauugccuggagcacuu

SEQ ID NO: 716687 - RNA, 19 nt, Homo sapiens
ggcacgagcuucucaacaa

SEQ ID NO: 716688 - RNA, 19 nt, Homo sapiens
gagaggaucaucuuugaga

SEQ ID NO: 716689 - RNA, 19 nt, Homo sapiens
ggacggugaagaacuauga

SEQ ID NO: 716690 - RNA, 19 nt, Homo sapiens
gcacuuugcagaguuguuu

SEQ ID NO: 716691 - RNA, 19 nt, Homo sapiens
gcugggcgcuguccugaau

SEQ ID NO: 716692 - RNA, 19 nt, Homo sapiens
cacaaguucuguaaucuuc

SEQ ID NO: 716693 - RNA, 19 nt, Homo sapiens
gcacaaguucuguaaucuu

SEQ ID NO: 716694 - RNA, 19 nt, Homo sapiens
caaguucuguaaucuucaa

SEQ ID NO: 716695 - RNA, 19 nt, Homo sapiens
ggagcacuuugcagaguug

SEQ ID NO: 716696 - RNA, 19 nt, Homo sapiens
gcuggaaucauuauaagga

SEQ ID NO: 716697 - RNA, 19 nt, Homo sapiens
caaauggauccuaucgaaa

SEQ ID NO: 716698 - RNA, 19 nt, Homo sapiens
gcacgagcuucucaacaac

SEQ ID NO: 716699 - RNA, 19 nt, Homo sapiens
ggaaucauuauaaggauca

SEQ ID NO: 716700 - RNA, 19 nt, Homo sapiens
uggcacaaguucuguaauc

SEQ ID NO: 716701 - RNA, 19 nt, Homo sapiens
caauuuugcuggaaucauu

SEQ ID NO: 716702 - RNA, 19 nt, Homo sapiens
augauuagcaggccuuaua

SEQ ID NO: 716703 - RNA, 19 nt, Homo sapiens
uauagcacccugcgagauu

SEQ ID NO: 716704 - RNA, 19 nt, Homo sapiens
gauguacuccuggccauga

SEQ ID NO: 716705 - RNA, 19 nt, Homo sapiens
gggcauggcacaaguucug

SEQ ID NO: 716706 - RNA, 19 nt, Homo sapiens
ggaggaguaaagacaguga

SEQ ID NO: 716707 - RNA, 19 nt, Homo sapiens
cuuguaguauggaggagua

SEQ ID NO: 716708 - RNA, 19 nt, Homo sapiens
ucaucacucuuguaguaug

SEQ ID NO: 716709 - RNA, 19 nt, Homo sapiens
gcauggcacaaguucugua

SEQ ID NO: 716710 - RNA, 19 nt, Homo sapiens
ggugaagaacuaugagaca

SEQ ID NO: 716711 - RNA, 19 nt, Homo sapiens
caaccauguuacuccacuu

SEQ ID NO: 716712 - RNA, 19 nt, Homo sapiens
guauggaggaguaaagaca

SEQ ID NO: 716713 - RNA, 19 nt, Homo sapiens
cauggcacaaguucuguaa

SEQ ID NO: 716714 - RNA, 19 nt, Homo sapiens
ggcacaaguucuguaaucu

SEQ ID NO: 716715 - RNA, 19 nt, Homo sapiens
caucacucuuguaguaugg

SEQ ID NO: 716716 - RNA, 19 nt, Homo sapiens
gcgacugggccaugauuag

SEQ ID NO: 716717 - RNA, 19 nt, Homo sapiens
uggcagagaggaucaucuu

SEQ ID NO: 716718 - RNA, 19 nt, Homo sapiens
uggagcacuuugcagaguu

SEQ ID NO: 716719 - RNA, 19 nt, Homo sapiens
aaauggauccuaucgaaaa

SEQ ID NO: 716720 - RNA, 19 nt, Homo sapiens
guaguauggaggaguaaag

SEQ ID NO: 716721 - RNA, 19 nt, Homo sapiens
gaugagugguuugugauua

SEQ ID NO: 716722 - RNA, 19 nt, Homo sapiens
ggacagagcaggcccacaa

SEQ ID NO: 716723 - RNA, 19 nt, Homo sapiens
gcacugagggcauugugua

SEQ ID NO: 716724 - RNA, 19 nt, Homo sapiens
gggagacgcugugguguga

SEQ ID NO: 716725 - RNA, 19 nt, Homo sapiens
ucacaggaguccagaguag

SEQ ID NO: 716726 - RNA, 19 nt, Homo sapiens
guggaugagugguuuguga

SEQ ID NO: 716727 - RNA, 19 nt, Homo sapiens
gcccaucaccucuucauga

SEQ ID NO: 716728 - RNA, 19 nt, Homo sapiens
gcaggaccaucaggagcua

SEQ ID NO: 716729 - RNA, 19 nt, Homo sapiens
ugacuuaccucuggaaagg

SEQ ID NO: 716730 - RNA, 19 nt, Homo sapiens
gaaagggucccagccuaga

SEQ ID NO: 716731 - RNA, 19 nt, Homo sapiens
gggacgugaccuugacuua

SEQ ID NO: 716732 - RNA, 19 nt, Homo sapiens
gcagggacgugaccuugac

SEQ ID NO: 716733 - RNA, 19 nt, Homo sapiens
augcagagguggacagguu

SEQ ID NO: 716734 - RNA, 19 nt, Homo sapiens
caagcgcacugagggcauu

SEQ ID NO: 716735 - RNA, 19 nt, Homo sapiens
gugcauggccgcuacuuca

SEQ ID NO: 716736 - RNA, 19 nt, Homo sapiens
augagugguuugugauuaa

SEQ ID NO: 716737 - RNA, 19 nt, Homo sapiens
ggaugagugguuugugauu

SEQ ID NO: 716738 - RNA, 19 nt, Homo sapiens
ugagugguuugugauuaaa

SEQ ID NO: 716739 - RNA, 19 nt, Homo sapiens
ucacccaguuccagguaga

SEQ ID NO: 716740 - RNA, 19 nt, Homo sapiens
ggacgugaccuugacuuac

SEQ ID NO: 716741 - RNA, 19 nt, Homo sapiens
gacgugaccuugacuuacc

SEQ ID NO: 716742 - RNA, 19 nt, Homo sapiens
ccgaggcucugguauuaac

SEQ ID NO: 716743 - RNA, 19 nt, Homo sapiens
gcucacaggaguccagagu

SEQ ID NO: 716744 - RNA, 19 nt, Homo sapiens
gagacgcuguggugugacu

SEQ ID NO: 716745 - RNA, 19 nt, Homo sapiens
cgacugcaccuggcacaug

SEQ ID NO: 716746 - RNA, 19 nt, Homo sapiens
cuagacugcuuaccccaua

SEQ ID NO: 716747 - RNA, 19 nt, Homo sapiens
ccuggcacauggcggagaa

SEQ ID NO: 716748 - RNA, 19 nt, Homo sapiens
gcagguuucuaugcuguuu

SEQ ID NO: 716749 - RNA, 19 nt, Homo sapiens
ggugcaaccuguccgaguu

SEQ ID NO: 716750 - RNA, 19 nt, Homo sapiens
cagaguccauuccaucaug

SEQ ID NO: 716751 - RNA, 19 nt, Homo sapiens
ggaaggcuuucgcagacau

SEQ ID NO: 716752 - RNA, 19 nt, Homo sapiens
cccaagcucuuugcucauu

SEQ ID NO: 716753 - RNA, 19 nt, Homo sapiens
ggaaaggcugggaggagaa

SEQ ID NO: 716754 - RNA, 19 nt, Homo sapiens
guuucuaugcuguuucuua

SEQ ID NO: 716755 - RNA, 19 nt, Homo sapiens
ccgaguucaucguguacua

SEQ ID NO: 716756 - RNA, 19 nt, Homo sapiens
uguccgaguucaucgugua

SEQ ID NO: 716757 - RNA, 19 nt, Homo sapiens
gcaagguggacgucuggaa

SEQ ID NO: 716758 - RNA, 19 nt, Homo sapiens
gcaacgagacaggcauguu

SEQ ID NO: 716759 - RNA, 19 nt, Homo sapiens
agaauccagccuagccuua

SEQ ID NO: 716760 - RNA, 19 nt, Homo sapiens
acaggcaguucuucuccaa

SEQ ID NO: 716761 - RNA, 19 nt, Homo sapiens
gauaaggccagagcuugug

SEQ ID NO: 716762 - RNA, 19 nt, Homo sapiens
ccaaugucgugggcugcua

SEQ ID NO: 716763 - RNA, 19 nt, Homo sapiens
agaguccauuccaucauga

SEQ ID NO: 716764 - RNA, 19 nt, Homo sapiens
uuucuaugcuguuucuuag

SEQ ID NO: 716765 - RNA, 19 nt, Homo sapiens
caagcucuuugcucauucu

SEQ ID NO: 716766 - RNA, 19 nt, Homo sapiens
gccaaucuccagcuacugu

SEQ ID NO: 716767 - RNA, 19 nt, Homo sapiens
ucaucccgcugaucguuau

SEQ ID NO: 716768 - RNA, 19 nt, Homo sapiens
cuggcaagcuggaagaaag

SEQ ID NO: 716769 - RNA, 19 nt, Homo sapiens
gagcuuguggccucuaucu

SEQ ID NO: 716770 - RNA, 19 nt, Homo sapiens
gaauccagccuagccuuag

SEQ ID NO: 716771 - RNA, 19 nt, Homo sapiens
ccaagcucuuugcucauuc

SEQ ID NO: 716772 - RNA, 19 nt, Homo sapiens
gcagaguccauuccaucau

SEQ ID NO: 716773 - RNA, 19 nt, Homo sapiens
gcuauccgcccaagcucuu

SEQ ID NO: 716774 - RNA, 19 nt, Homo sapiens
gggaaggcuuucgcagaca

SEQ ID NO: 716775 - RNA, 19 nt, Homo sapiens
ggugggugcugccaaucuc

SEQ ID NO: 716776 - RNA, 19 nt, Homo sapiens
gaguucaucguguacuaug

SEQ ID NO: 716777 - RNA, 19 nt, Homo sapiens
ucugcuaccaucuguguuu

SEQ ID NO: 716778 - RNA, 19 nt, Homo sapiens
gaaaggcugggaggagaag

SEQ ID NO: 716779 - RNA, 19 nt, Homo sapiens
ggaggaaaaugugauaagg

SEQ ID NO: 716780 - RNA, 19 nt, Homo sapiens
caaccuguccgaguucauc

SEQ ID NO: 716781 - RNA, 19 nt, Homo sapiens
uaucugcuaccaucugugu

SEQ ID NO: 716782 - RNA, 19 nt, Homo sapiens
ugauaaggccagagcuugu

SEQ ID NO: 716783 - RNA, 19 nt, Homo sapiens
caucguguacuaugagagu

SEQ ID NO: 716784 - RNA, 19 nt, Homo sapiens
gcaagcuggaagaaaguuc

SEQ ID NO: 716785 - RNA, 19 nt, Homo sapiens
guuauacccgucguucuga

SEQ ID NO: 716786 - RNA, 19 nt, Homo sapiens
gaacaggaaagacgaauua

SEQ ID NO: 716787 - RNA, 19 nt, Homo sapiens
acaaugagguucuuucuuu

SEQ ID NO: 716788 - RNA, 19 nt, Homo sapiens
gaucauggauucugaaaca

SEQ ID NO: 716789 - RNA, 19 nt, Homo sapiens
gggcaucgcuggacgcuuu

SEQ ID NO: 716790 - RNA, 19 nt, Homo sapiens
cagcagagauggccauauu

SEQ ID NO: 716791 - RNA, 19 nt, Homo sapiens
cugaagacauuucugauua

SEQ ID NO: 716792 - RNA, 19 nt, Homo sapiens
gaagguguauguuguggaa

SEQ ID NO: 716793 - RNA, 19 nt, Homo sapiens
gaaagguaauaguugguaa

SEQ ID NO: 716794 - RNA, 19 nt, Homo sapiens
ggucaggacucuauucaga

SEQ ID NO: 716795 - RNA, 19 nt, Homo sapiens
gaucaagaguuucucauag

SEQ ID NO: 716796 - RNA, 19 nt, Homo sapiens
gcucacaccuaacuugaaa

SEQ ID NO: 716797 - RNA, 19 nt, Homo sapiens
gaaguaauggcaaagagua

SEQ ID NO: 716798 - RNA, 19 nt, Homo sapiens
gcagagauggccauauuaa

SEQ ID NO: 716799 - RNA, 19 nt, Homo sapiens
ucauaucucuguccacuuu

SEQ ID NO: 716800 - RNA, 19 nt, Homo sapiens
ugggaaggcuaaagacuua

SEQ ID NO: 716801 - RNA, 19 nt, Homo sapiens
ugucuucacuucuacuuua

SEQ ID NO: 716802 - RNA, 19 nt, Homo sapiens
aaacauggcuucaaucaac

SEQ ID NO: 716803 - RNA, 19 nt, Homo sapiens
acacagugaucaagaguuu

SEQ ID NO: 716804 - RNA, 19 nt, Homo sapiens
gcuaaagacuuauauucug

SEQ ID NO: 716805 - RNA, 19 nt, Homo sapiens
ucauagugcuuugaaguua

SEQ ID NO: 716806 - RNA, 19 nt, Homo sapiens
caugaaugauuuccaguuu

SEQ ID NO: 716807 - RNA, 19 nt, Homo sapiens
gaaagaugcaaucaagaaa

SEQ ID NO: 716808 - RNA, 19 nt, Homo sapiens
guaaggccaauguuauuua

SEQ ID NO: 716809 - RNA, 19 nt, Homo sapiens
aaacagugguccugaauca

SEQ ID NO: 716810 - RNA, 19 nt, Homo sapiens
uagagagacuucaagcuuu

SEQ ID NO: 716811 - RNA, 19 nt, Homo sapiens
guuucaagcugaugcauuu

SEQ ID NO: 716812 - RNA, 19 nt, Homo sapiens
gaugaauucuuuccugugu

SEQ ID NO: 716813 - RNA, 19 nt, Homo sapiens
gcagaagaguuuucauuuu

SEQ ID NO: 716814 - RNA, 19 nt, Homo sapiens
ugaauucuuuccuguguuu

SEQ ID NO: 716815 - RNA, 19 nt, Homo sapiens
agggaaagcuuaaagaaga

SEQ ID NO: 716816 - RNA, 19 nt, Homo sapiens
ugacgaagguguauguugu

SEQ ID NO: 716817 - RNA, 19 nt, Homo sapiens
caugaaagaugcaaucaag

SEQ ID NO: 716818 - RNA, 19 nt, Homo sapiens
ccauggagucuuuauaaua

SEQ ID NO: 716819 - RNA, 19 nt, Homo sapiens
gaagggaacagugaagaaa

SEQ ID NO: 716820 - RNA, 19 nt, Homo sapiens
ggaggauucuggcauggaa

SEQ ID NO: 716821 - RNA, 19 nt, Homo sapiens
cauggauucugaaacauuu

SEQ ID NO: 716822 - RNA, 19 nt, Homo sapiens
gcagagaaggauauauaaa

SEQ ID NO: 716823 - RNA, 19 nt, Homo sapiens
ugaaggcacucuuauucuu

SEQ ID NO: 716824 - RNA, 19 nt, Homo sapiens
gcccagauuuaaauacauu

SEQ ID NO: 716825 - RNA, 19 nt, Homo sapiens
uugaucaucuuccaguuua

SEQ ID NO: 716826 - RNA, 19 nt, Homo sapiens
cagcauccuuuaucuguga

SEQ ID NO: 716827 - RNA, 19 nt, Homo sapiens
gauagccaacccacucuua

SEQ ID NO: 716828 - RNA, 19 nt, Homo sapiens
cggcagagaaggauauaua

SEQ ID NO: 716829 - RNA, 19 nt, Homo sapiens
gaaaauccgugucuuuauc

SEQ ID NO: 716830 - RNA, 19 nt, Homo sapiens
ggaaggcuaaagacuuaua

SEQ ID NO: 716831 - RNA, 19 nt, Homo sapiens
gggaaagcuuaaagaagaa

SEQ ID NO: 716832 - RNA, 19 nt, Homo sapiens
caagaaauuuguugugacu

SEQ ID NO: 716833 - RNA, 19 nt, Homo sapiens
gcagauaauguuuacuuug

SEQ ID NO: 716834 - RNA, 19 nt, Homo sapiens
gaugaaauacugaugaauc

SEQ ID NO: 716835 - RNA, 19 nt, Homo sapiens
agggaacagugaagaaaua

SEQ ID NO: 716836 - RNA, 19 nt, Homo sapiens
ugaaagaugcaaucaagaa

SEQ ID NO: 716837 - RNA, 19 nt, Homo sapiens
cauggagucuuuauaauac

SEQ ID NO: 716838 - RNA, 19 nt, Homo sapiens
caaagugggaucaacugua

SEQ ID NO: 716839 - RNA, 19 nt, Homo sapiens
gggcauuuauuccaaagug

SEQ ID NO: 716840 - RNA, 19 nt, Homo sapiens
augaaucucugugacauua

SEQ ID NO: 716841 - RNA, 19 nt, Homo sapiens
ugaaaucuggucuuacuuu

SEQ ID NO: 716842 - RNA, 19 nt, Homo sapiens
acacugagauguccaggau

SEQ ID NO: 716843 - RNA, 19 nt, Homo sapiens
aguauugacuuuccuuuga

SEQ ID NO: 716844 - RNA, 19 nt, Homo sapiens
ggacgguucugugguuaug

SEQ ID NO: 716845 - RNA, 19 nt, Homo sapiens
gaaaagcccagauuuaaau

SEQ ID NO: 716846 - RNA, 19 nt, Homo sapiens
gcacagcggcagagaagga

SEQ ID NO: 716847 - RNA, 19 nt, Homo sapiens
uuagccagaugaauucuuu

SEQ ID NO: 716848 - RNA, 19 nt, Homo sapiens
uaggacagaucauggauuc

SEQ ID NO: 716849 - RNA, 19 nt, Homo sapiens
gggcauauguuugaaagag

SEQ ID NO: 716850 - RNA, 19 nt, Homo sapiens
ggaaagaacggauauugcu

SEQ ID NO: 716851 - RNA, 19 nt, Homo sapiens
guacgccuuugguaucuga

SEQ ID NO: 716852 - RNA, 19 nt, Homo sapiens
caagaacaagcgaauaguu

SEQ ID NO: 716853 - RNA, 19 nt, Homo sapiens
gcaaucaagaaauuuguug

SEQ ID NO: 716854 - RNA, 19 nt, Homo sapiens
cugcaaaagugaaacauua

SEQ ID NO: 716855 - RNA, 19 nt, Homo sapiens
gaaucucugugacauuaca

SEQ ID NO: 716856 - RNA, 19 nt, Homo sapiens
gaaauacugaugaaucucu

SEQ ID NO: 716857 - RNA, 19 nt, Homo sapiens
gagauggccauauuaaaca

SEQ ID NO: 716858 - RNA, 19 nt, Homo sapiens
ggaaacagugguccugaau

SEQ ID NO: 716859 - RNA, 19 nt, Homo sapiens
gguuugccauggagucuuu

SEQ ID NO: 716860 - RNA, 19 nt, Homo sapiens
gagacugaaggcacucuua

SEQ ID NO: 716861 - RNA, 19 nt, Homo sapiens
caacuguacgccuuuggua

SEQ ID NO: 716862 - RNA, 19 nt, Homo sapiens
uaauacauccuuucacuca

SEQ ID NO: 716863 - RNA, 19 nt, Homo sapiens
gcucuccuauucuaccaaa

SEQ ID NO: 716864 - RNA, 19 nt, Homo sapiens
caggaucugugacugaaga

SEQ ID NO: 716865 - RNA, 19 nt, Homo sapiens
agagagacuucaagcuuug

SEQ ID NO: 716866 - RNA, 19 nt, Homo sapiens
ggaagaagggaacagugaa

SEQ ID NO: 716867 - RNA, 19 nt, Homo sapiens
agaaauuuguugugacuca

SEQ ID NO: 716868 - RNA, 19 nt, Homo sapiens
ucaagaguuucucauagug

SEQ ID NO: 716869 - RNA, 19 nt, Homo sapiens
acaccuaacuugaaaucug

SEQ ID NO: 716870 - RNA, 19 nt, Homo sapiens
gagggcauauguuugaaag

SEQ ID NO: 716871 - RNA, 19 nt, Homo sapiens
guccuaagccgcagauuug

SEQ ID NO: 716872 - RNA, 19 nt, Homo sapiens
gaucaacuguacgccuuug

SEQ ID NO: 716873 - RNA, 19 nt, Homo sapiens
aaagugggaucaacuguac

SEQ ID NO: 716874 - RNA, 19 nt, Homo sapiens
gguaaauuguagcuucuuc

SEQ ID NO: 716875 - RNA, 19 nt, Homo sapiens
gguaaggccaauguuauuu

SEQ ID NO: 716876 - RNA, 19 nt, Homo sapiens
ugacugaagacauuucuga

SEQ ID NO: 716877 - RNA, 19 nt, Homo sapiens
ggaggaauaccuuaucucu

SEQ ID NO: 716878 - RNA, 19 nt, Homo sapiens
uaacugccuuuccuuccuu

SEQ ID NO: 716879 - RNA, 19 nt, Homo sapiens
acauaaggaugaaauacug

SEQ ID NO: 716880 - RNA, 19 nt, Homo sapiens
aaaaugcucuccuauucua

SEQ ID NO: 716881 - RNA, 19 nt, Homo sapiens
ggccaauguuauuuaaaug

SEQ ID NO: 716882 - RNA, 19 nt, Homo sapiens
guugggacauacagucaaa

SEQ ID NO: 716883 - RNA, 19 nt, Homo sapiens
aagaacaagcgaauaguuu

SEQ ID NO: 716884 - RNA, 19 nt, Homo sapiens
gccauggagucuuuauaau

SEQ ID NO: 716885 - RNA, 19 nt, Homo sapiens
ggcagagaaggauauauaa

SEQ ID NO: 716886 - RNA, 19 nt, Homo sapiens
ggaaggagaugacaauuua

SEQ ID NO: 716887 - RNA, 19 nt, Homo sapiens
gaaaggaggcuguagaaua

SEQ ID NO: 716888 - RNA, 19 nt, Homo sapiens
caacauaaauugccauaga

SEQ ID NO: 716889 - RNA, 19 nt, Homo sapiens
ggaaauaaacugcuugaaa

SEQ ID NO: 716890 - RNA, 19 nt, Homo sapiens
gaugauacauuacuuguuc

SEQ ID NO: 716891 - RNA, 19 nt, Homo sapiens
aaaggaggcuguagaauau

SEQ ID NO: 716892 - RNA, 19 nt, Homo sapiens
gggaacagcugaauacuag

SEQ ID NO: 716893 - RNA, 19 nt, Homo sapiens
gcaccaagcugcccgacaa

SEQ ID NO: 716894 - RNA, 19 nt, Homo sapiens
uagcauguguucaagguua

SEQ ID NO: 716895 - RNA, 19 nt, Homo sapiens
ggaacgagcugaacuacgu

SEQ ID NO: 716896 - RNA, 19 nt, Homo sapiens
gcacggugaugcauaccua

SEQ ID NO: 716897 - RNA, 19 nt, Homo sapiens
caacagacauauagugaag

SEQ ID NO: 716898 - RNA, 19 nt, Homo sapiens
uaauaaagguugggugauu

SEQ ID NO: 716899 - RNA, 19 nt, Homo sapiens
gcaaagcaaauuucacaaa

SEQ ID NO: 716900 - RNA, 19 nt, Homo sapiens
gaacaacagacauauagug

SEQ ID NO: 716901 - RNA, 19 nt, Homo sapiens
gaauucaguuugccuguuc

SEQ ID NO: 716902 - RNA, 19 nt, Homo sapiens
caaagcaaauuucacaaag

SEQ ID NO: 716903 - RNA, 19 nt, Homo sapiens
ugacgcagcuggugacuuc

SEQ ID NO: 716904 - RNA, 19 nt, Homo sapiens
aauaaagguugggugauua

SEQ ID NO: 716905 - RNA, 19 nt, Homo sapiens
gcuguaacaugucucuuga

SEQ ID NO: 716906 - RNA, 19 nt, Homo sapiens
cagaauaugcuguaaucua

SEQ ID NO: 716907 - RNA, 19 nt, Homo sapiens
ugaaguacauuguccuuag

SEQ ID NO: 716908 - RNA, 19 nt, Homo sapiens
guuucaagcuucagccuuu

SEQ ID NO: 716909 - RNA, 19 nt, Homo sapiens
gcagucguguggcuucuug

SEQ ID NO: 716910 - RNA, 19 nt, Homo sapiens
gugaagagacccagcguuu

SEQ ID NO: 716911 - RNA, 19 nt, Homo sapiens
ggcgugugcucccagaaua

SEQ ID NO: 716912 - RNA, 19 nt, Homo sapiens
gaggugaggauaagaaaga

SEQ ID NO: 716913 - RNA, 19 nt, Homo sapiens
gaagcggcgucaggaauug

SEQ ID NO: 716914 - RNA, 19 nt, Homo sapiens
gcaggaaacggaagcaguu

SEQ ID NO: 716915 - RNA, 19 nt, Homo sapiens
gaacuguacaucucacaug

SEQ ID NO: 716916 - RNA, 19 nt, Homo sapiens
gcaacagaauuuccuaaaa

SEQ ID NO: 716917 - RNA, 19 nt, Homo sapiens
gcugaauacuaggaauaua

SEQ ID NO: 716918 - RNA, 19 nt, Homo sapiens
gaacagcugaauacuagga

SEQ ID NO: 716919 - RNA, 19 nt, Homo sapiens
ggacgaggaugugaagaag

SEQ ID NO: 716920 - RNA, 19 nt, Homo sapiens
aaacugaugcagagucuaa

SEQ ID NO: 716921 - RNA, 19 nt, Homo sapiens
ggaaggcguugggaugaug

SEQ ID NO: 716922 - RNA, 19 nt, Homo sapiens
agaagcaucugcaaagcaa

SEQ ID NO: 716923 - RNA, 19 nt, Homo sapiens
gugcuguggucgccuagua

SEQ ID NO: 716924 - RNA, 19 nt, Homo sapiens
caucucacauguugggaaa

SEQ ID NO: 716925 - RNA, 19 nt, Homo sapiens
ugccauagguggaauaauc

SEQ ID NO: 716926 - RNA, 19 nt, Homo sapiens
guagugcacuuggaauaau

SEQ ID NO: 716927 - RNA, 19 nt, Homo sapiens
gaauugauggagaaagaaa

SEQ ID NO: 716928 - RNA, 19 nt, Homo sapiens
aggaauauaucuugcucua

SEQ ID NO: 716929 - RNA, 19 nt, Homo sapiens
gcacuuggaauaauaaagg

SEQ ID NO: 716930 - RNA, 19 nt, Homo sapiens
ccaggugaauauuuaugaa

SEQ ID NO: 716931 - RNA, 19 nt, Homo sapiens
cgaccgcaauggcagcuuu

SEQ ID NO: 716932 - RNA, 19 nt, Homo sapiens
gaaagggaggcuagcaugu

SEQ ID NO: 716933 - RNA, 19 nt, Homo sapiens
cuuuagaucuuuccaaauc

SEQ ID NO: 716934 - RNA, 19 nt, Homo sapiens
ucucacggcuugucucaug

SEQ ID NO: 716935 - RNA, 19 nt, Homo sapiens
gaaguggaacaaacugaug

SEQ ID NO: 716936 - RNA, 19 nt, Homo sapiens
caguuugccuguucuguau

SEQ ID NO: 716937 - RNA, 19 nt, Homo sapiens
cucaggagaugaagaauuc

SEQ ID NO: 716938 - RNA, 19 nt, Homo sapiens
guggugagaggauagcuua

SEQ ID NO: 716939 - RNA, 19 nt, Homo sapiens
ggugaugcauaccuauaau

SEQ ID NO: 716940 - RNA, 19 nt, Homo sapiens
guugggugauuauaucuug

SEQ ID NO: 716941 - RNA, 19 nt, Homo sapiens
uagugcacuuggaauaaua

SEQ ID NO: 716942 - RNA, 19 nt, Homo sapiens
acgaagagauccagaagca

SEQ ID NO: 716943 - RNA, 19 nt, Homo sapiens
acugggaaaucauuagaaa

SEQ ID NO: 716944 - RNA, 19 nt, Homo sapiens
ggaagauccuccccuuuug

SEQ ID NO: 716945 - RNA, 19 nt, Homo sapiens
gcuagcauguguucaaggu

SEQ ID NO: 716946 - RNA, 19 nt, Homo sapiens
gaaagaaaacuugauguga

SEQ ID NO: 716947 - RNA, 19 nt, Homo sapiens
agaccaaccuggacaacau

SEQ ID NO: 716948 - RNA, 19 nt, Homo sapiens
aggaauugauggagaaaga

SEQ ID NO: 716949 - RNA, 19 nt, Homo sapiens
gagaagcggcgucaggaau

SEQ ID NO: 716950 - RNA, 19 nt, Homo sapiens
gaauugggcccugcucaug

SEQ ID NO: 716951 - RNA, 19 nt, Homo sapiens
gggaaaucauuagaaagga

SEQ ID NO: 716952 - RNA, 19 nt, Homo sapiens
cuucagccuuuaaccuaua

SEQ ID NO: 716953 - RNA, 19 nt, Homo sapiens
cagcugaauacuaggaaua

SEQ ID NO: 716954 - RNA, 19 nt, Homo sapiens
ugaaacuguugauccagaa

SEQ ID NO: 716955 - RNA, 19 nt, Homo sapiens
aaagagacccugcgguuca

SEQ ID NO: 716956 - RNA, 19 nt, Homo sapiens
gcucaggagaugaagaauu

SEQ ID NO: 716957 - RNA, 19 nt, Homo sapiens
ugccauagauagaagguau

SEQ ID NO: 716958 - RNA, 19 nt, Homo sapiens
ccaaaggccagaaguaucu

SEQ ID NO: 716959 - RNA, 19 nt, Homo sapiens
gaaguacauuguccuuagc

SEQ ID NO: 716960 - RNA, 19 nt, Homo sapiens
aagcaaauuucacaaagag

SEQ ID NO: 716961 - RNA, 19 nt, Homo sapiens
guccauggcucccgacuac

SEQ ID NO: 716962 - RNA, 19 nt, Homo sapiens
aggaggcuguagaauauuu

SEQ ID NO: 716963 - RNA, 19 nt, Homo sapiens
aaauggcccugcuguguca

SEQ ID NO: 716964 - RNA, 19 nt, Homo sapiens
gaccaaccuggacaacaua

SEQ ID NO: 716965 - RNA, 19 nt, Homo sapiens
gccuuuaaccuauaccuuu

SEQ ID NO: 716966 - RNA, 19 nt, Homo sapiens
cccagaauaugcuguaauc

SEQ ID NO: 716967 - RNA, 19 nt, Homo sapiens
gaaaaccagucuccaugug

SEQ ID NO: 716968 - RNA, 19 nt, Homo sapiens
uagaaaggaggcuguagaa

SEQ ID NO: 716969 - RNA, 19 nt, Homo sapiens
gucccaaucuuuaguccuu

SEQ ID NO: 716970 - RNA, 19 nt, Homo sapiens
caauacagccacugaugga

SEQ ID NO: 716971 - RNA, 19 nt, Homo sapiens
ugacaguagugcacuugga

SEQ ID NO: 716972 - RNA, 19 nt, Homo sapiens
gaagagacccagcguuucc

SEQ ID NO: 716973 - RNA, 19 nt, Homo sapiens
gaaagaaaccgcaaaacca

SEQ ID NO: 716974 - RNA, 19 nt, Homo sapiens
ugaaauggcccugcugugu

SEQ ID NO: 716975 - RNA, 19 nt, Homo sapiens
gaggcuagcauguguucaa

SEQ ID NO: 716976 - RNA, 19 nt, Homo sapiens
uuacuaccacucaaaugua

SEQ ID NO: 716977 - RNA, 19 nt, Homo sapiens
acagacauauagugaagau

SEQ ID NO: 716978 - RNA, 19 nt, Homo sapiens
caaguuccguagcuuugau

SEQ ID NO: 716979 - RNA, 19 nt, Homo sapiens
ccuuuaaccuauaccuuug

SEQ ID NO: 716980 - RNA, 19 nt, Homo sapiens
caaccagcguuuggacaug

SEQ ID NO: 716981 - RNA, 19 nt, Homo sapiens
gucaggaauugauggagaa

SEQ ID NO: 716982 - RNA, 19 nt, Homo sapiens
ucaguuugccuguucugua

SEQ ID NO: 716983 - RNA, 19 nt, Homo sapiens
cagcuacgacuaugaguuc

SEQ ID NO: 716984 - RNA, 19 nt, Homo sapiens
gcuucagccuuuaaccuau

SEQ ID NO: 716985 - RNA, 19 nt, Homo sapiens
caguagugcacuuggaaua

SEQ ID NO: 716986 - RNA, 19 nt, Homo sapiens
guuggacucuggacuguuu

SEQ ID NO: 716987 - RNA, 19 nt, Homo sapiens
gcagggcaaucgucuguuc

SEQ ID NO: 716988 - RNA, 19 nt, Homo sapiens
agagcgagcugcacuccua

SEQ ID NO: 716989 - RNA, 19 nt, Homo sapiens
ggagguuauugacgcauuc

SEQ ID NO: 716990 - RNA, 19 nt, Homo sapiens
gagcagggcaaucgucugu

SEQ ID NO: 716991 - RNA, 19 nt, Homo sapiens
guggaggacuacugagguu

SEQ ID NO: 716992 - RNA, 19 nt, Homo sapiens
ccaguggcaucaccuacga

SEQ ID NO: 716993 - RNA, 19 nt, Homo sapiens
guggcaagaucagcuuuga

SEQ ID NO: 716994 - RNA, 19 nt, Homo sapiens
acaaguacauggcggacau

SEQ ID NO: 716995 - RNA, 19 nt, Homo sapiens
gagauggagagcuaugaug

SEQ ID NO: 716996 - RNA, 19 nt, Homo sapiens
gaaaccacgagggugauga

SEQ ID NO: 716997 - RNA, 19 nt, Homo sapiens
ggagauggagagcuaugau

SEQ ID NO: 716998 - RNA, 19 nt, Homo sapiens
cuaugaaggagguuauuga

SEQ ID NO: 716999 - RNA, 19 nt, Homo sapiens
aggccaagcacgacaagua

SEQ ID NO: 717000 - RNA, 19 nt, Homo sapiens
cgaagaagaagcgcuggaa

SEQ ID NO: 717001 - RNA, 19 nt, Homo sapiens
gcuaugaaggagguuauug

SEQ ID NO: 717002 - RNA, 19 nt, Homo sapiens
agauggagagcuaugauga

SEQ ID NO: 717003 - RNA, 19 nt, Homo sapiens
ccaaucugcagcgagcuua

SEQ ID NO: 717004 - RNA, 19 nt, Homo sapiens
gaagagugccagcgaaacc

SEQ ID NO: 717005 - RNA, 19 nt, Homo sapiens
cuaccuguguggcaagauc

SEQ ID NO: 717006 - RNA, 19 nt, Homo sapiens
ggacgggcagucugugaag

SEQ ID NO: 717007 - RNA, 19 nt, Homo sapiens
gaggaagaagcgagacauc

SEQ ID NO: 717008 - RNA, 19 nt, Homo sapiens
aagaagaagcgcuggaaca

SEQ ID NO: 717009 - RNA, 19 nt, Homo sapiens
cuuacagccuggccaagga

SEQ ID NO: 717010 - RNA, 19 nt, Homo sapiens
gccuugugcuaccugaaga

SEQ ID NO: 717011 - RNA, 19 nt, Homo sapiens
guuauugacgcauucaucu

SEQ ID NO: 717012 - RNA, 19 nt, Homo sapiens
uggaagagugccagcgaaa

SEQ ID NO: 717013 - RNA, 19 nt, Homo sapiens
guacagcacuugauuauuu

SEQ ID NO: 717014 - RNA, 19 nt, Homo sapiens
gaauagagauguuucgaaa

SEQ ID NO: 717015 - RNA, 19 nt, Homo sapiens
gaugugaucugauuuguuu

SEQ ID NO: 717016 - RNA, 19 nt, Homo sapiens
gcauagaguuugcauuuaa

SEQ ID NO: 717017 - RNA, 19 nt, Homo sapiens
gaaaggaccucuccagcaa

SEQ ID NO: 717018 - RNA, 19 nt, Homo sapiens
gcacgucgcuuugcccuua

SEQ ID NO: 717019 - RNA, 19 nt, Homo sapiens
gaagccagcugauugauga

SEQ ID NO: 717020 - RNA, 19 nt, Homo sapiens
gcaaagagcugcaagaaaa

SEQ ID NO: 717021 - RNA, 19 nt, Homo sapiens
aaacagaggucaaaggaaa

SEQ ID NO: 717022 - RNA, 19 nt, Homo sapiens
gaacaggaaugaacuacau

SEQ ID NO: 717023 - RNA, 19 nt, Homo sapiens
gaacagaguugacauagcu

SEQ ID NO: 717024 - RNA, 19 nt, Homo sapiens
ggaaugaacuacaugaaag

SEQ ID NO: 717025 - RNA, 19 nt, Homo sapiens
gaagaagcauuagcaaaga

SEQ ID NO: 717026 - RNA, 19 nt, Homo sapiens
ccacucaucuccuauagaa

SEQ ID NO: 717027 - RNA, 19 nt, Homo sapiens
gcuaaugguuuguacaauu

SEQ ID NO: 717028 - RNA, 19 nt, Homo sapiens
gaaauuggaguauggauga

SEQ ID NO: 717029 - RNA, 19 nt, Homo sapiens
uuacaaaucuggaacucua

SEQ ID NO: 717030 - RNA, 19 nt, Homo sapiens
gauaacacauggcuaaaca

SEQ ID NO: 717031 - RNA, 19 nt, Homo sapiens
gagagggccuucagccuuu

SEQ ID NO: 717032 - RNA, 19 nt, Homo sapiens
ugacagaguugcuauuaga

SEQ ID NO: 717033 - RNA, 19 nt, Homo sapiens
caaugacacuugauaaaga

SEQ ID NO: 717034 - RNA, 19 nt, Homo sapiens
gagaagaagcugaugauga

SEQ ID NO: 717035 - RNA, 19 nt, Homo sapiens
gaaacaaauugacugaaca

SEQ ID NO: 717036 - RNA, 19 nt, Homo sapiens
ggaaucuacuugcugcuuu

SEQ ID NO: 717037 - RNA, 19 nt, Homo sapiens
ggagaaacacguagaauca

SEQ ID NO: 717038 - RNA, 19 nt, Homo sapiens
gaagagagccaaugaaagg

SEQ ID NO: 717039 - RNA, 19 nt, Homo sapiens
gagauuagagccauuugua

SEQ ID NO: 717040 - RNA, 19 nt, Homo sapiens
gaagaugauucaggauuug

SEQ ID NO: 717041 - RNA, 19 nt, Homo sapiens
agaagaagcugaugaugau

SEQ ID NO: 717042 - RNA, 19 nt, Homo sapiens
gaaagugaguuacaugaac

SEQ ID NO: 717043 - RNA, 19 nt, Homo sapiens
gaagcuauucgauugguua

SEQ ID NO: 717044 - RNA, 19 nt, Homo sapiens
gaugauagaaugucuguga

SEQ ID NO: 717045 - RNA, 19 nt, Homo sapiens
gcagacaucuucaaacacu

SEQ ID NO: 717046 - RNA, 19 nt, Homo sapiens
ugaagaagaugaagcuaau

SEQ ID NO: 717047 - RNA, 19 nt, Homo sapiens
gaagaugagagucuggaua

SEQ ID NO: 717048 - RNA, 19 nt, Homo sapiens
gggaauguaugacagaguu

SEQ ID NO: 717049 - RNA, 19 nt, Homo sapiens
gagaagagcagaauugaag

SEQ ID NO: 717050 - RNA, 19 nt, Homo sapiens
aaaguaaguucuuccuuga

SEQ ID NO: 717051 - RNA, 19 nt, Homo sapiens
gauaauacccagagacaau

SEQ ID NO: 717052 - RNA, 19 nt, Homo sapiens
ugacugcucuggugaaugu

SEQ ID NO: 717053 - RNA, 19 nt, Homo sapiens
gcagcgagcuugaagaaac

SEQ ID NO: 717054 - RNA, 19 nt, Homo sapiens
agaagaugauucaggauuu

SEQ ID NO: 717055 - RNA, 19 nt, Homo sapiens
gaaacagcccgaauggaaa

SEQ ID NO: 717056 - RNA, 19 nt, Homo sapiens
cagagucuauauaccaaua

SEQ ID NO: 717057 - RNA, 19 nt, Homo sapiens
guucauagauaccgugaug

SEQ ID NO: 717058 - RNA, 19 nt, Homo sapiens
guaaguucuuccuugauuu

SEQ ID NO: 717059 - RNA, 19 nt, Homo sapiens
ggaagaaacagcccgaaug

SEQ ID NO: 717060 - RNA, 19 nt, Homo sapiens
gaagccaguuagaagauau

SEQ ID NO: 717061 - RNA, 19 nt, Homo sapiens
ggacugacaccaugauuca

SEQ ID NO: 717062 - RNA, 19 nt, Homo sapiens
caaugacuauggugauauu

SEQ ID NO: 717063 - RNA, 19 nt, Homo sapiens
aaugggaucucuuugguaa

SEQ ID NO: 717064 - RNA, 19 nt, Homo sapiens
gaauauaccauccagaaca

SEQ ID NO: 717065 - RNA, 19 nt, Homo sapiens
cuacaaaucccacaguauu

SEQ ID NO: 717066 - RNA, 19 nt, Homo sapiens
gauuagagccauuuguauu

SEQ ID NO: 717067 - RNA, 19 nt, Homo sapiens
gggaagagagccaaugaaa

SEQ ID NO: 717068 - RNA, 19 nt, Homo sapiens
ggcauagaguuugcauuua

SEQ ID NO: 717069 - RNA, 19 nt, Homo sapiens
ggacaucgcacuucuggau

SEQ ID NO: 717070 - RNA, 19 nt, Homo sapiens
cagcaaugauuacuucaga

SEQ ID NO: 717071 - RNA, 19 nt, Homo sapiens
gcuaaggccagacuucuuu

SEQ ID NO: 717072 - RNA, 19 nt, Homo sapiens
ggacgaccuccacuucaua

SEQ ID NO: 717073 - RNA, 19 nt, Homo sapiens
gggugaagaugauagaaug

SEQ ID NO: 717074 - RNA, 19 nt, Homo sapiens
cagagaagguagcaaacuu

SEQ ID NO: 717075 - RNA, 19 nt, Homo sapiens
uuauagagcuaaugguuug

SEQ ID NO: 717076 - RNA, 19 nt, Homo sapiens
ucacaaggauggcauagag

SEQ ID NO: 717077 - RNA, 19 nt, Homo sapiens
aaauugaggccuuacauaa

SEQ ID NO: 717078 - RNA, 19 nt, Homo sapiens
ggagggugaugaagaagau

SEQ ID NO: 717079 - RNA, 19 nt, Homo sapiens
gaaugcacaugaucucaca

SEQ ID NO: 717080 - RNA, 19 nt, Homo sapiens
gaagaaacagcccgaaugg

SEQ ID NO: 717081 - RNA, 19 nt, Homo sapiens
ggacagaacaggaaugaac

SEQ ID NO: 717082 - RNA, 19 nt, Homo sapiens
gaaccugagucugaacaug

SEQ ID NO: 717083 - RNA, 19 nt, Homo sapiens
gauagaaugucugugaaca

SEQ ID NO: 717084 - RNA, 19 nt, Homo sapiens
gcucgaagccagcugauug

SEQ ID NO: 717085 - RNA, 19 nt, Homo sapiens
caaauaagaaaccucgaaa

SEQ ID NO: 717086 - RNA, 19 nt, Homo sapiens
caacucacauccacuguac

SEQ ID NO: 717087 - RNA, 19 nt, Homo sapiens
gaacuggcacgucgcuuug

SEQ ID NO: 717088 - RNA, 19 nt, Homo sapiens
cauggagggugaugaagaa

SEQ ID NO: 717089 - RNA, 19 nt, Homo sapiens
ggaaaacggugaaauccuu

SEQ ID NO: 717090 - RNA, 19 nt, Homo sapiens
uggaagaccuauugcaaga

SEQ ID NO: 717091 - RNA, 19 nt, Homo sapiens
cagcacagguagaauggaa

SEQ ID NO: 717092 - RNA, 19 nt, Homo sapiens
gaaaucuacagcacaggua

SEQ ID NO: 717093 - RNA, 19 nt, Homo sapiens
acaagcagaagaagcauua

SEQ ID NO: 717094 - RNA, 19 nt, Homo sapiens
guauagugaugccuuccua

SEQ ID NO: 717095 - RNA, 19 nt, Homo sapiens
ucaagaaccugagucugaa

SEQ ID NO: 717096 - RNA, 19 nt, Homo sapiens
aaaccaggcagauugauaa

SEQ ID NO: 717097 - RNA, 19 nt, Homo sapiens
gaaaggaaaacucaaauug

SEQ ID NO: 717098 - RNA, 19 nt, Homo sapiens
agaaacagcccgaauggaa

SEQ ID NO: 717099 - RNA, 19 nt, Homo sapiens
uguggaagcuauucgauug

SEQ ID NO: 717100 - RNA, 19 nt, Homo sapiens
cuaaaugacaguuaccuaa

SEQ ID NO: 717101 - RNA, 19 nt, Homo sapiens
ugaagaaauuggaguaugg

SEQ ID NO: 717102 - RNA, 19 nt, Homo sapiens
ggguauauuuguucauaga

SEQ ID NO: 717103 - RNA, 19 nt, Homo sapiens
caaaucuggaacucuauua

SEQ ID NO: 717104 - RNA, 19 nt, Homo sapiens
cgaagccaguuagaagaua

SEQ ID NO: 717105 - RNA, 19 nt, Homo sapiens
gcugauugaugaguuugua

SEQ ID NO: 717106 - RNA, 19 nt, Homo sapiens
guggaugacuggauugaau

SEQ ID NO: 717107 - RNA, 19 nt, Homo sapiens
uuacaggauucaacuaaug

SEQ ID NO: 717108 - RNA, 19 nt, Homo sapiens
gaaaggacgaccuccacuu

SEQ ID NO: 717109 - RNA, 19 nt, Homo sapiens
gaagaagaugaagcuaaua

SEQ ID NO: 717110 - RNA, 19 nt, Homo sapiens
cuaaugguuuguacaauuc

SEQ ID NO: 717111 - RNA, 19 nt, Homo sapiens
cagaguugcuauuagaaga

SEQ ID NO: 717112 - RNA, 19 nt, Homo sapiens
caagaacuguugaaagacu

SEQ ID NO: 717113 - RNA, 19 nt, Homo sapiens
caaauacccuuuacuguua

SEQ ID NO: 717114 - RNA, 19 nt, Homo sapiens
guaaauagauccauccaaa

SEQ ID NO: 717115 - RNA, 19 nt, Homo sapiens
gaagucgccuagucaaaua

SEQ ID NO: 717116 - RNA, 19 nt, Homo sapiens
ugaaauggcuugauguauu

SEQ ID NO: 717117 - RNA, 19 nt, Homo sapiens
gggagagacuguuuguuua

SEQ ID NO: 717118 - RNA, 19 nt, Homo sapiens
ggaggaugcuauauugaua

SEQ ID NO: 717119 - RNA, 19 nt, Homo sapiens
gaaauggcuugauguauuc

SEQ ID NO: 717120 - RNA, 19 nt, Homo sapiens
caacuggaaugcuuuauau

SEQ ID NO: 717121 - RNA, 19 nt, Homo sapiens
gaagaggaacucacacaua

SEQ ID NO: 717122 - RNA, 19 nt, Homo sapiens
caaauuggcaugucuuuaa

SEQ ID NO: 717123 - RNA, 19 nt, Homo sapiens
gagcaagaguggacauaaa

SEQ ID NO: 717124 - RNA, 19 nt, Homo sapiens
ccaaagcucuucuugauca

SEQ ID NO: 717125 - RNA, 19 nt, Homo sapiens
caucauggcuuucuaauac

SEQ ID NO: 717126 - RNA, 19 nt, Homo sapiens
ggaacgaacggcacucuua

SEQ ID NO: 717127 - RNA, 19 nt, Homo sapiens
ggacuuauuugccuugguu

SEQ ID NO: 717128 - RNA, 19 nt, Homo sapiens
gaaaaccacuucaaagauu

SEQ ID NO: 717129 - RNA, 19 nt, Homo sapiens
gagagacuguuuguuuaua

SEQ ID NO: 717130 - RNA, 19 nt, Homo sapiens
ggaacucacacauauauuu

SEQ ID NO: 717131 - RNA, 19 nt, Homo sapiens
caagaaaggccuaccauga

SEQ ID NO: 717132 - RNA, 19 nt, Homo sapiens
ggugauugguagugaguua

SEQ ID NO: 717133 - RNA, 19 nt, Homo sapiens
ggaaagguuugagggagua

SEQ ID NO: 717134 - RNA, 19 nt, Homo sapiens
gaauguaugucuggaguau

SEQ ID NO: 717135 - RNA, 19 nt, Homo sapiens
gagaaggcucuguguguua

SEQ ID NO: 717136 - RNA, 19 nt, Homo sapiens
gaucuggacucuuacauac

SEQ ID NO: 717137 - RNA, 19 nt, Homo sapiens
gaacucacacauauauuug

SEQ ID NO: 717138 - RNA, 19 nt, Homo sapiens
aagaggaacucacacauau

SEQ ID NO: 717139 - RNA, 19 nt, Homo sapiens
ggaaggugauugguaguga

SEQ ID NO: 717140 - RNA, 19 nt, Homo sapiens
gguaaagacccaugaaaug

SEQ ID NO: 717141 - RNA, 19 nt, Homo sapiens
uggcaugucuuuaaaguau

SEQ ID NO: 717142 - RNA, 19 nt, Homo sapiens
ucacguccuuggcaaauuu

SEQ ID NO: 717143 - RNA, 19 nt, Homo sapiens
caagaggagccaagcaaua

SEQ ID NO: 717144 - RNA, 19 nt, Homo sapiens
caagugaaaccaagccaua

SEQ ID NO: 717145 - RNA, 19 nt, Homo sapiens
ucaaauacccuuuacuguu

SEQ ID NO: 717146 - RNA, 19 nt, Homo sapiens
gaacaugguaagccuggua

SEQ ID NO: 717147 - RNA, 19 nt, Homo sapiens
aauggcagcuaaagauaua

SEQ ID NO: 717148 - RNA, 19 nt, Homo sapiens
ccaaugacguguuccacaa

SEQ ID NO: 717149 - RNA, 19 nt, Homo sapiens
uuggugaucuggacucuua

SEQ ID NO: 717150 - RNA, 19 nt, Homo sapiens
ggucagagaugcuggacau

SEQ ID NO: 717151 - RNA, 19 nt, Homo sapiens
uuacauaccucugcaugaa

SEQ ID NO: 717152 - RNA, 19 nt, Homo sapiens
gaggaacucacacauauau

SEQ ID NO: 717153 - RNA, 19 nt, Homo sapiens
gcaagccaaugacguguuc

SEQ ID NO: 717154 - RNA, 19 nt, Homo sapiens
ggauggagaugugagaaug

SEQ ID NO: 717155 - RNA, 19 nt, Homo sapiens
caucauaggguuacuuuau

SEQ ID NO: 717156 - RNA, 19 nt, Homo sapiens
gaaagaaaaccacuucaaa

SEQ ID NO: 717157 - RNA, 19 nt, Homo sapiens
gcaugaagauuuguugaca

SEQ ID NO: 717158 - RNA, 19 nt, Homo sapiens
ggaguccucucugauauca

SEQ ID NO: 717159 - RNA, 19 nt, Homo sapiens
uuuaaucucuccuguaaga

SEQ ID NO: 717160 - RNA, 19 nt, Homo sapiens
gauaggagaagcucaacuu

SEQ ID NO: 717161 - RNA, 19 nt, Homo sapiens
ggagagacuguuuguuuau

SEQ ID NO: 717162 - RNA, 19 nt, Homo sapiens
gcgcuugaaugccuacaga

SEQ ID NO: 717163 - RNA, 19 nt, Homo sapiens
agaaggcucuguguguuaa

SEQ ID NO: 717164 - RNA, 19 nt, Homo sapiens
gaggacagcaagagcuuaa

SEQ ID NO: 717165 - RNA, 19 nt, Homo sapiens
ugaaaacgcuuacagaugu

SEQ ID NO: 717166 - RNA, 19 nt, Homo sapiens
ggagcagauuggucacauu

SEQ ID NO: 717167 - RNA, 19 nt, Homo sapiens
gggaucaucaucuuugaaa

SEQ ID NO: 717168 - RNA, 19 nt, Homo sapiens
ggagauaggagaagcucaa

SEQ ID NO: 717169 - RNA, 19 nt, Homo sapiens
acacauauauuuggugauc

SEQ ID NO: 717170 - RNA, 19 nt, Homo sapiens
aaauagauccauccaaaug

SEQ ID NO: 717171 - RNA, 19 nt, Homo sapiens
ucuggaggaugcuauauug

SEQ ID NO: 717172 - RNA, 19 nt, Homo sapiens
gcaggaggcaauauaugaa

SEQ ID NO: 717173 - RNA, 19 nt, Homo sapiens
uuugguggauuuagucaua

SEQ ID NO: 717174 - RNA, 19 nt, Homo sapiens
gcaauaccugcaaauaaug

SEQ ID NO: 717175 - RNA, 19 nt, Homo sapiens
ccagacauuucacaagugu

SEQ ID NO: 717176 - RNA, 19 nt, Homo sapiens
cacuguacauuccucauuu

SEQ ID NO: 717177 - RNA, 19 nt, Homo sapiens
ugggagagacuguuuguuu

SEQ ID NO: 717178 - RNA, 19 nt, Homo sapiens
gcaagagcuuaaagacaca

SEQ ID NO: 717179 - RNA, 19 nt, Homo sapiens
gaggagggcauccacaguu

SEQ ID NO: 717180 - RNA, 19 nt, Homo sapiens
gaggaugcuauauugauaa

SEQ ID NO: 717181 - RNA, 19 nt, Homo sapiens
gcagauuggucacauucuc

SEQ ID NO: 717182 - RNA, 19 nt, Homo sapiens
gugaacaggauuuaauuga

SEQ ID NO: 717183 - RNA, 19 nt, Homo sapiens
gaggugaacaggauuuaau

SEQ ID NO: 717184 - RNA, 19 nt, Homo sapiens
ggcaggaggcaauauauga

SEQ ID NO: 717185 - RNA, 19 nt, Homo sapiens
gaaaccaagccauacuguu

SEQ ID NO: 717186 - RNA, 19 nt, Homo sapiens
caugaaauggcuugaugua

SEQ ID NO: 717187 - RNA, 19 nt, Homo sapiens
ucaacuggaaugcuuuaua

SEQ ID NO: 717188 - RNA, 19 nt, Homo sapiens
gccaguguuucuuugcuaa

SEQ ID NO: 717189 - RNA, 19 nt, Homo sapiens
ggagcaagaguggacauaa

SEQ ID NO: 717190 - RNA, 19 nt, Homo sapiens
agccaaagcucuucuugau

SEQ ID NO: 717191 - RNA, 19 nt, Homo sapiens
gucaaacaauacagucauu

SEQ ID NO: 717192 - RNA, 19 nt, Homo sapiens
uuacucagguagaaguuga

SEQ ID NO: 717193 - RNA, 19 nt, Homo sapiens
cagggaguccucucugaua

SEQ ID NO: 717194 - RNA, 19 nt, Homo sapiens
aguaaaagcccgauuauaa

SEQ ID NO: 717195 - RNA, 19 nt, Homo sapiens
auguaugucuggaguauuu

SEQ ID NO: 717196 - RNA, 19 nt, Homo sapiens
uaaccaguccuucagagaa

SEQ ID NO: 717197 - RNA, 19 nt, Homo sapiens
ugccggagcugcacgaaga

SEQ ID NO: 717198 - RNA, 19 nt, Homo sapiens
aagaggagccaagcaauaa

SEQ ID NO: 717199 - RNA, 19 nt, Homo sapiens
gagcagauuggucacauuc

SEQ ID NO: 717200 - RNA, 19 nt, Homo sapiens
gaacaguggagcagauugg

SEQ ID NO: 717201 - RNA, 19 nt, Homo sapiens
ugaaaugucccgaggugaa

SEQ ID NO: 717202 - RNA, 19 nt, Homo sapiens
gaacgaacggcacucuuac

SEQ ID NO: 717203 - RNA, 19 nt, Homo sapiens
cuuuggaguuuccuagaua

SEQ ID NO: 717204 - RNA, 19 nt, Homo sapiens
gagucucccuucagucgaa

SEQ ID NO: 717205 - RNA, 19 nt, Homo sapiens
gauguauucuagacuacug

SEQ ID NO: 717206 - RNA, 19 nt, Homo sapiens
caaaagagcacccugaugu

SEQ ID NO: 717207 - RNA, 19 nt, Homo sapiens
gccgagcucugggaagaaa

SEQ ID NO: 717208 - RNA, 19 nt, Homo sapiens
aaagaaacaggauccaaga

SEQ ID NO: 717209 - RNA, 19 nt, Homo sapiens
gaagcaaccaagccugaug

SEQ ID NO: 717210 - RNA, 19 nt, Homo sapiens
caucaugucagaagaggaa

SEQ ID NO: 717211 - RNA, 19 nt, Homo sapiens
gaucucaaacuugcaagaa

SEQ ID NO: 717212 - RNA, 19 nt, Homo sapiens
gaggcaauauaugaaaugu

SEQ ID NO: 717213 - RNA, 19 nt, Homo sapiens
ggacuuaugugacuuauau

SEQ ID NO: 717214 - RNA, 19 nt, Homo sapiens
gaaaggacauggaugagaa

SEQ ID NO: 717215 - RNA, 19 nt, Homo sapiens
gcagacagaugauagauug

SEQ ID NO: 717216 - RNA, 19 nt, Homo sapiens
gaccagagauccuacagua

SEQ ID NO: 717217 - RNA, 19 nt, Homo sapiens
gaaagccaauggaaagauu

SEQ ID NO: 717218 - RNA, 19 nt, Homo sapiens
ggauuacucuucccaauga

SEQ ID NO: 717219 - RNA, 19 nt, Homo sapiens
caauagaacuguagaagau

SEQ ID NO: 717220 - RNA, 19 nt, Homo sapiens
gacgagagcuuccugagaa

SEQ ID NO: 717221 - RNA, 19 nt, Homo sapiens
ggaauuguuugaagaaguu

SEQ ID NO: 717222 - RNA, 19 nt, Homo sapiens
agacagauaugcugaacua

SEQ ID NO: 717223 - RNA, 19 nt, Homo sapiens
gguguuagaugacaugauu

SEQ ID NO: 717224 - RNA, 19 nt, Homo sapiens
gcugagcgcugaugagauu

SEQ ID NO: 717225 - RNA, 19 nt, Homo sapiens
gaaaugucccuuuaagauu

SEQ ID NO: 717226 - RNA, 19 nt, Homo sapiens
cagcaucccuucaugaauu

SEQ ID NO: 717227 - RNA, 19 nt, Homo sapiens
gauauaacacugccuuuaa

SEQ ID NO: 717228 - RNA, 19 nt, Homo sapiens
gcaguuuguucgcuauaua

SEQ ID NO: 717229 - RNA, 19 nt, Homo sapiens
acagaaaucucuugcuaaa

SEQ ID NO: 717230 - RNA, 19 nt, Homo sapiens
uagaagauguugcagaauu

SEQ ID NO: 717231 - RNA, 19 nt, Homo sapiens
ccaaacauauauucuguga

SEQ ID NO: 717232 - RNA, 19 nt, Homo sapiens
uaugguugcuuguguaaua

SEQ ID NO: 717233 - RNA, 19 nt, Homo sapiens
guaaggaauuguuugaaga

SEQ ID NO: 717234 - RNA, 19 nt, Homo sapiens
agacagaaaucucuugcua

SEQ ID NO: 717235 - RNA, 19 nt, Homo sapiens
gaacagcgaucacuaaacc

SEQ ID NO: 717236 - RNA, 19 nt, Homo sapiens
gaacuuuaaucuucagcaa

SEQ ID NO: 717237 - RNA, 19 nt, Homo sapiens
guaggaaucucccauaugg

SEQ ID NO: 717238 - RNA, 19 nt, Homo sapiens
cacccaagaugucggauua

SEQ ID NO: 717239 - RNA, 19 nt, Homo sapiens
agaaaucucuugcuaaaca

SEQ ID NO: 717240 - RNA, 19 nt, Homo sapiens
ggauaucgauggugucuca

SEQ ID NO: 717241 - RNA, 19 nt, Homo sapiens
ggacuugauuggccagauu

SEQ ID NO: 717242 - RNA, 19 nt, Homo sapiens
ugacacacguucagaagaa

SEQ ID NO: 717243 - RNA, 19 nt, Homo sapiens
aaacucagcuuaagaaacu

SEQ ID NO: 717244 - RNA, 19 nt, Homo sapiens
uagagaaccuuggacauuu

SEQ ID NO: 717245 - RNA, 19 nt, Homo sapiens
gacagugacuacuuuaaau

SEQ ID NO: 717246 - RNA, 19 nt, Homo sapiens
cugcaaugcugaacuuuaa

SEQ ID NO: 717247 - RNA, 19 nt, Homo sapiens
gcuaaacacuggcuccaau

SEQ ID NO: 717248 - RNA, 19 nt, Homo sapiens
gcaagaaugugggaguaug

SEQ ID NO: 717249 - RNA, 19 nt, Homo sapiens
uaaagcauguccuucguau

SEQ ID NO: 717250 - RNA, 19 nt, Homo sapiens
gaucaaauccacaauagca

SEQ ID NO: 717251 - RNA, 19 nt, Homo sapiens
ugacggauauuuacuuaca

SEQ ID NO: 717252 - RNA, 19 nt, Homo sapiens
agaagauguugcagaauuu

SEQ ID NO: 717253 - RNA, 19 nt, Homo sapiens
uaacacugccuuuaaauuc

SEQ ID NO: 717254 - RNA, 19 nt, Homo sapiens
cuaaugauguccacucaga

SEQ ID NO: 717255 - RNA, 19 nt, Homo sapiens
aggaagagaugaagaacaa

SEQ ID NO: 717256 - RNA, 19 nt, Homo sapiens
cugagaagaugucugaauu

SEQ ID NO: 717257 - RNA, 19 nt, Homo sapiens
gaaguauucuccgauuuua

SEQ ID NO: 717258 - RNA, 19 nt, Homo sapiens
aagcggagccucagugaua

SEQ ID NO: 717259 - RNA, 19 nt, Homo sapiens
uauuacugcucccuacuua

SEQ ID NO: 717260 - RNA, 19 nt, Homo sapiens
gaaauacggcuuugaacca

SEQ ID NO: 717261 - RNA, 19 nt, Homo sapiens
uaacgccuuucaccauuaa

SEQ ID NO: 717262 - RNA, 19 nt, Homo sapiens
uguagaagauguugcagaa

SEQ ID NO: 717263 - RNA, 19 nt, Homo sapiens
gcacagaugcagacagaug

SEQ ID NO: 717264 - RNA, 19 nt, Homo sapiens
gaaccacucaccaggauga

SEQ ID NO: 717265 - RNA, 19 nt, Homo sapiens
gagaaccacucaccaggau

SEQ ID NO: 717266 - RNA, 19 nt, Homo sapiens
ggaaggaccgggacagaga

SEQ ID NO: 717267 - RNA, 19 nt, Homo sapiens
gagaagaugucugaauuuu

SEQ ID NO: 717268 - RNA, 19 nt, Homo sapiens
gaacugaaagagcagauuc

SEQ ID NO: 717269 - RNA, 19 nt, Homo sapiens
ugcagaagaugauguuaaa

SEQ ID NO: 717270 - RNA, 19 nt, Homo sapiens
ugaaaugucccuuuaagau

SEQ ID NO: 717271 - RNA, 19 nt, Homo sapiens
uaugacaaguucacaauuc

SEQ ID NO: 717272 - RNA, 19 nt, Homo sapiens
cgacagugacuacuuuaaa

SEQ ID NO: 717273 - RNA, 19 nt, Homo sapiens
gcauaucccauacugcuuu

SEQ ID NO: 717274 - RNA, 19 nt, Homo sapiens
ucauuugugugauguguuu

SEQ ID NO: 717275 - RNA, 19 nt, Homo sapiens
gaacgcacgcgcagaaauc

SEQ ID NO: 717276 - RNA, 19 nt, Homo sapiens
caaauccacaauagcaaua

SEQ ID NO: 717277 - RNA, 19 nt, Homo sapiens
gaaggagucaguucucuca

SEQ ID NO: 717278 - RNA, 19 nt, Homo sapiens
gaguaugucugccgguuuc

SEQ ID NO: 717279 - RNA, 19 nt, Homo sapiens
caauauccguugauuugau

SEQ ID NO: 717280 - RNA, 19 nt, Homo sapiens
gcagcaggcucgucagucu

SEQ ID NO: 717281 - RNA, 19 nt, Homo sapiens
gaagcaguuuguucgcuau

SEQ ID NO: 717282 - RNA, 19 nt, Homo sapiens
guugguaccuucccugaug

SEQ ID NO: 717283 - RNA, 19 nt, Homo sapiens
caauuugguugcuucuuug

SEQ ID NO: 717284 - RNA, 19 nt, Homo sapiens
gcgcagaaaucgacuacag

SEQ ID NO: 717285 - RNA, 19 nt, Homo sapiens
caagaacgcacgcgcagaa

SEQ ID NO: 717286 - RNA, 19 nt, Homo sapiens
aagcacagaugcagacaga

SEQ ID NO: 717287 - RNA, 19 nt, Homo sapiens
ccucgacagugacuacuuu

SEQ ID NO: 717288 - RNA, 19 nt, Homo sapiens
ucacagugcauaucccaua

SEQ ID NO: 717289 - RNA, 19 nt, Homo sapiens
uguaagaucuuccgugucu

SEQ ID NO: 717290 - RNA, 19 nt, Homo sapiens
gcccugaagugucugaaga

SEQ ID NO: 717291 - RNA, 19 nt, Homo sapiens
gagcauggauaucgauggu

SEQ ID NO: 717292 - RNA, 19 nt, Homo sapiens
gcagcucgcccucuaauag

SEQ ID NO: 717293 - RNA, 19 nt, Homo sapiens
gaaagucuggagucucuga

SEQ ID NO: 717294 - RNA, 19 nt, Homo sapiens
ggagcucaauagaacugua

SEQ ID NO: 717295 - RNA, 19 nt, Homo sapiens
guugaucccacguauauuu

SEQ ID NO: 717296 - RNA, 19 nt, Homo sapiens
uuaacgccuuucaccauua

SEQ ID NO: 717297 - RNA, 19 nt, Homo sapiens
ucacgaagcagguccagaa

SEQ ID NO: 717298 - RNA, 19 nt, Homo sapiens
gcaccuuuauggaggaguu

SEQ ID NO: 717299 - RNA, 19 nt, Homo sapiens
gcaacuagacaccgcgaaa

SEQ ID NO: 717300 - RNA, 19 nt, Homo sapiens
agaagaugauguuaaagug

SEQ ID NO: 717301 - RNA, 19 nt, Homo sapiens
cauaucccauacugcuuua

SEQ ID NO: 717302 - RNA, 19 nt, Homo sapiens
ggugccagcucuuugucua

SEQ ID NO: 717303 - RNA, 19 nt, Homo sapiens
uacaauaaauggugacaca

SEQ ID NO: 717304 - RNA, 19 nt, Homo sapiens
ggagaugaggguuggguuu

SEQ ID NO: 717305 - RNA, 19 nt, Homo sapiens
cgauauaacacugccuuua

SEQ ID NO: 717306 - RNA, 19 nt, Homo sapiens
ucaccaggaugaagaagug

SEQ ID NO: 717307 - RNA, 19 nt, Homo sapiens
gugcaagaaugugggagua

SEQ ID NO: 717308 - RNA, 19 nt, Homo sapiens
caacggaagucuuuuagug

SEQ ID NO: 717309 - RNA, 19 nt, Homo sapiens
gaaaguggaggagauagug

SEQ ID NO: 717310 - RNA, 19 nt, Homo sapiens
acugacggauauuuacuua

SEQ ID NO: 717311 - RNA, 19 nt, Homo sapiens
gaagagaugaagaacaaag

SEQ ID NO: 717312 - RNA, 19 nt, Homo sapiens
gauguuccuuguugugaug

SEQ ID NO: 717313 - RNA, 19 nt, Homo sapiens
gaucagcacugcacuguua

SEQ ID NO: 717314 - RNA, 19 nt, Homo sapiens
gcaaguauauugugaaugu

SEQ ID NO: 717315 - RNA, 19 nt, Homo sapiens
gcacaguucugcaaguaua

SEQ ID NO: 717316 - RNA, 19 nt, Homo sapiens
gaaacgagcgucagccuua

SEQ ID NO: 717317 - RNA, 19 nt, Homo sapiens
gcagggagauggaggauga

SEQ ID NO: 717318 - RNA, 19 nt, Homo sapiens
ggacaaagcucagggaucu

SEQ ID NO: 717319 - RNA, 19 nt, Homo sapiens
cuagugggauacacaaaua

SEQ ID NO: 717320 - RNA, 19 nt, Homo sapiens
ugacugcccugccuccuuu

SEQ ID NO: 717321 - RNA, 19 nt, Homo sapiens
ggucagggcugcagguaca

SEQ ID NO: 717322 - RNA, 19 nt, Homo sapiens
ucacuacccugcucacuag

SEQ ID NO: 717323 - RNA, 19 nt, Homo sapiens
ggaggucacugcacuacca

SEQ ID NO: 717324 - RNA, 19 nt, Homo sapiens
cagccuuacucaauuugua

SEQ ID NO: 717325 - RNA, 19 nt, Homo sapiens
ggaugaugcucccuaugau

SEQ ID NO: 717326 - RNA, 19 nt, Homo sapiens
cgucagccuuacucaauuu

SEQ ID NO: 717327 - RNA, 19 nt, Homo sapiens
guauuguucuagugggaua

SEQ ID NO: 717328 - RNA, 19 nt, Homo sapiens
acuauucacuggacaaguu

SEQ ID NO: 717329 - RNA, 19 nt, Homo sapiens
cagcaggacaccacaauga

SEQ ID NO: 717330 - RNA, 19 nt, Homo sapiens
guuugaagguucucggaaa

SEQ ID NO: 717331 - RNA, 19 nt, Homo sapiens
gagauggugcaguguguaa

SEQ ID NO: 717332 - RNA, 19 nt, Homo sapiens
gagaugccuuggaggucua

SEQ ID NO: 717333 - RNA, 19 nt, Homo sapiens
ccacugugcuggcugucaa

SEQ ID NO: 717334 - RNA, 19 nt, Homo sapiens
gugaauguauuguucuagu

SEQ ID NO: 717335 - RNA, 19 nt, Homo sapiens
gcucaucgccugguguuug

SEQ ID NO: 717336 - RNA, 19 nt, Homo sapiens
guaugaagcacccgaggaa

SEQ ID NO: 717337 - RNA, 19 nt, Homo sapiens
gcgucagccuuacucaauu

SEQ ID NO: 717338 - RNA, 19 nt, Homo sapiens
ccaaagccauggccauugc

SEQ ID NO: 717339 - RNA, 19 nt, Homo sapiens
caggacaccacaaugagua

SEQ ID NO: 717340 - RNA, 19 nt, Homo sapiens
caucucaaccucucacaga

SEQ ID NO: 717341 - RNA, 19 nt, Homo sapiens
cuccugaccucaucuacaa

SEQ ID NO: 717342 - RNA, 19 nt, Homo sapiens
ccaacagggugaagcucuu

SEQ ID NO: 717343 - RNA, 19 nt, Homo sapiens
ugaauguauuguucuagug

SEQ ID NO: 717344 - RNA, 19 nt, Homo sapiens
aggcacaguucugcaagua

SEQ ID NO: 717345 - RNA, 19 nt, Homo sapiens
gcucagcagccauaccuau

SEQ ID NO: 717346 - RNA, 19 nt, Homo sapiens
guuaagggacuaggagaaa

SEQ ID NO: 717347 - RNA, 19 nt, Homo sapiens
ggugcaguguguaacagaa

SEQ ID NO: 717348 - RNA, 19 nt, Homo sapiens
gggcaagcgucucaguucu

SEQ ID NO: 717349 - RNA, 19 nt, Homo sapiens
aaagucagguggcagaaac

SEQ ID NO: 717350 - RNA, 19 nt, Homo sapiens
gcuggaaggcuuuguuaag

SEQ ID NO: 717351 - RNA, 19 nt, Homo sapiens
cgaggaguaugacuauguc

SEQ ID NO: 717352 - RNA, 19 nt, Homo sapiens
gcuagccugccucucauuu

SEQ ID NO: 717353 - RNA, 19 nt, Homo sapiens
ccaguacccaggcuaauca

SEQ ID NO: 717354 - RNA, 19 nt, Homo sapiens
gaugaugcucccuaugaug

SEQ ID NO: 717355 - RNA, 19 nt, Homo sapiens
ccuuggaggucuacgaugu

SEQ ID NO: 717356 - RNA, 19 nt, Homo sapiens
gcaggacaccacaaugagu

SEQ ID NO: 717357 - RNA, 19 nt, Homo sapiens
gggauacacaaauaaguca

SEQ ID NO: 717358 - RNA, 19 nt, Homo sapiens
ccucucauuugggaaguuu

SEQ ID NO: 717359 - RNA, 19 nt, Homo sapiens
agagugcgggcaagacaua

SEQ ID NO: 717360 - RNA, 19 nt, Homo sapiens
uaagggacuaggagaaaug

SEQ ID NO: 717361 - RNA, 19 nt, Homo sapiens
ggagacgguuggccccuaa

SEQ ID NO: 717362 - RNA, 19 nt, Homo sapiens
cugcaaguauauugugaau

SEQ ID NO: 717363 - RNA, 19 nt, Homo sapiens
auuauucccugcuuuguca

SEQ ID NO: 717364 - RNA, 19 nt, Homo sapiens
aggaugaugcucccuauga

SEQ ID NO: 717365 - RNA, 19 nt, Homo sapiens
cuggaagacuggcugugaa

SEQ ID NO: 717366 - RNA, 19 nt, Homo sapiens
ugaagggcauggacaaagc

SEQ ID NO: 717367 - RNA, 19 nt, Homo sapiens
agaggaugaugcucccuau

SEQ ID NO: 717368 - RNA, 19 nt, Homo sapiens
uuacuccuuucuucaacaa

SEQ ID NO: 717369 - RNA, 19 nt, Homo sapiens
uggcuggaaggcuuuguua

SEQ ID NO: 717370 - RNA, 19 nt, Homo sapiens
gagccuuggccucccauga

SEQ ID NO: 717371 - RNA, 19 nt, Homo sapiens
uuaagggacuaggagaaau

SEQ ID NO: 717372 - RNA, 19 nt, Homo sapiens
uagccugccucucauuugg

SEQ ID NO: 717373 - RNA, 19 nt, Homo sapiens
aagagauggugcagugugu

SEQ ID NO: 717374 - RNA, 19 nt, Homo sapiens
gcccugccauccaagagau

SEQ ID NO: 717375 - RNA, 19 nt, Homo sapiens
ggacacacacuacgaaaag

SEQ ID NO: 717376 - RNA, 19 nt, Homo sapiens
gagcgucagccuuacucaa

SEQ ID NO: 717377 - RNA, 19 nt, Homo sapiens
caacagggugaagcucuug

SEQ ID NO: 717378 - RNA, 19 nt, Homo sapiens
ggccgaggaguaugacuau

SEQ ID NO: 717379 - RNA, 19 nt, Homo sapiens
gggcagugaggaacuagau

SEQ ID NO: 717380 - RNA, 19 nt, Homo sapiens
gauggugcaguguguaaca

SEQ ID NO: 717381 - RNA, 19 nt, Homo sapiens
ccgccugccugguuaugga

SEQ ID NO: 717382 - RNA, 19 nt, Homo sapiens
cuggaaggcuuuguuaagg

SEQ ID NO: 717383 - RNA, 19 nt, Homo sapiens
ccgaggaguaugacuaugu

SEQ ID NO: 717384 - RNA, 19 nt, Homo sapiens
gauacacaaauaagucagu

SEQ ID NO: 717385 - RNA, 19 nt, Homo sapiens
uuaauaaacccugcugucu

SEQ ID NO: 717386 - RNA, 19 nt, Homo sapiens
uggaagacuggcugugaaa

SEQ ID NO: 717387 - RNA, 19 nt, Homo sapiens
gcagcccugauguccagua

SEQ ID NO: 717388 - RNA, 19 nt, Homo sapiens
gaucagcacugcacuguua

SEQ ID NO: 717389 - RNA, 19 nt, Homo sapiens
gcaaguauauugugaaugu

SEQ ID NO: 717390 - RNA, 19 nt, Homo sapiens
gcacaguucugcaaguaua

SEQ ID NO: 717391 - RNA, 19 nt, Homo sapiens
gaaacgagcgucagccuua

SEQ ID NO: 717392 - RNA, 19 nt, Homo sapiens
gcagggagauggaggauga

SEQ ID NO: 717393 - RNA, 19 nt, Homo sapiens
ggacaaagcucagggaucu

SEQ ID NO: 717394 - RNA, 19 nt, Homo sapiens
cuagugggauacacaaaua

SEQ ID NO: 717395 - RNA, 19 nt, Homo sapiens
ugacugcccugccuccuuu

SEQ ID NO: 717396 - RNA, 19 nt, Homo sapiens
ggucagggcugcagguaca

SEQ ID NO: 717397 - RNA, 19 nt, Homo sapiens
ucacuacccugcucacuag

SEQ ID NO: 717398 - RNA, 19 nt, Homo sapiens
ggaggucacugcacuacca

SEQ ID NO: 717399 - RNA, 19 nt, Homo sapiens
cagccuuacucaauuugua

SEQ ID NO: 717400 - RNA, 19 nt, Homo sapiens
ggaugaugcucccuaugau

SEQ ID NO: 717401 - RNA, 19 nt, Homo sapiens
cgucagccuuacucaauuu

SEQ ID NO: 717402 - RNA, 19 nt, Homo sapiens
guauuguucuagugggaua

SEQ ID NO: 717403 - RNA, 19 nt, Homo sapiens
acuauucacuggacaaguu

SEQ ID NO: 717404 - RNA, 19 nt, Homo sapiens
cagcaggacaccacaauga

SEQ ID NO: 717405 - RNA, 19 nt, Homo sapiens
guuugaagguucucggaaa

SEQ ID NO: 717406 - RNA, 19 nt, Homo sapiens
gagauggugcaguguguaa

SEQ ID NO: 717407 - RNA, 19 nt, Homo sapiens
gagaugccuuggaggucua

SEQ ID NO: 717408 - RNA, 19 nt, Homo sapiens
ccacugugcuggcugucaa

SEQ ID NO: 717409 - RNA, 19 nt, Homo sapiens
gugaauguauuguucuagu

SEQ ID NO: 717410 - RNA, 19 nt, Homo sapiens
gcucaucgccugguguuug

SEQ ID NO: 717411 - RNA, 19 nt, Homo sapiens
guaugaagcacccgaggaa

SEQ ID NO: 717412 - RNA, 19 nt, Homo sapiens
gcgucagccuuacucaauu

SEQ ID NO: 717413 - RNA, 19 nt, Homo sapiens
ccaaagccauggccauugc

SEQ ID NO: 717414 - RNA, 19 nt, Homo sapiens
caggacaccacaaugagua

SEQ ID NO: 717415 - RNA, 19 nt, Homo sapiens
caucucaaccucucacaga

SEQ ID NO: 717416 - RNA, 19 nt, Homo sapiens
cuccugaccucaucuacaa

SEQ ID NO: 717417 - RNA, 19 nt, Homo sapiens
ugaauguauuguucuagug

SEQ ID NO: 717418 - RNA, 19 nt, Homo sapiens
aggcacaguucugcaagua

SEQ ID NO: 717419 - RNA, 19 nt, Homo sapiens
gcucagcagccauaccuau

SEQ ID NO: 717420 - RNA, 19 nt, Homo sapiens
guuaagggacuaggagaaa

SEQ ID NO: 717421 - RNA, 19 nt, Homo sapiens
ggugcaguguguaacagaa

SEQ ID NO: 717422 - RNA, 19 nt, Homo sapiens
gggcaagcgucucaguucu

SEQ ID NO: 717423 - RNA, 19 nt, Homo sapiens
aaagucagguggcagaaac

SEQ ID NO: 717424 - RNA, 19 nt, Homo sapiens
gcuggaaggcuuuguuaag

SEQ ID NO: 717425 - RNA, 19 nt, Homo sapiens
cgaggaguaugacuauguc

SEQ ID NO: 717426 - RNA, 19 nt, Homo sapiens
gcuagccugccucucauuu

SEQ ID NO: 717427 - RNA, 19 nt, Homo sapiens
ccaguacccaggcuaauca

SEQ ID NO: 717428 - RNA, 19 nt, Homo sapiens
gaugaugcucccuaugaug

SEQ ID NO: 717429 - RNA, 19 nt, Homo sapiens
ccuuggaggucuacgaugu

SEQ ID NO: 717430 - RNA, 19 nt, Homo sapiens
gcaggacaccacaaugagu

SEQ ID NO: 717431 - RNA, 19 nt, Homo sapiens
gggauacacaaauaaguca

SEQ ID NO: 717432 - RNA, 19 nt, Homo sapiens
ccucucauuugggaaguuu

SEQ ID NO: 717433 - RNA, 19 nt, Homo sapiens
agagugcgggcaagacaua

SEQ ID NO: 717434 - RNA, 19 nt, Homo sapiens
uaagggacuaggagaaaug

SEQ ID NO: 717435 - RNA, 19 nt, Homo sapiens
ggagacgguuggccccuaa

SEQ ID NO: 717436 - RNA, 19 nt, Homo sapiens
cugcaaguauauugugaau

SEQ ID NO: 717437 - RNA, 19 nt, Homo sapiens
auuauucccugcuuuguca

SEQ ID NO: 717438 - RNA, 19 nt, Homo sapiens
aggaugaugcucccuauga

SEQ ID NO: 717439 - RNA, 19 nt, Homo sapiens
cuggaagacuggcugugaa

SEQ ID NO: 717440 - RNA, 19 nt, Homo sapiens
ugaagggcauggacaaagc

SEQ ID NO: 717441 - RNA, 19 nt, Homo sapiens
agaggaugaugcucccuau

SEQ ID NO: 717442 - RNA, 19 nt, Homo sapiens
uuacuccuuucuucaacaa

SEQ ID NO: 717443 - RNA, 19 nt, Homo sapiens
uggcuggaaggcuuuguua

SEQ ID NO: 717444 - RNA, 19 nt, Homo sapiens
gagccuuggccucccauga

SEQ ID NO: 717445 - RNA, 19 nt, Homo sapiens
uuaagggacuaggagaaau

SEQ ID NO: 717446 - RNA, 19 nt, Homo sapiens
uagccugccucucauuugg

SEQ ID NO: 717447 - RNA, 19 nt, Homo sapiens
aagagauggugcagugugu

SEQ ID NO: 717448 - RNA, 19 nt, Homo sapiens
gcccugccauccaagagau

SEQ ID NO: 717449 - RNA, 19 nt, Homo sapiens
ggacacacacuacgaaaag

SEQ ID NO: 717450 - RNA, 19 nt, Homo sapiens
gagcgucagccuuacucaa

SEQ ID NO: 717451 - RNA, 19 nt, Homo sapiens
ggccgaggaguaugacuau

SEQ ID NO: 717452 - RNA, 19 nt, Homo sapiens
gggcagugaggaacuagau

SEQ ID NO: 717453 - RNA, 19 nt, Homo sapiens
gauggugcaguguguaaca

SEQ ID NO: 717454 - RNA, 19 nt, Homo sapiens
ccgccugccugguuaugga

SEQ ID NO: 717455 - RNA, 19 nt, Homo sapiens
cuggaaggcuuuguuaagg

SEQ ID NO: 717456 - RNA, 19 nt, Homo sapiens
ccgaggaguaugacuaugu

SEQ ID NO: 717457 - RNA, 19 nt, Homo sapiens
gauacacaaauaagucagu

SEQ ID NO: 717458 - RNA, 19 nt, Homo sapiens
uuaauaaacccugcugucu

SEQ ID NO: 717459 - RNA, 19 nt, Homo sapiens
uggaagacuggcugugaaa

SEQ ID NO: 717460 - RNA, 19 nt, Homo sapiens
gcagcccugauguccagua

SEQ ID NO: 717461 - RNA, 19 nt, Homo sapiens
ggacauacuuguucacuga

SEQ ID NO: 717462 - RNA, 19 nt, Homo sapiens
gcagagaguuauggaaaua

SEQ ID NO: 717463 - RNA, 19 nt, Homo sapiens
gcaaaggagagccagauua

SEQ ID NO: 717464 - RNA, 19 nt, Homo sapiens
caaaggagagccagauuaa

SEQ ID NO: 717465 - RNA, 19 nt, Homo sapiens
gcuccagccucccuucuua

SEQ ID NO: 717466 - RNA, 19 nt, Homo sapiens
gauuaagggugaagucuga

SEQ ID NO: 717467 - RNA, 19 nt, Homo sapiens
gaagaaacucccaggaauu

SEQ ID NO: 717468 - RNA, 19 nt, Homo sapiens
gcacguaauuggcaugugu

SEQ ID NO: 717469 - RNA, 19 nt, Homo sapiens
ccagaaguguuuaagcuuu

SEQ ID NO: 717470 - RNA, 19 nt, Homo sapiens
gcacuuucccgccucuuua

SEQ ID NO: 717471 - RNA, 19 nt, Homo sapiens
gauccuuccuacagcguua

SEQ ID NO: 717472 - RNA, 19 nt, Homo sapiens
agaagaaacucccaggaau

SEQ ID NO: 717473 - RNA, 19 nt, Homo sapiens
gagguguagugcaguauga

SEQ ID NO: 717474 - RNA, 19 nt, Homo sapiens
gggcuuugcuguaaguuuc

SEQ ID NO: 717475 - RNA, 19 nt, Homo sapiens
gaguucggcuucuauguca

SEQ ID NO: 717476 - RNA, 19 nt, Homo sapiens
cgacagcucugcggacuuc

SEQ ID NO: 717477 - RNA, 19 nt, Homo sapiens
ccauagauuugcacuguuc

SEQ ID NO: 717478 - RNA, 19 nt, Homo sapiens
ucccaagggugccugcuua

SEQ ID NO: 717479 - RNA, 19 nt, Homo sapiens
cgaguauaaugacguggua

SEQ ID NO: 717480 - RNA, 19 nt, Homo sapiens
gaacaucuuccagcagcua

SEQ ID NO: 717481 - RNA, 19 nt, Homo sapiens
gcucucagccuugucagua

SEQ ID NO: 717482 - RNA, 19 nt, Homo sapiens
gggccuggcucagugauga

SEQ ID NO: 717483 - RNA, 19 nt, Homo sapiens
caaauaucacucccuggua

SEQ ID NO: 717484 - RNA, 19 nt, Homo sapiens
cgacagacgauccuuccua

SEQ ID NO: 717485 - RNA, 19 nt, Homo sapiens
gaaacucccaggaauugga

SEQ ID NO: 717486 - RNA, 19 nt, Homo sapiens
uguccuugcuucucaguuu

SEQ ID NO: 717487 - RNA, 19 nt, Homo sapiens
ggaaauauaaguggaugau

SEQ ID NO: 717488 - RNA, 19 nt, Homo sapiens
cauccuuauucccaacuua

SEQ ID NO: 717489 - RNA, 19 nt, Homo sapiens
gagaaucccagauguccuu

SEQ ID NO: 717490 - RNA, 19 nt, Homo sapiens
aaagugcuguuuguuaaug

SEQ ID NO: 717491 - RNA, 19 nt, Homo sapiens
uuucuaaucuccuucuguu

SEQ ID NO: 717492 - RNA, 19 nt, Homo sapiens
ggugaagucugaaucucau

SEQ ID NO: 717493 - RNA, 19 nt, Homo sapiens
gcuuuaggauccucagaau

SEQ ID NO: 717494 - RNA, 19 nt, Homo sapiens
ggccagaaguguuuaagcu

SEQ ID NO: 717495 - RNA, 19 nt, Homo sapiens
gugagcacauucagcaguu

SEQ ID NO: 717496 - RNA, 19 nt, Homo sapiens
cggcagugguuguaucaga

SEQ ID NO: 717497 - RNA, 19 nt, Homo sapiens
ggcucaagcuggcaaagga

SEQ ID NO: 717498 - RNA, 19 nt, Homo sapiens
gagcacagaaccucaacug

SEQ ID NO: 717499 - RNA, 19 nt, Homo sapiens
ucagacauguaccgaguuc

SEQ ID NO: 717500 - RNA, 19 nt, Homo sapiens
uggcaugugcuaaguguaa

SEQ ID NO: 717501 - RNA, 19 nt, Homo sapiens
ggaaccugccauagauuug

SEQ ID NO: 717502 - RNA, 19 nt, Homo sapiens
gcuuccaacucuagggauu

SEQ ID NO: 717503 - RNA, 19 nt, Homo sapiens
aagaagaaacucccaggaa

SEQ ID NO: 717504 - RNA, 19 nt, Homo sapiens
gucacuauuugucuuucua

SEQ ID NO: 717505 - RNA, 19 nt, Homo sapiens
gcaccuguuccgcacguaa

SEQ ID NO: 717506 - RNA, 19 nt, Homo sapiens
aagaaacucccaggaauug

SEQ ID NO: 717507 - RNA, 19 nt, Homo sapiens
gcgccugggugagcacauu

SEQ ID NO: 717508 - RNA, 19 nt, Homo sapiens
ugccauagauuugcacugu

SEQ ID NO: 717509 - RNA, 19 nt, Homo sapiens
gauaagccuggaacacaga

SEQ ID NO: 717510 - RNA, 19 nt, Homo sapiens
cuagucacuuucuuucuca

SEQ ID NO: 717511 - RNA, 19 nt, Homo sapiens
ucauuucuaucucuguguu

SEQ ID NO: 717512 - RNA, 19 nt, Homo sapiens
uuuaggauccucagaauca

SEQ ID NO: 717513 - RNA, 19 nt, Homo sapiens
gcagguguuugggcucuca

SEQ ID NO: 717514 - RNA, 19 nt, Homo sapiens
gccuugcgcuggcugaugu

SEQ ID NO: 717515 - RNA, 19 nt, Homo sapiens
ugguggagauuccuucuuc

SEQ ID NO: 717516 - RNA, 19 nt, Homo sapiens
cuucuucugugucucuauu

SEQ ID NO: 717517 - RNA, 19 nt, Homo sapiens
guuaggggcuuugcuguaa

SEQ ID NO: 717518 - RNA, 19 nt, Homo sapiens
ggauuucuccgaguauaau

SEQ ID NO: 717519 - RNA, 19 nt, Homo sapiens
gauuugcacuguucuuucc

SEQ ID NO: 717520 - RNA, 19 nt, Homo sapiens
ccucugcuguguccucaau

SEQ ID NO: 717521 - RNA, 19 nt, Homo sapiens
ccucugcuguguccucaau

SEQ ID NO: 717522 - RNA, 19 nt, Homo sapiens
ccuagucacuuucuuucuc

SEQ ID NO: 717523 - RNA, 19 nt, Homo sapiens
gaccggcagugguuguauc

SEQ ID NO: 717524 - RNA, 19 nt, Homo sapiens
gugauaagccuggaacaca

SEQ ID NO: 717525 - RNA, 19 nt, Homo sapiens
gccauagauuugcacuguu

SEQ ID NO: 717526 - RNA, 19 nt, Homo sapiens
cuaucucucuuauuuaguc

SEQ ID NO: 717527 - RNA, 19 nt, Homo sapiens
ucuaaucuccuucuguuuc

SEQ ID NO: 717528 - RNA, 19 nt, Homo sapiens
gacuuuagauccugaaccu

SEQ ID NO: 717529 - RNA, 19 nt, Homo sapiens
ugggagguguagugcagua

SEQ ID NO: 717530 - RNA, 19 nt, Homo sapiens
ucucuguguuucugucuau

SEQ ID NO: 717531 - RNA, 19 nt, Homo sapiens
gcccucugcucuugguuuc

SEQ ID NO: 717532 - RNA, 19 nt, Homo sapiens
cagcguuacugggugaaug

SEQ ID NO: 717533 - RNA, 19 nt, Homo sapiens
uagauuugcacuguucuuu

SEQ ID NO: 717534 - RNA, 19 nt, Homo sapiens
cuaaucuccuucuguuucu

SEQ ID NO: 717535 - RNA, 19 nt, Homo sapiens
uugcagagaguuauggaaa

SEQ ID NO: 717536 - RNA, 19 nt, Homo sapiens
gcacuggcucccacugcuu

SEQ ID NO: 717537 - RNA, 19 nt, Homo sapiens
cagaaguguuuaagcuuuu

SEQ ID NO: 717538 - RNA, 19 nt, Homo sapiens
caacucuagggauucauga

SEQ ID NO: 717539 - RNA, 19 nt, Homo sapiens
cugucuauuucucuguuua

SEQ ID NO: 717540 - RNA, 19 nt, Homo sapiens
ggcaaaggagagccagauu

SEQ ID NO: 717541 - RNA, 19 nt, Homo sapiens
ggagguguagugcaguaug

SEQ ID NO: 717542 - RNA, 19 nt, Homo sapiens
gauucugguucaaauucug

SEQ ID NO: 717543 - RNA, 19 nt, Homo sapiens
gggugaagucugaaucuca

SEQ ID NO: 717544 - RNA, 19 nt, Homo sapiens
ccucccagcuagaccuaug

SEQ ID NO: 717545 - RNA, 19 nt, Homo sapiens
cuggauuucuccgaguaua

SEQ ID NO: 717546 - RNA, 19 nt, Homo sapiens
gcucuauuucugucucuga

SEQ ID NO: 717547 - RNA, 19 nt, Homo sapiens
gcucuccgucagugucuuu

SEQ ID NO: 717548 - RNA, 19 nt, Homo sapiens
ccuucuguuucucugaaua

SEQ ID NO: 717549 - RNA, 19 nt, Homo sapiens
ugagcacauucagcaguuu

SEQ ID NO: 717550 - RNA, 19 nt, Homo sapiens
gcccagcuccgcuucuugu

SEQ ID NO: 717551 - RNA, 19 nt, Homo sapiens
gcuuuauugcagagaguua

SEQ ID NO: 717552 - RNA, 19 nt, Homo sapiens
aaggagagccagauuaagg

SEQ ID NO: 717553 - RNA, 19 nt, Homo sapiens
ccuggcaugugcuaagugu

SEQ ID NO: 717554 - RNA, 19 nt, Homo sapiens
gagcacauucagcaguuuc

SEQ ID NO: 717555 - RNA, 19 nt, Homo sapiens
ucaugauucugguggagau

SEQ ID NO: 717556 - RNA, 19 nt, Homo sapiens
cucuaucucucuuauuuag

SEQ ID NO: 717557 - RNA, 19 nt, Homo sapiens
gaaccuguccuugcuucuc

SEQ ID NO: 717558 - RNA, 19 nt, Homo sapiens
ugcagagaguuauggaaau

SEQ ID NO: 717559 - RNA, 19 nt, Homo sapiens
uggcaugugucugcaaaca

SEQ ID NO: 717560 - RNA, 19 nt, Homo sapiens
uaugugagcagguguuugg

SEQ ID NO: 717561 - RNA, 19 nt, Homo sapiens
gcagggauauccaugcuua

SEQ ID NO: 717562 - RNA, 19 nt, Homo sapiens
gaacaaaugagacacauau

SEQ ID NO: 717563 - RNA, 19 nt, Homo sapiens
ggauauccaugcuuaugua

SEQ ID NO: 717564 - RNA, 19 nt, Homo sapiens
gagaguaauuugaagaaug

SEQ ID NO: 717565 - RNA, 19 nt, Homo sapiens
uaacugaggccuuuccaua

SEQ ID NO: 717566 - RNA, 19 nt, Homo sapiens
acacauggaugguggagua

SEQ ID NO: 717567 - RNA, 19 nt, Homo sapiens
gcgaagagauagcgcaguu

SEQ ID NO: 717568 - RNA, 19 nt, Homo sapiens
gaacgagaguaauuugaag

SEQ ID NO: 717569 - RNA, 19 nt, Homo sapiens
caaaugagacacauauaga

SEQ ID NO: 717570 - RNA, 19 nt, Homo sapiens
ggacauacaccaugcagau

SEQ ID NO: 717571 - RNA, 19 nt, Homo sapiens
ggaacgagaguaauuugaa

SEQ ID NO: 717572 - RNA, 19 nt, Homo sapiens
agacacauauagauacuga

SEQ ID NO: 717573 - RNA, 19 nt, Homo sapiens
gggcugagaucucggauac

SEQ ID NO: 717574 - RNA, 19 nt, Homo sapiens
caucacagcuugacucacu

SEQ ID NO: 717575 - RNA, 19 nt, Homo sapiens
gggaagaggagcugccuuu

SEQ ID NO: 717576 - RNA, 19 nt, Homo sapiens
caacccagcagcaauuuga

SEQ ID NO: 717577 - RNA, 19 nt, Homo sapiens
gcucaccaccuaccucuuu

SEQ ID NO: 717578 - RNA, 19 nt, Homo sapiens
ggcuugagcucaccaccua

SEQ ID NO: 717579 - RNA, 19 nt, Homo sapiens
cagcuugacucacuaacug

SEQ ID NO: 717580 - RNA, 19 nt, Homo sapiens
ggaacaaaugagacacaua

SEQ ID NO: 717581 - RNA, 19 nt, Homo sapiens
ggagagagggcaccaccaa

SEQ ID NO: 717582 - RNA, 19 nt, Homo sapiens
acacacacauaucacaguu

SEQ ID NO: 717583 - RNA, 19 nt, Homo sapiens
caagggagccaguuguguu

SEQ ID NO: 717584 - RNA, 19 nt, Homo sapiens
ccaucugucuguuucuauu

SEQ ID NO: 717585 - RNA, 19 nt, Homo sapiens
ccaugcagauccugaguuc

SEQ ID NO: 717586 - RNA, 19 nt, Homo sapiens
gagcccauguuuacagaca

SEQ ID NO: 717587 - RNA, 19 nt, Homo sapiens
gaucucggauaccaucauc

SEQ ID NO: 717588 - RNA, 19 nt, Homo sapiens
acacacacacacacacaua

SEQ ID NO: 717589 - RNA, 19 nt, Homo sapiens
gcugagaucucggauacca

SEQ ID NO: 717590 - RNA, 19 nt, Homo sapiens
ggccuucucucgucugauc

SEQ ID NO: 717591 - RNA, 19 nt, Homo sapiens
guaggaccaugcacucaca

SEQ ID NO: 717592 - RNA, 19 nt, Homo sapiens
gcuuauguauccaaacaca

SEQ ID NO: 717593 - RNA, 19 nt, Homo sapiens
cugaguuccugcuguauga

SEQ ID NO: 717594 - RNA, 19 nt, Homo sapiens
caacacauacacacacaca

SEQ ID NO: 717595 - RNA, 19 nt, Homo sapiens
caucugucuguuucuauua

SEQ ID NO: 717596 - RNA, 19 nt, Homo sapiens
ggagccaguuguguucaga

SEQ ID NO: 717597 - RNA, 19 nt, Homo sapiens
acacacauaucacaguuuu

SEQ ID NO: 717598 - RNA, 19 nt, Homo sapiens
gagagagggcaccaccaaa

SEQ ID NO: 717599 - RNA, 19 nt, Homo sapiens
agaguaauuugaagaaugc

SEQ ID NO: 717600 - RNA, 19 nt, Homo sapiens
cgagaguaauuugaagaau

SEQ ID NO: 717601 - RNA, 19 nt, Homo sapiens
acaaaugagacacauauag

SEQ ID NO: 717602 - RNA, 19 nt, Homo sapiens
ucuauacucuucgcuccua

SEQ ID NO: 717603 - RNA, 19 nt, Homo sapiens
ggagaaggccuuuuacaca

SEQ ID NO: 717604 - RNA, 19 nt, Homo sapiens
acacauauagauacugaga

SEQ ID NO: 717605 - RNA, 19 nt, Homo sapiens
gcccgcacauauccacuug

SEQ ID NO: 717606 - RNA, 19 nt, Homo sapiens
ccacugaggagaggaucua

SEQ ID NO: 717607 - RNA, 19 nt, Homo sapiens
gggaacgagaguaauuuga

SEQ ID NO: 717608 - RNA, 19 nt, Homo sapiens
guccucaccauaugccuua

SEQ ID NO: 717609 - RNA, 19 nt, Homo sapiens
gaagaggagcugccuuuug

SEQ ID NO: 717610 - RNA, 19 nt, Homo sapiens
gggaacaaaugagacacau

SEQ ID NO: 717611 - RNA, 19 nt, Homo sapiens
guccaucugucuguuucua

SEQ ID NO: 717612 - RNA, 19 nt, Homo sapiens
ccucaacccagcagcaauu

SEQ ID NO: 717613 - RNA, 19 nt, Homo sapiens
ugaagaaugcuugaaguca

SEQ ID NO: 717614 - RNA, 19 nt, Homo sapiens
ccgaguaugugcugcucuu

SEQ ID NO: 717615 - RNA, 19 nt, Homo sapiens
caggugggccuaauuccaa

SEQ ID NO: 717616 - RNA, 19 nt, Homo sapiens
gggauauccaugcuuaugu

SEQ ID NO: 717617 - RNA, 19 nt, Homo sapiens
cacaacacauacacacaca

SEQ ID NO: 717618 - RNA, 19 nt, Homo sapiens
gcaguggguguucgugaau

SEQ ID NO: 717619 - RNA, 19 nt, Homo sapiens
agccaggccugaaggaaga

SEQ ID NO: 717620 - RNA, 19 nt, Homo sapiens
cgucuuccauuccagaaag

SEQ ID NO: 717621 - RNA, 19 nt, Homo sapiens
ucacagcuugacucacuaa

SEQ ID NO: 717622 - RNA, 19 nt, Homo sapiens
ugagacacauauagauacu

SEQ ID NO: 717623 - RNA, 19 nt, Homo sapiens
aggaagaccugcggaugga

SEQ ID NO: 717624 - RNA, 19 nt, Homo sapiens
acacauacacacacacaca

SEQ ID NO: 717625 - RNA, 19 nt, Homo sapiens
agacaggugggccuaauuc

SEQ ID NO: 717626 - RNA, 19 nt, Homo sapiens
gauauccaugcuuauguau

SEQ ID NO: 717627 - RNA, 19 nt, Homo sapiens
ggacuuccucacccucuuc

SEQ ID NO: 717628 - RNA, 19 nt, Homo sapiens
cuagacaggugggccuaau

SEQ ID NO: 717629 - RNA, 19 nt, Homo sapiens
agagacccaugggaacaaa

SEQ ID NO: 717630 - RNA, 19 nt, Homo sapiens
uacacacacacaacacaua

SEQ ID NO: 717631 - RNA, 19 nt, Homo sapiens
auacugagaccugugugua

SEQ ID NO: 717632 - RNA, 19 nt, Homo sapiens
guacgcagagcuucgucuu

SEQ ID NO: 717633 - RNA, 19 nt, Homo sapiens
uauccaugcuuauguaucc

SEQ ID NO: 717634 - RNA, 19 nt, Homo sapiens
ccaugcuuauguauccaaa

SEQ ID NO: 717635 - RNA, 19 nt, Homo sapiens
uuacagacagggacauaca

SEQ ID NO: 717636 - RNA, 19 nt, Homo sapiens
uuauguauccaaacacaga

SEQ ID NO: 717637 - RNA, 19 nt, Homo sapiens
uggagcccauguuuacaga

SEQ ID NO: 717638 - RNA, 19 nt, Homo sapiens
ugcaguggguguucgugaa

SEQ ID NO: 717639 - RNA, 19 nt, Homo sapiens
augcuuauguauccaaaca

SEQ ID NO: 717640 - RNA, 19 nt, Homo sapiens
aagaggagcugccuuuugg

SEQ ID NO: 717641 - RNA, 19 nt, Homo sapiens
gauacugagaccugugugu

SEQ ID NO: 717642 - RNA, 19 nt, Homo sapiens
gcagggauauccaugcuua

SEQ ID NO: 717643 - RNA, 19 nt, Homo sapiens
gaacaaaugagacacauau

SEQ ID NO: 717644 - RNA, 19 nt, Homo sapiens
ggauauccaugcuuaugua

SEQ ID NO: 717645 - RNA, 19 nt, Homo sapiens
gagaguaauuugaagaaug

SEQ ID NO: 717646 - RNA, 19 nt, Homo sapiens
uaacugaggccuuuccaua

SEQ ID NO: 717647 - RNA, 19 nt, Homo sapiens
acacauggaugguggagua

SEQ ID NO: 717648 - RNA, 19 nt, Homo sapiens
gcgaagagauagcgcaguu

SEQ ID NO: 717649 - RNA, 19 nt, Homo sapiens
gaacgagaguaauuugaag

SEQ ID NO: 717650 - RNA, 19 nt, Homo sapiens
caaaugagacacauauaga

SEQ ID NO: 717651 - RNA, 19 nt, Homo sapiens
ggacauacaccaugcagau

SEQ ID NO: 717652 - RNA, 19 nt, Homo sapiens
ggaacgagaguaauuugaa

SEQ ID NO: 717653 - RNA, 19 nt, Homo sapiens
agacacauauagauacuga

SEQ ID NO: 717654 - RNA, 19 nt, Homo sapiens
caucacagcuugacucacu

SEQ ID NO: 717655 - RNA, 19 nt, Homo sapiens
gggaagaggagcugccuuu

SEQ ID NO: 717656 - RNA, 19 nt, Homo sapiens
caacccagcagcaauuuga

SEQ ID NO: 717657 - RNA, 19 nt, Homo sapiens
gcucaccaccuaccucuuu

SEQ ID NO: 717658 - RNA, 19 nt, Homo sapiens
ggcuugagcucaccaccua

SEQ ID NO: 717659 - RNA, 19 nt, Homo sapiens
cagcuugacucacuaacug

SEQ ID NO: 717660 - RNA, 19 nt, Homo sapiens
ggaacaaaugagacacaua

SEQ ID NO: 717661 - RNA, 19 nt, Homo sapiens
acacacacauaucacaguu

SEQ ID NO: 717662 - RNA, 19 nt, Homo sapiens
caagggagccaguuguguu

SEQ ID NO: 717663 - RNA, 19 nt, Homo sapiens
ccaucugucuguuucuauu

SEQ ID NO: 717664 - RNA, 19 nt, Homo sapiens
ccaugcagauccugaguuc

SEQ ID NO: 717665 - RNA, 19 nt, Homo sapiens
gagcccauguuuacagaca

SEQ ID NO: 717666 - RNA, 19 nt, Homo sapiens
acacacacacacacacaua

SEQ ID NO: 717667 - RNA, 19 nt, Homo sapiens
ggccuucucucgucugauc

SEQ ID NO: 717668 - RNA, 19 nt, Homo sapiens
guaggaccaugcacucaca

SEQ ID NO: 717669 - RNA, 19 nt, Homo sapiens
gcuuauguauccaaacaca

SEQ ID NO: 717670 - RNA, 19 nt, Homo sapiens
cugaguuccugcuguauga

SEQ ID NO: 717671 - RNA, 19 nt, Homo sapiens
caacacauacacacacaca

SEQ ID NO: 717672 - RNA, 19 nt, Homo sapiens
caucugucuguuucuauua

SEQ ID NO: 717673 - RNA, 19 nt, Homo sapiens
ggagccaguuguguucaga

SEQ ID NO: 717674 - RNA, 19 nt, Homo sapiens
acacacauaucacaguuuu

SEQ ID NO: 717675 - RNA, 19 nt, Homo sapiens
agaguaauuugaagaaugc

SEQ ID NO: 717676 - RNA, 19 nt, Homo sapiens
cgagaguaauuugaagaau

SEQ ID NO: 717677 - RNA, 19 nt, Homo sapiens
acaaaugagacacauauag

SEQ ID NO: 717678 - RNA, 19 nt, Homo sapiens
ucuauacucuucgcuccua

SEQ ID NO: 717679 - RNA, 19 nt, Homo sapiens
ggagaaggccuuuuacaca

SEQ ID NO: 717680 - RNA, 19 nt, Homo sapiens
acacauauagauacugaga

SEQ ID NO: 717681 - RNA, 19 nt, Homo sapiens
gcccgcacauauccacuug

SEQ ID NO: 717682 - RNA, 19 nt, Homo sapiens
ccacugaggagaggaucua

SEQ ID NO: 717683 - RNA, 19 nt, Homo sapiens
gggaacgagaguaauuuga

SEQ ID NO: 717684 - RNA, 19 nt, Homo sapiens
guccucaccauaugccuua

SEQ ID NO: 717685 - RNA, 19 nt, Homo sapiens
gaagaggagcugccuuuug

SEQ ID NO: 717686 - RNA, 19 nt, Homo sapiens
gggaacaaaugagacacau

SEQ ID NO: 717687 - RNA, 19 nt, Homo sapiens
guccaucugucuguuucua

SEQ ID NO: 717688 - RNA, 19 nt, Homo sapiens
ccucaacccagcagcaauu

SEQ ID NO: 717689 - RNA, 19 nt, Homo sapiens
ccgaguaugugcugcucuu

SEQ ID NO: 717690 - RNA, 19 nt, Homo sapiens
ugaagaaugcuugaaguca

SEQ ID NO: 717691 - RNA, 19 nt, Homo sapiens
caggugggccuaauuccaa

SEQ ID NO: 717692 - RNA, 19 nt, Homo sapiens
gggauauccaugcuuaugu

SEQ ID NO: 717693 - RNA, 19 nt, Homo sapiens
cacaacacauacacacaca

SEQ ID NO: 717694 - RNA, 19 nt, Homo sapiens
gcaguggguguucgugaau

SEQ ID NO: 717695 - RNA, 19 nt, Homo sapiens
agccaggccugaaggaaga

SEQ ID NO: 717696 - RNA, 19 nt, Homo sapiens
cgucuuccauuccagaaag

SEQ ID NO: 717697 - RNA, 19 nt, Homo sapiens
ucacagcuugacucacuaa

SEQ ID NO: 717698 - RNA, 19 nt, Homo sapiens
ugagacacauauagauacu

SEQ ID NO: 717699 - RNA, 19 nt, Homo sapiens
aggaagaccugcggaugga

SEQ ID NO: 717700 - RNA, 19 nt, Homo sapiens
acacauacacacacacaca

SEQ ID NO: 717701 - RNA, 19 nt, Homo sapiens
agacaggugggccuaauuc

SEQ ID NO: 717702 - RNA, 19 nt, Homo sapiens
ggacuuccucacccucuuc

SEQ ID NO: 717703 - RNA, 19 nt, Homo sapiens
gauauccaugcuuauguau

SEQ ID NO: 717704 - RNA, 19 nt, Homo sapiens
cuagacaggugggccuaau

SEQ ID NO: 717705 - RNA, 19 nt, Homo sapiens
agagacccaugggaacaaa

SEQ ID NO: 717706 - RNA, 19 nt, Homo sapiens
uacacacacacaacacaua

SEQ ID NO: 717707 - RNA, 19 nt, Homo sapiens
auacugagaccugugugua

SEQ ID NO: 717708 - RNA, 19 nt, Homo sapiens
guacgcagagcuucgucuu

SEQ ID NO: 717709 - RNA, 19 nt, Homo sapiens
uauccaugcuuauguaucc

SEQ ID NO: 717710 - RNA, 19 nt, Homo sapiens
ccaugcuuauguauccaaa

SEQ ID NO: 717711 - RNA, 19 nt, Homo sapiens
uuacagacagggacauaca

SEQ ID NO: 717712 - RNA, 19 nt, Homo sapiens
uuauguauccaaacacaga

SEQ ID NO: 717713 - RNA, 19 nt, Homo sapiens
uggagcccauguuuacaga

SEQ ID NO: 717714 - RNA, 19 nt, Homo sapiens
ugcaguggguguucgugaa

SEQ ID NO: 717715 - RNA, 19 nt, Homo sapiens
augcuuauguauccaaaca

SEQ ID NO: 717716 - RNA, 19 nt, Homo sapiens
aagaggagcugccuuuugg

SEQ ID NO: 717717 - RNA, 19 nt, Homo sapiens
gauacugagaccugugugu

SEQ ID NO: 717718 - RNA, 19 nt, Homo sapiens
gcagggauauccaugcuua

SEQ ID NO: 717719 - RNA, 19 nt, Homo sapiens
gaacaaaugagacacauau

SEQ ID NO: 717720 - RNA, 19 nt, Homo sapiens
ggauauccaugcuuaugua

SEQ ID NO: 717721 - RNA, 19 nt, Homo sapiens
gagaguaauuugaagaaug

SEQ ID NO: 717722 - RNA, 19 nt, Homo sapiens
uaacugaggccuuuccaua

SEQ ID NO: 717723 - RNA, 19 nt, Homo sapiens
acacauggaugguggagua

SEQ ID NO: 717724 - RNA, 19 nt, Homo sapiens
gaacgagaguaauuugaag

SEQ ID NO: 717725 - RNA, 19 nt, Homo sapiens
caaaugagacacauauaga

SEQ ID NO: 717726 - RNA, 19 nt, Homo sapiens
ggacauacaccaugcagau

SEQ ID NO: 717727 - RNA, 19 nt, Homo sapiens
ggaacgagaguaauuugaa

SEQ ID NO: 717728 - RNA, 19 nt, Homo sapiens
agacacauauagauacuga

SEQ ID NO: 717729 - RNA, 19 nt, Homo sapiens
gggcugagaucucggauac

SEQ ID NO: 717730 - RNA, 19 nt, Homo sapiens
caucacagcuugacucacu

SEQ ID NO: 717731 - RNA, 19 nt, Homo sapiens
gggaagaggagcugccuuu

SEQ ID NO: 717732 - RNA, 19 nt, Homo sapiens
caacccagcagcaauuuga

SEQ ID NO: 717733 - RNA, 19 nt, Homo sapiens
gcucaccaccuaccucuuu

SEQ ID NO: 717734 - RNA, 19 nt, Homo sapiens
ggcuugagcucaccaccua

SEQ ID NO: 717735 - RNA, 19 nt, Homo sapiens
cagcuugacucacuaacug

SEQ ID NO: 717736 - RNA, 19 nt, Homo sapiens
ggaacaaaugagacacaua

SEQ ID NO: 717737 - RNA, 19 nt, Homo sapiens
ggagagagggcaccaccaa

SEQ ID NO: 717738 - RNA, 19 nt, Homo sapiens
acacacacauaucacaguu

SEQ ID NO: 717739 - RNA, 19 nt, Homo sapiens
caagggagccaguuguguu

SEQ ID NO: 717740 - RNA, 19 nt, Homo sapiens
ccaucugucuguuucuauu

SEQ ID NO: 717741 - RNA, 19 nt, Homo sapiens
ccaugcagauccugaguuc

SEQ ID NO: 717742 - RNA, 19 nt, Homo sapiens
gagcccauguuuacagaca

SEQ ID NO: 717743 - RNA, 19 nt, Homo sapiens
gaucucggauaccaucauc

SEQ ID NO: 717744 - RNA, 19 nt, Homo sapiens
acacacacacacacacaua

SEQ ID NO: 717745 - RNA, 19 nt, Homo sapiens
gcugagaucucggauacca

SEQ ID NO: 717746 - RNA, 19 nt, Homo sapiens
guaggaccaugcacucaca

SEQ ID NO: 717747 - RNA, 19 nt, Homo sapiens
gcuuauguauccaaacaca

SEQ ID NO: 717748 - RNA, 19 nt, Homo sapiens
ggccuucucucgucugauc

SEQ ID NO: 717749 - RNA, 19 nt, Homo sapiens
cugaguuccugcuguauga

SEQ ID NO: 717750 - RNA, 19 nt, Homo sapiens
caacacauacacacacaca

SEQ ID NO: 717751 - RNA, 19 nt, Homo sapiens
caucugucuguuucuauua

SEQ ID NO: 717752 - RNA, 19 nt, Homo sapiens
ggagccaguuguguucaga

SEQ ID NO: 717753 - RNA, 19 nt, Homo sapiens
acacacauaucacaguuuu

SEQ ID NO: 717754 - RNA, 19 nt, Homo sapiens
gagagagggcaccaccaaa

SEQ ID NO: 717755 - RNA, 19 nt, Homo sapiens
agaguaauuugaagaaugc

SEQ ID NO: 717756 - RNA, 19 nt, Homo sapiens
cgagaguaauuugaagaau

SEQ ID NO: 717757 - RNA, 19 nt, Homo sapiens
acaaaugagacacauauag

SEQ ID NO: 717758 - RNA, 19 nt, Homo sapiens
ucuauacucuucgcuccua

SEQ ID NO: 717759 - RNA, 19 nt, Homo sapiens
ggagaaggccuuuuacaca

SEQ ID NO: 717760 - RNA, 19 nt, Homo sapiens
acacauauagauacugaga

SEQ ID NO: 717761 - RNA, 19 nt, Homo sapiens
gcccgcacauauccacuug

SEQ ID NO: 717762 - RNA, 19 nt, Homo sapiens
ccacugaggagaggaucua

SEQ ID NO: 717763 - RNA, 19 nt, Homo sapiens
gggaacgagaguaauuuga

SEQ ID NO: 717764 - RNA, 19 nt, Homo sapiens
guccucaccauaugccuua

SEQ ID NO: 717765 - RNA, 19 nt, Homo sapiens
gaagaggagcugccuuuug

SEQ ID NO: 717766 - RNA, 19 nt, Homo sapiens
gggaacaaaugagacacau

SEQ ID NO: 717767 - RNA, 19 nt, Homo sapiens
guccaucugucuguuucua

SEQ ID NO: 717768 - RNA, 19 nt, Homo sapiens
ccucaacccagcagcaauu

SEQ ID NO: 717769 - RNA, 19 nt, Homo sapiens
ugaagaaugcuugaaguca

SEQ ID NO: 717770 - RNA, 19 nt, Homo sapiens
ccgaguaugugcugcucuu

SEQ ID NO: 717771 - RNA, 19 nt, Homo sapiens
caggugggccuaauuccaa

SEQ ID NO: 717772 - RNA, 19 nt, Homo sapiens
gggauauccaugcuuaugu

SEQ ID NO: 717773 - RNA, 19 nt, Homo sapiens
gcaguggguguucgugaau

SEQ ID NO: 717774 - RNA, 19 nt, Homo sapiens
cacaacacauacacacaca

SEQ ID NO: 717775 - RNA, 19 nt, Homo sapiens
agccaggccugaaggaaga

SEQ ID NO: 717776 - RNA, 19 nt, Homo sapiens
cgucuuccauuccagaaag

SEQ ID NO: 717777 - RNA, 19 nt, Homo sapiens
ucacagcuugacucacuaa

SEQ ID NO: 717778 - RNA, 19 nt, Homo sapiens
ugagacacauauagauacu

SEQ ID NO: 717779 - RNA, 19 nt, Homo sapiens
aggaagaccugcggaugga

SEQ ID NO: 717780 - RNA, 19 nt, Homo sapiens
acacauacacacacacaca

SEQ ID NO: 717781 - RNA, 19 nt, Homo sapiens
ggacuuccucacccucuuc

SEQ ID NO: 717782 - RNA, 19 nt, Homo sapiens
agacaggugggccuaauuc

SEQ ID NO: 717783 - RNA, 19 nt, Homo sapiens
gauauccaugcuuauguau

SEQ ID NO: 717784 - RNA, 19 nt, Homo sapiens
cuagacaggugggccuaau

SEQ ID NO: 717785 - RNA, 19 nt, Homo sapiens
agagacccaugggaacaaa

SEQ ID NO: 717786 - RNA, 19 nt, Homo sapiens
uacacacacacaacacaua

SEQ ID NO: 717787 - RNA, 19 nt, Homo sapiens
auacugagaccugugugua

SEQ ID NO: 717788 - RNA, 19 nt, Homo sapiens
uauccaugcuuauguaucc

SEQ ID NO: 717789 - RNA, 19 nt, Homo sapiens
ccaugcuuauguauccaaa

SEQ ID NO: 717790 - RNA, 19 nt, Homo sapiens
uuacagacagggacauaca

SEQ ID NO: 717791 - RNA, 19 nt, Homo sapiens
uuauguauccaaacacaga

SEQ ID NO: 717792 - RNA, 19 nt, Homo sapiens
uggagcccauguuuacaga

SEQ ID NO: 717793 - RNA, 19 nt, Homo sapiens
ugcaguggguguucgugaa

SEQ ID NO: 717794 - RNA, 19 nt, Homo sapiens
augcuuauguauccaaaca

SEQ ID NO: 717795 - RNA, 19 nt, Homo sapiens
aagaggagcugccuuuugg

SEQ ID NO: 717796 - RNA, 19 nt, Homo sapiens
gauacugagaccugugugu

SEQ ID NO: 717797 - RNA, 19 nt, Homo sapiens
gcagggauauccaugcuua

SEQ ID NO: 717798 - RNA, 19 nt, Homo sapiens
gaacaaaugagacacauau

SEQ ID NO: 717799 - RNA, 19 nt, Homo sapiens
ggauauccaugcuuaugua

SEQ ID NO: 717800 - RNA, 19 nt, Homo sapiens
gagaguaauuugaagaaug

SEQ ID NO: 717801 - RNA, 19 nt, Homo sapiens
uaacugaggccuuuccaua

SEQ ID NO: 717802 - RNA, 19 nt, Homo sapiens
acacauggaugguggagua

SEQ ID NO: 717803 - RNA, 19 nt, Homo sapiens
gcgaagagauagcgcaguu

SEQ ID NO: 717804 - RNA, 19 nt, Homo sapiens
gaacgagaguaauuugaag

SEQ ID NO: 717805 - RNA, 19 nt, Homo sapiens
caaaugagacacauauaga

SEQ ID NO: 717806 - RNA, 19 nt, Homo sapiens
ggacauacaccaugcagau

SEQ ID NO: 717807 - RNA, 19 nt, Homo sapiens
ggaacgagaguaauuugaa

SEQ ID NO: 717808 - RNA, 19 nt, Homo sapiens
agacacauauagauacuga

SEQ ID NO: 717809 - RNA, 19 nt, Homo sapiens
gggcugagaucucggauac

SEQ ID NO: 717810 - RNA, 19 nt, Homo sapiens
caucacagcuugacucacu

SEQ ID NO: 717811 - RNA, 19 nt, Homo sapiens
gggaagaggagcugccuuu

SEQ ID NO: 717812 - RNA, 19 nt, Homo sapiens
caacccagcagcaauuuga

SEQ ID NO: 717813 - RNA, 19 nt, Homo sapiens
gcucaccaccuaccucuuu

SEQ ID NO: 717814 - RNA, 19 nt, Homo sapiens
ggcuugagcucaccaccua

SEQ ID NO: 717815 - RNA, 19 nt, Homo sapiens
cagcuugacucacuaacug

SEQ ID NO: 717816 - RNA, 19 nt, Homo sapiens
ggaacaaaugagacacaua

SEQ ID NO: 717817 - RNA, 19 nt, Homo sapiens
ggagagagggcaccaccaa

SEQ ID NO: 717818 - RNA, 19 nt, Homo sapiens
acacacacauaucacaguu

SEQ ID NO: 717819 - RNA, 19 nt, Homo sapiens
caagggagccaguuguguu

SEQ ID NO: 717820 - RNA, 19 nt, Homo sapiens
ccaucugucuguuucuauu

SEQ ID NO: 717821 - RNA, 19 nt, Homo sapiens
ccaugcagauccugaguuc

SEQ ID NO: 717822 - RNA, 19 nt, Homo sapiens
gagcccauguuuacagaca

SEQ ID NO: 717823 - RNA, 19 nt, Homo sapiens
gaucucggauaccaucauc

SEQ ID NO: 717824 - RNA, 19 nt, Homo sapiens
acacacacacacacacaua

SEQ ID NO: 717825 - RNA, 19 nt, Homo sapiens
gcugagaucucggauacca

SEQ ID NO: 717826 - RNA, 19 nt, Homo sapiens
ggccuucucucgucugauc

SEQ ID NO: 717827 - RNA, 19 nt, Homo sapiens
guaggaccaugcacucaca

SEQ ID NO: 717828 - RNA, 19 nt, Homo sapiens
gcuuauguauccaaacaca

SEQ ID NO: 717829 - RNA, 19 nt, Homo sapiens
cugaguuccugcuguauga

SEQ ID NO: 717830 - RNA, 19 nt, Homo sapiens
caacacauacacacacaca

SEQ ID NO: 717831 - RNA, 19 nt, Homo sapiens
caucugucuguuucuauua

SEQ ID NO: 717832 - RNA, 19 nt, Homo sapiens
ggagccaguuguguucaga

SEQ ID NO: 717833 - RNA, 19 nt, Homo sapiens
acacacauaucacaguuuu

SEQ ID NO: 717834 - RNA, 19 nt, Homo sapiens
gagagagggcaccaccaaa

SEQ ID NO: 717835 - RNA, 19 nt, Homo sapiens
agaguaauuugaagaaugc

SEQ ID NO: 717836 - RNA, 19 nt, Homo sapiens
cgagaguaauuugaagaau

SEQ ID NO: 717837 - RNA, 19 nt, Homo sapiens
acaaaugagacacauauag

SEQ ID NO: 717838 - RNA, 19 nt, Homo sapiens
ucuauacucuucgcuccua

SEQ ID NO: 717839 - RNA, 19 nt, Homo sapiens
ggagaaggccuuuuacaca

SEQ ID NO: 717840 - RNA, 19 nt, Homo sapiens
acacauauagauacugaga

SEQ ID NO: 717841 - RNA, 19 nt, Homo sapiens
gcccgcacauauccacuug

SEQ ID NO: 717842 - RNA, 19 nt, Homo sapiens
ccacugaggagaggaucua

SEQ ID NO: 717843 - RNA, 19 nt, Homo sapiens
gggaacgagaguaauuuga

SEQ ID NO: 717844 - RNA, 19 nt, Homo sapiens
guccucaccauaugccuua

SEQ ID NO: 717845 - RNA, 19 nt, Homo sapiens
gaagaggagcugccuuuug

SEQ ID NO: 717846 - RNA, 19 nt, Homo sapiens
gggaacaaaugagacacau

SEQ ID NO: 717847 - RNA, 19 nt, Homo sapiens
guccaucugucuguuucua

SEQ ID NO: 717848 - RNA, 19 nt, Homo sapiens
ccucaacccagcagcaauu

SEQ ID NO: 717849 - RNA, 19 nt, Homo sapiens
ugaagaaugcuugaaguca

SEQ ID NO: 717850 - RNA, 19 nt, Homo sapiens
caggugggccuaauuccaa

SEQ ID NO: 717851 - RNA, 19 nt, Homo sapiens
gggauauccaugcuuaugu

SEQ ID NO: 717852 - RNA, 19 nt, Homo sapiens
cacaacacauacacacaca

SEQ ID NO: 717853 - RNA, 19 nt, Homo sapiens
gcaguggguguucgugaau

SEQ ID NO: 717854 - RNA, 19 nt, Homo sapiens
agccaggccugaaggaaga

SEQ ID NO: 717855 - RNA, 19 nt, Homo sapiens
cgucuuccauuccagaaag

SEQ ID NO: 717856 - RNA, 19 nt, Homo sapiens
ucacagcuugacucacuaa

SEQ ID NO: 717857 - RNA, 19 nt, Homo sapiens
ugagacacauauagauacu

SEQ ID NO: 717858 - RNA, 19 nt, Homo sapiens
aggaagaccugcggaugga

SEQ ID NO: 717859 - RNA, 19 nt, Homo sapiens
acacauacacacacacaca

SEQ ID NO: 717860 - RNA, 19 nt, Homo sapiens
agacaggugggccuaauuc

SEQ ID NO: 717861 - RNA, 19 nt, Homo sapiens
gauauccaugcuuauguau

SEQ ID NO: 717862 - RNA, 19 nt, Homo sapiens
ggacuuccucacccucuuc

SEQ ID NO: 717863 - RNA, 19 nt, Homo sapiens
cuagacaggugggccuaau

SEQ ID NO: 717864 - RNA, 19 nt, Homo sapiens
agagacccaugggaacaaa

SEQ ID NO: 717865 - RNA, 19 nt, Homo sapiens
uacacacacacaacacaua

SEQ ID NO: 717866 - RNA, 19 nt, Homo sapiens
auacugagaccugugugua

SEQ ID NO: 717867 - RNA, 19 nt, Homo sapiens
guacgcagagcuucgucuu

SEQ ID NO: 717868 - RNA, 19 nt, Homo sapiens
uauccaugcuuauguaucc

SEQ ID NO: 717869 - RNA, 19 nt, Homo sapiens
ccaugcuuauguauccaaa

SEQ ID NO: 717870 - RNA, 19 nt, Homo sapiens
uuacagacagggacauaca

SEQ ID NO: 717871 - RNA, 19 nt, Homo sapiens
uuauguauccaaacacaga

SEQ ID NO: 717872 - RNA, 19 nt, Homo sapiens
uggagcccauguuuacaga

SEQ ID NO: 717873 - RNA, 19 nt, Homo sapiens
ugcaguggguguucgugaa

SEQ ID NO: 717874 - RNA, 19 nt, Homo sapiens
augcuuauguauccaaaca

SEQ ID NO: 717875 - RNA, 19 nt, Homo sapiens
aagaggagcugccuuuugg

SEQ ID NO: 717876 - RNA, 19 nt, Homo sapiens
gauacugagaccugugugu

SEQ ID NO: 717877 - RNA, 19 nt, Homo sapiens
gcagggauauccaugcuua

SEQ ID NO: 717878 - RNA, 19 nt, Homo sapiens
gaacaaaugagacacauau

SEQ ID NO: 717879 - RNA, 19 nt, Homo sapiens
ggauauccaugcuuaugua

SEQ ID NO: 717880 - RNA, 19 nt, Homo sapiens
gagaguaauuugaagaaug

SEQ ID NO: 717881 - RNA, 19 nt, Homo sapiens
uaacugaggccuuuccaua

SEQ ID NO: 717882 - RNA, 19 nt, Homo sapiens
acacauggaugguggagua

SEQ ID NO: 717883 - RNA, 19 nt, Homo sapiens
gcgaagagauagcgcaguu

SEQ ID NO: 717884 - RNA, 19 nt, Homo sapiens
gaacgagaguaauuugaag

SEQ ID NO: 717885 - RNA, 19 nt, Homo sapiens
caaaugagacacauauaga

SEQ ID NO: 717886 - RNA, 19 nt, Homo sapiens
ggacauacaccaugcagau

SEQ ID NO: 717887 - RNA, 19 nt, Homo sapiens
ggaacgagaguaauuugaa

SEQ ID NO: 717888 - RNA, 19 nt, Homo sapiens
agacacauauagauacuga

SEQ ID NO: 717889 - RNA, 19 nt, Homo sapiens
caucacagcuugacucacu

SEQ ID NO: 717890 - RNA, 19 nt, Homo sapiens
gggaagaggagcugccuuu

SEQ ID NO: 717891 - RNA, 19 nt, Homo sapiens
caacccagcagcaauuuga

SEQ ID NO: 717892 - RNA, 19 nt, Homo sapiens
gcucaccaccuaccucuuu

SEQ ID NO: 717893 - RNA, 19 nt, Homo sapiens
ggcuugagcucaccaccua

SEQ ID NO: 717894 - RNA, 19 nt, Homo sapiens
cagcuugacucacuaacug

SEQ ID NO: 717895 - RNA, 19 nt, Homo sapiens
ggaacaaaugagacacaua

SEQ ID NO: 717896 - RNA, 19 nt, Homo sapiens
acacacacauaucacaguu

SEQ ID NO: 717897 - RNA, 19 nt, Homo sapiens
caagggagccaguuguguu

SEQ ID NO: 717898 - RNA, 19 nt, Homo sapiens
ccaucugucuguuucuauu

SEQ ID NO: 717899 - RNA, 19 nt, Homo sapiens
ccaugcagauccugaguuc

SEQ ID NO: 717900 - RNA, 19 nt, Homo sapiens
gagcccauguuuacagaca

SEQ ID NO: 717901 - RNA, 19 nt, Homo sapiens
acacacacacacacacaua

SEQ ID NO: 717902 - RNA, 19 nt, Homo sapiens
ggccuucucucgucugauc

SEQ ID NO: 717903 - RNA, 19 nt, Homo sapiens
guaggaccaugcacucaca

SEQ ID NO: 717904 - RNA, 19 nt, Homo sapiens
gcuuauguauccaaacaca

SEQ ID NO: 717905 - RNA, 19 nt, Homo sapiens
cugaguuccugcuguauga

SEQ ID NO: 717906 - RNA, 19 nt, Homo sapiens
caacacauacacacacaca

SEQ ID NO: 717907 - RNA, 19 nt, Homo sapiens
caucugucuguuucuauua

SEQ ID NO: 717908 - RNA, 19 nt, Homo sapiens
ggagccaguuguguucaga

SEQ ID NO: 717909 - RNA, 19 nt, Homo sapiens
acacacauaucacaguuuu

SEQ ID NO: 717910 - RNA, 19 nt, Homo sapiens
agaguaauuugaagaaugc

SEQ ID NO: 717911 - RNA, 19 nt, Homo sapiens
cgagaguaauuugaagaau

SEQ ID NO: 717912 - RNA, 19 nt, Homo sapiens
acaaaugagacacauauag

SEQ ID NO: 717913 - RNA, 19 nt, Homo sapiens
ucuauacucuucgcuccua

SEQ ID NO: 717914 - RNA, 19 nt, Homo sapiens
ggagaaggccuuuuacaca

SEQ ID NO: 717915 - RNA, 19 nt, Homo sapiens
acacauauagauacugaga

SEQ ID NO: 717916 - RNA, 19 nt, Homo sapiens
gcccgcacauauccacuug

SEQ ID NO: 717917 - RNA, 19 nt, Homo sapiens
ccacugaggagaggaucua

SEQ ID NO: 717918 - RNA, 19 nt, Homo sapiens
gggaacgagaguaauuuga

SEQ ID NO: 717919 - RNA, 19 nt, Homo sapiens
guccucaccauaugccuua

SEQ ID NO: 717920 - RNA, 19 nt, Homo sapiens
gaagaggagcugccuuuug

SEQ ID NO: 717921 - RNA, 19 nt, Homo sapiens
gggaacaaaugagacacau

SEQ ID NO: 717922 - RNA, 19 nt, Homo sapiens
guccaucugucuguuucua

SEQ ID NO: 717923 - RNA, 19 nt, Homo sapiens
ccucaacccagcagcaauu

SEQ ID NO: 717924 - RNA, 19 nt, Homo sapiens
ccgaguaugugcugcucuu

SEQ ID NO: 717925 - RNA, 19 nt, Homo sapiens
ugaagaaugcuugaaguca

SEQ ID NO: 717926 - RNA, 19 nt, Homo sapiens
caggugggccuaauuccaa

SEQ ID NO: 717927 - RNA, 19 nt, Homo sapiens
gggauauccaugcuuaugu

SEQ ID NO: 717928 - RNA, 19 nt, Homo sapiens
cacaacacauacacacaca

SEQ ID NO: 717929 - RNA, 19 nt, Homo sapiens
gcaguggguguucgugaau

SEQ ID NO: 717930 - RNA, 19 nt, Homo sapiens
agccaggccugaaggaaga

SEQ ID NO: 717931 - RNA, 19 nt, Homo sapiens
cgucuuccauuccagaaag

SEQ ID NO: 717932 - RNA, 19 nt, Homo sapiens
ucacagcuugacucacuaa

SEQ ID NO: 717933 - RNA, 19 nt, Homo sapiens
ugagacacauauagauacu

SEQ ID NO: 717934 - RNA, 19 nt, Homo sapiens
aggaagaccugcggaugga

SEQ ID NO: 717935 - RNA, 19 nt, Homo sapiens
acacauacacacacacaca

SEQ ID NO: 717936 - RNA, 19 nt, Homo sapiens
agacaggugggccuaauuc

SEQ ID NO: 717937 - RNA, 19 nt, Homo sapiens
ggacuuccucacccucuuc

SEQ ID NO: 717938 - RNA, 19 nt, Homo sapiens
gauauccaugcuuauguau

SEQ ID NO: 717939 - RNA, 19 nt, Homo sapiens
cuagacaggugggccuaau

SEQ ID NO: 717940 - RNA, 19 nt, Homo sapiens
agagacccaugggaacaaa

SEQ ID NO: 717941 - RNA, 19 nt, Homo sapiens
uacacacacacaacacaua

SEQ ID NO: 717942 - RNA, 19 nt, Homo sapiens
auacugagaccugugugua

SEQ ID NO: 717943 - RNA, 19 nt, Homo sapiens
guacgcagagcuucgucuu

SEQ ID NO: 717944 - RNA, 19 nt, Homo sapiens
uauccaugcuuauguaucc

SEQ ID NO: 717945 - RNA, 19 nt, Homo sapiens
ccaugcuuauguauccaaa

SEQ ID NO: 717946 - RNA, 19 nt, Homo sapiens
uuacagacagggacauaca

SEQ ID NO: 717947 - RNA, 19 nt, Homo sapiens
uuauguauccaaacacaga

SEQ ID NO: 717948 - RNA, 19 nt, Homo sapiens
uggagcccauguuuacaga

SEQ ID NO: 717949 - RNA, 19 nt, Homo sapiens
ugcaguggguguucgugaa

SEQ ID NO: 717950 - RNA, 19 nt, Homo sapiens
augcuuauguauccaaaca

SEQ ID NO: 717951 - RNA, 19 nt, Homo sapiens
aagaggagcugccuuuugg

SEQ ID NO: 717952 - RNA, 19 nt, Homo sapiens
gauacugagaccugugugu

SEQ ID NO: 717953 - RNA, 19 nt, Homo sapiens
gaaacucugugugguauua

SEQ ID NO: 717954 - RNA, 19 nt, Homo sapiens
ggaaaugggugucaucaau

SEQ ID NO: 717955 - RNA, 19 nt, Homo sapiens
cugaguagguccacaaaua

SEQ ID NO: 717956 - RNA, 19 nt, Homo sapiens
acagagaacugcuggguuu

SEQ ID NO: 717957 - RNA, 19 nt, Homo sapiens
gaaaugggugucaucaauu

SEQ ID NO: 717958 - RNA, 19 nt, Homo sapiens
ccaucaaccugaaggcaua

SEQ ID NO: 717959 - RNA, 19 nt, Homo sapiens
gggccagccuuucccuuaa

SEQ ID NO: 717960 - RNA, 19 nt, Homo sapiens
gagcuggucuccucacucu

SEQ ID NO: 717961 - RNA, 19 nt, Homo sapiens
gcaagcccaucaaccugaa

SEQ ID NO: 717962 - RNA, 19 nt, Homo sapiens
gagaagggacaagcagaua

SEQ ID NO: 717963 - RNA, 19 nt, Homo sapiens
agaaugaaauccagaaacu

SEQ ID NO: 717964 - RNA, 19 nt, Homo sapiens
gaugaaccccggauauuua

SEQ ID NO: 717965 - RNA, 19 nt, Homo sapiens
ugaguagguccacaaauaa

SEQ ID NO: 717966 - RNA, 19 nt, Homo sapiens
gcugagaggccaugugaga

SEQ ID NO: 717967 - RNA, 19 nt, Homo sapiens
cuucuuaacucacccaugu

SEQ ID NO: 717968 - RNA, 19 nt, Homo sapiens
cuaccagacucacagagaa

SEQ ID NO: 717969 - RNA, 19 nt, Homo sapiens
caacuccagugggaaagaa

SEQ ID NO: 717970 - RNA, 19 nt, Homo sapiens
gcuggucuccucacucuuu

SEQ ID NO: 717971 - RNA, 19 nt, Homo sapiens
gauaagcgcaagcccauca

SEQ ID NO: 717972 - RNA, 19 nt, Homo sapiens
ccacaaucauaaccagaga

SEQ ID NO: 717973 - RNA, 19 nt, Homo sapiens
uccaugggcuccacaagaa

SEQ ID NO: 717974 - RNA, 19 nt, Homo sapiens
ggagaaugaaauccagaaa

SEQ ID NO: 717975 - RNA, 19 nt, Homo sapiens
uaaacuuuccgcuucuuaa

SEQ ID NO: 717976 - RNA, 19 nt, Homo sapiens
gaagggugugcgugucuuu

SEQ ID NO: 717977 - RNA, 19 nt, Homo sapiens
caugugagaccauauggaa

SEQ ID NO: 717978 - RNA, 19 nt, Homo sapiens
gaagggacaagcagauaag

SEQ ID NO: 717979 - RNA, 19 nt, Homo sapiens
ggaaauaccaacuuuaccu

SEQ ID NO: 717980 - RNA, 19 nt, Homo sapiens
ggagaagggacaagcagau

SEQ ID NO: 717981 - RNA, 19 nt, Homo sapiens
gugucuacuucucaguuua

SEQ ID NO: 717982 - RNA, 19 nt, Homo sapiens
ggaagggugugcgugucuu

SEQ ID NO: 717983 - RNA, 19 nt, Homo sapiens
gaggccaugugagaccaua

SEQ ID NO: 717984 - RNA, 19 nt, Homo sapiens
agacagugaugccgcuuca

SEQ ID NO: 717985 - RNA, 19 nt, Homo sapiens
guggagacccagaggauga

SEQ ID NO: 717986 - RNA, 19 nt, Homo sapiens
ucaccagcauugcacucua

SEQ ID NO: 717987 - RNA, 19 nt, Homo sapiens
cagcuucuccuacggauuc

SEQ ID NO: 717988 - RNA, 19 nt, Homo sapiens
gaguagguccacaaauaau

SEQ ID NO: 717989 - RNA, 19 nt, Homo sapiens
uaaagucugcaacaucguu

SEQ ID NO: 717990 - RNA, 19 nt, Homo sapiens
cagcauugcacucuacuuc

SEQ ID NO: 717991 - RNA, 19 nt, Homo sapiens
agaagggacaagcagauaa

SEQ ID NO: 717992 - RNA, 19 nt, Homo sapiens
uggaaggguuugucuugug

SEQ ID NO: 717993 - RNA, 19 nt, Homo sapiens
uuacaacuccagugggaaa

SEQ ID NO: 717994 - RNA, 19 nt, Homo sapiens
ccaucugucugauucuugu

SEQ ID NO: 717995 - RNA, 19 nt, Homo sapiens
gaucuccaucugucugauu

SEQ ID NO: 717996 - RNA, 19 nt, Homo sapiens
gugacccucuucucaagga

SEQ ID NO: 717997 - RNA, 19 nt, Homo sapiens
ugugucuacuucucaguuu

SEQ ID NO: 717998 - RNA, 19 nt, Homo sapiens
cgggccagccuuucccuua

SEQ ID NO: 717999 - RNA, 19 nt, Homo sapiens
gagaaugaaauccagaaac

SEQ ID NO: 718000 - RNA, 19 nt, Homo sapiens
uuaaacuuuccgcuucuua

SEQ ID NO: 718001 - RNA, 19 nt, Homo sapiens
ugugugguauuaguuugua

SEQ ID NO: 718002 - RNA, 19 nt, Homo sapiens
guggaaggguuugucuugu

SEQ ID NO: 718003 - RNA, 19 nt, Homo sapiens
ccaugucguuaaucaucuu

SEQ ID NO: 718004 - RNA, 19 nt, Homo sapiens
ucaccaaggcugaguaggu

SEQ ID NO: 718005 - RNA, 19 nt, Homo sapiens
ccagccaccuccuucugau

SEQ ID NO: 718006 - RNA, 19 nt, Homo sapiens
gagaggggcagcaauuuug

SEQ ID NO: 718007 - RNA, 19 nt, Homo sapiens
gcugagagagaggcaagaa

SEQ ID NO: 718008 - RNA, 19 nt, Homo sapiens
ggccagccuuucccuuaag

SEQ ID NO: 718009 - RNA, 19 nt, Homo sapiens
ucaaggaaaugggugucau

SEQ ID NO: 718010 - RNA, 19 nt, Homo sapiens
ugagagagaggcaagaaac

SEQ ID NO: 718011 - RNA, 19 nt, Homo sapiens
caaggaaaugggugucauc

SEQ ID NO: 718012 - RNA, 19 nt, Homo sapiens
aagaguggcagcugagaga

SEQ ID NO: 718013 - RNA, 19 nt, Homo sapiens
cauggaaguugggguuaua

SEQ ID NO: 718014 - RNA, 19 nt, Homo sapiens
guagguccacaaauaaugg

SEQ ID NO: 718015 - RNA, 19 nt, Homo sapiens
aaugaaauccagaaacucu

SEQ ID NO: 718016 - RNA, 19 nt, Homo sapiens
agacccagaggaugagaaa

SEQ ID NO: 718017 - RNA, 19 nt, Homo sapiens
guguguccaugucguuaau

SEQ ID NO: 718018 - RNA, 19 nt, Homo sapiens
guguccaugucguuaauca

SEQ ID NO: 718019 - RNA, 19 nt, Homo sapiens
caccagcauugcacucuac

SEQ ID NO: 718020 - RNA, 19 nt, Homo sapiens
gaaugaaauccagaaacuc

SEQ ID NO: 718021 - RNA, 19 nt, Homo sapiens
agagagauuuugaggagaa

SEQ ID NO: 718022 - RNA, 19 nt, Homo sapiens
ggacuggggcagagagauu

SEQ ID NO: 718023 - RNA, 19 nt, Homo sapiens
gagagagaggcaagaaacu

SEQ ID NO: 718024 - RNA, 19 nt, Homo sapiens
ggacuuucuaccagacuca

SEQ ID NO: 718025 - RNA, 19 nt, Homo sapiens
gcaguggaaggguuugucu

SEQ ID NO: 718026 - RNA, 19 nt, Homo sapiens
cugcugagaggccauguga

SEQ ID NO: 718027 - RNA, 19 nt, Homo sapiens
gauccugccucagcuucuc

SEQ ID NO: 718028 - RNA, 19 nt, Homo sapiens
guccaugucguuaaucauc

SEQ ID NO: 718029 - RNA, 19 nt, Homo sapiens
uauuaaacuuuccgcuucu

SEQ ID NO: 718030 - RNA, 19 nt, Homo sapiens
uuaacucacccaugugugu

SEQ ID NO: 718031 - RNA, 19 nt, Homo sapiens
aaacaaagcugcugugcua

SEQ ID NO: 718032 - RNA, 19 nt, Homo sapiens
gaaauaggccaugaaguua

SEQ ID NO: 718033 - RNA, 19 nt, Homo sapiens
aaacugaggugaugcaugu

SEQ ID NO: 718034 - RNA, 19 nt, Homo sapiens
caacuggauuucuagguaa

SEQ ID NO: 718035 - RNA, 19 nt, Homo sapiens
ugaaauaggccaugaaguu

SEQ ID NO: 718036 - RNA, 19 nt, Homo sapiens
gcaaaguaacugcuauaaa

SEQ ID NO: 718037 - RNA, 19 nt, Homo sapiens
ggaagaaguugguguuucg

SEQ ID NO: 718038 - RNA, 19 nt, Homo sapiens
caaagcugcugugcuauau

SEQ ID NO: 718039 - RNA, 19 nt, Homo sapiens
acaacuggauuucuaggua

SEQ ID NO: 718040 - RNA, 19 nt, Homo sapiens
gcaguaccacuuugauaaa

SEQ ID NO: 718041 - RNA, 19 nt, Homo sapiens
ggaacuauggcuaugcuaa

SEQ ID NO: 718042 - RNA, 19 nt, Homo sapiens
gaacuauggcuaugcuaau

SEQ ID NO: 718043 - RNA, 19 nt, Homo sapiens
aagcugcugugcuauauga

SEQ ID NO: 718044 - RNA, 19 nt, Homo sapiens
ggugaugcauguaauugug

SEQ ID NO: 718045 - RNA, 19 nt, Homo sapiens
gaaguuaaaacccagaaua

SEQ ID NO: 718046 - RNA, 19 nt, Homo sapiens
guauagugccugugaagaa

SEQ ID NO: 718047 - RNA, 19 nt, Homo sapiens
aauaggccaugaaguuaaa

SEQ ID NO: 718048 - RNA, 19 nt, Homo sapiens
guucaaauacuguggcauu

SEQ ID NO: 718049 - RNA, 19 nt, Homo sapiens
gcuaauaguggguauagug

SEQ ID NO: 718050 - RNA, 19 nt, Homo sapiens
acaaagcugcugugcuaua

SEQ ID NO: 718051 - RNA, 19 nt, Homo sapiens
gaaagucugagaagcaaag

SEQ ID NO: 718052 - RNA, 19 nt, Homo sapiens
ccagagggagccaaacaaa

SEQ ID NO: 718053 - RNA, 19 nt, Homo sapiens
gcugggcccugguacugaa

SEQ ID NO: 718054 - RNA, 19 nt, Homo sapiens
aacuauggcuaugcuaaua

SEQ ID NO: 718055 - RNA, 19 nt, Homo sapiens
gcaacuaugggaacuaugg

SEQ ID NO: 718056 - RNA, 19 nt, Homo sapiens
aaauaggccaugaaguuaa

SEQ ID NO: 718057 - RNA, 19 nt, Homo sapiens
gaggugaugcauguaauug

SEQ ID NO: 718058 - RNA, 19 nt, Homo sapiens
uuauuaaacugaggugaug

SEQ ID NO: 718059 - RNA, 19 nt, Homo sapiens
caauuugauuccacaacug

SEQ ID NO: 718060 - RNA, 19 nt, Homo sapiens
agucugagaagcaaaguaa

SEQ ID NO: 718061 - RNA, 19 nt, Homo sapiens
ccauugaaauaggccauga

SEQ ID NO: 718062 - RNA, 19 nt, Homo sapiens
ugcaguaccacuuugauaa

SEQ ID NO: 718063 - RNA, 19 nt, Homo sapiens
uggcaacuaugggaacuau

SEQ ID NO: 718064 - RNA, 19 nt, Homo sapiens
acaauuugauuccacaacu

SEQ ID NO: 718065 - RNA, 19 nt, Homo sapiens
aggccugggugaaggagua

SEQ ID NO: 718066 - RNA, 19 nt, Homo sapiens
cugaaagucugagaagcaa

SEQ ID NO: 718067 - RNA, 19 nt, Homo sapiens
uauagugccugugaagaag

SEQ ID NO: 718068 - RNA, 19 nt, Homo sapiens
cauuccuaguguucaaaua

SEQ ID NO: 718069 - RNA, 19 nt, Homo sapiens
gaguaccuccuggcaacua

SEQ ID NO: 718070 - RNA, 19 nt, Homo sapiens
gcuauaugaugcuguuuuc

SEQ ID NO: 718071 - RNA, 19 nt, Homo sapiens
ucacugaaagucugagaag

SEQ ID NO: 718072 - RNA, 19 nt, Homo sapiens
ugaugcauguaauugugaa

SEQ ID NO: 718073 - RNA, 19 nt, Homo sapiens
uaugggaacuauggcuaug

SEQ ID NO: 718074 - RNA, 19 nt, Homo sapiens
caucaaaacauuccuagug

SEQ ID NO: 718075 - RNA, 19 nt, Homo sapiens
ugaggugaugcauguaauu

SEQ ID NO: 718076 - RNA, 19 nt, Homo sapiens
ugugcuauaugaugcuguu

SEQ ID NO: 718077 - RNA, 19 nt, Homo sapiens
ugggcaaacugaagauuuu

SEQ ID NO: 718078 - RNA, 19 nt, Homo sapiens
guggguauagugccuguga

SEQ ID NO: 718079 - RNA, 19 nt, Homo sapiens
uugcaguaccacuuugaua

SEQ ID NO: 718080 - RNA, 19 nt, Homo sapiens
aaacuaugggcaaacugaa

SEQ ID NO: 718081 - RNA, 19 nt, Homo sapiens
gguauagugccugugaaga

SEQ ID NO: 718082 - RNA, 19 nt, Homo sapiens
uagugccugugaagaagaa

SEQ ID NO: 718083 - RNA, 19 nt, Homo sapiens
gugaugcauguaauuguga

SEQ ID NO: 718084 - RNA, 19 nt, Homo sapiens
gcuauaaaaucucuuucca

SEQ ID NO: 718085 - RNA, 19 nt, Homo sapiens
gagaggcucacugaaaguc

SEQ ID NO: 718086 - RNA, 19 nt, Homo sapiens
uaaaucagcuggagaagga

SEQ ID NO: 718087 - RNA, 19 nt, Homo sapiens
gcagaugaacuuaacaaua

SEQ ID NO: 718088 - RNA, 19 nt, Homo sapiens
aaacagaaguagaagauga

SEQ ID NO: 718089 - RNA, 19 nt, Homo sapiens
ggaaguaaaucgaguuagu

SEQ ID NO: 718090 - RNA, 19 nt, Homo sapiens
gcaagacucagauacauuu

SEQ ID NO: 718091 - RNA, 19 nt, Homo sapiens
uaaacucacucaagcaauu

SEQ ID NO: 718092 - RNA, 19 nt, Homo sapiens
gugcagagcaugaugaaua

SEQ ID NO: 718093 - RNA, 19 nt, Homo sapiens
ggaaugauguaagcaaaug

SEQ ID NO: 718094 - RNA, 19 nt, Homo sapiens
ggaagaagaagaggaagua

SEQ ID NO: 718095 - RNA, 19 nt, Homo sapiens
caauaagcauaccaucuuu

SEQ ID NO: 718096 - RNA, 19 nt, Homo sapiens
ggaagcaacagucaaagaa

SEQ ID NO: 718097 - RNA, 19 nt, Homo sapiens
ggacacaagugcgaauguu

SEQ ID NO: 718098 - RNA, 19 nt, Homo sapiens
gcagaguccuuuguacuga

SEQ ID NO: 718099 - RNA, 19 nt, Homo sapiens
guacuucaguuugaggaua

SEQ ID NO: 718100 - RNA, 19 nt, Homo sapiens
ugacauuccugaaacagaa

SEQ ID NO: 718101 - RNA, 19 nt, Homo sapiens
gauaaaagcagaaaaguga

SEQ ID NO: 718102 - RNA, 19 nt, Homo sapiens
agaggaagcugaggaagaa

SEQ ID NO: 718103 - RNA, 19 nt, Homo sapiens
ggaaaugugccuacaaugg

SEQ ID NO: 718104 - RNA, 19 nt, Homo sapiens
gaagagaaaagcaaaagua

SEQ ID NO: 718105 - RNA, 19 nt, Homo sapiens
guaaaucgaguuagucaga

SEQ ID NO: 718106 - RNA, 19 nt, Homo sapiens
agacauugaugaugacgaa

SEQ ID NO: 718107 - RNA, 19 nt, Homo sapiens
ccuaaagcuugcagaaauu

SEQ ID NO: 718108 - RNA, 19 nt, Homo sapiens
gagaaaagcaaaaguauga

SEQ ID NO: 718109 - RNA, 19 nt, Homo sapiens
gaaaccagaggaggaagua

SEQ ID NO: 718110 - RNA, 19 nt, Homo sapiens
ggaagcuuauuaugacaau

SEQ ID NO: 718111 - RNA, 19 nt, Homo sapiens
aaggagaaguggagaagaa

SEQ ID NO: 718112 - RNA, 19 nt, Homo sapiens
gaggaaguaaaucgaguua

SEQ ID NO: 718113 - RNA, 19 nt, Homo sapiens
gcugugagguuuuguuuaa

SEQ ID NO: 718114 - RNA, 19 nt, Homo sapiens
gacgaaagaccacauaauc

SEQ ID NO: 718115 - RNA, 19 nt, Homo sapiens
uagcugaccuuuuauauug

SEQ ID NO: 718116 - RNA, 19 nt, Homo sapiens
gcagugaagagcucagaaa

SEQ ID NO: 718117 - RNA, 19 nt, Homo sapiens
agacucagauacauuugaa

SEQ ID NO: 718118 - RNA, 19 nt, Homo sapiens
aguagaagaugaugaagga

SEQ ID NO: 718119 - RNA, 19 nt, Homo sapiens
gacacaagugcgaauguua

SEQ ID NO: 718120 - RNA, 19 nt, Homo sapiens
gagaggaagcugaggaaga

SEQ ID NO: 718121 - RNA, 19 nt, Homo sapiens
aaguagacauugaugauga

SEQ ID NO: 718122 - RNA, 19 nt, Homo sapiens
uauaacauguugcgacugu

SEQ ID NO: 718123 - RNA, 19 nt, Homo sapiens
gagcgccauucaaagauga

SEQ ID NO: 718124 - RNA, 19 nt, Homo sapiens
ggagcgccauucaaagaug

SEQ ID NO: 718125 - RNA, 19 nt, Homo sapiens
aaaagaaccugaugagaga

SEQ ID NO: 718126 - RNA, 19 nt, Homo sapiens
caccagauuuaguugauga

SEQ ID NO: 718127 - RNA, 19 nt, Homo sapiens
gaauaaugauaaccagaac

SEQ ID NO: 718128 - RNA, 19 nt, Homo sapiens
cacauguacuucaguuuga

SEQ ID NO: 718129 - RNA, 19 nt, Homo sapiens
gaagaagaagaggaaguaa

SEQ ID NO: 718130 - RNA, 19 nt, Homo sapiens
caaaugcugguucucauga

SEQ ID NO: 718131 - RNA, 19 nt, Homo sapiens
ccacaucucaguucuguuc

SEQ ID NO: 718132 - RNA, 19 nt, Homo sapiens
gagcagaugaacuuaacaa

SEQ ID NO: 718133 - RNA, 19 nt, Homo sapiens
gucccugucuugcgugaua

SEQ ID NO: 718134 - RNA, 19 nt, Homo sapiens
guggaaugauguaagcaaa

SEQ ID NO: 718135 - RNA, 19 nt, Homo sapiens
caaauuguggaaugaugua

SEQ ID NO: 718136 - RNA, 19 nt, Homo sapiens
gugaagagcucagaaaaga

SEQ ID NO: 718137 - RNA, 19 nt, Homo sapiens
agaagaagaggaaguaaau

SEQ ID NO: 718138 - RNA, 19 nt, Homo sapiens
aggaggaaguaaagaaauu

SEQ ID NO: 718139 - RNA, 19 nt, Homo sapiens
gaaguagacauugaugaug

SEQ ID NO: 718140 - RNA, 19 nt, Homo sapiens
acaauaagcauaccaucuu

SEQ ID NO: 718141 - RNA, 19 nt, Homo sapiens
acacaagugcgaauguuaa

SEQ ID NO: 718142 - RNA, 19 nt, Homo sapiens
gagcaugaugaauauauug

SEQ ID NO: 718143 - RNA, 19 nt, Homo sapiens
ucacauguacuucaguuug

SEQ ID NO: 718144 - RNA, 19 nt, Homo sapiens
aacuacagcuggagauauu

SEQ ID NO: 718145 - RNA, 19 nt, Homo sapiens
gcaaauuguggaaugaugu

SEQ ID NO: 718146 - RNA, 19 nt, Homo sapiens
agaaguagaagaugaugaa

SEQ ID NO: 718147 - RNA, 19 nt, Homo sapiens
ugaaacagaaguagaagau

SEQ ID NO: 718148 - RNA, 19 nt, Homo sapiens
ugaggaagcaacagucaaa

SEQ ID NO: 718149 - RNA, 19 nt, Homo sapiens
gaugacgaaagaccacaua

SEQ ID NO: 718150 - RNA, 19 nt, Homo sapiens
gcaaaugcugguucucaug

SEQ ID NO: 718151 - RNA, 19 nt, Homo sapiens
uccuaaagcuugcagaaau

SEQ ID NO: 718152 - RNA, 19 nt, Homo sapiens
cuggagauauugacauaga

SEQ ID NO: 718153 - RNA, 19 nt, Homo sapiens
caagugcgaauguuaaauc

SEQ ID NO: 718154 - RNA, 19 nt, Homo sapiens
gaaagugcagagcaugaug

SEQ ID NO: 718155 - RNA, 19 nt, Homo sapiens
gcaccagauuuaguugaug

SEQ ID NO: 718156 - RNA, 19 nt, Homo sapiens
ucucaguucuguuccaguu

SEQ ID NO: 718157 - RNA, 19 nt, Homo sapiens
aagcauaccaucuuuggaa

SEQ ID NO: 718158 - RNA, 19 nt, Homo sapiens
gagaaguggagaagaaauc

SEQ ID NO: 718159 - RNA, 19 nt, Homo sapiens
gagagaaagaauugccaaa

SEQ ID NO: 718160 - RNA, 19 nt, Homo sapiens
ggaggaaguaaagaaauug

SEQ ID NO: 718161 - RNA, 19 nt, Homo sapiens
ggagcagaguccuuuguac

SEQ ID NO: 718162 - RNA, 19 nt, Homo sapiens
gauaauggcacccacuuuu

SEQ ID NO: 718163 - RNA, 19 nt, Homo sapiens
uuuccuagcugaccuuuua

SEQ ID NO: 718164 - RNA, 19 nt, Homo sapiens
gaaaagaagcaagacaauu

SEQ ID NO: 718165 - RNA, 19 nt, Homo sapiens
gaggaaguaaagaaauuga

SEQ ID NO: 718166 - RNA, 19 nt, Homo sapiens
agauuuaguugaugaugga

SEQ ID NO: 718167 - RNA, 19 nt, Homo sapiens
gaaguaaaucgaguuaguc

SEQ ID NO: 718168 - RNA, 19 nt, Homo sapiens
ggaagcugaggaagaagaa

SEQ ID NO: 718169 - RNA, 19 nt, Homo sapiens
cgaaagaccacauaaucca

SEQ ID NO: 718170 - RNA, 19 nt, Homo sapiens
cauugaugaugacgaaaga

SEQ ID NO: 718171 - RNA, 19 nt, Homo sapiens
aaugcugguucucaugaua

SEQ ID NO: 718172 - RNA, 19 nt, Homo sapiens
gguggagagucuaucuaug

SEQ ID NO: 718173 - RNA, 19 nt, Homo sapiens
aguugugccugguuucaua

SEQ ID NO: 718174 - RNA, 19 nt, Homo sapiens
guuuggaagcuuauuauga

SEQ ID NO: 718175 - RNA, 19 nt, Homo sapiens
ccaaagaagcuccuaaagc

SEQ ID NO: 718176 - RNA, 19 nt, Homo sapiens
agaacuugcuggaaaugug

SEQ ID NO: 718177 - RNA, 19 nt, Homo sapiens
cugaaccaguuuaaaucua

SEQ ID NO: 718178 - RNA, 19 nt, Homo sapiens
gaagcaacagucaaagaag

SEQ ID NO: 718179 - RNA, 19 nt, Homo sapiens
gucaugacuugcuuaagga

SEQ ID NO: 718180 - RNA, 19 nt, Homo sapiens
cgaguuagucagagcauga

SEQ ID NO: 718181 - RNA, 19 nt, Homo sapiens
cagaggaggaaguaaagaa

SEQ ID NO: 718182 - RNA, 19 nt, Homo sapiens
caacuuuguuuggaagcuu

SEQ ID NO: 718183 - RNA, 19 nt, Homo sapiens
cuggaaaugugccuacaau

SEQ ID NO: 718184 - RNA, 19 nt, Homo sapiens
gaaggagggaagaaagcaa

SEQ ID NO: 718185 - RNA, 19 nt, Homo sapiens
ggaagaagccccuccagau

SEQ ID NO: 718186 - RNA, 19 nt, Homo sapiens
ggaacaggguuuauacuaa

SEQ ID NO: 718187 - RNA, 19 nt, Homo sapiens
gaacugacaagcuuaguaa

SEQ ID NO: 718188 - RNA, 19 nt, Homo sapiens
guacgacaguguauuguaa

SEQ ID NO: 718189 - RNA, 19 nt, Homo sapiens
ugaaagaacugacaagcuu

SEQ ID NO: 718190 - RNA, 19 nt, Homo sapiens
gaacaggguuuauacuaag

SEQ ID NO: 718191 - RNA, 19 nt, Homo sapiens
gcaacacaaugagcacuua

SEQ ID NO: 718192 - RNA, 19 nt, Homo sapiens
ggaauaagcugcggcaagu

SEQ ID NO: 718193 - RNA, 19 nt, Homo sapiens
gagaagacaugcccacugu

SEQ ID NO: 718194 - RNA, 19 nt, Homo sapiens
gaauagccaugauuaacug

SEQ ID NO: 718195 - RNA, 19 nt, Homo sapiens
ggaauuggugucccuguua

SEQ ID NO: 718196 - RNA, 19 nt, Homo sapiens
gccauaaagugguauuaaa

SEQ ID NO: 718197 - RNA, 19 nt, Homo sapiens
gaacauugaaguccugauu

SEQ ID NO: 718198 - RNA, 19 nt, Homo sapiens
gaugugcuauuguaugauu

SEQ ID NO: 718199 - RNA, 19 nt, Homo sapiens
ggaacccuaugauuuacua

SEQ ID NO: 718200 - RNA, 19 nt, Homo sapiens
acaaugagcacuuaaguuu

SEQ ID NO: 718201 - RNA, 19 nt, Homo sapiens
agaccuggcuaucgaguua

SEQ ID NO: 718202 - RNA, 19 nt, Homo sapiens
gaaagaacugacaagcuua

SEQ ID NO: 718203 - RNA, 19 nt, Homo sapiens
gacaguguauuguaaauuc

SEQ ID NO: 718204 - RNA, 19 nt, Homo sapiens
cgaauagucuguauguuuc

SEQ ID NO: 718205 - RNA, 19 nt, Homo sapiens
uagauagacuggagccaua

SEQ ID NO: 718206 - RNA, 19 nt, Homo sapiens
ggaguuagauuuggaugug

SEQ ID NO: 718207 - RNA, 19 nt, Homo sapiens
gaaagaagggcacucacuu

SEQ ID NO: 718208 - RNA, 19 nt, Homo sapiens
gaagacaugcccacuguug

SEQ ID NO: 718209 - RNA, 19 nt, Homo sapiens
ggaacuaaauaaaggacuu

SEQ ID NO: 718210 - RNA, 19 nt, Homo sapiens
gauaacggccuauaggauu

SEQ ID NO: 718211 - RNA, 19 nt, Homo sapiens
gcuauuguaugauuacgaa

SEQ ID NO: 718212 - RNA, 19 nt, Homo sapiens
caucaucuauuuaggaguu

SEQ ID NO: 718213 - RNA, 19 nt, Homo sapiens
gcucuuagcauucugugua

SEQ ID NO: 718214 - RNA, 19 nt, Homo sapiens
gacuggagccauaaaguua

SEQ ID NO: 718215 - RNA, 19 nt, Homo sapiens
gcagaggcaguuuggaaua

SEQ ID NO: 718216 - RNA, 19 nt, Homo sapiens
gguaggaacuaaauaaagg

SEQ ID NO: 718217 - RNA, 19 nt, Homo sapiens
gaggguaggaacuaaauaa

SEQ ID NO: 718218 - RNA, 19 nt, Homo sapiens
ggagaauagccaugauuaa

SEQ ID NO: 718219 - RNA, 19 nt, Homo sapiens
gcacuacucucauuuugaa

SEQ ID NO: 718220 - RNA, 19 nt, Homo sapiens
ccagauaggagauuacuug

SEQ ID NO: 718221 - RNA, 19 nt, Homo sapiens
gaauggugccugacaaaug

SEQ ID NO: 718222 - RNA, 19 nt, Homo sapiens
gaaagccacgggauuguau

SEQ ID NO: 718223 - RNA, 19 nt, Homo sapiens
gggaacaggguuuauacua

SEQ ID NO: 718224 - RNA, 19 nt, Homo sapiens
guguaaaacuguacuguua

SEQ ID NO: 718225 - RNA, 19 nt, Homo sapiens
ggagauuacuuggacauag

SEQ ID NO: 718226 - RNA, 19 nt, Homo sapiens
cagaggcaguuuggaauaa

SEQ ID NO: 718227 - RNA, 19 nt, Homo sapiens
caagaaagccacgggauug

SEQ ID NO: 718228 - RNA, 19 nt, Homo sapiens
gaagaggguaggaacuaaa

SEQ ID NO: 718229 - RNA, 19 nt, Homo sapiens
guaaagcagugaugaagac

SEQ ID NO: 718230 - RNA, 19 nt, Homo sapiens
aauggugccugacaaauga

SEQ ID NO: 718231 - RNA, 19 nt, Homo sapiens
gauuuacuaugcagaugaa

SEQ ID NO: 718232 - RNA, 19 nt, Homo sapiens
ggguagagguagaaagguu

SEQ ID NO: 718233 - RNA, 19 nt, Homo sapiens
ugaagaggguaggaacuaa

SEQ ID NO: 718234 - RNA, 19 nt, Homo sapiens
gaauuggugucccuguuag

SEQ ID NO: 718235 - RNA, 19 nt, Homo sapiens
gaucuacacuuggauggau

SEQ ID NO: 718236 - RNA, 19 nt, Homo sapiens
ugaagacagugcagcagaa

SEQ ID NO: 718237 - RNA, 19 nt, Homo sapiens
gggugaaggaggaaucuua

SEQ ID NO: 718238 - RNA, 19 nt, Homo sapiens
gcacuaguuuuaucuggua

SEQ ID NO: 718239 - RNA, 19 nt, Homo sapiens
uaagaaggagccagagaaa

SEQ ID NO: 718240 - RNA, 19 nt, Homo sapiens
gaucugagaggcaguaaag

SEQ ID NO: 718241 - RNA, 19 nt, Homo sapiens
ggaaaggacacgugagagu

SEQ ID NO: 718242 - RNA, 19 nt, Homo sapiens
gccacgggauuguaugaaa

SEQ ID NO: 718243 - RNA, 19 nt, Homo sapiens
uggaugugcuauuguauga

SEQ ID NO: 718244 - RNA, 19 nt, Homo sapiens
gcgcaugagaccauauuaa

SEQ ID NO: 718245 - RNA, 19 nt, Homo sapiens
ccagcgaguugcagaucua

SEQ ID NO: 718246 - RNA, 19 nt, Homo sapiens
gguaguggcgugcaucuga

SEQ ID NO: 718247 - RNA, 19 nt, Homo sapiens
gccauaaaguuaauuugca

SEQ ID NO: 718248 - RNA, 19 nt, Homo sapiens
gcaguaaagcagugaugaa

SEQ ID NO: 718249 - RNA, 19 nt, Homo sapiens
gagauuggcagcaccaugu

SEQ ID NO: 718250 - RNA, 19 nt, Homo sapiens
gagccuagaucuggugcuu

SEQ ID NO: 718251 - RNA, 19 nt, Homo sapiens
gagguagaaagguuuaauu

SEQ ID NO: 718252 - RNA, 19 nt, Homo sapiens
guagagguagaaagguuua

SEQ ID NO: 718253 - RNA, 19 nt, Homo sapiens
ccacgggauuguaugaaau

SEQ ID NO: 718254 - RNA, 19 nt, Homo sapiens
acgaauagucuguauguuu

SEQ ID NO: 718255 - RNA, 19 nt, Homo sapiens
gcaugagaccauauuaaau

SEQ ID NO: 718256 - RNA, 19 nt, Homo sapiens
ucgcagaaguuccagauag

SEQ ID NO: 718257 - RNA, 19 nt, Homo sapiens
uaaaagaccuggcuaucga

SEQ ID NO: 718258 - RNA, 19 nt, Homo sapiens
ccauggcacuacucucauu

SEQ ID NO: 718259 - RNA, 19 nt, Homo sapiens
gagauaacggccuauagga

SEQ ID NO: 718260 - RNA, 19 nt, Homo sapiens
ggagauaacggccuauagg

SEQ ID NO: 718261 - RNA, 19 nt, Homo sapiens
ggugaaggaggaaucuuaa

SEQ ID NO: 718262 - RNA, 19 nt, Homo sapiens
aaagaagucuacccagaag

SEQ ID NO: 718263 - RNA, 19 nt, Homo sapiens
gagaauagccaugauuaac

SEQ ID NO: 718264 - RNA, 19 nt, Homo sapiens
uggagaauagccaugauua

SEQ ID NO: 718265 - RNA, 19 nt, Homo sapiens
cugcaaccuuggauaaauu

SEQ ID NO: 718266 - RNA, 19 nt, Homo sapiens
gcgugcaucugaucugaga

SEQ ID NO: 718267 - RNA, 19 nt, Homo sapiens
ggagccauaaaguuaauuu

SEQ ID NO: 718268 - RNA, 19 nt, Homo sapiens
uaaaagagcuuagaauggu

SEQ ID NO: 718269 - RNA, 19 nt, Homo sapiens
gagaagagccaaggacaag

SEQ ID NO: 718270 - RNA, 19 nt, Homo sapiens
ggagaagagccaaggacaa

SEQ ID NO: 718271 - RNA, 19 nt, Homo sapiens
ugaaggaggaaucuuaaga

SEQ ID NO: 718272 - RNA, 19 nt, Homo sapiens
gguguagacugcuguaugc

SEQ ID NO: 718273 - RNA, 19 nt, Homo sapiens
aacaugaguuuguggugua

SEQ ID NO: 718274 - RNA, 19 nt, Homo sapiens
gauuacgaauagucuguau

SEQ ID NO: 718275 - RNA, 19 nt, Homo sapiens
gacaaggucagguugaaug

SEQ ID NO: 718276 - RNA, 19 nt, Homo sapiens
cuggagaucugcaaaugga

SEQ ID NO: 718277 - RNA, 19 nt, Homo sapiens
aggaggaaauuaagaagga

SEQ ID NO: 718278 - RNA, 19 nt, Homo sapiens
gaacaggcaacacaaugag

SEQ ID NO: 718279 - RNA, 19 nt, Homo sapiens
cagcagaggcaguuuggaa

SEQ ID NO: 718280 - RNA, 19 nt, Homo sapiens
guuucaagcccuucuguaa

SEQ ID NO: 718281 - RNA, 19 nt, Homo sapiens
gcaauuaccccuccaaauc

SEQ ID NO: 718282 - RNA, 19 nt, Homo sapiens
uggaggagcguaugguuaa

SEQ ID NO: 718283 - RNA, 19 nt, Homo sapiens
gagauuacuuggacauagc

SEQ ID NO: 718284 - RNA, 19 nt, Homo sapiens
uaaagaacaggcaacacaa

SEQ ID NO: 718285 - RNA, 19 nt, Homo sapiens
caggguaccaugacauaaa

SEQ ID NO: 718286 - RNA, 19 nt, Homo sapiens
gcacuuagaugaauuauug

SEQ ID NO: 718287 - RNA, 19 nt, Homo sapiens
ccaaauacaugcauagaaa

SEQ ID NO: 718288 - RNA, 19 nt, Homo sapiens
caacagagccuauucuaaa

SEQ ID NO: 718289 - RNA, 19 nt, Homo sapiens
caagauaccucuaaauaca

SEQ ID NO: 718290 - RNA, 19 nt, Homo sapiens
cugcagggcuuuacauuua

SEQ ID NO: 718291 - RNA, 19 nt, Homo sapiens
gcuuugaacuugacacaua

SEQ ID NO: 718292 - RNA, 19 nt, Homo sapiens
ggaaagagaggaccagaaa

SEQ ID NO: 718293 - RNA, 19 nt, Homo sapiens
acacaaggcuaaauuaaug

SEQ ID NO: 718294 - RNA, 19 nt, Homo sapiens
gaaaagggucuuccuauua

SEQ ID NO: 718295 - RNA, 19 nt, Homo sapiens
gcaacaaacccaugucaaa

SEQ ID NO: 718296 - RNA, 19 nt, Homo sapiens
guaggaaccuguggaauug

SEQ ID NO: 718297 - RNA, 19 nt, Homo sapiens
ggagauagaugaagaaaau

SEQ ID NO: 718298 - RNA, 19 nt, Homo sapiens
gaaaguaggagacaagugu

SEQ ID NO: 718299 - RNA, 19 nt, Homo sapiens
ccaaagaccuucugucaac

SEQ ID NO: 718300 - RNA, 19 nt, Homo sapiens
ggaggacaguggcaacaaa

SEQ ID NO: 718301 - RNA, 19 nt, Homo sapiens
gcaaguugaagcugcauua

SEQ ID NO: 718302 - RNA, 19 nt, Homo sapiens
gaacuugacacauacucua

SEQ ID NO: 718303 - RNA, 19 nt, Homo sapiens
gaagcugcauuaucuggaa

SEQ ID NO: 718304 - RNA, 19 nt, Homo sapiens
ccucaagccuguagaagaa

SEQ ID NO: 718305 - RNA, 19 nt, Homo sapiens
gagugugacugguaaaguu

SEQ ID NO: 718306 - RNA, 19 nt, Homo sapiens
caagaugucagaggauuua

SEQ ID NO: 718307 - RNA, 19 nt, Homo sapiens
gacgauaauuucccuguau

SEQ ID NO: 718308 - RNA, 19 nt, Homo sapiens
gaagauggacaguguuaug

SEQ ID NO: 718309 - RNA, 19 nt, Homo sapiens
gaguugaguuuaagccaaa

SEQ ID NO: 718310 - RNA, 19 nt, Homo sapiens
aaacuuagcugucguucag

SEQ ID NO: 718311 - RNA, 19 nt, Homo sapiens
gaaugaaacgugaagaaau

SEQ ID NO: 718312 - RNA, 19 nt, Homo sapiens
gagugaagauggacagugu

SEQ ID NO: 718313 - RNA, 19 nt, Homo sapiens
gaugugugauguuuauaug

SEQ ID NO: 718314 - RNA, 19 nt, Homo sapiens
aaagugaaauggcaacaau

SEQ ID NO: 718315 - RNA, 19 nt, Homo sapiens
ucacaguuauccugaguug

SEQ ID NO: 718316 - RNA, 19 nt, Homo sapiens
aaaagggucuuccuauuaa

SEQ ID NO: 718317 - RNA, 19 nt, Homo sapiens
ggauguguauuauuucagu

SEQ ID NO: 718318 - RNA, 19 nt, Homo sapiens
gacacauacucuagcaauu

SEQ ID NO: 718319 - RNA, 19 nt, Homo sapiens
uauccugaguugaguuuaa

SEQ ID NO: 718320 - RNA, 19 nt, Homo sapiens
cagguugucugcauuuguu

SEQ ID NO: 718321 - RNA, 19 nt, Homo sapiens
aauaucaggcgccuacuua

SEQ ID NO: 718322 - RNA, 19 nt, Homo sapiens
gugaagauggacaguguua

SEQ ID NO: 718323 - RNA, 19 nt, Homo sapiens
uaagccaaauacaugcaua

SEQ ID NO: 718324 - RNA, 19 nt, Homo sapiens
gaucagguugucugcauuu

SEQ ID NO: 718325 - RNA, 19 nt, Homo sapiens
gaaccucaagccuguagaa

SEQ ID NO: 718326 - RNA, 19 nt, Homo sapiens
gagaggaccagaaagugaa

SEQ ID NO: 718327 - RNA, 19 nt, Homo sapiens
caaucaccuuugcugguua

SEQ ID NO: 718328 - RNA, 19 nt, Homo sapiens
gaacaucaucacaguuauc

SEQ ID NO: 718329 - RNA, 19 nt, Homo sapiens
ugacgauaauuucccugua

SEQ ID NO: 718330 - RNA, 19 nt, Homo sapiens
gcugauguauagcccugua

SEQ ID NO: 718331 - RNA, 19 nt, Homo sapiens
ucagaugcuuugaacuuga

SEQ ID NO: 718332 - RNA, 19 nt, Homo sapiens
ccuguggaauugcugauaa

SEQ ID NO: 718333 - RNA, 19 nt, Homo sapiens
ccagcagcgugaauauaaa

SEQ ID NO: 718334 - RNA, 19 nt, Homo sapiens
gauggacaguguuaugaag

SEQ ID NO: 718335 - RNA, 19 nt, Homo sapiens
acgauaauuucccuguaua

SEQ ID NO: 718336 - RNA, 19 nt, Homo sapiens
cagguaaagaggaguauuu

SEQ ID NO: 718337 - RNA, 19 nt, Homo sapiens
gcucagcuccagcaaguug

SEQ ID NO: 718338 - RNA, 19 nt, Homo sapiens
cugagacgcuugcaaguuc

SEQ ID NO: 718339 - RNA, 19 nt, Homo sapiens
cacaagaugucagaggauu

SEQ ID NO: 718340 - RNA, 19 nt, Homo sapiens
ggaugugugauguuuauau

SEQ ID NO: 718341 - RNA, 19 nt, Homo sapiens
cggcagugguaccauguuu

SEQ ID NO: 718342 - RNA, 19 nt, Homo sapiens
gaaagugaaauggcaacaa

SEQ ID NO: 718343 - RNA, 19 nt, Homo sapiens
guuaugaagcggagauuga

SEQ ID NO: 718344 - RNA, 19 nt, Homo sapiens
auacagcacuuagaugaau

SEQ ID NO: 718345 - RNA, 19 nt, Homo sapiens
uugguuggcuucaguagaa

SEQ ID NO: 718346 - RNA, 19 nt, Homo sapiens
ggaguaggaaccuguggaa

SEQ ID NO: 718347 - RNA, 19 nt, Homo sapiens
aagcggagauugaggagau

SEQ ID NO: 718348 - RNA, 19 nt, Homo sapiens
gugcauuaaucugacgaua

SEQ ID NO: 718349 - RNA, 19 nt, Homo sapiens
cacauacucuagcaauuca

SEQ ID NO: 718350 - RNA, 19 nt, Homo sapiens
aaagagaggaccagaaagu

SEQ ID NO: 718351 - RNA, 19 nt, Homo sapiens
cccagcagcgugaauauaa

SEQ ID NO: 718352 - RNA, 19 nt, Homo sapiens
gaugagcucccuuuucuaa

SEQ ID NO: 718353 - RNA, 19 nt, Homo sapiens
uaagcaagauaccauuguc

SEQ ID NO: 718354 - RNA, 19 nt, Homo sapiens
gcaacaauucaacaacaga

SEQ ID NO: 718355 - RNA, 19 nt, Homo sapiens
gaaauggcaacaauucaac

SEQ ID NO: 718356 - RNA, 19 nt, Homo sapiens
cuacucaaccuacucauuc

SEQ ID NO: 718357 - RNA, 19 nt, Homo sapiens
ugauaaaccuaugacacaa

SEQ ID NO: 718358 - RNA, 19 nt, Homo sapiens
gaauugcugauaaaccuau

SEQ ID NO: 718359 - RNA, 19 nt, Homo sapiens
uuaauuagaucagguuguc

SEQ ID NO: 718360 - RNA, 19 nt, Homo sapiens
aguugaagcugcauuaucu

SEQ ID NO: 718361 - RNA, 19 nt, Homo sapiens
caucacaguuauccugagu

SEQ ID NO: 718362 - RNA, 19 nt, Homo sapiens
uagaugaguaagcaagaua

SEQ ID NO: 718363 - RNA, 19 nt, Homo sapiens
gggcuuuacauuuaccuuu

SEQ ID NO: 718364 - RNA, 19 nt, Homo sapiens
gauaaaccuaugacacaau

SEQ ID NO: 718365 - RNA, 19 nt, Homo sapiens
uggcaacaauucaacaaca

SEQ ID NO: 718366 - RNA, 19 nt, Homo sapiens
ugucagaggauuuagcaaa

SEQ ID NO: 718367 - RNA, 19 nt, Homo sapiens
agaaugaaacgugaagaaa

SEQ ID NO: 718368 - RNA, 19 nt, Homo sapiens
aguaggaaccuguggaauu

SEQ ID NO: 718369 - RNA, 19 nt, Homo sapiens
uugaggagauagaugaaga

SEQ ID NO: 718370 - RNA, 19 nt, Homo sapiens
agaaaagggucuuccuauu

SEQ ID NO: 718371 - RNA, 19 nt, Homo sapiens
gccaaauacaugcauagaa

SEQ ID NO: 718372 - RNA, 19 nt, Homo sapiens
uguagaugcuguuucauac

SEQ ID NO: 718373 - RNA, 19 nt, Homo sapiens
uagaaugaaacgugaagaa

SEQ ID NO: 718374 - RNA, 19 nt, Homo sapiens
ggaauugcugauaaaccua

SEQ ID NO: 718375 - RNA, 19 nt, Homo sapiens
ugguaaaguuggaguagga

SEQ ID NO: 718376 - RNA, 19 nt, Homo sapiens
cugagagugugacugguaa

SEQ ID NO: 718377 - RNA, 19 nt, Homo sapiens
uagaucagguugucugcau

SEQ ID NO: 718378 - RNA, 19 nt, Homo sapiens
acaccaaccugcuaaaaga

SEQ ID NO: 718379 - RNA, 19 nt, Homo sapiens
ugacacauacucuagcaau

SEQ ID NO: 718380 - RNA, 19 nt, Homo sapiens
guaagcaagauaccauugu

SEQ ID NO: 718381 - RNA, 19 nt, Homo sapiens
ucaagauaccucuaaauac

SEQ ID NO: 718382 - RNA, 19 nt, Homo sapiens
acaacagagccuauucuaa

SEQ ID NO: 718383 - RNA, 19 nt, Homo sapiens
caacaacagagccuauucu

SEQ ID NO: 718384 - RNA, 19 nt, Homo sapiens
gaccuucugucaacucaac

SEQ ID NO: 718385 - RNA, 19 nt, Homo sapiens
gucagaggauuuagcaaag

SEQ ID NO: 718386 - RNA, 19 nt, Homo sapiens
ccaaacaacuucagaaaga

SEQ ID NO: 718387 - RNA, 19 nt, Homo sapiens
gcaagaauguguaaacaau

SEQ ID NO: 718388 - RNA, 19 nt, Homo sapiens
ugagagaaauggagucaaa

SEQ ID NO: 718389 - RNA, 19 nt, Homo sapiens
gauuuaaacuggcagagaa

SEQ ID NO: 718390 - RNA, 19 nt, Homo sapiens
ggaggaaacucgcagauac

SEQ ID NO: 718391 - RNA, 19 nt, Homo sapiens
gguguaggcugcuguggua

SEQ ID NO: 718392 - RNA, 19 nt, Homo sapiens
ggaucuaaauugagagaaa

SEQ ID NO: 718393 - RNA, 19 nt, Homo sapiens
gcagauaccgaccuacuaa

SEQ ID NO: 718394 - RNA, 19 nt, Homo sapiens
uggaugcgcugccguauuu

SEQ ID NO: 718395 - RNA, 19 nt, Homo sapiens
ggguaucccuggucaguaa

SEQ ID NO: 718396 - RNA, 19 nt, Homo sapiens
gaaacugacauaaugagaa

SEQ ID NO: 718397 - RNA, 19 nt, Homo sapiens
ugaacuagauguaugugaa

SEQ ID NO: 718398 - RNA, 19 nt, Homo sapiens
cuaaacacauucuugauca

SEQ ID NO: 718399 - RNA, 19 nt, Homo sapiens
uguaaugccuggaaaguau

SEQ ID NO: 718400 - RNA, 19 nt, Homo sapiens
gagauugaacggacuauug

SEQ ID NO: 718401 - RNA, 19 nt, Homo sapiens
ggauuauucugccuuugaa

SEQ ID NO: 718402 - RNA, 19 nt, Homo sapiens
gagaaauggagucaaauug

SEQ ID NO: 718403 - RNA, 19 nt, Homo sapiens
gcaucaagcaguuagaauu

SEQ ID NO: 718404 - RNA, 19 nt, Homo sapiens
ggacuauuguucagcuaga

SEQ ID NO: 718405 - RNA, 19 nt, Homo sapiens
acucacagcuggaucuaaa

SEQ ID NO: 718406 - RNA, 19 nt, Homo sapiens
caauuuagcagguagaaga

SEQ ID NO: 718407 - RNA, 19 nt, Homo sapiens
uuagguagaugaacuagau

SEQ ID NO: 718408 - RNA, 19 nt, Homo sapiens
agagauaguucuaaacaca

SEQ ID NO: 718409 - RNA, 19 nt, Homo sapiens
uacaggaaguuggaaauuu

SEQ ID NO: 718410 - RNA, 19 nt, Homo sapiens
uagaugaacuagauguaug

SEQ ID NO: 718411 - RNA, 19 nt, Homo sapiens
caaauuaagcagcaacaug

SEQ ID NO: 718412 - RNA, 19 nt, Homo sapiens
ccauugauguuuaaguguu

SEQ ID NO: 718413 - RNA, 19 nt, Homo sapiens
ccuggaaaguauacaauga

SEQ ID NO: 718414 - RNA, 19 nt, Homo sapiens
agaaagaacaugcaacuca

SEQ ID NO: 718415 - RNA, 19 nt, Homo sapiens
gaacuagauguaugugaau

SEQ ID NO: 718416 - RNA, 19 nt, Homo sapiens
caucaucgucaucaucaua

SEQ ID NO: 718417 - RNA, 19 nt, Homo sapiens
guaggcugcugugguaauu

SEQ ID NO: 718418 - RNA, 19 nt, Homo sapiens
aaagacaauuuagcaggua

SEQ ID NO: 718419 - RNA, 19 nt, Homo sapiens
acagcuggaucuaaauuga

SEQ ID NO: 718420 - RNA, 19 nt, Homo sapiens
caucaagcaguuagaauug

SEQ ID NO: 718421 - RNA, 19 nt, Homo sapiens
acaauucuauggcccaguu

SEQ ID NO: 718422 - RNA, 19 nt, Homo sapiens
gaaacgauaugagcuucca

SEQ ID NO: 718423 - RNA, 19 nt, Homo sapiens
guucuaaacacauucuuga

SEQ ID NO: 718424 - RNA, 19 nt, Homo sapiens
guacaggaaguuggaaauu

SEQ ID NO: 718425 - RNA, 19 nt, Homo sapiens
guuagagcaucaagcaguu

SEQ ID NO: 718426 - RNA, 19 nt, Homo sapiens
cuuugaaacugacauaaug

SEQ ID NO: 718427 - RNA, 19 nt, Homo sapiens
ggagaggcaaacaaagaaa

SEQ ID NO: 718428 - RNA, 19 nt, Homo sapiens
gauaccgaccuacuaagaa

SEQ ID NO: 718429 - RNA, 19 nt, Homo sapiens
gaacacuuuagguagauga

SEQ ID NO: 718430 - RNA, 19 nt, Homo sapiens
ucugaacacuuuagguaga

SEQ ID NO: 718431 - RNA, 19 nt, Homo sapiens
gcagagaaagaacaugcaa

SEQ ID NO: 718432 - RNA, 19 nt, Homo sapiens
gagaaucuggaacuaaugu

SEQ ID NO: 718433 - RNA, 19 nt, Homo sapiens
guaaugccuggaaaguaua

SEQ ID NO: 718434 - RNA, 19 nt, Homo sapiens
guagaugaacuagauguau

SEQ ID NO: 718435 - RNA, 19 nt, Homo sapiens
caccaaacaacuucagaaa

SEQ ID NO: 718436 - RNA, 19 nt, Homo sapiens
uugagaaucuggaacuaau

SEQ ID NO: 718437 - RNA, 19 nt, Homo sapiens
gaauugagaaucuggaacu

SEQ ID NO: 718438 - RNA, 19 nt, Homo sapiens
gcaguuagaauugagaauc

SEQ ID NO: 718439 - RNA, 19 nt, Homo sapiens
gguagaugaacuagaugua

SEQ ID NO: 718440 - RNA, 19 nt, Homo sapiens
ucacagcuggaucuaaauu

SEQ ID NO: 718441 - RNA, 19 nt, Homo sapiens
uaaacuggcagagaaagaa

SEQ ID NO: 718442 - RNA, 19 nt, Homo sapiens
gagcaucaagcaguuagaa

SEQ ID NO: 718443 - RNA, 19 nt, Homo sapiens
aaccauugauguuuaagug

SEQ ID NO: 718444 - RNA, 19 nt, Homo sapiens
acaacagcaucuucccaaa

SEQ ID NO: 718445 - RNA, 19 nt, Homo sapiens
agagaaauggagucaaauu

SEQ ID NO: 718446 - RNA, 19 nt, Homo sapiens
gaaucuggaacuaauguca

SEQ ID NO: 718447 - RNA, 19 nt, Homo sapiens
gguuuaugacuuugucuaa

SEQ ID NO: 718448 - RNA, 19 nt, Homo sapiens
acaggaaguuggaaauuuu

SEQ ID NO: 718449 - RNA, 19 nt, Homo sapiens
ucagccauguggaccauau

SEQ ID NO: 718450 - RNA, 19 nt, Homo sapiens
gcagguagaagaaaaguug

SEQ ID NO: 718451 - RNA, 19 nt, Homo sapiens
ugucacagcauggauguaa

SEQ ID NO: 718452 - RNA, 19 nt, Homo sapiens
aagacuggcugcucgacaa

SEQ ID NO: 718453 - RNA, 19 nt, Homo sapiens
gaccauauuuuguauccaa

SEQ ID NO: 718454 - RNA, 19 nt, Homo sapiens
aaugaacugugaaggacaa

SEQ ID NO: 718455 - RNA, 19 nt, Homo sapiens
gcauggcaagaauguguaa

SEQ ID NO: 718456 - RNA, 19 nt, Homo sapiens
gaauugcucaguaugaaac

SEQ ID NO: 718457 - RNA, 19 nt, Homo sapiens
gcucgacaaccaauugaau

SEQ ID NO: 718458 - RNA, 19 nt, Homo sapiens
aaacauccggcaagacuuc

SEQ ID NO: 718459 - RNA, 19 nt, Homo sapiens
ccaguuagagcaucaagca

SEQ ID NO: 718460 - RNA, 19 nt, Homo sapiens
gaaaucauagaagguguag

SEQ ID NO: 718461 - RNA, 19 nt, Homo sapiens
caguuagaauugagaaucu

SEQ ID NO: 718462 - RNA, 19 nt, Homo sapiens
ggcaagaauguguaaacaa

SEQ ID NO: 718463 - RNA, 19 nt, Homo sapiens
uugaauugcucaguaugaa

SEQ ID NO: 718464 - RNA, 19 nt, Homo sapiens
cggauuauucugccuuuga

SEQ ID NO: 718465 - RNA, 19 nt, Homo sapiens
caaacaacuucagaaagac

SEQ ID NO: 718466 - RNA, 19 nt, Homo sapiens
acacauucuugaucaccaa

SEQ ID NO: 718467 - RNA, 19 nt, Homo sapiens
gaaaacauccggcaagacu

SEQ ID NO: 718468 - RNA, 19 nt, Homo sapiens
ggagucaaauuggguaucc

SEQ ID NO: 718469 - RNA, 19 nt, Homo sapiens
ucacagcauggauguaaug

SEQ ID NO: 718470 - RNA, 19 nt, Homo sapiens
ucaccaaacaacuucagaa

SEQ ID NO: 718471 - RNA, 19 nt, Homo sapiens
gcugugguaauucuauuug

SEQ ID NO: 718472 - RNA, 19 nt, Homo sapiens
uuugguggcuggagagguu

SEQ ID NO: 718473 - RNA, 19 nt, Homo sapiens
agaaauggagucaaauugg

SEQ ID NO: 718474 - RNA, 19 nt, Homo sapiens
gcaacucacagcuggaucu

SEQ ID NO: 718475 - RNA, 19 nt, Homo sapiens
gauguaaugccuggaaagu

SEQ ID NO: 718476 - RNA, 19 nt, Homo sapiens
uggcaagaauguguaaaca

SEQ ID NO: 718477 - RNA, 19 nt, Homo sapiens
caacauggagaggcaaaca

SEQ ID NO: 718478 - RNA, 19 nt, Homo sapiens
gacuauuguucagcuagaa

SEQ ID NO: 718479 - RNA, 19 nt, Homo sapiens
ugauugaacacgcacagaa

SEQ ID NO: 718480 - RNA, 19 nt, Homo sapiens
agaaaucauagaaggugua

SEQ ID NO: 718481 - RNA, 19 nt, Homo sapiens
acauggagaggcaaacaaa

SEQ ID NO: 718482 - RNA, 19 nt, Homo sapiens
ugaauugcucaguaugaaa

SEQ ID NO: 718483 - RNA, 19 nt, Homo sapiens
caacucacagcuggaucua

SEQ ID NO: 718484 - RNA, 19 nt, Homo sapiens
cuaagaacuaccugagcua

SEQ ID NO: 718485 - RNA, 19 nt, Homo sapiens
acucgcagauaccgaccua

SEQ ID NO: 718486 - RNA, 19 nt, Homo sapiens
gaacucagaaccagauuua

SEQ ID NO: 718487 - RNA, 19 nt, Homo sapiens
ggaaacauguccuuacuag

SEQ ID NO: 718488 - RNA, 19 nt, Homo sapiens
gggagggcaucaacaagaa

SEQ ID NO: 718489 - RNA, 19 nt, Homo sapiens
aaacauguccuuacuaggu

SEQ ID NO: 718490 - RNA, 19 nt, Homo sapiens
ucaauguccagucaugaua

SEQ ID NO: 718491 - RNA, 19 nt, Homo sapiens
acgcgcagcugcagaucua

SEQ ID NO: 718492 - RNA, 19 nt, Homo sapiens
ucagaauccugcacucaag

SEQ ID NO: 718493 - RNA, 19 nt, Homo sapiens
gaaucaaacacagaacuca

SEQ ID NO: 718494 - RNA, 19 nt, Homo sapiens
aggcgaggcucaucuacga

SEQ ID NO: 718495 - RNA, 19 nt, Homo sapiens
guacagcgaggagaacaug

SEQ ID NO: 718496 - RNA, 19 nt, Homo sapiens
caagguggcaggacccaau

SEQ ID NO: 718497 - RNA, 19 nt, Homo sapiens
gaaccuccgcaucguguag

SEQ ID NO: 718498 - RNA, 19 nt, Homo sapiens
ucaaacacagaacucagaa

SEQ ID NO: 718499 - RNA, 19 nt, Homo sapiens
gagggcaucaacaagaaga

SEQ ID NO: 718500 - RNA, 19 nt, Homo sapiens
gcgaggagaacaugcucuu

SEQ ID NO: 718501 - RNA, 19 nt, Homo sapiens
cagaguacagcgaggagaa

SEQ ID NO: 718502 - RNA, 19 nt, Homo sapiens
gcagaucuacacgcucaug

SEQ ID NO: 718503 - RNA, 19 nt, Homo sapiens
cgggagggcaucaacaaga

SEQ ID NO: 718504 - RNA, 19 nt, Homo sapiens
agaaggcgaggcucaucua

SEQ ID NO: 718505 - RNA, 19 nt, Homo sapiens
uggguucccuucagguguu

SEQ ID NO: 718506 - RNA, 19 nt, Homo sapiens
gagaaggcgaggcucaucu

SEQ ID NO: 718507 - RNA, 19 nt, Homo sapiens
agagcugggcgcagucuuu

SEQ ID NO: 718508 - RNA, 19 nt, Homo sapiens
cuuacuagguguuuuauca

SEQ ID NO: 718509 - RNA, 19 nt, Homo sapiens
cuggaaacauguccuuacu

SEQ ID NO: 718510 - RNA, 19 nt, Homo sapiens
ccuucaauguccagucaug

SEQ ID NO: 718511 - RNA, 19 nt, Homo sapiens
gcaacagacuucucaauaa

SEQ ID NO: 718512 - RNA, 19 nt, Homo sapiens
gaccagagcuugugaagaa

SEQ ID NO: 718513 - RNA, 19 nt, Homo sapiens
caacagacuucucaauaaa

SEQ ID NO: 718514 - RNA, 19 nt, Homo sapiens
ggacaucgacccagagaaa

SEQ ID NO: 718515 - RNA, 19 nt, Homo sapiens
cgauauggcugucaguauu

SEQ ID NO: 718516 - RNA, 19 nt, Homo sapiens
gauauggcugucaguauua

SEQ ID NO: 718517 - RNA, 19 nt, Homo sapiens
gcagucgaaauaacuaaua

SEQ ID NO: 718518 - RNA, 19 nt, Homo sapiens
gaacacacagggcgauaug

SEQ ID NO: 718519 - RNA, 19 nt, Homo sapiens
caaagaccaugaggagaug

SEQ ID NO: 718520 - RNA, 19 nt, Homo sapiens
acacgaauauccuaaguac

SEQ ID NO: 718521 - RNA, 19 nt, Homo sapiens
gugcuaugguuaugacuug

SEQ ID NO: 718522 - RNA, 19 nt, Homo sapiens
gaagaugaacacccacaau

SEQ ID NO: 718523 - RNA, 19 nt, Homo sapiens
gaacgugacccugcugugu

SEQ ID NO: 718524 - RNA, 19 nt, Homo sapiens
cuaaguaccaggcugaauu

SEQ ID NO: 718525 - RNA, 19 nt, Homo sapiens
gcacacccuucaucucagu

SEQ ID NO: 718526 - RNA, 19 nt, Homo sapiens
gacuugaacucucccuaug

SEQ ID NO: 718527 - RNA, 19 nt, Homo sapiens
gaacuuugggacucacuug

SEQ ID NO: 718528 - RNA, 19 nt, Homo sapiens
ggcaaacacuggacaucga

SEQ ID NO: 718529 - RNA, 19 nt, Homo sapiens
uaaggaaggagaagaugaa

SEQ ID NO: 718530 - RNA, 19 nt, Homo sapiens
ggaguaccgucuauauagg

SEQ ID NO: 718531 - RNA, 19 nt, Homo sapiens
uaaagcaacagacuucuca

SEQ ID NO: 718532 - RNA, 19 nt, Homo sapiens
ggacacacagccugaagau

SEQ ID NO: 718533 - RNA, 19 nt, Homo sapiens
caggaguaccgucuauaua

SEQ ID NO: 718534 - RNA, 19 nt, Homo sapiens
guaaggaaggagaagauga

SEQ ID NO: 718535 - RNA, 19 nt, Homo sapiens
gcauuuggcggcuucauuc

SEQ ID NO: 718536 - RNA, 19 nt, Homo sapiens
ggcggcaguuccacacuuu

SEQ ID NO: 718537 - RNA, 19 nt, Homo sapiens
uaagaagccaucacucuca

SEQ ID NO: 718538 - RNA, 19 nt, Homo sapiens
ucucugaugucggcuauga

SEQ ID NO: 718539 - RNA, 19 nt, Homo sapiens
gcagacuccacacucagua

SEQ ID NO: 718540 - RNA, 19 nt, Homo sapiens
acacuuuccuucugaccaa

SEQ ID NO: 718541 - RNA, 19 nt, Homo sapiens
ggaaggagaagaugaacac

SEQ ID NO: 718542 - RNA, 19 nt, Homo sapiens
ccaggaguaccgucuauau

SEQ ID NO: 718543 - RNA, 19 nt, Homo sapiens
gcccaggaguaccgucuau

SEQ ID NO: 718544 - RNA, 19 nt, Homo sapiens
acaaagaccaugaggagau

SEQ ID NO: 718545 - RNA, 19 nt, Homo sapiens
gcggcuucauucuguguaa

SEQ ID NO: 718546 - RNA, 19 nt, Homo sapiens
agcaacagacuucucaaua

SEQ ID NO: 718547 - RNA, 19 nt, Homo sapiens
ucaauacacgaauauccua

SEQ ID NO: 718548 - RNA, 19 nt, Homo sapiens
gacaggagccuacccaaaa

SEQ ID NO: 718549 - RNA, 19 nt, Homo sapiens
ugacaggagccuacccaaa

SEQ ID NO: 718550 - RNA, 19 nt, Homo sapiens
gaggagaugcugggaacuu

SEQ ID NO: 718551 - RNA, 19 nt, Homo sapiens
gcgauauggcugucaguau

SEQ ID NO: 718552 - RNA, 19 nt, Homo sapiens
caauacacgaauauccuaa

SEQ ID NO: 718553 - RNA, 19 nt, Homo sapiens
ggagaugcugggaacuuug

SEQ ID NO: 718554 - RNA, 19 nt, Homo sapiens
aggagaugcugggaacuuu

SEQ ID NO: 718555 - RNA, 19 nt, Homo sapiens
ucuaagaucaauacacgaa

SEQ ID NO: 718556 - RNA, 19 nt, Homo sapiens
ggucccagguguuucuaag

SEQ ID NO: 718557 - RNA, 19 nt, Homo sapiens
gaaggacacacagccugaa

SEQ ID NO: 718558 - RNA, 19 nt, Homo sapiens
uaaguaccaggcugaauuc

SEQ ID NO: 718559 - RNA, 19 nt, Homo sapiens
cuugaacucucccuaugug

SEQ ID NO: 718560 - RNA, 19 nt, Homo sapiens
aaaagcaggucgucucguu

SEQ ID NO: 718561 - RNA, 19 nt, Homo sapiens
ugauucugcagucgaaaua

SEQ ID NO: 718562 - RNA, 19 nt, Homo sapiens
ccucuaugcugccgugaag

SEQ ID NO: 718563 - RNA, 19 nt, Homo sapiens
ugacuugaacucucccuau

SEQ ID NO: 718564 - RNA, 19 nt, Homo sapiens
ggaacacacagggcgauau

SEQ ID NO: 718565 - RNA, 19 nt, Homo sapiens
cuuugggacucacuugauu

SEQ ID NO: 718566 - RNA, 19 nt, Homo sapiens
guuccacacuuuccuucug

SEQ ID NO: 718567 - RNA, 19 nt, Homo sapiens
aagaugaacacccacaaug

SEQ ID NO: 718568 - RNA, 19 nt, Homo sapiens
agucacagguggcauuugg

SEQ ID NO: 718569 - RNA, 19 nt, Homo sapiens
ggucgucucguuccaaucu

SEQ ID NO: 718570 - RNA, 19 nt, Homo sapiens
gaucaauacacgaauaucc

SEQ ID NO: 718571 - RNA, 19 nt, Homo sapiens
gcaguuccacacuuuccuu

SEQ ID NO: 718572 - RNA, 19 nt, Homo sapiens
gcaccgagggcucauccau

SEQ ID NO: 718573 - RNA, 19 nt, Homo sapiens
acaguggccucaggagaga

SEQ ID NO: 718574 - RNA, 19 nt, Homo sapiens
uggcacacccuucaucuca

SEQ ID NO: 718575 - RNA, 19 nt, Homo sapiens
caggucgucucguuccaau

SEQ ID NO: 718576 - RNA, 19 nt, Homo sapiens
acgaauauccuaaguacca

SEQ ID NO: 718577 - RNA, 19 nt, Homo sapiens
aggaguaccgucuauauag

SEQ ID NO: 718578 - RNA, 19 nt, Homo sapiens
aaaggcugauuuccaacau

SEQ ID NO: 718579 - RNA, 19 nt, Homo sapiens
auacacgaauauccuaagu

SEQ ID NO: 718580 - RNA, 19 nt, Homo sapiens
aauuaaagcaacagacuuc

SEQ ID NO: 718581 - RNA, 19 nt, Homo sapiens
gccugacccuccagugugu

SEQ ID NO: 718582 - RNA, 19 nt, Homo sapiens
ggcauuuggcggcuucauu

SEQ ID NO: 718583 - RNA, 19 nt, Homo sapiens
cgucucugcugaucugagu

SEQ ID NO: 718584 - RNA, 19 nt, Homo sapiens
gggaacacacagggcgaua

SEQ ID NO: 718585 - RNA, 19 nt, Homo sapiens
gcuaugguuaugacuugaa

SEQ ID NO: 718586 - RNA, 19 nt, Homo sapiens
gccuugaagcccaggagua

SEQ ID NO: 718587 - RNA, 19 nt, Homo sapiens
gagaugcugggaacuuugg

SEQ ID NO: 718588 - RNA, 19 nt, Homo sapiens
ucuaagaagccaucacucu

SEQ ID NO: 718589 - RNA, 19 nt, Homo sapiens
ggauacgaccagagcuugu

SEQ ID NO: 718590 - RNA, 19 nt, Homo sapiens
ccacuccgucuaagaucaa

SEQ ID NO: 718591 - RNA, 19 nt, Homo sapiens
uuccacacuuuccuucuga

SEQ ID NO: 718592 - RNA, 19 nt, Homo sapiens
gauacgaccagagcuugug

SEQ ID NO: 718593 - RNA, 19 nt, Homo sapiens
ggcgauauggcugucagua

SEQ ID NO: 718594 - RNA, 19 nt, Homo sapiens
gcaguaagaugguaacaaa

SEQ ID NO: 718595 - RNA, 19 nt, Homo sapiens
gaaagacacugacuacugu

SEQ ID NO: 718596 - RNA, 19 nt, Homo sapiens
gaaaugauucccugcagua

SEQ ID NO: 718597 - RNA, 19 nt, Homo sapiens
cguugcagcuuaacaauaa

SEQ ID NO: 718598 - RNA, 19 nt, Homo sapiens
ccauguacguugcagcuua

SEQ ID NO: 718599 - RNA, 19 nt, Homo sapiens
auucacaucugcaugauua

SEQ ID NO: 718600 - RNA, 19 nt, Homo sapiens
gcaauuaugcucccaaauc

SEQ ID NO: 718601 - RNA, 19 nt, Homo sapiens
gaaucuuugugagcaauua

SEQ ID NO: 718602 - RNA, 19 nt, Homo sapiens
aaauuugccuguaauggua

SEQ ID NO: 718603 - RNA, 19 nt, Homo sapiens
ggacugaggauuacauuca

SEQ ID NO: 718604 - RNA, 19 nt, Homo sapiens
caacggaacggcagaaaga

SEQ ID NO: 718605 - RNA, 19 nt, Homo sapiens
uaagguucauggauucuaa

SEQ ID NO: 718606 - RNA, 19 nt, Homo sapiens
gaaauuugccuguaauggu

SEQ ID NO: 718607 - RNA, 19 nt, Homo sapiens
gauugaacauccugaauac

SEQ ID NO: 718608 - RNA, 19 nt, Homo sapiens
caauuaugcucccaaaucu

SEQ ID NO: 718609 - RNA, 19 nt, Homo sapiens
guaaugguacugugauuga

SEQ ID NO: 718610 - RNA, 19 nt, Homo sapiens
gcgaagguuuucuuauuua

SEQ ID NO: 718611 - RNA, 19 nt, Homo sapiens
cggcagggacugaggauua

SEQ ID NO: 718612 - RNA, 19 nt, Homo sapiens
guaaaggaggaacagcuua

SEQ ID NO: 718613 - RNA, 19 nt, Homo sapiens
guagacuaguaacacauaa

SEQ ID NO: 718614 - RNA, 19 nt, Homo sapiens
uaaaggaggaacagcuuaa

SEQ ID NO: 718615 - RNA, 19 nt, Homo sapiens
gcuucaaggugaccaaaga

SEQ ID NO: 718616 - RNA, 19 nt, Homo sapiens
gcagaaagacacugacuac

SEQ ID NO: 718617 - RNA, 19 nt, Homo sapiens
gggcgaagguuuucuuauu

SEQ ID NO: 718618 - RNA, 19 nt, Homo sapiens
ugauugaacauccugaaua

SEQ ID NO: 718619 - RNA, 19 nt, Homo sapiens
ucccaaaucuaagcaagua

SEQ ID NO: 718620 - RNA, 19 nt, Homo sapiens
caacuaagggugacgacuu

SEQ ID NO: 718621 - RNA, 19 nt, Homo sapiens
cauguacguugcagcuuaa

SEQ ID NO: 718622 - RNA, 19 nt, Homo sapiens
gcuuaagguucauggauuc

SEQ ID NO: 718623 - RNA, 19 nt, Homo sapiens
ggaggaacagcuuaagguu

SEQ ID NO: 718624 - RNA, 19 nt, Homo sapiens
gggcauugcagaugauuau

SEQ ID NO: 718625 - RNA, 19 nt, Homo sapiens
agaaacuugugaaagcuuu

SEQ ID NO: 718626 - RNA, 19 nt, Homo sapiens
gcauugcagaugauuauga

SEQ ID NO: 718627 - RNA, 19 nt, Homo sapiens
guucauggauucuaaaaug

SEQ ID NO: 718628 - RNA, 19 nt, Homo sapiens
gagagguuauucagcuuca

SEQ ID NO: 718629 - RNA, 19 nt, Homo sapiens
guacguugcagcuuaacaa

SEQ ID NO: 718630 - RNA, 19 nt, Homo sapiens
aaacuuccauucacaucug

SEQ ID NO: 718631 - RNA, 19 nt, Homo sapiens
cgguuuggcugccuuguga

SEQ ID NO: 718632 - RNA, 19 nt, Homo sapiens
gaguguuuauuguucaguu

SEQ ID NO: 718633 - RNA, 19 nt, Homo sapiens
guaaacggacuuuucauuu

SEQ ID NO: 718634 - RNA, 19 nt, Homo sapiens
ggcgaagguuuucuuauuu

SEQ ID NO: 718635 - RNA, 19 nt, Homo sapiens
agaaagacacugacuacug

SEQ ID NO: 718636 - RNA, 19 nt, Homo sapiens
gcauguccacuauccagaa

SEQ ID NO: 718637 - RNA, 19 nt, Homo sapiens
ccaaaucuaagcaaguaau

SEQ ID NO: 718638 - RNA, 19 nt, Homo sapiens
aaaagaaacuugugaaagc

SEQ ID NO: 718639 - RNA, 19 nt, Homo sapiens
ugcagaugauuaugacaaa

SEQ ID NO: 718640 - RNA, 19 nt, Homo sapiens
guaacaaaaccucauauug

SEQ ID NO: 718641 - RNA, 19 nt, Homo sapiens
uauguagacuaguaacaca

SEQ ID NO: 718642 - RNA, 19 nt, Homo sapiens
uaaugguacugugauugaa

SEQ ID NO: 718643 - RNA, 19 nt, Homo sapiens
acugaggauuacauucaua

SEQ ID NO: 718644 - RNA, 19 nt, Homo sapiens
agacuaguaacacauaaga

SEQ ID NO: 718645 - RNA, 19 nt, Homo sapiens
uguagacuaguaacacaua

SEQ ID NO: 718646 - RNA, 19 nt, Homo sapiens
gacugaggauuacauucau

SEQ ID NO: 718647 - RNA, 19 nt, Homo sapiens
auuaugcucccaaaucuaa

SEQ ID NO: 718648 - RNA, 19 nt, Homo sapiens
guauuaaaccauguacguu

SEQ ID NO: 718649 - RNA, 19 nt, Homo sapiens
aaauugcaguaagauggua

SEQ ID NO: 718650 - RNA, 19 nt, Homo sapiens
cuuggagguuggcauugua

SEQ ID NO: 718651 - RNA, 19 nt, Homo sapiens
ggcagaaagacacugacua

SEQ ID NO: 718652 - RNA, 19 nt, Homo sapiens
gcaguaaacggacuuuuca

SEQ ID NO: 718653 - RNA, 19 nt, Homo sapiens
aaagaaacuugugaaagcu

SEQ ID NO: 718654 - RNA, 19 nt, Homo sapiens
ucaccggccucacacuagu

SEQ ID NO: 718655 - RNA, 19 nt, Homo sapiens
ggagguuggcauuguaaag

SEQ ID NO: 718656 - RNA, 19 nt, Homo sapiens
caucugccaguuucucuug

SEQ ID NO: 718657 - RNA, 19 nt, Homo sapiens
gcaacggaacggcagaaag

SEQ ID NO: 718658 - RNA, 19 nt, Homo sapiens
ucacacuaguaucgcaugu

SEQ ID NO: 718659 - RNA, 19 nt, Homo sapiens
guucagggcauugcagaug

SEQ ID NO: 718660 - RNA, 19 nt, Homo sapiens
auucaaacuuccauucaca

SEQ ID NO: 718661 - RNA, 19 nt, Homo sapiens
gcagaugauuaugacaaaa

SEQ ID NO: 718662 - RNA, 19 nt, Homo sapiens
gucuuuacauguuuccaau

SEQ ID NO: 718663 - RNA, 19 nt, Homo sapiens
ggcagggacugaggauuac

SEQ ID NO: 718664 - RNA, 19 nt, Homo sapiens
ccacuacagccuccugaca

SEQ ID NO: 718665 - RNA, 19 nt, Homo sapiens
gcugccuugugaaaugauu

SEQ ID NO: 718666 - RNA, 19 nt, Homo sapiens
uggcugccuugugaaauga

SEQ ID NO: 718667 - RNA, 19 nt, Homo sapiens
agcuuaagguucauggauu

SEQ ID NO: 718668 - RNA, 19 nt, Homo sapiens
cagcuuaagguucauggau

SEQ ID NO: 718669 - RNA, 19 nt, Homo sapiens
uaugaaucuuugugagcaa

SEQ ID NO: 718670 - RNA, 19 nt, Homo sapiens
ccucaccggccucacacua

SEQ ID NO: 718671 - RNA, 19 nt, Homo sapiens
aaccucauauugucuuuac

SEQ ID NO: 718672 - RNA, 19 nt, Homo sapiens
aguaucgcauguccacuau

SEQ ID NO: 718673 - RNA, 19 nt, Homo sapiens
gagguuggcauuguaaagg

SEQ ID NO: 718674 - RNA, 19 nt, Homo sapiens
cggagagguuauucagcuu

SEQ ID NO: 718675 - RNA, 19 nt, Homo sapiens
ucagggcauugcagaugau

SEQ ID NO: 718676 - RNA, 19 nt, Homo sapiens
guugcagcuuaacaauaaa

SEQ ID NO: 718677 - RNA, 19 nt, Homo sapiens
guuuauuacguuucacuug

SEQ ID NO: 718678 - RNA, 19 nt, Homo sapiens
uaucgcauguccacuaucc

SEQ ID NO: 718679 - RNA, 19 nt, Homo sapiens
cuuuacauguuuccaaugg

SEQ ID NO: 718680 - RNA, 19 nt, Homo sapiens
gcaaagcggucaaugagua

SEQ ID NO: 718681 - RNA, 19 nt, Homo sapiens
gcacaacacuuucuauuuc

SEQ ID NO: 718682 - RNA, 19 nt, Homo sapiens
acaaaggccuuaccaggaa

SEQ ID NO: 718683 - RNA, 19 nt, Homo sapiens
ugagggaguuaaccaaguu

SEQ ID NO: 718684 - RNA, 19 nt, Homo sapiens
ggcacaacacuuucuauuu

SEQ ID NO: 718685 - RNA, 19 nt, Homo sapiens
acacugaccauucuagaaa

SEQ ID NO: 718686 - RNA, 19 nt, Homo sapiens
ucgaauggcacaacacuuu

SEQ ID NO: 718687 - RNA, 19 nt, Homo sapiens
ggaccagucaguaagagaa

SEQ ID NO: 718688 - RNA, 19 nt, Homo sapiens
gaaauuuggaaacaccuau

SEQ ID NO: 718689 - RNA, 19 nt, Homo sapiens
gcccacagauggacugagu

SEQ ID NO: 718690 - RNA, 19 nt, Homo sapiens
acaccuauuucuuaacuca

SEQ ID NO: 718691 - RNA, 19 nt, Homo sapiens
guggagaaauuuggaaaca

SEQ ID NO: 718692 - RNA, 19 nt, Homo sapiens
cacaacacuuucuauuuca

SEQ ID NO: 718693 - RNA, 19 nt, Homo sapiens
ggacacugaccauucuaga

SEQ ID NO: 718694 - RNA, 19 nt, Homo sapiens
agacagagugggagagauu

SEQ ID NO: 718695 - RNA, 19 nt, Homo sapiens
uaagagaaggccaagaugu

SEQ ID NO: 718696 - RNA, 19 nt, Homo sapiens
gaaugagggaguuaaccaa

SEQ ID NO: 718697 - RNA, 19 nt, Homo sapiens
ggaaggguuaggacacuga

SEQ ID NO: 718698 - RNA, 19 nt, Homo sapiens
ucucggaccucgcuguguu

SEQ ID NO: 718699 - RNA, 19 nt, Homo sapiens
gaugcugguuucuacacuu

SEQ ID NO: 718700 - RNA, 19 nt, Homo sapiens
ggaaugagggaguuaacca

SEQ ID NO: 718701 - RNA, 19 nt, Homo sapiens
guagugagcguggagaaau

SEQ ID NO: 718702 - RNA, 19 nt, Homo sapiens
uagugagcguggagaaauu

SEQ ID NO: 718703 - RNA, 19 nt, Homo sapiens
gcagguuuagggcccauuu

SEQ ID NO: 718704 - RNA, 19 nt, Homo sapiens
gacagagugggagagauua

SEQ ID NO: 718705 - RNA, 19 nt, Homo sapiens
gacacugaccauucuagaa

SEQ ID NO: 718706 - RNA, 19 nt, Homo sapiens
guaagagaaggccaagaug

SEQ ID NO: 718707 - RNA, 19 nt, Homo sapiens
guuaggacacugaccauuc

SEQ ID NO: 718708 - RNA, 19 nt, Homo sapiens
uuaggacacugaccauucu

SEQ ID NO: 718709 - RNA, 19 nt, Homo sapiens
caaagcggucaaugaguau

SEQ ID NO: 718710 - RNA, 19 nt, Homo sapiens
ggaccucgcuguguuucac

SEQ ID NO: 718711 - RNA, 19 nt, Homo sapiens
aaaguccaguuuguaccua

SEQ ID NO: 718712 - RNA, 19 nt, Homo sapiens
uucaaggucucacuuaugg

SEQ ID NO: 718713 - RNA, 19 nt, Homo sapiens
gagcugagguggggugaga

SEQ ID NO: 718714 - RNA, 19 nt, Homo sapiens
gcguggcgaugcugguuuc

SEQ ID NO: 718715 - RNA, 19 nt, Homo sapiens
gagcguggagaaauuugga

SEQ ID NO: 718716 - RNA, 19 nt, Homo sapiens
uggcacaacacuuucuauu

SEQ ID NO: 718717 - RNA, 19 nt, Homo sapiens
cuuauggaccagucaguaa

SEQ ID NO: 718718 - RNA, 19 nt, Homo sapiens
uggcgaugcugguuucuac

SEQ ID NO: 718719 - RNA, 19 nt, Homo sapiens
gcgagugcaugugcuacug

SEQ ID NO: 718720 - RNA, 19 nt, Homo sapiens
caggcucugugcugaugaa

SEQ ID NO: 718721 - RNA, 19 nt, Homo sapiens
gaauggcacaacacuuucu

SEQ ID NO: 718722 - RNA, 19 nt, Homo sapiens
gagacagagugggagagau

SEQ ID NO: 718723 - RNA, 19 nt, Homo sapiens
caacacuuucuauuucaca

SEQ ID NO: 718724 - RNA, 19 nt, Homo sapiens
aguaagagaaggccaagau

SEQ ID NO: 718725 - RNA, 19 nt, Homo sapiens
aauaaaguccaguuuguac

SEQ ID NO: 718726 - RNA, 19 nt, Homo sapiens
gagggaguuaaccaaguuu

SEQ ID NO: 718727 - RNA, 19 nt, Homo sapiens
gcuguugacaaaggccuua

SEQ ID NO: 718728 - RNA, 19 nt, Homo sapiens
gagcguggcgaugcugguu

SEQ ID NO: 718729 - RNA, 19 nt, Homo sapiens
gcguggagaaauuuggaaa

SEQ ID NO: 718730 - RNA, 19 nt, Homo sapiens
cgaauggcacaacacuuuc

SEQ ID NO: 718731 - RNA, 19 nt, Homo sapiens
cacugaccauucuagaaau

SEQ ID NO: 718732 - RNA, 19 nt, Homo sapiens
gcacuuggcuaauagaaua

SEQ ID NO: 718733 - RNA, 19 nt, Homo sapiens
caucaaagauuccaacuca

SEQ ID NO: 718734 - RNA, 19 nt, Homo sapiens
gaaacgggccugaauuuga

SEQ ID NO: 718735 - RNA, 19 nt, Homo sapiens
ugacaagacugccagcuuu

SEQ ID NO: 718736 - RNA, 19 nt, Homo sapiens
ggaaacagaagcuacagua

SEQ ID NO: 718737 - RNA, 19 nt, Homo sapiens
caggauaguuucauaguga

SEQ ID NO: 718738 - RNA, 19 nt, Homo sapiens
ccaacucacuggcuuacua

SEQ ID NO: 718739 - RNA, 19 nt, Homo sapiens
gaggguaucuucaucaaag

SEQ ID NO: 718740 - RNA, 19 nt, Homo sapiens
aaacgggccugaauuugaa

SEQ ID NO: 718741 - RNA, 19 nt, Homo sapiens
uggcugauauugucauuaa

SEQ ID NO: 718742 - RNA, 19 nt, Homo sapiens
aacagaagcuacaguauga

SEQ ID NO: 718743 - RNA, 19 nt, Homo sapiens
ccaaacagcccacagaaga

SEQ ID NO: 718744 - RNA, 19 nt, Homo sapiens
ccaaugaaaucccucaaca

SEQ ID NO: 718745 - RNA, 19 nt, Homo sapiens
ucacgaagcuaguggaaca

SEQ ID NO: 718746 - RNA, 19 nt, Homo sapiens
aaacagccauugguaagaa

SEQ ID NO: 718747 - RNA, 19 nt, Homo sapiens
ugacccagcugaugcagaa

SEQ ID NO: 718748 - RNA, 19 nt, Homo sapiens
gaagguccaagcccaagua

SEQ ID NO: 718749 - RNA, 19 nt, Homo sapiens
gauuugaggacauucauuu

SEQ ID NO: 718750 - RNA, 19 nt, Homo sapiens
caucuucgguguagaggaa

SEQ ID NO: 718751 - RNA, 19 nt, Homo sapiens
gaucuugauuccacccaaa

SEQ ID NO: 718752 - RNA, 19 nt, Homo sapiens
gaggaaacagccauuggua

SEQ ID NO: 718753 - RNA, 19 nt, Homo sapiens
cagaaacgggccugaauuu

SEQ ID NO: 718754 - RNA, 19 nt, Homo sapiens
ccagaggucagaaauauug

SEQ ID NO: 718755 - RNA, 19 nt, Homo sapiens
cauauuuguuucgcucuua

SEQ ID NO: 718756 - RNA, 19 nt, Homo sapiens
ggaaacagccauugguaag

SEQ ID NO: 718757 - RNA, 19 nt, Homo sapiens
cagaucgacuggcaugauu

SEQ ID NO: 718758 - RNA, 19 nt, Homo sapiens
gccagaggaugacacuaaa

SEQ ID NO: 718759 - RNA, 19 nt, Homo sapiens
ggaccaggacacccaagua

SEQ ID NO: 718760 - RNA, 19 nt, Homo sapiens
gaaacagaagcuacaguau

SEQ ID NO: 718761 - RNA, 19 nt, Homo sapiens
ggaugaggguucagaugau

SEQ ID NO: 718762 - RNA, 19 nt, Homo sapiens
ccuacaggauaguuucaua

SEQ ID NO: 718763 - RNA, 19 nt, Homo sapiens
gguaagaguagcuggguuu

SEQ ID NO: 718764 - RNA, 19 nt, Homo sapiens
gaccugggauggccacuca

SEQ ID NO: 718765 - RNA, 19 nt, Homo sapiens
gguccaagcccaaguaauc

SEQ ID NO: 718766 - RNA, 19 nt, Homo sapiens
gaagcuaggauccgacaga

SEQ ID NO: 718767 - RNA, 19 nt, Homo sapiens
aaacagaagcuacaguaug

SEQ ID NO: 718768 - RNA, 19 nt, Homo sapiens
ggauaagacggaauggaaa

SEQ ID NO: 718769 - RNA, 19 nt, Homo sapiens
agauggaggucgagucuga

SEQ ID NO: 718770 - RNA, 19 nt, Homo sapiens
gaacaguacaccaagaucu

SEQ ID NO: 718771 - RNA, 19 nt, Homo sapiens
agaaagagcagcgcaacua

SEQ ID NO: 718772 - RNA, 19 nt, Homo sapiens
ccaggucucugucauuaag

SEQ ID NO: 718773 - RNA, 19 nt, Homo sapiens
gaggaugacacuaaagaga

SEQ ID NO: 718774 - RNA, 19 nt, Homo sapiens
gaaacagccauugguaaga

SEQ ID NO: 718775 - RNA, 19 nt, Homo sapiens
ggaugacacuaaagagaag

SEQ ID NO: 718776 - RNA, 19 nt, Homo sapiens
gaugaggguucagaugaug

SEQ ID NO: 718777 - RNA, 19 nt, Homo sapiens
uaucucagccuucgacuug

SEQ ID NO: 718778 - RNA, 19 nt, Homo sapiens
gugaggaaguugagaugga

SEQ ID NO: 718779 - RNA, 19 nt, Homo sapiens
ccagcaagcccaaugaaau

SEQ ID NO: 718780 - RNA, 19 nt, Homo sapiens
cgaagcuaguggaacagua

SEQ ID NO: 718781 - RNA, 19 nt, Homo sapiens
ggaggaagaaguagacaag

SEQ ID NO: 718782 - RNA, 19 nt, Homo sapiens
ucuggaaucucuuuguguu

SEQ ID NO: 718783 - RNA, 19 nt, Homo sapiens
agaggaaccugcugucaag

SEQ ID NO: 718784 - RNA, 19 nt, Homo sapiens
caaacagcccacagaagaa

SEQ ID NO: 718785 - RNA, 19 nt, Homo sapiens
cuccagaggucagaaauau

SEQ ID NO: 718786 - RNA, 19 nt, Homo sapiens
gaagaagaagggcagaaag

SEQ ID NO: 718787 - RNA, 19 nt, Homo sapiens
ccagaaacgggccugaauu

SEQ ID NO: 718788 - RNA, 19 nt, Homo sapiens
gcauauuuguuucgcucuu

SEQ ID NO: 718789 - RNA, 19 nt, Homo sapiens
ggucagcgaguucaaggaa

SEQ ID NO: 718790 - RNA, 19 nt, Homo sapiens
ggaggauucugcaccuucu

SEQ ID NO: 718791 - RNA, 19 nt, Homo sapiens
cgacagaacgagaucaaca

SEQ ID NO: 718792 - RNA, 19 nt, Homo sapiens
guguuagggucucgauuug

SEQ ID NO: 718793 - RNA, 19 nt, Homo sapiens
ggagcgcuaugaaaaguuu

SEQ ID NO: 718794 - RNA, 19 nt, Homo sapiens
gaaagagcagcgcaacuac

SEQ ID NO: 718795 - RNA, 19 nt, Homo sapiens
ugccuugccugcauauuug

SEQ ID NO: 718796 - RNA, 19 nt, Homo sapiens
cagaggaugacacuaaaga

SEQ ID NO: 718797 - RNA, 19 nt, Homo sapiens
gaaggaagaagaggagaag

SEQ ID NO: 718798 - RNA, 19 nt, Homo sapiens
gcacagccucuucaacuac

SEQ ID NO: 718799 - RNA, 19 nt, Homo sapiens
cgacuuggauguggugaag

SEQ ID NO: 718800 - RNA, 19 nt, Homo sapiens
gaggucagaaauauuguug

SEQ ID NO: 718801 - RNA, 19 nt, Homo sapiens
gauauugagagcagcuuga

SEQ ID NO: 718802 - RNA, 19 nt, Homo sapiens
ggacacccaaguacaagau

SEQ ID NO: 718803 - RNA, 19 nt, Homo sapiens
ccaggacacccaaguacaa

SEQ ID NO: 718804 - RNA, 19 nt, Homo sapiens
gguggcacuuggcuaauag

SEQ ID NO: 718805 - RNA, 19 nt, Homo sapiens
guuagggucucgauuugag

SEQ ID NO: 718806 - RNA, 19 nt, Homo sapiens
uuacucaguuugggaauuc

SEQ ID NO: 718807 - RNA, 19 nt, Homo sapiens
ucaagucccugccauuuug

SEQ ID NO: 718808 - RNA, 19 nt, Homo sapiens
ugaagaagaagggcagaaa

SEQ ID NO: 718809 - RNA, 19 nt, Homo sapiens
gacagaacgagaucaacaa

SEQ ID NO: 718810 - RNA, 19 nt, Homo sapiens
aagaagaggagaaggagaa

SEQ ID NO: 718811 - RNA, 19 nt, Homo sapiens
gcugauauugucauuaauc

SEQ ID NO: 718812 - RNA, 19 nt, Homo sapiens
aaauuguccugcagagguu

SEQ ID NO: 718813 - RNA, 19 nt, Homo sapiens
ugcccaacaugcaggauaa

SEQ ID NO: 718814 - RNA, 19 nt, Homo sapiens
aagaugagcccaccuccaa

SEQ ID NO: 718815 - RNA, 19 nt, Homo sapiens
cagcaagcccaaugaaauc

SEQ ID NO: 718816 - RNA, 19 nt, Homo sapiens
gugagaagcagagcgauga

SEQ ID NO: 718817 - RNA, 19 nt, Homo sapiens
gauuccacccaaagguuua

SEQ ID NO: 718818 - RNA, 19 nt, Homo sapiens
gcccagggauguccuacag

SEQ ID NO: 718819 - RNA, 19 nt, Homo sapiens
gcuuugccuugccugcaua

SEQ ID NO: 718820 - RNA, 19 nt, Homo sapiens
aagacggaauggaaacuga

SEQ ID NO: 718821 - RNA, 19 nt, Homo sapiens
ugccagaggaugacacuaa

SEQ ID NO: 718822 - RNA, 19 nt, Homo sapiens
ccaaguacaagauauggau

SEQ ID NO: 718823 - RNA, 19 nt, Homo sapiens
gaagcuaguggaacaguac

SEQ ID NO: 718824 - RNA, 19 nt, Homo sapiens
gggccugaauuugaagcua

SEQ ID NO: 718825 - RNA, 19 nt, Homo sapiens
agaagcagagcgaugauga

SEQ ID NO: 718826 - RNA, 19 nt, Homo sapiens
caggaacacaugcgcauug

SEQ ID NO: 718827 - RNA, 19 nt, Homo sapiens
ugaggaggaugacaaacag

SEQ ID NO: 718828 - RNA, 19 nt, Homo sapiens
ccaaugagcaagggaacuu

SEQ ID NO: 718829 - RNA, 19 nt, Homo sapiens
guggaacaguacaccaaga

SEQ ID NO: 718830 - RNA, 19 nt, Homo sapiens
cagcacagccucuucaacu

SEQ ID NO: 718831 - RNA, 19 nt, Homo sapiens
ccacagcacagccucuuca

SEQ ID NO: 718832 - RNA, 19 nt, Homo sapiens
agaaugaacuggacaaugu

SEQ ID NO: 718833 - RNA, 19 nt, Homo sapiens
ggaccagccugagguguaa

SEQ ID NO: 718834 - RNA, 19 nt, Homo sapiens
gagcccagcuuucccagaa

SEQ ID NO: 718835 - RNA, 19 nt, Homo sapiens
guuggugccuucccuauuu

SEQ ID NO: 718836 - RNA, 19 nt, Homo sapiens
gaucagauguggucagacu

SEQ ID NO: 718837 - RNA, 19 nt, Homo sapiens
caagaaagaguacgagaau

SEQ ID NO: 718838 - RNA, 19 nt, Homo sapiens
gccaggcucuuguuuauag

SEQ ID NO: 718839 - RNA, 19 nt, Homo sapiens
uggagaggauggaagauuu

SEQ ID NO: 718840 - RNA, 19 nt, Homo sapiens
gaccgugccuucucucuuc

SEQ ID NO: 718841 - RNA, 19 nt, Homo sapiens
gaaagaguacgagaaucua

SEQ ID NO: 718842 - RNA, 19 nt, Homo sapiens
ggagcaagaugaagaccau

SEQ ID NO: 718843 - RNA, 19 nt, Homo sapiens
cuacgaagccggaccugua

SEQ ID NO: 718844 - RNA, 19 nt, Homo sapiens
aauaagcucuucuuugauc

SEQ ID NO: 718845 - RNA, 19 nt, Homo sapiens
ggaggagaaugucuuggau

SEQ ID NO: 718846 - RNA, 19 nt, Homo sapiens
acacaugccugcaacuugu

SEQ ID NO: 718847 - RNA, 19 nt, Homo sapiens
acagagugcugacaaggaa

SEQ ID NO: 718848 - RNA, 19 nt, Homo sapiens
cuaauucaguccuuugaga

SEQ ID NO: 718849 - RNA, 19 nt, Homo sapiens
gaacagugagucugaccaa

SEQ ID NO: 718850 - RNA, 19 nt, Homo sapiens
cagcaaagaugugguaagg

SEQ ID NO: 718851 - RNA, 19 nt, Homo sapiens
ugucuuggaucgagaauuc

SEQ ID NO: 718852 - RNA, 19 nt, Homo sapiens
cagcaugguuacuacgaaa

SEQ ID NO: 718853 - RNA, 19 nt, Homo sapiens
uaacgaugcugcaggaaac

SEQ ID NO: 718854 - RNA, 19 nt, Homo sapiens
gacagucuacucugaauug

SEQ ID NO: 718855 - RNA, 19 nt, Homo sapiens
ggagcgaaauuugaagcaa

SEQ ID NO: 718856 - RNA, 19 nt, Homo sapiens
gacaugaccagcccacuga

SEQ ID NO: 718857 - RNA, 19 nt, Homo sapiens
gcagcaggaugagaccaaa

SEQ ID NO: 718858 - RNA, 19 nt, Homo sapiens
gugugucucucaagaaaga

SEQ ID NO: 718859 - RNA, 19 nt, Homo sapiens
ccaagaagauaugcaaagg

SEQ ID NO: 718860 - RNA, 19 nt, Homo sapiens
ggaaaucaugagccugaaa

SEQ ID NO: 718861 - RNA, 19 nt, Homo sapiens
gaaggagucccagcucuca

SEQ ID NO: 718862 - RNA, 19 nt, Homo sapiens
gcugaggaaggauuuguuu

SEQ ID NO: 718863 - RNA, 19 nt, Homo sapiens
acgcaaugcuacuguggua

SEQ ID NO: 718864 - RNA, 19 nt, Homo sapiens
ccagaaagacaaggagaaa

SEQ ID NO: 718865 - RNA, 19 nt, Homo sapiens
gcuccgacuucuucgauca

SEQ ID NO: 718866 - RNA, 19 nt, Homo sapiens
ggagaugauccgagacaug

SEQ ID NO: 718867 - RNA, 19 nt, Homo sapiens
gaagaacgcaaugcuacug

SEQ ID NO: 718868 - RNA, 19 nt, Homo sapiens
gggaccagccugaggugua

SEQ ID NO: 718869 - RNA, 19 nt, Homo sapiens
ugaagaccauggagcagau

SEQ ID NO: 718870 - RNA, 19 nt, Homo sapiens
ggaggaggagaaugucuug

SEQ ID NO: 718871 - RNA, 19 nt, Homo sapiens
ucaagaaagaguacgagaa

SEQ ID NO: 718872 - RNA, 19 nt, Homo sapiens
aaaagcagaugaaguacuu

SEQ ID NO: 718873 - RNA, 19 nt, Homo sapiens
gcaaugcuacugugguauc

SEQ ID NO: 718874 - RNA, 19 nt, Homo sapiens
gcagaugaaguacuuagag

SEQ ID NO: 718875 - RNA, 19 nt, Homo sapiens
ccagcaugguuacuacgaa

SEQ ID NO: 718876 - RNA, 19 nt, Homo sapiens
ccagaaggacuuacagagu

SEQ ID NO: 718877 - RNA, 19 nt, Homo sapiens
aaagaguacgagaaucuaa

SEQ ID NO: 718878 - RNA, 19 nt, Homo sapiens
uagagcagcagcaggauga

SEQ ID NO: 718879 - RNA, 19 nt, Homo sapiens
ggaucgagaauucuuaaag

SEQ ID NO: 718880 - RNA, 19 nt, Homo sapiens
guauggagaggauggaaga

SEQ ID NO: 718881 - RNA, 19 nt, Homo sapiens
uugccaggcucuuguuuau

SEQ ID NO: 718882 - RNA, 19 nt, Homo sapiens
gaaagacaaggagaaacga

SEQ ID NO: 718883 - RNA, 19 nt, Homo sapiens
ggaauggaggauagacaug

SEQ ID NO: 718884 - RNA, 19 nt, Homo sapiens
uuauagccaugaucagaug

SEQ ID NO: 718885 - RNA, 19 nt, Homo sapiens
gacacaugccugcaacuug

SEQ ID NO: 718886 - RNA, 19 nt, Homo sapiens
ugaucucaaugcuaccuuu

SEQ ID NO: 718887 - RNA, 19 nt, Homo sapiens
gaaaucaugagccugaaaa

SEQ ID NO: 718888 - RNA, 19 nt, Homo sapiens
gcaagaugaagaccaugga

SEQ ID NO: 718889 - RNA, 19 nt, Homo sapiens
guccagccaucaugccuau

SEQ ID NO: 718890 - RNA, 19 nt, Homo sapiens
gccuuugacuugcuucuag

SEQ ID NO: 718891 - RNA, 19 nt, Homo sapiens
cagugagucugaccaaugg

SEQ ID NO: 718892 - RNA, 19 nt, Homo sapiens
gugagaacagugagucuga

SEQ ID NO: 718893 - RNA, 19 nt, Homo sapiens
ccagcucccagcaugguua

SEQ ID NO: 718894 - RNA, 19 nt, Homo sapiens
agaaagaguacgagaaucu

SEQ ID NO: 718895 - RNA, 19 nt, Homo sapiens
ggagcagauugagcuucua

SEQ ID NO: 718896 - RNA, 19 nt, Homo sapiens
aggccaagcuggacaccuu

SEQ ID NO: 718897 - RNA, 19 nt, Homo sapiens
agucuacucugaauuggau

SEQ ID NO: 718898 - RNA, 19 nt, Homo sapiens
gaggagaugauccgagaca

SEQ ID NO: 718899 - RNA, 19 nt, Homo sapiens
uaaagaaugaacuggacaa

SEQ ID NO: 718900 - RNA, 19 nt, Homo sapiens
gcaaaagaaccauuaucaa

SEQ ID NO: 718901 - RNA, 19 nt, Homo sapiens
guugccaggcucuuguuua

SEQ ID NO: 718902 - RNA, 19 nt, Homo sapiens
gguaaggacaggcuucgau

SEQ ID NO: 718903 - RNA, 19 nt, Homo sapiens
uaucugcuccgacuucuuc

SEQ ID NO: 718904 - RNA, 19 nt, Homo sapiens
gacaagcugaggaaggauu

SEQ ID NO: 718905 - RNA, 19 nt, Homo sapiens
cugacaagcugaggaagga

SEQ ID NO: 718906 - RNA, 19 nt, Homo sapiens
gaccaaacaagcacaagag

SEQ ID NO: 718907 - RNA, 19 nt, Homo sapiens
agccggaccuguagcaguu

SEQ ID NO: 718908 - RNA, 19 nt, Homo sapiens
cugugugucucucaagaaa

SEQ ID NO: 718909 - RNA, 19 nt, Homo sapiens
gcgguggagcgaaauuuga

SEQ ID NO: 718910 - RNA, 19 nt, Homo sapiens
gauguggucagacucuuuc

SEQ ID NO: 718911 - RNA, 19 nt, Homo sapiens
gugccuaauucaguccuuu

SEQ ID NO: 718912 - RNA, 19 nt, Homo sapiens
gaaugucuuggaucgagaa

SEQ ID NO: 718913 - RNA, 19 nt, Homo sapiens
gaagucacacuccccaauu

SEQ ID NO: 718914 - RNA, 19 nt, Homo sapiens
gcucccagcaugguuacua

SEQ ID NO: 718915 - RNA, 19 nt, Homo sapiens
gaucucaaugcuaccuuug

SEQ ID NO: 718916 - RNA, 19 nt, Homo sapiens
ugaagucagcccagaagga

SEQ ID NO: 718917 - RNA, 19 nt, Homo sapiens
agucggaccugcccacagu

SEQ ID NO: 718918 - RNA, 19 nt, Homo sapiens
cuaacgaugcugcaggaaa

SEQ ID NO: 718919 - RNA, 19 nt, Homo sapiens
gcugacaaggaaaucauga

SEQ ID NO: 718920 - RNA, 19 nt, Homo sapiens
ggaucaggccaaguuagaa

SEQ ID NO: 718921 - RNA, 19 nt, Homo sapiens
gcagauugagcuucuacuc

SEQ ID NO: 718922 - RNA, 19 nt, Homo sapiens
ggaugagaccaaacaagca

SEQ ID NO: 718923 - RNA, 19 nt, Homo sapiens
gggaauggaggauagacau

SEQ ID NO: 718924 - RNA, 19 nt, Homo sapiens
guuuauagccaugaucaga

SEQ ID NO: 718925 - RNA, 19 nt, Homo sapiens
cgacugggagcugacauga

SEQ ID NO: 718926 - RNA, 19 nt, Homo sapiens
acagugagucugaccaaug

SEQ ID NO: 718927 - RNA, 19 nt, Homo sapiens
cauccagccuacugacaca

SEQ ID NO: 718928 - RNA, 19 nt, Homo sapiens
gaccuguagcaguuucuuu

SEQ ID NO: 718929 - RNA, 19 nt, Homo sapiens
guacgagaaucuaaaagag

SEQ ID NO: 718930 - RNA, 19 nt, Homo sapiens
ggaagaacgcaaugcuacu

SEQ ID NO: 718931 - RNA, 19 nt, Homo sapiens
cgagacagccaggucauca

SEQ ID NO: 718932 - RNA, 19 nt, Homo sapiens
gaaagaacaugagguauuu

SEQ ID NO: 718933 - RNA, 19 nt, Homo sapiens
ggaagaaggugauuaaaga

SEQ ID NO: 718934 - RNA, 19 nt, Homo sapiens
ccacaaagcuuuacaucuu

SEQ ID NO: 718935 - RNA, 19 nt, Homo sapiens
ggauuucaguucacauuua

SEQ ID NO: 718936 - RNA, 19 nt, Homo sapiens
aaacauggacagagaauua

SEQ ID NO: 718937 - RNA, 19 nt, Homo sapiens
ggagaaagaacaugaggua

SEQ ID NO: 718938 - RNA, 19 nt, Homo sapiens
uagaagaucuguauaaugg

SEQ ID NO: 718939 - RNA, 19 nt, Homo sapiens
gaaggcauacagaaaguua

SEQ ID NO: 718940 - RNA, 19 nt, Homo sapiens
gaaaguuagccaaggaaua

SEQ ID NO: 718941 - RNA, 19 nt, Homo sapiens
gaaagcagcagccaucaug

SEQ ID NO: 718942 - RNA, 19 nt, Homo sapiens
gaacaugagguauuucaga

SEQ ID NO: 718943 - RNA, 19 nt, Homo sapiens
aaggagagguaauuaauga

SEQ ID NO: 718944 - RNA, 19 nt, Homo sapiens
cauaagcugcuacaaauaa

SEQ ID NO: 718945 - RNA, 19 nt, Homo sapiens
gugaagggaugccgcagua

SEQ ID NO: 718946 - RNA, 19 nt, Homo sapiens
gaagaaggcauacagaaag

SEQ ID NO: 718947 - RNA, 19 nt, Homo sapiens
gcagugugcccaucaguaa

SEQ ID NO: 718948 - RNA, 19 nt, Homo sapiens
ugauagcucugaugaagaa

SEQ ID NO: 718949 - RNA, 19 nt, Homo sapiens
gggaaugauuugcacauga

SEQ ID NO: 718950 - RNA, 19 nt, Homo sapiens
cgugaagccuauaaugaua

SEQ ID NO: 718951 - RNA, 19 nt, Homo sapiens
ggagaaggagagguaauua

SEQ ID NO: 718952 - RNA, 19 nt, Homo sapiens
auaaagcacuugaaaggaa

SEQ ID NO: 718953 - RNA, 19 nt, Homo sapiens
aaacuaaccacaaagcuuu

SEQ ID NO: 718954 - RNA, 19 nt, Homo sapiens
aguaaacucugcaaacaaa

SEQ ID NO: 718955 - RNA, 19 nt, Homo sapiens
gagaaggagagguaauuaa

SEQ ID NO: 718956 - RNA, 19 nt, Homo sapiens
ggagagguaauuaaugaaa

SEQ ID NO: 718957 - RNA, 19 nt, Homo sapiens
gccuguaucuaucauuuaa

SEQ ID NO: 718958 - RNA, 19 nt, Homo sapiens
uaaagcacuugaaaggaaa

SEQ ID NO: 718959 - RNA, 19 nt, Homo sapiens
ggacaucuguuggucuaug

SEQ ID NO: 718960 - RNA, 19 nt, Homo sapiens
agacaagcuuucugaacua

SEQ ID NO: 718961 - RNA, 19 nt, Homo sapiens
gaagaaggugauuaaagaa

SEQ ID NO: 718962 - RNA, 19 nt, Homo sapiens
gcacuugaaaggaaacaaa

SEQ ID NO: 718963 - RNA, 19 nt, Homo sapiens
uauaguaucuacagagugu

SEQ ID NO: 718964 - RNA, 19 nt, Homo sapiens
gaagggaagaaggugauua

SEQ ID NO: 718965 - RNA, 19 nt, Homo sapiens
gaaggagagguaauuaaug

SEQ ID NO: 718966 - RNA, 19 nt, Homo sapiens
acacgaagcuguacgacau

SEQ ID NO: 718967 - RNA, 19 nt, Homo sapiens
caugaugcauccacucaaa

SEQ ID NO: 718968 - RNA, 19 nt, Homo sapiens
gcauaagcugcuacaaaua

SEQ ID NO: 718969 - RNA, 19 nt, Homo sapiens
gaacugagggacaucuguu

SEQ ID NO: 718970 - RNA, 19 nt, Homo sapiens
agguagagcuucaggaauu

SEQ ID NO: 718971 - RNA, 19 nt, Homo sapiens
ugcauaagcugcuacaaau

SEQ ID NO: 718972 - RNA, 19 nt, Homo sapiens
ggagguagagcuucaggaa

SEQ ID NO: 718973 - RNA, 19 nt, Homo sapiens
ucaguaaacucugcaaaca

SEQ ID NO: 718974 - RNA, 19 nt, Homo sapiens
gguagagcuucaggaauuu

SEQ ID NO: 718975 - RNA, 19 nt, Homo sapiens
agaaagaacaugagguauu

SEQ ID NO: 718976 - RNA, 19 nt, Homo sapiens
ugaagaaggcauacagaaa

SEQ ID NO: 718977 - RNA, 19 nt, Homo sapiens
caagacaaccaaacuacaa

SEQ ID NO: 718978 - RNA, 19 nt, Homo sapiens
uagccuguaucuaucauuu

SEQ ID NO: 718979 - RNA, 19 nt, Homo sapiens
caauuuguccugaagcuuu

SEQ ID NO: 718980 - RNA, 19 nt, Homo sapiens
cagcuggagugucuuauca

SEQ ID NO: 718981 - RNA, 19 nt, Homo sapiens
gcaguaucguaaucccuuu

SEQ ID NO: 718982 - RNA, 19 nt, Homo sapiens
gauuugcacaugacauaua

SEQ ID NO: 718983 - RNA, 19 nt, Homo sapiens
ggaaugauuugcacaugac

SEQ ID NO: 718984 - RNA, 19 nt, Homo sapiens
gaaggugauuaaagaaguc

SEQ ID NO: 718985 - RNA, 19 nt, Homo sapiens
ugaguuauaugacagauac

SEQ ID NO: 718986 - RNA, 19 nt, Homo sapiens
ugagaagcgugaguuauau

SEQ ID NO: 718987 - RNA, 19 nt, Homo sapiens
gguauaguaucuacagagu

SEQ ID NO: 718988 - RNA, 19 nt, Homo sapiens
gucagauuguggugaaaua

SEQ ID NO: 718989 - RNA, 19 nt, Homo sapiens
gaagcucuauguggauuuc

SEQ ID NO: 718990 - RNA, 19 nt, Homo sapiens
cugagaagcgugaguuaua

SEQ ID NO: 718991 - RNA, 19 nt, Homo sapiens
uagcugugguuguaaaguu

SEQ ID NO: 718992 - RNA, 19 nt, Homo sapiens
aaaguuagccaaggaauau

SEQ ID NO: 718993 - RNA, 19 nt, Homo sapiens
aaaguuugaugugcaguuu

SEQ ID NO: 718994 - RNA, 19 nt, Homo sapiens
acagaaaguuagccaagga

SEQ ID NO: 718995 - RNA, 19 nt, Homo sapiens
gagcuucaggaauuugaua

SEQ ID NO: 718996 - RNA, 19 nt, Homo sapiens
acaaccaaacuacaacuua

SEQ ID NO: 718997 - RNA, 19 nt, Homo sapiens
gaaguuccuaacauaauug

SEQ ID NO: 718998 - RNA, 19 nt, Homo sapiens
gacgucagauuguggugaa

SEQ ID NO: 718999 - RNA, 19 nt, Homo sapiens
ucagagagaugggaaugau

SEQ ID NO: 719000 - RNA, 19 nt, Homo sapiens
cgaaauggcagaagaagag

SEQ ID NO: 719001 - RNA, 19 nt, Homo sapiens
cagaguagaagucgaaaug

SEQ ID NO: 719002 - RNA, 19 nt, Homo sapiens
caaaugcaggagacaaauu

SEQ ID NO: 719003 - RNA, 19 nt, Homo sapiens
aaugauagcucugaugaag

SEQ ID NO: 719004 - RNA, 19 nt, Homo sapiens
gaucaacccagacaagcuu

SEQ ID NO: 719005 - RNA, 19 nt, Homo sapiens
agagagaugggaaugauuu

SEQ ID NO: 719006 - RNA, 19 nt, Homo sapiens
gcuggagugucuuaucaau

SEQ ID NO: 719007 - RNA, 19 nt, Homo sapiens
cagaggagguagagcuuca

SEQ ID NO: 719008 - RNA, 19 nt, Homo sapiens
uaauggagaaggagaggua

SEQ ID NO: 719009 - RNA, 19 nt, Homo sapiens
ggagcugacugggaacaau

SEQ ID NO: 719010 - RNA, 19 nt, Homo sapiens
gggaagaaggugauuaaag

SEQ ID NO: 719011 - RNA, 19 nt, Homo sapiens
cauuagcugugguuguaaa

SEQ ID NO: 719012 - RNA, 19 nt, Homo sapiens
ugacagauacggagagcaa

SEQ ID NO: 719013 - RNA, 19 nt, Homo sapiens
aaauaaagcacuugaaagg

SEQ ID NO: 719014 - RNA, 19 nt, Homo sapiens
guuggucuauguauaacuu

SEQ ID NO: 719015 - RNA, 19 nt, Homo sapiens
acauuugccugauuuguuc

SEQ ID NO: 719016 - RNA, 19 nt, Homo sapiens
gaagggaugccgcaguauc

SEQ ID NO: 719017 - RNA, 19 nt, Homo sapiens
cacaaagcuuuacaucuuc

SEQ ID NO: 719018 - RNA, 19 nt, Homo sapiens
uaaacuaaccacaaagcuu

SEQ ID NO: 719019 - RNA, 19 nt, Homo sapiens
ugguaucugugcuugauuu

SEQ ID NO: 719020 - RNA, 19 nt, Homo sapiens
ggcgugaagccuauaauga

SEQ ID NO: 719021 - RNA, 19 nt, Homo sapiens
ggaugccgcaguaucguaa

SEQ ID NO: 719022 - RNA, 19 nt, Homo sapiens
ugaaguccacguagacaaa

SEQ ID NO: 719023 - RNA, 19 nt, Homo sapiens
gcaagacaaccaaacuaca

SEQ ID NO: 719024 - RNA, 19 nt, Homo sapiens
gaagaggagaggacaugau

SEQ ID NO: 719025 - RNA, 19 nt, Homo sapiens
guccugaagcuuuguguuu

SEQ ID NO: 719026 - RNA, 19 nt, Homo sapiens
agaaggugauuaaagaagu

SEQ ID NO: 719027 - RNA, 19 nt, Homo sapiens
gcgagaacgagcugaagaa

SEQ ID NO: 719028 - RNA, 19 nt, Homo sapiens
agaaggagagguaauuaau

SEQ ID NO: 719029 - RNA, 19 nt, Homo sapiens
gcaccugcauaagcugcua

SEQ ID NO: 719030 - RNA, 19 nt, Homo sapiens
aaucccacauuguaaaguu

SEQ ID NO: 719031 - RNA, 19 nt, Homo sapiens
gcgugaagccuauaaugau

SEQ ID NO: 719032 - RNA, 19 nt, Homo sapiens
gaaaggagcaagacgauga

SEQ ID NO: 719033 - RNA, 19 nt, Homo sapiens
ggaagcacauagaggauga

SEQ ID NO: 719034 - RNA, 19 nt, Homo sapiens
gcacgugcaugagcuauau

SEQ ID NO: 719035 - RNA, 19 nt, Homo sapiens
gcacugcccugccucaaca

SEQ ID NO: 719036 - RNA, 19 nt, Homo sapiens
gcagagggccuacgugaga

SEQ ID NO: 719037 - RNA, 19 nt, Homo sapiens
guacucgucucucaccaaa

SEQ ID NO: 719038 - RNA, 19 nt, Homo sapiens
acucugaccuguuauuaaa

SEQ ID NO: 719039 - RNA, 19 nt, Homo sapiens
gaacuuccagugaggauug

SEQ ID NO: 719040 - RNA, 19 nt, Homo sapiens
caacaaugaugucgaucug

SEQ ID NO: 719041 - RNA, 19 nt, Homo sapiens
ccagacagauggacuuaca

SEQ ID NO: 719042 - RNA, 19 nt, Homo sapiens
ccaaagaagauuauugaga

SEQ ID NO: 719043 - RNA, 19 nt, Homo sapiens
aggaaucgcucacaaagau

SEQ ID NO: 719044 - RNA, 19 nt, Homo sapiens
caccaaagaagauuauuga

SEQ ID NO: 719045 - RNA, 19 nt, Homo sapiens
caauggcgguggacuguuc

SEQ ID NO: 719046 - RNA, 19 nt, Homo sapiens
ggucauggacuaccacuuc

SEQ ID NO: 719047 - RNA, 19 nt, Homo sapiens
cagcaccaguuccgucauu

SEQ ID NO: 719048 - RNA, 19 nt, Homo sapiens
gagccacaauggagaguca

SEQ ID NO: 719049 - RNA, 19 nt, Homo sapiens
ccucuugccuccagaacuu

SEQ ID NO: 719050 - RNA, 19 nt, Homo sapiens
ccuagacacucccuacaau

SEQ ID NO: 719051 - RNA, 19 nt, Homo sapiens
gagcacaaguauggcaaug

SEQ ID NO: 719052 - RNA, 19 nt, Homo sapiens
ggaggaaucgcucacaaag

SEQ ID NO: 719053 - RNA, 19 nt, Homo sapiens
caucuguacucgucucuca

SEQ ID NO: 719054 - RNA, 19 nt, Homo sapiens
uccagaagcugacagacuu

SEQ ID NO: 719055 - RNA, 19 nt, Homo sapiens
ccacucugaccuguuauua

SEQ ID NO: 719056 - RNA, 19 nt, Homo sapiens
ccaagaccgucaccuccuu

SEQ ID NO: 719057 - RNA, 19 nt, Homo sapiens
acucgucucucaccaaaga

SEQ ID NO: 719058 - RNA, 19 nt, Homo sapiens
cagcaagaacuuccaguga

SEQ ID NO: 719059 - RNA, 19 nt, Homo sapiens
acaaugaugucgaucugau

SEQ ID NO: 719060 - RNA, 19 nt, Homo sapiens
uagcggauccucaguccua

SEQ ID NO: 719061 - RNA, 19 nt, Homo sapiens
gaccuguuauuaaaguuca

SEQ ID NO: 719062 - RNA, 19 nt, Homo sapiens
agaagauuauugagaagug

SEQ ID NO: 719063 - RNA, 19 nt, Homo sapiens
gcacauagaggaugaaaag

SEQ ID NO: 719064 - RNA, 19 nt, Homo sapiens
caggguccauugccucuug

SEQ ID NO: 719065 - RNA, 19 nt, Homo sapiens
gaggaaucgcucacaaaga

SEQ ID NO: 719066 - RNA, 19 nt, Homo sapiens
gacuaccacuucacuacug

SEQ ID NO: 719067 - RNA, 19 nt, Homo sapiens
ccuacaaugucccagaugu

SEQ ID NO: 719068 - RNA, 19 nt, Homo sapiens
gcucguccgcuacuucuug

SEQ ID NO: 719069 - RNA, 19 nt, Homo sapiens
gacaagacgcugacuucga

SEQ ID NO: 719070 - RNA, 19 nt, Homo sapiens
guggaggaaucgcucacaa

SEQ ID NO: 719071 - RNA, 19 nt, Homo sapiens
ccgcaucaauggccaugug

SEQ ID NO: 719072 - RNA, 19 nt, Homo sapiens
ucaccaaagaagauuauug

SEQ ID NO: 719073 - RNA, 19 nt, Homo sapiens
gacggcagccaccuucuga

SEQ ID NO: 719074 - RNA, 19 nt, Homo sapiens
caauggagagucaccuaga

SEQ ID NO: 719075 - RNA, 19 nt, Homo sapiens
acagauggacuuacaugga

SEQ ID NO: 719076 - RNA, 19 nt, Homo sapiens
caagaccgucaccuccuuu

SEQ ID NO: 719077 - RNA, 19 nt, Homo sapiens
gacaauggcgguggacugu

SEQ ID NO: 719078 - RNA, 19 nt, Homo sapiens
caucuggacaugcauagug

SEQ ID NO: 719079 - RNA, 19 nt, Homo sapiens
gcacccuggucccugaagu

SEQ ID NO: 719080 - RNA, 19 nt, Homo sapiens
gcugcuggaugaccacaag

SEQ ID NO: 719081 - RNA, 19 nt, Homo sapiens
cggcagccaccuucugaaa

SEQ ID NO: 719082 - RNA, 19 nt, Homo sapiens
agacagauggacuuacaug

SEQ ID NO: 719083 - RNA, 19 nt, Homo sapiens
gcagccaccuucugaaaag

SEQ ID NO: 719084 - RNA, 19 nt, Homo sapiens
ucagggacccagacagaug

SEQ ID NO: 719085 - RNA, 19 nt, Homo sapiens
uagacacucccuacaaugu

SEQ ID NO: 719086 - RNA, 19 nt, Homo sapiens
ugaggacaagccugacuuu

SEQ ID NO: 719087 - RNA, 19 nt, Homo sapiens
agacuucccuccgaucaag

SEQ ID NO: 719088 - RNA, 19 nt, Homo sapiens
ucugaccuguuauuaaagu

SEQ ID NO: 719089 - RNA, 19 nt, Homo sapiens
ggacuaccacuucacuacu

SEQ ID NO: 719090 - RNA, 19 nt, Homo sapiens
cgccaacaaugaugucgau

SEQ ID NO: 719091 - RNA, 19 nt, Homo sapiens
ggaagugggcacccuugag

SEQ ID NO: 719092 - RNA, 19 nt, Homo sapiens
gcauuggcacggacgucua

SEQ ID NO: 719093 - RNA, 19 nt, Homo sapiens
gucauggacuaccacuuca

SEQ ID NO: 719094 - RNA, 19 nt, Homo sapiens
gaaucgcucacaaagaucu

SEQ ID NO: 719095 - RNA, 19 nt, Homo sapiens
cucgguaccugcagcaaga

SEQ ID NO: 719096 - RNA, 19 nt, Homo sapiens
cugccuuccuuucaucauu

SEQ ID NO: 719097 - RNA, 19 nt, Homo sapiens
ucucagggacccagacaga

SEQ ID NO: 719098 - RNA, 19 nt, Homo sapiens
caccaucgccaacaaugau

SEQ ID NO: 719099 - RNA, 19 nt, Homo sapiens
gcauguuggccacgcauca

SEQ ID NO: 719100 - RNA, 19 nt, Homo sapiens
gggaagugggcacccuuga

SEQ ID NO: 719101 - RNA, 19 nt, Homo sapiens
ggccaucuggacaugcaua

SEQ ID NO: 719102 - RNA, 19 nt, Homo sapiens
guaccugcagcaagaacuu

SEQ ID NO: 719103 - RNA, 19 nt, Homo sapiens
ucaccaucgccaacaauga

SEQ ID NO: 719104 - RNA, 19 nt, Homo sapiens
ugccuuccuuucaucauug

SEQ ID NO: 719105 - RNA, 19 nt, Homo sapiens
ucaucaccaucgccaacaa

SEQ ID NO: 719106 - RNA, 19 nt, Homo sapiens
acacacaccacguggagau

SEQ ID NO: 719107 - RNA, 19 nt, Homo sapiens
gcuuggaauccgcauguug

SEQ ID NO: 719108 - RNA, 19 nt, Homo sapiens
ugacuucgaggcuuggaau

SEQ ID NO: 719109 - RNA, 19 nt, Homo sapiens
uggaugaccacaaggaugu

SEQ ID NO: 719110 - RNA, 19 nt, Homo sapiens
uggaggaaucgcucacaaa

SEQ ID NO: 719111 - RNA, 19 nt, Homo sapiens
cacaauggagagucaccua

SEQ ID NO: 719112 - RNA, 19 nt, Homo sapiens
gaacucauccggcagaaua

SEQ ID NO: 719113 - RNA, 19 nt, Homo sapiens
gauguugacuagcuaauaa

SEQ ID NO: 719114 - RNA, 19 nt, Homo sapiens
cguaagagguuuguaguua

SEQ ID NO: 719115 - RNA, 19 nt, Homo sapiens
gaaauuaaucguucaguug

SEQ ID NO: 719116 - RNA, 19 nt, Homo sapiens
gcacaucuccguacaagga

SEQ ID NO: 719117 - RNA, 19 nt, Homo sapiens
guucguacgugcauaguuu

SEQ ID NO: 719118 - RNA, 19 nt, Homo sapiens
gaaaacauuuggauuggua

SEQ ID NO: 719119 - RNA, 19 nt, Homo sapiens
gagaauguauaacguggaa

SEQ ID NO: 719120 - RNA, 19 nt, Homo sapiens
ggacacuuauggcuucauu

SEQ ID NO: 719121 - RNA, 19 nt, Homo sapiens
gcaacgauaaauacucuua

SEQ ID NO: 719122 - RNA, 19 nt, Homo sapiens
acaauucucugcuuucuau

SEQ ID NO: 719123 - RNA, 19 nt, Homo sapiens
gagcaacgauaaauacucu

SEQ ID NO: 719124 - RNA, 19 nt, Homo sapiens
gagggaaacuuaagaacgu

SEQ ID NO: 719125 - RNA, 19 nt, Homo sapiens
aaacaccgagggaaacuua

SEQ ID NO: 719126 - RNA, 19 nt, Homo sapiens
uguaacacgucaaccauuu

SEQ ID NO: 719127 - RNA, 19 nt, Homo sapiens
gugcauaguuucgauauca

SEQ ID NO: 719128 - RNA, 19 nt, Homo sapiens
guaagagguuuguaguuag

SEQ ID NO: 719129 - RNA, 19 nt, Homo sapiens
acagagaaccguaucguaa

SEQ ID NO: 719130 - RNA, 19 nt, Homo sapiens
gaacaauccgcccaugaug

SEQ ID NO: 719131 - RNA, 19 nt, Homo sapiens
gcauguugauguugacuag

SEQ ID NO: 719132 - RNA, 19 nt, Homo sapiens
gcacuucagccaagcagaa

SEQ ID NO: 719133 - RNA, 19 nt, Homo sapiens
gaaauccacgggaccaaau

SEQ ID NO: 719134 - RNA, 19 nt, Homo sapiens
aggaaacucuucuuuaaag

SEQ ID NO: 719135 - RNA, 19 nt, Homo sapiens
cgccuggucugcaagauuu

SEQ ID NO: 719136 - RNA, 19 nt, Homo sapiens
ggaucgagcaccucaaaga

SEQ ID NO: 719137 - RNA, 19 nt, Homo sapiens
gaauguauaacguggaaau

SEQ ID NO: 719138 - RNA, 19 nt, Homo sapiens
cgauaaauacucuuaggaa

SEQ ID NO: 719139 - RNA, 19 nt, Homo sapiens
uaagagguuuguaguuagu

SEQ ID NO: 719140 - RNA, 19 nt, Homo sapiens
gagaacaauccgcccauga

SEQ ID NO: 719141 - RNA, 19 nt, Homo sapiens
gcuauccauuacagaaauu

SEQ ID NO: 719142 - RNA, 19 nt, Homo sapiens
guacgacaacuaccgacua

SEQ ID NO: 719143 - RNA, 19 nt, Homo sapiens
ggaaauccacgggaccaaa

SEQ ID NO: 719144 - RNA, 19 nt, Homo sapiens
agagaaccguaucguaaga

SEQ ID NO: 719145 - RNA, 19 nt, Homo sapiens
gacagagaaccguaucgua

SEQ ID NO: 719146 - RNA, 19 nt, Homo sapiens
guacgugcauaguuucgau

SEQ ID NO: 719147 - RNA, 19 nt, Homo sapiens
gaauccaggaguucauuga

SEQ ID NO: 719148 - RNA, 19 nt, Homo sapiens
gagucugcgucguuucgua

SEQ ID NO: 719149 - RNA, 19 nt, Homo sapiens
ugaaagaaguacugaugac

SEQ ID NO: 719150 - RNA, 19 nt, Homo sapiens
guugaaagaaguacugaug

SEQ ID NO: 719151 - RNA, 19 nt, Homo sapiens
agaacgggcugguccuuca

SEQ ID NO: 719152 - RNA, 19 nt, Homo sapiens
gaagagagaaaauaagguu

SEQ ID NO: 719153 - RNA, 19 nt, Homo sapiens
ccgagaagguguacaucau

SEQ ID NO: 719154 - RNA, 19 nt, Homo sapiens
gaagaggaagcgcauggau

SEQ ID NO: 719155 - RNA, 19 nt, Homo sapiens
uucgagagcugcugccaaa

SEQ ID NO: 719156 - RNA, 19 nt, Homo sapiens
gcgacgugaugaacgagaa

SEQ ID NO: 719157 - RNA, 19 nt, Homo sapiens
gcggcucaguuguccauga

SEQ ID NO: 719158 - RNA, 19 nt, Homo sapiens
gagacuggacgcugugaga

SEQ ID NO: 719159 - RNA, 19 nt, Homo sapiens
gauccgugagcaacgauaa

SEQ ID NO: 719160 - RNA, 19 nt, Homo sapiens
gaggacggcagcuccaaga

SEQ ID NO: 719161 - RNA, 19 nt, Homo sapiens
ucaagacaccacagugcua

SEQ ID NO: 719162 - RNA, 19 nt, Homo sapiens
gaaagaaguacugaugacu

SEQ ID NO: 719163 - RNA, 19 nt, Homo sapiens
ggcuacaauucucugcuuu

SEQ ID NO: 719164 - RNA, 19 nt, Homo sapiens
ugugagacaugcaagaaag

SEQ ID NO: 719165 - RNA, 19 nt, Homo sapiens
ggaguucagccucagaauc

SEQ ID NO: 719166 - RNA, 19 nt, Homo sapiens
gguuuguaguuagugcuua

SEQ ID NO: 719167 - RNA, 19 nt, Homo sapiens
uuccauaacuguagagucu

SEQ ID NO: 719168 - RNA, 19 nt, Homo sapiens
uugacuagcuaauaaacug

SEQ ID NO: 719169 - RNA, 19 nt, Homo sapiens
uauaggaguccgugauuuc

SEQ ID NO: 719170 - RNA, 19 nt, Homo sapiens
aaagauccgugagcaacga

SEQ ID NO: 719171 - RNA, 19 nt, Homo sapiens
aaagucgugugcccgagaa

SEQ ID NO: 719172 - RNA, 19 nt, Homo sapiens
cuacaauucucugcuuucu

SEQ ID NO: 719173 - RNA, 19 nt, Homo sapiens
cggcuacaauucucugcuu

SEQ ID NO: 719174 - RNA, 19 nt, Homo sapiens
guaacacgucaaccauuug

SEQ ID NO: 719175 - RNA, 19 nt, Homo sapiens
guuuguaguuagugcuuau

SEQ ID NO: 719176 - RNA, 19 nt, Homo sapiens
gagcaccucaaagagcaua

SEQ ID NO: 719177 - RNA, 19 nt, Homo sapiens
cgagaagguguacaucaug

SEQ ID NO: 719178 - RNA, 19 nt, Homo sapiens
gaucgagcaccucaaagag

SEQ ID NO: 719179 - RNA, 19 nt, Homo sapiens
guacugaugacuuuucaaa

SEQ ID NO: 719180 - RNA, 19 nt, Homo sapiens
gagcuggagaggacguuga

SEQ ID NO: 719181 - RNA, 19 nt, Homo sapiens
gcugugagacaugcaagaa

SEQ ID NO: 719182 - RNA, 19 nt, Homo sapiens
ugauguugacuagcuaaua

SEQ ID NO: 719183 - RNA, 19 nt, Homo sapiens
guucggagucugcgucguu

SEQ ID NO: 719184 - RNA, 19 nt, Homo sapiens
auauaggaguccgugauuu

SEQ ID NO: 719185 - RNA, 19 nt, Homo sapiens
aauauaggaguccgugauu

SEQ ID NO: 719186 - RNA, 19 nt, Homo sapiens
gacuagcuaauaaacugua

SEQ ID NO: 719187 - RNA, 19 nt, Homo sapiens
ccgcucagaagaacauuga

SEQ ID NO: 719188 - RNA, 19 nt, Homo sapiens
gaagcucagcguccucaag

SEQ ID NO: 719189 - RNA, 19 nt, Homo sapiens
ggaagaggaagcgcaugga

SEQ ID NO: 719190 - RNA, 19 nt, Homo sapiens
cugcuucgagaauguauaa

SEQ ID NO: 719191 - RNA, 19 nt, Homo sapiens
ccuacgagacgcugaacaa

SEQ ID NO: 719192 - RNA, 19 nt, Homo sapiens
cauuuggauugguaggauu

SEQ ID NO: 719193 - RNA, 19 nt, Homo sapiens
ccgucaagaugauaaaguc

SEQ ID NO: 719194 - RNA, 19 nt, Homo sapiens
uacaccagcugggaaacaa

SEQ ID NO: 719195 - RNA, 19 nt, Homo sapiens
acacgcacaucuccguaca

SEQ ID NO: 719196 - RNA, 19 nt, Homo sapiens
uaucguaagagguuuguag

SEQ ID NO: 719197 - RNA, 19 nt, Homo sapiens
aagcucagcguccucaaga

SEQ ID NO: 719198 - RNA, 19 nt, Homo sapiens
gcaccggagggacacuuau

SEQ ID NO: 719199 - RNA, 19 nt, Homo sapiens
cuacaacacggcugucaag

SEQ ID NO: 719200 - RNA, 19 nt, Homo sapiens
agaacaauccgcccaugau

SEQ ID NO: 719201 - RNA, 19 nt, Homo sapiens
cagagaaccguaucguaag

SEQ ID NO: 719202 - RNA, 19 nt, Homo sapiens
gagucuaauugcuauccau

SEQ ID NO: 719203 - RNA, 19 nt, Homo sapiens
acgagacgcugaacaaacg

SEQ ID NO: 719204 - RNA, 19 nt, Homo sapiens
ggagaacgggcugguccuu

SEQ ID NO: 719205 - RNA, 19 nt, Homo sapiens
ucaguuucuuuccuucugu

SEQ ID NO: 719206 - RNA, 19 nt, Homo sapiens
caacgauaaauacucuuag

SEQ ID NO: 719207 - RNA, 19 nt, Homo sapiens
caccagcugggaaacaauu

SEQ ID NO: 719208 - RNA, 19 nt, Homo sapiens
gcacgguggcggaucugau

SEQ ID NO: 719209 - RNA, 19 nt, Homo sapiens
agaggaaggcgguggaauc

SEQ ID NO: 719210 - RNA, 19 nt, Homo sapiens
gaguucagccucagaaucc

SEQ ID NO: 719211 - RNA, 19 nt, Homo sapiens
cuacgagacgcugaacaaa

SEQ ID NO: 719212 - RNA, 19 nt, Homo sapiens
cagaugaggugaaagcuua

SEQ ID NO: 719213 - RNA, 19 nt, Homo sapiens
ugaaugagauugagaagga

SEQ ID NO: 719214 - RNA, 19 nt, Homo sapiens
gcagacauguguugcuuug

SEQ ID NO: 719215 - RNA, 19 nt, Homo sapiens
cagcggagccugcacguua

SEQ ID NO: 719216 - RNA, 19 nt, Homo sapiens
gcaaggcacugcagaaacu

SEQ ID NO: 719217 - RNA, 19 nt, Homo sapiens
uuaugaagcuguccuuuga

SEQ ID NO: 719218 - RNA, 19 nt, Homo sapiens
uuaauaaacugagcucuug

SEQ ID NO: 719219 - RNA, 19 nt, Homo sapiens
gaagaagccggaugacaug

SEQ ID NO: 719220 - RNA, 19 nt, Homo sapiens
gaacagccuuggacaucau

SEQ ID NO: 719221 - RNA, 19 nt, Homo sapiens
cggaagaccuugccucugu

SEQ ID NO: 719222 - RNA, 19 nt, Homo sapiens
gguguuuccugcugaauga

SEQ ID NO: 719223 - RNA, 19 nt, Homo sapiens
gcaacucgcuggccaucau

SEQ ID NO: 719224 - RNA, 19 nt, Homo sapiens
aaacggacguguaaauagu

SEQ ID NO: 719225 - RNA, 19 nt, Homo sapiens
gcaaggaggcagagaagga

SEQ ID NO: 719226 - RNA, 19 nt, Homo sapiens
ucaauucccuucugguuca

SEQ ID NO: 719227 - RNA, 19 nt, Homo sapiens
ggcgagcgcugaugggaaa

SEQ ID NO: 719228 - RNA, 19 nt, Homo sapiens
ggauggagcucaaaaggaa

SEQ ID NO: 719229 - RNA, 19 nt, Homo sapiens
caacaaggccacccugugu

SEQ ID NO: 719230 - RNA, 19 nt, Homo sapiens
gagaagcucugguacuacu

SEQ ID NO: 719231 - RNA, 19 nt, Homo sapiens
gaacaaaugacgggugaau

SEQ ID NO: 719232 - RNA, 19 nt, Homo sapiens
ggacaaucaacucaaggua

SEQ ID NO: 719233 - RNA, 19 nt, Homo sapiens
gcaaggcugucagguuguu

SEQ ID NO: 719234 - RNA, 19 nt, Homo sapiens
gagcaagguucccgagaag

SEQ ID NO: 719235 - RNA, 19 nt, Homo sapiens
ggaagguggugcggcauug

SEQ ID NO: 719236 - RNA, 19 nt, Homo sapiens
ccaagaagaagccggauga

SEQ ID NO: 719237 - RNA, 19 nt, Homo sapiens
gacaggacguccauaaguc

SEQ ID NO: 719238 - RNA, 19 nt, Homo sapiens
aggagaagcucugguacua

SEQ ID NO: 719239 - RNA, 19 nt, Homo sapiens
ugaagcaccuacagggaaa

SEQ ID NO: 719240 - RNA, 19 nt, Homo sapiens
acgcagggcuggagaguau

SEQ ID NO: 719241 - RNA, 19 nt, Homo sapiens
gccgguaauucgcuaauga

SEQ ID NO: 719242 - RNA, 19 nt, Homo sapiens
gaggugaaagcuuauagaa

SEQ ID NO: 719243 - RNA, 19 nt, Homo sapiens
ccagacaggacguccauaa

SEQ ID NO: 719244 - RNA, 19 nt, Homo sapiens
ugagcaagguucccgagaa

SEQ ID NO: 719245 - RNA, 19 nt, Homo sapiens
gcugaaggcccuacagaug

SEQ ID NO: 719246 - RNA, 19 nt, Homo sapiens
ggacguguaaauaguggua

SEQ ID NO: 719247 - RNA, 19 nt, Homo sapiens
ggacaaggagcuccagaca

SEQ ID NO: 719248 - RNA, 19 nt, Homo sapiens
ccgccacccuccuggaaua

SEQ ID NO: 719249 - RNA, 19 nt, Homo sapiens
gguggucucuucugagcuu

SEQ ID NO: 719250 - RNA, 19 nt, Homo sapiens
gcaggaggcagacaugugu

SEQ ID NO: 719251 - RNA, 19 nt, Homo sapiens
gcacacagcacagagaaca

SEQ ID NO: 719252 - RNA, 19 nt, Homo sapiens
acuaugagaugcacaagau

SEQ ID NO: 719253 - RNA, 19 nt, Homo sapiens
gaugggaaaggaacaaaga

SEQ ID NO: 719254 - RNA, 19 nt, Homo sapiens
cugcucaucuugucccuuu

SEQ ID NO: 719255 - RNA, 19 nt, Homo sapiens
agaaggagaagcucuggua

SEQ ID NO: 719256 - RNA, 19 nt, Homo sapiens
ggacaucaccagccuguac

SEQ ID NO: 719257 - RNA, 19 nt, Homo sapiens
uuaaacggacguguaaaua

SEQ ID NO: 719258 - RNA, 19 nt, Homo sapiens
ggcagcagcuugaguucga

SEQ ID NO: 719259 - RNA, 19 nt, Homo sapiens
gcauugccuuccacauaug

SEQ ID NO: 719260 - RNA, 19 nt, Homo sapiens
ccacguggcacacagaaga

SEQ ID NO: 719261 - RNA, 19 nt, Homo sapiens
gcuccgggaucacaacugu

SEQ ID NO: 719262 - RNA, 19 nt, Homo sapiens
caggacagaccaagaagaa

SEQ ID NO: 719263 - RNA, 19 nt, Homo sapiens
ggaaccugguggucucuuc

SEQ ID NO: 719264 - RNA, 19 nt, Homo sapiens
gcagggcuggagaguauuu

SEQ ID NO: 719265 - RNA, 19 nt, Homo sapiens
ccacugaggaggccgugua

SEQ ID NO: 719266 - RNA, 19 nt, Homo sapiens
gcagcaaggugcgcaacau

SEQ ID NO: 719267 - RNA, 19 nt, Homo sapiens
guaaucuggugcacuccaa

SEQ ID NO: 719268 - RNA, 19 nt, Homo sapiens
gggccgacaucaacagcaa

SEQ ID NO: 719269 - RNA, 19 nt, Homo sapiens
gcagguugacuaugagaug

SEQ ID NO: 719270 - RNA, 19 nt, Homo sapiens
uggagcagauugacaagga

SEQ ID NO: 719271 - RNA, 19 nt, Homo sapiens
ugaaggcccuacagaugga

SEQ ID NO: 719272 - RNA, 19 nt, Homo sapiens
acagagacgucgggcauga

SEQ ID NO: 719273 - RNA, 19 nt, Homo sapiens
uaaacggacguguaaauag

SEQ ID NO: 719274 - RNA, 19 nt, Homo sapiens
gcacgccggucaacuucuc

SEQ ID NO: 719275 - RNA, 19 nt, Homo sapiens
ccagccggcuugaccuuga

SEQ ID NO: 719276 - RNA, 19 nt, Homo sapiens
guccuucccuaaauguaaa

SEQ ID NO: 719277 - RNA, 19 nt, Homo sapiens
agacauguguugcuuugca

SEQ ID NO: 719278 - RNA, 19 nt, Homo sapiens
guuaaacggacguguaaau

SEQ ID NO: 719279 - RNA, 19 nt, Homo sapiens
gccaaaggguagggaaaug

SEQ ID NO: 719280 - RNA, 19 nt, Homo sapiens
ccgcaccgcugcucaucuu

SEQ ID NO: 719281 - RNA, 19 nt, Homo sapiens
ugagcacccugaccuacaa

SEQ ID NO: 719282 - RNA, 19 nt, Homo sapiens
ccuggaagcucacagaacu

SEQ ID NO: 719283 - RNA, 19 nt, Homo sapiens
uuacggagaccaucacaug

SEQ ID NO: 719284 - RNA, 19 nt, Homo sapiens
agaagaagccggaugacau

SEQ ID NO: 719285 - RNA, 19 nt, Homo sapiens
cccuagaacuccagaaaca

SEQ ID NO: 719286 - RNA, 19 nt, Homo sapiens
ggcaggagcuaagggacaa

SEQ ID NO: 719287 - RNA, 19 nt, Homo sapiens
cugcacagcuuagguguca

SEQ ID NO: 719288 - RNA, 19 nt, Homo sapiens
gagcucagccaccgaugga

SEQ ID NO: 719289 - RNA, 19 nt, Homo sapiens
gaaggcacacgcucaaugc

SEQ ID NO: 719290 - RNA, 19 nt, Homo sapiens
ccaauggaaaggagacuga

SEQ ID NO: 719291 - RNA, 19 nt, Homo sapiens
cagcaaggcacugcagaaa

SEQ ID NO: 719292 - RNA, 19 nt, Homo sapiens
gaagcuguccuuugaugag

SEQ ID NO: 719293 - RNA, 19 nt, Homo sapiens
guuaugaagcuguccuuug

SEQ ID NO: 719294 - RNA, 19 nt, Homo sapiens
gacucgcacacauuuaaua

SEQ ID NO: 719295 - RNA, 19 nt, Homo sapiens
guguuaaacggacguguaa

SEQ ID NO: 719296 - RNA, 19 nt, Homo sapiens
caagguacgcccacugcaa

SEQ ID NO: 719297 - RNA, 19 nt, Homo sapiens
guccagcugugcuccagaa

SEQ ID NO: 719298 - RNA, 19 nt, Homo sapiens
aaugacgggugaauacaug

SEQ ID NO: 719299 - RNA, 19 nt, Homo sapiens
cgacagcuaaccuucauca

SEQ ID NO: 719300 - RNA, 19 nt, Homo sapiens
ugaacagccuuggacauca

SEQ ID NO: 719301 - RNA, 19 nt, Homo sapiens
ccaaggaguccacccugaa

SEQ ID NO: 719302 - RNA, 19 nt, Homo sapiens
cagcauccuucggaacuug

SEQ ID NO: 719303 - RNA, 19 nt, Homo sapiens
caaaugguggucccugaga

SEQ ID NO: 719304 - RNA, 19 nt, Homo sapiens
agaaggaggagaaggagaa

SEQ ID NO: 719305 - RNA, 19 nt, Homo sapiens
acaaaugacgggugaauac

SEQ ID NO: 719306 - RNA, 19 nt, Homo sapiens
ugccagaccucgguuccua

SEQ ID NO: 719307 - RNA, 19 nt, Homo sapiens
ggugccagaugaggugaaa

SEQ ID NO: 719308 - RNA, 19 nt, Homo sapiens
gacgaacagugaucuacgu

SEQ ID NO: 719309 - RNA, 19 nt, Homo sapiens
uaugagaugcacaagauga

SEQ ID NO: 719310 - RNA, 19 nt, Homo sapiens
caccugugcuguuaugaag

SEQ ID NO: 719311 - RNA, 19 nt, Homo sapiens
ggccaccugugcuguuaug

SEQ ID NO: 719312 - RNA, 19 nt, Homo sapiens
gaucaugaauguccgaaga

SEQ ID NO: 719313 - RNA, 19 nt, Homo sapiens
gaugagacccuacuacuga

SEQ ID NO: 719314 - RNA, 19 nt, Homo sapiens
cagcaaaggugccaaagau

SEQ ID NO: 719315 - RNA, 19 nt, Homo sapiens
acuaagaggugaacaugua

SEQ ID NO: 719316 - RNA, 19 nt, Homo sapiens
gcuccuaccuggacaacuu

SEQ ID NO: 719317 - RNA, 19 nt, Homo sapiens
gcgccgagccgaugaguaa

SEQ ID NO: 719318 - RNA, 19 nt, Homo sapiens
ggaagaagcggguggagau

SEQ ID NO: 719319 - RNA, 19 nt, Homo sapiens
gggugaagcugucagacuu

SEQ ID NO: 719320 - RNA, 19 nt, Homo sapiens
ggauaauggugauugagau

SEQ ID NO: 719321 - RNA, 19 nt, Homo sapiens
cagaaccacugccugaaga

SEQ ID NO: 719322 - RNA, 19 nt, Homo sapiens
agaaugugguggagaugua

SEQ ID NO: 719323 - RNA, 19 nt, Homo sapiens
ggacaacuucaucaagauu

SEQ ID NO: 719324 - RNA, 19 nt, Homo sapiens
ucaaagccaugaagaugau

SEQ ID NO: 719325 - RNA, 19 nt, Homo sapiens
ggacgaguuugagaacaug

SEQ ID NO: 719326 - RNA, 19 nt, Homo sapiens
guucuucugucuccaggaa

SEQ ID NO: 719327 - RNA, 19 nt, Homo sapiens
ucaacgaggugguaaucau

SEQ ID NO: 719328 - RNA, 19 nt, Homo sapiens
cuggacaacuucaucaaga

SEQ ID NO: 719329 - RNA, 19 nt, Homo sapiens
gggauaauggugauugaga

SEQ ID NO: 719330 - RNA, 19 nt, Homo sapiens
gcagcaaaggugccaaaga

SEQ ID NO: 719331 - RNA, 19 nt, Homo sapiens
gaggugaacauguaugagu

SEQ ID NO: 719332 - RNA, 19 nt, Homo sapiens
gaagaugauucgggacaac

SEQ ID NO: 719333 - RNA, 19 nt, Homo sapiens
gauaauggugauugagaug

SEQ ID NO: 719334 - RNA, 19 nt, Homo sapiens
ggacuaccagcacgagaau

SEQ ID NO: 719335 - RNA, 19 nt, Homo sapiens
caacgaggugguaaucaug

SEQ ID NO: 719336 - RNA, 19 nt, Homo sapiens
gugaagcugucagacuuug

SEQ ID NO: 719337 - RNA, 19 nt, Homo sapiens
gcaagcugguggccgucaa

SEQ ID NO: 719338 - RNA, 19 nt, Homo sapiens
guuuugaucucgugacuuu

SEQ ID NO: 719339 - RNA, 19 nt, Homo sapiens
gaguaucccaugagcaguu

SEQ ID NO: 719340 - RNA, 19 nt, Homo sapiens
ccucaaagccaugaagaug

SEQ ID NO: 719341 - RNA, 19 nt, Homo sapiens
gacaacuucaucaagauug

SEQ ID NO: 719342 - RNA, 19 nt, Homo sapiens
gggacuaccagcacgagaa

SEQ ID NO: 719343 - RNA, 19 nt, Homo sapiens
ggugaagcugucagacuuu

SEQ ID NO: 719344 - RNA, 19 nt, Homo sapiens
ccagaaccgcaccagauga

SEQ ID NO: 719345 - RNA, 19 nt, Homo sapiens
ugaagaugauucgggacaa

SEQ ID NO: 719346 - RNA, 19 nt, Homo sapiens
gccagaaccgcaccagaug

SEQ ID NO: 719347 - RNA, 19 nt, Homo sapiens
cgauccugcugacccauga

SEQ ID NO: 719348 - RNA, 19 nt, Homo sapiens
gcucuucaacgagguggua

SEQ ID NO: 719349 - RNA, 19 nt, Homo sapiens
gcagggugaagcugucaga

SEQ ID NO: 719350 - RNA, 19 nt, Homo sapiens
gcugguggccgucaagaag

SEQ ID NO: 719351 - RNA, 19 nt, Homo sapiens
uaauggugauugagauggu

SEQ ID NO: 719352 - RNA, 19 nt, Homo sapiens
gaagaagcggguggagauc

SEQ ID NO: 719353 - RNA, 19 nt, Homo sapiens
gagaaugugguggagaugu

SEQ ID NO: 719354 - RNA, 19 nt, Homo sapiens
acgagaaugugguggagau

SEQ ID NO: 719355 - RNA, 19 nt, Homo sapiens
cagagaagaggcccaaguc

SEQ ID NO: 719356 - RNA, 19 nt, Homo sapiens
acacuaagaggugaacaug

SEQ ID NO: 719357 - RNA, 19 nt, Homo sapiens
uggacaacuucaucaagau

SEQ ID NO: 719358 - RNA, 19 nt, Homo sapiens
guggagagaacacuaagag

SEQ ID NO: 719359 - RNA, 19 nt, Homo sapiens
uggacgaguuugagaacau

SEQ ID NO: 719360 - RNA, 19 nt, Homo sapiens
aagaggugaacauguauga

SEQ ID NO: 719361 - RNA, 19 nt, Homo sapiens
ggaugaacgaggagcagau

SEQ ID NO: 719362 - RNA, 19 nt, Homo sapiens
gcaccauguuugggaagag

SEQ ID NO: 719363 - RNA, 19 nt, Homo sapiens
ccagagaagaggcccaagu

SEQ ID NO: 719364 - RNA, 19 nt, Homo sapiens
cacagcgaguaucccauga

SEQ ID NO: 719365 - RNA, 19 nt, Homo sapiens
ucaugaauguccgaagagu

SEQ ID NO: 719366 - RNA, 19 nt, Homo sapiens
guuccaggucgagcaguua

SEQ ID NO: 719367 - RNA, 19 nt, Homo sapiens
uaacauaggucuucagaaa

SEQ ID NO: 719368 - RNA, 19 nt, Homo sapiens
ccaaagcuguuguacauuu

SEQ ID NO: 719369 - RNA, 19 nt, Homo sapiens
acacacaacuaucuguuua

SEQ ID NO: 719370 - RNA, 19 nt, Homo sapiens
gagcagcgguguaagauuc

SEQ ID NO: 719371 - RNA, 19 nt, Homo sapiens
gaacauugaccuucacuau

SEQ ID NO: 719372 - RNA, 19 nt, Homo sapiens
ccaagaacguuaaaggaaa

SEQ ID NO: 719373 - RNA, 19 nt, Homo sapiens
caucuggucucgcugguua

SEQ ID NO: 719374 - RNA, 19 nt, Homo sapiens
guauaugucuucuacuuug

SEQ ID NO: 719375 - RNA, 19 nt, Homo sapiens
gcaagucagccaaacauaa

SEQ ID NO: 719376 - RNA, 19 nt, Homo sapiens
gcagagugaucuuccagaa

SEQ ID NO: 719377 - RNA, 19 nt, Homo sapiens
gaacugaacccuuacaaac

SEQ ID NO: 719378 - RNA, 19 nt, Homo sapiens
caccaaagcuguuguacau

SEQ ID NO: 719379 - RNA, 19 nt, Homo sapiens
gaauaucuguucccuugga

SEQ ID NO: 719380 - RNA, 19 nt, Homo sapiens
ugucauagcuucugguguu

SEQ ID NO: 719381 - RNA, 19 nt, Homo sapiens
ggauauuucuguugauugu

SEQ ID NO: 719382 - RNA, 19 nt, Homo sapiens
agagugugcugccuaauuu

SEQ ID NO: 719383 - RNA, 19 nt, Homo sapiens
acauugaccuucacuauau

SEQ ID NO: 719384 - RNA, 19 nt, Homo sapiens
guacauucuuucuuucuug

SEQ ID NO: 719385 - RNA, 19 nt, Homo sapiens
uaagggaacuguacauucu

SEQ ID NO: 719386 - RNA, 19 nt, Homo sapiens
gaacagguuuacgcaaaug

SEQ ID NO: 719387 - RNA, 19 nt, Homo sapiens
gagcuggccuuuuaacaua

SEQ ID NO: 719388 - RNA, 19 nt, Homo sapiens
gaaguauucccuccucauu

SEQ ID NO: 719389 - RNA, 19 nt, Homo sapiens
gguguaagauucugcuguu

SEQ ID NO: 719390 - RNA, 19 nt, Homo sapiens
gcaaauggcauccggaaca

SEQ ID NO: 719391 - RNA, 19 nt, Homo sapiens
gaauuugaaugauccagau

SEQ ID NO: 719392 - RNA, 19 nt, Homo sapiens
gugcauuucuccuagcuuu

SEQ ID NO: 719393 - RNA, 19 nt, Homo sapiens
gaauaaaguaguugucuca

SEQ ID NO: 719394 - RNA, 19 nt, Homo sapiens
ggucuuagauugacagcau

SEQ ID NO: 719395 - RNA, 19 nt, Homo sapiens
gaacggaaaucuggcaaac

SEQ ID NO: 719396 - RNA, 19 nt, Homo sapiens
gaccuucacuauauuguuc

SEQ ID NO: 719397 - RNA, 19 nt, Homo sapiens
caugaagacuuugauaguu

SEQ ID NO: 719398 - RNA, 19 nt, Homo sapiens
auucagaccuuaccaagaa

SEQ ID NO: 719399 - RNA, 19 nt, Homo sapiens
ccuaagugguaagcaauua

SEQ ID NO: 719400 - RNA, 19 nt, Homo sapiens
gaaagcguauaacauaggu

SEQ ID NO: 719401 - RNA, 19 nt, Homo sapiens
cugagaugcuugugaagua

SEQ ID NO: 719402 - RNA, 19 nt, Homo sapiens
gaccuuaccaagaacguua

SEQ ID NO: 719403 - RNA, 19 nt, Homo sapiens
ccaacuguacugcaucuua

SEQ ID NO: 719404 - RNA, 19 nt, Homo sapiens
gaaaucagcaguggagugu

SEQ ID NO: 719405 - RNA, 19 nt, Homo sapiens
ugcuggaucuucauucuua

SEQ ID NO: 719406 - RNA, 19 nt, Homo sapiens
gauacuugcuggaucuuca

SEQ ID NO: 719407 - RNA, 19 nt, Homo sapiens
gagugucugugguaagaaa

SEQ ID NO: 719408 - RNA, 19 nt, Homo sapiens
acagucaucccaagaauaa

SEQ ID NO: 719409 - RNA, 19 nt, Homo sapiens
caaaaucauugcagcuaua

SEQ ID NO: 719410 - RNA, 19 nt, Homo sapiens
uggcugagcuggccuuuua

SEQ ID NO: 719411 - RNA, 19 nt, Homo sapiens
cauuagagaagacugguua

SEQ ID NO: 719412 - RNA, 19 nt, Homo sapiens
ggaaacaaguagaaaucag

SEQ ID NO: 719413 - RNA, 19 nt, Homo sapiens
gaacuguacauucuuucuu

SEQ ID NO: 719414 - RNA, 19 nt, Homo sapiens
cauugcagcuauaacauug

SEQ ID NO: 719415 - RNA, 19 nt, Homo sapiens
cauaaaucuuucagaguga

SEQ ID NO: 719416 - RNA, 19 nt, Homo sapiens
ggaaauguuugaugcuacu

SEQ ID NO: 719417 - RNA, 19 nt, Homo sapiens
ggaagaaaaugaaaacagu

SEQ ID NO: 719418 - RNA, 19 nt, Homo sapiens
ucucauagaaagcguauaa

SEQ ID NO: 719419 - RNA, 19 nt, Homo sapiens
caacuguacugcaucuuac

SEQ ID NO: 719420 - RNA, 19 nt, Homo sapiens
acggaaaucuggcaaacaa

SEQ ID NO: 719421 - RNA, 19 nt, Homo sapiens
gugcaaaucaacaaguuaa

SEQ ID NO: 719422 - RNA, 19 nt, Homo sapiens
cauacaaugucaugcucua

SEQ ID NO: 719423 - RNA, 19 nt, Homo sapiens
uuaagagugugcugccuaa

SEQ ID NO: 719424 - RNA, 19 nt, Homo sapiens
gguguccugugguuucuaa

SEQ ID NO: 719425 - RNA, 19 nt, Homo sapiens
gaagacugguuagaacauc

SEQ ID NO: 719426 - RNA, 19 nt, Homo sapiens
ggauuuaggacuucugaga

SEQ ID NO: 719427 - RNA, 19 nt, Homo sapiens
gcaaggucauaaaucuuuc

SEQ ID NO: 719428 - RNA, 19 nt, Homo sapiens
acuuuaugcuucacuguua

SEQ ID NO: 719429 - RNA, 19 nt, Homo sapiens
ucagagagcagcgguguaa

SEQ ID NO: 719430 - RNA, 19 nt, Homo sapiens
ccacagucaucccaagaau

SEQ ID NO: 719431 - RNA, 19 nt, Homo sapiens
caggauauuucuguugauu

SEQ ID NO: 719432 - RNA, 19 nt, Homo sapiens
cuaaggaauuugaaugauc

SEQ ID NO: 719433 - RNA, 19 nt, Homo sapiens
caaagcuguuguacauuuc

SEQ ID NO: 719434 - RNA, 19 nt, Homo sapiens
ccucaucugccuuacuuua

SEQ ID NO: 719435 - RNA, 19 nt, Homo sapiens
acacccacauccucucuuu

SEQ ID NO: 719436 - RNA, 19 nt, Homo sapiens
ucugaaagaucgagaacug

SEQ ID NO: 719437 - RNA, 19 nt, Homo sapiens
aguauucccuccucauuug

SEQ ID NO: 719438 - RNA, 19 nt, Homo sapiens
cagguuagaaguuuagaaa

SEQ ID NO: 719439 - RNA, 19 nt, Homo sapiens
gcuguuggcuggaguuguc

SEQ ID NO: 719440 - RNA, 19 nt, Homo sapiens
gaccugguguccugugguu

SEQ ID NO: 719441 - RNA, 19 nt, Homo sapiens
uguauaguaucuugugcua

SEQ ID NO: 719442 - RNA, 19 nt, Homo sapiens
ucaugugucuguguuugua

SEQ ID NO: 719443 - RNA, 19 nt, Homo sapiens
gguauaugucuucuacuuu

SEQ ID NO: 719444 - RNA, 19 nt, Homo sapiens
ugucugagauuuguauaug

SEQ ID NO: 719445 - RNA, 19 nt, Homo sapiens
uugaacagguuuacgcaaa

SEQ ID NO: 719446 - RNA, 19 nt, Homo sapiens
uugauugucuucaugugua

SEQ ID NO: 719447 - RNA, 19 nt, Homo sapiens
ccaaacauaagcuaccaaa

SEQ ID NO: 719448 - RNA, 19 nt, Homo sapiens
uagaaagcguauaacauag

SEQ ID NO: 719449 - RNA, 19 nt, Homo sapiens
cuacuuugccuccuucauu

SEQ ID NO: 719450 - RNA, 19 nt, Homo sapiens
ggaauguauuucguuggaa

SEQ ID NO: 719451 - RNA, 19 nt, Homo sapiens
cuucugagaugcuugugaa

SEQ ID NO: 719452 - RNA, 19 nt, Homo sapiens
caagaacguuaaaggaaac

SEQ ID NO: 719453 - RNA, 19 nt, Homo sapiens
uuacugcugucugagauuu

SEQ ID NO: 719454 - RNA, 19 nt, Homo sapiens
gaacuacgaacggaaaucu

SEQ ID NO: 719455 - RNA, 19 nt, Homo sapiens
gcaaaucaacaaguuaaca

SEQ ID NO: 719456 - RNA, 19 nt, Homo sapiens
ucaggaaaucccaaaguuu

SEQ ID NO: 719457 - RNA, 19 nt, Homo sapiens
aaccuuggauuaaacagaa

SEQ ID NO: 719458 - RNA, 19 nt, Homo sapiens
uuuguggacuucucucuuu

SEQ ID NO: 719459 - RNA, 19 nt, Homo sapiens
uguuugagcuggucauugu

SEQ ID NO: 719460 - RNA, 19 nt, Homo sapiens
acugaacccuuacaaacuu

SEQ ID NO: 719461 - RNA, 19 nt, Homo sapiens
gagaugcuugugaaguaua

SEQ ID NO: 719462 - RNA, 19 nt, Homo sapiens
guaagauucugcuguucuc

SEQ ID NO: 719463 - RNA, 19 nt, Homo sapiens
ugaacagguuuacgcaaau

SEQ ID NO: 719464 - RNA, 19 nt, Homo sapiens
gugcgagcguggacuguga

SEQ ID NO: 719465 - RNA, 19 nt, Homo sapiens
agagaagacugguuagaac

SEQ ID NO: 719466 - RNA, 19 nt, Homo sapiens
cagugcaaaucaacaaguu

SEQ ID NO: 719467 - RNA, 19 nt, Homo sapiens
ggacgaggaugccauguca

SEQ ID NO: 719468 - RNA, 19 nt, Homo sapiens
gcaagaugaugucugaguu

SEQ ID NO: 719469 - RNA, 19 nt, Homo sapiens
cuacagcccugaacucuug

SEQ ID NO: 719470 - RNA, 19 nt, Homo sapiens
gaacaucgucaaccagaaa

SEQ ID NO: 719471 - RNA, 19 nt, Homo sapiens
acaacucucuccagcaaua

SEQ ID NO: 719472 - RNA, 19 nt, Homo sapiens
acaagaaccuggacacugu

SEQ ID NO: 719473 - RNA, 19 nt, Homo sapiens
gaggaaaggcugugucuuc

SEQ ID NO: 719474 - RNA, 19 nt, Homo sapiens
gggcugcugcuguaauuua

SEQ ID NO: 719475 - RNA, 19 nt, Homo sapiens
agacaacucucuccagcaa

SEQ ID NO: 719476 - RNA, 19 nt, Homo sapiens
caagacagccuggaaguug

SEQ ID NO: 719477 - RNA, 19 nt, Homo sapiens
gaggagaggcugcauaagu

SEQ ID NO: 719478 - RNA, 19 nt, Homo sapiens
gcccugaacucuugagaca

SEQ ID NO: 719479 - RNA, 19 nt, Homo sapiens
gggaggagaggcugcauaa

SEQ ID NO: 719480 - RNA, 19 nt, Homo sapiens
caucugcaaugaccaguug

SEQ ID NO: 719481 - RNA, 19 nt, Homo sapiens
gcaccucccugaagcugau

SEQ ID NO: 719482 - RNA, 19 nt, Homo sapiens
gcaaugaccaguugauagg

SEQ ID NO: 719483 - RNA, 19 nt, Homo sapiens
ucugggaccuggagaaguu

SEQ ID NO: 719484 - RNA, 19 nt, Homo sapiens
cugcugcuguaauuuauaa

SEQ ID NO: 719485 - RNA, 19 nt, Homo sapiens
gaaccugagcggugcuuug

SEQ ID NO: 719486 - RNA, 19 nt, Homo sapiens
ccggcaagaugaugucuga

SEQ ID NO: 719487 - RNA, 19 nt, Homo sapiens
cagcaaaggaggcagcaaa

SEQ ID NO: 719488 - RNA, 19 nt, Homo sapiens
gugaagcucugggaucuca

SEQ ID NO: 719489 - RNA, 19 nt, Homo sapiens
aggagaggcugcauaagug

SEQ ID NO: 719490 - RNA, 19 nt, Homo sapiens
gaggaugccaugucacaga

SEQ ID NO: 719491 - RNA, 19 nt, Homo sapiens
ccuggaagcugccaaaauu

SEQ ID NO: 719492 - RNA, 19 nt, Homo sapiens
aagcccaacugcaucauga

SEQ ID NO: 719493 - RNA, 19 nt, Homo sapiens
ccugagcggugcuuugaug

SEQ ID NO: 719494 - RNA, 19 nt, Homo sapiens
gcaaaggccacgacaccau

SEQ ID NO: 719495 - RNA, 19 nt, Homo sapiens
ggacuacaacgagaucuuc

SEQ ID NO: 719496 - RNA, 19 nt, Homo sapiens
ggaccuggaagcugccaaa

SEQ ID NO: 719497 - RNA, 19 nt, Homo sapiens
agagcaacgucuccuccua

SEQ ID NO: 719498 - RNA, 19 nt, Homo sapiens
gggugaagcagaacucaga

SEQ ID NO: 719499 - RNA, 19 nt, Homo sapiens
ucaacguggucgaguuuca

SEQ ID NO: 719500 - RNA, 19 nt, Homo sapiens
gccuggaaguugcaagaga

SEQ ID NO: 719501 - RNA, 19 nt, Homo sapiens
gaccaugggcgacaucaag

SEQ ID NO: 719502 - RNA, 19 nt, Homo sapiens
ucaacaagcccaacugcau

SEQ ID NO: 719503 - RNA, 19 nt, Homo sapiens
ccugaacucuugagacaac

SEQ ID NO: 719504 - RNA, 19 nt, Homo sapiens
ugaacaucgucaaccagaa

SEQ ID NO: 719505 - RNA, 19 nt, Homo sapiens
caagaugaugucugaguuc

SEQ ID NO: 719506 - RNA, 19 nt, Homo sapiens
ccuggaaguugcaagagau

SEQ ID NO: 719507 - RNA, 19 nt, Homo sapiens
cagaugaccacaccgugaa

SEQ ID NO: 719508 - RNA, 19 nt, Homo sapiens
caacaucugcagccuggau

SEQ ID NO: 719509 - RNA, 19 nt, Homo sapiens
ggcugcugcuguaauuuau

SEQ ID NO: 719510 - RNA, 19 nt, Homo sapiens
cugcagagcaaguaugaga

SEQ ID NO: 719511 - RNA, 19 nt, Homo sapiens
cgacgcagccacagcaaag

SEQ ID NO: 719512 - RNA, 19 nt, Homo sapiens
gaacgccgaggacuacaac

SEQ ID NO: 719513 - RNA, 19 nt, Homo sapiens
gaccuggccaucugcaaug

SEQ ID NO: 719514 - RNA, 19 nt, Homo sapiens
ucaccaagacagccuggaa

SEQ ID NO: 719515 - RNA, 19 nt, Homo sapiens
gcccagcuuugcccaacug

SEQ ID NO: 719516 - RNA, 19 nt, Homo sapiens
ccaagacagccuggaaguu

SEQ ID NO: 719517 - RNA, 19 nt, Homo sapiens
ccaccguccugccacagau

SEQ ID NO: 719518 - RNA, 19 nt, Homo sapiens
gagagcguccgccucaaca

SEQ ID NO: 719519 - RNA, 19 nt, Homo sapiens
gucaaccugugguccauca

SEQ ID NO: 719520 - RNA, 19 nt, Homo sapiens
aaggcugugucuuccgaua

SEQ ID NO: 719521 - RNA, 19 nt, Homo sapiens
ugucaacguggucgaguuu

SEQ ID NO: 719522 - RNA, 19 nt, Homo sapiens
ucaccagccgccacaagaa

SEQ ID NO: 719523 - RNA, 19 nt, Homo sapiens
ccagaacgccgaggacuac

SEQ ID NO: 719524 - RNA, 19 nt, Homo sapiens
cucagagggugaagcagaa

SEQ ID NO: 719525 - RNA, 19 nt, Homo sapiens
ggcugugucuuccgauaca

SEQ ID NO: 719526 - RNA, 19 nt, Homo sapiens
ucagcggccuggucaagag

SEQ ID NO: 719527 - RNA, 19 nt, Homo sapiens
gcaguucccggugccaaau

SEQ ID NO: 719528 - RNA, 19 nt, Homo sapiens
ccagcaacguguccucacu

SEQ ID NO: 719529 - RNA, 19 nt, Homo sapiens
ggcaagaugaugucugagu

SEQ ID NO: 719530 - RNA, 19 nt, Homo sapiens
gcaaguaugagagcuacgu

SEQ ID NO: 719531 - RNA, 19 nt, Homo sapiens
gcugcugcuguaauuuaua

SEQ ID NO: 719532 - RNA, 19 nt, Homo sapiens
agaaagccucccuguggaa

SEQ ID NO: 719533 - RNA, 19 nt, Homo sapiens
ugucacagauccgcaaagg

SEQ ID NO: 719534 - RNA, 19 nt, Homo sapiens
ccacccguacggcgaguuu

SEQ ID NO: 719535 - RNA, 19 nt, Homo sapiens
ugccauggaugugcaguuc

SEQ ID NO: 719536 - RNA, 19 nt, Homo sapiens
cgaccuggccaucugcaau

SEQ ID NO: 719537 - RNA, 19 nt, Homo sapiens
gaacucuugagacaacucu

SEQ ID NO: 719538 - RNA, 19 nt, Homo sapiens
ugguggaccuccugaacau

SEQ ID NO: 719539 - RNA, 19 nt, Homo sapiens
ccuccuacgugguggaucu

SEQ ID NO: 719540 - RNA, 19 nt, Homo sapiens
ggacauaaguucauucaug

SEQ ID NO: 719541 - RNA, 19 nt, Homo sapiens
guaaggccuuucaauauua

SEQ ID NO: 719542 - RNA, 19 nt, Homo sapiens
gaacagaaccuucaggaau

SEQ ID NO: 719543 - RNA, 19 nt, Homo sapiens
gaacauagggacauaaguu

SEQ ID NO: 719544 - RNA, 19 nt, Homo sapiens
gaagagauuugaugauagu

SEQ ID NO: 719545 - RNA, 19 nt, Homo sapiens
ggaaagcagucuguucuga

SEQ ID NO: 719546 - RNA, 19 nt, Homo sapiens
cuucauaugugcaguauuu

SEQ ID NO: 719547 - RNA, 19 nt, Homo sapiens
ggaacaacuuuaccaguga

SEQ ID NO: 719548 - RNA, 19 nt, Homo sapiens
ggauacacgugcauuuaaa

SEQ ID NO: 719549 - RNA, 19 nt, Homo sapiens
guugggagguaaacaaaua

SEQ ID NO: 719550 - RNA, 19 nt, Homo sapiens
gcaguccucuugcuucuug

SEQ ID NO: 719551 - RNA, 19 nt, Homo sapiens
ggaagagauuugaugauag

SEQ ID NO: 719552 - RNA, 19 nt, Homo sapiens
uaucagcucuuucucuuug

SEQ ID NO: 719553 - RNA, 19 nt, Homo sapiens
uguaaggccuuucaauauu

SEQ ID NO: 719554 - RNA, 19 nt, Homo sapiens
aggaagagauuugaugaua

SEQ ID NO: 719555 - RNA, 19 nt, Homo sapiens
gcagacaaauaucaaaugg

SEQ ID NO: 719556 - RNA, 19 nt, Homo sapiens
caaauacggguccugcuua

SEQ ID NO: 719557 - RNA, 19 nt, Homo sapiens
ccaaguaucuuuccagcau

SEQ ID NO: 719558 - RNA, 19 nt, Homo sapiens
cauguaaggccuuucaaua

SEQ ID NO: 719559 - RNA, 19 nt, Homo sapiens
cagcauguuucucccauuu

SEQ ID NO: 719560 - RNA, 19 nt, Homo sapiens
gagaugaccugccuuaucc

SEQ ID NO: 719561 - RNA, 19 nt, Homo sapiens
caacggaauguaucaauga

SEQ ID NO: 719562 - RNA, 19 nt, Homo sapiens
gaaagcagucuguucugaa

SEQ ID NO: 719563 - RNA, 19 nt, Homo sapiens
gaacaacuuuaccagugau

SEQ ID NO: 719564 - RNA, 19 nt, Homo sapiens
gcaaggaagagauuugaug

SEQ ID NO: 719565 - RNA, 19 nt, Homo sapiens
aacagaaccuucaggaauu

SEQ ID NO: 719566 - RNA, 19 nt, Homo sapiens
ucacaaugcagacaaauau

SEQ ID NO: 719567 - RNA, 19 nt, Homo sapiens
aguaagcacucaauaaauc

SEQ ID NO: 719568 - RNA, 19 nt, Homo sapiens
acaguaagcacucaauaaa

SEQ ID NO: 719569 - RNA, 19 nt, Homo sapiens
ggagaugaccugccuuauc

SEQ ID NO: 719570 - RNA, 19 nt, Homo sapiens
caaggaagagauuugauga

SEQ ID NO: 719571 - RNA, 19 nt, Homo sapiens
gcauguuucucccauuuag

SEQ ID NO: 719572 - RNA, 19 nt, Homo sapiens
caacugggaaccuucauau

SEQ ID NO: 719573 - RNA, 19 nt, Homo sapiens
gcacuuaagccucggaaca

SEQ ID NO: 719574 - RNA, 19 nt, Homo sapiens
aauaucagcucuuucucuu

SEQ ID NO: 719575 - RNA, 19 nt, Homo sapiens
guucauucaugccaaguau

SEQ ID NO: 719576 - RNA, 19 nt, Homo sapiens
acagaagauugaagccuuu

SEQ ID NO: 719577 - RNA, 19 nt, Homo sapiens
cacaguaagcacucaauaa

SEQ ID NO: 719578 - RNA, 19 nt, Homo sapiens
ugaccugccuuauccuguu

SEQ ID NO: 719579 - RNA, 19 nt, Homo sapiens
gagucacaaugcagacaaa

SEQ ID NO: 719580 - RNA, 19 nt, Homo sapiens
gggagauuguugcaaggaa

SEQ ID NO: 719581 - RNA, 19 nt, Homo sapiens
gcucuuucucuuuguauuu

SEQ ID NO: 719582 - RNA, 19 nt, Homo sapiens
caacagagaagggaaagca

SEQ ID NO: 719583 - RNA, 19 nt, Homo sapiens
ugucuaaacuccaaacaac

SEQ ID NO: 719584 - RNA, 19 nt, Homo sapiens
agaaaggaaugaagaacag

SEQ ID NO: 719585 - RNA, 19 nt, Homo sapiens
ugccuuauccuguucuaua

SEQ ID NO: 719586 - RNA, 19 nt, Homo sapiens
aaaggagacagaagauuga

SEQ ID NO: 719587 - RNA, 19 nt, Homo sapiens
acaacggaauguaucaaug

SEQ ID NO: 719588 - RNA, 19 nt, Homo sapiens
guuuggugcugugucuuua

SEQ ID NO: 719589 - RNA, 19 nt, Homo sapiens
ucagcucuuucucuuugua

SEQ ID NO: 719590 - RNA, 19 nt, Homo sapiens
gaauaucuagcauguaagg

SEQ ID NO: 719591 - RNA, 19 nt, Homo sapiens
gaagauaaaaggagacaga

SEQ ID NO: 719592 - RNA, 19 nt, Homo sapiens
caaacaacggaauguauca

SEQ ID NO: 719593 - RNA, 19 nt, Homo sapiens
gccagugucuaaacuccaa

SEQ ID NO: 719594 - RNA, 19 nt, Homo sapiens
gauaaaaggagacagaaga

SEQ ID NO: 719595 - RNA, 19 nt, Homo sapiens
gaaugaagaacagaaccuu

SEQ ID NO: 719596 - RNA, 19 nt, Homo sapiens
ccaaacaacggaauguauc

SEQ ID NO: 719597 - RNA, 19 nt, Homo sapiens
uuucuacucuccuauuugu

SEQ ID NO: 719598 - RNA, 19 nt, Homo sapiens
uuucaucucuuucuacucu

SEQ ID NO: 719599 - RNA, 19 nt, Homo sapiens
acagaaccuucaggaauug

SEQ ID NO: 719600 - RNA, 19 nt, Homo sapiens
gaaaggaaugaagaacaga

SEQ ID NO: 719601 - RNA, 19 nt, Homo sapiens
acacaguaagcacucaaua

SEQ ID NO: 719602 - RNA, 19 nt, Homo sapiens
gcauguaaggccuuucaau

SEQ ID NO: 719603 - RNA, 19 nt, Homo sapiens
aauaucaaaugggagauug

SEQ ID NO: 719604 - RNA, 19 nt, Homo sapiens
uggauacacgugcauuuaa

SEQ ID NO: 719605 - RNA, 19 nt, Homo sapiens
gaagggaaagcagucuguu

SEQ ID NO: 719606 - RNA, 19 nt, Homo sapiens
cugggaaccuucauaugug

SEQ ID NO: 719607 - RNA, 19 nt, Homo sapiens
cagaaaggaaugaagaaca

SEQ ID NO: 719608 - RNA, 19 nt, Homo sapiens
cuacucuccuauuuguauu

SEQ ID NO: 719609 - RNA, 19 nt, Homo sapiens
gugcaguauuuauauugga

SEQ ID NO: 719610 - RNA, 19 nt, Homo sapiens
gucacaaugcagacaaaua

SEQ ID NO: 719611 - RNA, 19 nt, Homo sapiens
gccgaggggucgucuuaua

SEQ ID NO: 719612 - RNA, 19 nt, Homo sapiens
gcucucccuuugcuucuuc

SEQ ID NO: 719613 - RNA, 19 nt, Homo sapiens
uagaagagccaaccaacag

SEQ ID NO: 719614 - RNA, 19 nt, Homo sapiens
ccgcggaggugaagugaac

SEQ ID NO: 719615 - RNA, 19 nt, Homo sapiens
cuuccaaacuccucaacug

SEQ ID NO: 719616 - RNA, 19 nt, Homo sapiens
ucuuucuacucuccuauuu

SEQ ID NO: 719617 - RNA, 19 nt, Homo sapiens
ucaacugggaaccuucaua

SEQ ID NO: 719618 - RNA, 19 nt, Homo sapiens
cuucaggaauugagucaca

SEQ ID NO: 719619 - RNA, 19 nt, Homo sapiens
aaauacggguccugcuuag

SEQ ID NO: 719620 - RNA, 19 nt, Homo sapiens
gaccugccuuauccuguuc

SEQ ID NO: 719621 - RNA, 19 nt, Homo sapiens
caauaucagcucuuucucu

SEQ ID NO: 719622 - RNA, 19 nt, Homo sapiens
ucuuacagccagugucuaa

SEQ ID NO: 719623 - RNA, 19 nt, Homo sapiens
gagauuguugcaaggaaga

SEQ ID NO: 719624 - RNA, 19 nt, Homo sapiens
acaaugcagacaaauauca

SEQ ID NO: 719625 - RNA, 19 nt, Homo sapiens
caguaagcacucaauaaau

SEQ ID NO: 719626 - RNA, 19 nt, Homo sapiens
gcacacaguaagcacucaa

SEQ ID NO: 719627 - RNA, 19 nt, Homo sapiens
ugggagaugaccugccuua

SEQ ID NO: 719628 - RNA, 19 nt, Homo sapiens
caaugcagacaaauaucaa

SEQ ID NO: 719629 - RNA, 19 nt, Homo sapiens
gccguucuccagcgcuuua

SEQ ID NO: 719630 - RNA, 19 nt, Homo sapiens
cuaucaaagugucguaucu

SEQ ID NO: 719631 - RNA, 19 nt, Homo sapiens
acaaauacggguccugcuu

SEQ ID NO: 719632 - RNA, 19 nt, Homo sapiens
uaccagaaaggaaugaaga

SEQ ID NO: 719633 - RNA, 19 nt, Homo sapiens
caacuuuaccagugauucu

SEQ ID NO: 719634 - RNA, 19 nt, Homo sapiens
ccagcauguuucucccauu

SEQ ID NO: 719635 - RNA, 19 nt, Homo sapiens
guaagcacucaauaaaucu

SEQ ID NO: 719636 - RNA, 19 nt, Homo sapiens
ucuacucuccuauuuguau

SEQ ID NO: 719637 - RNA, 19 nt, Homo sapiens
auagggacauaaguucauu

SEQ ID NO: 719638 - RNA, 19 nt, Homo sapiens
acugggaaccuucauaugu

SEQ ID NO: 719639 - RNA, 19 nt, Homo sapiens
aaaggaaugaagaacagaa

SEQ ID NO: 719640 - RNA, 19 nt, Homo sapiens
gggaugagaugcugucuuc

SEQ ID NO: 719641 - RNA, 19 nt, Homo sapiens
ggaggaagaggaagaagaa

SEQ ID NO: 719642 - RNA, 19 nt, Homo sapiens
agaauuagcccuccaauca

SEQ ID NO: 719643 - RNA, 19 nt, Homo sapiens
ggaagaggaagaagaauca

SEQ ID NO: 719644 - RNA, 19 nt, Homo sapiens
ccugaacagucacaugaua

SEQ ID NO: 719645 - RNA, 19 nt, Homo sapiens
ucaaugaucaguucuagaa

SEQ ID NO: 719646 - RNA, 19 nt, Homo sapiens
gaauuagcccuccaaucaa

SEQ ID NO: 719647 - RNA, 19 nt, Homo sapiens
gacaaugaagcaucaauca

SEQ ID NO: 719648 - RNA, 19 nt, Homo sapiens
aaugaucaguucuagaaga

SEQ ID NO: 719649 - RNA, 19 nt, Homo sapiens
ggaggaggaggaagaggaa

SEQ ID NO: 719650 - RNA, 19 nt, Homo sapiens
gcauguagacaaugaagca

SEQ ID NO: 719651 - RNA, 19 nt, Homo sapiens
gcugucuucucacacugua

SEQ ID NO: 719652 - RNA, 19 nt, Homo sapiens
caaugaagcaucaaucaac

SEQ ID NO: 719653 - RNA, 19 nt, Homo sapiens
uguagacaaugaagcauca

SEQ ID NO: 719654 - RNA, 19 nt, Homo sapiens
aauuagcccuccaaucaau

SEQ ID NO: 719655 - RNA, 19 nt, Homo sapiens
gaugcugucuucucacacu

SEQ ID NO: 719656 - RNA, 19 nt, Homo sapiens
ggaggaggaagaggaagaa

SEQ ID NO: 719657 - RNA, 19 nt, Homo sapiens
gaagaauuagcccuccaau

SEQ ID NO: 719658 - RNA, 19 nt, Homo sapiens
guuggugcauguagacaau

SEQ ID NO: 719659 - RNA, 19 nt, Homo sapiens
uaccugaacagucacauga

SEQ ID NO: 719660 - RNA, 19 nt, Homo sapiens
gcaucaaucaaccaaacaa

SEQ ID NO: 719661 - RNA, 19 nt, Homo sapiens
aagcaucaaucaaccaaac

SEQ ID NO: 719662 - RNA, 19 nt, Homo sapiens
gaagcaucaaucaaccaaa

SEQ ID NO: 719663 - RNA, 19 nt, Homo sapiens
cccuggagcugagcacaaa

SEQ ID NO: 719664 - RNA, 19 nt, Homo sapiens
ugaacagucacaugauaug

SEQ ID NO: 719665 - RNA, 19 nt, Homo sapiens
acaaugaagcaucaaucaa

SEQ ID NO: 719666 - RNA, 19 nt, Homo sapiens
gagacgcugcugcgguuga

SEQ ID NO: 719667 - RNA, 19 nt, Homo sapiens
agaggaagaagaaucagau

SEQ ID NO: 719668 - RNA, 19 nt, Homo sapiens
aagaggaggaggaggaaga

SEQ ID NO: 719669 - RNA, 19 nt, Homo sapiens
ugaagcaucaaucaaccaa

SEQ ID NO: 719670 - RNA, 19 nt, Homo sapiens
gauauguuggugcauguag

SEQ ID NO: 719671 - RNA, 19 nt, Homo sapiens
agacgcugcugcgguugaa

SEQ ID NO: 719672 - RNA, 19 nt, Homo sapiens
guaccugaacagucacaug

SEQ ID NO: 719673 - RNA, 19 nt, Homo sapiens
uggugcauguagacaauga

SEQ ID NO: 719674 - RNA, 19 nt, Homo sapiens
caacugcgaugaugacuug

SEQ ID NO: 719675 - RNA, 19 nt, Homo sapiens
guaacucucuguccuggua

SEQ ID NO: 719676 - RNA, 19 nt, Homo sapiens
ugacaaagauagcuguaug

SEQ ID NO: 719677 - RNA, 19 nt, Homo sapiens
guacagaggaggagccauu

SEQ ID NO: 719678 - RNA, 19 nt, Homo sapiens
gaaguacgaggcacuguau

SEQ ID NO: 719679 - RNA, 19 nt, Homo sapiens
gcucaagugccauguguuu

SEQ ID NO: 719680 - RNA, 19 nt, Homo sapiens
gcauggaugugcugaacga

SEQ ID NO: 719681 - RNA, 19 nt, Homo sapiens
gccuaacucuguaccguuu

SEQ ID NO: 719682 - RNA, 19 nt, Homo sapiens
caguaacacuuuauagcaa

SEQ ID NO: 719683 - RNA, 19 nt, Homo sapiens
ggccagaacaugcugauga

SEQ ID NO: 719684 - RNA, 19 nt, Homo sapiens
cuaccucaguaacacuuua

SEQ ID NO: 719685 - RNA, 19 nt, Homo sapiens
gccaagcugcucagaagua

SEQ ID NO: 719686 - RNA, 19 nt, Homo sapiens
guccaugccuaacucugua

SEQ ID NO: 719687 - RNA, 19 nt, Homo sapiens
cauaugcccuaaacuuauc

SEQ ID NO: 719688 - RNA, 19 nt, Homo sapiens
ggauccagacgcccguuua

SEQ ID NO: 719689 - RNA, 19 nt, Homo sapiens
cggaccagcuccauggauu

SEQ ID NO: 719690 - RNA, 19 nt, Homo sapiens
gccagaacaugcugaugau

SEQ ID NO: 719691 - RNA, 19 nt, Homo sapiens
gaucuugucagagcgagua

SEQ ID NO: 719692 - RNA, 19 nt, Homo sapiens
ccauaugcccuaaacuuau

SEQ ID NO: 719693 - RNA, 19 nt, Homo sapiens
uccauaugcccuaaacuua

SEQ ID NO: 719694 - RNA, 19 nt, Homo sapiens
aagccaagcugcucagaag

SEQ ID NO: 719695 - RNA, 19 nt, Homo sapiens
gcaaaaucagugcaaauaa

SEQ ID NO: 719696 - RNA, 19 nt, Homo sapiens
gugcccagaucuugucaga

SEQ ID NO: 719697 - RNA, 19 nt, Homo sapiens
guacgaggcacuguauaug

SEQ ID NO: 719698 - RNA, 19 nt, Homo sapiens
gcucuggguccaugccuaa

SEQ ID NO: 719699 - RNA, 19 nt, Homo sapiens
gaaacccucucugcuccau

SEQ ID NO: 719700 - RNA, 19 nt, Homo sapiens
gagccagccuccagauggu

SEQ ID NO: 719701 - RNA, 19 nt, Homo sapiens
ucaguaacacuuuauagca

SEQ ID NO: 719702 - RNA, 19 nt, Homo sapiens
gugucugacucucucauga

SEQ ID NO: 719703 - RNA, 19 nt, Homo sapiens
gggcauggaugugcugaac

SEQ ID NO: 719704 - RNA, 19 nt, Homo sapiens
uguccaccgucuauuuauu

SEQ ID NO: 719705 - RNA, 19 nt, Homo sapiens
ccacgaugcugcagguacu

SEQ ID NO: 719706 - RNA, 19 nt, Homo sapiens
ugacugcacaucccauuca

SEQ ID NO: 719707 - RNA, 19 nt, Homo sapiens
gccaugagccuagugaauc

SEQ ID NO: 719708 - RNA, 19 nt, Homo sapiens
agaaguacgaggcacugua

SEQ ID NO: 719709 - RNA, 19 nt, Homo sapiens
gcgguggugucagcgguuu

SEQ ID NO: 719710 - RNA, 19 nt, Homo sapiens
cagagaggcugggcuugca

SEQ ID NO: 719711 - RNA, 19 nt, Homo sapiens
cugccuguaugguucagua

SEQ ID NO: 719712 - RNA, 19 nt, Homo sapiens
ggaaacacgcaaccauucg

SEQ ID NO: 719713 - RNA, 19 nt, Homo sapiens
guccaccgucuauuuauug

SEQ ID NO: 719714 - RNA, 19 nt, Homo sapiens
cuuguccaccgucuauuua

SEQ ID NO: 719715 - RNA, 19 nt, Homo sapiens
aacccucucugcuccauau

SEQ ID NO: 719716 - RNA, 19 nt, Homo sapiens
ggaccagcuccauggauuc

SEQ ID NO: 719717 - RNA, 19 nt, Homo sapiens
ccaagcugcucagaaguac

SEQ ID NO: 719718 - RNA, 19 nt, Homo sapiens
cggaaacacgcaaccauuc

SEQ ID NO: 719719 - RNA, 19 nt, Homo sapiens
gguccaugccuaacucugu

SEQ ID NO: 719720 - RNA, 19 nt, Homo sapiens
guagaggucaguggugaug

SEQ ID NO: 719721 - RNA, 19 nt, Homo sapiens
ucacuggaccggaguaacu

SEQ ID NO: 719722 - RNA, 19 nt, Homo sapiens
ggguuaugcugggcaagga

SEQ ID NO: 719723 - RNA, 19 nt, Homo sapiens
cuaacucuguaccguuuua

SEQ ID NO: 719724 - RNA, 19 nt, Homo sapiens
cagaggaggagccauugug

SEQ ID NO: 719725 - RNA, 19 nt, Homo sapiens
gcuagggacuucgcuuuug

SEQ ID NO: 719726 - RNA, 19 nt, Homo sapiens
ugaagaaggaugccaugag

SEQ ID NO: 719727 - RNA, 19 nt, Homo sapiens
acacaccuuuggccucauc

SEQ ID NO: 719728 - RNA, 19 nt, Homo sapiens
gccauguguuucgcuguga

SEQ ID NO: 719729 - RNA, 19 nt, Homo sapiens
uguggcaagugacaaagau

SEQ ID NO: 719730 - RNA, 19 nt, Homo sapiens
uaagccaagcugcucagaa

SEQ ID NO: 719731 - RNA, 19 nt, Homo sapiens
ccuuguccaccgucuauuu

SEQ ID NO: 719732 - RNA, 19 nt, Homo sapiens
ccaucauucuggucaacug

SEQ ID NO: 719733 - RNA, 19 nt, Homo sapiens
gaugccaugagccuaguga

SEQ ID NO: 719734 - RNA, 19 nt, Homo sapiens
caacugcgaugaugacuug

SEQ ID NO: 719735 - RNA, 19 nt, Homo sapiens
guaacucucuguccuggua

SEQ ID NO: 719736 - RNA, 19 nt, Homo sapiens
ugacaaagauagcuguaug

SEQ ID NO: 719737 - RNA, 19 nt, Homo sapiens
guacagaggaggagccauu

SEQ ID NO: 719738 - RNA, 19 nt, Homo sapiens
gaaguacgaggcacuguau

SEQ ID NO: 719739 - RNA, 19 nt, Homo sapiens
gcucaagugccauguguuu

SEQ ID NO: 719740 - RNA, 19 nt, Homo sapiens
gcauggaugugcugaacga

SEQ ID NO: 719741 - RNA, 19 nt, Homo sapiens
gccuaacucuguaccguuu

SEQ ID NO: 719742 - RNA, 19 nt, Homo sapiens
caguaacacuuuauagcaa

SEQ ID NO: 719743 - RNA, 19 nt, Homo sapiens
ggccagaacaugcugauga

SEQ ID NO: 719744 - RNA, 19 nt, Homo sapiens
cuaccucaguaacacuuua

SEQ ID NO: 719745 - RNA, 19 nt, Homo sapiens
gccaagcugcucagaagua

SEQ ID NO: 719746 - RNA, 19 nt, Homo sapiens
guccaugccuaacucugua

SEQ ID NO: 719747 - RNA, 19 nt, Homo sapiens
cauaugcccuaaacuuauc

SEQ ID NO: 719748 - RNA, 19 nt, Homo sapiens
ggauccagacgcccguuua

SEQ ID NO: 719749 - RNA, 19 nt, Homo sapiens
cggaccagcuccauggauu

SEQ ID NO: 719750 - RNA, 19 nt, Homo sapiens
gccagaacaugcugaugau

SEQ ID NO: 719751 - RNA, 19 nt, Homo sapiens
gaucuugucagagcgagua

SEQ ID NO: 719752 - RNA, 19 nt, Homo sapiens
ccauaugcccuaaacuuau

SEQ ID NO: 719753 - RNA, 19 nt, Homo sapiens
uccauaugcccuaaacuua

SEQ ID NO: 719754 - RNA, 19 nt, Homo sapiens
aagccaagcugcucagaag

SEQ ID NO: 719755 - RNA, 19 nt, Homo sapiens
gcaaaaucagugcaaauaa

SEQ ID NO: 719756 - RNA, 19 nt, Homo sapiens
gugcccagaucuugucaga

SEQ ID NO: 719757 - RNA, 19 nt, Homo sapiens
guacgaggcacuguauaug

SEQ ID NO: 719758 - RNA, 19 nt, Homo sapiens
gcucuggguccaugccuaa

SEQ ID NO: 719759 - RNA, 19 nt, Homo sapiens
gaaacccucucugcuccau

SEQ ID NO: 719760 - RNA, 19 nt, Homo sapiens
gagccagccuccagauggu

SEQ ID NO: 719761 - RNA, 19 nt, Homo sapiens
ucaguaacacuuuauagca

SEQ ID NO: 719762 - RNA, 19 nt, Homo sapiens
gugucugacucucucauga

SEQ ID NO: 719763 - RNA, 19 nt, Homo sapiens
gggcauggaugugcugaac

SEQ ID NO: 719764 - RNA, 19 nt, Homo sapiens
uguccaccgucuauuuauu

SEQ ID NO: 719765 - RNA, 19 nt, Homo sapiens
ccacgaugcugcagguacu

SEQ ID NO: 719766 - RNA, 19 nt, Homo sapiens
ugacugcacaucccauuca

SEQ ID NO: 719767 - RNA, 19 nt, Homo sapiens
gccaugagccuagugaauc

SEQ ID NO: 719768 - RNA, 19 nt, Homo sapiens
agaaguacgaggcacugua

SEQ ID NO: 719769 - RNA, 19 nt, Homo sapiens
gcgguggugucagcgguuu

SEQ ID NO: 719770 - RNA, 19 nt, Homo sapiens
cagagaggcugggcuugca

SEQ ID NO: 719771 - RNA, 19 nt, Homo sapiens
cugccuguaugguucagua

SEQ ID NO: 719772 - RNA, 19 nt, Homo sapiens
ggaaacacgcaaccauucg

SEQ ID NO: 719773 - RNA, 19 nt, Homo sapiens
guccaccgucuauuuauug

SEQ ID NO: 719774 - RNA, 19 nt, Homo sapiens
cuuguccaccgucuauuua

SEQ ID NO: 719775 - RNA, 19 nt, Homo sapiens
aacccucucugcuccauau

SEQ ID NO: 719776 - RNA, 19 nt, Homo sapiens
ggaccagcuccauggauuc

SEQ ID NO: 719777 - RNA, 19 nt, Homo sapiens
ccaagcugcucagaaguac

SEQ ID NO: 719778 - RNA, 19 nt, Homo sapiens
cggaaacacgcaaccauuc

SEQ ID NO: 719779 - RNA, 19 nt, Homo sapiens
gguccaugccuaacucugu

SEQ ID NO: 719780 - RNA, 19 nt, Homo sapiens
guagaggucaguggugaug

SEQ ID NO: 719781 - RNA, 19 nt, Homo sapiens
ucacuggaccggaguaacu

SEQ ID NO: 719782 - RNA, 19 nt, Homo sapiens
ggguuaugcugggcaagga

SEQ ID NO: 719783 - RNA, 19 nt, Homo sapiens
cuaacucuguaccguuuua

SEQ ID NO: 719784 - RNA, 19 nt, Homo sapiens
cagaggaggagccauugug

SEQ ID NO: 719785 - RNA, 19 nt, Homo sapiens
gcuagggacuucgcuuuug

SEQ ID NO: 719786 - RNA, 19 nt, Homo sapiens
ugaagaaggaugccaugag

SEQ ID NO: 719787 - RNA, 19 nt, Homo sapiens
acacaccuuuggccucauc

SEQ ID NO: 719788 - RNA, 19 nt, Homo sapiens
gccauguguuucgcuguga

SEQ ID NO: 719789 - RNA, 19 nt, Homo sapiens
uguggcaagugacaaagau

SEQ ID NO: 719790 - RNA, 19 nt, Homo sapiens
uaagccaagcugcucagaa

SEQ ID NO: 719791 - RNA, 19 nt, Homo sapiens
ccuuguccaccgucuauuu

SEQ ID NO: 719792 - RNA, 19 nt, Homo sapiens
ccaucauucuggucaacug

SEQ ID NO: 719793 - RNA, 19 nt, Homo sapiens
gaugccaugagccuaguga

SEQ ID NO: 719794 - RNA, 19 nt, Homo sapiens
caacugcgaugaugacuug

SEQ ID NO: 719795 - RNA, 19 nt, Homo sapiens
guaacucucuguccuggua

SEQ ID NO: 719796 - RNA, 19 nt, Homo sapiens
ugacaaagauagcuguaug

SEQ ID NO: 719797 - RNA, 19 nt, Homo sapiens
guacagaggaggagccauu

SEQ ID NO: 719798 - RNA, 19 nt, Homo sapiens
gaaguacgaggcacuguau

SEQ ID NO: 719799 - RNA, 19 nt, Homo sapiens
gcucaagugccauguguuu

SEQ ID NO: 719800 - RNA, 19 nt, Homo sapiens
gcauggaugugcugaacga

SEQ ID NO: 719801 - RNA, 19 nt, Homo sapiens
gccuaacucuguaccguuu

SEQ ID NO: 719802 - RNA, 19 nt, Homo sapiens
caguaacacuuuauagcaa

SEQ ID NO: 719803 - RNA, 19 nt, Homo sapiens
ggccagaacaugcugauga

SEQ ID NO: 719804 - RNA, 19 nt, Homo sapiens
cuaccucaguaacacuuua

SEQ ID NO: 719805 - RNA, 19 nt, Homo sapiens
gccaagcugcucagaagua

SEQ ID NO: 719806 - RNA, 19 nt, Homo sapiens
guccaugccuaacucugua

SEQ ID NO: 719807 - RNA, 19 nt, Homo sapiens
cauaugcccuaaacuuauc

SEQ ID NO: 719808 - RNA, 19 nt, Homo sapiens
ggauccagacgcccguuua

SEQ ID NO: 719809 - RNA, 19 nt, Homo sapiens
cggaccagcuccauggauu

SEQ ID NO: 719810 - RNA, 19 nt, Homo sapiens
gccagaacaugcugaugau

SEQ ID NO: 719811 - RNA, 19 nt, Homo sapiens
gaucuugucagagcgagua

SEQ ID NO: 719812 - RNA, 19 nt, Homo sapiens
ccauaugcccuaaacuuau

SEQ ID NO: 719813 - RNA, 19 nt, Homo sapiens
uccauaugcccuaaacuua

SEQ ID NO: 719814 - RNA, 19 nt, Homo sapiens
aagccaagcugcucagaag

SEQ ID NO: 719815 - RNA, 19 nt, Homo sapiens
gcaaaaucagugcaaauaa

SEQ ID NO: 719816 - RNA, 19 nt, Homo sapiens
gugcccagaucuugucaga

SEQ ID NO: 719817 - RNA, 19 nt, Homo sapiens
guacgaggcacuguauaug

SEQ ID NO: 719818 - RNA, 19 nt, Homo sapiens
gcucuggguccaugccuaa

SEQ ID NO: 719819 - RNA, 19 nt, Homo sapiens
gaaacccucucugcuccau

SEQ ID NO: 719820 - RNA, 19 nt, Homo sapiens
gagccagccuccagauggu

SEQ ID NO: 719821 - RNA, 19 nt, Homo sapiens
ucaguaacacuuuauagca

SEQ ID NO: 719822 - RNA, 19 nt, Homo sapiens
gugucugacucucucauga

SEQ ID NO: 719823 - RNA, 19 nt, Homo sapiens
gggcauggaugugcugaac

SEQ ID NO: 719824 - RNA, 19 nt, Homo sapiens
uguccaccgucuauuuauu

SEQ ID NO: 719825 - RNA, 19 nt, Homo sapiens
ccacgaugcugcagguacu

SEQ ID NO: 719826 - RNA, 19 nt, Homo sapiens
ugacugcacaucccauuca

SEQ ID NO: 719827 - RNA, 19 nt, Homo sapiens
gccaugagccuagugaauc

SEQ ID NO: 719828 - RNA, 19 nt, Homo sapiens
agaaguacgaggcacugua

SEQ ID NO: 719829 - RNA, 19 nt, Homo sapiens
gcgguggugucagcgguuu

SEQ ID NO: 719830 - RNA, 19 nt, Homo sapiens
cagagaggcugggcuugca

SEQ ID NO: 719831 - RNA, 19 nt, Homo sapiens
cugccuguaugguucagua

SEQ ID NO: 719832 - RNA, 19 nt, Homo sapiens
ggaaacacgcaaccauucg

SEQ ID NO: 719833 - RNA, 19 nt, Homo sapiens
guccaccgucuauuuauug

SEQ ID NO: 719834 - RNA, 19 nt, Homo sapiens
cuuguccaccgucuauuua

SEQ ID NO: 719835 - RNA, 19 nt, Homo sapiens
aacccucucugcuccauau

SEQ ID NO: 719836 - RNA, 19 nt, Homo sapiens
ggaccagcuccauggauuc

SEQ ID NO: 719837 - RNA, 19 nt, Homo sapiens
ccaagcugcucagaaguac

SEQ ID NO: 719838 - RNA, 19 nt, Homo sapiens
cggaaacacgcaaccauuc

SEQ ID NO: 719839 - RNA, 19 nt, Homo sapiens
gguccaugccuaacucugu

SEQ ID NO: 719840 - RNA, 19 nt, Homo sapiens
guagaggucaguggugaug

SEQ ID NO: 719841 - RNA, 19 nt, Homo sapiens
ucacuggaccggaguaacu

SEQ ID NO: 719842 - RNA, 19 nt, Homo sapiens
ggguuaugcugggcaagga

SEQ ID NO: 719843 - RNA, 19 nt, Homo sapiens
cuaacucuguaccguuuua

SEQ ID NO: 719844 - RNA, 19 nt, Homo sapiens
cagaggaggagccauugug

SEQ ID NO: 719845 - RNA, 19 nt, Homo sapiens
ugacagggacuucgcuuuu

SEQ ID NO: 719846 - RNA, 19 nt, Homo sapiens
ugaagaaggaugccaugag

SEQ ID NO: 719847 - RNA, 19 nt, Homo sapiens
acacaccuuuggccucauc

SEQ ID NO: 719848 - RNA, 19 nt, Homo sapiens
gccauguguuucgcuguga

SEQ ID NO: 719849 - RNA, 19 nt, Homo sapiens
uguggcaagugacaaagau

SEQ ID NO: 719850 - RNA, 19 nt, Homo sapiens
uaagccaagcugcucagaa

SEQ ID NO: 719851 - RNA, 19 nt, Homo sapiens
gacagggacuucgcuuuug

SEQ ID NO: 719852 - RNA, 19 nt, Homo sapiens
ccuuguccaccgucuauuu

SEQ ID NO: 719853 - RNA, 19 nt, Homo sapiens
ccaucauucuggucaacug

SEQ ID NO: 719854 - RNA, 19 nt, Homo sapiens
gaugccaugagccuaguga

SEQ ID NO: 719855 - RNA, 19 nt, Homo sapiens
caacugcgaugaugacuug

SEQ ID NO: 719856 - RNA, 19 nt, Homo sapiens
guaacucucuguccuggua

SEQ ID NO: 719857 - RNA, 19 nt, Homo sapiens
ugacaaagauagcuguaug

SEQ ID NO: 719858 - RNA, 19 nt, Homo sapiens
guacagaggaggagccauu

SEQ ID NO: 719859 - RNA, 19 nt, Homo sapiens
gaaguacgaggcacuguau

SEQ ID NO: 719860 - RNA, 19 nt, Homo sapiens
gcucaagugccauguguuu

SEQ ID NO: 719861 - RNA, 19 nt, Homo sapiens
gcauggaugugcugaacga

SEQ ID NO: 719862 - RNA, 19 nt, Homo sapiens
gccuaacucuguaccguuu

SEQ ID NO: 719863 - RNA, 19 nt, Homo sapiens
caguaacacuuuauagcaa

SEQ ID NO: 719864 - RNA, 19 nt, Homo sapiens
ggccagaacaugcugauga

SEQ ID NO: 719865 - RNA, 19 nt, Homo sapiens
cuaccucaguaacacuuua

SEQ ID NO: 719866 - RNA, 19 nt, Homo sapiens
gccaagcugcucagaagua

SEQ ID NO: 719867 - RNA, 19 nt, Homo sapiens
guccaugccuaacucugua

SEQ ID NO: 719868 - RNA, 19 nt, Homo sapiens
cauaugcccuaaacuuauc

SEQ ID NO: 719869 - RNA, 19 nt, Homo sapiens
ggauccagacgcccguuua

SEQ ID NO: 719870 - RNA, 19 nt, Homo sapiens
cggaccagcuccauggauu

SEQ ID NO: 719871 - RNA, 19 nt, Homo sapiens
gccagaacaugcugaugau

SEQ ID NO: 719872 - RNA, 19 nt, Homo sapiens
gaucuugucagagcgagua

SEQ ID NO: 719873 - RNA, 19 nt, Homo sapiens
ccauaugcccuaaacuuau

SEQ ID NO: 719874 - RNA, 19 nt, Homo sapiens
uccauaugcccuaaacuua

SEQ ID NO: 719875 - RNA, 19 nt, Homo sapiens
aagccaagcugcucagaag

SEQ ID NO: 719876 - RNA, 19 nt, Homo sapiens
gcaaaaucagugcaaauaa

SEQ ID NO: 719877 - RNA, 19 nt, Homo sapiens
gugcccagaucuugucaga

SEQ ID NO: 719878 - RNA, 19 nt, Homo sapiens
guacgaggcacuguauaug

SEQ ID NO: 719879 - RNA, 19 nt, Homo sapiens
gcucuggguccaugccuaa

SEQ ID NO: 719880 - RNA, 19 nt, Homo sapiens
gaaacccucucugcuccau

SEQ ID NO: 719881 - RNA, 19 nt, Homo sapiens
gagccagccuccagauggu

SEQ ID NO: 719882 - RNA, 19 nt, Homo sapiens
ucaguaacacuuuauagca

SEQ ID NO: 719883 - RNA, 19 nt, Homo sapiens
gugucugacucucucauga

SEQ ID NO: 719884 - RNA, 19 nt, Homo sapiens
gggcauggaugugcugaac

SEQ ID NO: 719885 - RNA, 19 nt, Homo sapiens
uguccaccgucuauuuauu

SEQ ID NO: 719886 - RNA, 19 nt, Homo sapiens
ccacgaugcugcagguacu

SEQ ID NO: 719887 - RNA, 19 nt, Homo sapiens
ugacugcacaucccauuca

SEQ ID NO: 719888 - RNA, 19 nt, Homo sapiens
gccaugagccuagugaauc

SEQ ID NO: 719889 - RNA, 19 nt, Homo sapiens
agaaguacgaggcacugua

SEQ ID NO: 719890 - RNA, 19 nt, Homo sapiens
gcgguggugucagcgguuu

SEQ ID NO: 719891 - RNA, 19 nt, Homo sapiens
cagagaggcugggcuugca

SEQ ID NO: 719892 - RNA, 19 nt, Homo sapiens
cugccuguaugguucagua

SEQ ID NO: 719893 - RNA, 19 nt, Homo sapiens
ggaaacacgcaaccauucg

SEQ ID NO: 719894 - RNA, 19 nt, Homo sapiens
guccaccgucuauuuauug

SEQ ID NO: 719895 - RNA, 19 nt, Homo sapiens
cuuguccaccgucuauuua

SEQ ID NO: 719896 - RNA, 19 nt, Homo sapiens
aacccucucugcuccauau

SEQ ID NO: 719897 - RNA, 19 nt, Homo sapiens
ggaccagcuccauggauuc

SEQ ID NO: 719898 - RNA, 19 nt, Homo sapiens
ccaagcugcucagaaguac

SEQ ID NO: 719899 - RNA, 19 nt, Homo sapiens
cggaaacacgcaaccauuc

SEQ ID NO: 719900 - RNA, 19 nt, Homo sapiens
gguccaugccuaacucugu

SEQ ID NO: 719901 - RNA, 19 nt, Homo sapiens
guagaggucaguggugaug

SEQ ID NO: 719902 - RNA, 19 nt, Homo sapiens
ucacuggaccggaguaacu

SEQ ID NO: 719903 - RNA, 19 nt, Homo sapiens
ggguuaugcugggcaagga

SEQ ID NO: 719904 - RNA, 19 nt, Homo sapiens
cuaacucuguaccguuuua

SEQ ID NO: 719905 - RNA, 19 nt, Homo sapiens
cagaggaggagccauugug

SEQ ID NO: 719906 - RNA, 19 nt, Homo sapiens
ugaagaaggaugccaugag

SEQ ID NO: 719907 - RNA, 19 nt, Homo sapiens
acacaccuuuggccucauc

SEQ ID NO: 719908 - RNA, 19 nt, Homo sapiens
gccauguguuucgcuguga

SEQ ID NO: 719909 - RNA, 19 nt, Homo sapiens
uguggcaagugacaaagau

SEQ ID NO: 719910 - RNA, 19 nt, Homo sapiens
uaagccaagcugcucagaa

SEQ ID NO: 719911 - RNA, 19 nt, Homo sapiens
ccuuguccaccgucuauuu

SEQ ID NO: 719912 - RNA, 19 nt, Homo sapiens
ccaucauucuggucaacug

SEQ ID NO: 719913 - RNA, 19 nt, Homo sapiens
gaugccaugagccuaguga

SEQ ID NO: 719914 - RNA, 19 nt, Homo sapiens
caacugcgaugaugacuug

SEQ ID NO: 719915 - RNA, 19 nt, Homo sapiens
guaacucucuguccuggua

SEQ ID NO: 719916 - RNA, 19 nt, Homo sapiens
ugacaaagauagcuguaug

SEQ ID NO: 719917 - RNA, 19 nt, Homo sapiens
guacagaggaggagccauu

SEQ ID NO: 719918 - RNA, 19 nt, Homo sapiens
gaaguacgaggcacuguau

SEQ ID NO: 719919 - RNA, 19 nt, Homo sapiens
gcucaagugccauguguuu

SEQ ID NO: 719920 - RNA, 19 nt, Homo sapiens
gcauggaugugcugaacga

SEQ ID NO: 719921 - RNA, 19 nt, Homo sapiens
gccuaacucuguaccguuu

SEQ ID NO: 719922 - RNA, 19 nt, Homo sapiens
caguaacacuuuauagcaa

SEQ ID NO: 719923 - RNA, 19 nt, Homo sapiens
ggccagaacaugcugauga

SEQ ID NO: 719924 - RNA, 19 nt, Homo sapiens
cuaccucaguaacacuuua

SEQ ID NO: 719925 - RNA, 19 nt, Homo sapiens
gccaagcugcucagaagua

SEQ ID NO: 719926 - RNA, 19 nt, Homo sapiens
guccaugccuaacucugua

SEQ ID NO: 719927 - RNA, 19 nt, Homo sapiens
cauaugcccuaaacuuauc

SEQ ID NO: 719928 - RNA, 19 nt, Homo sapiens
ggauccagacgcccguuua

SEQ ID NO: 719929 - RNA, 19 nt, Homo sapiens
cggaccagcuccauggauu

SEQ ID NO: 719930 - RNA, 19 nt, Homo sapiens
gccagaacaugcugaugau

SEQ ID NO: 719931 - RNA, 19 nt, Homo sapiens
gaucuugucagagcgagua

SEQ ID NO: 719932 - RNA, 19 nt, Homo sapiens
ccgagaggcugggcugauu

SEQ ID NO: 719933 - RNA, 19 nt, Homo sapiens
ccauaugcccuaaacuuau

SEQ ID NO: 719934 - RNA, 19 nt, Homo sapiens
uccauaugcccuaaacuua

SEQ ID NO: 719935 - RNA, 19 nt, Homo sapiens
aagccaagcugcucagaag

SEQ ID NO: 719936 - RNA, 19 nt, Homo sapiens
gcaaaaucagugcaaauaa

SEQ ID NO: 719937 - RNA, 19 nt, Homo sapiens
gugcccagaucuugucaga

SEQ ID NO: 719938 - RNA, 19 nt, Homo sapiens
gaacagugacagggacuuc

SEQ ID NO: 719939 - RNA, 19 nt, Homo sapiens
guacgaggcacuguauaug

SEQ ID NO: 719940 - RNA, 19 nt, Homo sapiens
gcucuggguccaugccuaa

SEQ ID NO: 719941 - RNA, 19 nt, Homo sapiens
gaaacccucucugcuccau

SEQ ID NO: 719942 - RNA, 19 nt, Homo sapiens
gagccagccuccagauggu

SEQ ID NO: 719943 - RNA, 19 nt, Homo sapiens
ucaguaacacuuuauagca

SEQ ID NO: 719944 - RNA, 19 nt, Homo sapiens
gugucugacucucucauga

SEQ ID NO: 719945 - RNA, 19 nt, Homo sapiens
gggcauggaugugcugaac

SEQ ID NO: 719946 - RNA, 19 nt, Homo sapiens
uguccaccgucuauuuauu

SEQ ID NO: 719947 - RNA, 19 nt, Homo sapiens
ccacgaugcugcagguacu

SEQ ID NO: 719948 - RNA, 19 nt, Homo sapiens
ugacugcacaucccauuca

SEQ ID NO: 719949 - RNA, 19 nt, Homo sapiens
gccaugagccuagugaauc

SEQ ID NO: 719950 - RNA, 19 nt, Homo sapiens
agaaguacgaggcacugua

SEQ ID NO: 719951 - RNA, 19 nt, Homo sapiens
gcgguggugucagcgguuu

SEQ ID NO: 719952 - RNA, 19 nt, Homo sapiens
cugccuguaugguucagua

SEQ ID NO: 719953 - RNA, 19 nt, Homo sapiens
ggaaacacgcaaccauucg

SEQ ID NO: 719954 - RNA, 19 nt, Homo sapiens
cagagaggcugggcuugca

SEQ ID NO: 719955 - RNA, 19 nt, Homo sapiens
gcucagcagggacaguuug

SEQ ID NO: 719956 - RNA, 19 nt, Homo sapiens
guccaccgucuauuuauug

SEQ ID NO: 719957 - RNA, 19 nt, Homo sapiens
cuuguccaccgucuauuua

SEQ ID NO: 719958 - RNA, 19 nt, Homo sapiens
aacccucucugcuccauau

SEQ ID NO: 719959 - RNA, 19 nt, Homo sapiens
ggaccagcuccauggauuc

SEQ ID NO: 719960 - RNA, 19 nt, Homo sapiens
ccaagcugcucagaaguac

SEQ ID NO: 719961 - RNA, 19 nt, Homo sapiens
cggaaacacgcaaccauuc

SEQ ID NO: 719962 - RNA, 19 nt, Homo sapiens
gguccaugccuaacucugu

SEQ ID NO: 719963 - RNA, 19 nt, Homo sapiens
guagaggucaguggugaug

SEQ ID NO: 719964 - RNA, 19 nt, Homo sapiens
ucacuggaccggaguaacu

SEQ ID NO: 719965 - RNA, 19 nt, Homo sapiens
cuaacucuguaccguuuua

SEQ ID NO: 719966 - RNA, 19 nt, Homo sapiens
ggguuaugcugggcaagga

SEQ ID NO: 719967 - RNA, 19 nt, Homo sapiens
cagaggaggagccauugug

SEQ ID NO: 719968 - RNA, 19 nt, Homo sapiens
ugacagggacuucgcuuuu

SEQ ID NO: 719969 - RNA, 19 nt, Homo sapiens
ugaagaaggaugccaugag

SEQ ID NO: 719970 - RNA, 19 nt, Homo sapiens
acacaccuuuggccucauc

SEQ ID NO: 719971 - RNA, 19 nt, Homo sapiens
gccauguguuucgcuguga

SEQ ID NO: 719972 - RNA, 19 nt, Homo sapiens
uguggcaagugacaaagau

SEQ ID NO: 719973 - RNA, 19 nt, Homo sapiens
uaagccaagcugcucagaa

SEQ ID NO: 719974 - RNA, 19 nt, Homo sapiens
gacagggacuucgcuuuug

SEQ ID NO: 719975 - RNA, 19 nt, Homo sapiens
ccuuguccaccgucuauuu

SEQ ID NO: 719976 - RNA, 19 nt, Homo sapiens
ccaucauucuggucaacug

SEQ ID NO: 719977 - RNA, 19 nt, Homo sapiens
gaugccaugagccuaguga

SEQ ID NO: 719978 - RNA, 19 nt, Homo sapiens
caacugcgaugaugacuug

SEQ ID NO: 719979 - RNA, 19 nt, Homo sapiens
guaacucucuguccuggua

SEQ ID NO: 719980 - RNA, 19 nt, Homo sapiens
ugacaaagauagcuguaug

SEQ ID NO: 719981 - RNA, 19 nt, Homo sapiens
guacagaggaggagccauu

SEQ ID NO: 719982 - RNA, 19 nt, Homo sapiens
gaaguacgaggcacuguau

SEQ ID NO: 719983 - RNA, 19 nt, Homo sapiens
gcucaagugccauguguuu

SEQ ID NO: 719984 - RNA, 19 nt, Homo sapiens
gcauggaugugcugaacga

SEQ ID NO: 719985 - RNA, 19 nt, Homo sapiens
gccuaacucuguaccguuu

SEQ ID NO: 719986 - RNA, 19 nt, Homo sapiens
caguaacacuuuauagcaa

SEQ ID NO: 719987 - RNA, 19 nt, Homo sapiens
ggccagaacaugcugauga

SEQ ID NO: 719988 - RNA, 19 nt, Homo sapiens
cuaccucaguaacacuuua

SEQ ID NO: 719989 - RNA, 19 nt, Homo sapiens
gccaagcugcucagaagua

SEQ ID NO: 719990 - RNA, 19 nt, Homo sapiens
guccaugccuaacucugua

SEQ ID NO: 719991 - RNA, 19 nt, Homo sapiens
cauaugcccuaaacuuauc

SEQ ID NO: 719992 - RNA, 19 nt, Homo sapiens
ggauccagacgcccguuua

SEQ ID NO: 719993 - RNA, 19 nt, Homo sapiens
cggaccagcuccauggauu

SEQ ID NO: 719994 - RNA, 19 nt, Homo sapiens
gccagaacaugcugaugau

SEQ ID NO: 719995 - RNA, 19 nt, Homo sapiens
gaucuugucagagcgagua

SEQ ID NO: 719996 - RNA, 19 nt, Homo sapiens
ccgagaggcugggcugauu

SEQ ID NO: 719997 - RNA, 19 nt, Homo sapiens
ccauaugcccuaaacuuau

SEQ ID NO: 719998 - RNA, 19 nt, Homo sapiens
uccauaugcccuaaacuua

SEQ ID NO: 719999 - RNA, 19 nt, Homo sapiens
aagccaagcugcucagaag

SEQ ID NO: 720000 - RNA, 19 nt, Homo sapiens
gcaaaaucagugcaaauaa

SEQ ID NO: 720001 - RNA, 19 nt, Homo sapiens
gugcccagaucuugucaga

SEQ ID NO: 720002 - RNA, 19 nt, Homo sapiens
gaacagugacagggacuuc

SEQ ID NO: 720003 - RNA, 19 nt, Homo sapiens
guacgaggcacuguauaug

SEQ ID NO: 720004 - RNA, 19 nt, Homo sapiens
gcucuggguccaugccuaa

SEQ ID NO: 720005 - RNA, 19 nt, Homo sapiens
gaaacccucucugcuccau

SEQ ID NO: 720006 - RNA, 19 nt, Homo sapiens
gagccagccuccagauggu

SEQ ID NO: 720007 - RNA, 19 nt, Homo sapiens
ucaguaacacuuuauagca

SEQ ID NO: 720008 - RNA, 19 nt, Homo sapiens
gugucugacucucucauga

SEQ ID NO: 720009 - RNA, 19 nt, Homo sapiens
gggcauggaugugcugaac

SEQ ID NO: 720010 - RNA, 19 nt, Homo sapiens
uguccaccgucuauuuauu

SEQ ID NO: 720011 - RNA, 19 nt, Homo sapiens
ccacgaugcugcagguacu

SEQ ID NO: 720012 - RNA, 19 nt, Homo sapiens
ugacugcacaucccauuca

SEQ ID NO: 720013 - RNA, 19 nt, Homo sapiens
gccaugagccuagugaauc

SEQ ID NO: 720014 - RNA, 19 nt, Homo sapiens
agaaguacgaggcacugua

SEQ ID NO: 720015 - RNA, 19 nt, Homo sapiens
gcgguggugucagcgguuu

SEQ ID NO: 720016 - RNA, 19 nt, Homo sapiens
gggccgauccucugaugug

SEQ ID NO: 720017 - RNA, 19 nt, Homo sapiens
ccaagggccgauccucuga

SEQ ID NO: 720018 - RNA, 19 nt, Homo sapiens
cugccuguaugguucagua

SEQ ID NO: 720019 - RNA, 19 nt, Homo sapiens
ggaaacacgcaaccauucg

SEQ ID NO: 720020 - RNA, 19 nt, Homo sapiens
cagagaggcugggcuugca

SEQ ID NO: 720021 - RNA, 19 nt, Homo sapiens
gcucagcagggacaguuug

SEQ ID NO: 720022 - RNA, 19 nt, Homo sapiens
guccaccgucuauuuauug

SEQ ID NO: 720023 - RNA, 19 nt, Homo sapiens
cuuguccaccgucuauuua

SEQ ID NO: 720024 - RNA, 19 nt, Homo sapiens
aacccucucugcuccauau

SEQ ID NO: 720025 - RNA, 19 nt, Homo sapiens
ggaccagcuccauggauuc

SEQ ID NO: 720026 - RNA, 19 nt, Homo sapiens
ccaagcugcucagaaguac

SEQ ID NO: 720027 - RNA, 19 nt, Homo sapiens
cggaaacacgcaaccauuc

SEQ ID NO: 720028 - RNA, 19 nt, Homo sapiens
gguccaugccuaacucugu

SEQ ID NO: 720029 - RNA, 19 nt, Homo sapiens
guagaggucaguggugaug

SEQ ID NO: 720030 - RNA, 19 nt, Homo sapiens
ucacuggaccggaguaacu

SEQ ID NO: 720031 - RNA, 19 nt, Homo sapiens
cuaacucuguaccguuuua

SEQ ID NO: 720032 - RNA, 19 nt, Homo sapiens
ggguuaugcugggcaagga

SEQ ID NO: 720033 - RNA, 19 nt, Homo sapiens
cagaggaggagccauugug

SEQ ID NO: 720034 - RNA, 19 nt, Homo sapiens
ugacagggacuucgcuuuu

SEQ ID NO: 720035 - RNA, 19 nt, Homo sapiens
ugaagaaggaugccaugag

SEQ ID NO: 720036 - RNA, 19 nt, Homo sapiens
acacaccuuuggccucauc

SEQ ID NO: 720037 - RNA, 19 nt, Homo sapiens
gccauguguuucgcuguga

SEQ ID NO: 720038 - RNA, 19 nt, Homo sapiens
uguggcaagugacaaagau

SEQ ID NO: 720039 - RNA, 19 nt, Homo sapiens
uaagccaagcugcucagaa

SEQ ID NO: 720040 - RNA, 19 nt, Homo sapiens
gacagggacuucgcuuuug

SEQ ID NO: 720041 - RNA, 19 nt, Homo sapiens
ccaucauucuggucaacug

SEQ ID NO: 720042 - RNA, 19 nt, Homo sapiens
ccuuguccaccgucuauuu

SEQ ID NO: 720043 - RNA, 19 nt, Homo sapiens
gaugccaugagccuaguga

SEQ ID NO: 720044 - RNA, 19 nt, Homo sapiens
gaaagcagauaauccauaa

SEQ ID NO: 720045 - RNA, 19 nt, Homo sapiens
gcugugaucuugagaauuu

SEQ ID NO: 720046 - RNA, 19 nt, Homo sapiens
gagaaacacuauagaugua

SEQ ID NO: 720047 - RNA, 19 nt, Homo sapiens
gagaaacccuauaaaugua

SEQ ID NO: 720048 - RNA, 19 nt, Homo sapiens
gagaaacccuauacaugua

SEQ ID NO: 720049 - RNA, 19 nt, Homo sapiens
gguaaagccuucagcuaua

SEQ ID NO: 720050 - RNA, 19 nt, Homo sapiens
gagagaagccuuauaaaug

SEQ ID NO: 720051 - RNA, 19 nt, Homo sapiens
gaagagaaacccuauaaau

SEQ ID NO: 720052 - RNA, 19 nt, Homo sapiens
aaacugugcucaacccuua

SEQ ID NO: 720053 - RNA, 19 nt, Homo sapiens
gcaaauacuuucuucuugu

SEQ ID NO: 720054 - RNA, 19 nt, Homo sapiens
ggaaagagccuuggaaugu

SEQ ID NO: 720055 - RNA, 19 nt, Homo sapiens
gagagaaaccuuauaaaug

SEQ ID NO: 720056 - RNA, 19 nt, Homo sapiens
guucauaccuuacuaaaca

SEQ ID NO: 720057 - RNA, 19 nt, Homo sapiens
caauaaaugugaggaagua

SEQ ID NO: 720058 - RNA, 19 nt, Homo sapiens
gaauguggcauaaccuuua

SEQ ID NO: 720059 - RNA, 19 nt, Homo sapiens
gcaaagccuucaacuauag

SEQ ID NO: 720060 - RNA, 19 nt, Homo sapiens
cuacaaaugugaagaaugu

SEQ ID NO: 720061 - RNA, 19 nt, Homo sapiens
cuacaaaugugaugaaugu

SEQ ID NO: 720062 - RNA, 19 nt, Homo sapiens
cuacaaaugugaagaaugu

SEQ ID NO: 720063 - RNA, 19 nt, Homo sapiens
ggcaaagccuucaacuaua

SEQ ID NO: 720064 - RNA, 19 nt, Homo sapiens
cuacaaaugugaagaaugu

SEQ ID NO: 720065 - RNA, 19 nt, Homo sapiens
gagagaaacccuauaaaug

SEQ ID NO: 720066 - RNA, 19 nt, Homo sapiens
gagaaaaccuuuacaaaug

SEQ ID NO: 720067 - RNA, 19 nt, Homo sapiens
gaagagaaaccauacaaau

SEQ ID NO: 720068 - RNA, 19 nt, Homo sapiens
ggucauaccucacuacaca

SEQ ID NO: 720069 - RNA, 19 nt, Homo sapiens
ggucauaccucacuacaca

SEQ ID NO: 720070 - RNA, 19 nt, Homo sapiens
ggucauaccucacuacaca

SEQ ID NO: 720071 - RNA, 19 nt, Homo sapiens
gcucaacccuuacucaaga

SEQ ID NO: 720072 - RNA, 19 nt, Homo sapiens
ggagagaaaccuuauaaau

SEQ ID NO: 720073 - RNA, 19 nt, Homo sapiens
gcaaauugauacuggagaa

SEQ ID NO: 720074 - RNA, 19 nt, Homo sapiens
ggcauaaccuuuaacuauu

SEQ ID NO: 720075 - RNA, 19 nt, Homo sapiens
gaaguuuaaugccaaaugu

SEQ ID NO: 720076 - RNA, 19 nt, Homo sapiens
gcacaucagagaagucaua

SEQ ID NO: 720077 - RNA, 19 nt, Homo sapiens
ucaaaucuguugcugcuuu

SEQ ID NO: 720078 - RNA, 19 nt, Homo sapiens
ggagagaaacccuauaaau

SEQ ID NO: 720079 - RNA, 19 nt, Homo sapiens
ggagagaagccuuauaaau

SEQ ID NO: 720080 - RNA, 19 nt, Homo sapiens
gagaaacccuauaaaugga

SEQ ID NO: 720081 - RNA, 19 nt, Homo sapiens
gauaauccauacuagagaa

SEQ ID NO: 720082 - RNA, 19 nt, Homo sapiens
gagaagccuuauaaaugua

SEQ ID NO: 720083 - RNA, 19 nt, Homo sapiens
gcaggucucuacucuaaau

SEQ ID NO: 720084 - RNA, 19 nt, Homo sapiens
gaaagagccuuggaaugug

SEQ ID NO: 720085 - RNA, 19 nt, Homo sapiens
guaaagaauuugaggaagu

SEQ ID NO: 720086 - RNA, 19 nt, Homo sapiens
cuaaauaguuaccgaaaug

SEQ ID NO: 720087 - RNA, 19 nt, Homo sapiens
gaauuuaugugagaaagga

SEQ ID NO: 720088 - RNA, 19 nt, Homo sapiens
ggagagagacccuacaaau

SEQ ID NO: 720089 - RNA, 19 nt, Homo sapiens
ggagagagacccuacaaau

SEQ ID NO: 720090 - RNA, 19 nt, Homo sapiens
gcaaagccuucaacucuag

SEQ ID NO: 720091 - RNA, 19 nt, Homo sapiens
ggagagagacccuacaaau

SEQ ID NO: 720092 - RNA, 19 nt, Homo sapiens
caacaucagacaacucaua

SEQ ID NO: 720093 - RNA, 19 nt, Homo sapiens
ggggauagcuuaaaccaua

SEQ ID NO: 720094 - RNA, 19 nt, Homo sapiens
gagagaaacccuauacaug

SEQ ID NO: 720095 - RNA, 19 nt, Homo sapiens
uaaagaauguggcaaaguc

SEQ ID NO: 720096 - RNA, 19 nt, Homo sapiens
agagaagccuuauaaaugu

SEQ ID NO: 720097 - RNA, 19 nt, Homo sapiens
uaaaguagcaagaacauug

SEQ ID NO: 720098 - RNA, 19 nt, Homo sapiens
uuucaagccuuacacaaua

SEQ ID NO: 720099 - RNA, 19 nt, Homo sapiens
gagagaaaccauacaaaug

SEQ ID NO: 720100 - RNA, 19 nt, Homo sapiens
aaccauaguuugcaccuua

SEQ ID NO: 720101 - RNA, 19 nt, Homo sapiens
cagaagaauuuguaucaga

SEQ ID NO: 720102 - RNA, 19 nt, Homo sapiens
caauggauguuaugaugaa

SEQ ID NO: 720103 - RNA, 19 nt, Homo sapiens
ggagagaaaccauacaaau

SEQ ID NO: 720104 - RNA, 19 nt, Homo sapiens
ggaaccagcucagaagaau

SEQ ID NO: 720105 - RNA, 19 nt, Homo sapiens
caucauugcuuaaucaaca

SEQ ID NO: 720106 - RNA, 19 nt, Homo sapiens
cacagaagcuucauuccaa

SEQ ID NO: 720107 - RNA, 19 nt, Homo sapiens
ccuuauaguucacaccuua

SEQ ID NO: 720108 - RNA, 19 nt, Homo sapiens
gcucguucuucaaaucuua

SEQ ID NO: 720109 - RNA, 19 nt, Homo sapiens
gcagauaauccauaaugaa

SEQ ID NO: 720110 - RNA, 19 nt, Homo sapiens
caucaaaucuuagaaagca

SEQ ID NO: 720111 - RNA, 19 nt, Homo sapiens
caucagagaagucauacua

SEQ ID NO: 720112 - RNA, 19 nt, Homo sapiens
ccagagacccuacaaaugu

SEQ ID NO: 720113 - RNA, 19 nt, Homo sapiens
caacaagaggaaauagaua

SEQ ID NO: 720114 - RNA, 19 nt, Homo sapiens
ucagagaauuuaugugaga

SEQ ID NO: 720115 - RNA, 19 nt, Homo sapiens
ucagagaagucauacuaga

SEQ ID NO: 720116 - RNA, 19 nt, Homo sapiens
gagagagacccuacaaaug

SEQ ID NO: 720117 - RNA, 19 nt, Homo sapiens
gagagagacccuacaaaug

SEQ ID NO: 720118 - RNA, 19 nt, Homo sapiens
ggcaaagccuucaacucua

SEQ ID NO: 720119 - RNA, 19 nt, Homo sapiens
gagagagacccuacaaaug

SEQ ID NO: 720120 - RNA, 19 nt, Homo sapiens
cgacaucaucgaauucaua

SEQ ID NO: 720121 - RNA, 19 nt, Homo sapiens
caaaucuuauugugcauga

SEQ ID NO: 720122 - RNA, 19 nt, Homo sapiens
gaaacccuauaaauggaaa

SEQ ID NO: 720123 - RNA, 19 nt, Homo sapiens
gggaaaacaucacauauau

SEQ ID NO: 720124 - RNA, 19 nt, Homo sapiens
gaugaauccucuguugaaa

SEQ ID NO: 720125 - RNA, 19 nt, Homo sapiens
cacaauggauguuaugaug

SEQ ID NO: 720126 - RNA, 19 nt, Homo sapiens
gaaacccuauacauguaaa

SEQ ID NO: 720127 - RNA, 19 nt, Homo sapiens
cuaaacagcagcaaauuga

SEQ ID NO: 720128 - RNA, 19 nt, Homo sapiens
gagaaaccauacaaaugug

SEQ ID NO: 720129 - RNA, 19 nt, Homo sapiens
gauaauccauaaugaagag

SEQ ID NO: 720130 - RNA, 19 nt, Homo sapiens
caacaucagaccauccaua

SEQ ID NO: 720131 - RNA, 19 nt, Homo sapiens
aggcaggucucuacucuaa

SEQ ID NO: 720132 - RNA, 19 nt, Homo sapiens
caugggagcugugaucuug

SEQ ID NO: 720133 - RNA, 19 nt, Homo sapiens
gcagaugcaauaaauguga

SEQ ID NO: 720134 - RNA, 19 nt, Homo sapiens
cacaauagcagagaauaua

SEQ ID NO: 720135 - RNA, 19 nt, Homo sapiens
ggauguggccguagaauuc

SEQ ID NO: 720136 - RNA, 19 nt, Homo sapiens
agagaaacccuauaaaugu

SEQ ID NO: 720137 - RNA, 19 nt, Homo sapiens
ggucuuuacucauucauca

SEQ ID NO: 720138 - RNA, 19 nt, Homo sapiens
caaauacuuucuucuugug

SEQ ID NO: 720139 - RNA, 19 nt, Homo sapiens
gagcugugaucuugagaau

SEQ ID NO: 720140 - RNA, 19 nt, Homo sapiens
gugaaacccuacaaauguu

SEQ ID NO: 720141 - RNA, 19 nt, Homo sapiens
uggcaaagccuucaacuau

SEQ ID NO: 720142 - RNA, 19 nt, Homo sapiens
guucaugccuuacucaaca

SEQ ID NO: 720143 - RNA, 19 nt, Homo sapiens
aaacagcagcaaauugaua

SEQ ID NO: 720144 - RNA, 19 nt, Homo sapiens
gcucaucgcuugcaaacag

SEQ ID NO: 720145 - RNA, 19 nt, Homo sapiens
ccaggagcguuuccaguuu

SEQ ID NO: 720146 - RNA, 19 nt, Homo sapiens
ccaauaaacaguugugguu

SEQ ID NO: 720147 - RNA, 19 nt, Homo sapiens
gcugagucuuucaccaaua

SEQ ID NO: 720148 - RNA, 19 nt, Homo sapiens
ugaggaagcugagucuuuc

SEQ ID NO: 720149 - RNA, 19 nt, Homo sapiens
gcagcgagcacaugaggaa

SEQ ID NO: 720150 - RNA, 19 nt, Homo sapiens
guucagaucugcgagaagu

SEQ ID NO: 720151 - RNA, 19 nt, Homo sapiens
aaacaguacuuccuugacu

SEQ ID NO: 720152 - RNA, 19 nt, Homo sapiens
cugagucuuucaccaauaa

SEQ ID NO: 720153 - RNA, 19 nt, Homo sapiens
ucagaagagugcaguacug

SEQ ID NO: 720154 - RNA, 19 nt, Homo sapiens
gagcuucuuucuucaucug

SEQ ID NO: 720155 - RNA, 19 nt, Homo sapiens
guaaauaguguacgauacu

SEQ ID NO: 720156 - RNA, 19 nt, Homo sapiens
gccaggagcguuuccaguu

SEQ ID NO: 720157 - RNA, 19 nt, Homo sapiens
acuagcaucugguauuuua

SEQ ID NO: 720158 - RNA, 19 nt, Homo sapiens
gauccuucguuuccuuuua

SEQ ID NO: 720159 - RNA, 19 nt, Homo sapiens
guacuuccuugacucacau

SEQ ID NO: 720160 - RNA, 19 nt, Homo sapiens
caggagcguuuccaguuuc

SEQ ID NO: 720161 - RNA, 19 nt, Homo sapiens
gguuguaaauaguguacga

SEQ ID NO: 720162 - RNA, 19 nt, Homo sapiens
cagcaggccaggagcguuu

SEQ ID NO: 720163 - RNA, 19 nt, Homo sapiens
cagcugcagguuguaaaua

SEQ ID NO: 720164 - RNA, 19 nt, Homo sapiens
acagauccuucguuuccuu

SEQ ID NO: 720165 - RNA, 19 nt, Homo sapiens
gcguuucucuuucugaacu

SEQ ID NO: 720166 - RNA, 19 nt, Homo sapiens
uacgcgagguaacguugua

SEQ ID NO: 720167 - RNA, 19 nt, Homo sapiens
ugaauugcugagcccauua

SEQ ID NO: 720168 - RNA, 19 nt, Homo sapiens
ggucagcugcagguuguaa

SEQ ID NO: 720169 - RNA, 19 nt, Homo sapiens
guacugguccacagagaag

SEQ ID NO: 720170 - RNA, 19 nt, Homo sapiens
ccauaaacaguacuuccuu

SEQ ID NO: 720171 - RNA, 19 nt, Homo sapiens
ccauugcguuucucuuucu

SEQ ID NO: 720172 - RNA, 19 nt, Homo sapiens
gcugcagguuguaaauagu

SEQ ID NO: 720173 - RNA, 19 nt, Homo sapiens
ggacuguaugggcaaguug

SEQ ID NO: 720174 - RNA, 19 nt, Homo sapiens
uguaaauaguguacgauac

SEQ ID NO: 720175 - RNA, 19 nt, Homo sapiens
ccccugagcuucuuucuuc

SEQ ID NO: 720176 - RNA, 19 nt, Homo sapiens
gcuucuuccugacauuuca

SEQ ID NO: 720177 - RNA, 19 nt, Homo sapiens
uugaauugcugagcccauu

SEQ ID NO: 720178 - RNA, 19 nt, Homo sapiens
uuucaccaauaaacaguug

SEQ ID NO: 720179 - RNA, 19 nt, Homo sapiens
gcagguuguaaauagugua

SEQ ID NO: 720180 - RNA, 19 nt, Homo sapiens
gcugguggccauaaacagu

SEQ ID NO: 720181 - RNA, 19 nt, Homo sapiens
gaauugcugagcccauuac

SEQ ID NO: 720182 - RNA, 19 nt, Homo sapiens
auaaacaguacuuccuuga

SEQ ID NO: 720183 - RNA, 19 nt, Homo sapiens
aagcugagucuuucaccaa

SEQ ID NO: 720184 - RNA, 19 nt, Homo sapiens
augaggaagcugagucuuu

SEQ ID NO: 720185 - RNA, 19 nt, Homo sapiens
caguacugguccacagaga

SEQ ID NO: 720186 - RNA, 19 nt, Homo sapiens
acuaugccuucaccagcua

SEQ ID NO: 720187 - RNA, 19 nt, Homo sapiens
gaaacagacccucaaauua

SEQ ID NO: 720188 - RNA, 19 nt, Homo sapiens
acaaagaccugugaauuua

SEQ ID NO: 720189 - RNA, 19 nt, Homo sapiens
gauuacaccugaaaccuua

SEQ ID NO: 720190 - RNA, 19 nt, Homo sapiens
ggaaaccucugacuugcua

SEQ ID NO: 720191 - RNA, 19 nt, Homo sapiens
aaacagacccucaaauuaa

SEQ ID NO: 720192 - RNA, 19 nt, Homo sapiens
guaacaaaguucuguauga

SEQ ID NO: 720193 - RNA, 19 nt, Homo sapiens
ggauguauauugcuaugua

SEQ ID NO: 720194 - RNA, 19 nt, Homo sapiens
cgaaggauauggacuauug

SEQ ID NO: 720195 - RNA, 19 nt, Homo sapiens
gaugauguguuuaaacuga

SEQ ID NO: 720196 - RNA, 19 nt, Homo sapiens
uaacuuuccuuccucauuu

SEQ ID NO: 720197 - RNA, 19 nt, Homo sapiens
gaacagauacauacauaga

SEQ ID NO: 720198 - RNA, 19 nt, Homo sapiens
gaaacuugguucccagaaa

SEQ ID NO: 720199 - RNA, 19 nt, Homo sapiens
gacaaagaccugugaauuu

SEQ ID NO: 720200 - RNA, 19 nt, Homo sapiens
ccauuucccugaacagaua

SEQ ID NO: 720201 - RNA, 19 nt, Homo sapiens
gacuguggcucuugccuua

SEQ ID NO: 720202 - RNA, 19 nt, Homo sapiens
ugaaacagacccucaaauu

SEQ ID NO: 720203 - RNA, 19 nt, Homo sapiens
gcucuugccuuaucuguuc

SEQ ID NO: 720204 - RNA, 19 nt, Homo sapiens
ccacggagauucagaacau

SEQ ID NO: 720205 - RNA, 19 nt, Homo sapiens
caacagcaccauagaaaug

SEQ ID NO: 720206 - RNA, 19 nt, Homo sapiens
caaauuaacuuuccuuccu

SEQ ID NO: 720207 - RNA, 19 nt, Homo sapiens
aaacuuaucugagucacuu

SEQ ID NO: 720208 - RNA, 19 nt, Homo sapiens
caacuaauaggaccucaaa

SEQ ID NO: 720209 - RNA, 19 nt, Homo sapiens
cugaacagauacauacaua

SEQ ID NO: 720210 - RNA, 19 nt, Homo sapiens
ccaagaccauuucacagaa

SEQ ID NO: 720211 - RNA, 19 nt, Homo sapiens
gcucaccugacauuaauua

SEQ ID NO: 720212 - RNA, 19 nt, Homo sapiens
caacaggcaccucuaauca

SEQ ID NO: 720213 - RNA, 19 nt, Homo sapiens
gaguaaggauucaguccaa

SEQ ID NO: 720214 - RNA, 19 nt, Homo sapiens
gcaaggugguagcaggaaa

SEQ ID NO: 720215 - RNA, 19 nt, Homo sapiens
ggaccgcccuggacaucaa

SEQ ID NO: 720216 - RNA, 19 nt, Homo sapiens
gaacgggaguggccaucug

SEQ ID NO: 720217 - RNA, 19 nt, Homo sapiens
aaaguggaauuugagguua

SEQ ID NO: 720218 - RNA, 19 nt, Homo sapiens
guccuugacuugaugaauu

SEQ ID NO: 720219 - RNA, 19 nt, Homo sapiens
ccaccacacucagcuaauu

SEQ ID NO: 720220 - RNA, 19 nt, Homo sapiens
aaaggaaaccucugacuug

SEQ ID NO: 720221 - RNA, 19 nt, Homo sapiens
ggacaucucaacucaacaa

SEQ ID NO: 720222 - RNA, 19 nt, Homo sapiens
gaggacaucucaacucaac

SEQ ID NO: 720223 - RNA, 19 nt, Homo sapiens
ugacaaagaccugugaauu

SEQ ID NO: 720224 - RNA, 19 nt, Homo sapiens
aaacagaaaucccuuuuga

SEQ ID NO: 720225 - RNA, 19 nt, Homo sapiens
acacugcgcugugacauga

SEQ ID NO: 720226 - RNA, 19 nt, Homo sapiens
gcacuugaaggguaacaaa

SEQ ID NO: 720227 - RNA, 19 nt, Homo sapiens
gacauaaugccaaggguaa

SEQ ID NO: 720228 - RNA, 19 nt, Homo sapiens
acagauacauacauagaga

SEQ ID NO: 720229 - RNA, 19 nt, Homo sapiens
uaacaaaguucuguaugag

SEQ ID NO: 720230 - RNA, 19 nt, Homo sapiens
aaacagaggccacacuuuc

SEQ ID NO: 720231 - RNA, 19 nt, Homo sapiens
ccaaagugcugagauuaca

SEQ ID NO: 720232 - RNA, 19 nt, Homo sapiens
ucaacaaacugugucauca

SEQ ID NO: 720233 - RNA, 19 nt, Homo sapiens
gaauuuggucugccucuga

SEQ ID NO: 720234 - RNA, 19 nt, Homo sapiens
auacauacauagagagaga

SEQ ID NO: 720235 - RNA, 19 nt, Homo sapiens
gcccuggacaucaagauua

SEQ ID NO: 720236 - RNA, 19 nt, Homo sapiens
ggagaccaccaacuucaaa

SEQ ID NO: 720237 - RNA, 19 nt, Homo sapiens
caucucaacucaacaaacu

SEQ ID NO: 720238 - RNA, 19 nt, Homo sapiens
gaaauuucccagcggcaaa

SEQ ID NO: 720239 - RNA, 19 nt, Homo sapiens
caccugacauuaauuaucu

SEQ ID NO: 720240 - RNA, 19 nt, Homo sapiens
ccaaagugcugggauuaca

SEQ ID NO: 720241 - RNA, 19 nt, Homo sapiens
cugaagcucugcaggauau

SEQ ID NO: 720242 - RNA, 19 nt, Homo sapiens
cugagucacuugaaacuug

SEQ ID NO: 720243 - RNA, 19 nt, Homo sapiens
gcaguuucccagaauauau

SEQ ID NO: 720244 - RNA, 19 nt, Homo sapiens
gucaggaaguuugcagaua

SEQ ID NO: 720245 - RNA, 19 nt, Homo sapiens
aaucagaccuuuucuuuga

SEQ ID NO: 720246 - RNA, 19 nt, Homo sapiens
ggauauggacuauugcaau

SEQ ID NO: 720247 - RNA, 19 nt, Homo sapiens
acaggcaccucuaaucaga

SEQ ID NO: 720248 - RNA, 19 nt, Homo sapiens
uuacagaacgucaaagaga

SEQ ID NO: 720249 - RNA, 19 nt, Homo sapiens
caauacauuucuuccuuca

SEQ ID NO: 720250 - RNA, 19 nt, Homo sapiens
ccagcaguuucccagaaua

SEQ ID NO: 720251 - RNA, 19 nt, Homo sapiens
gcccagcaguuucccagaa

SEQ ID NO: 720252 - RNA, 19 nt, Homo sapiens
gccaagaccauuucacaga

SEQ ID NO: 720253 - RNA, 19 nt, Homo sapiens
gagaaaagguuugggaugu

SEQ ID NO: 720254 - RNA, 19 nt, Homo sapiens
ugauuuaggcacugcuuua

SEQ ID NO: 720255 - RNA, 19 nt, Homo sapiens
uauguuugcuccuguuguu

SEQ ID NO: 720256 - RNA, 19 nt, Homo sapiens
caagugauccuccugucuu

SEQ ID NO: 720257 - RNA, 19 nt, Homo sapiens
gaacugccauaaaaucuca

SEQ ID NO: 720258 - RNA, 19 nt, Homo sapiens
ucaggaaguuugcagauac

SEQ ID NO: 720259 - RNA, 19 nt, Homo sapiens
gaccauggaaggaacugua

SEQ ID NO: 720260 - RNA, 19 nt, Homo sapiens
gacguaucauggcguguuu

SEQ ID NO: 720261 - RNA, 19 nt, Homo sapiens
ugaauuuccucugcacuug

SEQ ID NO: 720262 - RNA, 19 nt, Homo sapiens
gaaaagguuugggauguau

SEQ ID NO: 720263 - RNA, 19 nt, Homo sapiens
ucacuccgcuccucagaag

SEQ ID NO: 720264 - RNA, 19 nt, Homo sapiens
guuaagccuauccagauua

SEQ ID NO: 720265 - RNA, 19 nt, Homo sapiens
aaagaccugugaauuuauc

SEQ ID NO: 720266 - RNA, 19 nt, Homo sapiens
uaucauggcguguuuguca

SEQ ID NO: 720267 - RNA, 19 nt, Homo sapiens
ggguaaacaagccugauuu

SEQ ID NO: 720268 - RNA, 19 nt, Homo sapiens
ugcaauacauuucuuccuu

SEQ ID NO: 720269 - RNA, 19 nt, Homo sapiens
acacuagccuucuuuugua

SEQ ID NO: 720270 - RNA, 19 nt, Homo sapiens
guucgaaggauauggacua

SEQ ID NO: 720271 - RNA, 19 nt, Homo sapiens
gaggagggaagcauagaga

SEQ ID NO: 720272 - RNA, 19 nt, Homo sapiens
ggaauuugagguuaacauc

SEQ ID NO: 720273 - RNA, 19 nt, Homo sapiens
ucgaggacaucucaacuca

SEQ ID NO: 720274 - RNA, 19 nt, Homo sapiens
gcuggagaguggcaucaug

SEQ ID NO: 720275 - RNA, 19 nt, Homo sapiens
uuaagccuauccagauuau

SEQ ID NO: 720276 - RNA, 19 nt, Homo sapiens
ggaguggccaucuggaaau

SEQ ID NO: 720277 - RNA, 19 nt, Homo sapiens
gggaguggccaucuggaaa

SEQ ID NO: 720278 - RNA, 19 nt, Homo sapiens
caaagaccugugaauuuau

SEQ ID NO: 720279 - RNA, 19 nt, Homo sapiens
gauuaucaacagcaccaua

SEQ ID NO: 720280 - RNA, 19 nt, Homo sapiens
ucugaagucucaagaacug

SEQ ID NO: 720281 - RNA, 19 nt, Homo sapiens
ggucauaucgaguaaggau

SEQ ID NO: 720282 - RNA, 19 nt, Homo sapiens
cuugaaggguaacaaaguu

SEQ ID NO: 720283 - RNA, 19 nt, Homo sapiens
aaagaccucccaagcugua

SEQ ID NO: 720284 - RNA, 19 nt, Homo sapiens
cuaauaggaccucaaaaua

SEQ ID NO: 720285 - RNA, 19 nt, Homo sapiens
ucaaauccugccacuguuu

SEQ ID NO: 720286 - RNA, 19 nt, Homo sapiens
acacccagccucuguaguu

SEQ ID NO: 720287 - RNA, 19 nt, Homo sapiens
gagcagaucggacagaaga

SEQ ID NO: 720288 - RNA, 19 nt, Homo sapiens
ggacagaagauccgcaaga

SEQ ID NO: 720289 - RNA, 19 nt, Homo sapiens
gacagaagauccgcaagau

SEQ ID NO: 720290 - RNA, 19 nt, Homo sapiens
ggaccugccugacgcaucu

SEQ ID NO: 720291 - RNA, 19 nt, Homo sapiens
caacgucaccggugucuuc

SEQ ID NO: 720292 - RNA, 19 nt, Homo sapiens
gugaggagcuggagaagac

SEQ ID NO: 720293 - RNA, 19 nt, Homo sapiens
ggugagcgccuuccagaga

SEQ ID NO: 720294 - RNA, 19 nt, Homo sapiens
ccagagacgcuuugugguu

SEQ ID NO: 720295 - RNA, 19 nt, Homo sapiens
gccacgggcugcucauguu

SEQ ID NO: 720296 - RNA, 19 nt, Homo sapiens
ggcaggagaggaauaaaga

SEQ ID NO: 720297 - RNA, 19 nt, Homo sapiens
ugaccuuccucaucuccua

SEQ ID NO: 720298 - RNA, 19 nt, Homo sapiens
caccuucgcugccacagau

SEQ ID NO: 720299 - RNA, 19 nt, Homo sapiens
ccucaacuccuucaagaug

SEQ ID NO: 720300 - RNA, 19 nt, Homo sapiens
uggcaucgauccuauuugg

SEQ ID NO: 720301 - RNA, 19 nt, Homo sapiens
gugcagguccacaagauga

SEQ ID NO: 720302 - RNA, 19 nt, Homo sapiens
gggccuggaugaugaagag

SEQ ID NO: 720303 - RNA, 19 nt, Homo sapiens
gugagcagaucggacagaa

SEQ ID NO: 720304 - RNA, 19 nt, Homo sapiens
gcuaccugcuccugcuuau

SEQ ID NO: 720305 - RNA, 19 nt, Homo sapiens
gagaaccgaccggcuguga

SEQ ID NO: 720306 - RNA, 19 nt, Homo sapiens
gagccagccacguggauga

SEQ ID NO: 720307 - RNA, 19 nt, Homo sapiens
cagucuggcuggagugaug

SEQ ID NO: 720308 - RNA, 19 nt, Homo sapiens
ccaugguccuugcggagaa

SEQ ID NO: 720309 - RNA, 19 nt, Homo sapiens
gcugugaggagcuggagaa

SEQ ID NO: 720310 - RNA, 19 nt, Homo sapiens
gcaagaucacggacugcuu

SEQ ID NO: 720311 - RNA, 19 nt, Homo sapiens
ugcugggacucuucgguua

SEQ ID NO: 720312 - RNA, 19 nt, Homo sapiens
ugaggcaggagaggaauaa

SEQ ID NO: 720313 - RNA, 19 nt, Homo sapiens
ggugauggagggacucuca

SEQ ID NO: 720314 - RNA, 19 nt, Homo sapiens
uggcuggagugaugcauuc

SEQ ID NO: 720315 - RNA, 19 nt, Homo sapiens
caucuacaccggcuucauc

SEQ ID NO: 720316 - RNA, 19 nt, Homo sapiens
ccagcauccucauccacuu

SEQ ID NO: 720317 - RNA, 19 nt, Homo sapiens
ucaaccacgugcacuuugg

SEQ ID NO: 720318 - RNA, 19 nt, Homo sapiens
ccguguaccuggcccugaa

SEQ ID NO: 720319 - RNA, 19 nt, Homo sapiens
ccacguggaugaccuuccu

SEQ ID NO: 720320 - RNA, 19 nt, Homo sapiens
cucaacuccuucaagauga

SEQ ID NO: 720321 - RNA, 19 nt, Homo sapiens
uuccucaacuccuucaaga

SEQ ID NO: 720322 - RNA, 19 nt, Homo sapiens
cuacaacgagugcuucagu

SEQ ID NO: 720323 - RNA, 19 nt, Homo sapiens
agagacgcuuugugguuga

SEQ ID NO: 720324 - RNA, 19 nt, Homo sapiens
acaccggcuucaucuacaa

SEQ ID NO: 720325 - RNA, 19 nt, Homo sapiens
ggccuguucuccaucuaca

SEQ ID NO: 720326 - RNA, 19 nt, Homo sapiens
ccuguuugcugugauguuc

SEQ ID NO: 720327 - RNA, 19 nt, Homo sapiens
caagaugaaggccguguac

SEQ ID NO: 720328 - RNA, 19 nt, Homo sapiens
ucaucaacauguuccucuu

SEQ ID NO: 720329 - RNA, 19 nt, Homo sapiens
caucaacauguuccucuuc

SEQ ID NO: 720330 - RNA, 19 nt, Homo sapiens
ccacuucaucaacauguuc

SEQ ID NO: 720331 - RNA, 19 nt, Homo sapiens
ccuacaccaucaucaccuu

SEQ ID NO: 720332 - RNA, 19 nt, Homo sapiens
cuacaccggcuucaucuac

SEQ ID NO: 720333 - RNA, 19 nt, Homo sapiens
gagcagaucggacagaaga

SEQ ID NO: 720334 - RNA, 19 nt, Homo sapiens
ggacagaagauccgcaaga

SEQ ID NO: 720335 - RNA, 19 nt, Homo sapiens
gacagaagauccgcaagau

SEQ ID NO: 720336 - RNA, 19 nt, Homo sapiens
ggaccugccugacgcaucu

SEQ ID NO: 720337 - RNA, 19 nt, Homo sapiens
caacgucaccggugucuuc

SEQ ID NO: 720338 - RNA, 19 nt, Homo sapiens
gccacgggcugcucauguu

SEQ ID NO: 720339 - RNA, 19 nt, Homo sapiens
ucaagugagugagggauga

SEQ ID NO: 720340 - RNA, 19 nt, Homo sapiens
ggcaggagaggaauaaaga

SEQ ID NO: 720341 - RNA, 19 nt, Homo sapiens
ugaccuuccucaucuccua

SEQ ID NO: 720342 - RNA, 19 nt, Homo sapiens
caccuucgcugccacagau

SEQ ID NO: 720343 - RNA, 19 nt, Homo sapiens
ccucaacuccuucaagaug

SEQ ID NO: 720344 - RNA, 19 nt, Homo sapiens
uggcaucgauccuauuugg

SEQ ID NO: 720345 - RNA, 19 nt, Homo sapiens
gugcagguccacaagauga

SEQ ID NO: 720346 - RNA, 19 nt, Homo sapiens
gggccuggaugaugaagag

SEQ ID NO: 720347 - RNA, 19 nt, Homo sapiens
gugagcagaucggacagaa

SEQ ID NO: 720348 - RNA, 19 nt, Homo sapiens
gcuaccugcuccugcuuau

SEQ ID NO: 720349 - RNA, 19 nt, Homo sapiens
gagaaccgaccggcuguga

SEQ ID NO: 720350 - RNA, 19 nt, Homo sapiens
gagccagccacguggauga

SEQ ID NO: 720351 - RNA, 19 nt, Homo sapiens
cagucuggcuggagugaug

SEQ ID NO: 720352 - RNA, 19 nt, Homo sapiens
ccaugguccuugcggagaa

SEQ ID NO: 720353 - RNA, 19 nt, Homo sapiens
gcaagaucacggacugcuu

SEQ ID NO: 720354 - RNA, 19 nt, Homo sapiens
ugcugggacucuucgguua

SEQ ID NO: 720355 - RNA, 19 nt, Homo sapiens
ugaggcaggagaggaauaa

SEQ ID NO: 720356 - RNA, 19 nt, Homo sapiens
ggugauggagggacucuca

SEQ ID NO: 720357 - RNA, 19 nt, Homo sapiens
uggcuggagugaugcauuc

SEQ ID NO: 720358 - RNA, 19 nt, Homo sapiens
caucuacaccggcuucauc

SEQ ID NO: 720359 - RNA, 19 nt, Homo sapiens
ccagcauccucauccacuu

SEQ ID NO: 720360 - RNA, 19 nt, Homo sapiens
ucaaccacgugcacuuugg

SEQ ID NO: 720361 - RNA, 19 nt, Homo sapiens
ccacguggaugaccuuccu

SEQ ID NO: 720362 - RNA, 19 nt, Homo sapiens
ccguguaccuggcccugaa

SEQ ID NO: 720363 - RNA, 19 nt, Homo sapiens
cucaacuccuucaagauga

SEQ ID NO: 720364 - RNA, 19 nt, Homo sapiens
uuccucaacuccuucaaga

SEQ ID NO: 720365 - RNA, 19 nt, Homo sapiens
cuacaacgagugcuucagu

SEQ ID NO: 720366 - RNA, 19 nt, Homo sapiens
acaccggcuucaucuacaa

SEQ ID NO: 720367 - RNA, 19 nt, Homo sapiens
ggccuguucuccaucuaca

SEQ ID NO: 720368 - RNA, 19 nt, Homo sapiens
ccuguuugcugugauguuc

SEQ ID NO: 720369 - RNA, 19 nt, Homo sapiens
caagaugaaggccguguac

SEQ ID NO: 720370 - RNA, 19 nt, Homo sapiens
ucaucaacauguuccucuu

SEQ ID NO: 720371 - RNA, 19 nt, Homo sapiens
caucaacauguuccucuuc

SEQ ID NO: 720372 - RNA, 19 nt, Homo sapiens
ccacuucaucaacauguuc

SEQ ID NO: 720373 - RNA, 19 nt, Homo sapiens
ccuacaccaucaucaccuu

SEQ ID NO: 720374 - RNA, 19 nt, Homo sapiens
cuacaccggcuucaucuac

SEQ ID NO: 720375 - RNA, 19 nt, Homo sapiens
cuaaggagcuugaaucuug

SEQ ID NO: 720376 - RNA, 19 nt, Homo sapiens
cagaagcuuuccauaauua

SEQ ID NO: 720377 - RNA, 19 nt, Homo sapiens
caugugggcuccucaguua

SEQ ID NO: 720378 - RNA, 19 nt, Homo sapiens
gcuguaaacuuguuagaga

SEQ ID NO: 720379 - RNA, 19 nt, Homo sapiens
gaacucagaagaagaaaga

SEQ ID NO: 720380 - RNA, 19 nt, Homo sapiens
gaaaugcaacaguuacuaa

SEQ ID NO: 720381 - RNA, 19 nt, Homo sapiens
gaucagaccaagucaauug

SEQ ID NO: 720382 - RNA, 19 nt, Homo sapiens
gaagaaggccauccauuca

SEQ ID NO: 720383 - RNA, 19 nt, Homo sapiens
ggaaggaaauugucuacgu

SEQ ID NO: 720384 - RNA, 19 nt, Homo sapiens
ccaagaaugccaucugaua

SEQ ID NO: 720385 - RNA, 19 nt, Homo sapiens
uaaaguaagggcuaugaua

SEQ ID NO: 720386 - RNA, 19 nt, Homo sapiens
uaagggcuaugauauuuga

SEQ ID NO: 720387 - RNA, 19 nt, Homo sapiens
ucagcgaacuugaaagaaa

SEQ ID NO: 720388 - RNA, 19 nt, Homo sapiens
cagaauaaguacauggaaa

SEQ ID NO: 720389 - RNA, 19 nt, Homo sapiens
ggagagaugugaagaagac

SEQ ID NO: 720390 - RNA, 19 nt, Homo sapiens
gcacugcuguaaacuuguu

SEQ ID NO: 720391 - RNA, 19 nt, Homo sapiens
caagaaugccaucugauaa

SEQ ID NO: 720392 - RNA, 19 nt, Homo sapiens
gaagaagacuggguuuguc

SEQ ID NO: 720393 - RNA, 19 nt, Homo sapiens
ucagaagcuuuccauaauu

SEQ ID NO: 720394 - RNA, 19 nt, Homo sapiens
ggaagucagugauugucuu

SEQ ID NO: 720395 - RNA, 19 nt, Homo sapiens
aauaugcacuggcgaguuu

SEQ ID NO: 720396 - RNA, 19 nt, Homo sapiens
uuacucagcuauccauuau

SEQ ID NO: 720397 - RNA, 19 nt, Homo sapiens
uaacugguuucauguccua

SEQ ID NO: 720398 - RNA, 19 nt, Homo sapiens
gaaauugucuacgugucuu

SEQ ID NO: 720399 - RNA, 19 nt, Homo sapiens
ccagauugaucacuauguu

SEQ ID NO: 720400 - RNA, 19 nt, Homo sapiens
aguaagggcuaugauauuu

SEQ ID NO: 720401 - RNA, 19 nt, Homo sapiens
guacagaagucagaagaag

SEQ ID NO: 720402 - RNA, 19 nt, Homo sapiens
cgagccaguugccggauua

SEQ ID NO: 720403 - RNA, 19 nt, Homo sapiens
cauccaagcuguacagaag

SEQ ID NO: 720404 - RNA, 19 nt, Homo sapiens
gugcacugcuguaaacuug

SEQ ID NO: 720405 - RNA, 19 nt, Homo sapiens
gaaaggcuccgccauuugg

SEQ ID NO: 720406 - RNA, 19 nt, Homo sapiens
gaaucuugguuccuguaaa

SEQ ID NO: 720407 - RNA, 19 nt, Homo sapiens
ccucagaagcuuuccauaa

SEQ ID NO: 720408 - RNA, 19 nt, Homo sapiens
gaagucagugauugucuuu

SEQ ID NO: 720409 - RNA, 19 nt, Homo sapiens
cggaaucacccuucuaauu

SEQ ID NO: 720410 - RNA, 19 nt, Homo sapiens
agaaggccauccauucaaa

SEQ ID NO: 720411 - RNA, 19 nt, Homo sapiens
ggaagugccacauccaguu

SEQ ID NO: 720412 - RNA, 19 nt, Homo sapiens
ggaaaggcuccgccauuug

SEQ ID NO: 720413 - RNA, 19 nt, Homo sapiens
uaggauaagucaauaccuu

SEQ ID NO: 720414 - RNA, 19 nt, Homo sapiens
ucaucagugugguuucuua

SEQ ID NO: 720415 - RNA, 19 nt, Homo sapiens
gagaucagaccaagucaau

SEQ ID NO: 720416 - RNA, 19 nt, Homo sapiens
aggaaaggcuccgccauuu

SEQ ID NO: 720417 - RNA, 19 nt, Homo sapiens
ggaaagauuggagguaaga

SEQ ID NO: 720418 - RNA, 19 nt, Homo sapiens
agacccagauugaucacua

SEQ ID NO: 720419 - RNA, 19 nt, Homo sapiens
gcaccacgcugaucaugcu

SEQ ID NO: 720420 - RNA, 19 nt, Homo sapiens
guagagccuuuaccuguag

SEQ ID NO: 720421 - RNA, 19 nt, Homo sapiens
agaacuaucuuagaacuca

SEQ ID NO: 720422 - RNA, 19 nt, Homo sapiens
cucagaagcuuuccauaau

SEQ ID NO: 720423 - RNA, 19 nt, Homo sapiens
aaaguaagggcuaugauau

SEQ ID NO: 720424 - RNA, 19 nt, Homo sapiens
gccuuuaccuguagcuuga

SEQ ID NO: 720425 - RNA, 19 nt, Homo sapiens
aaccagaaaugcaacaguu

SEQ ID NO: 720426 - RNA, 19 nt, Homo sapiens
cagaccaagucaauuguug

SEQ ID NO: 720427 - RNA, 19 nt, Homo sapiens
gucguuacuuguacuauga

SEQ ID NO: 720428 - RNA, 19 nt, Homo sapiens
gaaggaaaauacucagugu

SEQ ID NO: 720429 - RNA, 19 nt, Homo sapiens
uugcugcuguguuuagaua

SEQ ID NO: 720430 - RNA, 19 nt, Homo sapiens
gaaguacaagacccagauu

SEQ ID NO: 720431 - RNA, 19 nt, Homo sapiens
gcccugaaacucauuauuc

SEQ ID NO: 720432 - RNA, 19 nt, Homo sapiens
agaagaaggccauccauuc

SEQ ID NO: 720433 - RNA, 19 nt, Homo sapiens
gcugugcacugcuguaaac

SEQ ID NO: 720434 - RNA, 19 nt, Homo sapiens
ggauacuccuuuucuuuaa

SEQ ID NO: 720435 - RNA, 19 nt, Homo sapiens
gagagaaaaugaaagaaca

SEQ ID NO: 720436 - RNA, 19 nt, Homo sapiens
gauuggagguaagagagaa

SEQ ID NO: 720437 - RNA, 19 nt, Homo sapiens
cugcccaccucaaguuuaa

SEQ ID NO: 720438 - RNA, 19 nt, Homo sapiens
gagccugcauuccaagcuu

SEQ ID NO: 720439 - RNA, 19 nt, Homo sapiens
guacauggaaaccagaaau

SEQ ID NO: 720440 - RNA, 19 nt, Homo sapiens
cauccuggcucuucucucu

SEQ ID NO: 720441 - RNA, 19 nt, Homo sapiens
gcccaccucaaguuuaaua

SEQ ID NO: 720442 - RNA, 19 nt, Homo sapiens
gaagugccacauccaguuc

SEQ ID NO: 720443 - RNA, 19 nt, Homo sapiens
ggaaauugucuacgugucu

SEQ ID NO: 720444 - RNA, 19 nt, Homo sapiens
gcacuggcgaguuuaaagu

SEQ ID NO: 720445 - RNA, 19 nt, Homo sapiens
gaggugaaauacagaaagc

SEQ ID NO: 720446 - RNA, 19 nt, Homo sapiens
aagaaugccaucugauaaa

SEQ ID NO: 720447 - RNA, 19 nt, Homo sapiens
gcagaauaaguacauggaa

SEQ ID NO: 720448 - RNA, 19 nt, Homo sapiens
cuacaaguccgucauccaa

SEQ ID NO: 720449 - RNA, 19 nt, Homo sapiens
gacccagauugaucacuau

SEQ ID NO: 720450 - RNA, 19 nt, Homo sapiens
guacaagacccagauugau

SEQ ID NO: 720451 - RNA, 19 nt, Homo sapiens
gcaugugggcuccucaguu

SEQ ID NO: 720452 - RNA, 19 nt, Homo sapiens
uuagaacucagaagaagaa

SEQ ID NO: 720453 - RNA, 19 nt, Homo sapiens
gcuugagccugcauuccaa

SEQ ID NO: 720454 - RNA, 19 nt, Homo sapiens
cagaagaaggccauccauu

SEQ ID NO: 720455 - RNA, 19 nt, Homo sapiens
gcugcuguguuuagauaau

SEQ ID NO: 720456 - RNA, 19 nt, Homo sapiens
gaauaugcacuggcgaguu

SEQ ID NO: 720457 - RNA, 19 nt, Homo sapiens
ggggaaagauuggagguaa

SEQ ID NO: 720458 - RNA, 19 nt, Homo sapiens
uaauggugguagagccuuu

SEQ ID NO: 720459 - RNA, 19 nt, Homo sapiens
ucccauccuuucccuuuaa

SEQ ID NO: 720460 - RNA, 19 nt, Homo sapiens
guaagggcuaugauauuug

SEQ ID NO: 720461 - RNA, 19 nt, Homo sapiens
uaacuuauaggugauagug

SEQ ID NO: 720462 - RNA, 19 nt, Homo sapiens
gcccucaaaucccuaucuu

SEQ ID NO: 720463 - RNA, 19 nt, Homo sapiens
gaguguggauaccuuccuu

SEQ ID NO: 720464 - RNA, 19 nt, Homo sapiens
gggaaagauuggagguaag

SEQ ID NO: 720465 - RNA, 19 nt, Homo sapiens
gccaguugccggauuauuc

SEQ ID NO: 720466 - RNA, 19 nt, Homo sapiens
uaacggaaucacccuucua

SEQ ID NO: 720467 - RNA, 19 nt, Homo sapiens
gcgagccaguugccggauu

SEQ ID NO: 720468 - RNA, 19 nt, Homo sapiens
gagaauucagcgaacuuga

SEQ ID NO: 720469 - RNA, 19 nt, Homo sapiens
ccuuaagaagucaugauua

SEQ ID NO: 720470 - RNA, 19 nt, Homo sapiens
gguagaagaucugguugac

SEQ ID NO: 720471 - RNA, 19 nt, Homo sapiens
acucauuauucgucucuuu

SEQ ID NO: 720472 - RNA, 19 nt, Homo sapiens
ugaagaagacuggguuugu

SEQ ID NO: 720473 - RNA, 19 nt, Homo sapiens
caagaggugaaauacagaa

SEQ ID NO: 720474 - RNA, 19 nt, Homo sapiens
cgucguuacuuguacuaug

SEQ ID NO: 720475 - RNA, 19 nt, Homo sapiens
gaauaaagcucauuugguu

SEQ ID NO: 720476 - RNA, 19 nt, Homo sapiens
ucacaacgcuugaccaaua

SEQ ID NO: 720477 - RNA, 19 nt, Homo sapiens
gaaagggaauacuaucuaa

SEQ ID NO: 720478 - RNA, 19 nt, Homo sapiens
gaacuuggaggaaaucuua

SEQ ID NO: 720479 - RNA, 19 nt, Homo sapiens
gaaauucccuucuggcaau

SEQ ID NO: 720480 - RNA, 19 nt, Homo sapiens
ucaauaccaucaucucuua

SEQ ID NO: 720481 - RNA, 19 nt, Homo sapiens
gggaaaggcugggaucaua

SEQ ID NO: 720482 - RNA, 19 nt, Homo sapiens
gcaaauucauccacacaaa

SEQ ID NO: 720483 - RNA, 19 nt, Homo sapiens
ggaaguggcaucauuguuu

SEQ ID NO: 720484 - RNA, 19 nt, Homo sapiens
gcaauuacccuccauguau

SEQ ID NO: 720485 - RNA, 19 nt, Homo sapiens
caagggaaguuacauaguu

SEQ ID NO: 720486 - RNA, 19 nt, Homo sapiens
caucaucucuuaucucuau

SEQ ID NO: 720487 - RNA, 19 nt, Homo sapiens
gcaugacccuuucuguaua

SEQ ID NO: 720488 - RNA, 19 nt, Homo sapiens
caaaugaaaugcucuaugg

SEQ ID NO: 720489 - RNA, 19 nt, Homo sapiens
acacuucacuucucuuuaa

SEQ ID NO: 720490 - RNA, 19 nt, Homo sapiens
gaugugaucuggcaauaug

SEQ ID NO: 720491 - RNA, 19 nt, Homo sapiens
uuacuaaacuggcacaauu

SEQ ID NO: 720492 - RNA, 19 nt, Homo sapiens
uaacagggucuaaguauuu

SEQ ID NO: 720493 - RNA, 19 nt, Homo sapiens
aggaauggcuggaacaaua

SEQ ID NO: 720494 - RNA, 19 nt, Homo sapiens
caauuacccuccauguaua

SEQ ID NO: 720495 - RNA, 19 nt, Homo sapiens
gaacauggaugcagaacac

SEQ ID NO: 720496 - RNA, 19 nt, Homo sapiens
gauaucagcacuuacagua

SEQ ID NO: 720497 - RNA, 19 nt, Homo sapiens
ggaauacuaucuaaccaau

SEQ ID NO: 720498 - RNA, 19 nt, Homo sapiens
gaucuaggguuacuuucuu

SEQ ID NO: 720499 - RNA, 19 nt, Homo sapiens
uaucugaacuuuggucuuu

SEQ ID NO: 720500 - RNA, 19 nt, Homo sapiens
gaugucaguuccaauuauu

SEQ ID NO: 720501 - RNA, 19 nt, Homo sapiens
gaaguggcaucauuguuuc

SEQ ID NO: 720502 - RNA, 19 nt, Homo sapiens
guauagggccuguaaguuu

SEQ ID NO: 720503 - RNA, 19 nt, Homo sapiens
gacaugaaguaccuguaua

SEQ ID NO: 720504 - RNA, 19 nt, Homo sapiens
caauauggguugcugaaga

SEQ ID NO: 720505 - RNA, 19 nt, Homo sapiens
caaauucuguucaaguguu

SEQ ID NO: 720506 - RNA, 19 nt, Homo sapiens
caauuuaucugaacuuugg

SEQ ID NO: 720507 - RNA, 19 nt, Homo sapiens
gagaucugcuuguccauug

SEQ ID NO: 720508 - RNA, 19 nt, Homo sapiens
gggaucauauguauuucua

SEQ ID NO: 720509 - RNA, 19 nt, Homo sapiens
gcaccucauuccuguguuu

SEQ ID NO: 720510 - RNA, 19 nt, Homo sapiens
gcugggaucauauguauuu

SEQ ID NO: 720511 - RNA, 19 nt, Homo sapiens
ugugaagagugacuauuua

SEQ ID NO: 720512 - RNA, 19 nt, Homo sapiens
gagaagacuugaucacagu

SEQ ID NO: 720513 - RNA, 19 nt, Homo sapiens
gugcuuuacuuacaucuuu

SEQ ID NO: 720514 - RNA, 19 nt, Homo sapiens
guauuugacuuacuaguuc

SEQ ID NO: 720515 - RNA, 19 nt, Homo sapiens
gagugacuauuuacaugua

SEQ ID NO: 720516 - RNA, 19 nt, Homo sapiens
cuauugagcuguagacgaa

SEQ ID NO: 720517 - RNA, 19 nt, Homo sapiens
gaucacaguucuccaagca

SEQ ID NO: 720518 - RNA, 19 nt, Homo sapiens
ccuauuaucuccuguuuag

SEQ ID NO: 720519 - RNA, 19 nt, Homo sapiens
gaugagaaagggaauacua

SEQ ID NO: 720520 - RNA, 19 nt, Homo sapiens
gcagguagcagucuccuau

SEQ ID NO: 720521 - RNA, 19 nt, Homo sapiens
aaacauacuuucagauugg

SEQ ID NO: 720522 - RNA, 19 nt, Homo sapiens
caaagucuccacugaugua

SEQ ID NO: 720523 - RNA, 19 nt, Homo sapiens
ggcaaagucuccacugaug

SEQ ID NO: 720524 - RNA, 19 nt, Homo sapiens
ggagagaggccugaaauca

SEQ ID NO: 720525 - RNA, 19 nt, Homo sapiens
ugacugacuuucuaaacuu

SEQ ID NO: 720526 - RNA, 19 nt, Homo sapiens
ggacuugguaccuaaauau

SEQ ID NO: 720527 - RNA, 19 nt, Homo sapiens
ggacaugaaguaccuguau

SEQ ID NO: 720528 - RNA, 19 nt, Homo sapiens
ucacacaggacaugaagua

SEQ ID NO: 720529 - RNA, 19 nt, Homo sapiens
gggagaagaacauuucaaa

SEQ ID NO: 720530 - RNA, 19 nt, Homo sapiens
uuacagugacuaugcauua

SEQ ID NO: 720531 - RNA, 19 nt, Homo sapiens
aaacaaagagucaaacugu

SEQ ID NO: 720532 - RNA, 19 nt, Homo sapiens
aaugguaccaggaauauua

SEQ ID NO: 720533 - RNA, 19 nt, Homo sapiens
gaagagugacuauuuacau

SEQ ID NO: 720534 - RNA, 19 nt, Homo sapiens
aaagggagagugagugaua

SEQ ID NO: 720535 - RNA, 19 nt, Homo sapiens
uaagaacuuuggaguggaa

SEQ ID NO: 720536 - RNA, 19 nt, Homo sapiens
aaaaguggaucuaggguua

SEQ ID NO: 720537 - RNA, 19 nt, Homo sapiens
gaaguugguuccuagaaaa

SEQ ID NO: 720538 - RNA, 19 nt, Homo sapiens
caucauuguuucaguucua

SEQ ID NO: 720539 - RNA, 19 nt, Homo sapiens
ucagcgauaucagcacuua

SEQ ID NO: 720540 - RNA, 19 nt, Homo sapiens
ugagugauauguacagugu

SEQ ID NO: 720541 - RNA, 19 nt, Homo sapiens
gagagugagugauauguac

SEQ ID NO: 720542 - RNA, 19 nt, Homo sapiens
ggagagugagugauaugua

SEQ ID NO: 720543 - RNA, 19 nt, Homo sapiens
ccuauaagguauucagaga

SEQ ID NO: 720544 - RNA, 19 nt, Homo sapiens
ggcagaagauugcaucaca

SEQ ID NO: 720545 - RNA, 19 nt, Homo sapiens
uaaguaagagcaccucauu

SEQ ID NO: 720546 - RNA, 19 nt, Homo sapiens
gcuacuauguccucagguu

SEQ ID NO: 720547 - RNA, 19 nt, Homo sapiens
ugucaaaggucaucaagca

SEQ ID NO: 720548 - RNA, 19 nt, Homo sapiens
agaaguugguuccuagaaa

SEQ ID NO: 720549 - RNA, 19 nt, Homo sapiens
gcagggagaagaacauuuc

SEQ ID NO: 720550 - RNA, 19 nt, Homo sapiens
uauccagaguucaugcuua

SEQ ID NO: 720551 - RNA, 19 nt, Homo sapiens
ucccuuccauuaucauuua

SEQ ID NO: 720552 - RNA, 19 nt, Homo sapiens
uauagggccuguaaguuug

SEQ ID NO: 720553 - RNA, 19 nt, Homo sapiens
cuacaacgcugagacaauc

SEQ ID NO: 720554 - RNA, 19 nt, Homo sapiens
gaaaggcugggaucauaug

SEQ ID NO: 720555 - RNA, 19 nt, Homo sapiens
gggagucauuuacauccua

SEQ ID NO: 720556 - RNA, 19 nt, Homo sapiens
gaaaggggacagaaauaua

SEQ ID NO: 720557 - RNA, 19 nt, Homo sapiens
uuugaacucugaaaggaua

SEQ ID NO: 720558 - RNA, 19 nt, Homo sapiens
gaauggugcuuagaguaug

SEQ ID NO: 720559 - RNA, 19 nt, Homo sapiens
cuacaucuaugcucuucuu

SEQ ID NO: 720560 - RNA, 19 nt, Homo sapiens
gccgaaggcuacuuugaug

SEQ ID NO: 720561 - RNA, 19 nt, Homo sapiens
uaaauggguuagcuacugu

SEQ ID NO: 720562 - RNA, 19 nt, Homo sapiens
uaaagacucucuggugcuu

SEQ ID NO: 720563 - RNA, 19 nt, Homo sapiens
gcauuagugcugacucuuu

SEQ ID NO: 720564 - RNA, 19 nt, Homo sapiens
gaaacaaagagucaaacug

SEQ ID NO: 720565 - RNA, 19 nt, Homo sapiens
uggcuggaauuuauuacua

SEQ ID NO: 720566 - RNA, 19 nt, Homo sapiens
guaccaggaauauuaugua

SEQ ID NO: 720567 - RNA, 19 nt, Homo sapiens
gagacauacucugcuacua

SEQ ID NO: 720568 - RNA, 19 nt, Homo sapiens
cacaacgcuugaccaauaa

SEQ ID NO: 720569 - RNA, 19 nt, Homo sapiens
guagcagucuccuauuauc

SEQ ID NO: 720570 - RNA, 19 nt, Homo sapiens
agguagcagucuccuauua

SEQ ID NO: 720571 - RNA, 19 nt, Homo sapiens
guugaagguuaguuuaaga

SEQ ID NO: 720572 - RNA, 19 nt, Homo sapiens
gaguugaagguuaguuuaa

SEQ ID NO: 720573 - RNA, 19 nt, Homo sapiens
cuaaaugcuuccaggagaa

SEQ ID NO: 720574 - RNA, 19 nt, Homo sapiens
cauccaggccuauaaggua

SEQ ID NO: 720575 - RNA, 19 nt, Homo sapiens
gcagaaauaucacaguuag

SEQ ID NO: 720576 - RNA, 19 nt, Homo sapiens
ccacauaccugcugaucuu

SEQ ID NO: 720577 - RNA, 19 nt, Homo sapiens
gcugggagcuggaggauga

SEQ ID NO: 720578 - RNA, 19 nt, Homo sapiens
gcaaugggcugaccugucu

SEQ ID NO: 720579 - RNA, 19 nt, Homo sapiens
gaaaguggaggacguggua

SEQ ID NO: 720580 - RNA, 19 nt, Homo sapiens
guacaggguugcagauguu

SEQ ID NO: 720581 - RNA, 19 nt, Homo sapiens
ggagacaagugaccaagau

SEQ ID NO: 720582 - RNA, 19 nt, Homo sapiens
caagugaggaguucuuuaa

SEQ ID NO: 720583 - RNA, 19 nt, Homo sapiens
gguugcagauguuuaguuu

SEQ ID NO: 720584 - RNA, 19 nt, Homo sapiens
gagcagagcauuggacuug

SEQ ID NO: 720585 - RNA, 19 nt, Homo sapiens
gaaagggcggaaguuauua

SEQ ID NO: 720586 - RNA, 19 nt, Homo sapiens
auacugaacuauacacuga

SEQ ID NO: 720587 - RNA, 19 nt, Homo sapiens
uuuaaugggugaagaguuu

SEQ ID NO: 720588 - RNA, 19 nt, Homo sapiens
acccauaacuuuacucuga

SEQ ID NO: 720589 - RNA, 19 nt, Homo sapiens
acacugaaaugguuaagau

SEQ ID NO: 720590 - RNA, 19 nt, Homo sapiens
ugaaagggcggaaguuauu

SEQ ID NO: 720591 - RNA, 19 nt, Homo sapiens
ccaccuccguccucacaua

SEQ ID NO: 720592 - RNA, 19 nt, Homo sapiens
gcauaucagucuaccuuuc

SEQ ID NO: 720593 - RNA, 19 nt, Homo sapiens
ggaccugguuccaaucuca

SEQ ID NO: 720594 - RNA, 19 nt, Homo sapiens
ugaccaagaugcuguuugu

SEQ ID NO: 720595 - RNA, 19 nt, Homo sapiens
caagagacauggccaacca

SEQ ID NO: 720596 - RNA, 19 nt, Homo sapiens
cagcaugcccagcuaauuu

SEQ ID NO: 720597 - RNA, 19 nt, Homo sapiens
ugguuaagaugguacauuu

SEQ ID NO: 720598 - RNA, 19 nt, Homo sapiens
gcaagugaggaguucuuua

SEQ ID NO: 720599 - RNA, 19 nt, Homo sapiens
ugaaaugguuaagauggua

SEQ ID NO: 720600 - RNA, 19 nt, Homo sapiens
gugaggaguucuuuaaugg

SEQ ID NO: 720601 - RNA, 19 nt, Homo sapiens
gaaagugcaaauaagcaaa

SEQ ID NO: 720602 - RNA, 19 nt, Homo sapiens
cauccugaguggagccuua

SEQ ID NO: 720603 - RNA, 19 nt, Homo sapiens
gggcaaagccagcaugcaa

SEQ ID NO: 720604 - RNA, 19 nt, Homo sapiens
gcacgcuacuguuugagau

SEQ ID NO: 720605 - RNA, 19 nt, Homo sapiens
ggaaagugcaaauaagcaa

SEQ ID NO: 720606 - RNA, 19 nt, Homo sapiens
gggcggaaguuauuaucug

SEQ ID NO: 720607 - RNA, 19 nt, Homo sapiens
ccaccgcgcugcucuucuu

SEQ ID NO: 720608 - RNA, 19 nt, Homo sapiens
gcacgccuaccaacuacua

SEQ ID NO: 720609 - RNA, 19 nt, Homo sapiens
caucaagcauaucagucua

SEQ ID NO: 720610 - RNA, 19 nt, Homo sapiens
gcagccagguccagauaca

SEQ ID NO: 720611 - RNA, 19 nt, Homo sapiens
gguacaggguugcagaugu

SEQ ID NO: 720612 - RNA, 19 nt, Homo sapiens
acuauacacugaaaugguu

SEQ ID NO: 720613 - RNA, 19 nt, Homo sapiens
ucccaaaguccucggauua

SEQ ID NO: 720614 - RNA, 19 nt, Homo sapiens
gucaugcuuuggcacuuua

SEQ ID NO: 720615 - RNA, 19 nt, Homo sapiens
gaagggcaagugaggaguu

SEQ ID NO: 720616 - RNA, 19 nt, Homo sapiens
gaaguuauuaucugcaucu

SEQ ID NO: 720617 - RNA, 19 nt, Homo sapiens
gccaaucaguccaccuuuc

SEQ ID NO: 720618 - RNA, 19 nt, Homo sapiens
cugcagaaauaucacaguu

SEQ ID NO: 720619 - RNA, 19 nt, Homo sapiens
gcagcacccugugugaugu

SEQ ID NO: 720620 - RNA, 19 nt, Homo sapiens
caugcucccugccgagaaa

SEQ ID NO: 720621 - RNA, 19 nt, Homo sapiens
aaacugagccccauucuga

SEQ ID NO: 720622 - RNA, 19 nt, Homo sapiens
ccaaaguccucggauuaca

SEQ ID NO: 720623 - RNA, 19 nt, Homo sapiens
uccuuacccugcagaaaua

SEQ ID NO: 720624 - RNA, 19 nt, Homo sapiens
gggagaggcugcugcucau

SEQ ID NO: 720625 - RNA, 19 nt, Homo sapiens
uaaaaccacccauaacuuu

SEQ ID NO: 720626 - RNA, 19 nt, Homo sapiens
gaacuauacacugaaaugg

SEQ ID NO: 720627 - RNA, 19 nt, Homo sapiens
gugccagacucagcuguuu

SEQ ID NO: 720628 - RNA, 19 nt, Homo sapiens
cagcagccagguccagaua

SEQ ID NO: 720629 - RNA, 19 nt, Homo sapiens
gggcguugguggcugcuau

SEQ ID NO: 720630 - RNA, 19 nt, Homo sapiens
agugaggaguucuuuaaug

SEQ ID NO: 720631 - RNA, 19 nt, Homo sapiens
aaguaguccuugaaacuga

SEQ ID NO: 720632 - RNA, 19 nt, Homo sapiens
ugaacuauacacugaaaug

SEQ ID NO: 720633 - RNA, 19 nt, Homo sapiens
caccucaguuucccucaga

SEQ ID NO: 720634 - RNA, 19 nt, Homo sapiens
uggcauguuuccuccuaaa

SEQ ID NO: 720635 - RNA, 19 nt, Homo sapiens
gcgcacgccuaccaacuac

SEQ ID NO: 720636 - RNA, 19 nt, Homo sapiens
aagcauaucagucuaccuu

SEQ ID NO: 720637 - RNA, 19 nt, Homo sapiens
agagggacagggacaagua

SEQ ID NO: 720638 - RNA, 19 nt, Homo sapiens
ugucaugcuuuggcacuuu

SEQ ID NO: 720639 - RNA, 19 nt, Homo sapiens
cgucaucuccggcaucuuc

SEQ ID NO: 720640 - RNA, 19 nt, Homo sapiens
acuccucucugccucaauu

SEQ ID NO: 720641 - RNA, 19 nt, Homo sapiens
acugaacuauacacugaaa

SEQ ID NO: 720642 - RNA, 19 nt, Homo sapiens
cccauaacuuuacucugaa

SEQ ID NO: 720643 - RNA, 19 nt, Homo sapiens
gaagagggacagggacaag

SEQ ID NO: 720644 - RNA, 19 nt, Homo sapiens
gaccucggccucccaaagu

SEQ ID NO: 720645 - RNA, 19 nt, Homo sapiens
agagugcaguggcgcgauu

SEQ ID NO: 720646 - RNA, 19 nt, Homo sapiens
ucacguacugucccuaguu

SEQ ID NO: 720647 - RNA, 19 nt, Homo sapiens
gcucagccaggacucaguu

SEQ ID NO: 720648 - RNA, 19 nt, Homo sapiens
acugaaagggcggaaguua

SEQ ID NO: 720649 - RNA, 19 nt, Homo sapiens
gcccugcugucaccaccuu

SEQ ID NO: 720650 - RNA, 19 nt, Homo sapiens
ugcagaaauaucacaguua

SEQ ID NO: 720651 - RNA, 19 nt, Homo sapiens
cccuggagcucuaugagau

SEQ ID NO: 720652 - RNA, 19 nt, Homo sapiens
ggcgcuggcuuuccacagu

SEQ ID NO: 720653 - RNA, 19 nt, Homo sapiens
ggcagcacccugugugaug

SEQ ID NO: 720654 - RNA, 19 nt, Homo sapiens
aaccaacaauacccucaga

SEQ ID NO: 720655 - RNA, 19 nt, Homo sapiens
guugguggcugcuauuucc

SEQ ID NO: 720656 - RNA, 19 nt, Homo sapiens
aagaggcgcuggcuuucca

SEQ ID NO: 720657 - RNA, 19 nt, Homo sapiens
cuugguuccuugccugaaa

SEQ ID NO: 720658 - RNA, 19 nt, Homo sapiens
cacguacugucccuaguuc

SEQ ID NO: 720659 - RNA, 19 nt, Homo sapiens
caaucaguccaccuuucua

SEQ ID NO: 720660 - RNA, 19 nt, Homo sapiens
ccaaucaguccaccuuucu

SEQ ID NO: 720661 - RNA, 19 nt, Homo sapiens
ucuccggcaucuucuucua

SEQ ID NO: 720662 - RNA, 19 nt, Homo sapiens
gagacaagugaccaagaug

SEQ ID NO: 720663 - RNA, 19 nt, Homo sapiens
ccauaacuuuacucugaag

SEQ ID NO: 720664 - RNA, 19 nt, Homo sapiens
cggaaguuauuaucugcau

SEQ ID NO: 720665 - RNA, 19 nt, Homo sapiens
uccagccgcuuccgagaga

SEQ ID NO: 720666 - RNA, 19 nt, Homo sapiens
gggcaagugaggaguucuu

SEQ ID NO: 720667 - RNA, 19 nt, Homo sapiens
ggagcuggaggaugaccuu

SEQ ID NO: 720668 - RNA, 19 nt, Homo sapiens
aaagggcggaaguuauuau

SEQ ID NO: 720669 - RNA, 19 nt, Homo sapiens
gcacuuuagcuaugguuuu

SEQ ID NO: 720670 - RNA, 19 nt, Homo sapiens
aggcuggucucaaacucuu

SEQ ID NO: 720671 - RNA, 19 nt, Homo sapiens
ccagcaugcccagcuaauu

SEQ ID NO: 720672 - RNA, 19 nt, Homo sapiens
ugaguggagccuuaaagug

SEQ ID NO: 720673 - RNA, 19 nt, Homo sapiens
aguggcauguuuccuccua

SEQ ID NO: 720674 - RNA, 19 nt, Homo sapiens
cugaaaugguuaagauggu

SEQ ID NO: 720675 - RNA, 19 nt, Homo sapiens
gaaagcagcugaagacauu

SEQ ID NO: 720676 - RNA, 19 nt, Homo sapiens
ggacagaguucuuauaaau

SEQ ID NO: 720677 - RNA, 19 nt, Homo sapiens
gcaagugguuugucaguaa

SEQ ID NO: 720678 - RNA, 19 nt, Homo sapiens
gcccagaaccugauaauua

SEQ ID NO: 720679 - RNA, 19 nt, Homo sapiens
caacugaacuuugugguuu

SEQ ID NO: 720680 - RNA, 19 nt, Homo sapiens
aaaguaaucuugcuccuaa

SEQ ID NO: 720681 - RNA, 19 nt, Homo sapiens
caagguacuucguuaguuu

SEQ ID NO: 720682 - RNA, 19 nt, Homo sapiens
aaaccaagguacuucguua

SEQ ID NO: 720683 - RNA, 19 nt, Homo sapiens
gaaugucgguguucaugaa

SEQ ID NO: 720684 - RNA, 19 nt, Homo sapiens
gaacaagaaggcagaagaa

SEQ ID NO: 720685 - RNA, 19 nt, Homo sapiens
gaaaugugaauuccucuuu

SEQ ID NO: 720686 - RNA, 19 nt, Homo sapiens
caaauuuccucuuggcauu

SEQ ID NO: 720687 - RNA, 19 nt, Homo sapiens
ugacugaacugcuucugaa

SEQ ID NO: 720688 - RNA, 19 nt, Homo sapiens
ugaagucacugauuaguuc

SEQ ID NO: 720689 - RNA, 19 nt, Homo sapiens
caagaaggcagaagaaaug

SEQ ID NO: 720690 - RNA, 19 nt, Homo sapiens
caacacaacccaaguuuca

SEQ ID NO: 720691 - RNA, 19 nt, Homo sapiens
gguguuaccauccuaauuu

SEQ ID NO: 720692 - RNA, 19 nt, Homo sapiens
gaaggcagaagaaauguga

SEQ ID NO: 720693 - RNA, 19 nt, Homo sapiens
ugagacaaauuuccucuug

SEQ ID NO: 720694 - RNA, 19 nt, Homo sapiens
cgagucagguguacaaugu

SEQ ID NO: 720695 - RNA, 19 nt, Homo sapiens
uaccagacuuuacuuugua

SEQ ID NO: 720696 - RNA, 19 nt, Homo sapiens
cccagaaccugauaauuau

SEQ ID NO: 720697 - RNA, 19 nt, Homo sapiens
ggccuuggacugauaguua

SEQ ID NO: 720698 - RNA, 19 nt, Homo sapiens
gaaauccacgccagaaugu

SEQ ID NO: 720699 - RNA, 19 nt, Homo sapiens
cacgugacaugcaaaguaa

SEQ ID NO: 720700 - RNA, 19 nt, Homo sapiens
gcagaagaaaugugaauuc

SEQ ID NO: 720701 - RNA, 19 nt, Homo sapiens
ccggacaaguuucagauaa

SEQ ID NO: 720702 - RNA, 19 nt, Homo sapiens
ucagacauguucaucaaug

SEQ ID NO: 720703 - RNA, 19 nt, Homo sapiens
gagcugggauauucuucuu

SEQ ID NO: 720704 - RNA, 19 nt, Homo sapiens
gaauucaguuggagucaag

SEQ ID NO: 720705 - RNA, 19 nt, Homo sapiens
ggacagguacccaccauuc

SEQ ID NO: 720706 - RNA, 19 nt, Homo sapiens
gcauuuacacuguggcuuu

SEQ ID NO: 720707 - RNA, 19 nt, Homo sapiens
uucaugaagucacugauua

SEQ ID NO: 720708 - RNA, 19 nt, Homo sapiens
gagcgucccauacauuaaa

SEQ ID NO: 720709 - RNA, 19 nt, Homo sapiens
caagugguuugucaguaaa

SEQ ID NO: 720710 - RNA, 19 nt, Homo sapiens
ucacgugacaugcaaagua

SEQ ID NO: 720711 - RNA, 19 nt, Homo sapiens
gcucagaaaccacugcauu

SEQ ID NO: 720712 - RNA, 19 nt, Homo sapiens
gggauugaguccauguuau

SEQ ID NO: 720713 - RNA, 19 nt, Homo sapiens
caagagcgucccauacauu

SEQ ID NO: 720714 - RNA, 19 nt, Homo sapiens
ccaagguacuucguuaguu

SEQ ID NO: 720715 - RNA, 19 nt, Homo sapiens
gaaaacagacucagacaug

SEQ ID NO: 720716 - RNA, 19 nt, Homo sapiens
caagaaagacgggaacuuc

SEQ ID NO: 720717 - RNA, 19 nt, Homo sapiens
gcuccuaauuauagaaaug

SEQ ID NO: 720718 - RNA, 19 nt, Homo sapiens
ggauguagcugggauugag

SEQ ID NO: 720719 - RNA, 19 nt, Homo sapiens
gaagaugagauugauguau

SEQ ID NO: 720720 - RNA, 19 nt, Homo sapiens
cauuuacacuguggcuuua

SEQ ID NO: 720721 - RNA, 19 nt, Homo sapiens
ggaauucaguuggagucaa

SEQ ID NO: 720722 - RNA, 19 nt, Homo sapiens
ggcaggcucuagagaauuc

SEQ ID NO: 720723 - RNA, 19 nt, Homo sapiens
cgcacacucuucauacuaa

SEQ ID NO: 720724 - RNA, 19 nt, Homo sapiens
aaacaaaccaagcccagaa

SEQ ID NO: 720725 - RNA, 19 nt, Homo sapiens
gaggaacaacugaacuuug

SEQ ID NO: 720726 - RNA, 19 nt, Homo sapiens
uuaccagacuuuacuuugu

SEQ ID NO: 720727 - RNA, 19 nt, Homo sapiens
ccaagcucaucuucauuga

SEQ ID NO: 720728 - RNA, 19 nt, Homo sapiens
cagucuaaauccuuucaaa

SEQ ID NO: 720729 - RNA, 19 nt, Homo sapiens
gcagguuucuggguucuca

SEQ ID NO: 720730 - RNA, 19 nt, Homo sapiens
ggaaagcagcugaagacau

SEQ ID NO: 720731 - RNA, 19 nt, Homo sapiens
ggcuuuagcuuucaaacca

SEQ ID NO: 720732 - RNA, 19 nt, Homo sapiens
caaaguaaucuugcuccua

SEQ ID NO: 720733 - RNA, 19 nt, Homo sapiens
aagagcgucccauacauua

SEQ ID NO: 720734 - RNA, 19 nt, Homo sapiens
ccaagagcgucccauacau

SEQ ID NO: 720735 - RNA, 19 nt, Homo sapiens
acucagacauguucaucaa

SEQ ID NO: 720736 - RNA, 19 nt, Homo sapiens
ugacaguucuuugagacaa

SEQ ID NO: 720737 - RNA, 19 nt, Homo sapiens
gccaagcucaucuucauug

SEQ ID NO: 720738 - RNA, 19 nt, Homo sapiens
ucacgugauuccugucaga

SEQ ID NO: 720739 - RNA, 19 nt, Homo sapiens
auaauaggcccgucucuug

SEQ ID NO: 720740 - RNA, 19 nt, Homo sapiens
ggacugauaguuacaccau

SEQ ID NO: 720741 - RNA, 19 nt, Homo sapiens
gcugcucucucauuucauc

SEQ ID NO: 720742 - RNA, 19 nt, Homo sapiens
ggauugaguccauguuauc

SEQ ID NO: 720743 - RNA, 19 nt, Homo sapiens
gcacgcacacucuucauac

SEQ ID NO: 720744 - RNA, 19 nt, Homo sapiens
gcugggauauucuucuucu

SEQ ID NO: 720745 - RNA, 19 nt, Homo sapiens
cagcuugcauggccuguca

SEQ ID NO: 720746 - RNA, 19 nt, Homo sapiens
uaaagugggcccuggugaa

SEQ ID NO: 720747 - RNA, 19 nt, Homo sapiens
gacagaguucuuauaaaug

SEQ ID NO: 720748 - RNA, 19 nt, Homo sapiens
cauacuaaguguuugacau

SEQ ID NO: 720749 - RNA, 19 nt, Homo sapiens
ugaaauccacgccagaaug

SEQ ID NO: 720750 - RNA, 19 nt, Homo sapiens
ucaaugaguuucccaucag

SEQ ID NO: 720751 - RNA, 19 nt, Homo sapiens
acugauaguuacaccauug

SEQ ID NO: 720752 - RNA, 19 nt, Homo sapiens
uguacagucuaaauccuuu

SEQ ID NO: 720753 - RNA, 19 nt, Homo sapiens
uuagggcucucaguucaaa

SEQ ID NO: 720754 - RNA, 19 nt, Homo sapiens
uaaauuaggcucagaaacc

SEQ ID NO: 720755 - RNA, 19 nt, Homo sapiens
agacuuuacuuuguacuca

SEQ ID NO: 720756 - RNA, 19 nt, Homo sapiens
gacaugcaaaguaaucuug

SEQ ID NO: 720757 - RNA, 19 nt, Homo sapiens
ggagcuuucugggaauuca

SEQ ID NO: 720758 - RNA, 19 nt, Homo sapiens
cugcugcucucucauuuca

SEQ ID NO: 720759 - RNA, 19 nt, Homo sapiens
uggacagaguucuuauaaa

SEQ ID NO: 720760 - RNA, 19 nt, Homo sapiens
agccugggaugaccaaauu

SEQ ID NO: 720761 - RNA, 19 nt, Homo sapiens
ugauaauuauggagcauuc

SEQ ID NO: 720762 - RNA, 19 nt, Homo sapiens
acaagaaggcagaagaaau

SEQ ID NO: 720763 - RNA, 19 nt, Homo sapiens
cuggacagaguucuuauaa

SEQ ID NO: 720764 - RNA, 19 nt, Homo sapiens
guucaugaagucacugauu

SEQ ID NO: 720765 - RNA, 19 nt, Homo sapiens
aaaugugaauuccucuuuc

SEQ ID NO: 720766 - RNA, 19 nt, Homo sapiens
agacgucuauuacaaucug

SEQ ID NO: 720767 - RNA, 19 nt, Homo sapiens
gccaucugcugcucucuca

SEQ ID NO: 720768 - RNA, 19 nt, Homo sapiens
guuaucggcucgguacuca

SEQ ID NO: 720769 - RNA, 19 nt, Homo sapiens
cgagagguacagaaacuug

SEQ ID NO: 720770 - RNA, 19 nt, Homo sapiens
gcacacucuucauacuaag

SEQ ID NO: 720771 - RNA, 19 nt, Homo sapiens
aauuuccucuuggcauuua

SEQ ID NO: 720772 - RNA, 19 nt, Homo sapiens
ggagcauucuacacugaca

SEQ ID NO: 720773 - RNA, 19 nt, Homo sapiens
caucugcugcucucucauu

SEQ ID NO: 720774 - RNA, 19 nt, Homo sapiens
guauaaauuaggcucagaa

SEQ ID NO: 720775 - RNA, 19 nt, Homo sapiens
gaaagcagcugaagacauu

SEQ ID NO: 720776 - RNA, 19 nt, Homo sapiens
ggacagaguucuuauaaau

SEQ ID NO: 720777 - RNA, 19 nt, Homo sapiens
gcaagugguuugucaguaa

SEQ ID NO: 720778 - RNA, 19 nt, Homo sapiens
gcccagaaccugauaauua

SEQ ID NO: 720779 - RNA, 19 nt, Homo sapiens
caacugaacuuugugguuu

SEQ ID NO: 720780 - RNA, 19 nt, Homo sapiens
aaaguaaucuugcuccuaa

SEQ ID NO: 720781 - RNA, 19 nt, Homo sapiens
caagguacuucguuaguuu

SEQ ID NO: 720782 - RNA, 19 nt, Homo sapiens
aaaccaagguacuucguua

SEQ ID NO: 720783 - RNA, 19 nt, Homo sapiens
gaaugucgguguucaugaa

SEQ ID NO: 720784 - RNA, 19 nt, Homo sapiens
gaacaagaaggcagaagaa

SEQ ID NO: 720785 - RNA, 19 nt, Homo sapiens
gaaaugugaauuccucuuu

SEQ ID NO: 720786 - RNA, 19 nt, Homo sapiens
caaauuuccucuuggcauu

SEQ ID NO: 720787 - RNA, 19 nt, Homo sapiens
ugacugaacugcuucugaa

SEQ ID NO: 720788 - RNA, 19 nt, Homo sapiens
ugaagucacugauuaguuc

SEQ ID NO: 720789 - RNA, 19 nt, Homo sapiens
caagaaggcagaagaaaug

SEQ ID NO: 720790 - RNA, 19 nt, Homo sapiens
caacacaacccaaguuuca

SEQ ID NO: 720791 - RNA, 19 nt, Homo sapiens
gguguuaccauccuaauuu

SEQ ID NO: 720792 - RNA, 19 nt, Homo sapiens
gaaggcagaagaaauguga

SEQ ID NO: 720793 - RNA, 19 nt, Homo sapiens
ugagacaaauuuccucuug

SEQ ID NO: 720794 - RNA, 19 nt, Homo sapiens
cgagucagguguacaaugu

SEQ ID NO: 720795 - RNA, 19 nt, Homo sapiens
uaccagacuuuacuuugua

SEQ ID NO: 720796 - RNA, 19 nt, Homo sapiens
cccagaaccugauaauuau

SEQ ID NO: 720797 - RNA, 19 nt, Homo sapiens
gaaauccacgccagaaugu

SEQ ID NO: 720798 - RNA, 19 nt, Homo sapiens
cacgugacaugcaaaguaa

SEQ ID NO: 720799 - RNA, 19 nt, Homo sapiens
gcagaagaaaugugaauuc

SEQ ID NO: 720800 - RNA, 19 nt, Homo sapiens
ccggacaaguuucagauaa

SEQ ID NO: 720801 - RNA, 19 nt, Homo sapiens
ucagacauguucaucaaug

SEQ ID NO: 720802 - RNA, 19 nt, Homo sapiens
gagcugggauauucuucuu

SEQ ID NO: 720803 - RNA, 19 nt, Homo sapiens
gaauucaguuggagucaag

SEQ ID NO: 720804 - RNA, 19 nt, Homo sapiens
ggacagguacccaccauuc

SEQ ID NO: 720805 - RNA, 19 nt, Homo sapiens
gcauuuacacuguggcuuu

SEQ ID NO: 720806 - RNA, 19 nt, Homo sapiens
uucaugaagucacugauua

SEQ ID NO: 720807 - RNA, 19 nt, Homo sapiens
gagcgucccauacauuaaa

SEQ ID NO: 720808 - RNA, 19 nt, Homo sapiens
caagugguuugucaguaaa

SEQ ID NO: 720809 - RNA, 19 nt, Homo sapiens
ucacgugacaugcaaagua

SEQ ID NO: 720810 - RNA, 19 nt, Homo sapiens
gcucagaaaccacugcauu

SEQ ID NO: 720811 - RNA, 19 nt, Homo sapiens
gggauugaguccauguuau

SEQ ID NO: 720812 - RNA, 19 nt, Homo sapiens
caagagcgucccauacauu

SEQ ID NO: 720813 - RNA, 19 nt, Homo sapiens
ccaagguacuucguuaguu

SEQ ID NO: 720814 - RNA, 19 nt, Homo sapiens
gaaaacagacucagacaug

SEQ ID NO: 720815 - RNA, 19 nt, Homo sapiens
caagaaagacgggaacuuc

SEQ ID NO: 720816 - RNA, 19 nt, Homo sapiens
gcuccuaauuauagaaaug

SEQ ID NO: 720817 - RNA, 19 nt, Homo sapiens
ggauguagcugggauugag

SEQ ID NO: 720818 - RNA, 19 nt, Homo sapiens
gaagaugagauugauguau

SEQ ID NO: 720819 - RNA, 19 nt, Homo sapiens
cauuuacacuguggcuuua

SEQ ID NO: 720820 - RNA, 19 nt, Homo sapiens
ggaauucaguuggagucaa

SEQ ID NO: 720821 - RNA, 19 nt, Homo sapiens
ggcaggcucuagagaauuc

SEQ ID NO: 720822 - RNA, 19 nt, Homo sapiens
cgcacacucuucauacuaa

SEQ ID NO: 720823 - RNA, 19 nt, Homo sapiens
aaacaaaccaagcccagaa

SEQ ID NO: 720824 - RNA, 19 nt, Homo sapiens
gaggaacaacugaacuuug

SEQ ID NO: 720825 - RNA, 19 nt, Homo sapiens
uuaccagacuuuacuuugu

SEQ ID NO: 720826 - RNA, 19 nt, Homo sapiens
ccaagcucaucuucauuga

SEQ ID NO: 720827 - RNA, 19 nt, Homo sapiens
cagucuaaauccuuucaaa

SEQ ID NO: 720828 - RNA, 19 nt, Homo sapiens
ggaaagcagcugaagacau

SEQ ID NO: 720829 - RNA, 19 nt, Homo sapiens
ggcuuuagcuuucaaacca

SEQ ID NO: 720830 - RNA, 19 nt, Homo sapiens
caaaguaaucuugcuccua

SEQ ID NO: 720831 - RNA, 19 nt, Homo sapiens
aagagcgucccauacauua

SEQ ID NO: 720832 - RNA, 19 nt, Homo sapiens
ccaagagcgucccauacau

SEQ ID NO: 720833 - RNA, 19 nt, Homo sapiens
acucagacauguucaucaa

SEQ ID NO: 720834 - RNA, 19 nt, Homo sapiens
ugacaguucuuugagacaa

SEQ ID NO: 720835 - RNA, 19 nt, Homo sapiens
gccaagcucaucuucauug

SEQ ID NO: 720836 - RNA, 19 nt, Homo sapiens
auaauaggcccgucucuug

SEQ ID NO: 720837 - RNA, 19 nt, Homo sapiens
gcugcucucucauuucauc

SEQ ID NO: 720838 - RNA, 19 nt, Homo sapiens
ggauugaguccauguuauc

SEQ ID NO: 720839 - RNA, 19 nt, Homo sapiens
gcacgcacacucuucauac

SEQ ID NO: 720840 - RNA, 19 nt, Homo sapiens
gcugggauauucuucuucu

SEQ ID NO: 720841 - RNA, 19 nt, Homo sapiens
uaaagugggcccuggugaa

SEQ ID NO: 720842 - RNA, 19 nt, Homo sapiens
gacagaguucuuauaaaug

SEQ ID NO: 720843 - RNA, 19 nt, Homo sapiens
cauacuaaguguuugacau

SEQ ID NO: 720844 - RNA, 19 nt, Homo sapiens
ugaaauccacgccagaaug

SEQ ID NO: 720845 - RNA, 19 nt, Homo sapiens
ucaaugaguuucccaucag

SEQ ID NO: 720846 - RNA, 19 nt, Homo sapiens
uguacagucuaaauccuuu

SEQ ID NO: 720847 - RNA, 19 nt, Homo sapiens
uuagggcucucaguucaaa

SEQ ID NO: 720848 - RNA, 19 nt, Homo sapiens
uaaauuaggcucagaaacc

SEQ ID NO: 720849 - RNA, 19 nt, Homo sapiens
agacuuuacuuuguacuca

SEQ ID NO: 720850 - RNA, 19 nt, Homo sapiens
gacaugcaaaguaaucuug

SEQ ID NO: 720851 - RNA, 19 nt, Homo sapiens
ggagcuuucugggaauuca

SEQ ID NO: 720852 - RNA, 19 nt, Homo sapiens
cugcugcucucucauuuca

SEQ ID NO: 720853 - RNA, 19 nt, Homo sapiens
uggacagaguucuuauaaa

SEQ ID NO: 720854 - RNA, 19 nt, Homo sapiens
agccugggaugaccaaauu

SEQ ID NO: 720855 - RNA, 19 nt, Homo sapiens
ugauaauuauggagcauuc

SEQ ID NO: 720856 - RNA, 19 nt, Homo sapiens
acaagaaggcagaagaaau

SEQ ID NO: 720857 - RNA, 19 nt, Homo sapiens
cuggacagaguucuuauaa

SEQ ID NO: 720858 - RNA, 19 nt, Homo sapiens
guucaugaagucacugauu

SEQ ID NO: 720859 - RNA, 19 nt, Homo sapiens
aaaugugaauuccucuuuc

SEQ ID NO: 720860 - RNA, 19 nt, Homo sapiens
agacgucuauuacaaucug

SEQ ID NO: 720861 - RNA, 19 nt, Homo sapiens
gccaucugcugcucucuca

SEQ ID NO: 720862 - RNA, 19 nt, Homo sapiens
guuaucggcucgguacuca

SEQ ID NO: 720863 - RNA, 19 nt, Homo sapiens
ggagcauucuacacugaca

SEQ ID NO: 720864 - RNA, 19 nt, Homo sapiens
cgagagguacagaaacuug

SEQ ID NO: 720865 - RNA, 19 nt, Homo sapiens
gcacacucuucauacuaag

SEQ ID NO: 720866 - RNA, 19 nt, Homo sapiens
aauuuccucuuggcauuua

SEQ ID NO: 720867 - RNA, 19 nt, Homo sapiens
caucugcugcucucucauu

SEQ ID NO: 720868 - RNA, 19 nt, Homo sapiens
guauaaauuaggcucagaa

SEQ ID NO: 720869 - RNA, 19 nt, Homo sapiens
ggacaaguuucagauaacc

SEQ ID NO: 720870 - RNA, 19 nt, Homo sapiens
gaagauuguccgccugucu

SEQ ID NO: 720871 - RNA, 19 nt, Homo sapiens
cuuugugguuugcuguuua

SEQ ID NO: 720872 - RNA, 19 nt, Homo sapiens
cgaggaacaacugaacuuu

SEQ ID NO: 720873 - RNA, 19 nt, Homo sapiens
gcagugauuccugucagaa

SEQ ID NO: 720874 - RNA, 19 nt, Homo sapiens
gcucgguacucaacacaac

SEQ ID NO: 720875 - RNA, 19 nt, Homo sapiens
gaaagcagcugaagacauu

SEQ ID NO: 720876 - RNA, 19 nt, Homo sapiens
ggacagaguucuuauaaau

SEQ ID NO: 720877 - RNA, 19 nt, Homo sapiens
gcaagugguuugucaguaa

SEQ ID NO: 720878 - RNA, 19 nt, Homo sapiens
gcccagaaccugauaauua

SEQ ID NO: 720879 - RNA, 19 nt, Homo sapiens
caacugaacuuugugguuu

SEQ ID NO: 720880 - RNA, 19 nt, Homo sapiens
aaaguaaucuugcuccuaa

SEQ ID NO: 720881 - RNA, 19 nt, Homo sapiens
caagguacuucguuaguuu

SEQ ID NO: 720882 - RNA, 19 nt, Homo sapiens
aaaccaagguacuucguua

SEQ ID NO: 720883 - RNA, 19 nt, Homo sapiens
gaaugucgguguucaugaa

SEQ ID NO: 720884 - RNA, 19 nt, Homo sapiens
gaacaagaaggcagaagaa

SEQ ID NO: 720885 - RNA, 19 nt, Homo sapiens
gaaaugugaauuccucuuu

SEQ ID NO: 720886 - RNA, 19 nt, Homo sapiens
caaauuuccucuuggcauu

SEQ ID NO: 720887 - RNA, 19 nt, Homo sapiens
ugacugaacugcuucugaa

SEQ ID NO: 720888 - RNA, 19 nt, Homo sapiens
ugaagucacugauuaguuc

SEQ ID NO: 720889 - RNA, 19 nt, Homo sapiens
caagaaggcagaagaaaug

SEQ ID NO: 720890 - RNA, 19 nt, Homo sapiens
caacacaacccaaguuuca

SEQ ID NO: 720891 - RNA, 19 nt, Homo sapiens
gguguuaccauccuaauuu

SEQ ID NO: 720892 - RNA, 19 nt, Homo sapiens
cgagaacccugacuaauac

SEQ ID NO: 720893 - RNA, 19 nt, Homo sapiens
gaaggcagaagaaauguga

SEQ ID NO: 720894 - RNA, 19 nt, Homo sapiens
ugagacaaauuuccucuug

SEQ ID NO: 720895 - RNA, 19 nt, Homo sapiens
aaacugccauuccguuauu

SEQ ID NO: 720896 - RNA, 19 nt, Homo sapiens
cgagucagguguacaaugu

SEQ ID NO: 720897 - RNA, 19 nt, Homo sapiens
uaccagacuuuacuuugua

SEQ ID NO: 720898 - RNA, 19 nt, Homo sapiens
cccagaaccugauaauuau

SEQ ID NO: 720899 - RNA, 19 nt, Homo sapiens
ggccuuggacugauaguua

SEQ ID NO: 720900 - RNA, 19 nt, Homo sapiens
gaaauccacgccagaaugu

SEQ ID NO: 720901 - RNA, 19 nt, Homo sapiens
cacgugacaugcaaaguaa

SEQ ID NO: 720902 - RNA, 19 nt, Homo sapiens
gcagaagaaaugugaauuc

SEQ ID NO: 720903 - RNA, 19 nt, Homo sapiens
ccggacaaguuucagauaa

SEQ ID NO: 720904 - RNA, 19 nt, Homo sapiens
ucagacauguucaucaaug

SEQ ID NO: 720905 - RNA, 19 nt, Homo sapiens
gagcugggauauucuucuu

SEQ ID NO: 720906 - RNA, 19 nt, Homo sapiens
gaauucaguuggagucaag

SEQ ID NO: 720907 - RNA, 19 nt, Homo sapiens
ggacagguacccaccauuc

SEQ ID NO: 720908 - RNA, 19 nt, Homo sapiens
gcauuuacacuguggcuuu

SEQ ID NO: 720909 - RNA, 19 nt, Homo sapiens
uucaugaagucacugauua

SEQ ID NO: 720910 - RNA, 19 nt, Homo sapiens
gagcgucccauacauuaaa

SEQ ID NO: 720911 - RNA, 19 nt, Homo sapiens
caagugguuugucaguaaa

SEQ ID NO: 720912 - RNA, 19 nt, Homo sapiens
acgagaacccugacuaaua

SEQ ID NO: 720913 - RNA, 19 nt, Homo sapiens
ucacgugacaugcaaagua

SEQ ID NO: 720914 - RNA, 19 nt, Homo sapiens
gcucagaaaccacugcauu

SEQ ID NO: 720915 - RNA, 19 nt, Homo sapiens
gggauugaguccauguuau

SEQ ID NO: 720916 - RNA, 19 nt, Homo sapiens
caagagcgucccauacauu

SEQ ID NO: 720917 - RNA, 19 nt, Homo sapiens
gaaacugccauuccguuau

SEQ ID NO: 720918 - RNA, 19 nt, Homo sapiens
ccaagguacuucguuaguu

SEQ ID NO: 720919 - RNA, 19 nt, Homo sapiens
gaaaacagacucagacaug

SEQ ID NO: 720920 - RNA, 19 nt, Homo sapiens
caagaaagacgggaacuuc

SEQ ID NO: 720921 - RNA, 19 nt, Homo sapiens
gcuccuaauuauagaaaug

SEQ ID NO: 720922 - RNA, 19 nt, Homo sapiens
ggauguagcugggauugag

SEQ ID NO: 720923 - RNA, 19 nt, Homo sapiens
gaagaugagauugauguau

SEQ ID NO: 720924 - RNA, 19 nt, Homo sapiens
cauuuacacuguggcuuua

SEQ ID NO: 720925 - RNA, 19 nt, Homo sapiens
ggaauucaguuggagucaa

SEQ ID NO: 720926 - RNA, 19 nt, Homo sapiens
ggcaggcucuagagaauuc

SEQ ID NO: 720927 - RNA, 19 nt, Homo sapiens
cgcacacucuucauacuaa

SEQ ID NO: 720928 - RNA, 19 nt, Homo sapiens
aaacaaaccaagcccagaa

SEQ ID NO: 720929 - RNA, 19 nt, Homo sapiens
gaggaacaacugaacuuug

SEQ ID NO: 720930 - RNA, 19 nt, Homo sapiens
uuaccagacuuuacuuugu

SEQ ID NO: 720931 - RNA, 19 nt, Homo sapiens
ccaagcucaucuucauuga

SEQ ID NO: 720932 - RNA, 19 nt, Homo sapiens
cagucuaaauccuuucaaa

SEQ ID NO: 720933 - RNA, 19 nt, Homo sapiens
ucacgagaacccugacuaa

SEQ ID NO: 720934 - RNA, 19 nt, Homo sapiens
gcagguuucuggguucuca

SEQ ID NO: 720935 - RNA, 19 nt, Homo sapiens
ggaaagcagcugaagacau

SEQ ID NO: 720936 - RNA, 19 nt, Homo sapiens
ggcuuuagcuuucaaacca

SEQ ID NO: 720937 - RNA, 19 nt, Homo sapiens
caaaguaaucuugcuccua

SEQ ID NO: 720938 - RNA, 19 nt, Homo sapiens
aagagcgucccauacauua

SEQ ID NO: 720939 - RNA, 19 nt, Homo sapiens
ccaagagcgucccauacau

SEQ ID NO: 720940 - RNA, 19 nt, Homo sapiens
acucagacauguucaucaa

SEQ ID NO: 720941 - RNA, 19 nt, Homo sapiens
ugacaguucuuugagacaa

SEQ ID NO: 720942 - RNA, 19 nt, Homo sapiens
cuagauguguuuggaguga

SEQ ID NO: 720943 - RNA, 19 nt, Homo sapiens
gccaagcucaucuucauug

SEQ ID NO: 720944 - RNA, 19 nt, Homo sapiens
cauacagccugguggucua

SEQ ID NO: 720945 - RNA, 19 nt, Homo sapiens
agaaacugccauuccguua

SEQ ID NO: 720946 - RNA, 19 nt, Homo sapiens
auaauaggcccgucucuug

SEQ ID NO: 720947 - RNA, 19 nt, Homo sapiens
ggacugauaguuacaccau

SEQ ID NO: 720948 - RNA, 19 nt, Homo sapiens
gcugcucucucauuucauc

SEQ ID NO: 720949 - RNA, 19 nt, Homo sapiens
ggauugaguccauguuauc

SEQ ID NO: 720950 - RNA, 19 nt, Homo sapiens
gcacgcacacucuucauac

SEQ ID NO: 720951 - RNA, 19 nt, Homo sapiens
gcugggauauucuucuucu

SEQ ID NO: 720952 - RNA, 19 nt, Homo sapiens
cagcuugcauggccuguca

SEQ ID NO: 720953 - RNA, 19 nt, Homo sapiens
uaaagugggcccuggugaa

SEQ ID NO: 720954 - RNA, 19 nt, Homo sapiens
gacagaguucuuauaaaug

SEQ ID NO: 720955 - RNA, 19 nt, Homo sapiens
cauacuaaguguuugacau

SEQ ID NO: 720956 - RNA, 19 nt, Homo sapiens
acugauaguuacaccauug

SEQ ID NO: 720957 - RNA, 19 nt, Homo sapiens
ugaaauccacgccagaaug

SEQ ID NO: 720958 - RNA, 19 nt, Homo sapiens
ucaaugaguuucccaucag

SEQ ID NO: 720959 - RNA, 19 nt, Homo sapiens
uguacagucuaaauccuuu

SEQ ID NO: 720960 - RNA, 19 nt, Homo sapiens
uuagggcucucaguucaaa

SEQ ID NO: 720961 - RNA, 19 nt, Homo sapiens
uaaauuaggcucagaaacc

SEQ ID NO: 720962 - RNA, 19 nt, Homo sapiens
agacuuuacuuuguacuca

SEQ ID NO: 720963 - RNA, 19 nt, Homo sapiens
gacaugcaaaguaaucuug

SEQ ID NO: 720964 - RNA, 19 nt, Homo sapiens
ggagcuuucugggaauuca

SEQ ID NO: 720965 - RNA, 19 nt, Homo sapiens
cugcugcucucucauuuca

SEQ ID NO: 720966 - RNA, 19 nt, Homo sapiens
uggacagaguucuuauaaa

SEQ ID NO: 720967 - RNA, 19 nt, Homo sapiens
agccugggaugaccaaauu

SEQ ID NO: 720968 - RNA, 19 nt, Homo sapiens
ugauaauuauggagcauuc

SEQ ID NO: 720969 - RNA, 19 nt, Homo sapiens
acaagaaggcagaagaaau

SEQ ID NO: 720970 - RNA, 19 nt, Homo sapiens
cuggacagaguucuuauaa

SEQ ID NO: 720971 - RNA, 19 nt, Homo sapiens
guucaugaagucacugauu

SEQ ID NO: 720972 - RNA, 19 nt, Homo sapiens
agacgucuauuacaaucug

SEQ ID NO: 720973 - RNA, 19 nt, Homo sapiens
aaaugugaauuccucuuuc

SEQ ID NO: 720974 - RNA, 19 nt, Homo sapiens
gccaucugcugcucucuca

SEQ ID NO: 720975 - RNA, 19 nt, Homo sapiens
gaaagcagcugaagacauu

SEQ ID NO: 720976 - RNA, 19 nt, Homo sapiens
ggacagaguucuuauaaau

SEQ ID NO: 720977 - RNA, 19 nt, Homo sapiens
gcaagugguuugucaguaa

SEQ ID NO: 720978 - RNA, 19 nt, Homo sapiens
caacugaacuuugugguuu

SEQ ID NO: 720979 - RNA, 19 nt, Homo sapiens
aaaguaaucuugcuccuaa

SEQ ID NO: 720980 - RNA, 19 nt, Homo sapiens
caagguacuucguuaguuu

SEQ ID NO: 720981 - RNA, 19 nt, Homo sapiens
aaaccaagguacuucguua

SEQ ID NO: 720982 - RNA, 19 nt, Homo sapiens
gaaugucgguguucaugaa

SEQ ID NO: 720983 - RNA, 19 nt, Homo sapiens
gaacaagaaggcagaagaa

SEQ ID NO: 720984 - RNA, 19 nt, Homo sapiens
gaaaugugaauuccucuuu

SEQ ID NO: 720985 - RNA, 19 nt, Homo sapiens
ugacugaacugcuucugaa

SEQ ID NO: 720986 - RNA, 19 nt, Homo sapiens
ugaagucacugauuaguuc

SEQ ID NO: 720987 - RNA, 19 nt, Homo sapiens
caacacaacccaaguuuca

SEQ ID NO: 720988 - RNA, 19 nt, Homo sapiens
caagaaggcagaagaaaug

SEQ ID NO: 720989 - RNA, 19 nt, Homo sapiens
gguguuaccauccuaauuu

SEQ ID NO: 720990 - RNA, 19 nt, Homo sapiens
gaaggcagaagaaauguga

SEQ ID NO: 720991 - RNA, 19 nt, Homo sapiens
cgagaacccugacuaauac

SEQ ID NO: 720992 - RNA, 19 nt, Homo sapiens
aaacugccauuccguuauu

SEQ ID NO: 720993 - RNA, 19 nt, Homo sapiens
cgagucagguguacaaugu

SEQ ID NO: 720994 - RNA, 19 nt, Homo sapiens
uaccagacuuuacuuugua

SEQ ID NO: 720995 - RNA, 19 nt, Homo sapiens
ggccuuggacugauaguua

SEQ ID NO: 720996 - RNA, 19 nt, Homo sapiens
gaaauccacgccagaaugu

SEQ ID NO: 720997 - RNA, 19 nt, Homo sapiens
cacgugacaugcaaaguaa

SEQ ID NO: 720998 - RNA, 19 nt, Homo sapiens
gcagaagaaaugugaauuc

SEQ ID NO: 720999 - RNA, 19 nt, Homo sapiens
ccggacaaguuucagauaa

SEQ ID NO: 721000 - RNA, 19 nt, Homo sapiens
ucagacauguucaucaaug

SEQ ID NO: 721001 - RNA, 19 nt, Homo sapiens
gagcugggauauucuucuu

SEQ ID NO: 721002 - RNA, 19 nt, Homo sapiens
gaauucaguuggagucaag

SEQ ID NO: 721003 - RNA, 19 nt, Homo sapiens
ggacagguacccaccauuc

SEQ ID NO: 721004 - RNA, 19 nt, Homo sapiens
uucaugaagucacugauua

SEQ ID NO: 721005 - RNA, 19 nt, Homo sapiens
gagcgucccauacauuaaa

SEQ ID NO: 721006 - RNA, 19 nt, Homo sapiens
caagugguuugucaguaaa

SEQ ID NO: 721007 - RNA, 19 nt, Homo sapiens
acgagaacccugacuaaua

SEQ ID NO: 721008 - RNA, 19 nt, Homo sapiens
ucacgugacaugcaaagua

SEQ ID NO: 721009 - RNA, 19 nt, Homo sapiens
gcucagaaaccacugcauu

SEQ ID NO: 721010 - RNA, 19 nt, Homo sapiens
gggauugaguccauguuau

SEQ ID NO: 721011 - RNA, 19 nt, Homo sapiens
caagagcgucccauacauu

SEQ ID NO: 721012 - RNA, 19 nt, Homo sapiens
gaaacugccauuccguuau

SEQ ID NO: 721013 - RNA, 19 nt, Homo sapiens
ccaagguacuucguuaguu

SEQ ID NO: 721014 - RNA, 19 nt, Homo sapiens
gaaaacagacucagacaug

SEQ ID NO: 721015 - RNA, 19 nt, Homo sapiens
caagaaagacgggaacuuc

SEQ ID NO: 721016 - RNA, 19 nt, Homo sapiens
gagauggcuuucccgaaga

SEQ ID NO: 721017 - RNA, 19 nt, Homo sapiens
gcuccuaauuauagaaaug

SEQ ID NO: 721018 - RNA, 19 nt, Homo sapiens
ggauguagcugggauugag

SEQ ID NO: 721019 - RNA, 19 nt, Homo sapiens
gaagaugagauugauguau

SEQ ID NO: 721020 - RNA, 19 nt, Homo sapiens
ggaauucaguuggagucaa

SEQ ID NO: 721021 - RNA, 19 nt, Homo sapiens
ggcaggcucuagagaauuc

SEQ ID NO: 721022 - RNA, 19 nt, Homo sapiens
cgcacacucuucauacuaa

SEQ ID NO: 721023 - RNA, 19 nt, Homo sapiens
gaggaacaacugaacuuug

SEQ ID NO: 721024 - RNA, 19 nt, Homo sapiens
uuaccagacuuuacuuugu

SEQ ID NO: 721025 - RNA, 19 nt, Homo sapiens
ccaagcucaucuucauuga

SEQ ID NO: 721026 - RNA, 19 nt, Homo sapiens
cagucuaaauccuuucaaa

SEQ ID NO: 721027 - RNA, 19 nt, Homo sapiens
ucacgagaacccugacuaa

SEQ ID NO: 721028 - RNA, 19 nt, Homo sapiens
gcagguuucuggguucuca

SEQ ID NO: 721029 - RNA, 19 nt, Homo sapiens
ggaaagcagcugaagacau

SEQ ID NO: 721030 - RNA, 19 nt, Homo sapiens
caaaguaaucuugcuccua

SEQ ID NO: 721031 - RNA, 19 nt, Homo sapiens
aagagcgucccauacauua

SEQ ID NO: 721032 - RNA, 19 nt, Homo sapiens
ccaagagcgucccauacau

SEQ ID NO: 721033 - RNA, 19 nt, Homo sapiens
acucagacauguucaucaa

SEQ ID NO: 721034 - RNA, 19 nt, Homo sapiens
gccaagcucaucuucauug

SEQ ID NO: 721035 - RNA, 19 nt, Homo sapiens
cauacagccugguggucua

SEQ ID NO: 721036 - RNA, 19 nt, Homo sapiens
agaaacugccauuccguua

SEQ ID NO: 721037 - RNA, 19 nt, Homo sapiens
auaauaggcccgucucuug

SEQ ID NO: 721038 - RNA, 19 nt, Homo sapiens
ggacugauaguuacaccau

SEQ ID NO: 721039 - RNA, 19 nt, Homo sapiens
gcugggauauucuucuucu

SEQ ID NO: 721040 - RNA, 19 nt, Homo sapiens
gcugcucucucauuucauc

SEQ ID NO: 721041 - RNA, 19 nt, Homo sapiens
ggauugaguccauguuauc

SEQ ID NO: 721042 - RNA, 19 nt, Homo sapiens
gcacgcacacucuucauac

SEQ ID NO: 721043 - RNA, 19 nt, Homo sapiens
cagcuugcauggccuguca

SEQ ID NO: 721044 - RNA, 19 nt, Homo sapiens
uaaagugggcccuggugaa

SEQ ID NO: 721045 - RNA, 19 nt, Homo sapiens
gacagaguucuuauaaaug

SEQ ID NO: 721046 - RNA, 19 nt, Homo sapiens
cauacuaaguguuugacau

SEQ ID NO: 721047 - RNA, 19 nt, Homo sapiens
ugaaauccacgccagaaug

SEQ ID NO: 721048 - RNA, 19 nt, Homo sapiens
ucaaugaguuucccaucag

SEQ ID NO: 721049 - RNA, 19 nt, Homo sapiens
uguacagucuaaauccuuu

SEQ ID NO: 721050 - RNA, 19 nt, Homo sapiens
acugauaguuacaccauug

SEQ ID NO: 721051 - RNA, 19 nt, Homo sapiens
uuagggcucucaguucaaa

SEQ ID NO: 721052 - RNA, 19 nt, Homo sapiens
uaaauuaggcucagaaacc

SEQ ID NO: 721053 - RNA, 19 nt, Homo sapiens
agacuuuacuuuguacuca

SEQ ID NO: 721054 - RNA, 19 nt, Homo sapiens
gacaugcaaaguaaucuug

SEQ ID NO: 721055 - RNA, 19 nt, Homo sapiens
ggagcuuucugggaauuca

SEQ ID NO: 721056 - RNA, 19 nt, Homo sapiens
cugcugcucucucauuuca

SEQ ID NO: 721057 - RNA, 19 nt, Homo sapiens
uggacagaguucuuauaaa

SEQ ID NO: 721058 - RNA, 19 nt, Homo sapiens
agccugggaugaccaaauu

SEQ ID NO: 721059 - RNA, 19 nt, Homo sapiens
aaaugugaauuccucuuuc

SEQ ID NO: 721060 - RNA, 19 nt, Homo sapiens
acaagaaggcagaagaaau

SEQ ID NO: 721061 - RNA, 19 nt, Homo sapiens
cuggacagaguucuuauaa

SEQ ID NO: 721062 - RNA, 19 nt, Homo sapiens
guucaugaagucacugauu

SEQ ID NO: 721063 - RNA, 19 nt, Homo sapiens
agacgucuauuacaaucug

SEQ ID NO: 721064 - RNA, 19 nt, Homo sapiens
gccaucugcugcucucuca

SEQ ID NO: 721065 - RNA, 19 nt, Homo sapiens
guuaucggcucgguacuca

SEQ ID NO: 721066 - RNA, 19 nt, Homo sapiens
cgagagguacagaaacuug

SEQ ID NO: 721067 - RNA, 19 nt, Homo sapiens
gcacacucuucauacuaag

SEQ ID NO: 721068 - RNA, 19 nt, Homo sapiens
cuagauguguuuggagaug

SEQ ID NO: 721069 - RNA, 19 nt, Homo sapiens
caucugcugcucucucauu

SEQ ID NO: 721070 - RNA, 19 nt, Homo sapiens
guauaaauuaggcucagaa

SEQ ID NO: 721071 - RNA, 19 nt, Homo sapiens
ggacaaguuucagauaacc

SEQ ID NO: 721072 - RNA, 19 nt, Homo sapiens
gaagauuguccgccugucu

SEQ ID NO: 721073 - RNA, 19 nt, Homo sapiens
cuuugugguuugcuguuua

SEQ ID NO: 721074 - RNA, 19 nt, Homo sapiens
cgaggaacaacugaacuuu

SEQ ID NO: 721075 - RNA, 19 nt, Homo sapiens
gaaagcagcugaagacauu

SEQ ID NO: 721076 - RNA, 19 nt, Homo sapiens
ggacagaguucuuauaaau

SEQ ID NO: 721077 - RNA, 19 nt, Homo sapiens
caggaaugcugcuuaauua

SEQ ID NO: 721078 - RNA, 19 nt, Homo sapiens
gcaagugguuugucaguaa

SEQ ID NO: 721079 - RNA, 19 nt, Homo sapiens
gcccagaaccugauaauua

SEQ ID NO: 721080 - RNA, 19 nt, Homo sapiens
caacugaacuuugugguuu

SEQ ID NO: 721081 - RNA, 19 nt, Homo sapiens
aaaguaaucuugcuccuaa

SEQ ID NO: 721082 - RNA, 19 nt, Homo sapiens
gaaagaaucagaucagaga

SEQ ID NO: 721083 - RNA, 19 nt, Homo sapiens
guuauacgcuuucuuaaug

SEQ ID NO: 721084 - RNA, 19 nt, Homo sapiens
caagguacuucguuaguuu

SEQ ID NO: 721085 - RNA, 19 nt, Homo sapiens
aaaccaagguacuucguua

SEQ ID NO: 721086 - RNA, 19 nt, Homo sapiens
gaaugucgguguucaugaa

SEQ ID NO: 721087 - RNA, 19 nt, Homo sapiens
gaacaagaaggcagaagaa

SEQ ID NO: 721088 - RNA, 19 nt, Homo sapiens
gaaaugugaauuccucuuu

SEQ ID NO: 721089 - RNA, 19 nt, Homo sapiens
gcagcgagguucuagaguu

SEQ ID NO: 721090 - RNA, 19 nt, Homo sapiens
caaauuuccucuuggcauu

SEQ ID NO: 721091 - RNA, 19 nt, Homo sapiens
gcaagugguccauacauuu

SEQ ID NO: 721092 - RNA, 19 nt, Homo sapiens
ugacugaacugcuucugaa

SEQ ID NO: 721093 - RNA, 19 nt, Homo sapiens
ugagggaccuggugccaua

SEQ ID NO: 721094 - RNA, 19 nt, Homo sapiens
caagugguccauacauuua

SEQ ID NO: 721095 - RNA, 19 nt, Homo sapiens
ugaagucacugauuaguuc

SEQ ID NO: 721096 - RNA, 19 nt, Homo sapiens
caacacaacccaaguuuca

SEQ ID NO: 721097 - RNA, 19 nt, Homo sapiens
caagaaggcagaagaaaug

SEQ ID NO: 721098 - RNA, 19 nt, Homo sapiens
ugaguuauacgcuuucuua

SEQ ID NO: 721099 - RNA, 19 nt, Homo sapiens
gaaugcugcuuaauuagau

SEQ ID NO: 721100 - RNA, 19 nt, Homo sapiens
gaaggcagaagaaauguga

SEQ ID NO: 721101 - RNA, 19 nt, Homo sapiens
gguguuaccauccuaauuu

SEQ ID NO: 721102 - RNA, 19 nt, Homo sapiens
guccauacauuuagaucua

SEQ ID NO: 721103 - RNA, 19 nt, Homo sapiens
ugagacaaauuuccucuug

SEQ ID NO: 721104 - RNA, 19 nt, Homo sapiens
cgagucagguguacaaugu

SEQ ID NO: 721105 - RNA, 19 nt, Homo sapiens
cagcgagguucuagaguuu

SEQ ID NO: 721106 - RNA, 19 nt, Homo sapiens
ggaaugcugcuuaauuaga

SEQ ID NO: 721107 - RNA, 19 nt, Homo sapiens
uaccagacuuuacuuugua

SEQ ID NO: 721108 - RNA, 19 nt, Homo sapiens
gaucuacaaugcgugguuu

SEQ ID NO: 721109 - RNA, 19 nt, Homo sapiens
cccagaaccugauaauuau

SEQ ID NO: 721110 - RNA, 19 nt, Homo sapiens
ggccuuggacugauaguua

SEQ ID NO: 721111 - RNA, 19 nt, Homo sapiens
gaaauccacgccagaaugu

SEQ ID NO: 721112 - RNA, 19 nt, Homo sapiens
cacgugacaugcaaaguaa

SEQ ID NO: 721113 - RNA, 19 nt, Homo sapiens
ccggacaaguuucagauaa

SEQ ID NO: 721114 - RNA, 19 nt, Homo sapiens
ucagacauguucaucaaug

SEQ ID NO: 721115 - RNA, 19 nt, Homo sapiens
gcagaagaaaugugaauuc

SEQ ID NO: 721116 - RNA, 19 nt, Homo sapiens
gagcugggauauucuucuu

SEQ ID NO: 721117 - RNA, 19 nt, Homo sapiens
gaacaggaaagaaucagau

SEQ ID NO: 721118 - RNA, 19 nt, Homo sapiens
gaauucaguuggagucaag

SEQ ID NO: 721119 - RNA, 19 nt, Homo sapiens
ggacagguacccaccauuc

SEQ ID NO: 721120 - RNA, 19 nt, Homo sapiens
gagacagaauuugaaggua

SEQ ID NO: 721121 - RNA, 19 nt, Homo sapiens
gcauuuacacuguggcuuu

SEQ ID NO: 721122 - RNA, 19 nt, Homo sapiens
uucaugaagucacugauua

SEQ ID NO: 721123 - RNA, 19 nt, Homo sapiens
gagcgucccauacauuaaa

SEQ ID NO: 721124 - RNA, 19 nt, Homo sapiens
caagugguuugucaguaaa

SEQ ID NO: 721125 - RNA, 19 nt, Homo sapiens
agacacauccucaugcuuu

SEQ ID NO: 721126 - RNA, 19 nt, Homo sapiens
gacagaugcuggcagaugu

SEQ ID NO: 721127 - RNA, 19 nt, Homo sapiens
ucacgugacaugcaaagua

SEQ ID NO: 721128 - RNA, 19 nt, Homo sapiens
gcucagaaaccacugcauu

SEQ ID NO: 721129 - RNA, 19 nt, Homo sapiens
gggauugaguccauguuau

SEQ ID NO: 721130 - RNA, 19 nt, Homo sapiens
uguuagaccuuugugcuua

SEQ ID NO: 721131 - RNA, 19 nt, Homo sapiens
guuauaacguuaccaugga

SEQ ID NO: 721132 - RNA, 19 nt, Homo sapiens
caagagcgucccauacauu

SEQ ID NO: 721133 - RNA, 19 nt, Homo sapiens
gaaugcaagugguccauac

SEQ ID NO: 721134 - RNA, 19 nt, Homo sapiens
gaagguacuugugcacauc

SEQ ID NO: 721135 - RNA, 19 nt, Homo sapiens
ccaagguacuucguuaguu

SEQ ID NO: 721136 - RNA, 19 nt, Homo sapiens
gaaaacagacucagacaug

SEQ ID NO: 721137 - RNA, 19 nt, Homo sapiens
caagaaagacgggaacuuc

SEQ ID NO: 721138 - RNA, 19 nt, Homo sapiens
gggcagaacaggaaagaau

SEQ ID NO: 721139 - RNA, 19 nt, Homo sapiens
gcuccuaauuauagaaaug

SEQ ID NO: 721140 - RNA, 19 nt, Homo sapiens
ggauguagcugggauugag

SEQ ID NO: 721141 - RNA, 19 nt, Homo sapiens
gaagaugagauugauguau

SEQ ID NO: 721142 - RNA, 19 nt, Homo sapiens
cauuuacacuguggcuuua

SEQ ID NO: 721143 - RNA, 19 nt, Homo sapiens
ggaauucaguuggagucaa

SEQ ID NO: 721144 - RNA, 19 nt, Homo sapiens
ggcaggcucuagagaauuc

SEQ ID NO: 721145 - RNA, 19 nt, Homo sapiens
ccacacagcacccgacuuc

SEQ ID NO: 721146 - RNA, 19 nt, Homo sapiens
ccuuugugcuuaacuguuu

SEQ ID NO: 721147 - RNA, 19 nt, Homo sapiens
cgcacacucuucauacuaa

SEQ ID NO: 721148 - RNA, 19 nt, Homo sapiens
gcacccgacuucuguaugc

SEQ ID NO: 721149 - RNA, 19 nt, Homo sapiens
guuagaccuuugugcuuaa

SEQ ID NO: 721150 - RNA, 19 nt, Homo sapiens
aaacaaaccaagcccagaa

SEQ ID NO: 721151 - RNA, 19 nt, Homo sapiens
gaggaacaacugaacuuug

SEQ ID NO: 721152 - RNA, 19 nt, Homo sapiens
uggcagauguuagaccuuu

SEQ ID NO: 721153 - RNA, 19 nt, Homo sapiens
uuaccagacuuuacuuugu

SEQ ID NO: 721154 - RNA, 19 nt, Homo sapiens
ccaagcucaucuucauuga

SEQ ID NO: 721155 - RNA, 19 nt, Homo sapiens
cagucuaaauccuuucaaa

SEQ ID NO: 721156 - RNA, 19 nt, Homo sapiens
gcagguuucuggguucuca

SEQ ID NO: 721157 - RNA, 19 nt, Homo sapiens
ggaaagcagcugaagacau

SEQ ID NO: 721158 - RNA, 19 nt, Homo sapiens
ggaccaaugcccagaaucu

SEQ ID NO: 721159 - RNA, 19 nt, Homo sapiens
ggcuuuagcuuucaaacca

SEQ ID NO: 721160 - RNA, 19 nt, Homo sapiens
caaaguaaucuugcuccua

SEQ ID NO: 721161 - RNA, 19 nt, Homo sapiens
aagagcgucccauacauua

SEQ ID NO: 721162 - RNA, 19 nt, Homo sapiens
ccaagagcgucccauacau

SEQ ID NO: 721163 - RNA, 19 nt, Homo sapiens
acucagacauguucaucaa

SEQ ID NO: 721164 - RNA, 19 nt, Homo sapiens
gcagaacaggaaagaauca

SEQ ID NO: 721165 - RNA, 19 nt, Homo sapiens
ugacaguucuuugagacaa

SEQ ID NO: 721166 - RNA, 19 nt, Homo sapiens
gccaagcucaucuucauug

SEQ ID NO: 721167 - RNA, 19 nt, Homo sapiens
gcauaaaacuagacacauc

SEQ ID NO: 721168 - RNA, 19 nt, Homo sapiens
ucacgugauuccugucaga

SEQ ID NO: 721169 - RNA, 19 nt, Homo sapiens
auaauaggcccgucucuug

SEQ ID NO: 721170 - RNA, 19 nt, Homo sapiens
ggacugauaguuacaccau

SEQ ID NO: 721171 - RNA, 19 nt, Homo sapiens
caucagaacacuggacuug

SEQ ID NO: 721172 - RNA, 19 nt, Homo sapiens
gcugcucucucauuucauc

SEQ ID NO: 721173 - RNA, 19 nt, Homo sapiens
ggauugaguccauguuauc

SEQ ID NO: 721174 - RNA, 19 nt, Homo sapiens
gcacgcacacucuucauac

SEQ ID NO: 721175 - RNA, 19 nt, Homo sapiens
ggaaaggacucaaauguca

SEQ ID NO: 721176 - RNA, 19 nt, Homo sapiens
aaucagagcucccaaguga

SEQ ID NO: 721177 - RNA, 19 nt, Homo sapiens
ccagaaggcuuucauuugu

SEQ ID NO: 721178 - RNA, 19 nt, Homo sapiens
gaugagcaauggcaacaaa

SEQ ID NO: 721179 - RNA, 19 nt, Homo sapiens
gagcagaauucaccagaga

SEQ ID NO: 721180 - RNA, 19 nt, Homo sapiens
gagaccagauugugucauu

SEQ ID NO: 721181 - RNA, 19 nt, Homo sapiens
ucaaguaccugcaggauca

SEQ ID NO: 721182 - RNA, 19 nt, Homo sapiens
gcacgaaucauggacauaa

SEQ ID NO: 721183 - RNA, 19 nt, Homo sapiens
gaauacaccuggcgucuac

SEQ ID NO: 721184 - RNA, 19 nt, Homo sapiens
cagaggagcuagugaagga

SEQ ID NO: 721185 - RNA, 19 nt, Homo sapiens
cagaagagaaugauggaua

SEQ ID NO: 721186 - RNA, 19 nt, Homo sapiens
cauccaaggugcacaagaa

SEQ ID NO: 721187 - RNA, 19 nt, Homo sapiens
cagaaggcuuucauuugua

SEQ ID NO: 721188 - RNA, 19 nt, Homo sapiens
gagcagcaauccuaagagu

SEQ ID NO: 721189 - RNA, 19 nt, Homo sapiens
uggcugagcucacaggaaa

SEQ ID NO: 721190 - RNA, 19 nt, Homo sapiens
caauuuguguguguguuua

SEQ ID NO: 721191 - RNA, 19 nt, Homo sapiens
agaaugaguugcugaaaca

SEQ ID NO: 721192 - RNA, 19 nt, Homo sapiens
agaagagaaugauggauau

SEQ ID NO: 721193 - RNA, 19 nt, Homo sapiens
aggaagagcugaagaagca

SEQ ID NO: 721194 - RNA, 19 nt, Homo sapiens
caacaaggcccuggaggaa

SEQ ID NO: 721195 - RNA, 19 nt, Homo sapiens
gcagaagcagcgugacuuu

SEQ ID NO: 721196 - RNA, 19 nt, Homo sapiens
ccaugaagcagcaguauga

SEQ ID NO: 721197 - RNA, 19 nt, Homo sapiens
gagcagcgcaccuccauuc

SEQ ID NO: 721198 - RNA, 19 nt, Homo sapiens
ggauagcuauuugcacgaa

SEQ ID NO: 721199 - RNA, 19 nt, Homo sapiens
gcauggcccuggaguucaa

SEQ ID NO: 721200 - RNA, 19 nt, Homo sapiens
ccaaggugcacaagaauga

SEQ ID NO: 721201 - RNA, 19 nt, Homo sapiens
ugaaacagcaggugaagau

SEQ ID NO: 721202 - RNA, 19 nt, Homo sapiens
gcagaaggcagaggagcua

SEQ ID NO: 721203 - RNA, 19 nt, Homo sapiens
ggaagagucccagauggaa

SEQ ID NO: 721204 - RNA, 19 nt, Homo sapiens
uaguugccaugaccaauuu

SEQ ID NO: 721205 - RNA, 19 nt, Homo sapiens
ugagauggguggccagcuu

SEQ ID NO: 721206 - RNA, 19 nt, Homo sapiens
ugaagaagcaaguggagaa

SEQ ID NO: 721207 - RNA, 19 nt, Homo sapiens
caagagaagcccucagaca

SEQ ID NO: 721208 - RNA, 19 nt, Homo sapiens
ugaaugaggagaaggaaga

SEQ ID NO: 721209 - RNA, 19 nt, Homo sapiens
gaagagaaugauggauauu

SEQ ID NO: 721210 - RNA, 19 nt, Homo sapiens
ucauuuggcuccaccuuca

SEQ ID NO: 721211 - RNA, 19 nt, Homo sapiens
ggaauacaccuggcgucua

SEQ ID NO: 721212 - RNA, 19 nt, Homo sapiens
caggagagcguuaccaugu

SEQ ID NO: 721213 - RNA, 19 nt, Homo sapiens
gccaucaucuccaccaaca

SEQ ID NO: 721214 - RNA, 19 nt, Homo sapiens
ccaaggagcugcgccaaaa

SEQ ID NO: 721215 - RNA, 19 nt, Homo sapiens
agaagcagcgugacuuuga

SEQ ID NO: 721216 - RNA, 19 nt, Homo sapiens
caggaaaggacucaaaugu

SEQ ID NO: 721217 - RNA, 19 nt, Homo sapiens
gugaggagcugugggaagu

SEQ ID NO: 721218 - RNA, 19 nt, Homo sapiens
gaccagauugugucauuug

SEQ ID NO: 721219 - RNA, 19 nt, Homo sapiens
ucagacagcagaagaggaa

SEQ ID NO: 721220 - RNA, 19 nt, Homo sapiens
ucccugaacugagcuguuu

SEQ ID NO: 721221 - RNA, 19 nt, Homo sapiens
agagccagcugaucucaau

SEQ ID NO: 721222 - RNA, 19 nt, Homo sapiens
ggagaggcauccgcagcuu

SEQ ID NO: 721223 - RNA, 19 nt, Homo sapiens
gcaagggauaaagauguua

SEQ ID NO: 721224 - RNA, 19 nt, Homo sapiens
cagaaugaguugcugaaac

SEQ ID NO: 721225 - RNA, 19 nt, Homo sapiens
caccuccucugaauuugaa

SEQ ID NO: 721226 - RNA, 19 nt, Homo sapiens
gcaccuccucugaauuuga

SEQ ID NO: 721227 - RNA, 19 nt, Homo sapiens
uggcaccuccucugaauuu

SEQ ID NO: 721228 - RNA, 19 nt, Homo sapiens
gaaggaagagcugaagaag

SEQ ID NO: 721229 - RNA, 19 nt, Homo sapiens
gaucgugagcgcaugaaug

SEQ ID NO: 721230 - RNA, 19 nt, Homo sapiens
cagcauuuccgguccauga

SEQ ID NO: 721231 - RNA, 19 nt, Homo sapiens
agaagaaggugaagaugcu

SEQ ID NO: 721232 - RNA, 19 nt, Homo sapiens
ucacaggaaaggacucaaa

SEQ ID NO: 721233 - RNA, 19 nt, Homo sapiens
gaggagcugugggaagugu

SEQ ID NO: 721234 - RNA, 19 nt, Homo sapiens
ucagagcucccaagugaug

SEQ ID NO: 721235 - RNA, 19 nt, Homo sapiens
gcuaaaagcauucaaagau

SEQ ID NO: 721236 - RNA, 19 nt, Homo sapiens
gagcuggucacgcagaaug

SEQ ID NO: 721237 - RNA, 19 nt, Homo sapiens
ggaagggacaggcaagaag

SEQ ID NO: 721238 - RNA, 19 nt, Homo sapiens
auuuggagcucaagaaguu

SEQ ID NO: 721239 - RNA, 19 nt, Homo sapiens
ggcaagagaagcccucaga

SEQ ID NO: 721240 - RNA, 19 nt, Homo sapiens
gcagaaugaguugcugaaa

SEQ ID NO: 721241 - RNA, 19 nt, Homo sapiens
ggagaacgaggcucugaag

SEQ ID NO: 721242 - RNA, 19 nt, Homo sapiens
cacgaaucauggacauaaa

SEQ ID NO: 721243 - RNA, 19 nt, Homo sapiens
gcuauuugcacgaaucaug

SEQ ID NO: 721244 - RNA, 19 nt, Homo sapiens
ccaauuuguguguguguuu

SEQ ID NO: 721245 - RNA, 19 nt, Homo sapiens
guacaccagucccugaacu

SEQ ID NO: 721246 - RNA, 19 nt, Homo sapiens
caaaucagagcucccaagu

SEQ ID NO: 721247 - RNA, 19 nt, Homo sapiens
gcaugaaugaggagaagga

SEQ ID NO: 721248 - RNA, 19 nt, Homo sapiens
ccagaacagaagagaauga

SEQ ID NO: 721249 - RNA, 19 nt, Homo sapiens
agaaggaagagcugaagaa

SEQ ID NO: 721250 - RNA, 19 nt, Homo sapiens
cccagaaggcuuucauuug

SEQ ID NO: 721251 - RNA, 19 nt, Homo sapiens
gcgcaugaaugaggagaag

SEQ ID NO: 721252 - RNA, 19 nt, Homo sapiens
gaagcacugagcauccaaa

SEQ ID NO: 721253 - RNA, 19 nt, Homo sapiens
cagcgugaguaccaggaaa

SEQ ID NO: 721254 - RNA, 19 nt, Homo sapiens
gagaggcauccgcagcuuu

SEQ ID NO: 721255 - RNA, 19 nt, Homo sapiens
gaagcagcgugacuuugac

SEQ ID NO: 721256 - RNA, 19 nt, Homo sapiens
gacagcagcaggcuagugu

SEQ ID NO: 721257 - RNA, 19 nt, Homo sapiens
gagcagcagccaugccaau

SEQ ID NO: 721258 - RNA, 19 nt, Homo sapiens
ugcaagggauaaagauguu

SEQ ID NO: 721259 - RNA, 19 nt, Homo sapiens
ugucaaaugcccagcuaaa

SEQ ID NO: 721260 - RNA, 19 nt, Homo sapiens
gagaaggaagagcugaaga

SEQ ID NO: 721261 - RNA, 19 nt, Homo sapiens
gaaggcagaggagcuagug

SEQ ID NO: 721262 - RNA, 19 nt, Homo sapiens
cuaaaagcauucaaagaug

SEQ ID NO: 721263 - RNA, 19 nt, Homo sapiens
uaggggagcuuuuggaaga

SEQ ID NO: 721264 - RNA, 19 nt, Homo sapiens
gcagugggaccagcauuuc

SEQ ID NO: 721265 - RNA, 19 nt, Homo sapiens
guucgaaauccaaaucaga

SEQ ID NO: 721266 - RNA, 19 nt, Homo sapiens
gaggagaaggcaagagaag

SEQ ID NO: 721267 - RNA, 19 nt, Homo sapiens
ccugucaaaugcccagcua

SEQ ID NO: 721268 - RNA, 19 nt, Homo sapiens
gugagcugcuggaagugaa

SEQ ID NO: 721269 - RNA, 19 nt, Homo sapiens
agaaguuguugaugagcaa

SEQ ID NO: 721270 - RNA, 19 nt, Homo sapiens
ucaaccgacuggcauccaa

SEQ ID NO: 721271 - RNA, 19 nt, Homo sapiens
agaaggcuuucauuuguac

SEQ ID NO: 721272 - RNA, 19 nt, Homo sapiens
gcugaucucaauugccaaa

SEQ ID NO: 721273 - RNA, 19 nt, Homo sapiens
cagcagaagaggaaagcaa

SEQ ID NO: 721274 - RNA, 19 nt, Homo sapiens
ccaaguccaagauugaaau

SEQ ID NO: 721275 - RNA, 19 nt, Homo sapiens
gaaugaagcugcaguuucc

SEQ ID NO: 721276 - RNA, 19 nt, Homo sapiens
caaccuaugugacagaugu

SEQ ID NO: 721277 - RNA, 19 nt, Homo sapiens
ccaaggugcuccaguccua

SEQ ID NO: 721278 - RNA, 19 nt, Homo sapiens
gcuacgcgcuucucuggaa

SEQ ID NO: 721279 - RNA, 19 nt, Homo sapiens
ggucugugaugauggcuuu

SEQ ID NO: 721280 - RNA, 19 nt, Homo sapiens
ggaaugaagcugcaguuuc

SEQ ID NO: 721281 - RNA, 19 nt, Homo sapiens
gcugugaggucugugauga

SEQ ID NO: 721282 - RNA, 19 nt, Homo sapiens
gaccagcgguucagcuaug

SEQ ID NO: 721283 - RNA, 19 nt, Homo sapiens
gaaggcaaccuaugugaca

SEQ ID NO: 721284 - RNA, 19 nt, Homo sapiens
gcaccgaacuccucaucuc

SEQ ID NO: 721285 - RNA, 19 nt, Homo sapiens
cuuaugagaucacguaugu

SEQ ID NO: 721286 - RNA, 19 nt, Homo sapiens
gaacgcuguuugccagguu

SEQ ID NO: 721287 - RNA, 19 nt, Homo sapiens
ggagaagacaguugcauca

SEQ ID NO: 721288 - RNA, 19 nt, Homo sapiens
ggacucugcuggcugaucu

SEQ ID NO: 721289 - RNA, 19 nt, Homo sapiens
gggacgacaucuucaagga

SEQ ID NO: 721290 - RNA, 19 nt, Homo sapiens
ccagucagccgaccaaaug

SEQ ID NO: 721291 - RNA, 19 nt, Homo sapiens
gaacuccucaucucucuag

SEQ ID NO: 721292 - RNA, 19 nt, Homo sapiens
gaagaagggcagagaagca

SEQ ID NO: 721293 - RNA, 19 nt, Homo sapiens
gcagcaaguuggcgcagau

SEQ ID NO: 721294 - RNA, 19 nt, Homo sapiens
caaggacagugccaagcuu

SEQ ID NO: 721295 - RNA, 19 nt, Homo sapiens
agaagacaguugcaucaug

SEQ ID NO: 721296 - RNA, 19 nt, Homo sapiens
gcaugcagcugccauucuc

SEQ ID NO: 721297 - RNA, 19 nt, Homo sapiens
gcuacgcccuggugaagga

SEQ ID NO: 721298 - RNA, 19 nt, Homo sapiens
caucacauccucagcgauu

SEQ ID NO: 721299 - RNA, 19 nt, Homo sapiens
gaauguggaaggcaaccua

SEQ ID NO: 721300 - RNA, 19 nt, Homo sapiens
gaaggcagacuccgucagu

SEQ ID NO: 721301 - RNA, 19 nt, Homo sapiens
gcagacacgagaaagaaga

SEQ ID NO: 721302 - RNA, 19 nt, Homo sapiens
gacccaggcuuccucaucu

SEQ ID NO: 721303 - RNA, 19 nt, Homo sapiens
gcccagcgccuacaacuuc

SEQ ID NO: 721304 - RNA, 19 nt, Homo sapiens
caugggagcccuaccaguu

SEQ ID NO: 721305 - RNA, 19 nt, Homo sapiens
gcagagaagcagagguguu

SEQ ID NO: 721306 - RNA, 19 nt, Homo sapiens
cggagaggaugcugggaaa

SEQ ID NO: 721307 - RNA, 19 nt, Homo sapiens
uggcugaucuggaaggaau

SEQ ID NO: 721308 - RNA, 19 nt, Homo sapiens
ggcagcacauggccacuga

SEQ ID NO: 721309 - RNA, 19 nt, Homo sapiens
gcuccugccugccucaugu

SEQ ID NO: 721310 - RNA, 19 nt, Homo sapiens
gagaccagcgguucagcua

SEQ ID NO: 721311 - RNA, 19 nt, Homo sapiens
aaacagaaccccucacaaa

SEQ ID NO: 721312 - RNA, 19 nt, Homo sapiens
cgaaggcccuggagaagac

SEQ ID NO: 721313 - RNA, 19 nt, Homo sapiens
ccaaggaccaggcggcauu

SEQ ID NO: 721314 - RNA, 19 nt, Homo sapiens
ggguggagauuuguucaug

SEQ ID NO: 721315 - RNA, 19 nt, Homo sapiens
gcuccaguccuacuauuau

SEQ ID NO: 721316 - RNA, 19 nt, Homo sapiens
cgagaaagaagaccaagca

SEQ ID NO: 721317 - RNA, 19 nt, Homo sapiens
ccugagagcuuugccaucu

SEQ ID NO: 721318 - RNA, 19 nt, Homo sapiens
ccacugccgugaccacaca

SEQ ID NO: 721319 - RNA, 19 nt, Homo sapiens
cagagaagcagagguguug

SEQ ID NO: 721320 - RNA, 19 nt, Homo sapiens
caagaagaagggcagagaa

SEQ ID NO: 721321 - RNA, 19 nt, Homo sapiens
agggaaggcuuaugagauc

SEQ ID NO: 721322 - RNA, 19 nt, Homo sapiens
gcaaguuggcgcagauaca

SEQ ID NO: 721323 - RNA, 19 nt, Homo sapiens
gcacacacugccagcaaug

SEQ ID NO: 721324 - RNA, 19 nt, Homo sapiens
ccuccuaccucaccgacuu

SEQ ID NO: 721325 - RNA, 19 nt, Homo sapiens
gguggagauuuguucaugu

SEQ ID NO: 721326 - RNA, 19 nt, Homo sapiens
ccacaauggagcccaaaug

SEQ ID NO: 721327 - RNA, 19 nt, Homo sapiens
uagaccggcucaacacguu

SEQ ID NO: 721328 - RNA, 19 nt, Homo sapiens
gaggaaugcacguuugauc

SEQ ID NO: 721329 - RNA, 19 nt, Homo sapiens
gaccagugccaucccaaga

SEQ ID NO: 721330 - RNA, 19 nt, Homo sapiens
gggaaucgcguaucucacu

SEQ ID NO: 721331 - RNA, 19 nt, Homo sapiens
cugcuacccuggcuucuuc

SEQ ID NO: 721332 - RNA, 19 nt, Homo sapiens
guggagauuuguucauguc

SEQ ID NO: 721333 - RNA, 19 nt, Homo sapiens
gaaccuggaggccauucug

SEQ ID NO: 721334 - RNA, 19 nt, Homo sapiens
ccaagaagaagggcagaga

SEQ ID NO: 721335 - RNA, 19 nt, Homo sapiens
ucugcuggcugaucuggaa

SEQ ID NO: 721336 - RNA, 19 nt, Homo sapiens
gcgaaggcccuggagaaga

SEQ ID NO: 721337 - RNA, 19 nt, Homo sapiens
gugcuccaguccuacuauu

SEQ ID NO: 721338 - RNA, 19 nt, Homo sapiens
gagcuuugccaucuacaag

SEQ ID NO: 721339 - RNA, 19 nt, Homo sapiens
ugagagcuuugccaucuac

SEQ ID NO: 721340 - RNA, 19 nt, Homo sapiens
cugaagaccugggccugaa

SEQ ID NO: 721341 - RNA, 19 nt, Homo sapiens
gugcugggcugagcgagau

SEQ ID NO: 721342 - RNA, 19 nt, Homo sapiens
cagagguguuggccaagga

SEQ ID NO: 721343 - RNA, 19 nt, Homo sapiens
ccucgagggugcugucaag

SEQ ID NO: 721344 - RNA, 19 nt, Homo sapiens
ugugaggucugugaugaug

SEQ ID NO: 721345 - RNA, 19 nt, Homo sapiens
acacgggccaguucuguga

SEQ ID NO: 721346 - RNA, 19 nt, Homo sapiens
ucacagcaccagggaaguu

SEQ ID NO: 721347 - RNA, 19 nt, Homo sapiens
gagugugcguacccaguuc

SEQ ID NO: 721348 - RNA, 19 nt, Homo sapiens
gggaaggcuuaugagauca

SEQ ID NO: 721349 - RNA, 19 nt, Homo sapiens
ccaagcaggcggagaggau

SEQ ID NO: 721350 - RNA, 19 nt, Homo sapiens
gccaggagccacagagaca

SEQ ID NO: 721351 - RNA, 19 nt, Homo sapiens
ggugccagcuggguuucuu

SEQ ID NO: 721352 - RNA, 19 nt, Homo sapiens
ccacgggugaccacuguga

SEQ ID NO: 721353 - RNA, 19 nt, Homo sapiens
ggaagaggagauucugcau

SEQ ID NO: 721354 - RNA, 19 nt, Homo sapiens
gauccagggcuucgagagu

SEQ ID NO: 721355 - RNA, 19 nt, Homo sapiens
gagcagcagauccgggaau

SEQ ID NO: 721356 - RNA, 19 nt, Homo sapiens
ugaaggccagacugacuuu

SEQ ID NO: 721357 - RNA, 19 nt, Homo sapiens
uagggaaggcuuaugagau

SEQ ID NO: 721358 - RNA, 19 nt, Homo sapiens
acgagugucugcccugcaa

SEQ ID NO: 721359 - RNA, 19 nt, Homo sapiens
gagaagacaguugcaucau

SEQ ID NO: 721360 - RNA, 19 nt, Homo sapiens
gcuccaaggguccgacugu

SEQ ID NO: 721361 - RNA, 19 nt, Homo sapiens
ccagugccaucccaagacu

SEQ ID NO: 721362 - RNA, 19 nt, Homo sapiens
gagacaccgccaccaagau

SEQ ID NO: 721363 - RNA, 19 nt, Homo sapiens
agagacaccgccaccaaga

SEQ ID NO: 721364 - RNA, 19 nt, Homo sapiens
acagagacaccgccaccaa

SEQ ID NO: 721365 - RNA, 19 nt, Homo sapiens
ucacacucccugccgauuc

SEQ ID NO: 721366 - RNA, 19 nt, Homo sapiens
cugagagcuuugccaucua

SEQ ID NO: 721367 - RNA, 19 nt, Homo sapiens
aggcuuaugagaucacgua

SEQ ID NO: 721368 - RNA, 19 nt, Homo sapiens
aagcugaaggccagacuga

SEQ ID NO: 721369 - RNA, 19 nt, Homo sapiens
cuagggaaggcuuaugaga

SEQ ID NO: 721370 - RNA, 19 nt, Homo sapiens
cugcaaagagaauguggaa

SEQ ID NO: 721371 - RNA, 19 nt, Homo sapiens
ccgaacuccucaucucucu

SEQ ID NO: 721372 - RNA, 19 nt, Homo sapiens
cuucgagggcuacaaaugu

SEQ ID NO: 721373 - RNA, 19 nt, Homo sapiens
gcuucgagggcuacaaaug

SEQ ID NO: 721374 - RNA, 19 nt, Homo sapiens
cacaauggagcccaaaugg

SEQ ID NO: 721375 - RNA, 19 nt, Homo sapiens
gagaggaaauuguacauaa

SEQ ID NO: 721376 - RNA, 19 nt, Homo sapiens
gagcaccgcuuccacauga

SEQ ID NO: 721377 - RNA, 19 nt, Homo sapiens
caacagagaggaaauugua

SEQ ID NO: 721378 - RNA, 19 nt, Homo sapiens
caagacaugucccaaguuu

SEQ ID NO: 721379 - RNA, 19 nt, Homo sapiens
gcugacuacuuauuuguua

SEQ ID NO: 721380 - RNA, 19 nt, Homo sapiens
auaaguaccucagcauuua

SEQ ID NO: 721381 - RNA, 19 nt, Homo sapiens
gagaaccacugacccaaau

SEQ ID NO: 721382 - RNA, 19 nt, Homo sapiens
guacuugucuucaccaaca

SEQ ID NO: 721383 - RNA, 19 nt, Homo sapiens
gaagaccugugcaagauag

SEQ ID NO: 721384 - RNA, 19 nt, Homo sapiens
ggaaagaggaggcaaaugg

SEQ ID NO: 721385 - RNA, 19 nt, Homo sapiens
aaacaccagucccgaaauu

SEQ ID NO: 721386 - RNA, 19 nt, Homo sapiens
gggagcagaugaaggugua

SEQ ID NO: 721387 - RNA, 19 nt, Homo sapiens
uaccuacccucacuauaua

SEQ ID NO: 721388 - RNA, 19 nt, Homo sapiens
ggccaguaauguuaaagua

SEQ ID NO: 721389 - RNA, 19 nt, Homo sapiens
gcagaagaccugugcaaga

SEQ ID NO: 721390 - RNA, 19 nt, Homo sapiens
ccaguaauguuaaaguaga

SEQ ID NO: 721391 - RNA, 19 nt, Homo sapiens
caagauaggaucagagaga

SEQ ID NO: 721392 - RNA, 19 nt, Homo sapiens
gaagguguguggagauucu

SEQ ID NO: 721393 - RNA, 19 nt, Homo sapiens
gggcgugccugugaaauga

SEQ ID NO: 721394 - RNA, 19 nt, Homo sapiens
ccacugacccaaaugaauu

SEQ ID NO: 721395 - RNA, 19 nt, Homo sapiens
gcucuaugccucagaaauu

SEQ ID NO: 721396 - RNA, 19 nt, Homo sapiens
cagaagaccugugcaagau

SEQ ID NO: 721397 - RNA, 19 nt, Homo sapiens
ccaaugugcucaugguuca

SEQ ID NO: 721398 - RNA, 19 nt, Homo sapiens
gaaccacugacccaaauga

SEQ ID NO: 721399 - RNA, 19 nt, Homo sapiens
cugaagaaauccaauccua

SEQ ID NO: 721400 - RNA, 19 nt, Homo sapiens
gaaggagaacgaaaugaug

SEQ ID NO: 721401 - RNA, 19 nt, Homo sapiens
ccacaagccugaauuucuc

SEQ ID NO: 721402 - RNA, 19 nt, Homo sapiens
gaacugcuaccuuccuaga

SEQ ID NO: 721403 - RNA, 19 nt, Homo sapiens
ggaagaaugugcggaggau

SEQ ID NO: 721404 - RNA, 19 nt, Homo sapiens
cauaaguaccucagcauuu

SEQ ID NO: 721405 - RNA, 19 nt, Homo sapiens
ccuaggcaaugaagaauau

SEQ ID NO: 721406 - RNA, 19 nt, Homo sapiens
gcucugcaccuguaggaua

SEQ ID NO: 721407 - RNA, 19 nt, Homo sapiens
caacaacgccaucaacuac

SEQ ID NO: 721408 - RNA, 19 nt, Homo sapiens
agaagaaacuaaucacagu

SEQ ID NO: 721409 - RNA, 19 nt, Homo sapiens
caaggcagcucggcuuugu

SEQ ID NO: 721410 - RNA, 19 nt, Homo sapiens
gcgcagcggucucaucuac

SEQ ID NO: 721411 - RNA, 19 nt, Homo sapiens
ugguaaaccucacaaaugu

SEQ ID NO: 721412 - RNA, 19 nt, Homo sapiens
ggagaaccacugacccaaa

SEQ ID NO: 721413 - RNA, 19 nt, Homo sapiens
ggaaugcacagggcaauug

SEQ ID NO: 721414 - RNA, 19 nt, Homo sapiens
gaugaagucccacgugaug

SEQ ID NO: 721415 - RNA, 19 nt, Homo sapiens
gugcauuguaggauaauua

SEQ ID NO: 721416 - RNA, 19 nt, Homo sapiens
acagugaaauggcagaaga

SEQ ID NO: 721417 - RNA, 19 nt, Homo sapiens
aaagagcgcugccacaacu

SEQ ID NO: 721418 - RNA, 19 nt, Homo sapiens
gaaugggcgugccugugaa

SEQ ID NO: 721419 - RNA, 19 nt, Homo sapiens
ggacagcaaagcuccaaga

SEQ ID NO: 721420 - RNA, 19 nt, Homo sapiens
gaccauggaugcugaugag

SEQ ID NO: 721421 - RNA, 19 nt, Homo sapiens
ucagagugaugaagagaau

SEQ ID NO: 721422 - RNA, 19 nt, Homo sapiens
gcacaaauccacauaaccu

SEQ ID NO: 721423 - RNA, 19 nt, Homo sapiens
ucauuaaggucauuacucu

SEQ ID NO: 721424 - RNA, 19 nt, Homo sapiens
gaauuucucaguguuggua

SEQ ID NO: 721425 - RNA, 19 nt, Homo sapiens
ccucagaaaccaaagcuuu

SEQ ID NO: 721426 - RNA, 19 nt, Homo sapiens
caaaaucugucacuacaau

SEQ ID NO: 721427 - RNA, 19 nt, Homo sapiens
agaugaagguguacaagug

SEQ ID NO: 721428 - RNA, 19 nt, Homo sapiens
uguugaagcucuuuacugu

SEQ ID NO: 721429 - RNA, 19 nt, Homo sapiens
ucucaguguugguaaguuu

SEQ ID NO: 721430 - RNA, 19 nt, Homo sapiens
cagaacugcuaccuuccua

SEQ ID NO: 721431 - RNA, 19 nt, Homo sapiens
ucucagcacuaugacauuu

SEQ ID NO: 721432 - RNA, 19 nt, Homo sapiens
uuaccuacccucacuauau

SEQ ID NO: 721433 - RNA, 19 nt, Homo sapiens
caacauuccucagaaacca

SEQ ID NO: 721434 - RNA, 19 nt, Homo sapiens
ggacgcacuccguugguaa

SEQ ID NO: 721435 - RNA, 19 nt, Homo sapiens
ccucagcauuuaauccaaa

SEQ ID NO: 721436 - RNA, 19 nt, Homo sapiens
cggcaacauuccucagaaa

SEQ ID NO: 721437 - RNA, 19 nt, Homo sapiens
agacaugucccaaguuuca

SEQ ID NO: 721438 - RNA, 19 nt, Homo sapiens
caaguaacgucgccaaacg

SEQ ID NO: 721439 - RNA, 19 nt, Homo sapiens
ccaccuaggcaaugaagaa

SEQ ID NO: 721440 - RNA, 19 nt, Homo sapiens
gagcucaccuguugaaacc

SEQ ID NO: 721441 - RNA, 19 nt, Homo sapiens
ucaacaacgccaucaacua

SEQ ID NO: 721442 - RNA, 19 nt, Homo sapiens
acagagucguggccaguaa

SEQ ID NO: 721443 - RNA, 19 nt, Homo sapiens
cggagaggcugcacuugug

SEQ ID NO: 721444 - RNA, 19 nt, Homo sapiens
ggaccaagccaucaacaac

SEQ ID NO: 721445 - RNA, 19 nt, Homo sapiens
agaacgaaaugaugaaguc

SEQ ID NO: 721446 - RNA, 19 nt, Homo sapiens
gaaugcacagggcaauuga

SEQ ID NO: 721447 - RNA, 19 nt, Homo sapiens
uaagcgauacuccagauga

SEQ ID NO: 721448 - RNA, 19 nt, Homo sapiens
gcucaugguucacaaaaga

SEQ ID NO: 721449 - RNA, 19 nt, Homo sapiens
gaggaaauuguacauaagu

SEQ ID NO: 721450 - RNA, 19 nt, Homo sapiens
ucaaccaccuaggcaauga

SEQ ID NO: 721451 - RNA, 19 nt, Homo sapiens
gucaagacaugucccaagu

SEQ ID NO: 721452 - RNA, 19 nt, Homo sapiens
ugaugagggucaagacaug

SEQ ID NO: 721453 - RNA, 19 nt, Homo sapiens
uggacagacuagcaaguaa

SEQ ID NO: 721454 - RNA, 19 nt, Homo sapiens
aaacagcgaagcucuuuag

SEQ ID NO: 721455 - RNA, 19 nt, Homo sapiens
acuaaagugugauaucugu

SEQ ID NO: 721456 - RNA, 19 nt, Homo sapiens
guaggauaauuagcaguau

SEQ ID NO: 721457 - RNA, 19 nt, Homo sapiens
ccugugcauuguaggauaa

SEQ ID NO: 721458 - RNA, 19 nt, Homo sapiens
agaaugggcgugccuguga

SEQ ID NO: 721459 - RNA, 19 nt, Homo sapiens
aacccaagcuuucaaacau

SEQ ID NO: 721460 - RNA, 19 nt, Homo sapiens
aagaaugugcggaggauuu

SEQ ID NO: 721461 - RNA, 19 nt, Homo sapiens
cccaaacucuccagacauc

SEQ ID NO: 721462 - RNA, 19 nt, Homo sapiens
ccugguggcuacccaauag

SEQ ID NO: 721463 - RNA, 19 nt, Homo sapiens
gcucuccugugcauuguag

SEQ ID NO: 721464 - RNA, 19 nt, Homo sapiens
ugaaaugaagcaacagaga

SEQ ID NO: 721465 - RNA, 19 nt, Homo sapiens
gcccauccgugcuaugaca

SEQ ID NO: 721466 - RNA, 19 nt, Homo sapiens
cgaaauuuggaucuucuuu

SEQ ID NO: 721467 - RNA, 19 nt, Homo sapiens
ggagaggcugcacuuguga

SEQ ID NO: 721468 - RNA, 19 nt, Homo sapiens
ggaaaacuaaagugugaua

SEQ ID NO: 721469 - RNA, 19 nt, Homo sapiens
ggaaagucggugucuguca

SEQ ID NO: 721470 - RNA, 19 nt, Homo sapiens
uguuugaguugguugauug

SEQ ID NO: 721471 - RNA, 19 nt, Homo sapiens
agaaugugcggaggauuua

SEQ ID NO: 721472 - RNA, 19 nt, Homo sapiens
ggaggcauucgacuuccua

SEQ ID NO: 721473 - RNA, 19 nt, Homo sapiens
gcaaugaagaauauaccau

SEQ ID NO: 721474 - RNA, 19 nt, Homo sapiens
ccuucaagauuaaugcuau

SEQ ID NO: 721475 - RNA, 19 nt, Homo sapiens
aaagggagauugugaauaa

SEQ ID NO: 721476 - RNA, 19 nt, Homo sapiens
ggaauucucuguacuaucu

SEQ ID NO: 721477 - RNA, 19 nt, Homo sapiens
caaagaggcugcagcaaau

SEQ ID NO: 721478 - RNA, 19 nt, Homo sapiens
guagagaggagucagauua

SEQ ID NO: 721479 - RNA, 19 nt, Homo sapiens
gaugaagucugaauagaau

SEQ ID NO: 721480 - RNA, 19 nt, Homo sapiens
acgaagaucucuauaguaa

SEQ ID NO: 721481 - RNA, 19 nt, Homo sapiens
gaagaucucuauaguaacu

SEQ ID NO: 721482 - RNA, 19 nt, Homo sapiens
guacgaagaucucuauagu

SEQ ID NO: 721483 - RNA, 19 nt, Homo sapiens
gaaacaugcugaagaugga

SEQ ID NO: 721484 - RNA, 19 nt, Homo sapiens
gauaagucauucagauuug

SEQ ID NO: 721485 - RNA, 19 nt, Homo sapiens
ggaaaccacugcaaugaca

SEQ ID NO: 721486 - RNA, 19 nt, Homo sapiens
gaugauaacguuagagaaa

SEQ ID NO: 721487 - RNA, 19 nt, Homo sapiens
caaaugacgucuucaccaa

SEQ ID NO: 721488 - RNA, 19 nt, Homo sapiens
gacuauaugucccuuauga

SEQ ID NO: 721489 - RNA, 19 nt, Homo sapiens
ggaaagggaaacauaguaa

SEQ ID NO: 721490 - RNA, 19 nt, Homo sapiens
gggcaaaccagugcaauua

SEQ ID NO: 721491 - RNA, 19 nt, Homo sapiens
uuaaaccucucuucucuuu

SEQ ID NO: 721492 - RNA, 19 nt, Homo sapiens
uauacuagcugagaaauug

SEQ ID NO: 721493 - RNA, 19 nt, Homo sapiens
auacacagguuguuuggua

SEQ ID NO: 721494 - RNA, 19 nt, Homo sapiens
aaaccucucuucucuuuga

SEQ ID NO: 721495 - RNA, 19 nt, Homo sapiens
ccagaaacaugcugaagau

SEQ ID NO: 721496 - RNA, 19 nt, Homo sapiens
gaucgaaugacaagucuaa

SEQ ID NO: 721497 - RNA, 19 nt, Homo sapiens
gcaaaccagugcaauuaca

SEQ ID NO: 721498 - RNA, 19 nt, Homo sapiens
gcaggguaauguaagauga

SEQ ID NO: 721499 - RNA, 19 nt, Homo sapiens
uaauugggcuaauagacua

SEQ ID NO: 721500 - RNA, 19 nt, Homo sapiens
ggugagggcuaucuaggaa

SEQ ID NO: 721501 - RNA, 19 nt, Homo sapiens
uaaauacccuccacucaag

SEQ ID NO: 721502 - RNA, 19 nt, Homo sapiens
guaaauacccuccacucaa

SEQ ID NO: 721503 - RNA, 19 nt, Homo sapiens
gaagauggaauggaacaaa

SEQ ID NO: 721504 - RNA, 19 nt, Homo sapiens
gaaacugggugagggcuau

SEQ ID NO: 721505 - RNA, 19 nt, Homo sapiens
gaaauuguaggcauguuug

SEQ ID NO: 721506 - RNA, 19 nt, Homo sapiens
gcugguaauugggcuaaua

SEQ ID NO: 721507 - RNA, 19 nt, Homo sapiens
caguaguguugauuucuua

SEQ ID NO: 721508 - RNA, 19 nt, Homo sapiens
uuuccuagcuccacucuaa

SEQ ID NO: 721509 - RNA, 19 nt, Homo sapiens
guaagaugauaacguuaga

SEQ ID NO: 721510 - RNA, 19 nt, Homo sapiens
caauugaguugaagcuguu

SEQ ID NO: 721511 - RNA, 19 nt, Homo sapiens
cccauaugcugucuuaauu

SEQ ID NO: 721512 - RNA, 19 nt, Homo sapiens
ucaaagacguuuucccaua

SEQ ID NO: 721513 - RNA, 19 nt, Homo sapiens
ggagacaugugagccaaau

SEQ ID NO: 721514 - RNA, 19 nt, Homo sapiens
gauggacuaugcaccaaug

SEQ ID NO: 721515 - RNA, 19 nt, Homo sapiens
uaacauauacuagcugaga

SEQ ID NO: 721516 - RNA, 19 nt, Homo sapiens
acaaagaggcugcagcaaa

SEQ ID NO: 721517 - RNA, 19 nt, Homo sapiens
cuacuauguuugccaauau

SEQ ID NO: 721518 - RNA, 19 nt, Homo sapiens
ugagggcuaucuaggaauu

SEQ ID NO: 721519 - RNA, 19 nt, Homo sapiens
gggaaacauaguaacuuua

SEQ ID NO: 721520 - RNA, 19 nt, Homo sapiens
aaagcugguuugaugagua

SEQ ID NO: 721521 - RNA, 19 nt, Homo sapiens
gcaaagggagauugugaau

SEQ ID NO: 721522 - RNA, 19 nt, Homo sapiens
caaaugcaaugugcuucuu

SEQ ID NO: 721523 - RNA, 19 nt, Homo sapiens
gaguagggcuauguagaga

SEQ ID NO: 721524 - RNA, 19 nt, Homo sapiens
acauuaaccuguaaacauc

SEQ ID NO: 721525 - RNA, 19 nt, Homo sapiens
ugaauagaaucuggaguau

SEQ ID NO: 721526 - RNA, 19 nt, Homo sapiens
ccaaucuaauuaugagcua

SEQ ID NO: 721527 - RNA, 19 nt, Homo sapiens
agggaaacauaguaacuuu

SEQ ID NO: 721528 - RNA, 19 nt, Homo sapiens
ucaguccucucccuuguga

SEQ ID NO: 721529 - RNA, 19 nt, Homo sapiens
gcuggcauccucacaauug

SEQ ID NO: 721530 - RNA, 19 nt, Homo sapiens
cuaaaacccuggauugaaa

SEQ ID NO: 721531 - RNA, 19 nt, Homo sapiens
caaguacgaagaucucuau

SEQ ID NO: 721532 - RNA, 19 nt, Homo sapiens
gcagugguuggacauuaua

SEQ ID NO: 721533 - RNA, 19 nt, Homo sapiens
agacuaaggagacauguga

SEQ ID NO: 721534 - RNA, 19 nt, Homo sapiens
auaagggaauccugagaaa

SEQ ID NO: 721535 - RNA, 19 nt, Homo sapiens
ugaaggacauucuacaaaa

SEQ ID NO: 721536 - RNA, 19 nt, Homo sapiens
cuaaaacaauccugacuuu

SEQ ID NO: 721537 - RNA, 19 nt, Homo sapiens
caaagggagauugugaaua

SEQ ID NO: 721538 - RNA, 19 nt, Homo sapiens
guaguugccuuuccuagcu

SEQ ID NO: 721539 - RNA, 19 nt, Homo sapiens
uagacuauaugucccuuau

SEQ ID NO: 721540 - RNA, 19 nt, Homo sapiens
cugaauagaaucuggagua

SEQ ID NO: 721541 - RNA, 19 nt, Homo sapiens
gaaggacauucuacaaaau

SEQ ID NO: 721542 - RNA, 19 nt, Homo sapiens
caaagacguuuucccauau

SEQ ID NO: 721543 - RNA, 19 nt, Homo sapiens
aagcucacauuaaccugua

SEQ ID NO: 721544 - RNA, 19 nt, Homo sapiens
gcaaguacgaagaucucua

SEQ ID NO: 721545 - RNA, 19 nt, Homo sapiens
cauaugcugucuuaauucu

SEQ ID NO: 721546 - RNA, 19 nt, Homo sapiens
guuugaagcucacauuaac

SEQ ID NO: 721547 - RNA, 19 nt, Homo sapiens
uaacugugacgauggacua

SEQ ID NO: 721548 - RNA, 19 nt, Homo sapiens
aaauauagcaggguaaugu

SEQ ID NO: 721549 - RNA, 19 nt, Homo sapiens
ugaauaagcacaaugaacu

SEQ ID NO: 721550 - RNA, 19 nt, Homo sapiens
caaaggaucgaaugacaag

SEQ ID NO: 721551 - RNA, 19 nt, Homo sapiens
uuucccauaugcugucuua

SEQ ID NO: 721552 - RNA, 19 nt, Homo sapiens
gugcaaagggagauuguga

SEQ ID NO: 721553 - RNA, 19 nt, Homo sapiens
acgcagugguuggacauua

SEQ ID NO: 721554 - RNA, 19 nt, Homo sapiens
gaauaagcacaaugaacug

SEQ ID NO: 721555 - RNA, 19 nt, Homo sapiens
caaugugcuucuuggauca

SEQ ID NO: 721556 - RNA, 19 nt, Homo sapiens
aaugacaaaugacgucuuc

SEQ ID NO: 721557 - RNA, 19 nt, Homo sapiens
uugaagcuguuccuccuaa

SEQ ID NO: 721558 - RNA, 19 nt, Homo sapiens
aauauuguccugcugguaa

SEQ ID NO: 721559 - RNA, 19 nt, Homo sapiens
ugaugaagucugaauagaa

SEQ ID NO: 721560 - RNA, 19 nt, Homo sapiens
caaguugaaggacauucua

SEQ ID NO: 721561 - RNA, 19 nt, Homo sapiens
gugauaagucauucagauu

SEQ ID NO: 721562 - RNA, 19 nt, Homo sapiens
gagaaauuguaggcauguu

SEQ ID NO: 721563 - RNA, 19 nt, Homo sapiens
gccagaaacaugcugaaga

SEQ ID NO: 721564 - RNA, 19 nt, Homo sapiens
caugaacccuuggcuguag

SEQ ID NO: 721565 - RNA, 19 nt, Homo sapiens
guaauugggcuaauagacu

SEQ ID NO: 721566 - RNA, 19 nt, Homo sapiens
acuacuauguuugccaaua

SEQ ID NO: 721567 - RNA, 19 nt, Homo sapiens
gguuugaugaguacaauga

SEQ ID NO: 721568 - RNA, 19 nt, Homo sapiens
cccaaaggaucgaaugaca

SEQ ID NO: 721569 - RNA, 19 nt, Homo sapiens
uaggaauucucuguacuau

SEQ ID NO: 721570 - RNA, 19 nt, Homo sapiens
acaguaguguugauuucuu

SEQ ID NO: 721571 - RNA, 19 nt, Homo sapiens
gcaaggccuccugcaauug

SEQ ID NO: 721572 - RNA, 19 nt, Homo sapiens
cacauuaaccuguaaacau

SEQ ID NO: 721573 - RNA, 19 nt, Homo sapiens
gggagauugugaauaagca

SEQ ID NO: 721574 - RNA, 19 nt, Homo sapiens
cuaggaauucucuguacua

SEQ ID NO: 721575 - RNA, 19 nt, Homo sapiens
gaaagaagcuccaucaguu

SEQ ID NO: 721576 - RNA, 19 nt, Homo sapiens
gcaaagaccuucaaacaga

SEQ ID NO: 721577 - RNA, 19 nt, Homo sapiens
aaagaaggcuccuaaauuu

SEQ ID NO: 721578 - RNA, 19 nt, Homo sapiens
ggaaagaucuggcuccaau

SEQ ID NO: 721579 - RNA, 19 nt, Homo sapiens
ggaaauacguuaugcuuca

SEQ ID NO: 721580 - RNA, 19 nt, Homo sapiens
gaaaaugaaugcuaccuua

SEQ ID NO: 721581 - RNA, 19 nt, Homo sapiens
gaugauauauugucuagga

SEQ ID NO: 721582 - RNA, 19 nt, Homo sapiens
uaaagaaggcuccuaaauu

SEQ ID NO: 721583 - RNA, 19 nt, Homo sapiens
uaagaugacuucagaaauc

SEQ ID NO: 721584 - RNA, 19 nt, Homo sapiens
gagaauaugugcaucuaca

SEQ ID NO: 721585 - RNA, 19 nt, Homo sapiens
uaaaagaucuccuggauga

SEQ ID NO: 721586 - RNA, 19 nt, Homo sapiens
agaauuacaugccauaaga

SEQ ID NO: 721587 - RNA, 19 nt, Homo sapiens
caaacugucuaaacuguga

SEQ ID NO: 721588 - RNA, 19 nt, Homo sapiens
gauuaggacuucuucuuga

SEQ ID NO: 721589 - RNA, 19 nt, Homo sapiens
caauguggauccugcuaua

SEQ ID NO: 721590 - RNA, 19 nt, Homo sapiens
cagaggaacugcggcuuua

SEQ ID NO: 721591 - RNA, 19 nt, Homo sapiens
gccauaagaugacuucaga

SEQ ID NO: 721592 - RNA, 19 nt, Homo sapiens
ggaaguaugaagaugauaa

SEQ ID NO: 721593 - RNA, 19 nt, Homo sapiens
caacuggagucuaaagaau

SEQ ID NO: 721594 - RNA, 19 nt, Homo sapiens
cagcagcaguggcuuauga

SEQ ID NO: 721595 - RNA, 19 nt, Homo sapiens
ugggagagguggaugauaa

SEQ ID NO: 721596 - RNA, 19 nt, Homo sapiens
ggaaaagucucuuguaagu

SEQ ID NO: 721597 - RNA, 19 nt, Homo sapiens
gaauggggcuuuaauuuau

SEQ ID NO: 721598 - RNA, 19 nt, Homo sapiens
ugauucaacuggagucuaa

SEQ ID NO: 721599 - RNA, 19 nt, Homo sapiens
ucaaugacauauggaagua

SEQ ID NO: 721600 - RNA, 19 nt, Homo sapiens
ggaauccugugcauuauac

SEQ ID NO: 721601 - RNA, 19 nt, Homo sapiens
gaacugcggcuuuaccaau

SEQ ID NO: 721602 - RNA, 19 nt, Homo sapiens
guaaagaaggcuccuaaau

SEQ ID NO: 721603 - RNA, 19 nt, Homo sapiens
aagauuuacuuccugguua

SEQ ID NO: 721604 - RNA, 19 nt, Homo sapiens
ucagaaauccuacuucaga

SEQ ID NO: 721605 - RNA, 19 nt, Homo sapiens
ggaagaggacuuuaugcaa

SEQ ID NO: 721606 - RNA, 19 nt, Homo sapiens
gggcugggauguugaagga

SEQ ID NO: 721607 - RNA, 19 nt, Homo sapiens
caagaaagaagcuccauca

SEQ ID NO: 721608 - RNA, 19 nt, Homo sapiens
gcugggauguugaaggaaa

SEQ ID NO: 721609 - RNA, 19 nt, Homo sapiens
gggaugauauauugucuag

SEQ ID NO: 721610 - RNA, 19 nt, Homo sapiens
uuagugaaguguuugauug

SEQ ID NO: 721611 - RNA, 19 nt, Homo sapiens
caaaugacagccuaaaugu

SEQ ID NO: 721612 - RNA, 19 nt, Homo sapiens
gaaguuauugucuaagaga

SEQ ID NO: 721613 - RNA, 19 nt, Homo sapiens
gcaacacguuuaaaucucu

SEQ ID NO: 721614 - RNA, 19 nt, Homo sapiens
agaaaucauuccagcauug

SEQ ID NO: 721615 - RNA, 19 nt, Homo sapiens
agaaugggcugggauguug

SEQ ID NO: 721616 - RNA, 19 nt, Homo sapiens
uaaggaucauguugagaaa

SEQ ID NO: 721617 - RNA, 19 nt, Homo sapiens
ugaaaugggugcgaacaga

SEQ ID NO: 721618 - RNA, 19 nt, Homo sapiens
cauaagaugacuucagaaa

SEQ ID NO: 721619 - RNA, 19 nt, Homo sapiens
ucacauaaagggaugauau

SEQ ID NO: 721620 - RNA, 19 nt, Homo sapiens
ucagauauaugugguagga

SEQ ID NO: 721621 - RNA, 19 nt, Homo sapiens
ucaaaugacagccuaaaug

SEQ ID NO: 721622 - RNA, 19 nt, Homo sapiens
ggggaaaagucucuuguaa

SEQ ID NO: 721623 - RNA, 19 nt, Homo sapiens
cagaaauccuacuucagaa

SEQ ID NO: 721624 - RNA, 19 nt, Homo sapiens
agacacucauguagaaauu

SEQ ID NO: 721625 - RNA, 19 nt, Homo sapiens
gggauguaaugaccgaauu

SEQ ID NO: 721626 - RNA, 19 nt, Homo sapiens
ggccucauccucuugguua

SEQ ID NO: 721627 - RNA, 19 nt, Homo sapiens
gugaaguguuugauuguau

SEQ ID NO: 721628 - RNA, 19 nt, Homo sapiens
guaaggaagaggacuuuau

SEQ ID NO: 721629 - RNA, 19 nt, Homo sapiens
uagcauagcaucugaaugg

SEQ ID NO: 721630 - RNA, 19 nt, Homo sapiens
ggcauggaauguuuguaaa

SEQ ID NO: 721631 - RNA, 19 nt, Homo sapiens
agaaggcuccuaaauuuga

SEQ ID NO: 721632 - RNA, 19 nt, Homo sapiens
gaaucuguuucacucaaug

SEQ ID NO: 721633 - RNA, 19 nt, Homo sapiens
gaggaaagacagaugacaa

SEQ ID NO: 721634 - RNA, 19 nt, Homo sapiens
cagaaaucauuccagcauu

SEQ ID NO: 721635 - RNA, 19 nt, Homo sapiens
caacccagaccuccagaaa

SEQ ID NO: 721636 - RNA, 19 nt, Homo sapiens
uaggguauccuuaaacuga

SEQ ID NO: 721637 - RNA, 19 nt, Homo sapiens
gaugagcaguagguaagaa

SEQ ID NO: 721638 - RNA, 19 nt, Homo sapiens
gggcuuuaauuuauucugu

SEQ ID NO: 721639 - RNA, 19 nt, Homo sapiens
ugaaauugaugaggcgaaa

SEQ ID NO: 721640 - RNA, 19 nt, Homo sapiens
gcuaaucauuucauuugca

SEQ ID NO: 721641 - RNA, 19 nt, Homo sapiens
gagaugagcaguagguaag

SEQ ID NO: 721642 - RNA, 19 nt, Homo sapiens
guuauugucuaagagauga

SEQ ID NO: 721643 - RNA, 19 nt, Homo sapiens
acuggagucuaaagaauuu

SEQ ID NO: 721644 - RNA, 19 nt, Homo sapiens
uaaggaagaggacuuuaug

SEQ ID NO: 721645 - RNA, 19 nt, Homo sapiens
ucagaaguguaauaaaugg

SEQ ID NO: 721646 - RNA, 19 nt, Homo sapiens
ucauuaggguauccuuaaa

SEQ ID NO: 721647 - RNA, 19 nt, Homo sapiens
agaucuggcuccaaugaaa

SEQ ID NO: 721648 - RNA, 19 nt, Homo sapiens
aaucauuccagcauuguua

SEQ ID NO: 721649 - RNA, 19 nt, Homo sapiens
uaagaaaaccucagucauu

SEQ ID NO: 721650 - RNA, 19 nt, Homo sapiens
ucuaagagaugagcaguag

SEQ ID NO: 721651 - RNA, 19 nt, Homo sapiens
caggaggugucacugaaga

SEQ ID NO: 721652 - RNA, 19 nt, Homo sapiens
cacauaaagggaugauaua

SEQ ID NO: 721653 - RNA, 19 nt, Homo sapiens
gaauggugauguuggugau

SEQ ID NO: 721654 - RNA, 19 nt, Homo sapiens
acggaaaugugcaagauau

SEQ ID NO: 721655 - RNA, 19 nt, Homo sapiens
ugacggaaaugugcaagau

SEQ ID NO: 721656 - RNA, 19 nt, Homo sapiens
cuucagaaauccuacuuca

SEQ ID NO: 721657 - RNA, 19 nt, Homo sapiens
aauuggaaguggagaauau

SEQ ID NO: 721658 - RNA, 19 nt, Homo sapiens
cugagcagauucccagaaa

SEQ ID NO: 721659 - RNA, 19 nt, Homo sapiens
ugaggugaauggugauguu

SEQ ID NO: 721660 - RNA, 19 nt, Homo sapiens
aaagaagcuccaucaguuu

SEQ ID NO: 721661 - RNA, 19 nt, Homo sapiens
ggauguaaugaccgaauuu

SEQ ID NO: 721662 - RNA, 19 nt, Homo sapiens
ucccaggcauggaauguuu

SEQ ID NO: 721663 - RNA, 19 nt, Homo sapiens
uguuggugaugaagauuua

SEQ ID NO: 721664 - RNA, 19 nt, Homo sapiens
ggagguagugcuagacaau

SEQ ID NO: 721665 - RNA, 19 nt, Homo sapiens
ugaauggggcuuuaauuua

SEQ ID NO: 721666 - RNA, 19 nt, Homo sapiens
auugggaggugguuuguuu

SEQ ID NO: 721667 - RNA, 19 nt, Homo sapiens
gaguagcaguccauaaagg

SEQ ID NO: 721668 - RNA, 19 nt, Homo sapiens
aaagaucuggcuccaauga

SEQ ID NO: 721669 - RNA, 19 nt, Homo sapiens
uuaaggaucauguugagaa

SEQ ID NO: 721670 - RNA, 19 nt, Homo sapiens
guuguuugcuaaucauuuc

SEQ ID NO: 721671 - RNA, 19 nt, Homo sapiens
caucauuaggguauccuua

SEQ ID NO: 721672 - RNA, 19 nt, Homo sapiens
gaaaucauuccagcauugu

SEQ ID NO: 721673 - RNA, 19 nt, Homo sapiens
cuaagaauuacaugccaua

SEQ ID NO: 721674 - RNA, 19 nt, Homo sapiens
caacacguuuaaaucucuu

SEQ ID NO: 721675 - RNA, 19 nt, Homo sapiens
gaagaguacugaagauuua

SEQ ID NO: 721676 - RNA, 19 nt, Homo sapiens
gaaaugaaccuaaggaauu

SEQ ID NO: 721677 - RNA, 19 nt, Homo sapiens
uaucgaagcugaugaagua

SEQ ID NO: 721678 - RNA, 19 nt, Homo sapiens
uaacuucgcugcuuucauu

SEQ ID NO: 721679 - RNA, 19 nt, Homo sapiens
caacaaacccugaagagua

SEQ ID NO: 721680 - RNA, 19 nt, Homo sapiens
caaauuauauugccagaga

SEQ ID NO: 721681 - RNA, 19 nt, Homo sapiens
gagaauggauccaccacua

SEQ ID NO: 721682 - RNA, 19 nt, Homo sapiens
gacaacaucuuccgaaaug

SEQ ID NO: 721683 - RNA, 19 nt, Homo sapiens
caagacaccuucauggaaa

SEQ ID NO: 721684 - RNA, 19 nt, Homo sapiens
gaaguuaccuuuuggguuu

SEQ ID NO: 721685 - RNA, 19 nt, Homo sapiens
ggaaucacuuggccuuaaa

SEQ ID NO: 721686 - RNA, 19 nt, Homo sapiens
aaaaggacaugcacuauua

SEQ ID NO: 721687 - RNA, 19 nt, Homo sapiens
caugaggucuauuaucuuu

SEQ ID NO: 721688 - RNA, 19 nt, Homo sapiens
gggaugaaacccucuauaa

SEQ ID NO: 721689 - RNA, 19 nt, Homo sapiens
gcaagacaccuucauggaa

SEQ ID NO: 721690 - RNA, 19 nt, Homo sapiens
ccaaagcagugucuucuca

SEQ ID NO: 721691 - RNA, 19 nt, Homo sapiens
gcaacauuauuaagcaguu

SEQ ID NO: 721692 - RNA, 19 nt, Homo sapiens
gcgcaacaauugauguaga

SEQ ID NO: 721693 - RNA, 19 nt, Homo sapiens
caaauacagccaugaagaa

SEQ ID NO: 721694 - RNA, 19 nt, Homo sapiens
ggacaugcacuauuaccaa

SEQ ID NO: 721695 - RNA, 19 nt, Homo sapiens
ucacuuggccuuaaagcua

SEQ ID NO: 721696 - RNA, 19 nt, Homo sapiens
ggaaaugaaccuaaggaau

SEQ ID NO: 721697 - RNA, 19 nt, Homo sapiens
gaugaaacccucuauaagg

SEQ ID NO: 721698 - RNA, 19 nt, Homo sapiens
gaaauuaucgaagcugaug

SEQ ID NO: 721699 - RNA, 19 nt, Homo sapiens
ugggaaaccugguauugaa

SEQ ID NO: 721700 - RNA, 19 nt, Homo sapiens
gggacaacaucuuccgaaa

SEQ ID NO: 721701 - RNA, 19 nt, Homo sapiens
caagcuggcugccucuuuc

SEQ ID NO: 721702 - RNA, 19 nt, Homo sapiens
ugaagaguacugaagauuu

SEQ ID NO: 721703 - RNA, 19 nt, Homo sapiens
cuccaacucuuacuuugua

SEQ ID NO: 721704 - RNA, 19 nt, Homo sapiens
ggucuauuaucuuugcaaa

SEQ ID NO: 721705 - RNA, 19 nt, Homo sapiens
ccaaauacagccaugaaga

SEQ ID NO: 721706 - RNA, 19 nt, Homo sapiens
ucucaugcgcuaaacauua

SEQ ID NO: 721707 - RNA, 19 nt, Homo sapiens
ggacaacaucuuccgaaau

SEQ ID NO: 721708 - RNA, 19 nt, Homo sapiens
cggaaucacuuggccuuaa

SEQ ID NO: 721709 - RNA, 19 nt, Homo sapiens
cagcuacucugaucaacau

SEQ ID NO: 721710 - RNA, 19 nt, Homo sapiens
acacuuaugugaugguugu

SEQ ID NO: 721711 - RNA, 19 nt, Homo sapiens
gacaugcacuauuaccaau

SEQ ID NO: 721712 - RNA, 19 nt, Homo sapiens
cggcaugggucagcucuuu

SEQ ID NO: 721713 - RNA, 19 nt, Homo sapiens
caacaacaaacccugaaga

SEQ ID NO: 721714 - RNA, 19 nt, Homo sapiens
ggaugaaacccucuauaag

SEQ ID NO: 721715 - RNA, 19 nt, Homo sapiens
gcguuugucucgcccauug

SEQ ID NO: 721716 - RNA, 19 nt, Homo sapiens
guauugaaccugugggauu

SEQ ID NO: 721717 - RNA, 19 nt, Homo sapiens
gcaagcuggcugccucuuu

SEQ ID NO: 721718 - RNA, 19 nt, Homo sapiens
uuaaagagcgagaagaaga

SEQ ID NO: 721719 - RNA, 19 nt, Homo sapiens
cgaagcugaugaaguacuu

SEQ ID NO: 721720 - RNA, 19 nt, Homo sapiens
gaaaaggacaugcacuauu

SEQ ID NO: 721721 - RNA, 19 nt, Homo sapiens
gcagcgugaugcccauaga

SEQ ID NO: 721722 - RNA, 19 nt, Homo sapiens
ggagagccgcgaacuggaa

SEQ ID NO: 721723 - RNA, 19 nt, Homo sapiens
auguggagguucugauuua

SEQ ID NO: 721724 - RNA, 19 nt, Homo sapiens
ggccauaggcgaugagaau

SEQ ID NO: 721725 - RNA, 19 nt, Homo sapiens
ucauugacaucuuuacauc

SEQ ID NO: 721726 - RNA, 19 nt, Homo sapiens
caacacuuaugugaugguu

SEQ ID NO: 721727 - RNA, 19 nt, Homo sapiens
gguaauuucucacuaucag

SEQ ID NO: 721728 - RNA, 19 nt, Homo sapiens
ggacuggaaaggacuuguu

SEQ ID NO: 721729 - RNA, 19 nt, Homo sapiens
gguccagcauaguuuauca

SEQ ID NO: 721730 - RNA, 19 nt, Homo sapiens
aagaagauuugaggcguuu

SEQ ID NO: 721731 - RNA, 19 nt, Homo sapiens
cgcaacaauugauguagaa

SEQ ID NO: 721732 - RNA, 19 nt, Homo sapiens
ggaccaaagcagugucuuc

SEQ ID NO: 721733 - RNA, 19 nt, Homo sapiens
gcccauagauuugagaaaa

SEQ ID NO: 721734 - RNA, 19 nt, Homo sapiens
caugcacuauuaccaauca

SEQ ID NO: 721735 - RNA, 19 nt, Homo sapiens
uggagguucugauuuaugu

SEQ ID NO: 721736 - RNA, 19 nt, Homo sapiens
cugaggcguucuccgcuua

SEQ ID NO: 721737 - RNA, 19 nt, Homo sapiens
gaagauuugaggcguuugu

SEQ ID NO: 721738 - RNA, 19 nt, Homo sapiens
gguucugauuuaugucuuu

SEQ ID NO: 721739 - RNA, 19 nt, Homo sapiens
uauugaaccugugggauug

SEQ ID NO: 721740 - RNA, 19 nt, Homo sapiens
caaacaaacaacaacaaca

SEQ ID NO: 721741 - RNA, 19 nt, Homo sapiens
gaugagaauaggcaguuga

SEQ ID NO: 721742 - RNA, 19 nt, Homo sapiens
caaaggcggaggcaagaau

SEQ ID NO: 721743 - RNA, 19 nt, Homo sapiens
gcaaugccaggaaacacuu

SEQ ID NO: 721744 - RNA, 19 nt, Homo sapiens
ucgcgguccucaccucuuu

SEQ ID NO: 721745 - RNA, 19 nt, Homo sapiens
gcgugaugcccauagauuu

SEQ ID NO: 721746 - RNA, 19 nt, Homo sapiens
aaagcagugucuucucaug

SEQ ID NO: 721747 - RNA, 19 nt, Homo sapiens
acucuaacuucgcugcuuu

SEQ ID NO: 721748 - RNA, 19 nt, Homo sapiens
caacauuauuaagcaguuc

SEQ ID NO: 721749 - RNA, 19 nt, Homo sapiens
ucugguaauuucucacuau

SEQ ID NO: 721750 - RNA, 19 nt, Homo sapiens
cugcagaauucuccagaug

SEQ ID NO: 721751 - RNA, 19 nt, Homo sapiens
ggugggugcuaccaaauac

SEQ ID NO: 721752 - RNA, 19 nt, Homo sapiens
gggugggugcuaccaaaua

SEQ ID NO: 721753 - RNA, 19 nt, Homo sapiens
aacaaacccugaagaguac

SEQ ID NO: 721754 - RNA, 19 nt, Homo sapiens
gccaggaaacacuuugaaa

SEQ ID NO: 721755 - RNA, 19 nt, Homo sapiens
cauccgcaaugccaggaaa

SEQ ID NO: 721756 - RNA, 19 nt, Homo sapiens
gagagcuacuuuucuggua

SEQ ID NO: 721757 - RNA, 19 nt, Homo sapiens
gaaauguggagguucugau

SEQ ID NO: 721758 - RNA, 19 nt, Homo sapiens
agcaugaggucuauuaucu

SEQ ID NO: 721759 - RNA, 19 nt, Homo sapiens
aaauacagccaugaagaaa

SEQ ID NO: 721760 - RNA, 19 nt, Homo sapiens
ggcaagacaccuucaugga

SEQ ID NO: 721761 - RNA, 19 nt, Homo sapiens
caacaauugauguagaaca

SEQ ID NO: 721762 - RNA, 19 nt, Homo sapiens
gacaaaggcggaggcaaga

SEQ ID NO: 721763 - RNA, 19 nt, Homo sapiens
aagaguggauggaccaaag

SEQ ID NO: 721764 - RNA, 19 nt, Homo sapiens
gaagucaggaacucuaacu

SEQ ID NO: 721765 - RNA, 19 nt, Homo sapiens
gcaugaggucuauuaucuu

SEQ ID NO: 721766 - RNA, 19 nt, Homo sapiens
uggaagaaucugacucuga

SEQ ID NO: 721767 - RNA, 19 nt, Homo sapiens
aaaggcggaggcaagaaua

SEQ ID NO: 721768 - RNA, 19 nt, Homo sapiens
uaaagagcgagaagaagau

SEQ ID NO: 721769 - RNA, 19 nt, Homo sapiens
gaaucugacucugagaaaa

SEQ ID NO: 721770 - RNA, 19 nt, Homo sapiens
acaccuucauggaaaauua

SEQ ID NO: 721771 - RNA, 19 nt, Homo sapiens
ugaggucuauuaucuuugc

SEQ ID NO: 721772 - RNA, 19 nt, Homo sapiens
gcgaugagaauaggcaguu

SEQ ID NO: 721773 - RNA, 19 nt, Homo sapiens
auccaacacuuaugugaug

SEQ ID NO: 721774 - RNA, 19 nt, Homo sapiens
cagcuggaaaugaaccuaa

SEQ ID NO: 721775 - RNA, 19 nt, Homo sapiens
gaagaguacugaagauuua

SEQ ID NO: 721776 - RNA, 19 nt, Homo sapiens
gaaaugaaccuaaggaauu

SEQ ID NO: 721777 - RNA, 19 nt, Homo sapiens
uaucgaagcugaugaagua

SEQ ID NO: 721778 - RNA, 19 nt, Homo sapiens
uaacuucgcugcuuucauu

SEQ ID NO: 721779 - RNA, 19 nt, Homo sapiens
caacaaacccugaagagua

SEQ ID NO: 721780 - RNA, 19 nt, Homo sapiens
caaauuauauugccagaga

SEQ ID NO: 721781 - RNA, 19 nt, Homo sapiens
gagaauggauccaccacua

SEQ ID NO: 721782 - RNA, 19 nt, Homo sapiens
gacaacaucuuccgaaaug

SEQ ID NO: 721783 - RNA, 19 nt, Homo sapiens
caagacaccuucauggaaa

SEQ ID NO: 721784 - RNA, 19 nt, Homo sapiens
gaaguuaccuuuuggguuu

SEQ ID NO: 721785 - RNA, 19 nt, Homo sapiens
ggaaucacuuggccuuaaa

SEQ ID NO: 721786 - RNA, 19 nt, Homo sapiens
aaaaggacaugcacuauua

SEQ ID NO: 721787 - RNA, 19 nt, Homo sapiens
caugaggucuauuaucuuu

SEQ ID NO: 721788 - RNA, 19 nt, Homo sapiens
gggaugaaacccucuauaa

SEQ ID NO: 721789 - RNA, 19 nt, Homo sapiens
gcaagacaccuucauggaa

SEQ ID NO: 721790 - RNA, 19 nt, Homo sapiens
ccaaagcagugucuucuca

SEQ ID NO: 721791 - RNA, 19 nt, Homo sapiens
gcaacauuauuaagcaguu

SEQ ID NO: 721792 - RNA, 19 nt, Homo sapiens
caaauacagccaugaagaa

SEQ ID NO: 721793 - RNA, 19 nt, Homo sapiens
ggacaugcacuauuaccaa

SEQ ID NO: 721794 - RNA, 19 nt, Homo sapiens
ucacuuggccuuaaagcua

SEQ ID NO: 721795 - RNA, 19 nt, Homo sapiens
ggaaaugaaccuaaggaau

SEQ ID NO: 721796 - RNA, 19 nt, Homo sapiens
gaugaaacccucuauaagg

SEQ ID NO: 721797 - RNA, 19 nt, Homo sapiens
gaaauuaucgaagcugaug

SEQ ID NO: 721798 - RNA, 19 nt, Homo sapiens
ugggaaaccugguauugaa

SEQ ID NO: 721799 - RNA, 19 nt, Homo sapiens
gggacaacaucuuccgaaa

SEQ ID NO: 721800 - RNA, 19 nt, Homo sapiens
caagcuggcugccucuuuc

SEQ ID NO: 721801 - RNA, 19 nt, Homo sapiens
ugaagaguacugaagauuu

SEQ ID NO: 721802 - RNA, 19 nt, Homo sapiens
cuccaacucuuacuuugua

SEQ ID NO: 721803 - RNA, 19 nt, Homo sapiens
ggucuauuaucuuugcaaa

SEQ ID NO: 721804 - RNA, 19 nt, Homo sapiens
ccaaauacagccaugaaga

SEQ ID NO: 721805 - RNA, 19 nt, Homo sapiens
ucucaugcgcuaaacauua

SEQ ID NO: 721806 - RNA, 19 nt, Homo sapiens
ggacaacaucuuccgaaau

SEQ ID NO: 721807 - RNA, 19 nt, Homo sapiens
cggaaucacuuggccuuaa

SEQ ID NO: 721808 - RNA, 19 nt, Homo sapiens
cagcuacucugaucaacau

SEQ ID NO: 721809 - RNA, 19 nt, Homo sapiens
acacuuaugugaugguugu

SEQ ID NO: 721810 - RNA, 19 nt, Homo sapiens
gacaugcacuauuaccaau

SEQ ID NO: 721811 - RNA, 19 nt, Homo sapiens
cguagacucuguuggaaau

SEQ ID NO: 721812 - RNA, 19 nt, Homo sapiens
gagcaccuacucucucgua

SEQ ID NO: 721813 - RNA, 19 nt, Homo sapiens
cggcaugggucagcucuuu

SEQ ID NO: 721814 - RNA, 19 nt, Homo sapiens
caacaacaaacccugaaga

SEQ ID NO: 721815 - RNA, 19 nt, Homo sapiens
ggaugaaacccucuauaag

SEQ ID NO: 721816 - RNA, 19 nt, Homo sapiens
gcguuugucucgcccauug

SEQ ID NO: 721817 - RNA, 19 nt, Homo sapiens
guauugaaccugugggauu

SEQ ID NO: 721818 - RNA, 19 nt, Homo sapiens
gcaagcuggcugccucuuu

SEQ ID NO: 721819 - RNA, 19 nt, Homo sapiens
uuaaagagcgagaagaaga

SEQ ID NO: 721820 - RNA, 19 nt, Homo sapiens
cgaagcugaugaaguacuu

SEQ ID NO: 721821 - RNA, 19 nt, Homo sapiens
gaaaaggacaugcacuauu

SEQ ID NO: 721822 - RNA, 19 nt, Homo sapiens
gcagcgugaugcccauaga

SEQ ID NO: 721823 - RNA, 19 nt, Homo sapiens
ggagagccgcgaacuggaa

SEQ ID NO: 721824 - RNA, 19 nt, Homo sapiens
auguggagguucugauuua

SEQ ID NO: 721825 - RNA, 19 nt, Homo sapiens
ggccauaggcgaugagaau

SEQ ID NO: 721826 - RNA, 19 nt, Homo sapiens
ucauugacaucuuuacauc

SEQ ID NO: 721827 - RNA, 19 nt, Homo sapiens
caacacuuaugugaugguu

SEQ ID NO: 721828 - RNA, 19 nt, Homo sapiens
gguaauuucucacuaucag

SEQ ID NO: 721829 - RNA, 19 nt, Homo sapiens
ggacuggaaaggacuuguu

SEQ ID NO: 721830 - RNA, 19 nt, Homo sapiens
gguccagcauaguuuauca

SEQ ID NO: 721831 - RNA, 19 nt, Homo sapiens
aagaagauuugaggcguuu

SEQ ID NO: 721832 - RNA, 19 nt, Homo sapiens
ggaccaaagcagugucuuc

SEQ ID NO: 721833 - RNA, 19 nt, Homo sapiens
gcccauagauuugagaaaa

SEQ ID NO: 721834 - RNA, 19 nt, Homo sapiens
caugcacuauuaccaauca

SEQ ID NO: 721835 - RNA, 19 nt, Homo sapiens
uggagguucugauuuaugu

SEQ ID NO: 721836 - RNA, 19 nt, Homo sapiens
cugaggcguucuccgcuua

SEQ ID NO: 721837 - RNA, 19 nt, Homo sapiens
gaagauuugaggcguuugu

SEQ ID NO: 721838 - RNA, 19 nt, Homo sapiens
gguucugauuuaugucuuu

SEQ ID NO: 721839 - RNA, 19 nt, Homo sapiens
uauugaaccugugggauug

SEQ ID NO: 721840 - RNA, 19 nt, Homo sapiens
caaacaaacaacaacaaca

SEQ ID NO: 721841 - RNA, 19 nt, Homo sapiens
gaugagaauaggcaguuga

SEQ ID NO: 721842 - RNA, 19 nt, Homo sapiens
caaaggcggaggcaagaau

SEQ ID NO: 721843 - RNA, 19 nt, Homo sapiens
gcaaugccaggaaacacuu

SEQ ID NO: 721844 - RNA, 19 nt, Homo sapiens
ucgcgguccucaccucuuu

SEQ ID NO: 721845 - RNA, 19 nt, Homo sapiens
gcgugaugcccauagauuu

SEQ ID NO: 721846 - RNA, 19 nt, Homo sapiens
aaagcagugucuucucaug

SEQ ID NO: 721847 - RNA, 19 nt, Homo sapiens
acucuaacuucgcugcuuu

SEQ ID NO: 721848 - RNA, 19 nt, Homo sapiens
caacauuauuaagcaguuc

SEQ ID NO: 721849 - RNA, 19 nt, Homo sapiens
ucugguaauuucucacuau

SEQ ID NO: 721850 - RNA, 19 nt, Homo sapiens
cugcagaauucuccagaug

SEQ ID NO: 721851 - RNA, 19 nt, Homo sapiens
ggugggugcuaccaaauac

SEQ ID NO: 721852 - RNA, 19 nt, Homo sapiens
gggugggugcuaccaaaua

SEQ ID NO: 721853 - RNA, 19 nt, Homo sapiens
gaccguauacauagucuuc

SEQ ID NO: 721854 - RNA, 19 nt, Homo sapiens
aacaaacccugaagaguac

SEQ ID NO: 721855 - RNA, 19 nt, Homo sapiens
gccaggaaacacuuugaaa

SEQ ID NO: 721856 - RNA, 19 nt, Homo sapiens
cauccgcaaugccaggaaa

SEQ ID NO: 721857 - RNA, 19 nt, Homo sapiens
gagagcuacuuuucuggua

SEQ ID NO: 721858 - RNA, 19 nt, Homo sapiens
gaaauguggagguucugau

SEQ ID NO: 721859 - RNA, 19 nt, Homo sapiens
agcaugaggucuauuaucu

SEQ ID NO: 721860 - RNA, 19 nt, Homo sapiens
aaauacagccaugaagaaa

SEQ ID NO: 721861 - RNA, 19 nt, Homo sapiens
ggcaagacaccuucaugga

SEQ ID NO: 721862 - RNA, 19 nt, Homo sapiens
gacaaaggcggaggcaaga

SEQ ID NO: 721863 - RNA, 19 nt, Homo sapiens
aagaguggauggaccaaag

SEQ ID NO: 721864 - RNA, 19 nt, Homo sapiens
gaagucaggaacucuaacu

SEQ ID NO: 721865 - RNA, 19 nt, Homo sapiens
gcaugaggucuauuaucuu

SEQ ID NO: 721866 - RNA, 19 nt, Homo sapiens
uggaagaaucugacucuga

SEQ ID NO: 721867 - RNA, 19 nt, Homo sapiens
aaaggcggaggcaagaaua

SEQ ID NO: 721868 - RNA, 19 nt, Homo sapiens
uaaagagcgagaagaagau

SEQ ID NO: 721869 - RNA, 19 nt, Homo sapiens
gaaucugacucugagaaaa

SEQ ID NO: 721870 - RNA, 19 nt, Homo sapiens
acaccuucauggaaaauua

SEQ ID NO: 721871 - RNA, 19 nt, Homo sapiens
ugaggucuauuaucuuugc

SEQ ID NO: 721872 - RNA, 19 nt, Homo sapiens
gcgaugagaauaggcaguu

SEQ ID NO: 721873 - RNA, 19 nt, Homo sapiens
auccaacacuuaugugaug

SEQ ID NO: 721874 - RNA, 19 nt, Homo sapiens
cagcuggaaaugaaccuaa

SEQ ID NO: 721875 - RNA, 19 nt, Homo sapiens
gcaagcaucauuucuauua

SEQ ID NO: 721876 - RNA, 19 nt, Homo sapiens
gguaggaggugacugaaua

SEQ ID NO: 721877 - RNA, 19 nt, Homo sapiens
gagaaacacuccaaaucua

SEQ ID NO: 721878 - RNA, 19 nt, Homo sapiens
gagauggaguuucaccuua

SEQ ID NO: 721879 - RNA, 19 nt, Homo sapiens
gcucagauaucacccauga

SEQ ID NO: 721880 - RNA, 19 nt, Homo sapiens
gacaguauuucuucuagua

SEQ ID NO: 721881 - RNA, 19 nt, Homo sapiens
caucuuaucccuugaauuu

SEQ ID NO: 721882 - RNA, 19 nt, Homo sapiens
ggaggugacugaauacaug

SEQ ID NO: 721883 - RNA, 19 nt, Homo sapiens
gcuggaaaccucagaguua

SEQ ID NO: 721884 - RNA, 19 nt, Homo sapiens
gccaauuucucuaguguaa

SEQ ID NO: 721885 - RNA, 19 nt, Homo sapiens
ucaauggcguuucuuguaa

SEQ ID NO: 721886 - RNA, 19 nt, Homo sapiens
gaacugugaguccaauuaa

SEQ ID NO: 721887 - RNA, 19 nt, Homo sapiens
ggaaagcagucuccauagu

SEQ ID NO: 721888 - RNA, 19 nt, Homo sapiens
cgaagauuccugaaauuua

SEQ ID NO: 721889 - RNA, 19 nt, Homo sapiens
ggaacugugaguccaauua

SEQ ID NO: 721890 - RNA, 19 nt, Homo sapiens
gaagagugcuugaccuuuu

SEQ ID NO: 721891 - RNA, 19 nt, Homo sapiens
ucaagucucugcucaaugu

SEQ ID NO: 721892 - RNA, 19 nt, Homo sapiens
ccacuuacaugagauggua

SEQ ID NO: 721893 - RNA, 19 nt, Homo sapiens
ccaaagcagugucucuauu

SEQ ID NO: 721894 - RNA, 19 nt, Homo sapiens
ccacagugauucuuuggaa

SEQ ID NO: 721895 - RNA, 19 nt, Homo sapiens
cagcaagcaucauuucuau

SEQ ID NO: 721896 - RNA, 19 nt, Homo sapiens
aagcaucguucuuucauuu

SEQ ID NO: 721897 - RNA, 19 nt, Homo sapiens
ucugugaccuuuaccauuu

SEQ ID NO: 721898 - RNA, 19 nt, Homo sapiens
aaaugcauguguccacuua

SEQ ID NO: 721899 - RNA, 19 nt, Homo sapiens
gggaauuaaucuacaauca

SEQ ID NO: 721900 - RNA, 19 nt, Homo sapiens
gagcaagcaucguucuuuc

SEQ ID NO: 721901 - RNA, 19 nt, Homo sapiens
caaaucauaucacuucucu

SEQ ID NO: 721902 - RNA, 19 nt, Homo sapiens
gcacuacaauucaaagcau

SEQ ID NO: 721903 - RNA, 19 nt, Homo sapiens
gaaacacuccaaaucuaaa

SEQ ID NO: 721904 - RNA, 19 nt, Homo sapiens
ccaccaugguuguaaguuu

SEQ ID NO: 721905 - RNA, 19 nt, Homo sapiens
caggaaagcagucuccaua

SEQ ID NO: 721906 - RNA, 19 nt, Homo sapiens
ccauccaaaucucaucuua

SEQ ID NO: 721907 - RNA, 19 nt, Homo sapiens
uugcagugcuugccaauuu

SEQ ID NO: 721908 - RNA, 19 nt, Homo sapiens
gacuacagcugaccugguu

SEQ ID NO: 721909 - RNA, 19 nt, Homo sapiens
guaaauguauccagaugag

SEQ ID NO: 721910 - RNA, 19 nt, Homo sapiens
ccagagacaucacccugaa

SEQ ID NO: 721911 - RNA, 19 nt, Homo sapiens
agaagauccuuucauguga

SEQ ID NO: 721912 - RNA, 19 nt, Homo sapiens
gauggaguuucaccuuauu

SEQ ID NO: 721913 - RNA, 19 nt, Homo sapiens
gagaaacaaccugaacuuu

SEQ ID NO: 721914 - RNA, 19 nt, Homo sapiens
ggagcaagcaucguucuuu

SEQ ID NO: 721915 - RNA, 19 nt, Homo sapiens
ggaccacuccucuggcuuu

SEQ ID NO: 721916 - RNA, 19 nt, Homo sapiens
gagacaguauuucuucuag

SEQ ID NO: 721917 - RNA, 19 nt, Homo sapiens
ggagugcaaugucgugauc

SEQ ID NO: 721918 - RNA, 19 nt, Homo sapiens
ccagucaugcuuccuguua

SEQ ID NO: 721919 - RNA, 19 nt, Homo sapiens
gaaagcagucuccauaguc

SEQ ID NO: 721920 - RNA, 19 nt, Homo sapiens
gcagcaagcagucagcaaa

SEQ ID NO: 721921 - RNA, 19 nt, Homo sapiens
gacguucacucucaaguca

SEQ ID NO: 721922 - RNA, 19 nt, Homo sapiens
cagaagauccuuucaugug

SEQ ID NO: 721923 - RNA, 19 nt, Homo sapiens
caauggcguuucuuguaaa

SEQ ID NO: 721924 - RNA, 19 nt, Homo sapiens
ggagacaguauuucuucua

SEQ ID NO: 721925 - RNA, 19 nt, Homo sapiens
gguguuugccucuuucuaa

SEQ ID NO: 721926 - RNA, 19 nt, Homo sapiens
caugagaugguaaauguuu

SEQ ID NO: 721927 - RNA, 19 nt, Homo sapiens
ccacuccucucccauuugu

SEQ ID NO: 721928 - RNA, 19 nt, Homo sapiens
ggacuagcuuccaacaucu

SEQ ID NO: 721929 - RNA, 19 nt, Homo sapiens
agaaggagcuggcgagaac

SEQ ID NO: 721930 - RNA, 19 nt, Homo sapiens
aaacagaaggccugacuga

SEQ ID NO: 721931 - RNA, 19 nt, Homo sapiens
ccaaagugcugggauuaca

SEQ ID NO: 721932 - RNA, 19 nt, Homo sapiens
ucauaucacuucucugcuu

SEQ ID NO: 721933 - RNA, 19 nt, Homo sapiens
cagccagcaucaucucuuu

SEQ ID NO: 721934 - RNA, 19 nt, Homo sapiens
ggcauucuaauuucucuua

SEQ ID NO: 721935 - RNA, 19 nt, Homo sapiens
caaccagauucgaagauuc

SEQ ID NO: 721936 - RNA, 19 nt, Homo sapiens
ggacugccaacuugucuga

SEQ ID NO: 721937 - RNA, 19 nt, Homo sapiens
cucccaaccugaccaauuu

SEQ ID NO: 721938 - RNA, 19 nt, Homo sapiens
augauucucuuuccucuuu

SEQ ID NO: 721939 - RNA, 19 nt, Homo sapiens
gggcagagaaccaggcaaa

SEQ ID NO: 721940 - RNA, 19 nt, Homo sapiens
ccagcaagcaucauuucua

SEQ ID NO: 721941 - RNA, 19 nt, Homo sapiens
caagcaucguucuuucauu

SEQ ID NO: 721942 - RNA, 19 nt, Homo sapiens
gucaauggcguuucuugua

SEQ ID NO: 721943 - RNA, 19 nt, Homo sapiens
aaagcagucuccauaguca

SEQ ID NO: 721944 - RNA, 19 nt, Homo sapiens
ggaaaccucagaguuaaau

SEQ ID NO: 721945 - RNA, 19 nt, Homo sapiens
ugacugcccuuuacaacuc

SEQ ID NO: 721946 - RNA, 19 nt, Homo sapiens
agaaacacuccaaaucuaa

SEQ ID NO: 721947 - RNA, 19 nt, Homo sapiens
caaagcagugucucuauuc

SEQ ID NO: 721948 - RNA, 19 nt, Homo sapiens
uauuauaccuugguguuug

SEQ ID NO: 721949 - RNA, 19 nt, Homo sapiens
gaacucacaaagagaaaca

SEQ ID NO: 721950 - RNA, 19 nt, Homo sapiens
caccacacccagcuaauuu

SEQ ID NO: 721951 - RNA, 19 nt, Homo sapiens
ggaagagugcuugaccuuu

SEQ ID NO: 721952 - RNA, 19 nt, Homo sapiens
uuucagaacucacaaagag

SEQ ID NO: 721953 - RNA, 19 nt, Homo sapiens
ccuaaggucuccagaaugc

SEQ ID NO: 721954 - RNA, 19 nt, Homo sapiens
caaauguagaggacaauga

SEQ ID NO: 721955 - RNA, 19 nt, Homo sapiens
gaucauucugugaccuuua

SEQ ID NO: 721956 - RNA, 19 nt, Homo sapiens
cuggaaaccucagaguuaa

SEQ ID NO: 721957 - RNA, 19 nt, Homo sapiens
uccagaagauccuuucaug

SEQ ID NO: 721958 - RNA, 19 nt, Homo sapiens
caaagcauuagaaacauug

SEQ ID NO: 721959 - RNA, 19 nt, Homo sapiens
acucugcgcugugcuauga

SEQ ID NO: 721960 - RNA, 19 nt, Homo sapiens
caacaucuuaucccuugaa

SEQ ID NO: 721961 - RNA, 19 nt, Homo sapiens
cagaugagguuggaagagu

SEQ ID NO: 721962 - RNA, 19 nt, Homo sapiens
agaguuaaaucccuauucu

SEQ ID NO: 721963 - RNA, 19 nt, Homo sapiens
ccacagucaacuauuugua

SEQ ID NO: 721964 - RNA, 19 nt, Homo sapiens
gcaagcaucguucuuucau

SEQ ID NO: 721965 - RNA, 19 nt, Homo sapiens
gggcccaucaugugguuua

SEQ ID NO: 721966 - RNA, 19 nt, Homo sapiens
caccaugguuguaaguuuc

SEQ ID NO: 721967 - RNA, 19 nt, Homo sapiens
acaaccagauucgaagauu

SEQ ID NO: 721968 - RNA, 19 nt, Homo sapiens
ugagaaacacuccaaaucu

SEQ ID NO: 721969 - RNA, 19 nt, Homo sapiens
gaucucagcacaccagaag

SEQ ID NO: 721970 - RNA, 19 nt, Homo sapiens
cugacgacguggaguuuaa

SEQ ID NO: 721971 - RNA, 19 nt, Homo sapiens
uaccacuccucucccauuu

SEQ ID NO: 721972 - RNA, 19 nt, Homo sapiens
uggcguuucuuguaaaugu

SEQ ID NO: 721973 - RNA, 19 nt, Homo sapiens
ugaagucaauggcguuucu

SEQ ID NO: 721974 - RNA, 19 nt, Homo sapiens
ucagaacucacaaagagaa

SEQ ID NO: 721975 - RNA, 19 nt, Homo sapiens
ggaaagagggaguuaauaa

SEQ ID NO: 721976 - RNA, 19 nt, Homo sapiens
gcacuggccuuaugccuuu

SEQ ID NO: 721977 - RNA, 19 nt, Homo sapiens
ggagauauauugugccuau

SEQ ID NO: 721978 - RNA, 19 nt, Homo sapiens
gaaagagggaguuaauaaa

SEQ ID NO: 721979 - RNA, 19 nt, Homo sapiens
ccagaaaugugaagugcua

SEQ ID NO: 721980 - RNA, 19 nt, Homo sapiens
gaaaggagccagaaaugug

SEQ ID NO: 721981 - RNA, 19 nt, Homo sapiens
gugcugagauuacauguau

SEQ ID NO: 721982 - RNA, 19 nt, Homo sapiens
gaagagaugaagcagcuaa

SEQ ID NO: 721983 - RNA, 19 nt, Homo sapiens
ggagguaacugcuuauagc

SEQ ID NO: 721984 - RNA, 19 nt, Homo sapiens
gaagaugccucugauuggu

SEQ ID NO: 721985 - RNA, 19 nt, Homo sapiens
gugccaagguuucaaguga

SEQ ID NO: 721986 - RNA, 19 nt, Homo sapiens
guguuugacuucaccuuua

SEQ ID NO: 721987 - RNA, 19 nt, Homo sapiens
gcacguggccuggagguaa

SEQ ID NO: 721988 - RNA, 19 nt, Homo sapiens
gcagauugaugacauacuc

SEQ ID NO: 721989 - RNA, 19 nt, Homo sapiens
ggaaugccacccauacuug

SEQ ID NO: 721990 - RNA, 19 nt, Homo sapiens
uggaguaucuggaccugua

SEQ ID NO: 721991 - RNA, 19 nt, Homo sapiens
aaaagcagcuguuaaguau

SEQ ID NO: 721992 - RNA, 19 nt, Homo sapiens
gagaugaagcagcuaaaug

SEQ ID NO: 721993 - RNA, 19 nt, Homo sapiens
gccuggagguaacugcuua

SEQ ID NO: 721994 - RNA, 19 nt, Homo sapiens
ggaaaggagccagaaaugu

SEQ ID NO: 721995 - RNA, 19 nt, Homo sapiens
caacggaaagagggaguua

SEQ ID NO: 721996 - RNA, 19 nt, Homo sapiens
uauauugugccuaugcuua

SEQ ID NO: 721997 - RNA, 19 nt, Homo sapiens
gaaugcugaugggacuaua

SEQ ID NO: 721998 - RNA, 19 nt, Homo sapiens
gcuaaaugcccugaacaaa

SEQ ID NO: 721999 - RNA, 19 nt, Homo sapiens
gcugagauuacauguauga

SEQ ID NO: 722000 - RNA, 19 nt, Homo sapiens
agugcuagcugaaggauga

SEQ ID NO: 722001 - RNA, 19 nt, Homo sapiens
uuaaugacccguacugaga

SEQ ID NO: 722002 - RNA, 19 nt, Homo sapiens
uggaggcacugguggcuaa

SEQ ID NO: 722003 - RNA, 19 nt, Homo sapiens
gcagcuaaaugcccugaac

SEQ ID NO: 722004 - RNA, 19 nt, Homo sapiens
uaaaagcagcuguuaagua

SEQ ID NO: 722005 - RNA, 19 nt, Homo sapiens
cggagugagugaccaaguu

SEQ ID NO: 722006 - RNA, 19 nt, Homo sapiens
ggcauuggcugaaaaguau

SEQ ID NO: 722007 - RNA, 19 nt, Homo sapiens
aaagagggaguuaauaaag

SEQ ID NO: 722008 - RNA, 19 nt, Homo sapiens
gggaguuaauaaagccauu

SEQ ID NO: 722009 - RNA, 19 nt, Homo sapiens
aaaggagccagaaauguga

SEQ ID NO: 722010 - RNA, 19 nt, Homo sapiens
gccaagguuucaagugauc

SEQ ID NO: 722011 - RNA, 19 nt, Homo sapiens
cugaugcacuggccuuaug

SEQ ID NO: 722012 - RNA, 19 nt, Homo sapiens
aagcagcuguuaaguaugc

SEQ ID NO: 722013 - RNA, 19 nt, Homo sapiens
ggagugagugaccaaguuc

SEQ ID NO: 722014 - RNA, 19 nt, Homo sapiens
uaucacuccuucucgaauc

SEQ ID NO: 722015 - RNA, 19 nt, Homo sapiens
ugauugugcugcuaucuac

SEQ ID NO: 722016 - RNA, 19 nt, Homo sapiens
cggaaagagggaguuaaua

SEQ ID NO: 722017 - RNA, 19 nt, Homo sapiens
gaggagcuguuugugacau

SEQ ID NO: 722018 - RNA, 19 nt, Homo sapiens
gauauauugugccuaugcu

SEQ ID NO: 722019 - RNA, 19 nt, Homo sapiens
ccacugcaccuggaaagga

SEQ ID NO: 722020 - RNA, 19 nt, Homo sapiens
cuaaaugcccugaacaaaa

SEQ ID NO: 722021 - RNA, 19 nt, Homo sapiens
cuaccucccagcucuguuu

SEQ ID NO: 722022 - RNA, 19 nt, Homo sapiens
ucucgaauccuucagaaca

SEQ ID NO: 722023 - RNA, 19 nt, Homo sapiens
gaaggaugagcagcagcua

SEQ ID NO: 722024 - RNA, 19 nt, Homo sapiens
ccuuugggcuccucugauc

SEQ ID NO: 722025 - RNA, 19 nt, Homo sapiens
cuucaacagucggcagauu

SEQ ID NO: 722026 - RNA, 19 nt, Homo sapiens
caauggcggcuuccugugu

SEQ ID NO: 722027 - RNA, 19 nt, Homo sapiens
uggaaaggagccagaaaug

SEQ ID NO: 722028 - RNA, 19 nt, Homo sapiens
cugcccaggugcugagauu

SEQ ID NO: 722029 - RNA, 19 nt, Homo sapiens
ggaguuaauaaagccauug

SEQ ID NO: 722030 - RNA, 19 nt, Homo sapiens
gagauauauugugccuaug

SEQ ID NO: 722031 - RNA, 19 nt, Homo sapiens
acagucggcagauugauga

SEQ ID NO: 722032 - RNA, 19 nt, Homo sapiens
gacaaccccuuccccaaga

SEQ ID NO: 722033 - RNA, 19 nt, Homo sapiens
gacuuaagcugaggaucgu

SEQ ID NO: 722034 - RNA, 19 nt, Homo sapiens
gguaaaagcagcuguuaag

SEQ ID NO: 722035 - RNA, 19 nt, Homo sapiens
aauggcggcuuccuguguu

SEQ ID NO: 722036 - RNA, 19 nt, Homo sapiens
ucggcagauugaugacaua

SEQ ID NO: 722037 - RNA, 19 nt, Homo sapiens
cugaugggacuauaugcua

SEQ ID NO: 722038 - RNA, 19 nt, Homo sapiens
uugaugacauacucagugu

SEQ ID NO: 722039 - RNA, 19 nt, Homo sapiens
gcuacgacuccacccacua

SEQ ID NO: 722040 - RNA, 19 nt, Homo sapiens
gagccagaaaugugaagug

SEQ ID NO: 722041 - RNA, 19 nt, Homo sapiens
aagagggaguuaauaaagc

SEQ ID NO: 722042 - RNA, 19 nt, Homo sapiens
gcccagaagagaugaagca

SEQ ID NO: 722043 - RNA, 19 nt, Homo sapiens
guccuggcauuggcugaaa

SEQ ID NO: 722044 - RNA, 19 nt, Homo sapiens
cgacuccacccacuacaag

SEQ ID NO: 722045 - RNA, 19 nt, Homo sapiens
agaagaugccucugauugg

SEQ ID NO: 722046 - RNA, 19 nt, Homo sapiens
cagcagcuagccaggcaaa

SEQ ID NO: 722047 - RNA, 19 nt, Homo sapiens
gguccugccacaacggaaa

SEQ ID NO: 722048 - RNA, 19 nt, Homo sapiens
uggaaugccacccauacuu

SEQ ID NO: 722049 - RNA, 19 nt, Homo sapiens
cgggaggagcuguuuguga

SEQ ID NO: 722050 - RNA, 19 nt, Homo sapiens
gcagcuagccaggcaaagg

SEQ ID NO: 722051 - RNA, 19 nt, Homo sapiens
agaugaagcagcuaaaugc

SEQ ID NO: 722052 - RNA, 19 nt, Homo sapiens
ggugcugagauuacaugua

SEQ ID NO: 722053 - RNA, 19 nt, Homo sapiens
gcuaccgccacauugauug

SEQ ID NO: 722054 - RNA, 19 nt, Homo sapiens
ggucuggguaccuggaaga

SEQ ID NO: 722055 - RNA, 19 nt, Homo sapiens
gaagugcuagcugaaggau

SEQ ID NO: 722056 - RNA, 19 nt, Homo sapiens
ggaaagagggaguuaauaa

SEQ ID NO: 722057 - RNA, 19 nt, Homo sapiens
gcacuggccuuaugccuuu

SEQ ID NO: 722058 - RNA, 19 nt, Homo sapiens
ggagauauauugugccuau

SEQ ID NO: 722059 - RNA, 19 nt, Homo sapiens
gaaagagggaguuaauaaa

SEQ ID NO: 722060 - RNA, 19 nt, Homo sapiens
gaagagaugaagcagcuaa

SEQ ID NO: 722061 - RNA, 19 nt, Homo sapiens
ggagguaacugcuuauagc

SEQ ID NO: 722062 - RNA, 19 nt, Homo sapiens
gaagaugccucugauuggu

SEQ ID NO: 722063 - RNA, 19 nt, Homo sapiens
guguuugacuucaccuuua

SEQ ID NO: 722064 - RNA, 19 nt, Homo sapiens
gcacguggccuggagguaa

SEQ ID NO: 722065 - RNA, 19 nt, Homo sapiens
gcagauugaugacauacuc

SEQ ID NO: 722066 - RNA, 19 nt, Homo sapiens
ggaaugccacccauacuug

SEQ ID NO: 722067 - RNA, 19 nt, Homo sapiens
uggaguaucuggaccugua

SEQ ID NO: 722068 - RNA, 19 nt, Homo sapiens
aaaagcagcuguuaaguau

SEQ ID NO: 722069 - RNA, 19 nt, Homo sapiens
gagaugaagcagcuaaaug

SEQ ID NO: 722070 - RNA, 19 nt, Homo sapiens
gccuggagguaacugcuua

SEQ ID NO: 722071 - RNA, 19 nt, Homo sapiens
caacggaaagagggaguua

SEQ ID NO: 722072 - RNA, 19 nt, Homo sapiens
uauauugugccuaugcuua

SEQ ID NO: 722073 - RNA, 19 nt, Homo sapiens
gaaugcugaugggacuaua

SEQ ID NO: 722074 - RNA, 19 nt, Homo sapiens
gcuaaaugcccugaacaaa

SEQ ID NO: 722075 - RNA, 19 nt, Homo sapiens
uuaaugacccguacugaga

SEQ ID NO: 722076 - RNA, 19 nt, Homo sapiens
uggaggcacugguggcuaa

SEQ ID NO: 722077 - RNA, 19 nt, Homo sapiens
gcagcuaaaugcccugaac

SEQ ID NO: 722078 - RNA, 19 nt, Homo sapiens
uaaaagcagcuguuaagua

SEQ ID NO: 722079 - RNA, 19 nt, Homo sapiens
cggagugagugaccaaguu

SEQ ID NO: 722080 - RNA, 19 nt, Homo sapiens
ggcauuggcugaaaaguau

SEQ ID NO: 722081 - RNA, 19 nt, Homo sapiens
aaagagggaguuaauaaag

SEQ ID NO: 722082 - RNA, 19 nt, Homo sapiens
gggaguuaauaaagccauu

SEQ ID NO: 722083 - RNA, 19 nt, Homo sapiens
cugaugcacuggccuuaug

SEQ ID NO: 722084 - RNA, 19 nt, Homo sapiens
aagcagcuguuaaguaugc

SEQ ID NO: 722085 - RNA, 19 nt, Homo sapiens
ggagugagugaccaaguuc

SEQ ID NO: 722086 - RNA, 19 nt, Homo sapiens
uaucacuccuucucgaauc

SEQ ID NO: 722087 - RNA, 19 nt, Homo sapiens
ugauugugcugcuaucuac

SEQ ID NO: 722088 - RNA, 19 nt, Homo sapiens
cggaaagagggaguuaaua

SEQ ID NO: 722089 - RNA, 19 nt, Homo sapiens
gaggagcuguuugugacau

SEQ ID NO: 722090 - RNA, 19 nt, Homo sapiens
gauauauugugccuaugcu

SEQ ID NO: 722091 - RNA, 19 nt, Homo sapiens
cuaaaugcccugaacaaaa

SEQ ID NO: 722092 - RNA, 19 nt, Homo sapiens
ucucgaauccuucagaaca

SEQ ID NO: 722093 - RNA, 19 nt, Homo sapiens
cuaccucccagcucuguuu

SEQ ID NO: 722094 - RNA, 19 nt, Homo sapiens
ccuuugggcuccucugauc

SEQ ID NO: 722095 - RNA, 19 nt, Homo sapiens
cuucaacagucggcagauu

SEQ ID NO: 722096 - RNA, 19 nt, Homo sapiens
caauggcggcuuccugugu

SEQ ID NO: 722097 - RNA, 19 nt, Homo sapiens
ggaguuaauaaagccauug

SEQ ID NO: 722098 - RNA, 19 nt, Homo sapiens
gagauauauugugccuaug

SEQ ID NO: 722099 - RNA, 19 nt, Homo sapiens
gacuuaagcugaggaucgu

SEQ ID NO: 722100 - RNA, 19 nt, Homo sapiens
acagucggcagauugauga

SEQ ID NO: 722101 - RNA, 19 nt, Homo sapiens
gacaaccccuuccccaaga

SEQ ID NO: 722102 - RNA, 19 nt, Homo sapiens
gguaaaagcagcuguuaag

SEQ ID NO: 722103 - RNA, 19 nt, Homo sapiens
aauggcggcuuccuguguu

SEQ ID NO: 722104 - RNA, 19 nt, Homo sapiens
ucggcagauugaugacaua

SEQ ID NO: 722105 - RNA, 19 nt, Homo sapiens
cugaugggacuauaugcua

SEQ ID NO: 722106 - RNA, 19 nt, Homo sapiens
uugaugacauacucagugu

SEQ ID NO: 722107 - RNA, 19 nt, Homo sapiens
gcuacgacuccacccacua

SEQ ID NO: 722108 - RNA, 19 nt, Homo sapiens
aagagggaguuaauaaagc

SEQ ID NO: 722109 - RNA, 19 nt, Homo sapiens
gcccagaagagaugaagca

SEQ ID NO: 722110 - RNA, 19 nt, Homo sapiens
guccuggcauuggcugaaa

SEQ ID NO: 722111 - RNA, 19 nt, Homo sapiens
cgacuccacccacuacaag

SEQ ID NO: 722112 - RNA, 19 nt, Homo sapiens
agaagaugccucugauugg

SEQ ID NO: 722113 - RNA, 19 nt, Homo sapiens
gguccugccacaacggaaa

SEQ ID NO: 722114 - RNA, 19 nt, Homo sapiens
uggaaugccacccauacuu

SEQ ID NO: 722115 - RNA, 19 nt, Homo sapiens
cgggaggagcuguuuguga

SEQ ID NO: 722116 - RNA, 19 nt, Homo sapiens
agaugaagcagcuaaaugc

SEQ ID NO: 722117 - RNA, 19 nt, Homo sapiens
gcuaccgccacauugauug

SEQ ID NO: 722118 - RNA, 19 nt, Homo sapiens
ggucuggguaccuggaaga

SEQ ID NO: 722119 - RNA, 19 nt, Homo sapiens
gcaagauuguuccuauuaa

SEQ ID NO: 722120 - RNA, 19 nt, Homo sapiens
acagaagccuuuaucguua

SEQ ID NO: 722121 - RNA, 19 nt, Homo sapiens
gugcugagcuguuugagaa

SEQ ID NO: 722122 - RNA, 19 nt, Homo sapiens
agacaucgcuacaauaaau

SEQ ID NO: 722123 - RNA, 19 nt, Homo sapiens
gaauugagagggaaacuuu

SEQ ID NO: 722124 - RNA, 19 nt, Homo sapiens
gcuauaauccuccaaauca

SEQ ID NO: 722125 - RNA, 19 nt, Homo sapiens
ccacuacguugaagaagaa

SEQ ID NO: 722126 - RNA, 19 nt, Homo sapiens
guagacaacaccaaguuua

SEQ ID NO: 722127 - RNA, 19 nt, Homo sapiens
gcagagacccacaccauga

SEQ ID NO: 722128 - RNA, 19 nt, Homo sapiens
gaaagggaaaugaucguuu

SEQ ID NO: 722129 - RNA, 19 nt, Homo sapiens
ggacaaacccagagaucaa

SEQ ID NO: 722130 - RNA, 19 nt, Homo sapiens
ucaguuguauguugcuaua

SEQ ID NO: 722131 - RNA, 19 nt, Homo sapiens
ucagacaucgcuacaauaa

SEQ ID NO: 722132 - RNA, 19 nt, Homo sapiens
guucagacaucgcuacaau

SEQ ID NO: 722133 - RNA, 19 nt, Homo sapiens
uagaagaggugcagacauc

SEQ ID NO: 722134 - RNA, 19 nt, Homo sapiens
gaagguggccuccagaauc

SEQ ID NO: 722135 - RNA, 19 nt, Homo sapiens
gcuacgugauugcugguua

SEQ ID NO: 722136 - RNA, 19 nt, Homo sapiens
ugaaaggguuugugauaca

SEQ ID NO: 722137 - RNA, 19 nt, Homo sapiens
cgugauugcugguuauuau

SEQ ID NO: 722138 - RNA, 19 nt, Homo sapiens
uagaacauuuggucaaguu

SEQ ID NO: 722139 - RNA, 19 nt, Homo sapiens
gcucucacccugauugauu

SEQ ID NO: 722140 - RNA, 19 nt, Homo sapiens
ccugaaaggguuugugaua

SEQ ID NO: 722141 - RNA, 19 nt, Homo sapiens
aaccaaaccuuagggaauu

SEQ ID NO: 722142 - RNA, 19 nt, Homo sapiens
cacagaagccuuuaucguu

SEQ ID NO: 722143 - RNA, 19 nt, Homo sapiens
ccaaugaguguguuuguga

SEQ ID NO: 722144 - RNA, 19 nt, Homo sapiens
ugaguguguuugugaguuu

SEQ ID NO: 722145 - RNA, 19 nt, Homo sapiens
guggaaagcugaccguuuu

SEQ ID NO: 722146 - RNA, 19 nt, Homo sapiens
agagugacgucuguacuuu

SEQ ID NO: 722147 - RNA, 19 nt, Homo sapiens
gauacagcggucacuauuu

SEQ ID NO: 722148 - RNA, 19 nt, Homo sapiens
gugcaagauuguuccuauu

SEQ ID NO: 722149 - RNA, 19 nt, Homo sapiens
uaaccaaaccuuagggaau

SEQ ID NO: 722150 - RNA, 19 nt, Homo sapiens
gacuuagacuucccgaguu

SEQ ID NO: 722151 - RNA, 19 nt, Homo sapiens
gcucguggauuucgauaac

SEQ ID NO: 722152 - RNA, 19 nt, Homo sapiens
gcaaagaucauagcuacgu

SEQ ID NO: 722153 - RNA, 19 nt, Homo sapiens
agagggaaacuuuauggua

SEQ ID NO: 722154 - RNA, 19 nt, Homo sapiens
cagguaggcugggcuguga

SEQ ID NO: 722155 - RNA, 19 nt, Homo sapiens
acacugcgcucaucauggu

SEQ ID NO: 722156 - RNA, 19 nt, Homo sapiens
gaaaggguuugugauacag

SEQ ID NO: 722157 - RNA, 19 nt, Homo sapiens
gaccugaaaggguuuguga

SEQ ID NO: 722158 - RNA, 19 nt, Homo sapiens
ucagagagcgguaccuuuc

SEQ ID NO: 722159 - RNA, 19 nt, Homo sapiens
ugcaagauuguuccuauua

SEQ ID NO: 722160 - RNA, 19 nt, Homo sapiens
caaacccagagaucaauaa

SEQ ID NO: 722161 - RNA, 19 nt, Homo sapiens
cuaaugagcgaguaaagga

SEQ ID NO: 722162 - RNA, 19 nt, Homo sapiens
acaccaaguuuacgaugga

SEQ ID NO: 722163 - RNA, 19 nt, Homo sapiens
gguagacaacaccaaguuu

SEQ ID NO: 722164 - RNA, 19 nt, Homo sapiens
ggaaagggaaaugaucguu

SEQ ID NO: 722165 - RNA, 19 nt, Homo sapiens
cagaagccuuuaucguuag

SEQ ID NO: 722166 - RNA, 19 nt, Homo sapiens
ccuguggacucucucaguu

SEQ ID NO: 722167 - RNA, 19 nt, Homo sapiens
uaaaggaugccaguccaaa

SEQ ID NO: 722168 - RNA, 19 nt, Homo sapiens
auacagcggucacuauuuu

SEQ ID NO: 722169 - RNA, 19 nt, Homo sapiens
uaccuuuccuacugucuuu

SEQ ID NO: 722170 - RNA, 19 nt, Homo sapiens
gaagcucuguguggguguu

SEQ ID NO: 722171 - RNA, 19 nt, Homo sapiens
gagaagguggccuccagaa

SEQ ID NO: 722172 - RNA, 19 nt, Homo sapiens
cuauaauccuccaaaucaa

SEQ ID NO: 722173 - RNA, 19 nt, Homo sapiens
cuacgugauugcugguuau

SEQ ID NO: 722174 - RNA, 19 nt, Homo sapiens
guguuucuguggucaggua

SEQ ID NO: 722175 - RNA, 19 nt, Homo sapiens
ugugcaagauuguuccuau

SEQ ID NO: 722176 - RNA, 19 nt, Homo sapiens
caccaugacuacugugaag

SEQ ID NO: 722177 - RNA, 19 nt, Homo sapiens
cgccuacgauccacgugua

SEQ ID NO: 722178 - RNA, 19 nt, Homo sapiens
ucucuuaacacauaggaaa

SEQ ID NO: 722179 - RNA, 19 nt, Homo sapiens
ugauacagcggucacuauu

SEQ ID NO: 722180 - RNA, 19 nt, Homo sapiens
gaacauuuggucaaguuuu

SEQ ID NO: 722181 - RNA, 19 nt, Homo sapiens
ucacagagccaccgcaacu

SEQ ID NO: 722182 - RNA, 19 nt, Homo sapiens
cgaucggugugaccugaaa

SEQ ID NO: 722183 - RNA, 19 nt, Homo sapiens
ucugguagccuguguggaa

SEQ ID NO: 722184 - RNA, 19 nt, Homo sapiens
ucgauaaccaccuggauga

SEQ ID NO: 722185 - RNA, 19 nt, Homo sapiens
gauugcugguuauuaucaa

SEQ ID NO: 722186 - RNA, 19 nt, Homo sapiens
ggaauugagagggaaacuu

SEQ ID NO: 722187 - RNA, 19 nt, Homo sapiens
ccacagaagccuuuaucgu

SEQ ID NO: 722188 - RNA, 19 nt, Homo sapiens
gcgguaccuuuccuacugu

SEQ ID NO: 722189 - RNA, 19 nt, Homo sapiens
guuguauguugcuauaauc

SEQ ID NO: 722190 - RNA, 19 nt, Homo sapiens
ucacccugauugauucaug

SEQ ID NO: 722191 - RNA, 19 nt, Homo sapiens
gcucuucagccacgcagaa

SEQ ID NO: 722192 - RNA, 19 nt, Homo sapiens
caccacugaugccacagaa

SEQ ID NO: 722193 - RNA, 19 nt, Homo sapiens
cgacacugcgcucaucaug

SEQ ID NO: 722194 - RNA, 19 nt, Homo sapiens
gauaaccaccuggaugaca

SEQ ID NO: 722195 - RNA, 19 nt, Homo sapiens
gacaacaccaaguuuacga

SEQ ID NO: 722196 - RNA, 19 nt, Homo sapiens
uggaggaauuuguaacgau

SEQ ID NO: 722197 - RNA, 19 nt, Homo sapiens
aaacccagagaucaauaaa

SEQ ID NO: 722198 - RNA, 19 nt, Homo sapiens
cggaaugacuggacaaacc

SEQ ID NO: 722199 - RNA, 19 nt, Homo sapiens
ucaagcuaaugagcgagua

SEQ ID NO: 722200 - RNA, 19 nt, Homo sapiens
caagcuaaugagcgaguaa

SEQ ID NO: 722201 - RNA, 19 nt, Homo sapiens
aaucuggagagaauacuuu

SEQ ID NO: 722202 - RNA, 19 nt, Homo sapiens
acaaacccagagaucaaua

SEQ ID NO: 722203 - RNA, 19 nt, Homo sapiens
gacaaacccagagaucaau

SEQ ID NO: 722204 - RNA, 19 nt, Homo sapiens
gugcagagacccacaccau

SEQ ID NO: 722205 - RNA, 19 nt, Homo sapiens
gauucauggugcaaagauc

SEQ ID NO: 722206 - RNA, 19 nt, Homo sapiens
caucuuauacuccaaugag

SEQ ID NO: 722207 - RNA, 19 nt, Homo sapiens
guaaaggaugccaguccaa

SEQ ID NO: 722208 - RNA, 19 nt, Homo sapiens
gguagcaggagcucagugu

SEQ ID NO: 722209 - RNA, 19 nt, Homo sapiens
uccacuacguugaagaaga

SEQ ID NO: 722210 - RNA, 19 nt, Homo sapiens
gagacccacaccaugacua

SEQ ID NO: 722211 - RNA, 19 nt, Homo sapiens
gagagcgguaccuuuccua

SEQ ID NO: 722212 - RNA, 19 nt, Homo sapiens
ggugcaaagaucauagcua

SEQ ID NO: 722213 - RNA, 19 nt, Homo sapiens
ccaggaaagggaaaugauc

SEQ ID NO: 722214 - RNA, 19 nt, Homo sapiens
uguacgagcaccaugagaa

SEQ ID NO: 722215 - RNA, 19 nt, Homo sapiens
uggacucucucaguuguau

SEQ ID NO: 722216 - RNA, 19 nt, Homo sapiens
uguggacucucucaguugu

SEQ ID NO: 722217 - RNA, 19 nt, Homo sapiens
gcugguuauuaucaagcua

SEQ ID NO: 722218 - RNA, 19 nt, Homo sapiens
cugaaaggguuugugauac

SEQ ID NO: 722219 - RNA, 19 nt, Homo sapiens
ggaaacaaaugaaagucuu

SEQ ID NO: 722220 - RNA, 19 nt, Homo sapiens
gauaagcuuuguuggguuu

SEQ ID NO: 722221 - RNA, 19 nt, Homo sapiens
gaugagaggccauauuuau

SEQ ID NO: 722222 - RNA, 19 nt, Homo sapiens
gagcaacaacacagauuua

SEQ ID NO: 722223 - RNA, 19 nt, Homo sapiens
ggugcucccuuuaucuuua

SEQ ID NO: 722224 - RNA, 19 nt, Homo sapiens
ggaacucccugcuguuuua

SEQ ID NO: 722225 - RNA, 19 nt, Homo sapiens
gauaaacccauuccucaaa

SEQ ID NO: 722226 - RNA, 19 nt, Homo sapiens
ucaguggccuuuaggagua

SEQ ID NO: 722227 - RNA, 19 nt, Homo sapiens
agacagagcuuaaaaugaa

SEQ ID NO: 722228 - RNA, 19 nt, Homo sapiens
ggaagcggcucugcucguu

SEQ ID NO: 722229 - RNA, 19 nt, Homo sapiens
gaagaacacaguacagcuu

SEQ ID NO: 722230 - RNA, 19 nt, Homo sapiens
aaacagaucucaguguaca

SEQ ID NO: 722231 - RNA, 19 nt, Homo sapiens
gcaacaacacagauuuaaa

SEQ ID NO: 722232 - RNA, 19 nt, Homo sapiens
cggcucugcucguuucuua

SEQ ID NO: 722233 - RNA, 19 nt, Homo sapiens
gcuggcaacugugggaaua

SEQ ID NO: 722234 - RNA, 19 nt, Homo sapiens
agaaugcuaucgaaucuau

SEQ ID NO: 722235 - RNA, 19 nt, Homo sapiens
guagcaacauacaggaauu

SEQ ID NO: 722236 - RNA, 19 nt, Homo sapiens
ggaacgauaagcuuuguug

SEQ ID NO: 722237 - RNA, 19 nt, Homo sapiens
aaauguuacuucaguggua

SEQ ID NO: 722238 - RNA, 19 nt, Homo sapiens
guccaugggugcucccuuu

SEQ ID NO: 722239 - RNA, 19 nt, Homo sapiens
gauaaugaguggauaaacc

SEQ ID NO: 722240 - RNA, 19 nt, Homo sapiens
gaugggaacgauaagcuuu

SEQ ID NO: 722241 - RNA, 19 nt, Homo sapiens
gauaaauccacgaaaggaa

SEQ ID NO: 722242 - RNA, 19 nt, Homo sapiens
uuagauaaauccacgaaag

SEQ ID NO: 722243 - RNA, 19 nt, Homo sapiens
ggaggcaaguuggucaaug

SEQ ID NO: 722244 - RNA, 19 nt, Homo sapiens
gccgagaacaguccacuuu

SEQ ID NO: 722245 - RNA, 19 nt, Homo sapiens
guacuucuccguugaugug

SEQ ID NO: 722246 - RNA, 19 nt, Homo sapiens
cuaugaggcuugcuccuau

SEQ ID NO: 722247 - RNA, 19 nt, Homo sapiens
gacaggcacuaaugaacau

SEQ ID NO: 722248 - RNA, 19 nt, Homo sapiens
ugaauaaugugguacucau

SEQ ID NO: 722249 - RNA, 19 nt, Homo sapiens
ggaaagugaagaauggaau

SEQ ID NO: 722250 - RNA, 19 nt, Homo sapiens
gaaggaacucccugcuguu

SEQ ID NO: 722251 - RNA, 19 nt, Homo sapiens
ggagcugcuuuucauaaua

SEQ ID NO: 722252 - RNA, 19 nt, Homo sapiens
ggauaaacccauuccucaa

SEQ ID NO: 722253 - RNA, 19 nt, Homo sapiens
agaaggaaagucaaucgua

SEQ ID NO: 722254 - RNA, 19 nt, Homo sapiens
ggagagaaggaaagucaau

SEQ ID NO: 722255 - RNA, 19 nt, Homo sapiens
cgaugugacugcucaaugg

SEQ ID NO: 722256 - RNA, 19 nt, Homo sapiens
cgagaacaguccacuuugg

SEQ ID NO: 722257 - RNA, 19 nt, Homo sapiens
gaguaaacacagaaugcua

SEQ ID NO: 722258 - RNA, 19 nt, Homo sapiens
acagaaugcuaucgaaucu

SEQ ID NO: 722259 - RNA, 19 nt, Homo sapiens
ugaugugaauaauguggua

SEQ ID NO: 722260 - RNA, 19 nt, Homo sapiens
gaaagugaagaauggaauc

SEQ ID NO: 722261 - RNA, 19 nt, Homo sapiens
gaggcaaguuggucaaugc

SEQ ID NO: 722262 - RNA, 19 nt, Homo sapiens
gagcugcuuuucauaauau

SEQ ID NO: 722263 - RNA, 19 nt, Homo sapiens
ccguugaugugaauaaugu

SEQ ID NO: 722264 - RNA, 19 nt, Homo sapiens
uuugaaggcuuacuugauc

SEQ ID NO: 722265 - RNA, 19 nt, Homo sapiens
caggguacuucuccguuga

SEQ ID NO: 722266 - RNA, 19 nt, Homo sapiens
ccagacaggcacuaaugaa

SEQ ID NO: 722267 - RNA, 19 nt, Homo sapiens
caugggugcucccuuuauc

SEQ ID NO: 722268 - RNA, 19 nt, Homo sapiens
cuuaagaauuaccaagaug

SEQ ID NO: 722269 - RNA, 19 nt, Homo sapiens
ggauuaaugacguggaugu

SEQ ID NO: 722270 - RNA, 19 nt, Homo sapiens
gugguuacuuuaugcacaa

SEQ ID NO: 722271 - RNA, 19 nt, Homo sapiens
guacaaaucuggggcaaag

SEQ ID NO: 722272 - RNA, 19 nt, Homo sapiens
gaagcggcucugcucguuu

SEQ ID NO: 722273 - RNA, 19 nt, Homo sapiens
uaugacagccccuggauua

SEQ ID NO: 722274 - RNA, 19 nt, Homo sapiens
gaucucaguguacaaaucu

SEQ ID NO: 722275 - RNA, 19 nt, Homo sapiens
aaacacagaaugcuaucga

SEQ ID NO: 722276 - RNA, 19 nt, Homo sapiens
ugaugagaggccauauuua

SEQ ID NO: 722277 - RNA, 19 nt, Homo sapiens
uuaaugacguggauguuuu

SEQ ID NO: 722278 - RNA, 19 nt, Homo sapiens
ugagcaacaacacagauuu

SEQ ID NO: 722279 - RNA, 19 nt, Homo sapiens
gugcucccuuuaucuuuau

SEQ ID NO: 722280 - RNA, 19 nt, Homo sapiens
auaaauccacgaaaggaaa

SEQ ID NO: 722281 - RNA, 19 nt, Homo sapiens
ccucaggaaacaaaugaaa

SEQ ID NO: 722282 - RNA, 19 nt, Homo sapiens
augaugagaggccauauuu

SEQ ID NO: 722283 - RNA, 19 nt, Homo sapiens
aagcggcucugcucguuuc

SEQ ID NO: 722284 - RNA, 19 nt, Homo sapiens
guaggaagaacacaguaca

SEQ ID NO: 722285 - RNA, 19 nt, Homo sapiens
cuuuaggaguagcaacaua

SEQ ID NO: 722286 - RNA, 19 nt, Homo sapiens
gcaucuugcuguuguuuug

SEQ ID NO: 722287 - RNA, 19 nt, Homo sapiens
gaacacaguacagcuucau

SEQ ID NO: 722288 - RNA, 19 nt, Homo sapiens
gcucugcucguuucuuauc

SEQ ID NO: 722289 - RNA, 19 nt, Homo sapiens
ucaggaaacaaaugaaagu

SEQ ID NO: 722290 - RNA, 19 nt, Homo sapiens
gguggaugccugacuggaa

SEQ ID NO: 722291 - RNA, 19 nt, Homo sapiens
ggaaagucaaucguaggaa

SEQ ID NO: 722292 - RNA, 19 nt, Homo sapiens
caagacagagcuuaaaaug

SEQ ID NO: 722293 - RNA, 19 nt, Homo sapiens
gguaucagcacuucaagac

SEQ ID NO: 722294 - RNA, 19 nt, Homo sapiens
ccucugcaguuacucaagu

SEQ ID NO: 722295 - RNA, 19 nt, Homo sapiens
gcgaugugacugcucaaug

SEQ ID NO: 722296 - RNA, 19 nt, Homo sapiens
gcacuucaagacagagcuu

SEQ ID NO: 722297 - RNA, 19 nt, Homo sapiens
gcaacugugggaauacauc

SEQ ID NO: 722298 - RNA, 19 nt, Homo sapiens
agacaggcacuaaugaaca

SEQ ID NO: 722299 - RNA, 19 nt, Homo sapiens
uguaauuucuuaggaacga

SEQ ID NO: 722300 - RNA, 19 nt, Homo sapiens
gcccuguacugccuauucu

SEQ ID NO: 722301 - RNA, 19 nt, Homo sapiens
ggucggaguaaacacagaa

SEQ ID NO: 722302 - RNA, 19 nt, Homo sapiens
caugaugagaggccauauu

SEQ ID NO: 722303 - RNA, 19 nt, Homo sapiens
gaguagcaacauacaggaa

SEQ ID NO: 722304 - RNA, 19 nt, Homo sapiens
ucuuaggaacgauuuauga

SEQ ID NO: 722305 - RNA, 19 nt, Homo sapiens
gacagccccuggauuaaug

SEQ ID NO: 722306 - RNA, 19 nt, Homo sapiens
gugauaaugaguggauaaa

SEQ ID NO: 722307 - RNA, 19 nt, Homo sapiens
acagaucucaguguacaaa

SEQ ID NO: 722308 - RNA, 19 nt, Homo sapiens
uuuggaaagugaagaaugg

SEQ ID NO: 722309 - RNA, 19 nt, Homo sapiens
aaggaacucccugcuguuu

SEQ ID NO: 722310 - RNA, 19 nt, Homo sapiens
uagcaacauacaggaauuu

SEQ ID NO: 722311 - RNA, 19 nt, Homo sapiens
agugaagaauggaauccuu

SEQ ID NO: 722312 - RNA, 19 nt, Homo sapiens
acacaguacagcuucauca

SEQ ID NO: 722313 - RNA, 19 nt, Homo sapiens
gagagaaggaaagucaauc

SEQ ID NO: 722314 - RNA, 19 nt, Homo sapiens
uaugaggcuugcuccuaug

SEQ ID NO: 722315 - RNA, 19 nt, Homo sapiens
cacagaaugcuaucgaauc

SEQ ID NO: 722316 - RNA, 19 nt, Homo sapiens
guaaacacagaaugcuauc

SEQ ID NO: 722317 - RNA, 19 nt, Homo sapiens
aaugcuaucgaaucuauga

SEQ ID NO: 722318 - RNA, 19 nt, Homo sapiens
aguaaacacagaaugcuau

SEQ ID NO: 722319 - RNA, 19 nt, Homo sapiens
gaacuagaaugggaaauug

SEQ ID NO: 722320 - RNA, 19 nt, Homo sapiens
cgaaucgacucagauauua

SEQ ID NO: 722321 - RNA, 19 nt, Homo sapiens
gcagggcucugguggauga

SEQ ID NO: 722322 - RNA, 19 nt, Homo sapiens
gcgaagcgcucuggagaau

SEQ ID NO: 722323 - RNA, 19 nt, Homo sapiens
gcacauaucgcaugaugag

SEQ ID NO: 722324 - RNA, 19 nt, Homo sapiens
ccgagaggcugacaauguu

SEQ ID NO: 722325 - RNA, 19 nt, Homo sapiens
ccauuacgcuaaagaugaa

SEQ ID NO: 722326 - RNA, 19 nt, Homo sapiens
caagaacuacguacgugua

SEQ ID NO: 722327 - RNA, 19 nt, Homo sapiens
gaccaugcccugcacauau

SEQ ID NO: 722328 - RNA, 19 nt, Homo sapiens
gagccaggaucuccacugu

SEQ ID NO: 722329 - RNA, 19 nt, Homo sapiens
caagaagaccauucagaug

SEQ ID NO: 722330 - RNA, 19 nt, Homo sapiens
ccaagaagaccauucagau

SEQ ID NO: 722331 - RNA, 19 nt, Homo sapiens
gaagcgcucuggagaaucc

SEQ ID NO: 722332 - RNA, 19 nt, Homo sapiens
gcaguaagcgaacagaucu

SEQ ID NO: 722333 - RNA, 19 nt, Homo sapiens
ccgaaucgacucagauauu

SEQ ID NO: 722334 - RNA, 19 nt, Homo sapiens
cauaucgcaugaugagcua

SEQ ID NO: 722335 - RNA, 19 nt, Homo sapiens
gagaggcugacaauguuaa

SEQ ID NO: 722336 - RNA, 19 nt, Homo sapiens
ucugguggaugaacuagaa

SEQ ID NO: 722337 - RNA, 19 nt, Homo sapiens
uagcggcacccucaaguuu

SEQ ID NO: 722338 - RNA, 19 nt, Homo sapiens
ggaggaauacgaggaugaa

SEQ ID NO: 722339 - RNA, 19 nt, Homo sapiens
ggaauacgaggaugaacuc

SEQ ID NO: 722340 - RNA, 19 nt, Homo sapiens
gugaccggaugaaggagua

SEQ ID NO: 722341 - RNA, 19 nt, Homo sapiens
ccacccaucgcaagaacua

SEQ ID NO: 722342 - RNA, 19 nt, Homo sapiens
ugaacuagaaugggaaauu

SEQ ID NO: 722343 - RNA, 19 nt, Homo sapiens
gcagccagguguaguuucg

SEQ ID NO: 722344 - RNA, 19 nt, Homo sapiens
cugcacauaucgcaugaug

SEQ ID NO: 722345 - RNA, 19 nt, Homo sapiens
uaagcgaacagaucuuugu

SEQ ID NO: 722346 - RNA, 19 nt, Homo sapiens
cgagaggcugacaauguua

SEQ ID NO: 722347 - RNA, 19 nt, Homo sapiens
ccgcuuagguaccaguuag

SEQ ID NO: 722348 - RNA, 19 nt, Homo sapiens
agagcauuguggaggaaua

SEQ ID NO: 722349 - RNA, 19 nt, Homo sapiens
gaacagauugauccuucca

SEQ ID NO: 722350 - RNA, 19 nt, Homo sapiens
gcauccgaaucgacucaga

SEQ ID NO: 722351 - RNA, 19 nt, Homo sapiens
gaugaacuagaaugggaaa

SEQ ID NO: 722352 - RNA, 19 nt, Homo sapiens
cugacaauguuaaagacaa

SEQ ID NO: 722353 - RNA, 19 nt, Homo sapiens
ccuguucgcgcgagaguuu

SEQ ID NO: 722354 - RNA, 19 nt, Homo sapiens
cuacaaggcauccgaaucg

SEQ ID NO: 722355 - RNA, 19 nt, Homo sapiens
cccauuacgcuaaagauga

SEQ ID NO: 722356 - RNA, 19 nt, Homo sapiens
ugaccaugcccugcacaua

SEQ ID NO: 722357 - RNA, 19 nt, Homo sapiens
cagagcugcuggaggagau

SEQ ID NO: 722358 - RNA, 19 nt, Homo sapiens
ugagagcauuguggaggaa

SEQ ID NO: 722359 - RNA, 19 nt, Homo sapiens
uaugugaccggaugaagga

SEQ ID NO: 722360 - RNA, 19 nt, Homo sapiens
cccgagaggcugacaaugu

SEQ ID NO: 722361 - RNA, 19 nt, Homo sapiens
gaaucgacucagauauuag

SEQ ID NO: 722362 - RNA, 19 nt, Homo sapiens
guggucacguggaucuguu

SEQ ID NO: 722363 - RNA, 19 nt, Homo sapiens
guaagcgaacagaucuuug

SEQ ID NO: 722364 - RNA, 19 nt, Homo sapiens
aggcugacaauguuaaaga

SEQ ID NO: 722365 - RNA, 19 nt, Homo sapiens
gcggcacccucaaguuugc

SEQ ID NO: 722366 - RNA, 19 nt, Homo sapiens
gagauaugugaccggauga

SEQ ID NO: 722367 - RNA, 19 nt, Homo sapiens
ccagagaggugguggaaua

SEQ ID NO: 722368 - RNA, 19 nt, Homo sapiens
gggcuggaaugaucuuuaa

SEQ ID NO: 722369 - RNA, 19 nt, Homo sapiens
gagcugacgugagaaauau

SEQ ID NO: 722370 - RNA, 19 nt, Homo sapiens
ccaggaagcugagaccuuu

SEQ ID NO: 722371 - RNA, 19 nt, Homo sapiens
ggaggcaaguguccuuuga

SEQ ID NO: 722372 - RNA, 19 nt, Homo sapiens
acauagagcugacgugaga

SEQ ID NO: 722373 - RNA, 19 nt, Homo sapiens
acacagaucuacugaguca

SEQ ID NO: 722374 - RNA, 19 nt, Homo sapiens
guccugaucuuaacccuuu

SEQ ID NO: 722375 - RNA, 19 nt, Homo sapiens
gggaucaaaugcuguaaug

SEQ ID NO: 722376 - RNA, 19 nt, Homo sapiens
gagguuugaugagugaaua

SEQ ID NO: 722377 - RNA, 19 nt, Homo sapiens
caacaccuguccuccuuug

SEQ ID NO: 722378 - RNA, 19 nt, Homo sapiens
gcaaucagacacagaucua

SEQ ID NO: 722379 - RNA, 19 nt, Homo sapiens
gagaggugguggaauagga

SEQ ID NO: 722380 - RNA, 19 nt, Homo sapiens
guaugugucuggagcuuga

SEQ ID NO: 722381 - RNA, 19 nt, Homo sapiens
agacacagaucuacugagu

SEQ ID NO: 722382 - RNA, 19 nt, Homo sapiens
gcucucaccuacucacaga

SEQ ID NO: 722383 - RNA, 19 nt, Homo sapiens
cagggaagguuugagguuu

SEQ ID NO: 722384 - RNA, 19 nt, Homo sapiens
gaucaaaugcuguaauggu

SEQ ID NO: 722385 - RNA, 19 nt, Homo sapiens
ucagacaacucagaagguu

SEQ ID NO: 722386 - RNA, 19 nt, Homo sapiens
gugcaccgcuuccuaccuu

SEQ ID NO: 722387 - RNA, 19 nt, Homo sapiens
aaacccaccugguacuguu

SEQ ID NO: 722388 - RNA, 19 nt, Homo sapiens
gggaagguuugagguuuga

SEQ ID NO: 722389 - RNA, 19 nt, Homo sapiens
gagcugagaggagcaggua

SEQ ID NO: 722390 - RNA, 19 nt, Homo sapiens
aggcaaguguccuuugaaa

SEQ ID NO: 722391 - RNA, 19 nt, Homo sapiens
gugguuuaauggcagauaa

SEQ ID NO: 722392 - RNA, 19 nt, Homo sapiens
caccugcagugguuuaaug

SEQ ID NO: 722393 - RNA, 19 nt, Homo sapiens
cuuccuaccuuaugagaug

SEQ ID NO: 722394 - RNA, 19 nt, Homo sapiens
cagagguggugacucagaa

SEQ ID NO: 722395 - RNA, 19 nt, Homo sapiens
ugccagagguggugacuca

SEQ ID NO: 722396 - RNA, 19 nt, Homo sapiens
gaugacgucuuugcacaca

SEQ ID NO: 722397 - RNA, 19 nt, Homo sapiens
gcuggaaugaucuuuaaug

SEQ ID NO: 722398 - RNA, 19 nt, Homo sapiens
gaacuuccuccuguacaga

SEQ ID NO: 722399 - RNA, 19 nt, Homo sapiens
ggagugccagggaagguuu

SEQ ID NO: 722400 - RNA, 19 nt, Homo sapiens
agagcugacgugagaaaua

SEQ ID NO: 722401 - RNA, 19 nt, Homo sapiens
cagaagugccugugcuaga

SEQ ID NO: 722402 - RNA, 19 nt, Homo sapiens
gaagguuugagguuugaug

SEQ ID NO: 722403 - RNA, 19 nt, Homo sapiens
cgcaacaccuguccuccuu

SEQ ID NO: 722404 - RNA, 19 nt, Homo sapiens
gagcgguacccacccuauu

SEQ ID NO: 722405 - RNA, 19 nt, Homo sapiens
ugacgugagaaauaucuuu

SEQ ID NO: 722406 - RNA, 19 nt, Homo sapiens
gguuugagguuugaugagu

SEQ ID NO: 722407 - RNA, 19 nt, Homo sapiens
gcugagaggagcagguaga

SEQ ID NO: 722408 - RNA, 19 nt, Homo sapiens
ugacgucuuugcacacaca

SEQ ID NO: 722409 - RNA, 19 nt, Homo sapiens
guacuguuccagcaucuuc

SEQ ID NO: 722410 - RNA, 19 nt, Homo sapiens
caaccucaccugcggcaau

SEQ ID NO: 722411 - RNA, 19 nt, Homo sapiens
gcaacaccuguccuccuuu

SEQ ID NO: 722412 - RNA, 19 nt, Homo sapiens
gaggaacuccagaaaauau

SEQ ID NO: 722413 - RNA, 19 nt, Homo sapiens
ccagggaagguuugagguu

SEQ ID NO: 722414 - RNA, 19 nt, Homo sapiens
ccacgacuccuucuucaac

SEQ ID NO: 722415 - RNA, 19 nt, Homo sapiens
cuggaaugaucuuuaaugg

SEQ ID NO: 722416 - RNA, 19 nt, Homo sapiens
agaagugccugugcuagag

SEQ ID NO: 722417 - RNA, 19 nt, Homo sapiens
gaggcaaguguccuuugaa

SEQ ID NO: 722418 - RNA, 19 nt, Homo sapiens
augcauccgucccguuuga

SEQ ID NO: 722419 - RNA, 19 nt, Homo sapiens
gcaccgcuuccuaccuuau

SEQ ID NO: 722420 - RNA, 19 nt, Homo sapiens
uuugagguuugaugaguga

SEQ ID NO: 722421 - RNA, 19 nt, Homo sapiens
agggaagguuugagguuug

SEQ ID NO: 722422 - RNA, 19 nt, Homo sapiens
guuccaggccagccagaaa

SEQ ID NO: 722423 - RNA, 19 nt, Homo sapiens
uggccaggaugaaguaucu

SEQ ID NO: 722424 - RNA, 19 nt, Homo sapiens
ccagagguggugacucaga

SEQ ID NO: 722425 - RNA, 19 nt, Homo sapiens
cagacacugccgccacuuu

SEQ ID NO: 722426 - RNA, 19 nt, Homo sapiens
uuacuugugggaucaaaug

SEQ ID NO: 722427 - RNA, 19 nt, Homo sapiens
ccucugggcuccuguuucc

SEQ ID NO: 722428 - RNA, 19 nt, Homo sapiens
gcacagacucacggagaca

SEQ ID NO: 722429 - RNA, 19 nt, Homo sapiens
gagggaggcaaguguccuu

SEQ ID NO: 722430 - RNA, 19 nt, Homo sapiens
uaagcuccgucugcaguuc

SEQ ID NO: 722431 - RNA, 19 nt, Homo sapiens
gaagugccugugcuagagu

SEQ ID NO: 722432 - RNA, 19 nt, Homo sapiens
cuggauggcuggaggaacu

SEQ ID NO: 722433 - RNA, 19 nt, Homo sapiens
gagguggugacucagaaug

SEQ ID NO: 722434 - RNA, 19 nt, Homo sapiens
ccaguauguuuuacagauu

SEQ ID NO: 722435 - RNA, 19 nt, Homo sapiens
ccucuucagucugcuagug

SEQ ID NO: 722436 - RNA, 19 nt, Homo sapiens
gcuggugcaccgcuuccua

SEQ ID NO: 722437 - RNA, 19 nt, Homo sapiens
gggaggcaaguguccuuug

SEQ ID NO: 722438 - RNA, 19 nt, Homo sapiens
ucacagacgggaugcuaag

SEQ ID NO: 722439 - RNA, 19 nt, Homo sapiens
gggcuccuguuuccauagg

SEQ ID NO: 722440 - RNA, 19 nt, Homo sapiens
gaugugacguugacaauua

SEQ ID NO: 722441 - RNA, 19 nt, Homo sapiens
gaacuucacccacuuguaa

SEQ ID NO: 722442 - RNA, 19 nt, Homo sapiens
gcaaaucuaucaagaacug

SEQ ID NO: 722443 - RNA, 19 nt, Homo sapiens
caaggaaacuguuacuuca

SEQ ID NO: 722444 - RNA, 19 nt, Homo sapiens
gcagauacauggccacaag

SEQ ID NO: 722445 - RNA, 19 nt, Homo sapiens
gaacugaccgauuugaaga

SEQ ID NO: 722446 - RNA, 19 nt, Homo sapiens
ugaaggagcucaucuugca

SEQ ID NO: 722447 - RNA, 19 nt, Homo sapiens
gaaccugggucuuauucug

SEQ ID NO: 722448 - RNA, 19 nt, Homo sapiens
gagauuagacuauuuggau

SEQ ID NO: 722449 - RNA, 19 nt, Homo sapiens
gaugggacuuucagaccua

SEQ ID NO: 722450 - RNA, 19 nt, Homo sapiens
cuauacaugucuuccauuu

SEQ ID NO: 722451 - RNA, 19 nt, Homo sapiens
guguagagcuuguguucuu

SEQ ID NO: 722452 - RNA, 19 nt, Homo sapiens
ugaagacugugcggaauuu

SEQ ID NO: 722453 - RNA, 19 nt, Homo sapiens
gcccauccuuggagcuuua

SEQ ID NO: 722454 - RNA, 19 nt, Homo sapiens
cagcaaaucuaucaagaac

SEQ ID NO: 722455 - RNA, 19 nt, Homo sapiens
ggaagcaccagggaauuaa

SEQ ID NO: 722456 - RNA, 19 nt, Homo sapiens
ccuuggagcuuuauaagug

SEQ ID NO: 722457 - RNA, 19 nt, Homo sapiens
gaaccugacccagcuuaaa

SEQ ID NO: 722458 - RNA, 19 nt, Homo sapiens
aucaagaacugaccgauuu

SEQ ID NO: 722459 - RNA, 19 nt, Homo sapiens
ccaagcagcagcaaaucua

SEQ ID NO: 722460 - RNA, 19 nt, Homo sapiens
ccuaugaaccugggucuua

SEQ ID NO: 722461 - RNA, 19 nt, Homo sapiens
ggaaacuguuacuucaugu

SEQ ID NO: 722462 - RNA, 19 nt, Homo sapiens
ccaaggaaacuguuacuuc

SEQ ID NO: 722463 - RNA, 19 nt, Homo sapiens
cuauuuggauucaugugua

SEQ ID NO: 722464 - RNA, 19 nt, Homo sapiens
caagagacuuucaauucca

SEQ ID NO: 722465 - RNA, 19 nt, Homo sapiens
gcagcaaaucuaucaagaa

SEQ ID NO: 722466 - RNA, 19 nt, Homo sapiens
auacaugucuuccauuugg

SEQ ID NO: 722467 - RNA, 19 nt, Homo sapiens
guggagaacccaacaauag

SEQ ID NO: 722468 - RNA, 19 nt, Homo sapiens
cagccuccauugugguaua

SEQ ID NO: 722469 - RNA, 19 nt, Homo sapiens
cuucagagacgaauaguug

SEQ ID NO: 722470 - RNA, 19 nt, Homo sapiens
caucuuucuuuguccuaua

SEQ ID NO: 722471 - RNA, 19 nt, Homo sapiens
ccaagagacuuucaauucc

SEQ ID NO: 722472 - RNA, 19 nt, Homo sapiens
ggacggcucaccucuguca

SEQ ID NO: 722473 - RNA, 19 nt, Homo sapiens
cugcagacuuccaggagua

SEQ ID NO: 722474 - RNA, 19 nt, Homo sapiens
ugaguuguagccuuuauaa

SEQ ID NO: 722475 - RNA, 19 nt, Homo sapiens
uuucugaguuguagccuuu

SEQ ID NO: 722476 - RNA, 19 nt, Homo sapiens
gggcccagcucgucguaau

SEQ ID NO: 722477 - RNA, 19 nt, Homo sapiens
aauccaagcugcaggagau

SEQ ID NO: 722478 - RNA, 19 nt, Homo sapiens
aauccaagcugcaggagau

SEQ ID NO: 722479 - RNA, 19 nt, Homo sapiens
aauccaagcugcaggagau

SEQ ID NO: 722480 - RNA, 19 nt, Homo sapiens
aauccaagcugcaggagau

SEQ ID NO: 722481 - RNA, 19 nt, Homo sapiens
aauccaagcugcaggagau

SEQ ID NO: 722482 - RNA, 19 nt, Homo sapiens
ggcuugguauguuguauga

SEQ ID NO: 722483 - RNA, 19 nt, Homo sapiens
gaagacugugcggaauuua

SEQ ID NO: 722484 - RNA, 19 nt, Homo sapiens
uccaagagacuuucaauuc

SEQ ID NO: 722485 - RNA, 19 nt, Homo sapiens
acuguuacuucaugucuaa

SEQ ID NO: 722486 - RNA, 19 nt, Homo sapiens
guggacggcucaccucugu

SEQ ID NO: 722487 - RNA, 19 nt, Homo sapiens
uuugaagacugcauuugaa

SEQ ID NO: 722488 - RNA, 19 nt, Homo sapiens
uagacuauuuggauucaug

SEQ ID NO: 722489 - RNA, 19 nt, Homo sapiens
aggaaacuguuacuucaug

SEQ ID NO: 722490 - RNA, 19 nt, Homo sapiens
gaagaagauccaacaacca

SEQ ID NO: 722491 - RNA, 19 nt, Homo sapiens
uggaagcaccagggaauua

SEQ ID NO: 722492 - RNA, 19 nt, Homo sapiens
caaacuaccaucugcucaa

SEQ ID NO: 722493 - RNA, 19 nt, Homo sapiens
gcagaacuucacccacuug

SEQ ID NO: 722494 - RNA, 19 nt, Homo sapiens
ggaacgacaaucgauguga

SEQ ID NO: 722495 - RNA, 19 nt, Homo sapiens
uagcgggaaugaagacugu

SEQ ID NO: 722496 - RNA, 19 nt, Homo sapiens
ucugaugccuccaaguuuc

SEQ ID NO: 722497 - RNA, 19 nt, Homo sapiens
guaugaauccacucucugu

SEQ ID NO: 722498 - RNA, 19 nt, Homo sapiens
cuugguauguuguaugaau

SEQ ID NO: 722499 - RNA, 19 nt, Homo sapiens
uaucaagaacugaccgauu

SEQ ID NO: 722500 - RNA, 19 nt, Homo sapiens
ggacuugcugguugaagga

SEQ ID NO: 722501 - RNA, 19 nt, Homo sapiens
gauuagacuauuuggauuc

SEQ ID NO: 722502 - RNA, 19 nt, Homo sapiens
ugagugggaugcauuuagg

SEQ ID NO: 722503 - RNA, 19 nt, Homo sapiens
cuaugaaccugggucuuau

SEQ ID NO: 722504 - RNA, 19 nt, Homo sapiens
gaagcaccagggaauuaau

SEQ ID NO: 722505 - RNA, 19 nt, Homo sapiens
ucucauccaugcaaacuac

SEQ ID NO: 722506 - RNA, 19 nt, Homo sapiens
cagagacgaauaguuguuu

SEQ ID NO: 722507 - RNA, 19 nt, Homo sapiens
caagaacugaccgauuuga

SEQ ID NO: 722508 - RNA, 19 nt, Homo sapiens
guugaaggagcucaucuug

SEQ ID NO: 722509 - RNA, 19 nt, Homo sapiens
ggagauuagacuauuugga

SEQ ID NO: 722510 - RNA, 19 nt, Homo sapiens
gaccugagugggaugcauu

SEQ ID NO: 722511 - RNA, 19 nt, Homo sapiens
cauccuuggagcuuuauaa

SEQ ID NO: 722512 - RNA, 19 nt, Homo sapiens
aauaguuguuucccugcua

SEQ ID NO: 722513 - RNA, 19 nt, Homo sapiens
cccaaggacuggacauucu

SEQ ID NO: 722514 - RNA, 19 nt, Homo sapiens
ugggugaguugccagagaa

SEQ ID NO: 722515 - RNA, 19 nt, Homo sapiens
ugggugaguugccagagaa

SEQ ID NO: 722516 - RNA, 19 nt, Homo sapiens
ugggugaguugccagagaa

SEQ ID NO: 722517 - RNA, 19 nt, Homo sapiens
ugggugaguugccagagaa

SEQ ID NO: 722518 - RNA, 19 nt, Homo sapiens
cagaaccugacccagcuua

SEQ ID NO: 722519 - RNA, 19 nt, Homo sapiens
gcaacuccucuccuucaug

SEQ ID NO: 722520 - RNA, 19 nt, Homo sapiens
caacaauagcgggaaugaa

SEQ ID NO: 722521 - RNA, 19 nt, Homo sapiens
ccauugugguauagcagaa

SEQ ID NO: 722522 - RNA, 19 nt, Homo sapiens
ccaacaauagcgggaauga

SEQ ID NO: 722523 - RNA, 19 nt, Homo sapiens
ggaaggcacguggcaaugg

SEQ ID NO: 722524 - RNA, 19 nt, Homo sapiens
ggaacaauccgagcaagac

SEQ ID NO: 722525 - RNA, 19 nt, Homo sapiens
gugggugaguugccagaga

SEQ ID NO: 722526 - RNA, 19 nt, Homo sapiens
gugggugaguugccagaga

SEQ ID NO: 722527 - RNA, 19 nt, Homo sapiens
gugggugaguugccagaga

SEQ ID NO: 722528 - RNA, 19 nt, Homo sapiens
gugggugaguugccagaga

SEQ ID NO: 722529 - RNA, 19 nt, Homo sapiens
acuaccaucugcucaacuu

SEQ ID NO: 722530 - RNA, 19 nt, Homo sapiens
uccuacagcugcagacuuc

SEQ ID NO: 722531 - RNA, 19 nt, Homo sapiens
aagacgcaaucuaccagaa

SEQ ID NO: 722532 - RNA, 19 nt, Homo sapiens
aacaauagcgggaaugaag

SEQ ID NO: 722533 - RNA, 19 nt, Homo sapiens
ggacagcgggaaaacauga

SEQ ID NO: 722534 - RNA, 19 nt, Homo sapiens
ucagagacgaauaguuguu

SEQ ID NO: 722535 - RNA, 19 nt, Homo sapiens
ccaagcugcaggagaucua

SEQ ID NO: 722536 - RNA, 19 nt, Homo sapiens
ccagcucgucguaaucaaa

SEQ ID NO: 722537 - RNA, 19 nt, Homo sapiens
ccaagcugcaggagaucua

SEQ ID NO: 722538 - RNA, 19 nt, Homo sapiens
ccaagcugcaggagaucua

SEQ ID NO: 722539 - RNA, 19 nt, Homo sapiens
ccaagcugcaggagaucua

SEQ ID NO: 722540 - RNA, 19 nt, Homo sapiens
gaacauacccuuagaagaa

SEQ ID NO: 722541 - RNA, 19 nt, Homo sapiens
gaacaacccuuuaggauag

SEQ ID NO: 722542 - RNA, 19 nt, Homo sapiens
gagguuagccugccaguua

SEQ ID NO: 722543 - RNA, 19 nt, Homo sapiens
uagaagaacuccaaagaaa

SEQ ID NO: 722544 - RNA, 19 nt, Homo sapiens
caagugaacauaucaguua

SEQ ID NO: 722545 - RNA, 19 nt, Homo sapiens
gacagaaagucuacaaauu

SEQ ID NO: 722546 - RNA, 19 nt, Homo sapiens
gauguuagcuggaauucuu

SEQ ID NO: 722547 - RNA, 19 nt, Homo sapiens
caaccaggauuuagaauau

SEQ ID NO: 722548 - RNA, 19 nt, Homo sapiens
gcauuuagaucucucauuc

SEQ ID NO: 722549 - RNA, 19 nt, Homo sapiens
ugaauuauccugcaacaua

SEQ ID NO: 722550 - RNA, 19 nt, Homo sapiens
ggucagagucuuucaauuu

SEQ ID NO: 722551 - RNA, 19 nt, Homo sapiens
ggaaaugccuggucagagu

SEQ ID NO: 722552 - RNA, 19 nt, Homo sapiens
ggauaugccuucuuuggaa

SEQ ID NO: 722553 - RNA, 19 nt, Homo sapiens
caacauaacucugcugauc

SEQ ID NO: 722554 - RNA, 19 nt, Homo sapiens
gaagaagaacaacccuuua

SEQ ID NO: 722555 - RNA, 19 nt, Homo sapiens
gcuuacaacugacuaauau

SEQ ID NO: 722556 - RNA, 19 nt, Homo sapiens
aaagugaauugguaccuua

SEQ ID NO: 722557 - RNA, 19 nt, Homo sapiens
gaacagcauucccaacaag

SEQ ID NO: 722558 - RNA, 19 nt, Homo sapiens
gaucugcccugguaucuca

SEQ ID NO: 722559 - RNA, 19 nt, Homo sapiens
gcccaaaccuguggaauau

SEQ ID NO: 722560 - RNA, 19 nt, Homo sapiens
gaagaacaacccuuuagga

SEQ ID NO: 722561 - RNA, 19 nt, Homo sapiens
gaaauuaacacuagucacu

SEQ ID NO: 722562 - RNA, 19 nt, Homo sapiens
cagaagaugaggucaauaa

SEQ ID NO: 722563 - RNA, 19 nt, Homo sapiens
cuucaaauaugcuuacuga

SEQ ID NO: 722564 - RNA, 19 nt, Homo sapiens
caacuuaucacaacugaau

SEQ ID NO: 722565 - RNA, 19 nt, Homo sapiens
uuagagggcuggccugauu

SEQ ID NO: 722566 - RNA, 19 nt, Homo sapiens
ugaaagcauucgugaagaa

SEQ ID NO: 722567 - RNA, 19 nt, Homo sapiens
gauagccacugcaacauca

SEQ ID NO: 722568 - RNA, 19 nt, Homo sapiens
gacaugagcuuucuaucag

SEQ ID NO: 722569 - RNA, 19 nt, Homo sapiens
gauaugccuucuuuggaaa

SEQ ID NO: 722570 - RNA, 19 nt, Homo sapiens
gcaacaucaugaccaaaga

SEQ ID NO: 722571 - RNA, 19 nt, Homo sapiens
aguaucaagugaaguguua

SEQ ID NO: 722572 - RNA, 19 nt, Homo sapiens
ggagacacuuaucuuacaa

SEQ ID NO: 722573 - RNA, 19 nt, Homo sapiens
gggcuggccugauucuuau

SEQ ID NO: 722574 - RNA, 19 nt, Homo sapiens
aagaugcucugaagaagaa

SEQ ID NO: 722575 - RNA, 19 nt, Homo sapiens
caauagaacauaucacgaa

SEQ ID NO: 722576 - RNA, 19 nt, Homo sapiens
gaagauauacagauuuguc

SEQ ID NO: 722577 - RNA, 19 nt, Homo sapiens
ucacaugucugaauuaucc

SEQ ID NO: 722578 - RNA, 19 nt, Homo sapiens
gcaucuaaguuauauccuu

SEQ ID NO: 722579 - RNA, 19 nt, Homo sapiens
uagcagccuuucuguauug

SEQ ID NO: 722580 - RNA, 19 nt, Homo sapiens
ugaagaagaacaacccuuu

SEQ ID NO: 722581 - RNA, 19 nt, Homo sapiens
gcaccaagcacauucaagu

SEQ ID NO: 722582 - RNA, 19 nt, Homo sapiens
gagcuaggcggugagguua

SEQ ID NO: 722583 - RNA, 19 nt, Homo sapiens
gaccaaguaucaagugaag

SEQ ID NO: 722584 - RNA, 19 nt, Homo sapiens
agaacaacccuuuaggaua

SEQ ID NO: 722585 - RNA, 19 nt, Homo sapiens
ucacccaacuaguuuauuc

SEQ ID NO: 722586 - RNA, 19 nt, Homo sapiens
guaaggaauuuggcaacuu

SEQ ID NO: 722587 - RNA, 19 nt, Homo sapiens
caaguucaaccaggauuua

SEQ ID NO: 722588 - RNA, 19 nt, Homo sapiens
cacaaucucuuucaugaag

SEQ ID NO: 722589 - RNA, 19 nt, Homo sapiens
gcaagagcauuguggaaaa

SEQ ID NO: 722590 - RNA, 19 nt, Homo sapiens
aaacgacauugaaagcauu

SEQ ID NO: 722591 - RNA, 19 nt, Homo sapiens
ccaaaccuguggaauaucu

SEQ ID NO: 722592 - RNA, 19 nt, Homo sapiens
caacuaguuuauucgcuau

SEQ ID NO: 722593 - RNA, 19 nt, Homo sapiens
ccacucugcuuucccaaau

SEQ ID NO: 722594 - RNA, 19 nt, Homo sapiens
aagcaaacgugggcucuuu

SEQ ID NO: 722595 - RNA, 19 nt, Homo sapiens
auacagauuugucuucaug

SEQ ID NO: 722596 - RNA, 19 nt, Homo sapiens
ggugaaaagugaauuggua

SEQ ID NO: 722597 - RNA, 19 nt, Homo sapiens
caauguugcuuucaauucu

SEQ ID NO: 722598 - RNA, 19 nt, Homo sapiens
ggaauuuggcaacuuauca

SEQ ID NO: 722599 - RNA, 19 nt, Homo sapiens
caucaugaccaaagacaaa

SEQ ID NO: 722600 - RNA, 19 nt, Homo sapiens
ggcccaaaccuguggaaua

SEQ ID NO: 722601 - RNA, 19 nt, Homo sapiens
uuagggugcuuacaacuga

SEQ ID NO: 722602 - RNA, 19 nt, Homo sapiens
acagaaagucuacaaauuc

SEQ ID NO: 722603 - RNA, 19 nt, Homo sapiens
gcccaucuguaaggaauuu

SEQ ID NO: 722604 - RNA, 19 nt, Homo sapiens
ugacaugagcuuucuauca

SEQ ID NO: 722605 - RNA, 19 nt, Homo sapiens
ccaggaacauacccuuaga

SEQ ID NO: 722606 - RNA, 19 nt, Homo sapiens
gagcuaagagaauuuguca

SEQ ID NO: 722607 - RNA, 19 nt, Homo sapiens
gucagagucuuucaauuuc

SEQ ID NO: 722608 - RNA, 19 nt, Homo sapiens
ggacucauaucaagaugcu

SEQ ID NO: 722609 - RNA, 19 nt, Homo sapiens
uuacuuggaugauggugaa

SEQ ID NO: 722610 - RNA, 19 nt, Homo sapiens
caaaagaccuaccgcugaa

SEQ ID NO: 722611 - RNA, 19 nt, Homo sapiens
gcgcagggccaggaacaua

SEQ ID NO: 722612 - RNA, 19 nt, Homo sapiens
uuccagagcugccagaaga

SEQ ID NO: 722613 - RNA, 19 nt, Homo sapiens
uagcuggaauucuuuggaa

SEQ ID NO: 722614 - RNA, 19 nt, Homo sapiens
ucaaccaggauuuagaaua

SEQ ID NO: 722615 - RNA, 19 nt, Homo sapiens
ggaacauacccuuagaaga

SEQ ID NO: 722616 - RNA, 19 nt, Homo sapiens
gaagcccacuaaaggacuu

SEQ ID NO: 722617 - RNA, 19 nt, Homo sapiens
ccugugagcuaagagaauu

SEQ ID NO: 722618 - RNA, 19 nt, Homo sapiens
gcugaaaaccaaagucuua

SEQ ID NO: 722619 - RNA, 19 nt, Homo sapiens
ccucaugccuucaggaaag

SEQ ID NO: 722620 - RNA, 19 nt, Homo sapiens
gaagaugaggucaauaaaa

SEQ ID NO: 722621 - RNA, 19 nt, Homo sapiens
gccagaagaugaggucaau

SEQ ID NO: 722622 - RNA, 19 nt, Homo sapiens
gauguuaaccauuucagau

SEQ ID NO: 722623 - RNA, 19 nt, Homo sapiens
caaagacaaagaaccuauu

SEQ ID NO: 722624 - RNA, 19 nt, Homo sapiens
gaacuacaucgcugagcuu

SEQ ID NO: 722625 - RNA, 19 nt, Homo sapiens
cagagugaguggugccauu

SEQ ID NO: 722626 - RNA, 19 nt, Homo sapiens
gagaguauagugguguuaa

SEQ ID NO: 722627 - RNA, 19 nt, Homo sapiens
ccuguggaauaucucaaua

SEQ ID NO: 722628 - RNA, 19 nt, Homo sapiens
gggauugagugcuaugaag

SEQ ID NO: 722629 - RNA, 19 nt, Homo sapiens
ccaacuuuguccagaguga

SEQ ID NO: 722630 - RNA, 19 nt, Homo sapiens
gauauacagauuugucuuc

SEQ ID NO: 722631 - RNA, 19 nt, Homo sapiens
ccaaguaucaagugaagug

SEQ ID NO: 722632 - RNA, 19 nt, Homo sapiens
gguguuaaauuugucuuca

SEQ ID NO: 722633 - RNA, 19 nt, Homo sapiens
gccaauugcucacuugcau

SEQ ID NO: 722634 - RNA, 19 nt, Homo sapiens
uaucagaguugacaguuuu

SEQ ID NO: 722635 - RNA, 19 nt, Homo sapiens
aauuaacacuagucacuga

SEQ ID NO: 722636 - RNA, 19 nt, Homo sapiens
gaggaagcccacuaaagga

SEQ ID NO: 722637 - RNA, 19 nt, Homo sapiens
ucuuagauaugucucagaa

SEQ ID NO: 722638 - RNA, 19 nt, Homo sapiens
gccauuacgaacucuauuu

SEQ ID NO: 722639 - RNA, 19 nt, Homo sapiens
ggcaagagcauuguggaaa

SEQ ID NO: 722640 - RNA, 19 nt, Homo sapiens
ggaagaauuugcuuaauga

SEQ ID NO: 722641 - RNA, 19 nt, Homo sapiens
gaugagaaaucagaacuua

SEQ ID NO: 722642 - RNA, 19 nt, Homo sapiens
ccaaagagauugcaauaga

SEQ ID NO: 722643 - RNA, 19 nt, Homo sapiens
gaaaugaaauuccaaaugc

SEQ ID NO: 722644 - RNA, 19 nt, Homo sapiens
gcagcaaacuugaagaauu

SEQ ID NO: 722645 - RNA, 19 nt, Homo sapiens
gaugauggcugcagugaug

SEQ ID NO: 722646 - RNA, 19 nt, Homo sapiens
ggagaacacugagaaagaa

SEQ ID NO: 722647 - RNA, 19 nt, Homo sapiens
gcucaggacuccagcauga

SEQ ID NO: 722648 - RNA, 19 nt, Homo sapiens
cagcaaacuugaagaauug

SEQ ID NO: 722649 - RNA, 19 nt, Homo sapiens
caaagagauugcaauagaa

SEQ ID NO: 722650 - RNA, 19 nt, Homo sapiens
ccaagaaggucuaaagaag

SEQ ID NO: 722651 - RNA, 19 nt, Homo sapiens
caacuguccuuggccuuua

SEQ ID NO: 722652 - RNA, 19 nt, Homo sapiens
caucagaccuggaauuugg

SEQ ID NO: 722653 - RNA, 19 nt, Homo sapiens
acucuggaaucuagaauua

SEQ ID NO: 722654 - RNA, 19 nt, Homo sapiens
gaaagcaacggaagugaug

SEQ ID NO: 722655 - RNA, 19 nt, Homo sapiens
gaugucaugccuaauauuu

SEQ ID NO: 722656 - RNA, 19 nt, Homo sapiens
caacggaagugaugaugca

SEQ ID NO: 722657 - RNA, 19 nt, Homo sapiens
ggacaguggcccugaagaa

SEQ ID NO: 722658 - RNA, 19 nt, Homo sapiens
ccagagagccggaggaaau

SEQ ID NO: 722659 - RNA, 19 nt, Homo sapiens
ugacagaggagaacacuga

SEQ ID NO: 722660 - RNA, 19 nt, Homo sapiens
ggaagaagagucaaagagu

SEQ ID NO: 722661 - RNA, 19 nt, Homo sapiens
guugagaaguccaaagaga

SEQ ID NO: 722662 - RNA, 19 nt, Homo sapiens
gugacuaucuucccauuuc

SEQ ID NO: 722663 - RNA, 19 nt, Homo sapiens
uaaagaggacguaugagaa

SEQ ID NO: 722664 - RNA, 19 nt, Homo sapiens
cggaagugaugaugcagua

SEQ ID NO: 722665 - RNA, 19 nt, Homo sapiens
gaaaugacagcuacacucu

SEQ ID NO: 722666 - RNA, 19 nt, Homo sapiens
ugaagcagcugagcaggaa

SEQ ID NO: 722667 - RNA, 19 nt, Homo sapiens
ggacagggaauggauuuga

SEQ ID NO: 722668 - RNA, 19 nt, Homo sapiens
caagaaggucuaaagaaga

SEQ ID NO: 722669 - RNA, 19 nt, Homo sapiens
ggaugccacuucaccagaa

SEQ ID NO: 722670 - RNA, 19 nt, Homo sapiens
gcacuucugugggagcuau

SEQ ID NO: 722671 - RNA, 19 nt, Homo sapiens
ccagugcccugcucugaga

SEQ ID NO: 722672 - RNA, 19 nt, Homo sapiens
uugaagaauugguccauuu

SEQ ID NO: 722673 - RNA, 19 nt, Homo sapiens
gcuacacucuggaaucuag

SEQ ID NO: 722674 - RNA, 19 nt, Homo sapiens
ggaauggauuugacuuguc

SEQ ID NO: 722675 - RNA, 19 nt, Homo sapiens
agaaagaacuggaaaacuu

SEQ ID NO: 722676 - RNA, 19 nt, Homo sapiens
ggaagcagcucuugaaaac

SEQ ID NO: 722677 - RNA, 19 nt, Homo sapiens
aggaagaauuugcuuaaug

SEQ ID NO: 722678 - RNA, 19 nt, Homo sapiens
gaagugaugaugcaguaug

SEQ ID NO: 722679 - RNA, 19 nt, Homo sapiens
gaacguguuugugcaacug

SEQ ID NO: 722680 - RNA, 19 nt, Homo sapiens
gggaauggauuugacuugu

SEQ ID NO: 722681 - RNA, 19 nt, Homo sapiens
ucaggaagaauuugcuuaa

SEQ ID NO: 722682 - RNA, 19 nt, Homo sapiens
cuaaagaggacguaugaga

SEQ ID NO: 722683 - RNA, 19 nt, Homo sapiens
gaaaagggcccaagaagca

SEQ ID NO: 722684 - RNA, 19 nt, Homo sapiens
uaaagaagaccaaagaacu

SEQ ID NO: 722685 - RNA, 19 nt, Homo sapiens
caucauccauucccuccuu

SEQ ID NO: 722686 - RNA, 19 nt, Homo sapiens
gaauuaaccaggcugaaag

SEQ ID NO: 722687 - RNA, 19 nt, Homo sapiens
ggaaguugagaacguguuu

SEQ ID NO: 722688 - RNA, 19 nt, Homo sapiens
ucucggagcaacucacuua

SEQ ID NO: 722689 - RNA, 19 nt, Homo sapiens
uguaauugguuaucaggaa

SEQ ID NO: 722690 - RNA, 19 nt, Homo sapiens
cagccuaccugucacuuca

SEQ ID NO: 722691 - RNA, 19 nt, Homo sapiens
gaaucugccuggccaaacu

SEQ ID NO: 722692 - RNA, 19 nt, Homo sapiens
ggauuugacuuguccuuuu

SEQ ID NO: 722693 - RNA, 19 nt, Homo sapiens
uagaagaaacugaggaaga

SEQ ID NO: 722694 - RNA, 19 nt, Homo sapiens
gaagaacagaagagugaga

SEQ ID NO: 722695 - RNA, 19 nt, Homo sapiens
uagaugucaugccuaauau

SEQ ID NO: 722696 - RNA, 19 nt, Homo sapiens
guccaaagagauugcaaua

SEQ ID NO: 722697 - RNA, 19 nt, Homo sapiens
gaccuggaauuuggaguug

SEQ ID NO: 722698 - RNA, 19 nt, Homo sapiens
guccauuucuuacaaguca

SEQ ID NO: 722699 - RNA, 19 nt, Homo sapiens
cagaggaggacaagaagaa

SEQ ID NO: 722700 - RNA, 19 nt, Homo sapiens
agaagaaacugaggaagag

SEQ ID NO: 722701 - RNA, 19 nt, Homo sapiens
gaaggaggaggaggaagaa

SEQ ID NO: 722702 - RNA, 19 nt, Homo sapiens
gaaaauggaaagacaaaug

SEQ ID NO: 722703 - RNA, 19 nt, Homo sapiens
ggaaaccuaccagaaguug

SEQ ID NO: 722704 - RNA, 19 nt, Homo sapiens
gcaacuguccuuggccuuu

SEQ ID NO: 722705 - RNA, 19 nt, Homo sapiens
ucaaagaguggcuuagaug

SEQ ID NO: 722706 - RNA, 19 nt, Homo sapiens
gguuugaccuccgguguug

SEQ ID NO: 722707 - RNA, 19 nt, Homo sapiens
ugagaaguccaaagagauu

SEQ ID NO: 722708 - RNA, 19 nt, Homo sapiens
cagcaagggauuccaagaa

SEQ ID NO: 722709 - RNA, 19 nt, Homo sapiens
uaaguuuaaugcccugaau

SEQ ID NO: 722710 - RNA, 19 nt, Homo sapiens
cuucaaagcuuccauuacg

SEQ ID NO: 722711 - RNA, 19 nt, Homo sapiens
gcucaagcuuccagaccuu

SEQ ID NO: 722712 - RNA, 19 nt, Homo sapiens
gcucuacaauuccuauaac

SEQ ID NO: 722713 - RNA, 19 nt, Homo sapiens
aaagaagaccaaagaacuu

SEQ ID NO: 722714 - RNA, 19 nt, Homo sapiens
augcggagcucauggaguu

SEQ ID NO: 722715 - RNA, 19 nt, Homo sapiens
aagaguggcuuagauguca

SEQ ID NO: 722716 - RNA, 19 nt, Homo sapiens
gcguugcugugguuccuaa

SEQ ID NO: 722717 - RNA, 19 nt, Homo sapiens
ugagaaaucagaacuuagu

SEQ ID NO: 722718 - RNA, 19 nt, Homo sapiens
gcuggaagaagccaaguug

SEQ ID NO: 722719 - RNA, 19 nt, Homo sapiens
cauacacagugacuugaug

SEQ ID NO: 722720 - RNA, 19 nt, Homo sapiens
gaaaagcgcaugucgaaag

SEQ ID NO: 722721 - RNA, 19 nt, Homo sapiens
gucaaagaguggcuuagau

SEQ ID NO: 722722 - RNA, 19 nt, Homo sapiens
uaacuucagccucccauuc

SEQ ID NO: 722723 - RNA, 19 nt, Homo sapiens
gcagugaugcuggucuuga

SEQ ID NO: 722724 - RNA, 19 nt, Homo sapiens
gguagaagaaacugaggaa

SEQ ID NO: 722725 - RNA, 19 nt, Homo sapiens
ugaaggaggaggaggaaga

SEQ ID NO: 722726 - RNA, 19 nt, Homo sapiens
cagaggagaacacugagaa

SEQ ID NO: 722727 - RNA, 19 nt, Homo sapiens
aaacugcccugggaaagca

SEQ ID NO: 722728 - RNA, 19 nt, Homo sapiens
ugugggagcuauucauaca

SEQ ID NO: 722729 - RNA, 19 nt, Homo sapiens
aggaagaacagaagaguga

SEQ ID NO: 722730 - RNA, 19 nt, Homo sapiens
gcugugguuccuaaguuua

SEQ ID NO: 722731 - RNA, 19 nt, Homo sapiens
cagcuacacucuggaaucu

SEQ ID NO: 722732 - RNA, 19 nt, Homo sapiens
ugccuaauauuucugaugu

SEQ ID NO: 722733 - RNA, 19 nt, Homo sapiens
caaagaguggcuuagaugu

SEQ ID NO: 722734 - RNA, 19 nt, Homo sapiens
ucucagaggaggacaagaa

SEQ ID NO: 722735 - RNA, 19 nt, Homo sapiens
guaggaaaggcuucucaga

SEQ ID NO: 722736 - RNA, 19 nt, Homo sapiens
caggaagaauuugcuuaau

SEQ ID NO: 722737 - RNA, 19 nt, Homo sapiens
ucaccaaggaacucuauug

SEQ ID NO: 722738 - RNA, 19 nt, Homo sapiens
gaccaaagaacuucaagac

SEQ ID NO: 722739 - RNA, 19 nt, Homo sapiens
ggaguaucuugcaguccaa

SEQ ID NO: 722740 - RNA, 19 nt, Homo sapiens
ggaagaauuugcuuaauga

SEQ ID NO: 722741 - RNA, 19 nt, Homo sapiens
gaugagaaaucagaacuua

SEQ ID NO: 722742 - RNA, 19 nt, Homo sapiens
ccaaagagauugcaauaga

SEQ ID NO: 722743 - RNA, 19 nt, Homo sapiens
gcagcaaacuugaagaauu

SEQ ID NO: 722744 - RNA, 19 nt, Homo sapiens
gaugauggcugcagugaug

SEQ ID NO: 722745 - RNA, 19 nt, Homo sapiens
ggagaacacugagaaagaa

SEQ ID NO: 722746 - RNA, 19 nt, Homo sapiens
gcucaggacuccagcauga

SEQ ID NO: 722747 - RNA, 19 nt, Homo sapiens
cagcaaacuugaagaauug

SEQ ID NO: 722748 - RNA, 19 nt, Homo sapiens
caaagagauugcaauagaa

SEQ ID NO: 722749 - RNA, 19 nt, Homo sapiens
ccaagaaggucuaaagaag

SEQ ID NO: 722750 - RNA, 19 nt, Homo sapiens
caacuguccuuggccuuua

SEQ ID NO: 722751 - RNA, 19 nt, Homo sapiens
gaaaggagaauaacucagu

SEQ ID NO: 722752 - RNA, 19 nt, Homo sapiens
caucagaccuggaauuugg

SEQ ID NO: 722753 - RNA, 19 nt, Homo sapiens
acucuggaaucuagaauua

SEQ ID NO: 722754 - RNA, 19 nt, Homo sapiens
gaaagcaacggaagugaug

SEQ ID NO: 722755 - RNA, 19 nt, Homo sapiens
gaugucaugccuaauauuu

SEQ ID NO: 722756 - RNA, 19 nt, Homo sapiens
caacggaagugaugaugca

SEQ ID NO: 722757 - RNA, 19 nt, Homo sapiens
ggacaguggcccugaagaa

SEQ ID NO: 722758 - RNA, 19 nt, Homo sapiens
ugacagaggagaacacuga

SEQ ID NO: 722759 - RNA, 19 nt, Homo sapiens
ggaagaagagucaaagagu

SEQ ID NO: 722760 - RNA, 19 nt, Homo sapiens
guugagaaguccaaagaga

SEQ ID NO: 722761 - RNA, 19 nt, Homo sapiens
gaggaggaaaggagaauaa

SEQ ID NO: 722762 - RNA, 19 nt, Homo sapiens
gugacuaucuucccauuuc

SEQ ID NO: 722763 - RNA, 19 nt, Homo sapiens
uaaagaggacguaugagaa

SEQ ID NO: 722764 - RNA, 19 nt, Homo sapiens
cggaagugaugaugcagua

SEQ ID NO: 722765 - RNA, 19 nt, Homo sapiens
gaaaugacagcuacacucu

SEQ ID NO: 722766 - RNA, 19 nt, Homo sapiens
ugaagcagcugagcaggaa

SEQ ID NO: 722767 - RNA, 19 nt, Homo sapiens
caagaaggucuaaagaaga

SEQ ID NO: 722768 - RNA, 19 nt, Homo sapiens
ggaugccacuucaccagaa

SEQ ID NO: 722769 - RNA, 19 nt, Homo sapiens
gcacuucugugggagcuau

SEQ ID NO: 722770 - RNA, 19 nt, Homo sapiens
ccagugcccugcucugaga

SEQ ID NO: 722771 - RNA, 19 nt, Homo sapiens
uugaagaauugguccauuu

SEQ ID NO: 722772 - RNA, 19 nt, Homo sapiens
gcuacacucuggaaucuag

SEQ ID NO: 722773 - RNA, 19 nt, Homo sapiens
agaaagaacuggaaaacuu

SEQ ID NO: 722774 - RNA, 19 nt, Homo sapiens
ggaagcagcucuugaaaac

SEQ ID NO: 722775 - RNA, 19 nt, Homo sapiens
aggaagaauuugcuuaaug

SEQ ID NO: 722776 - RNA, 19 nt, Homo sapiens
gaagugaugaugcaguaug

SEQ ID NO: 722777 - RNA, 19 nt, Homo sapiens
gaacguguuugugcaacug

SEQ ID NO: 722778 - RNA, 19 nt, Homo sapiens
ucaggaagaauuugcuuaa

SEQ ID NO: 722779 - RNA, 19 nt, Homo sapiens
gguaaaagcuccccagagu

SEQ ID NO: 722780 - RNA, 19 nt, Homo sapiens
cuaaagaggacguaugaga

SEQ ID NO: 722781 - RNA, 19 nt, Homo sapiens
ggacugccaucugcugugu

SEQ ID NO: 722782 - RNA, 19 nt, Homo sapiens
gaaaagggcccaagaagca

SEQ ID NO: 722783 - RNA, 19 nt, Homo sapiens
uaaagaagaccaaagaacu

SEQ ID NO: 722784 - RNA, 19 nt, Homo sapiens
caucauccauucccuccuu

SEQ ID NO: 722785 - RNA, 19 nt, Homo sapiens
gaauuaaccaggcugaaag

SEQ ID NO: 722786 - RNA, 19 nt, Homo sapiens
ggaaguugagaacguguuu

SEQ ID NO: 722787 - RNA, 19 nt, Homo sapiens
ucucggagcaacucacuua

SEQ ID NO: 722788 - RNA, 19 nt, Homo sapiens
uguaauugguuaucaggaa

SEQ ID NO: 722789 - RNA, 19 nt, Homo sapiens
cagccuaccugucacuuca

SEQ ID NO: 722790 - RNA, 19 nt, Homo sapiens
gaaucugccuggccaaacu

SEQ ID NO: 722791 - RNA, 19 nt, Homo sapiens
uagaagaaacugaggaaga

SEQ ID NO: 722792 - RNA, 19 nt, Homo sapiens
gaagaacagaagagugaga

SEQ ID NO: 722793 - RNA, 19 nt, Homo sapiens
uagaugucaugccuaauau

SEQ ID NO: 722794 - RNA, 19 nt, Homo sapiens
guccaaagagauugcaaua

SEQ ID NO: 722795 - RNA, 19 nt, Homo sapiens
gaccuggaauuuggaguug

SEQ ID NO: 722796 - RNA, 19 nt, Homo sapiens
guccauuucuuacaaguca

SEQ ID NO: 722797 - RNA, 19 nt, Homo sapiens
cagaggaggacaagaagaa

SEQ ID NO: 722798 - RNA, 19 nt, Homo sapiens
agaagaaacugaggaagag

SEQ ID NO: 722799 - RNA, 19 nt, Homo sapiens
gaaggaggaggaggaagaa

SEQ ID NO: 722800 - RNA, 19 nt, Homo sapiens
gaaaauggaaagacaaaug

SEQ ID NO: 722801 - RNA, 19 nt, Homo sapiens
ggaaaccuaccagaaguug

SEQ ID NO: 722802 - RNA, 19 nt, Homo sapiens
gcaacuguccuuggccuuu

SEQ ID NO: 722803 - RNA, 19 nt, Homo sapiens
ucaaagaguggcuuagaug

SEQ ID NO: 722804 - RNA, 19 nt, Homo sapiens
ugagaaguccaaagagauu

SEQ ID NO: 722805 - RNA, 19 nt, Homo sapiens
cagcaagggauuccaagaa

SEQ ID NO: 722806 - RNA, 19 nt, Homo sapiens
uaaguuuaaugcccugaau

SEQ ID NO: 722807 - RNA, 19 nt, Homo sapiens
cuucaaagcuuccauuacg

SEQ ID NO: 722808 - RNA, 19 nt, Homo sapiens
gcucaagcuuccagaccuu

SEQ ID NO: 722809 - RNA, 19 nt, Homo sapiens
gcucuacaauuccuauaac

SEQ ID NO: 722810 - RNA, 19 nt, Homo sapiens
aaagaagaccaaagaacuu

SEQ ID NO: 722811 - RNA, 19 nt, Homo sapiens
augcggagcucauggaguu

SEQ ID NO: 722812 - RNA, 19 nt, Homo sapiens
aagaguggcuuagauguca

SEQ ID NO: 722813 - RNA, 19 nt, Homo sapiens
gaggaaaggagaauaacuc

SEQ ID NO: 722814 - RNA, 19 nt, Homo sapiens
gcguugcugugguuccuaa

SEQ ID NO: 722815 - RNA, 19 nt, Homo sapiens
ugagaaaucagaacuuagu

SEQ ID NO: 722816 - RNA, 19 nt, Homo sapiens
gcuggaagaagccaaguug

SEQ ID NO: 722817 - RNA, 19 nt, Homo sapiens
cauacacagugacuugaug

SEQ ID NO: 722818 - RNA, 19 nt, Homo sapiens
gaaaagcgcaugucgaaag

SEQ ID NO: 722819 - RNA, 19 nt, Homo sapiens
gucaaagaguggcuuagau

SEQ ID NO: 722820 - RNA, 19 nt, Homo sapiens
uaacuucagccucccauuc

SEQ ID NO: 722821 - RNA, 19 nt, Homo sapiens
gcagugaugcuggucuuga

SEQ ID NO: 722822 - RNA, 19 nt, Homo sapiens
gguagaagaaacugaggaa

SEQ ID NO: 722823 - RNA, 19 nt, Homo sapiens
ugaaggaggaggaggaaga

SEQ ID NO: 722824 - RNA, 19 nt, Homo sapiens
cagaggagaacacugagaa

SEQ ID NO: 722825 - RNA, 19 nt, Homo sapiens
aaacugcccugggaaagca

SEQ ID NO: 722826 - RNA, 19 nt, Homo sapiens
ugugggagcuauucauaca

SEQ ID NO: 722827 - RNA, 19 nt, Homo sapiens
aggaagaacagaagaguga

SEQ ID NO: 722828 - RNA, 19 nt, Homo sapiens
gcugugguuccuaaguuua

SEQ ID NO: 722829 - RNA, 19 nt, Homo sapiens
cagcuacacucuggaaucu

SEQ ID NO: 722830 - RNA, 19 nt, Homo sapiens
ugccuaauauuucugaugu

SEQ ID NO: 722831 - RNA, 19 nt, Homo sapiens
caaagaguggcuuagaugu

SEQ ID NO: 722832 - RNA, 19 nt, Homo sapiens
ucucagaggaggacaagaa

SEQ ID NO: 722833 - RNA, 19 nt, Homo sapiens
guaggaaaggcuucucaga

SEQ ID NO: 722834 - RNA, 19 nt, Homo sapiens
caggaagaauuugcuuaau

SEQ ID NO: 722835 - RNA, 19 nt, Homo sapiens
ucaccaaggaacucuauug

SEQ ID NO: 722836 - RNA, 19 nt, Homo sapiens
gaccaaagaacuucaagac

SEQ ID NO: 722837 - RNA, 19 nt, Homo sapiens
gcggagcucauggaguuua

SEQ ID NO: 722838 - RNA, 19 nt, Homo sapiens
cgggaaaccuaccagaagu

SEQ ID NO: 722839 - RNA, 19 nt, Homo sapiens
ugucaugccuaauauuucu

SEQ ID NO: 722840 - RNA, 19 nt, Homo sapiens
ggaguucuaucacaaauug

SEQ ID NO: 722841 - RNA, 19 nt, Homo sapiens
guacaucggucaugacaga

SEQ ID NO: 722842 - RNA, 19 nt, Homo sapiens
ggagcugccuggugaagua

SEQ ID NO: 722843 - RNA, 19 nt, Homo sapiens
ugaaguaccuggaggagaa

SEQ ID NO: 722844 - RNA, 19 nt, Homo sapiens
gaaagcagagggaguucua

SEQ ID NO: 722845 - RNA, 19 nt, Homo sapiens
gacagaaccaugcaagaua

SEQ ID NO: 722846 - RNA, 19 nt, Homo sapiens
ccaagaagcggaaaugaga

SEQ ID NO: 722847 - RNA, 19 nt, Homo sapiens
agacgacaguucaaacaaa

SEQ ID NO: 722848 - RNA, 19 nt, Homo sapiens
caaagauguugaccaggaa

SEQ ID NO: 722849 - RNA, 19 nt, Homo sapiens
acagaaccaugcaagauau

SEQ ID NO: 722850 - RNA, 19 nt, Homo sapiens
gcaaggaccacacacucaa

SEQ ID NO: 722851 - RNA, 19 nt, Homo sapiens
ggacaucaacgcccacauc

SEQ ID NO: 722852 - RNA, 19 nt, Homo sapiens
uuaacgagcuggacauuuu

SEQ ID NO: 722853 - RNA, 19 nt, Homo sapiens
gcgaccgucuugcaucuga

SEQ ID NO: 722854 - RNA, 19 nt, Homo sapiens
caaagcagacgacaguuca

SEQ ID NO: 722855 - RNA, 19 nt, Homo sapiens
gaagaaguucaucgccaaa

SEQ ID NO: 722856 - RNA, 19 nt, Homo sapiens
gacgacaguucaaacaaag

SEQ ID NO: 722857 - RNA, 19 nt, Homo sapiens
gcagacgacaguucaaaca

SEQ ID NO: 722858 - RNA, 19 nt, Homo sapiens
agagggaguucuaucacaa

SEQ ID NO: 722859 - RNA, 19 nt, Homo sapiens
aagauggacuugcugugaa

SEQ ID NO: 722860 - RNA, 19 nt, Homo sapiens
ggaccacacacucaaguuc

SEQ ID NO: 722861 - RNA, 19 nt, Homo sapiens
gaaccaugcaagauauugu

SEQ ID NO: 722862 - RNA, 19 nt, Homo sapiens
gcacuacagacccaagaug

SEQ ID NO: 722863 - RNA, 19 nt, Homo sapiens
caaaacagcacuuagauuc

SEQ ID NO: 722864 - RNA, 19 nt, Homo sapiens
ggaauucccaaagauguug

SEQ ID NO: 722865 - RNA, 19 nt, Homo sapiens
gucacuagguggagauuca

SEQ ID NO: 722866 - RNA, 19 nt, Homo sapiens
cgauggaauucccaaagau

SEQ ID NO: 722867 - RNA, 19 nt, Homo sapiens
cagagggaguucuaucaca

SEQ ID NO: 722868 - RNA, 19 nt, Homo sapiens
gauggaauucccaaagaug

SEQ ID NO: 722869 - RNA, 19 nt, Homo sapiens
acucaaccuuucauccuuu

SEQ ID NO: 722870 - RNA, 19 nt, Homo sapiens
ugagaaagcagagggaguu

SEQ ID NO: 722871 - RNA, 19 nt, Homo sapiens
ccaugcaagauauuguuua

SEQ ID NO: 722872 - RNA, 19 nt, Homo sapiens
acgauggaauucccaaaga

SEQ ID NO: 722873 - RNA, 19 nt, Homo sapiens
gagggaguucuaucacaaa

SEQ ID NO: 722874 - RNA, 19 nt, Homo sapiens
guaccaggccuccaagaag

SEQ ID NO: 722875 - RNA, 19 nt, Homo sapiens
caugcaagauauuguuuac

SEQ ID NO: 722876 - RNA, 19 nt, Homo sapiens
gguaccaggccuccaagaa

SEQ ID NO: 722877 - RNA, 19 nt, Homo sapiens
ugacagaaccaugcaagau

SEQ ID NO: 722878 - RNA, 19 nt, Homo sapiens
ccaaagcagacgacaguuc

SEQ ID NO: 722879 - RNA, 19 nt, Homo sapiens
gcaaaacagcacuuagauu

SEQ ID NO: 722880 - RNA, 19 nt, Homo sapiens
caagaagcggaaaugagaa

SEQ ID NO: 722881 - RNA, 19 nt, Homo sapiens
gacaucaacgcccacauca

SEQ ID NO: 722882 - RNA, 19 nt, Homo sapiens
cucaaccuuucauccuuua

SEQ ID NO: 722883 - RNA, 19 nt, Homo sapiens
ggggagaccugcucugcaa

SEQ ID NO: 722884 - RNA, 19 nt, Homo sapiens
ggaggaggacaacgacuac

SEQ ID NO: 722885 - RNA, 19 nt, Homo sapiens
cggaggaggacaacgacua

SEQ ID NO: 722886 - RNA, 19 nt, Homo sapiens
ggcaaggaccacacacuca

SEQ ID NO: 722887 - RNA, 19 nt, Homo sapiens
agauggacuugcugugaau

SEQ ID NO: 722888 - RNA, 19 nt, Homo sapiens
aagaagcggaaaugagaaa

SEQ ID NO: 722889 - RNA, 19 nt, Homo sapiens
ugcaguacaucggucauga

SEQ ID NO: 722890 - RNA, 19 nt, Homo sapiens
aagcggaaaugagaaagca

SEQ ID NO: 722891 - RNA, 19 nt, Homo sapiens
ggaguguaacagcagcaaa

SEQ ID NO: 722892 - RNA, 19 nt, Homo sapiens
aaccaaagcagacgacagu

SEQ ID NO: 722893 - RNA, 19 nt, Homo sapiens
ugggauugcuggaucuuac

SEQ ID NO: 722894 - RNA, 19 nt, Homo sapiens
cagacgacaguucaaacaa

SEQ ID NO: 722895 - RNA, 19 nt, Homo sapiens
gggaguucuaucacaaauu

SEQ ID NO: 722896 - RNA, 19 nt, Homo sapiens
gaauucccaaagauguuga

SEQ ID NO: 722897 - RNA, 19 nt, Homo sapiens
uaacgagcuggacauuuua

SEQ ID NO: 722898 - RNA, 19 nt, Homo sapiens
uguagcagcuucuuaguua

SEQ ID NO: 722899 - RNA, 19 nt, Homo sapiens
gaacacuacucuuacaugu

SEQ ID NO: 722900 - RNA, 19 nt, Homo sapiens
guagagcccuuugagaaua

SEQ ID NO: 722901 - RNA, 19 nt, Homo sapiens
caagugggccuaauccuua

SEQ ID NO: 722902 - RNA, 19 nt, Homo sapiens
gcaauucagugcaguagga

SEQ ID NO: 722903 - RNA, 19 nt, Homo sapiens
guauaaagaugaagaugga

SEQ ID NO: 722904 - RNA, 19 nt, Homo sapiens
gaggaaaacuucugaguaa

SEQ ID NO: 722905 - RNA, 19 nt, Homo sapiens
gugaaucguuuauuggaua

SEQ ID NO: 722906 - RNA, 19 nt, Homo sapiens
acacuacucuuacauguau

SEQ ID NO: 722907 - RNA, 19 nt, Homo sapiens
caagucaggugaaauaucu

SEQ ID NO: 722908 - RNA, 19 nt, Homo sapiens
cuucucagccuacuaauua

SEQ ID NO: 722909 - RNA, 19 nt, Homo sapiens
ugacuugacuuucuagcuu

SEQ ID NO: 722910 - RNA, 19 nt, Homo sapiens
gcaauuauccugcacaaac

SEQ ID NO: 722911 - RNA, 19 nt, Homo sapiens
gaacugauagaacuucgaa

SEQ ID NO: 722912 - RNA, 19 nt, Homo sapiens
ccaaaagacuccaguacua

SEQ ID NO: 722913 - RNA, 19 nt, Homo sapiens
ccacagcagccaccauaua

SEQ ID NO: 722914 - RNA, 19 nt, Homo sapiens
cgaaauaaagugaaucguu

SEQ ID NO: 722915 - RNA, 19 nt, Homo sapiens
aaucaagucaggugaaaua

SEQ ID NO: 722916 - RNA, 19 nt, Homo sapiens
guacagagcccaaguucuc

SEQ ID NO: 722917 - RNA, 19 nt, Homo sapiens
gcguuuggcuuaacagaug

SEQ ID NO: 722918 - RNA, 19 nt, Homo sapiens
gaguaaugaugaaguaaca

SEQ ID NO: 722919 - RNA, 19 nt, Homo sapiens
gaaaacuucugaguaauga

SEQ ID NO: 722920 - RNA, 19 nt, Homo sapiens
gaucuaagugggaagcuaa

SEQ ID NO: 722921 - RNA, 19 nt, Homo sapiens
aaacuucucagccuacuaa

SEQ ID NO: 722922 - RNA, 19 nt, Homo sapiens
gagcaauuauccugcacaa

SEQ ID NO: 722923 - RNA, 19 nt, Homo sapiens
ccaggaccuuccaccaaua

SEQ ID NO: 722924 - RNA, 19 nt, Homo sapiens
ggucagauguaccaacagu

SEQ ID NO: 722925 - RNA, 19 nt, Homo sapiens
ggaaccaccuggagaacca

SEQ ID NO: 722926 - RNA, 19 nt, Homo sapiens
gaacggacaguuggaucua

SEQ ID NO: 722927 - RNA, 19 nt, Homo sapiens
cuuaacagaugaucagguu

SEQ ID NO: 722928 - RNA, 19 nt, Homo sapiens
gugggaagcuaaucaucaa

SEQ ID NO: 722929 - RNA, 19 nt, Homo sapiens
ugaaucaagucaggugaaa

SEQ ID NO: 722930 - RNA, 19 nt, Homo sapiens
gugauugacuugacuuucu

SEQ ID NO: 722931 - RNA, 19 nt, Homo sapiens
ccagggauauggccagcaa

SEQ ID NO: 722932 - RNA, 19 nt, Homo sapiens
uaacagaugaucagguuuc

SEQ ID NO: 722933 - RNA, 19 nt, Homo sapiens
gcaaguaugucugcuuuug

SEQ ID NO: 722934 - RNA, 19 nt, Homo sapiens
guucugaccuuuccuuugc

SEQ ID NO: 722935 - RNA, 19 nt, Homo sapiens
ggaacacuacucuuacaug

SEQ ID NO: 722936 - RNA, 19 nt, Homo sapiens
ucagcagccucaacaguau

SEQ ID NO: 722937 - RNA, 19 nt, Homo sapiens
uaugucagcguuuggcuua

SEQ ID NO: 722938 - RNA, 19 nt, Homo sapiens
gaccuuuccuuugcaauuc

SEQ ID NO: 722939 - RNA, 19 nt, Homo sapiens
ucugaguaaugaugaagua

SEQ ID NO: 722940 - RNA, 19 nt, Homo sapiens
ugauugacuugacuuucua

SEQ ID NO: 722941 - RNA, 19 nt, Homo sapiens
gauaucauuguugguguua

SEQ ID NO: 722942 - RNA, 19 nt, Homo sapiens
gcguaaccguccucccuuu

SEQ ID NO: 722943 - RNA, 19 nt, Homo sapiens
gcagaagaucguucaggaa

SEQ ID NO: 722944 - RNA, 19 nt, Homo sapiens
auaauuugcuggaacacaa

SEQ ID NO: 722945 - RNA, 19 nt, Homo sapiens
ggauauggccagcaaccaa

SEQ ID NO: 722946 - RNA, 19 nt, Homo sapiens
gguauucaguauucagcaa

SEQ ID NO: 722947 - RNA, 19 nt, Homo sapiens
ggaucuaagugggaagcua

SEQ ID NO: 722948 - RNA, 19 nt, Homo sapiens
gauacugaaacugacauua

SEQ ID NO: 722949 - RNA, 19 nt, Homo sapiens
gcagcuucuuaguuacuuu

SEQ ID NO: 722950 - RNA, 19 nt, Homo sapiens
cauuguugguguuaauuga

SEQ ID NO: 722951 - RNA, 19 nt, Homo sapiens
gauugaaggucagauguac

SEQ ID NO: 722952 - RNA, 19 nt, Homo sapiens
caagccgucuuucucuaga

SEQ ID NO: 722953 - RNA, 19 nt, Homo sapiens
aaagacuccaguacuauuu

SEQ ID NO: 722954 - RNA, 19 nt, Homo sapiens
aguaugguauucaguauuc

SEQ ID NO: 722955 - RNA, 19 nt, Homo sapiens
cugauagaacuucgaaaua

SEQ ID NO: 722956 - RNA, 19 nt, Homo sapiens
ccaccaauauuccugaaaa

SEQ ID NO: 722957 - RNA, 19 nt, Homo sapiens
aaguagagcccuuugagaa

SEQ ID NO: 722958 - RNA, 19 nt, Homo sapiens
caauuauccugcacaaacu

SEQ ID NO: 722959 - RNA, 19 nt, Homo sapiens
ggaccuuccaccaauauuc

SEQ ID NO: 722960 - RNA, 19 nt, Homo sapiens
ccuuugagaauacaagaua

SEQ ID NO: 722961 - RNA, 19 nt, Homo sapiens
cuucuuaguuacuuuggaa

SEQ ID NO: 722962 - RNA, 19 nt, Homo sapiens
gucgagaacugauagaacu

SEQ ID NO: 722963 - RNA, 19 nt, Homo sapiens
gcaagccgucuuucucuag

SEQ ID NO: 722964 - RNA, 19 nt, Homo sapiens
ccaagugggccuaauccuu

SEQ ID NO: 722965 - RNA, 19 nt, Homo sapiens
ggaacacccgacagcauug

SEQ ID NO: 722966 - RNA, 19 nt, Homo sapiens
guaccaggcgagcaauuau

SEQ ID NO: 722967 - RNA, 19 nt, Homo sapiens
acaguaugguauucaguau

SEQ ID NO: 722968 - RNA, 19 nt, Homo sapiens
aaacagucuacucagguua

SEQ ID NO: 722969 - RNA, 19 nt, Homo sapiens
aaagucugcuucugauucu

SEQ ID NO: 722970 - RNA, 19 nt, Homo sapiens
gauggagaucuuauaacaa

SEQ ID NO: 722971 - RNA, 19 nt, Homo sapiens
ggaaaacuucugaguaaug

SEQ ID NO: 722972 - RNA, 19 nt, Homo sapiens
cuuuggaacacuacucuua

SEQ ID NO: 722973 - RNA, 19 nt, Homo sapiens
gaacacaaagaccaaaaug

SEQ ID NO: 722974 - RNA, 19 nt, Homo sapiens
ugauaucauuguugguguu

SEQ ID NO: 722975 - RNA, 19 nt, Homo sapiens
uacaggagcucagacucaa

SEQ ID NO: 722976 - RNA, 19 nt, Homo sapiens
aaacuucugaguaaugaug

SEQ ID NO: 722977 - RNA, 19 nt, Homo sapiens
uuugauaguucugaccuuu

SEQ ID NO: 722978 - RNA, 19 nt, Homo sapiens
aaauguagcagcuucuuag

SEQ ID NO: 722979 - RNA, 19 nt, Homo sapiens
ccucaacaguaugguauuc

SEQ ID NO: 722980 - RNA, 19 nt, Homo sapiens
gacucaagcaggucagauu

SEQ ID NO: 722981 - RNA, 19 nt, Homo sapiens
gucuuucucuagaguugua

SEQ ID NO: 722982 - RNA, 19 nt, Homo sapiens
ugaccuuuccuuugcaauu

SEQ ID NO: 722983 - RNA, 19 nt, Homo sapiens
acacaaagaccaaaaugaa

SEQ ID NO: 722984 - RNA, 19 nt, Homo sapiens
gcuccucuacaccaauuaa

SEQ ID NO: 722985 - RNA, 19 nt, Homo sapiens
ggacaguuggaucuaagug

SEQ ID NO: 722986 - RNA, 19 nt, Homo sapiens
cgcaagccgucuuucucua

SEQ ID NO: 722987 - RNA, 19 nt, Homo sapiens
ccucuacaccaauuaaugu

SEQ ID NO: 722988 - RNA, 19 nt, Homo sapiens
aaggucagauguaccaaca

SEQ ID NO: 722989 - RNA, 19 nt, Homo sapiens
ccaauauuccugaaaauga

SEQ ID NO: 722990 - RNA, 19 nt, Homo sapiens
uuuauuggauagcuuggaa

SEQ ID NO: 722991 - RNA, 19 nt, Homo sapiens
caccaugaacggacaguug

SEQ ID NO: 722992 - RNA, 19 nt, Homo sapiens
guaacacugaugauagguu

SEQ ID NO: 722993 - RNA, 19 nt, Homo sapiens
gguuuagccaucuuacuug

SEQ ID NO: 722994 - RNA, 19 nt, Homo sapiens
aaacuuacacugcccaaac

SEQ ID NO: 722995 - RNA, 19 nt, Homo sapiens
gguuauggcagcaaguaug

SEQ ID NO: 722996 - RNA, 19 nt, Homo sapiens
aguauaauuugcuggaaca

SEQ ID NO: 722997 - RNA, 19 nt, Homo sapiens
ucucagccuacuaauuaua

SEQ ID NO: 722998 - RNA, 19 nt, Homo sapiens
gaaagagccuccuauguga

SEQ ID NO: 722999 - RNA, 19 nt, Homo sapiens
gagaaacacugcagaaauu

SEQ ID NO: 723000 - RNA, 19 nt, Homo sapiens
gcugguagcuguacuauuu

SEQ ID NO: 723001 - RNA, 19 nt, Homo sapiens
gaagagaaauucauuguca

SEQ ID NO: 723002 - RNA, 19 nt, Homo sapiens
gcaauuggcuggaugagaa

SEQ ID NO: 723003 - RNA, 19 nt, Homo sapiens
gcauaucucugcacucuuu

SEQ ID NO: 723004 - RNA, 19 nt, Homo sapiens
gacagaacauuucacguua

SEQ ID NO: 723005 - RNA, 19 nt, Homo sapiens
gcacgucccucuuacauau

SEQ ID NO: 723006 - RNA, 19 nt, Homo sapiens
gaacuacaguaacuugauu

SEQ ID NO: 723007 - RNA, 19 nt, Homo sapiens
gagaagagcacuccuguuu

SEQ ID NO: 723008 - RNA, 19 nt, Homo sapiens
gaacagcagcgguuuaauu

SEQ ID NO: 723009 - RNA, 19 nt, Homo sapiens
ucagaagcauguucauuua

SEQ ID NO: 723010 - RNA, 19 nt, Homo sapiens
gcagaaaucuacuuguaug

SEQ ID NO: 723011 - RNA, 19 nt, Homo sapiens
cagcagaaaucuacuugua

SEQ ID NO: 723012 - RNA, 19 nt, Homo sapiens
ggaaauacaugagaucaau

SEQ ID NO: 723013 - RNA, 19 nt, Homo sapiens
gaacgcaauggcuauauua

SEQ ID NO: 723014 - RNA, 19 nt, Homo sapiens
ggaaugaaguugauaagca

SEQ ID NO: 723015 - RNA, 19 nt, Homo sapiens
acacaauacuggcuaauaa

SEQ ID NO: 723016 - RNA, 19 nt, Homo sapiens
ucaauaggcuccagagauu

SEQ ID NO: 723017 - RNA, 19 nt, Homo sapiens
gauaaacgcuuucgaucug

SEQ ID NO: 723018 - RNA, 19 nt, Homo sapiens
gcagguuacuuacuguaua

SEQ ID NO: 723019 - RNA, 19 nt, Homo sapiens
caagagacauguuuuguua

SEQ ID NO: 723020 - RNA, 19 nt, Homo sapiens
ucaaagaacuucaagaaag

SEQ ID NO: 723021 - RNA, 19 nt, Homo sapiens
gaagagcacuccuguuucu

SEQ ID NO: 723022 - RNA, 19 nt, Homo sapiens
gaacagcacccuucccaaa

SEQ ID NO: 723023 - RNA, 19 nt, Homo sapiens
guucauugcugucuacuuu

SEQ ID NO: 723024 - RNA, 19 nt, Homo sapiens
gagauuguccuguuguuua

SEQ ID NO: 723025 - RNA, 19 nt, Homo sapiens
gagagaaacuucauugucu

SEQ ID NO: 723026 - RNA, 19 nt, Homo sapiens
ggacugauuucccuuuaga

SEQ ID NO: 723027 - RNA, 19 nt, Homo sapiens
gcauuucggucauauuuga

SEQ ID NO: 723028 - RNA, 19 nt, Homo sapiens
ggacagaacauuucacguu

SEQ ID NO: 723029 - RNA, 19 nt, Homo sapiens
gaucuacgguuaaacauca

SEQ ID NO: 723030 - RNA, 19 nt, Homo sapiens
caaagacaguguugaauca

SEQ ID NO: 723031 - RNA, 19 nt, Homo sapiens
gaacgaauaaacccaagua

SEQ ID NO: 723032 - RNA, 19 nt, Homo sapiens
ugacaggaguugcagauaa

SEQ ID NO: 723033 - RNA, 19 nt, Homo sapiens
gagagaggguuauugcauu

SEQ ID NO: 723034 - RNA, 19 nt, Homo sapiens
caacauaacagcuaauuuc

SEQ ID NO: 723035 - RNA, 19 nt, Homo sapiens
caucaacacuuuccuccua

SEQ ID NO: 723036 - RNA, 19 nt, Homo sapiens
ggaauugcacuuauuacua

SEQ ID NO: 723037 - RNA, 19 nt, Homo sapiens
gaaacuucauugucucuga

SEQ ID NO: 723038 - RNA, 19 nt, Homo sapiens
uacaaucccugugcaauua

SEQ ID NO: 723039 - RNA, 19 nt, Homo sapiens
gaaaacaccucaucgauca

SEQ ID NO: 723040 - RNA, 19 nt, Homo sapiens
gggcaacccuguuucuuug

SEQ ID NO: 723041 - RNA, 19 nt, Homo sapiens
ggaacgcaauggcuauauu

SEQ ID NO: 723042 - RNA, 19 nt, Homo sapiens
uugcuuagcucucuucuuu

SEQ ID NO: 723043 - RNA, 19 nt, Homo sapiens
gagguagcaucaacacuuu

SEQ ID NO: 723044 - RNA, 19 nt, Homo sapiens
ccacuguacuguauccaua

SEQ ID NO: 723045 - RNA, 19 nt, Homo sapiens
ucaaccagcucuucagaaa

SEQ ID NO: 723046 - RNA, 19 nt, Homo sapiens
gagccugaguucuuuauug

SEQ ID NO: 723047 - RNA, 19 nt, Homo sapiens
gaggauaugcacucuauuu

SEQ ID NO: 723048 - RNA, 19 nt, Homo sapiens
ucgccuagcugguauuuaa

SEQ ID NO: 723049 - RNA, 19 nt, Homo sapiens
caacuuagaggaacuguga

SEQ ID NO: 723050 - RNA, 19 nt, Homo sapiens
gaagaaggcccguguaguc

SEQ ID NO: 723051 - RNA, 19 nt, Homo sapiens
gcacaguguuggugaaauc

SEQ ID NO: 723052 - RNA, 19 nt, Homo sapiens
ggacagcguuuucugauaa

SEQ ID NO: 723053 - RNA, 19 nt, Homo sapiens
uuauguagaugccacuuua

SEQ ID NO: 723054 - RNA, 19 nt, Homo sapiens
gaaaaugguuuaccuuguu

SEQ ID NO: 723055 - RNA, 19 nt, Homo sapiens
gaauggaacuacaguaacu

SEQ ID NO: 723056 - RNA, 19 nt, Homo sapiens
ucagguagaucacauuaug

SEQ ID NO: 723057 - RNA, 19 nt, Homo sapiens
gcucaaagaacuucaagaa

SEQ ID NO: 723058 - RNA, 19 nt, Homo sapiens
ugacuaagcuggaagacau

SEQ ID NO: 723059 - RNA, 19 nt, Homo sapiens
ggucaaccaaguauaaaua

SEQ ID NO: 723060 - RNA, 19 nt, Homo sapiens
gaaaguggcaugcuuacga

SEQ ID NO: 723061 - RNA, 19 nt, Homo sapiens
gguagaaauuggccaggua

SEQ ID NO: 723062 - RNA, 19 nt, Homo sapiens
cauaacagcuaauuucaca

SEQ ID NO: 723063 - RNA, 19 nt, Homo sapiens
uggaagcaaugaccuauuu

SEQ ID NO: 723064 - RNA, 19 nt, Homo sapiens
gaaagaagaggaucaagag

SEQ ID NO: 723065 - RNA, 19 nt, Homo sapiens
gaggauacaugaccagauc

SEQ ID NO: 723066 - RNA, 19 nt, Homo sapiens
guacauauggguucacauu

SEQ ID NO: 723067 - RNA, 19 nt, Homo sapiens
ggacuugcuucaugcuuga

SEQ ID NO: 723068 - RNA, 19 nt, Homo sapiens
guggugagaugcuauuuga

SEQ ID NO: 723069 - RNA, 19 nt, Homo sapiens
ccacagaucccagaaacua

SEQ ID NO: 723070 - RNA, 19 nt, Homo sapiens
gaagcauguucauuuaugu

SEQ ID NO: 723071 - RNA, 19 nt, Homo sapiens
ugaagcagcccguguauga

SEQ ID NO: 723072 - RNA, 19 nt, Homo sapiens
caacuuauuucaggcugua

SEQ ID NO: 723073 - RNA, 19 nt, Homo sapiens
gcccuucuguugauccuua

SEQ ID NO: 723074 - RNA, 19 nt, Homo sapiens
cauagaagaugaucaggau

SEQ ID NO: 723075 - RNA, 19 nt, Homo sapiens
gaaauggaccagcaucuuc

SEQ ID NO: 723076 - RNA, 19 nt, Homo sapiens
ugaaucaguuacucaguuu

SEQ ID NO: 723077 - RNA, 19 nt, Homo sapiens
cauugucucugauagauuu

SEQ ID NO: 723078 - RNA, 19 nt, Homo sapiens
gaccagggccaaugucuuu

SEQ ID NO: 723079 - RNA, 19 nt, Homo sapiens
gaauggugcuuaucugucu

SEQ ID NO: 723080 - RNA, 19 nt, Homo sapiens
ccacguguauuucuucaga

SEQ ID NO: 723081 - RNA, 19 nt, Homo sapiens
gagaguaccaauggauuua

SEQ ID NO: 723082 - RNA, 19 nt, Homo sapiens
gcacugggaagaauacuug

SEQ ID NO: 723083 - RNA, 19 nt, Homo sapiens
uauguuggcuagucaauau

SEQ ID NO: 723084 - RNA, 19 nt, Homo sapiens
cagaaaagcuucagcagaa

SEQ ID NO: 723085 - RNA, 19 nt, Homo sapiens
cgcaauggcuauauuauuc

SEQ ID NO: 723086 - RNA, 19 nt, Homo sapiens
ugaccugaauccaacauuu

SEQ ID NO: 723087 - RNA, 19 nt, Homo sapiens
uacagaagaugaaaucaga

SEQ ID NO: 723088 - RNA, 19 nt, Homo sapiens
caaacugagucaagagaga

SEQ ID NO: 723089 - RNA, 19 nt, Homo sapiens
cacaugugguucucuauuu

SEQ ID NO: 723090 - RNA, 19 nt, Homo sapiens
ccagcgacgugcauuguuu

SEQ ID NO: 723091 - RNA, 19 nt, Homo sapiens
cuaaaggaauugcacuuau

SEQ ID NO: 723092 - RNA, 19 nt, Homo sapiens
gcuaaaggaauugcacuua

SEQ ID NO: 723093 - RNA, 19 nt, Homo sapiens
gaugccacuuuaagcuuua

SEQ ID NO: 723094 - RNA, 19 nt, Homo sapiens
gaacuucaagaaagcaauu

SEQ ID NO: 723095 - RNA, 19 nt, Homo sapiens
cagaagaaaugcagaggau

SEQ ID NO: 723096 - RNA, 19 nt, Homo sapiens
gagaucagguuggauggaa

SEQ ID NO: 723097 - RNA, 19 nt, Homo sapiens
gagaggaaauacaugagau

SEQ ID NO: 723098 - RNA, 19 nt, Homo sapiens
gcuaugaauucaccaguaa

SEQ ID NO: 723099 - RNA, 19 nt, Homo sapiens
ucccagaguuacuuuaaua

SEQ ID NO: 723100 - RNA, 19 nt, Homo sapiens
ucauagaguugacuuguuc

SEQ ID NO: 723101 - RNA, 19 nt, Homo sapiens
gagaagggccugauuugca

SEQ ID NO: 723102 - RNA, 19 nt, Homo sapiens
ggaccugggugcgaagcua

SEQ ID NO: 723103 - RNA, 19 nt, Homo sapiens
gugcgaagcuaugaauuca

SEQ ID NO: 723104 - RNA, 19 nt, Homo sapiens
ccgaaacaauugugacuca

SEQ ID NO: 723105 - RNA, 19 nt, Homo sapiens
gauauucacuaccaaaaga

SEQ ID NO: 723106 - RNA, 19 nt, Homo sapiens
cgucucagucucauaaaua

SEQ ID NO: 723107 - RNA, 19 nt, Homo sapiens
gaaagucuguacccaucca

SEQ ID NO: 723108 - RNA, 19 nt, Homo sapiens
ggagugacauauccaagac

SEQ ID NO: 723109 - RNA, 19 nt, Homo sapiens
uaaagguuguucauagagu

SEQ ID NO: 723110 - RNA, 19 nt, Homo sapiens
gguguuuccucccagaguu

SEQ ID NO: 723111 - RNA, 19 nt, Homo sapiens
aaagguuguucauagaguu

SEQ ID NO: 723112 - RNA, 19 nt, Homo sapiens
gaucaggcaggaggaguuu

SEQ ID NO: 723113 - RNA, 19 nt, Homo sapiens
ggccgucucagucucauaa

SEQ ID NO: 723114 - RNA, 19 nt, Homo sapiens
gggagugacauauccaaga

SEQ ID NO: 723115 - RNA, 19 nt, Homo sapiens
ugaaaacuccgaaacaauu

SEQ ID NO: 723116 - RNA, 19 nt, Homo sapiens
ggugcgaagcuaugaauuc

SEQ ID NO: 723117 - RNA, 19 nt, Homo sapiens
gggagccugcggaaucuuu

SEQ ID NO: 723118 - RNA, 19 nt, Homo sapiens
ccugagaagggccugauuu

SEQ ID NO: 723119 - RNA, 19 nt, Homo sapiens
caggaggaguuugggagaa

SEQ ID NO: 723120 - RNA, 19 nt, Homo sapiens
ggaucaggcaggaggaguu

SEQ ID NO: 723121 - RNA, 19 nt, Homo sapiens
aggaggaguuugggagaaa

SEQ ID NO: 723122 - RNA, 19 nt, Homo sapiens
gaaaacuccgaaacaauug

SEQ ID NO: 723123 - RNA, 19 nt, Homo sapiens
ccucccagaguuacuuuaa

SEQ ID NO: 723124 - RNA, 19 nt, Homo sapiens
caagaccugcugcuuccaa

SEQ ID NO: 723125 - RNA, 19 nt, Homo sapiens
gaccugcugcuuccaauac

SEQ ID NO: 723126 - RNA, 19 nt, Homo sapiens
guucauagaguugacuugu

SEQ ID NO: 723127 - RNA, 19 nt, Homo sapiens
gucucagucucauaaauag

SEQ ID NO: 723128 - RNA, 19 nt, Homo sapiens
cugagaagggccugauuug

SEQ ID NO: 723129 - RNA, 19 nt, Homo sapiens
agcuaugaauucaccagua

SEQ ID NO: 723130 - RNA, 19 nt, Homo sapiens
caauugugacucagcugaa

SEQ ID NO: 723131 - RNA, 19 nt, Homo sapiens
cccagaguuacuuuaauaa

SEQ ID NO: 723132 - RNA, 19 nt, Homo sapiens
guguuuccucccagaguua

SEQ ID NO: 723133 - RNA, 19 nt, Homo sapiens
gcaaagaagucaagccuaa

SEQ ID NO: 723134 - RNA, 19 nt, Homo sapiens
gaagaaggcugagaagaaa

SEQ ID NO: 723135 - RNA, 19 nt, Homo sapiens
gagaguaaaugcuugauaa

SEQ ID NO: 723136 - RNA, 19 nt, Homo sapiens
gaaagcaacucacaaggaa

SEQ ID NO: 723137 - RNA, 19 nt, Homo sapiens
gcaaacagcugcaaaagua

SEQ ID NO: 723138 - RNA, 19 nt, Homo sapiens
ggaaauacaccauucaauu

SEQ ID NO: 723139 - RNA, 19 nt, Homo sapiens
gguaaaagcugucacaaua

SEQ ID NO: 723140 - RNA, 19 nt, Homo sapiens
gaaggaaacugccauugau

SEQ ID NO: 723141 - RNA, 19 nt, Homo sapiens
aaagaaagcuaaagaagga

SEQ ID NO: 723142 - RNA, 19 nt, Homo sapiens
ucaagaaucuguuaugugu

SEQ ID NO: 723143 - RNA, 19 nt, Homo sapiens
ccaaauggauugagugaug

SEQ ID NO: 723144 - RNA, 19 nt, Homo sapiens
gaaagcagcugugucaaag

SEQ ID NO: 723145 - RNA, 19 nt, Homo sapiens
agacugugcucuaaguuua

SEQ ID NO: 723146 - RNA, 19 nt, Homo sapiens
ugacgaagauacugauaaa

SEQ ID NO: 723147 - RNA, 19 nt, Homo sapiens
agagaaaccugaaaggaaa

SEQ ID NO: 723148 - RNA, 19 nt, Homo sapiens
aagagaaccuccaucuaua

SEQ ID NO: 723149 - RNA, 19 nt, Homo sapiens
ggacaaagcccagccauuc

SEQ ID NO: 723150 - RNA, 19 nt, Homo sapiens
ggaaaugcaucuacaacca

SEQ ID NO: 723151 - RNA, 19 nt, Homo sapiens
agucaggucuggugaauuu

SEQ ID NO: 723152 - RNA, 19 nt, Homo sapiens
gaaagagaaccuccaucua

SEQ ID NO: 723153 - RNA, 19 nt, Homo sapiens
gaucacugcugaaggaaau

SEQ ID NO: 723154 - RNA, 19 nt, Homo sapiens
caaaauaucucugagcuuu

SEQ ID NO: 723155 - RNA, 19 nt, Homo sapiens
guacaauggcuauggauuu

SEQ ID NO: 723156 - RNA, 19 nt, Homo sapiens
ucucugagcuuuagacaug

SEQ ID NO: 723157 - RNA, 19 nt, Homo sapiens
gccuaaaccuccacaacua

SEQ ID NO: 723158 - RNA, 19 nt, Homo sapiens
gaagaggacagucacagaa

SEQ ID NO: 723159 - RNA, 19 nt, Homo sapiens
aaagagaaccuccaucuau

SEQ ID NO: 723160 - RNA, 19 nt, Homo sapiens
cgaagauacugauaaagga

SEQ ID NO: 723161 - RNA, 19 nt, Homo sapiens
ugagaucacugcugaagga

SEQ ID NO: 723162 - RNA, 19 nt, Homo sapiens
gugaugagcagacauguuu

SEQ ID NO: 723163 - RNA, 19 nt, Homo sapiens
gaagcaacaaggacaguaa

SEQ ID NO: 723164 - RNA, 19 nt, Homo sapiens
agaaggaacugaagaugug

SEQ ID NO: 723165 - RNA, 19 nt, Homo sapiens
gcagacaugaagcaucuua

SEQ ID NO: 723166 - RNA, 19 nt, Homo sapiens
caucagaagucacagaauc

SEQ ID NO: 723167 - RNA, 19 nt, Homo sapiens
caaacaagacauagugaaa

SEQ ID NO: 723168 - RNA, 19 nt, Homo sapiens
gcucuaagaauggguaaua

SEQ ID NO: 723169 - RNA, 19 nt, Homo sapiens
caaagucaccaaagaaaga

SEQ ID NO: 723170 - RNA, 19 nt, Homo sapiens
gaacagaaagaucaguaug

SEQ ID NO: 723171 - RNA, 19 nt, Homo sapiens
caaaagauguugaagaugu

SEQ ID NO: 723172 - RNA, 19 nt, Homo sapiens
gaagagaaaguuccagcuu

SEQ ID NO: 723173 - RNA, 19 nt, Homo sapiens
gaacagaagaaagcuaaga

SEQ ID NO: 723174 - RNA, 19 nt, Homo sapiens
ggauuucaguuuccuuuca

SEQ ID NO: 723175 - RNA, 19 nt, Homo sapiens
ugaagaagaugaugauggu

SEQ ID NO: 723176 - RNA, 19 nt, Homo sapiens
caaauggauugagugauga

SEQ ID NO: 723177 - RNA, 19 nt, Homo sapiens
ccagcaaagucaccaaaga

SEQ ID NO: 723178 - RNA, 19 nt, Homo sapiens
gacaucaucucaucugaag

SEQ ID NO: 723179 - RNA, 19 nt, Homo sapiens
ggagaguaaaugcuugaua

SEQ ID NO: 723180 - RNA, 19 nt, Homo sapiens
uguaccagcuucaaagaaa

SEQ ID NO: 723181 - RNA, 19 nt, Homo sapiens
ccaagacaguggagcaaga

SEQ ID NO: 723182 - RNA, 19 nt, Homo sapiens
gacagucacagaagacaua

SEQ ID NO: 723183 - RNA, 19 nt, Homo sapiens
uggcuucaguuagcuauua

SEQ ID NO: 723184 - RNA, 19 nt, Homo sapiens
caugaagcaucuuagagaa

SEQ ID NO: 723185 - RNA, 19 nt, Homo sapiens
gaacaucagaagucacaga

SEQ ID NO: 723186 - RNA, 19 nt, Homo sapiens
gagaaccuccaucuauaaa

SEQ ID NO: 723187 - RNA, 19 nt, Homo sapiens
agaagaaggcugagaagaa

SEQ ID NO: 723188 - RNA, 19 nt, Homo sapiens
agaaagaucaguaugcauu

SEQ ID NO: 723189 - RNA, 19 nt, Homo sapiens
gucaaagcaugaacagaaa

SEQ ID NO: 723190 - RNA, 19 nt, Homo sapiens
gaugagcagacauguuuaa

SEQ ID NO: 723191 - RNA, 19 nt, Homo sapiens
gaauuccuggcuucaguua

SEQ ID NO: 723192 - RNA, 19 nt, Homo sapiens
gaaggaaaugcaucuacaa

SEQ ID NO: 723193 - RNA, 19 nt, Homo sapiens
aaagaaagaacacucaguu

SEQ ID NO: 723194 - RNA, 19 nt, Homo sapiens
ugaaggaaaugcaucuaca

SEQ ID NO: 723195 - RNA, 19 nt, Homo sapiens
gauaaaggagaaauagaug

SEQ ID NO: 723196 - RNA, 19 nt, Homo sapiens
gcaaauacacaaacaagac

SEQ ID NO: 723197 - RNA, 19 nt, Homo sapiens
guccaaagcaggcaaagaa

SEQ ID NO: 723198 - RNA, 19 nt, Homo sapiens
ggagauuggugcgguuuca

SEQ ID NO: 723199 - RNA, 19 nt, Homo sapiens
ccaagugacaaacaaguaa

SEQ ID NO: 723200 - RNA, 19 nt, Homo sapiens
acacaaagauaagacugaa

SEQ ID NO: 723201 - RNA, 19 nt, Homo sapiens
cuacagacugcuauaaauu

SEQ ID NO: 723202 - RNA, 19 nt, Homo sapiens
guucaggcaauuaagaaua

SEQ ID NO: 723203 - RNA, 19 nt, Homo sapiens
gacaguaaacacacaugua

SEQ ID NO: 723204 - RNA, 19 nt, Homo sapiens
gacaguggagcaagaaauu

SEQ ID NO: 723205 - RNA, 19 nt, Homo sapiens
ugucaaagcaugaacagaa

SEQ ID NO: 723206 - RNA, 19 nt, Homo sapiens
uaucugacaucaucucauc

SEQ ID NO: 723207 - RNA, 19 nt, Homo sapiens
aagaaucuguuaugugugu

SEQ ID NO: 723208 - RNA, 19 nt, Homo sapiens
gcaagaguaucaaaagaug

SEQ ID NO: 723209 - RNA, 19 nt, Homo sapiens
caucauauggguaucuaaa

SEQ ID NO: 723210 - RNA, 19 nt, Homo sapiens
gaaagaucaguaugcauuc

SEQ ID NO: 723211 - RNA, 19 nt, Homo sapiens
gauuggcucagauccuuua

SEQ ID NO: 723212 - RNA, 19 nt, Homo sapiens
uggggaagcuuauauaaaa

SEQ ID NO: 723213 - RNA, 19 nt, Homo sapiens
gaauaugcaacccagagaa

SEQ ID NO: 723214 - RNA, 19 nt, Homo sapiens
gaacaucgagaaagagaac

SEQ ID NO: 723215 - RNA, 19 nt, Homo sapiens
gaaagaagagaaaguucca

SEQ ID NO: 723216 - RNA, 19 nt, Homo sapiens
uaaagggaaagaagagaaa

SEQ ID NO: 723217 - RNA, 19 nt, Homo sapiens
aaacugaacgagccaaaga

SEQ ID NO: 723218 - RNA, 19 nt, Homo sapiens
caagcucuauugccaagau

SEQ ID NO: 723219 - RNA, 19 nt, Homo sapiens
cagcaaagucaccaaagaa

SEQ ID NO: 723220 - RNA, 19 nt, Homo sapiens
uaugcauucugucgauaua

SEQ ID NO: 723221 - RNA, 19 nt, Homo sapiens
caagagaaaccugaaagga

SEQ ID NO: 723222 - RNA, 19 nt, Homo sapiens
guacuacagacugcuauaa

SEQ ID NO: 723223 - RNA, 19 nt, Homo sapiens
gagcucuggucaagcaaau

SEQ ID NO: 723224 - RNA, 19 nt, Homo sapiens
aaauggaucugugcccaaa

SEQ ID NO: 723225 - RNA, 19 nt, Homo sapiens
aaaggaacaucagaaguca

SEQ ID NO: 723226 - RNA, 19 nt, Homo sapiens
uaaaagcugucacaauaga

SEQ ID NO: 723227 - RNA, 19 nt, Homo sapiens
agaaggaaacugccauuga

SEQ ID NO: 723228 - RNA, 19 nt, Homo sapiens
agagaaagcagcuguguca

SEQ ID NO: 723229 - RNA, 19 nt, Homo sapiens
aaauaucucugagcuuuag

SEQ ID NO: 723230 - RNA, 19 nt, Homo sapiens
uaagaauggguaauaguug

SEQ ID NO: 723231 - RNA, 19 nt, Homo sapiens
cuaagaauggguaauaguu

SEQ ID NO: 723232 - RNA, 19 nt, Homo sapiens
gaaaggguggccaaaugga

SEQ ID NO: 723233 - RNA, 19 nt, Homo sapiens
guacgcaccugcacauuua

SEQ ID NO: 723234 - RNA, 19 nt, Homo sapiens
gaaagcagcuguccugugu

SEQ ID NO: 723235 - RNA, 19 nt, Homo sapiens
caauauggcuacuggguua

SEQ ID NO: 723236 - RNA, 19 nt, Homo sapiens
gcaauggauuucucaguaa

SEQ ID NO: 723237 - RNA, 19 nt, Homo sapiens
ggaaacauaucuaauccuu

SEQ ID NO: 723238 - RNA, 19 nt, Homo sapiens
gaaggcaucuugucccuau

SEQ ID NO: 723239 - RNA, 19 nt, Homo sapiens
uuaaagagcugacagaugu

SEQ ID NO: 723240 - RNA, 19 nt, Homo sapiens
gcuaaugccuuaaugaaau

SEQ ID NO: 723241 - RNA, 19 nt, Homo sapiens
acaaagaccuuauuuccaa

SEQ ID NO: 723242 - RNA, 19 nt, Homo sapiens
gcaaaggaaacauaucuaa

SEQ ID NO: 723243 - RNA, 19 nt, Homo sapiens
aagagaugcuuguacauua

SEQ ID NO: 723244 - RNA, 19 nt, Homo sapiens
gaaaagaugucagccauuu

SEQ ID NO: 723245 - RNA, 19 nt, Homo sapiens
caccaaacauuccgcauaa

SEQ ID NO: 723246 - RNA, 19 nt, Homo sapiens
ccaagaaacuaaagagugu

SEQ ID NO: 723247 - RNA, 19 nt, Homo sapiens
aacaauagcuggcucuaaa

SEQ ID NO: 723248 - RNA, 19 nt, Homo sapiens
caagaaguccauaguaauu

SEQ ID NO: 723249 - RNA, 19 nt, Homo sapiens
uaaacgagguggucaagga

SEQ ID NO: 723250 - RNA, 19 nt, Homo sapiens
caacucauauccacguuau

SEQ ID NO: 723251 - RNA, 19 nt, Homo sapiens
gaccaucucuuccuuucuu

SEQ ID NO: 723252 - RNA, 19 nt, Homo sapiens
cuacuggguuauaggauua

SEQ ID NO: 723253 - RNA, 19 nt, Homo sapiens
agugaaagcuggacauuga

SEQ ID NO: 723254 - RNA, 19 nt, Homo sapiens
cugagaagcuggaagauga

SEQ ID NO: 723255 - RNA, 19 nt, Homo sapiens
uagcaaagcaucauagauu

SEQ ID NO: 723256 - RNA, 19 nt, Homo sapiens
ccaccgagcuccugagugu

SEQ ID NO: 723257 - RNA, 19 nt, Homo sapiens
gcccaccgcuaaugccuua

SEQ ID NO: 723258 - RNA, 19 nt, Homo sapiens
uaauuccucugaucacuuu

SEQ ID NO: 723259 - RNA, 19 nt, Homo sapiens
ucaaagaggucaagaugag

SEQ ID NO: 723260 - RNA, 19 nt, Homo sapiens
guaaggcacuuuucuauga

SEQ ID NO: 723261 - RNA, 19 nt, Homo sapiens
caagcucuaugaucuuaaa

SEQ ID NO: 723262 - RNA, 19 nt, Homo sapiens
ggaggaaggugaggugaau

SEQ ID NO: 723263 - RNA, 19 nt, Homo sapiens
ccaagaacuucaagaguca

SEQ ID NO: 723264 - RNA, 19 nt, Homo sapiens
gcaccugaguucaucucua

SEQ ID NO: 723265 - RNA, 19 nt, Homo sapiens
caaaaucuguuuccaagaa

SEQ ID NO: 723266 - RNA, 19 nt, Homo sapiens
uacaagcucuaugaucuua

SEQ ID NO: 723267 - RNA, 19 nt, Homo sapiens
gcaagaaguccauaguaau

SEQ ID NO: 723268 - RNA, 19 nt, Homo sapiens
cagcagaguugguucuuuc

SEQ ID NO: 723269 - RNA, 19 nt, Homo sapiens
gaaacuaaagaguguauuc

SEQ ID NO: 723270 - RNA, 19 nt, Homo sapiens
gcacucaucuacaaguucu

SEQ ID NO: 723271 - RNA, 19 nt, Homo sapiens
gagcacucaucuacaaguu

SEQ ID NO: 723272 - RNA, 19 nt, Homo sapiens
guagaugugucuggaaaga

SEQ ID NO: 723273 - RNA, 19 nt, Homo sapiens
caauggauuucucaguaaa

SEQ ID NO: 723274 - RNA, 19 nt, Homo sapiens
agaaacuugucaacucaua

SEQ ID NO: 723275 - RNA, 19 nt, Homo sapiens
caaagaccuuauuuccaaa

SEQ ID NO: 723276 - RNA, 19 nt, Homo sapiens
gcuacuggguuauaggauu

SEQ ID NO: 723277 - RNA, 19 nt, Homo sapiens
ugcaauggauuucucagua

SEQ ID NO: 723278 - RNA, 19 nt, Homo sapiens
cgauuucacucauaacaau

SEQ ID NO: 723279 - RNA, 19 nt, Homo sapiens
ggaaaucccaaaucuagau

SEQ ID NO: 723280 - RNA, 19 nt, Homo sapiens
agcaagaaguccauaguaa

SEQ ID NO: 723281 - RNA, 19 nt, Homo sapiens
gaagaaagagaaacuuguc

SEQ ID NO: 723282 - RNA, 19 nt, Homo sapiens
uaucuaauccuuccuauag

SEQ ID NO: 723283 - RNA, 19 nt, Homo sapiens
gaauucaaauccaugugau

SEQ ID NO: 723284 - RNA, 19 nt, Homo sapiens
ggauuucucaguaaaggua

SEQ ID NO: 723285 - RNA, 19 nt, Homo sapiens
uaccuugguuucacuagua

SEQ ID NO: 723286 - RNA, 19 nt, Homo sapiens
ccagauauagaccucaaua

SEQ ID NO: 723287 - RNA, 19 nt, Homo sapiens
ggacauugaagaagccaaa

SEQ ID NO: 723288 - RNA, 19 nt, Homo sapiens
ucacuuacaagcucuauga

SEQ ID NO: 723289 - RNA, 19 nt, Homo sapiens
ggcacgauuucacucauaa

SEQ ID NO: 723290 - RNA, 19 nt, Homo sapiens
gaacaccaaggucaccaaa

SEQ ID NO: 723291 - RNA, 19 nt, Homo sapiens
caguaaagguagacauaga

SEQ ID NO: 723292 - RNA, 19 nt, Homo sapiens
uaauguauccuucagaaug

SEQ ID NO: 723293 - RNA, 19 nt, Homo sapiens
gagagaaccgccuggaaga

SEQ ID NO: 723294 - RNA, 19 nt, Homo sapiens
acaccaaggucaccaaaca

SEQ ID NO: 723295 - RNA, 19 nt, Homo sapiens
agagaaacuugucaacuca

SEQ ID NO: 723296 - RNA, 19 nt, Homo sapiens
gauuacagaauacauguga

SEQ ID NO: 723297 - RNA, 19 nt, Homo sapiens
guauugcuguaauuccuuu

SEQ ID NO: 723298 - RNA, 19 nt, Homo sapiens
gcaaggaagggcucuguuc

SEQ ID NO: 723299 - RNA, 19 nt, Homo sapiens
agaugugucuggaaagauu

SEQ ID NO: 723300 - RNA, 19 nt, Homo sapiens
ggcaggcauugucucauuu

SEQ ID NO: 723301 - RNA, 19 nt, Homo sapiens
gaagagcucuggguuugcu

SEQ ID NO: 723302 - RNA, 19 nt, Homo sapiens
aaagucauuugcuggguuu

SEQ ID NO: 723303 - RNA, 19 nt, Homo sapiens
gaaccucugagccuagauu

SEQ ID NO: 723304 - RNA, 19 nt, Homo sapiens
gccuggagcuccugacaga

SEQ ID NO: 723305 - RNA, 19 nt, Homo sapiens
uucagaauguguugguuua

SEQ ID NO: 723306 - RNA, 19 nt, Homo sapiens
aagagaaacuugucaacuc

SEQ ID NO: 723307 - RNA, 19 nt, Homo sapiens
aggaagagcucuggguuug

SEQ ID NO: 723308 - RNA, 19 nt, Homo sapiens
ucaccaaacauuccgcaua

SEQ ID NO: 723309 - RNA, 19 nt, Homo sapiens
agagaugcuuguacauuau

SEQ ID NO: 723310 - RNA, 19 nt, Homo sapiens
auaacaaucuuacccuuuc

SEQ ID NO: 723311 - RNA, 19 nt, Homo sapiens
ggaugugauugacgucaug

SEQ ID NO: 723312 - RNA, 19 nt, Homo sapiens
uagagaugcugcaggaugu

SEQ ID NO: 723313 - RNA, 19 nt, Homo sapiens
gauaaaggaggaucaagag

SEQ ID NO: 723314 - RNA, 19 nt, Homo sapiens
gucaaggaaugucaggaaa

SEQ ID NO: 723315 - RNA, 19 nt, Homo sapiens
aguaauguauccuucagaa

SEQ ID NO: 723316 - RNA, 19 nt, Homo sapiens
cugaagcacugcaggaguu

SEQ ID NO: 723317 - RNA, 19 nt, Homo sapiens
ggucaaggaaugucaggaa

SEQ ID NO: 723318 - RNA, 19 nt, Homo sapiens
cauaacaaucuuacccuuu

SEQ ID NO: 723319 - RNA, 19 nt, Homo sapiens
gaaggcacgauuucacuca

SEQ ID NO: 723320 - RNA, 19 nt, Homo sapiens
ccacggagcacucaucuac

SEQ ID NO: 723321 - RNA, 19 nt, Homo sapiens
gcaccugcacauuuaagaa

SEQ ID NO: 723322 - RNA, 19 nt, Homo sapiens
cuucgaauguugcuauuuc

SEQ ID NO: 723323 - RNA, 19 nt, Homo sapiens
gaaagcuggacauugaaga

SEQ ID NO: 723324 - RNA, 19 nt, Homo sapiens
ugcagaggcugauaaagga

SEQ ID NO: 723325 - RNA, 19 nt, Homo sapiens
gcagugcaauggauuucuc

SEQ ID NO: 723326 - RNA, 19 nt, Homo sapiens
cuuacaagcucuaugaucu

SEQ ID NO: 723327 - RNA, 19 nt, Homo sapiens
ucaagacuccucugcuuug

SEQ ID NO: 723328 - RNA, 19 nt, Homo sapiens
gaagaucgagagacagaag

SEQ ID NO: 723329 - RNA, 19 nt, Homo sapiens
gaaacuugucaacucauau

SEQ ID NO: 723330 - RNA, 19 nt, Homo sapiens
gaaagagaaacuugucaac

SEQ ID NO: 723331 - RNA, 19 nt, Homo sapiens
cuaugacucuucacauugu

SEQ ID NO: 723332 - RNA, 19 nt, Homo sapiens
guaauuguauugccguacu

SEQ ID NO: 723333 - RNA, 19 nt, Homo sapiens
ggaaugagguucagaaagg

SEQ ID NO: 723334 - RNA, 19 nt, Homo sapiens
ggacauguguaacuacuug

SEQ ID NO: 723335 - RNA, 19 nt, Homo sapiens
ggucucaucuguaauguga

SEQ ID NO: 723336 - RNA, 19 nt, Homo sapiens
guacagggcugggcacuga

SEQ ID NO: 723337 - RNA, 19 nt, Homo sapiens
caaaggugcugguagaaga

SEQ ID NO: 723338 - RNA, 19 nt, Homo sapiens
ggccauggcugaugccuuu

SEQ ID NO: 723339 - RNA, 19 nt, Homo sapiens
ggaagaauuucauguaucg

SEQ ID NO: 723340 - RNA, 19 nt, Homo sapiens
ccaaggagcagcuguuuga

SEQ ID NO: 723341 - RNA, 19 nt, Homo sapiens
gagcacgucugguucuaug

SEQ ID NO: 723342 - RNA, 19 nt, Homo sapiens
gaaugccacuucccaaaca

SEQ ID NO: 723343 - RNA, 19 nt, Homo sapiens
gaggugagccggaucuuga

SEQ ID NO: 723344 - RNA, 19 nt, Homo sapiens
gagaagccgugguggugaa

SEQ ID NO: 723345 - RNA, 19 nt, Homo sapiens
ggagggccguucagugaug

SEQ ID NO: 723346 - RNA, 19 nt, Homo sapiens
ggacacagauauggaggau

SEQ ID NO: 723347 - RNA, 19 nt, Homo sapiens
uggaggagguauucuugua

SEQ ID NO: 723348 - RNA, 19 nt, Homo sapiens
gaugcaggaugaaggaaga

SEQ ID NO: 723349 - RNA, 19 nt, Homo sapiens
ggacccagccgugguguuu

SEQ ID NO: 723350 - RNA, 19 nt, Homo sapiens
agagaaggcuggagagaag

SEQ ID NO: 723351 - RNA, 19 nt, Homo sapiens
gcucagguguccuucuuca

SEQ ID NO: 723352 - RNA, 19 nt, Homo sapiens
cuacuggcuuggcaacuuu

SEQ ID NO: 723353 - RNA, 19 nt, Homo sapiens
gauaaaggaaugagguuca

SEQ ID NO: 723354 - RNA, 19 nt, Homo sapiens
caagguagagugccuagga

SEQ ID NO: 723355 - RNA, 19 nt, Homo sapiens
uccagggucucaucuguaa

SEQ ID NO: 723356 - RNA, 19 nt, Homo sapiens
gaauugcuguggccucucu

SEQ ID NO: 723357 - RNA, 19 nt, Homo sapiens
guacccagccuccuucuuc

SEQ ID NO: 723358 - RNA, 19 nt, Homo sapiens
cuaagaagugggugaauga

SEQ ID NO: 723359 - RNA, 19 nt, Homo sapiens
guuugaggcugcauugaug

SEQ ID NO: 723360 - RNA, 19 nt, Homo sapiens
cugcugcucuggaagaauu

SEQ ID NO: 723361 - RNA, 19 nt, Homo sapiens
gagaggaggacgaggaugu

SEQ ID NO: 723362 - RNA, 19 nt, Homo sapiens
gccggaaccugucugacuu

SEQ ID NO: 723363 - RNA, 19 nt, Homo sapiens
caucuugaguggccucuuc

SEQ ID NO: 723364 - RNA, 19 nt, Homo sapiens
ccaccacccuguccaucuu

SEQ ID NO: 723365 - RNA, 19 nt, Homo sapiens
gcuccagggucucaucugu

SEQ ID NO: 723366 - RNA, 19 nt, Homo sapiens
gaauggcaagggcaaggua

SEQ ID NO: 723367 - RNA, 19 nt, Homo sapiens
gcucaggacagucucaaga

SEQ ID NO: 723368 - RNA, 19 nt, Homo sapiens
agaaguuccugcugaagug

SEQ ID NO: 723369 - RNA, 19 nt, Homo sapiens
gcucaaauaccgagaaggu

SEQ ID NO: 723370 - RNA, 19 nt, Homo sapiens
gcagaugcaggaugaagga

SEQ ID NO: 723371 - RNA, 19 nt, Homo sapiens
ugcuugagcucuucucuga

SEQ ID NO: 723372 - RNA, 19 nt, Homo sapiens
cucaagaucugguucaaca

SEQ ID NO: 723373 - RNA, 19 nt, Homo sapiens
gaucacaccgcucauguac

SEQ ID NO: 723374 - RNA, 19 nt, Homo sapiens
gugcucagguguccuucuu

SEQ ID NO: 723375 - RNA, 19 nt, Homo sapiens
uaagaucagggacagguuu

SEQ ID NO: 723376 - RNA, 19 nt, Homo sapiens
gagguauucuuguacuucu

SEQ ID NO: 723377 - RNA, 19 nt, Homo sapiens
ccucgaccguguccugaaa

SEQ ID NO: 723378 - RNA, 19 nt, Homo sapiens
cuggaagaauuucauguau

SEQ ID NO: 723379 - RNA, 19 nt, Homo sapiens
gaggagguauucuuguacu

SEQ ID NO: 723380 - RNA, 19 nt, Homo sapiens
ggaagcauggccaccuuug

SEQ ID NO: 723381 - RNA, 19 nt, Homo sapiens
ccggccagcuucacucuug

SEQ ID NO: 723382 - RNA, 19 nt, Homo sapiens
ucacgaggaccaauaagau

SEQ ID NO: 723383 - RNA, 19 nt, Homo sapiens
ccaagcaccugcagcucau

SEQ ID NO: 723384 - RNA, 19 nt, Homo sapiens
ucacucuuguccucauuga

SEQ ID NO: 723385 - RNA, 19 nt, Homo sapiens
ucagccaguuccucgauga

SEQ ID NO: 723386 - RNA, 19 nt, Homo sapiens
gaucugguucaacaacaaa

SEQ ID NO: 723387 - RNA, 19 nt, Homo sapiens
cgugcugccugcccucuuu

SEQ ID NO: 723388 - RNA, 19 nt, Homo sapiens
aguacaacgugcuguuuga

SEQ ID NO: 723389 - RNA, 19 nt, Homo sapiens
uggaagaauuucauguauc

SEQ ID NO: 723390 - RNA, 19 nt, Homo sapiens
ccaaacgcgucagccaguu

SEQ ID NO: 723391 - RNA, 19 nt, Homo sapiens
ggagguauucuuguacuuc

SEQ ID NO: 723392 - RNA, 19 nt, Homo sapiens
gggagguggucggcaagaa

SEQ ID NO: 723393 - RNA, 19 nt, Homo sapiens
ucaggacagucucaagauc

SEQ ID NO: 723394 - RNA, 19 nt, Homo sapiens
gggcgucuguccucaguac

SEQ ID NO: 723395 - RNA, 19 nt, Homo sapiens
cggagugccuguccuugga

SEQ ID NO: 723396 - RNA, 19 nt, Homo sapiens
gucugggacucucauggua

SEQ ID NO: 723397 - RNA, 19 nt, Homo sapiens
cuguauggcuggucgauca

SEQ ID NO: 723398 - RNA, 19 nt, Homo sapiens
gaagcuguccguggccauu

SEQ ID NO: 723399 - RNA, 19 nt, Homo sapiens
ucuggaagaauuucaugua

SEQ ID NO: 723400 - RNA, 19 nt, Homo sapiens
acccaaaggugcugguaga

SEQ ID NO: 723401 - RNA, 19 nt, Homo sapiens
ggacgaggacaccgaagag

SEQ ID NO: 723402 - RNA, 19 nt, Homo sapiens
gaagcauggccaccuuugu

SEQ ID NO: 723403 - RNA, 19 nt, Homo sapiens
caucguggugcucaucuuu

SEQ ID NO: 723404 - RNA, 19 nt, Homo sapiens
ucugggacauguguaacua

SEQ ID NO: 723405 - RNA, 19 nt, Homo sapiens
acuaagaagugggugaaug

SEQ ID NO: 723406 - RNA, 19 nt, Homo sapiens
aaaggaaugagguucagaa

SEQ ID NO: 723407 - RNA, 19 nt, Homo sapiens
gcuggaggagguauucuug

SEQ ID NO: 723408 - RNA, 19 nt, Homo sapiens
cuugagcucuucucugauc

SEQ ID NO: 723409 - RNA, 19 nt, Homo sapiens
cagcuucgccacacucuuc

SEQ ID NO: 723410 - RNA, 19 nt, Homo sapiens
gagaaggucgcacgcugau

SEQ ID NO: 723411 - RNA, 19 nt, Homo sapiens
ccucuuggccauggugaua

SEQ ID NO: 723412 - RNA, 19 nt, Homo sapiens
gcaucguggugcucaucuu

SEQ ID NO: 723413 - RNA, 19 nt, Homo sapiens
gcaacuuucucugggacau

SEQ ID NO: 723414 - RNA, 19 nt, Homo sapiens
gggauaaaggaaugagguu

SEQ ID NO: 723415 - RNA, 19 nt, Homo sapiens
gcaggacgcacacgcugau

SEQ ID NO: 723416 - RNA, 19 nt, Homo sapiens
ggaggugagccggaucuug

SEQ ID NO: 723417 - RNA, 19 nt, Homo sapiens
acaccagccucgaggagau

SEQ ID NO: 723418 - RNA, 19 nt, Homo sapiens
ccacccaccaccuggauga

SEQ ID NO: 723419 - RNA, 19 nt, Homo sapiens
caacgugcuguuugacaug

SEQ ID NO: 723420 - RNA, 19 nt, Homo sapiens
gcaccaugaaugccacuuc

SEQ ID NO: 723421 - RNA, 19 nt, Homo sapiens
cagggucucaucuguaaug

SEQ ID NO: 723422 - RNA, 19 nt, Homo sapiens
cgaucacaccgcucaugua

SEQ ID NO: 723423 - RNA, 19 nt, Homo sapiens
ugaugcugcugcucuggaa

SEQ ID NO: 723424 - RNA, 19 nt, Homo sapiens
acaacgugcuguuugacau

SEQ ID NO: 723425 - RNA, 19 nt, Homo sapiens
ucuacuggcuuggcaacuu

SEQ ID NO: 723426 - RNA, 19 nt, Homo sapiens
gaaggcugacacugacaug

SEQ ID NO: 723427 - RNA, 19 nt, Homo sapiens
gugaacaacaccugcuuuc

SEQ ID NO: 723428 - RNA, 19 nt, Homo sapiens
ccuaggagcccuggacuca

SEQ ID NO: 723429 - RNA, 19 nt, Homo sapiens
ggaggagguauucuuguac

SEQ ID NO: 723430 - RNA, 19 nt, Homo sapiens
ggucuuugccauguccuuu

SEQ ID NO: 723431 - RNA, 19 nt, Homo sapiens
gggugaaugaggucaggua

SEQ ID NO: 723432 - RNA, 19 nt, Homo sapiens
gccugaagacuaagaagug

SEQ ID NO: 723433 - RNA, 19 nt, Homo sapiens
ggacauguguaacuacuug

SEQ ID NO: 723434 - RNA, 19 nt, Homo sapiens
guacagggcugggcacuga

SEQ ID NO: 723435 - RNA, 19 nt, Homo sapiens
caaaggugcugguagaaga

SEQ ID NO: 723436 - RNA, 19 nt, Homo sapiens
ggccauggcugaugccuuu

SEQ ID NO: 723437 - RNA, 19 nt, Homo sapiens
ccaaggagcagcuguuuga

SEQ ID NO: 723438 - RNA, 19 nt, Homo sapiens
gagcacgucugguucuaug

SEQ ID NO: 723439 - RNA, 19 nt, Homo sapiens
gaggugagccggaucuuga

SEQ ID NO: 723440 - RNA, 19 nt, Homo sapiens
gagaagccgugguggugaa

SEQ ID NO: 723441 - RNA, 19 nt, Homo sapiens
ggagggccguucagugaug

SEQ ID NO: 723442 - RNA, 19 nt, Homo sapiens
ggacacagauauggaggau

SEQ ID NO: 723443 - RNA, 19 nt, Homo sapiens
uggaggagguauucuugua

SEQ ID NO: 723444 - RNA, 19 nt, Homo sapiens
gaugcaggaugaaggaaga

SEQ ID NO: 723445 - RNA, 19 nt, Homo sapiens
ggacccagccgugguguuu

SEQ ID NO: 723446 - RNA, 19 nt, Homo sapiens
agagaaggcuggagagaag

SEQ ID NO: 723447 - RNA, 19 nt, Homo sapiens
gcucagguguccuucuuca

SEQ ID NO: 723448 - RNA, 19 nt, Homo sapiens
cuacuggcuuggcaacuuu

SEQ ID NO: 723449 - RNA, 19 nt, Homo sapiens
caagguagagugccuagga

SEQ ID NO: 723450 - RNA, 19 nt, Homo sapiens
guacccagccuccuucuuc

SEQ ID NO: 723451 - RNA, 19 nt, Homo sapiens
cuaagaagugggugaauga

SEQ ID NO: 723452 - RNA, 19 nt, Homo sapiens
guuugaggcugcauugaug

SEQ ID NO: 723453 - RNA, 19 nt, Homo sapiens
gagaggaggacgaggaugu

SEQ ID NO: 723454 - RNA, 19 nt, Homo sapiens
gccggaaccugucugacuu

SEQ ID NO: 723455 - RNA, 19 nt, Homo sapiens
caucuugaguggccucuuc

SEQ ID NO: 723456 - RNA, 19 nt, Homo sapiens
ccaccacccuguccaucuu

SEQ ID NO: 723457 - RNA, 19 nt, Homo sapiens
gaauggcaagggcaaggua

SEQ ID NO: 723458 - RNA, 19 nt, Homo sapiens
gcucaggacagucucaaga

SEQ ID NO: 723459 - RNA, 19 nt, Homo sapiens
agaaguuccugcugaagug

SEQ ID NO: 723460 - RNA, 19 nt, Homo sapiens
gcucaaauaccgagaaggu

SEQ ID NO: 723461 - RNA, 19 nt, Homo sapiens
gcagaugcaggaugaagga

SEQ ID NO: 723462 - RNA, 19 nt, Homo sapiens
ugcuugagcucuucucuga

SEQ ID NO: 723463 - RNA, 19 nt, Homo sapiens
cucaagaucugguucaaca

SEQ ID NO: 723464 - RNA, 19 nt, Homo sapiens
gaucacaccgcucauguac

SEQ ID NO: 723465 - RNA, 19 nt, Homo sapiens
gugcucagguguccuucuu

SEQ ID NO: 723466 - RNA, 19 nt, Homo sapiens
uaagaucagggacagguuu

SEQ ID NO: 723467 - RNA, 19 nt, Homo sapiens
gagguauucuuguacuucu

SEQ ID NO: 723468 - RNA, 19 nt, Homo sapiens
ccucgaccguguccugaaa

SEQ ID NO: 723469 - RNA, 19 nt, Homo sapiens
gaggagguauucuuguacu

SEQ ID NO: 723470 - RNA, 19 nt, Homo sapiens
ggaagcauggccaccuuug

SEQ ID NO: 723471 - RNA, 19 nt, Homo sapiens
ccggccagcuucacucuug

SEQ ID NO: 723472 - RNA, 19 nt, Homo sapiens
ucacgaggaccaauaagau

SEQ ID NO: 723473 - RNA, 19 nt, Homo sapiens
ccaagcaccugcagcucau

SEQ ID NO: 723474 - RNA, 19 nt, Homo sapiens
ucacucuuguccucauuga

SEQ ID NO: 723475 - RNA, 19 nt, Homo sapiens
ucagccaguuccucgauga

SEQ ID NO: 723476 - RNA, 19 nt, Homo sapiens
gaucugguucaacaacaaa

SEQ ID NO: 723477 - RNA, 19 nt, Homo sapiens
cgugcugccugcccucuuu

SEQ ID NO: 723478 - RNA, 19 nt, Homo sapiens
aguacaacgugcuguuuga

SEQ ID NO: 723479 - RNA, 19 nt, Homo sapiens
ccaaacgcgucagccaguu

SEQ ID NO: 723480 - RNA, 19 nt, Homo sapiens
ggagguauucuuguacuuc

SEQ ID NO: 723481 - RNA, 19 nt, Homo sapiens
gggagguggucggcaagaa

SEQ ID NO: 723482 - RNA, 19 nt, Homo sapiens
ucaggacagucucaagauc

SEQ ID NO: 723483 - RNA, 19 nt, Homo sapiens
gggcgucuguccucaguac

SEQ ID NO: 723484 - RNA, 19 nt, Homo sapiens
cggagugccuguccuugga

SEQ ID NO: 723485 - RNA, 19 nt, Homo sapiens
gucugggacucucauggua

SEQ ID NO: 723486 - RNA, 19 nt, Homo sapiens
cuguauggcuggucgauca

SEQ ID NO: 723487 - RNA, 19 nt, Homo sapiens
gaagcuguccguggccauu

SEQ ID NO: 723488 - RNA, 19 nt, Homo sapiens
acccaaaggugcugguaga

SEQ ID NO: 723489 - RNA, 19 nt, Homo sapiens
ggacgaggacaccgaagag

SEQ ID NO: 723490 - RNA, 19 nt, Homo sapiens
gaagcauggccaccuuugu

SEQ ID NO: 723491 - RNA, 19 nt, Homo sapiens
caucguggugcucaucuuu

SEQ ID NO: 723492 - RNA, 19 nt, Homo sapiens
ucugggacauguguaacua

SEQ ID NO: 723493 - RNA, 19 nt, Homo sapiens
acuaagaagugggugaaug

SEQ ID NO: 723494 - RNA, 19 nt, Homo sapiens
gcuggaggagguauucuug

SEQ ID NO: 723495 - RNA, 19 nt, Homo sapiens
cuugagcucuucucugauc

SEQ ID NO: 723496 - RNA, 19 nt, Homo sapiens
cagcuucgccacacucuuc

SEQ ID NO: 723497 - RNA, 19 nt, Homo sapiens
gagaaggucgcacgcugau

SEQ ID NO: 723498 - RNA, 19 nt, Homo sapiens
ccucuuggccauggugaua

SEQ ID NO: 723499 - RNA, 19 nt, Homo sapiens
gcaucguggugcucaucuu

SEQ ID NO: 723500 - RNA, 19 nt, Homo sapiens
gcaacuuucucugggacau

SEQ ID NO: 723501 - RNA, 19 nt, Homo sapiens
gcaggacgcacacgcugau

SEQ ID NO: 723502 - RNA, 19 nt, Homo sapiens
ggaggugagccggaucuug

SEQ ID NO: 723503 - RNA, 19 nt, Homo sapiens
acaccagccucgaggagau

SEQ ID NO: 723504 - RNA, 19 nt, Homo sapiens
ccacccaccaccuggauga

SEQ ID NO: 723505 - RNA, 19 nt, Homo sapiens
caacgugcuguuugacaug

SEQ ID NO: 723506 - RNA, 19 nt, Homo sapiens
cgaucacaccgcucaugua

SEQ ID NO: 723507 - RNA, 19 nt, Homo sapiens
acaacgugcuguuugacau

SEQ ID NO: 723508 - RNA, 19 nt, Homo sapiens
ucuacuggcuuggcaacuu

SEQ ID NO: 723509 - RNA, 19 nt, Homo sapiens
gaaggcugacacugacaug

SEQ ID NO: 723510 - RNA, 19 nt, Homo sapiens
ccuaggagcccuggacuca

SEQ ID NO: 723511 - RNA, 19 nt, Homo sapiens
ggaggagguauucuuguac

SEQ ID NO: 723512 - RNA, 19 nt, Homo sapiens
ggucuuugccauguccuuu

SEQ ID NO: 723513 - RNA, 19 nt, Homo sapiens
gggugaaugaggucaggua

SEQ ID NO: 723514 - RNA, 19 nt, Homo sapiens
gccugaagacuaagaagug

SEQ ID NO: 723515 - RNA, 19 nt, Homo sapiens
ggacccaaaggugcuggua

SEQ ID NO: 723516 - RNA, 19 nt, Homo sapiens
gggcguggucuuccuguuc

SEQ ID NO: 723517 - RNA, 19 nt, Homo sapiens
cuacagcggagggaacaaa

SEQ ID NO: 723518 - RNA, 19 nt, Homo sapiens
cagaggaugccagcuguug

SEQ ID NO: 723519 - RNA, 19 nt, Homo sapiens
gugcucaccugcauaaacc

SEQ ID NO: 723520 - RNA, 19 nt, Homo sapiens
gcuacucuuugcaccagau

SEQ ID NO: 723521 - RNA, 19 nt, Homo sapiens
cuccaucuguguggucuuu

SEQ ID NO: 723522 - RNA, 19 nt, Homo sapiens
cagaaguuccugcugaagu

SEQ ID NO: 723523 - RNA, 19 nt, Homo sapiens
ggagacagcgcuggagaac

SEQ ID NO: 723524 - RNA, 19 nt, Homo sapiens
guccguggccauugccuuu

SEQ ID NO: 723525 - RNA, 19 nt, Homo sapiens
ucaguacaacgugcuguuu

SEQ ID NO: 723526 - RNA, 19 nt, Homo sapiens
gaaccaggccauggcugau

SEQ ID NO: 723527 - RNA, 19 nt, Homo sapiens
ucgggaagcuacucuuugc

SEQ ID NO: 723528 - RNA, 19 nt, Homo sapiens
caagaucugguucaacaac

SEQ ID NO: 723529 - RNA, 19 nt, Homo sapiens
ucagguguccuucuucagu

SEQ ID NO: 723530 - RNA, 19 nt, Homo sapiens
gugcugcggacacagauau

SEQ ID NO: 723531 - RNA, 19 nt, Homo sapiens
aaauccgcauggacauuga

SEQ ID NO: 723532 - RNA, 19 nt, Homo sapiens
gcagaggaugccagcuguu

SEQ ID NO: 723533 - RNA, 19 nt, Homo sapiens
ggaaauagaugacuuuaga

SEQ ID NO: 723534 - RNA, 19 nt, Homo sapiens
uuacacaccuggauaauua

SEQ ID NO: 723535 - RNA, 19 nt, Homo sapiens
gaaguuauauggaagaaga

SEQ ID NO: 723536 - RNA, 19 nt, Homo sapiens
gaacaaauuuccagaucuu

SEQ ID NO: 723537 - RNA, 19 nt, Homo sapiens
gaaaguaccgcaguuaaua

SEQ ID NO: 723538 - RNA, 19 nt, Homo sapiens
ugaaauaacugacauggaa

SEQ ID NO: 723539 - RNA, 19 nt, Homo sapiens
ccagaaggauuacagauuu

SEQ ID NO: 723540 - RNA, 19 nt, Homo sapiens
gaagauaccaccuuucauu

SEQ ID NO: 723541 - RNA, 19 nt, Homo sapiens
ugaagaaccuccuaacauu

SEQ ID NO: 723542 - RNA, 19 nt, Homo sapiens
gcaaagcauucaagacauu

SEQ ID NO: 723543 - RNA, 19 nt, Homo sapiens
uaaaggagcacucugaaua

SEQ ID NO: 723544 - RNA, 19 nt, Homo sapiens
ggaagaagauagccauaau

SEQ ID NO: 723545 - RNA, 19 nt, Homo sapiens
ucacggagcuuauucaaau

SEQ ID NO: 723546 - RNA, 19 nt, Homo sapiens
gaaaugaaguauggaaaug

SEQ ID NO: 723547 - RNA, 19 nt, Homo sapiens
uaauggagcugguaaauca

SEQ ID NO: 723548 - RNA, 19 nt, Homo sapiens
gaucagccacuauuuauaa

SEQ ID NO: 723549 - RNA, 19 nt, Homo sapiens
caaaggaaguggaacaaga

SEQ ID NO: 723550 - RNA, 19 nt, Homo sapiens
uaaaguaacucgugaaacu

SEQ ID NO: 723551 - RNA, 19 nt, Homo sapiens
gguaucaacucaauaugaa

SEQ ID NO: 723552 - RNA, 19 nt, Homo sapiens
ggauuucucuucacuguau

SEQ ID NO: 723553 - RNA, 19 nt, Homo sapiens
gcaaugcccuuaugggaau

SEQ ID NO: 723554 - RNA, 19 nt, Homo sapiens
gaugaucccuccuacaaug

SEQ ID NO: 723555 - RNA, 19 nt, Homo sapiens
cgacuuauccucuucagua

SEQ ID NO: 723556 - RNA, 19 nt, Homo sapiens
uaacugacauggaagaaau

SEQ ID NO: 723557 - RNA, 19 nt, Homo sapiens
agaagaagaugaagauguu

SEQ ID NO: 723558 - RNA, 19 nt, Homo sapiens
caucuuggcugauaggaaa

SEQ ID NO: 723559 - RNA, 19 nt, Homo sapiens
cuacaagaauguuuccuuu

SEQ ID NO: 723560 - RNA, 19 nt, Homo sapiens
ggagagcucuuuuguguuu

SEQ ID NO: 723561 - RNA, 19 nt, Homo sapiens
caaggaauauuaugagaca

SEQ ID NO: 723562 - RNA, 19 nt, Homo sapiens
ggaagagcccgaagaagaa

SEQ ID NO: 723563 - RNA, 19 nt, Homo sapiens
gcugacaucuuggcugaua

SEQ ID NO: 723564 - RNA, 19 nt, Homo sapiens
uaaggugucuggaaaugaa

SEQ ID NO: 723565 - RNA, 19 nt, Homo sapiens
ggcaacacuucgcuucuua

SEQ ID NO: 723566 - RNA, 19 nt, Homo sapiens
gauauagaaucccaguuau

SEQ ID NO: 723567 - RNA, 19 nt, Homo sapiens
cauaucgccugaaguuuaa

SEQ ID NO: 723568 - RNA, 19 nt, Homo sapiens
aaacagaaauggcucagau

SEQ ID NO: 723569 - RNA, 19 nt, Homo sapiens
acaccuggauaauuacuua

SEQ ID NO: 723570 - RNA, 19 nt, Homo sapiens
gggauucacuguguuauau

SEQ ID NO: 723571 - RNA, 19 nt, Homo sapiens
gcucugcaauauuuacuuu

SEQ ID NO: 723572 - RNA, 19 nt, Homo sapiens
gggaaauguugaugauaaa

SEQ ID NO: 723573 - RNA, 19 nt, Homo sapiens
ugggaaauguugaugauaa

SEQ ID NO: 723574 - RNA, 19 nt, Homo sapiens
ugacaucucugaaugaagu

SEQ ID NO: 723575 - RNA, 19 nt, Homo sapiens
gaagagaccauggauauag

SEQ ID NO: 723576 - RNA, 19 nt, Homo sapiens
cggguuauaugcaaguuua

SEQ ID NO: 723577 - RNA, 19 nt, Homo sapiens
guaagaaaguaccgcaguu

SEQ ID NO: 723578 - RNA, 19 nt, Homo sapiens
cugauaaacugaugaaaug

SEQ ID NO: 723579 - RNA, 19 nt, Homo sapiens
ggcccaagcuuacaaugaa

SEQ ID NO: 723580 - RNA, 19 nt, Homo sapiens
gaaaauagccaucagaaau

SEQ ID NO: 723581 - RNA, 19 nt, Homo sapiens
gaaaauacaugugacaaga

SEQ ID NO: 723582 - RNA, 19 nt, Homo sapiens
gaucaucuuuguuucugaa

SEQ ID NO: 723583 - RNA, 19 nt, Homo sapiens
ggaaguggaacaagaggua

SEQ ID NO: 723584 - RNA, 19 nt, Homo sapiens
gagcauuccucugaugauu

SEQ ID NO: 723585 - RNA, 19 nt, Homo sapiens
ucauaucgccugaaguuua

SEQ ID NO: 723586 - RNA, 19 nt, Homo sapiens
gaccauggauauagaacuu

SEQ ID NO: 723587 - RNA, 19 nt, Homo sapiens
gaaaggaagaacagucauu

SEQ ID NO: 723588 - RNA, 19 nt, Homo sapiens
gauccaagugcuucaaaua

SEQ ID NO: 723589 - RNA, 19 nt, Homo sapiens
ugaaagagcacuuggaguu

SEQ ID NO: 723590 - RNA, 19 nt, Homo sapiens
gaaccggugucuccagaau

SEQ ID NO: 723591 - RNA, 19 nt, Homo sapiens
caugaaaucuuugagaaug

SEQ ID NO: 723592 - RNA, 19 nt, Homo sapiens
ugaaaggacugggcaaaga

SEQ ID NO: 723593 - RNA, 19 nt, Homo sapiens
caagaaaggcugucaguag

SEQ ID NO: 723594 - RNA, 19 nt, Homo sapiens
uaaugacucuggccuggua

SEQ ID NO: 723595 - RNA, 19 nt, Homo sapiens
uguuauagcuguauugaug

SEQ ID NO: 723596 - RNA, 19 nt, Homo sapiens
gguaguaucaguaggcaua

SEQ ID NO: 723597 - RNA, 19 nt, Homo sapiens
gccauaaucuguaagaaag

SEQ ID NO: 723598 - RNA, 19 nt, Homo sapiens
uggcacagcauaacauuua

SEQ ID NO: 723599 - RNA, 19 nt, Homo sapiens
gaaaggacugggcaaagaa

SEQ ID NO: 723600 - RNA, 19 nt, Homo sapiens
acagugaccuugauaagug

SEQ ID NO: 723601 - RNA, 19 nt, Homo sapiens
acucaacucucugaaauaa

SEQ ID NO: 723602 - RNA, 19 nt, Homo sapiens
acagaucacugcaauacuu

SEQ ID NO: 723603 - RNA, 19 nt, Homo sapiens
ugaaauaaauccugagcau

SEQ ID NO: 723604 - RNA, 19 nt, Homo sapiens
ggccuuggcuuccuuuaug

SEQ ID NO: 723605 - RNA, 19 nt, Homo sapiens
gaugaaauggcacagcaua

SEQ ID NO: 723606 - RNA, 19 nt, Homo sapiens
ggaaauauagggaaaagua

SEQ ID NO: 723607 - RNA, 19 nt, Homo sapiens
gaaggaaacaaggaaauau

SEQ ID NO: 723608 - RNA, 19 nt, Homo sapiens
ggaagacccuuaaaaugaa

SEQ ID NO: 723609 - RNA, 19 nt, Homo sapiens
ggaggaggaaccagucaua

SEQ ID NO: 723610 - RNA, 19 nt, Homo sapiens
uaccauaccuucagagugu

SEQ ID NO: 723611 - RNA, 19 nt, Homo sapiens
guucuuaugggaauuguua

SEQ ID NO: 723612 - RNA, 19 nt, Homo sapiens
ggaauuaugcuguuucagu

SEQ ID NO: 723613 - RNA, 19 nt, Homo sapiens
aagaguaacuggacaagga

SEQ ID NO: 723614 - RNA, 19 nt, Homo sapiens
agggagaaauuaugaauga

SEQ ID NO: 723615 - RNA, 19 nt, Homo sapiens
gaguugacaucaguuauug

SEQ ID NO: 723616 - RNA, 19 nt, Homo sapiens
gaagucacaacaaaucauu

SEQ ID NO: 723617 - RNA, 19 nt, Homo sapiens
ucaauaaagcuaacacuga

SEQ ID NO: 723618 - RNA, 19 nt, Homo sapiens
ggaaaugaaguauggaaau

SEQ ID NO: 723619 - RNA, 19 nt, Homo sapiens
cauaauugguugugcaguu

SEQ ID NO: 723620 - RNA, 19 nt, Homo sapiens
gaccagggcauaaggaauu

SEQ ID NO: 723621 - RNA, 19 nt, Homo sapiens
ugaaccaacugcuggauug

SEQ ID NO: 723622 - RNA, 19 nt, Homo sapiens
ggaguugacaucaguuauu

SEQ ID NO: 723623 - RNA, 19 nt, Homo sapiens
cacaacaaaucauucugua

SEQ ID NO: 723624 - RNA, 19 nt, Homo sapiens
uagagaaacucaucccaau

SEQ ID NO: 723625 - RNA, 19 nt, Homo sapiens
ggacauuccauuauacuuc

SEQ ID NO: 723626 - RNA, 19 nt, Homo sapiens
gaaggaaaaucagcaauug

SEQ ID NO: 723627 - RNA, 19 nt, Homo sapiens
guauauaguuugccuuugg

SEQ ID NO: 723628 - RNA, 19 nt, Homo sapiens
gaaauaaauccugagcauu

SEQ ID NO: 723629 - RNA, 19 nt, Homo sapiens
ggauggguauuaagucuuc

SEQ ID NO: 723630 - RNA, 19 nt, Homo sapiens
ugacaucaguuauuggaau

SEQ ID NO: 723631 - RNA, 19 nt, Homo sapiens
ggagcacucugaauacaca

SEQ ID NO: 723632 - RNA, 19 nt, Homo sapiens
ugaacaaccuccuaaaguc

SEQ ID NO: 723633 - RNA, 19 nt, Homo sapiens
gaacauagcuauagaagug

SEQ ID NO: 723634 - RNA, 19 nt, Homo sapiens
gaaaugaacugcaggaaga

SEQ ID NO: 723635 - RNA, 19 nt, Homo sapiens
ggaagaaacuaaugagaaa

SEQ ID NO: 723636 - RNA, 19 nt, Homo sapiens
uaacaaaccugcacauuca

SEQ ID NO: 723637 - RNA, 19 nt, Homo sapiens
gaacuguguuucuagauuu

SEQ ID NO: 723638 - RNA, 19 nt, Homo sapiens
ccaaauacccuauaucuuu

SEQ ID NO: 723639 - RNA, 19 nt, Homo sapiens
gaaggaauaugcaggcaaa

SEQ ID NO: 723640 - RNA, 19 nt, Homo sapiens
gggcauaggcuaccauuua

SEQ ID NO: 723641 - RNA, 19 nt, Homo sapiens
gacaauacauuacgucauu

SEQ ID NO: 723642 - RNA, 19 nt, Homo sapiens
ggaaaggacaaacaaauuu

SEQ ID NO: 723643 - RNA, 19 nt, Homo sapiens
gaaaucagacagaguaauu

SEQ ID NO: 723644 - RNA, 19 nt, Homo sapiens
gagaaaggauccuguguuc

SEQ ID NO: 723645 - RNA, 19 nt, Homo sapiens
agaaauaccugauguagau

SEQ ID NO: 723646 - RNA, 19 nt, Homo sapiens
gcaaccaaaucccauguuu

SEQ ID NO: 723647 - RNA, 19 nt, Homo sapiens
gcagagauccugaggcuuu

SEQ ID NO: 723648 - RNA, 19 nt, Homo sapiens
gaugauaacuggagacaca

SEQ ID NO: 723649 - RNA, 19 nt, Homo sapiens
aagaauggcugauauagaa

SEQ ID NO: 723650 - RNA, 19 nt, Homo sapiens
gauccuguguucagaauuu

SEQ ID NO: 723651 - RNA, 19 nt, Homo sapiens
gaaagaagccaucagaauc

SEQ ID NO: 723652 - RNA, 19 nt, Homo sapiens
gaaagaaugagaacaguga

SEQ ID NO: 723653 - RNA, 19 nt, Homo sapiens
gcagugagagucaucuuua

SEQ ID NO: 723654 - RNA, 19 nt, Homo sapiens
gcucuucucuguuccuuaa

SEQ ID NO: 723655 - RNA, 19 nt, Homo sapiens
caaauccuguguaguauug

SEQ ID NO: 723656 - RNA, 19 nt, Homo sapiens
gaaggaaaaucaacuauug

SEQ ID NO: 723657 - RNA, 19 nt, Homo sapiens
ggaggaagauauccagaug

SEQ ID NO: 723658 - RNA, 19 nt, Homo sapiens
gcacccaguuuauagauga

SEQ ID NO: 723659 - RNA, 19 nt, Homo sapiens
agagucaucuuuacugaua

SEQ ID NO: 723660 - RNA, 19 nt, Homo sapiens
gcuaauaccuuaccuucau

SEQ ID NO: 723661 - RNA, 19 nt, Homo sapiens
cauuaaugcugcuaucaua

SEQ ID NO: 723662 - RNA, 19 nt, Homo sapiens
ugaagaaccuggcacaaau

SEQ ID NO: 723663 - RNA, 19 nt, Homo sapiens
ggcauaggcuaccauuuaa

SEQ ID NO: 723664 - RNA, 19 nt, Homo sapiens
gaaacuaacuuuugggauu

SEQ ID NO: 723665 - RNA, 19 nt, Homo sapiens
ggaaagaagccaucagaau

SEQ ID NO: 723666 - RNA, 19 nt, Homo sapiens
gauaguugcuacugaucua

SEQ ID NO: 723667 - RNA, 19 nt, Homo sapiens
ugaaugagguguuucugaa

SEQ ID NO: 723668 - RNA, 19 nt, Homo sapiens
caaauacccuauaucuuuc

SEQ ID NO: 723669 - RNA, 19 nt, Homo sapiens
gaguauggguaccgaagua

SEQ ID NO: 723670 - RNA, 19 nt, Homo sapiens
ugaaaggugugguguuuga

SEQ ID NO: 723671 - RNA, 19 nt, Homo sapiens
ucaaaugucuucaauggau

SEQ ID NO: 723672 - RNA, 19 nt, Homo sapiens
ggaugaagcuggaaaccau

SEQ ID NO: 723673 - RNA, 19 nt, Homo sapiens
cauggagaaugcuuaauuu

SEQ ID NO: 723674 - RNA, 19 nt, Homo sapiens
gguguacgcugccgugaaa

SEQ ID NO: 723675 - RNA, 19 nt, Homo sapiens
gauuggcucucuauucauu

SEQ ID NO: 723676 - RNA, 19 nt, Homo sapiens
guuaauaccucccuucaca

SEQ ID NO: 723677 - RNA, 19 nt, Homo sapiens
ggaacugucuccaaauaca

SEQ ID NO: 723678 - RNA, 19 nt, Homo sapiens
aaagacacaugcacacgua

SEQ ID NO: 723679 - RNA, 19 nt, Homo sapiens
ggcauaagccuaagccaua

SEQ ID NO: 723680 - RNA, 19 nt, Homo sapiens
gcaauggacuacuuggaau

SEQ ID NO: 723681 - RNA, 19 nt, Homo sapiens
aaaguucgcuuccuaaagu

SEQ ID NO: 723682 - RNA, 19 nt, Homo sapiens
uauggaaucuccugaaaga

SEQ ID NO: 723683 - RNA, 19 nt, Homo sapiens
gagaguagaagcuuugaaa

SEQ ID NO: 723684 - RNA, 19 nt, Homo sapiens
gaaccagugucuccagaau

SEQ ID NO: 723685 - RNA, 19 nt, Homo sapiens
gaauggacuuugugucuuc

SEQ ID NO: 723686 - RNA, 19 nt, Homo sapiens
ucauagaaaucgcaacaaa

SEQ ID NO: 723687 - RNA, 19 nt, Homo sapiens
agacagaccuuguuggaau

SEQ ID NO: 723688 - RNA, 19 nt, Homo sapiens
gcaauaauuauccucagua

SEQ ID NO: 723689 - RNA, 19 nt, Homo sapiens
uugaagagcauauggauua

SEQ ID NO: 723690 - RNA, 19 nt, Homo sapiens
ccacuuggauucuucacaa

SEQ ID NO: 723691 - RNA, 19 nt, Homo sapiens
uaugcuggcuucauccuua

SEQ ID NO: 723692 - RNA, 19 nt, Homo sapiens
cagcauuggugacuacaaa

SEQ ID NO: 723693 - RNA, 19 nt, Homo sapiens
uuacagggaucuugauaga

SEQ ID NO: 723694 - RNA, 19 nt, Homo sapiens
aaacuuaagugguggacaa

SEQ ID NO: 723695 - RNA, 19 nt, Homo sapiens
gaugaacuguguuucuaga

SEQ ID NO: 723696 - RNA, 19 nt, Homo sapiens
gaaagacaauacauuacgu

SEQ ID NO: 723697 - RNA, 19 nt, Homo sapiens
gcacauguaucccagaacu

SEQ ID NO: 723698 - RNA, 19 nt, Homo sapiens
ccagaggagauuauauuua

SEQ ID NO: 723699 - RNA, 19 nt, Homo sapiens
gaucacagauuuucaauag

SEQ ID NO: 723700 - RNA, 19 nt, Homo sapiens
gcagcacuguuuacaauag

SEQ ID NO: 723701 - RNA, 19 nt, Homo sapiens
guucuuaauucacugguuu

SEQ ID NO: 723702 - RNA, 19 nt, Homo sapiens
ggagcugggugaucuugaa

SEQ ID NO: 723703 - RNA, 19 nt, Homo sapiens
cgugaaaggucucaggaaa

SEQ ID NO: 723704 - RNA, 19 nt, Homo sapiens
ugaaaaggaucacagauuu

SEQ ID NO: 723705 - RNA, 19 nt, Homo sapiens
caaaugauagaccggauaa

SEQ ID NO: 723706 - RNA, 19 nt, Homo sapiens
ccuauugacuuccggguaa

SEQ ID NO: 723707 - RNA, 19 nt, Homo sapiens
cauguuuccuacuguguua

SEQ ID NO: 723708 - RNA, 19 nt, Homo sapiens
gaaaggauccuguguucag

SEQ ID NO: 723709 - RNA, 19 nt, Homo sapiens
gacagaacauagcuauaga

SEQ ID NO: 723710 - RNA, 19 nt, Homo sapiens
ugggaacugucuccaaaua

SEQ ID NO: 723711 - RNA, 19 nt, Homo sapiens
guacaggaauuagaaaugg

SEQ ID NO: 723712 - RNA, 19 nt, Homo sapiens
ggagaaagagguacaacga

SEQ ID NO: 723713 - RNA, 19 nt, Homo sapiens
uggcccagcuuauacauuu

SEQ ID NO: 723714 - RNA, 19 nt, Homo sapiens
ggaauggacuuugugucuu

SEQ ID NO: 723715 - RNA, 19 nt, Homo sapiens
gauagcauuaggagaaaua

SEQ ID NO: 723716 - RNA, 19 nt, Homo sapiens
ggaaggcugagauguauug

SEQ ID NO: 723717 - RNA, 19 nt, Homo sapiens
ccaagaagcaacgcuauuu

SEQ ID NO: 723718 - RNA, 19 nt, Homo sapiens
ggaagguguucauauccaa

SEQ ID NO: 723719 - RNA, 19 nt, Homo sapiens
cacaugaaguggagaaaga

SEQ ID NO: 723720 - RNA, 19 nt, Homo sapiens
gaaaucgcaacaaaucauu

SEQ ID NO: 723721 - RNA, 19 nt, Homo sapiens
ccucaaaugucuucaaugg

SEQ ID NO: 723722 - RNA, 19 nt, Homo sapiens
guaacaaaccugcacauuc

SEQ ID NO: 723723 - RNA, 19 nt, Homo sapiens
gcacacguauguuuauugc

SEQ ID NO: 723724 - RNA, 19 nt, Homo sapiens
caggaaggcugagauguau

SEQ ID NO: 723725 - RNA, 19 nt, Homo sapiens
cauuuaaguuugcaucuga

SEQ ID NO: 723726 - RNA, 19 nt, Homo sapiens
ggacaggaagguguucaua

SEQ ID NO: 723727 - RNA, 19 nt, Homo sapiens
caaaauccauaccucauaa

SEQ ID NO: 723728 - RNA, 19 nt, Homo sapiens
ccaaaucccauguuuccua

SEQ ID NO: 723729 - RNA, 19 nt, Homo sapiens
gcugaaggcucccgugaag

SEQ ID NO: 723730 - RNA, 19 nt, Homo sapiens
cuuaggagcuucagaaucu

SEQ ID NO: 723731 - RNA, 19 nt, Homo sapiens
ugaacuguguuucuagauu

SEQ ID NO: 723732 - RNA, 19 nt, Homo sapiens
gaaagagguacaacgaguu

SEQ ID NO: 723733 - RNA, 19 nt, Homo sapiens
gaacauagcuauagaagug

SEQ ID NO: 723734 - RNA, 19 nt, Homo sapiens
gaaaugaacugcaggaaga

SEQ ID NO: 723735 - RNA, 19 nt, Homo sapiens
ggaagaaacuaaugagaaa

SEQ ID NO: 723736 - RNA, 19 nt, Homo sapiens
uaacaaaccugcacauuca

SEQ ID NO: 723737 - RNA, 19 nt, Homo sapiens
gaacuguguuucuagauuu

SEQ ID NO: 723738 - RNA, 19 nt, Homo sapiens
ccaaauacccuauaucuuu

SEQ ID NO: 723739 - RNA, 19 nt, Homo sapiens
gaaggaauaugcaggcaaa

SEQ ID NO: 723740 - RNA, 19 nt, Homo sapiens
gggcauaggcuaccauuua

SEQ ID NO: 723741 - RNA, 19 nt, Homo sapiens
gacaauacauuacgucauu

SEQ ID NO: 723742 - RNA, 19 nt, Homo sapiens
ggaaaggacaaacaaauuu

SEQ ID NO: 723743 - RNA, 19 nt, Homo sapiens
gaaaucagacagaguaauu

SEQ ID NO: 723744 - RNA, 19 nt, Homo sapiens
gagaaaggauccuguguuc

SEQ ID NO: 723745 - RNA, 19 nt, Homo sapiens
agaaauaccugauguagau

SEQ ID NO: 723746 - RNA, 19 nt, Homo sapiens
gcaaccaaaucccauguuu

SEQ ID NO: 723747 - RNA, 19 nt, Homo sapiens
gcagagauccugaggcuuu

SEQ ID NO: 723748 - RNA, 19 nt, Homo sapiens
gaugauaacuggagacaca

SEQ ID NO: 723749 - RNA, 19 nt, Homo sapiens
aagaauggcugauauagaa

SEQ ID NO: 723750 - RNA, 19 nt, Homo sapiens
gauccuguguucagaauuu

SEQ ID NO: 723751 - RNA, 19 nt, Homo sapiens
gaaagaagccaucagaauc

SEQ ID NO: 723752 - RNA, 19 nt, Homo sapiens
gaaagaaugagaacaguga

SEQ ID NO: 723753 - RNA, 19 nt, Homo sapiens
gcagugagagucaucuuua

SEQ ID NO: 723754 - RNA, 19 nt, Homo sapiens
gcucuucucuguuccuuaa

SEQ ID NO: 723755 - RNA, 19 nt, Homo sapiens
caaauccuguguaguauug

SEQ ID NO: 723756 - RNA, 19 nt, Homo sapiens
gaaggaaaaucaacuauug

SEQ ID NO: 723757 - RNA, 19 nt, Homo sapiens
ggaggaagauauccagaug

SEQ ID NO: 723758 - RNA, 19 nt, Homo sapiens
gcacccaguuuauagauga

SEQ ID NO: 723759 - RNA, 19 nt, Homo sapiens
agagucaucuuuacugaua

SEQ ID NO: 723760 - RNA, 19 nt, Homo sapiens
gcuaauaccuuaccuucau

SEQ ID NO: 723761 - RNA, 19 nt, Homo sapiens
cauuaaugcugcuaucaua

SEQ ID NO: 723762 - RNA, 19 nt, Homo sapiens
ugaagaaccuggcacaaau

SEQ ID NO: 723763 - RNA, 19 nt, Homo sapiens
ggcauaggcuaccauuuaa

SEQ ID NO: 723764 - RNA, 19 nt, Homo sapiens
gaaacuaacuuuugggauu

SEQ ID NO: 723765 - RNA, 19 nt, Homo sapiens
ggaaagaagccaucagaau

SEQ ID NO: 723766 - RNA, 19 nt, Homo sapiens
gauaguugcuacugaucua

SEQ ID NO: 723767 - RNA, 19 nt, Homo sapiens
ugaaugagguguuucugaa

SEQ ID NO: 723768 - RNA, 19 nt, Homo sapiens
caaauacccuauaucuuuc

SEQ ID NO: 723769 - RNA, 19 nt, Homo sapiens
gaguauggguaccgaagua

SEQ ID NO: 723770 - RNA, 19 nt, Homo sapiens
ugaaaggugugguguuuga

SEQ ID NO: 723771 - RNA, 19 nt, Homo sapiens
ucaaaugucuucaauggau

SEQ ID NO: 723772 - RNA, 19 nt, Homo sapiens
ggaugaagcuggaaaccau

SEQ ID NO: 723773 - RNA, 19 nt, Homo sapiens
cauggagaaugcuuaauuu

SEQ ID NO: 723774 - RNA, 19 nt, Homo sapiens
gguguacgcugccgugaaa

SEQ ID NO: 723775 - RNA, 19 nt, Homo sapiens
gauuggcucucuauucauu

SEQ ID NO: 723776 - RNA, 19 nt, Homo sapiens
guuaauaccucccuucaca

SEQ ID NO: 723777 - RNA, 19 nt, Homo sapiens
ggaacugucuccaaauaca

SEQ ID NO: 723778 - RNA, 19 nt, Homo sapiens
aaagacacaugcacacgua

SEQ ID NO: 723779 - RNA, 19 nt, Homo sapiens
ggcauaagccuaagccaua

SEQ ID NO: 723780 - RNA, 19 nt, Homo sapiens
gcaauggacuacuuggaau

SEQ ID NO: 723781 - RNA, 19 nt, Homo sapiens
aaaguucgcuuccuaaagu

SEQ ID NO: 723782 - RNA, 19 nt, Homo sapiens
uauggaaucuccugaaaga

SEQ ID NO: 723783 - RNA, 19 nt, Homo sapiens
gagaguagaagcuuugaaa

SEQ ID NO: 723784 - RNA, 19 nt, Homo sapiens
gaaccagugucuccagaau

SEQ ID NO: 723785 - RNA, 19 nt, Homo sapiens
gaauggacuuugugucuuc

SEQ ID NO: 723786 - RNA, 19 nt, Homo sapiens
ucauagaaaucgcaacaaa

SEQ ID NO: 723787 - RNA, 19 nt, Homo sapiens
agacagaccuuguuggaau

SEQ ID NO: 723788 - RNA, 19 nt, Homo sapiens
gcaauaauuauccucagua

SEQ ID NO: 723789 - RNA, 19 nt, Homo sapiens
uugaagagcauauggauua

SEQ ID NO: 723790 - RNA, 19 nt, Homo sapiens
ccacuuggauucuucacaa

SEQ ID NO: 723791 - RNA, 19 nt, Homo sapiens
uaugcuggcuucauccuua

SEQ ID NO: 723792 - RNA, 19 nt, Homo sapiens
cagcauuggugacuacaaa

SEQ ID NO: 723793 - RNA, 19 nt, Homo sapiens
uuacagggaucuugauaga

SEQ ID NO: 723794 - RNA, 19 nt, Homo sapiens
aaacuuaagugguggacaa

SEQ ID NO: 723795 - RNA, 19 nt, Homo sapiens
gaugaacuguguuucuaga

SEQ ID NO: 723796 - RNA, 19 nt, Homo sapiens
gaaagacaauacauuacgu

SEQ ID NO: 723797 - RNA, 19 nt, Homo sapiens
gcacauguaucccagaacu

SEQ ID NO: 723798 - RNA, 19 nt, Homo sapiens
ccagaggagauuauauuua

SEQ ID NO: 723799 - RNA, 19 nt, Homo sapiens
gaucacagauuuucaauag

SEQ ID NO: 723800 - RNA, 19 nt, Homo sapiens
gcagcacuguuuacaauag

SEQ ID NO: 723801 - RNA, 19 nt, Homo sapiens
guucuuaauucacugguuu

SEQ ID NO: 723802 - RNA, 19 nt, Homo sapiens
ggagcugggugaucuugaa

SEQ ID NO: 723803 - RNA, 19 nt, Homo sapiens
cgugaaaggucucaggaaa

SEQ ID NO: 723804 - RNA, 19 nt, Homo sapiens
ugaaaaggaucacagauuu

SEQ ID NO: 723805 - RNA, 19 nt, Homo sapiens
caaaugauagaccggauaa

SEQ ID NO: 723806 - RNA, 19 nt, Homo sapiens
ccuauugacuuccggguaa

SEQ ID NO: 723807 - RNA, 19 nt, Homo sapiens
cauguuuccuacuguguua

SEQ ID NO: 723808 - RNA, 19 nt, Homo sapiens
gaaaggauccuguguucag

SEQ ID NO: 723809 - RNA, 19 nt, Homo sapiens
gacagaacauagcuauaga

SEQ ID NO: 723810 - RNA, 19 nt, Homo sapiens
ugggaacugucuccaaaua

SEQ ID NO: 723811 - RNA, 19 nt, Homo sapiens
guacaggaauuagaaaugg

SEQ ID NO: 723812 - RNA, 19 nt, Homo sapiens
ggagaaagagguacaacga

SEQ ID NO: 723813 - RNA, 19 nt, Homo sapiens
uggcccagcuuauacauuu

SEQ ID NO: 723814 - RNA, 19 nt, Homo sapiens
ggaauggacuuugugucuu

SEQ ID NO: 723815 - RNA, 19 nt, Homo sapiens
gauagcauuaggagaaaua

SEQ ID NO: 723816 - RNA, 19 nt, Homo sapiens
ggaaggcugagauguauug

SEQ ID NO: 723817 - RNA, 19 nt, Homo sapiens
ccaagaagcaacgcuauuu

SEQ ID NO: 723818 - RNA, 19 nt, Homo sapiens
ggaagguguucauauccaa

SEQ ID NO: 723819 - RNA, 19 nt, Homo sapiens
cacaugaaguggagaaaga

SEQ ID NO: 723820 - RNA, 19 nt, Homo sapiens
gaaaucgcaacaaaucauu

SEQ ID NO: 723821 - RNA, 19 nt, Homo sapiens
ccucaaaugucuucaaugg

SEQ ID NO: 723822 - RNA, 19 nt, Homo sapiens
guaacaaaccugcacauuc

SEQ ID NO: 723823 - RNA, 19 nt, Homo sapiens
gcacacguauguuuauugc

SEQ ID NO: 723824 - RNA, 19 nt, Homo sapiens
caggaaggcugagauguau

SEQ ID NO: 723825 - RNA, 19 nt, Homo sapiens
cauuuaaguuugcaucuga

SEQ ID NO: 723826 - RNA, 19 nt, Homo sapiens
ggacaggaagguguucaua

SEQ ID NO: 723827 - RNA, 19 nt, Homo sapiens
caaaauccauaccucauaa

SEQ ID NO: 723828 - RNA, 19 nt, Homo sapiens
ccaaaucccauguuuccua

SEQ ID NO: 723829 - RNA, 19 nt, Homo sapiens
gcugaaggcucccgugaag

SEQ ID NO: 723830 - RNA, 19 nt, Homo sapiens
cuuaggagcuucagaaucu

SEQ ID NO: 723831 - RNA, 19 nt, Homo sapiens
ugaacuguguuucuagauu

SEQ ID NO: 723832 - RNA, 19 nt, Homo sapiens
gaaagagguacaacgaguu

SEQ ID NO: 723833 - RNA, 19 nt, Homo sapiens
gaacauagcuuuagaagug

SEQ ID NO: 723834 - RNA, 19 nt, Homo sapiens
gcaaaugccuugaauucua

SEQ ID NO: 723835 - RNA, 19 nt, Homo sapiens
ggaaagaaaucaaugagaa

SEQ ID NO: 723836 - RNA, 19 nt, Homo sapiens
gcacugcuauuaauucuaa

SEQ ID NO: 723837 - RNA, 19 nt, Homo sapiens
ugaaagaucugguauuuga

SEQ ID NO: 723838 - RNA, 19 nt, Homo sapiens
gaaagguacuccucucuga

SEQ ID NO: 723839 - RNA, 19 nt, Homo sapiens
guacauauccgaacugaaa

SEQ ID NO: 723840 - RNA, 19 nt, Homo sapiens
agaaauggcugaccuagaa

SEQ ID NO: 723841 - RNA, 19 nt, Homo sapiens
ccaaaucacugcaauacuu

SEQ ID NO: 723842 - RNA, 19 nt, Homo sapiens
uauaagaucuacccaguuu

SEQ ID NO: 723843 - RNA, 19 nt, Homo sapiens
agagucaccuuuacuaaua

SEQ ID NO: 723844 - RNA, 19 nt, Homo sapiens
gcagagauccugaggcuuu

SEQ ID NO: 723845 - RNA, 19 nt, Homo sapiens
ugaaauauguguugaggaa

SEQ ID NO: 723846 - RNA, 19 nt, Homo sapiens
gaaagaagccaucagaauc

SEQ ID NO: 723847 - RNA, 19 nt, Homo sapiens
uagcagcaauguucuauuu

SEQ ID NO: 723848 - RNA, 19 nt, Homo sapiens
cagcaaaucugcgcaauug

SEQ ID NO: 723849 - RNA, 19 nt, Homo sapiens
ggacagaggcauuugacua

SEQ ID NO: 723850 - RNA, 19 nt, Homo sapiens
cgaaagugauauuccauuu

SEQ ID NO: 723851 - RNA, 19 nt, Homo sapiens
ucagaaaguucacaaaugu

SEQ ID NO: 723852 - RNA, 19 nt, Homo sapiens
caacacgacccaacagaua

SEQ ID NO: 723853 - RNA, 19 nt, Homo sapiens
gaauggaaguuuggaaaga

SEQ ID NO: 723854 - RNA, 19 nt, Homo sapiens
acaaggagcucaguggaua

SEQ ID NO: 723855 - RNA, 19 nt, Homo sapiens
gaagaaauaguaagaguca

SEQ ID NO: 723856 - RNA, 19 nt, Homo sapiens
ggaacuuucuccucauuug

SEQ ID NO: 723857 - RNA, 19 nt, Homo sapiens
gaucugguauuugacauuu

SEQ ID NO: 723858 - RNA, 19 nt, Homo sapiens
ggaaagaagccaucagaau

SEQ ID NO: 723859 - RNA, 19 nt, Homo sapiens
ucacaugacugaguaggua

SEQ ID NO: 723860 - RNA, 19 nt, Homo sapiens
uaaccuagacugagaaauu

SEQ ID NO: 723861 - RNA, 19 nt, Homo sapiens
guacagccauuucugguau

SEQ ID NO: 723862 - RNA, 19 nt, Homo sapiens
ccauacagcucauuguuau

SEQ ID NO: 723863 - RNA, 19 nt, Homo sapiens
cacaagaaguggauaaaga

SEQ ID NO: 723864 - RNA, 19 nt, Homo sapiens
ucaacaaacuugggccuua

SEQ ID NO: 723865 - RNA, 19 nt, Homo sapiens
gaaacaagaugaggaagag

SEQ ID NO: 723866 - RNA, 19 nt, Homo sapiens
ggugauaacuggagacaca

SEQ ID NO: 723867 - RNA, 19 nt, Homo sapiens
ugacauacgugauuuccuu

SEQ ID NO: 723868 - RNA, 19 nt, Homo sapiens
gaagacaugcuacuuacaa

SEQ ID NO: 723869 - RNA, 19 nt, Homo sapiens
gcacauccauuaaggugau

SEQ ID NO: 723870 - RNA, 19 nt, Homo sapiens
gggauuggauaucacuuaa

SEQ ID NO: 723871 - RNA, 19 nt, Homo sapiens
uauggaaccuucugaaaga

SEQ ID NO: 723872 - RNA, 19 nt, Homo sapiens
guucuuaucuucucaucuu

SEQ ID NO: 723873 - RNA, 19 nt, Homo sapiens
cccaacagauaaugaauaa

SEQ ID NO: 723874 - RNA, 19 nt, Homo sapiens
caacagcucacaugacuga

SEQ ID NO: 723875 - RNA, 19 nt, Homo sapiens
caaauucuguguuccuguu

SEQ ID NO: 723876 - RNA, 19 nt, Homo sapiens
gguaaaagcacauccauua

SEQ ID NO: 723877 - RNA, 19 nt, Homo sapiens
guaaugggcuacuuggaau

SEQ ID NO: 723878 - RNA, 19 nt, Homo sapiens
ucacaucacuguacagaca

SEQ ID NO: 723879 - RNA, 19 nt, Homo sapiens
gaacagcaaaugccuugaa

SEQ ID NO: 723880 - RNA, 19 nt, Homo sapiens
guuaaaccaucaguacaua

SEQ ID NO: 723881 - RNA, 19 nt, Homo sapiens
gacaugcuacuuacaauaa

SEQ ID NO: 723882 - RNA, 19 nt, Homo sapiens
gaacaagcgccuccagaau

SEQ ID NO: 723883 - RNA, 19 nt, Homo sapiens
caaauuucauguuggcauu

SEQ ID NO: 723884 - RNA, 19 nt, Homo sapiens
gaaaagagaguccuuaaug

SEQ ID NO: 723885 - RNA, 19 nt, Homo sapiens
gacagaggcauuugacuaa

SEQ ID NO: 723886 - RNA, 19 nt, Homo sapiens
ugaagaaccuggcacaagu

SEQ ID NO: 723887 - RNA, 19 nt, Homo sapiens
cuugaaagaucugguauuu

SEQ ID NO: 723888 - RNA, 19 nt, Homo sapiens
gauguuuacugugaaguuu

SEQ ID NO: 723889 - RNA, 19 nt, Homo sapiens
ggacggguagauacauuua

SEQ ID NO: 723890 - RNA, 19 nt, Homo sapiens
guugauacuuuccuaagaa

SEQ ID NO: 723891 - RNA, 19 nt, Homo sapiens
uggaagaugugcaaccuuu

SEQ ID NO: 723892 - RNA, 19 nt, Homo sapiens
gauaaaccauaccucuaga

SEQ ID NO: 723893 - RNA, 19 nt, Homo sapiens
gauuggcuguuuguucuua

SEQ ID NO: 723894 - RNA, 19 nt, Homo sapiens
gagcuacauuucaaacuuc

SEQ ID NO: 723895 - RNA, 19 nt, Homo sapiens
cagcaucgaugauuauaag

SEQ ID NO: 723896 - RNA, 19 nt, Homo sapiens
ugagcagcaucgaugauua

SEQ ID NO: 723897 - RNA, 19 nt, Homo sapiens
ggcaagcauugaugacuuu

SEQ ID NO: 723898 - RNA, 19 nt, Homo sapiens
gauuaucuuugguagcuuu

SEQ ID NO: 723899 - RNA, 19 nt, Homo sapiens
caacaaacuugggccuuau

SEQ ID NO: 723900 - RNA, 19 nt, Homo sapiens
gcuuugaccuagaggagua

SEQ ID NO: 723901 - RNA, 19 nt, Homo sapiens
ugaaccaacugcuggauug

SEQ ID NO: 723902 - RNA, 19 nt, Homo sapiens
agaaguggauaaagagauu

SEQ ID NO: 723903 - RNA, 19 nt, Homo sapiens
uuaaugagcaucuugguaa

SEQ ID NO: 723904 - RNA, 19 nt, Homo sapiens
ucacuuaagcuugcaguua

SEQ ID NO: 723905 - RNA, 19 nt, Homo sapiens
gaaagucaacacugcuaaa

SEQ ID NO: 723906 - RNA, 19 nt, Homo sapiens
gaagauguuuacugugaag

SEQ ID NO: 723907 - RNA, 19 nt, Homo sapiens
caaagaaggagcacaagga

SEQ ID NO: 723908 - RNA, 19 nt, Homo sapiens
ggauauuugucacuugguu

SEQ ID NO: 723909 - RNA, 19 nt, Homo sapiens
gaaaggggaugcugagguu

SEQ ID NO: 723910 - RNA, 19 nt, Homo sapiens
uaaaggaaagccugauaaa

SEQ ID NO: 723911 - RNA, 19 nt, Homo sapiens
ccagaugaggaaaguauua

SEQ ID NO: 723912 - RNA, 19 nt, Homo sapiens
ggauaaaccauaccucuag

SEQ ID NO: 723913 - RNA, 19 nt, Homo sapiens
cagcaaaugccuugaauuc

SEQ ID NO: 723914 - RNA, 19 nt, Homo sapiens
gggcaagcauugaugacuu

SEQ ID NO: 723915 - RNA, 19 nt, Homo sapiens
caguggagcuggaaaguca

SEQ ID NO: 723916 - RNA, 19 nt, Homo sapiens
gcucuaugcugguuucauc

SEQ ID NO: 723917 - RNA, 19 nt, Homo sapiens
aaucuagacuuuagugaug

SEQ ID NO: 723918 - RNA, 19 nt, Homo sapiens
caagaggaagaauaagaua

SEQ ID NO: 723919 - RNA, 19 nt, Homo sapiens
gaacugaaagaaguacauu

SEQ ID NO: 723920 - RNA, 19 nt, Homo sapiens
gaagucaaauaguuaaagc

SEQ ID NO: 723921 - RNA, 19 nt, Homo sapiens
gcucuucuuuguuucuaaa

SEQ ID NO: 723922 - RNA, 19 nt, Homo sapiens
caacacugcuaaacauucu

SEQ ID NO: 723923 - RNA, 19 nt, Homo sapiens
uuaauggaauggcugaauu

SEQ ID NO: 723924 - RNA, 19 nt, Homo sapiens
gauguaggcauaaauggaa

SEQ ID NO: 723925 - RNA, 19 nt, Homo sapiens
ggaagaugugcaaccuuua

SEQ ID NO: 723926 - RNA, 19 nt, Homo sapiens
ucugggagguugagaugua

SEQ ID NO: 723927 - RNA, 19 nt, Homo sapiens
gcaccagaacauagcuuua

SEQ ID NO: 723928 - RNA, 19 nt, Homo sapiens
caugacaacuuugaaugaa

SEQ ID NO: 723929 - RNA, 19 nt, Homo sapiens
gacauggaaugccagcaaa

SEQ ID NO: 723930 - RNA, 19 nt, Homo sapiens
ccucucugaugguuuauaa

SEQ ID NO: 723931 - RNA, 19 nt, Homo sapiens
caaaugccuugaauucuac

SEQ ID NO: 723932 - RNA, 19 nt, Homo sapiens
cuaauuccuuuccuucauu

SEQ ID NO: 723933 - RNA, 19 nt, Homo sapiens
gcacaagguuucaacaaga

SEQ ID NO: 723934 - RNA, 19 nt, Homo sapiens
ggacaugacugcuguucuu

SEQ ID NO: 723935 - RNA, 19 nt, Homo sapiens
gccaggaggugaagaaauu

SEQ ID NO: 723936 - RNA, 19 nt, Homo sapiens
gaacacacacaauuaaguu

SEQ ID NO: 723937 - RNA, 19 nt, Homo sapiens
ggaugaauaugacucugua

SEQ ID NO: 723938 - RNA, 19 nt, Homo sapiens
gaacacugcucgcuacaag

SEQ ID NO: 723939 - RNA, 19 nt, Homo sapiens
caauuaaguuggauccuuu

SEQ ID NO: 723940 - RNA, 19 nt, Homo sapiens
gaauauugcuuuguagcuu

SEQ ID NO: 723941 - RNA, 19 nt, Homo sapiens
ugaagaaauugguggguuu

SEQ ID NO: 723942 - RNA, 19 nt, Homo sapiens
cagacuaccucgauuacaa

SEQ ID NO: 723943 - RNA, 19 nt, Homo sapiens
uauaggaaguuucaacgaa

SEQ ID NO: 723944 - RNA, 19 nt, Homo sapiens
ggacaaggaccauuuagag

SEQ ID NO: 723945 - RNA, 19 nt, Homo sapiens
ggucagacuaccucgauua

SEQ ID NO: 723946 - RNA, 19 nt, Homo sapiens
cagaggagauagugcagaa

SEQ ID NO: 723947 - RNA, 19 nt, Homo sapiens
cagccgacauucuguugua

SEQ ID NO: 723948 - RNA, 19 nt, Homo sapiens
cuaccucgauuacaacauu

SEQ ID NO: 723949 - RNA, 19 nt, Homo sapiens
gauaacggcagcuuuccua

SEQ ID NO: 723950 - RNA, 19 nt, Homo sapiens
gagaagguuuuacaaauug

SEQ ID NO: 723951 - RNA, 19 nt, Homo sapiens
gagguuacaggaugaauau

SEQ ID NO: 723952 - RNA, 19 nt, Homo sapiens
cagaugcugugauugagaa

SEQ ID NO: 723953 - RNA, 19 nt, Homo sapiens
ucacauccaugaagaaggu

SEQ ID NO: 723954 - RNA, 19 nt, Homo sapiens
guacaaguccacacacguu

SEQ ID NO: 723955 - RNA, 19 nt, Homo sapiens
caaggaccauuuagagaag

SEQ ID NO: 723956 - RNA, 19 nt, Homo sapiens
ggagauagugcagaaauuc

SEQ ID NO: 723957 - RNA, 19 nt, Homo sapiens
caaagacuaccaagcagaa

SEQ ID NO: 723958 - RNA, 19 nt, Homo sapiens
cagcaagaagcgaguauuu

SEQ ID NO: 723959 - RNA, 19 nt, Homo sapiens
cacaagguuucaacaagaa

SEQ ID NO: 723960 - RNA, 19 nt, Homo sapiens
ugguauagcugauuauugg

SEQ ID NO: 723961 - RNA, 19 nt, Homo sapiens
gacauucuguuguacaagu

SEQ ID NO: 723962 - RNA, 19 nt, Homo sapiens
gaugaauauugcuuuguag

SEQ ID NO: 723963 - RNA, 19 nt, Homo sapiens
gcugauuauuggcuuuauu

SEQ ID NO: 723964 - RNA, 19 nt, Homo sapiens
gacaaggaccauuuagaga

SEQ ID NO: 723965 - RNA, 19 nt, Homo sapiens
gguuacaggaugaauauga

SEQ ID NO: 723966 - RNA, 19 nt, Homo sapiens
acaaggaccauuuagagaa

SEQ ID NO: 723967 - RNA, 19 nt, Homo sapiens
gaggagauagugcagaaau

SEQ ID NO: 723968 - RNA, 19 nt, Homo sapiens
cguggcagaugcugugauu

SEQ ID NO: 723969 - RNA, 19 nt, Homo sapiens
gaccuccacuccauuacug

SEQ ID NO: 723970 - RNA, 19 nt, Homo sapiens
uaacggcagcuuuccuaaa

SEQ ID NO: 723971 - RNA, 19 nt, Homo sapiens
cgugagcgcuggagcuuca

SEQ ID NO: 723972 - RNA, 19 nt, Homo sapiens
gcuggacaaggaccauuua

SEQ ID NO: 723973 - RNA, 19 nt, Homo sapiens
acaauuaaguuggauccuu

SEQ ID NO: 723974 - RNA, 19 nt, Homo sapiens
ccaacaaucucaggugucu

SEQ ID NO: 723975 - RNA, 19 nt, Homo sapiens
gaaauacgacaguguucca

SEQ ID NO: 723976 - RNA, 19 nt, Homo sapiens
cggugggccugcucacaua

SEQ ID NO: 723977 - RNA, 19 nt, Homo sapiens
caugacugcuguucuucuu

SEQ ID NO: 723978 - RNA, 19 nt, Homo sapiens
agauggcgcugcacucaau

SEQ ID NO: 723979 - RNA, 19 nt, Homo sapiens
ggaucuagcacaagguuuc

SEQ ID NO: 723980 - RNA, 19 nt, Homo sapiens
guugaccuccacuccauua

SEQ ID NO: 723981 - RNA, 19 nt, Homo sapiens
ccaaagaauuagcauacac

SEQ ID NO: 723982 - RNA, 19 nt, Homo sapiens
uggcagaugcugugauuga

SEQ ID NO: 723983 - RNA, 19 nt, Homo sapiens
ggaaggcaaagacuaccaa

SEQ ID NO: 723984 - RNA, 19 nt, Homo sapiens
gcuuuguagcuuugaaaua

SEQ ID NO: 723985 - RNA, 19 nt, Homo sapiens
cgaaucacagcaaggcuuu

SEQ ID NO: 723986 - RNA, 19 nt, Homo sapiens
aacugaagcuggacaagga

SEQ ID NO: 723987 - RNA, 19 nt, Homo sapiens
gcagaugcugugauugaga

SEQ ID NO: 723988 - RNA, 19 nt, Homo sapiens
gcaagaagcgaguauuuuc

SEQ ID NO: 723989 - RNA, 19 nt, Homo sapiens
caagauggcgcugcacuca

SEQ ID NO: 723990 - RNA, 19 nt, Homo sapiens
ccagaaagacagcaagaag

SEQ ID NO: 723991 - RNA, 19 nt, Homo sapiens
ucugaacacacacaauuaa

SEQ ID NO: 723992 - RNA, 19 nt, Homo sapiens
ugucugaacacacacaauu

SEQ ID NO: 723993 - RNA, 19 nt, Homo sapiens
caaaucccaucaacaaaau

SEQ ID NO: 723994 - RNA, 19 nt, Homo sapiens
ugagguuacaggaugaaua

SEQ ID NO: 723995 - RNA, 19 nt, Homo sapiens
auacgacaguguuccaaau

SEQ ID NO: 723996 - RNA, 19 nt, Homo sapiens
gccaaagaauuagcauaca

SEQ ID NO: 723997 - RNA, 19 nt, Homo sapiens
agacagcccagaggagaua

SEQ ID NO: 723998 - RNA, 19 nt, Homo sapiens
auaggaaguuucaacgaau

SEQ ID NO: 723999 - RNA, 19 nt, Homo sapiens
agcaaaagccaaagaauua

SEQ ID NO: 724000 - RNA, 19 nt, Homo sapiens
gcgcuggcguguccaacau

SEQ ID NO: 724001 - RNA, 19 nt, Homo sapiens
ugggacauuuaauuuggua

SEQ ID NO: 724002 - RNA, 19 nt, Homo sapiens
caaauuggaucagcaaaag

SEQ ID NO: 724003 - RNA, 19 nt, Homo sapiens
aggagauagugcagaaauu

SEQ ID NO: 724004 - RNA, 19 nt, Homo sapiens
gucugaacacacacaauua

SEQ ID NO: 724005 - RNA, 19 nt, Homo sapiens
aaaaugcugugaacaacaa

SEQ ID NO: 724006 - RNA, 19 nt, Homo sapiens
ccaaaucccaucaacaaaa

SEQ ID NO: 724007 - RNA, 19 nt, Homo sapiens
cuuuguagcuuugaaauac

SEQ ID NO: 724008 - RNA, 19 nt, Homo sapiens
gggugagguuacaggauga

SEQ ID NO: 724009 - RNA, 19 nt, Homo sapiens
ccgacauucuguuguacaa

SEQ ID NO: 724010 - RNA, 19 nt, Homo sapiens
gaaguuucaacgaaucaca

SEQ ID NO: 724011 - RNA, 19 nt, Homo sapiens
uaggaaguuucaacgaauc

SEQ ID NO: 724012 - RNA, 19 nt, Homo sapiens
cagagcauccuggacauga

SEQ ID NO: 724013 - RNA, 19 nt, Homo sapiens
ccgaguccauucucacauc

SEQ ID NO: 724014 - RNA, 19 nt, Homo sapiens
caaagaauuagcauacacu

SEQ ID NO: 724015 - RNA, 19 nt, Homo sapiens
cagcaaaagccaaagaauu

SEQ ID NO: 724016 - RNA, 19 nt, Homo sapiens
ugaacacacacaauuaagu

SEQ ID NO: 724017 - RNA, 19 nt, Homo sapiens
uuccaaaucccaucaacaa

SEQ ID NO: 724018 - RNA, 19 nt, Homo sapiens
ccaagacccagcuguccuu

SEQ ID NO: 724019 - RNA, 19 nt, Homo sapiens
gcuggcguguccaacauag

SEQ ID NO: 724020 - RNA, 19 nt, Homo sapiens
uagcacaagguuucaacaa

SEQ ID NO: 724021 - RNA, 19 nt, Homo sapiens
ccaggcagccgacauucug

SEQ ID NO: 724022 - RNA, 19 nt, Homo sapiens
cacacacaauuaaguugga

SEQ ID NO: 724023 - RNA, 19 nt, Homo sapiens
ggcauucaaccuacaggaa

SEQ ID NO: 724024 - RNA, 19 nt, Homo sapiens
gcucacauacccaguacuc

SEQ ID NO: 724025 - RNA, 19 nt, Homo sapiens
aggcaaagacuaccaagca

SEQ ID NO: 724026 - RNA, 19 nt, Homo sapiens
uagcugauuauuggcuuua

SEQ ID NO: 724027 - RNA, 19 nt, Homo sapiens
gcgaguauuuuccggcauu

SEQ ID NO: 724028 - RNA, 19 nt, Homo sapiens
gagaaguuugccccaauua

SEQ ID NO: 724029 - RNA, 19 nt, Homo sapiens
gcugugaacaacaacaaca

SEQ ID NO: 724030 - RNA, 19 nt, Homo sapiens
uuacaaauuggaucagcaa

SEQ ID NO: 724031 - RNA, 19 nt, Homo sapiens
gaccauuuagagaagguuu

SEQ ID NO: 724032 - RNA, 19 nt, Homo sapiens
augcugugauugagaaguu

SEQ ID NO: 724033 - RNA, 19 nt, Homo sapiens
gacaaaguuucaacaauug

SEQ ID NO: 724034 - RNA, 19 nt, Homo sapiens
ggacagugaugaggaagaa

SEQ ID NO: 724035 - RNA, 19 nt, Homo sapiens
gggagggacuugggucuuu

SEQ ID NO: 724036 - RNA, 19 nt, Homo sapiens
gaugagcaaugauguuucu

SEQ ID NO: 724037 - RNA, 19 nt, Homo sapiens
ggagagcgaggaagaggaa

SEQ ID NO: 724038 - RNA, 19 nt, Homo sapiens
ccuguucccugacaaaguu

SEQ ID NO: 724039 - RNA, 19 nt, Homo sapiens
agacgaguguaauguggua

SEQ ID NO: 724040 - RNA, 19 nt, Homo sapiens
gagccaaagacgaguguaa

SEQ ID NO: 724041 - RNA, 19 nt, Homo sapiens
ccaccugccugugagaauu

SEQ ID NO: 724042 - RNA, 19 nt, Homo sapiens
ggagggacuugggucuuug

SEQ ID NO: 724043 - RNA, 19 nt, Homo sapiens
guaaugugguagaaguugu

SEQ ID NO: 724044 - RNA, 19 nt, Homo sapiens
auaaagugguguggaguuu

SEQ ID NO: 724045 - RNA, 19 nt, Homo sapiens
caaagacgaguguaaugug

SEQ ID NO: 724046 - RNA, 19 nt, Homo sapiens
ccaaagacgaguguaaugu

SEQ ID NO: 724047 - RNA, 19 nt, Homo sapiens
agaggacagugaugaggaa

SEQ ID NO: 724048 - RNA, 19 nt, Homo sapiens
uaagguagaggaagaggau

SEQ ID NO: 724049 - RNA, 19 nt, Homo sapiens
cugacaaaguuucaacaau

SEQ ID NO: 724050 - RNA, 19 nt, Homo sapiens
ggcaccagauuguuacgau

SEQ ID NO: 724051 - RNA, 19 nt, Homo sapiens
cgaguguaaugugguagaa

SEQ ID NO: 724052 - RNA, 19 nt, Homo sapiens
ggaagaggacagugaugag

SEQ ID NO: 724053 - RNA, 19 nt, Homo sapiens
gccaaagacgaguguaaug

SEQ ID NO: 724054 - RNA, 19 nt, Homo sapiens
caccagauuguuacgauga

SEQ ID NO: 724055 - RNA, 19 nt, Homo sapiens
cagcuccaaccaccuguaa

SEQ ID NO: 724056 - RNA, 19 nt, Homo sapiens
gcacccuguucccugacaa

SEQ ID NO: 724057 - RNA, 19 nt, Homo sapiens
gugaugaggaagaaguuga

SEQ ID NO: 724058 - RNA, 19 nt, Homo sapiens
ugagcaaugauguuucuga

SEQ ID NO: 724059 - RNA, 19 nt, Homo sapiens
ugugagaauuggagguuag

SEQ ID NO: 724060 - RNA, 19 nt, Homo sapiens
ggaagaggaagaggacagu

SEQ ID NO: 724061 - RNA, 19 nt, Homo sapiens
aagaggaagaggacaguga

SEQ ID NO: 724062 - RNA, 19 nt, Homo sapiens
gcagcugccuuagcguuuu

SEQ ID NO: 724063 - RNA, 19 nt, Homo sapiens
cggucacuauggacaguuu

SEQ ID NO: 724064 - RNA, 19 nt, Homo sapiens
gccaacccaugcucagucu

SEQ ID NO: 724065 - RNA, 19 nt, Homo sapiens
aguguaaugugguagaagu

SEQ ID NO: 724066 - RNA, 19 nt, Homo sapiens
acgaugagcaaugauguuu

SEQ ID NO: 724067 - RNA, 19 nt, Homo sapiens
ucaccgagggagccaaaga

SEQ ID NO: 724068 - RNA, 19 nt, Homo sapiens
gaggaagaggacagugaug

SEQ ID NO: 724069 - RNA, 19 nt, Homo sapiens
aauaaagugguguggaguu

SEQ ID NO: 724070 - RNA, 19 nt, Homo sapiens
agaagaagaucaagaaaga

SEQ ID NO: 724071 - RNA, 19 nt, Homo sapiens
cagcaucccuuuagcuuuc

SEQ ID NO: 724072 - RNA, 19 nt, Homo sapiens
caugaacacucuccugaau

SEQ ID NO: 724073 - RNA, 19 nt, Homo sapiens
cggagaagauccaggagaa

SEQ ID NO: 724074 - RNA, 19 nt, Homo sapiens
gagagaagcagcaguacau

SEQ ID NO: 724075 - RNA, 19 nt, Homo sapiens
gagaagauccaggagaaga

SEQ ID NO: 724076 - RNA, 19 nt, Homo sapiens
gagaagcagcaguacauga

SEQ ID NO: 724077 - RNA, 19 nt, Homo sapiens
ugaacacucuccugaaugg

SEQ ID NO: 724078 - RNA, 19 nt, Homo sapiens
gagaagaagaucaagaaag

SEQ ID NO: 724079 - RNA, 19 nt, Homo sapiens
ggagaagaagaucaagaaa

SEQ ID NO: 724080 - RNA, 19 nt, Homo sapiens
gggcguaccagcagucuga

SEQ ID NO: 724081 - RNA, 19 nt, Homo sapiens
agagagagaagcagcagua

SEQ ID NO: 724082 - RNA, 19 nt, Homo sapiens
gcucugggcucaugaacac

SEQ ID NO: 724083 - RNA, 19 nt, Homo sapiens
gaagaagaucaagaaagaa

SEQ ID NO: 724084 - RNA, 19 nt, Homo sapiens
ccagcagucugaagccuau

SEQ ID NO: 724085 - RNA, 19 nt, Homo sapiens
ggacacagggcagacgaaa

SEQ ID NO: 724086 - RNA, 19 nt, Homo sapiens
gcagcaucccuuuagcuuu

SEQ ID NO: 724087 - RNA, 19 nt, Homo sapiens
agaagcagcaguacaugaa

SEQ ID NO: 724088 - RNA, 19 nt, Homo sapiens
ggucccauccugcaccuuu

SEQ ID NO: 724089 - RNA, 19 nt, Homo sapiens
ucugaagccuauaagaugu

SEQ ID NO: 724090 - RNA, 19 nt, Homo sapiens
gcugggcacucuggacuuc

SEQ ID NO: 724091 - RNA, 19 nt, Homo sapiens
gcgauggcuucuccaccuu

SEQ ID NO: 724092 - RNA, 19 nt, Homo sapiens
gaagaucaagaaagaagac

SEQ ID NO: 724093 - RNA, 19 nt, Homo sapiens
gaugaggccgagagagaga

SEQ ID NO: 724094 - RNA, 19 nt, Homo sapiens
gccauaggccacacaggaa

SEQ ID NO: 724095 - RNA, 19 nt, Homo sapiens
aggagaagaagaucaagaa

SEQ ID NO: 724096 - RNA, 19 nt, Homo sapiens
gaagauccaggagaagaag

SEQ ID NO: 724097 - RNA, 19 nt, Homo sapiens
gucugaagccuauaagaug

SEQ ID NO: 724098 - RNA, 19 nt, Homo sapiens
gcucaucguccgcaucaag

SEQ ID NO: 724099 - RNA, 19 nt, Homo sapiens
uggaugaggccgagagaga

SEQ ID NO: 724100 - RNA, 19 nt, Homo sapiens
gaagcagcaguacaugaag

SEQ ID NO: 724101 - RNA, 19 nt, Homo sapiens
ugggcacucuggacuucua

SEQ ID NO: 724102 - RNA, 19 nt, Homo sapiens
agaagauccaggagaagaa

SEQ ID NO: 724103 - RNA, 19 nt, Homo sapiens
cgcgauacacccagaagaa

SEQ ID NO: 724104 - RNA, 19 nt, Homo sapiens
aagaagaucaagaaagaag

SEQ ID NO: 724105 - RNA, 19 nt, Homo sapiens
cccuuuagcuuucaaucuc

SEQ ID NO: 724106 - RNA, 19 nt, Homo sapiens
agaugaauguggccuucga

SEQ ID NO: 724107 - RNA, 19 nt, Homo sapiens
caggagaagaagaucaaga

SEQ ID NO: 724108 - RNA, 19 nt, Homo sapiens
guacaaagcccuaaguuua

SEQ ID NO: 724109 - RNA, 19 nt, Homo sapiens
gaaauaaguuguugccuau

SEQ ID NO: 724110 - RNA, 19 nt, Homo sapiens
ggaaagagagguucugauu

SEQ ID NO: 724111 - RNA, 19 nt, Homo sapiens
gaagauaacggacuguaaa

SEQ ID NO: 724112 - RNA, 19 nt, Homo sapiens
gaagaauucucauguccuu

SEQ ID NO: 724113 - RNA, 19 nt, Homo sapiens
gaggaauucuugaaccaua

SEQ ID NO: 724114 - RNA, 19 nt, Homo sapiens
gggaauuccugucuucuuu

SEQ ID NO: 724115 - RNA, 19 nt, Homo sapiens
gacagugacuugaaacauu

SEQ ID NO: 724116 - RNA, 19 nt, Homo sapiens
gaagagagauggaaaacuu

SEQ ID NO: 724117 - RNA, 19 nt, Homo sapiens
gcacaaggcuaaagguuac

SEQ ID NO: 724118 - RNA, 19 nt, Homo sapiens
cagcaaggcucuucuguuc

SEQ ID NO: 724119 - RNA, 19 nt, Homo sapiens
ugaacagacucgaucguua

SEQ ID NO: 724120 - RNA, 19 nt, Homo sapiens
gagaacaacuucgagcaaa

SEQ ID NO: 724121 - RNA, 19 nt, Homo sapiens
gaagaugagcaacgaagua

SEQ ID NO: 724122 - RNA, 19 nt, Homo sapiens
uauaugagcuuccuaugga

SEQ ID NO: 724123 - RNA, 19 nt, Homo sapiens
aaacagcgcuaccuugaug

SEQ ID NO: 724124 - RNA, 19 nt, Homo sapiens
caccaacaauccagaauuu

SEQ ID NO: 724125 - RNA, 19 nt, Homo sapiens
caagagagccuacaguaug

SEQ ID NO: 724126 - RNA, 19 nt, Homo sapiens
gcagcuugcuucugaaaug

SEQ ID NO: 724127 - RNA, 19 nt, Homo sapiens
gugaaagaauuaucaguga

SEQ ID NO: 724128 - RNA, 19 nt, Homo sapiens
ggacaccauugacucauau

SEQ ID NO: 724129 - RNA, 19 nt, Homo sapiens
gcacaauaccuaauucaug

SEQ ID NO: 724130 - RNA, 19 nt, Homo sapiens
gguuacagcugagaucuuu

SEQ ID NO: 724131 - RNA, 19 nt, Homo sapiens
guaaaggaacggucuguuu

SEQ ID NO: 724132 - RNA, 19 nt, Homo sapiens
agaacuaccugucauguug

SEQ ID NO: 724133 - RNA, 19 nt, Homo sapiens
ggagugcgguggcuauuca

SEQ ID NO: 724134 - RNA, 19 nt, Homo sapiens
ggaauuguccucuguggaa

SEQ ID NO: 724135 - RNA, 19 nt, Homo sapiens
aaagagagguucugauucu

SEQ ID NO: 724136 - RNA, 19 nt, Homo sapiens
ggaauuguccuuaugugaa

SEQ ID NO: 724137 - RNA, 19 nt, Homo sapiens
gaacagaggcaugaagaug

SEQ ID NO: 724138 - RNA, 19 nt, Homo sapiens
guuacaggcuagcacaaua

SEQ ID NO: 724139 - RNA, 19 nt, Homo sapiens
cacaauaccuaauucaugu

SEQ ID NO: 724140 - RNA, 19 nt, Homo sapiens
gauaaggagcguuacauga

SEQ ID NO: 724141 - RNA, 19 nt, Homo sapiens
gaaugagcgucgagaacaa

SEQ ID NO: 724142 - RNA, 19 nt, Homo sapiens
gaaagaaacagagguaaag

SEQ ID NO: 724143 - RNA, 19 nt, Homo sapiens
uaauucauguuucccagua

SEQ ID NO: 724144 - RNA, 19 nt, Homo sapiens
uaccaucacuuggcaauuu

SEQ ID NO: 724145 - RNA, 19 nt, Homo sapiens
gaacagacucgaucguuag

SEQ ID NO: 724146 - RNA, 19 nt, Homo sapiens
cagaaaggcaaaucucaua

SEQ ID NO: 724147 - RNA, 19 nt, Homo sapiens
caucuugguuacauaauga

SEQ ID NO: 724148 - RNA, 19 nt, Homo sapiens
acagugacuugaaacauuu

SEQ ID NO: 724149 - RNA, 19 nt, Homo sapiens
ggaauuccugucuucuuua

SEQ ID NO: 724150 - RNA, 19 nt, Homo sapiens
gcagaucccuuugcuugug

SEQ ID NO: 724151 - RNA, 19 nt, Homo sapiens
ugacaucccuauauuuaca

SEQ ID NO: 724152 - RNA, 19 nt, Homo sapiens
gcaaugaacagaggcauga

SEQ ID NO: 724153 - RNA, 19 nt, Homo sapiens
guuuggaacuguugaaaug

SEQ ID NO: 724154 - RNA, 19 nt, Homo sapiens
auucacagaugcuaucaua

SEQ ID NO: 724155 - RNA, 19 nt, Homo sapiens
gagaguuucuugcauugga

SEQ ID NO: 724156 - RNA, 19 nt, Homo sapiens
gaaggagaguuucuugcau

SEQ ID NO: 724157 - RNA, 19 nt, Homo sapiens
ggaagauaacggacuguaa

SEQ ID NO: 724158 - RNA, 19 nt, Homo sapiens
caaggucaguugcuucaga

SEQ ID NO: 724159 - RNA, 19 nt, Homo sapiens
cuucugaaaugcugucuuu

SEQ ID NO: 724160 - RNA, 19 nt, Homo sapiens
gaaaacaacagcaacaaaa

SEQ ID NO: 724161 - RNA, 19 nt, Homo sapiens
gcaggcagguggauagaag

SEQ ID NO: 724162 - RNA, 19 nt, Homo sapiens
gaauuguccuuaugugaag

SEQ ID NO: 724163 - RNA, 19 nt, Homo sapiens
gaaagagagguucugauuc

SEQ ID NO: 724164 - RNA, 19 nt, Homo sapiens
gaagugaaggcgauugaga

SEQ ID NO: 724165 - RNA, 19 nt, Homo sapiens
ggaagacuuuucauuguaa

SEQ ID NO: 724166 - RNA, 19 nt, Homo sapiens
gaacaacuucgagcaaaga

SEQ ID NO: 724167 - RNA, 19 nt, Homo sapiens
cagagugagucuucaaaug

SEQ ID NO: 724168 - RNA, 19 nt, Homo sapiens
gaaguugaugugcuuguuu

SEQ ID NO: 724169 - RNA, 19 nt, Homo sapiens
ccauuuccauuucuguuaa

SEQ ID NO: 724170 - RNA, 19 nt, Homo sapiens
acuccaagauguuccauaa

SEQ ID NO: 724171 - RNA, 19 nt, Homo sapiens
gcacagcaguggagaagcu

SEQ ID NO: 724172 - RNA, 19 nt, Homo sapiens
gaaagggagacaagguauu

SEQ ID NO: 724173 - RNA, 19 nt, Homo sapiens
gaauuccugucuucuuuag

SEQ ID NO: 724174 - RNA, 19 nt, Homo sapiens
acaaagcccuaaguuuauu

SEQ ID NO: 724175 - RNA, 19 nt, Homo sapiens
uagcaaagcucgggaagca

SEQ ID NO: 724176 - RNA, 19 nt, Homo sapiens
gcaaaucucauaggcaaga

SEQ ID NO: 724177 - RNA, 19 nt, Homo sapiens
uacaaggucuucaguagga

SEQ ID NO: 724178 - RNA, 19 nt, Homo sapiens
agacagcaaugcacccaaa

SEQ ID NO: 724179 - RNA, 19 nt, Homo sapiens
gcaugaagaugagcaacga

SEQ ID NO: 724180 - RNA, 19 nt, Homo sapiens
aagagagccuacaguauga

SEQ ID NO: 724181 - RNA, 19 nt, Homo sapiens
gaaagaauuaucagugagu

SEQ ID NO: 724182 - RNA, 19 nt, Homo sapiens
uuaagaaguugaugugcuu

SEQ ID NO: 724183 - RNA, 19 nt, Homo sapiens
guacauguguuuggaacug

SEQ ID NO: 724184 - RNA, 19 nt, Homo sapiens
caaggaagaauucucaugu

SEQ ID NO: 724185 - RNA, 19 nt, Homo sapiens
gaaagggaaagaguacaaa

SEQ ID NO: 724186 - RNA, 19 nt, Homo sapiens
uaaaguggaucugcauauc

SEQ ID NO: 724187 - RNA, 19 nt, Homo sapiens
ucucauuuguguucaguuu

SEQ ID NO: 724188 - RNA, 19 nt, Homo sapiens
cuauaaaccuagccaguuc

SEQ ID NO: 724189 - RNA, 19 nt, Homo sapiens
aaggagaguuucuugcauu

SEQ ID NO: 724190 - RNA, 19 nt, Homo sapiens
gcagcaacauguauaugag

SEQ ID NO: 724191 - RNA, 19 nt, Homo sapiens
aaacagaggccuacaaggu

SEQ ID NO: 724192 - RNA, 19 nt, Homo sapiens
ccagaaaucacaaggaugu

SEQ ID NO: 724193 - RNA, 19 nt, Homo sapiens
ggaaagggagacaagguau

SEQ ID NO: 724194 - RNA, 19 nt, Homo sapiens
acacaucacuugacaccau

SEQ ID NO: 724195 - RNA, 19 nt, Homo sapiens
gugaagcuuugaaggugua

SEQ ID NO: 724196 - RNA, 19 nt, Homo sapiens
ccauggaaauuugaacuga

SEQ ID NO: 724197 - RNA, 19 nt, Homo sapiens
gaagaaagaggaagaaacc

SEQ ID NO: 724198 - RNA, 19 nt, Homo sapiens
gucaguugcuucagaguga

SEQ ID NO: 724199 - RNA, 19 nt, Homo sapiens
ugcaugagauuucaagaga

SEQ ID NO: 724200 - RNA, 19 nt, Homo sapiens
gaucaucauucuucugacu

SEQ ID NO: 724201 - RNA, 19 nt, Homo sapiens
ccaagauguuccauaagug

SEQ ID NO: 724202 - RNA, 19 nt, Homo sapiens
ugagaaagaaacagaggua

SEQ ID NO: 724203 - RNA, 19 nt, Homo sapiens
gaaaucacaaggauguuag

SEQ ID NO: 724204 - RNA, 19 nt, Homo sapiens
acaagaagcagcugaggaa

SEQ ID NO: 724205 - RNA, 19 nt, Homo sapiens
gugaggaggcaguaaauga

SEQ ID NO: 724206 - RNA, 19 nt, Homo sapiens
gagagguucugauucuuac

SEQ ID NO: 724207 - RNA, 19 nt, Homo sapiens
gcaaggaagaauucucaug

SEQ ID NO: 724208 - RNA, 19 nt, Homo sapiens
ggcaagaccuacaccaaga

SEQ ID NO: 724209 - RNA, 19 nt, Homo sapiens
uaauuuaaguggcaucuuc

SEQ ID NO: 724210 - RNA, 19 nt, Homo sapiens
gauccuccuugacgaguuu

SEQ ID NO: 724211 - RNA, 19 nt, Homo sapiens
ugugaugccuugugagaaa

SEQ ID NO: 724212 - RNA, 19 nt, Homo sapiens
aaacugugacugguauuua

SEQ ID NO: 724213 - RNA, 19 nt, Homo sapiens
guauuacuguacauagaga

SEQ ID NO: 724214 - RNA, 19 nt, Homo sapiens
accaagaguucgcaucuga

SEQ ID NO: 724215 - RNA, 19 nt, Homo sapiens
agaccacgauccuccuuga

SEQ ID NO: 724216 - RNA, 19 nt, Homo sapiens
gcaaacgcaccgccacuca

SEQ ID NO: 724217 - RNA, 19 nt, Homo sapiens
guauauagugacugacaaa

SEQ ID NO: 724218 - RNA, 19 nt, Homo sapiens
ugggcuaccugguucguuu

SEQ ID NO: 724219 - RNA, 19 nt, Homo sapiens
caaacugugacugguauuu

SEQ ID NO: 724220 - RNA, 19 nt, Homo sapiens
ucugugcgaucgugccuuu

SEQ ID NO: 724221 - RNA, 19 nt, Homo sapiens
gaugccuugugagaaauaa

SEQ ID NO: 724222 - RNA, 19 nt, Homo sapiens
cccaaacugugacugguau

SEQ ID NO: 724223 - RNA, 19 nt, Homo sapiens
uguacugucugcggcauuu

SEQ ID NO: 724224 - RNA, 19 nt, Homo sapiens
gagagacaggugggcauuu

SEQ ID NO: 724225 - RNA, 19 nt, Homo sapiens
ggcuugugaugccuuguga

SEQ ID NO: 724226 - RNA, 19 nt, Homo sapiens
aacugugacugguauuuau

SEQ ID NO: 724227 - RNA, 19 nt, Homo sapiens
ggcugcggcuggaaguuug

SEQ ID NO: 724228 - RNA, 19 nt, Homo sapiens
caagaguucgcaucugaag

SEQ ID NO: 724229 - RNA, 19 nt, Homo sapiens
ggcacagcguggcuacaga

SEQ ID NO: 724230 - RNA, 19 nt, Homo sapiens
agaccuacaccaagaguuc

SEQ ID NO: 724231 - RNA, 19 nt, Homo sapiens
gaggaucgaggcuugugau

SEQ ID NO: 724232 - RNA, 19 nt, Homo sapiens
gcacgcacacaggugagaa

SEQ ID NO: 724233 - RNA, 19 nt, Homo sapiens
gcggcaagaccuacaccaa

SEQ ID NO: 724234 - RNA, 19 nt, Homo sapiens
uguauauagugacugacaa

SEQ ID NO: 724235 - RNA, 19 nt, Homo sapiens
ugccguccuucuccacuuu

SEQ ID NO: 724236 - RNA, 19 nt, Homo sapiens
ccauuccagugccaucugu

SEQ ID NO: 724237 - RNA, 19 nt, Homo sapiens
ccaagaguucgcaucugaa

SEQ ID NO: 724238 - RNA, 19 nt, Homo sapiens
gcaccgacgacgaccucaa

SEQ ID NO: 724239 - RNA, 19 nt, Homo sapiens
aaacgcaccgccacucaca

SEQ ID NO: 724240 - RNA, 19 nt, Homo sapiens
ggaaguuugcgcgcucaga

SEQ ID NO: 724241 - RNA, 19 nt, Homo sapiens
ccacucacaccugcagcua

SEQ ID NO: 724242 - RNA, 19 nt, Homo sapiens
gcaagaccuacaccaagag

SEQ ID NO: 724243 - RNA, 19 nt, Homo sapiens
agagacaggugggcauuuu

SEQ ID NO: 724244 - RNA, 19 nt, Homo sapiens
gccuuaauuuguacugucu

SEQ ID NO: 724245 - RNA, 19 nt, Homo sapiens
gaaguaguauuccugcaau

SEQ ID NO: 724246 - RNA, 19 nt, Homo sapiens
aaagguggcugcccucaga

SEQ ID NO: 724247 - RNA, 19 nt, Homo sapiens
gcacuuuaguuagcuguug

SEQ ID NO: 724248 - RNA, 19 nt, Homo sapiens
gagguuugccggaagauuu

SEQ ID NO: 724249 - RNA, 19 nt, Homo sapiens
caaucuccaugacaacuuu

SEQ ID NO: 724250 - RNA, 19 nt, Homo sapiens
gcucggacaucuuuaguac

SEQ ID NO: 724251 - RNA, 19 nt, Homo sapiens
gagaagaagagaugguaug

SEQ ID NO: 724252 - RNA, 19 nt, Homo sapiens
gaaagaugaggcacagugu

SEQ ID NO: 724253 - RNA, 19 nt, Homo sapiens
gcgcugugcuccucaugga

SEQ ID NO: 724254 - RNA, 19 nt, Homo sapiens
cacugagccugaaguagua

SEQ ID NO: 724255 - RNA, 19 nt, Homo sapiens
cagcugggaucuccaccaa

SEQ ID NO: 724256 - RNA, 19 nt, Homo sapiens
ccagggauccucagaaagu

SEQ ID NO: 724257 - RNA, 19 nt, Homo sapiens
ggaaggcggcagugguuga

SEQ ID NO: 724258 - RNA, 19 nt, Homo sapiens
ucacugagccugaaguagu

SEQ ID NO: 724259 - RNA, 19 nt, Homo sapiens
gaagguaggggaaagauga

SEQ ID NO: 724260 - RNA, 19 nt, Homo sapiens
gcaaucccguggaaaugag

SEQ ID NO: 724261 - RNA, 19 nt, Homo sapiens
caacuuugaugccuuuagc

SEQ ID NO: 724262 - RNA, 19 nt, Homo sapiens
caaggaggcuuugccaacu

SEQ ID NO: 724263 - RNA, 19 nt, Homo sapiens
ggauaccaguguuuuauau

SEQ ID NO: 724264 - RNA, 19 nt, Homo sapiens
gcccucagauuccacaaag

SEQ ID NO: 724265 - RNA, 19 nt, Homo sapiens
gcagggcuccaucccagaa

SEQ ID NO: 724266 - RNA, 19 nt, Homo sapiens
uuccagggauccucagaaa

SEQ ID NO: 724267 - RNA, 19 nt, Homo sapiens
gcuccugucaagcacuuua

SEQ ID NO: 724268 - RNA, 19 nt, Homo sapiens
gaaggcggcagugguugaa

SEQ ID NO: 724269 - RNA, 19 nt, Homo sapiens
aauaugagaagaagagaug

SEQ ID NO: 724270 - RNA, 19 nt, Homo sapiens
cugucaagcacuuuaguua

SEQ ID NO: 724271 - RNA, 19 nt, Homo sapiens
ugaaguaguauuccugcaa

SEQ ID NO: 724272 - RNA, 19 nt, Homo sapiens
gucaagcacuuuaguuagc

SEQ ID NO: 724273 - RNA, 19 nt, Homo sapiens
aagaugaggcacaguguug

SEQ ID NO: 724274 - RNA, 19 nt, Homo sapiens
guggaggugcuaaugcuuu

SEQ ID NO: 724275 - RNA, 19 nt, Homo sapiens
ugccaacuuugaugccuuu

SEQ ID NO: 724276 - RNA, 19 nt, Homo sapiens
cucagaaagugaaggaguu

SEQ ID NO: 724277 - RNA, 19 nt, Homo sapiens
ucggacaucuuuaguacca

SEQ ID NO: 724278 - RNA, 19 nt, Homo sapiens
ccaugacaacuuucacuga

SEQ ID NO: 724279 - RNA, 19 nt, Homo sapiens
uggaggugcuaaugcuuug

SEQ ID NO: 724280 - RNA, 19 nt, Homo sapiens
aggaggcuuugccaacuuu

SEQ ID NO: 724281 - RNA, 19 nt, Homo sapiens
ugacuggacccucaucaag

SEQ ID NO: 724282 - RNA, 19 nt, Homo sapiens
ccaaaccuccaaccaccaa

SEQ ID NO: 724283 - RNA, 19 nt, Homo sapiens
cuuaggaucagccaaguug

SEQ ID NO: 724284 - RNA, 19 nt, Homo sapiens
gagccuucacuaacccuuu

SEQ ID NO: 724285 - RNA, 19 nt, Homo sapiens
ccccagcucuucuguguuu

SEQ ID NO: 724286 - RNA, 19 nt, Homo sapiens
ucagaaagugaaggaguuu

SEQ ID NO: 724287 - RNA, 19 nt, Homo sapiens
gaagaagagaugguauguc

SEQ ID NO: 724288 - RNA, 19 nt, Homo sapiens
cuggaggagugaugguuga

SEQ ID NO: 724289 - RNA, 19 nt, Homo sapiens
ccaccaaccccuucuugua

SEQ ID NO: 724290 - RNA, 19 nt, Homo sapiens
aaugagguuugccggaaga

SEQ ID NO: 724291 - RNA, 19 nt, Homo sapiens
gaugguggaggugcuaaug

SEQ ID NO: 724292 - RNA, 19 nt, Homo sapiens
aaggaggcuuugccaacuu

SEQ ID NO: 724293 - RNA, 19 nt, Homo sapiens
gauuugguugggucuguuu

SEQ ID NO: 724294 - RNA, 19 nt, Homo sapiens
gcaccgucucucucaguug

SEQ ID NO: 724295 - RNA, 19 nt, Homo sapiens
gaugaggcacaguguugau

SEQ ID NO: 724296 - RNA, 19 nt, Homo sapiens
ccagauggcaccagcuuuu

SEQ ID NO: 724297 - RNA, 19 nt, Homo sapiens
guuagcuguuggugucaug

SEQ ID NO: 724298 - RNA, 19 nt, Homo sapiens
ugaccagacaguccugaga

SEQ ID NO: 724299 - RNA, 19 nt, Homo sapiens
aaagaugaggcacaguguu

SEQ ID NO: 724300 - RNA, 19 nt, Homo sapiens
agaagaagagaugguaugu

SEQ ID NO: 724301 - RNA, 19 nt, Homo sapiens
gggauccucagaaagugaa

SEQ ID NO: 724302 - RNA, 19 nt, Homo sapiens
cagggauccucagaaagug

SEQ ID NO: 724303 - RNA, 19 nt, Homo sapiens
gaauggagauggagaagua

SEQ ID NO: 724304 - RNA, 19 nt, Homo sapiens
gaaauugccuucaagaugu

SEQ ID NO: 724305 - RNA, 19 nt, Homo sapiens
ggacuucgcuuuacccaaa

SEQ ID NO: 724306 - RNA, 19 nt, Homo sapiens
gagcugaucugaagggaaa

SEQ ID NO: 724307 - RNA, 19 nt, Homo sapiens
gagcaucucuugauaaagu

SEQ ID NO: 724308 - RNA, 19 nt, Homo sapiens
uaagaugacuccaguguga

SEQ ID NO: 724309 - RNA, 19 nt, Homo sapiens
ggaagaauuugaacagguu

SEQ ID NO: 724310 - RNA, 19 nt, Homo sapiens
gaaaagugauggaauauga

SEQ ID NO: 724311 - RNA, 19 nt, Homo sapiens
aaagaagucugugaugaua

SEQ ID NO: 724312 - RNA, 19 nt, Homo sapiens
gaacacagcaagauucaga

SEQ ID NO: 724313 - RNA, 19 nt, Homo sapiens
gaacuucuuuacuuuccua

SEQ ID NO: 724314 - RNA, 19 nt, Homo sapiens
gaacucacuuucugcuuug

SEQ ID NO: 724315 - RNA, 19 nt, Homo sapiens
ggaaggaucuguguuaguc

SEQ ID NO: 724316 - RNA, 19 nt, Homo sapiens
gaauuuguuuccaucauga

SEQ ID NO: 724317 - RNA, 19 nt, Homo sapiens
gauaaacaaugaugaggau

SEQ ID NO: 724318 - RNA, 19 nt, Homo sapiens
gaacugagcaauaaggaau

SEQ ID NO: 724319 - RNA, 19 nt, Homo sapiens
gaaagaagucugugaugau

SEQ ID NO: 724320 - RNA, 19 nt, Homo sapiens
gacaaaaucuuccgauauu

SEQ ID NO: 724321 - RNA, 19 nt, Homo sapiens
ccaggaaggaucuguguua

SEQ ID NO: 724322 - RNA, 19 nt, Homo sapiens
ugaacucacuuucugcuuu

SEQ ID NO: 724323 - RNA, 19 nt, Homo sapiens
gcuggagcaucucuugaua

SEQ ID NO: 724324 - RNA, 19 nt, Homo sapiens
guucagcccucacaaccua

SEQ ID NO: 724325 - RNA, 19 nt, Homo sapiens
agaaagaagucugugauga

SEQ ID NO: 724326 - RNA, 19 nt, Homo sapiens
gcaguuugguggcaugcua

SEQ ID NO: 724327 - RNA, 19 nt, Homo sapiens
ccacagagaucguccaacu

SEQ ID NO: 724328 - RNA, 19 nt, Homo sapiens
ggugauaaagggaagaaua

SEQ ID NO: 724329 - RNA, 19 nt, Homo sapiens
aaagugacaucggugauaa

SEQ ID NO: 724330 - RNA, 19 nt, Homo sapiens
agaagucugugaugauaaa

SEQ ID NO: 724331 - RNA, 19 nt, Homo sapiens
gaucacagcccauccagau

SEQ ID NO: 724332 - RNA, 19 nt, Homo sapiens
gggucuggaucaauauaua

SEQ ID NO: 724333 - RNA, 19 nt, Homo sapiens
gcaauaaggaauuuguuuc

SEQ ID NO: 724334 - RNA, 19 nt, Homo sapiens
uggagcaucucuugauaaa

SEQ ID NO: 724335 - RNA, 19 nt, Homo sapiens
agaaguagauauggaagaa

SEQ ID NO: 724336 - RNA, 19 nt, Homo sapiens
gaagcagaaguguuuauga

SEQ ID NO: 724337 - RNA, 19 nt, Homo sapiens
gugauaaagggaagaauaa

SEQ ID NO: 724338 - RNA, 19 nt, Homo sapiens
guaaagcucagacauuugu

SEQ ID NO: 724339 - RNA, 19 nt, Homo sapiens
guggaaaugugcacaggaa

SEQ ID NO: 724340 - RNA, 19 nt, Homo sapiens
gagcucauguucccugcaa

SEQ ID NO: 724341 - RNA, 19 nt, Homo sapiens
cuguaaagcucagacauuu

SEQ ID NO: 724342 - RNA, 19 nt, Homo sapiens
ccauauggcuggagcaucu

SEQ ID NO: 724343 - RNA, 19 nt, Homo sapiens
agggaaagcugacaaucaa

SEQ ID NO: 724344 - RNA, 19 nt, Homo sapiens
ggaaagacagagaaaauuu

SEQ ID NO: 724345 - RNA, 19 nt, Homo sapiens
caacagcaccacccauuca

SEQ ID NO: 724346 - RNA, 19 nt, Homo sapiens
ggagauggagaaguagaua

SEQ ID NO: 724347 - RNA, 19 nt, Homo sapiens
ugaugaaggcaguauauuu

SEQ ID NO: 724348 - RNA, 19 nt, Homo sapiens
acagaaaagugauggaaua

SEQ ID NO: 724349 - RNA, 19 nt, Homo sapiens
gaugggagaauuacugaga

SEQ ID NO: 724350 - RNA, 19 nt, Homo sapiens
gggagcaucugcaguaacu

SEQ ID NO: 724351 - RNA, 19 nt, Homo sapiens
gacuaaugaugguggcuuu

SEQ ID NO: 724352 - RNA, 19 nt, Homo sapiens
uaaacaaugaugaggauga

SEQ ID NO: 724353 - RNA, 19 nt, Homo sapiens
cgucugaacucacuuucug

SEQ ID NO: 724354 - RNA, 19 nt, Homo sapiens
gauaaagggaagaauaaag

SEQ ID NO: 724355 - RNA, 19 nt, Homo sapiens
guacuggucuuuuguggaa

SEQ ID NO: 724356 - RNA, 19 nt, Homo sapiens
aggaaagggucugacauuu

SEQ ID NO: 724357 - RNA, 19 nt, Homo sapiens
agaggcagcucaagaagca

SEQ ID NO: 724358 - RNA, 19 nt, Homo sapiens
uggagaaugugggcucaua

SEQ ID NO: 724359 - RNA, 19 nt, Homo sapiens
gaugaaggcaguauauuuu

SEQ ID NO: 724360 - RNA, 19 nt, Homo sapiens
ggucuggaucaauauauaa

SEQ ID NO: 724361 - RNA, 19 nt, Homo sapiens
gugauggaauaugagaaua

SEQ ID NO: 724362 - RNA, 19 nt, Homo sapiens
uuaaaguaguugcuucaug

SEQ ID NO: 724363 - RNA, 19 nt, Homo sapiens
ccacaaguagggaagauau

SEQ ID NO: 724364 - RNA, 19 nt, Homo sapiens
gaagcauccaguucucaaa

SEQ ID NO: 724365 - RNA, 19 nt, Homo sapiens
ucaggacucugucgguuuc

SEQ ID NO: 724366 - RNA, 19 nt, Homo sapiens
gggaugaccucaggacucu

SEQ ID NO: 724367 - RNA, 19 nt, Homo sapiens
ccaggacaguggcuaaagu

SEQ ID NO: 724368 - RNA, 19 nt, Homo sapiens
aaugugggcucauauccuu

SEQ ID NO: 724369 - RNA, 19 nt, Homo sapiens
ccuugaaagucaucaguga

SEQ ID NO: 724370 - RNA, 19 nt, Homo sapiens
ggaagcauccaguucucaa

SEQ ID NO: 724371 - RNA, 19 nt, Homo sapiens
ggguuucacucgccucaug

SEQ ID NO: 724372 - RNA, 19 nt, Homo sapiens
gcagcaugauguucugaag

SEQ ID NO: 724373 - RNA, 19 nt, Homo sapiens
ggaauaugagaauaggauu

SEQ ID NO: 724374 - RNA, 19 nt, Homo sapiens
gauguuugauuugaaugga

SEQ ID NO: 724375 - RNA, 19 nt, Homo sapiens
ugcagaaucuccaccaugu

SEQ ID NO: 724376 - RNA, 19 nt, Homo sapiens
ggaaacugccugggacuuc

SEQ ID NO: 724377 - RNA, 19 nt, Homo sapiens
gagcaauaaggaauuuguu

SEQ ID NO: 724378 - RNA, 19 nt, Homo sapiens
guaaacugcagcaugaugu

SEQ ID NO: 724379 - RNA, 19 nt, Homo sapiens
gcugaugaaggcaguauau

SEQ ID NO: 724380 - RNA, 19 nt, Homo sapiens
acuugggucuggaucaaua

SEQ ID NO: 724381 - RNA, 19 nt, Homo sapiens
gauggaauaugagaauagg

SEQ ID NO: 724382 - RNA, 19 nt, Homo sapiens
uuagugagcaauagugauu

SEQ ID NO: 724383 - RNA, 19 nt, Homo sapiens
ccucgcagccucccuaaga

SEQ ID NO: 724384 - RNA, 19 nt, Homo sapiens
ucucagaccacguguguga

SEQ ID NO: 724385 - RNA, 19 nt, Homo sapiens
gaaggaaagggucugacau

SEQ ID NO: 724386 - RNA, 19 nt, Homo sapiens
ccugggagcaucugcagua

SEQ ID NO: 724387 - RNA, 19 nt, Homo sapiens
cagauccggcgaagacuaa

SEQ ID NO: 724388 - RNA, 19 nt, Homo sapiens
ccacuccucagagaaauuu

SEQ ID NO: 724389 - RNA, 19 nt, Homo sapiens
caauaaacauccccaaagu

SEQ ID NO: 724390 - RNA, 19 nt, Homo sapiens
agcguaaacugcagcauga

SEQ ID NO: 724391 - RNA, 19 nt, Homo sapiens
gagaaguagauauggaaga

SEQ ID NO: 724392 - RNA, 19 nt, Homo sapiens
auaaacauccccaaaguua

SEQ ID NO: 724393 - RNA, 19 nt, Homo sapiens
uccaaggccugcucuagga

SEQ ID NO: 724394 - RNA, 19 nt, Homo sapiens
gaaaugugcacaggaaacu

SEQ ID NO: 724395 - RNA, 19 nt, Homo sapiens
uucugaagcuugaguuuga

SEQ ID NO: 724396 - RNA, 19 nt, Homo sapiens
ggagaaugugggcucauau

SEQ ID NO: 724397 - RNA, 19 nt, Homo sapiens
gaugauaaacaaugaugag

SEQ ID NO: 724398 - RNA, 19 nt, Homo sapiens
gcucucagaccacgugugu

SEQ ID NO: 724399 - RNA, 19 nt, Homo sapiens
aaggaaagggucugacauu

SEQ ID NO: 724400 - RNA, 19 nt, Homo sapiens
ggaaagcugacaaucaaaa

SEQ ID NO: 724401 - RNA, 19 nt, Homo sapiens
guagauauggaagaauuug

SEQ ID NO: 724402 - RNA, 19 nt, Homo sapiens
gagaaugugggcucauauc

SEQ ID NO: 724403 - RNA, 19 nt, Homo sapiens
guaauaagcacucauguua

SEQ ID NO: 724404 - RNA, 19 nt, Homo sapiens
cgaagcagcuaauguaaua

SEQ ID NO: 724405 - RNA, 19 nt, Homo sapiens
caacaucauuggcaucaua

SEQ ID NO: 724406 - RNA, 19 nt, Homo sapiens
ggaaggaccuccacauucu

SEQ ID NO: 724407 - RNA, 19 nt, Homo sapiens
agaguaccaugaagaauua

SEQ ID NO: 724408 - RNA, 19 nt, Homo sapiens
aagagucacugcauaauaa

SEQ ID NO: 724409 - RNA, 19 nt, Homo sapiens
gaccagaaaucaaagaugu

SEQ ID NO: 724410 - RNA, 19 nt, Homo sapiens
gcacggacccucgucuuua

SEQ ID NO: 724411 - RNA, 19 nt, Homo sapiens
caggaagaaugaagaagua

SEQ ID NO: 724412 - RNA, 19 nt, Homo sapiens
ggaagagccuguacuaggu

SEQ ID NO: 724413 - RNA, 19 nt, Homo sapiens
gcacucauguuauuaaagg

SEQ ID NO: 724414 - RNA, 19 nt, Homo sapiens
gugcacaucuauauugaaa

SEQ ID NO: 724415 - RNA, 19 nt, Homo sapiens
ggacuaaaucuacaaguga

SEQ ID NO: 724416 - RNA, 19 nt, Homo sapiens
ugacagagguauccagaug

SEQ ID NO: 724417 - RNA, 19 nt, Homo sapiens
cgucugaacugaccucuga

SEQ ID NO: 724418 - RNA, 19 nt, Homo sapiens
gaagaaugaagaaguaaug

SEQ ID NO: 724419 - RNA, 19 nt, Homo sapiens
caucaucgcagaaauugua

SEQ ID NO: 724420 - RNA, 19 nt, Homo sapiens
ugaagaugcugacuacgaa

SEQ ID NO: 724421 - RNA, 19 nt, Homo sapiens
gaaaccagcaggaagaaug

SEQ ID NO: 724422 - RNA, 19 nt, Homo sapiens
ucaaagagucacugcauaa

SEQ ID NO: 724423 - RNA, 19 nt, Homo sapiens
ucauuggcaucauaguuua

SEQ ID NO: 724424 - RNA, 19 nt, Homo sapiens
ggacacagccgaauaucuc

SEQ ID NO: 724425 - RNA, 19 nt, Homo sapiens
gggcacggacuacugguua

SEQ ID NO: 724426 - RNA, 19 nt, Homo sapiens
aaagagucacugcauaaua

SEQ ID NO: 724427 - RNA, 19 nt, Homo sapiens
gaagaauuaugaggaugug

SEQ ID NO: 724428 - RNA, 19 nt, Homo sapiens
gaaagggaggauugaagaa

SEQ ID NO: 724429 - RNA, 19 nt, Homo sapiens
caaagaaugaaaccaaaug

SEQ ID NO: 724430 - RNA, 19 nt, Homo sapiens
cagaguaccaugaagaauu

SEQ ID NO: 724431 - RNA, 19 nt, Homo sapiens
uggaagaggacuuuacuaa

SEQ ID NO: 724432 - RNA, 19 nt, Homo sapiens
gcaaaggcuuccacaccau

SEQ ID NO: 724433 - RNA, 19 nt, Homo sapiens
gcaagaaaaucgaucacuu

SEQ ID NO: 724434 - RNA, 19 nt, Homo sapiens
ucaagccaaucccuuaaug

SEQ ID NO: 724435 - RNA, 19 nt, Homo sapiens
gcaggaagaaugaagaagu

SEQ ID NO: 724436 - RNA, 19 nt, Homo sapiens
gcacggacuacugguuaua

SEQ ID NO: 724437 - RNA, 19 nt, Homo sapiens
acagagguauccagauguu

SEQ ID NO: 724438 - RNA, 19 nt, Homo sapiens
gaauuaugaggauguguga

SEQ ID NO: 724439 - RNA, 19 nt, Homo sapiens
caugaagaauuaugaggau

SEQ ID NO: 724440 - RNA, 19 nt, Homo sapiens
gccggugccuuuaagaaga

SEQ ID NO: 724441 - RNA, 19 nt, Homo sapiens
gacuaaaucuacaagugau

SEQ ID NO: 724442 - RNA, 19 nt, Homo sapiens
aaacaugaccagaaaucaa

SEQ ID NO: 724443 - RNA, 19 nt, Homo sapiens
gaacaggacacagccgaau

SEQ ID NO: 724444 - RNA, 19 nt, Homo sapiens
ugaaagggaggauugaaga

SEQ ID NO: 724445 - RNA, 19 nt, Homo sapiens
gaagagccuguacuagguu

SEQ ID NO: 724446 - RNA, 19 nt, Homo sapiens
ccuuaaagccuaggcguua

SEQ ID NO: 724447 - RNA, 19 nt, Homo sapiens
ucagcccucucccacauuu

SEQ ID NO: 724448 - RNA, 19 nt, Homo sapiens
guaccaugaagaauuauga

SEQ ID NO: 724449 - RNA, 19 nt, Homo sapiens
gagcugccggugccuuuaa

SEQ ID NO: 724450 - RNA, 19 nt, Homo sapiens
gcucauaguuguccccauu

SEQ ID NO: 724451 - RNA, 19 nt, Homo sapiens
gccaaucccuuaaugucau

SEQ ID NO: 724452 - RNA, 19 nt, Homo sapiens
ggagccuucucuuucauca

SEQ ID NO: 724453 - RNA, 19 nt, Homo sapiens
cagcagacacaacgucauu

SEQ ID NO: 724454 - RNA, 19 nt, Homo sapiens
ggaagaaugaagaaguaau

SEQ ID NO: 724455 - RNA, 19 nt, Homo sapiens
uuacccggcugcagaguga

SEQ ID NO: 724456 - RNA, 19 nt, Homo sapiens
ucauuccucucucugugua

SEQ ID NO: 724457 - RNA, 19 nt, Homo sapiens
gugcaggacuaaaucuaca

SEQ ID NO: 724458 - RNA, 19 nt, Homo sapiens
caaaaggagaccugaauuu

SEQ ID NO: 724459 - RNA, 19 nt, Homo sapiens
ucagaaggcagcagugaug

SEQ ID NO: 724460 - RNA, 19 nt, Homo sapiens
ggguuaagcaacaucauug

SEQ ID NO: 724461 - RNA, 19 nt, Homo sapiens
agacacaacgucauucuca

SEQ ID NO: 724462 - RNA, 19 nt, Homo sapiens
aagggaggauugaagaaug

SEQ ID NO: 724463 - RNA, 19 nt, Homo sapiens
cggaguuccugaagaaauc

SEQ ID NO: 724464 - RNA, 19 nt, Homo sapiens
agaggugugugcaggacua

SEQ ID NO: 724465 - RNA, 19 nt, Homo sapiens
gaaggaccuccacauucuu

SEQ ID NO: 724466 - RNA, 19 nt, Homo sapiens
uucaaagagucacugcaua

SEQ ID NO: 724467 - RNA, 19 nt, Homo sapiens
ccacaauuccacacccaaa

SEQ ID NO: 724468 - RNA, 19 nt, Homo sapiens
uuucuacaguuccacaauu

SEQ ID NO: 724469 - RNA, 19 nt, Homo sapiens
caaagagucacugcauaau

SEQ ID NO: 724470 - RNA, 19 nt, Homo sapiens
caucauuggcaucauaguu

SEQ ID NO: 724471 - RNA, 19 nt, Homo sapiens
uaggagccuuugccgcuuu

SEQ ID NO: 724472 - RNA, 19 nt, Homo sapiens
aagagccuguacuagguua

SEQ ID NO: 724473 - RNA, 19 nt, Homo sapiens
agaaaucaaagaugucaga

SEQ ID NO: 724474 - RNA, 19 nt, Homo sapiens
gaggaccugcugccuagaa

SEQ ID NO: 724475 - RNA, 19 nt, Homo sapiens
aacaugaccagaaaucaaa

SEQ ID NO: 724476 - RNA, 19 nt, Homo sapiens
gcaugguccuugugauggu

SEQ ID NO: 724477 - RNA, 19 nt, Homo sapiens
caaagucccuguggaugcu

SEQ ID NO: 724478 - RNA, 19 nt, Homo sapiens
gaagccaggcgcaucucaa

SEQ ID NO: 724479 - RNA, 19 nt, Homo sapiens
uuuccuuucuuccuucuuu

SEQ ID NO: 724480 - RNA, 19 nt, Homo sapiens
ccacgcccgucugaacuga

SEQ ID NO: 724481 - RNA, 19 nt, Homo sapiens
caaagaguucaaagaguca

SEQ ID NO: 724482 - RNA, 19 nt, Homo sapiens
ggaccacgcuuuucuacag

SEQ ID NO: 724483 - RNA, 19 nt, Homo sapiens
gccgugcacaucuauauug

SEQ ID NO: 724484 - RNA, 19 nt, Homo sapiens
aaaccagcaggaagaauga

SEQ ID NO: 724485 - RNA, 19 nt, Homo sapiens
aggacuaaaucuacaagug

SEQ ID NO: 724486 - RNA, 19 nt, Homo sapiens
agagguauccagauguuga

SEQ ID NO: 724487 - RNA, 19 nt, Homo sapiens
ccagaaaucaaagauguca

SEQ ID NO: 724488 - RNA, 19 nt, Homo sapiens
ccucggcuccagaaacuuu

SEQ ID NO: 724489 - RNA, 19 nt, Homo sapiens
cugaagaaaucuacuuuug

SEQ ID NO: 724490 - RNA, 19 nt, Homo sapiens
ccgugcacaucuauauuga

SEQ ID NO: 724491 - RNA, 19 nt, Homo sapiens
gcagacacaacgucauucu

SEQ ID NO: 724492 - RNA, 19 nt, Homo sapiens
aaugaaaccagcaggaaga

SEQ ID NO: 724493 - RNA, 19 nt, Homo sapiens
ggagcaggcggagagcuuu

SEQ ID NO: 724494 - RNA, 19 nt, Homo sapiens
gaagcagcuaauguaauaa

SEQ ID NO: 724495 - RNA, 19 nt, Homo sapiens
cccaaagaguucaaagagu

SEQ ID NO: 724496 - RNA, 19 nt, Homo sapiens
aaaaguuacuccuaugguu

SEQ ID NO: 724497 - RNA, 19 nt, Homo sapiens
uguaauaagcacucauguu

SEQ ID NO: 724498 - RNA, 19 nt, Homo sapiens
ggaaguguacagagauguc

SEQ ID NO: 724499 - RNA, 19 nt, Homo sapiens
guucaaagagucacugcau

SEQ ID NO: 724500 - RNA, 19 nt, Homo sapiens
ugaagaauuaugaggaugu

SEQ ID NO: 724501 - RNA, 19 nt, Homo sapiens
acaggacacagccgaauau

SEQ ID NO: 724502 - RNA, 19 nt, Homo sapiens
cagcaggaagaaugaagaa

SEQ ID NO: 724503 - RNA, 19 nt, Homo sapiens
uaacaucauuggcaucaua

SEQ ID NO: 724504 - RNA, 19 nt, Homo sapiens
gcaagcaaauugaucacuu

SEQ ID NO: 724505 - RNA, 19 nt, Homo sapiens
gaagucgguuggguguuua

SEQ ID NO: 724506 - RNA, 19 nt, Homo sapiens
gaacaaagaagcaaaacaa

SEQ ID NO: 724507 - RNA, 19 nt, Homo sapiens
uaugacccauuccggauua

SEQ ID NO: 724508 - RNA, 19 nt, Homo sapiens
ugacacagcagaauauuuc

SEQ ID NO: 724509 - RNA, 19 nt, Homo sapiens
ucgguuggguguuuauaua

SEQ ID NO: 724510 - RNA, 19 nt, Homo sapiens
caagcaaauugaucacuuc

SEQ ID NO: 724511 - RNA, 19 nt, Homo sapiens
agaagucgguuggguguuu

SEQ ID NO: 724512 - RNA, 19 nt, Homo sapiens
ugaucgagguguucaaaug

SEQ ID NO: 724513 - RNA, 19 nt, Homo sapiens
caacaggaaaugugggaaa

SEQ ID NO: 724514 - RNA, 19 nt, Homo sapiens
ggaaaugugggaaaauaua

SEQ ID NO: 724515 - RNA, 19 nt, Homo sapiens
aaaggucugugcaagcaaa

SEQ ID NO: 724516 - RNA, 19 nt, Homo sapiens
ucaaaggucugugcaagca

SEQ ID NO: 724517 - RNA, 19 nt, Homo sapiens
ucccagaggaugcagauua

SEQ ID NO: 724518 - RNA, 19 nt, Homo sapiens
gagaaccugcugccuagaa

SEQ ID NO: 724519 - RNA, 19 nt, Homo sapiens
ggaugcagauuacgaagcu

SEQ ID NO: 724520 - RNA, 19 nt, Homo sapiens
caggaaaugugggaaaaua

SEQ ID NO: 724521 - RNA, 19 nt, Homo sapiens
ucauuggcaucauagugua

SEQ ID NO: 724522 - RNA, 19 nt, Homo sapiens
ucacaacuguauccagaag

SEQ ID NO: 724523 - RNA, 19 nt, Homo sapiens
caucauaguguacauaucu

SEQ ID NO: 724524 - RNA, 19 nt, Homo sapiens
gaacaguuucugaucucaa

SEQ ID NO: 724525 - RNA, 19 nt, Homo sapiens
ggaacaguuucugaucuca

SEQ ID NO: 724526 - RNA, 19 nt, Homo sapiens
gggaagaaaacaaacuuua

SEQ ID NO: 724527 - RNA, 19 nt, Homo sapiens
agaagggaauuucaaaggu

SEQ ID NO: 724528 - RNA, 19 nt, Homo sapiens
gguuggguguuuauauaau

SEQ ID NO: 724529 - RNA, 19 nt, Homo sapiens
aaagaacgaggaaguuaug

SEQ ID NO: 724530 - RNA, 19 nt, Homo sapiens
aacaguuucugaucucaaa

SEQ ID NO: 724531 - RNA, 19 nt, Homo sapiens
acaacuguauccagaagga

SEQ ID NO: 724532 - RNA, 19 nt, Homo sapiens
uaacagcuuccuccagguu

SEQ ID NO: 724533 - RNA, 19 nt, Homo sapiens
guuggguguuuauauaaug

SEQ ID NO: 724534 - RNA, 19 nt, Homo sapiens
ggucugugcaagcaaauug

SEQ ID NO: 724535 - RNA, 19 nt, Homo sapiens
ggucugaguaacaucauug

SEQ ID NO: 724536 - RNA, 19 nt, Homo sapiens
gcuguuugaucgagguguu

SEQ ID NO: 724537 - RNA, 19 nt, Homo sapiens
gcaggucugaguaacauca

SEQ ID NO: 724538 - RNA, 19 nt, Homo sapiens
ccuagaagggaauuucaaa

SEQ ID NO: 724539 - RNA, 19 nt, Homo sapiens
cuacaaaacucgacacaac

SEQ ID NO: 724540 - RNA, 19 nt, Homo sapiens
guacuugcacccucacaca

SEQ ID NO: 724541 - RNA, 19 nt, Homo sapiens
gcaucauaguguacauauc

SEQ ID NO: 724542 - RNA, 19 nt, Homo sapiens
aaauauaaacgagggaaga

SEQ ID NO: 724543 - RNA, 19 nt, Homo sapiens
uauaagaggaacaaagaag

SEQ ID NO: 724544 - RNA, 19 nt, Homo sapiens
ucauacggcugguccuucu

SEQ ID NO: 724545 - RNA, 19 nt, Homo sapiens
gaggaaguuaugacccauu

SEQ ID NO: 724546 - RNA, 19 nt, Homo sapiens
uaagaggaacaaagaagca

SEQ ID NO: 724547 - RNA, 19 nt, Homo sapiens
ggcaucauaguguacauau

SEQ ID NO: 724548 - RNA, 19 nt, Homo sapiens
caucauuggcaucauagug

SEQ ID NO: 724549 - RNA, 19 nt, Homo sapiens
gaaccgacuauuggcucua

SEQ ID NO: 724550 - RNA, 19 nt, Homo sapiens
caaaacaacaggaaaugug

SEQ ID NO: 724551 - RNA, 19 nt, Homo sapiens
cggcugguccuucuacuuc

SEQ ID NO: 724552 - RNA, 19 nt, Homo sapiens
aagaauaguuacucauacg

SEQ ID NO: 724553 - RNA, 19 nt, Homo sapiens
uagaagggaauuucaaagg

SEQ ID NO: 724554 - RNA, 19 nt, Homo sapiens
uaacucuccauauucucua

SEQ ID NO: 724555 - RNA, 19 nt, Homo sapiens
aggaaguuaugacccauuc

SEQ ID NO: 724556 - RNA, 19 nt, Homo sapiens
gagaaugaaaccagcaaaa

SEQ ID NO: 724557 - RNA, 19 nt, Homo sapiens
aaagugucagugagaauga

SEQ ID NO: 724558 - RNA, 19 nt, Homo sapiens
ccaaaagugucagugagaa

SEQ ID NO: 724559 - RNA, 19 nt, Homo sapiens
gaucgagguguucaaaugc

SEQ ID NO: 724560 - RNA, 19 nt, Homo sapiens
cccagaggaugcagauuac

SEQ ID NO: 724561 - RNA, 19 nt, Homo sapiens
ccuccagguucacaacugu

SEQ ID NO: 724562 - RNA, 19 nt, Homo sapiens
uggaacaguuucugaucuc

SEQ ID NO: 724563 - RNA, 19 nt, Homo sapiens
guguacauaucugccaaug

SEQ ID NO: 724564 - RNA, 19 nt, Homo sapiens
cugcaggucugaguaacau

SEQ ID NO: 724565 - RNA, 19 nt, Homo sapiens
cagaggaugcagauuacga

SEQ ID NO: 724566 - RNA, 19 nt, Homo sapiens
cauuccggauuauggagaa

SEQ ID NO: 724567 - RNA, 19 nt, Homo sapiens
ugagugugauucugcuuuu

SEQ ID NO: 724568 - RNA, 19 nt, Homo sapiens
cgagguguucaaaugcuuu

SEQ ID NO: 724569 - RNA, 19 nt, Homo sapiens
gcaaacauuucacagauuu

SEQ ID NO: 724570 - RNA, 19 nt, Homo sapiens
gcucaacuguuagauauua

SEQ ID NO: 724571 - RNA, 19 nt, Homo sapiens
gcaaacugcuuaaucuugu

SEQ ID NO: 724572 - RNA, 19 nt, Homo sapiens
aaagaaacauucccuuaga

SEQ ID NO: 724573 - RNA, 19 nt, Homo sapiens
augcuaaacuggaagauua

SEQ ID NO: 724574 - RNA, 19 nt, Homo sapiens
gauaauaggguguggaaug

SEQ ID NO: 724575 - RNA, 19 nt, Homo sapiens
gcauuugaguacagacuaa

SEQ ID NO: 724576 - RNA, 19 nt, Homo sapiens
ccaccucccuuauguaguu

SEQ ID NO: 724577 - RNA, 19 nt, Homo sapiens
gugcucaacuguuagauau

SEQ ID NO: 724578 - RNA, 19 nt, Homo sapiens
ucaaaugacugaacugcau

SEQ ID NO: 724579 - RNA, 19 nt, Homo sapiens
gcuguugacucgaucgaaa

SEQ ID NO: 724580 - RNA, 19 nt, Homo sapiens
cauagacacugauuucauc

SEQ ID NO: 724581 - RNA, 19 nt, Homo sapiens
ggcaaacauuucacagauu

SEQ ID NO: 724582 - RNA, 19 nt, Homo sapiens
ucaaggagcugcccgaacu

SEQ ID NO: 724583 - RNA, 19 nt, Homo sapiens
gacacugugcuaauaguua

SEQ ID NO: 724584 - RNA, 19 nt, Homo sapiens
gggccaaacuguucuggau

SEQ ID NO: 724585 - RNA, 19 nt, Homo sapiens
gaacugcauucagauuuac

SEQ ID NO: 724586 - RNA, 19 nt, Homo sapiens
uguagaugguuucaaauga

SEQ ID NO: 724587 - RNA, 19 nt, Homo sapiens
gaaaagauacuacuguguu

SEQ ID NO: 724588 - RNA, 19 nt, Homo sapiens
ucaggaaagucauacuguu

SEQ ID NO: 724589 - RNA, 19 nt, Homo sapiens
gccaaacuguucuggauca

SEQ ID NO: 724590 - RNA, 19 nt, Homo sapiens
ucacccaccucccuuaugu

SEQ ID NO: 724591 - RNA, 19 nt, Homo sapiens
aaccagcacuuccgagauu

SEQ ID NO: 724592 - RNA, 19 nt, Homo sapiens
guuucugucuucaacauuu

SEQ ID NO: 724593 - RNA, 19 nt, Homo sapiens
ugaaagguuugagaacuug

SEQ ID NO: 724594 - RNA, 19 nt, Homo sapiens
cuacuguguugaaagcuuu

SEQ ID NO: 724595 - RNA, 19 nt, Homo sapiens
acacugugcuaauaguuau

SEQ ID NO: 724596 - RNA, 19 nt, Homo sapiens
gaaauaucuagcuaacuug

SEQ ID NO: 724597 - RNA, 19 nt, Homo sapiens
uggcaaacauuucacagau

SEQ ID NO: 724598 - RNA, 19 nt, Homo sapiens
aaacugccaucucgcuuca

SEQ ID NO: 724599 - RNA, 19 nt, Homo sapiens
caaccaguauuucaaccau

SEQ ID NO: 724600 - RNA, 19 nt, Homo sapiens
guagaugguuucaaaugac

SEQ ID NO: 724601 - RNA, 19 nt, Homo sapiens
ggcaaacugcuuaaucuug

SEQ ID NO: 724602 - RNA, 19 nt, Homo sapiens
caacggaggggaaauaaaa

SEQ ID NO: 724603 - RNA, 19 nt, Homo sapiens
agacacaguaucucacuuu

SEQ ID NO: 724604 - RNA, 19 nt, Homo sapiens
gaugugggccaaacuguuc

SEQ ID NO: 724605 - RNA, 19 nt, Homo sapiens
ugacggacuucgugugcaa

SEQ ID NO: 724606 - RNA, 19 nt, Homo sapiens
ccauauguacagaugauaa

SEQ ID NO: 724607 - RNA, 19 nt, Homo sapiens
gaucuugaaagguuugaga

SEQ ID NO: 724608 - RNA, 19 nt, Homo sapiens
aaucuuggcaaacugcuua

SEQ ID NO: 724609 - RNA, 19 nt, Homo sapiens
aaacagaugugggccaaac

SEQ ID NO: 724610 - RNA, 19 nt, Homo sapiens
gaagcucaacaaccaguau

SEQ ID NO: 724611 - RNA, 19 nt, Homo sapiens
gaucaggaaagucauacug

SEQ ID NO: 724612 - RNA, 19 nt, Homo sapiens
guugaaauaucuagcuaac

SEQ ID NO: 724613 - RNA, 19 nt, Homo sapiens
uugagaacuuggaaacaaa

SEQ ID NO: 724614 - RNA, 19 nt, Homo sapiens
aaacauucccuuagacaca

SEQ ID NO: 724615 - RNA, 19 nt, Homo sapiens
auaauaggguguggaaugu

SEQ ID NO: 724616 - RNA, 19 nt, Homo sapiens
ugcagaagcucaacaacca

SEQ ID NO: 724617 - RNA, 19 nt, Homo sapiens
gucauacuguucacuuuca

SEQ ID NO: 724618 - RNA, 19 nt, Homo sapiens
uaacuaugcauuugaguac

SEQ ID NO: 724619 - RNA, 19 nt, Homo sapiens
ccuaaugggcgagcacaua

SEQ ID NO: 724620 - RNA, 19 nt, Homo sapiens
uuugagaacuuggaaacaa

SEQ ID NO: 724621 - RNA, 19 nt, Homo sapiens
uugaaagguuugagaacuu

SEQ ID NO: 724622 - RNA, 19 nt, Homo sapiens
cagcagcccagcagaguga

SEQ ID NO: 724623 - RNA, 19 nt, Homo sapiens
cgacgaggaaguucuuaug

SEQ ID NO: 724624 - RNA, 19 nt, Homo sapiens
acuggaagauuaaacagau

SEQ ID NO: 724625 - RNA, 19 nt, Homo sapiens
ugauagaaauggguuugga

SEQ ID NO: 724626 - RNA, 19 nt, Homo sapiens
gauauuacugcacaaacug

SEQ ID NO: 724627 - RNA, 19 nt, Homo sapiens
ccaggaagguccccucuau

SEQ ID NO: 724628 - RNA, 19 nt, Homo sapiens
caaacugcuuaaucuugug

SEQ ID NO: 724629 - RNA, 19 nt, Homo sapiens
ucaacaaccaguauuucaa

SEQ ID NO: 724630 - RNA, 19 nt, Homo sapiens
caacaaccaguauuucaac

SEQ ID NO: 724631 - RNA, 19 nt, Homo sapiens
gaaugucgucaguggcaaa

SEQ ID NO: 724632 - RNA, 19 nt, Homo sapiens
gguguggaaugucgucagu

SEQ ID NO: 724633 - RNA, 19 nt, Homo sapiens
gauuuacgagugaaaggaa

SEQ ID NO: 724634 - RNA, 19 nt, Homo sapiens
caacuucuucggcgugaau

SEQ ID NO: 724635 - RNA, 19 nt, Homo sapiens
cacaguaucucacuuuuca

SEQ ID NO: 724636 - RNA, 19 nt, Homo sapiens
caggaaagucauacuguuc

SEQ ID NO: 724637 - RNA, 19 nt, Homo sapiens
gcucaacaaccaguauuuc

SEQ ID NO: 724638 - RNA, 19 nt, Homo sapiens
gacgaggaaguucuuaugu

SEQ ID NO: 724639 - RNA, 19 nt, Homo sapiens
ggaaagucauacuguucac

SEQ ID NO: 724640 - RNA, 19 nt, Homo sapiens
agauauuacugcacaaacu

SEQ ID NO: 724641 - RNA, 19 nt, Homo sapiens
gcauuaguugguugcauga

SEQ ID NO: 724642 - RNA, 19 nt, Homo sapiens
gaugguuucaaaugacuga

SEQ ID NO: 724643 - RNA, 19 nt, Homo sapiens
accacuacaugccggauuu

SEQ ID NO: 724644 - RNA, 19 nt, Homo sapiens
uuuguagccuugacauuca

SEQ ID NO: 724645 - RNA, 19 nt, Homo sapiens
aaaagauacuacuguguug

SEQ ID NO: 724646 - RNA, 19 nt, Homo sapiens
ucccuuauguaguugaaau

SEQ ID NO: 724647 - RNA, 19 nt, Homo sapiens
gcuaaacuggaagauuaaa

SEQ ID NO: 724648 - RNA, 19 nt, Homo sapiens
gcgcuuugcacgccaggaa

SEQ ID NO: 724649 - RNA, 19 nt, Homo sapiens
gcugcaggccaccagauga

SEQ ID NO: 724650 - RNA, 19 nt, Homo sapiens
agauacuacuguguugaaa

SEQ ID NO: 724651 - RNA, 19 nt, Homo sapiens
aaagggaacggcuccgaau

SEQ ID NO: 724652 - RNA, 19 nt, Homo sapiens
acugccaucucgcuucauu

SEQ ID NO: 724653 - RNA, 19 nt, Homo sapiens
ggacuucgugugcaaacag

SEQ ID NO: 724654 - RNA, 19 nt, Homo sapiens
acgaggaaguucuuauguc

SEQ ID NO: 724655 - RNA, 19 nt, Homo sapiens
aagauacuacuguguugaa

SEQ ID NO: 724656 - RNA, 19 nt, Homo sapiens
aaacggaaggacuggaaau

SEQ ID NO: 724657 - RNA, 19 nt, Homo sapiens
cauucagauuuacgaguga

SEQ ID NO: 724658 - RNA, 19 nt, Homo sapiens
uuggcaaacugcuuaaucu

SEQ ID NO: 724659 - RNA, 19 nt, Homo sapiens
gacacaguaucucacuuuu

SEQ ID NO: 724660 - RNA, 19 nt, Homo sapiens
ggugauagaaauggguuug

SEQ ID NO: 724661 - RNA, 19 nt, Homo sapiens
gcggccagguuuaacaacu

SEQ ID NO: 724662 - RNA, 19 nt, Homo sapiens
ucuuauguccuuggugaua

SEQ ID NO: 724663 - RNA, 19 nt, Homo sapiens
auacuacuguguugaaagc

SEQ ID NO: 724664 - RNA, 19 nt, Homo sapiens
gauacuacuguguugaaag

SEQ ID NO: 724665 - RNA, 19 nt, Homo sapiens
guggcaaacauuucacaga

SEQ ID NO: 724666 - RNA, 19 nt, Homo sapiens
accaguauuucaaccauca

SEQ ID NO: 724667 - RNA, 19 nt, Homo sapiens
gauauuaaucuuggcaaac

SEQ ID NO: 724668 - RNA, 19 nt, Homo sapiens
ucauagacacugauuucau

SEQ ID NO: 724669 - RNA, 19 nt, Homo sapiens
ccaaagaaauguccaauag

SEQ ID NO: 724670 - RNA, 19 nt, Homo sapiens
ccucaaagcucgucugauu

SEQ ID NO: 724671 - RNA, 19 nt, Homo sapiens
aaacuugccuagacaauaa

SEQ ID NO: 724672 - RNA, 19 nt, Homo sapiens
gaaaagacauccugaaaga

SEQ ID NO: 724673 - RNA, 19 nt, Homo sapiens
ggacagagcagcaugauuc

SEQ ID NO: 724674 - RNA, 19 nt, Homo sapiens
ggcauuauguggauguuua

SEQ ID NO: 724675 - RNA, 19 nt, Homo sapiens
ccaacaaugugaucacuuu

SEQ ID NO: 724676 - RNA, 19 nt, Homo sapiens
ggucagauaugcaagaaug

SEQ ID NO: 724677 - RNA, 19 nt, Homo sapiens
agagagcgcuggucuauug

SEQ ID NO: 724678 - RNA, 19 nt, Homo sapiens
gagcaaaggaucacauauu

SEQ ID NO: 724679 - RNA, 19 nt, Homo sapiens
ccacagcccugaagagaga

SEQ ID NO: 724680 - RNA, 19 nt, Homo sapiens
gaagucuggugaauaaaug

SEQ ID NO: 724681 - RNA, 19 nt, Homo sapiens
gaagagagaaucaucuaug

SEQ ID NO: 724682 - RNA, 19 nt, Homo sapiens
gaaacuugccuagacaaua

SEQ ID NO: 724683 - RNA, 19 nt, Homo sapiens
gauccaaaguucauuagug

SEQ ID NO: 724684 - RNA, 19 nt, Homo sapiens
guuauaaccuuugcaagaa

SEQ ID NO: 724685 - RNA, 19 nt, Homo sapiens
gaucagccguguguaugua

SEQ ID NO: 724686 - RNA, 19 nt, Homo sapiens
ucaagguacuuaaggcaua

SEQ ID NO: 724687 - RNA, 19 nt, Homo sapiens
gcaccuacauugaaauugg

SEQ ID NO: 724688 - RNA, 19 nt, Homo sapiens
uggaagcacuuacaagaaa

SEQ ID NO: 724689 - RNA, 19 nt, Homo sapiens
gaaagcgugugcugagugu

SEQ ID NO: 724690 - RNA, 19 nt, Homo sapiens
gaagucauccagccaugua

SEQ ID NO: 724691 - RNA, 19 nt, Homo sapiens
acaaagaaauguuggaauc

SEQ ID NO: 724692 - RNA, 19 nt, Homo sapiens
cagcugaguuccaccaauu

SEQ ID NO: 724693 - RNA, 19 nt, Homo sapiens
cuagaaaccucaaacaagu

SEQ ID NO: 724694 - RNA, 19 nt, Homo sapiens
aaagaaauguccaauagca

SEQ ID NO: 724695 - RNA, 19 nt, Homo sapiens
gaagauggacaguaugaug

SEQ ID NO: 724696 - RNA, 19 nt, Homo sapiens
uaugaacaaucgcccaaua

SEQ ID NO: 724697 - RNA, 19 nt, Homo sapiens
gcucaaugauccaaaguuc

SEQ ID NO: 724698 - RNA, 19 nt, Homo sapiens
uaacuaggauugucugucu

SEQ ID NO: 724699 - RNA, 19 nt, Homo sapiens
ggaaccgacugcuauuuca

SEQ ID NO: 724700 - RNA, 19 nt, Homo sapiens
agcaaaggaucacauauuu

SEQ ID NO: 724701 - RNA, 19 nt, Homo sapiens
gccaacagcuccaguuauc

SEQ ID NO: 724702 - RNA, 19 nt, Homo sapiens
gcacaagacgacaagauau

SEQ ID NO: 724703 - RNA, 19 nt, Homo sapiens
gcaaagagacgcacaagac

SEQ ID NO: 724704 - RNA, 19 nt, Homo sapiens
gauggacaguaugauguua

SEQ ID NO: 724705 - RNA, 19 nt, Homo sapiens
ggaccuuccugaugauguu

SEQ ID NO: 724706 - RNA, 19 nt, Homo sapiens
gugaauaaauggacaacau

SEQ ID NO: 724707 - RNA, 19 nt, Homo sapiens
uaacaaauggaagcacuua

SEQ ID NO: 724708 - RNA, 19 nt, Homo sapiens
acacagagcauuuggaaga

SEQ ID NO: 724709 - RNA, 19 nt, Homo sapiens
gcagagagcgcuggucuau

SEQ ID NO: 724710 - RNA, 19 nt, Homo sapiens
cagcaacaacuauauauug

SEQ ID NO: 724711 - RNA, 19 nt, Homo sapiens
cauguacaauccaguguuu

SEQ ID NO: 724712 - RNA, 19 nt, Homo sapiens
guagaaacuugccuagaca

SEQ ID NO: 724713 - RNA, 19 nt, Homo sapiens
gaacaaucgcccaauagug

SEQ ID NO: 724714 - RNA, 19 nt, Homo sapiens
ggagaauuauacucuggaa

SEQ ID NO: 724715 - RNA, 19 nt, Homo sapiens
gcucuaagaccaaagaaau

SEQ ID NO: 724716 - RNA, 19 nt, Homo sapiens
cauacaaacucuucuuaag

SEQ ID NO: 724717 - RNA, 19 nt, Homo sapiens
ugaguaacuuuccuaauag

SEQ ID NO: 724718 - RNA, 19 nt, Homo sapiens
caggaggacccacgaauuu

SEQ ID NO: 724719 - RNA, 19 nt, Homo sapiens
gaaauguccaauagcauga

SEQ ID NO: 724720 - RNA, 19 nt, Homo sapiens
cauucgaccugguuaauau

SEQ ID NO: 724721 - RNA, 19 nt, Homo sapiens
uaaagaugaugauggagau

SEQ ID NO: 724722 - RNA, 19 nt, Homo sapiens
ggacaacauuccucaaagc

SEQ ID NO: 724723 - RNA, 19 nt, Homo sapiens
guucagacuuacaccauga

SEQ ID NO: 724724 - RNA, 19 nt, Homo sapiens
gaauaggucagauaugcaa

SEQ ID NO: 724725 - RNA, 19 nt, Homo sapiens
ugaguuccaccaauuauaa

SEQ ID NO: 724726 - RNA, 19 nt, Homo sapiens
gagaaucaucuauggugua

SEQ ID NO: 724727 - RNA, 19 nt, Homo sapiens
gacaagauauaagaaaugg

SEQ ID NO: 724728 - RNA, 19 nt, Homo sapiens
ggagacuugguaugauuua

SEQ ID NO: 724729 - RNA, 19 nt, Homo sapiens
uagcaugagugaugugaga

SEQ ID NO: 724730 - RNA, 19 nt, Homo sapiens
guacuuaaggcauauaauc

SEQ ID NO: 724731 - RNA, 19 nt, Homo sapiens
gaacggaguaggcuguaug

SEQ ID NO: 724732 - RNA, 19 nt, Homo sapiens
ggaggacccacgaauuuga

SEQ ID NO: 724733 - RNA, 19 nt, Homo sapiens
gaaaagggaccgaaaacaa

SEQ ID NO: 724734 - RNA, 19 nt, Homo sapiens
cagaguggaugaucauauc

SEQ ID NO: 724735 - RNA, 19 nt, Homo sapiens
gacucacuguucagacuua

SEQ ID NO: 724736 - RNA, 19 nt, Homo sapiens
gcagcaacaacuauauauu

SEQ ID NO: 724737 - RNA, 19 nt, Homo sapiens
gacuugguaugauuuagaa

SEQ ID NO: 724738 - RNA, 19 nt, Homo sapiens
cacaagacgacaagauaua

SEQ ID NO: 724739 - RNA, 19 nt, Homo sapiens
cuaaggagacuugguauga

SEQ ID NO: 724740 - RNA, 19 nt, Homo sapiens
uagaauaggucagauaugc

SEQ ID NO: 724741 - RNA, 19 nt, Homo sapiens
aaagacauccugaaagaau

SEQ ID NO: 724742 - RNA, 19 nt, Homo sapiens
uacaaacucuucuuaaggu

SEQ ID NO: 724743 - RNA, 19 nt, Homo sapiens
gggauggacccaacuauca

SEQ ID NO: 724744 - RNA, 19 nt, Homo sapiens
aaggagacuugguaugauu

SEQ ID NO: 724745 - RNA, 19 nt, Homo sapiens
ggaccguucuuaaaguagu

SEQ ID NO: 724746 - RNA, 19 nt, Homo sapiens
ugcagaagauggacaguau

SEQ ID NO: 724747 - RNA, 19 nt, Homo sapiens
gauaugcaagaaugacuuu

SEQ ID NO: 724748 - RNA, 19 nt, Homo sapiens
agcaugggcugguuaacua

SEQ ID NO: 724749 - RNA, 19 nt, Homo sapiens
acagaaggauucaggcaau

SEQ ID NO: 724750 - RNA, 19 nt, Homo sapiens
gcuagaauaggucagauau

SEQ ID NO: 724751 - RNA, 19 nt, Homo sapiens
uccugaagaugacaaagua

SEQ ID NO: 724752 - RNA, 19 nt, Homo sapiens
gugacaauccugaagauga

SEQ ID NO: 724753 - RNA, 19 nt, Homo sapiens
gaauuauacucuggaacug

SEQ ID NO: 724754 - RNA, 19 nt, Homo sapiens
gaaugcaagugggcuggaa

SEQ ID NO: 724755 - RNA, 19 nt, Homo sapiens
ugccaaggcugaaauuauc

SEQ ID NO: 724756 - RNA, 19 nt, Homo sapiens
gauguugggaccguucuua

SEQ ID NO: 724757 - RNA, 19 nt, Homo sapiens
cagaagauggacaguauga

SEQ ID NO: 724758 - RNA, 19 nt, Homo sapiens
gaucaaaacggauguaaau

SEQ ID NO: 724759 - RNA, 19 nt, Homo sapiens
gcgagacuuugcuaucuuc

SEQ ID NO: 724760 - RNA, 19 nt, Homo sapiens
caaauggaagcacuuacaa

SEQ ID NO: 724761 - RNA, 19 nt, Homo sapiens
cggcaaaggccaggacaua

SEQ ID NO: 724762 - RNA, 19 nt, Homo sapiens
ugacacagagcauuuggaa

SEQ ID NO: 724763 - RNA, 19 nt, Homo sapiens
caaacucuucuuaagguaa

SEQ ID NO: 724764 - RNA, 19 nt, Homo sapiens
agagaauaguagcacauuu

SEQ ID NO: 724765 - RNA, 19 nt, Homo sapiens
caagagcaaacuaucagaa

SEQ ID NO: 724766 - RNA, 19 nt, Homo sapiens
cuaagcagcaacaacuaua

SEQ ID NO: 724767 - RNA, 19 nt, Homo sapiens
aacaaucgcccaauaguga

SEQ ID NO: 724768 - RNA, 19 nt, Homo sapiens
aauccaguguuuccuauga

SEQ ID NO: 724769 - RNA, 19 nt, Homo sapiens
ugacagauguuaaagcuuu

SEQ ID NO: 724770 - RNA, 19 nt, Homo sapiens
uguuaaagcuuucugguua

SEQ ID NO: 724771 - RNA, 19 nt, Homo sapiens
ggagaggaauacuaauuau

SEQ ID NO: 724772 - RNA, 19 nt, Homo sapiens
cagcuuaacugacagaugu

SEQ ID NO: 724773 - RNA, 19 nt, Homo sapiens
caaggaagaugcugccaau

SEQ ID NO: 724774 - RNA, 19 nt, Homo sapiens
aaccuuaaccgccuuauua

SEQ ID NO: 724775 - RNA, 19 nt, Homo sapiens
gaacgccugucaguugauu

SEQ ID NO: 724776 - RNA, 19 nt, Homo sapiens
ggaagaugcugccaauaac

SEQ ID NO: 724777 - RNA, 19 nt, Homo sapiens
acaaugaggccaucuauga

SEQ ID NO: 724778 - RNA, 19 nt, Homo sapiens
caaccuacacuaaccuuaa

SEQ ID NO: 724779 - RNA, 19 nt, Homo sapiens
ccacaaguuugaccugaug

SEQ ID NO: 724780 - RNA, 19 nt, Homo sapiens
ugacagaauuccagaccaa

SEQ ID NO: 724781 - RNA, 19 nt, Homo sapiens
caucaccaaugcuugcuuu

SEQ ID NO: 724782 - RNA, 19 nt, Homo sapiens
caucacugcuucccugaga

SEQ ID NO: 724783 - RNA, 19 nt, Homo sapiens
cgagggcacuacaccauug

SEQ ID NO: 724784 - RNA, 19 nt, Homo sapiens
gauggagcccugaauguug

SEQ ID NO: 724785 - RNA, 19 nt, Homo sapiens
gaaggauuaugaggagguu

SEQ ID NO: 724786 - RNA, 19 nt, Homo sapiens
ggccaucuaugacaucugu

SEQ ID NO: 724787 - RNA, 19 nt, Homo sapiens
uccaucauaucucaaagua

SEQ ID NO: 724788 - RNA, 19 nt, Homo sapiens
aaagcuuucugguuagauu

SEQ ID NO: 724789 - RNA, 19 nt, Homo sapiens
gcagacaucaccaaugcuu

SEQ ID NO: 724790 - RNA, 19 nt, Homo sapiens
uagcagacaucaccaaugc

SEQ ID NO: 724791 - RNA, 19 nt, Homo sapiens
aggaagaugcugccaauaa

SEQ ID NO: 724792 - RNA, 19 nt, Homo sapiens
aggagaggaauacuaauua

SEQ ID NO: 724793 - RNA, 19 nt, Homo sapiens
ugacgugguucccaaagau

SEQ ID NO: 724794 - RNA, 19 nt, Homo sapiens
cagauuguguccuccauca

SEQ ID NO: 724795 - RNA, 19 nt, Homo sapiens
gauggaggaaggcgaguuu

SEQ ID NO: 724796 - RNA, 19 nt, Homo sapiens
gaacccacagucauugaug

SEQ ID NO: 724797 - RNA, 19 nt, Homo sapiens
ucaacaccuucuucaguga

SEQ ID NO: 724798 - RNA, 19 nt, Homo sapiens
ugaaggagagggugaggaa

SEQ ID NO: 724799 - RNA, 19 nt, Homo sapiens
uggaacgccugucaguuga

SEQ ID NO: 724800 - RNA, 19 nt, Homo sapiens
guuaaagcuuucugguuag

SEQ ID NO: 724801 - RNA, 19 nt, Homo sapiens
gaggaauacuaauuaucca

SEQ ID NO: 724802 - RNA, 19 nt, Homo sapiens
ccaagugacaagaccauug

SEQ ID NO: 724803 - RNA, 19 nt, Homo sapiens
gagaggaauacuaauuauc

SEQ ID NO: 724804 - RNA, 19 nt, Homo sapiens
aaggagaggaauacuaauu

SEQ ID NO: 724805 - RNA, 19 nt, Homo sapiens
caccaaugcuugcuuugag

SEQ ID NO: 724806 - RNA, 19 nt, Homo sapiens
cugaaucccuagccauaug

SEQ ID NO: 724807 - RNA, 19 nt, Homo sapiens
gcucauggaacgccuguca

SEQ ID NO: 724808 - RNA, 19 nt, Homo sapiens
ugauugugccuucauggua

SEQ ID NO: 724809 - RNA, 19 nt, Homo sapiens
gggcuguguuuguagacuu

SEQ ID NO: 724810 - RNA, 19 nt, Homo sapiens
ugucaugcucccagaauuu

SEQ ID NO: 724811 - RNA, 19 nt, Homo sapiens
agauauggcugcccuugag

SEQ ID NO: 724812 - RNA, 19 nt, Homo sapiens
gugacgugguucccaaaga

SEQ ID NO: 724813 - RNA, 19 nt, Homo sapiens
gaagaugcugccaauaacu

SEQ ID NO: 724814 - RNA, 19 nt, Homo sapiens
cauguguaccuguaauauu

SEQ ID NO: 724815 - RNA, 19 nt, Homo sapiens
uuaaagcuuucugguuaga

SEQ ID NO: 724816 - RNA, 19 nt, Homo sapiens
gugccuuuguucacuggua

SEQ ID NO: 724817 - RNA, 19 nt, Homo sapiens
cugcuucccugagauuuga

SEQ ID NO: 724818 - RNA, 19 nt, Homo sapiens
cuuauuagccagauugugu

SEQ ID NO: 724819 - RNA, 19 nt, Homo sapiens
ggagguugguguggauucu

SEQ ID NO: 724820 - RNA, 19 nt, Homo sapiens
aagaugcugccaauaacua

SEQ ID NO: 724821 - RNA, 19 nt, Homo sapiens
ggagcucuacugccuggaa

SEQ ID NO: 724822 - RNA, 19 nt, Homo sapiens
caaguuugaccugauguau

SEQ ID NO: 724823 - RNA, 19 nt, Homo sapiens
gugcaucuccauccacguu

SEQ ID NO: 724824 - RNA, 19 nt, Homo sapiens
auguugaccugacagaauu

SEQ ID NO: 724825 - RNA, 19 nt, Homo sapiens
gaauguugaccugacagaa

SEQ ID NO: 724826 - RNA, 19 nt, Homo sapiens
gacagauguuaaagcuuuc

SEQ ID NO: 724827 - RNA, 19 nt, Homo sapiens
ugaggagguugguguggau

SEQ ID NO: 724828 - RNA, 19 nt, Homo sapiens
ggccagaugccaagugaca

SEQ ID NO: 724829 - RNA, 19 nt, Homo sapiens
ccaaccuacacuaaccuua

SEQ ID NO: 724830 - RNA, 19 nt, Homo sapiens
caagugacaagaccauugg

SEQ ID NO: 724831 - RNA, 19 nt, Homo sapiens
ugauggagcccugaauguu

SEQ ID NO: 724832 - RNA, 19 nt, Homo sapiens
ucacugcuucccugagauu

SEQ ID NO: 724833 - RNA, 19 nt, Homo sapiens
uaaccuuaaccgccuuauu

SEQ ID NO: 724834 - RNA, 19 nt, Homo sapiens
agacaaugaggccaucuau

SEQ ID NO: 724835 - RNA, 19 nt, Homo sapiens
uguggauucuguugaagga

SEQ ID NO: 724836 - RNA, 19 nt, Homo sapiens
ucaccaaugcuugcuuuga

SEQ ID NO: 724837 - RNA, 19 nt, Homo sapiens
auggagcccugaauguuga

SEQ ID NO: 724838 - RNA, 19 nt, Homo sapiens
ugucguagaaaccucgaua

SEQ ID NO: 724839 - RNA, 19 nt, Homo sapiens
ucccagaauuucagcuuca

SEQ ID NO: 724840 - RNA, 19 nt, Homo sapiens
ugguguggauucuguugaa

SEQ ID NO: 724841 - RNA, 19 nt, Homo sapiens
ucccaaagaugucaaugcu

SEQ ID NO: 724842 - RNA, 19 nt, Homo sapiens
guagcagacaucaccaaug

SEQ ID NO: 724843 - RNA, 19 nt, Homo sapiens
gacaaugaggccaucuaug

SEQ ID NO: 724844 - RNA, 19 nt, Homo sapiens
acuuggugaucaugucuuu

SEQ ID NO: 724845 - RNA, 19 nt, Homo sapiens
ggaacccacagucauugau

SEQ ID NO: 724846 - RNA, 19 nt, Homo sapiens
gauauggcugcccuugaga

SEQ ID NO: 724847 - RNA, 19 nt, Homo sapiens
ggcuguguuuguagacuug

SEQ ID NO: 724848 - RNA, 19 nt, Homo sapiens
gccuggaccacaaguuuga

SEQ ID NO: 724849 - RNA, 19 nt, Homo sapiens
gccugucaguugauuaugg

SEQ ID NO: 724850 - RNA, 19 nt, Homo sapiens
acugacagauguuaaagcu

SEQ ID NO: 724851 - RNA, 19 nt, Homo sapiens
aguuugaccugauguaugc

SEQ ID NO: 724852 - RNA, 19 nt, Homo sapiens
ucgccuggaccacaaguuu

SEQ ID NO: 724853 - RNA, 19 nt, Homo sapiens
gagcgcccaaccuacacua

SEQ ID NO: 724854 - RNA, 19 nt, Homo sapiens
uuccacagcuguaguugag

SEQ ID NO: 724855 - RNA, 19 nt, Homo sapiens
ccauguguaccuguaauau

SEQ ID NO: 724856 - RNA, 19 nt, Homo sapiens
cuucaacaccuucuucagu

SEQ ID NO: 724857 - RNA, 19 nt, Homo sapiens
caacaagaguucugaauuu

SEQ ID NO: 724858 - RNA, 19 nt, Homo sapiens
gcagagacuuggucaggua

SEQ ID NO: 724859 - RNA, 19 nt, Homo sapiens
cgauugaccuguccucuuu

SEQ ID NO: 724860 - RNA, 19 nt, Homo sapiens
guggagaacucaaggcuaa

SEQ ID NO: 724861 - RNA, 19 nt, Homo sapiens
ggagugugcugggaugaua

SEQ ID NO: 724862 - RNA, 19 nt, Homo sapiens
ccaccgaaguuccagguaa

SEQ ID NO: 724863 - RNA, 19 nt, Homo sapiens
caagaguucugaauuuaag

SEQ ID NO: 724864 - RNA, 19 nt, Homo sapiens
guaagggacuaggaaauuc

SEQ ID NO: 724865 - RNA, 19 nt, Homo sapiens
ugagauauacgcccucuuu

SEQ ID NO: 724866 - RNA, 19 nt, Homo sapiens
gccagggacucagaaagua

SEQ ID NO: 724867 - RNA, 19 nt, Homo sapiens
gccaagcacuuuauauuuu

SEQ ID NO: 724868 - RNA, 19 nt, Homo sapiens
cacagaaucuuaucacagu

SEQ ID NO: 724869 - RNA, 19 nt, Homo sapiens
gaagauggagcaggccuuu

SEQ ID NO: 724870 - RNA, 19 nt, Homo sapiens
cuccaggacucccucaaua

SEQ ID NO: 724871 - RNA, 19 nt, Homo sapiens
ccaggaugcugccuucuuc

SEQ ID NO: 724872 - RNA, 19 nt, Homo sapiens
gauauacgcccucuuucau

SEQ ID NO: 724873 - RNA, 19 nt, Homo sapiens
gggcaauauuuaagggaaa

SEQ ID NO: 724874 - RNA, 19 nt, Homo sapiens
ucaacaagaguucugaauu

SEQ ID NO: 724875 - RNA, 19 nt, Homo sapiens
ggagaacucaaggcuaauu

SEQ ID NO: 724876 - RNA, 19 nt, Homo sapiens
gagaacucaaggcuaauuu

SEQ ID NO: 724877 - RNA, 19 nt, Homo sapiens
aggacucccucaauaauga

SEQ ID NO: 724878 - RNA, 19 nt, Homo sapiens
gcugugcacucaacaagag

SEQ ID NO: 724879 - RNA, 19 nt, Homo sapiens
gcguggagcucuucagaac

SEQ ID NO: 724880 - RNA, 19 nt, Homo sapiens
gaaauuccaaaugguguga

SEQ ID NO: 724881 - RNA, 19 nt, Homo sapiens
cacacuggcugguggagaa

SEQ ID NO: 724882 - RNA, 19 nt, Homo sapiens
ugauaaucguguccugaaa

SEQ ID NO: 724883 - RNA, 19 nt, Homo sapiens
ugauaauucucaguaguug

SEQ ID NO: 724884 - RNA, 19 nt, Homo sapiens
aagccaagcacuuuauauu

SEQ ID NO: 724885 - RNA, 19 nt, Homo sapiens
gugauaauucucaguaguu

SEQ ID NO: 724886 - RNA, 19 nt, Homo sapiens
ugaccuguccucuuuguga

SEQ ID NO: 724887 - RNA, 19 nt, Homo sapiens
caaggccugggcaauauuu

SEQ ID NO: 724888 - RNA, 19 nt, Homo sapiens
cauacuccacagaaucuua

SEQ ID NO: 724889 - RNA, 19 nt, Homo sapiens
gcaguccauucagacauug

SEQ ID NO: 724890 - RNA, 19 nt, Homo sapiens
ucaaagcgacagcacaguu

SEQ ID NO: 724891 - RNA, 19 nt, Homo sapiens
cuucaaggccugggcaaua

SEQ ID NO: 724892 - RNA, 19 nt, Homo sapiens
ccaccucaccucuuuguuc

SEQ ID NO: 724893 - RNA, 19 nt, Homo sapiens
ccaggacucccucaauaau

SEQ ID NO: 724894 - RNA, 19 nt, Homo sapiens
ccuguccucuuugugauaa

SEQ ID NO: 724895 - RNA, 19 nt, Homo sapiens
cuucagaaccgccuacuuc

SEQ ID NO: 724896 - RNA, 19 nt, Homo sapiens
caaagcgacagcacaguuc

SEQ ID NO: 724897 - RNA, 19 nt, Homo sapiens
uguaagggacuaggaaauu

SEQ ID NO: 724898 - RNA, 19 nt, Homo sapiens
gugauaaucguguccugaa

SEQ ID NO: 724899 - RNA, 19 nt, Homo sapiens
gaccuguccucuuugugau

SEQ ID NO: 724900 - RNA, 19 nt, Homo sapiens
ccucaccucuuuguucuuc

SEQ ID NO: 724901 - RNA, 19 nt, Homo sapiens
ggccuuugcccgauacuug

SEQ ID NO: 724902 - RNA, 19 nt, Homo sapiens
gagacuuggucagguacuu

SEQ ID NO: 724903 - RNA, 19 nt, Homo sapiens
agccaagcacuuuauauuu

SEQ ID NO: 724904 - RNA, 19 nt, Homo sapiens
guaguuguccgugauaauc

SEQ ID NO: 724905 - RNA, 19 nt, Homo sapiens
ccuuugaaguagacucauu

SEQ ID NO: 724906 - RNA, 19 nt, Homo sapiens
ccugaccucccaacucuaa

SEQ ID NO: 724907 - RNA, 19 nt, Homo sapiens
uauacgcccucuuucaucu

SEQ ID NO: 724908 - RNA, 19 nt, Homo sapiens
cagccauacuccacagaau

SEQ ID NO: 724909 - RNA, 19 nt, Homo sapiens
acaggaaguuacagacaca

SEQ ID NO: 724910 - RNA, 19 nt, Homo sapiens
gaggaaggaggaagaggau

SEQ ID NO: 724911 - RNA, 19 nt, Homo sapiens
cucagaaaguaccaucaaa

SEQ ID NO: 724912 - RNA, 19 nt, Homo sapiens
ccagguaacacugaauuuc

SEQ ID NO: 724913 - RNA, 19 nt, Homo sapiens
ccacaggaaguuacagaca

SEQ ID NO: 724914 - RNA, 19 nt, Homo sapiens
caccucaccucuuuguucu

SEQ ID NO: 724915 - RNA, 19 nt, Homo sapiens
caguaguuguccgugauaa

SEQ ID NO: 724916 - RNA, 19 nt, Homo sapiens
ucuuccaccucaccucuuu

SEQ ID NO: 724917 - RNA, 19 nt, Homo sapiens
ucagaaaguaccaucaaag

SEQ ID NO: 724918 - RNA, 19 nt, Homo sapiens
gaacugggugguggagcaa

SEQ ID NO: 724919 - RNA, 19 nt, Homo sapiens
gagauauacgcccucuuuc

SEQ ID NO: 724920 - RNA, 19 nt, Homo sapiens
agauauacgcccucuuuca

SEQ ID NO: 724921 - RNA, 19 nt, Homo sapiens
gauaaucguguccugaaaa

SEQ ID NO: 724922 - RNA, 19 nt, Homo sapiens
ucaguaguuguccgugaua

SEQ ID NO: 724923 - RNA, 19 nt, Homo sapiens
gcaggccuuugcccgauac

SEQ ID NO: 724924 - RNA, 19 nt, Homo sapiens
ggaaacaugcaggcaagca

SEQ ID NO: 724925 - RNA, 19 nt, Homo sapiens
aagaggaugccaugcagaa

SEQ ID NO: 724926 - RNA, 19 nt, Homo sapiens
ucccugaccucccaacucu

SEQ ID NO: 724927 - RNA, 19 nt, Homo sapiens
ugugauaauucucaguagu

SEQ ID NO: 724928 - RNA, 19 nt, Homo sapiens
uucaaggccugggcaauau

SEQ ID NO: 724929 - RNA, 19 nt, Homo sapiens
cugaauuucugggaagaga

SEQ ID NO: 724930 - RNA, 19 nt, Homo sapiens
ggcaauauuuaagggaaag

SEQ ID NO: 724931 - RNA, 19 nt, Homo sapiens
agcaguccauucagacauu

SEQ ID NO: 724932 - RNA, 19 nt, Homo sapiens
ggagcaguccauucagaca

SEQ ID NO: 724933 - RNA, 19 nt, Homo sapiens
aagaccauguuccggauuc

SEQ ID NO: 724934 - RNA, 19 nt, Homo sapiens
cgcccucuuucaucuguaa

SEQ ID NO: 724935 - RNA, 19 nt, Homo sapiens
cuacuucugcagagacuug

SEQ ID NO: 724936 - RNA, 19 nt, Homo sapiens
cugcucaccuucaucuaca

SEQ ID NO: 724937 - RNA, 19 nt, Homo sapiens
gagcaguccauucagacau

SEQ ID NO: 724938 - RNA, 19 nt, Homo sapiens
uccaggacucccucaauaa

SEQ ID NO: 724939 - RNA, 19 nt, Homo sapiens
gcuccaggacucccucaau

SEQ ID NO: 724940 - RNA, 19 nt, Homo sapiens
gcagcaggcagccauucug

SEQ ID NO: 724941 - RNA, 19 nt, Homo sapiens
cagguaacacugaauuucu

SEQ ID NO: 724942 - RNA, 19 nt, Homo sapiens
caggacucccucaauaaug

SEQ ID NO: 724943 - RNA, 19 nt, Homo sapiens
gaggaugccaugcagaacu

SEQ ID NO: 724944 - RNA, 19 nt, Homo sapiens
acucacugcugcucaccuu

SEQ ID NO: 724945 - RNA, 19 nt, Homo sapiens
gcacacucagucccucugu

SEQ ID NO: 724946 - RNA, 19 nt, Homo sapiens
cagaaaguaccaucaaagc

SEQ ID NO: 724947 - RNA, 19 nt, Homo sapiens
uuaagggaaaguauaagga

SEQ ID NO: 724948 - RNA, 19 nt, Homo sapiens
gaccaaagcugaccgauug

SEQ ID NO: 724949 - RNA, 19 nt, Homo sapiens
gagcauauguucuucauug

SEQ ID NO: 724950 - RNA, 19 nt, Homo sapiens
caauugaguuggagacuua

SEQ ID NO: 724951 - RNA, 19 nt, Homo sapiens
caacagaccugcagaccaa

SEQ ID NO: 724952 - RNA, 19 nt, Homo sapiens
guacagugcuauuaaagaa

SEQ ID NO: 724953 - RNA, 19 nt, Homo sapiens
gcaguacagugcuauuaaa

SEQ ID NO: 724954 - RNA, 19 nt, Homo sapiens
gaauuagaguuccaccuuu

SEQ ID NO: 724955 - RNA, 19 nt, Homo sapiens
ggaggcaaguuaaccgaua

SEQ ID NO: 724956 - RNA, 19 nt, Homo sapiens
agacuugguucucaaauaa

SEQ ID NO: 724957 - RNA, 19 nt, Homo sapiens
ggaaacacauuaucacaac

SEQ ID NO: 724958 - RNA, 19 nt, Homo sapiens
gcacagaugagcauauguu

SEQ ID NO: 724959 - RNA, 19 nt, Homo sapiens
guuaagcccugucucagaa

SEQ ID NO: 724960 - RNA, 19 nt, Homo sapiens
acaaggaugugaagcauau

SEQ ID NO: 724961 - RNA, 19 nt, Homo sapiens
aagaggaucugccuucuga

SEQ ID NO: 724962 - RNA, 19 nt, Homo sapiens
gaggaauuaugacuacuau

SEQ ID NO: 724963 - RNA, 19 nt, Homo sapiens
aauuagaguuccaccuuua

SEQ ID NO: 724964 - RNA, 19 nt, Homo sapiens
aaaaugcacuuguuccuua

SEQ ID NO: 724965 - RNA, 19 nt, Homo sapiens
gaaggagaccuggguauug

SEQ ID NO: 724966 - RNA, 19 nt, Homo sapiens
gcuuaaaccagauuucuuu

SEQ ID NO: 724967 - RNA, 19 nt, Homo sapiens
ggaauguucuucaguacca

SEQ ID NO: 724968 - RNA, 19 nt, Homo sapiens
gggaagaaauacugaagca

SEQ ID NO: 724969 - RNA, 19 nt, Homo sapiens
ggagacuuauaaacucauu

SEQ ID NO: 724970 - RNA, 19 nt, Homo sapiens
ggagcaggaaauaagauua

SEQ ID NO: 724971 - RNA, 19 nt, Homo sapiens
uggaauugcuuaugaagga

SEQ ID NO: 724972 - RNA, 19 nt, Homo sapiens
aagacuugguucucaaaua

SEQ ID NO: 724973 - RNA, 19 nt, Homo sapiens
ggaucugccuucugaggaa

SEQ ID NO: 724974 - RNA, 19 nt, Homo sapiens
ggagaagaccugugcaaca

SEQ ID NO: 724975 - RNA, 19 nt, Homo sapiens
gaaaagacuugguucucaa

SEQ ID NO: 724976 - RNA, 19 nt, Homo sapiens
ggaguuaagcccugucuca

SEQ ID NO: 724977 - RNA, 19 nt, Homo sapiens
gacaauguaacaguucuua

SEQ ID NO: 724978 - RNA, 19 nt, Homo sapiens
uuacucaaccugacaauug

SEQ ID NO: 724979 - RNA, 19 nt, Homo sapiens
ggaauuaugacuacuaugc

SEQ ID NO: 724980 - RNA, 19 nt, Homo sapiens
gaggcaaguuaaccgauau

SEQ ID NO: 724981 - RNA, 19 nt, Homo sapiens
caacguuguuccagagugu

SEQ ID NO: 724982 - RNA, 19 nt, Homo sapiens
caaggaauauaccgaaggu

SEQ ID NO: 724983 - RNA, 19 nt, Homo sapiens
ggaaaagacuugguucuca

SEQ ID NO: 724984 - RNA, 19 nt, Homo sapiens
uggccacacugaggaauua

SEQ ID NO: 724985 - RNA, 19 nt, Homo sapiens
cacuugagcucaggaguuu

SEQ ID NO: 724986 - RNA, 19 nt, Homo sapiens
cgaguuccagaaucuauua

SEQ ID NO: 724987 - RNA, 19 nt, Homo sapiens
caaguuaaccgauauccau

SEQ ID NO: 724988 - RNA, 19 nt, Homo sapiens
ccagccauauuacaacuau

SEQ ID NO: 724989 - RNA, 19 nt, Homo sapiens
ccaccgcacuuggcuuaaa

SEQ ID NO: 724990 - RNA, 19 nt, Homo sapiens
caaguugguuacugacugu

SEQ ID NO: 724991 - RNA, 19 nt, Homo sapiens
cagaugagcauauguucuu

SEQ ID NO: 724992 - RNA, 19 nt, Homo sapiens
guugguagccuccgcauau

SEQ ID NO: 724993 - RNA, 19 nt, Homo sapiens
ggaauugcuuaugaaggaa

SEQ ID NO: 724994 - RNA, 19 nt, Homo sapiens
acagugcuauuaaagaaga

SEQ ID NO: 724995 - RNA, 19 nt, Homo sapiens
guaugauggugagaaguuu

SEQ ID NO: 724996 - RNA, 19 nt, Homo sapiens
cgaggcagguggaucacuu

SEQ ID NO: 724997 - RNA, 19 nt, Homo sapiens
gggaaacacauuaucacaa

SEQ ID NO: 724998 - RNA, 19 nt, Homo sapiens
gauggaaccaaggaauaua

SEQ ID NO: 724999 - RNA, 19 nt, Homo sapiens
gacagucagugggaagaaa

SEQ ID NO: 725000 - RNA, 19 nt, Homo sapiens
gauagucagacguguuauu

SEQ ID NO: 725001 - RNA, 19 nt, Homo sapiens
gcuuguagcauaggguuua

SEQ ID NO: 725002 - RNA, 19 nt, Homo sapiens
ggaggagcaggaaauaaga

SEQ ID NO: 725003 - RNA, 19 nt, Homo sapiens
guaggaggagcaggaaaua

SEQ ID NO: 725004 - RNA, 19 nt, Homo sapiens
ggauggaaccaaggaauau

SEQ ID NO: 725005 - RNA, 19 nt, Homo sapiens
caaagugcaugggaugaca

SEQ ID NO: 725006 - RNA, 19 nt, Homo sapiens
gcaaguccugguuguaaga

SEQ ID NO: 725007 - RNA, 19 nt, Homo sapiens
ucaaaaggcaggaaugaua

SEQ ID NO: 725008 - RNA, 19 nt, Homo sapiens
uguaacaguucuuauugga

SEQ ID NO: 725009 - RNA, 19 nt, Homo sapiens
guaccauggcuuccaguaa

SEQ ID NO: 725010 - RNA, 19 nt, Homo sapiens
cugaagggauugcuuguag

SEQ ID NO: 725011 - RNA, 19 nt, Homo sapiens
ccaccuuuaucauuguuga

SEQ ID NO: 725012 - RNA, 19 nt, Homo sapiens
uugagaggcugaagcagaa

SEQ ID NO: 725013 - RNA, 19 nt, Homo sapiens
caaauuaacugggcauccu

SEQ ID NO: 725014 - RNA, 19 nt, Homo sapiens
ccacacugaggaauuauga

SEQ ID NO: 725015 - RNA, 19 nt, Homo sapiens
aaaugcacuuguuccuuaa

SEQ ID NO: 725016 - RNA, 19 nt, Homo sapiens
ggauacuugugcuccagaa

SEQ ID NO: 725017 - RNA, 19 nt, Homo sapiens
gaaacacauuaucacaacu

SEQ ID NO: 725018 - RNA, 19 nt, Homo sapiens
ggaauauaccgaaggucuu

SEQ ID NO: 725019 - RNA, 19 nt, Homo sapiens
cacugaccauucacugaua

SEQ ID NO: 725020 - RNA, 19 nt, Homo sapiens
agccucugcuuauguauuu

SEQ ID NO: 725021 - RNA, 19 nt, Homo sapiens
cugaggaaguggaucaaga

SEQ ID NO: 725022 - RNA, 19 nt, Homo sapiens
guuggagacuuauaaacuc

SEQ ID NO: 725023 - RNA, 19 nt, Homo sapiens
gaguuccaccuuuaucauu

SEQ ID NO: 725024 - RNA, 19 nt, Homo sapiens
gaagaagugagaaaacauu

SEQ ID NO: 725025 - RNA, 19 nt, Homo sapiens
aaggagaccuggguauugu

SEQ ID NO: 725026 - RNA, 19 nt, Homo sapiens
gcaagccgaguuccagaau

SEQ ID NO: 725027 - RNA, 19 nt, Homo sapiens
caacuacucgaucccauag

SEQ ID NO: 725028 - RNA, 19 nt, Homo sapiens
gccauagcaggaguuauua

SEQ ID NO: 725029 - RNA, 19 nt, Homo sapiens
agaauuagaguuccaccuu

SEQ ID NO: 725030 - RNA, 19 nt, Homo sapiens
cgauauccaugggaauguu

SEQ ID NO: 725031 - RNA, 19 nt, Homo sapiens
ugaaggagaccuggguauu

SEQ ID NO: 725032 - RNA, 19 nt, Homo sapiens
gcugggaaacacauuauca

SEQ ID NO: 725033 - RNA, 19 nt, Homo sapiens
gaauugcuuaugaaggaaa

SEQ ID NO: 725034 - RNA, 19 nt, Homo sapiens
uaccauggcuuccaguaac

SEQ ID NO: 725035 - RNA, 19 nt, Homo sapiens
gaauuaugacuacuaugca

SEQ ID NO: 725036 - RNA, 19 nt, Homo sapiens
ugaggaauuaugacuacua

SEQ ID NO: 725037 - RNA, 19 nt, Homo sapiens
augggaauguucuucagua

SEQ ID NO: 725038 - RNA, 19 nt, Homo sapiens
gcugaccgauuggcacaga

SEQ ID NO: 725039 - RNA, 19 nt, Homo sapiens
gaucccauagcaacaaguu

SEQ ID NO: 725040 - RNA, 19 nt, Homo sapiens
agccauagcaggaguuauu

SEQ ID NO: 725041 - RNA, 19 nt, Homo sapiens
uggcacagaugagcauaug

SEQ ID NO: 725042 - RNA, 19 nt, Homo sapiens
uuuggaaucucacucuguu

SEQ ID NO: 725043 - RNA, 19 nt, Homo sapiens
ggcccacgcugguaauuuu

SEQ ID NO: 725044 - RNA, 19 nt, Homo sapiens
cauuaugguuaucaugugu

SEQ ID NO: 725045 - RNA, 19 nt, Homo sapiens
guaacaguucuuauuggaa

SEQ ID NO: 725046 - RNA, 19 nt, Homo sapiens
uggauggaaccaaggaaua

SEQ ID NO: 725047 - RNA, 19 nt, Homo sapiens
ccuguaaucccagcacuuu

SEQ ID NO: 725048 - RNA, 19 nt, Homo sapiens
gcucgcagcuggagugaga

SEQ ID NO: 725049 - RNA, 19 nt, Homo sapiens
guacgugccucgagccauu

SEQ ID NO: 725050 - RNA, 19 nt, Homo sapiens
gcaaggugcgugaggagua

SEQ ID NO: 725051 - RNA, 19 nt, Homo sapiens
ccaccuaggccacguguga

SEQ ID NO: 725052 - RNA, 19 nt, Homo sapiens
gccugacaauuucaucuuu

SEQ ID NO: 725053 - RNA, 19 nt, Homo sapiens
ggaucagcgucuacuacaa

SEQ ID NO: 725054 - RNA, 19 nt, Homo sapiens
caaggugcgugaggaguau

SEQ ID NO: 725055 - RNA, 19 nt, Homo sapiens
gcaguucacggccauguuc

SEQ ID NO: 725056 - RNA, 19 nt, Homo sapiens
caagcuggccgucaacaug

SEQ ID NO: 725057 - RNA, 19 nt, Homo sapiens
ucugggaagucaucaguga

SEQ ID NO: 725058 - RNA, 19 nt, Homo sapiens
gaagccagcagugucuaaa

SEQ ID NO: 725059 - RNA, 19 nt, Homo sapiens
gcaagaacagcagcuacuu

SEQ ID NO: 725060 - RNA, 19 nt, Homo sapiens
uaaaucuauugcugucaga

SEQ ID NO: 725061 - RNA, 19 nt, Homo sapiens
gcuccugucucugucuuau

SEQ ID NO: 725062 - RNA, 19 nt, Homo sapiens
caagaacagcagcuacuuc

SEQ ID NO: 725063 - RNA, 19 nt, Homo sapiens
ccugacaauuucaucuuug

SEQ ID NO: 725064 - RNA, 19 nt, Homo sapiens
gcgagggcauggacgagau

SEQ ID NO: 725065 - RNA, 19 nt, Homo sapiens
gagcucacccagcagaugu

SEQ ID NO: 725066 - RNA, 19 nt, Homo sapiens
uggauucgguccuggaugu

SEQ ID NO: 725067 - RNA, 19 nt, Homo sapiens
cgaggccucuucucacaag

SEQ ID NO: 725068 - RNA, 19 nt, Homo sapiens
gaucagcgucuacuacaac

SEQ ID NO: 725069 - RNA, 19 nt, Homo sapiens
aggaagagggcgagaugua

SEQ ID NO: 725070 - RNA, 19 nt, Homo sapiens
gcauggacgagauggaguu

SEQ ID NO: 725071 - RNA, 19 nt, Homo sapiens
gccaaguucugggaaguca

SEQ ID NO: 725072 - RNA, 19 nt, Homo sapiens
ggaagagggcgagauguac

SEQ ID NO: 725073 - RNA, 19 nt, Homo sapiens
cgaggaagagggcgagaug

SEQ ID NO: 725074 - RNA, 19 nt, Homo sapiens
uccugucucugucuuauug

SEQ ID NO: 725075 - RNA, 19 nt, Homo sapiens
ccgcccuccugcaguauuu

SEQ ID NO: 725076 - RNA, 19 nt, Homo sapiens
gcgcaucuccgagcaguuc

SEQ ID NO: 725077 - RNA, 19 nt, Homo sapiens
ggagguggacgagcagaug

SEQ ID NO: 725078 - RNA, 19 nt, Homo sapiens
ugaagguggccguguguga

SEQ ID NO: 725079 - RNA, 19 nt, Homo sapiens
ccggaaccauggacagugu

SEQ ID NO: 725080 - RNA, 19 nt, Homo sapiens
acaacgaggccucuucuca

SEQ ID NO: 725081 - RNA, 19 nt, Homo sapiens
cgaagccagcagugucuaa

SEQ ID NO: 725082 - RNA, 19 nt, Homo sapiens
cuccaggccugacguuuua

SEQ ID NO: 725083 - RNA, 19 nt, Homo sapiens
agggcgagauguacgaaga

SEQ ID NO: 725084 - RNA, 19 nt, Homo sapiens
ucaccgaggccgagagcaa

SEQ ID NO: 725085 - RNA, 19 nt, Homo sapiens
aagauguccuccaccuuca

SEQ ID NO: 725086 - RNA, 19 nt, Homo sapiens
aacgaggccucuucucaca

SEQ ID NO: 725087 - RNA, 19 nt, Homo sapiens
gggccaaguucugggaagu

SEQ ID NO: 725088 - RNA, 19 nt, Homo sapiens
caaguucugggaagucauc

SEQ ID NO: 725089 - RNA, 19 nt, Homo sapiens
gcaagcuggccgucaacau

SEQ ID NO: 725090 - RNA, 19 nt, Homo sapiens
acgaggcgcucuacgacau

SEQ ID NO: 725091 - RNA, 19 nt, Homo sapiens
aauuucaucuuuggucaga

SEQ ID NO: 725092 - RNA, 19 nt, Homo sapiens
acaacgaggcgcucuacga

SEQ ID NO: 725093 - RNA, 19 nt, Homo sapiens
ggccugacaauuucaucuu

SEQ ID NO: 725094 - RNA, 19 nt, Homo sapiens
gcacgcugcucaucaguaa

SEQ ID NO: 725095 - RNA, 19 nt, Homo sapiens
gaccuugccucaccuuuaa

SEQ ID NO: 725096 - RNA, 19 nt, Homo sapiens
gagcugcaguucaccuuug

SEQ ID NO: 725097 - RNA, 19 nt, Homo sapiens
gaccuugccucaccuuuca

SEQ ID NO: 725098 - RNA, 19 nt, Homo sapiens
caacuucucuuugaucucu

SEQ ID NO: 725099 - RNA, 19 nt, Homo sapiens
gagcccuaauuuaucuuua

SEQ ID NO: 725100 - RNA, 19 nt, Homo sapiens
gccucacccucaauaaaua

SEQ ID NO: 725101 - RNA, 19 nt, Homo sapiens
aaaccgcaccuuuaacuuu

SEQ ID NO: 725102 - RNA, 19 nt, Homo sapiens
uagcuuaucugggagagaa

SEQ ID NO: 725103 - RNA, 19 nt, Homo sapiens
gcacuucaccgcugaccuu

SEQ ID NO: 725104 - RNA, 19 nt, Homo sapiens
gcaguucaccuuugaccuu

SEQ ID NO: 725105 - RNA, 19 nt, Homo sapiens
ggaaaccgcaccuuuaacu

SEQ ID NO: 725106 - RNA, 19 nt, Homo sapiens
gcaaguccugguuuauauu

SEQ ID NO: 725107 - RNA, 19 nt, Homo sapiens
ugaccuugccucaccuuua

SEQ ID NO: 725108 - RNA, 19 nt, Homo sapiens
ccucgaggcuucugaccuu

SEQ ID NO: 725109 - RNA, 19 nt, Homo sapiens
uggagaggaucaacgugua

SEQ ID NO: 725110 - RNA, 19 nt, Homo sapiens
ugcaaguccugguuuauau

SEQ ID NO: 725111 - RNA, 19 nt, Homo sapiens
uuugggagguuaucaguga

SEQ ID NO: 725112 - RNA, 19 nt, Homo sapiens
gaaaccgcaccuuuaacuu

SEQ ID NO: 725113 - RNA, 19 nt, Homo sapiens
ucuggaaaccgcaccuuua

SEQ ID NO: 725114 - RNA, 19 nt, Homo sapiens
accuauaaguucugguuua

SEQ ID NO: 725115 - RNA, 19 nt, Homo sapiens
cgaggcuucugaccuuuga

SEQ ID NO: 725116 - RNA, 19 nt, Homo sapiens
gcaguucacggccauguuc

SEQ ID NO: 725117 - RNA, 19 nt, Homo sapiens
caagcuggccgucaacaug

SEQ ID NO: 725118 - RNA, 19 nt, Homo sapiens
ugacuucugcuucaccuuu

SEQ ID NO: 725119 - RNA, 19 nt, Homo sapiens
ccuuugagcccuaauuuau

SEQ ID NO: 725120 - RNA, 19 nt, Homo sapiens
gcaagaacagcagcuacuu

SEQ ID NO: 725121 - RNA, 19 nt, Homo sapiens
caaguccugguuuauauug

SEQ ID NO: 725122 - RNA, 19 nt, Homo sapiens
aaccgcaccuuuaacuuug

SEQ ID NO: 725123 - RNA, 19 nt, Homo sapiens
gacuccaacuucucuuuca

SEQ ID NO: 725124 - RNA, 19 nt, Homo sapiens
gguuaucagugacgaacau

SEQ ID NO: 725125 - RNA, 19 nt, Homo sapiens
uaucugaguaccagcagua

SEQ ID NO: 725126 - RNA, 19 nt, Homo sapiens
caagaacagcagcuacuuc

SEQ ID NO: 725127 - RNA, 19 nt, Homo sapiens
cuggaaaccgcaccuuuaa

SEQ ID NO: 725128 - RNA, 19 nt, Homo sapiens
gcgagggcauggacgagau

SEQ ID NO: 725129 - RNA, 19 nt, Homo sapiens
gagcucacccagcagaugu

SEQ ID NO: 725130 - RNA, 19 nt, Homo sapiens
ggccacaggaggaaauuau

SEQ ID NO: 725131 - RNA, 19 nt, Homo sapiens
ccucuagaccuauaaguuc

SEQ ID NO: 725132 - RNA, 19 nt, Homo sapiens
ccgcugacccuaacaauac

SEQ ID NO: 725133 - RNA, 19 nt, Homo sapiens
ccacaggaggaaauuaugu

SEQ ID NO: 725134 - RNA, 19 nt, Homo sapiens
cugcaaguccugguuuaua

SEQ ID NO: 725135 - RNA, 19 nt, Homo sapiens
ccccaugaaucccauuuua

SEQ ID NO: 725136 - RNA, 19 nt, Homo sapiens
gcauggacgagauggaguu

SEQ ID NO: 725137 - RNA, 19 nt, Homo sapiens
ggcaacaacugggcaaagg

SEQ ID NO: 725138 - RNA, 19 nt, Homo sapiens
ccggacaacuucguguuug

SEQ ID NO: 725139 - RNA, 19 nt, Homo sapiens
ccucugagcugcacuucac

SEQ ID NO: 725140 - RNA, 19 nt, Homo sapiens
gacuucugcuucaccuuug

SEQ ID NO: 725141 - RNA, 19 nt, Homo sapiens
cuugagcucuuccaaccuu

SEQ ID NO: 725142 - RNA, 19 nt, Homo sapiens
agaauacggaugagaccua

SEQ ID NO: 725143 - RNA, 19 nt, Homo sapiens
gcgcaucuccgagcaguuc

SEQ ID NO: 725144 - RNA, 19 nt, Homo sapiens
ggagguggacgagcagaug

SEQ ID NO: 725145 - RNA, 19 nt, Homo sapiens
cgacaacgaggcacucuac

SEQ ID NO: 725146 - RNA, 19 nt, Homo sapiens
gaccccaacuucucuuuga

SEQ ID NO: 725147 - RNA, 19 nt, Homo sapiens
cauuuuaccucuagaccua

SEQ ID NO: 725148 - RNA, 19 nt, Homo sapiens
gacccuggcuccccuuuga

SEQ ID NO: 725149 - RNA, 19 nt, Homo sapiens
ucucuuugaucucugaauc

SEQ ID NO: 725150 - RNA, 19 nt, Homo sapiens
gacccuaacaauaccuuug

SEQ ID NO: 725151 - RNA, 19 nt, Homo sapiens
ccagaccgcaucaugaaca

SEQ ID NO: 725152 - RNA, 19 nt, Homo sapiens
gccggacaacuucguguuu

SEQ ID NO: 725153 - RNA, 19 nt, Homo sapiens
gaccuauaaguucugguuu

SEQ ID NO: 725154 - RNA, 19 nt, Homo sapiens
gcccuaauuuaucuuuaac

SEQ ID NO: 725155 - RNA, 19 nt, Homo sapiens
ccucacccucaauaaauaa

SEQ ID NO: 725156 - RNA, 19 nt, Homo sapiens
uuugagcccuaauuuaucu

SEQ ID NO: 725157 - RNA, 19 nt, Homo sapiens
ucaccgaggccgagagcaa

SEQ ID NO: 725158 - RNA, 19 nt, Homo sapiens
gcaagcuggccgucaacau

SEQ ID NO: 725159 - RNA, 19 nt, Homo sapiens
agaccuauaaguucugguu

SEQ ID NO: 725160 - RNA, 19 nt, Homo sapiens
ggagaggaucaacguguac

SEQ ID NO: 725161 - RNA, 19 nt, Homo sapiens
ucccagaccgcaucaugaa

SEQ ID NO: 725162 - RNA, 19 nt, Homo sapiens
gaagcagugugaacucuuu

SEQ ID NO: 725163 - RNA, 19 nt, Homo sapiens
gacgagaccuacugcauug

SEQ ID NO: 725164 - RNA, 19 nt, Homo sapiens
gaagcuggcugugaacaug

SEQ ID NO: 725165 - RNA, 19 nt, Homo sapiens
gaagcucucuacgacauuu

SEQ ID NO: 725166 - RNA, 19 nt, Homo sapiens
ggagguggaugagcaaaug

SEQ ID NO: 725167 - RNA, 19 nt, Homo sapiens
gcaaaugcuuaauguccaa

SEQ ID NO: 725168 - RNA, 19 nt, Homo sapiens
gagaccuacugcauugaua

SEQ ID NO: 725169 - RNA, 19 nt, Homo sapiens
gcaagauccgggaggagua

SEQ ID NO: 725170 - RNA, 19 nt, Homo sapiens
ccacauccaugcuguacag

SEQ ID NO: 725171 - RNA, 19 nt, Homo sapiens
ugagggaaaucgugcacuu

SEQ ID NO: 725172 - RNA, 19 nt, Homo sapiens
gcagugugaacucuuuauu

SEQ ID NO: 725173 - RNA, 19 nt, Homo sapiens
cuacugcauugauaacgaa

SEQ ID NO: 725174 - RNA, 19 nt, Homo sapiens
ggugcuggauguugugaga

SEQ ID NO: 725175 - RNA, 19 nt, Homo sapiens
gcaguucacggccauguuc

SEQ ID NO: 725176 - RNA, 19 nt, Homo sapiens
cgaggcugcuguuugucua

SEQ ID NO: 725177 - RNA, 19 nt, Homo sapiens
cuacgacauuugcuucaga

SEQ ID NO: 725178 - RNA, 19 nt, Homo sapiens
ucacccagcagauguuuga

SEQ ID NO: 725179 - RNA, 19 nt, Homo sapiens
gggaggugaucagcgauga

SEQ ID NO: 725180 - RNA, 19 nt, Homo sapiens
cuacaacgccacccucuca

SEQ ID NO: 725181 - RNA, 19 nt, Homo sapiens
gauguuugaugccaagaac

SEQ ID NO: 725182 - RNA, 19 nt, Homo sapiens
gcagugcggcaaccaaauc

SEQ ID NO: 725183 - RNA, 19 nt, Homo sapiens
gaaggagguggaugagcaa

SEQ ID NO: 725184 - RNA, 19 nt, Homo sapiens
agacgagaccuacugcauu

SEQ ID NO: 725185 - RNA, 19 nt, Homo sapiens
gcgagggcauggacgagau

SEQ ID NO: 725186 - RNA, 19 nt, Homo sapiens
ccaugaaggagguggauga

SEQ ID NO: 725187 - RNA, 19 nt, Homo sapiens
gggcagugcggcaaccaaa

SEQ ID NO: 725188 - RNA, 19 nt, Homo sapiens
gagcucacccagcagaugu

SEQ ID NO: 725189 - RNA, 19 nt, Homo sapiens
uggaacgcaucaacgugua

SEQ ID NO: 725190 - RNA, 19 nt, Homo sapiens
gggaagcagugugaacucu

SEQ ID NO: 725191 - RNA, 19 nt, Homo sapiens
gcauggacgagauggaguu

SEQ ID NO: 725192 - RNA, 19 nt, Homo sapiens
gaaagcagggaagcagugu

SEQ ID NO: 725193 - RNA, 19 nt, Homo sapiens
ugcggaagcuggcugugaa

SEQ ID NO: 725194 - RNA, 19 nt, Homo sapiens
ggaagcagugugaacucuu

SEQ ID NO: 725195 - RNA, 19 nt, Homo sapiens
gcgcaucuccgagcaguuc

SEQ ID NO: 725196 - RNA, 19 nt, Homo sapiens
guacccuccucaucagcaa

SEQ ID NO: 725197 - RNA, 19 nt, Homo sapiens
ccagacaggaucaugaaca

SEQ ID NO: 725198 - RNA, 19 nt, Homo sapiens
ugaccacgcccaccuaugg

SEQ ID NO: 725199 - RNA, 19 nt, Homo sapiens
aagcagggaagcaguguga

SEQ ID NO: 725200 - RNA, 19 nt, Homo sapiens
ccuagagccuucagucacu

SEQ ID NO: 725201 - RNA, 19 nt, Homo sapiens
uacgacauuugcuucagaa

SEQ ID NO: 725202 - RNA, 19 nt, Homo sapiens
acgaagcucucuacgacau

SEQ ID NO: 725203 - RNA, 19 nt, Homo sapiens
agaccuacugcauugauaa

SEQ ID NO: 725204 - RNA, 19 nt, Homo sapiens
gcugcuguuugucuacuuc

SEQ ID NO: 725205 - RNA, 19 nt, Homo sapiens
acaggaucaugaacacguu

SEQ ID NO: 725206 - RNA, 19 nt, Homo sapiens
aggaggagguggccuagag

SEQ ID NO: 725207 - RNA, 19 nt, Homo sapiens
ugaaaacggcugucuguga

SEQ ID NO: 725208 - RNA, 19 nt, Homo sapiens
ggaagcuggcugugaacau

SEQ ID NO: 725209 - RNA, 19 nt, Homo sapiens
gagggaaaucgugcacuug

SEQ ID NO: 725210 - RNA, 19 nt, Homo sapiens
ccuacugcauugauaacga

SEQ ID NO: 725211 - RNA, 19 nt, Homo sapiens
ucaccgaggccgagagcaa

SEQ ID NO: 725212 - RNA, 19 nt, Homo sapiens
acacagacgagaccuacug

SEQ ID NO: 725213 - RNA, 19 nt, Homo sapiens
ugcuggauguugugagaaa

SEQ ID NO: 725214 - RNA, 19 nt, Homo sapiens
cagugugaacucuuuauuc

SEQ ID NO: 725215 - RNA, 19 nt, Homo sapiens
gcagggaagcagugugaac

SEQ ID NO: 725216 - RNA, 19 nt, Homo sapiens
gaucaugaacacguuuagu

SEQ ID NO: 725217 - RNA, 19 nt, Homo sapiens
cagacaggaucaugaacac

SEQ ID NO: 725218 - RNA, 19 nt, Homo sapiens
uggacucggugcuggaugu

SEQ ID NO: 725219 - RNA, 19 nt, Homo sapiens
gcucacccagcagauguuu

SEQ ID NO: 725220 - RNA, 19 nt, Homo sapiens
ggugucugcuaccaugagu

SEQ ID NO: 725221 - RNA, 19 nt, Homo sapiens
acucggugcuggauguugu

SEQ ID NO: 725222 - RNA, 19 nt, Homo sapiens
caacaaaugugauaaguga

SEQ ID NO: 725223 - RNA, 19 nt, Homo sapiens
gaaauaagccuaagagaga

SEQ ID NO: 725224 - RNA, 19 nt, Homo sapiens
gcagaaaggugaauuaacu

SEQ ID NO: 725225 - RNA, 19 nt, Homo sapiens
guucugaucuucacauuga

SEQ ID NO: 725226 - RNA, 19 nt, Homo sapiens
gaacguguaugcagaugga

SEQ ID NO: 725227 - RNA, 19 nt, Homo sapiens
gggcuuagcuaaugaaagu

SEQ ID NO: 725228 - RNA, 19 nt, Homo sapiens
gcaagugguugucaaguuc

SEQ ID NO: 725229 - RNA, 19 nt, Homo sapiens
guaagaacguggagaggaa

SEQ ID NO: 725230 - RNA, 19 nt, Homo sapiens
gcaaauacccuagagauuc

SEQ ID NO: 725231 - RNA, 19 nt, Homo sapiens
cugaagcacuuuacugaua

SEQ ID NO: 725232 - RNA, 19 nt, Homo sapiens
ggucauugguggauguuaa

SEQ ID NO: 725233 - RNA, 19 nt, Homo sapiens
gaaaauggcccucuucaaa

SEQ ID NO: 725234 - RNA, 19 nt, Homo sapiens
gauggugacuucuacgaaa

SEQ ID NO: 725235 - RNA, 19 nt, Homo sapiens
gagaauaaccucauaguac

SEQ ID NO: 725236 - RNA, 19 nt, Homo sapiens
caaccaaucagaaccauaa

SEQ ID NO: 725237 - RNA, 19 nt, Homo sapiens
ccacugcccugaccauuug

SEQ ID NO: 725238 - RNA, 19 nt, Homo sapiens
uagaaagaauggagaacua

SEQ ID NO: 725239 - RNA, 19 nt, Homo sapiens
ggaugucacuccuuuaauc

SEQ ID NO: 725240 - RNA, 19 nt, Homo sapiens
gaacaucccggcuguggaa

SEQ ID NO: 725241 - RNA, 19 nt, Homo sapiens
agacaacccugagagauuu

SEQ ID NO: 725242 - RNA, 19 nt, Homo sapiens
gaaaacugcuccucauuau

SEQ ID NO: 725243 - RNA, 19 nt, Homo sapiens
gaguugacaucccuauuga

SEQ ID NO: 725244 - RNA, 19 nt, Homo sapiens
gagagacucaaccauaaua

SEQ ID NO: 725245 - RNA, 19 nt, Homo sapiens
gagaacggauacuggacua

SEQ ID NO: 725246 - RNA, 19 nt, Homo sapiens
caaggaagcuaaaagaauu

SEQ ID NO: 725247 - RNA, 19 nt, Homo sapiens
gcacuuuacugauauucau

SEQ ID NO: 725248 - RNA, 19 nt, Homo sapiens
gaucucauaucuacaccuu

SEQ ID NO: 725249 - RNA, 19 nt, Homo sapiens
gaaagaauggagaacuauu

SEQ ID NO: 725250 - RNA, 19 nt, Homo sapiens
ggaguugacaucccuauug

SEQ ID NO: 725251 - RNA, 19 nt, Homo sapiens
ugggagauguucagccuua

SEQ ID NO: 725252 - RNA, 19 nt, Homo sapiens
gaacucaaguggaggaaaa

SEQ ID NO: 725253 - RNA, 19 nt, Homo sapiens
caacagagcaagaaauaag

SEQ ID NO: 725254 - RNA, 19 nt, Homo sapiens
acauugaagugaaggguua

SEQ ID NO: 725255 - RNA, 19 nt, Homo sapiens
caaauacccuagagauucu

SEQ ID NO: 725256 - RNA, 19 nt, Homo sapiens
gaaaugggauacgcugcaa

SEQ ID NO: 725257 - RNA, 19 nt, Homo sapiens
ggaaaacugcuccucauua

SEQ ID NO: 725258 - RNA, 19 nt, Homo sapiens
gagccucuauauccuguuu

SEQ ID NO: 725259 - RNA, 19 nt, Homo sapiens
gaagcacuuuacugauauu

SEQ ID NO: 725260 - RNA, 19 nt, Homo sapiens
ggaucuuccuggacuauga

SEQ ID NO: 725261 - RNA, 19 nt, Homo sapiens
gagccagccuuccuucaau

SEQ ID NO: 725262 - RNA, 19 nt, Homo sapiens
ugacugaugggaauaagua

SEQ ID NO: 725263 - RNA, 19 nt, Homo sapiens
gagcaagaaauaagccuaa

SEQ ID NO: 725264 - RNA, 19 nt, Homo sapiens
guaugcagauggaaaggaa

SEQ ID NO: 725265 - RNA, 19 nt, Homo sapiens
ggcaagugguugucaaguu

SEQ ID NO: 725266 - RNA, 19 nt, Homo sapiens
aaacugcuccucauuauca

SEQ ID NO: 725267 - RNA, 19 nt, Homo sapiens
guuauaagcuuugguggau

SEQ ID NO: 725268 - RNA, 19 nt, Homo sapiens
gaaagagagcgagagauga

SEQ ID NO: 725269 - RNA, 19 nt, Homo sapiens
gagcaaauacccuagagau

SEQ ID NO: 725270 - RNA, 19 nt, Homo sapiens
caaaugugauaagugauug

SEQ ID NO: 725271 - RNA, 19 nt, Homo sapiens
ggaauacuaagaaaugguu

SEQ ID NO: 725272 - RNA, 19 nt, Homo sapiens
ugaagcacuuuacugauau

SEQ ID NO: 725273 - RNA, 19 nt, Homo sapiens
gagaucucguucuauaaug

SEQ ID NO: 725274 - RNA, 19 nt, Homo sapiens
gaucuaaacagcaauaacu

SEQ ID NO: 725275 - RNA, 19 nt, Homo sapiens
guuaaacccauauuccuuu

SEQ ID NO: 725276 - RNA, 19 nt, Homo sapiens
ugacaucccuauugacucu

SEQ ID NO: 725277 - RNA, 19 nt, Homo sapiens
ucucauaucuacaccuuuc

SEQ ID NO: 725278 - RNA, 19 nt, Homo sapiens
gaacggauacuggacuaug

SEQ ID NO: 725279 - RNA, 19 nt, Homo sapiens
caaaagaaguagagaguuc

SEQ ID NO: 725280 - RNA, 19 nt, Homo sapiens
aaguagacaugacaaguga

SEQ ID NO: 725281 - RNA, 19 nt, Homo sapiens
gcccagaaccaaccugaaa

SEQ ID NO: 725282 - RNA, 19 nt, Homo sapiens
gcaagaaauaagccuaaga

SEQ ID NO: 725283 - RNA, 19 nt, Homo sapiens
aaagagagcgagagaugaa

SEQ ID NO: 725284 - RNA, 19 nt, Homo sapiens
ggaagcaccugugguugca

SEQ ID NO: 725285 - RNA, 19 nt, Homo sapiens
gaaaagacagccagcauau

SEQ ID NO: 725286 - RNA, 19 nt, Homo sapiens
cuagaggccacacuugaua

SEQ ID NO: 725287 - RNA, 19 nt, Homo sapiens
gcacugaagcacuuuacug

SEQ ID NO: 725288 - RNA, 19 nt, Homo sapiens
gaacuauuaaccaccauuc

SEQ ID NO: 725289 - RNA, 19 nt, Homo sapiens
cagagugucuugguugaga

SEQ ID NO: 725290 - RNA, 19 nt, Homo sapiens
ucuuagugcuguguuauaa

SEQ ID NO: 725291 - RNA, 19 nt, Homo sapiens
cagacaacccugagagauu

SEQ ID NO: 725292 - RNA, 19 nt, Homo sapiens
gcaacagagcaagaaauaa

SEQ ID NO: 725293 - RNA, 19 nt, Homo sapiens
aaacccauauuccuuucaa

SEQ ID NO: 725294 - RNA, 19 nt, Homo sapiens
caugugacuuggaaagaga

SEQ ID NO: 725295 - RNA, 19 nt, Homo sapiens
ggacuaugggccugacuga

SEQ ID NO: 725296 - RNA, 19 nt, Homo sapiens
ucacaucagggagacauua

SEQ ID NO: 725297 - RNA, 19 nt, Homo sapiens
gagcgagagaugaaagaaa

SEQ ID NO: 725298 - RNA, 19 nt, Homo sapiens
agaaagagagcgagagaug

SEQ ID NO: 725299 - RNA, 19 nt, Homo sapiens
ggaaaagacagccagcaua

SEQ ID NO: 725300 - RNA, 19 nt, Homo sapiens
gguguauccugcaucauca

SEQ ID NO: 725301 - RNA, 19 nt, Homo sapiens
ccaagauggugacuucuac

SEQ ID NO: 725302 - RNA, 19 nt, Homo sapiens
uuuaagugcuuguggaguu

SEQ ID NO: 725303 - RNA, 19 nt, Homo sapiens
agaagucuuuggccuauca

SEQ ID NO: 725304 - RNA, 19 nt, Homo sapiens
caagaaauaagccuaagag

SEQ ID NO: 725305 - RNA, 19 nt, Homo sapiens
guggaugucacuccuuuaa

SEQ ID NO: 725306 - RNA, 19 nt, Homo sapiens
uauaagcuuugguggaugu

SEQ ID NO: 725307 - RNA, 19 nt, Homo sapiens
ugaaguaacaucucugcuu

SEQ ID NO: 725308 - RNA, 19 nt, Homo sapiens
caaacgccauccuccuugu

SEQ ID NO: 725309 - RNA, 19 nt, Homo sapiens
agacucaaccauaauagaa

SEQ ID NO: 725310 - RNA, 19 nt, Homo sapiens
uauuauugcucaccacugu

SEQ ID NO: 725311 - RNA, 19 nt, Homo sapiens
gauucucugugauauagga

SEQ ID NO: 725312 - RNA, 19 nt, Homo sapiens
ugucuugguugagagaaua

SEQ ID NO: 725313 - RNA, 19 nt, Homo sapiens
ggugcagaaaggugaauua

SEQ ID NO: 725314 - RNA, 19 nt, Homo sapiens
ugaguuucguaccaccuua

SEQ ID NO: 725315 - RNA, 19 nt, Homo sapiens
agaaaagaguggcauauug

SEQ ID NO: 725316 - RNA, 19 nt, Homo sapiens
agagaagucuuuggccuau

SEQ ID NO: 725317 - RNA, 19 nt, Homo sapiens
ugcaacagagcaagaaaua

SEQ ID NO: 725318 - RNA, 19 nt, Homo sapiens
ccacccaacaaaugugaua

SEQ ID NO: 725319 - RNA, 19 nt, Homo sapiens
gacuagaggccacacuuga

SEQ ID NO: 725320 - RNA, 19 nt, Homo sapiens
uacaguaauuugugcaguu

SEQ ID NO: 725321 - RNA, 19 nt, Homo sapiens
gaaggguuaugaggaugga

SEQ ID NO: 725322 - RNA, 19 nt, Homo sapiens
ggagaacccugacuaauaa

SEQ ID NO: 725323 - RNA, 19 nt, Homo sapiens
gagccaaucuccuuaauaa

SEQ ID NO: 725324 - RNA, 19 nt, Homo sapiens
gaaauucucuccuucuguu

SEQ ID NO: 725325 - RNA, 19 nt, Homo sapiens
uaucauaucugccuuugua

SEQ ID NO: 725326 - RNA, 19 nt, Homo sapiens
gaauugcgauggagaagaa

SEQ ID NO: 725327 - RNA, 19 nt, Homo sapiens
ucucaugucuggcuuaaua

SEQ ID NO: 725328 - RNA, 19 nt, Homo sapiens
ggaugaagaugaaugaaga

SEQ ID NO: 725329 - RNA, 19 nt, Homo sapiens
gaagaugaaugaagaacau

SEQ ID NO: 725330 - RNA, 19 nt, Homo sapiens
ccaaacaucgcgauuaaua

SEQ ID NO: 725331 - RNA, 19 nt, Homo sapiens
caaacuuccugaucuaauu

SEQ ID NO: 725332 - RNA, 19 nt, Homo sapiens
ggaacuaguuguuucauag

SEQ ID NO: 725333 - RNA, 19 nt, Homo sapiens
ggacaccaguggcuucaaa

SEQ ID NO: 725334 - RNA, 19 nt, Homo sapiens
gaucagagauagaggaagu

SEQ ID NO: 725335 - RNA, 19 nt, Homo sapiens
ggaccaagguuguaaggau

SEQ ID NO: 725336 - RNA, 19 nt, Homo sapiens
gaacagaggagcagaugga

SEQ ID NO: 725337 - RNA, 19 nt, Homo sapiens
ucacuagucuguggcuuua

SEQ ID NO: 725338 - RNA, 19 nt, Homo sapiens
cauaucugccuuuguauua

SEQ ID NO: 725339 - RNA, 19 nt, Homo sapiens
acaaucagcuucccugguu

SEQ ID NO: 725340 - RNA, 19 nt, Homo sapiens
guaguuccuuugcuuguaa

SEQ ID NO: 725341 - RNA, 19 nt, Homo sapiens
ggacugagaguuacacaau

SEQ ID NO: 725342 - RNA, 19 nt, Homo sapiens
gggaacuaguuguuucaua

SEQ ID NO: 725343 - RNA, 19 nt, Homo sapiens
gaugagcuguugugcgauu

SEQ ID NO: 725344 - RNA, 19 nt, Homo sapiens
caagaagaauugcgaugga

SEQ ID NO: 725345 - RNA, 19 nt, Homo sapiens
ccaaucuccuuaauaaaug

SEQ ID NO: 725346 - RNA, 19 nt, Homo sapiens
gaccugggaugaagaugaa

SEQ ID NO: 725347 - RNA, 19 nt, Homo sapiens
aaagaaaguugaacaagag

SEQ ID NO: 725348 - RNA, 19 nt, Homo sapiens
uggagaacccugacuaaua

SEQ ID NO: 725349 - RNA, 19 nt, Homo sapiens
cagaagagauuggcaagug

SEQ ID NO: 725350 - RNA, 19 nt, Homo sapiens
caacaggguucaccaggau

SEQ ID NO: 725351 - RNA, 19 nt, Homo sapiens
gcucagaugucccugcaau

SEQ ID NO: 725352 - RNA, 19 nt, Homo sapiens
auaaaugccugcucauaga

SEQ ID NO: 725353 - RNA, 19 nt, Homo sapiens
cuagacagcugguacaaca

SEQ ID NO: 725354 - RNA, 19 nt, Homo sapiens
gaucucaugucuggcuuaa

SEQ ID NO: 725355 - RNA, 19 nt, Homo sapiens
gauaggauguuuugugaaa

SEQ ID NO: 725356 - RNA, 19 nt, Homo sapiens
gagcuucgccucagggaaa

SEQ ID NO: 725357 - RNA, 19 nt, Homo sapiens
ccgcaguguuuguguauaa

SEQ ID NO: 725358 - RNA, 19 nt, Homo sapiens
gauaugcagaucagagaua

SEQ ID NO: 725359 - RNA, 19 nt, Homo sapiens
ggucauacauaacgucaca

SEQ ID NO: 725360 - RNA, 19 nt, Homo sapiens
gacagcugguacaacauua

SEQ ID NO: 725361 - RNA, 19 nt, Homo sapiens
caaccugacuggauuaagg

SEQ ID NO: 725362 - RNA, 19 nt, Homo sapiens
gaaaguugaacaagaggaa

SEQ ID NO: 725363 - RNA, 19 nt, Homo sapiens
guaugugcaucuauaucua

SEQ ID NO: 725364 - RNA, 19 nt, Homo sapiens
gccaaucuccuuaauaaau

SEQ ID NO: 725365 - RNA, 19 nt, Homo sapiens
gaggaaaggcaaauucuuc

SEQ ID NO: 725366 - RNA, 19 nt, Homo sapiens
uccaugugcugguuaauuu

SEQ ID NO: 725367 - RNA, 19 nt, Homo sapiens
gcacacuacugagagaaug

SEQ ID NO: 725368 - RNA, 19 nt, Homo sapiens
gcuguugugcgauuucuua

SEQ ID NO: 725369 - RNA, 19 nt, Homo sapiens
gauaagcccuggccaucuc

SEQ ID NO: 725370 - RNA, 19 nt, Homo sapiens
gaagaauugcgauggagaa

SEQ ID NO: 725371 - RNA, 19 nt, Homo sapiens
ggagaaggaaacugucauu

SEQ ID NO: 725372 - RNA, 19 nt, Homo sapiens
uaauaaaugccugcucaua

SEQ ID NO: 725373 - RNA, 19 nt, Homo sapiens
ucagaugucccugcaauaa

SEQ ID NO: 725374 - RNA, 19 nt, Homo sapiens
gaucaucagagacaaguau

SEQ ID NO: 725375 - RNA, 19 nt, Homo sapiens
gcagaggaaaggcaaauuc

SEQ ID NO: 725376 - RNA, 19 nt, Homo sapiens
cugacuggauuaaggaaua

SEQ ID NO: 725377 - RNA, 19 nt, Homo sapiens
guacuuagucccugagugu

SEQ ID NO: 725378 - RNA, 19 nt, Homo sapiens
ggagagggaaccagauaug

SEQ ID NO: 725379 - RNA, 19 nt, Homo sapiens
uuucauagcucccagucaa

SEQ ID NO: 725380 - RNA, 19 nt, Homo sapiens
caccagagccuauagaauc

SEQ ID NO: 725381 - RNA, 19 nt, Homo sapiens
acaaguaugugaggaaugu

SEQ ID NO: 725382 - RNA, 19 nt, Homo sapiens
ggaccugggaugaagauga

SEQ ID NO: 725383 - RNA, 19 nt, Homo sapiens
gaaagugagagaagcuguu

SEQ ID NO: 725384 - RNA, 19 nt, Homo sapiens
gagacacucuucuucuucu

SEQ ID NO: 725385 - RNA, 19 nt, Homo sapiens
gggaaauucucuccuucug

SEQ ID NO: 725386 - RNA, 19 nt, Homo sapiens
aaacuuuacugcacacuac

SEQ ID NO: 725387 - RNA, 19 nt, Homo sapiens
ucacagccaugcagauaag

SEQ ID NO: 725388 - RNA, 19 nt, Homo sapiens
gagaaggaaacugucauuu

SEQ ID NO: 725389 - RNA, 19 nt, Homo sapiens
gaaaggcaaauucuucucu

SEQ ID NO: 725390 - RNA, 19 nt, Homo sapiens
agaagagauuggcaaguga

SEQ ID NO: 725391 - RNA, 19 nt, Homo sapiens
cuucaaacuuccugaucua

SEQ ID NO: 725392 - RNA, 19 nt, Homo sapiens
gcauagggaacuaguuguu

SEQ ID NO: 725393 - RNA, 19 nt, Homo sapiens
cagcaucuguugcaucaag

SEQ ID NO: 725394 - RNA, 19 nt, Homo sapiens
uggcaggccuugggucuaa

SEQ ID NO: 725395 - RNA, 19 nt, Homo sapiens
gagcugagacacucuucuu

SEQ ID NO: 725396 - RNA, 19 nt, Homo sapiens
ggagggaccaagguuguaa

SEQ ID NO: 725397 - RNA, 19 nt, Homo sapiens
gucuguggcuuuaguaguu

SEQ ID NO: 725398 - RNA, 19 nt, Homo sapiens
caucugcccugcacucaca

SEQ ID NO: 725399 - RNA, 19 nt, Homo sapiens
cuaugaagcuggagauguc

SEQ ID NO: 725400 - RNA, 19 nt, Homo sapiens
gagauuggcaagugaguca

SEQ ID NO: 725401 - RNA, 19 nt, Homo sapiens
uaauccaugugcugguuaa

SEQ ID NO: 725402 - RNA, 19 nt, Homo sapiens
gucagcaucuguugcauca

SEQ ID NO: 725403 - RNA, 19 nt, Homo sapiens
acauuacgcugccaucugu

SEQ ID NO: 725404 - RNA, 19 nt, Homo sapiens
aggagcagauggaggagua

SEQ ID NO: 725405 - RNA, 19 nt, Homo sapiens
gaucuaccgcuguuacuuc

SEQ ID NO: 725406 - RNA, 19 nt, Homo sapiens
cagcguggcccuggucaua

SEQ ID NO: 725407 - RNA, 19 nt, Homo sapiens
gcaucuggcuggagugcau

SEQ ID NO: 725408 - RNA, 19 nt, Homo sapiens
ggcuuuggacugagaguua

SEQ ID NO: 725409 - RNA, 19 nt, Homo sapiens
ggaaauucucuccuucugu

SEQ ID NO: 725410 - RNA, 19 nt, Homo sapiens
guuaauccaugugcugguu

SEQ ID NO: 725411 - RNA, 19 nt, Homo sapiens
agagauagaggaaguggaa

SEQ ID NO: 725412 - RNA, 19 nt, Homo sapiens
ggaaccagauaugcagauc

SEQ ID NO: 725413 - RNA, 19 nt, Homo sapiens
caagugagucagugggaaa

SEQ ID NO: 725414 - RNA, 19 nt, Homo sapiens
ugagugugguugagguuug

SEQ ID NO: 725415 - RNA, 19 nt, Homo sapiens
gcuaagucccaccauaaga

SEQ ID NO: 725416 - RNA, 19 nt, Homo sapiens
ggucuaagccccucauuga

SEQ ID NO: 725417 - RNA, 19 nt, Homo sapiens
guaucuacaucuauaucug

SEQ ID NO: 725418 - RNA, 19 nt, Homo sapiens
gcuucaaacuuccugaucu

SEQ ID NO: 725419 - RNA, 19 nt, Homo sapiens
ggaugugguuuggcucaga

SEQ ID NO: 725420 - RNA, 19 nt, Homo sapiens
cagaugcuguggacuugga

SEQ ID NO: 725421 - RNA, 19 nt, Homo sapiens
aaaucaggauaaccacauu

SEQ ID NO: 725422 - RNA, 19 nt, Homo sapiens
gagaagagcucguuaguuu

SEQ ID NO: 725423 - RNA, 19 nt, Homo sapiens
gaaauugaaucuccacaua

SEQ ID NO: 725424 - RNA, 19 nt, Homo sapiens
ggauagagaugacuuauga

SEQ ID NO: 725425 - RNA, 19 nt, Homo sapiens
gaacuuaaaucuucuguca

SEQ ID NO: 725426 - RNA, 19 nt, Homo sapiens
gcagggaacuuaauaaaga

SEQ ID NO: 725427 - RNA, 19 nt, Homo sapiens
gaagaacgguuuauggaaa

SEQ ID NO: 725428 - RNA, 19 nt, Homo sapiens
ggaaagaauuuaccaaugu

SEQ ID NO: 725429 - RNA, 19 nt, Homo sapiens
uagaggagcuggagaauuu

SEQ ID NO: 725430 - RNA, 19 nt, Homo sapiens
ggaauaauauccgacauaa

SEQ ID NO: 725431 - RNA, 19 nt, Homo sapiens
caacagaggcuucaucuuu

SEQ ID NO: 725432 - RNA, 19 nt, Homo sapiens
caacaucuguggaaauaaa

SEQ ID NO: 725433 - RNA, 19 nt, Homo sapiens
caaagaagcuacugacaau

SEQ ID NO: 725434 - RNA, 19 nt, Homo sapiens
gacaacaucuguggaaaua

SEQ ID NO: 725435 - RNA, 19 nt, Homo sapiens
uaacagcuauucagaugua

SEQ ID NO: 725436 - RNA, 19 nt, Homo sapiens
guacaaauauacagcauug

SEQ ID NO: 725437 - RNA, 19 nt, Homo sapiens
gaaagaagauaugaaagug

SEQ ID NO: 725438 - RNA, 19 nt, Homo sapiens
ccacgaagaagaagaauua

SEQ ID NO: 725439 - RNA, 19 nt, Homo sapiens
ugaaacagauugcaggaua

SEQ ID NO: 725440 - RNA, 19 nt, Homo sapiens
gaagagcucguuaguuuaa

SEQ ID NO: 725441 - RNA, 19 nt, Homo sapiens
gugaagaugugaagauuaa

SEQ ID NO: 725442 - RNA, 19 nt, Homo sapiens
uauaggaacccucaaauua

SEQ ID NO: 725443 - RNA, 19 nt, Homo sapiens
gcaaguggaucacagauuc

SEQ ID NO: 725444 - RNA, 19 nt, Homo sapiens
gaacaaaccgaccauauca

SEQ ID NO: 725445 - RNA, 19 nt, Homo sapiens
gacaagaacuggcacauca

SEQ ID NO: 725446 - RNA, 19 nt, Homo sapiens
gaccagaucuccagcaguu

SEQ ID NO: 725447 - RNA, 19 nt, Homo sapiens
guaacgagauguauagaga

SEQ ID NO: 725448 - RNA, 19 nt, Homo sapiens
uaagagaaccgaaaucaaa

SEQ ID NO: 725449 - RNA, 19 nt, Homo sapiens
aagaaucgcugauauauag

SEQ ID NO: 725450 - RNA, 19 nt, Homo sapiens
gaagaaucgcugauauaua

SEQ ID NO: 725451 - RNA, 19 nt, Homo sapiens
gaauugacuucugagcuua

SEQ ID NO: 725452 - RNA, 19 nt, Homo sapiens
gaaauaauagucagcuuga

SEQ ID NO: 725453 - RNA, 19 nt, Homo sapiens
gaggauauccacaauguuu

SEQ ID NO: 725454 - RNA, 19 nt, Homo sapiens
gcggauaggucaauuagau

SEQ ID NO: 725455 - RNA, 19 nt, Homo sapiens
gaaguucagugcauaucaa

SEQ ID NO: 725456 - RNA, 19 nt, Homo sapiens
gauguaagcagauauaguu

SEQ ID NO: 725457 - RNA, 19 nt, Homo sapiens
ugaaagaaaugcuaaugug

SEQ ID NO: 725458 - RNA, 19 nt, Homo sapiens
gaaacagauugcaggauau

SEQ ID NO: 725459 - RNA, 19 nt, Homo sapiens
uaaggacucugaauuugaa

SEQ ID NO: 725460 - RNA, 19 nt, Homo sapiens
gaagcuuuguguagaauga

SEQ ID NO: 725461 - RNA, 19 nt, Homo sapiens
ggaguuggagguacaauaa

SEQ ID NO: 725462 - RNA, 19 nt, Homo sapiens
gaaaugcuaaugugugaaa

SEQ ID NO: 725463 - RNA, 19 nt, Homo sapiens
aaagagaacauaccaguaa

SEQ ID NO: 725464 - RNA, 19 nt, Homo sapiens
gggaaagaauuuaccaaug

SEQ ID NO: 725465 - RNA, 19 nt, Homo sapiens
ggaauuugcuaaaccuuca

SEQ ID NO: 725466 - RNA, 19 nt, Homo sapiens
caaaaugucugaaagugua

SEQ ID NO: 725467 - RNA, 19 nt, Homo sapiens
gaaucagacuuccacgaaa

SEQ ID NO: 725468 - RNA, 19 nt, Homo sapiens
gaucauaauucugaaggaa

SEQ ID NO: 725469 - RNA, 19 nt, Homo sapiens
agaugaagcuguucuaaau

SEQ ID NO: 725470 - RNA, 19 nt, Homo sapiens
uaggaacccucaaauuaaa

SEQ ID NO: 725471 - RNA, 19 nt, Homo sapiens
gaauaguccuacaaagaga

SEQ ID NO: 725472 - RNA, 19 nt, Homo sapiens
gagcuuaauuccugggauu

SEQ ID NO: 725473 - RNA, 19 nt, Homo sapiens
gaagcaaguguacccuuua

SEQ ID NO: 725474 - RNA, 19 nt, Homo sapiens
ggaaauaagaauaguccua

SEQ ID NO: 725475 - RNA, 19 nt, Homo sapiens
gcuaaugugugaaaucuag

SEQ ID NO: 725476 - RNA, 19 nt, Homo sapiens
caacaucugagaacaauga

SEQ ID NO: 725477 - RNA, 19 nt, Homo sapiens
gacaucaagucuacaagaa

SEQ ID NO: 725478 - RNA, 19 nt, Homo sapiens
uuaaaucgguucuccuaaa

SEQ ID NO: 725479 - RNA, 19 nt, Homo sapiens
guagaagcuuuguguagaa

SEQ ID NO: 725480 - RNA, 19 nt, Homo sapiens
gggaaccacuauaacauga

SEQ ID NO: 725481 - RNA, 19 nt, Homo sapiens
cgaagcaaguguacccuuu

SEQ ID NO: 725482 - RNA, 19 nt, Homo sapiens
gaugacagcaagacugaua

SEQ ID NO: 725483 - RNA, 19 nt, Homo sapiens
ggacuucuaacgaugauaa

SEQ ID NO: 725484 - RNA, 19 nt, Homo sapiens
gaaguaacgagauguauag

SEQ ID NO: 725485 - RNA, 19 nt, Homo sapiens
guagcagaauccuugauaa

SEQ ID NO: 725486 - RNA, 19 nt, Homo sapiens
gacaaagggaauagaaaua

SEQ ID NO: 725487 - RNA, 19 nt, Homo sapiens
cuacauugcuggagauaau

SEQ ID NO: 725488 - RNA, 19 nt, Homo sapiens
ggaaagucauuuagcaucu

SEQ ID NO: 725489 - RNA, 19 nt, Homo sapiens
gcagauauaguucagaaga

SEQ ID NO: 725490 - RNA, 19 nt, Homo sapiens
aaucgguucuccuaaauaa

SEQ ID NO: 725491 - RNA, 19 nt, Homo sapiens
gaaacacaaucagcaacaa

SEQ ID NO: 725492 - RNA, 19 nt, Homo sapiens
uaaagaggauauccacaau

SEQ ID NO: 725493 - RNA, 19 nt, Homo sapiens
aaagaugguugccugguuu

SEQ ID NO: 725494 - RNA, 19 nt, Homo sapiens
gaaagaaaugcuaaugugu

SEQ ID NO: 725495 - RNA, 19 nt, Homo sapiens
agaagggucuuuacauuuc

SEQ ID NO: 725496 - RNA, 19 nt, Homo sapiens
gauagaagacuuaguugau

SEQ ID NO: 725497 - RNA, 19 nt, Homo sapiens
gcaaguguacccuuuauag

SEQ ID NO: 725498 - RNA, 19 nt, Homo sapiens
guacaacucaguaaggaaa

SEQ ID NO: 725499 - RNA, 19 nt, Homo sapiens
uaaaucgguucuccuaaau

SEQ ID NO: 725500 - RNA, 19 nt, Homo sapiens
gaaagucauuuagcaucuu

SEQ ID NO: 725501 - RNA, 19 nt, Homo sapiens
ggaagacauagaagagaua

SEQ ID NO: 725502 - RNA, 19 nt, Homo sapiens
gaugaagcuguucuaaaua

SEQ ID NO: 725503 - RNA, 19 nt, Homo sapiens
aagaaaugcuaauguguga

SEQ ID NO: 725504 - RNA, 19 nt, Homo sapiens
ccaaugaaguagaaaugga

SEQ ID NO: 725505 - RNA, 19 nt, Homo sapiens
ggauauuucucaaccuugu

SEQ ID NO: 725506 - RNA, 19 nt, Homo sapiens
gaagcuguucuaaauauga

SEQ ID NO: 725507 - RNA, 19 nt, Homo sapiens
gaaccacuauaacaugagu

SEQ ID NO: 725508 - RNA, 19 nt, Homo sapiens
uuaaggacaugcuagaaga

SEQ ID NO: 725509 - RNA, 19 nt, Homo sapiens
cgagauguguuugaugaaa

SEQ ID NO: 725510 - RNA, 19 nt, Homo sapiens
gaaaacagcucagcaacau

SEQ ID NO: 725511 - RNA, 19 nt, Homo sapiens
gaaacagaguacagaugug

SEQ ID NO: 725512 - RNA, 19 nt, Homo sapiens
gcugauauauaggaagaaa

SEQ ID NO: 725513 - RNA, 19 nt, Homo sapiens
gccagaaagucaaaucuca

SEQ ID NO: 725514 - RNA, 19 nt, Homo sapiens
ccagacauacuccaacuaa

SEQ ID NO: 725515 - RNA, 19 nt, Homo sapiens
gaaaagcaaccaaaacaaa

SEQ ID NO: 725516 - RNA, 19 nt, Homo sapiens
gaaggaagacauagaagag

SEQ ID NO: 725517 - RNA, 19 nt, Homo sapiens
aaacgucgcugcauauacu

SEQ ID NO: 725518 - RNA, 19 nt, Homo sapiens
ugagagggaaccacuauaa

SEQ ID NO: 725519 - RNA, 19 nt, Homo sapiens
cagccaagcucuaaaauga

SEQ ID NO: 725520 - RNA, 19 nt, Homo sapiens
gaagacuaccuuuguuaau

SEQ ID NO: 725521 - RNA, 19 nt, Homo sapiens
uaaagcagaaguagaaguu

SEQ ID NO: 725522 - RNA, 19 nt, Homo sapiens
gaaagggaauagccauaua

SEQ ID NO: 725523 - RNA, 19 nt, Homo sapiens
gaagauaccuguguccaaa

SEQ ID NO: 725524 - RNA, 19 nt, Homo sapiens
gaaguguucuuaccaguuu

SEQ ID NO: 725525 - RNA, 19 nt, Homo sapiens
ucuaagagcucaucacuaa

SEQ ID NO: 725526 - RNA, 19 nt, Homo sapiens
ggacagaauuucguuguuu

SEQ ID NO: 725527 - RNA, 19 nt, Homo sapiens
gaaggagaaucaagagaaa

SEQ ID NO: 725528 - RNA, 19 nt, Homo sapiens
gggaauagccauauaaauu

SEQ ID NO: 725529 - RNA, 19 nt, Homo sapiens
gaaauggugcuauauguuu

SEQ ID NO: 725530 - RNA, 19 nt, Homo sapiens
gaaguuaaauuccaaaugc

SEQ ID NO: 725531 - RNA, 19 nt, Homo sapiens
gaagugccauucccaaaga

SEQ ID NO: 725532 - RNA, 19 nt, Homo sapiens
gagaucaagucgaauuaaa

SEQ ID NO: 725533 - RNA, 19 nt, Homo sapiens
gaagugauacaguuuauga

SEQ ID NO: 725534 - RNA, 19 nt, Homo sapiens
gcucuucgcuuucuugaga

SEQ ID NO: 725535 - RNA, 19 nt, Homo sapiens
ggaugaaacuggaagcuau

SEQ ID NO: 725536 - RNA, 19 nt, Homo sapiens
aaacaaggcuucucuaagg

SEQ ID NO: 725537 - RNA, 19 nt, Homo sapiens
gaggaaacaacaccaaaua

SEQ ID NO: 725538 - RNA, 19 nt, Homo sapiens
ucacuacgcuuggacauuu

SEQ ID NO: 725539 - RNA, 19 nt, Homo sapiens
cauuaaagcuguguuacua

SEQ ID NO: 725540 - RNA, 19 nt, Homo sapiens
gcuaugagaaucaguuaua

SEQ ID NO: 725541 - RNA, 19 nt, Homo sapiens
caaacgaucuccucagcaa

SEQ ID NO: 725542 - RNA, 19 nt, Homo sapiens
caaauuggcaguucuuuau

SEQ ID NO: 725543 - RNA, 19 nt, Homo sapiens
cagagaccguggcauguua

SEQ ID NO: 725544 - RNA, 19 nt, Homo sapiens
gacaaacagugaaugaaga

SEQ ID NO: 725545 - RNA, 19 nt, Homo sapiens
ggagauauuuauacuacga

SEQ ID NO: 725546 - RNA, 19 nt, Homo sapiens
acauacagauccucagaua

SEQ ID NO: 725547 - RNA, 19 nt, Homo sapiens
ggauugacaacuucuauaa

SEQ ID NO: 725548 - RNA, 19 nt, Homo sapiens
aaagugaagcuccaaguua

SEQ ID NO: 725549 - RNA, 19 nt, Homo sapiens
gugaugugaugaugaagua

SEQ ID NO: 725550 - RNA, 19 nt, Homo sapiens
gaccguggcauguuauaua

SEQ ID NO: 725551 - RNA, 19 nt, Homo sapiens
guccucagguguuuacaua

SEQ ID NO: 725552 - RNA, 19 nt, Homo sapiens
uaucagggauugacaacuu

SEQ ID NO: 725553 - RNA, 19 nt, Homo sapiens
guauuucucuuagcaguuu

SEQ ID NO: 725554 - RNA, 19 nt, Homo sapiens
ucagcaaacuguaccauau

SEQ ID NO: 725555 - RNA, 19 nt, Homo sapiens
aaauauaugucccaucguu

SEQ ID NO: 725556 - RNA, 19 nt, Homo sapiens
cgauggaacuauguauaua

SEQ ID NO: 725557 - RNA, 19 nt, Homo sapiens
ccacuaggguaccagauga

SEQ ID NO: 725558 - RNA, 19 nt, Homo sapiens
agacaugaaugcaacuauu

SEQ ID NO: 725559 - RNA, 19 nt, Homo sapiens
aagaggaaauggugcuaua

SEQ ID NO: 725560 - RNA, 19 nt, Homo sapiens
gaugaagugauacaguuua

SEQ ID NO: 725561 - RNA, 19 nt, Homo sapiens
ugaaggagaaccauuguuu

SEQ ID NO: 725562 - RNA, 19 nt, Homo sapiens
uaaaaucgcugaccagaga

SEQ ID NO: 725563 - RNA, 19 nt, Homo sapiens
caaaguugguaugaaauug

SEQ ID NO: 725564 - RNA, 19 nt, Homo sapiens
caaguuguuuguaugaaga

SEQ ID NO: 725565 - RNA, 19 nt, Homo sapiens
ggaaauggugcuauauguu

SEQ ID NO: 725566 - RNA, 19 nt, Homo sapiens
gauggagucagauuaaauu

SEQ ID NO: 725567 - RNA, 19 nt, Homo sapiens
cuuauaagcuuucaugaag

SEQ ID NO: 725568 - RNA, 19 nt, Homo sapiens
agugauaacugccuccuuu

SEQ ID NO: 725569 - RNA, 19 nt, Homo sapiens
gaacccguaucucaucugu

SEQ ID NO: 725570 - RNA, 19 nt, Homo sapiens
caggagauauuuauacuac

SEQ ID NO: 725571 - RNA, 19 nt, Homo sapiens
gaaacaaggcuucucuaag

SEQ ID NO: 725572 - RNA, 19 nt, Homo sapiens
gaaggagaaccauuguuug

SEQ ID NO: 725573 - RNA, 19 nt, Homo sapiens
gcagcugccugaccacuuc

SEQ ID NO: 725574 - RNA, 19 nt, Homo sapiens
gaagcaagccagcauucaa

SEQ ID NO: 725575 - RNA, 19 nt, Homo sapiens
guaugauucucgagauauu

SEQ ID NO: 725576 - RNA, 19 nt, Homo sapiens
ggacaaacagugaaugaag

SEQ ID NO: 725577 - RNA, 19 nt, Homo sapiens
gcaucugccacauuauuua

SEQ ID NO: 725578 - RNA, 19 nt, Homo sapiens
accaguaccucucagcuua

SEQ ID NO: 725579 - RNA, 19 nt, Homo sapiens
gaugugaugaugaaguaua

SEQ ID NO: 725580 - RNA, 19 nt, Homo sapiens
caaaggaguaugcgucuga

SEQ ID NO: 725581 - RNA, 19 nt, Homo sapiens
gacaugaaugcaacuauuu

SEQ ID NO: 725582 - RNA, 19 nt, Homo sapiens
uugcagaacuguaguaaca

SEQ ID NO: 725583 - RNA, 19 nt, Homo sapiens
auucucagguguacuguua

SEQ ID NO: 725584 - RNA, 19 nt, Homo sapiens
aaaaggagcaguucuguua

SEQ ID NO: 725585 - RNA, 19 nt, Homo sapiens
ccacauuauuuaagaagga

SEQ ID NO: 725586 - RNA, 19 nt, Homo sapiens
caaugccacuucaguaugu

SEQ ID NO: 725587 - RNA, 19 nt, Homo sapiens
gauaucaucuuuucucaga

SEQ ID NO: 725588 - RNA, 19 nt, Homo sapiens
gucaggagaucaagucgaa

SEQ ID NO: 725589 - RNA, 19 nt, Homo sapiens
uaaacuuggucuucuuuca

SEQ ID NO: 725590 - RNA, 19 nt, Homo sapiens
ucaaauuggcaguucuuua

SEQ ID NO: 725591 - RNA, 19 nt, Homo sapiens
agagugaugugaugaugaa

SEQ ID NO: 725592 - RNA, 19 nt, Homo sapiens
uaagagcucaucacuaaau

SEQ ID NO: 725593 - RNA, 19 nt, Homo sapiens
ggugcuauauguuuauugu

SEQ ID NO: 725594 - RNA, 19 nt, Homo sapiens
guagauuggguuuccauaa

SEQ ID NO: 725595 - RNA, 19 nt, Homo sapiens
ccucucagcuuacucuuca

SEQ ID NO: 725596 - RNA, 19 nt, Homo sapiens
caagagugaugugaugaug

SEQ ID NO: 725597 - RNA, 19 nt, Homo sapiens
ugaaacaaggcuucucuaa

SEQ ID NO: 725598 - RNA, 19 nt, Homo sapiens
uuauauagcuguaccugau

SEQ ID NO: 725599 - RNA, 19 nt, Homo sapiens
ucaaugcagucuccacaga

SEQ ID NO: 725600 - RNA, 19 nt, Homo sapiens
acuggaagcuauugacaaa

SEQ ID NO: 725601 - RNA, 19 nt, Homo sapiens
ggucuucuuucaaguuguu

SEQ ID NO: 725602 - RNA, 19 nt, Homo sapiens
ccauggaugucaagaagga

SEQ ID NO: 725603 - RNA, 19 nt, Homo sapiens
guagacaguucccauaaaa

SEQ ID NO: 725604 - RNA, 19 nt, Homo sapiens
cagguguacuguuaacauu

SEQ ID NO: 725605 - RNA, 19 nt, Homo sapiens
gcaaagcaccaaacgaucu

SEQ ID NO: 725606 - RNA, 19 nt, Homo sapiens
ggagaucaagucgaauuaa

SEQ ID NO: 725607 - RNA, 19 nt, Homo sapiens
caaguaugauucucgagau

SEQ ID NO: 725608 - RNA, 19 nt, Homo sapiens
gaaguucauaucacauuug

SEQ ID NO: 725609 - RNA, 19 nt, Homo sapiens
ggaaacaacaccaaauagg

SEQ ID NO: 725610 - RNA, 19 nt, Homo sapiens
gauaugaaacaaucuguag

SEQ ID NO: 725611 - RNA, 19 nt, Homo sapiens
gacgauggaacuauguaua

SEQ ID NO: 725612 - RNA, 19 nt, Homo sapiens
aaagcuguguuacuacauu

SEQ ID NO: 725613 - RNA, 19 nt, Homo sapiens
caccacaaguucaccacua

SEQ ID NO: 725614 - RNA, 19 nt, Homo sapiens
gagcucaucacuaaauuca

SEQ ID NO: 725615 - RNA, 19 nt, Homo sapiens
caaacuguaccauauguug

SEQ ID NO: 725616 - RNA, 19 nt, Homo sapiens
cuaaaugggucugaaaugg

SEQ ID NO: 725617 - RNA, 19 nt, Homo sapiens
uauaagcuuucaugaagug

SEQ ID NO: 725618 - RNA, 19 nt, Homo sapiens
uaucagaauugcagaacug

SEQ ID NO: 725619 - RNA, 19 nt, Homo sapiens
uggaugaagugauacaguu

SEQ ID NO: 725620 - RNA, 19 nt, Homo sapiens
aagugaagcuccaaguuau

SEQ ID NO: 725621 - RNA, 19 nt, Homo sapiens
ucaagaaggagaaucaaga

SEQ ID NO: 725622 - RNA, 19 nt, Homo sapiens
gaacacagauaucaaagug

SEQ ID NO: 725623 - RNA, 19 nt, Homo sapiens
gcaaugaucuacaagaaau

SEQ ID NO: 725624 - RNA, 19 nt, Homo sapiens
gcaagaagaaccaauagua

SEQ ID NO: 725625 - RNA, 19 nt, Homo sapiens
gaagaacacagauaucaaa

SEQ ID NO: 725626 - RNA, 19 nt, Homo sapiens
guucuaauguugacuguuu

SEQ ID NO: 725627 - RNA, 19 nt, Homo sapiens
aagcaucccugucuuuaua

SEQ ID NO: 725628 - RNA, 19 nt, Homo sapiens
gaagggaaauuacugucuu

SEQ ID NO: 725629 - RNA, 19 nt, Homo sapiens
ggacaaacccugauuggau

SEQ ID NO: 725630 - RNA, 19 nt, Homo sapiens
gggaauggcucguuagaag

SEQ ID NO: 725631 - RNA, 19 nt, Homo sapiens
gggcaucgaucaacaagga

SEQ ID NO: 725632 - RNA, 19 nt, Homo sapiens
auacaugucuucagaauca

SEQ ID NO: 725633 - RNA, 19 nt, Homo sapiens
caaguguccuuucuccuuu

SEQ ID NO: 725634 - RNA, 19 nt, Homo sapiens
caagaaaucugcaguucag

SEQ ID NO: 725635 - RNA, 19 nt, Homo sapiens
gugguaacuuugucaauuu

SEQ ID NO: 725636 - RNA, 19 nt, Homo sapiens
guggagaguucuaauguug

SEQ ID NO: 725637 - RNA, 19 nt, Homo sapiens
auaaagaccuugaauuugg

SEQ ID NO: 725638 - RNA, 19 nt, Homo sapiens
gcaccucugugggcauaua

SEQ ID NO: 725639 - RNA, 19 nt, Homo sapiens
gaaaagauguggagauucu

SEQ ID NO: 725640 - RNA, 19 nt, Homo sapiens
ugacugaagugcaaaucuu

SEQ ID NO: 725641 - RNA, 19 nt, Homo sapiens
guggaaagauaaacuaagu

SEQ ID NO: 725642 - RNA, 19 nt, Homo sapiens
ccagugggcuucgggcaua

SEQ ID NO: 725643 - RNA, 19 nt, Homo sapiens
gcaucccugucuuuauaua

SEQ ID NO: 725644 - RNA, 19 nt, Homo sapiens
gauucacuaucaacaguuu

SEQ ID NO: 725645 - RNA, 19 nt, Homo sapiens
gaacauugcgauuuggaau

SEQ ID NO: 725646 - RNA, 19 nt, Homo sapiens
caggaaagaaaguaacaua

SEQ ID NO: 725647 - RNA, 19 nt, Homo sapiens
gcuagaagaacacagauau

SEQ ID NO: 725648 - RNA, 19 nt, Homo sapiens
ccuguuagcaugcagaaua

SEQ ID NO: 725649 - RNA, 19 nt, Homo sapiens
uaaagcggcuagaagaaca

SEQ ID NO: 725650 - RNA, 19 nt, Homo sapiens
gggaaauuacugucuuuaa

SEQ ID NO: 725651 - RNA, 19 nt, Homo sapiens
uaaagaccuugaauuugga

SEQ ID NO: 725652 - RNA, 19 nt, Homo sapiens
ugagguggaacuaguaaua

SEQ ID NO: 725653 - RNA, 19 nt, Homo sapiens
gccaugugauuguaauuau

SEQ ID NO: 725654 - RNA, 19 nt, Homo sapiens
gcaaggguauugggaaugg

SEQ ID NO: 725655 - RNA, 19 nt, Homo sapiens
gaccuugaauuuggauuga

SEQ ID NO: 725656 - RNA, 19 nt, Homo sapiens
agaguucccuccuggauug

SEQ ID NO: 725657 - RNA, 19 nt, Homo sapiens
caagaaagcaugcagaaaa

SEQ ID NO: 725658 - RNA, 19 nt, Homo sapiens
uaacuauccugugugagaa

SEQ ID NO: 725659 - RNA, 19 nt, Homo sapiens
acauugcgauuuggaauaa

SEQ ID NO: 725660 - RNA, 19 nt, Homo sapiens
ccaaaucucaucaccauca

SEQ ID NO: 725661 - RNA, 19 nt, Homo sapiens
uaauugaugugacugaagu

SEQ ID NO: 725662 - RNA, 19 nt, Homo sapiens
caagaagaaccaauaguag

SEQ ID NO: 725663 - RNA, 19 nt, Homo sapiens
gguaagcaccagccacaaa

SEQ ID NO: 725664 - RNA, 19 nt, Homo sapiens
gguggagaguucuaauguu

SEQ ID NO: 725665 - RNA, 19 nt, Homo sapiens
cuacagcucauucuaauca

SEQ ID NO: 725666 - RNA, 19 nt, Homo sapiens
gagguggaacuaguaauaa

SEQ ID NO: 725667 - RNA, 19 nt, Homo sapiens
ggguggauaagaacaaaua

SEQ ID NO: 725668 - RNA, 19 nt, Homo sapiens
gaauaauugaugugacuga

SEQ ID NO: 725669 - RNA, 19 nt, Homo sapiens
gaagaguucccuccuggau

SEQ ID NO: 725670 - RNA, 19 nt, Homo sapiens
ugugguaacuuugucaauu

SEQ ID NO: 725671 - RNA, 19 nt, Homo sapiens
agucccaucuuguaaauug

SEQ ID NO: 725672 - RNA, 19 nt, Homo sapiens
gguaacacgcccuaacuau

SEQ ID NO: 725673 - RNA, 19 nt, Homo sapiens
gaaaucugcaguucagcuu

SEQ ID NO: 725674 - RNA, 19 nt, Homo sapiens
cugcaaugaucuacaagaa

SEQ ID NO: 725675 - RNA, 19 nt, Homo sapiens
uagcugcaaugaucuacaa

SEQ ID NO: 725676 - RNA, 19 nt, Homo sapiens
caacuaaagcggcuagaag

SEQ ID NO: 725677 - RNA, 19 nt, Homo sapiens
ggaauggcucguuagaaga

SEQ ID NO: 725678 - RNA, 19 nt, Homo sapiens
gaaauccuguuagcaugca

SEQ ID NO: 725679 - RNA, 19 nt, Homo sapiens
ugacacagcauucauaggu

SEQ ID NO: 725680 - RNA, 19 nt, Homo sapiens
ucuggaacauugcgauuug

SEQ ID NO: 725681 - RNA, 19 nt, Homo sapiens
caauaaacaucuguacaac

SEQ ID NO: 725682 - RNA, 19 nt, Homo sapiens
uauugggaauggcucguua

SEQ ID NO: 725683 - RNA, 19 nt, Homo sapiens
cuaacuauccugugugaga

SEQ ID NO: 725684 - RNA, 19 nt, Homo sapiens
agaagaaccaauaguaguu

SEQ ID NO: 725685 - RNA, 19 nt, Homo sapiens
gggaaacaggcaagaagaa

SEQ ID NO: 725686 - RNA, 19 nt, Homo sapiens
uagaagaacacagauauca

SEQ ID NO: 725687 - RNA, 19 nt, Homo sapiens
gaauaaugugguaacuuug

SEQ ID NO: 725688 - RNA, 19 nt, Homo sapiens
acacagauacaucccacua

SEQ ID NO: 725689 - RNA, 19 nt, Homo sapiens
ggagaguucuaauguugac

SEQ ID NO: 725690 - RNA, 19 nt, Homo sapiens
uacaagaaaucugcaguuc

SEQ ID NO: 725691 - RNA, 19 nt, Homo sapiens
ugaugugacugaagugcaa

SEQ ID NO: 725692 - RNA, 19 nt, Homo sapiens
caggcaagaagaaccaaua

SEQ ID NO: 725693 - RNA, 19 nt, Homo sapiens
gcagaauaaugugguaacu

SEQ ID NO: 725694 - RNA, 19 nt, Homo sapiens
aagggaaauuacugucuuu

SEQ ID NO: 725695 - RNA, 19 nt, Homo sapiens
gugauuacauuagcugcaa

SEQ ID NO: 725696 - RNA, 19 nt, Homo sapiens
ccuugaauuuggauugaaa

SEQ ID NO: 725697 - RNA, 19 nt, Homo sapiens
guaacacgcccuaacuauc

SEQ ID NO: 725698 - RNA, 19 nt, Homo sapiens
cgucucaccugcacauaca

SEQ ID NO: 725699 - RNA, 19 nt, Homo sapiens
ggagucggaggcgauauuu

SEQ ID NO: 725700 - RNA, 19 nt, Homo sapiens
ccuguggccuuuucauuua

SEQ ID NO: 725701 - RNA, 19 nt, Homo sapiens
uuuacucaguggaaagaua

SEQ ID NO: 725702 - RNA, 19 nt, Homo sapiens
ucagaauaauacugugaug

SEQ ID NO: 725703 - RNA, 19 nt, Homo sapiens
gagaaugggaauuucaagu

SEQ ID NO: 725704 - RNA, 19 nt, Homo sapiens
caugcagaauaauguggua

SEQ ID NO: 725705 - RNA, 19 nt, Homo sapiens
cuguuagcaugcagaauaa

SEQ ID NO: 725706 - RNA, 19 nt, Homo sapiens
gccaagaaagcaugcagaa

SEQ ID NO: 725707 - RNA, 19 nt, Homo sapiens
gaauggcucguuagaagag

SEQ ID NO: 725708 - RNA, 19 nt, Homo sapiens
uuacucaguggaaagauaa

SEQ ID NO: 725709 - RNA, 19 nt, Homo sapiens
caacaccaccauugucaag

SEQ ID NO: 725710 - RNA, 19 nt, Homo sapiens
ccgcagugguggagaguuc

SEQ ID NO: 725711 - RNA, 19 nt, Homo sapiens
ggaacauugcgauuuggaa

SEQ ID NO: 725712 - RNA, 19 nt, Homo sapiens
caccaucauuggacuguca

SEQ ID NO: 725713 - RNA, 19 nt, Homo sapiens
agguggaacuaguaauaaa

SEQ ID NO: 725714 - RNA, 19 nt, Homo sapiens
ccaagaaagcaugcagaaa

SEQ ID NO: 725715 - RNA, 19 nt, Homo sapiens
caaggucucuacagcucau

SEQ ID NO: 725716 - RNA, 19 nt, Homo sapiens
gcuugugccuguggccuuu

SEQ ID NO: 725717 - RNA, 19 nt, Homo sapiens
ucaguggaaagauaaacua

SEQ ID NO: 725718 - RNA, 19 nt, Homo sapiens
gaauuucaagucccaucuu

SEQ ID NO: 725719 - RNA, 19 nt, Homo sapiens
ucucuacagcucauucuaa

SEQ ID NO: 725720 - RNA, 19 nt, Homo sapiens
gagugggcaucgaucaaca

SEQ ID NO: 725721 - RNA, 19 nt, Homo sapiens
cuuugucaauuucccauuu

SEQ ID NO: 725722 - RNA, 19 nt, Homo sapiens
ggucuucugugauuauuua

SEQ ID NO: 725723 - RNA, 19 nt, Homo sapiens
gagcugggccuuuccuuua

SEQ ID NO: 725724 - RNA, 19 nt, Homo sapiens
gaaagaaggcuauaagaag

SEQ ID NO: 725725 - RNA, 19 nt, Homo sapiens
gcaaugugcuggauaucaa

SEQ ID NO: 725726 - RNA, 19 nt, Homo sapiens
ggugagaucuggaaaucaa

SEQ ID NO: 725727 - RNA, 19 nt, Homo sapiens
gagaagcccuaccugaguu

SEQ ID NO: 725728 - RNA, 19 nt, Homo sapiens
agaaugagcuccuucgaau

SEQ ID NO: 725729 - RNA, 19 nt, Homo sapiens
ucccuuaacuucucccuua

SEQ ID NO: 725730 - RNA, 19 nt, Homo sapiens
gaucccagcuagacuuaga

SEQ ID NO: 725731 - RNA, 19 nt, Homo sapiens
ggucaacggaauagauuua

SEQ ID NO: 725732 - RNA, 19 nt, Homo sapiens
acucugagaugccacauuu

SEQ ID NO: 725733 - RNA, 19 nt, Homo sapiens
aaagaaggcuauaagaagu

SEQ ID NO: 725734 - RNA, 19 nt, Homo sapiens
ccaagaaugugcacgacaa

SEQ ID NO: 725735 - RNA, 19 nt, Homo sapiens
gcuauaagaaguccucaaa

SEQ ID NO: 725736 - RNA, 19 nt, Homo sapiens
gaugccacauuucauuuga

SEQ ID NO: 725737 - RNA, 19 nt, Homo sapiens
ugaaagaaggcuauaagaa

SEQ ID NO: 725738 - RNA, 19 nt, Homo sapiens
uaaaguuucugcaguccuu

SEQ ID NO: 725739 - RNA, 19 nt, Homo sapiens
gacaagaagcugcguguga

SEQ ID NO: 725740 - RNA, 19 nt, Homo sapiens
gaacuggaagccacugcua

SEQ ID NO: 725741 - RNA, 19 nt, Homo sapiens
cagcuagacuuagaacuug

SEQ ID NO: 725742 - RNA, 19 nt, Homo sapiens
gagcagacaggcaggauug

SEQ ID NO: 725743 - RNA, 19 nt, Homo sapiens
ucagaagagucacaguuug

SEQ ID NO: 725744 - RNA, 19 nt, Homo sapiens
gaugugauccucugcaugu

SEQ ID NO: 725745 - RNA, 19 nt, Homo sapiens
gagaugccacauuucauuu

SEQ ID NO: 725746 - RNA, 19 nt, Homo sapiens
gaacugaggguugcaaugg

SEQ ID NO: 725747 - RNA, 19 nt, Homo sapiens
gagaaugagcuccuucgaa

SEQ ID NO: 725748 - RNA, 19 nt, Homo sapiens
ggaaauugaugggcucucu

SEQ ID NO: 725749 - RNA, 19 nt, Homo sapiens
aaauggguguccacucuuu

SEQ ID NO: 725750 - RNA, 19 nt, Homo sapiens
agaaauggguguccacucu

SEQ ID NO: 725751 - RNA, 19 nt, Homo sapiens
ccacuacgcacaaagaguu

SEQ ID NO: 725752 - RNA, 19 nt, Homo sapiens
gaucgaagaggaaauugau

SEQ ID NO: 725753 - RNA, 19 nt, Homo sapiens
gcacgacaaccacuucugu

SEQ ID NO: 725754 - RNA, 19 nt, Homo sapiens
gggcugaagcggaacauga

SEQ ID NO: 725755 - RNA, 19 nt, Homo sapiens
caaggucacgcaacucuga

SEQ ID NO: 725756 - RNA, 19 nt, Homo sapiens
ugagaugccacauuucauu

SEQ ID NO: 725757 - RNA, 19 nt, Homo sapiens
gaugagauucgacgguuga

SEQ ID NO: 725758 - RNA, 19 nt, Homo sapiens
gcauccguauagcacuuua

SEQ ID NO: 725759 - RNA, 19 nt, Homo sapiens
acaagguccucaucuggaa

SEQ ID NO: 725760 - RNA, 19 nt, Homo sapiens
gaggaaaccgagagaagug

SEQ ID NO: 725761 - RNA, 19 nt, Homo sapiens
acaagaagcugcgugugau

SEQ ID NO: 725762 - RNA, 19 nt, Homo sapiens
cauuugaucuuguacacau

SEQ ID NO: 725763 - RNA, 19 nt, Homo sapiens
gcaguccuuugacacauag

SEQ ID NO: 725764 - RNA, 19 nt, Homo sapiens
gccgaucucuccgucguuu

SEQ ID NO: 725765 - RNA, 19 nt, Homo sapiens
gagauucgacgguugaaag

SEQ ID NO: 725766 - RNA, 19 nt, Homo sapiens
ucagccacuuucagccuua

SEQ ID NO: 725767 - RNA, 19 nt, Homo sapiens
ccagcuagacuuagaacuu

SEQ ID NO: 725768 - RNA, 19 nt, Homo sapiens
cuacucaucccuuaacuuc

SEQ ID NO: 725769 - RNA, 19 nt, Homo sapiens
uuaaggcucccaucaaaga

SEQ ID NO: 725770 - RNA, 19 nt, Homo sapiens
gcaauggggaaaugacuua

SEQ ID NO: 725771 - RNA, 19 nt, Homo sapiens
ugacaaaugacagaacuga

SEQ ID NO: 725772 - RNA, 19 nt, Homo sapiens
ccucuugucuucagggaau

SEQ ID NO: 725773 - RNA, 19 nt, Homo sapiens
gcuccaaguuccggaaugu

SEQ ID NO: 725774 - RNA, 19 nt, Homo sapiens
aggaagacauuuacccaau

SEQ ID NO: 725775 - RNA, 19 nt, Homo sapiens
ucuacaagcuggugacucu

SEQ ID NO: 725776 - RNA, 19 nt, Homo sapiens
caggugagcugggccuuuc

SEQ ID NO: 725777 - RNA, 19 nt, Homo sapiens
gaaauggguguccacucuu

SEQ ID NO: 725778 - RNA, 19 nt, Homo sapiens
gaucuggaaaucaagaaau

SEQ ID NO: 725779 - RNA, 19 nt, Homo sapiens
ucaagaugccaaucccuuu

SEQ ID NO: 725780 - RNA, 19 nt, Homo sapiens
caagaugccaaucccuuug

SEQ ID NO: 725781 - RNA, 19 nt, Homo sapiens
gggaucccagcuagacuua

SEQ ID NO: 725782 - RNA, 19 nt, Homo sapiens
ggaagcgggaucccagcua

SEQ ID NO: 725783 - RNA, 19 nt, Homo sapiens
auuuaaggcucccaucaaa

SEQ ID NO: 725784 - RNA, 19 nt, Homo sapiens
ccacauuucauuugaucuu

SEQ ID NO: 725785 - RNA, 19 nt, Homo sapiens
ugaagguaccacaguguaa

SEQ ID NO: 725786 - RNA, 19 nt, Homo sapiens
uuuguggucuucugugauu

SEQ ID NO: 725787 - RNA, 19 nt, Homo sapiens
gaaacauccgguacuacga

SEQ ID NO: 725788 - RNA, 19 nt, Homo sapiens
ccaaggauagaauugaaau

SEQ ID NO: 725789 - RNA, 19 nt, Homo sapiens
ucccaaggauagaauugaa

SEQ ID NO: 725790 - RNA, 19 nt, Homo sapiens
ccaggcaggguagggauua

SEQ ID NO: 725791 - RNA, 19 nt, Homo sapiens
ccugaccucaugcuaauaa

SEQ ID NO: 725792 - RNA, 19 nt, Homo sapiens
gcagacaggcaggauugaa

SEQ ID NO: 725793 - RNA, 19 nt, Homo sapiens
cagaaggacauccgcauuc

SEQ ID NO: 725794 - RNA, 19 nt, Homo sapiens
caagaagcugcgugugauu

SEQ ID NO: 725795 - RNA, 19 nt, Homo sapiens
gaagguaccacaguguaag

SEQ ID NO: 725796 - RNA, 19 nt, Homo sapiens
agacuuagaacuuggacuu

SEQ ID NO: 725797 - RNA, 19 nt, Homo sapiens
ccagaaggacauccgcauu

SEQ ID NO: 725798 - RNA, 19 nt, Homo sapiens
gaaugagcuccuucgaaug

SEQ ID NO: 725799 - RNA, 19 nt, Homo sapiens
agaagaguguuguggucaa

SEQ ID NO: 725800 - RNA, 19 nt, Homo sapiens
ccacuucugugccgucaac

SEQ ID NO: 725801 - RNA, 19 nt, Homo sapiens
gcugggccuuuccuuuaug

SEQ ID NO: 725802 - RNA, 19 nt, Homo sapiens
uauacuccauaccugcuuu

SEQ ID NO: 725803 - RNA, 19 nt, Homo sapiens
gguguccacucuuuucuuu

SEQ ID NO: 725804 - RNA, 19 nt, Homo sapiens
ugcaguccuuugacacaua

SEQ ID NO: 725805 - RNA, 19 nt, Homo sapiens
acaaugggcccacgaccaa

SEQ ID NO: 725806 - RNA, 19 nt, Homo sapiens
acuggaagccaaccucuaa

SEQ ID NO: 725807 - RNA, 19 nt, Homo sapiens
gcagcaggaugagauucga

SEQ ID NO: 725808 - RNA, 19 nt, Homo sapiens
ccacgugcaaggacaagaa

SEQ ID NO: 725809 - RNA, 19 nt, Homo sapiens
caucuccuccucccacauu

SEQ ID NO: 725810 - RNA, 19 nt, Homo sapiens
ucagggaauucagaggauu

SEQ ID NO: 725811 - RNA, 19 nt, Homo sapiens
aaugagcuccuucgaaugu

SEQ ID NO: 725812 - RNA, 19 nt, Homo sapiens
gagaucccgugcugauguc

SEQ ID NO: 725813 - RNA, 19 nt, Homo sapiens
cgagaucccgugcugaugu

SEQ ID NO: 725814 - RNA, 19 nt, Homo sapiens
uggaaagggugauggaaac

SEQ ID NO: 725815 - RNA, 19 nt, Homo sapiens
cguuucuacucaucccuua

SEQ ID NO: 725816 - RNA, 19 nt, Homo sapiens
gacagagaaugagcuccuu

SEQ ID NO: 725817 - RNA, 19 nt, Homo sapiens
gcacugagaagcccuaccu

SEQ ID NO: 725818 - RNA, 19 nt, Homo sapiens
ggagcagacaggcaggauu

SEQ ID NO: 725819 - RNA, 19 nt, Homo sapiens
gaaagggugauggaaacau

SEQ ID NO: 725820 - RNA, 19 nt, Homo sapiens
ccacucuuuucuuucauua

SEQ ID NO: 725821 - RNA, 19 nt, Homo sapiens
gagagaaguggcccaaggu

SEQ ID NO: 725822 - RNA, 19 nt, Homo sapiens
gaacacgucucuagaaaua

SEQ ID NO: 725823 - RNA, 19 nt, Homo sapiens
gcgaagagcugaccaaaua

SEQ ID NO: 725824 - RNA, 19 nt, Homo sapiens
gaauaaagcugugagcaaa

SEQ ID NO: 725825 - RNA, 19 nt, Homo sapiens
gcagaaauguugaaaguca

SEQ ID NO: 725826 - RNA, 19 nt, Homo sapiens
gaaugacgaugccuucaaa

SEQ ID NO: 725827 - RNA, 19 nt, Homo sapiens
uaacagagauuugccuaaa

SEQ ID NO: 725828 - RNA, 19 nt, Homo sapiens
gagacuuuauugccuauua

SEQ ID NO: 725829 - RNA, 19 nt, Homo sapiens
gagcaacacuggcauaaca

SEQ ID NO: 725830 - RNA, 19 nt, Homo sapiens
gaaaguuaaugucaaggaa

SEQ ID NO: 725831 - RNA, 19 nt, Homo sapiens
gaaauaaucccaucagagu

SEQ ID NO: 725832 - RNA, 19 nt, Homo sapiens
gcagagaguuuggcagaaa

SEQ ID NO: 725833 - RNA, 19 nt, Homo sapiens
gcaaaggccucacgcaucu

SEQ ID NO: 725834 - RNA, 19 nt, Homo sapiens
gaaugaugccagaaacuua

SEQ ID NO: 725835 - RNA, 19 nt, Homo sapiens
gaagaugagaagcggauua

SEQ ID NO: 725836 - RNA, 19 nt, Homo sapiens
gaaagucaaccagacguua

SEQ ID NO: 725837 - RNA, 19 nt, Homo sapiens
agaaucagaucacagcuaa

SEQ ID NO: 725838 - RNA, 19 nt, Homo sapiens
agaagcaauuccagaaaua

SEQ ID NO: 725839 - RNA, 19 nt, Homo sapiens
agaaugcccucagcucuua

SEQ ID NO: 725840 - RNA, 19 nt, Homo sapiens
uaaauacacugugaagaga

SEQ ID NO: 725841 - RNA, 19 nt, Homo sapiens
cagaacacgucucuagaaa

SEQ ID NO: 725842 - RNA, 19 nt, Homo sapiens
acaacaaucucaacgacua

SEQ ID NO: 725843 - RNA, 19 nt, Homo sapiens
gcgaggagguguccgaguu

SEQ ID NO: 725844 - RNA, 19 nt, Homo sapiens
acacgcagcugaagaugaa

SEQ ID NO: 725845 - RNA, 19 nt, Homo sapiens
ggaagagacagaagcaauu

SEQ ID NO: 725846 - RNA, 19 nt, Homo sapiens
ggcaagagguggagauugu

SEQ ID NO: 725847 - RNA, 19 nt, Homo sapiens
gcagaacacgucucuagaa

SEQ ID NO: 725848 - RNA, 19 nt, Homo sapiens
ucacugagguccaucugaa

SEQ ID NO: 725849 - RNA, 19 nt, Homo sapiens
agaagcggauuaucuguuu

SEQ ID NO: 725850 - RNA, 19 nt, Homo sapiens
acaacuugcugaagaauga

SEQ ID NO: 725851 - RNA, 19 nt, Homo sapiens
gaagacaaguugcuguuuu

SEQ ID NO: 725852 - RNA, 19 nt, Homo sapiens
ggaauaaagcugugagcaa

SEQ ID NO: 725853 - RNA, 19 nt, Homo sapiens
aaaaugaacucaacgauga

SEQ ID NO: 725854 - RNA, 19 nt, Homo sapiens
caaagaaugaugccagaaa

SEQ ID NO: 725855 - RNA, 19 nt, Homo sapiens
caaauucuucuuccacuuu

SEQ ID NO: 725856 - RNA, 19 nt, Homo sapiens
acagugagauggaaauaau

SEQ ID NO: 725857 - RNA, 19 nt, Homo sapiens
gaagcaauuccagaaauaa

SEQ ID NO: 725858 - RNA, 19 nt, Homo sapiens
cuaaguacccgcuacaauu

SEQ ID NO: 725859 - RNA, 19 nt, Homo sapiens
cagaagcaauuccagaaau

SEQ ID NO: 725860 - RNA, 19 nt, Homo sapiens
guaaauacacugugaagag

SEQ ID NO: 725861 - RNA, 19 nt, Homo sapiens
ccaccggcauccucaauga

SEQ ID NO: 725862 - RNA, 19 nt, Homo sapiens
guggacaacuugcugaaga

SEQ ID NO: 725863 - RNA, 19 nt, Homo sapiens
caaagucuaugaagaugag

SEQ ID NO: 725864 - RNA, 19 nt, Homo sapiens
gaacagcaaaucaaucucu

SEQ ID NO: 725865 - RNA, 19 nt, Homo sapiens
gcaaguccaugcugcuaca

SEQ ID NO: 725866 - RNA, 19 nt, Homo sapiens
gagcagggccacagugaga

SEQ ID NO: 725867 - RNA, 19 nt, Homo sapiens
ucggcaaacucccuaagua

SEQ ID NO: 725868 - RNA, 19 nt, Homo sapiens
uggcagaaauguugaaagu

SEQ ID NO: 725869 - RNA, 19 nt, Homo sapiens
ugaccuauuuggguuuaua

SEQ ID NO: 725870 - RNA, 19 nt, Homo sapiens
guccaaagccaaacagaaa

SEQ ID NO: 725871 - RNA, 19 nt, Homo sapiens
gaagaugaauuugggaaaa

SEQ ID NO: 725872 - RNA, 19 nt, Homo sapiens
gcauccaaauggcugcuuu

SEQ ID NO: 725873 - RNA, 19 nt, Homo sapiens
cguguuugauggauuagua

SEQ ID NO: 725874 - RNA, 19 nt, Homo sapiens
gccaagugauuguaaguca

SEQ ID NO: 725875 - RNA, 19 nt, Homo sapiens
gaugagaagcggauuaucu

SEQ ID NO: 725876 - RNA, 19 nt, Homo sapiens
gaagaacagcaaaucaauc

SEQ ID NO: 725877 - RNA, 19 nt, Homo sapiens
gggaaucgcaggcuuggaa

SEQ ID NO: 725878 - RNA, 19 nt, Homo sapiens
ucucagcacuuucccaugu

SEQ ID NO: 725879 - RNA, 19 nt, Homo sapiens
cuaaauggaaaccugauaa

SEQ ID NO: 725880 - RNA, 19 nt, Homo sapiens
aaccagacguuaaagcauu

SEQ ID NO: 725881 - RNA, 19 nt, Homo sapiens
gacagaagcaauuccagaa

SEQ ID NO: 725882 - RNA, 19 nt, Homo sapiens
gaagagacagaagcaauuc

SEQ ID NO: 725883 - RNA, 19 nt, Homo sapiens
ccacgggcuuuuaauuuua

SEQ ID NO: 725884 - RNA, 19 nt, Homo sapiens
ggaaaguuaaugucaagga

SEQ ID NO: 725885 - RNA, 19 nt, Homo sapiens
gagaagcggauuaucuguu

SEQ ID NO: 725886 - RNA, 19 nt, Homo sapiens
ggaagacaaguugcuguuu

SEQ ID NO: 725887 - RNA, 19 nt, Homo sapiens
gaccagcaguccuaugagu

SEQ ID NO: 725888 - RNA, 19 nt, Homo sapiens
gcaauuuccuucgguuucu

SEQ ID NO: 725889 - RNA, 19 nt, Homo sapiens
gggaacuucuggucacuca

SEQ ID NO: 725890 - RNA, 19 nt, Homo sapiens
cuagaucacuuguccucuu

SEQ ID NO: 725891 - RNA, 19 nt, Homo sapiens
ugugguggcugcuccauga

SEQ ID NO: 725892 - RNA, 19 nt, Homo sapiens
gaguuuggcagaaauguug

SEQ ID NO: 725893 - RNA, 19 nt, Homo sapiens
gaagagcugaccaaauaca

SEQ ID NO: 725894 - RNA, 19 nt, Homo sapiens
uaaaggugcuaagcgaaga

SEQ ID NO: 725895 - RNA, 19 nt, Homo sapiens
gaaaagcaaucgggaacuu

SEQ ID NO: 725896 - RNA, 19 nt, Homo sapiens
ggacacacgcagcugaaga

SEQ ID NO: 725897 - RNA, 19 nt, Homo sapiens
ccgcucauuuguuaauaaa

SEQ ID NO: 725898 - RNA, 19 nt, Homo sapiens
gagaaugcccucagcucuu

SEQ ID NO: 725899 - RNA, 19 nt, Homo sapiens
gcguaaaccagaucacuga

SEQ ID NO: 725900 - RNA, 19 nt, Homo sapiens
gcacgaugacccugacaga

SEQ ID NO: 725901 - RNA, 19 nt, Homo sapiens
uggaggagaucuacaugga

SEQ ID NO: 725902 - RNA, 19 nt, Homo sapiens
ggccuuggcugcuggagau

SEQ ID NO: 725903 - RNA, 19 nt, Homo sapiens
gaacuucuggucacucaca

SEQ ID NO: 725904 - RNA, 19 nt, Homo sapiens
cuugcccgcucauuuguua

SEQ ID NO: 725905 - RNA, 19 nt, Homo sapiens
gugauucugucccuccaaa

SEQ ID NO: 725906 - RNA, 19 nt, Homo sapiens
ccagcaguccuaugaguuu

SEQ ID NO: 725907 - RNA, 19 nt, Homo sapiens
cgaugacccugacagaugu

SEQ ID NO: 725908 - RNA, 19 nt, Homo sapiens
uaaguacccgcuacaauuc

SEQ ID NO: 725909 - RNA, 19 nt, Homo sapiens
ccagcuggcagaugcguua

SEQ ID NO: 725910 - RNA, 19 nt, Homo sapiens
caaaucaaucucugagguu

SEQ ID NO: 725911 - RNA, 19 nt, Homo sapiens
gugaagaacagcaaaucaa

SEQ ID NO: 725912 - RNA, 19 nt, Homo sapiens
uggcaaagauagagaaugc

SEQ ID NO: 725913 - RNA, 19 nt, Homo sapiens
gccaaagucuaugaagaug

SEQ ID NO: 725914 - RNA, 19 nt, Homo sapiens
ggccaaagucuaugaagau

SEQ ID NO: 725915 - RNA, 19 nt, Homo sapiens
cagcagaacacgucucuag

SEQ ID NO: 725916 - RNA, 19 nt, Homo sapiens
ccaacggcaucuccacaga

SEQ ID NO: 725917 - RNA, 19 nt, Homo sapiens
cggcagcccugaggagaaa

SEQ ID NO: 725918 - RNA, 19 nt, Homo sapiens
uagaucacuuguccucuug

SEQ ID NO: 725919 - RNA, 19 nt, Homo sapiens
gcugaagggugacuaaacg

SEQ ID NO: 725920 - RNA, 19 nt, Homo sapiens
aggcuacccuccucuagaa

SEQ ID NO: 725921 - RNA, 19 nt, Homo sapiens
cagaggaggccaaagucua

SEQ ID NO: 725922 - RNA, 19 nt, Homo sapiens
gaagagagcuccauuggua

SEQ ID NO: 725923 - RNA, 19 nt, Homo sapiens
gaacaaggcauccguuaua

SEQ ID NO: 725924 - RNA, 19 nt, Homo sapiens
ucaccuaacuugcagaaua

SEQ ID NO: 725925 - RNA, 19 nt, Homo sapiens
gaugaaagcuauacuccaa

SEQ ID NO: 725926 - RNA, 19 nt, Homo sapiens
aaacaacagugaagacauu

SEQ ID NO: 725927 - RNA, 19 nt, Homo sapiens
ccaaguggcuggauucaug

SEQ ID NO: 725928 - RNA, 19 nt, Homo sapiens
caugauguaucguucaaua

SEQ ID NO: 725929 - RNA, 19 nt, Homo sapiens
gaagccaacucguucauuc

SEQ ID NO: 725930 - RNA, 19 nt, Homo sapiens
ggaagagacacccauauga

SEQ ID NO: 725931 - RNA, 19 nt, Homo sapiens
gagcuccauugguaaauuu

SEQ ID NO: 725932 - RNA, 19 nt, Homo sapiens
gaacauccaauucagaaga

SEQ ID NO: 725933 - RNA, 19 nt, Homo sapiens
cuacaaaucugaugaaagc

SEQ ID NO: 725934 - RNA, 19 nt, Homo sapiens
caagaucucagucagagua

SEQ ID NO: 725935 - RNA, 19 nt, Homo sapiens
ggaaccaaguggcuggauu

SEQ ID NO: 725936 - RNA, 19 nt, Homo sapiens
caaaucugaugaaagcuau

SEQ ID NO: 725937 - RNA, 19 nt, Homo sapiens
ugaauagucucgcccuaga

SEQ ID NO: 725938 - RNA, 19 nt, Homo sapiens
aggcauccguuauaucuaa

SEQ ID NO: 725939 - RNA, 19 nt, Homo sapiens
gaagagacacccauaugag

SEQ ID NO: 725940 - RNA, 19 nt, Homo sapiens
gaugguugcagguugaaua

SEQ ID NO: 725941 - RNA, 19 nt, Homo sapiens
gaaauucggcaacuugagu

SEQ ID NO: 725942 - RNA, 19 nt, Homo sapiens
caccuaacuugcagaauau

SEQ ID NO: 725943 - RNA, 19 nt, Homo sapiens
gaaccaaguggcuggauuc

SEQ ID NO: 725944 - RNA, 19 nt, Homo sapiens
gaacaguacgggaaauugg

SEQ ID NO: 725945 - RNA, 19 nt, Homo sapiens
uuuccuagauguacaacua

SEQ ID NO: 725946 - RNA, 19 nt, Homo sapiens
cauaagaagccaacucguu

SEQ ID NO: 725947 - RNA, 19 nt, Homo sapiens
caacagugaagacauuaug

SEQ ID NO: 725948 - RNA, 19 nt, Homo sapiens
gauuuggaguggaucaguu

SEQ ID NO: 725949 - RNA, 19 nt, Homo sapiens
caaggcauccguuauaucu

SEQ ID NO: 725950 - RNA, 19 nt, Homo sapiens
ucauguaccuuuauugaac

SEQ ID NO: 725951 - RNA, 19 nt, Homo sapiens
acccauaugagacaaauua

SEQ ID NO: 725952 - RNA, 19 nt, Homo sapiens
gccaaucaccugaauggaa

SEQ ID NO: 725953 - RNA, 19 nt, Homo sapiens
cauguucccuuaacugaca

SEQ ID NO: 725954 - RNA, 19 nt, Homo sapiens
gacuacaaaucugaugaaa

SEQ ID NO: 725955 - RNA, 19 nt, Homo sapiens
guggaucaguuacgagaug

SEQ ID NO: 725956 - RNA, 19 nt, Homo sapiens
cgcccuagaucucaccuaa

SEQ ID NO: 725957 - RNA, 19 nt, Homo sapiens
ucacaaccuacaagaaauu

SEQ ID NO: 725958 - RNA, 19 nt, Homo sapiens
ggaacaguacgggaaauug

SEQ ID NO: 725959 - RNA, 19 nt, Homo sapiens
gguaaauuuccuagaugua

SEQ ID NO: 725960 - RNA, 19 nt, Homo sapiens
guagaagagagcuccauug

SEQ ID NO: 725961 - RNA, 19 nt, Homo sapiens
ggaggugccgagaaucuga

SEQ ID NO: 725962 - RNA, 19 nt, Homo sapiens
ggauucauguucccuuaac

SEQ ID NO: 725963 - RNA, 19 nt, Homo sapiens
ucagucagaguaggaaaua

SEQ ID NO: 725964 - RNA, 19 nt, Homo sapiens
cuagaucucaccuaacuug

SEQ ID NO: 725965 - RNA, 19 nt, Homo sapiens
gauguaucguucaauaagg

SEQ ID NO: 725966 - RNA, 19 nt, Homo sapiens
aaugaugguugcagguuga

SEQ ID NO: 725967 - RNA, 19 nt, Homo sapiens
gguugcagguugaauaguc

SEQ ID NO: 725968 - RNA, 19 nt, Homo sapiens
gugccgagaaucugaguuu

SEQ ID NO: 725969 - RNA, 19 nt, Homo sapiens
cuggauucauguucccuua

SEQ ID NO: 725970 - RNA, 19 nt, Homo sapiens
acaaaucugaugaaagcua

SEQ ID NO: 725971 - RNA, 19 nt, Homo sapiens
acaggacauucaguuagua

SEQ ID NO: 725972 - RNA, 19 nt, Homo sapiens
acaagaaauucggcaacuu

SEQ ID NO: 725973 - RNA, 19 nt, Homo sapiens
guaaauuuccuagauguac

SEQ ID NO: 725974 - RNA, 19 nt, Homo sapiens
gaucucagucagaguagga

SEQ ID NO: 725975 - RNA, 19 nt, Homo sapiens
uuuggucacucucaucuug

SEQ ID NO: 725976 - RNA, 19 nt, Homo sapiens
aacaaggcauccguuauau

SEQ ID NO: 725977 - RNA, 19 nt, Homo sapiens
aauauacacaccaguagaa

SEQ ID NO: 725978 - RNA, 19 nt, Homo sapiens
guauuuaugcagacuacaa

SEQ ID NO: 725979 - RNA, 19 nt, Homo sapiens
guaaugaugguugcagguu

SEQ ID NO: 725980 - RNA, 19 nt, Homo sapiens
cauguaccuuuauugaaca

SEQ ID NO: 725981 - RNA, 19 nt, Homo sapiens
uccuagauguacaacuaua

SEQ ID NO: 725982 - RNA, 19 nt, Homo sapiens
ucccuuaacugacaaucau

SEQ ID NO: 725983 - RNA, 19 nt, Homo sapiens
ggaaauugggucacaagcu

SEQ ID NO: 725984 - RNA, 19 nt, Homo sapiens
agagcuccauugguaaauu

SEQ ID NO: 725985 - RNA, 19 nt, Homo sapiens
uagaagagagcuccauugg

SEQ ID NO: 725986 - RNA, 19 nt, Homo sapiens
aagagacacccauaugaga

SEQ ID NO: 725987 - RNA, 19 nt, Homo sapiens
gccaacucguucauucaug

SEQ ID NO: 725988 - RNA, 19 nt, Homo sapiens
aacauccaauucagaagaa

SEQ ID NO: 725989 - RNA, 19 nt, Homo sapiens
ugaacaaggcauccguuau

SEQ ID NO: 725990 - RNA, 19 nt, Homo sapiens
ugguaaauuuccuagaugu

SEQ ID NO: 725991 - RNA, 19 nt, Homo sapiens
agagagcuccauugguaaa

SEQ ID NO: 725992 - RNA, 19 nt, Homo sapiens
caggacauucaguuaguaa

SEQ ID NO: 725993 - RNA, 19 nt, Homo sapiens
uggaagagacacccauaug

SEQ ID NO: 725994 - RNA, 19 nt, Homo sapiens
aacaggacauucaguuagu

SEQ ID NO: 725995 - RNA, 19 nt, Homo sapiens
ccaagcaagaucucaguca

SEQ ID NO: 725996 - RNA, 19 nt, Homo sapiens
gaugacaaucuagaaacuu

SEQ ID NO: 725997 - RNA, 19 nt, Homo sapiens
ggggucauauuaucuuuau

SEQ ID NO: 725998 - RNA, 19 nt, Homo sapiens
gagacacccauaugagaca

SEQ ID NO: 725999 - RNA, 19 nt, Homo sapiens
cccuagaucucaccuaacu

SEQ ID NO: 726000 - RNA, 19 nt, Homo sapiens
gucagaguaggaaauaauu

SEQ ID NO: 726001 - RNA, 19 nt, Homo sapiens
uguaacaggacauucaguu

SEQ ID NO: 726002 - RNA, 19 nt, Homo sapiens
gaugguucccagccucauu

SEQ ID NO: 726003 - RNA, 19 nt, Homo sapiens
cuagauguacaacuauaga

SEQ ID NO: 726004 - RNA, 19 nt, Homo sapiens
aaauauacacaccaguaga

SEQ ID NO: 726005 - RNA, 19 nt, Homo sapiens
uaagaagccaacucguuca

SEQ ID NO: 726006 - RNA, 19 nt, Homo sapiens
caagcuguuuggucacucu

SEQ ID NO: 726007 - RNA, 19 nt, Homo sapiens
gaauagucucgcccuagau

SEQ ID NO: 726008 - RNA, 19 nt, Homo sapiens
ucaguuacgagaugacaau

SEQ ID NO: 726009 - RNA, 19 nt, Homo sapiens
gauuucaugauguaucguu

SEQ ID NO: 726010 - RNA, 19 nt, Homo sapiens
uagauuucaugauguaucg

SEQ ID NO: 726011 - RNA, 19 nt, Homo sapiens
acucucaucuugcaaacca

SEQ ID NO: 726012 - RNA, 19 nt, Homo sapiens
aaagcuauacuccaagcaa

SEQ ID NO: 726013 - RNA, 19 nt, Homo sapiens
agacuacaaaucugaugaa

SEQ ID NO: 726014 - RNA, 19 nt, Homo sapiens
ccuaacuugcagaauauuu

SEQ ID NO: 726015 - RNA, 19 nt, Homo sapiens
guucaauaaggugacuuua

SEQ ID NO: 726016 - RNA, 19 nt, Homo sapiens
ugauguaucguucaauaag

SEQ ID NO: 726017 - RNA, 19 nt, Homo sapiens
ccuuaacugacaaucauaa

SEQ ID NO: 726018 - RNA, 19 nt, Homo sapiens
uugaacaaggcauccguua

SEQ ID NO: 726019 - RNA, 19 nt, Homo sapiens
uugguaaauuuccuagaug

SEQ ID NO: 726020 - RNA, 19 nt, Homo sapiens
guucccagccucauuuagu

SEQ ID NO: 726021 - RNA, 19 nt, Homo sapiens
acacccauaugagacaaau

SEQ ID NO: 726022 - RNA, 19 nt, Homo sapiens
gcucauaaauccagacuuc

SEQ ID NO: 726023 - RNA, 19 nt, Homo sapiens
gaaggacgguggaguagug

SEQ ID NO: 726024 - RNA, 19 nt, Homo sapiens
ggaguaguguccucgcuaa

SEQ ID NO: 726025 - RNA, 19 nt, Homo sapiens
gaggcaaccuugucucuau

SEQ ID NO: 726026 - RNA, 19 nt, Homo sapiens
ggaagaagacauuguugaa

SEQ ID NO: 726027 - RNA, 19 nt, Homo sapiens
caaaggagcaggagagaga

SEQ ID NO: 726028 - RNA, 19 nt, Homo sapiens
caagaaggacgguggagua

SEQ ID NO: 726029 - RNA, 19 nt, Homo sapiens
caaccucuccugcucauaa

SEQ ID NO: 726030 - RNA, 19 nt, Homo sapiens
gaugggagccacuggaauu

SEQ ID NO: 726031 - RNA, 19 nt, Homo sapiens
ggacccagcugccuuagac

SEQ ID NO: 726032 - RNA, 19 nt, Homo sapiens
caacuucaacuaucgcauu

SEQ ID NO: 726033 - RNA, 19 nt, Homo sapiens
aagaagacauuguugaagu

SEQ ID NO: 726034 - RNA, 19 nt, Homo sapiens
gggaagaagacauuguuga

SEQ ID NO: 726035 - RNA, 19 nt, Homo sapiens
gggaacaguuucugcucuu

SEQ ID NO: 726036 - RNA, 19 nt, Homo sapiens
gaagaagacauuguugaag

SEQ ID NO: 726037 - RNA, 19 nt, Homo sapiens
ugacuucaacuucaacuau

SEQ ID NO: 726038 - RNA, 19 nt, Homo sapiens
gaacaguuucugcucuuca

SEQ ID NO: 726039 - RNA, 19 nt, Homo sapiens
ggaaguccaaggugcaaga

SEQ ID NO: 726040 - RNA, 19 nt, Homo sapiens
agaagacauuguugaagug

SEQ ID NO: 726041 - RNA, 19 nt, Homo sapiens
gaccugccgcuaccuauug

SEQ ID NO: 726042 - RNA, 19 nt, Homo sapiens
caacuuugaggaugaggaa

SEQ ID NO: 726043 - RNA, 19 nt, Homo sapiens
aagacaacuuugaggauga

SEQ ID NO: 726044 - RNA, 19 nt, Homo sapiens
ggaacaguuucugcucuuc

SEQ ID NO: 726045 - RNA, 19 nt, Homo sapiens
gacuucaacuucaacuauc

SEQ ID NO: 726046 - RNA, 19 nt, Homo sapiens
ggaggcaaccuugucucua

SEQ ID NO: 726047 - RNA, 19 nt, Homo sapiens
gaagugcagggaaguccaa

SEQ ID NO: 726048 - RNA, 19 nt, Homo sapiens
uauacuagacacacaaaga

SEQ ID NO: 726049 - RNA, 19 nt, Homo sapiens
ugacggaggaggugauuca

SEQ ID NO: 726050 - RNA, 19 nt, Homo sapiens
ggaucuggauaguucaaag

SEQ ID NO: 726051 - RNA, 19 nt, Homo sapiens
gggcuauacuagacacaca

SEQ ID NO: 726052 - RNA, 19 nt, Homo sapiens
gcaccaaaggagguuauug

SEQ ID NO: 726053 - RNA, 19 nt, Homo sapiens
caagaccugccgcuaccua

SEQ ID NO: 726054 - RNA, 19 nt, Homo sapiens
gcuaaaagacaguagauau

SEQ ID NO: 726055 - RNA, 19 nt, Homo sapiens
ggaaggggcuauacuagac

SEQ ID NO: 726056 - RNA, 19 nt, Homo sapiens
cagggaagaagacauuguu

SEQ ID NO: 726057 - RNA, 19 nt, Homo sapiens
gcuauacuagacacacaaa

SEQ ID NO: 726058 - RNA, 19 nt, Homo sapiens
acaagcaacugcccuucgu

SEQ ID NO: 726059 - RNA, 19 nt, Homo sapiens
gcuccuguguggcccuaug

SEQ ID NO: 726060 - RNA, 19 nt, Homo sapiens
gggagccacuggaauuuug

SEQ ID NO: 726061 - RNA, 19 nt, Homo sapiens
ggagcaggagagagacuug

SEQ ID NO: 726062 - RNA, 19 nt, Homo sapiens
aaagacaguagauaugcaa

SEQ ID NO: 726063 - RNA, 19 nt, Homo sapiens
uugcagaagcucagaaugu

SEQ ID NO: 726064 - RNA, 19 nt, Homo sapiens
gcacuagcacagucaacca

SEQ ID NO: 726065 - RNA, 19 nt, Homo sapiens
ugcagaagcucagaauguc

SEQ ID NO: 726066 - RNA, 19 nt, Homo sapiens
cuucgucugcuccuucuaa

SEQ ID NO: 726067 - RNA, 19 nt, Homo sapiens
aaccucuccugcucauaaa

SEQ ID NO: 726068 - RNA, 19 nt, Homo sapiens
uccaugacuucaacuucaa

SEQ ID NO: 726069 - RNA, 19 nt, Homo sapiens
auccaugacuucaacuuca

SEQ ID NO: 726070 - RNA, 19 nt, Homo sapiens
gcagaagcucagaaugucu

SEQ ID NO: 726071 - RNA, 19 nt, Homo sapiens
uggagagccuagagacaca

SEQ ID NO: 726072 - RNA, 19 nt, Homo sapiens
gaguaguguccucgcuaaa

SEQ ID NO: 726073 - RNA, 19 nt, Homo sapiens
gaaaugagccgaugucgua

SEQ ID NO: 726074 - RNA, 19 nt, Homo sapiens
gaaacgaagugacgauuca

SEQ ID NO: 726075 - RNA, 19 nt, Homo sapiens
ggacagagaugccauugag

SEQ ID NO: 726076 - RNA, 19 nt, Homo sapiens
aggcugagcuguccuauaa

SEQ ID NO: 726077 - RNA, 19 nt, Homo sapiens
gaaccuggaggacuaauuu

SEQ ID NO: 726078 - RNA, 19 nt, Homo sapiens
ccagaacacugaaaccaaa

SEQ ID NO: 726079 - RNA, 19 nt, Homo sapiens
caucaaggcugccaucaug

SEQ ID NO: 726080 - RNA, 19 nt, Homo sapiens
gaacugaagagacgcaauu

SEQ ID NO: 726081 - RNA, 19 nt, Homo sapiens
gcaggcgucuaaauacuuu

SEQ ID NO: 726082 - RNA, 19 nt, Homo sapiens
gaaagaagccggacaccau

SEQ ID NO: 726083 - RNA, 19 nt, Homo sapiens
cuacagaucuaccaauaug

SEQ ID NO: 726084 - RNA, 19 nt, Homo sapiens
gcagaaauacucacuccua

SEQ ID NO: 726085 - RNA, 19 nt, Homo sapiens
ccaaagcucucaccaaugg

SEQ ID NO: 726086 - RNA, 19 nt, Homo sapiens
gaccuugacuggaauaugu

SEQ ID NO: 726087 - RNA, 19 nt, Homo sapiens
cagaaauacucacuccuaa

SEQ ID NO: 726088 - RNA, 19 nt, Homo sapiens
ccaaggaacuguccagcuu

SEQ ID NO: 726089 - RNA, 19 nt, Homo sapiens
uuaagaaccuggaggacua

SEQ ID NO: 726090 - RNA, 19 nt, Homo sapiens
ggaucaagguuccagacua

SEQ ID NO: 726091 - RNA, 19 nt, Homo sapiens
gcacaaagcgcccucaaag

SEQ ID NO: 726092 - RNA, 19 nt, Homo sapiens
ucauagaccuugacuggaa

SEQ ID NO: 726093 - RNA, 19 nt, Homo sapiens
gaaauacucacuccuaaag

SEQ ID NO: 726094 - RNA, 19 nt, Homo sapiens
ccucaacucuguaucacua

SEQ ID NO: 726095 - RNA, 19 nt, Homo sapiens
ugacucagcugacuaccaa

SEQ ID NO: 726096 - RNA, 19 nt, Homo sapiens
gaaugaaggugccauagac

SEQ ID NO: 726097 - RNA, 19 nt, Homo sapiens
uaacggcccugcuggagaa

SEQ ID NO: 726098 - RNA, 19 nt, Homo sapiens
uaaagcgccuacuuaaaga

SEQ ID NO: 726099 - RNA, 19 nt, Homo sapiens
gggcaaaccagaucagaaa

SEQ ID NO: 726100 - RNA, 19 nt, Homo sapiens
gcugagcuguccuauaaga

SEQ ID NO: 726101 - RNA, 19 nt, Homo sapiens
gaagucaaagagaaguuua

SEQ ID NO: 726102 - RNA, 19 nt, Homo sapiens
gggaauaacggcucuguga

SEQ ID NO: 726103 - RNA, 19 nt, Homo sapiens
gaucaagguuccagacuac

SEQ ID NO: 726104 - RNA, 19 nt, Homo sapiens
cagcugaaguuguaaagau

SEQ ID NO: 726105 - RNA, 19 nt, Homo sapiens
aaaccuagcugccacucaa

SEQ ID NO: 726106 - RNA, 19 nt, Homo sapiens
ucacaagccuggcacuuuc

SEQ ID NO: 726107 - RNA, 19 nt, Homo sapiens
gggcuucgauccuuucaau

SEQ ID NO: 726108 - RNA, 19 nt, Homo sapiens
gugaugaagcuagaaauua

SEQ ID NO: 726109 - RNA, 19 nt, Homo sapiens
gcacagcuuuaugaagauu

SEQ ID NO: 726110 - RNA, 19 nt, Homo sapiens
aaaucuaggugaucacuga

SEQ ID NO: 726111 - RNA, 19 nt, Homo sapiens
ggacagccaaacugaaauu

SEQ ID NO: 726112 - RNA, 19 nt, Homo sapiens
ccugagcgcucccucguuu

SEQ ID NO: 726113 - RNA, 19 nt, Homo sapiens
gaaggacagucugcuuaug

SEQ ID NO: 726114 - RNA, 19 nt, Homo sapiens
ugaugaagcuagaaauuag

SEQ ID NO: 726115 - RNA, 19 nt, Homo sapiens
ccaaagacaccaaaucuag

SEQ ID NO: 726116 - RNA, 19 nt, Homo sapiens
ggacuaauuuacccaaagg

SEQ ID NO: 726117 - RNA, 19 nt, Homo sapiens
uugagggucuguauucaua

SEQ ID NO: 726118 - RNA, 19 nt, Homo sapiens
gugugcagcugaaguugua

SEQ ID NO: 726119 - RNA, 19 nt, Homo sapiens
gauccuaacacaaauugaa

SEQ ID NO: 726120 - RNA, 19 nt, Homo sapiens
gcucgagacuacguuguuu

SEQ ID NO: 726121 - RNA, 19 nt, Homo sapiens
ggaggucagucauugaagu

SEQ ID NO: 726122 - RNA, 19 nt, Homo sapiens
caaccuggccgugugcuua

SEQ ID NO: 726123 - RNA, 19 nt, Homo sapiens
ggccaagccucaacucugu

SEQ ID NO: 726124 - RNA, 19 nt, Homo sapiens
cagccaaacugaaauuuac

SEQ ID NO: 726125 - RNA, 19 nt, Homo sapiens
uggauggccuguuuaaaga

SEQ ID NO: 726126 - RNA, 19 nt, Homo sapiens
gaucagaaagauuugaaug

SEQ ID NO: 726127 - RNA, 19 nt, Homo sapiens
caaaccagaucagaaagau

SEQ ID NO: 726128 - RNA, 19 nt, Homo sapiens
gcaaaccagaucagaaaga

SEQ ID NO: 726129 - RNA, 19 nt, Homo sapiens
ucaacacccugaagagaga

SEQ ID NO: 726130 - RNA, 19 nt, Homo sapiens
gaauggguucuguguguaa

SEQ ID NO: 726131 - RNA, 19 nt, Homo sapiens
gugcagaguugacuuaagg

SEQ ID NO: 726132 - RNA, 19 nt, Homo sapiens
cgaacaaacucucggaaac

SEQ ID NO: 726133 - RNA, 19 nt, Homo sapiens
ggagaacgaggacaucuuc

SEQ ID NO: 726134 - RNA, 19 nt, Homo sapiens
guacgaaagaggagcguuu

SEQ ID NO: 726135 - RNA, 19 nt, Homo sapiens
augcacagcuuuaugaaga

SEQ ID NO: 726136 - RNA, 19 nt, Homo sapiens
gauguagaccuguuggauu

SEQ ID NO: 726137 - RNA, 19 nt, Homo sapiens
caaacucucggaaaccuuu

SEQ ID NO: 726138 - RNA, 19 nt, Homo sapiens
caacaggcaccgacugaga

SEQ ID NO: 726139 - RNA, 19 nt, Homo sapiens
ggaauaacggcucugugaa

SEQ ID NO: 726140 - RNA, 19 nt, Homo sapiens
uuaugaagauuuccuguuc

SEQ ID NO: 726141 - RNA, 19 nt, Homo sapiens
ucaaagagaaguuuaaagg

SEQ ID NO: 726142 - RNA, 19 nt, Homo sapiens
auacacaccuucuaacaag

SEQ ID NO: 726143 - RNA, 19 nt, Homo sapiens
ggaagagcccuccgagauc

SEQ ID NO: 726144 - RNA, 19 nt, Homo sapiens
ggucccggcuugaagaguu

SEQ ID NO: 726145 - RNA, 19 nt, Homo sapiens
gagggucuguauucauaga

SEQ ID NO: 726146 - RNA, 19 nt, Homo sapiens
gaggacuaauuuacccaaa

SEQ ID NO: 726147 - RNA, 19 nt, Homo sapiens
gaaauucuggacagccaaa

SEQ ID NO: 726148 - RNA, 19 nt, Homo sapiens
aaccagaucagaaagauuu

SEQ ID NO: 726149 - RNA, 19 nt, Homo sapiens
ccaggguaaugcaaagaaa

SEQ ID NO: 726150 - RNA, 19 nt, Homo sapiens
gaugaaugaaggugccaua

SEQ ID NO: 726151 - RNA, 19 nt, Homo sapiens
gaaauacacaccuucuaac

SEQ ID NO: 726152 - RNA, 19 nt, Homo sapiens
cucaagagcucccaucaca

SEQ ID NO: 726153 - RNA, 19 nt, Homo sapiens
gcucuaugcaggcgucuaa

SEQ ID NO: 726154 - RNA, 19 nt, Homo sapiens
caagagagagcaugauuuu

SEQ ID NO: 726155 - RNA, 19 nt, Homo sapiens
cggcccugcuggagaaaua

SEQ ID NO: 726156 - RNA, 19 nt, Homo sapiens
cuaugcaggcgucuaaaua

SEQ ID NO: 726157 - RNA, 19 nt, Homo sapiens
aagcuggaguguaggaauu

SEQ ID NO: 726158 - RNA, 19 nt, Homo sapiens
aaaccuuucuacagaucua

SEQ ID NO: 726159 - RNA, 19 nt, Homo sapiens
gaauaacggcucugugaac

SEQ ID NO: 726160 - RNA, 19 nt, Homo sapiens
guacuuagagggcuucgau

SEQ ID NO: 726161 - RNA, 19 nt, Homo sapiens
ggaaacgaagugacgauuc

SEQ ID NO: 726162 - RNA, 19 nt, Homo sapiens
guguaggaauugacuauag

SEQ ID NO: 726163 - RNA, 19 nt, Homo sapiens
uguguaauccugaaacaaa

SEQ ID NO: 726164 - RNA, 19 nt, Homo sapiens
uggcggaucuggagaacga

SEQ ID NO: 726165 - RNA, 19 nt, Homo sapiens
ucaagagagagcaugauuu

SEQ ID NO: 726166 - RNA, 19 nt, Homo sapiens
aauccaaacucaccuacau

SEQ ID NO: 726167 - RNA, 19 nt, Homo sapiens
guggauggccuguuuaaag

SEQ ID NO: 726168 - RNA, 19 nt, Homo sapiens
cauagacugugucaacuac

SEQ ID NO: 726169 - RNA, 19 nt, Homo sapiens
uauguaagacugugcgaaa

SEQ ID NO: 726170 - RNA, 19 nt, Homo sapiens
acagccaaacugaaauuua

SEQ ID NO: 726171 - RNA, 19 nt, Homo sapiens
caugugcagaguugacuua

SEQ ID NO: 726172 - RNA, 19 nt, Homo sapiens
uaaagaagucaaagagaag

SEQ ID NO: 726173 - RNA, 19 nt, Homo sapiens
gcaaauaccugauguguca

SEQ ID NO: 726174 - RNA, 19 nt, Homo sapiens
caaaggagcugacacugua

SEQ ID NO: 726175 - RNA, 19 nt, Homo sapiens
gaagacagaugauguuuca

SEQ ID NO: 726176 - RNA, 19 nt, Homo sapiens
ggacagauccucuuugaaa

SEQ ID NO: 726177 - RNA, 19 nt, Homo sapiens
caacagccauugaggauaa

SEQ ID NO: 726178 - RNA, 19 nt, Homo sapiens
caacuuagauggugaaaca

SEQ ID NO: 726179 - RNA, 19 nt, Homo sapiens
cagaagagcugcuaauuca

SEQ ID NO: 726180 - RNA, 19 nt, Homo sapiens
gaaguacccugaauuauac

SEQ ID NO: 726181 - RNA, 19 nt, Homo sapiens
gaacaucuaaucugaauga

SEQ ID NO: 726182 - RNA, 19 nt, Homo sapiens
ccuaucagcuuauugguua

SEQ ID NO: 726183 - RNA, 19 nt, Homo sapiens
gagcugacacuguaauuua

SEQ ID NO: 726184 - RNA, 19 nt, Homo sapiens
gcaauguaaugcaguuuaa

SEQ ID NO: 726185 - RNA, 19 nt, Homo sapiens
gaaacuuuguguacacuuu

SEQ ID NO: 726186 - RNA, 19 nt, Homo sapiens
gcgagaaggugacaagauu

SEQ ID NO: 726187 - RNA, 19 nt, Homo sapiens
gcaagaaacugccauuaac

SEQ ID NO: 726188 - RNA, 19 nt, Homo sapiens
ugaaguacccugaauuaua

SEQ ID NO: 726189 - RNA, 19 nt, Homo sapiens
ggaagaaagauaugaauug

SEQ ID NO: 726190 - RNA, 19 nt, Homo sapiens
ucaagugccugaaaccaua

SEQ ID NO: 726191 - RNA, 19 nt, Homo sapiens
gcucgaacaucuaaucuga

SEQ ID NO: 726192 - RNA, 19 nt, Homo sapiens
gaggauaaauuacaagauc

SEQ ID NO: 726193 - RNA, 19 nt, Homo sapiens
acagacaucucuacgauuu

SEQ ID NO: 726194 - RNA, 19 nt, Homo sapiens
gaagagaguuaugaguuga

SEQ ID NO: 726195 - RNA, 19 nt, Homo sapiens
gaaggugacaagauuauuu

SEQ ID NO: 726196 - RNA, 19 nt, Homo sapiens
gaagagcugcuaauucauu

SEQ ID NO: 726197 - RNA, 19 nt, Homo sapiens
gcaaacuguugaagaagaa

SEQ ID NO: 726198 - RNA, 19 nt, Homo sapiens
aagagaacauguugaagua

SEQ ID NO: 726199 - RNA, 19 nt, Homo sapiens
caaauaugccuuaaccuuu

SEQ ID NO: 726200 - RNA, 19 nt, Homo sapiens
caagauuucucuacucuca

SEQ ID NO: 726201 - RNA, 19 nt, Homo sapiens
ucacauuccuuccaagauu

SEQ ID NO: 726202 - RNA, 19 nt, Homo sapiens
gaaacaagucaaagucgua

SEQ ID NO: 726203 - RNA, 19 nt, Homo sapiens
cgaagagaguuaugaguug

SEQ ID NO: 726204 - RNA, 19 nt, Homo sapiens
gaagaaagauaugaauugc

SEQ ID NO: 726205 - RNA, 19 nt, Homo sapiens
ucaacaaucucauuccuau

SEQ ID NO: 726206 - RNA, 19 nt, Homo sapiens
ccagagggcuuucuuaaac

SEQ ID NO: 726207 - RNA, 19 nt, Homo sapiens
gggcgcaacugcucaagaa

SEQ ID NO: 726208 - RNA, 19 nt, Homo sapiens
guucaguucuggagucuuu

SEQ ID NO: 726209 - RNA, 19 nt, Homo sapiens
ccacucaguuauucuguuu

SEQ ID NO: 726210 - RNA, 19 nt, Homo sapiens
aaacagacaucucuacgau

SEQ ID NO: 726211 - RNA, 19 nt, Homo sapiens
gaaauuguccacugggaaa

SEQ ID NO: 726212 - RNA, 19 nt, Homo sapiens
gaugugguguacaagguua

SEQ ID NO: 726213 - RNA, 19 nt, Homo sapiens
acaccaagcugaugcagaa

SEQ ID NO: 726214 - RNA, 19 nt, Homo sapiens
ggugauaacuguguguuug

SEQ ID NO: 726215 - RNA, 19 nt, Homo sapiens
cagaugauguuucagagaa

SEQ ID NO: 726216 - RNA, 19 nt, Homo sapiens
cagcagaucucaucagucu

SEQ ID NO: 726217 - RNA, 19 nt, Homo sapiens
ggacacuccugcaaacugu

SEQ ID NO: 726218 - RNA, 19 nt, Homo sapiens
ggaaaagacugguaucuca

SEQ ID NO: 726219 - RNA, 19 nt, Homo sapiens
agacagggcuuaccagcaa

SEQ ID NO: 726220 - RNA, 19 nt, Homo sapiens
aaauaugccuuaaccuuug

SEQ ID NO: 726221 - RNA, 19 nt, Homo sapiens
caacugcaccuauaauaug

SEQ ID NO: 726222 - RNA, 19 nt, Homo sapiens
gaacuuggccagguuaaau

SEQ ID NO: 726223 - RNA, 19 nt, Homo sapiens
gugauaagagcauaugaua

SEQ ID NO: 726224 - RNA, 19 nt, Homo sapiens
ggaaucuacucaucucugu

SEQ ID NO: 726225 - RNA, 19 nt, Homo sapiens
caacaucagauaucaaaga

SEQ ID NO: 726226 - RNA, 19 nt, Homo sapiens
guugaaguacccugaauua

SEQ ID NO: 726227 - RNA, 19 nt, Homo sapiens
cauggugccuggaacuaua

SEQ ID NO: 726228 - RNA, 19 nt, Homo sapiens
guaaugcaguuuaagaagu

SEQ ID NO: 726229 - RNA, 19 nt, Homo sapiens
gcagugaacaagaaacaaa

SEQ ID NO: 726230 - RNA, 19 nt, Homo sapiens
gaggaaguaaggacuauuu

SEQ ID NO: 726231 - RNA, 19 nt, Homo sapiens
ccauagcucaguucaaaua

SEQ ID NO: 726232 - RNA, 19 nt, Homo sapiens
caagaggacugcuuuuaaa

SEQ ID NO: 726233 - RNA, 19 nt, Homo sapiens
gaaaagagaacauguugaa

SEQ ID NO: 726234 - RNA, 19 nt, Homo sapiens
acagaaggguuaagaacuu

SEQ ID NO: 726235 - RNA, 19 nt, Homo sapiens
cacuuaagcucucaaaugu

SEQ ID NO: 726236 - RNA, 19 nt, Homo sapiens
acauaaagcugauaaugca

SEQ ID NO: 726237 - RNA, 19 nt, Homo sapiens
uuacagcaaugccuccuuu

SEQ ID NO: 726238 - RNA, 19 nt, Homo sapiens
aaugaaggcucucuugaug

SEQ ID NO: 726239 - RNA, 19 nt, Homo sapiens
aggcauacuucauaaauug

SEQ ID NO: 726240 - RNA, 19 nt, Homo sapiens
ccacuuaagcucucaaaug

SEQ ID NO: 726241 - RNA, 19 nt, Homo sapiens
aaaaugaccugguaucuug

SEQ ID NO: 726242 - RNA, 19 nt, Homo sapiens
gagcauaugauaccacgaa

SEQ ID NO: 726243 - RNA, 19 nt, Homo sapiens
caaaugaugucagcaugau

SEQ ID NO: 726244 - RNA, 19 nt, Homo sapiens
gaagaacaugggaaugauu

SEQ ID NO: 726245 - RNA, 19 nt, Homo sapiens
acaguggguucauggaaua

SEQ ID NO: 726246 - RNA, 19 nt, Homo sapiens
ugaaaggcaggcucuguua

SEQ ID NO: 726247 - RNA, 19 nt, Homo sapiens
gguaugcguucucucaaga

SEQ ID NO: 726248 - RNA, 19 nt, Homo sapiens
gaacuuguaccgcucugaa

SEQ ID NO: 726249 - RNA, 19 nt, Homo sapiens
gaucugguuugccuuuguu

SEQ ID NO: 726250 - RNA, 19 nt, Homo sapiens
gcaaaugaugucagcauga

SEQ ID NO: 726251 - RNA, 19 nt, Homo sapiens
ugaaggcucucuugaugga

SEQ ID NO: 726252 - RNA, 19 nt, Homo sapiens
gcaaaggagcugacacugu

SEQ ID NO: 726253 - RNA, 19 nt, Homo sapiens
ggaaacauaaggcuugaug

SEQ ID NO: 726254 - RNA, 19 nt, Homo sapiens
cauugaaacauccaacuua

SEQ ID NO: 726255 - RNA, 19 nt, Homo sapiens
gaagaaccacgugaacuug

SEQ ID NO: 726256 - RNA, 19 nt, Homo sapiens
gcagccauguuguucaguu

SEQ ID NO: 726257 - RNA, 19 nt, Homo sapiens
ggaaaacccucaaauaugc

SEQ ID NO: 726258 - RNA, 19 nt, Homo sapiens
cagcuuauugguuacauua

SEQ ID NO: 726259 - RNA, 19 nt, Homo sapiens
aaacauuggucgaugaagu

SEQ ID NO: 726260 - RNA, 19 nt, Homo sapiens
uggaugggcuuguuauuca

SEQ ID NO: 726261 - RNA, 19 nt, Homo sapiens
gauuggagacaucauauug

SEQ ID NO: 726262 - RNA, 19 nt, Homo sapiens
ccaagugcaucuuauacug

SEQ ID NO: 726263 - RNA, 19 nt, Homo sapiens
ucucauuccuaucagcuua

SEQ ID NO: 726264 - RNA, 19 nt, Homo sapiens
agacugguaucucaaucua

SEQ ID NO: 726265 - RNA, 19 nt, Homo sapiens
gagcaguuguacuuggaaa

SEQ ID NO: 726266 - RNA, 19 nt, Homo sapiens
uuugaaagaugguguauag

SEQ ID NO: 726267 - RNA, 19 nt, Homo sapiens
cuccauagcucaguucaaa

SEQ ID NO: 726268 - RNA, 19 nt, Homo sapiens
gcacguugguguugguauc

SEQ ID NO: 726269 - RNA, 19 nt, Homo sapiens
ccugcaaacuguugaagaa

SEQ ID NO: 726270 - RNA, 19 nt, Homo sapiens
aaugaaagcagacaucaaa

SEQ ID NO: 726271 - RNA, 19 nt, Homo sapiens
gcagaacaggcuacucaaa

SEQ ID NO: 726272 - RNA, 19 nt, Homo sapiens
ggucagagcagccaagcaa

SEQ ID NO: 726273 - RNA, 19 nt, Homo sapiens
caacaaaucuacguaguua

SEQ ID NO: 726274 - RNA, 19 nt, Homo sapiens
gagaggcaaugacucguua

SEQ ID NO: 726275 - RNA, 19 nt, Homo sapiens
cagaggaguuucuuaauga

SEQ ID NO: 726276 - RNA, 19 nt, Homo sapiens
gggagaagaucauuuagau

SEQ ID NO: 726277 - RNA, 19 nt, Homo sapiens
caaaugaggucuauuacgu

SEQ ID NO: 726278 - RNA, 19 nt, Homo sapiens
cagagugaauugaauauug

SEQ ID NO: 726279 - RNA, 19 nt, Homo sapiens
ccagaggaguuucuuaaug

SEQ ID NO: 726280 - RNA, 19 nt, Homo sapiens
guaguuaacuugaagaaac

SEQ ID NO: 726281 - RNA, 19 nt, Homo sapiens
aggaagaaaugcagaguaa

SEQ ID NO: 726282 - RNA, 19 nt, Homo sapiens
ucagggagaagaucauuua

SEQ ID NO: 726283 - RNA, 19 nt, Homo sapiens
ggagaucacccagcacuuu

SEQ ID NO: 726284 - RNA, 19 nt, Homo sapiens
ggaguuucuuaaugagaua

SEQ ID NO: 726285 - RNA, 19 nt, Homo sapiens
ggucagagugaauugaaua

SEQ ID NO: 726286 - RNA, 19 nt, Homo sapiens
ucagaacucuuugcucuug

SEQ ID NO: 726287 - RNA, 19 nt, Homo sapiens
ccagaccaauaaauuugua

SEQ ID NO: 726288 - RNA, 19 nt, Homo sapiens
uaaaguuggugcaucuaga

SEQ ID NO: 726289 - RNA, 19 nt, Homo sapiens
ucgcugaggugaagccuuu

SEQ ID NO: 726290 - RNA, 19 nt, Homo sapiens
gcaggcgccuacacccuaa

SEQ ID NO: 726291 - RNA, 19 nt, Homo sapiens
cuagaaagcuuugaaugca

SEQ ID NO: 726292 - RNA, 19 nt, Homo sapiens
gagcucugguggagacaaa

SEQ ID NO: 726293 - RNA, 19 nt, Homo sapiens
gaaguuuggucagagugaa

SEQ ID NO: 726294 - RNA, 19 nt, Homo sapiens
ggaacaacaaaucuacgua

SEQ ID NO: 726295 - RNA, 19 nt, Homo sapiens
cuaacucgauuugcucuaa

SEQ ID NO: 726296 - RNA, 19 nt, Homo sapiens
ggagaagaucauuuagauu

SEQ ID NO: 726297 - RNA, 19 nt, Homo sapiens
ccagugcaguugugauuuc

SEQ ID NO: 726298 - RNA, 19 nt, Homo sapiens
uaacucgauuugcucuaaa

SEQ ID NO: 726299 - RNA, 19 nt, Homo sapiens
guauuuauuuccagaccaa

SEQ ID NO: 726300 - RNA, 19 nt, Homo sapiens
gaguacggaugggaaacua

SEQ ID NO: 726301 - RNA, 19 nt, Homo sapiens
cauaggaaguuuggucaga

SEQ ID NO: 726302 - RNA, 19 nt, Homo sapiens
cagcaaacguugggcauca

SEQ ID NO: 726303 - RNA, 19 nt, Homo sapiens
guacggaugggaaacuauu

SEQ ID NO: 726304 - RNA, 19 nt, Homo sapiens
ucgcugaggccuucaagua

SEQ ID NO: 726305 - RNA, 19 nt, Homo sapiens
gcaccguccuuuccuuucu

SEQ ID NO: 726306 - RNA, 19 nt, Homo sapiens
cagcgucacuucucuggau

SEQ ID NO: 726307 - RNA, 19 nt, Homo sapiens
ggcgcgaccuggagauuga

SEQ ID NO: 726308 - RNA, 19 nt, Homo sapiens
gaagaaaugcagaguaacg

SEQ ID NO: 726309 - RNA, 19 nt, Homo sapiens
gcagcacacacuucacaaa

SEQ ID NO: 726310 - RNA, 19 nt, Homo sapiens
ggacaucgagacuuuacau

SEQ ID NO: 726311 - RNA, 19 nt, Homo sapiens
ucaccggccuccugcaaga

SEQ ID NO: 726312 - RNA, 19 nt, Homo sapiens
gcagacaaacacugacguu

SEQ ID NO: 726313 - RNA, 19 nt, Homo sapiens
gcuggaacgugaacucagu

SEQ ID NO: 726314 - RNA, 19 nt, Homo sapiens
aaagaccacucuccucaag

SEQ ID NO: 726315 - RNA, 19 nt, Homo sapiens
gaacgugaacucaguagcu

SEQ ID NO: 726316 - RNA, 19 nt, Homo sapiens
gagauccagugcaguugug

SEQ ID NO: 726317 - RNA, 19 nt, Homo sapiens
cuacguaguuaacuugaag

SEQ ID NO: 726318 - RNA, 19 nt, Homo sapiens
ggacucugaucucuguagu

SEQ ID NO: 726319 - RNA, 19 nt, Homo sapiens
guggagggccuuguccuua

SEQ ID NO: 726320 - RNA, 19 nt, Homo sapiens
ggaaguuuggucagaguga

SEQ ID NO: 726321 - RNA, 19 nt, Homo sapiens
uuugagagauuggcuuaaa

SEQ ID NO: 726322 - RNA, 19 nt, Homo sapiens
agaccacucuccucaagau

SEQ ID NO: 726323 - RNA, 19 nt, Homo sapiens
ggagggccuuguccuuauc

SEQ ID NO: 726324 - RNA, 19 nt, Homo sapiens
gagaucacccagcacuuug

SEQ ID NO: 726325 - RNA, 19 nt, Homo sapiens
gacuuuacauggcucuguu

SEQ ID NO: 726326 - RNA, 19 nt, Homo sapiens
gggcaagagaggcugagua

SEQ ID NO: 726327 - RNA, 19 nt, Homo sapiens
ccagcuugguccaggaauu

SEQ ID NO: 726328 - RNA, 19 nt, Homo sapiens
gugcaguugugauuucugu

SEQ ID NO: 726329 - RNA, 19 nt, Homo sapiens
agcaggacaucgagacuuu

SEQ ID NO: 726330 - RNA, 19 nt, Homo sapiens
uacaugagccagugauuau

SEQ ID NO: 726331 - RNA, 19 nt, Homo sapiens
gcaggacaucgagacuuua

SEQ ID NO: 726332 - RNA, 19 nt, Homo sapiens
ugucgaggcuagaggcauu

SEQ ID NO: 726333 - RNA, 19 nt, Homo sapiens
caucgcauccucuuccauu

SEQ ID NO: 726334 - RNA, 19 nt, Homo sapiens
uggaguccuucaacaguuu

SEQ ID NO: 726335 - RNA, 19 nt, Homo sapiens
gggauuccuuguuguugug

SEQ ID NO: 726336 - RNA, 19 nt, Homo sapiens
auacaugagccagugauua

SEQ ID NO: 726337 - RNA, 19 nt, Homo sapiens
gcuagaggcauuuggaaca

SEQ ID NO: 726338 - RNA, 19 nt, Homo sapiens
gcucuaaacaacccugaga

SEQ ID NO: 726339 - RNA, 19 nt, Homo sapiens
ucccuggccuugaguagaa

SEQ ID NO: 726340 - RNA, 19 nt, Homo sapiens
guucaucaaugccuacaac

SEQ ID NO: 726341 - RNA, 19 nt, Homo sapiens
caccguggauuuucucaua

SEQ ID NO: 726342 - RNA, 19 nt, Homo sapiens
gaaugcagaagcaaacaag

SEQ ID NO: 726343 - RNA, 19 nt, Homo sapiens
gcugaggccuucaaguacu

SEQ ID NO: 726344 - RNA, 19 nt, Homo sapiens
uggagggccuuguccuuau

SEQ ID NO: 726345 - RNA, 19 nt, Homo sapiens
uaaacaacccugagauggu

SEQ ID NO: 726346 - RNA, 19 nt, Homo sapiens
guugagauccagugcaguu

SEQ ID NO: 726347 - RNA, 19 nt, Homo sapiens
cuagaggcauuuggaacaa

SEQ ID NO: 726348 - RNA, 19 nt, Homo sapiens
gacaugcaggcaccucuuu

SEQ ID NO: 726349 - RNA, 19 nt, Homo sapiens
uaacugaggagaagcugau

SEQ ID NO: 726350 - RNA, 19 nt, Homo sapiens
gagccagugauuauucuug

SEQ ID NO: 726351 - RNA, 19 nt, Homo sapiens
ucuccuggcuuuacagaca

SEQ ID NO: 726352 - RNA, 19 nt, Homo sapiens
gcaggcaccucuuuuaaac

SEQ ID NO: 726353 - RNA, 19 nt, Homo sapiens
uagcaugacccgccugaug

SEQ ID NO: 726354 - RNA, 19 nt, Homo sapiens
cagcuugguccaggaauuu

SEQ ID NO: 726355 - RNA, 19 nt, Homo sapiens
uuugaaggcuuuaguucug

SEQ ID NO: 726356 - RNA, 19 nt, Homo sapiens
ucuagcauccucuuaaugu

SEQ ID NO: 726357 - RNA, 19 nt, Homo sapiens
caaagaccacucuccucaa

SEQ ID NO: 726358 - RNA, 19 nt, Homo sapiens
ccaggaauuuugagagauu

SEQ ID NO: 726359 - RNA, 19 nt, Homo sapiens
ugaagccuuugguggagaa

SEQ ID NO: 726360 - RNA, 19 nt, Homo sapiens
gaaggaagaaaugcagagu

SEQ ID NO: 726361 - RNA, 19 nt, Homo sapiens
gauacaugagccagugauu

SEQ ID NO: 726362 - RNA, 19 nt, Homo sapiens
gcaaacguugggcaucaug

SEQ ID NO: 726363 - RNA, 19 nt, Homo sapiens
gcaucuagaaagcuuugaa

SEQ ID NO: 726364 - RNA, 19 nt, Homo sapiens
acaacaaaucuacguaguu

SEQ ID NO: 726365 - RNA, 19 nt, Homo sapiens
gaaaaggugggauucaugu

SEQ ID NO: 726366 - RNA, 19 nt, Homo sapiens
gccagugauuauucuuguu

SEQ ID NO: 726367 - RNA, 19 nt, Homo sapiens
aaaguuggugcaucuagaa

SEQ ID NO: 726368 - RNA, 19 nt, Homo sapiens
uaacuugaagaaaccgauu

SEQ ID NO: 726369 - RNA, 19 nt, Homo sapiens
ggccugucauccucaccua

SEQ ID NO: 726370 - RNA, 19 nt, Homo sapiens
ccuacacccuaacucgauu

SEQ ID NO: 726371 - RNA, 19 nt, Homo sapiens
gaggaguuucuuaaugaga

SEQ ID NO: 726372 - RNA, 19 nt, Homo sapiens
gcaguugggaggaggaagu

SEQ ID NO: 726373 - RNA, 19 nt, Homo sapiens
gaaccgugauggcuucauu

SEQ ID NO: 726374 - RNA, 19 nt, Homo sapiens
uaaggaggcuuucaacaug

SEQ ID NO: 726375 - RNA, 19 nt, Homo sapiens
aaacauggcgccaaggaua

SEQ ID NO: 726376 - RNA, 19 nt, Homo sapiens
gggaggcacccauugauaa

SEQ ID NO: 726377 - RNA, 19 nt, Homo sapiens
ggcagaaucuccaauagag

SEQ ID NO: 726378 - RNA, 19 nt, Homo sapiens
gaaaggcaacuucaacuac

SEQ ID NO: 726379 - RNA, 19 nt, Homo sapiens
gauaagaaaggcaacuuca

SEQ ID NO: 726380 - RNA, 19 nt, Homo sapiens
cgugauggcuucauugaca

SEQ ID NO: 726381 - RNA, 19 nt, Homo sapiens
caacaugauugaccagaac

SEQ ID NO: 726382 - RNA, 19 nt, Homo sapiens
gcagauguucccacaguga

SEQ ID NO: 726383 - RNA, 19 nt, Homo sapiens
gggcagaaucuccaauaga

SEQ ID NO: 726384 - RNA, 19 nt, Homo sapiens
aaacaggccaggagaagug

SEQ ID NO: 726385 - RNA, 19 nt, Homo sapiens
agaaaggcaacuucaacua

SEQ ID NO: 726386 - RNA, 19 nt, Homo sapiens
cauccaaugucuucgcaau

SEQ ID NO: 726387 - RNA, 19 nt, Homo sapiens
gcacagaccccgaggaugu

SEQ ID NO: 726388 - RNA, 19 nt, Homo sapiens
caaugucuucgcaauguuu

SEQ ID NO: 726389 - RNA, 19 nt, Homo sapiens
ccaaugucuucgcaauguu

SEQ ID NO: 726390 - RNA, 19 nt, Homo sapiens
uaagaaaggcaacuucaac

SEQ ID NO: 726391 - RNA, 19 nt, Homo sapiens
cccaucaacuucaccaugu

SEQ ID NO: 726392 - RNA, 19 nt, Homo sapiens
aagccaagauguccagcaa

SEQ ID NO: 726393 - RNA, 19 nt, Homo sapiens
aaugcaagcucaccaaggu

SEQ ID NO: 726394 - RNA, 19 nt, Homo sapiens
ccaaggauaaagacgacua

SEQ ID NO: 726395 - RNA, 19 nt, Homo sapiens
aaggaggcuuucaacauga

SEQ ID NO: 726396 - RNA, 19 nt, Homo sapiens
ggaaguggacgagauguac

SEQ ID NO: 726397 - RNA, 19 nt, Homo sapiens
ggaagccucagguuucauc

SEQ ID NO: 726398 - RNA, 19 nt, Homo sapiens
gaaacaggccaggagaagu

SEQ ID NO: 726399 - RNA, 19 nt, Homo sapiens
aggcacccauugauaagaa

SEQ ID NO: 726400 - RNA, 19 nt, Homo sapiens
uuaaggaggcuuucaacau

SEQ ID NO: 726401 - RNA, 19 nt, Homo sapiens
uccaaugucuucgcaaugu

SEQ ID NO: 726402 - RNA, 19 nt, Homo sapiens
ggaggcacccauugauaag

SEQ ID NO: 726403 - RNA, 19 nt, Homo sapiens
ccaucaacuucaccauguu

SEQ ID NO: 726404 - RNA, 19 nt, Homo sapiens
aagccaagaccaccaagaa

SEQ ID NO: 726405 - RNA, 19 nt, Homo sapiens
aggcagauguucccacagu

SEQ ID NO: 726406 - RNA, 19 nt, Homo sapiens
cgggaggcacccauugaua

SEQ ID NO: 726407 - RNA, 19 nt, Homo sapiens
gugauggcuucauugacaa

SEQ ID NO: 726408 - RNA, 19 nt, Homo sapiens
gcacacacccguccauacc

SEQ ID NO: 726409 - RNA, 19 nt, Homo sapiens
gaagaaccccacagacgaa

SEQ ID NO: 726410 - RNA, 19 nt, Homo sapiens
ucaaacauggcgccaagga

SEQ ID NO: 726411 - RNA, 19 nt, Homo sapiens
ccaaagccaagaccaccaa

SEQ ID NO: 726412 - RNA, 19 nt, Homo sapiens
ccugggcuauagucucuga

SEQ ID NO: 726413 - RNA, 19 nt, Homo sapiens
ucccagauccaggaguuua

SEQ ID NO: 726414 - RNA, 19 nt, Homo sapiens
ucacccgcauccucaaaca

SEQ ID NO: 726415 - RNA, 19 nt, Homo sapiens
ggcacccauugauaagaaa

SEQ ID NO: 726416 - RNA, 19 nt, Homo sapiens
guaccgggaggcacccauu

SEQ ID NO: 726417 - RNA, 19 nt, Homo sapiens
aggaggaccugcacgacau

SEQ ID NO: 726418 - RNA, 19 nt, Homo sapiens
gggcagcguggacaucugu

SEQ ID NO: 726419 - RNA, 19 nt, Homo sapiens
agucccagauccaggaguu

SEQ ID NO: 726420 - RNA, 19 nt, Homo sapiens
ugaggaaguggacgagaug

SEQ ID NO: 726421 - RNA, 19 nt, Homo sapiens
acaaaugcaagcucaccaa

SEQ ID NO: 726422 - RNA, 19 nt, Homo sapiens
uggcagagcuuuacaaaua

SEQ ID NO: 726423 - RNA, 19 nt, Homo sapiens
caaauacacuguccaggau

SEQ ID NO: 726424 - RNA, 19 nt, Homo sapiens
uagaugaacugaagcaaga

SEQ ID NO: 726425 - RNA, 19 nt, Homo sapiens
gauaagaccaucaucaugu

SEQ ID NO: 726426 - RNA, 19 nt, Homo sapiens
ggaaagaucauuguagaug

SEQ ID NO: 726427 - RNA, 19 nt, Homo sapiens
ggcagagcuuuacaaauaa

SEQ ID NO: 726428 - RNA, 19 nt, Homo sapiens
ggcacacgcuagaaguuua

SEQ ID NO: 726429 - RNA, 19 nt, Homo sapiens
ccaaggaugugcugagugu

SEQ ID NO: 726430 - RNA, 19 nt, Homo sapiens
guuaugggaucucaacgaa

SEQ ID NO: 726431 - RNA, 19 nt, Homo sapiens
cagagugggugucuugugu

SEQ ID NO: 726432 - RNA, 19 nt, Homo sapiens
gagauaagaccaucaucau

SEQ ID NO: 726433 - RNA, 19 nt, Homo sapiens
gaagcaagaaguuaucagu

SEQ ID NO: 726434 - RNA, 19 nt, Homo sapiens
gaugagaccaacuauggaa

SEQ ID NO: 726435 - RNA, 19 nt, Homo sapiens
gagaccaacuauggaauuc

SEQ ID NO: 726436 - RNA, 19 nt, Homo sapiens
gggaugagaccaacuaugg

SEQ ID NO: 726437 - RNA, 19 nt, Homo sapiens
uaacccagaucgcuacuac

SEQ ID NO: 726438 - RNA, 19 nt, Homo sapiens
uauggaaccuggcuaacug

SEQ ID NO: 726439 - RNA, 19 nt, Homo sapiens
ggucacucccacuuuguua

SEQ ID NO: 726440 - RNA, 19 nt, Homo sapiens
agggaaagaucauuguaga

SEQ ID NO: 726441 - RNA, 19 nt, Homo sapiens
cauuguagaugaacugaag

SEQ ID NO: 726442 - RNA, 19 nt, Homo sapiens
ggauuuagagggaaagauc

SEQ ID NO: 726443 - RNA, 19 nt, Homo sapiens
gcugaagaccaaccacauu

SEQ ID NO: 726444 - RNA, 19 nt, Homo sapiens
gugacugucucuccagaug

SEQ ID NO: 726445 - RNA, 19 nt, Homo sapiens
cgagauaagaccaucauca

SEQ ID NO: 726446 - RNA, 19 nt, Homo sapiens
gagguuguggugcuaguuu

SEQ ID NO: 726447 - RNA, 19 nt, Homo sapiens
gauaaaaccaucaagcuau

SEQ ID NO: 726448 - RNA, 19 nt, Homo sapiens
ggaaacugaccagggauga

SEQ ID NO: 726449 - RNA, 19 nt, Homo sapiens
gcacacgcuagaaguuuau

SEQ ID NO: 726450 - RNA, 19 nt, Homo sapiens
ccagggaugagaccaacua

SEQ ID NO: 726451 - RNA, 19 nt, Homo sapiens
cuccucagauggccaguuu

SEQ ID NO: 726452 - RNA, 19 nt, Homo sapiens
gagggaaagaucauuguag

SEQ ID NO: 726453 - RNA, 19 nt, Homo sapiens
aagcaagaaguuaucagua

SEQ ID NO: 726454 - RNA, 19 nt, Homo sapiens
ggccacaacggcuggguaa

SEQ ID NO: 726455 - RNA, 19 nt, Homo sapiens
ccacacaggcuaucugaac

SEQ ID NO: 726456 - RNA, 19 nt, Homo sapiens
caaccacauuggccacaca

SEQ ID NO: 726457 - RNA, 19 nt, Homo sapiens
gcaguucccggacaugauc

SEQ ID NO: 726458 - RNA, 19 nt, Homo sapiens
aauacacuguccaggauga

SEQ ID NO: 726459 - RNA, 19 nt, Homo sapiens
ugagaccaacuauggaauu

SEQ ID NO: 726460 - RNA, 19 nt, Homo sapiens
auaagaccaucaucaugug

SEQ ID NO: 726461 - RNA, 19 nt, Homo sapiens
acugcaagcugaagaccaa

SEQ ID NO: 726462 - RNA, 19 nt, Homo sapiens
aaacugaccagggaugaga

SEQ ID NO: 726463 - RNA, 19 nt, Homo sapiens
agcaagaaguuaucaguac

SEQ ID NO: 726464 - RNA, 19 nt, Homo sapiens
gagagguuguggugcuagu

SEQ ID NO: 726465 - RNA, 19 nt, Homo sapiens
ggaugagaccaacuaugga

SEQ ID NO: 726466 - RNA, 19 nt, Homo sapiens
cacacaggcuaucugaaca

SEQ ID NO: 726467 - RNA, 19 nt, Homo sapiens
gcagcaacccuaucaucgu

SEQ ID NO: 726468 - RNA, 19 nt, Homo sapiens
cgccaugacugagcagaug

SEQ ID NO: 726469 - RNA, 19 nt, Homo sapiens
uauggcagagcuuuacaaa

SEQ ID NO: 726470 - RNA, 19 nt, Homo sapiens
ggccacacaggcuaucuga

SEQ ID NO: 726471 - RNA, 19 nt, Homo sapiens
caacagcagcaacccuauc

SEQ ID NO: 726472 - RNA, 19 nt, Homo sapiens
gggaaagaucauuguagau

SEQ ID NO: 726473 - RNA, 19 nt, Homo sapiens
ggaucucaacgaaggcaaa

SEQ ID NO: 726474 - RNA, 19 nt, Homo sapiens
gaacacggugacugucucu

SEQ ID NO: 726475 - RNA, 19 nt, Homo sapiens
cugaagaccaaccacauug

SEQ ID NO: 726476 - RNA, 19 nt, Homo sapiens
agaccaucaucauguggaa

SEQ ID NO: 726477 - RNA, 19 nt, Homo sapiens
cagcagcaacccuaucauc

SEQ ID NO: 726478 - RNA, 19 nt, Homo sapiens
uuagugaugugguuaucuc

SEQ ID NO: 726479 - RNA, 19 nt, Homo sapiens
agagggaaagaucauugua

SEQ ID NO: 726480 - RNA, 19 nt, Homo sapiens
gauggaucccucugugcuu

SEQ ID NO: 726481 - RNA, 19 nt, Homo sapiens
acaagcuggucaagguaug

SEQ ID NO: 726482 - RNA, 19 nt, Homo sapiens
uuagagggaaagaucauug

SEQ ID NO: 726483 - RNA, 19 nt, Homo sapiens
gcuaacugcaagcugaaga

SEQ ID NO: 726484 - RNA, 19 nt, Homo sapiens
uaccaaggaugugcugagu

SEQ ID NO: 726485 - RNA, 19 nt, Homo sapiens
agauaagaccaucaucaug

SEQ ID NO: 726486 - RNA, 19 nt, Homo sapiens
gauuuagagggaaagauca

SEQ ID NO: 726487 - RNA, 19 nt, Homo sapiens
ggaaccuggcuaacugcaa

SEQ ID NO: 726488 - RNA, 19 nt, Homo sapiens
gaacuuuccuaggugauua

SEQ ID NO: 726489 - RNA, 19 nt, Homo sapiens
ccauaaagccucuuccuua

SEQ ID NO: 726490 - RNA, 19 nt, Homo sapiens
ucaauccgcucuacuggaa

SEQ ID NO: 726491 - RNA, 19 nt, Homo sapiens
guuaacagcugaggcuauu

SEQ ID NO: 726492 - RNA, 19 nt, Homo sapiens
cauaaagccucuuccuuac

SEQ ID NO: 726493 - RNA, 19 nt, Homo sapiens
gccgacauauggccauuga

SEQ ID NO: 726494 - RNA, 19 nt, Homo sapiens
cacaagaggagcugauuga

SEQ ID NO: 726495 - RNA, 19 nt, Homo sapiens
acauucccauucaccaaua

SEQ ID NO: 726496 - RNA, 19 nt, Homo sapiens
gagcuccaacccacacauu

SEQ ID NO: 726497 - RNA, 19 nt, Homo sapiens
uuuccuaggugauuacuuc

SEQ ID NO: 726498 - RNA, 19 nt, Homo sapiens
ccacaagaggagcugauug

SEQ ID NO: 726499 - RNA, 19 nt, Homo sapiens
ucaccauccugcuccugaa

SEQ ID NO: 726500 - RNA, 19 nt, Homo sapiens
gcacgaugggaacacaaga

SEQ ID NO: 726501 - RNA, 19 nt, Homo sapiens
cccuggacgugccgacaua

SEQ ID NO: 726502 - RNA, 19 nt, Homo sapiens
gggaagcacagccaacuac

SEQ ID NO: 726503 - RNA, 19 nt, Homo sapiens
gcacugggguucgcuggaa

SEQ ID NO: 726504 - RNA, 19 nt, Homo sapiens
cauucccauucaccaauaa

SEQ ID NO: 726505 - RNA, 19 nt, Homo sapiens
caacccacacauucccauu

SEQ ID NO: 726506 - RNA, 19 nt, Homo sapiens
uaccugggcugggccauca

SEQ ID NO: 726507 - RNA, 19 nt, Homo sapiens
aauccgcucuacuggaaug

SEQ ID NO: 726508 - RNA, 19 nt, Homo sapiens
ugagaucuaccggcagaaa

SEQ ID NO: 726509 - RNA, 19 nt, Homo sapiens
ccauccugcuccugaacuu

SEQ ID NO: 726510 - RNA, 19 nt, Homo sapiens
acccacacauucccauuca

SEQ ID NO: 726511 - RNA, 19 nt, Homo sapiens
gaacuuuccuaggugauua

SEQ ID NO: 726512 - RNA, 19 nt, Homo sapiens
ucaauccgcucuacuggaa

SEQ ID NO: 726513 - RNA, 19 nt, Homo sapiens
gcggaggccucggcaauau

SEQ ID NO: 726514 - RNA, 19 nt, Homo sapiens
gccgacauauggccauuga

SEQ ID NO: 726515 - RNA, 19 nt, Homo sapiens
ggaggccucggcaauauug

SEQ ID NO: 726516 - RNA, 19 nt, Homo sapiens
cacaagaggagcugauuga

SEQ ID NO: 726517 - RNA, 19 nt, Homo sapiens
acauucccauucaccaaua

SEQ ID NO: 726518 - RNA, 19 nt, Homo sapiens
gagccgagguaacgaacag

SEQ ID NO: 726519 - RNA, 19 nt, Homo sapiens
gagcuccaacccacacauu

SEQ ID NO: 726520 - RNA, 19 nt, Homo sapiens
uuuccuaggugauuacuuc

SEQ ID NO: 726521 - RNA, 19 nt, Homo sapiens
ccacaagaggagcugauug

SEQ ID NO: 726522 - RNA, 19 nt, Homo sapiens
ucaccauccugcuccugaa

SEQ ID NO: 726523 - RNA, 19 nt, Homo sapiens
gcacgaugggaacacaaga

SEQ ID NO: 726524 - RNA, 19 nt, Homo sapiens
cccuggacgugccgacaua

SEQ ID NO: 726525 - RNA, 19 nt, Homo sapiens
gggaagcacagccaacuac

SEQ ID NO: 726526 - RNA, 19 nt, Homo sapiens
gcacugggguucgcuggaa

SEQ ID NO: 726527 - RNA, 19 nt, Homo sapiens
cauucccauucaccaauaa

SEQ ID NO: 726528 - RNA, 19 nt, Homo sapiens
caacccacacauucccauu

SEQ ID NO: 726529 - RNA, 19 nt, Homo sapiens
uaccugggcugggccauca

SEQ ID NO: 726530 - RNA, 19 nt, Homo sapiens
aauccgcucuacuggaaug

SEQ ID NO: 726531 - RNA, 19 nt, Homo sapiens
ugagaucuaccggcagaaa

SEQ ID NO: 726532 - RNA, 19 nt, Homo sapiens
ccauccugcuccugaacuu

SEQ ID NO: 726533 - RNA, 19 nt, Homo sapiens
acccacacauucccauuca

SEQ ID NO: 726534 - RNA, 19 nt, Homo sapiens
ggccucggcaauauugauu

SEQ ID NO: 726535 - RNA, 19 nt, Homo sapiens
gaacuuuccuaggugauua

SEQ ID NO: 726536 - RNA, 19 nt, Homo sapiens
gcacaccacuauuguuuua

SEQ ID NO: 726537 - RNA, 19 nt, Homo sapiens
ucaauccgcucuacuggaa

SEQ ID NO: 726538 - RNA, 19 nt, Homo sapiens
gagaggcacaccacuauug

SEQ ID NO: 726539 - RNA, 19 nt, Homo sapiens
gaggagaggcacaccacua

SEQ ID NO: 726540 - RNA, 19 nt, Homo sapiens
gccgacauauggccauuga

SEQ ID NO: 726541 - RNA, 19 nt, Homo sapiens
cacaagaggagcugauuga

SEQ ID NO: 726542 - RNA, 19 nt, Homo sapiens
acauucccauucaccaaua

SEQ ID NO: 726543 - RNA, 19 nt, Homo sapiens
ggagaggcacaccacuauu

SEQ ID NO: 726544 - RNA, 19 nt, Homo sapiens
gagcuccaacccacacauu

SEQ ID NO: 726545 - RNA, 19 nt, Homo sapiens
uuuccuaggugauuacuuc

SEQ ID NO: 726546 - RNA, 19 nt, Homo sapiens
aggcacaccacuauuguuu

SEQ ID NO: 726547 - RNA, 19 nt, Homo sapiens
ccacaagaggagcugauug

SEQ ID NO: 726548 - RNA, 19 nt, Homo sapiens
ucaccauccugcuccugaa

SEQ ID NO: 726549 - RNA, 19 nt, Homo sapiens
gcacgaugggaacacaaga

SEQ ID NO: 726550 - RNA, 19 nt, Homo sapiens
cccuggacgugccgacaua

SEQ ID NO: 726551 - RNA, 19 nt, Homo sapiens
gggaagcacagccaacuac

SEQ ID NO: 726552 - RNA, 19 nt, Homo sapiens
gcacugggguucgcuggaa

SEQ ID NO: 726553 - RNA, 19 nt, Homo sapiens
ccugauuccuggcagacuu

SEQ ID NO: 726554 - RNA, 19 nt, Homo sapiens
cauucccauucaccaauaa

SEQ ID NO: 726555 - RNA, 19 nt, Homo sapiens
caacccacacauucccauu

SEQ ID NO: 726556 - RNA, 19 nt, Homo sapiens
uaccugggcugggccauca

SEQ ID NO: 726557 - RNA, 19 nt, Homo sapiens
gaggcacaccacuauuguu

SEQ ID NO: 726558 - RNA, 19 nt, Homo sapiens
aauccgcucuacuggaaug

SEQ ID NO: 726559 - RNA, 19 nt, Homo sapiens
ugagaucuaccggcagaaa

SEQ ID NO: 726560 - RNA, 19 nt, Homo sapiens
ccauccugcuccugaacuu

SEQ ID NO: 726561 - RNA, 19 nt, Homo sapiens
acccacacauucccauuca

SEQ ID NO: 726562 - RNA, 19 nt, Homo sapiens
caaaugcucucucuucuua

SEQ ID NO: 726563 - RNA, 19 nt, Homo sapiens
cauccaagguuuagauuua

SEQ ID NO: 726564 - RNA, 19 nt, Homo sapiens
caaaugggaugguauguga

SEQ ID NO: 726565 - RNA, 19 nt, Homo sapiens
caagaaggcucccuaugaa

SEQ ID NO: 726566 - RNA, 19 nt, Homo sapiens
ggacugaguucccuggauu

SEQ ID NO: 726567 - RNA, 19 nt, Homo sapiens
cccaaaggguuaauauuua

SEQ ID NO: 726568 - RNA, 19 nt, Homo sapiens
ggagauccaucagagaaua

SEQ ID NO: 726569 - RNA, 19 nt, Homo sapiens
agacagaccuucacagaug

SEQ ID NO: 726570 - RNA, 19 nt, Homo sapiens
gcaggaacccuucuacaaa

SEQ ID NO: 726571 - RNA, 19 nt, Homo sapiens
gaagcgcacuuuaccuuug

SEQ ID NO: 726572 - RNA, 19 nt, Homo sapiens
gaagaaggucgaaguuauu

SEQ ID NO: 726573 - RNA, 19 nt, Homo sapiens
gaagcucucacccauaaua

SEQ ID NO: 726574 - RNA, 19 nt, Homo sapiens
gaaauguucuuuagauggu

SEQ ID NO: 726575 - RNA, 19 nt, Homo sapiens
gcucauggcccuguaguua

SEQ ID NO: 726576 - RNA, 19 nt, Homo sapiens
gagccgacauccaagguuu

SEQ ID NO: 726577 - RNA, 19 nt, Homo sapiens
agaagaaggucgaaguuau

SEQ ID NO: 726578 - RNA, 19 nt, Homo sapiens
ggaccuauguuguaauuuu

SEQ ID NO: 726579 - RNA, 19 nt, Homo sapiens
ggacagagaacuuuauuuu

SEQ ID NO: 726580 - RNA, 19 nt, Homo sapiens
caucagagaauaagaagaa

SEQ ID NO: 726581 - RNA, 19 nt, Homo sapiens
ggagccaaaugugauuaua

SEQ ID NO: 726582 - RNA, 19 nt, Homo sapiens
ucacauccauugucucuuc

SEQ ID NO: 726583 - RNA, 19 nt, Homo sapiens
cuucacagaugccuacuuu

SEQ ID NO: 726584 - RNA, 19 nt, Homo sapiens
gaaggaggcaucugagguu

SEQ ID NO: 726585 - RNA, 19 nt, Homo sapiens
gggucucucucuauuuaua

SEQ ID NO: 726586 - RNA, 19 nt, Homo sapiens
ggaggcaaaugggauggua

SEQ ID NO: 726587 - RNA, 19 nt, Homo sapiens
gcacauuccuuuggguaug

SEQ ID NO: 726588 - RNA, 19 nt, Homo sapiens
acaagaaggcucccuauga

SEQ ID NO: 726589 - RNA, 19 nt, Homo sapiens
gauuguggauguggacuuu

SEQ ID NO: 726590 - RNA, 19 nt, Homo sapiens
gagaagaagccuacaugga

SEQ ID NO: 726591 - RNA, 19 nt, Homo sapiens
caagugcagcagauucuua

SEQ ID NO: 726592 - RNA, 19 nt, Homo sapiens
ccaaacccauggcucuauu

SEQ ID NO: 726593 - RNA, 19 nt, Homo sapiens
ggaauuacuccuugucugu

SEQ ID NO: 726594 - RNA, 19 nt, Homo sapiens
cagcuaagguucugucucu

SEQ ID NO: 726595 - RNA, 19 nt, Homo sapiens
uugggucucucucuauuua

SEQ ID NO: 726596 - RNA, 19 nt, Homo sapiens
gaugguggcacauuccuuu

SEQ ID NO: 726597 - RNA, 19 nt, Homo sapiens
ccaagaaggaggcaucuga

SEQ ID NO: 726598 - RNA, 19 nt, Homo sapiens
caaugaaacccaagaagga

SEQ ID NO: 726599 - RNA, 19 nt, Homo sapiens
ggacggaauuacuccuugu

SEQ ID NO: 726600 - RNA, 19 nt, Homo sapiens
uaucuaaguucacaguguu

SEQ ID NO: 726601 - RNA, 19 nt, Homo sapiens
uuucagagauggacagaga

SEQ ID NO: 726602 - RNA, 19 nt, Homo sapiens
gaugguaugugagcuagga

SEQ ID NO: 726603 - RNA, 19 nt, Homo sapiens
ugaguucccuggauuaugg

SEQ ID NO: 726604 - RNA, 19 nt, Homo sapiens
ggcccuaccuggaagcaaa

SEQ ID NO: 726605 - RNA, 19 nt, Homo sapiens
ggaagcgcacuuuaccuuu

SEQ ID NO: 726606 - RNA, 19 nt, Homo sapiens
ccucaucucugccugacaa

SEQ ID NO: 726607 - RNA, 19 nt, Homo sapiens
uuauggagauucuuaguuc

SEQ ID NO: 726608 - RNA, 19 nt, Homo sapiens
agacagagagucagcacua

SEQ ID NO: 726609 - RNA, 19 nt, Homo sapiens
gagauggacagagaacuuu

SEQ ID NO: 726610 - RNA, 19 nt, Homo sapiens
gggcacugaucaaggagaa

SEQ ID NO: 726611 - RNA, 19 nt, Homo sapiens
gcuugggucucucucuauu

SEQ ID NO: 726612 - RNA, 19 nt, Homo sapiens
gacaauagaaagcucauca

SEQ ID NO: 726613 - RNA, 19 nt, Homo sapiens
ccagacagaccuucacaga

SEQ ID NO: 726614 - RNA, 19 nt, Homo sapiens
caauagaaagcucaucaga

SEQ ID NO: 726615 - RNA, 19 nt, Homo sapiens
ugaaaccauugcccuucua

SEQ ID NO: 726616 - RNA, 19 nt, Homo sapiens
gcccucaggucccucuuug

SEQ ID NO: 726617 - RNA, 19 nt, Homo sapiens
uaaagcacauggugaugag

SEQ ID NO: 726618 - RNA, 19 nt, Homo sapiens
ccaggugcuucuuggcuuu

SEQ ID NO: 726619 - RNA, 19 nt, Homo sapiens
ggaagaugcgccugacugu

SEQ ID NO: 726620 - RNA, 19 nt, Homo sapiens
cuucaugucuauuccauuc

SEQ ID NO: 726621 - RNA, 19 nt, Homo sapiens
cauugucucuucaugucua

SEQ ID NO: 726622 - RNA, 19 nt, Homo sapiens
cuggaaauguucuuuagau

SEQ ID NO: 726623 - RNA, 19 nt, Homo sapiens
uaagaagaaggucgaaguu

SEQ ID NO: 726624 - RNA, 19 nt, Homo sapiens
caaaauacuccaaagauga

SEQ ID NO: 726625 - RNA, 19 nt, Homo sapiens
gacaggcaguuucagagau

SEQ ID NO: 726626 - RNA, 19 nt, Homo sapiens
aaugcucucucuucuuauu

SEQ ID NO: 726627 - RNA, 19 nt, Homo sapiens
gacagagagucagcacuau

SEQ ID NO: 726628 - RNA, 19 nt, Homo sapiens
aagaagaaggucgaaguua

SEQ ID NO: 726629 - RNA, 19 nt, Homo sapiens
ccaaaauacuccaaagaug

SEQ ID NO: 726630 - RNA, 19 nt, Homo sapiens
gcaaaugggaugguaugug

SEQ ID NO: 726631 - RNA, 19 nt, Homo sapiens
gagauccaucagagaauaa

SEQ ID NO: 726632 - RNA, 19 nt, Homo sapiens
gcacugaucaaggagaaau

SEQ ID NO: 726633 - RNA, 19 nt, Homo sapiens
gaaaccauugcccuucuau

SEQ ID NO: 726634 - RNA, 19 nt, Homo sapiens
acccauggcucuauuucuu

SEQ ID NO: 726635 - RNA, 19 nt, Homo sapiens
ggauccuggugcccaauga

SEQ ID NO: 726636 - RNA, 19 nt, Homo sapiens
cuuaguuccuguucagauu

SEQ ID NO: 726637 - RNA, 19 nt, Homo sapiens
guucacaguguuucuuauu

SEQ ID NO: 726638 - RNA, 19 nt, Homo sapiens
ccucugaucucucccuucu

SEQ ID NO: 726639 - RNA, 19 nt, Homo sapiens
gacaaggccagcacccaaa

SEQ ID NO: 726640 - RNA, 19 nt, Homo sapiens
uuucauuucuucagacaga

SEQ ID NO: 726641 - RNA, 19 nt, Homo sapiens
gggauuuccuguccagucu

SEQ ID NO: 726642 - RNA, 19 nt, Homo sapiens
ggaggcaucugagguuugc

SEQ ID NO: 726643 - RNA, 19 nt, Homo sapiens
cuucgaugcugcccuuuau

SEQ ID NO: 726644 - RNA, 19 nt, Homo sapiens
caggaacccuucuacaaaa

SEQ ID NO: 726645 - RNA, 19 nt, Homo sapiens
aaccauugcccuucuauga

SEQ ID NO: 726646 - RNA, 19 nt, Homo sapiens
uggaaauguucuuuagaug

SEQ ID NO: 726647 - RNA, 19 nt, Homo sapiens
ggagcugggcgaauuaaag

SEQ ID NO: 726648 - RNA, 19 nt, Homo sapiens
acaggcaguuucagagaug

SEQ ID NO: 726649 - RNA, 19 nt, Homo sapiens
ucaccucacuagaugaaca

SEQ ID NO: 726650 - RNA, 19 nt, Homo sapiens
cgacauccaagguuuagau

SEQ ID NO: 726651 - RNA, 19 nt, Homo sapiens
gaaggcucccuaugaaucu

SEQ ID NO: 726652 - RNA, 19 nt, Homo sapiens
gcgccugacugucccuugu

SEQ ID NO: 726653 - RNA, 19 nt, Homo sapiens
caaggucaaugggaaacug

SEQ ID NO: 726654 - RNA, 19 nt, Homo sapiens
ccauacaggugcagcuaag

SEQ ID NO: 726655 - RNA, 19 nt, Homo sapiens
gcucucacccauaauaaag

SEQ ID NO: 726656 - RNA, 19 nt, Homo sapiens
acagagaacuuuauuuugg

SEQ ID NO: 726657 - RNA, 19 nt, Homo sapiens
gauggacagagaacuuuau

SEQ ID NO: 726658 - RNA, 19 nt, Homo sapiens
cuaaggagcccugcuaugg

SEQ ID NO: 726659 - RNA, 19 nt, Homo sapiens
ucauuucccuggacugagu

SEQ ID NO: 726660 - RNA, 19 nt, Homo sapiens
gacaagaaggcucccuaug

SEQ ID NO: 726661 - RNA, 19 nt, Homo sapiens
caauuggucaucugaguuc

SEQ ID NO: 726662 - RNA, 19 nt, Homo sapiens
gaaaugaaacggagaaaua

SEQ ID NO: 726663 - RNA, 19 nt, Homo sapiens
gaacaucagcggaauauuu

SEQ ID NO: 726664 - RNA, 19 nt, Homo sapiens
uaagguggcuguuggaauu

SEQ ID NO: 726665 - RNA, 19 nt, Homo sapiens
cgacuccuaugauguaaua

SEQ ID NO: 726666 - RNA, 19 nt, Homo sapiens
ggaagaaaccagccuuaaa

SEQ ID NO: 726667 - RNA, 19 nt, Homo sapiens
uuacauaugucacgaaguu

SEQ ID NO: 726668 - RNA, 19 nt, Homo sapiens
aaagauugcuuccuuguau

SEQ ID NO: 726669 - RNA, 19 nt, Homo sapiens
gauccagccuuguuuauca

SEQ ID NO: 726670 - RNA, 19 nt, Homo sapiens
guugugaucucuuugauga

SEQ ID NO: 726671 - RNA, 19 nt, Homo sapiens
uggaugcacucgucaaaua

SEQ ID NO: 726672 - RNA, 19 nt, Homo sapiens
gaauaaugguccuguuuua

SEQ ID NO: 726673 - RNA, 19 nt, Homo sapiens
ggaaugccaccaugucuuu

SEQ ID NO: 726674 - RNA, 19 nt, Homo sapiens
gaagaaaccagccuuaaac

SEQ ID NO: 726675 - RNA, 19 nt, Homo sapiens
gaaagauugcuuccuugua

SEQ ID NO: 726676 - RNA, 19 nt, Homo sapiens
gaauaagacauuaggagaa

SEQ ID NO: 726677 - RNA, 19 nt, Homo sapiens
uuagaaagauugcuuccuu

SEQ ID NO: 726678 - RNA, 19 nt, Homo sapiens
ccaugucuuugaugaauaa

SEQ ID NO: 726679 - RNA, 19 nt, Homo sapiens
cagauccuauucacaauga

SEQ ID NO: 726680 - RNA, 19 nt, Homo sapiens
gugcugucuuccucuauua

SEQ ID NO: 726681 - RNA, 19 nt, Homo sapiens
uaagauccagccuuguuua

SEQ ID NO: 726682 - RNA, 19 nt, Homo sapiens
cagcuuaauuucugugaau

SEQ ID NO: 726683 - RNA, 19 nt, Homo sapiens
uaagaacgcguaucacaau

SEQ ID NO: 726684 - RNA, 19 nt, Homo sapiens
gaacagcagcuuaugaacu

SEQ ID NO: 726685 - RNA, 19 nt, Homo sapiens
ugaauaagaacgcguauca

SEQ ID NO: 726686 - RNA, 19 nt, Homo sapiens
ucaccuagcugguuuuaaa

SEQ ID NO: 726687 - RNA, 19 nt, Homo sapiens
guugaugggugacaaaaua

SEQ ID NO: 726688 - RNA, 19 nt, Homo sapiens
gagaacaucagcggaauau

SEQ ID NO: 726689 - RNA, 19 nt, Homo sapiens
gaaguucaccuagcugguu

SEQ ID NO: 726690 - RNA, 19 nt, Homo sapiens
cagaacagcagcuuaugaa

SEQ ID NO: 726691 - RNA, 19 nt, Homo sapiens
aggacaaccuuccgacuuu

SEQ ID NO: 726692 - RNA, 19 nt, Homo sapiens
ggaugcacucgucaaauaa

SEQ ID NO: 726693 - RNA, 19 nt, Homo sapiens
ucaagaguccuuugcacua

SEQ ID NO: 726694 - RNA, 19 nt, Homo sapiens
ccaacaacaggaauuauug

SEQ ID NO: 726695 - RNA, 19 nt, Homo sapiens
ugaugaguuugacaacaua

SEQ ID NO: 726696 - RNA, 19 nt, Homo sapiens
ccaaaaguguuucccaaaa

SEQ ID NO: 726697 - RNA, 19 nt, Homo sapiens
ggaggaguuuugaagaaua

SEQ ID NO: 726698 - RNA, 19 nt, Homo sapiens
ucuauuauguacugcauug

SEQ ID NO: 726699 - RNA, 19 nt, Homo sapiens
gauugacucuacagacuca

SEQ ID NO: 726700 - RNA, 19 nt, Homo sapiens
gaaguugggagaaggacaa

SEQ ID NO: 726701 - RNA, 19 nt, Homo sapiens
uuuaggacaugaagaagaa

SEQ ID NO: 726702 - RNA, 19 nt, Homo sapiens
guagcgauaaguuugauuu

SEQ ID NO: 726703 - RNA, 19 nt, Homo sapiens
gcacucgucaaauaauuau

SEQ ID NO: 726704 - RNA, 19 nt, Homo sapiens
gaauuauugccaucacauu

SEQ ID NO: 726705 - RNA, 19 nt, Homo sapiens
cauaaccaccagcuuaauu

SEQ ID NO: 726706 - RNA, 19 nt, Homo sapiens
gaagaaguugggagaagga

SEQ ID NO: 726707 - RNA, 19 nt, Homo sapiens
caccaugucuuugaugaau

SEQ ID NO: 726708 - RNA, 19 nt, Homo sapiens
uaucagaacagcagcuuau

SEQ ID NO: 726709 - RNA, 19 nt, Homo sapiens
gaagaagaaguugggagaa

SEQ ID NO: 726710 - RNA, 19 nt, Homo sapiens
gccaccaugucuuugauga

SEQ ID NO: 726711 - RNA, 19 nt, Homo sapiens
aaucgacuccuaugaugua

SEQ ID NO: 726712 - RNA, 19 nt, Homo sapiens
gggaacgaaugucuauugg

SEQ ID NO: 726713 - RNA, 19 nt, Homo sapiens
ucacgaaguucaccuagcu

SEQ ID NO: 726714 - RNA, 19 nt, Homo sapiens
gaagaauaagacauuagga

SEQ ID NO: 726715 - RNA, 19 nt, Homo sapiens
caagaguccuuugcacuac

SEQ ID NO: 726716 - RNA, 19 nt, Homo sapiens
aacagcagcuuaugaacug

SEQ ID NO: 726717 - RNA, 19 nt, Homo sapiens
gccaugagaggguaucuug

SEQ ID NO: 726718 - RNA, 19 nt, Homo sapiens
gguaucuuguggccauauu

SEQ ID NO: 726719 - RNA, 19 nt, Homo sapiens
gaggaguuuugaagaauaa

SEQ ID NO: 726720 - RNA, 19 nt, Homo sapiens
ggaaaugaaacggagaaau

SEQ ID NO: 726721 - RNA, 19 nt, Homo sapiens
auucauaaccaccagcuua

SEQ ID NO: 726722 - RNA, 19 nt, Homo sapiens
ggacaugaagaagaaguug

SEQ ID NO: 726723 - RNA, 19 nt, Homo sapiens
ugagugcugucuuccucua

SEQ ID NO: 726724 - RNA, 19 nt, Homo sapiens
gauuugcccuaugggauga

SEQ ID NO: 726725 - RNA, 19 nt, Homo sapiens
uaaguuugauuugcccuau

SEQ ID NO: 726726 - RNA, 19 nt, Homo sapiens
aauaagauccagccuuguu

SEQ ID NO: 726727 - RNA, 19 nt, Homo sapiens
ucagaacagcagcuuauga

SEQ ID NO: 726728 - RNA, 19 nt, Homo sapiens
caaauccgaauauuagauc

SEQ ID NO: 726729 - RNA, 19 nt, Homo sapiens
agaagaugaugcuaacagu

SEQ ID NO: 726730 - RNA, 19 nt, Homo sapiens
cuacagacucagaagauga

SEQ ID NO: 726731 - RNA, 19 nt, Homo sapiens
uaagccacaugauuuaagg

SEQ ID NO: 726732 - RNA, 19 nt, Homo sapiens
gaguugugaucucuuugau

SEQ ID NO: 726733 - RNA, 19 nt, Homo sapiens
ggaauuauugccaucacau

SEQ ID NO: 726734 - RNA, 19 nt, Homo sapiens
ugaucucuuugaugaguuu

SEQ ID NO: 726735 - RNA, 19 nt, Homo sapiens
auaaccaccagcuuaauuu

SEQ ID NO: 726736 - RNA, 19 nt, Homo sapiens
aauaagaacgcguaucaca

SEQ ID NO: 726737 - RNA, 19 nt, Homo sapiens
cacaaugacccuaauacga

SEQ ID NO: 726738 - RNA, 19 nt, Homo sapiens
uuucagauccuauucacaa

SEQ ID NO: 726739 - RNA, 19 nt, Homo sapiens
gauccuuucauuaucagaa

SEQ ID NO: 726740 - RNA, 19 nt, Homo sapiens
ggacaaccuuccgacuuuu

SEQ ID NO: 726741 - RNA, 19 nt, Homo sapiens
aagauugacucuacagacu

SEQ ID NO: 726742 - RNA, 19 nt, Homo sapiens
caugagaggguaucuugug

SEQ ID NO: 726743 - RNA, 19 nt, Homo sapiens
ugagaacaucagcggaaua

SEQ ID NO: 726744 - RNA, 19 nt, Homo sapiens
cccaacaacaggaauuauu

SEQ ID NO: 726745 - RNA, 19 nt, Homo sapiens
aagaagaaguugggagaag

SEQ ID NO: 726746 - RNA, 19 nt, Homo sapiens
uugacaacauacccuguaa

SEQ ID NO: 726747 - RNA, 19 nt, Homo sapiens
gaaacggagaaauaagauc

SEQ ID NO: 726748 - RNA, 19 nt, Homo sapiens
uaugguagcgauaaguuug

SEQ ID NO: 726749 - RNA, 19 nt, Homo sapiens
guaugguagcgauaaguuu

SEQ ID NO: 726750 - RNA, 19 nt, Homo sapiens
acucagaagaugaugcuaa

SEQ ID NO: 726751 - RNA, 19 nt, Homo sapiens
agaguccuuugcacuacua

SEQ ID NO: 726752 - RNA, 19 nt, Homo sapiens
uggcaccuguggaaaugaa

SEQ ID NO: 726753 - RNA, 19 nt, Homo sapiens
gacaacauacccuguaaaa

SEQ ID NO: 726754 - RNA, 19 nt, Homo sapiens
gaugcacucgucaaauaau

SEQ ID NO: 726755 - RNA, 19 nt, Homo sapiens
aaaccuaaacacccaacaa

SEQ ID NO: 726756 - RNA, 19 nt, Homo sapiens
aaaaucgacuccuaugaug

SEQ ID NO: 726757 - RNA, 19 nt, Homo sapiens
uugaugaguuugacaacau

SEQ ID NO: 726758 - RNA, 19 nt, Homo sapiens
gcgccaccuuccuuugguu

SEQ ID NO: 726759 - RNA, 19 nt, Homo sapiens
ccaccagcuuaauuucugu

SEQ ID NO: 726760 - RNA, 19 nt, Homo sapiens
uuauguauacugucuguug

SEQ ID NO: 726761 - RNA, 19 nt, Homo sapiens
aagaugaugcuaacagugu

SEQ ID NO: 726762 - RNA, 19 nt, Homo sapiens
gaagaaagcuacucuaauu

SEQ ID NO: 726763 - RNA, 19 nt, Homo sapiens
ggacauggaucccggaaua

SEQ ID NO: 726764 - RNA, 19 nt, Homo sapiens
gaaugaaacugaagaagaa

SEQ ID NO: 726765 - RNA, 19 nt, Homo sapiens
ggaaauugcuagaguagaa

SEQ ID NO: 726766 - RNA, 19 nt, Homo sapiens
gcgaauaaaucaugaaaga

SEQ ID NO: 726767 - RNA, 19 nt, Homo sapiens
ccaacugccuugucaaaua

SEQ ID NO: 726768 - RNA, 19 nt, Homo sapiens
gaagauggaauuaugcaua

SEQ ID NO: 726769 - RNA, 19 nt, Homo sapiens
gcagauacuugcacgguuu

SEQ ID NO: 726770 - RNA, 19 nt, Homo sapiens
gaguagaacuagaauguga

SEQ ID NO: 726771 - RNA, 19 nt, Homo sapiens
gaagaucucucggaaaaua

SEQ ID NO: 726772 - RNA, 19 nt, Homo sapiens
gaacuagaaugugaaacaa

SEQ ID NO: 726773 - RNA, 19 nt, Homo sapiens
gagaagaaagcuacucuaa

SEQ ID NO: 726774 - RNA, 19 nt, Homo sapiens
gcagcagacuauuaauaaa

SEQ ID NO: 726775 - RNA, 19 nt, Homo sapiens
guacucaguugcagacauu

SEQ ID NO: 726776 - RNA, 19 nt, Homo sapiens
ccagugagcuugaguccuu

SEQ ID NO: 726777 - RNA, 19 nt, Homo sapiens
ggaggauacuuuagaacaa

SEQ ID NO: 726778 - RNA, 19 nt, Homo sapiens
auacagggcucaaguuuau

SEQ ID NO: 726779 - RNA, 19 nt, Homo sapiens
gaauugcagcagacuauua

SEQ ID NO: 726780 - RNA, 19 nt, Homo sapiens
ugagaacucugaaagaaga

SEQ ID NO: 726781 - RNA, 19 nt, Homo sapiens
gaaagcuacucuaauuaag

SEQ ID NO: 726782 - RNA, 19 nt, Homo sapiens
gugaagcuaugaaugaauu

SEQ ID NO: 726783 - RNA, 19 nt, Homo sapiens
ggaaugaggaguuaaaaua

SEQ ID NO: 726784 - RNA, 19 nt, Homo sapiens
agaagaaacugaagaugga

SEQ ID NO: 726785 - RNA, 19 nt, Homo sapiens
gauacauacugccaugaaa

SEQ ID NO: 726786 - RNA, 19 nt, Homo sapiens
cuaauagacugcaucaaga

SEQ ID NO: 726787 - RNA, 19 nt, Homo sapiens
uaaacaaaccgacaucuga

SEQ ID NO: 726788 - RNA, 19 nt, Homo sapiens
gaaagcaagagaaguguga

SEQ ID NO: 726789 - RNA, 19 nt, Homo sapiens
ggagaacacucgacuacag

SEQ ID NO: 726790 - RNA, 19 nt, Homo sapiens
aagaagagguuccaagaau

SEQ ID NO: 726791 - RNA, 19 nt, Homo sapiens
gaagaagagguuccaagaa

SEQ ID NO: 726792 - RNA, 19 nt, Homo sapiens
caaagaagcgauugaaaca

SEQ ID NO: 726793 - RNA, 19 nt, Homo sapiens
aaacacaauuagcagagua

SEQ ID NO: 726794 - RNA, 19 nt, Homo sapiens
gagauaaguaugagaagaa

SEQ ID NO: 726795 - RNA, 19 nt, Homo sapiens
ugaaugcaaugauaacaga

SEQ ID NO: 726796 - RNA, 19 nt, Homo sapiens
ugaggaaauugcuagagua

SEQ ID NO: 726797 - RNA, 19 nt, Homo sapiens
cauaauguguccaugaaau

SEQ ID NO: 726798 - RNA, 19 nt, Homo sapiens
gaugaucuuuaccaacaaa

SEQ ID NO: 726799 - RNA, 19 nt, Homo sapiens
gcugagaauuccaaagguu

SEQ ID NO: 726800 - RNA, 19 nt, Homo sapiens
gaaacugaagauggaauua

SEQ ID NO: 726801 - RNA, 19 nt, Homo sapiens
gcaaagaagcgauugaaac

SEQ ID NO: 726802 - RNA, 19 nt, Homo sapiens
cagaagaucucucggaaaa

SEQ ID NO: 726803 - RNA, 19 nt, Homo sapiens
cgacagcuuugaugagaug

SEQ ID NO: 726804 - RNA, 19 nt, Homo sapiens
caacugccuugucaaauac

SEQ ID NO: 726805 - RNA, 19 nt, Homo sapiens
aggcauacaugagcaauuu

SEQ ID NO: 726806 - RNA, 19 nt, Homo sapiens
gaacagauugcaagauugg

SEQ ID NO: 726807 - RNA, 19 nt, Homo sapiens
gcuaauagacugcaucaag

SEQ ID NO: 726808 - RNA, 19 nt, Homo sapiens
caugaaaucucuacaagcu

SEQ ID NO: 726809 - RNA, 19 nt, Homo sapiens
cgagaccacuuaaugacaa

SEQ ID NO: 726810 - RNA, 19 nt, Homo sapiens
gaugguugcuacacauguu

SEQ ID NO: 726811 - RNA, 19 nt, Homo sapiens
gaggauacuuuagaacaau

SEQ ID NO: 726812 - RNA, 19 nt, Homo sapiens
gaagaaugcaugucagaag

SEQ ID NO: 726813 - RNA, 19 nt, Homo sapiens
ucagugaagcuaugaauga

SEQ ID NO: 726814 - RNA, 19 nt, Homo sapiens
ugugagaacucugaaagaa

SEQ ID NO: 726815 - RNA, 19 nt, Homo sapiens
uuauguaccucuuaaggaa

SEQ ID NO: 726816 - RNA, 19 nt, Homo sapiens
gaaacacaauuagcagagu

SEQ ID NO: 726817 - RNA, 19 nt, Homo sapiens
gcaaaccacgacugaagaa

SEQ ID NO: 726818 - RNA, 19 nt, Homo sapiens
uggaugaucuuuaccaaca

SEQ ID NO: 726819 - RNA, 19 nt, Homo sapiens
ugaaugaaacugaagaaga

SEQ ID NO: 726820 - RNA, 19 nt, Homo sapiens
uagcagaguaucacaaauu

SEQ ID NO: 726821 - RNA, 19 nt, Homo sapiens
aaaccgacaucugaaagaa

SEQ ID NO: 726822 - RNA, 19 nt, Homo sapiens
uaucacaaauuggcuagaa

SEQ ID NO: 726823 - RNA, 19 nt, Homo sapiens
gagcgaauaaaucaugaaa

SEQ ID NO: 726824 - RNA, 19 nt, Homo sapiens
acacucgacuacagaauau

SEQ ID NO: 726825 - RNA, 19 nt, Homo sapiens
cuacaagcucccucuguua

SEQ ID NO: 726826 - RNA, 19 nt, Homo sapiens
aagaaugcaugucagaaga

SEQ ID NO: 726827 - RNA, 19 nt, Homo sapiens
uagagaauaugaagaaugc

SEQ ID NO: 726828 - RNA, 19 nt, Homo sapiens
aagaagcgauugaaacaca

SEQ ID NO: 726829 - RNA, 19 nt, Homo sapiens
gcagacauugagcgaauaa

SEQ ID NO: 726830 - RNA, 19 nt, Homo sapiens
gaagagguuccaagaaucu

SEQ ID NO: 726831 - RNA, 19 nt, Homo sapiens
gaauagucaacuugguaua

SEQ ID NO: 726832 - RNA, 19 nt, Homo sapiens
gauaacagaaagcaagaga

SEQ ID NO: 726833 - RNA, 19 nt, Homo sapiens
guuguggaaugaggaguua

SEQ ID NO: 726834 - RNA, 19 nt, Homo sapiens
cgaaucgucuagagucguu

SEQ ID NO: 726835 - RNA, 19 nt, Homo sapiens
gccgacagcuuugaugaga

SEQ ID NO: 726836 - RNA, 19 nt, Homo sapiens
ggaauagucaacuugguau

SEQ ID NO: 726837 - RNA, 19 nt, Homo sapiens
caaauacagggcucaaguu

SEQ ID NO: 726838 - RNA, 19 nt, Homo sapiens
ggaaaguugaguauaaaca

SEQ ID NO: 726839 - RNA, 19 nt, Homo sapiens
augaacagauugcaagauu

SEQ ID NO: 726840 - RNA, 19 nt, Homo sapiens
agucaaaacugaaggauuu

SEQ ID NO: 726841 - RNA, 19 nt, Homo sapiens
gcucaccuuuauuugauga

SEQ ID NO: 726842 - RNA, 19 nt, Homo sapiens
gagauuagagauaaguaug

SEQ ID NO: 726843 - RNA, 19 nt, Homo sapiens
gaaagaagaaguucaaaag

SEQ ID NO: 726844 - RNA, 19 nt, Homo sapiens
ccucauacauggccucaca

SEQ ID NO: 726845 - RNA, 19 nt, Homo sapiens
ugaagaagagguuccaaga

SEQ ID NO: 726846 - RNA, 19 nt, Homo sapiens
gagaccacuuaaugacaaa

SEQ ID NO: 726847 - RNA, 19 nt, Homo sapiens
caagagaagugugagaacu

SEQ ID NO: 726848 - RNA, 19 nt, Homo sapiens
uaacagaaagcaagagaag

SEQ ID NO: 726849 - RNA, 19 nt, Homo sapiens
agaaaagucucgcuauuug

SEQ ID NO: 726850 - RNA, 19 nt, Homo sapiens
ucuacaagcucccucuguu

SEQ ID NO: 726851 - RNA, 19 nt, Homo sapiens
gacccgagaccacuuaaug

SEQ ID NO: 726852 - RNA, 19 nt, Homo sapiens
gaaugcaugucagaagauc

SEQ ID NO: 726853 - RNA, 19 nt, Homo sapiens
gacgaaaagugggaaauaa

SEQ ID NO: 726854 - RNA, 19 nt, Homo sapiens
cuaaaggugcugagaauuc

SEQ ID NO: 726855 - RNA, 19 nt, Homo sapiens
gcaauuuggagucucauuc

SEQ ID NO: 726856 - RNA, 19 nt, Homo sapiens
ugaacagauugcaagauug

SEQ ID NO: 726857 - RNA, 19 nt, Homo sapiens
aaacaaaccgacaucugaa

SEQ ID NO: 726858 - RNA, 19 nt, Homo sapiens
aaccacgacugaagaaaga

SEQ ID NO: 726859 - RNA, 19 nt, Homo sapiens
gcgggaauaccaacuaguu

SEQ ID NO: 726860 - RNA, 19 nt, Homo sapiens
aaauacagggcucaaguuu

SEQ ID NO: 726861 - RNA, 19 nt, Homo sapiens
gagaacacucgacuacaga

SEQ ID NO: 726862 - RNA, 19 nt, Homo sapiens
gaagcacucucacuuauua

SEQ ID NO: 726863 - RNA, 19 nt, Homo sapiens
gcaaagaccuacccagaua

SEQ ID NO: 726864 - RNA, 19 nt, Homo sapiens
gagggaagauuguuguuua

SEQ ID NO: 726865 - RNA, 19 nt, Homo sapiens
gaaaugaugucaagaaugg

SEQ ID NO: 726866 - RNA, 19 nt, Homo sapiens
caaauucucugauucuaga

SEQ ID NO: 726867 - RNA, 19 nt, Homo sapiens
gccaagaauucauaagaua

SEQ ID NO: 726868 - RNA, 19 nt, Homo sapiens
caacauaugguagggauua

SEQ ID NO: 726869 - RNA, 19 nt, Homo sapiens
gcaagaauggcaucucuaa

SEQ ID NO: 726870 - RNA, 19 nt, Homo sapiens
gguggaagaugcagaaaug

SEQ ID NO: 726871 - RNA, 19 nt, Homo sapiens
caaccuagcuguuuauggu

SEQ ID NO: 726872 - RNA, 19 nt, Homo sapiens
gaaaacuccucuucacaua

SEQ ID NO: 726873 - RNA, 19 nt, Homo sapiens
gguggaagcugccaagguu

SEQ ID NO: 726874 - RNA, 19 nt, Homo sapiens
ggacagacaucaacuuuug

SEQ ID NO: 726875 - RNA, 19 nt, Homo sapiens
gggaagcacucucacuuau

SEQ ID NO: 726876 - RNA, 19 nt, Homo sapiens
ggaaagcuauaugcaagaa

SEQ ID NO: 726877 - RNA, 19 nt, Homo sapiens
ccacauagaaucaacauau

SEQ ID NO: 726878 - RNA, 19 nt, Homo sapiens
gcagaaaugaugucaagaa

SEQ ID NO: 726879 - RNA, 19 nt, Homo sapiens
gagcaaauauccagaacag

SEQ ID NO: 726880 - RNA, 19 nt, Homo sapiens
ggagaagaaucagcuguga

SEQ ID NO: 726881 - RNA, 19 nt, Homo sapiens
gaauguugcugcugcuguu

SEQ ID NO: 726882 - RNA, 19 nt, Homo sapiens
gaagaaaugcugccuaggu

SEQ ID NO: 726883 - RNA, 19 nt, Homo sapiens
gagccagucuacuugauga

SEQ ID NO: 726884 - RNA, 19 nt, Homo sapiens
ucacacagguauucaggaa

SEQ ID NO: 726885 - RNA, 19 nt, Homo sapiens
gaagcaagagggaagauug

SEQ ID NO: 726886 - RNA, 19 nt, Homo sapiens
ucaaagcacaacucuauuu

SEQ ID NO: 726887 - RNA, 19 nt, Homo sapiens
uaaccaaccuuacaucaac

SEQ ID NO: 726888 - RNA, 19 nt, Homo sapiens
cagaaaugaugucaagaau

SEQ ID NO: 726889 - RNA, 19 nt, Homo sapiens
gagaagggccucagaagca

SEQ ID NO: 726890 - RNA, 19 nt, Homo sapiens
gagccaagaauucauaaga

SEQ ID NO: 726891 - RNA, 19 nt, Homo sapiens
gauuggcacuucugguuga

SEQ ID NO: 726892 - RNA, 19 nt, Homo sapiens
ucaucaaccuagcuguuua

SEQ ID NO: 726893 - RNA, 19 nt, Homo sapiens
ggaagaugcagaaaugaug

SEQ ID NO: 726894 - RNA, 19 nt, Homo sapiens
ggugaccucuuucgaugaa

SEQ ID NO: 726895 - RNA, 19 nt, Homo sapiens
uaagaggacuuuugaagaa

SEQ ID NO: 726896 - RNA, 19 nt, Homo sapiens
aaagcuauaugcaagaaug

SEQ ID NO: 726897 - RNA, 19 nt, Homo sapiens
ggaagcacucucacuuauu

SEQ ID NO: 726898 - RNA, 19 nt, Homo sapiens
caacuacagucuggugaug

SEQ ID NO: 726899 - RNA, 19 nt, Homo sapiens
cuuccaguauuaucaguua

SEQ ID NO: 726900 - RNA, 19 nt, Homo sapiens
caacucuauuucaugcuuu

SEQ ID NO: 726901 - RNA, 19 nt, Homo sapiens
ccucuucacauaacaauuu

SEQ ID NO: 726902 - RNA, 19 nt, Homo sapiens
gcuguuguuucuuauguug

SEQ ID NO: 726903 - RNA, 19 nt, Homo sapiens
gcaagagggaagauuguug

SEQ ID NO: 726904 - RNA, 19 nt, Homo sapiens
gcagagaagggccucagaa

SEQ ID NO: 726905 - RNA, 19 nt, Homo sapiens
aagaugggcuggagaaagu

SEQ ID NO: 726906 - RNA, 19 nt, Homo sapiens
gggcuguuguuucuuaugu

SEQ ID NO: 726907 - RNA, 19 nt, Homo sapiens
cuucaaagcacaacucuau

SEQ ID NO: 726908 - RNA, 19 nt, Homo sapiens
ccaaagcagaugaauguug

SEQ ID NO: 726909 - RNA, 19 nt, Homo sapiens
aagaauggcaucucuaaga

SEQ ID NO: 726910 - RNA, 19 nt, Homo sapiens
gggaagauuguuguuuaua

SEQ ID NO: 726911 - RNA, 19 nt, Homo sapiens
ggucuuggcagcagcauug

SEQ ID NO: 726912 - RNA, 19 nt, Homo sapiens
gaagaacaagguggaguug

SEQ ID NO: 726913 - RNA, 19 nt, Homo sapiens
gaagaugcagaaaugaugu

SEQ ID NO: 726914 - RNA, 19 nt, Homo sapiens
cuagaaacaguaagaaaga

SEQ ID NO: 726915 - RNA, 19 nt, Homo sapiens
ugacgcaggaaccuucuua

SEQ ID NO: 726916 - RNA, 19 nt, Homo sapiens
guuggugccuuccaguauu

SEQ ID NO: 726917 - RNA, 19 nt, Homo sapiens
guaaagcccagaacagauc

SEQ ID NO: 726918 - RNA, 19 nt, Homo sapiens
cuugauacuuuccaaauuc

SEQ ID NO: 726919 - RNA, 19 nt, Homo sapiens
aagcacaacucuauuucau

SEQ ID NO: 726920 - RNA, 19 nt, Homo sapiens
uuugggcuguuguuucuua

SEQ ID NO: 726921 - RNA, 19 nt, Homo sapiens
gagaagggacagacaucaa

SEQ ID NO: 726922 - RNA, 19 nt, Homo sapiens
ucgaugaacugcagagaag

SEQ ID NO: 726923 - RNA, 19 nt, Homo sapiens
gcgauuggcacuucugguu

SEQ ID NO: 726924 - RNA, 19 nt, Homo sapiens
caaagcacaacucuauuuc

SEQ ID NO: 726925 - RNA, 19 nt, Homo sapiens
gguggagccuuuauaucau

SEQ ID NO: 726926 - RNA, 19 nt, Homo sapiens
ugauggcgguggagccuuu

SEQ ID NO: 726927 - RNA, 19 nt, Homo sapiens
caaauauccagaacagguu

SEQ ID NO: 726928 - RNA, 19 nt, Homo sapiens
agagaucacugggagcaaa

SEQ ID NO: 726929 - RNA, 19 nt, Homo sapiens
aaacuccucuucacauaac

SEQ ID NO: 726930 - RNA, 19 nt, Homo sapiens
uugcagacauggaagaaau

SEQ ID NO: 726931 - RNA, 19 nt, Homo sapiens
gauacugauuccuucaaca

SEQ ID NO: 726932 - RNA, 19 nt, Homo sapiens
acucaaggacggugcaaua

SEQ ID NO: 726933 - RNA, 19 nt, Homo sapiens
ccacugggcugcaauucac

SEQ ID NO: 726934 - RNA, 19 nt, Homo sapiens
gguaaauauuuccaacuac

SEQ ID NO: 726935 - RNA, 19 nt, Homo sapiens
caucuacaguccucacaca

SEQ ID NO: 726936 - RNA, 19 nt, Homo sapiens
caagagggaagauuguugu

SEQ ID NO: 726937 - RNA, 19 nt, Homo sapiens
uacaucaacuacucaagga

SEQ ID NO: 726938 - RNA, 19 nt, Homo sapiens
cauugggacuccuccagaa

SEQ ID NO: 726939 - RNA, 19 nt, Homo sapiens
uuggugccuuccaguauua

SEQ ID NO: 726940 - RNA, 19 nt, Homo sapiens
ugggaagcacucucacuua

SEQ ID NO: 726941 - RNA, 19 nt, Homo sapiens
guggagccuuuauaucaug

SEQ ID NO: 726942 - RNA, 19 nt, Homo sapiens
cgguggagccuuuauauca

SEQ ID NO: 726943 - RNA, 19 nt, Homo sapiens
gggcauuucuuuauaucac

SEQ ID NO: 726944 - RNA, 19 nt, Homo sapiens
acaacucuauuucaugcuu

SEQ ID NO: 726945 - RNA, 19 nt, Homo sapiens
gauccaaagcagaugaaug

SEQ ID NO: 726946 - RNA, 19 nt, Homo sapiens
agaacaagguggaguuggu

SEQ ID NO: 726947 - RNA, 19 nt, Homo sapiens
cacucucacuuauuaaaga

SEQ ID NO: 726948 - RNA, 19 nt, Homo sapiens
gcuuuggcaucucucauuc

SEQ ID NO: 726949 - RNA, 19 nt, Homo sapiens
guggagauguugcuaaagc

SEQ ID NO: 726950 - RNA, 19 nt, Homo sapiens
gguccuagaaacaguaaga

SEQ ID NO: 726951 - RNA, 19 nt, Homo sapiens
ggagaagggacagacauca

SEQ ID NO: 726952 - RNA, 19 nt, Homo sapiens
uaugagcgauuggcacuuc

SEQ ID NO: 726953 - RNA, 19 nt, Homo sapiens
cuggacagcugggauguug

SEQ ID NO: 726954 - RNA, 19 nt, Homo sapiens
gcccagaacagauccuaug

SEQ ID NO: 726955 - RNA, 19 nt, Homo sapiens
ccaagaauucauaagauag

SEQ ID NO: 726956 - RNA, 19 nt, Homo sapiens
gaaacaguaagaaagaaac

SEQ ID NO: 726957 - RNA, 19 nt, Homo sapiens
cuaaagcaaucaucaaccu

SEQ ID NO: 726958 - RNA, 19 nt, Homo sapiens
agaccuacccagauacuga

SEQ ID NO: 726959 - RNA, 19 nt, Homo sapiens
caagaaaaccaacuggaaa

SEQ ID NO: 726960 - RNA, 19 nt, Homo sapiens
gguaaagcccagaacagau

SEQ ID NO: 726961 - RNA, 19 nt, Homo sapiens
uaaagcaaucaucaaccua

SEQ ID NO: 726962 - RNA, 19 nt, Homo sapiens
gaccacagcuucucccuuu

SEQ ID NO: 726963 - RNA, 19 nt, Homo sapiens
ccaccaggcugagcaguga

SEQ ID NO: 726964 - RNA, 19 nt, Homo sapiens
gcagugaggagagaaaguu

SEQ ID NO: 726965 - RNA, 19 nt, Homo sapiens
gaugaaaugcugccgcaau

SEQ ID NO: 726966 - RNA, 19 nt, Homo sapiens
aguaaccacuuucagcaaa

SEQ ID NO: 726967 - RNA, 19 nt, Homo sapiens
gaagguguccugugucacu

SEQ ID NO: 726968 - RNA, 19 nt, Homo sapiens
ccaggugaacauuaacuuu

SEQ ID NO: 726969 - RNA, 19 nt, Homo sapiens
gcuccaggcugaccagaac

SEQ ID NO: 726970 - RNA, 19 nt, Homo sapiens
ugccuucucugcccaaaug

SEQ ID NO: 726971 - RNA, 19 nt, Homo sapiens
gcugagcagugaggagaga

SEQ ID NO: 726972 - RNA, 19 nt, Homo sapiens
gacucuguauucccucuug

SEQ ID NO: 726973 - RNA, 19 nt, Homo sapiens
augaaaugcugccgcaaug

SEQ ID NO: 726974 - RNA, 19 nt, Homo sapiens
caggugaacauuaacuuuc

SEQ ID NO: 726975 - RNA, 19 nt, Homo sapiens
gcacaggagcagagaagac

SEQ ID NO: 726976 - RNA, 19 nt, Homo sapiens
cuucucugcccaaaugaua

SEQ ID NO: 726977 - RNA, 19 nt, Homo sapiens
guaaccacuuucagcaaaa

SEQ ID NO: 726978 - RNA, 19 nt, Homo sapiens
cggcuucacccuagucuca

SEQ ID NO: 726979 - RNA, 19 nt, Homo sapiens
gaccacagcuucucccuuu

SEQ ID NO: 726980 - RNA, 19 nt, Homo sapiens
gggacucucucaaagauaa

SEQ ID NO: 726981 - RNA, 19 nt, Homo sapiens
ccaccaggcugagcaguga

SEQ ID NO: 726982 - RNA, 19 nt, Homo sapiens
gucaaucucuuccacucua

SEQ ID NO: 726983 - RNA, 19 nt, Homo sapiens
ccaacuggcugagugauuc

SEQ ID NO: 726984 - RNA, 19 nt, Homo sapiens
gcagugaggagagaaaguu

SEQ ID NO: 726985 - RNA, 19 nt, Homo sapiens
gcugagugauucgaagaaa

SEQ ID NO: 726986 - RNA, 19 nt, Homo sapiens
gaugaaaugcugccgcaau

SEQ ID NO: 726987 - RNA, 19 nt, Homo sapiens
gaagguguccugugucacu

SEQ ID NO: 726988 - RNA, 19 nt, Homo sapiens
ccaggugaacauuaacuuu

SEQ ID NO: 726989 - RNA, 19 nt, Homo sapiens
ucaaucucuuccacucuaa

SEQ ID NO: 726990 - RNA, 19 nt, Homo sapiens
gcuccaggcugaccagaac

SEQ ID NO: 726991 - RNA, 19 nt, Homo sapiens
gcugagcagugaggagaga

SEQ ID NO: 726992 - RNA, 19 nt, Homo sapiens
cgaagaaagugaggaaucc

SEQ ID NO: 726993 - RNA, 19 nt, Homo sapiens
gacucuguauucccucuug

SEQ ID NO: 726994 - RNA, 19 nt, Homo sapiens
augaaaugcugccgcaaug

SEQ ID NO: 726995 - RNA, 19 nt, Homo sapiens
caggugaacauuaacuuuc

SEQ ID NO: 726996 - RNA, 19 nt, Homo sapiens
aauccucccuggacacugu

SEQ ID NO: 726997 - RNA, 19 nt, Homo sapiens
gcacaggagcagagaagac

SEQ ID NO: 726998 - RNA, 19 nt, Homo sapiens
ugagugauucgaagaaagu

SEQ ID NO: 726999 - RNA, 19 nt, Homo sapiens
cggcuucacccuagucuca

SEQ ID NO: 727000 - RNA, 19 nt, Homo sapiens
gaccacagcuucucccuuu

SEQ ID NO: 727001 - RNA, 19 nt, Homo sapiens
ccaccaggcugagcaguga

SEQ ID NO: 727002 - RNA, 19 nt, Homo sapiens
gcagugaggagagaaaguu

SEQ ID NO: 727003 - RNA, 19 nt, Homo sapiens
gaugaaaugcugccgcaau

SEQ ID NO: 727004 - RNA, 19 nt, Homo sapiens
gaagguguccugugucacu

SEQ ID NO: 727005 - RNA, 19 nt, Homo sapiens
ccaggugaacauuaacuuu

SEQ ID NO: 727006 - RNA, 19 nt, Homo sapiens
gcugagcagugaggagaga

SEQ ID NO: 727007 - RNA, 19 nt, Homo sapiens
ucacccuagucucagauaa

SEQ ID NO: 727008 - RNA, 19 nt, Homo sapiens
gacucuguauucccucuug

SEQ ID NO: 727009 - RNA, 19 nt, Homo sapiens
augaaaugcugccgcaaug

SEQ ID NO: 727010 - RNA, 19 nt, Homo sapiens
caggugaacauuaacuuuc

SEQ ID NO: 727011 - RNA, 19 nt, Homo sapiens
gcuucacccuagucucaga

SEQ ID NO: 727012 - RNA, 19 nt, Homo sapiens
cggcuucacccuagucuca

SEQ ID NO: 727013 - RNA, 19 nt, Homo sapiens
gaccacagcuucucccuuu

SEQ ID NO: 727014 - RNA, 19 nt, Homo sapiens
uaucgccucugcccacuua

SEQ ID NO: 727015 - RNA, 19 nt, Homo sapiens
ccaccaggcugagcaguga

SEQ ID NO: 727016 - RNA, 19 nt, Homo sapiens
ccacuuacccuuacuccuu

SEQ ID NO: 727017 - RNA, 19 nt, Homo sapiens
caaguuaaucucccuguau

SEQ ID NO: 727018 - RNA, 19 nt, Homo sapiens
gcagugaggagagaaaguu

SEQ ID NO: 727019 - RNA, 19 nt, Homo sapiens
gaugaaaugcugccgcaau

SEQ ID NO: 727020 - RNA, 19 nt, Homo sapiens
gaagguguccugugucacu

SEQ ID NO: 727021 - RNA, 19 nt, Homo sapiens
acaaguuaaucucccugua

SEQ ID NO: 727022 - RNA, 19 nt, Homo sapiens
cacuuacccuuacuccuuu

SEQ ID NO: 727023 - RNA, 19 nt, Homo sapiens
ccaggugaacauuaacuuu

SEQ ID NO: 727024 - RNA, 19 nt, Homo sapiens
gcugagcagugaggagaga

SEQ ID NO: 727025 - RNA, 19 nt, Homo sapiens
gacucuguauucccucuug

SEQ ID NO: 727026 - RNA, 19 nt, Homo sapiens
augaaaugcugccgcaaug

SEQ ID NO: 727027 - RNA, 19 nt, Homo sapiens
caggugaacauuaacuuuc

SEQ ID NO: 727028 - RNA, 19 nt, Homo sapiens
aaguuaaucucccuguauc

SEQ ID NO: 727029 - RNA, 19 nt, Homo sapiens
gggccaugcugcagguaca

SEQ ID NO: 727030 - RNA, 19 nt, Homo sapiens
gcagguacaaguuaaucuc

SEQ ID NO: 727031 - RNA, 19 nt, Homo sapiens
aagcugagguccugugauu

SEQ ID NO: 727032 - RNA, 19 nt, Homo sapiens
gagguccugugauuccauu

SEQ ID NO: 727033 - RNA, 19 nt, Homo sapiens
cggaggcucugggagauuu

SEQ ID NO: 727034 - RNA, 19 nt, Homo sapiens
gcuccaggcugaccagaac

SEQ ID NO: 727035 - RNA, 19 nt, Homo sapiens
gcacaggagcagagaagac

SEQ ID NO: 727036 - RNA, 19 nt, Homo sapiens
ccacuggcaccuaaagaca

SEQ ID NO: 727037 - RNA, 19 nt, Homo sapiens
cggcuucacccuagucuca

SEQ ID NO: 727038 - RNA, 19 nt, Homo sapiens
gguccugugauuccauuug

SEQ ID NO: 727039 - RNA, 19 nt, Homo sapiens
caagggaucugcagacuuu

SEQ ID NO: 727040 - RNA, 19 nt, Homo sapiens
gaauagguguugcguauca

SEQ ID NO: 727041 - RNA, 19 nt, Homo sapiens
gugaagagcugauaaaaga

SEQ ID NO: 727042 - RNA, 19 nt, Homo sapiens
gaaugaauuuagcaccaaa

SEQ ID NO: 727043 - RNA, 19 nt, Homo sapiens
aaauacagaugaagaagga

SEQ ID NO: 727044 - RNA, 19 nt, Homo sapiens
gcagggauguugaaguauc

SEQ ID NO: 727045 - RNA, 19 nt, Homo sapiens
aggcagggauguugaagua

SEQ ID NO: 727046 - RNA, 19 nt, Homo sapiens
uggaauagguguugcguau

SEQ ID NO: 727047 - RNA, 19 nt, Homo sapiens
gaauguguggcuuauagua

SEQ ID NO: 727048 - RNA, 19 nt, Homo sapiens
uaaaggaauguguggcuua

SEQ ID NO: 727049 - RNA, 19 nt, Homo sapiens
gauaguagcguguccacau

SEQ ID NO: 727050 - RNA, 19 nt, Homo sapiens
cccaagggcuuaaaggaau

SEQ ID NO: 727051 - RNA, 19 nt, Homo sapiens
gcagugcucuuggcagaca

SEQ ID NO: 727052 - RNA, 19 nt, Homo sapiens
gaaguaucccaagggcuua

SEQ ID NO: 727053 - RNA, 19 nt, Homo sapiens
aaaggaauguguggcuuau

SEQ ID NO: 727054 - RNA, 19 nt, Homo sapiens
ggaaggcagggauguugaa

SEQ ID NO: 727055 - RNA, 19 nt, Homo sapiens
gcucugaucccuggaauag

SEQ ID NO: 727056 - RNA, 19 nt, Homo sapiens
gaaacgggaccucuuacca

SEQ ID NO: 727057 - RNA, 19 nt, Homo sapiens
caaaggugaagagcugaua

SEQ ID NO: 727058 - RNA, 19 nt, Homo sapiens
ugaaugaauuuagcaccaa

SEQ ID NO: 727059 - RNA, 19 nt, Homo sapiens
aggaauguguggcuuauag

SEQ ID NO: 727060 - RNA, 19 nt, Homo sapiens
ccaagggcuuaaaggaaug

SEQ ID NO: 727061 - RNA, 19 nt, Homo sapiens
ccacauuguccuuugagaa

SEQ ID NO: 727062 - RNA, 19 nt, Homo sapiens
ucaccagccuucuccuugu

SEQ ID NO: 727063 - RNA, 19 nt, Homo sapiens
gaaaagagaaaccagagau

SEQ ID NO: 727064 - RNA, 19 nt, Homo sapiens
auaguagcguguccacauu

SEQ ID NO: 727065 - RNA, 19 nt, Homo sapiens
gcaagggaucugcagacuu

SEQ ID NO: 727066 - RNA, 19 nt, Homo sapiens
ucugaucccuggaauaggu

SEQ ID NO: 727067 - RNA, 19 nt, Homo sapiens
agugaaacgggaccucuua

SEQ ID NO: 727068 - RNA, 19 nt, Homo sapiens
agacaugaggcaacgauug

SEQ ID NO: 727069 - RNA, 19 nt, Homo sapiens
cacauuguccuuugagaau

SEQ ID NO: 727070 - RNA, 19 nt, Homo sapiens
ucucaagccagacauguga

SEQ ID NO: 727071 - RNA, 19 nt, Homo sapiens
gcagacaugaggcaacgau

SEQ ID NO: 727072 - RNA, 19 nt, Homo sapiens
ggacccucauuuaggaucu

SEQ ID NO: 727073 - RNA, 19 nt, Homo sapiens
ggagaacucagggaaagag

SEQ ID NO: 727074 - RNA, 19 nt, Homo sapiens
aaaggugaagagcugauaa

SEQ ID NO: 727075 - RNA, 19 nt, Homo sapiens
gcuacgccacgcagugaaa

SEQ ID NO: 727076 - RNA, 19 nt, Homo sapiens
ucggagaacucagggaaag

SEQ ID NO: 727077 - RNA, 19 nt, Homo sapiens
gcuuauaguagguguucaa

SEQ ID NO: 727078 - RNA, 19 nt, Homo sapiens
ggaauguguggcuuauagu

SEQ ID NO: 727079 - RNA, 19 nt, Homo sapiens
uguccacauuguccuuuga

SEQ ID NO: 727080 - RNA, 19 nt, Homo sapiens
caccagccuucuccuugug

SEQ ID NO: 727081 - RNA, 19 nt, Homo sapiens
aagagaaaccagagaugga

SEQ ID NO: 727082 - RNA, 19 nt, Homo sapiens
auacagaugaagaaggaaa

SEQ ID NO: 727083 - RNA, 19 nt, Homo sapiens
cgugacauuugcucugauc

SEQ ID NO: 727084 - RNA, 19 nt, Homo sapiens
ucccaagggcuuaaaggaa

SEQ ID NO: 727085 - RNA, 19 nt, Homo sapiens
caagggaucugcagacuuu

SEQ ID NO: 727086 - RNA, 19 nt, Homo sapiens
ccaccgggaauuagaaaua

SEQ ID NO: 727087 - RNA, 19 nt, Homo sapiens
ggaauuagaaauaccaucu

SEQ ID NO: 727088 - RNA, 19 nt, Homo sapiens
gauaguagcguguccacau

SEQ ID NO: 727089 - RNA, 19 nt, Homo sapiens
ucagugcgaggacaaauaa

SEQ ID NO: 727090 - RNA, 19 nt, Homo sapiens
agacaacgcuguggauaag

SEQ ID NO: 727091 - RNA, 19 nt, Homo sapiens
gcagugcucuuggcagaca

SEQ ID NO: 727092 - RNA, 19 nt, Homo sapiens
gugagagaccggaguauga

SEQ ID NO: 727093 - RNA, 19 nt, Homo sapiens
ggucuguggcucugacuaa

SEQ ID NO: 727094 - RNA, 19 nt, Homo sapiens
uaaggagaguagagacuuc

SEQ ID NO: 727095 - RNA, 19 nt, Homo sapiens
cagacaacgcuguggauaa

SEQ ID NO: 727096 - RNA, 19 nt, Homo sapiens
gaaacgggaccucuuacca

SEQ ID NO: 727097 - RNA, 19 nt, Homo sapiens
ccacauuguccuuugagaa

SEQ ID NO: 727098 - RNA, 19 nt, Homo sapiens
ucaccagccuucuccuugu

SEQ ID NO: 727099 - RNA, 19 nt, Homo sapiens
acaacgcuguggauaagga

SEQ ID NO: 727100 - RNA, 19 nt, Homo sapiens
gcaagggaucugcagacuu

SEQ ID NO: 727101 - RNA, 19 nt, Homo sapiens
auaguagcguguccacauu

SEQ ID NO: 727102 - RNA, 19 nt, Homo sapiens
agugaaacgggaccucuua

SEQ ID NO: 727103 - RNA, 19 nt, Homo sapiens
agacaugaggcaacgauug

SEQ ID NO: 727104 - RNA, 19 nt, Homo sapiens
cacauuguccuuugagaau

SEQ ID NO: 727105 - RNA, 19 nt, Homo sapiens
ucucaagccagacauguga

SEQ ID NO: 727106 - RNA, 19 nt, Homo sapiens
gcagacaugaggcaacgau

SEQ ID NO: 727107 - RNA, 19 nt, Homo sapiens
caugugagagaccggagua

SEQ ID NO: 727108 - RNA, 19 nt, Homo sapiens
gaauuagaaauaccaucug

SEQ ID NO: 727109 - RNA, 19 nt, Homo sapiens
ggagaacucagggaaagag

SEQ ID NO: 727110 - RNA, 19 nt, Homo sapiens
gauaaggagaguagagacu

SEQ ID NO: 727111 - RNA, 19 nt, Homo sapiens
gcuacgccacgcagugaaa

SEQ ID NO: 727112 - RNA, 19 nt, Homo sapiens
ucggagaacucagggaaag

SEQ ID NO: 727113 - RNA, 19 nt, Homo sapiens
ggacaaauaaaaguaguga

SEQ ID NO: 727114 - RNA, 19 nt, Homo sapiens
uguccacauuguccuuuga

SEQ ID NO: 727115 - RNA, 19 nt, Homo sapiens
cuuccugccuccugucuuc

SEQ ID NO: 727116 - RNA, 19 nt, Homo sapiens
caccagccuucuccuugug

SEQ ID NO: 727117 - RNA, 19 nt, Homo sapiens
caccgggaauuagaaauac

SEQ ID NO: 727118 - RNA, 19 nt, Homo sapiens
caagggaucugcagacuuu

SEQ ID NO: 727119 - RNA, 19 nt, Homo sapiens
gaauagguguugcguauca

SEQ ID NO: 727120 - RNA, 19 nt, Homo sapiens
gugaagagcugauaaaaga

SEQ ID NO: 727121 - RNA, 19 nt, Homo sapiens
gaaugaauuuagcaccaaa

SEQ ID NO: 727122 - RNA, 19 nt, Homo sapiens
aaauacagaugaagaagga

SEQ ID NO: 727123 - RNA, 19 nt, Homo sapiens
gcagggauguugaaguauc

SEQ ID NO: 727124 - RNA, 19 nt, Homo sapiens
aggcagggauguugaagua

SEQ ID NO: 727125 - RNA, 19 nt, Homo sapiens
uggaauagguguugcguau

SEQ ID NO: 727126 - RNA, 19 nt, Homo sapiens
gaauguguggcuuauagua

SEQ ID NO: 727127 - RNA, 19 nt, Homo sapiens
uaaaggaauguguggcuua

SEQ ID NO: 727128 - RNA, 19 nt, Homo sapiens
ccaccgggaauuagaaaua

SEQ ID NO: 727129 - RNA, 19 nt, Homo sapiens
ggaauuagaaauaccaucu

SEQ ID NO: 727130 - RNA, 19 nt, Homo sapiens
gauaguagcguguccacau

SEQ ID NO: 727131 - RNA, 19 nt, Homo sapiens
cccaagggcuuaaaggaau

SEQ ID NO: 727132 - RNA, 19 nt, Homo sapiens
gcagugcucuuggcagaca

SEQ ID NO: 727133 - RNA, 19 nt, Homo sapiens
gaaguaucccaagggcuua

SEQ ID NO: 727134 - RNA, 19 nt, Homo sapiens
aaaggaauguguggcuuau

SEQ ID NO: 727135 - RNA, 19 nt, Homo sapiens
ggaaggcagggauguugaa

SEQ ID NO: 727136 - RNA, 19 nt, Homo sapiens
gcucugaucccuggaauag

SEQ ID NO: 727137 - RNA, 19 nt, Homo sapiens
gaaacgggaccucuuacca

SEQ ID NO: 727138 - RNA, 19 nt, Homo sapiens
caaaggugaagagcugaua

SEQ ID NO: 727139 - RNA, 19 nt, Homo sapiens
ugaaugaauuuagcaccaa

SEQ ID NO: 727140 - RNA, 19 nt, Homo sapiens
aggaauguguggcuuauag

SEQ ID NO: 727141 - RNA, 19 nt, Homo sapiens
ccaagggcuuaaaggaaug

SEQ ID NO: 727142 - RNA, 19 nt, Homo sapiens
ccacauuguccuuugagaa

SEQ ID NO: 727143 - RNA, 19 nt, Homo sapiens
ucaccagccuucuccuugu

SEQ ID NO: 727144 - RNA, 19 nt, Homo sapiens
gaaaagagaaaccagagau

SEQ ID NO: 727145 - RNA, 19 nt, Homo sapiens
auaguagcguguccacauu

SEQ ID NO: 727146 - RNA, 19 nt, Homo sapiens
gcaagggaucugcagacuu

SEQ ID NO: 727147 - RNA, 19 nt, Homo sapiens
ucugaucccuggaauaggu

SEQ ID NO: 727148 - RNA, 19 nt, Homo sapiens
agugaaacgggaccucuua

SEQ ID NO: 727149 - RNA, 19 nt, Homo sapiens
agacaugaggcaacgauug

SEQ ID NO: 727150 - RNA, 19 nt, Homo sapiens
cacauuguccuuugagaau

SEQ ID NO: 727151 - RNA, 19 nt, Homo sapiens
ucucaagccagacauguga

SEQ ID NO: 727152 - RNA, 19 nt, Homo sapiens
gcagacaugaggcaacgau

SEQ ID NO: 727153 - RNA, 19 nt, Homo sapiens
gaauuagaaauaccaucug

SEQ ID NO: 727154 - RNA, 19 nt, Homo sapiens
ggagaacucagggaaagag

SEQ ID NO: 727155 - RNA, 19 nt, Homo sapiens
aaaggugaagagcugauaa

SEQ ID NO: 727156 - RNA, 19 nt, Homo sapiens
gcuacgccacgcagugaaa

SEQ ID NO: 727157 - RNA, 19 nt, Homo sapiens
ucggagaacucagggaaag

SEQ ID NO: 727158 - RNA, 19 nt, Homo sapiens
gcuuauaguagguguucaa

SEQ ID NO: 727159 - RNA, 19 nt, Homo sapiens
ggaauguguggcuuauagu

SEQ ID NO: 727160 - RNA, 19 nt, Homo sapiens
caccagccuucuccuugug

SEQ ID NO: 727161 - RNA, 19 nt, Homo sapiens
uguccacauuguccuuuga

SEQ ID NO: 727162 - RNA, 19 nt, Homo sapiens
aagagaaaccagagaugga

SEQ ID NO: 727163 - RNA, 19 nt, Homo sapiens
auacagaugaagaaggaaa

SEQ ID NO: 727164 - RNA, 19 nt, Homo sapiens
cgugacauuugcucugauc

SEQ ID NO: 727165 - RNA, 19 nt, Homo sapiens
caccgggaauuagaaauac

SEQ ID NO: 727166 - RNA, 19 nt, Homo sapiens
ucccaagggcuuaaaggaa

SEQ ID NO: 727167 - RNA, 19 nt, Homo sapiens
gauaguagcguguccacau

SEQ ID NO: 727168 - RNA, 19 nt, Homo sapiens
ucagugcgaggacaaauaa

SEQ ID NO: 727169 - RNA, 19 nt, Homo sapiens
agacaacgcuguggauaag

SEQ ID NO: 727170 - RNA, 19 nt, Homo sapiens
gcagugcucuuggcagaca

SEQ ID NO: 727171 - RNA, 19 nt, Homo sapiens
gugagagaccggaguauga

SEQ ID NO: 727172 - RNA, 19 nt, Homo sapiens
ggucuguggcucugacuaa

SEQ ID NO: 727173 - RNA, 19 nt, Homo sapiens
uaaggagaguagagacuuc

SEQ ID NO: 727174 - RNA, 19 nt, Homo sapiens
cagacaacgcuguggauaa

SEQ ID NO: 727175 - RNA, 19 nt, Homo sapiens
gaaacgggaccucuuacca

SEQ ID NO: 727176 - RNA, 19 nt, Homo sapiens
ucaccagccuucuccuugu

SEQ ID NO: 727177 - RNA, 19 nt, Homo sapiens
ccacauuguccuuugagaa

SEQ ID NO: 727178 - RNA, 19 nt, Homo sapiens
acaacgcuguggauaagga

SEQ ID NO: 727179 - RNA, 19 nt, Homo sapiens
auaguagcguguccacauu

SEQ ID NO: 727180 - RNA, 19 nt, Homo sapiens
agugaaacgggaccucuua

SEQ ID NO: 727181 - RNA, 19 nt, Homo sapiens
agacaugaggcaacgauug

SEQ ID NO: 727182 - RNA, 19 nt, Homo sapiens
cacauuguccuuugagaau

SEQ ID NO: 727183 - RNA, 19 nt, Homo sapiens
ucucaagccagacauguga

SEQ ID NO: 727184 - RNA, 19 nt, Homo sapiens
gcagacaugaggcaacgau

SEQ ID NO: 727185 - RNA, 19 nt, Homo sapiens
caugugagagaccggagua

SEQ ID NO: 727186 - RNA, 19 nt, Homo sapiens
ggagaacucagggaaagag

SEQ ID NO: 727187 - RNA, 19 nt, Homo sapiens
gauaaggagaguagagacu

SEQ ID NO: 727188 - RNA, 19 nt, Homo sapiens
gcuacgccacgcagugaaa

SEQ ID NO: 727189 - RNA, 19 nt, Homo sapiens
ucggagaacucagggaaag

SEQ ID NO: 727190 - RNA, 19 nt, Homo sapiens
ggacaaauaaaaguaguga

SEQ ID NO: 727191 - RNA, 19 nt, Homo sapiens
cuuccugccuccugucuuc

SEQ ID NO: 727192 - RNA, 19 nt, Homo sapiens
uguccacauuguccuuuga

SEQ ID NO: 727193 - RNA, 19 nt, Homo sapiens
caccagccuucuccuugug

SEQ ID NO: 727194 - RNA, 19 nt, Homo sapiens
gaaagacgccugcuguuua

SEQ ID NO: 727195 - RNA, 19 nt, Homo sapiens
gaaccugcaucagauuuaa

SEQ ID NO: 727196 - RNA, 19 nt, Homo sapiens
aaacugauguugcugauau

SEQ ID NO: 727197 - RNA, 19 nt, Homo sapiens
ccaagaaccugcaucagau

SEQ ID NO: 727198 - RNA, 19 nt, Homo sapiens
gccaagaauacuguaauua

SEQ ID NO: 727199 - RNA, 19 nt, Homo sapiens
gauaguagcguguccacau

SEQ ID NO: 727200 - RNA, 19 nt, Homo sapiens
guuguugacugcaggagaa

SEQ ID NO: 727201 - RNA, 19 nt, Homo sapiens
gcagugcucuuggcagaca

SEQ ID NO: 727202 - RNA, 19 nt, Homo sapiens
cgccugcuguuuacauuaa

SEQ ID NO: 727203 - RNA, 19 nt, Homo sapiens
aaagacgccugcuguuuac

SEQ ID NO: 727204 - RNA, 19 nt, Homo sapiens
agaaagacgccugcuguuu

SEQ ID NO: 727205 - RNA, 19 nt, Homo sapiens
gaaacgggaccucuuacca

SEQ ID NO: 727206 - RNA, 19 nt, Homo sapiens
ugccaagaauacuguaauu

SEQ ID NO: 727207 - RNA, 19 nt, Homo sapiens
gacgccugcuguuuacauu

SEQ ID NO: 727208 - RNA, 19 nt, Homo sapiens
caagaaccugcaucagauu

SEQ ID NO: 727209 - RNA, 19 nt, Homo sapiens
ccacauuguccuuugagaa

SEQ ID NO: 727210 - RNA, 19 nt, Homo sapiens
ucaccagccuucuccuugu

SEQ ID NO: 727211 - RNA, 19 nt, Homo sapiens
auaguagcguguccacauu

SEQ ID NO: 727212 - RNA, 19 nt, Homo sapiens
agaaccugcaucagauuua

SEQ ID NO: 727213 - RNA, 19 nt, Homo sapiens
agugaaacgggaccucuua

SEQ ID NO: 727214 - RNA, 19 nt, Homo sapiens
agacaugaggcaacgauug

SEQ ID NO: 727215 - RNA, 19 nt, Homo sapiens
cacauuguccuuugagaau

SEQ ID NO: 727216 - RNA, 19 nt, Homo sapiens
ucucaagccagacauguga

SEQ ID NO: 727217 - RNA, 19 nt, Homo sapiens
gcagacaugaggcaacgau

SEQ ID NO: 727218 - RNA, 19 nt, Homo sapiens
ggagaacucagggaaagag

SEQ ID NO: 727219 - RNA, 19 nt, Homo sapiens
accaagaaccugcaucaga

SEQ ID NO: 727220 - RNA, 19 nt, Homo sapiens
gcuacgccacgcagugaaa

SEQ ID NO: 727221 - RNA, 19 nt, Homo sapiens
ucggagaacucagggaaag

SEQ ID NO: 727222 - RNA, 19 nt, Homo sapiens
uguccacauuguccuuuga

SEQ ID NO: 727223 - RNA, 19 nt, Homo sapiens
caccagccuucuccuugug

SEQ ID NO: 727224 - RNA, 19 nt, Homo sapiens
aagaaccugcaucagauuu

SEQ ID NO: 727225 - RNA, 19 nt, Homo sapiens
uuaccaagaaccugcauca

SEQ ID NO: 727226 - RNA, 19 nt, Homo sapiens
gcaucagauuuaaaaguug

SEQ ID NO: 727227 - RNA, 19 nt, Homo sapiens
caagggaucugcagacuuu

SEQ ID NO: 727228 - RNA, 19 nt, Homo sapiens
gaauagguguugcguauca

SEQ ID NO: 727229 - RNA, 19 nt, Homo sapiens
gugaagagcugauaaaaga

SEQ ID NO: 727230 - RNA, 19 nt, Homo sapiens
gaaugaauuuagcaccaaa

SEQ ID NO: 727231 - RNA, 19 nt, Homo sapiens
aaauacagaugaagaagga

SEQ ID NO: 727232 - RNA, 19 nt, Homo sapiens
gcagggauguugaaguauc

SEQ ID NO: 727233 - RNA, 19 nt, Homo sapiens
aggcagggauguugaagua

SEQ ID NO: 727234 - RNA, 19 nt, Homo sapiens
caacggaccuuaaaacaug

SEQ ID NO: 727235 - RNA, 19 nt, Homo sapiens
uggaauagguguugcguau

SEQ ID NO: 727236 - RNA, 19 nt, Homo sapiens
gaauguguggcuuauagua

SEQ ID NO: 727237 - RNA, 19 nt, Homo sapiens
uaaaggaauguguggcuua

SEQ ID NO: 727238 - RNA, 19 nt, Homo sapiens
ucuguuugcuguucucuuu

SEQ ID NO: 727239 - RNA, 19 nt, Homo sapiens
cccaagggcuuaaaggaau

SEQ ID NO: 727240 - RNA, 19 nt, Homo sapiens
gaaguaucccaagggcuua

SEQ ID NO: 727241 - RNA, 19 nt, Homo sapiens
aaaggaauguguggcuuau

SEQ ID NO: 727242 - RNA, 19 nt, Homo sapiens
ggaaggcagggauguugaa

SEQ ID NO: 727243 - RNA, 19 nt, Homo sapiens
gcucugaucccuggaauag

SEQ ID NO: 727244 - RNA, 19 nt, Homo sapiens
caaaggugaagagcugaua

SEQ ID NO: 727245 - RNA, 19 nt, Homo sapiens
ugaaugaauuuagcaccaa

SEQ ID NO: 727246 - RNA, 19 nt, Homo sapiens
aggaauguguggcuuauag

SEQ ID NO: 727247 - RNA, 19 nt, Homo sapiens
ccaagggcuuaaaggaaug

SEQ ID NO: 727248 - RNA, 19 nt, Homo sapiens
gaaaagagaaaccagagau

SEQ ID NO: 727249 - RNA, 19 nt, Homo sapiens
gcaagggaucugcagacuu

SEQ ID NO: 727250 - RNA, 19 nt, Homo sapiens
caaacucagugcacaucuc

SEQ ID NO: 727251 - RNA, 19 nt, Homo sapiens
ucugaucccuggaauaggu

SEQ ID NO: 727252 - RNA, 19 nt, Homo sapiens
ggacccucauuuaggaucu

SEQ ID NO: 727253 - RNA, 19 nt, Homo sapiens
aaaggugaagagcugauaa

SEQ ID NO: 727254 - RNA, 19 nt, Homo sapiens
gcuuauaguagguguucaa

SEQ ID NO: 727255 - RNA, 19 nt, Homo sapiens
ggaauguguggcuuauagu

SEQ ID NO: 727256 - RNA, 19 nt, Homo sapiens
aagagaaaccagagaugga

SEQ ID NO: 727257 - RNA, 19 nt, Homo sapiens
auacagaugaagaaggaaa

SEQ ID NO: 727258 - RNA, 19 nt, Homo sapiens
cgugacauuugcucugauc

SEQ ID NO: 727259 - RNA, 19 nt, Homo sapiens
ucccaagggcuuaaaggaa

SEQ ID NO: 727260 - RNA, 19 nt, Homo sapiens
aaacaaacucagugcacau

SEQ ID NO: 727261 - RNA, 19 nt, Homo sapiens
caagggaucugcagacuuu

SEQ ID NO: 727262 - RNA, 19 nt, Homo sapiens
gaauagguguugcguauca

SEQ ID NO: 727263 - RNA, 19 nt, Homo sapiens
gugaagagcugauaaaaga

SEQ ID NO: 727264 - RNA, 19 nt, Homo sapiens
gaaugaauuuagcaccaaa

SEQ ID NO: 727265 - RNA, 19 nt, Homo sapiens
aaauacagaugaagaagga

SEQ ID NO: 727266 - RNA, 19 nt, Homo sapiens
gcagggauguugaaguauc

SEQ ID NO: 727267 - RNA, 19 nt, Homo sapiens
aggcagggauguugaagua

SEQ ID NO: 727268 - RNA, 19 nt, Homo sapiens
caacggaccuuaaaacaug

SEQ ID NO: 727269 - RNA, 19 nt, Homo sapiens
uggaauagguguugcguau

SEQ ID NO: 727270 - RNA, 19 nt, Homo sapiens
gaauguguggcuuauagua

SEQ ID NO: 727271 - RNA, 19 nt, Homo sapiens
uaaaggaauguguggcuua

SEQ ID NO: 727272 - RNA, 19 nt, Homo sapiens
ccaccgggaauuagaaaua

SEQ ID NO: 727273 - RNA, 19 nt, Homo sapiens
ucuguuugcuguucucuuu

SEQ ID NO: 727274 - RNA, 19 nt, Homo sapiens
ggaauuagaaauaccaucu

SEQ ID NO: 727275 - RNA, 19 nt, Homo sapiens
cccaagggcuuaaaggaau

SEQ ID NO: 727276 - RNA, 19 nt, Homo sapiens
gaaguaucccaagggcuua

SEQ ID NO: 727277 - RNA, 19 nt, Homo sapiens
aaaggaauguguggcuuau

SEQ ID NO: 727278 - RNA, 19 nt, Homo sapiens
ggaaggcagggauguugaa

SEQ ID NO: 727279 - RNA, 19 nt, Homo sapiens
gcucugaucccuggaauag

SEQ ID NO: 727280 - RNA, 19 nt, Homo sapiens
caaaggugaagagcugaua

SEQ ID NO: 727281 - RNA, 19 nt, Homo sapiens
ugaaugaauuuagcaccaa

SEQ ID NO: 727282 - RNA, 19 nt, Homo sapiens
aggaauguguggcuuauag

SEQ ID NO: 727283 - RNA, 19 nt, Homo sapiens
ccaagggcuuaaaggaaug

SEQ ID NO: 727284 - RNA, 19 nt, Homo sapiens
gaaaagagaaaccagagau

SEQ ID NO: 727285 - RNA, 19 nt, Homo sapiens
gcaagggaucugcagacuu

SEQ ID NO: 727286 - RNA, 19 nt, Homo sapiens
ucugaucccuggaauaggu

SEQ ID NO: 727287 - RNA, 19 nt, Homo sapiens
gaauuagaaauaccaucug

SEQ ID NO: 727288 - RNA, 19 nt, Homo sapiens
aaaggugaagagcugauaa

SEQ ID NO: 727289 - RNA, 19 nt, Homo sapiens
gcuuauaguagguguucaa

SEQ ID NO: 727290 - RNA, 19 nt, Homo sapiens
ggaauguguggcuuauagu

SEQ ID NO: 727291 - RNA, 19 nt, Homo sapiens
aagagaaaccagagaugga

SEQ ID NO: 727292 - RNA, 19 nt, Homo sapiens
auacagaugaagaaggaaa

SEQ ID NO: 727293 - RNA, 19 nt, Homo sapiens
caccgggaauuagaaauac

SEQ ID NO: 727294 - RNA, 19 nt, Homo sapiens
ucccaagggcuuaaaggaa

SEQ ID NO: 727295 - RNA, 19 nt, Homo sapiens
ggcaauugcuugucauuaa

SEQ ID NO: 727296 - RNA, 19 nt, Homo sapiens
gcaauugcuugucauuaaa

SEQ ID NO: 727297 - RNA, 19 nt, Homo sapiens
gaacaagaccucuggaugu

SEQ ID NO: 727298 - RNA, 19 nt, Homo sapiens
caagaccucuggauguuuc

SEQ ID NO: 727299 - RNA, 19 nt, Homo sapiens
guuccuggcugcagaauuc

SEQ ID NO: 727300 - RNA, 19 nt, Homo sapiens
gagccgagggaauuucuuu

SEQ ID NO: 727301 - RNA, 19 nt, Homo sapiens
acagacagaucuucuagag

SEQ ID NO: 727302 - RNA, 19 nt, Homo sapiens
gguugcuccuguguaauua

SEQ ID NO: 727303 - RNA, 19 nt, Homo sapiens
ggagaccgaugcuucuaac

SEQ ID NO: 727304 - RNA, 19 nt, Homo sapiens
gagagaaggcugcaaagcu

SEQ ID NO: 727305 - RNA, 19 nt, Homo sapiens
gcuccuguguaauuacgaa

SEQ ID NO: 727306 - RNA, 19 nt, Homo sapiens
cgacccagcuaccgggaau

SEQ ID NO: 727307 - RNA, 19 nt, Homo sapiens
ggauguuuccaguuucaaa

SEQ ID NO: 727308 - RNA, 19 nt, Homo sapiens
gcgaggcuccgcaacuuug

SEQ ID NO: 727309 - RNA, 19 nt, Homo sapiens
gggagaccgaugcuucuaa

SEQ ID NO: 727310 - RNA, 19 nt, Homo sapiens
gcucaaacacagacagauc

SEQ ID NO: 727311 - RNA, 19 nt, Homo sapiens
uaaauaagugcgagcuaca

SEQ ID NO: 727312 - RNA, 19 nt, Homo sapiens
ccuguguaauuacgaaaga

SEQ ID NO: 727313 - RNA, 19 nt, Homo sapiens
gauguuuccaguuucaaau

SEQ ID NO: 727314 - RNA, 19 nt, Homo sapiens
uggcgaggcuccgcaacuu

SEQ ID NO: 727315 - RNA, 19 nt, Homo sapiens
aaacugccauuucauucac

SEQ ID NO: 727316 - RNA, 19 nt, Homo sapiens
aaacacagacagaucuucu

SEQ ID NO: 727317 - RNA, 19 nt, Homo sapiens
aauaagugcgagcuacaaa

SEQ ID NO: 727318 - RNA, 19 nt, Homo sapiens
uguuuccaguuucaaauug

SEQ ID NO: 727319 - RNA, 19 nt, Homo sapiens
gccauuucauucacacaag

SEQ ID NO: 727320 - RNA, 19 nt, Homo sapiens
guccgaaggugcaaaauag

SEQ ID NO: 727321 - RNA, 19 nt, Homo sapiens
uggcaauugcuugucauua

SEQ ID NO: 727322 - RNA, 19 nt, Homo sapiens
acacagacagaucuucuag

SEQ ID NO: 727323 - RNA, 19 nt, Homo sapiens
gggcacccuuuggagaaga

SEQ ID NO: 727324 - RNA, 19 nt, Homo sapiens
gccuggcaauugcuuguca

SEQ ID NO: 727325 - RNA, 19 nt, Homo sapiens
ccugcgagccuggcaauug

SEQ ID NO: 727326 - RNA, 19 nt, Homo sapiens
gagccuggcaauugcuugu

SEQ ID NO: 727327 - RNA, 19 nt, Homo sapiens
ccacuuagcuuguccacau

SEQ ID NO: 727328 - RNA, 19 nt, Homo sapiens
gcaaucagaucuuuaugag

SEQ ID NO: 727329 - RNA, 19 nt, Homo sapiens
cuaccuagauuucucauga

SEQ ID NO: 727330 - RNA, 19 nt, Homo sapiens
ugacaaacauucucucauc

SEQ ID NO: 727331 - RNA, 19 nt, Homo sapiens
uauaaauggugcaacagua

SEQ ID NO: 727332 - RNA, 19 nt, Homo sapiens
caaacauucucucauccua

SEQ ID NO: 727333 - RNA, 19 nt, Homo sapiens
gaggcaagcucagcaagaa

SEQ ID NO: 727334 - RNA, 19 nt, Homo sapiens
aagaagggcuacaauguga

SEQ ID NO: 727335 - RNA, 19 nt, Homo sapiens
gaagaagggcuacaaugug

SEQ ID NO: 727336 - RNA, 19 nt, Homo sapiens
uaauauaccuucagucaac

SEQ ID NO: 727337 - RNA, 19 nt, Homo sapiens
gcugagaguugaauagcuu

SEQ ID NO: 727338 - RNA, 19 nt, Homo sapiens
ucagucaacuuuaccaaga

SEQ ID NO: 727339 - RNA, 19 nt, Homo sapiens
ccaaggcaaucagaucuuu

SEQ ID NO: 727340 - RNA, 19 nt, Homo sapiens
acacaccacucauuggaaa

SEQ ID NO: 727341 - RNA, 19 nt, Homo sapiens
gugcaacaguaauaaaguu

SEQ ID NO: 727342 - RNA, 19 nt, Homo sapiens
cuacuuagccuaccuagau

SEQ ID NO: 727343 - RNA, 19 nt, Homo sapiens
gaaagugcaguacaucguu

SEQ ID NO: 727344 - RNA, 19 nt, Homo sapiens
gcaccuguaguucuguuua

SEQ ID NO: 727345 - RNA, 19 nt, Homo sapiens
ggagugaugcguuugauuc

SEQ ID NO: 727346 - RNA, 19 nt, Homo sapiens
gggagaauccaaauaguau

SEQ ID NO: 727347 - RNA, 19 nt, Homo sapiens
gauuucucaugacgaguua

SEQ ID NO: 727348 - RNA, 19 nt, Homo sapiens
gaagaagaagggcuacaau

SEQ ID NO: 727349 - RNA, 19 nt, Homo sapiens
cgagaaagccaaggagaaa

SEQ ID NO: 727350 - RNA, 19 nt, Homo sapiens
caacacaccacucauugga

SEQ ID NO: 727351 - RNA, 19 nt, Homo sapiens
guggaugaaugccagcuuu

SEQ ID NO: 727352 - RNA, 19 nt, Homo sapiens
accaagaaguccuggauuu

SEQ ID NO: 727353 - RNA, 19 nt, Homo sapiens
ccaaggagaaagacaagaa

SEQ ID NO: 727354 - RNA, 19 nt, Homo sapiens
aaagugcaguacaucguuu

SEQ ID NO: 727355 - RNA, 19 nt, Homo sapiens
gauauguauugcccaagga

SEQ ID NO: 727356 - RNA, 19 nt, Homo sapiens
ggcaaucagaucuuuauga

SEQ ID NO: 727357 - RNA, 19 nt, Homo sapiens
ccaaggagggcaaggagaa

SEQ ID NO: 727358 - RNA, 19 nt, Homo sapiens
gugguugggugcaccugua

SEQ ID NO: 727359 - RNA, 19 nt, Homo sapiens
agaagaagggcuacaaugu

SEQ ID NO: 727360 - RNA, 19 nt, Homo sapiens
caaggcaaucagaucuuua

SEQ ID NO: 727361 - RNA, 19 nt, Homo sapiens
gcagcuaauuccgaccaaa

SEQ ID NO: 727362 - RNA, 19 nt, Homo sapiens
agacagagcccacuuagcu

SEQ ID NO: 727363 - RNA, 19 nt, Homo sapiens
ugacaaggacagccuauag

SEQ ID NO: 727364 - RNA, 19 nt, Homo sapiens
ggaggcaagcucagcaaga

SEQ ID NO: 727365 - RNA, 19 nt, Homo sapiens
ggugggagaauccaaauag

SEQ ID NO: 727366 - RNA, 19 nt, Homo sapiens
ucuaauauaccuucaguca

SEQ ID NO: 727367 - RNA, 19 nt, Homo sapiens
aaggacagccuauaggaaa

SEQ ID NO: 727368 - RNA, 19 nt, Homo sapiens
caaggacagccuauaggaa

SEQ ID NO: 727369 - RNA, 19 nt, Homo sapiens
ccacggaagcgccuaguuc

SEQ ID NO: 727370 - RNA, 19 nt, Homo sapiens
caaugugaacgacgagaaa

SEQ ID NO: 727371 - RNA, 19 nt, Homo sapiens
cauucuuccucuccagaua

SEQ ID NO: 727372 - RNA, 19 nt, Homo sapiens
caaugggaguugggaguga

SEQ ID NO: 727373 - RNA, 19 nt, Homo sapiens
auaaauggugcaacaguaa

SEQ ID NO: 727374 - RNA, 19 nt, Homo sapiens
gcaguuccaguuucucuuc

SEQ ID NO: 727375 - RNA, 19 nt, Homo sapiens
ugggagaauccaaauagua

SEQ ID NO: 727376 - RNA, 19 nt, Homo sapiens
aaauggugcaacaguaaua

SEQ ID NO: 727377 - RNA, 19 nt, Homo sapiens
uuaauguuguggaugaaug

SEQ ID NO: 727378 - RNA, 19 nt, Homo sapiens
gcaaggccgaggagaagga

SEQ ID NO: 727379 - RNA, 19 nt, Homo sapiens
ggagaaggagggcgagaag

SEQ ID NO: 727380 - RNA, 19 nt, Homo sapiens
caccaacacaccacucauu

SEQ ID NO: 727381 - RNA, 19 nt, Homo sapiens
ucucuuccauucuguguca

SEQ ID NO: 727382 - RNA, 19 nt, Homo sapiens
guucauugcaguuccaguu

SEQ ID NO: 727383 - RNA, 19 nt, Homo sapiens
agaaagccaaggagaaaga

SEQ ID NO: 727384 - RNA, 19 nt, Homo sapiens
ggcaagcucagcaagaaga

SEQ ID NO: 727385 - RNA, 19 nt, Homo sapiens
caccuguaguucuguuuau

SEQ ID NO: 727386 - RNA, 19 nt, Homo sapiens
gaaacugccgccacaugca

SEQ ID NO: 727387 - RNA, 19 nt, Homo sapiens
caagauccgcgucugaaag

SEQ ID NO: 727388 - RNA, 19 nt, Homo sapiens
ccaagauccgcgucugaaa

SEQ ID NO: 727389 - RNA, 19 nt, Homo sapiens
ccaagaaguccuggauuuc

SEQ ID NO: 727390 - RNA, 19 nt, Homo sapiens
cagucaacuuuaccaagaa

SEQ ID NO: 727391 - RNA, 19 nt, Homo sapiens
cauucucucauccuacuua

SEQ ID NO: 727392 - RNA, 19 nt, Homo sapiens
cgugaaagagugacaagga

SEQ ID NO: 727393 - RNA, 19 nt, Homo sapiens
agaaggagggcgagaagga

SEQ ID NO: 727394 - RNA, 19 nt, Homo sapiens
ucuccuaucucuccucucu

SEQ ID NO: 727395 - RNA, 19 nt, Homo sapiens
guauaaauggugcaacagu

SEQ ID NO: 727396 - RNA, 19 nt, Homo sapiens
gcaagcucagcaagaagaa

SEQ ID NO: 727397 - RNA, 19 nt, Homo sapiens
caguuucucuuccauucug

SEQ ID NO: 727398 - RNA, 19 nt, Homo sapiens
ugccaauccuccauucuuc

SEQ ID NO: 727399 - RNA, 19 nt, Homo sapiens
cuccuauacuaacuuguuu

SEQ ID NO: 727400 - RNA, 19 nt, Homo sapiens
aagaagaagggcuacaaug

SEQ ID NO: 727401 - RNA, 19 nt, Homo sapiens
ucauugcaguuccaguuuc

SEQ ID NO: 727402 - RNA, 19 nt, Homo sapiens
acaaggacagccuauagga

SEQ ID NO: 727403 - RNA, 19 nt, Homo sapiens
uaaauggugcaacaguaau

SEQ ID NO: 727404 - RNA, 19 nt, Homo sapiens
gggugcaccuguaguucug

SEQ ID NO: 727405 - RNA, 19 nt, Homo sapiens
ggagugacaaacauucucu

SEQ ID NO: 727406 - RNA, 19 nt, Homo sapiens
gugggagaauccaaauagu

SEQ ID NO: 727407 - RNA, 19 nt, Homo sapiens
aaaacaaucuccucucucu

SEQ ID NO: 727408 - RNA, 19 nt, Homo sapiens
gaagggcuacaaugugaac

SEQ ID NO: 727409 - RNA, 19 nt, Homo sapiens
uacuuagccuaccuagauu

SEQ ID NO: 727410 - RNA, 19 nt, Homo sapiens
gaaugccagcuuucagaca

SEQ ID NO: 727411 - RNA, 19 nt, Homo sapiens
uaccuucagucaacuuuac

SEQ ID NO: 727412 - RNA, 19 nt, Homo sapiens
ucucuccuauacuaacuug

SEQ ID NO: 727413 - RNA, 19 nt, Homo sapiens
uccaguuucucuuccauuc

SEQ ID NO: 727414 - RNA, 19 nt, Homo sapiens
gugcaccuguaguucuguu

SEQ ID NO: 727415 - RNA, 19 nt, Homo sapiens
gacagagcccacuuagcuu

SEQ ID NO: 727416 - RNA, 19 nt, Homo sapiens
gggagugaugcguuugauu

SEQ ID NO: 727417 - RNA, 19 nt, Homo sapiens
uugaauagcuuuucuucug

SEQ ID NO: 727418 - RNA, 19 nt, Homo sapiens
ccaaaccguaaccgugaaa

SEQ ID NO: 727419 - RNA, 19 nt, Homo sapiens
agaagaagaagggcuacaa

SEQ ID NO: 727420 - RNA, 19 nt, Homo sapiens
guuuauuggucaguggaaa

SEQ ID NO: 727421 - RNA, 19 nt, Homo sapiens
gacaaggacagccuauagg

SEQ ID NO: 727422 - RNA, 19 nt, Homo sapiens
uagccuaccuagauuucuc

SEQ ID NO: 727423 - RNA, 19 nt, Homo sapiens
acccagagccgaacuccaa

SEQ ID NO: 727424 - RNA, 19 nt, Homo sapiens
cuaacuuguuucaaauugg

SEQ ID NO: 727425 - RNA, 19 nt, Homo sapiens
uuguauaaauggugcaaca

SEQ ID NO: 727426 - RNA, 19 nt, Homo sapiens
ccuguaguucuguuuauug

SEQ ID NO: 727427 - RNA, 19 nt, Homo sapiens
aaaggaaacuguugagaaa

SEQ ID NO: 727428 - RNA, 19 nt, Homo sapiens
ucaauaaagugcacguguu

SEQ ID NO: 727429 - RNA, 19 nt, Homo sapiens
caauaaagugcacguguuu

SEQ ID NO: 727430 - RNA, 19 nt, Homo sapiens
gaaagggagggcucacuga

SEQ ID NO: 727431 - RNA, 19 nt, Homo sapiens
ugaguaaccaucccaguaa

SEQ ID NO: 727432 - RNA, 19 nt, Homo sapiens
ggucuucgcuggacaccau

SEQ ID NO: 727433 - RNA, 19 nt, Homo sapiens
ggagccgaguccuguauca

SEQ ID NO: 727434 - RNA, 19 nt, Homo sapiens
guucaacacccucuucaug

SEQ ID NO: 727435 - RNA, 19 nt, Homo sapiens
gcucugcccaugaccugua

SEQ ID NO: 727436 - RNA, 19 nt, Homo sapiens
cugaguaaccaucccagua

SEQ ID NO: 727437 - RNA, 19 nt, Homo sapiens
ugagaaaccgaaacuacug

SEQ ID NO: 727438 - RNA, 19 nt, Homo sapiens
gaguaaccaucccaguaac

SEQ ID NO: 727439 - RNA, 19 nt, Homo sapiens
guugagaaaccgaaacuac

SEQ ID NO: 727440 - RNA, 19 nt, Homo sapiens
caggagcucugcccaugac

SEQ ID NO: 727441 - RNA, 19 nt, Homo sapiens
ugaagucuagggacaggaa

SEQ ID NO: 727442 - RNA, 19 nt, Homo sapiens
aaaaggaaacuguugagaa

SEQ ID NO: 727443 - RNA, 19 nt, Homo sapiens
gaaaaggaaacuguugaga

SEQ ID NO: 727444 - RNA, 19 nt, Homo sapiens
ugccugggcuucauagcau

SEQ ID NO: 727445 - RNA, 19 nt, Homo sapiens
cuucuucucuccugucaac

SEQ ID NO: 727446 - RNA, 19 nt, Homo sapiens
cuuccucucuaucuuaaag

SEQ ID NO: 727447 - RNA, 19 nt, Homo sapiens
ggaagaacauggcaaagug

SEQ ID NO: 727448 - RNA, 19 nt, Homo sapiens
ggaccgagaugcccaauuc

SEQ ID NO: 727449 - RNA, 19 nt, Homo sapiens
ucaaugagcugcaguacug

SEQ ID NO: 727450 - RNA, 19 nt, Homo sapiens
gagaauggcugugggaaug

SEQ ID NO: 727451 - RNA, 19 nt, Homo sapiens
gcccggaacuugccuguuu

SEQ ID NO: 727452 - RNA, 19 nt, Homo sapiens
gaccggaaguaccaccuua

SEQ ID NO: 727453 - RNA, 19 nt, Homo sapiens
ucaaggauguggaggcaaa

SEQ ID NO: 727454 - RNA, 19 nt, Homo sapiens
gggaaugcaucuccucaga

SEQ ID NO: 727455 - RNA, 19 nt, Homo sapiens
gaaccgguauacagugaug

SEQ ID NO: 727456 - RNA, 19 nt, Homo sapiens
gagcgucucuuuguuguca

SEQ ID NO: 727457 - RNA, 19 nt, Homo sapiens
ggacaccacucaccaacag

SEQ ID NO: 727458 - RNA, 19 nt, Homo sapiens
gcaccuacgucugcaacaa

SEQ ID NO: 727459 - RNA, 19 nt, Homo sapiens
gagcagaagaaucucaauu

SEQ ID NO: 727460 - RNA, 19 nt, Homo sapiens
gcuccaugcuccacacuga

SEQ ID NO: 727461 - RNA, 19 nt, Homo sapiens
ucaaugagcgucucuuugu

SEQ ID NO: 727462 - RNA, 19 nt, Homo sapiens
gcucaugacccaacagaga

SEQ ID NO: 727463 - RNA, 19 nt, Homo sapiens
gcgaggagucccuggauuu

SEQ ID NO: 727464 - RNA, 19 nt, Homo sapiens
ggacacuacucaacauggu

SEQ ID NO: 727465 - RNA, 19 nt, Homo sapiens
ugugaugacuggcagcuaa

SEQ ID NO: 727466 - RNA, 19 nt, Homo sapiens
gauccuagagcuucuguug

SEQ ID NO: 727467 - RNA, 19 nt, Homo sapiens
gagcuggaccucaucuuug

SEQ ID NO: 727468 - RNA, 19 nt, Homo sapiens
gcacuucgugguacauuau

SEQ ID NO: 727469 - RNA, 19 nt, Homo sapiens
ucaaggagcagaagaaucu

SEQ ID NO: 727470 - RNA, 19 nt, Homo sapiens
caaugagcgucucuuuguu

SEQ ID NO: 727471 - RNA, 19 nt, Homo sapiens
cgugggaacucaugagaug

SEQ ID NO: 727472 - RNA, 19 nt, Homo sapiens
ggaagugcaugagcugauc

SEQ ID NO: 727473 - RNA, 19 nt, Homo sapiens
ggacuucaaccguaucauc

SEQ ID NO: 727474 - RNA, 19 nt, Homo sapiens
ggcacuucgugguacauua

SEQ ID NO: 727475 - RNA, 19 nt, Homo sapiens
gcaggaaccgguauacagu

SEQ ID NO: 727476 - RNA, 19 nt, Homo sapiens
cgugguacauuaucuggaa

SEQ ID NO: 727477 - RNA, 19 nt, Homo sapiens
gcugggacguugugugcaa

SEQ ID NO: 727478 - RNA, 19 nt, Homo sapiens
uggagccucuucaacagua

SEQ ID NO: 727479 - RNA, 19 nt, Homo sapiens
ggucaauucugcaggugau

SEQ ID NO: 727480 - RNA, 19 nt, Homo sapiens
gcagggaccguguuguuca

SEQ ID NO: 727481 - RNA, 19 nt, Homo sapiens
cggcuguucugcucuuuga

SEQ ID NO: 727482 - RNA, 19 nt, Homo sapiens
gcugguggaugggaucuug

SEQ ID NO: 727483 - RNA, 19 nt, Homo sapiens
gcaacaagaggcagcagau

SEQ ID NO: 727484 - RNA, 19 nt, Homo sapiens
ggagccaaguugugggaau

SEQ ID NO: 727485 - RNA, 19 nt, Homo sapiens
gagggaaaccacacacuag

SEQ ID NO: 727486 - RNA, 19 nt, Homo sapiens
ucaggaaguucauuaagcu

SEQ ID NO: 727487 - RNA, 19 nt, Homo sapiens
uggcgaggauuuccacaug

SEQ ID NO: 727488 - RNA, 19 nt, Homo sapiens
gcuggaagaacauggcaaa

SEQ ID NO: 727489 - RNA, 19 nt, Homo sapiens
gagccaaguugugggaauc

SEQ ID NO: 727490 - RNA, 19 nt, Homo sapiens
gugccucucucaccacuca

SEQ ID NO: 727491 - RNA, 19 nt, Homo sapiens
ugagggaaaccacacacua

SEQ ID NO: 727492 - RNA, 19 nt, Homo sapiens
ggagaauggcugugggaau

SEQ ID NO: 727493 - RNA, 19 nt, Homo sapiens
uccuagagcuucuguugga

SEQ ID NO: 727494 - RNA, 19 nt, Homo sapiens
gaggagcugcugcacauca

SEQ ID NO: 727495 - RNA, 19 nt, Homo sapiens
ggugcccucugccauguga

SEQ ID NO: 727496 - RNA, 19 nt, Homo sapiens
gaucuuggcccugggacuu

SEQ ID NO: 727497 - RNA, 19 nt, Homo sapiens
ccaugcggcuggaagaaca

SEQ ID NO: 727498 - RNA, 19 nt, Homo sapiens
gacguugugugcaauagag

SEQ ID NO: 727499 - RNA, 19 nt, Homo sapiens
aaucucaauuccuucuuug

SEQ ID NO: 727500 - RNA, 19 nt, Homo sapiens
gacuggagccucuucaaca

SEQ ID NO: 727501 - RNA, 19 nt, Homo sapiens
ucaaccguaucaucaagga

SEQ ID NO: 727502 - RNA, 19 nt, Homo sapiens
ggacguugugugcaauaga

SEQ ID NO: 727503 - RNA, 19 nt, Homo sapiens
gagccaggaauaacgaaug

SEQ ID NO: 727504 - RNA, 19 nt, Homo sapiens
ggacccgagccaggaauaa

SEQ ID NO: 727505 - RNA, 19 nt, Homo sapiens
cuucuuugccgucauguuu

SEQ ID NO: 727506 - RNA, 19 nt, Homo sapiens
ggcaggugcuggugaaggu

SEQ ID NO: 727507 - RNA, 19 nt, Homo sapiens
ccaccagcuuccuccagaa

SEQ ID NO: 727508 - RNA, 19 nt, Homo sapiens
ggacaagcaggacuucaac

SEQ ID NO: 727509 - RNA, 19 nt, Homo sapiens
acaagggcacuucguggua

SEQ ID NO: 727510 - RNA, 19 nt, Homo sapiens
agccaggaauaacgaauga

SEQ ID NO: 727511 - RNA, 19 nt, Homo sapiens
gcggcugccucacaaaguc

SEQ ID NO: 727512 - RNA, 19 nt, Homo sapiens
caaccuggagcgcuucaug

SEQ ID NO: 727513 - RNA, 19 nt, Homo sapiens
aggaaccgguauacaguga

SEQ ID NO: 727514 - RNA, 19 nt, Homo sapiens
uugaggagcugcugcacau

SEQ ID NO: 727515 - RNA, 19 nt, Homo sapiens
caggucagcgcacggauga

SEQ ID NO: 727516 - RNA, 19 nt, Homo sapiens
gggaaaccacacacuagug

SEQ ID NO: 727517 - RNA, 19 nt, Homo sapiens
gaauggcugugggaaugca

SEQ ID NO: 727518 - RNA, 19 nt, Homo sapiens
agacauuccucagcgacuu

SEQ ID NO: 727519 - RNA, 19 nt, Homo sapiens
cagcugugccauccaaguu

SEQ ID NO: 727520 - RNA, 19 nt, Homo sapiens
gcaaggcagggaccguguu

SEQ ID NO: 727521 - RNA, 19 nt, Homo sapiens
agagcuggaccucaucuuu

SEQ ID NO: 727522 - RNA, 19 nt, Homo sapiens
acaaaguccggaagcugua

SEQ ID NO: 727523 - RNA, 19 nt, Homo sapiens
ugugacagccuccgugaga

SEQ ID NO: 727524 - RNA, 19 nt, Homo sapiens
cagauuccagugcucauga

SEQ ID NO: 727525 - RNA, 19 nt, Homo sapiens
gacuucaaccguaucauca

SEQ ID NO: 727526 - RNA, 19 nt, Homo sapiens
ugagggagaugauuuugga

SEQ ID NO: 727527 - RNA, 19 nt, Homo sapiens
gaagagcuggaccucaucu

SEQ ID NO: 727528 - RNA, 19 nt, Homo sapiens
acacacuaguggagaaucu

SEQ ID NO: 727529 - RNA, 19 nt, Homo sapiens
gcucaggaaguucauuaag

SEQ ID NO: 727530 - RNA, 19 nt, Homo sapiens
gauaaaguccccuaugaca

SEQ ID NO: 727531 - RNA, 19 nt, Homo sapiens
caaggcagggaccguguug

SEQ ID NO: 727532 - RNA, 19 nt, Homo sapiens
gcgaggauuuccacaugcu

SEQ ID NO: 727533 - RNA, 19 nt, Homo sapiens
uuugagaagaugagaauga

SEQ ID NO: 727534 - RNA, 19 nt, Homo sapiens
cugcucaggaaguucauua

SEQ ID NO: 727535 - RNA, 19 nt, Homo sapiens
ggagccucuucaacaguau

SEQ ID NO: 727536 - RNA, 19 nt, Homo sapiens
agcuggaccucaucuuuga

SEQ ID NO: 727537 - RNA, 19 nt, Homo sapiens
cauggaaccaccggguaua

SEQ ID NO: 727538 - RNA, 19 nt, Homo sapiens
aaugagcgucucuuuguug

SEQ ID NO: 727539 - RNA, 19 nt, Homo sapiens
ugacagccuccgugagaga

SEQ ID NO: 727540 - RNA, 19 nt, Homo sapiens
gccacagguuggagaaugg

SEQ ID NO: 727541 - RNA, 19 nt, Homo sapiens
acagcuggcucuggugaau

SEQ ID NO: 727542 - RNA, 19 nt, Homo sapiens
uugagaagaugagaaugau

SEQ ID NO: 727543 - RNA, 19 nt, Homo sapiens
gagcggcugccucacaaag

SEQ ID NO: 727544 - RNA, 19 nt, Homo sapiens
ccaggcaggaaccgguaua

SEQ ID NO: 727545 - RNA, 19 nt, Homo sapiens
ggaagggaucugucaacgu

SEQ ID NO: 727546 - RNA, 19 nt, Homo sapiens
ugugcgagcuugaaaagaa

SEQ ID NO: 727547 - RNA, 19 nt, Homo sapiens
ggagauggcuuuacaagaa

SEQ ID NO: 727548 - RNA, 19 nt, Homo sapiens
ggaagagaaugguuacuaa

SEQ ID NO: 727549 - RNA, 19 nt, Homo sapiens
gggagaaacagaaguauua

SEQ ID NO: 727550 - RNA, 19 nt, Homo sapiens
caagaaagcccauguaaca

SEQ ID NO: 727551 - RNA, 19 nt, Homo sapiens
aggcuaagcuuuaccauaa

SEQ ID NO: 727552 - RNA, 19 nt, Homo sapiens
gaaagaagaaggcauggaa

SEQ ID NO: 727553 - RNA, 19 nt, Homo sapiens
ccaaugggcuugcguuuca

SEQ ID NO: 727554 - RNA, 19 nt, Homo sapiens
caaagguacugucauugaa

SEQ ID NO: 727555 - RNA, 19 nt, Homo sapiens
gagauggcuuuacaagaaa

SEQ ID NO: 727556 - RNA, 19 nt, Homo sapiens
gagaaugguuacuaaagug

SEQ ID NO: 727557 - RNA, 19 nt, Homo sapiens
ggaagucccucugccuaaa

SEQ ID NO: 727558 - RNA, 19 nt, Homo sapiens
gggacaaucucgagcuaaa

SEQ ID NO: 727559 - RNA, 19 nt, Homo sapiens
gaaacugccauuacuguga

SEQ ID NO: 727560 - RNA, 19 nt, Homo sapiens
gaaaaccaccuaaauauga

SEQ ID NO: 727561 - RNA, 19 nt, Homo sapiens
gaagagaaugguuacuaaa

SEQ ID NO: 727562 - RNA, 19 nt, Homo sapiens
ggacagagagggacaaucu

SEQ ID NO: 727563 - RNA, 19 nt, Homo sapiens
caagaaaaccaccuaaaua

SEQ ID NO: 727564 - RNA, 19 nt, Homo sapiens
gaagaaggcauggaagaga

SEQ ID NO: 727565 - RNA, 19 nt, Homo sapiens
gaacaggaaagagaaagaa

SEQ ID NO: 727566 - RNA, 19 nt, Homo sapiens
ggacuacacaccaauugaa

SEQ ID NO: 727567 - RNA, 19 nt, Homo sapiens
uaacacauccugaacugaa

SEQ ID NO: 727568 - RNA, 19 nt, Homo sapiens
ugaagaaacugccauuacu

SEQ ID NO: 727569 - RNA, 19 nt, Homo sapiens
gcauggaagagaaugguua

SEQ ID NO: 727570 - RNA, 19 nt, Homo sapiens
ccaaagguacugucauuga

SEQ ID NO: 727571 - RNA, 19 nt, Homo sapiens
gagggacaaucucgagcua

SEQ ID NO: 727572 - RNA, 19 nt, Homo sapiens
guucaaagaaggcaaagaa

SEQ ID NO: 727573 - RNA, 19 nt, Homo sapiens
acugugauguuucugaaua

SEQ ID NO: 727574 - RNA, 19 nt, Homo sapiens
ugauuggucugaaggcuaa

SEQ ID NO: 727575 - RNA, 19 nt, Homo sapiens
ggagaaacagaaguauuaa

SEQ ID NO: 727576 - RNA, 19 nt, Homo sapiens
ccacagaaugaauauauug

SEQ ID NO: 727577 - RNA, 19 nt, Homo sapiens
ccauacaugucugcaauga

SEQ ID NO: 727578 - RNA, 19 nt, Homo sapiens
gaagaaacugccauuacug

SEQ ID NO: 727579 - RNA, 19 nt, Homo sapiens
caaggaggcaaaguuauuu

SEQ ID NO: 727580 - RNA, 19 nt, Homo sapiens
uauacaacuuuggguguua

SEQ ID NO: 727581 - RNA, 19 nt, Homo sapiens
gaaaagagaaggcgggaaa

SEQ ID NO: 727582 - RNA, 19 nt, Homo sapiens
auacaugucugcaaugaag

SEQ ID NO: 727583 - RNA, 19 nt, Homo sapiens
uaaagaagaaucccucauc

SEQ ID NO: 727584 - RNA, 19 nt, Homo sapiens
gccacagaaugaauauauu

SEQ ID NO: 727585 - RNA, 19 nt, Homo sapiens
guauacaacuuuggguguu

SEQ ID NO: 727586 - RNA, 19 nt, Homo sapiens
ccagggagaaacagaagua

SEQ ID NO: 727587 - RNA, 19 nt, Homo sapiens
agagaaugguuacuaaagu

SEQ ID NO: 727588 - RNA, 19 nt, Homo sapiens
aagaaggcauggaagagaa

SEQ ID NO: 727589 - RNA, 19 nt, Homo sapiens
gaaaaugauuggucugaag

SEQ ID NO: 727590 - RNA, 19 nt, Homo sapiens
ugucugcaaugaagagauu

SEQ ID NO: 727591 - RNA, 19 nt, Homo sapiens
ggucugaaggcuaagcuuu

SEQ ID NO: 727592 - RNA, 19 nt, Homo sapiens
aagagaaacaccaaacaaa

SEQ ID NO: 727593 - RNA, 19 nt, Homo sapiens
acauuaaagugguccaguu

SEQ ID NO: 727594 - RNA, 19 nt, Homo sapiens
ccaaacagccauacauguc

SEQ ID NO: 727595 - RNA, 19 nt, Homo sapiens
gggaaaauaugcccagguu

SEQ ID NO: 727596 - RNA, 19 nt, Homo sapiens
gaaguaaaugugagcgaau

SEQ ID NO: 727597 - RNA, 19 nt, Homo sapiens
caggaaagagaaagaagaa

SEQ ID NO: 727598 - RNA, 19 nt, Homo sapiens
aaagagaaacaccaaacaa

SEQ ID NO: 727599 - RNA, 19 nt, Homo sapiens
caagaugcaugaaaagaga

SEQ ID NO: 727600 - RNA, 19 nt, Homo sapiens
aaacugccauuacugugau

SEQ ID NO: 727601 - RNA, 19 nt, Homo sapiens
cuacacaccaauugaagaa

SEQ ID NO: 727602 - RNA, 19 nt, Homo sapiens
caacaauccugaaaaugau

SEQ ID NO: 727603 - RNA, 19 nt, Homo sapiens
cauuaaagugguccaguuu

SEQ ID NO: 727604 - RNA, 19 nt, Homo sapiens
uuacugugauguuucugaa

SEQ ID NO: 727605 - RNA, 19 nt, Homo sapiens
auggauaccguuuggauua

SEQ ID NO: 727606 - RNA, 19 nt, Homo sapiens
ccaacaauccugaaaauga

SEQ ID NO: 727607 - RNA, 19 nt, Homo sapiens
ccaccuaaauaugaaagau

SEQ ID NO: 727608 - RNA, 19 nt, Homo sapiens
caaagaaggcaaagaaaau

SEQ ID NO: 727609 - RNA, 19 nt, Homo sapiens
gaggacuacacaccaauug

SEQ ID NO: 727610 - RNA, 19 nt, Homo sapiens
uguaacacauccugaacug

SEQ ID NO: 727611 - RNA, 19 nt, Homo sapiens
aaaguuauucgaacaggaa

SEQ ID NO: 727612 - RNA, 19 nt, Homo sapiens
gaaagucgagaggcucaug

SEQ ID NO: 727613 - RNA, 19 nt, Homo sapiens
gaaaauaugcccagguuac

SEQ ID NO: 727614 - RNA, 19 nt, Homo sapiens
aaguaaaugugagcgaauu

SEQ ID NO: 727615 - RNA, 19 nt, Homo sapiens
gucugaaggcuaagcuuua

SEQ ID NO: 727616 - RNA, 19 nt, Homo sapiens
ugccauuacugugauguuu

SEQ ID NO: 727617 - RNA, 19 nt, Homo sapiens
uggaagagaaugguuacua

SEQ ID NO: 727618 - RNA, 19 nt, Homo sapiens
gacaaucucgagcuaaagu

SEQ ID NO: 727619 - RNA, 19 nt, Homo sapiens
ucaccaugccacagaauga

SEQ ID NO: 727620 - RNA, 19 nt, Homo sapiens
ccauuacugugauguuucu

SEQ ID NO: 727621 - RNA, 19 nt, Homo sapiens
ccaugccacagaaugaaua

SEQ ID NO: 727622 - RNA, 19 nt, Homo sapiens
ucgagaggcucaugaacgu

SEQ ID NO: 727623 - RNA, 19 nt, Homo sapiens
acacaccaauugaagaaac

SEQ ID NO: 727624 - RNA, 19 nt, Homo sapiens
ugauguuucugaauacuac

SEQ ID NO: 727625 - RNA, 19 nt, Homo sapiens
caacuuuggguguuauuac

SEQ ID NO: 727626 - RNA, 19 nt, Homo sapiens
agaaagcccauguaacaca

SEQ ID NO: 727627 - RNA, 19 nt, Homo sapiens
guacgugcccagggagaaa

SEQ ID NO: 727628 - RNA, 19 nt, Homo sapiens
caaacagccauacaugucu

SEQ ID NO: 727629 - RNA, 19 nt, Homo sapiens
ugccacagaaugaauauau

SEQ ID NO: 727630 - RNA, 19 nt, Homo sapiens
aagaagaaggcauggaaga

SEQ ID NO: 727631 - RNA, 19 nt, Homo sapiens
gcugagaaaauacaaauga

SEQ ID NO: 727632 - RNA, 19 nt, Homo sapiens
cgaacaggaaagagaaaga

SEQ ID NO: 727633 - RNA, 19 nt, Homo sapiens
gaaaagagaaacaccaaac

SEQ ID NO: 727634 - RNA, 19 nt, Homo sapiens
agccauacaugucugcaau

SEQ ID NO: 727635 - RNA, 19 nt, Homo sapiens
ucaaagaaggcaaagaaaa

SEQ ID NO: 727636 - RNA, 19 nt, Homo sapiens
uguuggagauggcuuuaca

SEQ ID NO: 727637 - RNA, 19 nt, Homo sapiens
gaagucccucugccuaaag

SEQ ID NO: 727638 - RNA, 19 nt, Homo sapiens
aagaaacugccauuacugu

SEQ ID NO: 727639 - RNA, 19 nt, Homo sapiens
uuacugguuugacagcaau

SEQ ID NO: 727640 - RNA, 19 nt, Homo sapiens
ugauggauguauaaaugca

SEQ ID NO: 727641 - RNA, 19 nt, Homo sapiens
aacacauccugaacugaaa

SEQ ID NO: 727642 - RNA, 19 nt, Homo sapiens
acaggaaagagaaagaaga

SEQ ID NO: 727643 - RNA, 19 nt, Homo sapiens
uaccaaacagccauacaug

SEQ ID NO: 727644 - RNA, 19 nt, Homo sapiens
aaggcuaagcuuuaccaua

SEQ ID NO: 727645 - RNA, 19 nt, Homo sapiens
ccaaacaaaagaaugauga

SEQ ID NO: 727646 - RNA, 19 nt, Homo sapiens
gagaaacaccaaacaaaag

SEQ ID NO: 727647 - RNA, 19 nt, Homo sapiens
gaacaaacguccagcaaga

SEQ ID NO: 727648 - RNA, 19 nt, Homo sapiens
ggaaguaaauucuaguuug

SEQ ID NO: 727649 - RNA, 19 nt, Homo sapiens
ugagauaccugaugaugua

SEQ ID NO: 727650 - RNA, 19 nt, Homo sapiens
ggucagagauacuucuuaa

SEQ ID NO: 727651 - RNA, 19 nt, Homo sapiens
gaaaacagcagaaagauua

SEQ ID NO: 727652 - RNA, 19 nt, Homo sapiens
gcacauugauuuggaguuu

SEQ ID NO: 727653 - RNA, 19 nt, Homo sapiens
gaaaggagcaaaccagaaa

SEQ ID NO: 727654 - RNA, 19 nt, Homo sapiens
gaaggagugccuauaauuu

SEQ ID NO: 727655 - RNA, 19 nt, Homo sapiens
caaauaauguugcuguguu

SEQ ID NO: 727656 - RNA, 19 nt, Homo sapiens
ccaccaagcuagauaaaga

SEQ ID NO: 727657 - RNA, 19 nt, Homo sapiens
gcacacuugucaaauauau

SEQ ID NO: 727658 - RNA, 19 nt, Homo sapiens
gagcaugaauuaacucuuc

SEQ ID NO: 727659 - RNA, 19 nt, Homo sapiens
gcagauguuugaaguaguu

SEQ ID NO: 727660 - RNA, 19 nt, Homo sapiens
caaaugaccauauuaguga

SEQ ID NO: 727661 - RNA, 19 nt, Homo sapiens
ggaaggagauggaaugaac

SEQ ID NO: 727662 - RNA, 19 nt, Homo sapiens
gcucagauccuuuccuuaa

SEQ ID NO: 727663 - RNA, 19 nt, Homo sapiens
gaagugagccuguuuggau

SEQ ID NO: 727664 - RNA, 19 nt, Homo sapiens
guucugacauccuuaauga

SEQ ID NO: 727665 - RNA, 19 nt, Homo sapiens
gaacaaugacgaccaauag

SEQ ID NO: 727666 - RNA, 19 nt, Homo sapiens
gugaguagguucauaaugu

SEQ ID NO: 727667 - RNA, 19 nt, Homo sapiens
ggaaggagugccuauaauu

SEQ ID NO: 727668 - RNA, 19 nt, Homo sapiens
gcaaaugaccauauuagug

SEQ ID NO: 727669 - RNA, 19 nt, Homo sapiens
gagauggaaugaacauaga

SEQ ID NO: 727670 - RNA, 19 nt, Homo sapiens
gcaagcauguuguuauaag

SEQ ID NO: 727671 - RNA, 19 nt, Homo sapiens
gugaaucuguuaauaguug

SEQ ID NO: 727672 - RNA, 19 nt, Homo sapiens
guaguggaauguauccuuu

SEQ ID NO: 727673 - RNA, 19 nt, Homo sapiens
gaagagaugauguaacuag

SEQ ID NO: 727674 - RNA, 19 nt, Homo sapiens
gaaguaguuuaguguucua

SEQ ID NO: 727675 - RNA, 19 nt, Homo sapiens
ucagagugcuccagugaaa

SEQ ID NO: 727676 - RNA, 19 nt, Homo sapiens
gauguggucucuuguuuua

SEQ ID NO: 727677 - RNA, 19 nt, Homo sapiens
gggcauacgguagauauua

SEQ ID NO: 727678 - RNA, 19 nt, Homo sapiens
uagaauacaugacuaguag

SEQ ID NO: 727679 - RNA, 19 nt, Homo sapiens
gcucauauguuagguacuu

SEQ ID NO: 727680 - RNA, 19 nt, Homo sapiens
ucauuuagcuuuggaaguu

SEQ ID NO: 727681 - RNA, 19 nt, Homo sapiens
ucgcaagcauguuguuaua

SEQ ID NO: 727682 - RNA, 19 nt, Homo sapiens
ggcaaaagcugcuaugaaa

SEQ ID NO: 727683 - RNA, 19 nt, Homo sapiens
aauauugccuucaagauug

SEQ ID NO: 727684 - RNA, 19 nt, Homo sapiens
ggaauucagugaguagguu

SEQ ID NO: 727685 - RNA, 19 nt, Homo sapiens
gcaggaagcuuugaguucu

SEQ ID NO: 727686 - RNA, 19 nt, Homo sapiens
auauggagaucuuccuuua

SEQ ID NO: 727687 - RNA, 19 nt, Homo sapiens
ccagaugacuuccugaaca

SEQ ID NO: 727688 - RNA, 19 nt, Homo sapiens
aaugcacacuugucaaaua

SEQ ID NO: 727689 - RNA, 19 nt, Homo sapiens
ccaguuaaauguucaccaa

SEQ ID NO: 727690 - RNA, 19 nt, Homo sapiens
gccaguagccacagauuaa

SEQ ID NO: 727691 - RNA, 19 nt, Homo sapiens
ggaaauggccacugcagau

SEQ ID NO: 727692 - RNA, 19 nt, Homo sapiens
uuaagggucuuucaauguu

SEQ ID NO: 727693 - RNA, 19 nt, Homo sapiens
guaugugucuacaggagua

SEQ ID NO: 727694 - RNA, 19 nt, Homo sapiens
gagaugauguaacuagagu

SEQ ID NO: 727695 - RNA, 19 nt, Homo sapiens
acaguuggcucuaaagaau

SEQ ID NO: 727696 - RNA, 19 nt, Homo sapiens
guaguuuaguguucuagaa

SEQ ID NO: 727697 - RNA, 19 nt, Homo sapiens
caggcagacugaauucuaa

SEQ ID NO: 727698 - RNA, 19 nt, Homo sapiens
aaccagaaauggcuuuauu

SEQ ID NO: 727699 - RNA, 19 nt, Homo sapiens
auacaugccuucuauaugg

SEQ ID NO: 727700 - RNA, 19 nt, Homo sapiens
cuucuuagaucuacuuaug

SEQ ID NO: 727701 - RNA, 19 nt, Homo sapiens
caaucacuguguuguauau

SEQ ID NO: 727702 - RNA, 19 nt, Homo sapiens
ugauguaacuagaguaugu

SEQ ID NO: 727703 - RNA, 19 nt, Homo sapiens
gcugaccucuuucacaguu

SEQ ID NO: 727704 - RNA, 19 nt, Homo sapiens
aaaggcagcuguucuagag

SEQ ID NO: 727705 - RNA, 19 nt, Homo sapiens
gacccuggauagaauacua

SEQ ID NO: 727706 - RNA, 19 nt, Homo sapiens
cacauuaacgacuagauua

SEQ ID NO: 727707 - RNA, 19 nt, Homo sapiens
cagagauacuucuuaaauc

SEQ ID NO: 727708 - RNA, 19 nt, Homo sapiens
ugauggagcacauugauuu

SEQ ID NO: 727709 - RNA, 19 nt, Homo sapiens
guuaaauguucaccaauca

SEQ ID NO: 727710 - RNA, 19 nt, Homo sapiens
ccagcaagauacuuuaauc

SEQ ID NO: 727711 - RNA, 19 nt, Homo sapiens
ggagauggaaugaacauag

SEQ ID NO: 727712 - RNA, 19 nt, Homo sapiens
gaaacucaaacauugcaaa

SEQ ID NO: 727713 - RNA, 19 nt, Homo sapiens
gcaaucacuguguuguaua

SEQ ID NO: 727714 - RNA, 19 nt, Homo sapiens
guaguugaauuuagcaaag

SEQ ID NO: 727715 - RNA, 19 nt, Homo sapiens
ggaaaggagcaaaccagaa

SEQ ID NO: 727716 - RNA, 19 nt, Homo sapiens
cacccaaacauaacauuua

SEQ ID NO: 727717 - RNA, 19 nt, Homo sapiens
gauuaucugcucucucuuu

SEQ ID NO: 727718 - RNA, 19 nt, Homo sapiens
uuaaugacauggagucugu

SEQ ID NO: 727719 - RNA, 19 nt, Homo sapiens
caagcauguuguuauaaga

SEQ ID NO: 727720 - RNA, 19 nt, Homo sapiens
ggaccuugauagagaacuu

SEQ ID NO: 727721 - RNA, 19 nt, Homo sapiens
uaagggucuuucaauguuu

SEQ ID NO: 727722 - RNA, 19 nt, Homo sapiens
gcucauuccucuccagcuu

SEQ ID NO: 727723 - RNA, 19 nt, Homo sapiens
ggcauacgguagauauuau

SEQ ID NO: 727724 - RNA, 19 nt, Homo sapiens
gacaguggacuaagcauga

SEQ ID NO: 727725 - RNA, 19 nt, Homo sapiens
cuaggcaaaugaccauauu

SEQ ID NO: 727726 - RNA, 19 nt, Homo sapiens
uauaaggcaugagacaauu

SEQ ID NO: 727727 - RNA, 19 nt, Homo sapiens
aaccaaggcugaagacugu

SEQ ID NO: 727728 - RNA, 19 nt, Homo sapiens
gaacaguguggaugagaug

SEQ ID NO: 727729 - RNA, 19 nt, Homo sapiens
uuucagaucuuccaaagca

SEQ ID NO: 727730 - RNA, 19 nt, Homo sapiens
cuaagaguccuuucccuuu

SEQ ID NO: 727731 - RNA, 19 nt, Homo sapiens
acaccgugcugccauuaaa

SEQ ID NO: 727732 - RNA, 19 nt, Homo sapiens
aaacgagcaugaauuaacu

SEQ ID NO: 727733 - RNA, 19 nt, Homo sapiens
gauuggaauucagugagua

SEQ ID NO: 727734 - RNA, 19 nt, Homo sapiens
gagcuuauaaggcaugaga

SEQ ID NO: 727735 - RNA, 19 nt, Homo sapiens
cuaaaucugugaaggaucu

SEQ ID NO: 727736 - RNA, 19 nt, Homo sapiens
ucacaucgaucagacaaca

SEQ ID NO: 727737 - RNA, 19 nt, Homo sapiens
agucagggcuucuuagauc

SEQ ID NO: 727738 - RNA, 19 nt, Homo sapiens
aguaauaguugguugugaa

SEQ ID NO: 727739 - RNA, 19 nt, Homo sapiens
guccauugcugcuguuaau

SEQ ID NO: 727740 - RNA, 19 nt, Homo sapiens
ugagaacaaugacgaccaa

SEQ ID NO: 727741 - RNA, 19 nt, Homo sapiens
uaaaagugcuuaacugcuu

SEQ ID NO: 727742 - RNA, 19 nt, Homo sapiens
ccucaguguuguagcagua

SEQ ID NO: 727743 - RNA, 19 nt, Homo sapiens
uaucagcagauuagcuuua

SEQ ID NO: 727744 - RNA, 19 nt, Homo sapiens
gaaauggccacugcagaug

SEQ ID NO: 727745 - RNA, 19 nt, Homo sapiens
gaugauguaacuagaguau

SEQ ID NO: 727746 - RNA, 19 nt, Homo sapiens
aggaagagaugauguaacu

SEQ ID NO: 727747 - RNA, 19 nt, Homo sapiens
ggaaagcaauguaagguua

SEQ ID NO: 727748 - RNA, 19 nt, Homo sapiens
ggacagacaccuucaauuu

SEQ ID NO: 727749 - RNA, 19 nt, Homo sapiens
ucaaagaacugaugcacua

SEQ ID NO: 727750 - RNA, 19 nt, Homo sapiens
ccaauuaguugauuuguug

SEQ ID NO: 727751 - RNA, 19 nt, Homo sapiens
gaaaggaaguaccaauuag

SEQ ID NO: 727752 - RNA, 19 nt, Homo sapiens
ucaaggauguuucuaguuu

SEQ ID NO: 727753 - RNA, 19 nt, Homo sapiens
gaugugaccuaccagauuu

SEQ ID NO: 727754 - RNA, 19 nt, Homo sapiens
gauaagaccucagaucaga

SEQ ID NO: 727755 - RNA, 19 nt, Homo sapiens
ggccaacacuuucucauaa

SEQ ID NO: 727756 - RNA, 19 nt, Homo sapiens
gugaagacauuaaaucuga

SEQ ID NO: 727757 - RNA, 19 nt, Homo sapiens
gcagagacauaugcuuuaa

SEQ ID NO: 727758 - RNA, 19 nt, Homo sapiens
acugaugccuugauaauua

SEQ ID NO: 727759 - RNA, 19 nt, Homo sapiens
gcaauucucaagucuauaa

SEQ ID NO: 727760 - RNA, 19 nt, Homo sapiens
ccugugaucuuuacgcuua

SEQ ID NO: 727761 - RNA, 19 nt, Homo sapiens
guguaggguuuaugaauua

SEQ ID NO: 727762 - RNA, 19 nt, Homo sapiens
ggaaagugauacuaagaau

SEQ ID NO: 727763 - RNA, 19 nt, Homo sapiens
gaaggaaagugauacuaag

SEQ ID NO: 727764 - RNA, 19 nt, Homo sapiens
guacacauguuaauuagca

SEQ ID NO: 727765 - RNA, 19 nt, Homo sapiens
ugaaaggaaguaccaauua

SEQ ID NO: 727766 - RNA, 19 nt, Homo sapiens
gaacugaugcacuauauag

SEQ ID NO: 727767 - RNA, 19 nt, Homo sapiens
gguaugugcuuaauauuuc

SEQ ID NO: 727768 - RNA, 19 nt, Homo sapiens
ccacacugaugccuugaua

SEQ ID NO: 727769 - RNA, 19 nt, Homo sapiens
guaaguguauuguuucuca

SEQ ID NO: 727770 - RNA, 19 nt, Homo sapiens
agagguaaguguauuguuu

SEQ ID NO: 727771 - RNA, 19 nt, Homo sapiens
aagugaagaucgacauuua

SEQ ID NO: 727772 - RNA, 19 nt, Homo sapiens
ggacuacuguucgaagauu

SEQ ID NO: 727773 - RNA, 19 nt, Homo sapiens
gcuauugccugugaucuuu

SEQ ID NO: 727774 - RNA, 19 nt, Homo sapiens
ggaggcacauguuggacua

SEQ ID NO: 727775 - RNA, 19 nt, Homo sapiens
ggacugaugugaccuacca

SEQ ID NO: 727776 - RNA, 19 nt, Homo sapiens
gcagugguggccagaauua

SEQ ID NO: 727777 - RNA, 19 nt, Homo sapiens
ggauuaaacguuaguauuc

SEQ ID NO: 727778 - RNA, 19 nt, Homo sapiens
ggaaguaccaauuaguuga

SEQ ID NO: 727779 - RNA, 19 nt, Homo sapiens
cauauuauucgccuuguua

SEQ ID NO: 727780 - RNA, 19 nt, Homo sapiens
ggaaguguaggguuuauga

SEQ ID NO: 727781 - RNA, 19 nt, Homo sapiens
guaauauagucgccauuga

SEQ ID NO: 727782 - RNA, 19 nt, Homo sapiens
ugaaugcuauugccuguga

SEQ ID NO: 727783 - RNA, 19 nt, Homo sapiens
gcacauguuggacuacuuu

SEQ ID NO: 727784 - RNA, 19 nt, Homo sapiens
gguauuaaguccaucuugu

SEQ ID NO: 727785 - RNA, 19 nt, Homo sapiens
cgaaggaaagugauacuaa

SEQ ID NO: 727786 - RNA, 19 nt, Homo sapiens
agaaagcuauaguggcaua

SEQ ID NO: 727787 - RNA, 19 nt, Homo sapiens
guaagguuaugucugugua

SEQ ID NO: 727788 - RNA, 19 nt, Homo sapiens
uaaagcagcagugugaaua

SEQ ID NO: 727789 - RNA, 19 nt, Homo sapiens
gaaguccgguagucgagaa

SEQ ID NO: 727790 - RNA, 19 nt, Homo sapiens
acagacaccuucaauuugu

SEQ ID NO: 727791 - RNA, 19 nt, Homo sapiens
guacauuggcagagacaua

SEQ ID NO: 727792 - RNA, 19 nt, Homo sapiens
acgcuuaacuguuguguau

SEQ ID NO: 727793 - RNA, 19 nt, Homo sapiens
gccaacacuuucucauaaa

SEQ ID NO: 727794 - RNA, 19 nt, Homo sapiens
ccuguaaacuucauucugu

SEQ ID NO: 727795 - RNA, 19 nt, Homo sapiens
gagccaguaucauuggauu

SEQ ID NO: 727796 - RNA, 19 nt, Homo sapiens
gacacucaguccaauuaaa

SEQ ID NO: 727797 - RNA, 19 nt, Homo sapiens
gaggggaucugaugauaaa

SEQ ID NO: 727798 - RNA, 19 nt, Homo sapiens
uguaugucauucacacuua

SEQ ID NO: 727799 - RNA, 19 nt, Homo sapiens
gacagacaccuucaauuug

SEQ ID NO: 727800 - RNA, 19 nt, Homo sapiens
uaaugcaguuuguucugua

SEQ ID NO: 727801 - RNA, 19 nt, Homo sapiens
gggccaacacuuucucaua

SEQ ID NO: 727802 - RNA, 19 nt, Homo sapiens
guuaaguacuguaaguguu

SEQ ID NO: 727803 - RNA, 19 nt, Homo sapiens
ugauggaaguguaggguuu

SEQ ID NO: 727804 - RNA, 19 nt, Homo sapiens
gaaagugauacuaagaaug

SEQ ID NO: 727805 - RNA, 19 nt, Homo sapiens
uuaaguccaucuuguguug

SEQ ID NO: 727806 - RNA, 19 nt, Homo sapiens
gcccacauuuguaauauag

SEQ ID NO: 727807 - RNA, 19 nt, Homo sapiens
agacagagguaaguguauu

SEQ ID NO: 727808 - RNA, 19 nt, Homo sapiens
aauguaagguuaugucugu

SEQ ID NO: 727809 - RNA, 19 nt, Homo sapiens
gcuaguauuucuuugucaa

SEQ ID NO: 727810 - RNA, 19 nt, Homo sapiens
gugaagaucgacauuuaaa

SEQ ID NO: 727811 - RNA, 19 nt, Homo sapiens
acacaaacacugaaucgaa

SEQ ID NO: 727812 - RNA, 19 nt, Homo sapiens
gaaaagaggggaucugaug

SEQ ID NO: 727813 - RNA, 19 nt, Homo sapiens
gagaacggcauaaagugaa

SEQ ID NO: 727814 - RNA, 19 nt, Homo sapiens
gaaagcaauguaagguuau

SEQ ID NO: 727815 - RNA, 19 nt, Homo sapiens
gaauuugcagucagccaua

SEQ ID NO: 727816 - RNA, 19 nt, Homo sapiens
ucaaugcaauucucaaguc

SEQ ID NO: 727817 - RNA, 19 nt, Homo sapiens
ggaaauuaucgcccacauu

SEQ ID NO: 727818 - RNA, 19 nt, Homo sapiens
gugacacucaguccaauua

SEQ ID NO: 727819 - RNA, 19 nt, Homo sapiens
ucucugacuuucuguuaaa

SEQ ID NO: 727820 - RNA, 19 nt, Homo sapiens
gaaaacaggauuaaacguu

SEQ ID NO: 727821 - RNA, 19 nt, Homo sapiens
gaaucgaaggaaagugaua

SEQ ID NO: 727822 - RNA, 19 nt, Homo sapiens
gcagcagugugaauagcaa

SEQ ID NO: 727823 - RNA, 19 nt, Homo sapiens
uaauauagucgccauugaa

SEQ ID NO: 727824 - RNA, 19 nt, Homo sapiens
guaaguaugcacagaugaa

SEQ ID NO: 727825 - RNA, 19 nt, Homo sapiens
aagaacugaugcacuauau

SEQ ID NO: 727826 - RNA, 19 nt, Homo sapiens
ucuuuacgcuuaacuguug

SEQ ID NO: 727827 - RNA, 19 nt, Homo sapiens
ggcagagacauaugcuuua

SEQ ID NO: 727828 - RNA, 19 nt, Homo sapiens
ucacuuugauuagggcuuu

SEQ ID NO: 727829 - RNA, 19 nt, Homo sapiens
acaggcacauggcuuuaaa

SEQ ID NO: 727830 - RNA, 19 nt, Homo sapiens
caucuuguguugguacauu

SEQ ID NO: 727831 - RNA, 19 nt, Homo sapiens
ccacauuuguaauauaguc

SEQ ID NO: 727832 - RNA, 19 nt, Homo sapiens
ggcauaaagugaagaucga

SEQ ID NO: 727833 - RNA, 19 nt, Homo sapiens
cucacuggcugauacauuu

SEQ ID NO: 727834 - RNA, 19 nt, Homo sapiens
gcuuaacuguuguguaucu

SEQ ID NO: 727835 - RNA, 19 nt, Homo sapiens
caaggauucagucaaacua

SEQ ID NO: 727836 - RNA, 19 nt, Homo sapiens
uuuauugccuugcauucua

SEQ ID NO: 727837 - RNA, 19 nt, Homo sapiens
gaagacacaaacacugaau

SEQ ID NO: 727838 - RNA, 19 nt, Homo sapiens
gcguaaguaugcacagaug

SEQ ID NO: 727839 - RNA, 19 nt, Homo sapiens
uaguauauaugccacugaa

SEQ ID NO: 727840 - RNA, 19 nt, Homo sapiens
gaggugaaagaaagcuaua

SEQ ID NO: 727841 - RNA, 19 nt, Homo sapiens
aaagaacugaugcacuaua

SEQ ID NO: 727842 - RNA, 19 nt, Homo sapiens
gugaagacacaaacacuga

SEQ ID NO: 727843 - RNA, 19 nt, Homo sapiens
gauggaaguguaggguuua

SEQ ID NO: 727844 - RNA, 19 nt, Homo sapiens
guguauuguuucucacuuu

SEQ ID NO: 727845 - RNA, 19 nt, Homo sapiens
gaaguaccaauuaguugau

SEQ ID NO: 727846 - RNA, 19 nt, Homo sapiens
aguguaggguuuaugaauu

SEQ ID NO: 727847 - RNA, 19 nt, Homo sapiens
ggaaacagccuccuccuuu

SEQ ID NO: 727848 - RNA, 19 nt, Homo sapiens
gaauaaagacuaucucugu

SEQ ID NO: 727849 - RNA, 19 nt, Homo sapiens
cgucaguguuuccauguua

SEQ ID NO: 727850 - RNA, 19 nt, Homo sapiens
gaccaucucugcacugaag

SEQ ID NO: 727851 - RNA, 19 nt, Homo sapiens
gcgcauagcuccgacuaca

SEQ ID NO: 727852 - RNA, 19 nt, Homo sapiens
cuugagaagugaauaaaug

SEQ ID NO: 727853 - RNA, 19 nt, Homo sapiens
cagcuacucuaaauuaugg

SEQ ID NO: 727854 - RNA, 19 nt, Homo sapiens
gcacgggcauugggaaaca

SEQ ID NO: 727855 - RNA, 19 nt, Homo sapiens
uucccaaccuugcuucuua

SEQ ID NO: 727856 - RNA, 19 nt, Homo sapiens
guagacagcgccucaguuc

SEQ ID NO: 727857 - RNA, 19 nt, Homo sapiens
gcugagugcgucccugaua

SEQ ID NO: 727858 - RNA, 19 nt, Homo sapiens
ggcacucgcuggucucguu

SEQ ID NO: 727859 - RNA, 19 nt, Homo sapiens
ccaaauacagcaucaccuu

SEQ ID NO: 727860 - RNA, 19 nt, Homo sapiens
cuccagcuacucuaaauua

SEQ ID NO: 727861 - RNA, 19 nt, Homo sapiens
ccugggcgcugaugaagga

SEQ ID NO: 727862 - RNA, 19 nt, Homo sapiens
gaagaaccaguacgucagu

SEQ ID NO: 727863 - RNA, 19 nt, Homo sapiens
ggaucucucugcguuugaa

SEQ ID NO: 727864 - RNA, 19 nt, Homo sapiens
cagcagggacaaugagauu

SEQ ID NO: 727865 - RNA, 19 nt, Homo sapiens
guaacgggcugcgcgacuu

SEQ ID NO: 727866 - RNA, 19 nt, Homo sapiens
uauggucuccuuauaaguu

SEQ ID NO: 727867 - RNA, 19 nt, Homo sapiens
cugagugcgucccugauaa

SEQ ID NO: 727868 - RNA, 19 nt, Homo sapiens
gcguuugaauaaagacuau

SEQ ID NO: 727869 - RNA, 19 nt, Homo sapiens
gacagcggcuucaccuucu

SEQ ID NO: 727870 - RNA, 19 nt, Homo sapiens
ggaggaagaaccaguacgu

SEQ ID NO: 727871 - RNA, 19 nt, Homo sapiens
ucucugcguuugaauaaag

SEQ ID NO: 727872 - RNA, 19 nt, Homo sapiens
gccucgggcuuaaauagga

SEQ ID NO: 727873 - RNA, 19 nt, Homo sapiens
cuaaauuauggucuccuua

SEQ ID NO: 727874 - RNA, 19 nt, Homo sapiens
aaauacagcaucaccuuca

SEQ ID NO: 727875 - RNA, 19 nt, Homo sapiens
ggccaacuccuucuacuac

SEQ ID NO: 727876 - RNA, 19 nt, Homo sapiens
uacagcauguggaggaaga

SEQ ID NO: 727877 - RNA, 19 nt, Homo sapiens
auaaagacuaucucuguug

SEQ ID NO: 727878 - RNA, 19 nt, Homo sapiens
ucuaaauuauggucuccuu

SEQ ID NO: 727879 - RNA, 19 nt, Homo sapiens
gggaaacagccuccuccuu

SEQ ID NO: 727880 - RNA, 19 nt, Homo sapiens
ucucucugcguuugaauaa

SEQ ID NO: 727881 - RNA, 19 nt, Homo sapiens
auggucuccuuauaaguua

SEQ ID NO: 727882 - RNA, 19 nt, Homo sapiens
ccugauaacugcgucuaag

SEQ ID NO: 727883 - RNA, 19 nt, Homo sapiens
uaacgggcugcgcgacuuu

SEQ ID NO: 727884 - RNA, 19 nt, Homo sapiens
ggcuccagcuacucuaaau

SEQ ID NO: 727885 - RNA, 19 nt, Homo sapiens
ccgaccaucucugcacuga

SEQ ID NO: 727886 - RNA, 19 nt, Homo sapiens
ggaacuggagccucauugg

SEQ ID NO: 727887 - RNA, 19 nt, Homo sapiens
gcacucgcuggucucguuu

SEQ ID NO: 727888 - RNA, 19 nt, Homo sapiens
gaaccaguacgucaguaac

SEQ ID NO: 727889 - RNA, 19 nt, Homo sapiens
gucaguguuuccauguuau

SEQ ID NO: 727890 - RNA, 19 nt, Homo sapiens
ccagcuacucuaaauuaug

SEQ ID NO: 727891 - RNA, 19 nt, Homo sapiens
gccccgagcucgaagaaga

SEQ ID NO: 727892 - RNA, 19 nt, Homo sapiens
gcgucaguguuuccauguu

SEQ ID NO: 727893 - RNA, 19 nt, Homo sapiens
agacagcgccucaguucca

SEQ ID NO: 727894 - RNA, 19 nt, Homo sapiens
gggcgcugaugaaggagau

SEQ ID NO: 727895 - RNA, 19 nt, Homo sapiens
agaaccaguacgucaguaa

SEQ ID NO: 727896 - RNA, 19 nt, Homo sapiens
uccagcuacucuaaauuau

SEQ ID NO: 727897 - RNA, 19 nt, Homo sapiens
gcuccagcuacucuaaauu

SEQ ID NO: 727898 - RNA, 19 nt, Homo sapiens
aagaaccaguacgucagua

SEQ ID NO: 727899 - RNA, 19 nt, Homo sapiens
ccaaggcuccagcuacucu

SEQ ID NO: 727900 - RNA, 19 nt, Homo sapiens
gcgccucaguuccagaaac

SEQ ID NO: 727901 - RNA, 19 nt, Homo sapiens
guacuaagcugaaacaugu

SEQ ID NO: 727902 - RNA, 19 nt, Homo sapiens
ggacagaacgcgccauuua

SEQ ID NO: 727903 - RNA, 19 nt, Homo sapiens
gaacaagauuccacauuug

SEQ ID NO: 727904 - RNA, 19 nt, Homo sapiens
aaacagagcugguagacuu

SEQ ID NO: 727905 - RNA, 19 nt, Homo sapiens
caaacaaguugcagaauug

SEQ ID NO: 727906 - RNA, 19 nt, Homo sapiens
gaucauagacgaagaagaa

SEQ ID NO: 727907 - RNA, 19 nt, Homo sapiens
ugaacaagauuccacauuu

SEQ ID NO: 727908 - RNA, 19 nt, Homo sapiens
guucuaagcuaucuaucua

SEQ ID NO: 727909 - RNA, 19 nt, Homo sapiens
gagacauccuuucugaaua

SEQ ID NO: 727910 - RNA, 19 nt, Homo sapiens
gaucagagcaugcaauguu

SEQ ID NO: 727911 - RNA, 19 nt, Homo sapiens
ggaaccagcuaccgcguaa

SEQ ID NO: 727912 - RNA, 19 nt, Homo sapiens
gcaauguucauccuuguua

SEQ ID NO: 727913 - RNA, 19 nt, Homo sapiens
ucaaacaaguugcagaauu

SEQ ID NO: 727914 - RNA, 19 nt, Homo sapiens
gaacuaccuuuguauccaa

SEQ ID NO: 727915 - RNA, 19 nt, Homo sapiens
gcaauguuguucuaagcua

SEQ ID NO: 727916 - RNA, 19 nt, Homo sapiens
guauaguccugaauaugua

SEQ ID NO: 727917 - RNA, 19 nt, Homo sapiens
accaauggcuggauuauuu

SEQ ID NO: 727918 - RNA, 19 nt, Homo sapiens
cgaaauccauccauccaaa

SEQ ID NO: 727919 - RNA, 19 nt, Homo sapiens
gaagaaauucgacaacaga

SEQ ID NO: 727920 - RNA, 19 nt, Homo sapiens
gaacagagagggugauaag

SEQ ID NO: 727921 - RNA, 19 nt, Homo sapiens
gcaucaagucucuuucuua

SEQ ID NO: 727922 - RNA, 19 nt, Homo sapiens
ggauuaagcugagcaagca

SEQ ID NO: 727923 - RNA, 19 nt, Homo sapiens
ccaagaaacuuugugaaca

SEQ ID NO: 727924 - RNA, 19 nt, Homo sapiens
ggaacaggcugcgugauuc

SEQ ID NO: 727925 - RNA, 19 nt, Homo sapiens
gugagcagcugaaggaaga

SEQ ID NO: 727926 - RNA, 19 nt, Homo sapiens
ggagugagcagcugaagga

SEQ ID NO: 727927 - RNA, 19 nt, Homo sapiens
gaaaauggaggaagaaauu

SEQ ID NO: 727928 - RNA, 19 nt, Homo sapiens
agacacacccaaaggauua

SEQ ID NO: 727929 - RNA, 19 nt, Homo sapiens
ccaaauggagccucaguuu

SEQ ID NO: 727930 - RNA, 19 nt, Homo sapiens
ucucugaacuaccuuugua

SEQ ID NO: 727931 - RNA, 19 nt, Homo sapiens
ggacaaagugcccaaguca

SEQ ID NO: 727932 - RNA, 19 nt, Homo sapiens
ggaagaaauucgacaacag

SEQ ID NO: 727933 - RNA, 19 nt, Homo sapiens
cuaagggaaaggaauauua

SEQ ID NO: 727934 - RNA, 19 nt, Homo sapiens
gaucccacuccaagaauua

SEQ ID NO: 727935 - RNA, 19 nt, Homo sapiens
cagagagggugauaaggaa

SEQ ID NO: 727936 - RNA, 19 nt, Homo sapiens
cuucagaggauucacauua

SEQ ID NO: 727937 - RNA, 19 nt, Homo sapiens
cauaguauaguccugaaua

SEQ ID NO: 727938 - RNA, 19 nt, Homo sapiens
aaacaaaucuaagggaaag

SEQ ID NO: 727939 - RNA, 19 nt, Homo sapiens
uaggaaacauucacagaug

SEQ ID NO: 727940 - RNA, 19 nt, Homo sapiens
uaacaagucaugugggaaa

SEQ ID NO: 727941 - RNA, 19 nt, Homo sapiens
gacagaacgcgccauuuaa

SEQ ID NO: 727942 - RNA, 19 nt, Homo sapiens
caucaagucucuuucuuac

SEQ ID NO: 727943 - RNA, 19 nt, Homo sapiens
gcaaagacaagaaggagau

SEQ ID NO: 727944 - RNA, 19 nt, Homo sapiens
ggacaagccacccuagugu

SEQ ID NO: 727945 - RNA, 19 nt, Homo sapiens
gaagaggagcauugauguu

SEQ ID NO: 727946 - RNA, 19 nt, Homo sapiens
cgacuggaacguaggcuua

SEQ ID NO: 727947 - RNA, 19 nt, Homo sapiens
ucaagucucuuucuuacca

SEQ ID NO: 727948 - RNA, 19 nt, Homo sapiens
uaagaagcaucaagucucu

SEQ ID NO: 727949 - RNA, 19 nt, Homo sapiens
cuaaguaaguguucagaag

SEQ ID NO: 727950 - RNA, 19 nt, Homo sapiens
gaacuuggagacugcaaug

SEQ ID NO: 727951 - RNA, 19 nt, Homo sapiens
gggaacaggcugcgugauu

SEQ ID NO: 727952 - RNA, 19 nt, Homo sapiens
ggaucccacuccaagaauu

SEQ ID NO: 727953 - RNA, 19 nt, Homo sapiens
gaagacacacccaaaggau

SEQ ID NO: 727954 - RNA, 19 nt, Homo sapiens
gagggaccauuauuacauc

SEQ ID NO: 727955 - RNA, 19 nt, Homo sapiens
gcaagcaauucugguggaa

SEQ ID NO: 727956 - RNA, 19 nt, Homo sapiens
gguacuaaauccuuauugg

SEQ ID NO: 727957 - RNA, 19 nt, Homo sapiens
ccuagugucucauguuugu

SEQ ID NO: 727958 - RNA, 19 nt, Homo sapiens
ggagggaccauuauuacau

SEQ ID NO: 727959 - RNA, 19 nt, Homo sapiens
guucuuggagggaccauua

SEQ ID NO: 727960 - RNA, 19 nt, Homo sapiens
caaguuugcaaaucaguuu

SEQ ID NO: 727961 - RNA, 19 nt, Homo sapiens
caaaauuggucucuuuaga

SEQ ID NO: 727962 - RNA, 19 nt, Homo sapiens
uaaauuguguacgcuaguu

SEQ ID NO: 727963 - RNA, 19 nt, Homo sapiens
agagguaugugaagcaguu

SEQ ID NO: 727964 - RNA, 19 nt, Homo sapiens
gcgaaggcgucaaacaagu

SEQ ID NO: 727965 - RNA, 19 nt, Homo sapiens
gaggaucccacuccaagaa

SEQ ID NO: 727966 - RNA, 19 nt, Homo sapiens
cuuguuaggugguuuauag

SEQ ID NO: 727967 - RNA, 19 nt, Homo sapiens
ugaauugcuuucucccaaa

SEQ ID NO: 727968 - RNA, 19 nt, Homo sapiens
agaggaguauguacaauuc

SEQ ID NO: 727969 - RNA, 19 nt, Homo sapiens
caaguacagacucacauuu

SEQ ID NO: 727970 - RNA, 19 nt, Homo sapiens
ccagguuaauggcuaagaa

SEQ ID NO: 727971 - RNA, 19 nt, Homo sapiens
guuaggugguuuauaguuc

SEQ ID NO: 727972 - RNA, 19 nt, Homo sapiens
guacuaaauccuuauugga

SEQ ID NO: 727973 - RNA, 19 nt, Homo sapiens
ucagaggauucacauuaau

SEQ ID NO: 727974 - RNA, 19 nt, Homo sapiens
gaaagucaaaccugucagu

SEQ ID NO: 727975 - RNA, 19 nt, Homo sapiens
gagaacagagagggugaua

SEQ ID NO: 727976 - RNA, 19 nt, Homo sapiens
gcaaccaugucuggaagug

SEQ ID NO: 727977 - RNA, 19 nt, Homo sapiens
agacauccuuucugaauac

SEQ ID NO: 727978 - RNA, 19 nt, Homo sapiens
cagagacugugcagcgaaa

SEQ ID NO: 727979 - RNA, 19 nt, Homo sapiens
agagaaagaugaagaugac

SEQ ID NO: 727980 - RNA, 19 nt, Homo sapiens
gaagagaaagaugaagaug

SEQ ID NO: 727981 - RNA, 19 nt, Homo sapiens
ggacccggauccagguguu

SEQ ID NO: 727982 - RNA, 19 nt, Homo sapiens
ggaccauuauuacaucucu

SEQ ID NO: 727983 - RNA, 19 nt, Homo sapiens
ggaauauuaugggauuaag

SEQ ID NO: 727984 - RNA, 19 nt, Homo sapiens
gagaucagagcaugcaaug

SEQ ID NO: 727985 - RNA, 19 nt, Homo sapiens
gaauguaacaagucaugug

SEQ ID NO: 727986 - RNA, 19 nt, Homo sapiens
gugcaaagccgagacauca

SEQ ID NO: 727987 - RNA, 19 nt, Homo sapiens
cagcgaaggcgucaaacaa

SEQ ID NO: 727988 - RNA, 19 nt, Homo sapiens
ccaccaagggauaguguaa

SEQ ID NO: 727989 - RNA, 19 nt, Homo sapiens
ccaaugcauuccuucaaca

SEQ ID NO: 727990 - RNA, 19 nt, Homo sapiens
gagcaguucccagguugua

SEQ ID NO: 727991 - RNA, 19 nt, Homo sapiens
cagaagagaaagaugaaga

SEQ ID NO: 727992 - RNA, 19 nt, Homo sapiens
gggaauugguccgagaaga

SEQ ID NO: 727993 - RNA, 19 nt, Homo sapiens
caagaugagggcucucuga

SEQ ID NO: 727994 - RNA, 19 nt, Homo sapiens
acaaugcucugaauacacu

SEQ ID NO: 727995 - RNA, 19 nt, Homo sapiens
aggaauggccacagguuua

SEQ ID NO: 727996 - RNA, 19 nt, Homo sapiens
aaucuaagggaaaggaaua

SEQ ID NO: 727997 - RNA, 19 nt, Homo sapiens
uuucaagucuccucaguca

SEQ ID NO: 727998 - RNA, 19 nt, Homo sapiens
guuugcccaucucuucuua

SEQ ID NO: 727999 - RNA, 19 nt, Homo sapiens
ucuuuggccuguucaauga

SEQ ID NO: 728000 - RNA, 19 nt, Homo sapiens
guaggaaacauucacagau

SEQ ID NO: 728001 - RNA, 19 nt, Homo sapiens
caacagagauccuaugauu

SEQ ID NO: 728002 - RNA, 19 nt, Homo sapiens
cgaaauagcugacacacua

SEQ ID NO: 728003 - RNA, 19 nt, Homo sapiens
ggcaagggauuauaauuaa

SEQ ID NO: 728004 - RNA, 19 nt, Homo sapiens
gggcugaccucccaucuaa

SEQ ID NO: 728005 - RNA, 19 nt, Homo sapiens
gggcaagggauuauaauua

SEQ ID NO: 728006 - RNA, 19 nt, Homo sapiens
ccugagagaugauauaauu

SEQ ID NO: 728007 - RNA, 19 nt, Homo sapiens
ccaagaaggugugguauga

SEQ ID NO: 728008 - RNA, 19 nt, Homo sapiens
ugagaugccuuauguggua

SEQ ID NO: 728009 - RNA, 19 nt, Homo sapiens
gcaccagucuguucugcua

SEQ ID NO: 728010 - RNA, 19 nt, Homo sapiens
ccuccaagcuguacaauga

SEQ ID NO: 728011 - RNA, 19 nt, Homo sapiens
ucagacauaugaaguguuu

SEQ ID NO: 728012 - RNA, 19 nt, Homo sapiens
gaauaucccugagaacaug

SEQ ID NO: 728013 - RNA, 19 nt, Homo sapiens
gaagggauuuccuguucuu

SEQ ID NO: 728014 - RNA, 19 nt, Homo sapiens
guacaucuaugggcuguga

SEQ ID NO: 728015 - RNA, 19 nt, Homo sapiens
caagggcuaugaagacuau

SEQ ID NO: 728016 - RNA, 19 nt, Homo sapiens
ggacuggaauacgcuaauu

SEQ ID NO: 728017 - RNA, 19 nt, Homo sapiens
gaacggauuuucagccuuu

SEQ ID NO: 728018 - RNA, 19 nt, Homo sapiens
gagaggagcauuucaaucu

SEQ ID NO: 728019 - RNA, 19 nt, Homo sapiens
ggaguacacuuccuuucug

SEQ ID NO: 728020 - RNA, 19 nt, Homo sapiens
cccauccucuucccuauua

SEQ ID NO: 728021 - RNA, 19 nt, Homo sapiens
gcacuaguuugacuuugug

SEQ ID NO: 728022 - RNA, 19 nt, Homo sapiens
acagagauccuaugauuga

SEQ ID NO: 728023 - RNA, 19 nt, Homo sapiens
cagaggaccugagagauga

SEQ ID NO: 728024 - RNA, 19 nt, Homo sapiens
gaggaaauaccaauaaagu

SEQ ID NO: 728025 - RNA, 19 nt, Homo sapiens
guaagaggaaauaccaaua

SEQ ID NO: 728026 - RNA, 19 nt, Homo sapiens
agagaaagcagacaucauu

SEQ ID NO: 728027 - RNA, 19 nt, Homo sapiens
ggagaaggauaccaauguc

SEQ ID NO: 728028 - RNA, 19 nt, Homo sapiens
gauuuccuguucuuucuaa

SEQ ID NO: 728029 - RNA, 19 nt, Homo sapiens
ugcaguggcucuugaaauu

SEQ ID NO: 728030 - RNA, 19 nt, Homo sapiens
ggccaucacucuuccaugu

SEQ ID NO: 728031 - RNA, 19 nt, Homo sapiens
caucuaaucaugucauuga

SEQ ID NO: 728032 - RNA, 19 nt, Homo sapiens
caagaacucccuggaauau

SEQ ID NO: 728033 - RNA, 19 nt, Homo sapiens
gaaccguccuccaccuaau

SEQ ID NO: 728034 - RNA, 19 nt, Homo sapiens
aagaagggauuuccuguuc

SEQ ID NO: 728035 - RNA, 19 nt, Homo sapiens
aaaaggaccccaucaaaua

SEQ ID NO: 728036 - RNA, 19 nt, Homo sapiens
gaggugcaguucaucauca

SEQ ID NO: 728037 - RNA, 19 nt, Homo sapiens
ggaccugagagaugauaua

SEQ ID NO: 728038 - RNA, 19 nt, Homo sapiens
ucaagaacucccuggaaua

SEQ ID NO: 728039 - RNA, 19 nt, Homo sapiens
gagauccuaugauugacaa

SEQ ID NO: 728040 - RNA, 19 nt, Homo sapiens
uaaugccuaugaacucuuu

SEQ ID NO: 728041 - RNA, 19 nt, Homo sapiens
ggauugcaguggcucuuga

SEQ ID NO: 728042 - RNA, 19 nt, Homo sapiens
gcacucagccucaagaacu

SEQ ID NO: 728043 - RNA, 19 nt, Homo sapiens
gaaggugcaguacaucuau

SEQ ID NO: 728044 - RNA, 19 nt, Homo sapiens
caucagacaugagggaaug

SEQ ID NO: 728045 - RNA, 19 nt, Homo sapiens
ccaauaccuggaauacuua

SEQ ID NO: 728046 - RNA, 19 nt, Homo sapiens
ggaauuagugcuggauuug

SEQ ID NO: 728047 - RNA, 19 nt, Homo sapiens
gcaccaaccaccacucaga

SEQ ID NO: 728048 - RNA, 19 nt, Homo sapiens
gaaaaggaccccaucaaau

SEQ ID NO: 728049 - RNA, 19 nt, Homo sapiens
gcauuuuccugaccaauaa

SEQ ID NO: 728050 - RNA, 19 nt, Homo sapiens
gcucaagccaccaaucuau

SEQ ID NO: 728051 - RNA, 19 nt, Homo sapiens
gcuguaugcuguggagaaa

SEQ ID NO: 728052 - RNA, 19 nt, Homo sapiens
aaucugcuuuccugccuua

SEQ ID NO: 728053 - RNA, 19 nt, Homo sapiens
gggauguucucaugguuuc

SEQ ID NO: 728054 - RNA, 19 nt, Homo sapiens
gaccugagagaugauauaa

SEQ ID NO: 728055 - RNA, 19 nt, Homo sapiens
ggaggugaacacaguacua

SEQ ID NO: 728056 - RNA, 19 nt, Homo sapiens
ccaagugaccguagucuca

SEQ ID NO: 728057 - RNA, 19 nt, Homo sapiens
uggacaaucuggaaucuca

SEQ ID NO: 728058 - RNA, 19 nt, Homo sapiens
cuacuaguaucaaggaauc

SEQ ID NO: 728059 - RNA, 19 nt, Homo sapiens
ggaauaucccugagaacau

SEQ ID NO: 728060 - RNA, 19 nt, Homo sapiens
caaggugggcaagggauua

SEQ ID NO: 728061 - RNA, 19 nt, Homo sapiens
gcuauugcaccuuggaauu

SEQ ID NO: 728062 - RNA, 19 nt, Homo sapiens
gaauuuuggugcauauuug

SEQ ID NO: 728063 - RNA, 19 nt, Homo sapiens
gagaaagcagacaucauug

SEQ ID NO: 728064 - RNA, 19 nt, Homo sapiens
cagcaggccaucuauaaau

SEQ ID NO: 728065 - RNA, 19 nt, Homo sapiens
ggcacuaguuugacuuugu

SEQ ID NO: 728066 - RNA, 19 nt, Homo sapiens
uggaaucucagacauauga

SEQ ID NO: 728067 - RNA, 19 nt, Homo sapiens
gggauuuccuguucuuucu

SEQ ID NO: 728068 - RNA, 19 nt, Homo sapiens
ccagaggaccugagagaug

SEQ ID NO: 728069 - RNA, 19 nt, Homo sapiens
gugauuggcuacuaguauc

SEQ ID NO: 728070 - RNA, 19 nt, Homo sapiens
ccuggaauaucccugagaa

SEQ ID NO: 728071 - RNA, 19 nt, Homo sapiens
gaauuagugcuggauuuga

SEQ ID NO: 728072 - RNA, 19 nt, Homo sapiens
ggauggagcccagcacuuc

SEQ ID NO: 728073 - RNA, 19 nt, Homo sapiens
gaagccaagugaccguagu

SEQ ID NO: 728074 - RNA, 19 nt, Homo sapiens
gaccucccaucuaaucaug

SEQ ID NO: 728075 - RNA, 19 nt, Homo sapiens
aauuagugcuggauuugaa

SEQ ID NO: 728076 - RNA, 19 nt, Homo sapiens
aggaauuagugcuggauuu

SEQ ID NO: 728077 - RNA, 19 nt, Homo sapiens
uacagaaggugcaguacau

SEQ ID NO: 728078 - RNA, 19 nt, Homo sapiens
gagcccagcacuuccuaaa

SEQ ID NO: 728079 - RNA, 19 nt, Homo sapiens
gggcucauuugcugacaau

SEQ ID NO: 728080 - RNA, 19 nt, Homo sapiens
uggcacaacuuccggacuu

SEQ ID NO: 728081 - RNA, 19 nt, Homo sapiens
gagagaugauauaauugag

SEQ ID NO: 728082 - RNA, 19 nt, Homo sapiens
ucaggaagggacuggaaua

SEQ ID NO: 728083 - RNA, 19 nt, Homo sapiens
agacauaugaaguguuuga

SEQ ID NO: 728084 - RNA, 19 nt, Homo sapiens
ccaucacucuuccauguuc

SEQ ID NO: 728085 - RNA, 19 nt, Homo sapiens
ucaagccaccaaucuauga

SEQ ID NO: 728086 - RNA, 19 nt, Homo sapiens
ggugggcaagggauuauaa

SEQ ID NO: 728087 - RNA, 19 nt, Homo sapiens
ccacaggccgcucauauac

SEQ ID NO: 728088 - RNA, 19 nt, Homo sapiens
ggacuuugugugacuauag

SEQ ID NO: 728089 - RNA, 19 nt, Homo sapiens
acaccaaccuggccagagu

SEQ ID NO: 728090 - RNA, 19 nt, Homo sapiens
aaagcuuucuccauggauu

SEQ ID NO: 728091 - RNA, 19 nt, Homo sapiens
gguuccugcuccuguagua

SEQ ID NO: 728092 - RNA, 19 nt, Homo sapiens
uaagaagggauuuccuguu

SEQ ID NO: 728093 - RNA, 19 nt, Homo sapiens
uggagaagauucgcaggaa

SEQ ID NO: 728094 - RNA, 19 nt, Homo sapiens
cucaagaacucccuggaau

SEQ ID NO: 728095 - RNA, 19 nt, Homo sapiens
ucagagaggagcauuucaa

SEQ ID NO: 728096 - RNA, 19 nt, Homo sapiens
gcccauaacgguacgugaa

SEQ ID NO: 728097 - RNA, 19 nt, Homo sapiens
ccuauuaagcagcccauaa

SEQ ID NO: 728098 - RNA, 19 nt, Homo sapiens
gacaacaaccgcuauugca

SEQ ID NO: 728099 - RNA, 19 nt, Homo sapiens
gauggacaaucuggaaucu

SEQ ID NO: 728100 - RNA, 19 nt, Homo sapiens
aguuugagaugccuuaugu

SEQ ID NO: 728101 - RNA, 19 nt, Homo sapiens
uuacagagcugcaauaaga

SEQ ID NO: 728102 - RNA, 19 nt, Homo sapiens
ggucauggcucuuagcuaa

SEQ ID NO: 728103 - RNA, 19 nt, Homo sapiens
gagaugagcccuauaauga

SEQ ID NO: 728104 - RNA, 19 nt, Homo sapiens
agaugaagcuggucaaaua

SEQ ID NO: 728105 - RNA, 19 nt, Homo sapiens
ugagaggccuuccuaguua

SEQ ID NO: 728106 - RNA, 19 nt, Homo sapiens
gcucuuagcuaaccuauuc

SEQ ID NO: 728107 - RNA, 19 nt, Homo sapiens
ucuaagaacugccugauaa

SEQ ID NO: 728108 - RNA, 19 nt, Homo sapiens
gggcaaacaugcugaaaga

SEQ ID NO: 728109 - RNA, 19 nt, Homo sapiens
ggaagacccuggaggaaau

SEQ ID NO: 728110 - RNA, 19 nt, Homo sapiens
gaugagcccuauaaugaaa

SEQ ID NO: 728111 - RNA, 19 nt, Homo sapiens
gaaguacagcucaugaaua

SEQ ID NO: 728112 - RNA, 19 nt, Homo sapiens
gcagauguguucucuuaug

SEQ ID NO: 728113 - RNA, 19 nt, Homo sapiens
ggugauggcucuuaagaug

SEQ ID NO: 728114 - RNA, 19 nt, Homo sapiens
uuaaagagaucccaccauu

SEQ ID NO: 728115 - RNA, 19 nt, Homo sapiens
uaacauggaucccaaacug

SEQ ID NO: 728116 - RNA, 19 nt, Homo sapiens
aggcagauguguucucuua

SEQ ID NO: 728117 - RNA, 19 nt, Homo sapiens
gauguguucucuuauggua

SEQ ID NO: 728118 - RNA, 19 nt, Homo sapiens
guacagaguuaaagagauc

SEQ ID NO: 728119 - RNA, 19 nt, Homo sapiens
gagcugcaauaagaaauaa

SEQ ID NO: 728120 - RNA, 19 nt, Homo sapiens
uagcuaaccuauucaaaga

SEQ ID NO: 728121 - RNA, 19 nt, Homo sapiens
ugaagcuggucaaauauuu

SEQ ID NO: 728122 - RNA, 19 nt, Homo sapiens
guaucgagcucuuauaagu

SEQ ID NO: 728123 - RNA, 19 nt, Homo sapiens
ccacgucacuacauuucua

SEQ ID NO: 728124 - RNA, 19 nt, Homo sapiens
cagaggaugucuaguucua

SEQ ID NO: 728125 - RNA, 19 nt, Homo sapiens
gcuaccagcugcccuguug

SEQ ID NO: 728126 - RNA, 19 nt, Homo sapiens
ugucaucucucugguauuu

SEQ ID NO: 728127 - RNA, 19 nt, Homo sapiens
ggagauggagguagaagaa

SEQ ID NO: 728128 - RNA, 19 nt, Homo sapiens
aauagggucuggcuucuuu

SEQ ID NO: 728129 - RNA, 19 nt, Homo sapiens
gcaagucugucaucucucu

SEQ ID NO: 728130 - RNA, 19 nt, Homo sapiens
gaucggagcaaacggaauu

SEQ ID NO: 728131 - RNA, 19 nt, Homo sapiens
caagacauuuucagacuua

SEQ ID NO: 728132 - RNA, 19 nt, Homo sapiens
uaauugcuguuugcacuua

SEQ ID NO: 728133 - RNA, 19 nt, Homo sapiens
caaacaugcugaaagaagu

SEQ ID NO: 728134 - RNA, 19 nt, Homo sapiens
uaaaggagucuuaauguuc

SEQ ID NO: 728135 - RNA, 19 nt, Homo sapiens
ccauaagacuuucaaccuu

SEQ ID NO: 728136 - RNA, 19 nt, Homo sapiens
gaccagaggaugucuaguu

SEQ ID NO: 728137 - RNA, 19 nt, Homo sapiens
gaacaguugcuagacagua

SEQ ID NO: 728138 - RNA, 19 nt, Homo sapiens
uuucauaacuugcuucugu

SEQ ID NO: 728139 - RNA, 19 nt, Homo sapiens
gcagugagaggccuuccua

SEQ ID NO: 728140 - RNA, 19 nt, Homo sapiens
cagcaagucugucaucucu

SEQ ID NO: 728141 - RNA, 19 nt, Homo sapiens
gcaaacaugcugaaagaag

SEQ ID NO: 728142 - RNA, 19 nt, Homo sapiens
aaguacagcucaugaauag

SEQ ID NO: 728143 - RNA, 19 nt, Homo sapiens
gcaguagucuccucguucu

SEQ ID NO: 728144 - RNA, 19 nt, Homo sapiens
gaagaaucgcuaucugaug

SEQ ID NO: 728145 - RNA, 19 nt, Homo sapiens
ggaagaaucgcuaucugau

SEQ ID NO: 728146 - RNA, 19 nt, Homo sapiens
gggaagaaucgcuaucuga

SEQ ID NO: 728147 - RNA, 19 nt, Homo sapiens
gaagagcaggagagggaua

SEQ ID NO: 728148 - RNA, 19 nt, Homo sapiens
gaaagaaguacagcucaug

SEQ ID NO: 728149 - RNA, 19 nt, Homo sapiens
uguguggaguuccuucuua

SEQ ID NO: 728150 - RNA, 19 nt, Homo sapiens
uaacuugcuucuguugauu

SEQ ID NO: 728151 - RNA, 19 nt, Homo sapiens
gaauauugggugcuucuug

SEQ ID NO: 728152 - RNA, 19 nt, Homo sapiens
uaaguagucucaaguacag

SEQ ID NO: 728153 - RNA, 19 nt, Homo sapiens
ucucgaagccagucagaua

SEQ ID NO: 728154 - RNA, 19 nt, Homo sapiens
uuacuaugcucccucuuug

SEQ ID NO: 728155 - RNA, 19 nt, Homo sapiens
ucagcuaccuucacuucaa

SEQ ID NO: 728156 - RNA, 19 nt, Homo sapiens
ggguaaaacuggccuauga

SEQ ID NO: 728157 - RNA, 19 nt, Homo sapiens
ugauggcucuuaagaugaa

SEQ ID NO: 728158 - RNA, 19 nt, Homo sapiens
gaaauaaccaaagaugaag

SEQ ID NO: 728159 - RNA, 19 nt, Homo sapiens
uaagcucacuggaugacaa

SEQ ID NO: 728160 - RNA, 19 nt, Homo sapiens
caacugcuguaacauggau

SEQ ID NO: 728161 - RNA, 19 nt, Homo sapiens
cagcuaccuucacuucaaa

SEQ ID NO: 728162 - RNA, 19 nt, Homo sapiens
gugagaggccuuccuaguu

SEQ ID NO: 728163 - RNA, 19 nt, Homo sapiens
ccaacauccuuagguauau

SEQ ID NO: 728164 - RNA, 19 nt, Homo sapiens
ugacgcguuuggaugauuu

SEQ ID NO: 728165 - RNA, 19 nt, Homo sapiens
ggagcaaacggaauucaau

SEQ ID NO: 728166 - RNA, 19 nt, Homo sapiens
ccaguauucuaagacauuu

SEQ ID NO: 728167 - RNA, 19 nt, Homo sapiens
guaauggucauggcuguuu

SEQ ID NO: 728168 - RNA, 19 nt, Homo sapiens
acauggagcugaucaagag

SEQ ID NO: 728169 - RNA, 19 nt, Homo sapiens
gaacauggagcugaucaag

SEQ ID NO: 728170 - RNA, 19 nt, Homo sapiens
agucucaaguacagaguua

SEQ ID NO: 728171 - RNA, 19 nt, Homo sapiens
ucaucucucugguauuuga

SEQ ID NO: 728172 - RNA, 19 nt, Homo sapiens
ccaaacugcgcccaucuuu

SEQ ID NO: 728173 - RNA, 19 nt, Homo sapiens
ccgggaaccuggaacaguu

SEQ ID NO: 728174 - RNA, 19 nt, Homo sapiens
gaguuuggccaucuucgua

SEQ ID NO: 728175 - RNA, 19 nt, Homo sapiens
aaaggagucuuaauguucu

SEQ ID NO: 728176 - RNA, 19 nt, Homo sapiens
gggaagacccuggaggaaa

SEQ ID NO: 728177 - RNA, 19 nt, Homo sapiens
ggaugagaaugguuacucu

SEQ ID NO: 728178 - RNA, 19 nt, Homo sapiens
gauaaagagggaugagaau

SEQ ID NO: 728179 - RNA, 19 nt, Homo sapiens
guguggaguuccuucuuaa

SEQ ID NO: 728180 - RNA, 19 nt, Homo sapiens
ggaggagaaggaaauguga

SEQ ID NO: 728181 - RNA, 19 nt, Homo sapiens
ugccauggcuggagcuuug

SEQ ID NO: 728182 - RNA, 19 nt, Homo sapiens
ucacuacauuucuaugcaa

SEQ ID NO: 728183 - RNA, 19 nt, Homo sapiens
gcacauggugggagacugu

SEQ ID NO: 728184 - RNA, 19 nt, Homo sapiens
caacgagcugugaggguua

SEQ ID NO: 728185 - RNA, 19 nt, Homo sapiens
cgagaugagcccuauaaug

SEQ ID NO: 728186 - RNA, 19 nt, Homo sapiens
gcaguaaccgggcaaacau

SEQ ID NO: 728187 - RNA, 19 nt, Homo sapiens
gugauacauucaauugguu

SEQ ID NO: 728188 - RNA, 19 nt, Homo sapiens
cagaccacgucacuacauu

SEQ ID NO: 728189 - RNA, 19 nt, Homo sapiens
gggaagaguuuggccaucu

SEQ ID NO: 728190 - RNA, 19 nt, Homo sapiens
gcugauaccaagccucuga

SEQ ID NO: 728191 - RNA, 19 nt, Homo sapiens
aacaguugcuagacaguaa

SEQ ID NO: 728192 - RNA, 19 nt, Homo sapiens
cccaacauccuuagguaua

SEQ ID NO: 728193 - RNA, 19 nt, Homo sapiens
caaaccagaagagaaguaa

SEQ ID NO: 728194 - RNA, 19 nt, Homo sapiens
gaugaagcuggucaaauau

SEQ ID NO: 728195 - RNA, 19 nt, Homo sapiens
gaguggggcugguuuugua

SEQ ID NO: 728196 - RNA, 19 nt, Homo sapiens
gcccauuggcuguguauga

SEQ ID NO: 728197 - RNA, 19 nt, Homo sapiens
gcuccauucuccaggaaga

SEQ ID NO: 728198 - RNA, 19 nt, Homo sapiens
gaaccuggaacaguugcua

SEQ ID NO: 728199 - RNA, 19 nt, Homo sapiens
ggucaggugauggcucuua

SEQ ID NO: 728200 - RNA, 19 nt, Homo sapiens
guuacuaugcucccucuuu

SEQ ID NO: 728201 - RNA, 19 nt, Homo sapiens
caauuucccuuucccaaua

SEQ ID NO: 728202 - RNA, 19 nt, Homo sapiens
cagcaaauaugacaucuug

SEQ ID NO: 728203 - RNA, 19 nt, Homo sapiens
gcgcaagcaucucuucuuu

SEQ ID NO: 728204 - RNA, 19 nt, Homo sapiens
gaugugaugugggaauaua

SEQ ID NO: 728205 - RNA, 19 nt, Homo sapiens
gagauggucugguggaugu

SEQ ID NO: 728206 - RNA, 19 nt, Homo sapiens
gaaccgggaugcucagauc

SEQ ID NO: 728207 - RNA, 19 nt, Homo sapiens
gaauauaagugggagaaca

SEQ ID NO: 728208 - RNA, 19 nt, Homo sapiens
ggaggaggaugaugaugau

SEQ ID NO: 728209 - RNA, 19 nt, Homo sapiens
gcauugacuuugaccucua

SEQ ID NO: 728210 - RNA, 19 nt, Homo sapiens
guucggaucacacccuuua

SEQ ID NO: 728211 - RNA, 19 nt, Homo sapiens
gaggaaggccacuuugaug

SEQ ID NO: 728212 - RNA, 19 nt, Homo sapiens
ggaggaaggccacuuugau

SEQ ID NO: 728213 - RNA, 19 nt, Homo sapiens
cauguucgcugaggaguug

SEQ ID NO: 728214 - RNA, 19 nt, Homo sapiens
gcgaugaggaggaggauga

SEQ ID NO: 728215 - RNA, 19 nt, Homo sapiens
caagggaacgguuggcuau

SEQ ID NO: 728216 - RNA, 19 nt, Homo sapiens
gauggaggaaggccacuuu

SEQ ID NO: 728217 - RNA, 19 nt, Homo sapiens
cuacaacuccaaacgcauu

SEQ ID NO: 728218 - RNA, 19 nt, Homo sapiens
gagcuccuauugccuagag

SEQ ID NO: 728219 - RNA, 19 nt, Homo sapiens
gggcaaccuugguguguac

SEQ ID NO: 728220 - RNA, 19 nt, Homo sapiens
ugaggaggaugaggaugaa

SEQ ID NO: 728221 - RNA, 19 nt, Homo sapiens
cuaugcgucugaaggguuu

SEQ ID NO: 728222 - RNA, 19 nt, Homo sapiens
uggaugugaugugggaaua

SEQ ID NO: 728223 - RNA, 19 nt, Homo sapiens
ggaguuggcggaggaggaa

SEQ ID NO: 728224 - RNA, 19 nt, Homo sapiens
gggaauauaagugggagaa

SEQ ID NO: 728225 - RNA, 19 nt, Homo sapiens
gagccgcuuuaaaggcaaa

SEQ ID NO: 728226 - RNA, 19 nt, Homo sapiens
gguccugggagccgcuuua

SEQ ID NO: 728227 - RNA, 19 nt, Homo sapiens
ggaggaugaggaugaaauc

SEQ ID NO: 728228 - RNA, 19 nt, Homo sapiens
ccuauugccuagagagaca

SEQ ID NO: 728229 - RNA, 19 nt, Homo sapiens
ccugggagccgcuuuaaag

SEQ ID NO: 728230 - RNA, 19 nt, Homo sapiens
caaagaggaaagugaccuu

SEQ ID NO: 728231 - RNA, 19 nt, Homo sapiens
cacccucccuggacauguu

SEQ ID NO: 728232 - RNA, 19 nt, Homo sapiens
ggaggcaccaagugucuca

SEQ ID NO: 728233 - RNA, 19 nt, Homo sapiens
ggaggaggcaaagggagaa

SEQ ID NO: 728234 - RNA, 19 nt, Homo sapiens
caacauugacugggugaag

SEQ ID NO: 728235 - RNA, 19 nt, Homo sapiens
aauuucccuuucccaauaa

SEQ ID NO: 728236 - RNA, 19 nt, Homo sapiens
ucaauuucccuuucccaau

SEQ ID NO: 728237 - RNA, 19 nt, Homo sapiens
cuucuuuccuggacuuugu

SEQ ID NO: 728238 - RNA, 19 nt, Homo sapiens
auucccagcuugagaaaca

SEQ ID NO: 728239 - RNA, 19 nt, Homo sapiens
gaggaggcaccaagugucu

SEQ ID NO: 728240 - RNA, 19 nt, Homo sapiens
gcccuucuuuccuggacuu

SEQ ID NO: 728241 - RNA, 19 nt, Homo sapiens
aacauugacugggugaaga

SEQ ID NO: 728242 - RNA, 19 nt, Homo sapiens
aggaggaggaugaugauga

SEQ ID NO: 728243 - RNA, 19 nt, Homo sapiens
ggauucccagcuugagaaa

SEQ ID NO: 728244 - RNA, 19 nt, Homo sapiens
gcuugagaaacaccucuuu

SEQ ID NO: 728245 - RNA, 19 nt, Homo sapiens
cuccaaacgcauugacuuu

SEQ ID NO: 728246 - RNA, 19 nt, Homo sapiens
gaggaaauuggaggccauu

SEQ ID NO: 728247 - RNA, 19 nt, Homo sapiens
ucaggcagcgaggaaauug

SEQ ID NO: 728248 - RNA, 19 nt, Homo sapiens
gggagauggucugguggau

SEQ ID NO: 728249 - RNA, 19 nt, Homo sapiens
ggaggcaaagggagaaagg

SEQ ID NO: 728250 - RNA, 19 nt, Homo sapiens
ccagaaagcuccagauaaa

SEQ ID NO: 728251 - RNA, 19 nt, Homo sapiens
gagaugagcugacggaaau

SEQ ID NO: 728252 - RNA, 19 nt, Homo sapiens
gcacguagguggcguuguu

SEQ ID NO: 728253 - RNA, 19 nt, Homo sapiens
caagauggcugaugucuca

SEQ ID NO: 728254 - RNA, 19 nt, Homo sapiens
ucucugaucuuauugcuua

SEQ ID NO: 728255 - RNA, 19 nt, Homo sapiens
ccucagcccuggacuguua

SEQ ID NO: 728256 - RNA, 19 nt, Homo sapiens
aaacauugcuagcauuuga

SEQ ID NO: 728257 - RNA, 19 nt, Homo sapiens
caagauguccuauuauuga

SEQ ID NO: 728258 - RNA, 19 nt, Homo sapiens
ugucaagcaugcuaauuua

SEQ ID NO: 728259 - RNA, 19 nt, Homo sapiens
gaauugccguguagacauu

SEQ ID NO: 728260 - RNA, 19 nt, Homo sapiens
ggugauagaugcccucaga

SEQ ID NO: 728261 - RNA, 19 nt, Homo sapiens
ccucugggcucuugaguug

SEQ ID NO: 728262 - RNA, 19 nt, Homo sapiens
gaguggaccucaccuggaa

SEQ ID NO: 728263 - RNA, 19 nt, Homo sapiens
gaacccagaugcgguggaa

SEQ ID NO: 728264 - RNA, 19 nt, Homo sapiens
gaccagaaagcuccagaua

SEQ ID NO: 728265 - RNA, 19 nt, Homo sapiens
gaccucaccuggaaacuca

SEQ ID NO: 728266 - RNA, 19 nt, Homo sapiens
ggaagauacuggugucucu

SEQ ID NO: 728267 - RNA, 19 nt, Homo sapiens
ggaccauccuggaagagaa

SEQ ID NO: 728268 - RNA, 19 nt, Homo sapiens
cagagagggugcugaguga

SEQ ID NO: 728269 - RNA, 19 nt, Homo sapiens
gaacauccaggaccaagau

SEQ ID NO: 728270 - RNA, 19 nt, Homo sapiens
gagcuuagaagaucccaaa

SEQ ID NO: 728271 - RNA, 19 nt, Homo sapiens
ucaagaagauccggaggaa

SEQ ID NO: 728272 - RNA, 19 nt, Homo sapiens
gcgguggaauuguuuaaga

SEQ ID NO: 728273 - RNA, 19 nt, Homo sapiens
gcagaagacccgaccauag

SEQ ID NO: 728274 - RNA, 19 nt, Homo sapiens
cagaugcgguggaauuguu

SEQ ID NO: 728275 - RNA, 19 nt, Homo sapiens
agacagaacuccggaagau

SEQ ID NO: 728276 - RNA, 19 nt, Homo sapiens
ucugacagguguuuacaaa

SEQ ID NO: 728277 - RNA, 19 nt, Homo sapiens
gaacaacaaccagcagaau

SEQ ID NO: 728278 - RNA, 19 nt, Homo sapiens
cagaagacccgaccauaga

SEQ ID NO: 728279 - RNA, 19 nt, Homo sapiens
gaagaucccaaaaguauaa

SEQ ID NO: 728280 - RNA, 19 nt, Homo sapiens
ugagagacuuccagacaga

SEQ ID NO: 728281 - RNA, 19 nt, Homo sapiens
caucaccacuucccaagau

SEQ ID NO: 728282 - RNA, 19 nt, Homo sapiens
acuagucacucacagauga

SEQ ID NO: 728283 - RNA, 19 nt, Homo sapiens
gcuagcauuugaagacaug

SEQ ID NO: 728284 - RNA, 19 nt, Homo sapiens
accaagauguccuauuauu

SEQ ID NO: 728285 - RNA, 19 nt, Homo sapiens
caugggagcuuagaagauc

SEQ ID NO: 728286 - RNA, 19 nt, Homo sapiens
agaaagcuccagauaaaga

SEQ ID NO: 728287 - RNA, 19 nt, Homo sapiens
gcacccaguggaugaauga

SEQ ID NO: 728288 - RNA, 19 nt, Homo sapiens
ccaagauguccuauuauug

SEQ ID NO: 728289 - RNA, 19 nt, Homo sapiens
gaaaacauugcuagcauuu

SEQ ID NO: 728290 - RNA, 19 nt, Homo sapiens
uaagaaggcgaaugcaaug

SEQ ID NO: 728291 - RNA, 19 nt, Homo sapiens
gaugaaugauccagaaacg

SEQ ID NO: 728292 - RNA, 19 nt, Homo sapiens
uugaagacaugcuggagaa

SEQ ID NO: 728293 - RNA, 19 nt, Homo sapiens
caagcaugcuaauuuaacu

SEQ ID NO: 728294 - RNA, 19 nt, Homo sapiens
uugaguugcugcuugaauu

SEQ ID NO: 728295 - RNA, 19 nt, Homo sapiens
ccugcucucugaucuuauu

SEQ ID NO: 728296 - RNA, 19 nt, Homo sapiens
uaauugaacacgcagaaga

SEQ ID NO: 728297 - RNA, 19 nt, Homo sapiens
caacccagaguuaauguca

SEQ ID NO: 728298 - RNA, 19 nt, Homo sapiens
cuccugcucucugaucuua

SEQ ID NO: 728299 - RNA, 19 nt, Homo sapiens
caugagagacuuccagaca

SEQ ID NO: 728300 - RNA, 19 nt, Homo sapiens
ugacggagguagguuucaa

SEQ ID NO: 728301 - RNA, 19 nt, Homo sapiens
uaacuagucacucacagau

SEQ ID NO: 728302 - RNA, 19 nt, Homo sapiens
gagagggugcugagugaug

SEQ ID NO: 728303 - RNA, 19 nt, Homo sapiens
cgacaguccucucuuucag

SEQ ID NO: 728304 - RNA, 19 nt, Homo sapiens
uggaguggcuaauugaaca

SEQ ID NO: 728305 - RNA, 19 nt, Homo sapiens
gacagaacuccggaagaua

SEQ ID NO: 728306 - RNA, 19 nt, Homo sapiens
ucauuucccugauggagau

SEQ ID NO: 728307 - RNA, 19 nt, Homo sapiens
ucaucgagguggcgcagaa

SEQ ID NO: 728308 - RNA, 19 nt, Homo sapiens
aaacuuuggugacgguagu

SEQ ID NO: 728309 - RNA, 19 nt, Homo sapiens
gcuaauugaacacgcagaa

SEQ ID NO: 728310 - RNA, 19 nt, Homo sapiens
uuaagaaggcgaaugcaau

SEQ ID NO: 728311 - RNA, 19 nt, Homo sapiens
cgguggaauuguuuaagaa

SEQ ID NO: 728312 - RNA, 19 nt, Homo sapiens
guuaaugucaagcaugcua

SEQ ID NO: 728313 - RNA, 19 nt, Homo sapiens
gaaagcuccagauaaagag

SEQ ID NO: 728314 - RNA, 19 nt, Homo sapiens
auagaugcccucagaguga

SEQ ID NO: 728315 - RNA, 19 nt, Homo sapiens
ucacagaugacuuuucuuu

SEQ ID NO: 728316 - RNA, 19 nt, Homo sapiens
caugcuaauuuaacuaguc

SEQ ID NO: 728317 - RNA, 19 nt, Homo sapiens
cugcuugaauugccgugua

SEQ ID NO: 728318 - RNA, 19 nt, Homo sapiens
gaccaagauguccuauuau

SEQ ID NO: 728319 - RNA, 19 nt, Homo sapiens
cgaaaacauugcuagcauu

SEQ ID NO: 728320 - RNA, 19 nt, Homo sapiens
uagaagaucccaaaaguau

SEQ ID NO: 728321 - RNA, 19 nt, Homo sapiens
uagaugcccucagagugaa

SEQ ID NO: 728322 - RNA, 19 nt, Homo sapiens
gaagacccgaccauagaca

SEQ ID NO: 728323 - RNA, 19 nt, Homo sapiens
ccaaaaguauaacccauca

SEQ ID NO: 728324 - RNA, 19 nt, Homo sapiens
gaaucuuccagacacuaaa

SEQ ID NO: 728325 - RNA, 19 nt, Homo sapiens
ggccgucauuucccugaug

SEQ ID NO: 728326 - RNA, 19 nt, Homo sapiens
ccauggaguggcuaauuga

SEQ ID NO: 728327 - RNA, 19 nt, Homo sapiens
gugcuccucugggcucuug

SEQ ID NO: 728328 - RNA, 19 nt, Homo sapiens
gucaagcaugcuaauuuaa

SEQ ID NO: 728329 - RNA, 19 nt, Homo sapiens
uggugacgguaguguguaa

SEQ ID NO: 728330 - RNA, 19 nt, Homo sapiens
gagcugacggaaaucuuca

SEQ ID NO: 728331 - RNA, 19 nt, Homo sapiens
gaugcgguggaauuguuua

SEQ ID NO: 728332 - RNA, 19 nt, Homo sapiens
guguagacauuugcuugga

SEQ ID NO: 728333 - RNA, 19 nt, Homo sapiens
ugaacaacaaccagcagaa

SEQ ID NO: 728334 - RNA, 19 nt, Homo sapiens
agagaugagcugacggaaa

SEQ ID NO: 728335 - RNA, 19 nt, Homo sapiens
acagaacuccggaagauac

SEQ ID NO: 728336 - RNA, 19 nt, Homo sapiens
agaccaacaugagagacuu

SEQ ID NO: 728337 - RNA, 19 nt, Homo sapiens
ugaugucucagcagaagaa

SEQ ID NO: 728338 - RNA, 19 nt, Homo sapiens
acugggaaguggagugaug

SEQ ID NO: 728339 - RNA, 19 nt, Homo sapiens
ccuggaaacucaccuucag

SEQ ID NO: 728340 - RNA, 19 nt, Homo sapiens
gcaugcuaauuuaacuagu

SEQ ID NO: 728341 - RNA, 19 nt, Homo sapiens
cagaguuaaugucaagcau

SEQ ID NO: 728342 - RNA, 19 nt, Homo sapiens
accagaaagcuccagauaa

SEQ ID NO: 728343 - RNA, 19 nt, Homo sapiens
aaccugcccuccuacaaca

SEQ ID NO: 728344 - RNA, 19 nt, Homo sapiens
agaaucuuccagacacuaa

SEQ ID NO: 728345 - RNA, 19 nt, Homo sapiens
aagaagauccggaggaaaa

SEQ ID NO: 728346 - RNA, 19 nt, Homo sapiens
caagaagauccggaggaaa

SEQ ID NO: 728347 - RNA, 19 nt, Homo sapiens
caaccugcccuccuacaac

SEQ ID NO: 728348 - RNA, 19 nt, Homo sapiens
ucacggagaugggcuuucc

SEQ ID NO: 728349 - RNA, 19 nt, Homo sapiens
ucaagcaugcuaauuuaac

SEQ ID NO: 728350 - RNA, 19 nt, Homo sapiens
ggaaugagcucuucuacug

SEQ ID NO: 728351 - RNA, 19 nt, Homo sapiens
ggacuucacuauuugacuu

SEQ ID NO: 728352 - RNA, 19 nt, Homo sapiens
caucauuucuuucuacuuc

SEQ ID NO: 728353 - RNA, 19 nt, Homo sapiens
uggcgggacuucacuauuu

SEQ ID NO: 728354 - RNA, 19 nt, Homo sapiens
gcauauaguagcugcuuaa

SEQ ID NO: 728355 - RNA, 19 nt, Homo sapiens
gcacagacuuuucuuguuc

SEQ ID NO: 728356 - RNA, 19 nt, Homo sapiens
gcuggacgcuuucgaugga

SEQ ID NO: 728357 - RNA, 19 nt, Homo sapiens
aauaaauacucgucuguca

SEQ ID NO: 728358 - RNA, 19 nt, Homo sapiens
gaauguaaacuccaugaag

SEQ ID NO: 728359 - RNA, 19 nt, Homo sapiens
uaaauacucgucugucaau

SEQ ID NO: 728360 - RNA, 19 nt, Homo sapiens
gagccacgcuguucuucca

SEQ ID NO: 728361 - RNA, 19 nt, Homo sapiens
ggcauauaguagcugcuua

SEQ ID NO: 728362 - RNA, 19 nt, Homo sapiens
agaguaagaccaacuugaa

SEQ ID NO: 728363 - RNA, 19 nt, Homo sapiens
ccaugaaggcacagacuuu

SEQ ID NO: 728364 - RNA, 19 nt, Homo sapiens
ggccugcucuguucaccuu

SEQ ID NO: 728365 - RNA, 19 nt, Homo sapiens
uacccucacuagaauguaa

SEQ ID NO: 728366 - RNA, 19 nt, Homo sapiens
auacucgucugucaaugaa

SEQ ID NO: 728367 - RNA, 19 nt, Homo sapiens
ggcgggacuucacuauuug

SEQ ID NO: 728368 - RNA, 19 nt, Homo sapiens
gcuagggacgcuugaguga

SEQ ID NO: 728369 - RNA, 19 nt, Homo sapiens
caacuugaaccuggcauau

SEQ ID NO: 728370 - RNA, 19 nt, Homo sapiens
gucacaagaugaucgacuu

SEQ ID NO: 728371 - RNA, 19 nt, Homo sapiens
gaccgcugcuccaccaugu

SEQ ID NO: 728372 - RNA, 19 nt, Homo sapiens
acuugaaccuggcauauag

SEQ ID NO: 728373 - RNA, 19 nt, Homo sapiens
ucucacgccuuccucaugu

SEQ ID NO: 728374 - RNA, 19 nt, Homo sapiens
cagcaugaguuuggaugug

SEQ ID NO: 728375 - RNA, 19 nt, Homo sapiens
ccaugugccuguuggucaa

SEQ ID NO: 728376 - RNA, 19 nt, Homo sapiens
acgcuguucuuccaaauca

SEQ ID NO: 728377 - RNA, 19 nt, Homo sapiens
cacugacugucuacaugua

SEQ ID NO: 728378 - RNA, 19 nt, Homo sapiens
ccacuuguuugaugucacu

SEQ ID NO: 728379 - RNA, 19 nt, Homo sapiens
cggauugucuucgccauca

SEQ ID NO: 728380 - RNA, 19 nt, Homo sapiens
gccacgcuguucuuccaaa

SEQ ID NO: 728381 - RNA, 19 nt, Homo sapiens
caucgguuaugcccggauu

SEQ ID NO: 728382 - RNA, 19 nt, Homo sapiens
ccaccgcccacuuguuuga

SEQ ID NO: 728383 - RNA, 19 nt, Homo sapiens
uccucuaccuguuccauuu

SEQ ID NO: 728384 - RNA, 19 nt, Homo sapiens
guuuggauguggccaguca

SEQ ID NO: 728385 - RNA, 19 nt, Homo sapiens
ccacgcuguucuuccaaau

SEQ ID NO: 728386 - RNA, 19 nt, Homo sapiens
uugcugaagucgcucauca

SEQ ID NO: 728387 - RNA, 19 nt, Homo sapiens
guagcugcuuaauaaauac

SEQ ID NO: 728388 - RNA, 19 nt, Homo sapiens
uagaguaagaccaacuuga

SEQ ID NO: 728389 - RNA, 19 nt, Homo sapiens
ugacugucuacauguauuu

SEQ ID NO: 728390 - RNA, 19 nt, Homo sapiens
gacuugguuuccuuucaga

SEQ ID NO: 728391 - RNA, 19 nt, Homo sapiens
ugacuugguuuccuuucag

SEQ ID NO: 728392 - RNA, 19 nt, Homo sapiens
ucugagggaccuuuaguug

SEQ ID NO: 728393 - RNA, 19 nt, Homo sapiens
ggcugcaccuccacaguuc

SEQ ID NO: 728394 - RNA, 19 nt, Homo sapiens
ccaacuugaaccuggcaua

SEQ ID NO: 728395 - RNA, 19 nt, Homo sapiens
uagaauguaaacuccauga

SEQ ID NO: 728396 - RNA, 19 nt, Homo sapiens
aauacucgucugucaauga

SEQ ID NO: 728397 - RNA, 19 nt, Homo sapiens
uauuugacuugguuuccuu

SEQ ID NO: 728398 - RNA, 19 nt, Homo sapiens
gauugucuucgccaucauu

SEQ ID NO: 728399 - RNA, 19 nt, Homo sapiens
cugacugucuacauguauu

SEQ ID NO: 728400 - RNA, 19 nt, Homo sapiens
ucacugacugucuacaugu

SEQ ID NO: 728401 - RNA, 19 nt, Homo sapiens
uugguuuccuuucagauau

SEQ ID NO: 728402 - RNA, 19 nt, Homo sapiens
caccuugugugcugggaau

SEQ ID NO: 728403 - RNA, 19 nt, Homo sapiens
ccucgaggccugcucuguu

SEQ ID NO: 728404 - RNA, 19 nt, Homo sapiens
gacugucuacauguauuua

SEQ ID NO: 728405 - RNA, 19 nt, Homo sapiens
cuugguuuccuuucagaua

SEQ ID NO: 728406 - RNA, 19 nt, Homo sapiens
gaccuuuaguuggcucugu

SEQ ID NO: 728407 - RNA, 19 nt, Homo sapiens
ucuucgccaucauuucuuu

SEQ ID NO: 728408 - RNA, 19 nt, Homo sapiens
caaccuggcccugcuguac

SEQ ID NO: 728409 - RNA, 19 nt, Homo sapiens
gcugcucgcgcucuuaauc

SEQ ID NO: 728410 - RNA, 19 nt, Homo sapiens
ggugugagggccagguuuc

SEQ ID NO: 728411 - RNA, 19 nt, Homo sapiens
cgccaucauuucuuucuac

SEQ ID NO: 728412 - RNA, 19 nt, Homo sapiens
gguuaugcccggauugucu

SEQ ID NO: 728413 - RNA, 19 nt, Homo sapiens
ggaaugagcucuucuacug

SEQ ID NO: 728414 - RNA, 19 nt, Homo sapiens
ggacuucacuauuugacuu

SEQ ID NO: 728415 - RNA, 19 nt, Homo sapiens
caucauuucuuucuacuuc

SEQ ID NO: 728416 - RNA, 19 nt, Homo sapiens
uggcgggacuucacuauuu

SEQ ID NO: 728417 - RNA, 19 nt, Homo sapiens
gcauauaguagcugcuuaa

SEQ ID NO: 728418 - RNA, 19 nt, Homo sapiens
gcacagacuuuucuuguuc

SEQ ID NO: 728419 - RNA, 19 nt, Homo sapiens
gcuggacgcuuucgaugga

SEQ ID NO: 728420 - RNA, 19 nt, Homo sapiens
aauaaauacucgucuguca

SEQ ID NO: 728421 - RNA, 19 nt, Homo sapiens
gaauguaaacuccaugaag

SEQ ID NO: 728422 - RNA, 19 nt, Homo sapiens
uaaauacucgucugucaau

SEQ ID NO: 728423 - RNA, 19 nt, Homo sapiens
gagccacgcuguucuucca

SEQ ID NO: 728424 - RNA, 19 nt, Homo sapiens
ggcauauaguagcugcuua

SEQ ID NO: 728425 - RNA, 19 nt, Homo sapiens
agaguaagaccaacuugaa

SEQ ID NO: 728426 - RNA, 19 nt, Homo sapiens
ccaugaaggcacagacuuu

SEQ ID NO: 728427 - RNA, 19 nt, Homo sapiens
ggccugcucuguucaccuu

SEQ ID NO: 728428 - RNA, 19 nt, Homo sapiens
ccaagguuaugcccggauu

SEQ ID NO: 728429 - RNA, 19 nt, Homo sapiens
uacccucacuagaauguaa

SEQ ID NO: 728430 - RNA, 19 nt, Homo sapiens
auacucgucugucaaugaa

SEQ ID NO: 728431 - RNA, 19 nt, Homo sapiens
ggcgggacuucacuauuug

SEQ ID NO: 728432 - RNA, 19 nt, Homo sapiens
gcuagggacgcuugaguga

SEQ ID NO: 728433 - RNA, 19 nt, Homo sapiens
caacuugaaccuggcauau

SEQ ID NO: 728434 - RNA, 19 nt, Homo sapiens
gucacaagaugaucgacuu

SEQ ID NO: 728435 - RNA, 19 nt, Homo sapiens
gaccgcugcuccaccaugu

SEQ ID NO: 728436 - RNA, 19 nt, Homo sapiens
acuugaaccuggcauauag

SEQ ID NO: 728437 - RNA, 19 nt, Homo sapiens
ucucacgccuuccucaugu

SEQ ID NO: 728438 - RNA, 19 nt, Homo sapiens
cagcaugaguuuggaugug

SEQ ID NO: 728439 - RNA, 19 nt, Homo sapiens
ccaugugccuguuggucaa

SEQ ID NO: 728440 - RNA, 19 nt, Homo sapiens
acgcuguucuuccaaauca

SEQ ID NO: 728441 - RNA, 19 nt, Homo sapiens
cacugacugucuacaugua

SEQ ID NO: 728442 - RNA, 19 nt, Homo sapiens
ccacuuguuugaugucacu

SEQ ID NO: 728443 - RNA, 19 nt, Homo sapiens
gccacgcuguucuuccaaa

SEQ ID NO: 728444 - RNA, 19 nt, Homo sapiens
cggauugucuucgccauca

SEQ ID NO: 728445 - RNA, 19 nt, Homo sapiens
ccaccgcccacuuguuuga

SEQ ID NO: 728446 - RNA, 19 nt, Homo sapiens
uccucuaccuguuccauuu

SEQ ID NO: 728447 - RNA, 19 nt, Homo sapiens
guuuggauguggccaguca

SEQ ID NO: 728448 - RNA, 19 nt, Homo sapiens
ccacgcuguucuuccaaau

SEQ ID NO: 728449 - RNA, 19 nt, Homo sapiens
uugcugaagucgcucauca

SEQ ID NO: 728450 - RNA, 19 nt, Homo sapiens
guagcugcuuaauaaauac

SEQ ID NO: 728451 - RNA, 19 nt, Homo sapiens
uagaguaagaccaacuuga

SEQ ID NO: 728452 - RNA, 19 nt, Homo sapiens
ugacugucuacauguauuu

SEQ ID NO: 728453 - RNA, 19 nt, Homo sapiens
gacuugguuuccuuucaga

SEQ ID NO: 728454 - RNA, 19 nt, Homo sapiens
ugacuugguuuccuuucag

SEQ ID NO: 728455 - RNA, 19 nt, Homo sapiens
ucugagggaccuuuaguug

SEQ ID NO: 728456 - RNA, 19 nt, Homo sapiens
gcgucccguuccaagguua

SEQ ID NO: 728457 - RNA, 19 nt, Homo sapiens
ggcugcaccuccacaguuc

SEQ ID NO: 728458 - RNA, 19 nt, Homo sapiens
ccaacuugaaccuggcaua

SEQ ID NO: 728459 - RNA, 19 nt, Homo sapiens
uagaauguaaacuccauga

SEQ ID NO: 728460 - RNA, 19 nt, Homo sapiens
aauacucgucugucaauga

SEQ ID NO: 728461 - RNA, 19 nt, Homo sapiens
uauuugacuugguuuccuu

SEQ ID NO: 728462 - RNA, 19 nt, Homo sapiens
gauugucuucgccaucauu

SEQ ID NO: 728463 - RNA, 19 nt, Homo sapiens
cugacugucuacauguauu

SEQ ID NO: 728464 - RNA, 19 nt, Homo sapiens
ucacugacugucuacaugu

SEQ ID NO: 728465 - RNA, 19 nt, Homo sapiens
uugguuuccuuucagauau

SEQ ID NO: 728466 - RNA, 19 nt, Homo sapiens
caccuugugugcugggaau

SEQ ID NO: 728467 - RNA, 19 nt, Homo sapiens
ccucgaggccugcucuguu

SEQ ID NO: 728468 - RNA, 19 nt, Homo sapiens
gacugucuacauguauuua

SEQ ID NO: 728469 - RNA, 19 nt, Homo sapiens
cuugguuuccuuucagaua

SEQ ID NO: 728470 - RNA, 19 nt, Homo sapiens
ucuucgccaucauuucuuu

SEQ ID NO: 728471 - RNA, 19 nt, Homo sapiens
gaccuuuaguuggcucugu

SEQ ID NO: 728472 - RNA, 19 nt, Homo sapiens
caaccuggcccugcuguac

SEQ ID NO: 728473 - RNA, 19 nt, Homo sapiens
ggugugagggccagguuuc

SEQ ID NO: 728474 - RNA, 19 nt, Homo sapiens
gcugcucgcgcucuuaauc

SEQ ID NO: 728475 - RNA, 19 nt, Homo sapiens
cgccaucauuucuuucuac

SEQ ID NO: 728476 - RNA, 19 nt, Homo sapiens
gguuaugcccggauugucu

SEQ ID NO: 728477 - RNA, 19 nt, Homo sapiens
guacagaucuccucaagaa

SEQ ID NO: 728478 - RNA, 19 nt, Homo sapiens
gcaagaaagucacaauauu

SEQ ID NO: 728479 - RNA, 19 nt, Homo sapiens
gaagaaccaucagaauaua

SEQ ID NO: 728480 - RNA, 19 nt, Homo sapiens
gagaagaaccaucagaaua

SEQ ID NO: 728481 - RNA, 19 nt, Homo sapiens
gaagacaaccagauaugua

SEQ ID NO: 728482 - RNA, 19 nt, Homo sapiens
cccaacagcugccuaauuu

SEQ ID NO: 728483 - RNA, 19 nt, Homo sapiens
ggaaaugcaguuuaaagaa

SEQ ID NO: 728484 - RNA, 19 nt, Homo sapiens
ggauugaacuuuguaaaca

SEQ ID NO: 728485 - RNA, 19 nt, Homo sapiens
uaaacaggauugaacuuug

SEQ ID NO: 728486 - RNA, 19 nt, Homo sapiens
gagcaagaaagucacaaua

SEQ ID NO: 728487 - RNA, 19 nt, Homo sapiens
caacagaaagaucauuuga

SEQ ID NO: 728488 - RNA, 19 nt, Homo sapiens
uaccaaggaucacaauaaa

SEQ ID NO: 728489 - RNA, 19 nt, Homo sapiens
agauaaagaugcacuuaga

SEQ ID NO: 728490 - RNA, 19 nt, Homo sapiens
ggaauauucuguugaccau

SEQ ID NO: 728491 - RNA, 19 nt, Homo sapiens
caagcagcauuaagacuga

SEQ ID NO: 728492 - RNA, 19 nt, Homo sapiens
aaugggaaaugcaguuuaa

SEQ ID NO: 728493 - RNA, 19 nt, Homo sapiens
aguguuaacugccauauau

SEQ ID NO: 728494 - RNA, 19 nt, Homo sapiens
ucaagggacuccuguguca

SEQ ID NO: 728495 - RNA, 19 nt, Homo sapiens
gaaugggaaaugcaguuua

SEQ ID NO: 728496 - RNA, 19 nt, Homo sapiens
guauggaugugucugaaug

SEQ ID NO: 728497 - RNA, 19 nt, Homo sapiens
gacugaaguuggaauauuc

SEQ ID NO: 728498 - RNA, 19 nt, Homo sapiens
aaacaggauugaacuuugu

SEQ ID NO: 728499 - RNA, 19 nt, Homo sapiens
gaaguuggaauauucuguu

SEQ ID NO: 728500 - RNA, 19 nt, Homo sapiens
ugaagaagauaccaaggau

SEQ ID NO: 728501 - RNA, 19 nt, Homo sapiens
agaagaaccaucagaauau

SEQ ID NO: 728502 - RNA, 19 nt, Homo sapiens
gggaaaugcaguuuaaaga

SEQ ID NO: 728503 - RNA, 19 nt, Homo sapiens
ugaauaugaugaucucuca

SEQ ID NO: 728504 - RNA, 19 nt, Homo sapiens
agacugaaguuggaauauu

SEQ ID NO: 728505 - RNA, 19 nt, Homo sapiens
ccaaggaucacaauaaaca

SEQ ID NO: 728506 - RNA, 19 nt, Homo sapiens
ggagaguguucgagaaugg

SEQ ID NO: 728507 - RNA, 19 nt, Homo sapiens
caacagcugccuaauuuua

SEQ ID NO: 728508 - RNA, 19 nt, Homo sapiens
ggagaagaaccaucagaau

SEQ ID NO: 728509 - RNA, 19 nt, Homo sapiens
gggaaaugcugcugaacgu

SEQ ID NO: 728510 - RNA, 19 nt, Homo sapiens
gacaaccagauauguauuu

SEQ ID NO: 728511 - RNA, 19 nt, Homo sapiens
gauauguauuugcuacuca

SEQ ID NO: 728512 - RNA, 19 nt, Homo sapiens
cuucuuuccuuucuucuuu

SEQ ID NO: 728513 - RNA, 19 nt, Homo sapiens
gcaguuguuuguaaugucu

SEQ ID NO: 728514 - RNA, 19 nt, Homo sapiens
cauuaagacugaaguugga

SEQ ID NO: 728515 - RNA, 19 nt, Homo sapiens
gaaagaucauuugaaacca

SEQ ID NO: 728516 - RNA, 19 nt, Homo sapiens
uauggaauauuugcuggua

SEQ ID NO: 728517 - RNA, 19 nt, Homo sapiens
uuaaagagcaagaaaguca

SEQ ID NO: 728518 - RNA, 19 nt, Homo sapiens
gaccaaaggcagcaaguuc

SEQ ID NO: 728519 - RNA, 19 nt, Homo sapiens
gcauguacaauaaaccaaa

SEQ ID NO: 728520 - RNA, 19 nt, Homo sapiens
uuacuucuuuccuuccuuu

SEQ ID NO: 728521 - RNA, 19 nt, Homo sapiens
cagaauauacagaugaaga

SEQ ID NO: 728522 - RNA, 19 nt, Homo sapiens
ggaaagccccuauaaugaa

SEQ ID NO: 728523 - RNA, 19 nt, Homo sapiens
guacaaauggagaguguuc

SEQ ID NO: 728524 - RNA, 19 nt, Homo sapiens
gcacuuagagaugaauaug

SEQ ID NO: 728525 - RNA, 19 nt, Homo sapiens
aagaugcacuuagagauga

SEQ ID NO: 728526 - RNA, 19 nt, Homo sapiens
ugauucaccugcugcgaaa

SEQ ID NO: 728527 - RNA, 19 nt, Homo sapiens
gaagauaccaaggaucaca

SEQ ID NO: 728528 - RNA, 19 nt, Homo sapiens
gagaaugggaaaugcaguu

SEQ ID NO: 728529 - RNA, 19 nt, Homo sapiens
uaagacugaaguuggaaua

SEQ ID NO: 728530 - RNA, 19 nt, Homo sapiens
gaaagccccuauaaugaau

SEQ ID NO: 728531 - RNA, 19 nt, Homo sapiens
auaccaaggaucacaauaa

SEQ ID NO: 728532 - RNA, 19 nt, Homo sapiens
uacacaaacucaauuagca

SEQ ID NO: 728533 - RNA, 19 nt, Homo sapiens
cuacucaaguguacagauc

SEQ ID NO: 728534 - RNA, 19 nt, Homo sapiens
ccaaaggcagcaaguucua

SEQ ID NO: 728535 - RNA, 19 nt, Homo sapiens
ucagaaaucacuacaagca

SEQ ID NO: 728536 - RNA, 19 nt, Homo sapiens
uggagcagcugcgccagua

SEQ ID NO: 728537 - RNA, 19 nt, Homo sapiens
cagguggguuuaagucaga

SEQ ID NO: 728538 - RNA, 19 nt, Homo sapiens
gaauuucagguggguuuaa

SEQ ID NO: 728539 - RNA, 19 nt, Homo sapiens
ugaaugcaguacaaaugga

SEQ ID NO: 728540 - RNA, 19 nt, Homo sapiens
guuaacugccauauaugua

SEQ ID NO: 728541 - RNA, 19 nt, Homo sapiens
ucacuuaacauagacuuga

SEQ ID NO: 728542 - RNA, 19 nt, Homo sapiens
ggaauuucagguggguuua

SEQ ID NO: 728543 - RNA, 19 nt, Homo sapiens
aaagaugcacuuagagaug

SEQ ID NO: 728544 - RNA, 19 nt, Homo sapiens
gggacucuuucugcagaua

SEQ ID NO: 728545 - RNA, 19 nt, Homo sapiens
cuagauaaagaugcacuua

SEQ ID NO: 728546 - RNA, 19 nt, Homo sapiens
gggaaagccccuauaauga

SEQ ID NO: 728547 - RNA, 19 nt, Homo sapiens
uauugaagacaaccagaua

SEQ ID NO: 728548 - RNA, 19 nt, Homo sapiens
gauaccaaggaucacaaua

SEQ ID NO: 728549 - RNA, 19 nt, Homo sapiens
aagaagauaccaaggauca

SEQ ID NO: 728550 - RNA, 19 nt, Homo sapiens
uaaagaugcacuuagagau

SEQ ID NO: 728551 - RNA, 19 nt, Homo sapiens
cagaucuccucaagaaaca

SEQ ID NO: 728552 - RNA, 19 nt, Homo sapiens
caguacaaauggagagugu

SEQ ID NO: 728553 - RNA, 19 nt, Homo sapiens
uguauuugcuacucaagug

SEQ ID NO: 728554 - RNA, 19 nt, Homo sapiens
aaugugaauucccaaacuu

SEQ ID NO: 728555 - RNA, 19 nt, Homo sapiens
cauuauuuaugcugccaaa

SEQ ID NO: 728556 - RNA, 19 nt, Homo sapiens
agauuugaaugcaguacaa

SEQ ID NO: 728557 - RNA, 19 nt, Homo sapiens
cuugauaucauucugugua

SEQ ID NO: 728558 - RNA, 19 nt, Homo sapiens
acaaccagauauguauuug

SEQ ID NO: 728559 - RNA, 19 nt, Homo sapiens
auaaagaugcacuuagaga

SEQ ID NO: 728560 - RNA, 19 nt, Homo sapiens
auucagaaaucacuacaag

SEQ ID NO: 728561 - RNA, 19 nt, Homo sapiens
guguacagaucuccucaag

SEQ ID NO: 728562 - RNA, 19 nt, Homo sapiens
gaucacaauaaacaggauu

SEQ ID NO: 728563 - RNA, 19 nt, Homo sapiens
uggagugggugucaguaug

SEQ ID NO: 728564 - RNA, 19 nt, Homo sapiens
acuacaagcagcauuaaga

SEQ ID NO: 728565 - RNA, 19 nt, Homo sapiens
cagaggacuggccacauuu

SEQ ID NO: 728566 - RNA, 19 nt, Homo sapiens
ccaacagaaagaucauuug

SEQ ID NO: 728567 - RNA, 19 nt, Homo sapiens
gcaauucuuacucccuuuc

SEQ ID NO: 728568 - RNA, 19 nt, Homo sapiens
ugccuuauuucacuuaaca

SEQ ID NO: 728569 - RNA, 19 nt, Homo sapiens
aaaugugaauucccaaacu

SEQ ID NO: 728570 - RNA, 19 nt, Homo sapiens
caucaagggacuccugugu

SEQ ID NO: 728571 - RNA, 19 nt, Homo sapiens
gauaaagaugcacuuagag

SEQ ID NO: 728572 - RNA, 19 nt, Homo sapiens
aauggagaguguucgagaa

SEQ ID NO: 728573 - RNA, 19 nt, Homo sapiens
ggaucacaauaaacaggau

SEQ ID NO: 728574 - RNA, 19 nt, Homo sapiens
cugcagauacuguaaauac

SEQ ID NO: 728575 - RNA, 19 nt, Homo sapiens
caguauggaugugucugaa

SEQ ID NO: 728576 - RNA, 19 nt, Homo sapiens
aagacaaccagauauguau

SEQ ID NO: 728577 - RNA, 19 nt, Homo sapiens
ggaagaagcuguuugaaua

SEQ ID NO: 728578 - RNA, 19 nt, Homo sapiens
ggaaauggcucacgaagug

SEQ ID NO: 728579 - RNA, 19 nt, Homo sapiens
gcaacgaggucuucuguuu

SEQ ID NO: 728580 - RNA, 19 nt, Homo sapiens
caacuuggcuggaugcuaa

SEQ ID NO: 728581 - RNA, 19 nt, Homo sapiens
ggagaacccugcugaaaga

SEQ ID NO: 728582 - RNA, 19 nt, Homo sapiens
gggaagcccucaagaagua

SEQ ID NO: 728583 - RNA, 19 nt, Homo sapiens
gaacccugcugaaagauuu

SEQ ID NO: 728584 - RNA, 19 nt, Homo sapiens
cagcaugccuccugccuua

SEQ ID NO: 728585 - RNA, 19 nt, Homo sapiens
gaagagaaaggacacagua

SEQ ID NO: 728586 - RNA, 19 nt, Homo sapiens
gagaaaggacacaguauuu

SEQ ID NO: 728587 - RNA, 19 nt, Homo sapiens
gagaacagauuaggaguau

SEQ ID NO: 728588 - RNA, 19 nt, Homo sapiens
aaagguaucucauucaguu

SEQ ID NO: 728589 - RNA, 19 nt, Homo sapiens
gaaacagccaacuacauua

SEQ ID NO: 728590 - RNA, 19 nt, Homo sapiens
ccacgagacuccuugguuu

SEQ ID NO: 728591 - RNA, 19 nt, Homo sapiens
gaauuguuccucccaaaua

SEQ ID NO: 728592 - RNA, 19 nt, Homo sapiens
gcaaugaagaggacuauga

SEQ ID NO: 728593 - RNA, 19 nt, Homo sapiens
gaacagauuaggaguauag

SEQ ID NO: 728594 - RNA, 19 nt, Homo sapiens
gguccgagauccuguacua

SEQ ID NO: 728595 - RNA, 19 nt, Homo sapiens
gcaauacaccuacccauau

SEQ ID NO: 728596 - RNA, 19 nt, Homo sapiens
ggaaaggucaggcagaauu

SEQ ID NO: 728597 - RNA, 19 nt, Homo sapiens
gaacuggccugugcaaugg

SEQ ID NO: 728598 - RNA, 19 nt, Homo sapiens
gaaaggucaggcagaauuu

SEQ ID NO: 728599 - RNA, 19 nt, Homo sapiens
ucaaguccuuccugugaua

SEQ ID NO: 728600 - RNA, 19 nt, Homo sapiens
ugaaacagccaacuacauu

SEQ ID NO: 728601 - RNA, 19 nt, Homo sapiens
gcaaugcuccaaauguaaa

SEQ ID NO: 728602 - RNA, 19 nt, Homo sapiens
aaaguugagugguuuauuc

SEQ ID NO: 728603 - RNA, 19 nt, Homo sapiens
guucaaugcuuccacucua

SEQ ID NO: 728604 - RNA, 19 nt, Homo sapiens
gcucaguucucgucaagga

SEQ ID NO: 728605 - RNA, 19 nt, Homo sapiens
gcaaaugaacccagaaugg

SEQ ID NO: 728606 - RNA, 19 nt, Homo sapiens
ggagaacagauuaggagua

SEQ ID NO: 728607 - RNA, 19 nt, Homo sapiens
caauacaccuacccauaug

SEQ ID NO: 728608 - RNA, 19 nt, Homo sapiens
cauguuaccuggagagugu

SEQ ID NO: 728609 - RNA, 19 nt, Homo sapiens
gcaaugucaucugcucaaa

SEQ ID NO: 728610 - RNA, 19 nt, Homo sapiens
ggagggagggaaaguguuu

SEQ ID NO: 728611 - RNA, 19 nt, Homo sapiens
gaggauagcugugacucau

SEQ ID NO: 728612 - RNA, 19 nt, Homo sapiens
caaaaugucuguacugcaa

SEQ ID NO: 728613 - RNA, 19 nt, Homo sapiens
gaggagaacccugcugaaa

SEQ ID NO: 728614 - RNA, 19 nt, Homo sapiens
ggucuucuguuucaagugu

SEQ ID NO: 728615 - RNA, 19 nt, Homo sapiens
caguggcugucguuuguua

SEQ ID NO: 728616 - RNA, 19 nt, Homo sapiens
ggauugggagaacagauua

SEQ ID NO: 728617 - RNA, 19 nt, Homo sapiens
uggcucaccuuuauucuug

SEQ ID NO: 728618 - RNA, 19 nt, Homo sapiens
gaaaauaaauuggcauugg

SEQ ID NO: 728619 - RNA, 19 nt, Homo sapiens
ccucuuaguugauuucugu

SEQ ID NO: 728620 - RNA, 19 nt, Homo sapiens
gaaaaccucucauggaaag

SEQ ID NO: 728621 - RNA, 19 nt, Homo sapiens
gaagacucauggcagugaa

SEQ ID NO: 728622 - RNA, 19 nt, Homo sapiens
uacaaaggguggaagagaa

SEQ ID NO: 728623 - RNA, 19 nt, Homo sapiens
caaaugaacccagaaugga

SEQ ID NO: 728624 - RNA, 19 nt, Homo sapiens
gcaaacaucagggucagaa

SEQ ID NO: 728625 - RNA, 19 nt, Homo sapiens
aaggcaaacuauaggauaa

SEQ ID NO: 728626 - RNA, 19 nt, Homo sapiens
agagaucugugaauauugu

SEQ ID NO: 728627 - RNA, 19 nt, Homo sapiens
guacggagacaguccagaa

SEQ ID NO: 728628 - RNA, 19 nt, Homo sapiens
cagagauauuggacagaua

SEQ ID NO: 728629 - RNA, 19 nt, Homo sapiens
ggaagaagaagaagaagac

SEQ ID NO: 728630 - RNA, 19 nt, Homo sapiens
ggacuaugacccaaauugu

SEQ ID NO: 728631 - RNA, 19 nt, Homo sapiens
ggaugugucuaggagauug

SEQ ID NO: 728632 - RNA, 19 nt, Homo sapiens
gcaaguuucagagauauug

SEQ ID NO: 728633 - RNA, 19 nt, Homo sapiens
gauuaggaguauagcaaau

SEQ ID NO: 728634 - RNA, 19 nt, Homo sapiens
ggccucugcuuuccauauu

SEQ ID NO: 728635 - RNA, 19 nt, Homo sapiens
gcuggaggcugagaucgaa

SEQ ID NO: 728636 - RNA, 19 nt, Homo sapiens
ccaggaagaagcuguuuga

SEQ ID NO: 728637 - RNA, 19 nt, Homo sapiens
augcaaugcuccaaaugua

SEQ ID NO: 728638 - RNA, 19 nt, Homo sapiens
ucaagugucgucagaugua

SEQ ID NO: 728639 - RNA, 19 nt, Homo sapiens
ccagaggacuuuguguuuc

SEQ ID NO: 728640 - RNA, 19 nt, Homo sapiens
guaugcaguuugugcgaaa

SEQ ID NO: 728641 - RNA, 19 nt, Homo sapiens
gguaccauguaagcuauaa

SEQ ID NO: 728642 - RNA, 19 nt, Homo sapiens
ccagguaccauguaagcua

SEQ ID NO: 728643 - RNA, 19 nt, Homo sapiens
gaagaagcuguuugaauac

SEQ ID NO: 728644 - RNA, 19 nt, Homo sapiens
ggaagacucauggcaguga

SEQ ID NO: 728645 - RNA, 19 nt, Homo sapiens
gcacagggaauaaauaucc

SEQ ID NO: 728646 - RNA, 19 nt, Homo sapiens
aaacaucagggucagaauu

SEQ ID NO: 728647 - RNA, 19 nt, Homo sapiens
uuaccuugguccuuucuuu

SEQ ID NO: 728648 - RNA, 19 nt, Homo sapiens
aaaggcaaacuauaggaua

SEQ ID NO: 728649 - RNA, 19 nt, Homo sapiens
cgucaaguccuuccuguga

SEQ ID NO: 728650 - RNA, 19 nt, Homo sapiens
ggagcuaacugugaaugag

SEQ ID NO: 728651 - RNA, 19 nt, Homo sapiens
uuaggaguauagcaaauga

SEQ ID NO: 728652 - RNA, 19 nt, Homo sapiens
aauuguuccucccaaauaa

SEQ ID NO: 728653 - RNA, 19 nt, Homo sapiens
gaauugagagagaaauaca

SEQ ID NO: 728654 - RNA, 19 nt, Homo sapiens
aaugaagaauugagagaga

SEQ ID NO: 728655 - RNA, 19 nt, Homo sapiens
ugacccaaauugugaggaa

SEQ ID NO: 728656 - RNA, 19 nt, Homo sapiens
ucacuugcuugaccuacaa

SEQ ID NO: 728657 - RNA, 19 nt, Homo sapiens
ggacuuuguguuuccauug

SEQ ID NO: 728658 - RNA, 19 nt, Homo sapiens
caaguagagcugauacaga

SEQ ID NO: 728659 - RNA, 19 nt, Homo sapiens
gaguuguagucccaaagaa

SEQ ID NO: 728660 - RNA, 19 nt, Homo sapiens
ggcaguaccuacagaaugc

SEQ ID NO: 728661 - RNA, 19 nt, Homo sapiens
caacugcuuuccugaucug

SEQ ID NO: 728662 - RNA, 19 nt, Homo sapiens
ucagagauauuggacagau

SEQ ID NO: 728663 - RNA, 19 nt, Homo sapiens
guuaacaucaucaggaaga

SEQ ID NO: 728664 - RNA, 19 nt, Homo sapiens
gcugccagguucuguacuu

SEQ ID NO: 728665 - RNA, 19 nt, Homo sapiens
gcaacugcuuuccugaucu

SEQ ID NO: 728666 - RNA, 19 nt, Homo sapiens
ggguagaggccauguugaa

SEQ ID NO: 728667 - RNA, 19 nt, Homo sapiens
ggacuuggagaaccagaug

SEQ ID NO: 728668 - RNA, 19 nt, Homo sapiens
gucgauacacccugcaaua

SEQ ID NO: 728669 - RNA, 19 nt, Homo sapiens
ucauggcagugaauacuau

SEQ ID NO: 728670 - RNA, 19 nt, Homo sapiens
caauucugcucaacugcuu

SEQ ID NO: 728671 - RNA, 19 nt, Homo sapiens
agagaaaggacacaguauu

SEQ ID NO: 728672 - RNA, 19 nt, Homo sapiens
caagggaacaagugguuug

SEQ ID NO: 728673 - RNA, 19 nt, Homo sapiens
acacuggcaacaccucuua

SEQ ID NO: 728674 - RNA, 19 nt, Homo sapiens
agauuuccaugacaccuaa

SEQ ID NO: 728675 - RNA, 19 nt, Homo sapiens
ggagaaccagaugcauaua

SEQ ID NO: 728676 - RNA, 19 nt, Homo sapiens
acaccuacccauaugcaua

SEQ ID NO: 728677 - RNA, 19 nt, Homo sapiens
gcaaauaccuguuggaugu

SEQ ID NO: 728678 - RNA, 19 nt, Homo sapiens
ggaaagaaaucgacaugga

SEQ ID NO: 728679 - RNA, 19 nt, Homo sapiens
uaacuugacuggaauucua

SEQ ID NO: 728680 - RNA, 19 nt, Homo sapiens
cagcauaacuugacuggaa

SEQ ID NO: 728681 - RNA, 19 nt, Homo sapiens
gaagauugaugcugcuuau

SEQ ID NO: 728682 - RNA, 19 nt, Homo sapiens
ggugauaggauauucauua

SEQ ID NO: 728683 - RNA, 19 nt, Homo sapiens
gauaagcauuggaaagaaa

SEQ ID NO: 728684 - RNA, 19 nt, Homo sapiens
uaagaggauuggagaauuu

SEQ ID NO: 728685 - RNA, 19 nt, Homo sapiens
ggauuuggaucacaucauu

SEQ ID NO: 728686 - RNA, 19 nt, Homo sapiens
gaaggaaaggcaaaucuaa

SEQ ID NO: 728687 - RNA, 19 nt, Homo sapiens
gaacuuguccguccagcua

SEQ ID NO: 728688 - RNA, 19 nt, Homo sapiens
caagcaagguuucuagcua

SEQ ID NO: 728689 - RNA, 19 nt, Homo sapiens
gcagagacgauuacaguuu

SEQ ID NO: 728690 - RNA, 19 nt, Homo sapiens
gggaugagcuuuggaacaa

SEQ ID NO: 728691 - RNA, 19 nt, Homo sapiens
gcaaagcuccugagaaaca

SEQ ID NO: 728692 - RNA, 19 nt, Homo sapiens
ugcauuaccuuuacacaua

SEQ ID NO: 728693 - RNA, 19 nt, Homo sapiens
gggcgaagcggauggaaua

SEQ ID NO: 728694 - RNA, 19 nt, Homo sapiens
ggagucgaaugcauuugua

SEQ ID NO: 728695 - RNA, 19 nt, Homo sapiens
gaccaagucugcagaguca

SEQ ID NO: 728696 - RNA, 19 nt, Homo sapiens
cgacauggauaaugaagau

SEQ ID NO: 728697 - RNA, 19 nt, Homo sapiens
ggaaaggcaaaucuaagua

SEQ ID NO: 728698 - RNA, 19 nt, Homo sapiens
ccaggacgcugcagaccua

SEQ ID NO: 728699 - RNA, 19 nt, Homo sapiens
gcaccaaguuugucaugau

SEQ ID NO: 728700 - RNA, 19 nt, Homo sapiens
gaguugggaugguugcaua

SEQ ID NO: 728701 - RNA, 19 nt, Homo sapiens
aaauuagggugauaggaua

SEQ ID NO: 728702 - RNA, 19 nt, Homo sapiens
ugagaaacaugccagaguu

SEQ ID NO: 728703 - RNA, 19 nt, Homo sapiens
augcaaagcuccugagaaa

SEQ ID NO: 728704 - RNA, 19 nt, Homo sapiens
gagaauguaugagccacua

SEQ ID NO: 728705 - RNA, 19 nt, Homo sapiens
gacacgaaauucccauuga

SEQ ID NO: 728706 - RNA, 19 nt, Homo sapiens
gauuacaguuugaagagaa

SEQ ID NO: 728707 - RNA, 19 nt, Homo sapiens
gagagucuucgguuucuua

SEQ ID NO: 728708 - RNA, 19 nt, Homo sapiens
uggaauacauccucacuga

SEQ ID NO: 728709 - RNA, 19 nt, Homo sapiens
ggacacuuaccacgaauuu

SEQ ID NO: 728710 - RNA, 19 nt, Homo sapiens
caaaucagccuucuucaca

SEQ ID NO: 728711 - RNA, 19 nt, Homo sapiens
gaaagagcuuauucgacaa

SEQ ID NO: 728712 - RNA, 19 nt, Homo sapiens
uaaagcagcguguaaauag

SEQ ID NO: 728713 - RNA, 19 nt, Homo sapiens
gaauauugacccauuucua

SEQ ID NO: 728714 - RNA, 19 nt, Homo sapiens
ggucaaggagacuuuauaa

SEQ ID NO: 728715 - RNA, 19 nt, Homo sapiens
caucagauccaacaguuaa

SEQ ID NO: 728716 - RNA, 19 nt, Homo sapiens
cgacucgcauggacuuuaa

SEQ ID NO: 728717 - RNA, 19 nt, Homo sapiens
cagagacgauuacaguuug

SEQ ID NO: 728718 - RNA, 19 nt, Homo sapiens
gaaagaaaucgacauggau

SEQ ID NO: 728719 - RNA, 19 nt, Homo sapiens
gauguucguugcacugcua

SEQ ID NO: 728720 - RNA, 19 nt, Homo sapiens
agaaacagcgugaaauuga

SEQ ID NO: 728721 - RNA, 19 nt, Homo sapiens
ugggaugguugcauaauaa

SEQ ID NO: 728722 - RNA, 19 nt, Homo sapiens
guuauuugcucaggccuua

SEQ ID NO: 728723 - RNA, 19 nt, Homo sapiens
aaaucgacauggauaauga

SEQ ID NO: 728724 - RNA, 19 nt, Homo sapiens
gcauuaccuuuacacauau

SEQ ID NO: 728725 - RNA, 19 nt, Homo sapiens
ugacgagagucuucgguuu

SEQ ID NO: 728726 - RNA, 19 nt, Homo sapiens
gaauacauccucacugaca

SEQ ID NO: 728727 - RNA, 19 nt, Homo sapiens
gcucaggccuuaccaagag

SEQ ID NO: 728728 - RNA, 19 nt, Homo sapiens
aaagaaaucgacauggaua

SEQ ID NO: 728729 - RNA, 19 nt, Homo sapiens
gcucacaguugcgaauauu

SEQ ID NO: 728730 - RNA, 19 nt, Homo sapiens
gaaacagcgugaaauugag

SEQ ID NO: 728731 - RNA, 19 nt, Homo sapiens
aaagaaacagcgugaaauu

SEQ ID NO: 728732 - RNA, 19 nt, Homo sapiens
gaugguaacgucauugcua

SEQ ID NO: 728733 - RNA, 19 nt, Homo sapiens
gaaaggcaaaucuaaguag

SEQ ID NO: 728734 - RNA, 19 nt, Homo sapiens
ugaggacacuuaccacgaa

SEQ ID NO: 728735 - RNA, 19 nt, Homo sapiens
caaaguuccugauaagcau

SEQ ID NO: 728736 - RNA, 19 nt, Homo sapiens
gcacuuaauggacuugcua

SEQ ID NO: 728737 - RNA, 19 nt, Homo sapiens
uguuggauguucucaauaa

SEQ ID NO: 728738 - RNA, 19 nt, Homo sapiens
ggaagauugaugcugcuua

SEQ ID NO: 728739 - RNA, 19 nt, Homo sapiens
ucugugagauccuuuguau

SEQ ID NO: 728740 - RNA, 19 nt, Homo sapiens
guaaaucccuaagucaagu

SEQ ID NO: 728741 - RNA, 19 nt, Homo sapiens
gaucagacucccacuacaa

SEQ ID NO: 728742 - RNA, 19 nt, Homo sapiens
gaugauuccuucguuuaug

SEQ ID NO: 728743 - RNA, 19 nt, Homo sapiens
gaaaucgacauggauaaug

SEQ ID NO: 728744 - RNA, 19 nt, Homo sapiens
guucacauuugucucuaaa

SEQ ID NO: 728745 - RNA, 19 nt, Homo sapiens
cagagaauacuaucgauug

SEQ ID NO: 728746 - RNA, 19 nt, Homo sapiens
ggauacgggugguacuaug

SEQ ID NO: 728747 - RNA, 19 nt, Homo sapiens
cuaaagcagcguguaaaua

SEQ ID NO: 728748 - RNA, 19 nt, Homo sapiens
ggucaauacucuaccucuu

SEQ ID NO: 728749 - RNA, 19 nt, Homo sapiens
caagaaagagcuuauucga

SEQ ID NO: 728750 - RNA, 19 nt, Homo sapiens
gucauuaucaggucacaua

SEQ ID NO: 728751 - RNA, 19 nt, Homo sapiens
uggcugcacuguucacauu

SEQ ID NO: 728752 - RNA, 19 nt, Homo sapiens
guacgucuuucagggcaua

SEQ ID NO: 728753 - RNA, 19 nt, Homo sapiens
caaaaugucccaacuaaga

SEQ ID NO: 728754 - RNA, 19 nt, Homo sapiens
cagccucgauuaucauguu

SEQ ID NO: 728755 - RNA, 19 nt, Homo sapiens
cugcagaccuauucacaga

SEQ ID NO: 728756 - RNA, 19 nt, Homo sapiens
gaccuaugaucccaaaaua

SEQ ID NO: 728757 - RNA, 19 nt, Homo sapiens
gugauaggauauucauuag

SEQ ID NO: 728758 - RNA, 19 nt, Homo sapiens
aauauuaaccucugugaga

SEQ ID NO: 728759 - RNA, 19 nt, Homo sapiens
gguaacgucauugcuauuu

SEQ ID NO: 728760 - RNA, 19 nt, Homo sapiens
gaggauuggagaauuuaaa

SEQ ID NO: 728761 - RNA, 19 nt, Homo sapiens
ucagaaugcucaagaugca

SEQ ID NO: 728762 - RNA, 19 nt, Homo sapiens
caacuuagagcuguguuug

SEQ ID NO: 728763 - RNA, 19 nt, Homo sapiens
ggaagggacacaugugcaa

SEQ ID NO: 728764 - RNA, 19 nt, Homo sapiens
ucaaggagacuuuauaagg

SEQ ID NO: 728765 - RNA, 19 nt, Homo sapiens
gauccuuuguaucuuaaug

SEQ ID NO: 728766 - RNA, 19 nt, Homo sapiens
ccacgagugcgccauguuu

SEQ ID NO: 728767 - RNA, 19 nt, Homo sapiens
gcaguauuacaucacauuu

SEQ ID NO: 728768 - RNA, 19 nt, Homo sapiens
cgaagcggauggaauacau

SEQ ID NO: 728769 - RNA, 19 nt, Homo sapiens
aagcaagguuucuagcuau

SEQ ID NO: 728770 - RNA, 19 nt, Homo sapiens
cagcuacgacuuuguauca

SEQ ID NO: 728771 - RNA, 19 nt, Homo sapiens
agauugaugcugcuuauuu

SEQ ID NO: 728772 - RNA, 19 nt, Homo sapiens
gcgaaugcaucagcuaaag

SEQ ID NO: 728773 - RNA, 19 nt, Homo sapiens
uuagagcuguguuugauca

SEQ ID NO: 728774 - RNA, 19 nt, Homo sapiens
gagccacuaccuaagagua

SEQ ID NO: 728775 - RNA, 19 nt, Homo sapiens
uguaugagccacuaccuaa

SEQ ID NO: 728776 - RNA, 19 nt, Homo sapiens
gaacucagagaauacuauc

SEQ ID NO: 728777 - RNA, 19 nt, Homo sapiens
ccaaacauguucaccaaua

SEQ ID NO: 728778 - RNA, 19 nt, Homo sapiens
gcucaacugucucaaauuu

SEQ ID NO: 728779 - RNA, 19 nt, Homo sapiens
gggaaaggcugugacaaua

SEQ ID NO: 728780 - RNA, 19 nt, Homo sapiens
gcaguuuacuuguuuguuu

SEQ ID NO: 728781 - RNA, 19 nt, Homo sapiens
uaaccuagguaaagcauaa

SEQ ID NO: 728782 - RNA, 19 nt, Homo sapiens
gaccagaaguucagaauuc

SEQ ID NO: 728783 - RNA, 19 nt, Homo sapiens
gaagaaagaacuugacaga

SEQ ID NO: 728784 - RNA, 19 nt, Homo sapiens
cagagaagcugacaagaga

SEQ ID NO: 728785 - RNA, 19 nt, Homo sapiens
ucaaacagcccuauuauau

SEQ ID NO: 728786 - RNA, 19 nt, Homo sapiens
guagcuauguggaaugaua

SEQ ID NO: 728787 - RNA, 19 nt, Homo sapiens
agaaugagguugacuaaug

SEQ ID NO: 728788 - RNA, 19 nt, Homo sapiens
gaaagaacuugacagaucu

SEQ ID NO: 728789 - RNA, 19 nt, Homo sapiens
gagaagcgcgugagaaauu

SEQ ID NO: 728790 - RNA, 19 nt, Homo sapiens
cagggugcaucuauuauua

SEQ ID NO: 728791 - RNA, 19 nt, Homo sapiens
uaacauuucuggacuugaa

SEQ ID NO: 728792 - RNA, 19 nt, Homo sapiens
caucagagcuauuacaaca

SEQ ID NO: 728793 - RNA, 19 nt, Homo sapiens
agaaagaacuugacagauc

SEQ ID NO: 728794 - RNA, 19 nt, Homo sapiens
caaacagcccuauuauaua

SEQ ID NO: 728795 - RNA, 19 nt, Homo sapiens
caacguagauggaaaugca

SEQ ID NO: 728796 - RNA, 19 nt, Homo sapiens
gaacaacaacccaaccauu

SEQ ID NO: 728797 - RNA, 19 nt, Homo sapiens
aaacugugcugcauuguug

SEQ ID NO: 728798 - RNA, 19 nt, Homo sapiens
gcaaauuuauguagcuaug

SEQ ID NO: 728799 - RNA, 19 nt, Homo sapiens
gcauauggcucaacugucu

SEQ ID NO: 728800 - RNA, 19 nt, Homo sapiens
aaucagagaucaaguacaa

SEQ ID NO: 728801 - RNA, 19 nt, Homo sapiens
ucagagaccuaacgcaauu

SEQ ID NO: 728802 - RNA, 19 nt, Homo sapiens
gcaguauccucaacaguau

SEQ ID NO: 728803 - RNA, 19 nt, Homo sapiens
gaauugguuucuacacauu

SEQ ID NO: 728804 - RNA, 19 nt, Homo sapiens
agaauaagguguacuaaag

SEQ ID NO: 728805 - RNA, 19 nt, Homo sapiens
ggaggcaguuacccagaua

SEQ ID NO: 728806 - RNA, 19 nt, Homo sapiens
gaacaccucccacugcaaa

SEQ ID NO: 728807 - RNA, 19 nt, Homo sapiens
ggaaaggcugugacaauaa

SEQ ID NO: 728808 - RNA, 19 nt, Homo sapiens
ggauauggauugcaucauc

SEQ ID NO: 728809 - RNA, 19 nt, Homo sapiens
aaacagcccuauuauauac

SEQ ID NO: 728810 - RNA, 19 nt, Homo sapiens
acacaggcuuuacugaaua

SEQ ID NO: 728811 - RNA, 19 nt, Homo sapiens
gcaguauggugaauauguu

SEQ ID NO: 728812 - RNA, 19 nt, Homo sapiens
ucagagcuauuacaacaaa

SEQ ID NO: 728813 - RNA, 19 nt, Homo sapiens
gaaaggcugugacaauaac

SEQ ID NO: 728814 - RNA, 19 nt, Homo sapiens
gcaguggauuuguuccuuu

SEQ ID NO: 728815 - RNA, 19 nt, Homo sapiens
uaaacgauguuccugaaga

SEQ ID NO: 728816 - RNA, 19 nt, Homo sapiens
gagguugacuaaugcauau

SEQ ID NO: 728817 - RNA, 19 nt, Homo sapiens
uagaggaugugcuuggaua

SEQ ID NO: 728818 - RNA, 19 nt, Homo sapiens
caauagaguuucaguacau

SEQ ID NO: 728819 - RNA, 19 nt, Homo sapiens
gaaggcauuuguuaauaca

SEQ ID NO: 728820 - RNA, 19 nt, Homo sapiens
gugcuuggauauacuaauu

SEQ ID NO: 728821 - RNA, 19 nt, Homo sapiens
cgauguuccugaagaauuu

SEQ ID NO: 728822 - RNA, 19 nt, Homo sapiens
gagaauaagguguacuaaa

SEQ ID NO: 728823 - RNA, 19 nt, Homo sapiens
guuugaagcuguuaugaga

SEQ ID NO: 728824 - RNA, 19 nt, Homo sapiens
uagauacacuuucaucaga

SEQ ID NO: 728825 - RNA, 19 nt, Homo sapiens
gaagcuggauauuugacaa

SEQ ID NO: 728826 - RNA, 19 nt, Homo sapiens
gacacaggcuuuacugaau

SEQ ID NO: 728827 - RNA, 19 nt, Homo sapiens
gcauaugaauugcuuaaac

SEQ ID NO: 728828 - RNA, 19 nt, Homo sapiens
ccggauaguuuacuuguga

SEQ ID NO: 728829 - RNA, 19 nt, Homo sapiens
gauugugucugauauagau

SEQ ID NO: 728830 - RNA, 19 nt, Homo sapiens
uaacgaugaugcuguuuca

SEQ ID NO: 728831 - RNA, 19 nt, Homo sapiens
uuacuacucugcucucuau

SEQ ID NO: 728832 - RNA, 19 nt, Homo sapiens
ccagauccuucauaacuug

SEQ ID NO: 728833 - RNA, 19 nt, Homo sapiens
aaaggugagcggagaauua

SEQ ID NO: 728834 - RNA, 19 nt, Homo sapiens
gauugagucuucagaguuc

SEQ ID NO: 728835 - RNA, 19 nt, Homo sapiens
gauauggauugcaucauca

SEQ ID NO: 728836 - RNA, 19 nt, Homo sapiens
ggauuucccucuacuugug

SEQ ID NO: 728837 - RNA, 19 nt, Homo sapiens
gaauugaguccacaaagga

SEQ ID NO: 728838 - RNA, 19 nt, Homo sapiens
caaguuguuuccucucuau

SEQ ID NO: 728839 - RNA, 19 nt, Homo sapiens
aaacugcaguggauuuguu

SEQ ID NO: 728840 - RNA, 19 nt, Homo sapiens
aguggaagcuggauauuug

SEQ ID NO: 728841 - RNA, 19 nt, Homo sapiens
ccaguaacccgguauauuc

SEQ ID NO: 728842 - RNA, 19 nt, Homo sapiens
cagcagauuuguaagugaa

SEQ ID NO: 728843 - RNA, 19 nt, Homo sapiens
gcagcagauuuguaaguga

SEQ ID NO: 728844 - RNA, 19 nt, Homo sapiens
gcggugcaguugucaauug

SEQ ID NO: 728845 - RNA, 19 nt, Homo sapiens
gaaagccugagaccuguaa

SEQ ID NO: 728846 - RNA, 19 nt, Homo sapiens
augaucagccuacuaauua

SEQ ID NO: 728847 - RNA, 19 nt, Homo sapiens
gaaugagguugacuaaugc

SEQ ID NO: 728848 - RNA, 19 nt, Homo sapiens
guaccguguuauuuguuua

SEQ ID NO: 728849 - RNA, 19 nt, Homo sapiens
gaugcuguuucaccaagua

SEQ ID NO: 728850 - RNA, 19 nt, Homo sapiens
gaaagagccagauccuuca

SEQ ID NO: 728851 - RNA, 19 nt, Homo sapiens
gcuggaugaucguguauau

SEQ ID NO: 728852 - RNA, 19 nt, Homo sapiens
uaacagauacuuccuuagu

SEQ ID NO: 728853 - RNA, 19 nt, Homo sapiens
guucauugcuucuucagau

SEQ ID NO: 728854 - RNA, 19 nt, Homo sapiens
gcaauuaccagugauaaca

SEQ ID NO: 728855 - RNA, 19 nt, Homo sapiens
cagagaagcgcgugagaaa

SEQ ID NO: 728856 - RNA, 19 nt, Homo sapiens
uuacagcacucugcauuga

SEQ ID NO: 728857 - RNA, 19 nt, Homo sapiens
uaaguucacuagcagaugu

SEQ ID NO: 728858 - RNA, 19 nt, Homo sapiens
uaucacagccucaaauguu

SEQ ID NO: 728859 - RNA, 19 nt, Homo sapiens
uuagaugugucucauaaug

SEQ ID NO: 728860 - RNA, 19 nt, Homo sapiens
ucauuucgguguacuuuga

SEQ ID NO: 728861 - RNA, 19 nt, Homo sapiens
cagauaugcuuucuucauc

SEQ ID NO: 728862 - RNA, 19 nt, Homo sapiens
aacaacaacccaaccauua

SEQ ID NO: 728863 - RNA, 19 nt, Homo sapiens
uaugcuaugucaacuguuu

SEQ ID NO: 728864 - RNA, 19 nt, Homo sapiens
gguaccguguuauuuguuu

SEQ ID NO: 728865 - RNA, 19 nt, Homo sapiens
caagagaugccuuagugaa

SEQ ID NO: 728866 - RNA, 19 nt, Homo sapiens
gcuggauauuugacaauuu

SEQ ID NO: 728867 - RNA, 19 nt, Homo sapiens
aaacgauguuccugaagaa

SEQ ID NO: 728868 - RNA, 19 nt, Homo sapiens
ccugagaccuguaaaccuu

SEQ ID NO: 728869 - RNA, 19 nt, Homo sapiens
agagacagcagaccauuaa

SEQ ID NO: 728870 - RNA, 19 nt, Homo sapiens
agagccagauccuucauaa

SEQ ID NO: 728871 - RNA, 19 nt, Homo sapiens
ucacaauccuucacaagca

SEQ ID NO: 728872 - RNA, 19 nt, Homo sapiens
gcagggugcaucuauuauu

SEQ ID NO: 728873 - RNA, 19 nt, Homo sapiens
gcacuauucauuucuacaa

SEQ ID NO: 728874 - RNA, 19 nt, Homo sapiens
ccagauucauuucggugua

SEQ ID NO: 728875 - RNA, 19 nt, Homo sapiens
caacacuucagccugguua

SEQ ID NO: 728876 - RNA, 19 nt, Homo sapiens
aagacaaucucauccgaaa

SEQ ID NO: 728877 - RNA, 19 nt, Homo sapiens
gaagagacaaguucaagua

SEQ ID NO: 728878 - RNA, 19 nt, Homo sapiens
gaaggaagaugaaguggau

SEQ ID NO: 728879 - RNA, 19 nt, Homo sapiens
gagacaaguucaaguaaau

SEQ ID NO: 728880 - RNA, 19 nt, Homo sapiens
gcagcaacauggaggaauu

SEQ ID NO: 728881 - RNA, 19 nt, Homo sapiens
guacacaaguuaagaaagg

SEQ ID NO: 728882 - RNA, 19 nt, Homo sapiens
gaagaacuggccauccaua

SEQ ID NO: 728883 - RNA, 19 nt, Homo sapiens
gaacuggccauccauaauc

SEQ ID NO: 728884 - RNA, 19 nt, Homo sapiens
agagaaaccuaaagaaaca

SEQ ID NO: 728885 - RNA, 19 nt, Homo sapiens
gaucacaggcaguuugaaa

SEQ ID NO: 728886 - RNA, 19 nt, Homo sapiens
gugcgucugugaaauguuu

SEQ ID NO: 728887 - RNA, 19 nt, Homo sapiens
gaucagaggaugccaggaa

SEQ ID NO: 728888 - RNA, 19 nt, Homo sapiens
gagaguauagugaagauga

SEQ ID NO: 728889 - RNA, 19 nt, Homo sapiens
gaaguaaggguaacuaagg

SEQ ID NO: 728890 - RNA, 19 nt, Homo sapiens
gcugcggucuugugaguuu

SEQ ID NO: 728891 - RNA, 19 nt, Homo sapiens
gugaagaugauguaaauga

SEQ ID NO: 728892 - RNA, 19 nt, Homo sapiens
gaagaaguaaggguaacua

SEQ ID NO: 728893 - RNA, 19 nt, Homo sapiens
gugaagagcagacacagaa

SEQ ID NO: 728894 - RNA, 19 nt, Homo sapiens
cuagagaaaccuaaagaaa

SEQ ID NO: 728895 - RNA, 19 nt, Homo sapiens
agagacaaguucaaguaaa

SEQ ID NO: 728896 - RNA, 19 nt, Homo sapiens
gaaaggagaggagacugaa

SEQ ID NO: 728897 - RNA, 19 nt, Homo sapiens
guagugaggaggaagauga

SEQ ID NO: 728898 - RNA, 19 nt, Homo sapiens
ccaaauccuucuucaagca

SEQ ID NO: 728899 - RNA, 19 nt, Homo sapiens
caagguggccucucauuag

SEQ ID NO: 728900 - RNA, 19 nt, Homo sapiens
cuaaagaggccaaauccuu

SEQ ID NO: 728901 - RNA, 19 nt, Homo sapiens
gaagagcuagagaaaccua

SEQ ID NO: 728902 - RNA, 19 nt, Homo sapiens
ucaaugaugugggaccaaa

SEQ ID NO: 728903 - RNA, 19 nt, Homo sapiens
acaggcaguuugaaauuga

SEQ ID NO: 728904 - RNA, 19 nt, Homo sapiens
ucacaggcaguuugaaauu

SEQ ID NO: 728905 - RNA, 19 nt, Homo sapiens
ggaaagagggguacauuga

SEQ ID NO: 728906 - RNA, 19 nt, Homo sapiens
cagaagagcuagagaaacc

SEQ ID NO: 728907 - RNA, 19 nt, Homo sapiens
ugaaguggauggugaagag

SEQ ID NO: 728908 - RNA, 19 nt, Homo sapiens
acauugaaguucugucuau

SEQ ID NO: 728909 - RNA, 19 nt, Homo sapiens
gcuuaauccuguuuacaau

SEQ ID NO: 728910 - RNA, 19 nt, Homo sapiens
uugaaguucugucuaugua

SEQ ID NO: 728911 - RNA, 19 nt, Homo sapiens
guuacgggcuaaaucaaga

SEQ ID NO: 728912 - RNA, 19 nt, Homo sapiens
aaugaaaccuugauguuac

SEQ ID NO: 728913 - RNA, 19 nt, Homo sapiens
gugaagaacuggccaucca

SEQ ID NO: 728914 - RNA, 19 nt, Homo sapiens
uaaaucaagagcagcuuaa

SEQ ID NO: 728915 - RNA, 19 nt, Homo sapiens
caagcagaaugagaaagaa

SEQ ID NO: 728916 - RNA, 19 nt, Homo sapiens
caaguacacaaguuaagaa

SEQ ID NO: 728917 - RNA, 19 nt, Homo sapiens
acaagguggccucucauua

SEQ ID NO: 728918 - RNA, 19 nt, Homo sapiens
gauguuacgggcuaaauca

SEQ ID NO: 728919 - RNA, 19 nt, Homo sapiens
ucaagcagaaugagaaaga

SEQ ID NO: 728920 - RNA, 19 nt, Homo sapiens
ggccaaauccuucuucaag

SEQ ID NO: 728921 - RNA, 19 nt, Homo sapiens
ggaggaugccaauucagaa

SEQ ID NO: 728922 - RNA, 19 nt, Homo sapiens
gacaaguucaaguaaauug

SEQ ID NO: 728923 - RNA, 19 nt, Homo sapiens
gggccagcuuccucaauga

SEQ ID NO: 728924 - RNA, 19 nt, Homo sapiens
agaggaggaugccaauuca

SEQ ID NO: 728925 - RNA, 19 nt, Homo sapiens
cuaaaucaagagcagcuua

SEQ ID NO: 728926 - RNA, 19 nt, Homo sapiens
gguaaaagcagaagagcua

SEQ ID NO: 728927 - RNA, 19 nt, Homo sapiens
ggaagaggaggaugccaau

SEQ ID NO: 728928 - RNA, 19 nt, Homo sapiens
gagcagcuuaauccuguuu

SEQ ID NO: 728929 - RNA, 19 nt, Homo sapiens
cacaggcaguuugaaauug

SEQ ID NO: 728930 - RNA, 19 nt, Homo sapiens
guauagugaagaugaugua

SEQ ID NO: 728931 - RNA, 19 nt, Homo sapiens
gcuagagaaaccuaaagaa

SEQ ID NO: 728932 - RNA, 19 nt, Homo sapiens
agaggagacugaagagaca

SEQ ID NO: 728933 - RNA, 19 nt, Homo sapiens
aagacaagguggccucuca

SEQ ID NO: 728934 - RNA, 19 nt, Homo sapiens
ggugaagaaguaaggguaa

SEQ ID NO: 728935 - RNA, 19 nt, Homo sapiens
ccaaguacacaaguuaaga

SEQ ID NO: 728936 - RNA, 19 nt, Homo sapiens
aagguggccucucauuaga

SEQ ID NO: 728937 - RNA, 19 nt, Homo sapiens
gaggccaaauccuucuuca

SEQ ID NO: 728938 - RNA, 19 nt, Homo sapiens
gaaucugagggaagcagua

SEQ ID NO: 728939 - RNA, 19 nt, Homo sapiens
gacaagguggccucucauu

SEQ ID NO: 728940 - RNA, 19 nt, Homo sapiens
gaaagagggguacauugaa

SEQ ID NO: 728941 - RNA, 19 nt, Homo sapiens
aaagaaaggcccagagcau

SEQ ID NO: 728942 - RNA, 19 nt, Homo sapiens
ccagcuuccucaaugaugu

SEQ ID NO: 728943 - RNA, 19 nt, Homo sapiens
gaagaggaggaugccaauu

SEQ ID NO: 728944 - RNA, 19 nt, Homo sapiens
gcagcuuaauccuguuuac

SEQ ID NO: 728945 - RNA, 19 nt, Homo sapiens
uagagaaaccuaaagaaac

SEQ ID NO: 728946 - RNA, 19 nt, Homo sapiens
gcaguagugaggaggaaga

SEQ ID NO: 728947 - RNA, 19 nt, Homo sapiens
gguggccucucauuagaag

SEQ ID NO: 728948 - RNA, 19 nt, Homo sapiens
ugagcacccuugagaaguc

SEQ ID NO: 728949 - RNA, 19 nt, Homo sapiens
agaaaggagaggagacuga

SEQ ID NO: 728950 - RNA, 19 nt, Homo sapiens
gaagagcagacacagaaaa

SEQ ID NO: 728951 - RNA, 19 nt, Homo sapiens
caucuaaagaggccaaauc

SEQ ID NO: 728952 - RNA, 19 nt, Homo sapiens
agaaaggcccagagcauuc

SEQ ID NO: 728953 - RNA, 19 nt, Homo sapiens
aagaggaggaugccaauuc

SEQ ID NO: 728954 - RNA, 19 nt, Homo sapiens
aaguaaggguaacuaagga

SEQ ID NO: 728955 - RNA, 19 nt, Homo sapiens
gaaaccuaaagaaacagaa

SEQ ID NO: 728956 - RNA, 19 nt, Homo sapiens
aagagacaaguucaaguaa

SEQ ID NO: 728957 - RNA, 19 nt, Homo sapiens
aagaaaggcccagagcauu

SEQ ID NO: 728958 - RNA, 19 nt, Homo sapiens
cauccauaaucgagggaaa

SEQ ID NO: 728959 - RNA, 19 nt, Homo sapiens
gccgucggguggagaguau

SEQ ID NO: 728960 - RNA, 19 nt, Homo sapiens
agacugaagagacaaguuc

SEQ ID NO: 728961 - RNA, 19 nt, Homo sapiens
ggacugggagagcuucaag

SEQ ID NO: 728962 - RNA, 19 nt, Homo sapiens
aaaaugagcacccuugaga

SEQ ID NO: 728963 - RNA, 19 nt, Homo sapiens
aagcagaagagcuagagaa

SEQ ID NO: 728964 - RNA, 19 nt, Homo sapiens
cuagagcuuugccguugga

SEQ ID NO: 728965 - RNA, 19 nt, Homo sapiens
ggagaggagacugaagaga

SEQ ID NO: 728966 - RNA, 19 nt, Homo sapiens
ugggccagcuuccucaaug

SEQ ID NO: 728967 - RNA, 19 nt, Homo sapiens
aagaacuggccauccauaa

SEQ ID NO: 728968 - RNA, 19 nt, Homo sapiens
uuacaguguuucucaucau

SEQ ID NO: 728969 - RNA, 19 nt, Homo sapiens
gguggagaguauagugaag

SEQ ID NO: 728970 - RNA, 19 nt, Homo sapiens
aaggguaacuaaggaagug

SEQ ID NO: 728971 - RNA, 19 nt, Homo sapiens
aagaaguaaggguaacuaa

SEQ ID NO: 728972 - RNA, 19 nt, Homo sapiens
aaggagaggagacugaaga

SEQ ID NO: 728973 - RNA, 19 nt, Homo sapiens
cuucagcucugccaucacu

SEQ ID NO: 728974 - RNA, 19 nt, Homo sapiens
cggaggaggacgaggacua

SEQ ID NO: 728975 - RNA, 19 nt, Homo sapiens
cauugaaguucugucuaug

SEQ ID NO: 728976 - RNA, 19 nt, Homo sapiens
uggagaguauagugaagau

SEQ ID NO: 728977 - RNA, 19 nt, Homo sapiens
gcucaggucuggaugauaa

SEQ ID NO: 728978 - RNA, 19 nt, Homo sapiens
guacaacgccuucuggaaa

SEQ ID NO: 728979 - RNA, 19 nt, Homo sapiens
gaaguaaacaguauuugga

SEQ ID NO: 728980 - RNA, 19 nt, Homo sapiens
gcauugaguuugacuggaa

SEQ ID NO: 728981 - RNA, 19 nt, Homo sapiens
gagcauagacuccaacauc

SEQ ID NO: 728982 - RNA, 19 nt, Homo sapiens
ggagucaccuaccucuuug

SEQ ID NO: 728983 - RNA, 19 nt, Homo sapiens
ggauguggcagaccugaua

SEQ ID NO: 728984 - RNA, 19 nt, Homo sapiens
acaucagucugguccauua

SEQ ID NO: 728985 - RNA, 19 nt, Homo sapiens
gcacuuuggcccuguaugu

SEQ ID NO: 728986 - RNA, 19 nt, Homo sapiens
gaugauaacacgcuaugau

SEQ ID NO: 728987 - RNA, 19 nt, Homo sapiens
guucuuggccacuuucuuu

SEQ ID NO: 728988 - RNA, 19 nt, Homo sapiens
cugcugagcuuauuauguc

SEQ ID NO: 728989 - RNA, 19 nt, Homo sapiens
gggaacugcuucgcucuug

SEQ ID NO: 728990 - RNA, 19 nt, Homo sapiens
gaguuugacuggaaguaca

SEQ ID NO: 728991 - RNA, 19 nt, Homo sapiens
gggaaggcggcaucuauga

SEQ ID NO: 728992 - RNA, 19 nt, Homo sapiens
caacaucagucugguccau

SEQ ID NO: 728993 - RNA, 19 nt, Homo sapiens
caagggagaguacaagauc

SEQ ID NO: 728994 - RNA, 19 nt, Homo sapiens
ggucuaaaccuugucaugu

SEQ ID NO: 728995 - RNA, 19 nt, Homo sapiens
guaaacaguauuuggaaag

SEQ ID NO: 728996 - RNA, 19 nt, Homo sapiens
guaugucgccguugucaau

SEQ ID NO: 728997 - RNA, 19 nt, Homo sapiens
gauaacacgcuaugaucug

SEQ ID NO: 728998 - RNA, 19 nt, Homo sapiens
gcaagggagaguacaagau

SEQ ID NO: 728999 - RNA, 19 nt, Homo sapiens
ucaugacccuguuucacuu

SEQ ID NO: 729000 - RNA, 19 nt, Homo sapiens
ggccacugcugagcuuauu

SEQ ID NO: 729001 - RNA, 19 nt, Homo sapiens
uacaacgccuucuggaaau

SEQ ID NO: 729002 - RNA, 19 nt, Homo sapiens
uggagucaccuaccucuuu

SEQ ID NO: 729003 - RNA, 19 nt, Homo sapiens
ccacugcugagcuuauuau

SEQ ID NO: 729004 - RNA, 19 nt, Homo sapiens
gucuaaaccuugucauguc

SEQ ID NO: 729005 - RNA, 19 nt, Homo sapiens
gcuucgcucuugccuacuu

SEQ ID NO: 729006 - RNA, 19 nt, Homo sapiens
gaaggcggcaucuaugacu

SEQ ID NO: 729007 - RNA, 19 nt, Homo sapiens
ugaaguaaacaguauuugg

SEQ ID NO: 729008 - RNA, 19 nt, Homo sapiens
gagaguacaagaucauggu

SEQ ID NO: 729009 - RNA, 19 nt, Homo sapiens
uaacacgcuaugaucugua

SEQ ID NO: 729010 - RNA, 19 nt, Homo sapiens
agcauagacuccaacauca

SEQ ID NO: 729011 - RNA, 19 nt, Homo sapiens
uauuaugucccgcugcauu

SEQ ID NO: 729012 - RNA, 19 nt, Homo sapiens
ucagcacuuuggcccugua

SEQ ID NO: 729013 - RNA, 19 nt, Homo sapiens
guuccucagugucuacaag

SEQ ID NO: 729014 - RNA, 19 nt, Homo sapiens
auaacacgcuaugaucugu

SEQ ID NO: 729015 - RNA, 19 nt, Homo sapiens
cauagacuccaacaucagu

SEQ ID NO: 729016 - RNA, 19 nt, Homo sapiens
ggcaagggagaguacaaga

SEQ ID NO: 729017 - RNA, 19 nt, Homo sapiens
caugaaggccagcguggau

SEQ ID NO: 729018 - RNA, 19 nt, Homo sapiens
ggaaggcggcaucuaugac

SEQ ID NO: 729019 - RNA, 19 nt, Homo sapiens
ucagucugguccauuacau

SEQ ID NO: 729020 - RNA, 19 nt, Homo sapiens
ugacaggcauguuguauaa

SEQ ID NO: 729021 - RNA, 19 nt, Homo sapiens
ggaggacacuucaguaguu

SEQ ID NO: 729022 - RNA, 19 nt, Homo sapiens
gaacauggccugguccaaa

SEQ ID NO: 729023 - RNA, 19 nt, Homo sapiens
ggauacagaugaguuuauu

SEQ ID NO: 729024 - RNA, 19 nt, Homo sapiens
gauuugagcuggccuucuu

SEQ ID NO: 729025 - RNA, 19 nt, Homo sapiens
gagcuggccuucuuuacga

SEQ ID NO: 729026 - RNA, 19 nt, Homo sapiens
gaaggaaacccagaacaug

SEQ ID NO: 729027 - RNA, 19 nt, Homo sapiens
ugaacccucugucuccuua

SEQ ID NO: 729028 - RNA, 19 nt, Homo sapiens
aagaugaccuuaacacagu

SEQ ID NO: 729029 - RNA, 19 nt, Homo sapiens
gcaggauacagaugaguuu

SEQ ID NO: 729030 - RNA, 19 nt, Homo sapiens
uaacugggagcacaugaaa

SEQ ID NO: 729031 - RNA, 19 nt, Homo sapiens
cagccucuaugcacuauau

SEQ ID NO: 729032 - RNA, 19 nt, Homo sapiens
accaagaaauguacagauu

SEQ ID NO: 729033 - RNA, 19 nt, Homo sapiens
cggcuaggauugaaggaaa

SEQ ID NO: 729034 - RNA, 19 nt, Homo sapiens
aaggacaguuugggaguua

SEQ ID NO: 729035 - RNA, 19 nt, Homo sapiens
guacagauuuugaauaugg

SEQ ID NO: 729036 - RNA, 19 nt, Homo sapiens
ugacaggacuaacacuuac

SEQ ID NO: 729037 - RNA, 19 nt, Homo sapiens
gaauggaggacacuucagu

SEQ ID NO: 729038 - RNA, 19 nt, Homo sapiens
gugcagaagaugaccuuaa

SEQ ID NO: 729039 - RNA, 19 nt, Homo sapiens
cauuuggugucaucauuga

SEQ ID NO: 729040 - RNA, 19 nt, Homo sapiens
caacagucacucugaagau

SEQ ID NO: 729041 - RNA, 19 nt, Homo sapiens
ggacaguuugggaguuauu

SEQ ID NO: 729042 - RNA, 19 nt, Homo sapiens
caucuaggauccuuuuauu

SEQ ID NO: 729043 - RNA, 19 nt, Homo sapiens
guccaaaccaagaaaugua

SEQ ID NO: 729044 - RNA, 19 nt, Homo sapiens
uaaggacaguuugggaguu

SEQ ID NO: 729045 - RNA, 19 nt, Homo sapiens
gaggacacuucaguaguuc

SEQ ID NO: 729046 - RNA, 19 nt, Homo sapiens
cccucugucuccuuauuua

SEQ ID NO: 729047 - RNA, 19 nt, Homo sapiens
gcauuuggugucaucauug

SEQ ID NO: 729048 - RNA, 19 nt, Homo sapiens
ucucuggcuuugcucuaua

SEQ ID NO: 729049 - RNA, 19 nt, Homo sapiens
cugacaggacuaacacuua

SEQ ID NO: 729050 - RNA, 19 nt, Homo sapiens
guuacucgcacgcggauuu

SEQ ID NO: 729051 - RNA, 19 nt, Homo sapiens
uuaccuaccggagcuaaua

SEQ ID NO: 729052 - RNA, 19 nt, Homo sapiens
ggucuucggcuaggauuga

SEQ ID NO: 729053 - RNA, 19 nt, Homo sapiens
uggaggauguugcaugaca

SEQ ID NO: 729054 - RNA, 19 nt, Homo sapiens
aacagucacucugaagauu

SEQ ID NO: 729055 - RNA, 19 nt, Homo sapiens
ugaaggaaacccagaacau

SEQ ID NO: 729056 - RNA, 19 nt, Homo sapiens
gcuccaacagucacucuga

SEQ ID NO: 729057 - RNA, 19 nt, Homo sapiens
ccaacagucacucugaaga

SEQ ID NO: 729058 - RNA, 19 nt, Homo sapiens
gaaaacacgaggugcagaa

SEQ ID NO: 729059 - RNA, 19 nt, Homo sapiens
ugcauuuggugucaucauu

SEQ ID NO: 729060 - RNA, 19 nt, Homo sapiens
uauagugcauuugguguca

SEQ ID NO: 729061 - RNA, 19 nt, Homo sapiens
acacuuaccagccucuaug

SEQ ID NO: 729062 - RNA, 19 nt, Homo sapiens
aacacgaggugcagaagau

SEQ ID NO: 729063 - RNA, 19 nt, Homo sapiens
cgauaccucgugcaggaua

SEQ ID NO: 729064 - RNA, 19 nt, Homo sapiens
gauugaaggaaacccagaa

SEQ ID NO: 729065 - RNA, 19 nt, Homo sapiens
caggauacagaugaguuua

SEQ ID NO: 729066 - RNA, 19 nt, Homo sapiens
uucaguaguucaucuagga

SEQ ID NO: 729067 - RNA, 19 nt, Homo sapiens
acacuucaguaguucaucu

SEQ ID NO: 729068 - RNA, 19 nt, Homo sapiens
gcucuauagugcauuuggu

SEQ ID NO: 729069 - RNA, 19 nt, Homo sapiens
gcacuuugggcuaauacuc

SEQ ID NO: 729070 - RNA, 19 nt, Homo sapiens
gguccaaaccaagaaaugu

SEQ ID NO: 729071 - RNA, 19 nt, Homo sapiens
acagucacucugaagauuu

SEQ ID NO: 729072 - RNA, 19 nt, Homo sapiens
gcagaagaugaccuuaaca

SEQ ID NO: 729073 - RNA, 19 nt, Homo sapiens
cuaauacucuagguucucu

SEQ ID NO: 729074 - RNA, 19 nt, Homo sapiens
auuggaggauguugcauga

SEQ ID NO: 729075 - RNA, 19 nt, Homo sapiens
ggacacuucaguaguucau

SEQ ID NO: 729076 - RNA, 19 nt, Homo sapiens
ugcagaagaugaccuuaac

SEQ ID NO: 729077 - RNA, 19 nt, Homo sapiens
gaauggucuucggcuagga

SEQ ID NO: 729078 - RNA, 19 nt, Homo sapiens
gacaguuugggaguuauuu

SEQ ID NO: 729079 - RNA, 19 nt, Homo sapiens
agaugaccuuaacacagua

SEQ ID NO: 729080 - RNA, 19 nt, Homo sapiens
aaacacgaggugcagaaga

SEQ ID NO: 729081 - RNA, 19 nt, Homo sapiens
gggcugcguuuggugcaau

SEQ ID NO: 729082 - RNA, 19 nt, Homo sapiens
ccucuaugcacuauauaau

SEQ ID NO: 729083 - RNA, 19 nt, Homo sapiens
gccucuaugcacuauauaa

SEQ ID NO: 729084 - RNA, 19 nt, Homo sapiens
gcuuugcucuauagugcau

SEQ ID NO: 729085 - RNA, 19 nt, Homo sapiens
aacccucugucuccuuauu

SEQ ID NO: 729086 - RNA, 19 nt, Homo sapiens
acuuugggcuaauacucua

SEQ ID NO: 729087 - RNA, 19 nt, Homo sapiens
uugcugcgauaccauggaa

SEQ ID NO: 729088 - RNA, 19 nt, Homo sapiens
caacagcacugguggcuuu

SEQ ID NO: 729089 - RNA, 19 nt, Homo sapiens
uagccgagcucucugauua

SEQ ID NO: 729090 - RNA, 19 nt, Homo sapiens
agacccagcugaauaguua

SEQ ID NO: 729091 - RNA, 19 nt, Homo sapiens
ccaaguaggugguguuaga

SEQ ID NO: 729092 - RNA, 19 nt, Homo sapiens
gaaggaagcagaugccaaa

SEQ ID NO: 729093 - RNA, 19 nt, Homo sapiens
gcccauaccuuuccugguu

SEQ ID NO: 729094 - RNA, 19 nt, Homo sapiens
gagaugauccuguuaagug

SEQ ID NO: 729095 - RNA, 19 nt, Homo sapiens
ccaggcagcuucauauaau

SEQ ID NO: 729096 - RNA, 19 nt, Homo sapiens
guaaccagccauccucuua

SEQ ID NO: 729097 - RNA, 19 nt, Homo sapiens
gagcugcgccgucaugaaa

SEQ ID NO: 729098 - RNA, 19 nt, Homo sapiens
cuacgacgaucccuacaaa

SEQ ID NO: 729099 - RNA, 19 nt, Homo sapiens
caaaguccucgcuggauua

SEQ ID NO: 729100 - RNA, 19 nt, Homo sapiens
ggugaaagacuacgcguuu

SEQ ID NO: 729101 - RNA, 19 nt, Homo sapiens
uaacuacucuggcccauac

SEQ ID NO: 729102 - RNA, 19 nt, Homo sapiens
gugcagacccagcugaaua

SEQ ID NO: 729103 - RNA, 19 nt, Homo sapiens
gcuauucgggcuccuauaa

SEQ ID NO: 729104 - RNA, 19 nt, Homo sapiens
agggucagcuuaaccauuu

SEQ ID NO: 729105 - RNA, 19 nt, Homo sapiens
uuacagauccagguuauaa

SEQ ID NO: 729106 - RNA, 19 nt, Homo sapiens
gcuuaaccauuuccuaugu

SEQ ID NO: 729107 - RNA, 19 nt, Homo sapiens
gguuacagauccagguuau

SEQ ID NO: 729108 - RNA, 19 nt, Homo sapiens
cuucuucgcucaacuccua

SEQ ID NO: 729109 - RNA, 19 nt, Homo sapiens
gacagucaguugguaugua

SEQ ID NO: 729110 - RNA, 19 nt, Homo sapiens
acaaaguccucgcuggauu

SEQ ID NO: 729111 - RNA, 19 nt, Homo sapiens
gaaagacuacgcguuuguu

SEQ ID NO: 729112 - RNA, 19 nt, Homo sapiens
gaaagggucagcuuaacca

SEQ ID NO: 729113 - RNA, 19 nt, Homo sapiens
cccaauggcuggcuccuau

SEQ ID NO: 729114 - RNA, 19 nt, Homo sapiens
ccaggaaagggucagcuua

SEQ ID NO: 729115 - RNA, 19 nt, Homo sapiens
gcuacuggcucuagaucug

SEQ ID NO: 729116 - RNA, 19 nt, Homo sapiens
caggaaagggucagcuuaa

SEQ ID NO: 729117 - RNA, 19 nt, Homo sapiens
gcccaaggccucuuaauac

SEQ ID NO: 729118 - RNA, 19 nt, Homo sapiens
acagucaguugguauguau

SEQ ID NO: 729119 - RNA, 19 nt, Homo sapiens
ccucggcccuuuccuccua

SEQ ID NO: 729120 - RNA, 19 nt, Homo sapiens
uguagacuguugagacuga

SEQ ID NO: 729121 - RNA, 19 nt, Homo sapiens
aaagagguggguaggguua

SEQ ID NO: 729122 - RNA, 19 nt, Homo sapiens
ccgaugcccauuccgauua

SEQ ID NO: 729123 - RNA, 19 nt, Homo sapiens
gagcccaggcagcuucaua

SEQ ID NO: 729124 - RNA, 19 nt, Homo sapiens
ccaccaagggucagaagaa

SEQ ID NO: 729125 - RNA, 19 nt, Homo sapiens
cagcuuaaccauuuccuau

SEQ ID NO: 729126 - RNA, 19 nt, Homo sapiens
guuaaguguucggcaguaa

SEQ ID NO: 729127 - RNA, 19 nt, Homo sapiens
guuccucccuugccuccua

SEQ ID NO: 729128 - RNA, 19 nt, Homo sapiens
gcccacaccacccuucuuu

SEQ ID NO: 729129 - RNA, 19 nt, Homo sapiens
uauucgggcuccuauaaug

SEQ ID NO: 729130 - RNA, 19 nt, Homo sapiens
ucccuugccuccuauggua

SEQ ID NO: 729131 - RNA, 19 nt, Homo sapiens
ggaaggaggccaggaaagg

SEQ ID NO: 729132 - RNA, 19 nt, Homo sapiens
cgcccaaggccucuuaaua

SEQ ID NO: 729133 - RNA, 19 nt, Homo sapiens
gcucaacggcaaagaagug

SEQ ID NO: 729134 - RNA, 19 nt, Homo sapiens
gcagcucaacggcaaagaa

SEQ ID NO: 729135 - RNA, 19 nt, Homo sapiens
cagccuaccuguccauguc

SEQ ID NO: 729136 - RNA, 19 nt, Homo sapiens
gcgacaaaaugaagauauu

SEQ ID NO: 729137 - RNA, 19 nt, Homo sapiens
gcccaggcagcuucauaua

SEQ ID NO: 729138 - RNA, 19 nt, Homo sapiens
gugaaagacuacgcguuug

SEQ ID NO: 729139 - RNA, 19 nt, Homo sapiens
uauuuaaggucgucuggau

SEQ ID NO: 729140 - RNA, 19 nt, Homo sapiens
cagagucgcagcuuucguu

SEQ ID NO: 729141 - RNA, 19 nt, Homo sapiens
cucauuggcugcuuccuau

SEQ ID NO: 729142 - RNA, 19 nt, Homo sapiens
agugugacguggugaaaga

SEQ ID NO: 729143 - RNA, 19 nt, Homo sapiens
ugaaacaguucgccuucgu

SEQ ID NO: 729144 - RNA, 19 nt, Homo sapiens
gugacguggugaaagacua

SEQ ID NO: 729145 - RNA, 19 nt, Homo sapiens
gugcagcugcuucuuccua

SEQ ID NO: 729146 - RNA, 19 nt, Homo sapiens
cuucuucacucggcccaua

SEQ ID NO: 729147 - RNA, 19 nt, Homo sapiens
ggacaagaccaagaaacca

SEQ ID NO: 729148 - RNA, 19 nt, Homo sapiens
uaucagagucgcagcuuuc

SEQ ID NO: 729149 - RNA, 19 nt, Homo sapiens
ucagucaucagccucauug

SEQ ID NO: 729150 - RNA, 19 nt, Homo sapiens
ccaaccugcugccuaugug

SEQ ID NO: 729151 - RNA, 19 nt, Homo sapiens
ccaaggccucuuaauacuu

SEQ ID NO: 729152 - RNA, 19 nt, Homo sapiens
ccacaccacccuucuuugg

SEQ ID NO: 729153 - RNA, 19 nt, Homo sapiens
ggacuacaaauaaaacuug

SEQ ID NO: 729154 - RNA, 19 nt, Homo sapiens
ggacagucaguugguaugu

SEQ ID NO: 729155 - RNA, 19 nt, Homo sapiens
cccaggcagcuucauauaa

SEQ ID NO: 729156 - RNA, 19 nt, Homo sapiens
gcagccuccucacuagcuu

SEQ ID NO: 729157 - RNA, 19 nt, Homo sapiens
ugaaagacuacgcguuugu

SEQ ID NO: 729158 - RNA, 19 nt, Homo sapiens
gagcggcacagucccacuu

SEQ ID NO: 729159 - RNA, 19 nt, Homo sapiens
gcgccgucaugaaacaguu

SEQ ID NO: 729160 - RNA, 19 nt, Homo sapiens
ggagaugauccuguuaagu

SEQ ID NO: 729161 - RNA, 19 nt, Homo sapiens
caggcagcuucauauaaug

SEQ ID NO: 729162 - RNA, 19 nt, Homo sapiens
agaugauccuguuaagugu

SEQ ID NO: 729163 - RNA, 19 nt, Homo sapiens
gcugcgccgucaugaaaca

SEQ ID NO: 729164 - RNA, 19 nt, Homo sapiens
cccaaggccucuuaauacu

SEQ ID NO: 729165 - RNA, 19 nt, Homo sapiens
cagcacugguggcuuugau

SEQ ID NO: 729166 - RNA, 19 nt, Homo sapiens
ccacucuggcagcuccuua

SEQ ID NO: 729167 - RNA, 19 nt, Homo sapiens
cuacgcguuuguucacaug

SEQ ID NO: 729168 - RNA, 19 nt, Homo sapiens
gcagcugcuucuuccuaca

SEQ ID NO: 729169 - RNA, 19 nt, Homo sapiens
caccaagggucagaagaag

SEQ ID NO: 729170 - RNA, 19 nt, Homo sapiens
caacggcaaagaagugaag

SEQ ID NO: 729171 - RNA, 19 nt, Homo sapiens
caaguaggugguguuagaa

SEQ ID NO: 729172 - RNA, 19 nt, Homo sapiens
cagauccagguuauaacua

SEQ ID NO: 729173 - RNA, 19 nt, Homo sapiens
ggguuacagauccagguua

SEQ ID NO: 729174 - RNA, 19 nt, Homo sapiens
ccucauuggcugcuuccua

SEQ ID NO: 729175 - RNA, 19 nt, Homo sapiens
gugaagggcaagcgcauca

SEQ ID NO: 729176 - RNA, 19 nt, Homo sapiens
agucccugcugaccacuaa

SEQ ID NO: 729177 - RNA, 19 nt, Homo sapiens
ggcucuagaucugcgguuu

SEQ ID NO: 729178 - RNA, 19 nt, Homo sapiens
guaaccuacuuuguuccuu

SEQ ID NO: 729179 - RNA, 19 nt, Homo sapiens
gaugauccuguuaaguguu

SEQ ID NO: 729180 - RNA, 19 nt, Homo sapiens
gacaaaguccucgcuggau

SEQ ID NO: 729181 - RNA, 19 nt, Homo sapiens
uuaccgcacucagucauca

SEQ ID NO: 729182 - RNA, 19 nt, Homo sapiens
gcccucggccucuuacaau

SEQ ID NO: 729183 - RNA, 19 nt, Homo sapiens
gacgcgucaucgaguguga

SEQ ID NO: 729184 - RNA, 19 nt, Homo sapiens
ccuccucacuagcuuaugg

SEQ ID NO: 729185 - RNA, 19 nt, Homo sapiens
ggaacugcgcagccucuuc

SEQ ID NO: 729186 - RNA, 19 nt, Homo sapiens
gcuacgacgaucccuacaa

SEQ ID NO: 729187 - RNA, 19 nt, Homo sapiens
ggaaagggucagcuuaacc

SEQ ID NO: 729188 - RNA, 19 nt, Homo sapiens
gggaggagcuuuaucuuua

SEQ ID NO: 729189 - RNA, 19 nt, Homo sapiens
gaugaggaaucuauuguaa

SEQ ID NO: 729190 - RNA, 19 nt, Homo sapiens
caaauaauaucuccucaug

SEQ ID NO: 729191 - RNA, 19 nt, Homo sapiens
guaguuaccauacagauua

SEQ ID NO: 729192 - RNA, 19 nt, Homo sapiens
uaagaggccuuguguagaa

SEQ ID NO: 729193 - RNA, 19 nt, Homo sapiens
gcagaagccuuugcaggua

SEQ ID NO: 729194 - RNA, 19 nt, Homo sapiens
cccaggaucuacuauauua

SEQ ID NO: 729195 - RNA, 19 nt, Homo sapiens
gaaauauugugcuguaaca

SEQ ID NO: 729196 - RNA, 19 nt, Homo sapiens
ccaguggacuuauuugaaa

SEQ ID NO: 729197 - RNA, 19 nt, Homo sapiens
ucagaacccuauaccauaa

SEQ ID NO: 729198 - RNA, 19 nt, Homo sapiens
gaggugguauuacauuauu

SEQ ID NO: 729199 - RNA, 19 nt, Homo sapiens
gaggagcuuuaucuuuaua

SEQ ID NO: 729200 - RNA, 19 nt, Homo sapiens
auaaaugggugcuaauuga

SEQ ID NO: 729201 - RNA, 19 nt, Homo sapiens
ggcaagaaauauuccauug

SEQ ID NO: 729202 - RNA, 19 nt, Homo sapiens
gaacguggcuaugccuuca

SEQ ID NO: 729203 - RNA, 19 nt, Homo sapiens
gacccaggaucuacuauau

SEQ ID NO: 729204 - RNA, 19 nt, Homo sapiens
gaaguacaccagcaucauu

SEQ ID NO: 729205 - RNA, 19 nt, Homo sapiens
cagccaaugugaccuuuaa

SEQ ID NO: 729206 - RNA, 19 nt, Homo sapiens
ggaggagcuuuaucuuuau

SEQ ID NO: 729207 - RNA, 19 nt, Homo sapiens
uguuaggccuguuacauua

SEQ ID NO: 729208 - RNA, 19 nt, Homo sapiens
gcaagaaauauuccauuga

SEQ ID NO: 729209 - RNA, 19 nt, Homo sapiens
ccagguaacaggaauaauu

SEQ ID NO: 729210 - RNA, 19 nt, Homo sapiens
agaaugaggugguauuaca

SEQ ID NO: 729211 - RNA, 19 nt, Homo sapiens
cuacaaaucagcaagauau

SEQ ID NO: 729212 - RNA, 19 nt, Homo sapiens
gagcugaggcgguguaugu

SEQ ID NO: 729213 - RNA, 19 nt, Homo sapiens
gauaaacuccuaccuccaa

SEQ ID NO: 729214 - RNA, 19 nt, Homo sapiens
uaucagaaguucacauauc

SEQ ID NO: 729215 - RNA, 19 nt, Homo sapiens
guaauggacuauacaggau

SEQ ID NO: 729216 - RNA, 19 nt, Homo sapiens
gcaguaugcuuaaugaaaa

SEQ ID NO: 729217 - RNA, 19 nt, Homo sapiens
gguaucagaaguucacaua

SEQ ID NO: 729218 - RNA, 19 nt, Homo sapiens
gaagguaugaugcacaguu

SEQ ID NO: 729219 - RNA, 19 nt, Homo sapiens
ggacuauacaggauguuaa

SEQ ID NO: 729220 - RNA, 19 nt, Homo sapiens
cuucauagcaggccaagua

SEQ ID NO: 729221 - RNA, 19 nt, Homo sapiens
aauaauaucuccucaugag

SEQ ID NO: 729222 - RNA, 19 nt, Homo sapiens
uagagaaaccagacauuaa

SEQ ID NO: 729223 - RNA, 19 nt, Homo sapiens
uaauaagaaugagguggua

SEQ ID NO: 729224 - RNA, 19 nt, Homo sapiens
ugauggaugucaagcaauu

SEQ ID NO: 729225 - RNA, 19 nt, Homo sapiens
gauuucaucuucucauagu

SEQ ID NO: 729226 - RNA, 19 nt, Homo sapiens
uaagaaugaggugguauua

SEQ ID NO: 729227 - RNA, 19 nt, Homo sapiens
agagaaaccagacauuaaa

SEQ ID NO: 729228 - RNA, 19 nt, Homo sapiens
guaguagaguguaaaccuu

SEQ ID NO: 729229 - RNA, 19 nt, Homo sapiens
ggcuaugccuucaugguuu

SEQ ID NO: 729230 - RNA, 19 nt, Homo sapiens
guaauaaaggcuagucaga

SEQ ID NO: 729231 - RNA, 19 nt, Homo sapiens
gcacuacuuauuucgaauu

SEQ ID NO: 729232 - RNA, 19 nt, Homo sapiens
cagcuacugucaauacaug

SEQ ID NO: 729233 - RNA, 19 nt, Homo sapiens
cauagcaggccaaguauug

SEQ ID NO: 729234 - RNA, 19 nt, Homo sapiens
gucagaacccuauaccaua

SEQ ID NO: 729235 - RNA, 19 nt, Homo sapiens
aaacuucaugcacuacuua

SEQ ID NO: 729236 - RNA, 19 nt, Homo sapiens
gaucaagaagugaagaaug

SEQ ID NO: 729237 - RNA, 19 nt, Homo sapiens
cugcauggauugggagaua

SEQ ID NO: 729238 - RNA, 19 nt, Homo sapiens
aaugggugcuaauugauaa

SEQ ID NO: 729239 - RNA, 19 nt, Homo sapiens
ugauauuucucaacugugu

SEQ ID NO: 729240 - RNA, 19 nt, Homo sapiens
cuucaugcacuacuuauuu

SEQ ID NO: 729241 - RNA, 19 nt, Homo sapiens
agguauaaaugagcaguua

SEQ ID NO: 729242 - RNA, 19 nt, Homo sapiens
gcuaugccuucaugguuug

SEQ ID NO: 729243 - RNA, 19 nt, Homo sapiens
uaauaaaggcuagucagaa

SEQ ID NO: 729244 - RNA, 19 nt, Homo sapiens
caacccagguaacaggaau

SEQ ID NO: 729245 - RNA, 19 nt, Homo sapiens
ucgaauuacuguaccuuau

SEQ ID NO: 729246 - RNA, 19 nt, Homo sapiens
auagagaaaccagacauua

SEQ ID NO: 729247 - RNA, 19 nt, Homo sapiens
cagaagccuuugcagguau

SEQ ID NO: 729248 - RNA, 19 nt, Homo sapiens
aaugauggaugucaagcaa

SEQ ID NO: 729249 - RNA, 19 nt, Homo sapiens
uggcauuccuucuaacaga

SEQ ID NO: 729250 - RNA, 19 nt, Homo sapiens
gcuguaacaugggaaagug

SEQ ID NO: 729251 - RNA, 19 nt, Homo sapiens
cagaaguucacauaucaaa

SEQ ID NO: 729252 - RNA, 19 nt, Homo sapiens
caaauuuacaccuagcuau

SEQ ID NO: 729253 - RNA, 19 nt, Homo sapiens
aaaugggugcuaauugaua

SEQ ID NO: 729254 - RNA, 19 nt, Homo sapiens
aauaaaggcuagucagaac

SEQ ID NO: 729255 - RNA, 19 nt, Homo sapiens
uauaaaugggugcuaauug

SEQ ID NO: 729256 - RNA, 19 nt, Homo sapiens
uaucgguggugcuaauaga

SEQ ID NO: 729257 - RNA, 19 nt, Homo sapiens
gaaacuggcaggugucacu

SEQ ID NO: 729258 - RNA, 19 nt, Homo sapiens
gaauuacuguaccuuaucc

SEQ ID NO: 729259 - RNA, 19 nt, Homo sapiens
gcuguaauuugacauucug

SEQ ID NO: 729260 - RNA, 19 nt, Homo sapiens
cagcaucauuguaguagag

SEQ ID NO: 729261 - RNA, 19 nt, Homo sapiens
gaggccuuguguagaagua

SEQ ID NO: 729262 - RNA, 19 nt, Homo sapiens
ucacuaagaggccuugugu

SEQ ID NO: 729263 - RNA, 19 nt, Homo sapiens
aaacuccuaccuccaauug

SEQ ID NO: 729264 - RNA, 19 nt, Homo sapiens
ggaugucaagcaauucauu

SEQ ID NO: 729265 - RNA, 19 nt, Homo sapiens
gauuaaacaggcagcagaa

SEQ ID NO: 729266 - RNA, 19 nt, Homo sapiens
uacuguaccuuauccaaau

SEQ ID NO: 729267 - RNA, 19 nt, Homo sapiens
cgacccaggaucuacuaua

SEQ ID NO: 729268 - RNA, 19 nt, Homo sapiens
cagauucacaggaggauga

SEQ ID NO: 729269 - RNA, 19 nt, Homo sapiens
gggaaaguguaaauguuuu

SEQ ID NO: 729270 - RNA, 19 nt, Homo sapiens
ugggaaaguguaaauguuu

SEQ ID NO: 729271 - RNA, 19 nt, Homo sapiens
ggugcuaauugauaaugga

SEQ ID NO: 729272 - RNA, 19 nt, Homo sapiens
cauaaaguguaguuaccau

SEQ ID NO: 729273 - RNA, 19 nt, Homo sapiens
gccaguggacuuauuugaa

SEQ ID NO: 729274 - RNA, 19 nt, Homo sapiens
ggccaaguauugccucucu

SEQ ID NO: 729275 - RNA, 19 nt, Homo sapiens
ggaaaugauggaugucaag

SEQ ID NO: 729276 - RNA, 19 nt, Homo sapiens
aacaggaaaugauggaugu

SEQ ID NO: 729277 - RNA, 19 nt, Homo sapiens
uuaggccuguuacauuaaa

SEQ ID NO: 729278 - RNA, 19 nt, Homo sapiens
uaauggcccuuuuauuuug

SEQ ID NO: 729279 - RNA, 19 nt, Homo sapiens
auacugcccuuaccacaca

SEQ ID NO: 729280 - RNA, 19 nt, Homo sapiens
augaggugguauuacauua

SEQ ID NO: 729281 - RNA, 19 nt, Homo sapiens
ugauugacgucacuaagag

SEQ ID NO: 729282 - RNA, 19 nt, Homo sapiens
ccaaauuuacaccuagcua

SEQ ID NO: 729283 - RNA, 19 nt, Homo sapiens
ccaugcagugucuguauuu

SEQ ID NO: 729284 - RNA, 19 nt, Homo sapiens
gguauaaaugagcaguuaa

SEQ ID NO: 729285 - RNA, 19 nt, Homo sapiens
caugcccagucuucaaauu

SEQ ID NO: 729286 - RNA, 19 nt, Homo sapiens
uaaauaugaacguggcuau

SEQ ID NO: 729287 - RNA, 19 nt, Homo sapiens
ucauuguaguagaguguaa

SEQ ID NO: 729288 - RNA, 19 nt, Homo sapiens
ggacaggccuugcccucaa

SEQ ID NO: 729289 - RNA, 19 nt, Homo sapiens
ggugaaggcuuugcugaaa

SEQ ID NO: 729290 - RNA, 19 nt, Homo sapiens
ugacuucauugaucucuaa

SEQ ID NO: 729291 - RNA, 19 nt, Homo sapiens
uauggucgcuggccaguga

SEQ ID NO: 729292 - RNA, 19 nt, Homo sapiens
ggauucugguugcaauaaa

SEQ ID NO: 729293 - RNA, 19 nt, Homo sapiens
guggacaucuggaggauuc

SEQ ID NO: 729294 - RNA, 19 nt, Homo sapiens
ccacugacuucauugaucu

SEQ ID NO: 729295 - RNA, 19 nt, Homo sapiens
gcaugcagauccccacaua

SEQ ID NO: 729296 - RNA, 19 nt, Homo sapiens
ggacuuccgccacaccauu

SEQ ID NO: 729297 - RNA, 19 nt, Homo sapiens
caagaucccaccuguaugg

SEQ ID NO: 729298 - RNA, 19 nt, Homo sapiens
gcaagggcaagaaggagaa

SEQ ID NO: 729299 - RNA, 19 nt, Homo sapiens
aagaauaaccacaaagugu

SEQ ID NO: 729300 - RNA, 19 nt, Homo sapiens
cccaagaucccaccuguau

SEQ ID NO: 729301 - RNA, 19 nt, Homo sapiens
ccaucgcuuuccucugaua

SEQ ID NO: 729302 - RNA, 19 nt, Homo sapiens
ccaaggugcccaucuaucu

SEQ ID NO: 729303 - RNA, 19 nt, Homo sapiens
gggauucugguugcaauaa

SEQ ID NO: 729304 - RNA, 19 nt, Homo sapiens
ggagucagggucccaagau

SEQ ID NO: 729305 - RNA, 19 nt, Homo sapiens
cuucauugaucucuaaucu

SEQ ID NO: 729306 - RNA, 19 nt, Homo sapiens
ccucaucccuagcuccaau

SEQ ID NO: 729307 - RNA, 19 nt, Homo sapiens
acaauacuccuucuuccuu

SEQ ID NO: 729308 - RNA, 19 nt, Homo sapiens
ggaggggccugaagaagau

SEQ ID NO: 729309 - RNA, 19 nt, Homo sapiens
caacaggagcaaaccaagu

SEQ ID NO: 729310 - RNA, 19 nt, Homo sapiens
cuaccuuucuggcuucaau

SEQ ID NO: 729311 - RNA, 19 nt, Homo sapiens
gagggaguguggacaucug

SEQ ID NO: 729312 - RNA, 19 nt, Homo sapiens
caaguaacccucggugaca

SEQ ID NO: 729313 - RNA, 19 nt, Homo sapiens
gucccugggugaaggcuuu

SEQ ID NO: 729314 - RNA, 19 nt, Homo sapiens
uggaugauguccugcagau

SEQ ID NO: 729315 - RNA, 19 nt, Homo sapiens
aaagaauaaccacaaagug

SEQ ID NO: 729316 - RNA, 19 nt, Homo sapiens
gagucagggucccaagauc

SEQ ID NO: 729317 - RNA, 19 nt, Homo sapiens
ccaucucccucccgguuau

SEQ ID NO: 729318 - RNA, 19 nt, Homo sapiens
ccccaucgcuuuccucuga

SEQ ID NO: 729319 - RNA, 19 nt, Homo sapiens
gaaugcaacaggagcaaac

SEQ ID NO: 729320 - RNA, 19 nt, Homo sapiens
agaagaguuugccguccuu

SEQ ID NO: 729321 - RNA, 19 nt, Homo sapiens
gggugaaggcuuugcugaa

SEQ ID NO: 729322 - RNA, 19 nt, Homo sapiens
auucagauguuuggcaaga

SEQ ID NO: 729323 - RNA, 19 nt, Homo sapiens
gauucugguugcaauaaaa

SEQ ID NO: 729324 - RNA, 19 nt, Homo sapiens
gaagaguuugccguccuuu

SEQ ID NO: 729325 - RNA, 19 nt, Homo sapiens
gugaaggcuuugcugaaac

SEQ ID NO: 729326 - RNA, 19 nt, Homo sapiens
gggagggaguguggacauc

SEQ ID NO: 729327 - RNA, 19 nt, Homo sapiens
gccaucucccucccgguua

SEQ ID NO: 729328 - RNA, 19 nt, Homo sapiens
cccacugacuucauugauc

SEQ ID NO: 729329 - RNA, 19 nt, Homo sapiens
aaaccaaguguugcuguga

SEQ ID NO: 729330 - RNA, 19 nt, Homo sapiens
gagaaugcaacaggagcaa

SEQ ID NO: 729331 - RNA, 19 nt, Homo sapiens
gagccugucaugagaaugc

SEQ ID NO: 729332 - RNA, 19 nt, Homo sapiens
caaggugcccaucuaucug

SEQ ID NO: 729333 - RNA, 19 nt, Homo sapiens
acacaguuccuaccuuucu

SEQ ID NO: 729334 - RNA, 19 nt, Homo sapiens
gaaccgagcuggcuugcua

SEQ ID NO: 729335 - RNA, 19 nt, Homo sapiens
gauaggagguuacagaguu

SEQ ID NO: 729336 - RNA, 19 nt, Homo sapiens
ucagaucacuuuccaguug

SEQ ID NO: 729337 - RNA, 19 nt, Homo sapiens
gagaagaacugugaaagag

SEQ ID NO: 729338 - RNA, 19 nt, Homo sapiens
gaacaaacagaagugauuu

SEQ ID NO: 729339 - RNA, 19 nt, Homo sapiens
gcacugagacuguggaguu

SEQ ID NO: 729340 - RNA, 19 nt, Homo sapiens
gagccaauucuguauaaua

SEQ ID NO: 729341 - RNA, 19 nt, Homo sapiens
cuaauacaguuccaaggua

SEQ ID NO: 729342 - RNA, 19 nt, Homo sapiens
ggagaagaacugugaaaga

SEQ ID NO: 729343 - RNA, 19 nt, Homo sapiens
uuacagaguuugcaguuug

SEQ ID NO: 729344 - RNA, 19 nt, Homo sapiens
uaaaguauccaguggugua

SEQ ID NO: 729345 - RNA, 19 nt, Homo sapiens
ugaauacuguucuugcaaa

SEQ ID NO: 729346 - RNA, 19 nt, Homo sapiens
gaacccugaugauggagaa

SEQ ID NO: 729347 - RNA, 19 nt, Homo sapiens
ggagagaacccugaugaug

SEQ ID NO: 729348 - RNA, 19 nt, Homo sapiens
gcugacugcuggaagauga

SEQ ID NO: 729349 - RNA, 19 nt, Homo sapiens
gcacauacacaaucauagu

SEQ ID NO: 729350 - RNA, 19 nt, Homo sapiens
cuacagguuuauauccaua

SEQ ID NO: 729351 - RNA, 19 nt, Homo sapiens
gaagacauaugagcuacuc

SEQ ID NO: 729352 - RNA, 19 nt, Homo sapiens
gcaguuugguuccaugcuu

SEQ ID NO: 729353 - RNA, 19 nt, Homo sapiens
cagcagugauccuauuguu

SEQ ID NO: 729354 - RNA, 19 nt, Homo sapiens
ggcuuuagcucccagauuc

SEQ ID NO: 729355 - RNA, 19 nt, Homo sapiens
gaaagagagcagucaggaa

SEQ ID NO: 729356 - RNA, 19 nt, Homo sapiens
ccaguuggauguaugaaag

SEQ ID NO: 729357 - RNA, 19 nt, Homo sapiens
ccaaagugcugggauuaca

SEQ ID NO: 729358 - RNA, 19 nt, Homo sapiens
gaugaucuuucugcacuga

SEQ ID NO: 729359 - RNA, 19 nt, Homo sapiens
agagaacccugaugaugga

SEQ ID NO: 729360 - RNA, 19 nt, Homo sapiens
ugaacaaacagaagugauu

SEQ ID NO: 729361 - RNA, 19 nt, Homo sapiens
gcagugauccuauuguuuu

SEQ ID NO: 729362 - RNA, 19 nt, Homo sapiens
gcccagcagugauccuauu

SEQ ID NO: 729363 - RNA, 19 nt, Homo sapiens
gacaagcacaagucuauau

SEQ ID NO: 729364 - RNA, 19 nt, Homo sapiens
ggaggcggguggaucacuu

SEQ ID NO: 729365 - RNA, 19 nt, Homo sapiens
ggagagauaaggcaaugug

SEQ ID NO: 729366 - RNA, 19 nt, Homo sapiens
aaagagagcagucaggaau

SEQ ID NO: 729367 - RNA, 19 nt, Homo sapiens
caaggucaguguggaguau

SEQ ID NO: 729368 - RNA, 19 nt, Homo sapiens
ccucaugguucaacuuuua

SEQ ID NO: 729369 - RNA, 19 nt, Homo sapiens
gauaucacccaccagaguu

SEQ ID NO: 729370 - RNA, 19 nt, Homo sapiens
ccacagccuuugaggaagu

SEQ ID NO: 729371 - RNA, 19 nt, Homo sapiens
cagaaccuuugaccgcuuu

SEQ ID NO: 729372 - RNA, 19 nt, Homo sapiens
ccacaagaguuuccccuuu

SEQ ID NO: 729373 - RNA, 19 nt, Homo sapiens
gugacaagcacaagucuau

SEQ ID NO: 729374 - RNA, 19 nt, Homo sapiens
ugagcugacugcuggaaga

SEQ ID NO: 729375 - RNA, 19 nt, Homo sapiens
gcaaggucaguguggagua

SEQ ID NO: 729376 - RNA, 19 nt, Homo sapiens
uuaagaauccaguaucaga

SEQ ID NO: 729377 - RNA, 19 nt, Homo sapiens
gcucccagauucccaugug

SEQ ID NO: 729378 - RNA, 19 nt, Homo sapiens
ggacagauaggagguuaca

SEQ ID NO: 729379 - RNA, 19 nt, Homo sapiens
uaccacagccuuugaggaa

SEQ ID NO: 729380 - RNA, 19 nt, Homo sapiens
cgaauucccagaaccuuug

SEQ ID NO: 729381 - RNA, 19 nt, Homo sapiens
caagcacaagucuauauug

SEQ ID NO: 729382 - RNA, 19 nt, Homo sapiens
cauaguaaauuggcagaag

SEQ ID NO: 729383 - RNA, 19 nt, Homo sapiens
caggaaugcuaguggugaa

SEQ ID NO: 729384 - RNA, 19 nt, Homo sapiens
caguuugguuccaugcuuu

SEQ ID NO: 729385 - RNA, 19 nt, Homo sapiens
acagauaggagguuacaga

SEQ ID NO: 729386 - RNA, 19 nt, Homo sapiens
ggacuucagggacagauag

SEQ ID NO: 729387 - RNA, 19 nt, Homo sapiens
gagauaaggcaaugugcau

SEQ ID NO: 729388 - RNA, 19 nt, Homo sapiens
cggcacauacacaaucaua

SEQ ID NO: 729389 - RNA, 19 nt, Homo sapiens
guuacagaguuugcaguuu

SEQ ID NO: 729390 - RNA, 19 nt, Homo sapiens
gcuccucccacaagaguuu

SEQ ID NO: 729391 - RNA, 19 nt, Homo sapiens
gaauacuguucuugcaaac

SEQ ID NO: 729392 - RNA, 19 nt, Homo sapiens
auaguaaauuggcagaaga

SEQ ID NO: 729393 - RNA, 19 nt, Homo sapiens
cacauacacaaucauagua

SEQ ID NO: 729394 - RNA, 19 nt, Homo sapiens
ggccagugauggauucaag

SEQ ID NO: 729395 - RNA, 19 nt, Homo sapiens
gaaaccagaaacuguugau

SEQ ID NO: 729396 - RNA, 19 nt, Homo sapiens
gaagguaauuaagaaucca

SEQ ID NO: 729397 - RNA, 19 nt, Homo sapiens
aaaucugucucucucugaa

SEQ ID NO: 729398 - RNA, 19 nt, Homo sapiens
auagauuccuggcuagaug

SEQ ID NO: 729399 - RNA, 19 nt, Homo sapiens
guuuauauccauacacaga

SEQ ID NO: 729400 - RNA, 19 nt, Homo sapiens
ggugguagcggcacauaca

SEQ ID NO: 729401 - RNA, 19 nt, Homo sapiens
aaacugaacaaacagaagu

SEQ ID NO: 729402 - RNA, 19 nt, Homo sapiens
ugauggagaagaacuguga

SEQ ID NO: 729403 - RNA, 19 nt, Homo sapiens
auaggagguuacagaguuu

SEQ ID NO: 729404 - RNA, 19 nt, Homo sapiens
aaacuuaccacagccuuug

SEQ ID NO: 729405 - RNA, 19 nt, Homo sapiens
uccaguaucagaucacuuu

SEQ ID NO: 729406 - RNA, 19 nt, Homo sapiens
aaggagagaacccugauga

SEQ ID NO: 729407 - RNA, 19 nt, Homo sapiens
cagauucccaugugcuaaa

SEQ ID NO: 729408 - RNA, 19 nt, Homo sapiens
ggaggccguaggcuuauug

SEQ ID NO: 729409 - RNA, 19 nt, Homo sapiens
uaugaauacuguucuugca

SEQ ID NO: 729410 - RNA, 19 nt, Homo sapiens
gcuacagguuuauauccau

SEQ ID NO: 729411 - RNA, 19 nt, Homo sapiens
cgaggccagugauggauuc

SEQ ID NO: 729412 - RNA, 19 nt, Homo sapiens
gguaauuaagaauccagua

SEQ ID NO: 729413 - RNA, 19 nt, Homo sapiens
ccuguaaucccagcacuuu

SEQ ID NO: 729414 - RNA, 19 nt, Homo sapiens
uaaaucugucucucucuga

SEQ ID NO: 729415 - RNA, 19 nt, Homo sapiens
ugacaagcacaagucuaua

SEQ ID NO: 729416 - RNA, 19 nt, Homo sapiens
caagguagggaagacauau

SEQ ID NO: 729417 - RNA, 19 nt, Homo sapiens
ucauuugacaguaguagaa

SEQ ID NO: 729418 - RNA, 19 nt, Homo sapiens
ucaagguagggaagacaua

SEQ ID NO: 729419 - RNA, 19 nt, Homo sapiens
agaguuugcugaugcugau

SEQ ID NO: 729420 - RNA, 19 nt, Homo sapiens
ccaccagaguuugcugaug

SEQ ID NO: 729421 - RNA, 19 nt, Homo sapiens
ccaucccgguugucaguga

SEQ ID NO: 729422 - RNA, 19 nt, Homo sapiens
cagaagcuuuugaagguaa

SEQ ID NO: 729423 - RNA, 19 nt, Homo sapiens
acaagcacaagucuauauu

SEQ ID NO: 729424 - RNA, 19 nt, Homo sapiens
ggccucaugguucaacuuu

SEQ ID NO: 729425 - RNA, 19 nt, Homo sapiens
cuauauuguugaagaaugg

SEQ ID NO: 729426 - RNA, 19 nt, Homo sapiens
gugccuguauucccaaagu

SEQ ID NO: 729427 - RNA, 19 nt, Homo sapiens
caugguggcgugccuguau

SEQ ID NO: 729428 - RNA, 19 nt, Homo sapiens
gguuacagaguuugcaguu

SEQ ID NO: 729429 - RNA, 19 nt, Homo sapiens
agggacagauaggagguua

SEQ ID NO: 729430 - RNA, 19 nt, Homo sapiens
cacugagacuguggaguuu

SEQ ID NO: 729431 - RNA, 19 nt, Homo sapiens
agaauccaguaucagauca

SEQ ID NO: 729432 - RNA, 19 nt, Homo sapiens
uggccaacguggugaaauc

SEQ ID NO: 729433 - RNA, 19 nt, Homo sapiens
agaaacuguugaugucaca

SEQ ID NO: 729434 - RNA, 19 nt, Homo sapiens
uaagaauggugcuaaagua

SEQ ID NO: 729435 - RNA, 19 nt, Homo sapiens
gaagaggagugcaaauuca

SEQ ID NO: 729436 - RNA, 19 nt, Homo sapiens
gggaaugggccaccaguua

SEQ ID NO: 729437 - RNA, 19 nt, Homo sapiens
ggagagaagucugccacua

SEQ ID NO: 729438 - RNA, 19 nt, Homo sapiens
ggaaugggccaccaguuaa

SEQ ID NO: 729439 - RNA, 19 nt, Homo sapiens
gagaagaggagugcaaauu

SEQ ID NO: 729440 - RNA, 19 nt, Homo sapiens
ggaaacccuuggaagauca

SEQ ID NO: 729441 - RNA, 19 nt, Homo sapiens
ucauggagauccucaaugu

SEQ ID NO: 729442 - RNA, 19 nt, Homo sapiens
gagagaagucugccacuau

SEQ ID NO: 729443 - RNA, 19 nt, Homo sapiens
gaauggugcuaaaguaaaa

SEQ ID NO: 729444 - RNA, 19 nt, Homo sapiens
uggaugaacuugacaugga

SEQ ID NO: 729445 - RNA, 19 nt, Homo sapiens
ccucggcaccugcuacuua

SEQ ID NO: 729446 - RNA, 19 nt, Homo sapiens
gggaaacccuuggaagauc

SEQ ID NO: 729447 - RNA, 19 nt, Homo sapiens
ggaagaguuugaggacaug

SEQ ID NO: 729448 - RNA, 19 nt, Homo sapiens
agagaagucugccacuaug

SEQ ID NO: 729449 - RNA, 19 nt, Homo sapiens
gguuaaaggcgcuuauuuc

SEQ ID NO: 729450 - RNA, 19 nt, Homo sapiens
caaugugacccucuacuau

SEQ ID NO: 729451 - RNA, 19 nt, Homo sapiens
caagacaggcaaucuauac

SEQ ID NO: 729452 - RNA, 19 nt, Homo sapiens
cuacaagacaggcaaucua

SEQ ID NO: 729453 - RNA, 19 nt, Homo sapiens
ggccaccaguuaacuacaa

SEQ ID NO: 729454 - RNA, 19 nt, Homo sapiens
ucaaugugacccucuacua

SEQ ID NO: 729455 - RNA, 19 nt, Homo sapiens
gcaagcguuagacuucuuu

SEQ ID NO: 729456 - RNA, 19 nt, Homo sapiens
gcaggugggaguucaagug

SEQ ID NO: 729457 - RNA, 19 nt, Homo sapiens
aagaauggugcuaaaguaa

SEQ ID NO: 729458 - RNA, 19 nt, Homo sapiens
uggaagaguuugaggacau

SEQ ID NO: 729459 - RNA, 19 nt, Homo sapiens
augcaccgcuugucaaugu

SEQ ID NO: 729460 - RNA, 19 nt, Homo sapiens
agaagaggagugcaaauuc

SEQ ID NO: 729461 - RNA, 19 nt, Homo sapiens
cuacggaaacgcacaggaa

SEQ ID NO: 729462 - RNA, 19 nt, Homo sapiens
agaauggugcuaaaguaaa

SEQ ID NO: 729463 - RNA, 19 nt, Homo sapiens
ggaaacgcacaggaacaaa

SEQ ID NO: 729464 - RNA, 19 nt, Homo sapiens
uaucauggagugugcaaug

SEQ ID NO: 729465 - RNA, 19 nt, Homo sapiens
gaaacgcacaggaacaaaa

SEQ ID NO: 729466 - RNA, 19 nt, Homo sapiens
ccaaugcaccgcuugucaa

SEQ ID NO: 729467 - RNA, 19 nt, Homo sapiens
acaagacaggcaaucuaua

SEQ ID NO: 729468 - RNA, 19 nt, Homo sapiens
cacuaugccugcagcucua

SEQ ID NO: 729469 - RNA, 19 nt, Homo sapiens
cuaagaauggugcuaaagu

SEQ ID NO: 729470 - RNA, 19 nt, Homo sapiens
ggagaagaggagugcaaau

SEQ ID NO: 729471 - RNA, 19 nt, Homo sapiens
gcaccgcuugucaauguga

SEQ ID NO: 729472 - RNA, 19 nt, Homo sapiens
ggucauggagauccucaau

SEQ ID NO: 729473 - RNA, 19 nt, Homo sapiens
uacaagacaggcaaucuau

SEQ ID NO: 729474 - RNA, 19 nt, Homo sapiens
ggagugcaaauucaacaag

SEQ ID NO: 729475 - RNA, 19 nt, Homo sapiens
caagugccagcauggagaa

SEQ ID NO: 729476 - RNA, 19 nt, Homo sapiens
gaggagugcaaauucaaca

SEQ ID NO: 729477 - RNA, 19 nt, Homo sapiens
caaugcaccgcuugucaau

SEQ ID NO: 729478 - RNA, 19 nt, Homo sapiens
caggaguguuugcuucaag

SEQ ID NO: 729479 - RNA, 19 nt, Homo sapiens
augugacccucuacuauga

SEQ ID NO: 729480 - RNA, 19 nt, Homo sapiens
gaguguuugcuucaaguga

SEQ ID NO: 729481 - RNA, 19 nt, Homo sapiens
ucaggaguguuugcuucaa

SEQ ID NO: 729482 - RNA, 19 nt, Homo sapiens
gaaugggccaccaguuaac

SEQ ID NO: 729483 - RNA, 19 nt, Homo sapiens
aaugugacccucuacuaug

SEQ ID NO: 729484 - RNA, 19 nt, Homo sapiens
ugucgccacuucugcuguu

SEQ ID NO: 729485 - RNA, 19 nt, Homo sapiens
gcacaggaacaaaauguca

SEQ ID NO: 729486 - RNA, 19 nt, Homo sapiens
ugguuaaaggcgcuuauuu

SEQ ID NO: 729487 - RNA, 19 nt, Homo sapiens
cggaaacgcacaggaacaa

SEQ ID NO: 729488 - RNA, 19 nt, Homo sapiens
guuaaaggcgcuuauuucc

SEQ ID NO: 729489 - RNA, 19 nt, Homo sapiens
caugaagcccagauacaca

SEQ ID NO: 729490 - RNA, 19 nt, Homo sapiens
ggucaccgucaaugggaaa

SEQ ID NO: 729491 - RNA, 19 nt, Homo sapiens
uugaggacauggagagaag

SEQ ID NO: 729492 - RNA, 19 nt, Homo sapiens
gaaauaagguuguauguug

SEQ ID NO: 729493 - RNA, 19 nt, Homo sapiens
gaaaugaguuguugcagaa

SEQ ID NO: 729494 - RNA, 19 nt, Homo sapiens
ggaaauaacagacaagaaa

SEQ ID NO: 729495 - RNA, 19 nt, Homo sapiens
ggacagaggugcagcuuca

SEQ ID NO: 729496 - RNA, 19 nt, Homo sapiens
gaacagagucaaggaaaua

SEQ ID NO: 729497 - RNA, 19 nt, Homo sapiens
ggaaagaaucagaguauau

SEQ ID NO: 729498 - RNA, 19 nt, Homo sapiens
ucuguaggcugaaauuaua

SEQ ID NO: 729499 - RNA, 19 nt, Homo sapiens
auaagcagcugugaaauuu

SEQ ID NO: 729500 - RNA, 19 nt, Homo sapiens
ugacuguacucucaauaaa

SEQ ID NO: 729501 - RNA, 19 nt, Homo sapiens
aagcagcugugaaauuuaa

SEQ ID NO: 729502 - RNA, 19 nt, Homo sapiens
caucaaaaguugccaauaa

SEQ ID NO: 729503 - RNA, 19 nt, Homo sapiens
caguagaaauucacgagua

SEQ ID NO: 729504 - RNA, 19 nt, Homo sapiens
ugaagacuauccaguagaa

SEQ ID NO: 729505 - RNA, 19 nt, Homo sapiens
gaaagcgugaaaugacuua

SEQ ID NO: 729506 - RNA, 19 nt, Homo sapiens
gggcaagguuuaaaugugu

SEQ ID NO: 729507 - RNA, 19 nt, Homo sapiens
aaacaggaauuggaaagaa

SEQ ID NO: 729508 - RNA, 19 nt, Homo sapiens
gaguauauaugaacagagu

SEQ ID NO: 729509 - RNA, 19 nt, Homo sapiens
caugaugacuguacucuca

SEQ ID NO: 729510 - RNA, 19 nt, Homo sapiens
uaaugaagacuauccagua

SEQ ID NO: 729511 - RNA, 19 nt, Homo sapiens
gcugugaaauuuaagugaa

SEQ ID NO: 729512 - RNA, 19 nt, Homo sapiens
cgaaggccgugagguauuu

SEQ ID NO: 729513 - RNA, 19 nt, Homo sapiens
gaaauuauagguacaucug

SEQ ID NO: 729514 - RNA, 19 nt, Homo sapiens
caugaugucuguuucuaga

SEQ ID NO: 729515 - RNA, 19 nt, Homo sapiens
ggaaauaagguuguauguu

SEQ ID NO: 729516 - RNA, 19 nt, Homo sapiens
cauaauggcaggugaagaa

SEQ ID NO: 729517 - RNA, 19 nt, Homo sapiens
gaugggaaauaagguugua

SEQ ID NO: 729518 - RNA, 19 nt, Homo sapiens
guauguugauggaugaauu

SEQ ID NO: 729519 - RNA, 19 nt, Homo sapiens
gguuguacuuuaauucuug

SEQ ID NO: 729520 - RNA, 19 nt, Homo sapiens
ggaauuacugcuuuguuga

SEQ ID NO: 729521 - RNA, 19 nt, Homo sapiens
ucaaggaaauaacagacaa

SEQ ID NO: 729522 - RNA, 19 nt, Homo sapiens
aauggcaggugaagaaauu

SEQ ID NO: 729523 - RNA, 19 nt, Homo sapiens
uaaauacuuuccucuccaa

SEQ ID NO: 729524 - RNA, 19 nt, Homo sapiens
uaaggaacauccaguaaaa

SEQ ID NO: 729525 - RNA, 19 nt, Homo sapiens
guacaucuguuuucacuau

SEQ ID NO: 729526 - RNA, 19 nt, Homo sapiens
uauaagcagcugugaaauu

SEQ ID NO: 729527 - RNA, 19 nt, Homo sapiens
ggaauuggaaagaaucaga

SEQ ID NO: 729528 - RNA, 19 nt, Homo sapiens
ugucagcguuugagaauuc

SEQ ID NO: 729529 - RNA, 19 nt, Homo sapiens
ggauuugguuucugcauac

SEQ ID NO: 729530 - RNA, 19 nt, Homo sapiens
aggaauuacugcuuuguug

SEQ ID NO: 729531 - RNA, 19 nt, Homo sapiens
uaugaaguaugcuaucugu

SEQ ID NO: 729532 - RNA, 19 nt, Homo sapiens
uggauuugguuucugcaua

SEQ ID NO: 729533 - RNA, 19 nt, Homo sapiens
gaugagacucuuauuucuu

SEQ ID NO: 729534 - RNA, 19 nt, Homo sapiens
uggaaagaaucagaguaua

SEQ ID NO: 729535 - RNA, 19 nt, Homo sapiens
cuaaggaacauccaguaaa

SEQ ID NO: 729536 - RNA, 19 nt, Homo sapiens
ugaaguaugcuaucuguag

SEQ ID NO: 729537 - RNA, 19 nt, Homo sapiens
aggugcagcuucaagauuu

SEQ ID NO: 729538 - RNA, 19 nt, Homo sapiens
uaagaaagcgugaaaugac

SEQ ID NO: 729539 - RNA, 19 nt, Homo sapiens
gcagggcaagguuuaaaug

SEQ ID NO: 729540 - RNA, 19 nt, Homo sapiens
cagaguauauaugaacaga

SEQ ID NO: 729541 - RNA, 19 nt, Homo sapiens
gccucuaugucccauuuaa

SEQ ID NO: 729542 - RNA, 19 nt, Homo sapiens
ugaacagagucaaggaaau

SEQ ID NO: 729543 - RNA, 19 nt, Homo sapiens
gaauuacugcuuuguugau

SEQ ID NO: 729544 - RNA, 19 nt, Homo sapiens
gaggugcagcuucaagauu

SEQ ID NO: 729545 - RNA, 19 nt, Homo sapiens
uuaagaaagcgugaaauga

SEQ ID NO: 729546 - RNA, 19 nt, Homo sapiens
uuuauaagcagcugugaaa

SEQ ID NO: 729547 - RNA, 19 nt, Homo sapiens
ugaugagacucuuauuucu

SEQ ID NO: 729548 - RNA, 19 nt, Homo sapiens
gcaggugaagaaauuaaug

SEQ ID NO: 729549 - RNA, 19 nt, Homo sapiens
aguagaaauucacgaguau

SEQ ID NO: 729550 - RNA, 19 nt, Homo sapiens
aaugaagacuauccaguag

SEQ ID NO: 729551 - RNA, 19 nt, Homo sapiens
caauaaaggcugaaaaugu

SEQ ID NO: 729552 - RNA, 19 nt, Homo sapiens
guuguauguugauggauga

SEQ ID NO: 729553 - RNA, 19 nt, Homo sapiens
gauuagcacugaggauuuu

SEQ ID NO: 729554 - RNA, 19 nt, Homo sapiens
agacuauccaguagaaauu

SEQ ID NO: 729555 - RNA, 19 nt, Homo sapiens
uaagcagcugugaaauuua

SEQ ID NO: 729556 - RNA, 19 nt, Homo sapiens
gguuucugcauacacauua

SEQ ID NO: 729557 - RNA, 19 nt, Homo sapiens
ggcugaaaauguuguauaa

SEQ ID NO: 729558 - RNA, 19 nt, Homo sapiens
gaugacuguacucucaaua

SEQ ID NO: 729559 - RNA, 19 nt, Homo sapiens
gcaagguuuaaauguguuu

SEQ ID NO: 729560 - RNA, 19 nt, Homo sapiens
ccuaaggaacauccaguaa

SEQ ID NO: 729561 - RNA, 19 nt, Homo sapiens
caggugaagaaauuaauga

SEQ ID NO: 729562 - RNA, 19 nt, Homo sapiens
gaccuuaugaaguaugcua

SEQ ID NO: 729563 - RNA, 19 nt, Homo sapiens
gcagcuucaagauuuguaa

SEQ ID NO: 729564 - RNA, 19 nt, Homo sapiens
uggaugagaugcugaagac

SEQ ID NO: 729565 - RNA, 19 nt, Homo sapiens
cgugaaaugacuuaaaugu

SEQ ID NO: 729566 - RNA, 19 nt, Homo sapiens
gcaaguaccauuuuauaag

SEQ ID NO: 729567 - RNA, 19 nt, Homo sapiens
ggugcagcuucaagauuug

SEQ ID NO: 729568 - RNA, 19 nt, Homo sapiens
gagaugcugaagaccauga

SEQ ID NO: 729569 - RNA, 19 nt, Homo sapiens
gggaaauaagguuguaugu

SEQ ID NO: 729570 - RNA, 19 nt, Homo sapiens
ugauuagcacugaggauuu

SEQ ID NO: 729571 - RNA, 19 nt, Homo sapiens
ggcaagguuuaaauguguu

SEQ ID NO: 729572 - RNA, 19 nt, Homo sapiens
cugcauacacauuaaauuc

SEQ ID NO: 729573 - RNA, 19 nt, Homo sapiens
agucgaaggccgugaggua

SEQ ID NO: 729574 - RNA, 19 nt, Homo sapiens
guauauaugaacagaguca

SEQ ID NO: 729575 - RNA, 19 nt, Homo sapiens
aacaggaauuggaaagaau

SEQ ID NO: 729576 - RNA, 19 nt, Homo sapiens
gaagacuauccaguagaaa

SEQ ID NO: 729577 - RNA, 19 nt, Homo sapiens
agcgugaaaugacuuaaau

SEQ ID NO: 729578 - RNA, 19 nt, Homo sapiens
aagaaagcgugaaaugacu

SEQ ID NO: 729579 - RNA, 19 nt, Homo sapiens
gaguauuugucagcguuug

SEQ ID NO: 729580 - RNA, 19 nt, Homo sapiens
uugaugagacucuuauuuc

SEQ ID NO: 729581 - RNA, 19 nt, Homo sapiens
cuugaugagacucuuauuu

SEQ ID NO: 729582 - RNA, 19 nt, Homo sapiens
gcacugaggauuuuaacau

SEQ ID NO: 729583 - RNA, 19 nt, Homo sapiens
uugccucuaugucccauuu

SEQ ID NO: 729584 - RNA, 19 nt, Homo sapiens
guagaaauucacgaguauu

SEQ ID NO: 729585 - RNA, 19 nt, Homo sapiens
aaaguugccaauaaaggaa

SEQ ID NO: 729586 - RNA, 19 nt, Homo sapiens
guuucugcauacacauuaa

SEQ ID NO: 729587 - RNA, 19 nt, Homo sapiens
aagguuguauguugaugga

SEQ ID NO: 729588 - RNA, 19 nt, Homo sapiens
uaucuguaggcugaaauua

SEQ ID NO: 729589 - RNA, 19 nt, Homo sapiens
acuguacucucaauaaagg

SEQ ID NO: 729590 - RNA, 19 nt, Homo sapiens
ccauuggugcuguggauga

SEQ ID NO: 729591 - RNA, 19 nt, Homo sapiens
ggugaagaaauuaaugaag

SEQ ID NO: 729592 - RNA, 19 nt, Homo sapiens
gaaauaagguuguauguug

SEQ ID NO: 729593 - RNA, 19 nt, Homo sapiens
gaaaugaguuguugcagaa

SEQ ID NO: 729594 - RNA, 19 nt, Homo sapiens
ggaaauaacagacaagaaa

SEQ ID NO: 729595 - RNA, 19 nt, Homo sapiens
ggacagaggugcagcuuca

SEQ ID NO: 729596 - RNA, 19 nt, Homo sapiens
gaacagagucaaggaaaua

SEQ ID NO: 729597 - RNA, 19 nt, Homo sapiens
ggaaagaaucagaguauau

SEQ ID NO: 729598 - RNA, 19 nt, Homo sapiens
ucuguaggcugaaauuaua

SEQ ID NO: 729599 - RNA, 19 nt, Homo sapiens
auaagcagcugugaaauuu

SEQ ID NO: 729600 - RNA, 19 nt, Homo sapiens
ugacuguacucucaauaaa

SEQ ID NO: 729601 - RNA, 19 nt, Homo sapiens
aagcagcugugaaauuuaa

SEQ ID NO: 729602 - RNA, 19 nt, Homo sapiens
caucaaaaguugccaauaa

SEQ ID NO: 729603 - RNA, 19 nt, Homo sapiens
caguagaaauucacgagua

SEQ ID NO: 729604 - RNA, 19 nt, Homo sapiens
ugaagacuauccaguagaa

SEQ ID NO: 729605 - RNA, 19 nt, Homo sapiens
gaaagcgugaaaugacuua

SEQ ID NO: 729606 - RNA, 19 nt, Homo sapiens
gggcaagguuuaaaugugu

SEQ ID NO: 729607 - RNA, 19 nt, Homo sapiens
aaacaggaauuggaaagaa

SEQ ID NO: 729608 - RNA, 19 nt, Homo sapiens
gaguauauaugaacagagu

SEQ ID NO: 729609 - RNA, 19 nt, Homo sapiens
caugaugacuguacucuca

SEQ ID NO: 729610 - RNA, 19 nt, Homo sapiens
uaaugaagacuauccagua

SEQ ID NO: 729611 - RNA, 19 nt, Homo sapiens
gcugugaaauuuaagugaa

SEQ ID NO: 729612 - RNA, 19 nt, Homo sapiens
gaaauuauagguacaucug

SEQ ID NO: 729613 - RNA, 19 nt, Homo sapiens
caugaugucuguuucuaga

SEQ ID NO: 729614 - RNA, 19 nt, Homo sapiens
ggaaauaagguuguauguu

SEQ ID NO: 729615 - RNA, 19 nt, Homo sapiens
cauaauggcaggugaagaa

SEQ ID NO: 729616 - RNA, 19 nt, Homo sapiens
gaugggaaauaagguugua

SEQ ID NO: 729617 - RNA, 19 nt, Homo sapiens
guauguugauggaugaauu

SEQ ID NO: 729618 - RNA, 19 nt, Homo sapiens
gguuguacuuuaauucuug

SEQ ID NO: 729619 - RNA, 19 nt, Homo sapiens
ggaauuacugcuuuguuga

SEQ ID NO: 729620 - RNA, 19 nt, Homo sapiens
aauggcaggugaagaaauu

SEQ ID NO: 729621 - RNA, 19 nt, Homo sapiens
ucaaggaaauaacagacaa

SEQ ID NO: 729622 - RNA, 19 nt, Homo sapiens
uaaauacuuuccucuccaa

SEQ ID NO: 729623 - RNA, 19 nt, Homo sapiens
uaaggaacauccaguaaaa

SEQ ID NO: 729624 - RNA, 19 nt, Homo sapiens
guacaucuguuuucacuau

SEQ ID NO: 729625 - RNA, 19 nt, Homo sapiens
uauaagcagcugugaaauu

SEQ ID NO: 729626 - RNA, 19 nt, Homo sapiens
ggaauuggaaagaaucaga

SEQ ID NO: 729627 - RNA, 19 nt, Homo sapiens
ugucagcguuugagaauuc

SEQ ID NO: 729628 - RNA, 19 nt, Homo sapiens
ggauuugguuucugcauac

SEQ ID NO: 729629 - RNA, 19 nt, Homo sapiens
aggaauuacugcuuuguug

SEQ ID NO: 729630 - RNA, 19 nt, Homo sapiens
uaugaaguaugcuaucugu

SEQ ID NO: 729631 - RNA, 19 nt, Homo sapiens
uggauuugguuucugcaua

SEQ ID NO: 729632 - RNA, 19 nt, Homo sapiens
gaugagacucuuauuucuu

SEQ ID NO: 729633 - RNA, 19 nt, Homo sapiens
uggaaagaaucagaguaua

SEQ ID NO: 729634 - RNA, 19 nt, Homo sapiens
cuaaggaacauccaguaaa

SEQ ID NO: 729635 - RNA, 19 nt, Homo sapiens
ugaaguaugcuaucuguag

SEQ ID NO: 729636 - RNA, 19 nt, Homo sapiens
aggugcagcuucaagauuu

SEQ ID NO: 729637 - RNA, 19 nt, Homo sapiens
uaagaaagcgugaaaugac

SEQ ID NO: 729638 - RNA, 19 nt, Homo sapiens
gcagggcaagguuuaaaug

SEQ ID NO: 729639 - RNA, 19 nt, Homo sapiens
cagaguauauaugaacaga

SEQ ID NO: 729640 - RNA, 19 nt, Homo sapiens
gccucuaugucccauuuaa

SEQ ID NO: 729641 - RNA, 19 nt, Homo sapiens
ugaacagagucaaggaaau

SEQ ID NO: 729642 - RNA, 19 nt, Homo sapiens
gaauuacugcuuuguugau

SEQ ID NO: 729643 - RNA, 19 nt, Homo sapiens
gaggugcagcuucaagauu

SEQ ID NO: 729644 - RNA, 19 nt, Homo sapiens
uuaagaaagcgugaaauga

SEQ ID NO: 729645 - RNA, 19 nt, Homo sapiens
uuuauaagcagcugugaaa

SEQ ID NO: 729646 - RNA, 19 nt, Homo sapiens
ugaugagacucuuauuucu

SEQ ID NO: 729647 - RNA, 19 nt, Homo sapiens
gcaggugaagaaauuaaug

SEQ ID NO: 729648 - RNA, 19 nt, Homo sapiens
aguagaaauucacgaguau

SEQ ID NO: 729649 - RNA, 19 nt, Homo sapiens
aaugaagacuauccaguag

SEQ ID NO: 729650 - RNA, 19 nt, Homo sapiens
ggccgugagucagccauaa

SEQ ID NO: 729651 - RNA, 19 nt, Homo sapiens
caauaaaggcugaaaaugu

SEQ ID NO: 729652 - RNA, 19 nt, Homo sapiens
guuguauguugauggauga

SEQ ID NO: 729653 - RNA, 19 nt, Homo sapiens
gauuagcacugaggauuuu

SEQ ID NO: 729654 - RNA, 19 nt, Homo sapiens
uaagcagcugugaaauuua

SEQ ID NO: 729655 - RNA, 19 nt, Homo sapiens
agacuauccaguagaaauu

SEQ ID NO: 729656 - RNA, 19 nt, Homo sapiens
gguuucugcauacacauua

SEQ ID NO: 729657 - RNA, 19 nt, Homo sapiens
ggcugaaaauguuguauaa

SEQ ID NO: 729658 - RNA, 19 nt, Homo sapiens
gaugacuguacucucaaua

SEQ ID NO: 729659 - RNA, 19 nt, Homo sapiens
gcaagguuuaaauguguuu

SEQ ID NO: 729660 - RNA, 19 nt, Homo sapiens
ccuaaggaacauccaguaa

SEQ ID NO: 729661 - RNA, 19 nt, Homo sapiens
gaccuuaugaaguaugcua

SEQ ID NO: 729662 - RNA, 19 nt, Homo sapiens
uggaugagaugcugaagac

SEQ ID NO: 729663 - RNA, 19 nt, Homo sapiens
gcagcuucaagauuuguaa

SEQ ID NO: 729664 - RNA, 19 nt, Homo sapiens
caggugaagaaauuaauga

SEQ ID NO: 729665 - RNA, 19 nt, Homo sapiens
cgugaaaugacuuaaaugu

SEQ ID NO: 729666 - RNA, 19 nt, Homo sapiens
gcaaguaccauuuuauaag

SEQ ID NO: 729667 - RNA, 19 nt, Homo sapiens
ggugcagcuucaagauuug

SEQ ID NO: 729668 - RNA, 19 nt, Homo sapiens
gggaaauaagguuguaugu

SEQ ID NO: 729669 - RNA, 19 nt, Homo sapiens
ugauuagcacugaggauuu

SEQ ID NO: 729670 - RNA, 19 nt, Homo sapiens
ggcaagguuuaaauguguu

SEQ ID NO: 729671 - RNA, 19 nt, Homo sapiens
gagaugcugaagaccauga

SEQ ID NO: 729672 - RNA, 19 nt, Homo sapiens
cugcauacacauuaaauuc

SEQ ID NO: 729673 - RNA, 19 nt, Homo sapiens
guauauaugaacagaguca

SEQ ID NO: 729674 - RNA, 19 nt, Homo sapiens
aacaggaauuggaaagaau

SEQ ID NO: 729675 - RNA, 19 nt, Homo sapiens
gaagacuauccaguagaaa

SEQ ID NO: 729676 - RNA, 19 nt, Homo sapiens
agcgugaaaugacuuaaau

SEQ ID NO: 729677 - RNA, 19 nt, Homo sapiens
aagaaagcgugaaaugacu

SEQ ID NO: 729678 - RNA, 19 nt, Homo sapiens
gaguauuugucagcguuug

SEQ ID NO: 729679 - RNA, 19 nt, Homo sapiens
uugaugagacucuuauuuc

SEQ ID NO: 729680 - RNA, 19 nt, Homo sapiens
cuugaugagacucuuauuu

SEQ ID NO: 729681 - RNA, 19 nt, Homo sapiens
gcacugaggauuuuaacau

SEQ ID NO: 729682 - RNA, 19 nt, Homo sapiens
uugccucuaugucccauuu

SEQ ID NO: 729683 - RNA, 19 nt, Homo sapiens
aaaguugccaauaaaggaa

SEQ ID NO: 729684 - RNA, 19 nt, Homo sapiens
guagaaauucacgaguauu

SEQ ID NO: 729685 - RNA, 19 nt, Homo sapiens
guuucugcauacacauuaa

SEQ ID NO: 729686 - RNA, 19 nt, Homo sapiens
aagguuguauguugaugga

SEQ ID NO: 729687 - RNA, 19 nt, Homo sapiens
uaucuguaggcugaaauua

SEQ ID NO: 729688 - RNA, 19 nt, Homo sapiens
acuguacucucaauaaagg

SEQ ID NO: 729689 - RNA, 19 nt, Homo sapiens
cagaggugcagcuucaaga

SEQ ID NO: 729690 - RNA, 19 nt, Homo sapiens
ggugaagaaauuaaugaag

SEQ ID NO: 729691 - RNA, 19 nt, Homo sapiens
ccauuggugcuguggauga

SEQ ID NO: 729692 - RNA, 19 nt, Homo sapiens
gaacaugucucaauccaua

SEQ ID NO: 729693 - RNA, 19 nt, Homo sapiens
gcacugaacucacucaagu

SEQ ID NO: 729694 - RNA, 19 nt, Homo sapiens
gcaguccacucccauguaa

SEQ ID NO: 729695 - RNA, 19 nt, Homo sapiens
cauguaaccuuaagauguu

SEQ ID NO: 729696 - RNA, 19 nt, Homo sapiens
gaagauggagaaccaaaug

SEQ ID NO: 729697 - RNA, 19 nt, Homo sapiens
gcauguaaccuuaagaugu

SEQ ID NO: 729698 - RNA, 19 nt, Homo sapiens
cuuaagauguugcauucua

SEQ ID NO: 729699 - RNA, 19 nt, Homo sapiens
ggaggagagucauaagcaa

SEQ ID NO: 729700 - RNA, 19 nt, Homo sapiens
uagcugcauuucaugaaua

SEQ ID NO: 729701 - RNA, 19 nt, Homo sapiens
gauguugcauucuaaacug

SEQ ID NO: 729702 - RNA, 19 nt, Homo sapiens
gaacccuugucaaugcauu

SEQ ID NO: 729703 - RNA, 19 nt, Homo sapiens
caaagcauguaaccuuaag

SEQ ID NO: 729704 - RNA, 19 nt, Homo sapiens
cucaaagcauguaaccuua

SEQ ID NO: 729705 - RNA, 19 nt, Homo sapiens
ugaggcagcuacuggagaa

SEQ ID NO: 729706 - RNA, 19 nt, Homo sapiens
gacuguagcugcauuucau

SEQ ID NO: 729707 - RNA, 19 nt, Homo sapiens
gauggagaaccaaaugaaa

SEQ ID NO: 729708 - RNA, 19 nt, Homo sapiens
gagaagauggagaaccaaa

SEQ ID NO: 729709 - RNA, 19 nt, Homo sapiens
aaagagagccagagagcuu

SEQ ID NO: 729710 - RNA, 19 nt, Homo sapiens
gaaccgggacgcgauaaau

SEQ ID NO: 729711 - RNA, 19 nt, Homo sapiens
guagcugcauuucaugaau

SEQ ID NO: 729712 - RNA, 19 nt, Homo sapiens
gugcagaacaugucucaau

SEQ ID NO: 729713 - RNA, 19 nt, Homo sapiens
gaugggcacugaacucacu

SEQ ID NO: 729714 - RNA, 19 nt, Homo sapiens
uggagaaggugcagaacau

SEQ ID NO: 729715 - RNA, 19 nt, Homo sapiens
ccaauacuuagcaccauuu

SEQ ID NO: 729716 - RNA, 19 nt, Homo sapiens
ucaaagcauguaaccuuaa

SEQ ID NO: 729717 - RNA, 19 nt, Homo sapiens
gagaaggugcagaacaugu

SEQ ID NO: 729718 - RNA, 19 nt, Homo sapiens
uggagaagauggagaacca

SEQ ID NO: 729719 - RNA, 19 nt, Homo sapiens
cagaacaugucucaaucca

SEQ ID NO: 729720 - RNA, 19 nt, Homo sapiens
acucaaagcauguaaccuu

SEQ ID NO: 729721 - RNA, 19 nt, Homo sapiens
ggaaccgggacgcgauaaa

SEQ ID NO: 729722 - RNA, 19 nt, Homo sapiens
aaccgggacgcgauaaaua

SEQ ID NO: 729723 - RNA, 19 nt, Homo sapiens
caugaaagagagccagaga

SEQ ID NO: 729724 - RNA, 19 nt, Homo sapiens
ccagagagacuugcaguac

SEQ ID NO: 729725 - RNA, 19 nt, Homo sapiens
gggacgcgauaaauaugca

SEQ ID NO: 729726 - RNA, 19 nt, Homo sapiens
ugcaguacguggagaagau

SEQ ID NO: 729727 - RNA, 19 nt, Homo sapiens
agagagacuugcaguacgu

SEQ ID NO: 729728 - RNA, 19 nt, Homo sapiens
ugcagaacaugucucaauc

SEQ ID NO: 729729 - RNA, 19 nt, Homo sapiens
ggagaaggugcagaacaug

SEQ ID NO: 729730 - RNA, 19 nt, Homo sapiens
uccaauacuuagcaccauu

SEQ ID NO: 729731 - RNA, 19 nt, Homo sapiens
cgacuguagcugcauuuca

SEQ ID NO: 729732 - RNA, 19 nt, Homo sapiens
ggagaaccaaaugaaagga

SEQ ID NO: 729733 - RNA, 19 nt, Homo sapiens
accuuaagauguugcauuc

SEQ ID NO: 729734 - RNA, 19 nt, Homo sapiens
agauggagaaccaaaugaa

SEQ ID NO: 729735 - RNA, 19 nt, Homo sapiens
gaaggugcagaacaugucu

SEQ ID NO: 729736 - RNA, 19 nt, Homo sapiens
cugcauuucaugaauaguu

SEQ ID NO: 729737 - RNA, 19 nt, Homo sapiens
uagcaccauuucacuaagg

SEQ ID NO: 729738 - RNA, 19 nt, Homo sapiens
cucaagugcugcccaccaa

SEQ ID NO: 729739 - RNA, 19 nt, Homo sapiens
uuucaaugcugcagugacu

SEQ ID NO: 729740 - RNA, 19 nt, Homo sapiens
gaacaugucucaauccaua

SEQ ID NO: 729741 - RNA, 19 nt, Homo sapiens
ggaagaaacucccguauuu

SEQ ID NO: 729742 - RNA, 19 nt, Homo sapiens
caaagggacuccugugaaa

SEQ ID NO: 729743 - RNA, 19 nt, Homo sapiens
gcacugaacucacucaagu

SEQ ID NO: 729744 - RNA, 19 nt, Homo sapiens
gaauuacucucuucuuguu

SEQ ID NO: 729745 - RNA, 19 nt, Homo sapiens
gugcaacguucuucuguua

SEQ ID NO: 729746 - RNA, 19 nt, Homo sapiens
gaacaaauacucccacauc

SEQ ID NO: 729747 - RNA, 19 nt, Homo sapiens
gaacuuaggccuuugauac

SEQ ID NO: 729748 - RNA, 19 nt, Homo sapiens
gcaacguucuucuguuauu

SEQ ID NO: 729749 - RNA, 19 nt, Homo sapiens
uaaaugcaaugccguaguu

SEQ ID NO: 729750 - RNA, 19 nt, Homo sapiens
gcaugaacauuuccuuaga

SEQ ID NO: 729751 - RNA, 19 nt, Homo sapiens
guacaaggccgaugccaaa

SEQ ID NO: 729752 - RNA, 19 nt, Homo sapiens
guugcugucucuuagauua

SEQ ID NO: 729753 - RNA, 19 nt, Homo sapiens
caaggccgaugccaaauug

SEQ ID NO: 729754 - RNA, 19 nt, Homo sapiens
ccacagacgucggaagaaa

SEQ ID NO: 729755 - RNA, 19 nt, Homo sapiens
gaacaacggccaccagauc

SEQ ID NO: 729756 - RNA, 19 nt, Homo sapiens
caaaggaauuacucucuuc

SEQ ID NO: 729757 - RNA, 19 nt, Homo sapiens
gaagauggagaaccaaaug

SEQ ID NO: 729758 - RNA, 19 nt, Homo sapiens
gaagaaaggcuccgugcau

SEQ ID NO: 729759 - RNA, 19 nt, Homo sapiens
gguuugaccugaagacaga

SEQ ID NO: 729760 - RNA, 19 nt, Homo sapiens
ggaggagagucauaagcaa

SEQ ID NO: 729761 - RNA, 19 nt, Homo sapiens
gaagaaacucccguauuug

SEQ ID NO: 729762 - RNA, 19 nt, Homo sapiens
guaccaagguccacuaugc

SEQ ID NO: 729763 - RNA, 19 nt, Homo sapiens
gccguaguuuggauuaaua

SEQ ID NO: 729764 - RNA, 19 nt, Homo sapiens
cuacaacgguucuaucuac

SEQ ID NO: 729765 - RNA, 19 nt, Homo sapiens
gaaaauggaugaacuuagg

SEQ ID NO: 729766 - RNA, 19 nt, Homo sapiens
guacuauccaguuaucuaa

SEQ ID NO: 729767 - RNA, 19 nt, Homo sapiens
ggugguaacuucguauguu

SEQ ID NO: 729768 - RNA, 19 nt, Homo sapiens
uaacaauaccgaucuugaa

SEQ ID NO: 729769 - RNA, 19 nt, Homo sapiens
caaacaacauacuaaagag

SEQ ID NO: 729770 - RNA, 19 nt, Homo sapiens
acaacaacauguaccacua

SEQ ID NO: 729771 - RNA, 19 nt, Homo sapiens
gaaauuggcgccuaugacu

SEQ ID NO: 729772 - RNA, 19 nt, Homo sapiens
ucaaaggaauuacucucuu

SEQ ID NO: 729773 - RNA, 19 nt, Homo sapiens
ggucaaacaacauacuaaa

SEQ ID NO: 729774 - RNA, 19 nt, Homo sapiens
ccaauaacacuaacaauac

SEQ ID NO: 729775 - RNA, 19 nt, Homo sapiens
gcgauaaccggguguggua

SEQ ID NO: 729776 - RNA, 19 nt, Homo sapiens
ccaguuaucuaaggaacaa

SEQ ID NO: 729777 - RNA, 19 nt, Homo sapiens
gcaaugccguaguuuggau

SEQ ID NO: 729778 - RNA, 19 nt, Homo sapiens
ggacggcuaucacaacaac

SEQ ID NO: 729779 - RNA, 19 nt, Homo sapiens
ggaccugugucuaguacau

SEQ ID NO: 729780 - RNA, 19 nt, Homo sapiens
uaggauggcaugaacauuu

SEQ ID NO: 729781 - RNA, 19 nt, Homo sapiens
ggaauuacucucuucuugu

SEQ ID NO: 729782 - RNA, 19 nt, Homo sapiens
gaacauuuccuuagaucgu

SEQ ID NO: 729783 - RNA, 19 nt, Homo sapiens
ucacaacaaccgcuucgua

SEQ ID NO: 729784 - RNA, 19 nt, Homo sapiens
ugaggcagcuacuggagaa

SEQ ID NO: 729785 - RNA, 19 nt, Homo sapiens
cuucguauguucaguuuau

SEQ ID NO: 729786 - RNA, 19 nt, Homo sapiens
gaacuucagagcagagugu

SEQ ID NO: 729787 - RNA, 19 nt, Homo sapiens
uggaugaacuuaggccuuu

SEQ ID NO: 729788 - RNA, 19 nt, Homo sapiens
auagagacauagucaaguu

SEQ ID NO: 729789 - RNA, 19 nt, Homo sapiens
aaaucaguguucacccuua

SEQ ID NO: 729790 - RNA, 19 nt, Homo sapiens
ucaugaacacggacaauuu

SEQ ID NO: 729791 - RNA, 19 nt, Homo sapiens
gauggagaaccaaaugaaa

SEQ ID NO: 729792 - RNA, 19 nt, Homo sapiens
aagaggagguccagaaucu

SEQ ID NO: 729793 - RNA, 19 nt, Homo sapiens
gagaagauggagaaccaaa

SEQ ID NO: 729794 - RNA, 19 nt, Homo sapiens
aggaauuacucucuucuug

SEQ ID NO: 729795 - RNA, 19 nt, Homo sapiens
gaaccgggacgcgauaaau

SEQ ID NO: 729796 - RNA, 19 nt, Homo sapiens
gagcagaguguccaaucuu

SEQ ID NO: 729797 - RNA, 19 nt, Homo sapiens
caaauugguauugcaguuu

SEQ ID NO: 729798 - RNA, 19 nt, Homo sapiens
gcaacaguaugcggaaagu

SEQ ID NO: 729799 - RNA, 19 nt, Homo sapiens
gaugauuguuguaaaugca

SEQ ID NO: 729800 - RNA, 19 nt, Homo sapiens
gcaacaucguggucaguag

SEQ ID NO: 729801 - RNA, 19 nt, Homo sapiens
ugacgucagugcuuaacga

SEQ ID NO: 729802 - RNA, 19 nt, Homo sapiens
gaugggcacugaacucacu

SEQ ID NO: 729803 - RNA, 19 nt, Homo sapiens
caugaacauuuccuuagau

SEQ ID NO: 729804 - RNA, 19 nt, Homo sapiens
gaccaaugccuccaccuau

SEQ ID NO: 729805 - RNA, 19 nt, Homo sapiens
gugcagaacaugucucaau

SEQ ID NO: 729806 - RNA, 19 nt, Homo sapiens
gaaguugacgggcaucagu

SEQ ID NO: 729807 - RNA, 19 nt, Homo sapiens
caacguucuucuguuauuc

SEQ ID NO: 729808 - RNA, 19 nt, Homo sapiens
gcagugccguuucuugacu

SEQ ID NO: 729809 - RNA, 19 nt, Homo sapiens
gcagaguguccaaucuuga

SEQ ID NO: 729810 - RNA, 19 nt, Homo sapiens
uuaaagaggagguccagaa

SEQ ID NO: 729811 - RNA, 19 nt, Homo sapiens
uaaagaggcgaggcaauga

SEQ ID NO: 729812 - RNA, 19 nt, Homo sapiens
ggcauuaccuccguguuuc

SEQ ID NO: 729813 - RNA, 19 nt, Homo sapiens
ggacuaugccgguuacaac

SEQ ID NO: 729814 - RNA, 19 nt, Homo sapiens
gccaccagauccucuacaa

SEQ ID NO: 729815 - RNA, 19 nt, Homo sapiens
ccaaugccuccaccuauga

SEQ ID NO: 729816 - RNA, 19 nt, Homo sapiens
uggagaaggugcagaacau

SEQ ID NO: 729817 - RNA, 19 nt, Homo sapiens
gugguaacuucguauguuc

SEQ ID NO: 729818 - RNA, 19 nt, Homo sapiens
ccaagguccacuaugcaua

SEQ ID NO: 729819 - RNA, 19 nt, Homo sapiens
agacagagaccauccucaa

SEQ ID NO: 729820 - RNA, 19 nt, Homo sapiens
uaaagaggagguccagaau

SEQ ID NO: 729821 - RNA, 19 nt, Homo sapiens
gagaaggugcagaacaugu

SEQ ID NO: 729822 - RNA, 19 nt, Homo sapiens
acagagaccauccucaaga

SEQ ID NO: 729823 - RNA, 19 nt, Homo sapiens
ggucagcuccgaggaaugu

SEQ ID NO: 729824 - RNA, 19 nt, Homo sapiens
cuaaagaggcgaggcaaug

SEQ ID NO: 729825 - RNA, 19 nt, Homo sapiens
cggaagaaacucccguauu

SEQ ID NO: 729826 - RNA, 19 nt, Homo sapiens
ccacaucaucaucagguuu

SEQ ID NO: 729827 - RNA, 19 nt, Homo sapiens
gaaaggcuccgugcaugca

SEQ ID NO: 729828 - RNA, 19 nt, Homo sapiens
gggcaacaguaugcggaaa

SEQ ID NO: 729829 - RNA, 19 nt, Homo sapiens
cagaacaugucucaaucca

SEQ ID NO: 729830 - RNA, 19 nt, Homo sapiens
acaaagggacuccugugaa

SEQ ID NO: 729831 - RNA, 19 nt, Homo sapiens
uggagaagauggagaacca

SEQ ID NO: 729832 - RNA, 19 nt, Homo sapiens
uggcaugaacauuuccuua

SEQ ID NO: 729833 - RNA, 19 nt, Homo sapiens
uuugauaccuguguuggaa

SEQ ID NO: 729834 - RNA, 19 nt, Homo sapiens
gaugaacuuaggccuuuga

SEQ ID NO: 729835 - RNA, 19 nt, Homo sapiens
gugcugaggcuccacauag

SEQ ID NO: 729836 - RNA, 19 nt, Homo sapiens
ggccacagacgucggaaga

SEQ ID NO: 729837 - RNA, 19 nt, Homo sapiens
cuaacaauaccgaucuuga

SEQ ID NO: 729838 - RNA, 19 nt, Homo sapiens
gacaucccauuccagaaca

SEQ ID NO: 729839 - RNA, 19 nt, Homo sapiens
caacaaccgcuucguacgu

SEQ ID NO: 729840 - RNA, 19 nt, Homo sapiens
gcaaagagauggcugauuc

SEQ ID NO: 729841 - RNA, 19 nt, Homo sapiens
gaacgagcuucccuuguuu

SEQ ID NO: 729842 - RNA, 19 nt, Homo sapiens
gcacugaacucacucaaaa

SEQ ID NO: 729843 - RNA, 19 nt, Homo sapiens
ugaacgagcuucccuuguu

SEQ ID NO: 729844 - RNA, 19 nt, Homo sapiens
gggcuaugccugugucuua

SEQ ID NO: 729845 - RNA, 19 nt, Homo sapiens
ggacagaugcauucauuca

SEQ ID NO: 729846 - RNA, 19 nt, Homo sapiens
ugagacaccuuggcaaaga

SEQ ID NO: 729847 - RNA, 19 nt, Homo sapiens
aaacaaagcagagaagaug

SEQ ID NO: 729848 - RNA, 19 nt, Homo sapiens
acagaugcauucauucaug

SEQ ID NO: 729849 - RNA, 19 nt, Homo sapiens
cuggacagaugcauucauu

SEQ ID NO: 729850 - RNA, 19 nt, Homo sapiens
gagagaagacacugaacga

SEQ ID NO: 729851 - RNA, 19 nt, Homo sapiens
gaaccgggacgcgauaaau

SEQ ID NO: 729852 - RNA, 19 nt, Homo sapiens
ccagagagcgagaggaaga

SEQ ID NO: 729853 - RNA, 19 nt, Homo sapiens
acacacacaugcacacaca

SEQ ID NO: 729854 - RNA, 19 nt, Homo sapiens
gguuaugucgucccgcuua

SEQ ID NO: 729855 - RNA, 19 nt, Homo sapiens
gaugggcacugaacucacu

SEQ ID NO: 729856 - RNA, 19 nt, Homo sapiens
cagaugcauucauucaugu

SEQ ID NO: 729857 - RNA, 19 nt, Homo sapiens
gcacacacacacacacaca

SEQ ID NO: 729858 - RNA, 19 nt, Homo sapiens
gaagaccacaggagagaag

SEQ ID NO: 729859 - RNA, 19 nt, Homo sapiens
gguggaggguggugguugu

SEQ ID NO: 729860 - RNA, 19 nt, Homo sapiens
ggccagagagcgagaggaa

SEQ ID NO: 729861 - RNA, 19 nt, Homo sapiens
cuaugccugugucuuauug

SEQ ID NO: 729862 - RNA, 19 nt, Homo sapiens
ggaaccgggacgcgauaaa

SEQ ID NO: 729863 - RNA, 19 nt, Homo sapiens
caggagagaagacacugaa

SEQ ID NO: 729864 - RNA, 19 nt, Homo sapiens
aaccgggacgcgauaaaua

SEQ ID NO: 729865 - RNA, 19 nt, Homo sapiens
gagacaccuuggcaaagag

SEQ ID NO: 729866 - RNA, 19 nt, Homo sapiens
gggacgcgauaaauaugca

SEQ ID NO: 729867 - RNA, 19 nt, Homo sapiens
ggcuaugccugugucuuau

SEQ ID NO: 729868 - RNA, 19 nt, Homo sapiens
cccaggaugugcaguccaa

SEQ ID NO: 729869 - RNA, 19 nt, Homo sapiens
gaagacacugaacgagcuu

SEQ ID NO: 729870 - RNA, 19 nt, Homo sapiens
ggaagaccacaggagagaa

SEQ ID NO: 729871 - RNA, 19 nt, Homo sapiens
gcuaugccugugucuuauu

SEQ ID NO: 729872 - RNA, 19 nt, Homo sapiens
gaaaacaaagcagagaaga

SEQ ID NO: 729873 - RNA, 19 nt, Homo sapiens
acacacacacacacacaug

SEQ ID NO: 729874 - RNA, 19 nt, Homo sapiens
gguggugguugugcacugu

SEQ ID NO: 729875 - RNA, 19 nt, Homo sapiens
caaagggcuaugccugugu

SEQ ID NO: 729876 - RNA, 19 nt, Homo sapiens
ggcacugaacucacucaaa

SEQ ID NO: 729877 - RNA, 19 nt, Homo sapiens
ggagguagcuuugcaguuu

SEQ ID NO: 729878 - RNA, 19 nt, Homo sapiens
ggacuucucugccugguuu

SEQ ID NO: 729879 - RNA, 19 nt, Homo sapiens
ugaaggagcugguaucuug

SEQ ID NO: 729880 - RNA, 19 nt, Homo sapiens
caacauggaucauuucaca

SEQ ID NO: 729881 - RNA, 19 nt, Homo sapiens
caucacaaguggugccuua

SEQ ID NO: 729882 - RNA, 19 nt, Homo sapiens
aaccagggcuccacaguua

SEQ ID NO: 729883 - RNA, 19 nt, Homo sapiens
gcucauguacuucaaauaa

SEQ ID NO: 729884 - RNA, 19 nt, Homo sapiens
cgagaaggauuucagaaga

SEQ ID NO: 729885 - RNA, 19 nt, Homo sapiens
acaacuugcuuccaauaua

SEQ ID NO: 729886 - RNA, 19 nt, Homo sapiens
gaaacaacuugcuuccaau

SEQ ID NO: 729887 - RNA, 19 nt, Homo sapiens
guaagugcuugaaagauga

SEQ ID NO: 729888 - RNA, 19 nt, Homo sapiens
ggacuucuuuccuaggauu

SEQ ID NO: 729889 - RNA, 19 nt, Homo sapiens
aaagagacauuuagcacuu

SEQ ID NO: 729890 - RNA, 19 nt, Homo sapiens
ggugguaucuuucaagcaa

SEQ ID NO: 729891 - RNA, 19 nt, Homo sapiens
ggaggcaugauguuaguua

SEQ ID NO: 729892 - RNA, 19 nt, Homo sapiens
agaaacaacuugcuuccaa

SEQ ID NO: 729893 - RNA, 19 nt, Homo sapiens
gagucaacauggaucauuu

SEQ ID NO: 729894 - RNA, 19 nt, Homo sapiens
gagaaggauuucagaagau

SEQ ID NO: 729895 - RNA, 19 nt, Homo sapiens
gaaaggaagaucccuggaa

SEQ ID NO: 729896 - RNA, 19 nt, Homo sapiens
ggcaugauguuaguuaauu

SEQ ID NO: 729897 - RNA, 19 nt, Homo sapiens
guuagucccucaucacuug

SEQ ID NO: 729898 - RNA, 19 nt, Homo sapiens
ucuccuagcuuuaauugaa

SEQ ID NO: 729899 - RNA, 19 nt, Homo sapiens
gaagggugcuaaaagauaa

SEQ ID NO: 729900 - RNA, 19 nt, Homo sapiens
cgagggaguuugacagcua

SEQ ID NO: 729901 - RNA, 19 nt, Homo sapiens
acaaaacucucuuccuuua

SEQ ID NO: 729902 - RNA, 19 nt, Homo sapiens
caucaucucuugcggacuu

SEQ ID NO: 729903 - RNA, 19 nt, Homo sapiens
caacuugcuuccaauauac

SEQ ID NO: 729904 - RNA, 19 nt, Homo sapiens
gugagaugcuuuauggauu

SEQ ID NO: 729905 - RNA, 19 nt, Homo sapiens
gaugagcacuucagaacag

SEQ ID NO: 729906 - RNA, 19 nt, Homo sapiens
gaaaauggaugagcacuuc

SEQ ID NO: 729907 - RNA, 19 nt, Homo sapiens
cugcauaaacgauguauuu

SEQ ID NO: 729908 - RNA, 19 nt, Homo sapiens
acagugagaugcuuuaugg

SEQ ID NO: 729909 - RNA, 19 nt, Homo sapiens
gaauugcauuugugaucaa

SEQ ID NO: 729910 - RNA, 19 nt, Homo sapiens
gaggcaugauguuaguuaa

SEQ ID NO: 729911 - RNA, 19 nt, Homo sapiens
ugagaugcuuuauggauug

SEQ ID NO: 729912 - RNA, 19 nt, Homo sapiens
gacaauaucaguaggacuu

SEQ ID NO: 729913 - RNA, 19 nt, Homo sapiens
guaggcauuuaauuacuga

SEQ ID NO: 729914 - RNA, 19 nt, Homo sapiens
guuguagacuucgauguuu

SEQ ID NO: 729915 - RNA, 19 nt, Homo sapiens
ggaguuugacagcuauuaa

SEQ ID NO: 729916 - RNA, 19 nt, Homo sapiens
aaacaacuugcuuccaaua

SEQ ID NO: 729917 - RNA, 19 nt, Homo sapiens
ccaauauacccaauucuau

SEQ ID NO: 729918 - RNA, 19 nt, Homo sapiens
gggaguaaaccacagacua

SEQ ID NO: 729919 - RNA, 19 nt, Homo sapiens
acacuugaauugcauuugu

SEQ ID NO: 729920 - RNA, 19 nt, Homo sapiens
ggcauuuaauuacugauug

SEQ ID NO: 729921 - RNA, 19 nt, Homo sapiens
aguaagugcuugaaagaug

SEQ ID NO: 729922 - RNA, 19 nt, Homo sapiens
cuggaagaguuuaguguuu

SEQ ID NO: 729923 - RNA, 19 nt, Homo sapiens
cuuuauggauugaaggaua

SEQ ID NO: 729924 - RNA, 19 nt, Homo sapiens
gaagaucaaguuacagucu

SEQ ID NO: 729925 - RNA, 19 nt, Homo sapiens
gagacuaucgacaauauca

SEQ ID NO: 729926 - RNA, 19 nt, Homo sapiens
uggagacuaucgacaauau

SEQ ID NO: 729927 - RNA, 19 nt, Homo sapiens
uauaggaggcaugauguua

SEQ ID NO: 729928 - RNA, 19 nt, Homo sapiens
gaguuuaguguuucuugua

SEQ ID NO: 729929 - RNA, 19 nt, Homo sapiens
ggaagaguuuaguguuucu

SEQ ID NO: 729930 - RNA, 19 nt, Homo sapiens
ggaguaaaccacagacuac

SEQ ID NO: 729931 - RNA, 19 nt, Homo sapiens
ggaacuuacucuuucuuuu

SEQ ID NO: 729932 - RNA, 19 nt, Homo sapiens
ugaaggauaugguaaaaug

SEQ ID NO: 729933 - RNA, 19 nt, Homo sapiens
gagguagcuuugcaguuug

SEQ ID NO: 729934 - RNA, 19 nt, Homo sapiens
gguaggcauuuaauuacug

SEQ ID NO: 729935 - RNA, 19 nt, Homo sapiens
gauugaaggauaugguaaa

SEQ ID NO: 729936 - RNA, 19 nt, Homo sapiens
ugaauugcauuugugauca

SEQ ID NO: 729937 - RNA, 19 nt, Homo sapiens
ugagaauuaugcagaguca

SEQ ID NO: 729938 - RNA, 19 nt, Homo sapiens
gaaaauacaguaagugcuu

SEQ ID NO: 729939 - RNA, 19 nt, Homo sapiens
ggaagggugcuaaaagaua

SEQ ID NO: 729940 - RNA, 19 nt, Homo sapiens
gagggaguuugacagcuau

SEQ ID NO: 729941 - RNA, 19 nt, Homo sapiens
gagaugcuuuauggauuga

SEQ ID NO: 729942 - RNA, 19 nt, Homo sapiens
gaguuugacagcuauuaaa

SEQ ID NO: 729943 - RNA, 19 nt, Homo sapiens
cauugguggugguaucuuu

SEQ ID NO: 729944 - RNA, 19 nt, Homo sapiens
ggauugaaggauaugguaa

SEQ ID NO: 729945 - RNA, 19 nt, Homo sapiens
gauuucagaagaucaaguu

SEQ ID NO: 729946 - RNA, 19 nt, Homo sapiens
ucccaaugguccucaguuu

SEQ ID NO: 729947 - RNA, 19 nt, Homo sapiens
gauugacuguaguaugguu

SEQ ID NO: 729948 - RNA, 19 nt, Homo sapiens
caaguccucugcauaaacg

SEQ ID NO: 729949 - RNA, 19 nt, Homo sapiens
ggagggcuguuuuccauga

SEQ ID NO: 729950 - RNA, 19 nt, Homo sapiens
gagcugguaucuuguugac

SEQ ID NO: 729951 - RNA, 19 nt, Homo sapiens
ggcauucuccuagcuuuaa

SEQ ID NO: 729952 - RNA, 19 nt, Homo sapiens
ugugggaaauggagaacaa

SEQ ID NO: 729953 - RNA, 19 nt, Homo sapiens
cuacaucugugggaaaugg

SEQ ID NO: 729954 - RNA, 19 nt, Homo sapiens
uuacacauuugccuacauc

SEQ ID NO: 729955 - RNA, 19 nt, Homo sapiens
ugaggauauuggauacaaa

SEQ ID NO: 729956 - RNA, 19 nt, Homo sapiens
cauggcgaauuguggauga

SEQ ID NO: 729957 - RNA, 19 nt, Homo sapiens
acaguuaggagguagcuuu

SEQ ID NO: 729958 - RNA, 19 nt, Homo sapiens
ggggaagggugcuaaaaga

SEQ ID NO: 729959 - RNA, 19 nt, Homo sapiens
guuaggagguagcuuugca

SEQ ID NO: 729960 - RNA, 19 nt, Homo sapiens
uaguaugguucaagucaga

SEQ ID NO: 729961 - RNA, 19 nt, Homo sapiens
agugacauguggcccuaua

SEQ ID NO: 729962 - RNA, 19 nt, Homo sapiens
gguuuuguguguucuguua

SEQ ID NO: 729963 - RNA, 19 nt, Homo sapiens
uacaguaagugcuugaaag

SEQ ID NO: 729964 - RNA, 19 nt, Homo sapiens
uacauaugguaggcauuua

SEQ ID NO: 729965 - RNA, 19 nt, Homo sapiens
uucaagcaaucaaagguuu

SEQ ID NO: 729966 - RNA, 19 nt, Homo sapiens
guuccaaguccucugcaua

SEQ ID NO: 729967 - RNA, 19 nt, Homo sapiens
uggaagaguuuaguguuuc

SEQ ID NO: 729968 - RNA, 19 nt, Homo sapiens
auacaaaacucucuuccuu

SEQ ID NO: 729969 - RNA, 19 nt, Homo sapiens
cagaagaucaaguuacagu

SEQ ID NO: 729970 - RNA, 19 nt, Homo sapiens
guccucaguuugcagaaga

SEQ ID NO: 729971 - RNA, 19 nt, Homo sapiens
gcauucuccuagcuuuaau

SEQ ID NO: 729972 - RNA, 19 nt, Homo sapiens
cauaaacgauguauuuugg

SEQ ID NO: 729973 - RNA, 19 nt, Homo sapiens
gggaguuugacagcuauua

SEQ ID NO: 729974 - RNA, 19 nt, Homo sapiens
aagaauucauggagagugu

SEQ ID NO: 729975 - RNA, 19 nt, Homo sapiens
uccaauauacccaauucua

SEQ ID NO: 729976 - RNA, 19 nt, Homo sapiens
agacuacgagggaguuuga

SEQ ID NO: 729977 - RNA, 19 nt, Homo sapiens
gggaagaucuccaguuaua

SEQ ID NO: 729978 - RNA, 19 nt, Homo sapiens
ggaaugagccagacaaaua

SEQ ID NO: 729979 - RNA, 19 nt, Homo sapiens
gaaagaagauugcucagau

SEQ ID NO: 729980 - RNA, 19 nt, Homo sapiens
gaaauuugauccugaagaa

SEQ ID NO: 729981 - RNA, 19 nt, Homo sapiens
ggaagcacguccuccauua

SEQ ID NO: 729982 - RNA, 19 nt, Homo sapiens
gcacaucacuuaguucaaa

SEQ ID NO: 729983 - RNA, 19 nt, Homo sapiens
guaauacucuuggcuguua

SEQ ID NO: 729984 - RNA, 19 nt, Homo sapiens
ggaaauggcugcaguaugc

SEQ ID NO: 729985 - RNA, 19 nt, Homo sapiens
gaagauugcucagauguug

SEQ ID NO: 729986 - RNA, 19 nt, Homo sapiens
gaaagaugcuggaaagauc

SEQ ID NO: 729987 - RNA, 19 nt, Homo sapiens
cagggaagaucuccaguua

SEQ ID NO: 729988 - RNA, 19 nt, Homo sapiens
gagaagaaguaacgaguga

SEQ ID NO: 729989 - RNA, 19 nt, Homo sapiens
gguaauagaccagauguua

SEQ ID NO: 729990 - RNA, 19 nt, Homo sapiens
cagcaaauguuagauagua

SEQ ID NO: 729991 - RNA, 19 nt, Homo sapiens
caagauggguacagguaua

SEQ ID NO: 729992 - RNA, 19 nt, Homo sapiens
ccaaauccaccaucaaaua

SEQ ID NO: 729993 - RNA, 19 nt, Homo sapiens
gagaacaguuguaaagaau

SEQ ID NO: 729994 - RNA, 19 nt, Homo sapiens
gaauaaacauggugugucu

SEQ ID NO: 729995 - RNA, 19 nt, Homo sapiens
gguaggagcuaggauguuu

SEQ ID NO: 729996 - RNA, 19 nt, Homo sapiens
gcaaguuguuaaaguguaa

SEQ ID NO: 729997 - RNA, 19 nt, Homo sapiens
ggguacagguauaauguua

SEQ ID NO: 729998 - RNA, 19 nt, Homo sapiens
ggaagcaccugaguaauag

SEQ ID NO: 729999 - RNA, 19 nt, Homo sapiens
ccagcaaguuguuuaaauu

SEQ ID NO: 730000 - RNA, 19 nt, Homo sapiens
caaaggauguucccagcaa

SEQ ID NO: 730001 - RNA, 19 nt, Homo sapiens
gauguuggaucguuaugaa

SEQ ID NO: 730002 - RNA, 19 nt, Homo sapiens
caagaugacucucagauac

SEQ ID NO: 730003 - RNA, 19 nt, Homo sapiens
gaacaguuguaaagaaucu

SEQ ID NO: 730004 - RNA, 19 nt, Homo sapiens
gcacauguucuaaauggua

SEQ ID NO: 730005 - RNA, 19 nt, Homo sapiens
gaccagauguuauugaauc

SEQ ID NO: 730006 - RNA, 19 nt, Homo sapiens
gaacagacagguuugugaa

SEQ ID NO: 730007 - RNA, 19 nt, Homo sapiens
caaagaaauugaagagcuu

SEQ ID NO: 730008 - RNA, 19 nt, Homo sapiens
caagaucgauaugugagua

SEQ ID NO: 730009 - RNA, 19 nt, Homo sapiens
gagccugucuuggaguuua

SEQ ID NO: 730010 - RNA, 19 nt, Homo sapiens
gaagaucuccaguuauaau

SEQ ID NO: 730011 - RNA, 19 nt, Homo sapiens
ugagaacaguuguaaagaa

SEQ ID NO: 730012 - RNA, 19 nt, Homo sapiens
cauaagaggauuuguacua

SEQ ID NO: 730013 - RNA, 19 nt, Homo sapiens
gcauauucaucuuguaaug

SEQ ID NO: 730014 - RNA, 19 nt, Homo sapiens
ggacaagcauaauggaaca

SEQ ID NO: 730015 - RNA, 19 nt, Homo sapiens
gaugagauauauagcacaa

SEQ ID NO: 730016 - RNA, 19 nt, Homo sapiens
gaugagaugccugguaaua

SEQ ID NO: 730017 - RNA, 19 nt, Homo sapiens
gagaauaggaguaguguuc

SEQ ID NO: 730018 - RNA, 19 nt, Homo sapiens
ugagaugccugguaauaga

SEQ ID NO: 730019 - RNA, 19 nt, Homo sapiens
gggauaaagugauucuaau

SEQ ID NO: 730020 - RNA, 19 nt, Homo sapiens
uaauaaagcuaugccauca

SEQ ID NO: 730021 - RNA, 19 nt, Homo sapiens
aagaaauacugacuuggua

SEQ ID NO: 730022 - RNA, 19 nt, Homo sapiens
gaucuccaguuauaauaga

SEQ ID NO: 730023 - RNA, 19 nt, Homo sapiens
gcauagaccuuugcaugau

SEQ ID NO: 730024 - RNA, 19 nt, Homo sapiens
ggucauaagaggauuugua

SEQ ID NO: 730025 - RNA, 19 nt, Homo sapiens
agacaaauaucccuguaau

SEQ ID NO: 730026 - RNA, 19 nt, Homo sapiens
gaaugagccagacaaauau

SEQ ID NO: 730027 - RNA, 19 nt, Homo sapiens
gaaugaggcacauguucua

SEQ ID NO: 730028 - RNA, 19 nt, Homo sapiens
uagcacaaguaaagcauuu

SEQ ID NO: 730029 - RNA, 19 nt, Homo sapiens
ggaaagaucauuguaugga

SEQ ID NO: 730030 - RNA, 19 nt, Homo sapiens
gaaauugaagagcuugaaa

SEQ ID NO: 730031 - RNA, 19 nt, Homo sapiens
cagaggacauaguuauuug

SEQ ID NO: 730032 - RNA, 19 nt, Homo sapiens
auaaucagcacaucacuua

SEQ ID NO: 730033 - RNA, 19 nt, Homo sapiens
uggaagcaccugaguaaua

SEQ ID NO: 730034 - RNA, 19 nt, Homo sapiens
gcucagauguuggaucguu

SEQ ID NO: 730035 - RNA, 19 nt, Homo sapiens
uauacaagcuugggaaaug

SEQ ID NO: 730036 - RNA, 19 nt, Homo sapiens
gaggauuuguacuauagaa

SEQ ID NO: 730037 - RNA, 19 nt, Homo sapiens
agagaaagaugcuggaaag

SEQ ID NO: 730038 - RNA, 19 nt, Homo sapiens
gcauuuauaggacccauuu

SEQ ID NO: 730039 - RNA, 19 nt, Homo sapiens
ggaauugcaugacuuuuga

SEQ ID NO: 730040 - RNA, 19 nt, Homo sapiens
ccaagaugacucucagaua

SEQ ID NO: 730041 - RNA, 19 nt, Homo sapiens
caaauccaccaucaaauau

SEQ ID NO: 730042 - RNA, 19 nt, Homo sapiens
ucucuuggcucacauaauc

SEQ ID NO: 730043 - RNA, 19 nt, Homo sapiens
guucaucccucuggaaaug

SEQ ID NO: 730044 - RNA, 19 nt, Homo sapiens
ccagacaaauaucccugua

SEQ ID NO: 730045 - RNA, 19 nt, Homo sapiens
gguaaauucuugggaccua

SEQ ID NO: 730046 - RNA, 19 nt, Homo sapiens
ggaacagacagguuuguga

SEQ ID NO: 730047 - RNA, 19 nt, Homo sapiens
gaugucuuauggugaaauu

SEQ ID NO: 730048 - RNA, 19 nt, Homo sapiens
caaugaauauacugacugu

SEQ ID NO: 730049 - RNA, 19 nt, Homo sapiens
gacaaguaauaccuacauu

SEQ ID NO: 730050 - RNA, 19 nt, Homo sapiens
ucacagaauccaagagaaa

SEQ ID NO: 730051 - RNA, 19 nt, Homo sapiens
ccagcaaguuguuaaagug

SEQ ID NO: 730052 - RNA, 19 nt, Homo sapiens
uauggaagcaccugaguaa

SEQ ID NO: 730053 - RNA, 19 nt, Homo sapiens
cauguuaacuggaauugca

SEQ ID NO: 730054 - RNA, 19 nt, Homo sapiens
acucuuggcuguuauggaa

SEQ ID NO: 730055 - RNA, 19 nt, Homo sapiens
uguaaugaauucaguggaa

SEQ ID NO: 730056 - RNA, 19 nt, Homo sapiens
ugaggcacauguucuaaau

SEQ ID NO: 730057 - RNA, 19 nt, Homo sapiens
aaagaagauugcucagaug

SEQ ID NO: 730058 - RNA, 19 nt, Homo sapiens
ggaaaaggauacagaguag

SEQ ID NO: 730059 - RNA, 19 nt, Homo sapiens
ggaaaugaagccauaugug

SEQ ID NO: 730060 - RNA, 19 nt, Homo sapiens
ucacagagguucgugucuu

SEQ ID NO: 730061 - RNA, 19 nt, Homo sapiens
gaguaaugguuucugugaa

SEQ ID NO: 730062 - RNA, 19 nt, Homo sapiens
ugagauauauagcacaagu

SEQ ID NO: 730063 - RNA, 19 nt, Homo sapiens
gaaaagaggaauaaacaug

SEQ ID NO: 730064 - RNA, 19 nt, Homo sapiens
gaagccauauguggaagug

SEQ ID NO: 730065 - RNA, 19 nt, Homo sapiens
gauaugugaguaaugguuu

SEQ ID NO: 730066 - RNA, 19 nt, Homo sapiens
gcaguaugcaagaucgaua

SEQ ID NO: 730067 - RNA, 19 nt, Homo sapiens
gaauaggaguaguguucau

SEQ ID NO: 730068 - RNA, 19 nt, Homo sapiens
uauacugacuguagugaga

SEQ ID NO: 730069 - RNA, 19 nt, Homo sapiens
uauaggacccauuuacaaa

SEQ ID NO: 730070 - RNA, 19 nt, Homo sapiens
uagaccagauguuauugaa

SEQ ID NO: 730071 - RNA, 19 nt, Homo sapiens
guaauagaccagauguuau

SEQ ID NO: 730072 - RNA, 19 nt, Homo sapiens
aagaggauuuguacuauag

SEQ ID NO: 730073 - RNA, 19 nt, Homo sapiens
ggaccuagagaagaaguaa

SEQ ID NO: 730074 - RNA, 19 nt, Homo sapiens
ggaaauuugauccugaaga

SEQ ID NO: 730075 - RNA, 19 nt, Homo sapiens
caccaaauccaccaucaaa

SEQ ID NO: 730076 - RNA, 19 nt, Homo sapiens
ggacaaguaauaccuacau

SEQ ID NO: 730077 - RNA, 19 nt, Homo sapiens
caaaguaaguggugacaaa

SEQ ID NO: 730078 - RNA, 19 nt, Homo sapiens
ggacaucucuggccacaug

SEQ ID NO: 730079 - RNA, 19 nt, Homo sapiens
gcacugcaguaacuuuaaa

SEQ ID NO: 730080 - RNA, 19 nt, Homo sapiens
gcgcuucucuucuaccuaa

SEQ ID NO: 730081 - RNA, 19 nt, Homo sapiens
ggagaaacaucaauuacag

SEQ ID NO: 730082 - RNA, 19 nt, Homo sapiens
gcagcgcgcuucucuucua

SEQ ID NO: 730083 - RNA, 19 nt, Homo sapiens
agaagaagcugcuggacaa

SEQ ID NO: 730084 - RNA, 19 nt, Homo sapiens
gcgagauguuccucaauuu

SEQ ID NO: 730085 - RNA, 19 nt, Homo sapiens
ggaucgagguuuccuacaa

SEQ ID NO: 730086 - RNA, 19 nt, Homo sapiens
caaccugggcccuguauaa

SEQ ID NO: 730087 - RNA, 19 nt, Homo sapiens
gaucgagguuuccuacaau

SEQ ID NO: 730088 - RNA, 19 nt, Homo sapiens
gagcacugcaguaacuuua

SEQ ID NO: 730089 - RNA, 19 nt, Homo sapiens
gagaagcaggaacucauua

SEQ ID NO: 730090 - RNA, 19 nt, Homo sapiens
gcacauuccagccuacaaa

SEQ ID NO: 730091 - RNA, 19 nt, Homo sapiens
ugaauggcauggaauccua

SEQ ID NO: 730092 - RNA, 19 nt, Homo sapiens
gacaggaacauucaaguga

SEQ ID NO: 730093 - RNA, 19 nt, Homo sapiens
gaacgcugccuguaacuuc

SEQ ID NO: 730094 - RNA, 19 nt, Homo sapiens
ugaaggaauucccagagaa

SEQ ID NO: 730095 - RNA, 19 nt, Homo sapiens
cuagagaacugcagcaucu

SEQ ID NO: 730096 - RNA, 19 nt, Homo sapiens
uguauaaccucgugucugu

SEQ ID NO: 730097 - RNA, 19 nt, Homo sapiens
caggaacucauuaggaaua

SEQ ID NO: 730098 - RNA, 19 nt, Homo sapiens
ucaagugccacaaauauga

SEQ ID NO: 730099 - RNA, 19 nt, Homo sapiens
gcauugagccuuccaagag

SEQ ID NO: 730100 - RNA, 19 nt, Homo sapiens
gagaagcuguccgccaaga

SEQ ID NO: 730101 - RNA, 19 nt, Homo sapiens
gaacauggacacgucuaga

SEQ ID NO: 730102 - RNA, 19 nt, Homo sapiens
acuaaugacuucccaguuc

SEQ ID NO: 730103 - RNA, 19 nt, Homo sapiens
ugagggacauaauuaagau

SEQ ID NO: 730104 - RNA, 19 nt, Homo sapiens
cuucugagggacauaauua

SEQ ID NO: 730105 - RNA, 19 nt, Homo sapiens
gcccucugcugaucaaaga

SEQ ID NO: 730106 - RNA, 19 nt, Homo sapiens
gagauguuccucaauuuca

SEQ ID NO: 730107 - RNA, 19 nt, Homo sapiens
guacugcccucugcugauc

SEQ ID NO: 730108 - RNA, 19 nt, Homo sapiens
ugaagaggccgcugcaguu

SEQ ID NO: 730109 - RNA, 19 nt, Homo sapiens
gaauguggcagaagugaag

SEQ ID NO: 730110 - RNA, 19 nt, Homo sapiens
gaaggaauucccagagaag

SEQ ID NO: 730111 - RNA, 19 nt, Homo sapiens
ggagugcccuguggaacau

SEQ ID NO: 730112 - RNA, 19 nt, Homo sapiens
ggugaacgcugccuguaac

SEQ ID NO: 730113 - RNA, 19 nt, Homo sapiens
ccaagagccugcagacacu

SEQ ID NO: 730114 - RNA, 19 nt, Homo sapiens
caggucauuugaaccaauu

SEQ ID NO: 730115 - RNA, 19 nt, Homo sapiens
cuaaugacuucccaguuca

SEQ ID NO: 730116 - RNA, 19 nt, Homo sapiens
agcaggaacucauuaggaa

SEQ ID NO: 730117 - RNA, 19 nt, Homo sapiens
ugcgagauguuccucaauu

SEQ ID NO: 730118 - RNA, 19 nt, Homo sapiens
gaagaggccgcugcaguuc

SEQ ID NO: 730119 - RNA, 19 nt, Homo sapiens
ccuaacaaauuccgaguac

SEQ ID NO: 730120 - RNA, 19 nt, Homo sapiens
ccucaagugccacaaauau

SEQ ID NO: 730121 - RNA, 19 nt, Homo sapiens
cauuccagccuacaaagua

SEQ ID NO: 730122 - RNA, 19 nt, Homo sapiens
gaacucauuaggaauaugc

SEQ ID NO: 730123 - RNA, 19 nt, Homo sapiens
uggacugccugaaggaauu

SEQ ID NO: 730124 - RNA, 19 nt, Homo sapiens
uuaaagaggagaacaugga

SEQ ID NO: 730125 - RNA, 19 nt, Homo sapiens
ggaauaugcuaggacuuuu

SEQ ID NO: 730126 - RNA, 19 nt, Homo sapiens
acauggacacgucuagaua

SEQ ID NO: 730127 - RNA, 19 nt, Homo sapiens
ugauugagcacugcaguaa

SEQ ID NO: 730128 - RNA, 19 nt, Homo sapiens
ggcaggagaccaaggaaau

SEQ ID NO: 730129 - RNA, 19 nt, Homo sapiens
cugaaggaauucccagaga

SEQ ID NO: 730130 - RNA, 19 nt, Homo sapiens
gcccucaagugccacaaau

SEQ ID NO: 730131 - RNA, 19 nt, Homo sapiens
gcuaccugcuggacaagga

SEQ ID NO: 730132 - RNA, 19 nt, Homo sapiens
gagcuucuucagccucuuu

SEQ ID NO: 730133 - RNA, 19 nt, Homo sapiens
agagcagcaucauaccuuu

SEQ ID NO: 730134 - RNA, 19 nt, Homo sapiens
gcaggagaccaaggaaaug

SEQ ID NO: 730135 - RNA, 19 nt, Homo sapiens
cagaugaaacuccugacaa

SEQ ID NO: 730136 - RNA, 19 nt, Homo sapiens
caaccgacgcuuuuccuua

SEQ ID NO: 730137 - RNA, 19 nt, Homo sapiens
ggaauguggcagaagugaa

SEQ ID NO: 730138 - RNA, 19 nt, Homo sapiens
ggaacucauuaggaauaug

SEQ ID NO: 730139 - RNA, 19 nt, Homo sapiens
ugauggcccucuguacuga

SEQ ID NO: 730140 - RNA, 19 nt, Homo sapiens
ggugcugaauggcauggaa

SEQ ID NO: 730141 - RNA, 19 nt, Homo sapiens
aaauaugacaggaacauuc

SEQ ID NO: 730142 - RNA, 19 nt, Homo sapiens
caaauaugacaggaacauu

SEQ ID NO: 730143 - RNA, 19 nt, Homo sapiens
guggagcuguaccugacua

SEQ ID NO: 730144 - RNA, 19 nt, Homo sapiens
ccuuaauguuagugagaua

SEQ ID NO: 730145 - RNA, 19 nt, Homo sapiens
agaugaaacuccugacaac

SEQ ID NO: 730146 - RNA, 19 nt, Homo sapiens
caggaacauucaagugaca

SEQ ID NO: 730147 - RNA, 19 nt, Homo sapiens
gcucgucaaugaguaugug

SEQ ID NO: 730148 - RNA, 19 nt, Homo sapiens
ugacaggaacauucaagug

SEQ ID NO: 730149 - RNA, 19 nt, Homo sapiens
gccacaugauccuagagaa

SEQ ID NO: 730150 - RNA, 19 nt, Homo sapiens
cgagauguuccucaauuuc

SEQ ID NO: 730151 - RNA, 19 nt, Homo sapiens
ugaccaugcugaagcugau

SEQ ID NO: 730152 - RNA, 19 nt, Homo sapiens
gagaacauggacacgucua

SEQ ID NO: 730153 - RNA, 19 nt, Homo sapiens
gagcugggacauaaacucu

SEQ ID NO: 730154 - RNA, 19 nt, Homo sapiens
aggaauaugcuaggacuuu

SEQ ID NO: 730155 - RNA, 19 nt, Homo sapiens
ccugacaacugcgagaugu

SEQ ID NO: 730156 - RNA, 19 nt, Homo sapiens
ucuucuaccuaacaaauuc

SEQ ID NO: 730157 - RNA, 19 nt, Homo sapiens
caauuacaggucauuugaa

SEQ ID NO: 730158 - RNA, 19 nt, Homo sapiens
cggagaaacaucaauuaca

SEQ ID NO: 730159 - RNA, 19 nt, Homo sapiens
gcaggaacucauuaggaau

SEQ ID NO: 730160 - RNA, 19 nt, Homo sapiens
gagcuguaccugacuaacu

SEQ ID NO: 730161 - RNA, 19 nt, Homo sapiens
gcaguuccucgggcucuuu

SEQ ID NO: 730162 - RNA, 19 nt, Homo sapiens
ggcguccucucccacauca

SEQ ID NO: 730163 - RNA, 19 nt, Homo sapiens
cuucggcuguacaaacauu

SEQ ID NO: 730164 - RNA, 19 nt, Homo sapiens
aagcaggaacucauuagga

SEQ ID NO: 730165 - RNA, 19 nt, Homo sapiens
agauguuccucaauuucaa

SEQ ID NO: 730166 - RNA, 19 nt, Homo sapiens
ggucaucacggcccucaag

SEQ ID NO: 730167 - RNA, 19 nt, Homo sapiens
gcaaccugggcccuguaua

SEQ ID NO: 730168 - RNA, 19 nt, Homo sapiens
gggaauguggcagaaguga

SEQ ID NO: 730169 - RNA, 19 nt, Homo sapiens
gaagcaggaacucauuagg

SEQ ID NO: 730170 - RNA, 19 nt, Homo sapiens
agagaagcaggaacucauu

SEQ ID NO: 730171 - RNA, 19 nt, Homo sapiens
ucaacggcaugaagcucuu

SEQ ID NO: 730172 - RNA, 19 nt, Homo sapiens
gagcaccggccugagauca

SEQ ID NO: 730173 - RNA, 19 nt, Homo sapiens
auuccagccuacaaaguaa

SEQ ID NO: 730174 - RNA, 19 nt, Homo sapiens
gugauugagcacugcagua

SEQ ID NO: 730175 - RNA, 19 nt, Homo sapiens
aauuacaggucauuugaac

SEQ ID NO: 730176 - RNA, 19 nt, Homo sapiens
cagagaagcaggaacucau

SEQ ID NO: 730177 - RNA, 19 nt, Homo sapiens
gaacaacggugauuucuuc

SEQ ID NO: 730178 - RNA, 19 nt, Homo sapiens
ggaagaaguucgaugauga

SEQ ID NO: 730179 - RNA, 19 nt, Homo sapiens
gaaacaaggugucaucaag

SEQ ID NO: 730180 - RNA, 19 nt, Homo sapiens
gcucauaaaugcuguguug

SEQ ID NO: 730181 - RNA, 19 nt, Homo sapiens
guaagaggauggacaaaga

SEQ ID NO: 730182 - RNA, 19 nt, Homo sapiens
cagaggaccugauugauga

SEQ ID NO: 730183 - RNA, 19 nt, Homo sapiens
caacggugauuucuucauu

SEQ ID NO: 730184 - RNA, 19 nt, Homo sapiens
gcaaggcccuguuuagcaa

SEQ ID NO: 730185 - RNA, 19 nt, Homo sapiens
ggauagggcuggccuuugu

SEQ ID NO: 730186 - RNA, 19 nt, Homo sapiens
gaagauaucccggaaacaa

SEQ ID NO: 730187 - RNA, 19 nt, Homo sapiens
gagaugagguccuggaaca

SEQ ID NO: 730188 - RNA, 19 nt, Homo sapiens
gaacaggaacugcauaagu

SEQ ID NO: 730189 - RNA, 19 nt, Homo sapiens
gcagagcaaccaaggauaa

SEQ ID NO: 730190 - RNA, 19 nt, Homo sapiens
gugcugaacuucucugaug

SEQ ID NO: 730191 - RNA, 19 nt, Homo sapiens
gaagaacaacggugauuuc

SEQ ID NO: 730192 - RNA, 19 nt, Homo sapiens
gcagaggaccugauugaug

SEQ ID NO: 730193 - RNA, 19 nt, Homo sapiens
gaagaagaagguauccaaa

SEQ ID NO: 730194 - RNA, 19 nt, Homo sapiens
gcuggaagccugcagauga

SEQ ID NO: 730195 - RNA, 19 nt, Homo sapiens
ucaucaagcugaagaacaa

SEQ ID NO: 730196 - RNA, 19 nt, Homo sapiens
ucaaggacaugcgagauga

SEQ ID NO: 730197 - RNA, 19 nt, Homo sapiens
gaacccuccuccagugaga

SEQ ID NO: 730198 - RNA, 19 nt, Homo sapiens
gcucuacgauccugucauc

SEQ ID NO: 730199 - RNA, 19 nt, Homo sapiens
gguccggccuggaagauau

SEQ ID NO: 730200 - RNA, 19 nt, Homo sapiens
acaguaagcucaaggacau

SEQ ID NO: 730201 - RNA, 19 nt, Homo sapiens
ggaaacaaggugucaucaa

SEQ ID NO: 730202 - RNA, 19 nt, Homo sapiens
ccaaggauaaccagauuga

SEQ ID NO: 730203 - RNA, 19 nt, Homo sapiens
cgauucgucuuccuuauca

SEQ ID NO: 730204 - RNA, 19 nt, Homo sapiens
aacaggaacugcauaagug

SEQ ID NO: 730205 - RNA, 19 nt, Homo sapiens
ccaaauggcgccucagcaa

SEQ ID NO: 730206 - RNA, 19 nt, Homo sapiens
aaauucagcugccgcuuca

SEQ ID NO: 730207 - RNA, 19 nt, Homo sapiens
gccauugauuugagccuuu

SEQ ID NO: 730208 - RNA, 19 nt, Homo sapiens
aaccaaggauaaccagauu

SEQ ID NO: 730209 - RNA, 19 nt, Homo sapiens
ggaccugauugaugacagu

SEQ ID NO: 730210 - RNA, 19 nt, Homo sapiens
gaggauagggcuggccuuu

SEQ ID NO: 730211 - RNA, 19 nt, Homo sapiens
gggcugaggcugccaagau

SEQ ID NO: 730212 - RNA, 19 nt, Homo sapiens
aagcucaccuggucagaau

SEQ ID NO: 730213 - RNA, 19 nt, Homo sapiens
ggacuucgacaaccagaca

SEQ ID NO: 730214 - RNA, 19 nt, Homo sapiens
aaucuccucucagccuuua

SEQ ID NO: 730215 - RNA, 19 nt, Homo sapiens
ggaccucauugcccucauc

SEQ ID NO: 730216 - RNA, 19 nt, Homo sapiens
cugaugcgcucgcgugaga

SEQ ID NO: 730217 - RNA, 19 nt, Homo sapiens
gguacgcccugcucuacga

SEQ ID NO: 730218 - RNA, 19 nt, Homo sapiens
caaccaaggauaaccagau

SEQ ID NO: 730219 - RNA, 19 nt, Homo sapiens
agaagaagguauccaaagc

SEQ ID NO: 730220 - RNA, 19 nt, Homo sapiens
gggcagagcaaccaaggau

SEQ ID NO: 730221 - RNA, 19 nt, Homo sapiens
caugagcucuccggacuuc

SEQ ID NO: 730222 - RNA, 19 nt, Homo sapiens
gaagaaguucgaugaugag

SEQ ID NO: 730223 - RNA, 19 nt, Homo sapiens
agaggaagaaguucgauga

SEQ ID NO: 730224 - RNA, 19 nt, Homo sapiens
ccagguucaucaagaggaa

SEQ ID NO: 730225 - RNA, 19 nt, Homo sapiens
ugaagaacaacggugauuu

SEQ ID NO: 730226 - RNA, 19 nt, Homo sapiens
gaugagguccuggaacaug

SEQ ID NO: 730227 - RNA, 19 nt, Homo sapiens
ccagagcaaggcccuguuu

SEQ ID NO: 730228 - RNA, 19 nt, Homo sapiens
agaagaagaagguauccaa

SEQ ID NO: 730229 - RNA, 19 nt, Homo sapiens
ggaucuggcagucuaggaa

SEQ ID NO: 730230 - RNA, 19 nt, Homo sapiens
cagagcaaggcccuguuua

SEQ ID NO: 730231 - RNA, 19 nt, Homo sapiens
ccaagcgugugaagaagag

SEQ ID NO: 730232 - RNA, 19 nt, Homo sapiens
caccuucacuccugugucu

SEQ ID NO: 730233 - RNA, 19 nt, Homo sapiens
uggaagauaucccggaaac

SEQ ID NO: 730234 - RNA, 19 nt, Homo sapiens
aggaagaaguucgaugaug

SEQ ID NO: 730235 - RNA, 19 nt, Homo sapiens
gccaagaucacaccacagu

SEQ ID NO: 730236 - RNA, 19 nt, Homo sapiens
uguuggaucuggcagucua

SEQ ID NO: 730237 - RNA, 19 nt, Homo sapiens
aaggauaaccagauugaug

SEQ ID NO: 730238 - RNA, 19 nt, Homo sapiens
gaggauggacaaagauucu

SEQ ID NO: 730239 - RNA, 19 nt, Homo sapiens
ccaucuuccucucucuaaa

SEQ ID NO: 730240 - RNA, 19 nt, Homo sapiens
gaaucuccucucagccuuu

SEQ ID NO: 730241 - RNA, 19 nt, Homo sapiens
cggagaaauuguuggaucu

SEQ ID NO: 730242 - RNA, 19 nt, Homo sapiens
ggcugaggcugccaagauc

SEQ ID NO: 730243 - RNA, 19 nt, Homo sapiens
uaucaaccaggaccucauu

SEQ ID NO: 730244 - RNA, 19 nt, Homo sapiens
ggcagcucaugaagcagua

SEQ ID NO: 730245 - RNA, 19 nt, Homo sapiens
ccagugagaagaagaaggu

SEQ ID NO: 730246 - RNA, 19 nt, Homo sapiens
ccauugauuugagccuuug

SEQ ID NO: 730247 - RNA, 19 nt, Homo sapiens
gaccuccugcucauaaaug

SEQ ID NO: 730248 - RNA, 19 nt, Homo sapiens
ggauggacaaagauucuca

SEQ ID NO: 730249 - RNA, 19 nt, Homo sapiens
uggaacaggaacugcauaa

SEQ ID NO: 730250 - RNA, 19 nt, Homo sapiens
gcgauucgucuuccuuauc

SEQ ID NO: 730251 - RNA, 19 nt, Homo sapiens
gagcaaccaaggauaacca

SEQ ID NO: 730252 - RNA, 19 nt, Homo sapiens
acuggcagcucaugaagca

SEQ ID NO: 730253 - RNA, 19 nt, Homo sapiens
gagcaaggcccuguuuagc

SEQ ID NO: 730254 - RNA, 19 nt, Homo sapiens
gaggaagaaguucgaugau

SEQ ID NO: 730255 - RNA, 19 nt, Homo sapiens
gacagcaucacaggcauga

SEQ ID NO: 730256 - RNA, 19 nt, Homo sapiens
cacuucaggugaccaagga

SEQ ID NO: 730257 - RNA, 19 nt, Homo sapiens
ucaucaagaggaagaaguu

SEQ ID NO: 730258 - RNA, 19 nt, Homo sapiens
ccucaggcuucccuagauc

SEQ ID NO: 730259 - RNA, 19 nt, Homo sapiens
gaucuggcagucuaggaau

SEQ ID NO: 730260 - RNA, 19 nt, Homo sapiens
gauccugucaucuccaagu

SEQ ID NO: 730261 - RNA, 19 nt, Homo sapiens
guuuggaaccaguggcuuu

SEQ ID NO: 730262 - RNA, 19 nt, Homo sapiens
acaacucugugguggagau

SEQ ID NO: 730263 - RNA, 19 nt, Homo sapiens
aaauggcgccucagcaaca

SEQ ID NO: 730264 - RNA, 19 nt, Homo sapiens
ggcagagcaaccaaggaua

SEQ ID NO: 730265 - RNA, 19 nt, Homo sapiens
ccuggaacaugagcugaug

SEQ ID NO: 730266 - RNA, 19 nt, Homo sapiens
uaagaggauggacaaagau

SEQ ID NO: 730267 - RNA, 19 nt, Homo sapiens
agaguaaacagccacuuca

SEQ ID NO: 730268 - RNA, 19 nt, Homo sapiens
gccucagacucuucuuuua

SEQ ID NO: 730269 - RNA, 19 nt, Homo sapiens
gcuaguggacagcaucaca

SEQ ID NO: 730270 - RNA, 19 nt, Homo sapiens
gcacccagaggcuauugca

SEQ ID NO: 730271 - RNA, 19 nt, Homo sapiens
ccaccugggcgugaaauuc

SEQ ID NO: 730272 - RNA, 19 nt, Homo sapiens
gugagaagaagaagguauc

SEQ ID NO: 730273 - RNA, 19 nt, Homo sapiens
aggauaaccagauugaugu

SEQ ID NO: 730274 - RNA, 19 nt, Homo sapiens
agaagcuccuccagguuca

SEQ ID NO: 730275 - RNA, 19 nt, Homo sapiens
gcauaaguggcaggugcua

SEQ ID NO: 730276 - RNA, 19 nt, Homo sapiens
augagguccuggaacauga

SEQ ID NO: 730277 - RNA, 19 nt, Homo sapiens
ggaggaagcugcccagauc

SEQ ID NO: 730278 - RNA, 19 nt, Homo sapiens
ggacugcaaugaccuauuc

SEQ ID NO: 730279 - RNA, 19 nt, Homo sapiens
ggagagggaugcccaggaa

SEQ ID NO: 730280 - RNA, 19 nt, Homo sapiens
ccaguuggcuuguguaugg

SEQ ID NO: 730281 - RNA, 19 nt, Homo sapiens
gagcaggacuccagacucu

SEQ ID NO: 730282 - RNA, 19 nt, Homo sapiens
ccaacaugcugcaccuuaa

SEQ ID NO: 730283 - RNA, 19 nt, Homo sapiens
acccacagcuacaacauua

SEQ ID NO: 730284 - RNA, 19 nt, Homo sapiens
ccaacccgauucacucuuu

SEQ ID NO: 730285 - RNA, 19 nt, Homo sapiens
gaagcugacuuucuauagg

SEQ ID NO: 730286 - RNA, 19 nt, Homo sapiens
ccucuucucuuucucugua

SEQ ID NO: 730287 - RNA, 19 nt, Homo sapiens
ggucaccucugcugccauu

SEQ ID NO: 730288 - RNA, 19 nt, Homo sapiens
ggaagagaaggcauauuga

SEQ ID NO: 730289 - RNA, 19 nt, Homo sapiens
ugaggaacaucuccaagga

SEQ ID NO: 730290 - RNA, 19 nt, Homo sapiens
caaguggccuuugcugaug

SEQ ID NO: 730291 - RNA, 19 nt, Homo sapiens
ccaccaggcucguucaaag

SEQ ID NO: 730292 - RNA, 19 nt, Homo sapiens
uuaaggagcugggacugaa

SEQ ID NO: 730293 - RNA, 19 nt, Homo sapiens
gaagagaaggcauauugag

SEQ ID NO: 730294 - RNA, 19 nt, Homo sapiens
gaaaggaacgaaaggaacu

SEQ ID NO: 730295 - RNA, 19 nt, Homo sapiens
guaccuuuguggagaaaug

SEQ ID NO: 730296 - RNA, 19 nt, Homo sapiens
gaaaucacuaggacuacuu

SEQ ID NO: 730297 - RNA, 19 nt, Homo sapiens
gccaacaugcugcaccuua

SEQ ID NO: 730298 - RNA, 19 nt, Homo sapiens
ggacuugccagcugauuag

SEQ ID NO: 730299 - RNA, 19 nt, Homo sapiens
uuccgaagcugacuuucua

SEQ ID NO: 730300 - RNA, 19 nt, Homo sapiens
agagaaaucacuaggacua

SEQ ID NO: 730301 - RNA, 19 nt, Homo sapiens
guacugggccugccugcaa

SEQ ID NO: 730302 - RNA, 19 nt, Homo sapiens
ggagaugacggaccacugu

SEQ ID NO: 730303 - RNA, 19 nt, Homo sapiens
gcacaggccaacccaggaa

SEQ ID NO: 730304 - RNA, 19 nt, Homo sapiens
gcaugaaccugcgggagau

SEQ ID NO: 730305 - RNA, 19 nt, Homo sapiens
gggaaaggaacgaaaggaa

SEQ ID NO: 730306 - RNA, 19 nt, Homo sapiens
caacaacaacgcucucagu

SEQ ID NO: 730307 - RNA, 19 nt, Homo sapiens
uacaggaacucuaucucaa

SEQ ID NO: 730308 - RNA, 19 nt, Homo sapiens
guucaaagacccacagcuu

SEQ ID NO: 730309 - RNA, 19 nt, Homo sapiens
caacauuacccgccuccuu

SEQ ID NO: 730310 - RNA, 19 nt, Homo sapiens
uccuagaccucaacaagaa

SEQ ID NO: 730311 - RNA, 19 nt, Homo sapiens
uaagacgguuagugugguu

SEQ ID NO: 730312 - RNA, 19 nt, Homo sapiens
gaagaggcagggcuauaca

SEQ ID NO: 730313 - RNA, 19 nt, Homo sapiens
gagcugggacugaacaaca

SEQ ID NO: 730314 - RNA, 19 nt, Homo sapiens
aggaagagaaggcauauug

SEQ ID NO: 730315 - RNA, 19 nt, Homo sapiens
acacuuguaucuggacuug

SEQ ID NO: 730316 - RNA, 19 nt, Homo sapiens
caacuuggagauacucaug

SEQ ID NO: 730317 - RNA, 19 nt, Homo sapiens
gugguacccuggcauguuc

SEQ ID NO: 730318 - RNA, 19 nt, Homo sapiens
gcaggacuccagacucuuc

SEQ ID NO: 730319 - RNA, 19 nt, Homo sapiens
acaaggaagagaaggcaua

SEQ ID NO: 730320 - RNA, 19 nt, Homo sapiens
gggagggacuuuggcuaga

SEQ ID NO: 730321 - RNA, 19 nt, Homo sapiens
gaugacggaccacuguuug

SEQ ID NO: 730322 - RNA, 19 nt, Homo sapiens
uugaaaugcugcccaacuu

SEQ ID NO: 730323 - RNA, 19 nt, Homo sapiens
acgggaagcugaagauaca

SEQ ID NO: 730324 - RNA, 19 nt, Homo sapiens
gacuuucuauaggcaauuu

SEQ ID NO: 730325 - RNA, 19 nt, Homo sapiens
gcauuccgaagcugacuuu

SEQ ID NO: 730326 - RNA, 19 nt, Homo sapiens
ggaccaaagaggccacuuc

SEQ ID NO: 730327 - RNA, 19 nt, Homo sapiens
uaucacauccugcuaucuu

SEQ ID NO: 730328 - RNA, 19 nt, Homo sapiens
cagaagaggcagggcuaua

SEQ ID NO: 730329 - RNA, 19 nt, Homo sapiens
aagcuggacaucaccaaua

SEQ ID NO: 730330 - RNA, 19 nt, Homo sapiens
cuacaggaacucuaucuca

SEQ ID NO: 730331 - RNA, 19 nt, Homo sapiens
gcagcugggccaagacaga

SEQ ID NO: 730332 - RNA, 19 nt, Homo sapiens
ggccacuucuugccacaga

SEQ ID NO: 730333 - RNA, 19 nt, Homo sapiens
ugaccaagcuggacaucac

SEQ ID NO: 730334 - RNA, 19 nt, Homo sapiens
ggagggacuuuggcuagag

SEQ ID NO: 730335 - RNA, 19 nt, Homo sapiens
gaggaacaucuccaaggaa

SEQ ID NO: 730336 - RNA, 19 nt, Homo sapiens
ggaacgaaaggaacuaaaa

SEQ ID NO: 730337 - RNA, 19 nt, Homo sapiens
aagcugaccacacuuguau

SEQ ID NO: 730338 - RNA, 19 nt, Homo sapiens
ccaggaacgccucaucuca

SEQ ID NO: 730339 - RNA, 19 nt, Homo sapiens
ccgaagcugacuuucuaua

SEQ ID NO: 730340 - RNA, 19 nt, Homo sapiens
gagacacuguugccaccau

SEQ ID NO: 730341 - RNA, 19 nt, Homo sapiens
gaacccacagcuacaacau

SEQ ID NO: 730342 - RNA, 19 nt, Homo sapiens
gauuggcggcaacaaggua

SEQ ID NO: 730343 - RNA, 19 nt, Homo sapiens
cugcagagcaacagcauug

SEQ ID NO: 730344 - RNA, 19 nt, Homo sapiens
cgaagcugacuuucuauag

SEQ ID NO: 730345 - RNA, 19 nt, Homo sapiens
aaguugcccuuaccuccua

SEQ ID NO: 730346 - RNA, 19 nt, Homo sapiens
gacauggacccacgugcuu

SEQ ID NO: 730347 - RNA, 19 nt, Homo sapiens
caaggaagagaaggcauau

SEQ ID NO: 730348 - RNA, 19 nt, Homo sapiens
agcuggacaucaccaauaa

SEQ ID NO: 730349 - RNA, 19 nt, Homo sapiens
ccacgggaagcugaagaua

SEQ ID NO: 730350 - RNA, 19 nt, Homo sapiens
agacacuguugccaccauu

SEQ ID NO: 730351 - RNA, 19 nt, Homo sapiens
gaccaaagaggccacuucu

SEQ ID NO: 730352 - RNA, 19 nt, Homo sapiens
cagaggacaaggaagagaa

SEQ ID NO: 730353 - RNA, 19 nt, Homo sapiens
cccugcagcuccaccauga

SEQ ID NO: 730354 - RNA, 19 nt, Homo sapiens
ggucuccaucgacaaguuu

SEQ ID NO: 730355 - RNA, 19 nt, Homo sapiens
ucaaguuccuagaccucaa

SEQ ID NO: 730356 - RNA, 19 nt, Homo sapiens
ugaaaugcugcccaacuug

SEQ ID NO: 730357 - RNA, 19 nt, Homo sapiens
agccagaucugaaggacau

SEQ ID NO: 730358 - RNA, 19 nt, Homo sapiens
ccagcugggcuucgacuga

SEQ ID NO: 730359 - RNA, 19 nt, Homo sapiens
caagacagauggggcuuug

SEQ ID NO: 730360 - RNA, 19 nt, Homo sapiens
ggagggugacagcagaaga

SEQ ID NO: 730361 - RNA, 19 nt, Homo sapiens
uggagacccucaugcucaa

SEQ ID NO: 730362 - RNA, 19 nt, Homo sapiens
gguauacaaaccuccaugu

SEQ ID NO: 730363 - RNA, 19 nt, Homo sapiens
ucaguugcuugcucuugug

SEQ ID NO: 730364 - RNA, 19 nt, Homo sapiens
cugcugccauucugaggaa

SEQ ID NO: 730365 - RNA, 19 nt, Homo sapiens
uauacaaaccuccaugucu

SEQ ID NO: 730366 - RNA, 19 nt, Homo sapiens
gcaguagagaaaucacuag

SEQ ID NO: 730367 - RNA, 19 nt, Homo sapiens
gggaggaagcugcccagau

SEQ ID NO: 730368 - RNA, 19 nt, Homo sapiens
caacaugcugcaccuuaag

SEQ ID NO: 730369 - RNA, 19 nt, Homo sapiens
gcagagcaacagcauuguc

SEQ ID NO: 730370 - RNA, 19 nt, Homo sapiens
ggaacgggagggacuuugg

SEQ ID NO: 730371 - RNA, 19 nt, Homo sapiens
uggacuugccagcugauua

SEQ ID NO: 730372 - RNA, 19 nt, Homo sapiens
gaagcucagccuguucuca

SEQ ID NO: 730373 - RNA, 19 nt, Homo sapiens
ccuaucacauccugcuauc

SEQ ID NO: 730374 - RNA, 19 nt, Homo sapiens
gcugacacuaagacgguua

SEQ ID NO: 730375 - RNA, 19 nt, Homo sapiens
gagaugacggaccacuguu

SEQ ID NO: 730376 - RNA, 19 nt, Homo sapiens
uuggagauacucaugauug

SEQ ID NO: 730377 - RNA, 19 nt, Homo sapiens
caaccaaacucaaugauga

SEQ ID NO: 730378 - RNA, 19 nt, Homo sapiens
gcagagcuauguguaaaua

SEQ ID NO: 730379 - RNA, 19 nt, Homo sapiens
ggaagggcauuaagacaaa

SEQ ID NO: 730380 - RNA, 19 nt, Homo sapiens
cauacaagauggaacaaua

SEQ ID NO: 730381 - RNA, 19 nt, Homo sapiens
cuacaaagccucccagaua

SEQ ID NO: 730382 - RNA, 19 nt, Homo sapiens
ggacacagcugcacguucu

SEQ ID NO: 730383 - RNA, 19 nt, Homo sapiens
gcaugaguauugucucuuu

SEQ ID NO: 730384 - RNA, 19 nt, Homo sapiens
gaagcuauucggauaauuu

SEQ ID NO: 730385 - RNA, 19 nt, Homo sapiens
ucaaaucacugaaccaugu

SEQ ID NO: 730386 - RNA, 19 nt, Homo sapiens
ugagugguguuaagaauaa

SEQ ID NO: 730387 - RNA, 19 nt, Homo sapiens
ccaagaaacugaggaaugu

SEQ ID NO: 730388 - RNA, 19 nt, Homo sapiens
guuggaagcuauucggaua

SEQ ID NO: 730389 - RNA, 19 nt, Homo sapiens
gaagcaagacuaauggaaa

SEQ ID NO: 730390 - RNA, 19 nt, Homo sapiens
gaacagcacauaaagaaca

SEQ ID NO: 730391 - RNA, 19 nt, Homo sapiens
gaggagauguggcaccauu

SEQ ID NO: 730392 - RNA, 19 nt, Homo sapiens
caagauggaacaauaguuu

SEQ ID NO: 730393 - RNA, 19 nt, Homo sapiens
ggagauguggcaccauuua

SEQ ID NO: 730394 - RNA, 19 nt, Homo sapiens
ggagaaguauuagacacua

SEQ ID NO: 730395 - RNA, 19 nt, Homo sapiens
gggagcacaucuauuacua

SEQ ID NO: 730396 - RNA, 19 nt, Homo sapiens
aaagagauuuggcuaguug

SEQ ID NO: 730397 - RNA, 19 nt, Homo sapiens
ggacagcuaagucaguaua

SEQ ID NO: 730398 - RNA, 19 nt, Homo sapiens
guaacugaaugguuuguga

SEQ ID NO: 730399 - RNA, 19 nt, Homo sapiens
ucacagaacuggagaacca

SEQ ID NO: 730400 - RNA, 19 nt, Homo sapiens
gaggcaugcuuuaauauca

SEQ ID NO: 730401 - RNA, 19 nt, Homo sapiens
aaggaggcaugcuuuaaua

SEQ ID NO: 730402 - RNA, 19 nt, Homo sapiens
gcacuuaaauuucgaaccu

SEQ ID NO: 730403 - RNA, 19 nt, Homo sapiens
gaaggaggcaugcuuuaau

SEQ ID NO: 730404 - RNA, 19 nt, Homo sapiens
ggaaggaggcaugcuuuaa

SEQ ID NO: 730405 - RNA, 19 nt, Homo sapiens
ggaagagggaucaauguug

SEQ ID NO: 730406 - RNA, 19 nt, Homo sapiens
ggccggagcauauuaauga

SEQ ID NO: 730407 - RNA, 19 nt, Homo sapiens
uaggguggauacuuuauuu

SEQ ID NO: 730408 - RNA, 19 nt, Homo sapiens
ggagagaauugaagaaagc

SEQ ID NO: 730409 - RNA, 19 nt, Homo sapiens
ggaaauguggagagaauug

SEQ ID NO: 730410 - RNA, 19 nt, Homo sapiens
gcaauacuagcauacguuu

SEQ ID NO: 730411 - RNA, 19 nt, Homo sapiens
gggaauaacuugauuuugu

SEQ ID NO: 730412 - RNA, 19 nt, Homo sapiens
uuccagggauugugaaaua

SEQ ID NO: 730413 - RNA, 19 nt, Homo sapiens
cuucagauguucacuaaau

SEQ ID NO: 730414 - RNA, 19 nt, Homo sapiens
cagcuaagucaguauauuu

SEQ ID NO: 730415 - RNA, 19 nt, Homo sapiens
ggaugcaaguuuaggaaau

SEQ ID NO: 730416 - RNA, 19 nt, Homo sapiens
caaagccucccagauauaa

SEQ ID NO: 730417 - RNA, 19 nt, Homo sapiens
uacaaagccucccagauau

SEQ ID NO: 730418 - RNA, 19 nt, Homo sapiens
caggacagcuaagucagua

SEQ ID NO: 730419 - RNA, 19 nt, Homo sapiens
uguguuagcuaugggaaua

SEQ ID NO: 730420 - RNA, 19 nt, Homo sapiens
gcacauuucccuaaaagua

SEQ ID NO: 730421 - RNA, 19 nt, Homo sapiens
ggccugaaguuguagaaau

SEQ ID NO: 730422 - RNA, 19 nt, Homo sapiens
aagcgcacuuucacucuua

SEQ ID NO: 730423 - RNA, 19 nt, Homo sapiens
guccgacucuccugaugua

SEQ ID NO: 730424 - RNA, 19 nt, Homo sapiens
gcacauaaagaacaauaag

SEQ ID NO: 730425 - RNA, 19 nt, Homo sapiens
gaaaagugccauaaacuga

SEQ ID NO: 730426 - RNA, 19 nt, Homo sapiens
gauguggcaccauuuauug

SEQ ID NO: 730427 - RNA, 19 nt, Homo sapiens
gauguucacuaaauaacuc

SEQ ID NO: 730428 - RNA, 19 nt, Homo sapiens
gcggacugauaacauuuaa

SEQ ID NO: 730429 - RNA, 19 nt, Homo sapiens
aagcuauaguggcauauuu

SEQ ID NO: 730430 - RNA, 19 nt, Homo sapiens
aaagugccauaaacugaaa

SEQ ID NO: 730431 - RNA, 19 nt, Homo sapiens
uuagagcaauacuagcaua

SEQ ID NO: 730432 - RNA, 19 nt, Homo sapiens
gagcaaccaaacucaauga

SEQ ID NO: 730433 - RNA, 19 nt, Homo sapiens
ccgaagcuauaguggcaua

SEQ ID NO: 730434 - RNA, 19 nt, Homo sapiens
gaaauguggagagaauuga

SEQ ID NO: 730435 - RNA, 19 nt, Homo sapiens
aagcaagacuaauggaaau

SEQ ID NO: 730436 - RNA, 19 nt, Homo sapiens
gggaagggcauuaagacaa

SEQ ID NO: 730437 - RNA, 19 nt, Homo sapiens
auacuucccucaauucugu

SEQ ID NO: 730438 - RNA, 19 nt, Homo sapiens
aggauggccugaaguugua

SEQ ID NO: 730439 - RNA, 19 nt, Homo sapiens
uuacugggcggacugauaa

SEQ ID NO: 730440 - RNA, 19 nt, Homo sapiens
gucaguauauuuagagcaa

SEQ ID NO: 730441 - RNA, 19 nt, Homo sapiens
ggagcacaucuauuacuaa

SEQ ID NO: 730442 - RNA, 19 nt, Homo sapiens
gcaaccaaacucaaugaug

SEQ ID NO: 730443 - RNA, 19 nt, Homo sapiens
ggaagcuauucggauaauu

SEQ ID NO: 730444 - RNA, 19 nt, Homo sapiens
gagcaauacuagcauacgu

SEQ ID NO: 730445 - RNA, 19 nt, Homo sapiens
gcaaguuuaggaaaucuau

SEQ ID NO: 730446 - RNA, 19 nt, Homo sapiens
uuagacugcuaugguaaua

SEQ ID NO: 730447 - RNA, 19 nt, Homo sapiens
gaugcaaguuuaggaaauc

SEQ ID NO: 730448 - RNA, 19 nt, Homo sapiens
gccugaaguuguagaaaug

SEQ ID NO: 730449 - RNA, 19 nt, Homo sapiens
ggaggccggagcauauuaa

SEQ ID NO: 730450 - RNA, 19 nt, Homo sapiens
gguggcagcuucacagaac

SEQ ID NO: 730451 - RNA, 19 nt, Homo sapiens
uaauggaaauguggagaga

SEQ ID NO: 730452 - RNA, 19 nt, Homo sapiens
cagcacauaaagaacaaua

SEQ ID NO: 730453 - RNA, 19 nt, Homo sapiens
acaaagccucccagauaua

SEQ ID NO: 730454 - RNA, 19 nt, Homo sapiens
agcaguaucuguuauuuag

SEQ ID NO: 730455 - RNA, 19 nt, Homo sapiens
uaugaaguaucucaaacug

SEQ ID NO: 730456 - RNA, 19 nt, Homo sapiens
uuuguuaccuucagauguu

SEQ ID NO: 730457 - RNA, 19 nt, Homo sapiens
gaagcuauaguggcauauu

SEQ ID NO: 730458 - RNA, 19 nt, Homo sapiens
uguuuagacugcuauggua

SEQ ID NO: 730459 - RNA, 19 nt, Homo sapiens
caagacuaauggaaaugug

SEQ ID NO: 730460 - RNA, 19 nt, Homo sapiens
ccuggaagauaauguuuua

SEQ ID NO: 730461 - RNA, 19 nt, Homo sapiens
gaaaacauacaucggauau

SEQ ID NO: 730462 - RNA, 19 nt, Homo sapiens
aguuguguguguaauguua

SEQ ID NO: 730463 - RNA, 19 nt, Homo sapiens
agacugcuaugguaauaca

SEQ ID NO: 730464 - RNA, 19 nt, Homo sapiens
gggaggccggagcauauua

SEQ ID NO: 730465 - RNA, 19 nt, Homo sapiens
gcacuuucacucuuaaugg

SEQ ID NO: 730466 - RNA, 19 nt, Homo sapiens
gaacaauaaggauacaaac

SEQ ID NO: 730467 - RNA, 19 nt, Homo sapiens
ggaggcaugcuuuaauauc

SEQ ID NO: 730468 - RNA, 19 nt, Homo sapiens
ggauuuguguuagcuaugg

SEQ ID NO: 730469 - RNA, 19 nt, Homo sapiens
gaaggauggccugaaguug

SEQ ID NO: 730470 - RNA, 19 nt, Homo sapiens
gaucaaacugccauucaca

SEQ ID NO: 730471 - RNA, 19 nt, Homo sapiens
ggugugugcaugaguauug

SEQ ID NO: 730472 - RNA, 19 nt, Homo sapiens
gcaagacuaauggaaaugu

SEQ ID NO: 730473 - RNA, 19 nt, Homo sapiens
ugaaggauggccugaaguu

SEQ ID NO: 730474 - RNA, 19 nt, Homo sapiens
uaugaaggauggccugaag

SEQ ID NO: 730475 - RNA, 19 nt, Homo sapiens
cagggauugugaaauaaau

SEQ ID NO: 730476 - RNA, 19 nt, Homo sapiens
gggcauuaaauauauguug

SEQ ID NO: 730477 - RNA, 19 nt, Homo sapiens
uaaagaagcugaaguuguu

SEQ ID NO: 730478 - RNA, 19 nt, Homo sapiens
caagaaagauggaacuguu

SEQ ID NO: 730479 - RNA, 19 nt, Homo sapiens
gaaacuuccuccaguauuc

SEQ ID NO: 730480 - RNA, 19 nt, Homo sapiens
gaguuuggaucuugacaua

SEQ ID NO: 730481 - RNA, 19 nt, Homo sapiens
gagaagaaugugacaaaua

SEQ ID NO: 730482 - RNA, 19 nt, Homo sapiens
gaauggaugucaggaaauu

SEQ ID NO: 730483 - RNA, 19 nt, Homo sapiens
ugaagaugcuguuaagaaa

SEQ ID NO: 730484 - RNA, 19 nt, Homo sapiens
uaucauagcuagugaagau

SEQ ID NO: 730485 - RNA, 19 nt, Homo sapiens
caauugaagugaagacaaa

SEQ ID NO: 730486 - RNA, 19 nt, Homo sapiens
gaagaaagcaggacugagu

SEQ ID NO: 730487 - RNA, 19 nt, Homo sapiens
ggcaaagucucaccugaaa

SEQ ID NO: 730488 - RNA, 19 nt, Homo sapiens
gcaauguccugcagaguuc

SEQ ID NO: 730489 - RNA, 19 nt, Homo sapiens
acaccugguucacgaauua

SEQ ID NO: 730490 - RNA, 19 nt, Homo sapiens
uaaugaugcuggcuacuuu

SEQ ID NO: 730491 - RNA, 19 nt, Homo sapiens
gagaggaguuuggaucuug

SEQ ID NO: 730492 - RNA, 19 nt, Homo sapiens
ggacauggauuugguagag

SEQ ID NO: 730493 - RNA, 19 nt, Homo sapiens
gugaauggaugucaggaaa

SEQ ID NO: 730494 - RNA, 19 nt, Homo sapiens
gaugcuggcuacuuuaaug

SEQ ID NO: 730495 - RNA, 19 nt, Homo sapiens
gauggaaagcugcuaauga

SEQ ID NO: 730496 - RNA, 19 nt, Homo sapiens
gaacgcccuuuggagcuua

SEQ ID NO: 730497 - RNA, 19 nt, Homo sapiens
gaugaaauggcaccaauug

SEQ ID NO: 730498 - RNA, 19 nt, Homo sapiens
gaaguacauucucucagau

SEQ ID NO: 730499 - RNA, 19 nt, Homo sapiens
acagaaacuuccuccagua

SEQ ID NO: 730500 - RNA, 19 nt, Homo sapiens
ggcaaugacugcagagaau

SEQ ID NO: 730501 - RNA, 19 nt, Homo sapiens
cuacugacuugucugaauu

SEQ ID NO: 730502 - RNA, 19 nt, Homo sapiens
ugaaauggcaccaauugaa

SEQ ID NO: 730503 - RNA, 19 nt, Homo sapiens
gcuccgagguguguuugua

SEQ ID NO: 730504 - RNA, 19 nt, Homo sapiens
ccacuucugccuuagauaa

SEQ ID NO: 730505 - RNA, 19 nt, Homo sapiens
ucacaccacuggcaagaau

SEQ ID NO: 730506 - RNA, 19 nt, Homo sapiens
gugaagaugcuguuaagaa

SEQ ID NO: 730507 - RNA, 19 nt, Homo sapiens
gcauugaucaugaauagga

SEQ ID NO: 730508 - RNA, 19 nt, Homo sapiens
ugcuggagcuguuaucaua

SEQ ID NO: 730509 - RNA, 19 nt, Homo sapiens
gaaauggcaccaauugaag

SEQ ID NO: 730510 - RNA, 19 nt, Homo sapiens
gcuacugacuugucugaau

SEQ ID NO: 730511 - RNA, 19 nt, Homo sapiens
aaaccacccuggaacaguu

SEQ ID NO: 730512 - RNA, 19 nt, Homo sapiens
ggaggaaccgaaagcauga

SEQ ID NO: 730513 - RNA, 19 nt, Homo sapiens
aaccaccacuucugccuua

SEQ ID NO: 730514 - RNA, 19 nt, Homo sapiens
cagagaagaaugugacaaa

SEQ ID NO: 730515 - RNA, 19 nt, Homo sapiens
gaagugaagacaaagaaag

SEQ ID NO: 730516 - RNA, 19 nt, Homo sapiens
ggcaaggcauguugguuug

SEQ ID NO: 730517 - RNA, 19 nt, Homo sapiens
caaagucucaccugaaaca

SEQ ID NO: 730518 - RNA, 19 nt, Homo sapiens
ggagguggccaagguauug

SEQ ID NO: 730519 - RNA, 19 nt, Homo sapiens
ccagcucucacgauuaaua

SEQ ID NO: 730520 - RNA, 19 nt, Homo sapiens
ccagugaaauaugauguau

SEQ ID NO: 730521 - RNA, 19 nt, Homo sapiens
guauugcugucaucauuca

SEQ ID NO: 730522 - RNA, 19 nt, Homo sapiens
uuacggaggccuucugaaa

SEQ ID NO: 730523 - RNA, 19 nt, Homo sapiens
uggaucagcuugcauugga

SEQ ID NO: 730524 - RNA, 19 nt, Homo sapiens
cugcagaguucuucagaug

SEQ ID NO: 730525 - RNA, 19 nt, Homo sapiens
aaacucaacuauagaagac

SEQ ID NO: 730526 - RNA, 19 nt, Homo sapiens
gaaagcugcuaaugaugcu

SEQ ID NO: 730527 - RNA, 19 nt, Homo sapiens
gucaggaaauuuguguuaa

SEQ ID NO: 730528 - RNA, 19 nt, Homo sapiens
ugucaggaaauuuguguua

SEQ ID NO: 730529 - RNA, 19 nt, Homo sapiens
gcagaguucuucagaugcu

SEQ ID NO: 730530 - RNA, 19 nt, Homo sapiens
caagcucccuacuguguca

SEQ ID NO: 730531 - RNA, 19 nt, Homo sapiens
uacauucucucagauuuga

SEQ ID NO: 730532 - RNA, 19 nt, Homo sapiens
gagcuaaaacucaacuaua

SEQ ID NO: 730533 - RNA, 19 nt, Homo sapiens
uugaaccagugaaauauga

SEQ ID NO: 730534 - RNA, 19 nt, Homo sapiens
ccauugaaacagugauuaa

SEQ ID NO: 730535 - RNA, 19 nt, Homo sapiens
cagagcagcugccacaacu

SEQ ID NO: 730536 - RNA, 19 nt, Homo sapiens
cgagguguguuuguaguug

SEQ ID NO: 730537 - RNA, 19 nt, Homo sapiens
guacauucucucagauuug

SEQ ID NO: 730538 - RNA, 19 nt, Homo sapiens
guuuggaucuugacauaag

SEQ ID NO: 730539 - RNA, 19 nt, Homo sapiens
caagaauugugggcuacuu

SEQ ID NO: 730540 - RNA, 19 nt, Homo sapiens
acggaggccuucugaaaga

SEQ ID NO: 730541 - RNA, 19 nt, Homo sapiens
auaucaagcuggaagauuc

SEQ ID NO: 730542 - RNA, 19 nt, Homo sapiens
gauaucaagcuggaagauu

SEQ ID NO: 730543 - RNA, 19 nt, Homo sapiens
ugacuugucugaauuugcu

SEQ ID NO: 730544 - RNA, 19 nt, Homo sapiens
ggcaauguccugcagaguu

SEQ ID NO: 730545 - RNA, 19 nt, Homo sapiens
agucucaccugaaacaguu

SEQ ID NO: 730546 - RNA, 19 nt, Homo sapiens
auggaaagcugcuaaugau

SEQ ID NO: 730547 - RNA, 19 nt, Homo sapiens
caaaauaagcagagaagaa

SEQ ID NO: 730548 - RNA, 19 nt, Homo sapiens
aagcuuggaucagauauca

SEQ ID NO: 730549 - RNA, 19 nt, Homo sapiens
guucuucagaugcuauaua

SEQ ID NO: 730550 - RNA, 19 nt, Homo sapiens
aauaggagcccaugcuaga

SEQ ID NO: 730551 - RNA, 19 nt, Homo sapiens
gggaaugcaucggguguag

SEQ ID NO: 730552 - RNA, 19 nt, Homo sapiens
aagaaagauggaacuguua

SEQ ID NO: 730553 - RNA, 19 nt, Homo sapiens
caaauaugcccugcaguca

SEQ ID NO: 730554 - RNA, 19 nt, Homo sapiens
gaagaaugugacaaauaug

SEQ ID NO: 730555 - RNA, 19 nt, Homo sapiens
caggaaauuuguguuaaag

SEQ ID NO: 730556 - RNA, 19 nt, Homo sapiens
uggcaaggcauguugguuu

SEQ ID NO: 730557 - RNA, 19 nt, Homo sapiens
gaaccagugaaauaugaug

SEQ ID NO: 730558 - RNA, 19 nt, Homo sapiens
uuaaggacauggauuuggu

SEQ ID NO: 730559 - RNA, 19 nt, Homo sapiens
gcuggcuacuuuaaugaug

SEQ ID NO: 730560 - RNA, 19 nt, Homo sapiens
aguacauucucucagauuu

SEQ ID NO: 730561 - RNA, 19 nt, Homo sapiens
aauaugcccugcagucaca

SEQ ID NO: 730562 - RNA, 19 nt, Homo sapiens
uuaaagaagcugaaguugu

SEQ ID NO: 730563 - RNA, 19 nt, Homo sapiens
gcuaagcgaacgcccuuug

SEQ ID NO: 730564 - RNA, 19 nt, Homo sapiens
uaaauguugccuuaacuuc

SEQ ID NO: 730565 - RNA, 19 nt, Homo sapiens
ugauguauuucugagcuaa

SEQ ID NO: 730566 - RNA, 19 nt, Homo sapiens
ugaauaggagcccaugcua

SEQ ID NO: 730567 - RNA, 19 nt, Homo sapiens
agguauugcugucaucauu

SEQ ID NO: 730568 - RNA, 19 nt, Homo sapiens
cugaaacaguugacagugu

SEQ ID NO: 730569 - RNA, 19 nt, Homo sapiens
uagugaagaugcuguuaag

SEQ ID NO: 730570 - RNA, 19 nt, Homo sapiens
gaaacaguugacaguguga

SEQ ID NO: 730571 - RNA, 19 nt, Homo sapiens
agagaagaaugugacaaau

SEQ ID NO: 730572 - RNA, 19 nt, Homo sapiens
gccaagcucccuacugugu

SEQ ID NO: 730573 - RNA, 19 nt, Homo sapiens
acaguugacagugugauua

SEQ ID NO: 730574 - RNA, 19 nt, Homo sapiens
gaagaugcuguuaagaaac

SEQ ID NO: 730575 - RNA, 19 nt, Homo sapiens
cuagugaagaugcuguuaa

SEQ ID NO: 730576 - RNA, 19 nt, Homo sapiens
cagaaacuuccuccaguau

SEQ ID NO: 730577 - RNA, 19 nt, Homo sapiens
ggaagaaguucgaugauga

SEQ ID NO: 730578 - RNA, 19 nt, Homo sapiens
ggaagacgcuugaagagaa

SEQ ID NO: 730579 - RNA, 19 nt, Homo sapiens
gaugaugacugguugaaga

SEQ ID NO: 730580 - RNA, 19 nt, Homo sapiens
gcaagcagcauuugggaua

SEQ ID NO: 730581 - RNA, 19 nt, Homo sapiens
caucacagauauucagauu

SEQ ID NO: 730582 - RNA, 19 nt, Homo sapiens
gcucaaauccucaggugua

SEQ ID NO: 730583 - RNA, 19 nt, Homo sapiens
ggaaguggacgacaaaguu

SEQ ID NO: 730584 - RNA, 19 nt, Homo sapiens
ccaaaccaaugagaauuaa

SEQ ID NO: 730585 - RNA, 19 nt, Homo sapiens
guacauggacaucaagauu

SEQ ID NO: 730586 - RNA, 19 nt, Homo sapiens
gaagacgcuugaagagaau

SEQ ID NO: 730587 - RNA, 19 nt, Homo sapiens
gccaaaccaaugagaauua

SEQ ID NO: 730588 - RNA, 19 nt, Homo sapiens
gcaagcaugugguguuugg

SEQ ID NO: 730589 - RNA, 19 nt, Homo sapiens
gaagaaguucgaugaugaa

SEQ ID NO: 730590 - RNA, 19 nt, Homo sapiens
gggaagaaguucgaugaug

SEQ ID NO: 730591 - RNA, 19 nt, Homo sapiens
gcucuuacguguuuucuuu

SEQ ID NO: 730592 - RNA, 19 nt, Homo sapiens
ggacguacaauucguguca

SEQ ID NO: 730593 - RNA, 19 nt, Homo sapiens
cgacaaaguucuucaugcu

SEQ ID NO: 730594 - RNA, 19 nt, Homo sapiens
gcaaggacgggaagccaaa

SEQ ID NO: 730595 - RNA, 19 nt, Homo sapiens
ugaagagaauaaagaggaa

SEQ ID NO: 730596 - RNA, 19 nt, Homo sapiens
ggagacaucacagauauuc

SEQ ID NO: 730597 - RNA, 19 nt, Homo sapiens
guguggcucuuacguguuu

SEQ ID NO: 730598 - RNA, 19 nt, Homo sapiens
cagaggaaguggacgacaa

SEQ ID NO: 730599 - RNA, 19 nt, Homo sapiens
ucacagauauucagauucc

SEQ ID NO: 730600 - RNA, 19 nt, Homo sapiens
ggucagagccucccaaagc

SEQ ID NO: 730601 - RNA, 19 nt, Homo sapiens
agauuccucuggauuauga

SEQ ID NO: 730602 - RNA, 19 nt, Homo sapiens
gaaguucgaugaugaaaac

SEQ ID NO: 730603 - RNA, 19 nt, Homo sapiens
gaaguggacgacaaaguuc

SEQ ID NO: 730604 - RNA, 19 nt, Homo sapiens
gcagcuaucgacaacauga

SEQ ID NO: 730605 - RNA, 19 nt, Homo sapiens
ggcacagccuggacuauuc

SEQ ID NO: 730606 - RNA, 19 nt, Homo sapiens
caauggcucucaguucuuc

SEQ ID NO: 730607 - RNA, 19 nt, Homo sapiens
cagcagcuaucgacaacau

SEQ ID NO: 730608 - RNA, 19 nt, Homo sapiens
agggagagcccauugcuaa

SEQ ID NO: 730609 - RNA, 19 nt, Homo sapiens
gaugacugguugaagaagu

SEQ ID NO: 730610 - RNA, 19 nt, Homo sapiens
gaaaagcaccgaggauuug

SEQ ID NO: 730611 - RNA, 19 nt, Homo sapiens
uuggagacaucacagauau

SEQ ID NO: 730612 - RNA, 19 nt, Homo sapiens
caagcagcauuugggauau

SEQ ID NO: 730613 - RNA, 19 nt, Homo sapiens
uggcaagcaugugguguuu

SEQ ID NO: 730614 - RNA, 19 nt, Homo sapiens
gcaagauggccaccaccaa

SEQ ID NO: 730615 - RNA, 19 nt, Homo sapiens
gggaagacgcuugaagaga

SEQ ID NO: 730616 - RNA, 19 nt, Homo sapiens
ugacaugugacaagacaga

SEQ ID NO: 730617 - RNA, 19 nt, Homo sapiens
gggagagcccauugcuaaa

SEQ ID NO: 730618 - RNA, 19 nt, Homo sapiens
gagggagagcccauugcua

SEQ ID NO: 730619 - RNA, 19 nt, Homo sapiens
guucgaugaugaaaacuuu

SEQ ID NO: 730620 - RNA, 19 nt, Homo sapiens
ccaugacagcagagaauuu

SEQ ID NO: 730621 - RNA, 19 nt, Homo sapiens
ccaguuuggucagaugaug

SEQ ID NO: 730622 - RNA, 19 nt, Homo sapiens
caaagcagaaggugaucau

SEQ ID NO: 730623 - RNA, 19 nt, Homo sapiens
ccgaaggccuagaugucuu

SEQ ID NO: 730624 - RNA, 19 nt, Homo sapiens
ccugacaugugacaagaca

SEQ ID NO: 730625 - RNA, 19 nt, Homo sapiens
ucgacaacaugaaugaauc

SEQ ID NO: 730626 - RNA, 19 nt, Homo sapiens
caaauccucagguguacau

SEQ ID NO: 730627 - RNA, 19 nt, Homo sapiens
gucagagccucccaaagca

SEQ ID NO: 730628 - RNA, 19 nt, Homo sapiens
ggccaaaccaaugagaauu

SEQ ID NO: 730629 - RNA, 19 nt, Homo sapiens
acauggacaucaagauugg

SEQ ID NO: 730630 - RNA, 19 nt, Homo sapiens
ggacgacaaaguucuucau

SEQ ID NO: 730631 - RNA, 19 nt, Homo sapiens
gcaccgaggauuugcuuuu

SEQ ID NO: 730632 - RNA, 19 nt, Homo sapiens
gacgacaaaguucuucaug

SEQ ID NO: 730633 - RNA, 19 nt, Homo sapiens
caagacagacuggcuggau

SEQ ID NO: 730634 - RNA, 19 nt, Homo sapiens
aacuuuauccucaagcaua

SEQ ID NO: 730635 - RNA, 19 nt, Homo sapiens
gcccaugacagcagagaau

SEQ ID NO: 730636 - RNA, 19 nt, Homo sapiens
caugacagcagagaauuuc

SEQ ID NO: 730637 - RNA, 19 nt, Homo sapiens
acaucaagauugggaacaa

SEQ ID NO: 730638 - RNA, 19 nt, Homo sapiens
uacauggacaucaagauug

SEQ ID NO: 730639 - RNA, 19 nt, Homo sapiens
agaggaaguggacgacaaa

SEQ ID NO: 730640 - RNA, 19 nt, Homo sapiens
accaauggcucucaguucu

SEQ ID NO: 730641 - RNA, 19 nt, Homo sapiens
augcugcguucauuccuuu

SEQ ID NO: 730642 - RNA, 19 nt, Homo sapiens
caucaagauugggaacaag

SEQ ID NO: 730643 - RNA, 19 nt, Homo sapiens
gagaauaaagaggaagaag

SEQ ID NO: 730644 - RNA, 19 nt, Homo sapiens
augaaugaaucugagcuuu

SEQ ID NO: 730645 - RNA, 19 nt, Homo sapiens
cgaaggccuagaugucuug

SEQ ID NO: 730646 - RNA, 19 nt, Homo sapiens
gcuccugcguucugauguc

SEQ ID NO: 730647 - RNA, 19 nt, Homo sapiens
ggagagcccauugcuaaaa

SEQ ID NO: 730648 - RNA, 19 nt, Homo sapiens
ggucaccgaaggccuagau

SEQ ID NO: 730649 - RNA, 19 nt, Homo sapiens
aaaccaaugagaauuaagg

SEQ ID NO: 730650 - RNA, 19 nt, Homo sapiens
cgagggugccuguuugaag

SEQ ID NO: 730651 - RNA, 19 nt, Homo sapiens
caugcugcguucauuccuu

SEQ ID NO: 730652 - RNA, 19 nt, Homo sapiens
gacaucacagauauucaga

SEQ ID NO: 730653 - RNA, 19 nt, Homo sapiens
aagcagcauuugggauaug

SEQ ID NO: 730654 - RNA, 19 nt, Homo sapiens
ggaagccaaagcagaaggu

SEQ ID NO: 730655 - RNA, 19 nt, Homo sapiens
ccaauggcucucaguucuu

SEQ ID NO: 730656 - RNA, 19 nt, Homo sapiens
ucugaugucgugcccauga

SEQ ID NO: 730657 - RNA, 19 nt, Homo sapiens
ggagggagagcccauugcu

SEQ ID NO: 730658 - RNA, 19 nt, Homo sapiens
gcucuuccaggccaguuug

SEQ ID NO: 730659 - RNA, 19 nt, Homo sapiens
ggaagaggaugaauaaauu

SEQ ID NO: 730660 - RNA, 19 nt, Homo sapiens
gaucaagggcuauaauuua

SEQ ID NO: 730661 - RNA, 19 nt, Homo sapiens
gaagaaagcauuaaugaug

SEQ ID NO: 730662 - RNA, 19 nt, Homo sapiens
gcagagaccgaacuuauua

SEQ ID NO: 730663 - RNA, 19 nt, Homo sapiens
gaaaggagaugcacacagu

SEQ ID NO: 730664 - RNA, 19 nt, Homo sapiens
uaauagaucuucagcagua

SEQ ID NO: 730665 - RNA, 19 nt, Homo sapiens
gagauguggugaagauuua

SEQ ID NO: 730666 - RNA, 19 nt, Homo sapiens
caacauuccugaacuugua

SEQ ID NO: 730667 - RNA, 19 nt, Homo sapiens
caaagaagcagaaguguaa

SEQ ID NO: 730668 - RNA, 19 nt, Homo sapiens
gcagcaguaucuauuaaua

SEQ ID NO: 730669 - RNA, 19 nt, Homo sapiens
gagggugucuucauauuaa

SEQ ID NO: 730670 - RNA, 19 nt, Homo sapiens
gcaaagcacaucaagauuu

SEQ ID NO: 730671 - RNA, 19 nt, Homo sapiens
caaaggccuuccugauuua

SEQ ID NO: 730672 - RNA, 19 nt, Homo sapiens
gaagagcccugcaaacaca

SEQ ID NO: 730673 - RNA, 19 nt, Homo sapiens
gaaacauuaucacgacuuu

SEQ ID NO: 730674 - RNA, 19 nt, Homo sapiens
acaaaggccuuccugauuu

SEQ ID NO: 730675 - RNA, 19 nt, Homo sapiens
uaauggaacuuguggagua

SEQ ID NO: 730676 - RNA, 19 nt, Homo sapiens
ucagggagauggugaaauu

SEQ ID NO: 730677 - RNA, 19 nt, Homo sapiens
gaaaggagauguggugaag

SEQ ID NO: 730678 - RNA, 19 nt, Homo sapiens
gaaauggcuuugucuaaca

SEQ ID NO: 730679 - RNA, 19 nt, Homo sapiens
gaaaggaucugggcuaggu

SEQ ID NO: 730680 - RNA, 19 nt, Homo sapiens
ggugauaacuaugaaauga

SEQ ID NO: 730681 - RNA, 19 nt, Homo sapiens
ccaacaaggugacucauug

SEQ ID NO: 730682 - RNA, 19 nt, Homo sapiens
gagaaaaggugauaacuau

SEQ ID NO: 730683 - RNA, 19 nt, Homo sapiens
ugaaggacuuggcacaaua

SEQ ID NO: 730684 - RNA, 19 nt, Homo sapiens
gcauuugacuuguuugaug

SEQ ID NO: 730685 - RNA, 19 nt, Homo sapiens
gagagggugucuucauauu

SEQ ID NO: 730686 - RNA, 19 nt, Homo sapiens
gcucagguuugcaucauaa

SEQ ID NO: 730687 - RNA, 19 nt, Homo sapiens
aggcauaucuucuuauuug

SEQ ID NO: 730688 - RNA, 19 nt, Homo sapiens
gaauuagagugguauuuca

SEQ ID NO: 730689 - RNA, 19 nt, Homo sapiens
gaaugccagucaucaguaa

SEQ ID NO: 730690 - RNA, 19 nt, Homo sapiens
gaccuuuaccucagaauua

SEQ ID NO: 730691 - RNA, 19 nt, Homo sapiens
ccucagauguuacucauga

SEQ ID NO: 730692 - RNA, 19 nt, Homo sapiens
gcaauuagcauuaaguaca

SEQ ID NO: 730693 - RNA, 19 nt, Homo sapiens
agaaauggcuagaacaguu

SEQ ID NO: 730694 - RNA, 19 nt, Homo sapiens
gcagugaucguauguaaga

SEQ ID NO: 730695 - RNA, 19 nt, Homo sapiens
aauagacccucuccuuaua

SEQ ID NO: 730696 - RNA, 19 nt, Homo sapiens
uaagugagcuaucccugaa

SEQ ID NO: 730697 - RNA, 19 nt, Homo sapiens
caagagauaugagagaguu

SEQ ID NO: 730698 - RNA, 19 nt, Homo sapiens
agaccgaacuuauuaauag

SEQ ID NO: 730699 - RNA, 19 nt, Homo sapiens
gaucugggcuagguauauu

SEQ ID NO: 730700 - RNA, 19 nt, Homo sapiens
gcgaagaacuccuaaacag

SEQ ID NO: 730701 - RNA, 19 nt, Homo sapiens
gagaagggauaaauagaag

SEQ ID NO: 730702 - RNA, 19 nt, Homo sapiens
acacaaagaugagugcaaa

SEQ ID NO: 730703 - RNA, 19 nt, Homo sapiens
gcagauuuguguagaguuc

SEQ ID NO: 730704 - RNA, 19 nt, Homo sapiens
ucaauagacccucuccuua

SEQ ID NO: 730705 - RNA, 19 nt, Homo sapiens
guacaaagaagcagaagug

SEQ ID NO: 730706 - RNA, 19 nt, Homo sapiens
caaagagucaggagaauau

SEQ ID NO: 730707 - RNA, 19 nt, Homo sapiens
gggcagaaauuuagcaucu

SEQ ID NO: 730708 - RNA, 19 nt, Homo sapiens
ccaauaaccugaagaagcu

SEQ ID NO: 730709 - RNA, 19 nt, Homo sapiens
ugagagaguuguccuuguu

SEQ ID NO: 730710 - RNA, 19 nt, Homo sapiens
gauccagguuuaccaaaga

SEQ ID NO: 730711 - RNA, 19 nt, Homo sapiens
acagguggauccagguuua

SEQ ID NO: 730712 - RNA, 19 nt, Homo sapiens
gaaauggcuagaacaguuu

SEQ ID NO: 730713 - RNA, 19 nt, Homo sapiens
gaaccaggagcauuaaguu

SEQ ID NO: 730714 - RNA, 19 nt, Homo sapiens
gcugagauuucuaaagaug

SEQ ID NO: 730715 - RNA, 19 nt, Homo sapiens
ggagauguggugaagauuu

SEQ ID NO: 730716 - RNA, 19 nt, Homo sapiens
cagaagaaagcauuaauga

SEQ ID NO: 730717 - RNA, 19 nt, Homo sapiens
uagcagcaguaucuauuaa

SEQ ID NO: 730718 - RNA, 19 nt, Homo sapiens
uaacauaagaccagacuau

SEQ ID NO: 730719 - RNA, 19 nt, Homo sapiens
ggacucggcucagguguuc

SEQ ID NO: 730720 - RNA, 19 nt, Homo sapiens
ccaaagaugcaggucauua

SEQ ID NO: 730721 - RNA, 19 nt, Homo sapiens
gagcaaauaaugggaaauu

SEQ ID NO: 730722 - RNA, 19 nt, Homo sapiens
gaacugaaccaggagcauu

SEQ ID NO: 730723 - RNA, 19 nt, Homo sapiens
gagccuaaauacauucuuc

SEQ ID NO: 730724 - RNA, 19 nt, Homo sapiens
gugaagauuuacacaaaga

SEQ ID NO: 730725 - RNA, 19 nt, Homo sapiens
gcacaggaccaaagaguca

SEQ ID NO: 730726 - RNA, 19 nt, Homo sapiens
gaagaugucaaacugaaau

SEQ ID NO: 730727 - RNA, 19 nt, Homo sapiens
ucaacauccucccuccuua

SEQ ID NO: 730728 - RNA, 19 nt, Homo sapiens
ucaggagaauaugcaauua

SEQ ID NO: 730729 - RNA, 19 nt, Homo sapiens
ccaaaccaguagauuauuc

SEQ ID NO: 730730 - RNA, 19 nt, Homo sapiens
ccacugauccgacugagaa

SEQ ID NO: 730731 - RNA, 19 nt, Homo sapiens
gaaauuaagcagacagaag

SEQ ID NO: 730732 - RNA, 19 nt, Homo sapiens
caauagacccucuccuuau

SEQ ID NO: 730733 - RNA, 19 nt, Homo sapiens
cagaaacacuccuguggau

SEQ ID NO: 730734 - RNA, 19 nt, Homo sapiens
gacacuaacuuggcccuuu

SEQ ID NO: 730735 - RNA, 19 nt, Homo sapiens
caaagcacaucaagauuuu

SEQ ID NO: 730736 - RNA, 19 nt, Homo sapiens
guacaauaaugaagcaaag

SEQ ID NO: 730737 - RNA, 19 nt, Homo sapiens
gaaccuaaugcaagagauu

SEQ ID NO: 730738 - RNA, 19 nt, Homo sapiens
ggaagcacaucagcccaaa

SEQ ID NO: 730739 - RNA, 19 nt, Homo sapiens
cgaggcauuugacuuguuu

SEQ ID NO: 730740 - RNA, 19 nt, Homo sapiens
ugaggagccuaaauacauu

SEQ ID NO: 730741 - RNA, 19 nt, Homo sapiens
gcacaacuggguccuuuau

SEQ ID NO: 730742 - RNA, 19 nt, Homo sapiens
gagaccgaacuuauuaaua

SEQ ID NO: 730743 - RNA, 19 nt, Homo sapiens
gauggugaaauucgaauaa

SEQ ID NO: 730744 - RNA, 19 nt, Homo sapiens
aagaagaugucaaacugaa

SEQ ID NO: 730745 - RNA, 19 nt, Homo sapiens
ugcaagagauucaugauuc

SEQ ID NO: 730746 - RNA, 19 nt, Homo sapiens
ucacaaccuucaugauuuc

SEQ ID NO: 730747 - RNA, 19 nt, Homo sapiens
gccuagagcugugcaagaa

SEQ ID NO: 730748 - RNA, 19 nt, Homo sapiens
gcacagcaucgugaauuaa

SEQ ID NO: 730749 - RNA, 19 nt, Homo sapiens
ggacugcgaagaacuccua

SEQ ID NO: 730750 - RNA, 19 nt, Homo sapiens
aguacaagauagccaauaa

SEQ ID NO: 730751 - RNA, 19 nt, Homo sapiens
uggcagugaucguauguaa

SEQ ID NO: 730752 - RNA, 19 nt, Homo sapiens
gaaggcaaaucugaaacug

SEQ ID NO: 730753 - RNA, 19 nt, Homo sapiens
gaaagauccagccuuacuu

SEQ ID NO: 730754 - RNA, 19 nt, Homo sapiens
gaccaaagagucaggagaa

SEQ ID NO: 730755 - RNA, 19 nt, Homo sapiens
gaaaaggugauaacuauga

SEQ ID NO: 730756 - RNA, 19 nt, Homo sapiens
caacagaagaaagcauuaa

SEQ ID NO: 730757 - RNA, 19 nt, Homo sapiens
acaacuggguccuuuauuc

SEQ ID NO: 730758 - RNA, 19 nt, Homo sapiens
ggaaagauccagccuuacu

SEQ ID NO: 730759 - RNA, 19 nt, Homo sapiens
ggaaauacacauugaacaa

SEQ ID NO: 730760 - RNA, 19 nt, Homo sapiens
gcagguggguguggaguuu

SEQ ID NO: 730761 - RNA, 19 nt, Homo sapiens
ggagggcacugucaugucu

SEQ ID NO: 730762 - RNA, 19 nt, Homo sapiens
gcugggaaauacacauuga

SEQ ID NO: 730763 - RNA, 19 nt, Homo sapiens
gugccacgcuggagaagaa

SEQ ID NO: 730764 - RNA, 19 nt, Homo sapiens
ucucaacgcucaggucauu

SEQ ID NO: 730765 - RNA, 19 nt, Homo sapiens
gaagaaccgggacauuuua

SEQ ID NO: 730766 - RNA, 19 nt, Homo sapiens
ggaagaaccgggacauuuu

SEQ ID NO: 730767 - RNA, 19 nt, Homo sapiens
gcaacauacuaccacaaag

SEQ ID NO: 730768 - RNA, 19 nt, Homo sapiens
gaagugcaaggagcuguuu

SEQ ID NO: 730769 - RNA, 19 nt, Homo sapiens
uggaagaaccgggacauuu

SEQ ID NO: 730770 - RNA, 19 nt, Homo sapiens
caagaacaaguuucagugu

SEQ ID NO: 730771 - RNA, 19 nt, Homo sapiens
gaaauacacauugaacaac

SEQ ID NO: 730772 - RNA, 19 nt, Homo sapiens
caagcucacagucaacaaa

SEQ ID NO: 730773 - RNA, 19 nt, Homo sapiens
uucaaaggcucuguggaua

SEQ ID NO: 730774 - RNA, 19 nt, Homo sapiens
ugaaucaccgcaagaacaa

SEQ ID NO: 730775 - RNA, 19 nt, Homo sapiens
caaaggcucuguggauagc

SEQ ID NO: 730776 - RNA, 19 nt, Homo sapiens
gcaugcacgcaacauacua

SEQ ID NO: 730777 - RNA, 19 nt, Homo sapiens
ggagaggagggcacuguca

SEQ ID NO: 730778 - RNA, 19 nt, Homo sapiens
ccucguggguucaggaauc

SEQ ID NO: 730779 - RNA, 19 nt, Homo sapiens
ggaagugcaaggagcuguu

SEQ ID NO: 730780 - RNA, 19 nt, Homo sapiens
aaggagcuguuucccauuc

SEQ ID NO: 730781 - RNA, 19 nt, Homo sapiens
ucaggucaaccacacagua

SEQ ID NO: 730782 - RNA, 19 nt, Homo sapiens
caacauacuaccacaaagc

SEQ ID NO: 730783 - RNA, 19 nt, Homo sapiens
ggaguccaacuaccacuuc

SEQ ID NO: 730784 - RNA, 19 nt, Homo sapiens
gugucaagcucacagucaa

SEQ ID NO: 730785 - RNA, 19 nt, Homo sapiens
gggaaauacacauugaaca

SEQ ID NO: 730786 - RNA, 19 nt, Homo sapiens
gaggagggcacugucaugu

SEQ ID NO: 730787 - RNA, 19 nt, Homo sapiens
gcuucgggauucugaguag

SEQ ID NO: 730788 - RNA, 19 nt, Homo sapiens
agacccagcagucgaaguu

SEQ ID NO: 730789 - RNA, 19 nt, Homo sapiens
gacaacaguggcagucuca

SEQ ID NO: 730790 - RNA, 19 nt, Homo sapiens
ucccaucuccucgguauaa

SEQ ID NO: 730791 - RNA, 19 nt, Homo sapiens
ugaauggcgcuucgggauu

SEQ ID NO: 730792 - RNA, 19 nt, Homo sapiens
caaguuucaguguggcuuu

SEQ ID NO: 730793 - RNA, 19 nt, Homo sapiens
ggccaaccuccucuucaaa

SEQ ID NO: 730794 - RNA, 19 nt, Homo sapiens
cgcaacauacuaccacaaa

SEQ ID NO: 730795 - RNA, 19 nt, Homo sapiens
ucaaaggcucuguggauag

SEQ ID NO: 730796 - RNA, 19 nt, Homo sapiens
aggccaaccuccucuucaa

SEQ ID NO: 730797 - RNA, 19 nt, Homo sapiens
gggcaugcacgcaacauac

SEQ ID NO: 730798 - RNA, 19 nt, Homo sapiens
acacauugaacaacugguu

SEQ ID NO: 730799 - RNA, 19 nt, Homo sapiens
caguagcccucagcacaau

SEQ ID NO: 730800 - RNA, 19 nt, Homo sapiens
cuucaaaggcucuguggau

SEQ ID NO: 730801 - RNA, 19 nt, Homo sapiens
gagaggagggcacugucau

SEQ ID NO: 730802 - RNA, 19 nt, Homo sapiens
caucuccucgguauaaauc

SEQ ID NO: 730803 - RNA, 19 nt, Homo sapiens
ggugucaagcucacaguca

SEQ ID NO: 730804 - RNA, 19 nt, Homo sapiens
ccaaccuccucuucaaagg

SEQ ID NO: 730805 - RNA, 19 nt, Homo sapiens
uagcugggaaauacacauu

SEQ ID NO: 730806 - RNA, 19 nt, Homo sapiens
gagcuguuucccauucaga

SEQ ID NO: 730807 - RNA, 19 nt, Homo sapiens
gaggagugccaccggaagu

SEQ ID NO: 730808 - RNA, 19 nt, Homo sapiens
caaggccaaccuccucuuc

SEQ ID NO: 730809 - RNA, 19 nt, Homo sapiens
caaggagcuguuucccauu

SEQ ID NO: 730810 - RNA, 19 nt, Homo sapiens
gccaaccuccucuucaaag

SEQ ID NO: 730811 - RNA, 19 nt, Homo sapiens
gaauccucguagcccacua

SEQ ID NO: 730812 - RNA, 19 nt, Homo sapiens
acccagcagucgaaguuug

SEQ ID NO: 730813 - RNA, 19 nt, Homo sapiens
ucaacgcucaggucauuca

SEQ ID NO: 730814 - RNA, 19 nt, Homo sapiens
caacaguggcagucucaac

SEQ ID NO: 730815 - RNA, 19 nt, Homo sapiens
gaugagcucuuccgucuuu

SEQ ID NO: 730816 - RNA, 19 nt, Homo sapiens
gaacaacugcuuccuguau

SEQ ID NO: 730817 - RNA, 19 nt, Homo sapiens
ggagauugcugcgaugauu

SEQ ID NO: 730818 - RNA, 19 nt, Homo sapiens
gaacgaggaugagcucuuc

SEQ ID NO: 730819 - RNA, 19 nt, Homo sapiens
gaacugucuuuaccacuga

SEQ ID NO: 730820 - RNA, 19 nt, Homo sapiens
gggauuacaagguuaaaua

SEQ ID NO: 730821 - RNA, 19 nt, Homo sapiens
ggccugaguuagacuauuu

SEQ ID NO: 730822 - RNA, 19 nt, Homo sapiens
gaggacagcuggcucaagu

SEQ ID NO: 730823 - RNA, 19 nt, Homo sapiens
ggagcuugcugcagaguga

SEQ ID NO: 730824 - RNA, 19 nt, Homo sapiens
ccacagagaacgaggauga

SEQ ID NO: 730825 - RNA, 19 nt, Homo sapiens
gaaagaaagaggaguugga

SEQ ID NO: 730826 - RNA, 19 nt, Homo sapiens
ggacuuguuugaaagaaag

SEQ ID NO: 730827 - RNA, 19 nt, Homo sapiens
gacaugacccugcuaguga

SEQ ID NO: 730828 - RNA, 19 nt, Homo sapiens
gugagaggauuuaaaguca

SEQ ID NO: 730829 - RNA, 19 nt, Homo sapiens
gacaguagcccuccacuuc

SEQ ID NO: 730830 - RNA, 19 nt, Homo sapiens
cagcugagaugaacugucu

SEQ ID NO: 730831 - RNA, 19 nt, Homo sapiens
gagaugaacugucuuuacc

SEQ ID NO: 730832 - RNA, 19 nt, Homo sapiens
ggacgaguguacccugugu

SEQ ID NO: 730833 - RNA, 19 nt, Homo sapiens
ggacaugacccugcuagug

SEQ ID NO: 730834 - RNA, 19 nt, Homo sapiens
cacaaaggcuugggaacaa

SEQ ID NO: 730835 - RNA, 19 nt, Homo sapiens
ggaccugccuugguugugu

SEQ ID NO: 730836 - RNA, 19 nt, Homo sapiens
ugugaacccuguaguguug

SEQ ID NO: 730837 - RNA, 19 nt, Homo sapiens
aaccaaagcccgaccuuaa

SEQ ID NO: 730838 - RNA, 19 nt, Homo sapiens
gagaggauuuaaagucagu

SEQ ID NO: 730839 - RNA, 19 nt, Homo sapiens
gaccugagccauuguguca

SEQ ID NO: 730840 - RNA, 19 nt, Homo sapiens
gaugauugacacugaguuu

SEQ ID NO: 730841 - RNA, 19 nt, Homo sapiens
cagcagaaauggaagaaaa

SEQ ID NO: 730842 - RNA, 19 nt, Homo sapiens
ggaagccacagcagaaaug

SEQ ID NO: 730843 - RNA, 19 nt, Homo sapiens
gcaaccgagugaccaacuu

SEQ ID NO: 730844 - RNA, 19 nt, Homo sapiens
ggagugagaacaacugcuu

SEQ ID NO: 730845 - RNA, 19 nt, Homo sapiens
gcaggcagcugagaugaac

SEQ ID NO: 730846 - RNA, 19 nt, Homo sapiens
ggacagcuggcucaaguuc

SEQ ID NO: 730847 - RNA, 19 nt, Homo sapiens
caaccaaagcccgaccuua

SEQ ID NO: 730848 - RNA, 19 nt, Homo sapiens
gggcuuggaugcuggaaag

SEQ ID NO: 730849 - RNA, 19 nt, Homo sapiens
ccagcugccuccucaguau

SEQ ID NO: 730850 - RNA, 19 nt, Homo sapiens
gcccagagcaccagcaaga

SEQ ID NO: 730851 - RNA, 19 nt, Homo sapiens
acacugaguuugccaagca

SEQ ID NO: 730852 - RNA, 19 nt, Homo sapiens
gcaggugagaggauuuaaa

SEQ ID NO: 730853 - RNA, 19 nt, Homo sapiens
gggacuuguuugaaagaaa

SEQ ID NO: 730854 - RNA, 19 nt, Homo sapiens
gguacaaaccgugcacuuu

SEQ ID NO: 730855 - RNA, 19 nt, Homo sapiens
gauuuaaagucagucacaa

SEQ ID NO: 730856 - RNA, 19 nt, Homo sapiens
gauugccacuccuguuuca

SEQ ID NO: 730857 - RNA, 19 nt, Homo sapiens
gcugagaugaacugucuuu

SEQ ID NO: 730858 - RNA, 19 nt, Homo sapiens
gaccugugguucauaccuu

SEQ ID NO: 730859 - RNA, 19 nt, Homo sapiens
guacaaaccgugcacuuuu

SEQ ID NO: 730860 - RNA, 19 nt, Homo sapiens
ggugagaggauuuaaaguc

SEQ ID NO: 730861 - RNA, 19 nt, Homo sapiens
gcuggugccugccuugcuu

SEQ ID NO: 730862 - RNA, 19 nt, Homo sapiens
gaucggggauuacaagguu

SEQ ID NO: 730863 - RNA, 19 nt, Homo sapiens
cauguucucugccuucagu

SEQ ID NO: 730864 - RNA, 19 nt, Homo sapiens
gaguguacccugugucugu

SEQ ID NO: 730865 - RNA, 19 nt, Homo sapiens
acaaaggcuugggaacaaa

SEQ ID NO: 730866 - RNA, 19 nt, Homo sapiens
ccgcaggguuccuccaaga

SEQ ID NO: 730867 - RNA, 19 nt, Homo sapiens
gugccugccuugcuucuuc

SEQ ID NO: 730868 - RNA, 19 nt, Homo sapiens
gcaggguuccuccaagaug

SEQ ID NO: 730869 - RNA, 19 nt, Homo sapiens
gagguuccuuugagacaca

SEQ ID NO: 730870 - RNA, 19 nt, Homo sapiens
aaagaaagaggaguuggaa

SEQ ID NO: 730871 - RNA, 19 nt, Homo sapiens
uacaaaccgugcacuuuua

SEQ ID NO: 730872 - RNA, 19 nt, Homo sapiens
uaucagaagauccuugaga

SEQ ID NO: 730873 - RNA, 19 nt, Homo sapiens
ucacaaaggcuugggaaca

SEQ ID NO: 730874 - RNA, 19 nt, Homo sapiens
ggacaagccacacaaucag

SEQ ID NO: 730875 - RNA, 19 nt, Homo sapiens
gaagcaggccgagagacuu

SEQ ID NO: 730876 - RNA, 19 nt, Homo sapiens
ggacaguagcccuccacuu

SEQ ID NO: 730877 - RNA, 19 nt, Homo sapiens
ggauuuaaagucagucaca

SEQ ID NO: 730878 - RNA, 19 nt, Homo sapiens
acacggacauugaccuucu

SEQ ID NO: 730879 - RNA, 19 nt, Homo sapiens
ggaagcaggccgagagacu

SEQ ID NO: 730880 - RNA, 19 nt, Homo sapiens
uagacuauuucccacaugu

SEQ ID NO: 730881 - RNA, 19 nt, Homo sapiens
ccaggaccaucgcccuuuc

SEQ ID NO: 730882 - RNA, 19 nt, Homo sapiens
cugcgaugauugacacuga

SEQ ID NO: 730883 - RNA, 19 nt, Homo sapiens
gagauugcugcgaugauug

SEQ ID NO: 730884 - RNA, 19 nt, Homo sapiens
guuagacuauuucccacau

SEQ ID NO: 730885 - RNA, 19 nt, Homo sapiens
gguugugucaucuguugua

SEQ ID NO: 730886 - RNA, 19 nt, Homo sapiens
ccacuucuccagccucuca

SEQ ID NO: 730887 - RNA, 19 nt, Homo sapiens
cgaggacggucguguugag

SEQ ID NO: 730888 - RNA, 19 nt, Homo sapiens
cagagcagagggccaggua

SEQ ID NO: 730889 - RNA, 19 nt, Homo sapiens
uguggacuuugcugaguuu

SEQ ID NO: 730890 - RNA, 19 nt, Homo sapiens
gacgacgccuuggcugaga

SEQ ID NO: 730891 - RNA, 19 nt, Homo sapiens
caggugagaggauuuaaag

SEQ ID NO: 730892 - RNA, 19 nt, Homo sapiens
ugugucaucuguuguaaac

SEQ ID NO: 730893 - RNA, 19 nt, Homo sapiens
uaugauggcaaccgaguga

SEQ ID NO: 730894 - RNA, 19 nt, Homo sapiens
gggccugaguuagacuauu

SEQ ID NO: 730895 - RNA, 19 nt, Homo sapiens
guugugucaucuguuguaa

SEQ ID NO: 730896 - RNA, 19 nt, Homo sapiens
ccacagcagaaauggaaga

SEQ ID NO: 730897 - RNA, 19 nt, Homo sapiens
uggacaagccacacaauca

SEQ ID NO: 730898 - RNA, 19 nt, Homo sapiens
gaggaaugcagcccaagca

SEQ ID NO: 730899 - RNA, 19 nt, Homo sapiens
ggacuuugcugaguuuuac

SEQ ID NO: 730900 - RNA, 19 nt, Homo sapiens
gacccucucccuugucaug

SEQ ID NO: 730901 - RNA, 19 nt, Homo sapiens
gcgugacccucucccuugu

SEQ ID NO: 730902 - RNA, 19 nt, Homo sapiens
gcaagccuccagucgcaau

SEQ ID NO: 730903 - RNA, 19 nt, Homo sapiens
uggcgguccuucucaacaa

SEQ ID NO: 730904 - RNA, 19 nt, Homo sapiens
gaggaagcaggccgagaga

SEQ ID NO: 730905 - RNA, 19 nt, Homo sapiens
gacguuagagagggaaauu

SEQ ID NO: 730906 - RNA, 19 nt, Homo sapiens
gcuacccgcugggcgaaau

SEQ ID NO: 730907 - RNA, 19 nt, Homo sapiens
gcugccaaguccaaaccaa

SEQ ID NO: 730908 - RNA, 19 nt, Homo sapiens
agaagauccuugagagacu

SEQ ID NO: 730909 - RNA, 19 nt, Homo sapiens
gggaagccacagcagaaau

SEQ ID NO: 730910 - RNA, 19 nt, Homo sapiens
gagccauugugucaguauc

SEQ ID NO: 730911 - RNA, 19 nt, Homo sapiens
ugagaugaacugucuuuac

SEQ ID NO: 730912 - RNA, 19 nt, Homo sapiens
ucagaagauccuugagaga

SEQ ID NO: 730913 - RNA, 19 nt, Homo sapiens
aacaacugcuuccuguaug

SEQ ID NO: 730914 - RNA, 19 nt, Homo sapiens
ugacccugcuagugaggaa

SEQ ID NO: 730915 - RNA, 19 nt, Homo sapiens
gaagauggcuaucagauga

SEQ ID NO: 730916 - RNA, 19 nt, Homo sapiens
ggaaugaucugacuaacuu

SEQ ID NO: 730917 - RNA, 19 nt, Homo sapiens
cuacagcucugaugaauaa

SEQ ID NO: 730918 - RNA, 19 nt, Homo sapiens
gaaauuaugcgugcacuua

SEQ ID NO: 730919 - RNA, 19 nt, Homo sapiens
gaaacgaagugaagcuaaa

SEQ ID NO: 730920 - RNA, 19 nt, Homo sapiens
caacagagaugcuuauuuu

SEQ ID NO: 730921 - RNA, 19 nt, Homo sapiens
ucacaaagaucauguucaa

SEQ ID NO: 730922 - RNA, 19 nt, Homo sapiens
acacugagauguaucauga

SEQ ID NO: 730923 - RNA, 19 nt, Homo sapiens
ggaccaggcugaaggcauu

SEQ ID NO: 730924 - RNA, 19 nt, Homo sapiens
gaauagaacagcaaugaga

SEQ ID NO: 730925 - RNA, 19 nt, Homo sapiens
caaaugcuguggugaacuu

SEQ ID NO: 730926 - RNA, 19 nt, Homo sapiens
gcagaacuauguggauuug

SEQ ID NO: 730927 - RNA, 19 nt, Homo sapiens
gcuauucgaugccguguau

SEQ ID NO: 730928 - RNA, 19 nt, Homo sapiens
caggaaauggugacuauua

SEQ ID NO: 730929 - RNA, 19 nt, Homo sapiens
cauaaacacugagauguau

SEQ ID NO: 730930 - RNA, 19 nt, Homo sapiens
gcccaaaccagguguauuu

SEQ ID NO: 730931 - RNA, 19 nt, Homo sapiens
ugacuaacuucacugauau

SEQ ID NO: 730932 - RNA, 19 nt, Homo sapiens
gaugugcuguuaccucuga

SEQ ID NO: 730933 - RNA, 19 nt, Homo sapiens
ucagaugaaugcacaaaug

SEQ ID NO: 730934 - RNA, 19 nt, Homo sapiens
cugacuaacuucacugaua

SEQ ID NO: 730935 - RNA, 19 nt, Homo sapiens
gcaaugagagccagucaga

SEQ ID NO: 730936 - RNA, 19 nt, Homo sapiens
caaaagagguaaucaggaa

SEQ ID NO: 730937 - RNA, 19 nt, Homo sapiens
gaaggcauuugcaaagcuu

SEQ ID NO: 730938 - RNA, 19 nt, Homo sapiens
gcaacagagaugcuuauuu

SEQ ID NO: 730939 - RNA, 19 nt, Homo sapiens
cagcaaggaugacucaauc

SEQ ID NO: 730940 - RNA, 19 nt, Homo sapiens
gaacagacaggaaaucaac

SEQ ID NO: 730941 - RNA, 19 nt, Homo sapiens
aaggaaggaugugcuguua

SEQ ID NO: 730942 - RNA, 19 nt, Homo sapiens
gaguagaggagaaagcuaa

SEQ ID NO: 730943 - RNA, 19 nt, Homo sapiens
ccauaaacacugagaugua

SEQ ID NO: 730944 - RNA, 19 nt, Homo sapiens
gauuugguguccaguuuga

SEQ ID NO: 730945 - RNA, 19 nt, Homo sapiens
ggaaacgaagugaagcuaa

SEQ ID NO: 730946 - RNA, 19 nt, Homo sapiens
uauauaagcaggccacuga

SEQ ID NO: 730947 - RNA, 19 nt, Homo sapiens
ggaagauggcuaucagaug

SEQ ID NO: 730948 - RNA, 19 nt, Homo sapiens
gggaauuugugggcuguuu

SEQ ID NO: 730949 - RNA, 19 nt, Homo sapiens
cuaaauaagcuucauugug

SEQ ID NO: 730950 - RNA, 19 nt, Homo sapiens
aauggugacuauuacagua

SEQ ID NO: 730951 - RNA, 19 nt, Homo sapiens
ggaaggaugugcuguuacc

SEQ ID NO: 730952 - RNA, 19 nt, Homo sapiens
caaaugggacgcauggaau

SEQ ID NO: 730953 - RNA, 19 nt, Homo sapiens
gacagggcaacauuucaua

SEQ ID NO: 730954 - RNA, 19 nt, Homo sapiens
ccaaaugggacgcauggaa

SEQ ID NO: 730955 - RNA, 19 nt, Homo sapiens
cagaaggacuuugaaaauu

SEQ ID NO: 730956 - RNA, 19 nt, Homo sapiens
aacaggaaauggugacuau

SEQ ID NO: 730957 - RNA, 19 nt, Homo sapiens
aaacugugaugaccacuac

SEQ ID NO: 730958 - RNA, 19 nt, Homo sapiens
ggcaugugcucaaggacuu

SEQ ID NO: 730959 - RNA, 19 nt, Homo sapiens
ggagaggcaugugcucaag

SEQ ID NO: 730960 - RNA, 19 nt, Homo sapiens
guaguucagcugcacauga

SEQ ID NO: 730961 - RNA, 19 nt, Homo sapiens
acugagauguaucaugaaa

SEQ ID NO: 730962 - RNA, 19 nt, Homo sapiens
uaagcuucauugugccuuu

SEQ ID NO: 730963 - RNA, 19 nt, Homo sapiens
caaggaaggaugugcuguu

SEQ ID NO: 730964 - RNA, 19 nt, Homo sapiens
gaaauggugacuauuacag

SEQ ID NO: 730965 - RNA, 19 nt, Homo sapiens
ggaacagacaggaaaucaa

SEQ ID NO: 730966 - RNA, 19 nt, Homo sapiens
cagcugcacaugaauagaa

SEQ ID NO: 730967 - RNA, 19 nt, Homo sapiens
ggaaauggugacuauuaca

SEQ ID NO: 730968 - RNA, 19 nt, Homo sapiens
caggaaaucaacuggguuu

SEQ ID NO: 730969 - RNA, 19 nt, Homo sapiens
gaucaacaaggccaaaugg

SEQ ID NO: 730970 - RNA, 19 nt, Homo sapiens
ggaacuaaauaagcuucau

SEQ ID NO: 730971 - RNA, 19 nt, Homo sapiens
aauuaugcgugcacuuaaa

SEQ ID NO: 730972 - RNA, 19 nt, Homo sapiens
caguuugaguccuucauug

SEQ ID NO: 730973 - RNA, 19 nt, Homo sapiens
ccagguguauuugacuuga

SEQ ID NO: 730974 - RNA, 19 nt, Homo sapiens
aguaaagcauguccaagga

SEQ ID NO: 730975 - RNA, 19 nt, Homo sapiens
guaaagcauguccaaggaa

SEQ ID NO: 730976 - RNA, 19 nt, Homo sapiens
guggugaacuucuuaucca

SEQ ID NO: 730977 - RNA, 19 nt, Homo sapiens
aaacucuacgcgcuauaua

SEQ ID NO: 730978 - RNA, 19 nt, Homo sapiens
gcugaaggcauuugcaaag

SEQ ID NO: 730979 - RNA, 19 nt, Homo sapiens
ggaugcuccucuuacacuu

SEQ ID NO: 730980 - RNA, 19 nt, Homo sapiens
caucugacagggcaacauu

SEQ ID NO: 730981 - RNA, 19 nt, Homo sapiens
gacucaaucaucacuguuu

SEQ ID NO: 730982 - RNA, 19 nt, Homo sapiens
guggugaccuccgaagaug

SEQ ID NO: 730983 - RNA, 19 nt, Homo sapiens
gaccacuacagcagaguaa

SEQ ID NO: 730984 - RNA, 19 nt, Homo sapiens
gggaagauggcuaucagau

SEQ ID NO: 730985 - RNA, 19 nt, Homo sapiens
ucacuacagcucugaugaa

SEQ ID NO: 730986 - RNA, 19 nt, Homo sapiens
aaacuacacgcuguuaaug

SEQ ID NO: 730987 - RNA, 19 nt, Homo sapiens
agaggcaugugcucaagga

SEQ ID NO: 730988 - RNA, 19 nt, Homo sapiens
gugggaaugaucugacuaa

SEQ ID NO: 730989 - RNA, 19 nt, Homo sapiens
uaacaggaaauggugacua

SEQ ID NO: 730990 - RNA, 19 nt, Homo sapiens
uaaacacugagauguauca

SEQ ID NO: 730991 - RNA, 19 nt, Homo sapiens
aggcagaacuauguggauu

SEQ ID NO: 730992 - RNA, 19 nt, Homo sapiens
agaacuauguggauuuggu

SEQ ID NO: 730993 - RNA, 19 nt, Homo sapiens
ggcagaacuauguggauuu

SEQ ID NO: 730994 - RNA, 19 nt, Homo sapiens
cacuacagcucugaugaau

SEQ ID NO: 730995 - RNA, 19 nt, Homo sapiens
gaugcuccucuuacacuuu

SEQ ID NO: 730996 - RNA, 19 nt, Homo sapiens
gugcuagaauaucaauuac

SEQ ID NO: 730997 - RNA, 19 nt, Homo sapiens
guacuggaacuaaauaagc

SEQ ID NO: 730998 - RNA, 19 nt, Homo sapiens
cagggaagauggcuaucag

SEQ ID NO: 730999 - RNA, 19 nt, Homo sapiens
ggaguagaggagaaagcua

SEQ ID NO: 731000 - RNA, 19 nt, Homo sapiens
aaauuaugcgugcacuuaa

SEQ ID NO: 731001 - RNA, 19 nt, Homo sapiens
ugaagaaugcaauguccuu

SEQ ID NO: 731002 - RNA, 19 nt, Homo sapiens
agaaggacuuugaaaauuc

SEQ ID NO: 731003 - RNA, 19 nt, Homo sapiens
uaagcaggccacugaagga

SEQ ID NO: 731004 - RNA, 19 nt, Homo sapiens
aaaaugccauaaacacuga

SEQ ID NO: 731005 - RNA, 19 nt, Homo sapiens
gugcuguuaccucugauuu

SEQ ID NO: 731006 - RNA, 19 nt, Homo sapiens
gguggugaccuccgaagau

SEQ ID NO: 731007 - RNA, 19 nt, Homo sapiens
ucauuggaauccucuaguc

SEQ ID NO: 731008 - RNA, 19 nt, Homo sapiens
ccaguuugaguccuucauu

SEQ ID NO: 731009 - RNA, 19 nt, Homo sapiens
gaagugaagcuaaaacucu

SEQ ID NO: 731010 - RNA, 19 nt, Homo sapiens
cagaguaaagcauguccaa

SEQ ID NO: 731011 - RNA, 19 nt, Homo sapiens
ucuacgcgcuauauaagca

SEQ ID NO: 731012 - RNA, 19 nt, Homo sapiens
uuugaguccuucauuggaa

SEQ ID NO: 731013 - RNA, 19 nt, Homo sapiens
ggauuugguguccaguuug

SEQ ID NO: 731014 - RNA, 19 nt, Homo sapiens
uguuaaugcugaagaaugc

SEQ ID NO: 731015 - RNA, 19 nt, Homo sapiens
ggaaugagccucuuugauc

SEQ ID NO: 731016 - RNA, 19 nt, Homo sapiens
cacccaaacugaccaauaa

SEQ ID NO: 731017 - RNA, 19 nt, Homo sapiens
gggauacguuuccacgaua

SEQ ID NO: 731018 - RNA, 19 nt, Homo sapiens
gggacucaaugcuuaagua

SEQ ID NO: 731019 - RNA, 19 nt, Homo sapiens
gaaugagccucuuugaucu

SEQ ID NO: 731020 - RNA, 19 nt, Homo sapiens
caagaucacuaaaccagau

SEQ ID NO: 731021 - RNA, 19 nt, Homo sapiens
aauagcaucuucagcgaua

SEQ ID NO: 731022 - RNA, 19 nt, Homo sapiens
ggauacguuuccacgauaa

SEQ ID NO: 731023 - RNA, 19 nt, Homo sapiens
gaauuuggcuucggcuuca

SEQ ID NO: 731024 - RNA, 19 nt, Homo sapiens
gaugauguauggccuaugg

SEQ ID NO: 731025 - RNA, 19 nt, Homo sapiens
ggagagugaugcaagaagu

SEQ ID NO: 731026 - RNA, 19 nt, Homo sapiens
gagaugaagaugaugauga

SEQ ID NO: 731027 - RNA, 19 nt, Homo sapiens
cuucgggacucaaugcuua

SEQ ID NO: 731028 - RNA, 19 nt, Homo sapiens
ggacagagacuacaguaac

SEQ ID NO: 731029 - RNA, 19 nt, Homo sapiens
gcugacgccucgcucaauu

SEQ ID NO: 731030 - RNA, 19 nt, Homo sapiens
ucacagggcugcgcagguu

SEQ ID NO: 731031 - RNA, 19 nt, Homo sapiens
ugaagaugaugaugaggaa

SEQ ID NO: 731032 - RNA, 19 nt, Homo sapiens
cggcuuugaugaccuagua

SEQ ID NO: 731033 - RNA, 19 nt, Homo sapiens
guacgagauuucaauagca

SEQ ID NO: 731034 - RNA, 19 nt, Homo sapiens
ccauugcccaccauuaaua

SEQ ID NO: 731035 - RNA, 19 nt, Homo sapiens
ucccagaggccauuucaua

SEQ ID NO: 731036 - RNA, 19 nt, Homo sapiens
uaaaccagaugggauagug

SEQ ID NO: 731037 - RNA, 19 nt, Homo sapiens
ugaggaagaagaagaagaa

SEQ ID NO: 731038 - RNA, 19 nt, Homo sapiens
gaggccauuucauagguuu

SEQ ID NO: 731039 - RNA, 19 nt, Homo sapiens
ggacucaaugcuuaaguau

SEQ ID NO: 731040 - RNA, 19 nt, Homo sapiens
cacgauaacuucggcuuug

SEQ ID NO: 731041 - RNA, 19 nt, Homo sapiens
gagccucuuugaucucuuc

SEQ ID NO: 731042 - RNA, 19 nt, Homo sapiens
ucacccaaacugaccaaua

SEQ ID NO: 731043 - RNA, 19 nt, Homo sapiens
caugucaguuugucacuca

SEQ ID NO: 731044 - RNA, 19 nt, Homo sapiens
ggagggaugacucgagaug

SEQ ID NO: 731045 - RNA, 19 nt, Homo sapiens
gcuuggauauguggaauag

SEQ ID NO: 731046 - RNA, 19 nt, Homo sapiens
uuggauauguggaauagug

SEQ ID NO: 731047 - RNA, 19 nt, Homo sapiens
cagaggccauuucauaggu

SEQ ID NO: 731048 - RNA, 19 nt, Homo sapiens
agggaugacucgagaugaa

SEQ ID NO: 731049 - RNA, 19 nt, Homo sapiens
ugaccaagaucacuaaacc

SEQ ID NO: 731050 - RNA, 19 nt, Homo sapiens
cuaguacgagauuucaaua

SEQ ID NO: 731051 - RNA, 19 nt, Homo sapiens
gauccagaaucaccaagac

SEQ ID NO: 731052 - RNA, 19 nt, Homo sapiens
gauaacuucggcuuugaug

SEQ ID NO: 731053 - RNA, 19 nt, Homo sapiens
gacucgagaugaagaugau

SEQ ID NO: 731054 - RNA, 19 nt, Homo sapiens
cacuaaaccagaugggaua

SEQ ID NO: 731055 - RNA, 19 nt, Homo sapiens
gaugaccuaguacgagauu

SEQ ID NO: 731056 - RNA, 19 nt, Homo sapiens
agaugaagaugaugaugag

SEQ ID NO: 731057 - RNA, 19 nt, Homo sapiens
uacaguaacccgacacgaa

SEQ ID NO: 731058 - RNA, 19 nt, Homo sapiens
ccacgauaacuucggcuuu

SEQ ID NO: 731059 - RNA, 19 nt, Homo sapiens
gggaaugagccucuuugau

SEQ ID NO: 731060 - RNA, 19 nt, Homo sapiens
uagguuugaugauguaugg

SEQ ID NO: 731061 - RNA, 19 nt, Homo sapiens
guacgggaaugagccucuu

SEQ ID NO: 731062 - RNA, 19 nt, Homo sapiens
gggcuuggauauguggaau

SEQ ID NO: 731063 - RNA, 19 nt, Homo sapiens
gaagcagauagcaguccua

SEQ ID NO: 731064 - RNA, 19 nt, Homo sapiens
acucaaugcuuaaguaucc

SEQ ID NO: 731065 - RNA, 19 nt, Homo sapiens
ggaugacucgagaugaaga

SEQ ID NO: 731066 - RNA, 19 nt, Homo sapiens
gagccacagagaucccuuu

SEQ ID NO: 731067 - RNA, 19 nt, Homo sapiens
gacagagacuacaguaacc

SEQ ID NO: 731068 - RNA, 19 nt, Homo sapiens
uaacuucggcuuugaugac

SEQ ID NO: 731069 - RNA, 19 nt, Homo sapiens
cauugcccaccauuaauaa

SEQ ID NO: 731070 - RNA, 19 nt, Homo sapiens
acccauugcccaccauuaa

SEQ ID NO: 731071 - RNA, 19 nt, Homo sapiens
gagagugaugcaagaagug

SEQ ID NO: 731072 - RNA, 19 nt, Homo sapiens
agggauacguuuccacgau

SEQ ID NO: 731073 - RNA, 19 nt, Homo sapiens
ugaugaggaagaagaagaa

SEQ ID NO: 731074 - RNA, 19 nt, Homo sapiens
ggauauguggaauagugaa

SEQ ID NO: 731075 - RNA, 19 nt, Homo sapiens
ccaggaggagggauacguu

SEQ ID NO: 731076 - RNA, 19 nt, Homo sapiens
uuccaccucucacccauug

SEQ ID NO: 731077 - RNA, 19 nt, Homo sapiens
ccucggagccacagagauc

SEQ ID NO: 731078 - RNA, 19 nt, Homo sapiens
gaccuugccuucccauccu

SEQ ID NO: 731079 - RNA, 19 nt, Homo sapiens
ugaccuaguacgagauuuc

SEQ ID NO: 731080 - RNA, 19 nt, Homo sapiens
caggaggagggauacguuu

SEQ ID NO: 731081 - RNA, 19 nt, Homo sapiens
ugacucgagaugaagauga

SEQ ID NO: 731082 - RNA, 19 nt, Homo sapiens
uacgagauuucaauagcau

SEQ ID NO: 731083 - RNA, 19 nt, Homo sapiens
ccuaguacgagauuucaau

SEQ ID NO: 731084 - RNA, 19 nt, Homo sapiens
cuucggcuuugaugaccua

SEQ ID NO: 731085 - RNA, 19 nt, Homo sapiens
acgauaacuucggcuuuga

SEQ ID NO: 731086 - RNA, 19 nt, Homo sapiens
gagggaugacucgagauga

SEQ ID NO: 731087 - RNA, 19 nt, Homo sapiens
aagaugaugaugaggaaga

SEQ ID NO: 731088 - RNA, 19 nt, Homo sapiens
agaugaugaugaggaagaa

SEQ ID NO: 731089 - RNA, 19 nt, Homo sapiens
ggcuucggcuucagcuuca

SEQ ID NO: 731090 - RNA, 19 nt, Homo sapiens
caccagcccaggaucuuug

SEQ ID NO: 731091 - RNA, 19 nt, Homo sapiens
gaggagggauacguuucca

SEQ ID NO: 731092 - RNA, 19 nt, Homo sapiens
uauguggaauagugaacug

SEQ ID NO: 731093 - RNA, 19 nt, Homo sapiens
aaagguucgcgucccagua

SEQ ID NO: 731094 - RNA, 19 nt, Homo sapiens
gagaagaacugcagaaaug

SEQ ID NO: 731095 - RNA, 19 nt, Homo sapiens
uaacagauauggccacuuu

SEQ ID NO: 731096 - RNA, 19 nt, Homo sapiens
gaagaacgaucgaaauuca

SEQ ID NO: 731097 - RNA, 19 nt, Homo sapiens
gaaaaugacuggaaugaaa

SEQ ID NO: 731098 - RNA, 19 nt, Homo sapiens
gagaagcuacuauugauua

SEQ ID NO: 731099 - RNA, 19 nt, Homo sapiens
ccagaggaauucagaguua

SEQ ID NO: 731100 - RNA, 19 nt, Homo sapiens
gaugaaaacugccagauua

SEQ ID NO: 731101 - RNA, 19 nt, Homo sapiens
gagggaaucuuagagguua

SEQ ID NO: 731102 - RNA, 19 nt, Homo sapiens
uggaaugucucuacuauuu

SEQ ID NO: 731103 - RNA, 19 nt, Homo sapiens
gaauacaacccaauagaaa

SEQ ID NO: 731104 - RNA, 19 nt, Homo sapiens
ccauguaacuguaugcaua

SEQ ID NO: 731105 - RNA, 19 nt, Homo sapiens
gagagaagcuacuauugau

SEQ ID NO: 731106 - RNA, 19 nt, Homo sapiens
ggauaauacuggccuguuu

SEQ ID NO: 731107 - RNA, 19 nt, Homo sapiens
ggagagaagcuacuauuga

SEQ ID NO: 731108 - RNA, 19 nt, Homo sapiens
ccugaaagcucccuaauag

SEQ ID NO: 731109 - RNA, 19 nt, Homo sapiens
uauagucgcugcacauauu

SEQ ID NO: 731110 - RNA, 19 nt, Homo sapiens
gguaugaugugcacacuug

SEQ ID NO: 731111 - RNA, 19 nt, Homo sapiens
aauggaaccuucagccuua

SEQ ID NO: 731112 - RNA, 19 nt, Homo sapiens
ggaauacaacccaauagaa

SEQ ID NO: 731113 - RNA, 19 nt, Homo sapiens
cgacgaaaccuuccucaaa

SEQ ID NO: 731114 - RNA, 19 nt, Homo sapiens
ggagcacaaucaauuaaau

SEQ ID NO: 731115 - RNA, 19 nt, Homo sapiens
ugaaagaccuucugcuuac

SEQ ID NO: 731116 - RNA, 19 nt, Homo sapiens
gcuccuggcugcaagauug

SEQ ID NO: 731117 - RNA, 19 nt, Homo sapiens
cauggcaacuugaucagua

SEQ ID NO: 731118 - RNA, 19 nt, Homo sapiens
cagguuaacugcaagaaga

SEQ ID NO: 731119 - RNA, 19 nt, Homo sapiens
gccaaacgauuucaugaug

SEQ ID NO: 731120 - RNA, 19 nt, Homo sapiens
gacgaaaccuuccucaaag

SEQ ID NO: 731121 - RNA, 19 nt, Homo sapiens
guaaggauuucaccucugu

SEQ ID NO: 731122 - RNA, 19 nt, Homo sapiens
uuagguaacuaguaggaua

SEQ ID NO: 731123 - RNA, 19 nt, Homo sapiens
caaggaauacaacccaaua

SEQ ID NO: 731124 - RNA, 19 nt, Homo sapiens
gaaaugaggcugguuuauc

SEQ ID NO: 731125 - RNA, 19 nt, Homo sapiens
gcagaaaugaggcugguuu

SEQ ID NO: 731126 - RNA, 19 nt, Homo sapiens
aagaugaggucccugguuu

SEQ ID NO: 731127 - RNA, 19 nt, Homo sapiens
gcaaaggccugagugucuu

SEQ ID NO: 731128 - RNA, 19 nt, Homo sapiens
gacccagccucgccuuuaa

SEQ ID NO: 731129 - RNA, 19 nt, Homo sapiens
ggaggucuguaccaucauu

SEQ ID NO: 731130 - RNA, 19 nt, Homo sapiens
gcauaaagccaauguaguc

SEQ ID NO: 731131 - RNA, 19 nt, Homo sapiens
ccacacacuuggucaguau

SEQ ID NO: 731132 - RNA, 19 nt, Homo sapiens
cauggaaugucucuacuau

SEQ ID NO: 731133 - RNA, 19 nt, Homo sapiens
gagggagcacaaucaauua

SEQ ID NO: 731134 - RNA, 19 nt, Homo sapiens
gauuucaccucuguuugua

SEQ ID NO: 731135 - RNA, 19 nt, Homo sapiens
gcccaagccugugguauga

SEQ ID NO: 731136 - RNA, 19 nt, Homo sapiens
ccaagaauuuaaaggaguu

SEQ ID NO: 731137 - RNA, 19 nt, Homo sapiens
ucaaagaucuccccauuau

SEQ ID NO: 731138 - RNA, 19 nt, Homo sapiens
cagaagaacgaucgaaauu

SEQ ID NO: 731139 - RNA, 19 nt, Homo sapiens
gugcuggaguggcuauuaa

SEQ ID NO: 731140 - RNA, 19 nt, Homo sapiens
gaaauugggacgauguuca

SEQ ID NO: 731141 - RNA, 19 nt, Homo sapiens
cauaacgucuucccugaug

SEQ ID NO: 731142 - RNA, 19 nt, Homo sapiens
uuaaauggcuggucuucug

SEQ ID NO: 731143 - RNA, 19 nt, Homo sapiens
gaaagauguguacguggua

SEQ ID NO: 731144 - RNA, 19 nt, Homo sapiens
uggagaagauggaauuuca

SEQ ID NO: 731145 - RNA, 19 nt, Homo sapiens
caaacgauuucaugaugug

SEQ ID NO: 731146 - RNA, 19 nt, Homo sapiens
ggauggagaagauggaauu

SEQ ID NO: 731147 - RNA, 19 nt, Homo sapiens
aaaugaggcugguuuaucu

SEQ ID NO: 731148 - RNA, 19 nt, Homo sapiens
cucgugggcucaaauauaa

SEQ ID NO: 731149 - RNA, 19 nt, Homo sapiens
ugagggagcacaaucaauu

SEQ ID NO: 731150 - RNA, 19 nt, Homo sapiens
gcgggauacuuucagcuuu

SEQ ID NO: 731151 - RNA, 19 nt, Homo sapiens
cuagccacuuccucaauua

SEQ ID NO: 731152 - RNA, 19 nt, Homo sapiens
cagaucagauuccuguguu

SEQ ID NO: 731153 - RNA, 19 nt, Homo sapiens
gggacgauguucagugaga

SEQ ID NO: 731154 - RNA, 19 nt, Homo sapiens
ggaauuucaucuacgucuu

SEQ ID NO: 731155 - RNA, 19 nt, Homo sapiens
acacguaugugcucaaugg

SEQ ID NO: 731156 - RNA, 19 nt, Homo sapiens
ugacuauguuccagaagaa

SEQ ID NO: 731157 - RNA, 19 nt, Homo sapiens
gaaagaccuucugcuuaca

SEQ ID NO: 731158 - RNA, 19 nt, Homo sapiens
auacuacucucauaaaugg

SEQ ID NO: 731159 - RNA, 19 nt, Homo sapiens
agaagaggcgggauacuuu

SEQ ID NO: 731160 - RNA, 19 nt, Homo sapiens
gcaacuugaucaguaagga

SEQ ID NO: 731161 - RNA, 19 nt, Homo sapiens
ccacuucaauacacacuca

SEQ ID NO: 731162 - RNA, 19 nt, Homo sapiens
guuccaagcuaacugaauc

SEQ ID NO: 731163 - RNA, 19 nt, Homo sapiens
guaacuaguaggauagaaa

SEQ ID NO: 731164 - RNA, 19 nt, Homo sapiens
ggaauguggucagaagcaa

SEQ ID NO: 731165 - RNA, 19 nt, Homo sapiens
gaugacagacguccugaug

SEQ ID NO: 731166 - RNA, 19 nt, Homo sapiens
ccaaucauacugugaauca

SEQ ID NO: 731167 - RNA, 19 nt, Homo sapiens
ccaaacgauuucaugaugu

SEQ ID NO: 731168 - RNA, 19 nt, Homo sapiens
cagaggaauucagaguuaa

SEQ ID NO: 731169 - RNA, 19 nt, Homo sapiens
gauaauacuggccuguuug

SEQ ID NO: 731170 - RNA, 19 nt, Homo sapiens
gugacuauguuccagaaga

SEQ ID NO: 731171 - RNA, 19 nt, Homo sapiens
gagcacaaucaauuaaaug

SEQ ID NO: 731172 - RNA, 19 nt, Homo sapiens
gaauucagaguuaaaccuu

SEQ ID NO: 731173 - RNA, 19 nt, Homo sapiens
ggauguggaugagaugugu

SEQ ID NO: 731174 - RNA, 19 nt, Homo sapiens
ccuagccacuuccucaauu

SEQ ID NO: 731175 - RNA, 19 nt, Homo sapiens
ggauuucaccucuguuugu

SEQ ID NO: 731176 - RNA, 19 nt, Homo sapiens
guaguccaguuucuaagau

SEQ ID NO: 731177 - RNA, 19 nt, Homo sapiens
ucagugagaguuucuguga

SEQ ID NO: 731178 - RNA, 19 nt, Homo sapiens
cagaaaugaggcugguuua

SEQ ID NO: 731179 - RNA, 19 nt, Homo sapiens
ccucgugggcucaaauaua

SEQ ID NO: 731180 - RNA, 19 nt, Homo sapiens
ccauggacauuuaguuagu

SEQ ID NO: 731181 - RNA, 19 nt, Homo sapiens
ccaagccugugguaugaug

SEQ ID NO: 731182 - RNA, 19 nt, Homo sapiens
aagaucauguuccaagcua

SEQ ID NO: 731183 - RNA, 19 nt, Homo sapiens
acuuucagcuuuccaugua

SEQ ID NO: 731184 - RNA, 19 nt, Homo sapiens
gcaaggcuucuuuucauua

SEQ ID NO: 731185 - RNA, 19 nt, Homo sapiens
cgagcacccugauuucugu

SEQ ID NO: 731186 - RNA, 19 nt, Homo sapiens
aauacuggccuguuuguuu

SEQ ID NO: 731187 - RNA, 19 nt, Homo sapiens
ccucaauuauucuaccauu

SEQ ID NO: 731188 - RNA, 19 nt, Homo sapiens
uauguuugauguccugauu

SEQ ID NO: 731189 - RNA, 19 nt, Homo sapiens
gcugagugaaggaaugaua

SEQ ID NO: 731190 - RNA, 19 nt, Homo sapiens
gaagaggcgggauacuuuc

SEQ ID NO: 731191 - RNA, 19 nt, Homo sapiens
gaaugucucuacuauuucc

SEQ ID NO: 731192 - RNA, 19 nt, Homo sapiens
caagccaccaucacaauug

SEQ ID NO: 731193 - RNA, 19 nt, Homo sapiens
cgaaauucauccgacgaaa

SEQ ID NO: 731194 - RNA, 19 nt, Homo sapiens
gcaagaauccucagaagua

SEQ ID NO: 731195 - RNA, 19 nt, Homo sapiens
gugcugcgcugaagaaaua

SEQ ID NO: 731196 - RNA, 19 nt, Homo sapiens
agaaucagcuggaagaaau

SEQ ID NO: 731197 - RNA, 19 nt, Homo sapiens
agggcgagcuggagaauua

SEQ ID NO: 731198 - RNA, 19 nt, Homo sapiens
gagcagcgccgauguggaa

SEQ ID NO: 731199 - RNA, 19 nt, Homo sapiens
acaaggagcugcaguacau

SEQ ID NO: 731200 - RNA, 19 nt, Homo sapiens
uuacgcagcuggagcagaa

SEQ ID NO: 731201 - RNA, 19 nt, Homo sapiens
acaggcagauccagaauca

SEQ ID NO: 731202 - RNA, 19 nt, Homo sapiens
cauguagccuguucuguca

SEQ ID NO: 731203 - RNA, 19 nt, Homo sapiens
ggagagcacacccaucaug

SEQ ID NO: 731204 - RNA, 19 nt, Homo sapiens
gagagcacacccaucauga

SEQ ID NO: 731205 - RNA, 19 nt, Homo sapiens
caaagaacucggagacguu

SEQ ID NO: 731206 - RNA, 19 nt, Homo sapiens
gcagcaagaauccucagaa

SEQ ID NO: 731207 - RNA, 19 nt, Homo sapiens
uggaagaaaugcugaaguc

SEQ ID NO: 731208 - RNA, 19 nt, Homo sapiens
cagcaagaauccucagaag

SEQ ID NO: 731209 - RNA, 19 nt, Homo sapiens
cugcuucuccugccuaaua

SEQ ID NO: 731210 - RNA, 19 nt, Homo sapiens
caagaauccucagaaguac

SEQ ID NO: 731211 - RNA, 19 nt, Homo sapiens
guacacgccucuggucaca

SEQ ID NO: 731212 - RNA, 19 nt, Homo sapiens
caggagagcacacccauca

SEQ ID NO: 731213 - RNA, 19 nt, Homo sapiens
gggccuggaugacuaugga

SEQ ID NO: 731214 - RNA, 19 nt, Homo sapiens
cagcugaagccgacaguga

SEQ ID NO: 731215 - RNA, 19 nt, Homo sapiens
gaaauaccagacugagcaa

SEQ ID NO: 731216 - RNA, 19 nt, Homo sapiens
acacgccucuggucacaug

SEQ ID NO: 731217 - RNA, 19 nt, Homo sapiens
ggagcgcaauggccguaug

SEQ ID NO: 731218 - RNA, 19 nt, Homo sapiens
gcaagagcgugaccccaaa

SEQ ID NO: 731219 - RNA, 19 nt, Homo sapiens
ugaagaaauaccagacuga

SEQ ID NO: 731220 - RNA, 19 nt, Homo sapiens
aguccaaccuggucauuuc

SEQ ID NO: 731221 - RNA, 19 nt, Homo sapiens
gcacaugagccugcagcaa

SEQ ID NO: 731222 - RNA, 19 nt, Homo sapiens
cuacaagaccgcacugaca

SEQ ID NO: 731223 - RNA, 19 nt, Homo sapiens
gagcacacccaucaugaac

SEQ ID NO: 731224 - RNA, 19 nt, Homo sapiens
ggacaaggagcugcaguac

SEQ ID NO: 731225 - RNA, 19 nt, Homo sapiens
cagaaucagcuggaagaaa

SEQ ID NO: 731226 - RNA, 19 nt, Homo sapiens
ucacggaaaaugucuauaa

SEQ ID NO: 731227 - RNA, 19 nt, Homo sapiens
gugacaggcugcacaugag

SEQ ID NO: 731228 - RNA, 19 nt, Homo sapiens
gcuaugccaccaccgagaa

SEQ ID NO: 731229 - RNA, 19 nt, Homo sapiens
gaguuaagggaggacauuu

SEQ ID NO: 731230 - RNA, 19 nt, Homo sapiens
gagagagugagaagaccaa

SEQ ID NO: 731231 - RNA, 19 nt, Homo sapiens
ccgccugacuagaguuaga

SEQ ID NO: 731232 - RNA, 19 nt, Homo sapiens
auucugagccgccugacua

SEQ ID NO: 731233 - RNA, 19 nt, Homo sapiens
cgggcaaccuccuggacaa

SEQ ID NO: 731234 - RNA, 19 nt, Homo sapiens
gcugguuucccuucuccua

SEQ ID NO: 731235 - RNA, 19 nt, Homo sapiens
agaaguacucggacaagga

SEQ ID NO: 731236 - RNA, 19 nt, Homo sapiens
ugagugcugcgcugaagaa

SEQ ID NO: 731237 - RNA, 19 nt, Homo sapiens
gugcguuccuguguagaga

SEQ ID NO: 731238 - RNA, 19 nt, Homo sapiens
agagugagaagaccaagau

SEQ ID NO: 731239 - RNA, 19 nt, Homo sapiens
gagagugagaagaccaaga

SEQ ID NO: 731240 - RNA, 19 nt, Homo sapiens
caucaugaacggcgucaca

SEQ ID NO: 731241 - RNA, 19 nt, Homo sapiens
cggacaaggagcugcagua

SEQ ID NO: 731242 - RNA, 19 nt, Homo sapiens
gaaucagcuggaagaaaug

SEQ ID NO: 731243 - RNA, 19 nt, Homo sapiens
gcacccuccugagcuucaa

SEQ ID NO: 731244 - RNA, 19 nt, Homo sapiens
acagcacccuccugagcuu

SEQ ID NO: 731245 - RNA, 19 nt, Homo sapiens
uggcaggugugacguaugc

SEQ ID NO: 731246 - RNA, 19 nt, Homo sapiens
uuucacaacgagcugcuua

SEQ ID NO: 731247 - RNA, 19 nt, Homo sapiens
guuaagggaggacauuugg

SEQ ID NO: 731248 - RNA, 19 nt, Homo sapiens
ugugacguaugcagccaaa

SEQ ID NO: 731249 - RNA, 19 nt, Homo sapiens
cagcgccgauguggaagug

SEQ ID NO: 731250 - RNA, 19 nt, Homo sapiens
ccaccgagaacaagacucu

SEQ ID NO: 731251 - RNA, 19 nt, Homo sapiens
gacaaggagcugcaguaca

SEQ ID NO: 731252 - RNA, 19 nt, Homo sapiens
ggaagaaaugcugaagucu

SEQ ID NO: 731253 - RNA, 19 nt, Homo sapiens
caucugugcguuccugugu

SEQ ID NO: 731254 - RNA, 19 nt, Homo sapiens
gagccagggcagcaagaau

SEQ ID NO: 731255 - RNA, 19 nt, Homo sapiens
agugacaggcugcacauga

SEQ ID NO: 731256 - RNA, 19 nt, Homo sapiens
gcaagcucagcgacuccua

SEQ ID NO: 731257 - RNA, 19 nt, Homo sapiens
ccacaggcagauccagaau

SEQ ID NO: 731258 - RNA, 19 nt, Homo sapiens
gcaagaauccucagaagua

SEQ ID NO: 731259 - RNA, 19 nt, Homo sapiens
gcaguuacuuguuugaaua

SEQ ID NO: 731260 - RNA, 19 nt, Homo sapiens
guaaagugcugaacauauu

SEQ ID NO: 731261 - RNA, 19 nt, Homo sapiens
gugcugcgcugaagaaaua

SEQ ID NO: 731262 - RNA, 19 nt, Homo sapiens
guacugcaguuacuuguuu

SEQ ID NO: 731263 - RNA, 19 nt, Homo sapiens
ccuaaacgcucucgucuuu

SEQ ID NO: 731264 - RNA, 19 nt, Homo sapiens
ggacguggcugguaguguu

SEQ ID NO: 731265 - RNA, 19 nt, Homo sapiens
uaucugaugugguuuagua

SEQ ID NO: 731266 - RNA, 19 nt, Homo sapiens
ggaugaauguagacacaaa

SEQ ID NO: 731267 - RNA, 19 nt, Homo sapiens
ggucuaaaguuugaagaaa

SEQ ID NO: 731268 - RNA, 19 nt, Homo sapiens
agaaucagcuggaagaaau

SEQ ID NO: 731269 - RNA, 19 nt, Homo sapiens
agggcgagcuggagaauua

SEQ ID NO: 731270 - RNA, 19 nt, Homo sapiens
acacuuguaugaagaugua

SEQ ID NO: 731271 - RNA, 19 nt, Homo sapiens
acaaggagcugcaguacau

SEQ ID NO: 731272 - RNA, 19 nt, Homo sapiens
cagcaacacuuguaugaag

SEQ ID NO: 731273 - RNA, 19 nt, Homo sapiens
ugagccaggucuaaaguuu

SEQ ID NO: 731274 - RNA, 19 nt, Homo sapiens
uuacgcagcuggagcagaa

SEQ ID NO: 731275 - RNA, 19 nt, Homo sapiens
acaggcagauccagaauca

SEQ ID NO: 731276 - RNA, 19 nt, Homo sapiens
cuacugguauugucucuuc

SEQ ID NO: 731277 - RNA, 19 nt, Homo sapiens
ggagagcacacccaucaug

SEQ ID NO: 731278 - RNA, 19 nt, Homo sapiens
gagagcacacccaucauga

SEQ ID NO: 731279 - RNA, 19 nt, Homo sapiens
caaagaacucggagacguu

SEQ ID NO: 731280 - RNA, 19 nt, Homo sapiens
gcagcaagaauccucagaa

SEQ ID NO: 731281 - RNA, 19 nt, Homo sapiens
uggaagaaaugcugaaguc

SEQ ID NO: 731282 - RNA, 19 nt, Homo sapiens
caaacacaguggacucagu

SEQ ID NO: 731283 - RNA, 19 nt, Homo sapiens
cagcaagaauccucagaag

SEQ ID NO: 731284 - RNA, 19 nt, Homo sapiens
caagaauccucagaaguac

SEQ ID NO: 731285 - RNA, 19 nt, Homo sapiens
gaagauguaaagugcugaa

SEQ ID NO: 731286 - RNA, 19 nt, Homo sapiens
caggagagcacacccauca

SEQ ID NO: 731287 - RNA, 19 nt, Homo sapiens
caaaacagcaacacuugua

SEQ ID NO: 731288 - RNA, 19 nt, Homo sapiens
gggccuggaugacuaugga

SEQ ID NO: 731289 - RNA, 19 nt, Homo sapiens
gcacgcugguguccacagu

SEQ ID NO: 731290 - RNA, 19 nt, Homo sapiens
gaaauaccagacugagcaa

SEQ ID NO: 731291 - RNA, 19 nt, Homo sapiens
ggagcgcaauggccguaug

SEQ ID NO: 731292 - RNA, 19 nt, Homo sapiens
acacggacauuccaaagac

SEQ ID NO: 731293 - RNA, 19 nt, Homo sapiens
gcacacggacauuccaaag

SEQ ID NO: 731294 - RNA, 19 nt, Homo sapiens
gcaagagcgugaccccaaa

SEQ ID NO: 731295 - RNA, 19 nt, Homo sapiens
ugaagaaauaccagacuga

SEQ ID NO: 731296 - RNA, 19 nt, Homo sapiens
aguccaaccuggucauuuc

SEQ ID NO: 731297 - RNA, 19 nt, Homo sapiens
cucaauggaugaauguaga

SEQ ID NO: 731298 - RNA, 19 nt, Homo sapiens
ccgcuccgcuaaagauuuc

SEQ ID NO: 731299 - RNA, 19 nt, Homo sapiens
cuuggugacuuuagaaaca

SEQ ID NO: 731300 - RNA, 19 nt, Homo sapiens
agccaggucuaaaguuuga

SEQ ID NO: 731301 - RNA, 19 nt, Homo sapiens
gcacaugagccugcagcaa

SEQ ID NO: 731302 - RNA, 19 nt, Homo sapiens
cuacaagaccgcacugaca

SEQ ID NO: 731303 - RNA, 19 nt, Homo sapiens
uguaaagugcugaacauau

SEQ ID NO: 731304 - RNA, 19 nt, Homo sapiens
caacacuuguaugaagaug

SEQ ID NO: 731305 - RNA, 19 nt, Homo sapiens
gagccaggucuaaaguuug

SEQ ID NO: 731306 - RNA, 19 nt, Homo sapiens
caugcucaauggaugaaug

SEQ ID NO: 731307 - RNA, 19 nt, Homo sapiens
gagcacacccaucaugaac

SEQ ID NO: 731308 - RNA, 19 nt, Homo sapiens
ggacaaggagcugcaguac

SEQ ID NO: 731309 - RNA, 19 nt, Homo sapiens
cagaaucagcuggaagaaa

SEQ ID NO: 731310 - RNA, 19 nt, Homo sapiens
gcucaauggaugaauguag

SEQ ID NO: 731311 - RNA, 19 nt, Homo sapiens
uccuuuaucugaugugguu

SEQ ID NO: 731312 - RNA, 19 nt, Homo sapiens
ucacggaaaaugucuauaa

SEQ ID NO: 731313 - RNA, 19 nt, Homo sapiens
aaacagcaacacuuguaug

SEQ ID NO: 731314 - RNA, 19 nt, Homo sapiens
gugacaggcugcacaugag

SEQ ID NO: 731315 - RNA, 19 nt, Homo sapiens
gcuaugccaccaccgagaa

SEQ ID NO: 731316 - RNA, 19 nt, Homo sapiens
gcaacacuuguaugaagau

SEQ ID NO: 731317 - RNA, 19 nt, Homo sapiens
gagagagugagaagaccaa

SEQ ID NO: 731318 - RNA, 19 nt, Homo sapiens
aacagcaacacuuguauga

SEQ ID NO: 731319 - RNA, 19 nt, Homo sapiens
cgggcaaccuccuggacaa

SEQ ID NO: 731320 - RNA, 19 nt, Homo sapiens
gcugguuucccuucuccua

SEQ ID NO: 731321 - RNA, 19 nt, Homo sapiens
agaaguacucggacaagga

SEQ ID NO: 731322 - RNA, 19 nt, Homo sapiens
ugagugcugcgcugaagaa

SEQ ID NO: 731323 - RNA, 19 nt, Homo sapiens
ugcaguuacuuguuugaau

SEQ ID NO: 731324 - RNA, 19 nt, Homo sapiens
agagugagaagaccaagau

SEQ ID NO: 731325 - RNA, 19 nt, Homo sapiens
cuguggcacucacugcuuu

SEQ ID NO: 731326 - RNA, 19 nt, Homo sapiens
gaaucagcuggaagaaaug

SEQ ID NO: 731327 - RNA, 19 nt, Homo sapiens
gagagugagaagaccaaga

SEQ ID NO: 731328 - RNA, 19 nt, Homo sapiens
caucaugaacggcgucaca

SEQ ID NO: 731329 - RNA, 19 nt, Homo sapiens
cggacaaggagcugcagua

SEQ ID NO: 731330 - RNA, 19 nt, Homo sapiens
ugaauugugcccuguacug

SEQ ID NO: 731331 - RNA, 19 nt, Homo sapiens
uggcaggugugacguaugc

SEQ ID NO: 731332 - RNA, 19 nt, Homo sapiens
cgggccagguguacauaga

SEQ ID NO: 731333 - RNA, 19 nt, Homo sapiens
gcacccuccugagcuucaa

SEQ ID NO: 731334 - RNA, 19 nt, Homo sapiens
acagcacccuccugagcuu

SEQ ID NO: 731335 - RNA, 19 nt, Homo sapiens
uuucacaacgagcugcuua

SEQ ID NO: 731336 - RNA, 19 nt, Homo sapiens
uguaugaagauguaaagug

SEQ ID NO: 731337 - RNA, 19 nt, Homo sapiens
ggaagaaaugcugaagucu

SEQ ID NO: 731338 - RNA, 19 nt, Homo sapiens
gcacucacugcuuuucuaa

SEQ ID NO: 731339 - RNA, 19 nt, Homo sapiens
gguuuguucuuggguuguu

SEQ ID NO: 731340 - RNA, 19 nt, Homo sapiens
ugugacguaugcagccaaa

SEQ ID NO: 731341 - RNA, 19 nt, Homo sapiens
ccaccgagaacaagacucu

SEQ ID NO: 731342 - RNA, 19 nt, Homo sapiens
gacaaggagcugcaguaca

SEQ ID NO: 731343 - RNA, 19 nt, Homo sapiens
agcaacacuuguaugaaga

SEQ ID NO: 731344 - RNA, 19 nt, Homo sapiens
gcgcuccuuuaucugaugu

SEQ ID NO: 731345 - RNA, 19 nt, Homo sapiens
ccugcccgguucuuccuaa

SEQ ID NO: 731346 - RNA, 19 nt, Homo sapiens
gagccagggcagcaagaau

SEQ ID NO: 731347 - RNA, 19 nt, Homo sapiens
ccacaggcagauccagaau

SEQ ID NO: 731348 - RNA, 19 nt, Homo sapiens
agugacaggcugcacauga

SEQ ID NO: 731349 - RNA, 19 nt, Homo sapiens
gcaagcucagcgacuccua

SEQ ID NO: 731350 - RNA, 19 nt, Homo sapiens
gcaagaauccucagaagua

SEQ ID NO: 731351 - RNA, 19 nt, Homo sapiens
gugcugcgcugaagaaaua

SEQ ID NO: 731352 - RNA, 19 nt, Homo sapiens
guucuaagccucaaacaaa

SEQ ID NO: 731353 - RNA, 19 nt, Homo sapiens
agaaucagcuggaagaaau

SEQ ID NO: 731354 - RNA, 19 nt, Homo sapiens
agggcgagcuggagaauua

SEQ ID NO: 731355 - RNA, 19 nt, Homo sapiens
acaaggagcugcaguacau

SEQ ID NO: 731356 - RNA, 19 nt, Homo sapiens
uuacgcagcuggagcagaa

SEQ ID NO: 731357 - RNA, 19 nt, Homo sapiens
gaagacaacacacaaaggu

SEQ ID NO: 731358 - RNA, 19 nt, Homo sapiens
cgaagcaacaauaaacuuu

SEQ ID NO: 731359 - RNA, 19 nt, Homo sapiens
gagcugcacuggugacaac

SEQ ID NO: 731360 - RNA, 19 nt, Homo sapiens
acaggcagauccagaauca

SEQ ID NO: 731361 - RNA, 19 nt, Homo sapiens
cacccuggcuggaagauga

SEQ ID NO: 731362 - RNA, 19 nt, Homo sapiens
ggagagcacacccaucaug

SEQ ID NO: 731363 - RNA, 19 nt, Homo sapiens
agacaacacacaaagguuu

SEQ ID NO: 731364 - RNA, 19 nt, Homo sapiens
gagagcacacccaucauga

SEQ ID NO: 731365 - RNA, 19 nt, Homo sapiens
ccauacuguuuguuuguuu

SEQ ID NO: 731366 - RNA, 19 nt, Homo sapiens
caaagaacucggagacguu

SEQ ID NO: 731367 - RNA, 19 nt, Homo sapiens
gcagcaagaauccucagaa

SEQ ID NO: 731368 - RNA, 19 nt, Homo sapiens
uggaagaaaugcugaaguc

SEQ ID NO: 731369 - RNA, 19 nt, Homo sapiens
gauuugugcucuuccauac

SEQ ID NO: 731370 - RNA, 19 nt, Homo sapiens
cagcaagaauccucagaag

SEQ ID NO: 731371 - RNA, 19 nt, Homo sapiens
gcucuuccauacuguuugu

SEQ ID NO: 731372 - RNA, 19 nt, Homo sapiens
caagaauccucagaaguac

SEQ ID NO: 731373 - RNA, 19 nt, Homo sapiens
uuacaucucuuuggcaaca

SEQ ID NO: 731374 - RNA, 19 nt, Homo sapiens
gccuguagguccauucuuc

SEQ ID NO: 731375 - RNA, 19 nt, Homo sapiens
caggagagcacacccauca

SEQ ID NO: 731376 - RNA, 19 nt, Homo sapiens
gacagacauugcccucaga

SEQ ID NO: 731377 - RNA, 19 nt, Homo sapiens
aagaugaacuucccguaag

SEQ ID NO: 731378 - RNA, 19 nt, Homo sapiens
gggccuggaugacuaugga

SEQ ID NO: 731379 - RNA, 19 nt, Homo sapiens
cggcagaccucagaagaca

SEQ ID NO: 731380 - RNA, 19 nt, Homo sapiens
cagcugaagccgacaguga

SEQ ID NO: 731381 - RNA, 19 nt, Homo sapiens
gaaauaccagacugagcaa

SEQ ID NO: 731382 - RNA, 19 nt, Homo sapiens
uuucuuagcuucauuucuc

SEQ ID NO: 731383 - RNA, 19 nt, Homo sapiens
gcgaagcaacaauaaacuu

SEQ ID NO: 731384 - RNA, 19 nt, Homo sapiens
gcagauuugugcucuucca

SEQ ID NO: 731385 - RNA, 19 nt, Homo sapiens
ggagcgcaauggccguaug

SEQ ID NO: 731386 - RNA, 19 nt, Homo sapiens
cauacuguuuguuuguuug

SEQ ID NO: 731387 - RNA, 19 nt, Homo sapiens
gcaagagcgugaccccaaa

SEQ ID NO: 731388 - RNA, 19 nt, Homo sapiens
ugaagaaauaccagacuga

SEQ ID NO: 731389 - RNA, 19 nt, Homo sapiens
ucagaagacaacacacaaa

SEQ ID NO: 731390 - RNA, 19 nt, Homo sapiens
aguccaaccuggucauuuc

SEQ ID NO: 731391 - RNA, 19 nt, Homo sapiens
ggggagcucugcuggaauu

SEQ ID NO: 731392 - RNA, 19 nt, Homo sapiens
gcacaugagccugcagcaa

SEQ ID NO: 731393 - RNA, 19 nt, Homo sapiens
cuacaagaccgcacugaca

SEQ ID NO: 731394 - RNA, 19 nt, Homo sapiens
ggccagcugucaggugcua

SEQ ID NO: 731395 - RNA, 19 nt, Homo sapiens
gagcacacccaucaugaac

SEQ ID NO: 731396 - RNA, 19 nt, Homo sapiens
ggacaaggagcugcaguac

SEQ ID NO: 731397 - RNA, 19 nt, Homo sapiens
cagaaucagcuggaagaaa

SEQ ID NO: 731398 - RNA, 19 nt, Homo sapiens
ucacggaaaaugucuauaa

SEQ ID NO: 731399 - RNA, 19 nt, Homo sapiens
cagaagacaacacacaaag

SEQ ID NO: 731400 - RNA, 19 nt, Homo sapiens
gugacaggcugcacaugag

SEQ ID NO: 731401 - RNA, 19 nt, Homo sapiens
gcuaugccaccaccgagaa

SEQ ID NO: 731402 - RNA, 19 nt, Homo sapiens
gcccagcugugcucaacuc

SEQ ID NO: 731403 - RNA, 19 nt, Homo sapiens
gagagagugagaagaccaa

SEQ ID NO: 731404 - RNA, 19 nt, Homo sapiens
gacaacacacaaagguuuc

SEQ ID NO: 731405 - RNA, 19 nt, Homo sapiens
cgggcaaccuccuggacaa

SEQ ID NO: 731406 - RNA, 19 nt, Homo sapiens
gcugguuucccuucuccua

SEQ ID NO: 731407 - RNA, 19 nt, Homo sapiens
agaaguacucggacaagga

SEQ ID NO: 731408 - RNA, 19 nt, Homo sapiens
ugagugcugcgcugaagaa

SEQ ID NO: 731409 - RNA, 19 nt, Homo sapiens
agagugagaagaccaagau

SEQ ID NO: 731410 - RNA, 19 nt, Homo sapiens
gaccucagaagacaacaca

SEQ ID NO: 731411 - RNA, 19 nt, Homo sapiens
gcagaccucagaagacaac

SEQ ID NO: 731412 - RNA, 19 nt, Homo sapiens
ccagggacagacagacauu

SEQ ID NO: 731413 - RNA, 19 nt, Homo sapiens
gagagugagaagaccaaga

SEQ ID NO: 731414 - RNA, 19 nt, Homo sapiens
caucaugaacggcgucaca

SEQ ID NO: 731415 - RNA, 19 nt, Homo sapiens
cggacaaggagcugcagua

SEQ ID NO: 731416 - RNA, 19 nt, Homo sapiens
gaaucagcuggaagaaaug

SEQ ID NO: 731417 - RNA, 19 nt, Homo sapiens
caaggaacaagaaaacauu

SEQ ID NO: 731418 - RNA, 19 nt, Homo sapiens
uuuguuaggugaaauacag

SEQ ID NO: 731419 - RNA, 19 nt, Homo sapiens
agauuugugcucuuccaua

SEQ ID NO: 731420 - RNA, 19 nt, Homo sapiens
uggcaggugugacguaugc

SEQ ID NO: 731421 - RNA, 19 nt, Homo sapiens
gcacccuccugagcuucaa

SEQ ID NO: 731422 - RNA, 19 nt, Homo sapiens
acagcacccuccugagcuu

SEQ ID NO: 731423 - RNA, 19 nt, Homo sapiens
uuucacaacgagcugcuua

SEQ ID NO: 731424 - RNA, 19 nt, Homo sapiens
cuuccauacuguuuguuug

SEQ ID NO: 731425 - RNA, 19 nt, Homo sapiens
ccaccgagaacaagacucu

SEQ ID NO: 731426 - RNA, 19 nt, Homo sapiens
ugugacguaugcagccaaa

SEQ ID NO: 731427 - RNA, 19 nt, Homo sapiens
ggaagaaaugcugaagucu

SEQ ID NO: 731428 - RNA, 19 nt, Homo sapiens
gacaaggagcugcaguaca

SEQ ID NO: 731429 - RNA, 19 nt, Homo sapiens
aaacuuuacaucucuuugg

SEQ ID NO: 731430 - RNA, 19 nt, Homo sapiens
cuuagcuucauuucucuua

SEQ ID NO: 731431 - RNA, 19 nt, Homo sapiens
gaagggcagggaggagguu

SEQ ID NO: 731432 - RNA, 19 nt, Homo sapiens
gagccagggcagcaagaau

SEQ ID NO: 731433 - RNA, 19 nt, Homo sapiens
ccucagaagacaacacaca

SEQ ID NO: 731434 - RNA, 19 nt, Homo sapiens
ccacaggcagauccagaau

SEQ ID NO: 731435 - RNA, 19 nt, Homo sapiens
caacgacaggugugaucug

SEQ ID NO: 731436 - RNA, 19 nt, Homo sapiens
agugacaggcugcacauga

SEQ ID NO: 731437 - RNA, 19 nt, Homo sapiens
gcaagcucagcgacuccua

SEQ ID NO: 731438 - RNA, 19 nt, Homo sapiens
gcugugaguuguuucaaua

SEQ ID NO: 731439 - RNA, 19 nt, Homo sapiens
gaagaaugauguggagaaa

SEQ ID NO: 731440 - RNA, 19 nt, Homo sapiens
gacaagaccucaacuuugg

SEQ ID NO: 731441 - RNA, 19 nt, Homo sapiens
gaaauucgucuuugagauc

SEQ ID NO: 731442 - RNA, 19 nt, Homo sapiens
caaauacugugcugugagu

SEQ ID NO: 731443 - RNA, 19 nt, Homo sapiens
cgacaagaccucaacuuug

SEQ ID NO: 731444 - RNA, 19 nt, Homo sapiens
cugcauggcugcccugauu

SEQ ID NO: 731445 - RNA, 19 nt, Homo sapiens
agaaugauguggagaaagu

SEQ ID NO: 731446 - RNA, 19 nt, Homo sapiens
gagaaauucgucuuugaga

SEQ ID NO: 731447 - RNA, 19 nt, Homo sapiens
gagaagauccaggucauca

SEQ ID NO: 731448 - RNA, 19 nt, Homo sapiens
uggagaaauucgucuuuga

SEQ ID NO: 731449 - RNA, 19 nt, Homo sapiens
gaaaguggugguggugauu

SEQ ID NO: 731450 - RNA, 19 nt, Homo sapiens
gaagauccaggucaucaag

SEQ ID NO: 731451 - RNA, 19 nt, Homo sapiens
caacacugucugucucaaa

SEQ ID NO: 731452 - RNA, 19 nt, Homo sapiens
gcucuuaucgccucugugu

SEQ ID NO: 731453 - RNA, 19 nt, Homo sapiens
ccacugaugcccaaacugu

SEQ ID NO: 731454 - RNA, 19 nt, Homo sapiens
guggagaaauucgucuuug

SEQ ID NO: 731455 - RNA, 19 nt, Homo sapiens
ggagaaauucgucuuugag

SEQ ID NO: 731456 - RNA, 19 nt, Homo sapiens
caacgugccgguccagaug

SEQ ID NO: 731457 - RNA, 19 nt, Homo sapiens
ggagguggcugugcaucuc

SEQ ID NO: 731458 - RNA, 19 nt, Homo sapiens
gcccaaacugucagacuuu

SEQ ID NO: 731459 - RNA, 19 nt, Homo sapiens
agaaauucgucuuugagau

SEQ ID NO: 731460 - RNA, 19 nt, Homo sapiens
gugaguuguuucaauaaag

SEQ ID NO: 731461 - RNA, 19 nt, Homo sapiens
gaugcagcuuuacguggaa

SEQ ID NO: 731462 - RNA, 19 nt, Homo sapiens
uccagaaacgcaagaagua

SEQ ID NO: 731463 - RNA, 19 nt, Homo sapiens
agaagaaugauguggagaa

SEQ ID NO: 731464 - RNA, 19 nt, Homo sapiens
ugaguuguuucaauaaagg

SEQ ID NO: 731465 - RNA, 19 nt, Homo sapiens
acgacaagaccucaacuuu

SEQ ID NO: 731466 - RNA, 19 nt, Homo sapiens
agaaaguggugguggugau

SEQ ID NO: 731467 - RNA, 19 nt, Homo sapiens
gauuccaagugcucuuauc

SEQ ID NO: 731468 - RNA, 19 nt, Homo sapiens
aaauucgucuuugagauca

SEQ ID NO: 731469 - RNA, 19 nt, Homo sapiens
gcaccgcccaguggagaaa

SEQ ID NO: 731470 - RNA, 19 nt, Homo sapiens
aacacugucugucucaaau

SEQ ID NO: 731471 - RNA, 19 nt, Homo sapiens
ugcccaaacugucagacuu

SEQ ID NO: 731472 - RNA, 19 nt, Homo sapiens
uccaggucaucaaggauuu

SEQ ID NO: 731473 - RNA, 19 nt, Homo sapiens
agauccaggucaucaagga

SEQ ID NO: 731474 - RNA, 19 nt, Homo sapiens
gugggcaucuuccagaaac

SEQ ID NO: 731475 - RNA, 19 nt, Homo sapiens
acacugucugucucaaaua

SEQ ID NO: 731476 - RNA, 19 nt, Homo sapiens
accaugacgucggacauuu

SEQ ID NO: 731477 - RNA, 19 nt, Homo sapiens
cagaaacgcaagaaguaca

SEQ ID NO: 731478 - RNA, 19 nt, Homo sapiens
ccgcugugcucugcgaguu

SEQ ID NO: 731479 - RNA, 19 nt, Homo sapiens
gcucagacucgcuguuguc

SEQ ID NO: 731480 - RNA, 19 nt, Homo sapiens
cucaaauacugugcuguga

SEQ ID NO: 731481 - RNA, 19 nt, Homo sapiens
cgucggacauuuuaaagau

SEQ ID NO: 731482 - RNA, 19 nt, Homo sapiens
gacucgcuguugucucaug

SEQ ID NO: 731483 - RNA, 19 nt, Homo sapiens
ggaccuggaugcaguggua

SEQ ID NO: 731484 - RNA, 19 nt, Homo sapiens
ccacagaucugaacuccau

SEQ ID NO: 731485 - RNA, 19 nt, Homo sapiens
agaagugcguggaggauua

SEQ ID NO: 731486 - RNA, 19 nt, Homo sapiens
gcacggagccgaggaagaa

SEQ ID NO: 731487 - RNA, 19 nt, Homo sapiens
caaauggugucuccaggaa

SEQ ID NO: 731488 - RNA, 19 nt, Homo sapiens
gcaccucgcuucccacaag

SEQ ID NO: 731489 - RNA, 19 nt, Homo sapiens
gagcggaccuguaaaacua

SEQ ID NO: 731490 - RNA, 19 nt, Homo sapiens
gaacgaagagucacugaag

SEQ ID NO: 731491 - RNA, 19 nt, Homo sapiens
ggaagaucauggacagguu

SEQ ID NO: 731492 - RNA, 19 nt, Homo sapiens
gcagaagacuaaagagaac

SEQ ID NO: 731493 - RNA, 19 nt, Homo sapiens
gaaugagucugcaggucuu

SEQ ID NO: 731494 - RNA, 19 nt, Homo sapiens
gagcagaagacuaaagaga

SEQ ID NO: 731495 - RNA, 19 nt, Homo sapiens
caacuuaccacagaucuga

SEQ ID NO: 731496 - RNA, 19 nt, Homo sapiens
ccaagaaccuggccaaagc

SEQ ID NO: 731497 - RNA, 19 nt, Homo sapiens
ucucuuaggugucauguuc

SEQ ID NO: 731498 - RNA, 19 nt, Homo sapiens
gcgacgaccucaucuccaa

SEQ ID NO: 731499 - RNA, 19 nt, Homo sapiens
uggauuaccuggagcaguu

SEQ ID NO: 731500 - RNA, 19 nt, Homo sapiens
gaaagaggagagcuucaga

SEQ ID NO: 731501 - RNA, 19 nt, Homo sapiens
gaaccuggccaaagcuaug

SEQ ID NO: 731502 - RNA, 19 nt, Homo sapiens
gcugaaauccagaaaguuc

SEQ ID NO: 731503 - RNA, 19 nt, Homo sapiens
ggacagguucgaagagguu

SEQ ID NO: 731504 - RNA, 19 nt, Homo sapiens
gaaggugacuuuucagaca

SEQ ID NO: 731505 - RNA, 19 nt, Homo sapiens
caaaacuacucauggaauu

SEQ ID NO: 731506 - RNA, 19 nt, Homo sapiens
aagcugaaauccagaaagu

SEQ ID NO: 731507 - RNA, 19 nt, Homo sapiens
caguggagcagaagacuaa

SEQ ID NO: 731508 - RNA, 19 nt, Homo sapiens
agaagacaguggagcagaa

SEQ ID NO: 731509 - RNA, 19 nt, Homo sapiens
accaacagcucaucaagga

SEQ ID NO: 731510 - RNA, 19 nt, Homo sapiens
ucgaagagguuguguacca

SEQ ID NO: 731511 - RNA, 19 nt, Homo sapiens
aaauugcgacuuccuguuu

SEQ ID NO: 731512 - RNA, 19 nt, Homo sapiens
ucgaggagcggaccuguaa

SEQ ID NO: 731513 - RNA, 19 nt, Homo sapiens
gaaccaacagcucaucaag

SEQ ID NO: 731514 - RNA, 19 nt, Homo sapiens
gaaguuaccggaagaucgu

SEQ ID NO: 731515 - RNA, 19 nt, Homo sapiens
gaagagucacugaagaagu

SEQ ID NO: 731516 - RNA, 19 nt, Homo sapiens
caaggaaguggaugccaaa

SEQ ID NO: 731517 - RNA, 19 nt, Homo sapiens
acgaggagcugaccaggau

SEQ ID NO: 731518 - RNA, 19 nt, Homo sapiens
ccuuauaccucaaguucga

SEQ ID NO: 731519 - RNA, 19 nt, Homo sapiens
ccacagacgcacaggauuc

SEQ ID NO: 731520 - RNA, 19 nt, Homo sapiens
gaaaaugugccacccaaga

SEQ ID NO: 731521 - RNA, 19 nt, Homo sapiens
gaucugcgacgaccucauc

SEQ ID NO: 731522 - RNA, 19 nt, Homo sapiens
aagaccaacuuaccacaga

SEQ ID NO: 731523 - RNA, 19 nt, Homo sapiens
caaaauggaugacccaaac

SEQ ID NO: 731524 - RNA, 19 nt, Homo sapiens
ccaaggagacugggagaga

SEQ ID NO: 731525 - RNA, 19 nt, Homo sapiens
gaccuggacugcucaagcu

SEQ ID NO: 731526 - RNA, 19 nt, Homo sapiens
ggaaguggaugccaaaacu

SEQ ID NO: 731527 - RNA, 19 nt, Homo sapiens
uagcauggccagcaaacuu

SEQ ID NO: 731528 - RNA, 19 nt, Homo sapiens
aggauuaccuggcaaggau

SEQ ID NO: 731529 - RNA, 19 nt, Homo sapiens
gaucauggacagguucgaa

SEQ ID NO: 731530 - RNA, 19 nt, Homo sapiens
ccucugagacccuagaaga

SEQ ID NO: 731531 - RNA, 19 nt, Homo sapiens
ugacacccuuggacuggaa

SEQ ID NO: 731532 - RNA, 19 nt, Homo sapiens
gcaaacuugaggcuccuuu

SEQ ID NO: 731533 - RNA, 19 nt, Homo sapiens
ggaugcaagcccagccuuu

SEQ ID NO: 731534 - RNA, 19 nt, Homo sapiens
ggacacagaaagagaacca

SEQ ID NO: 731535 - RNA, 19 nt, Homo sapiens
gaauuugauguaucugaug

SEQ ID NO: 731536 - RNA, 19 nt, Homo sapiens
gagugacacccgccucuga

SEQ ID NO: 731537 - RNA, 19 nt, Homo sapiens
gagcaagccguggaggaaa

SEQ ID NO: 731538 - RNA, 19 nt, Homo sapiens
gaugcaagcccagccuuug

SEQ ID NO: 731539 - RNA, 19 nt, Homo sapiens
gaagaagugcguggaggau

SEQ ID NO: 731540 - RNA, 19 nt, Homo sapiens
uggaggaaguucagaagca

SEQ ID NO: 731541 - RNA, 19 nt, Homo sapiens
gacagagucccagcacaaa

SEQ ID NO: 731542 - RNA, 19 nt, Homo sapiens
cagacgcacaggauucuaa

SEQ ID NO: 731543 - RNA, 19 nt, Homo sapiens
ccuuaguuccuauuccuua

SEQ ID NO: 731544 - RNA, 19 nt, Homo sapiens
ugucuguccugucugauuc

SEQ ID NO: 731545 - RNA, 19 nt, Homo sapiens
ccaaagcugaaauccagaa

SEQ ID NO: 731546 - RNA, 19 nt, Homo sapiens
gagaaccaacagcucauca

SEQ ID NO: 731547 - RNA, 19 nt, Homo sapiens
caacagcagagagcaagga

SEQ ID NO: 731548 - RNA, 19 nt, Homo sapiens
ugucuugucuucaacuuuu

SEQ ID NO: 731549 - RNA, 19 nt, Homo sapiens
aacgaagagucacugaaga

SEQ ID NO: 731550 - RNA, 19 nt, Homo sapiens
acacgccuguggugcaguu

SEQ ID NO: 731551 - RNA, 19 nt, Homo sapiens
cugauucucuuagguguca

SEQ ID NO: 731552 - RNA, 19 nt, Homo sapiens
caaagcugaaauccagaaa

SEQ ID NO: 731553 - RNA, 19 nt, Homo sapiens
gcaggucuuaaacgacaaa

SEQ ID NO: 731554 - RNA, 19 nt, Homo sapiens
guccuuauaccucaaguuc

SEQ ID NO: 731555 - RNA, 19 nt, Homo sapiens
ggaagcaguccuuauaccu

SEQ ID NO: 731556 - RNA, 19 nt, Homo sapiens
aagaggagagcuucagaga

SEQ ID NO: 731557 - RNA, 19 nt, Homo sapiens
ucccagagcccaggaaguu

SEQ ID NO: 731558 - RNA, 19 nt, Homo sapiens
gaagacaguggagcagaag

SEQ ID NO: 731559 - RNA, 19 nt, Homo sapiens
gaggauuaccuggcaagga

SEQ ID NO: 731560 - RNA, 19 nt, Homo sapiens
aaacuugaggcuccuuuca

SEQ ID NO: 731561 - RNA, 19 nt, Homo sapiens
acgaagagucacugaagaa

SEQ ID NO: 731562 - RNA, 19 nt, Homo sapiens
gcaagaacgaagagucacu

SEQ ID NO: 731563 - RNA, 19 nt, Homo sapiens
guucgaagagguuguguac

SEQ ID NO: 731564 - RNA, 19 nt, Homo sapiens
gcauggccagcaaacuuga

SEQ ID NO: 731565 - RNA, 19 nt, Homo sapiens
gcucaucaaggaaguggau

SEQ ID NO: 731566 - RNA, 19 nt, Homo sapiens
accggaagaucgucuguuc

SEQ ID NO: 731567 - RNA, 19 nt, Homo sapiens
ccgcaagaacgaagaguca

SEQ ID NO: 731568 - RNA, 19 nt, Homo sapiens
gaaacagaaagaggugauc

SEQ ID NO: 731569 - RNA, 19 nt, Homo sapiens
ccaccucgacugggacaaa

SEQ ID NO: 731570 - RNA, 19 nt, Homo sapiens
gagccgaggaagaaugcaa

SEQ ID NO: 731571 - RNA, 19 nt, Homo sapiens
ugagcaagccguggaggaa

SEQ ID NO: 731572 - RNA, 19 nt, Homo sapiens
gacgaccucaucuccaaga

SEQ ID NO: 731573 - RNA, 19 nt, Homo sapiens
agcagaagacuaaagagaa

SEQ ID NO: 731574 - RNA, 19 nt, Homo sapiens
uggagcagaagacuaaaga

SEQ ID NO: 731575 - RNA, 19 nt, Homo sapiens
guaccaggccauggaggaa

SEQ ID NO: 731576 - RNA, 19 nt, Homo sapiens
gaggagcggaccuguaaaa

SEQ ID NO: 731577 - RNA, 19 nt, Homo sapiens
uguccugucugauucucuu

SEQ ID NO: 731578 - RNA, 19 nt, Homo sapiens
gaggagcuccacgggaaga

SEQ ID NO: 731579 - RNA, 19 nt, Homo sapiens
aagcuaugaaggugacuuu

SEQ ID NO: 731580 - RNA, 19 nt, Homo sapiens
acucauggaauucuacaga

SEQ ID NO: 731581 - RNA, 19 nt, Homo sapiens
guccuagcauggccagcaa

SEQ ID NO: 731582 - RNA, 19 nt, Homo sapiens
agaagcagaaggaacuuuc

SEQ ID NO: 731583 - RNA, 19 nt, Homo sapiens
uaaggaagcugucauuaaa

SEQ ID NO: 731584 - RNA, 19 nt, Homo sapiens
gaacuuaccuuacauagcu

SEQ ID NO: 731585 - RNA, 19 nt, Homo sapiens
guacagaguugaaguuguu

SEQ ID NO: 731586 - RNA, 19 nt, Homo sapiens
ggaccugcauacuuacuua

SEQ ID NO: 731587 - RNA, 19 nt, Homo sapiens
ugacaggaaucuucuaauu

SEQ ID NO: 731588 - RNA, 19 nt, Homo sapiens
cagcaaaccucaugaagga

SEQ ID NO: 731589 - RNA, 19 nt, Homo sapiens
gguaauggcucagucauga

SEQ ID NO: 731590 - RNA, 19 nt, Homo sapiens
ucacuuaucuugcauaucu

SEQ ID NO: 731591 - RNA, 19 nt, Homo sapiens
uagaagauguugugauuga

SEQ ID NO: 731592 - RNA, 19 nt, Homo sapiens
gcaugaaugucaccagaaa

SEQ ID NO: 731593 - RNA, 19 nt, Homo sapiens
uaagaugccuguuaaaugg

SEQ ID NO: 731594 - RNA, 19 nt, Homo sapiens
ggaaagaugggaaggaauu

SEQ ID NO: 731595 - RNA, 19 nt, Homo sapiens
acacacaguuggacacaua

SEQ ID NO: 731596 - RNA, 19 nt, Homo sapiens
gaccgagucuacacaagua

SEQ ID NO: 731597 - RNA, 19 nt, Homo sapiens
guaggagaauccaauugua

SEQ ID NO: 731598 - RNA, 19 nt, Homo sapiens
gacccugacucuauaauug

SEQ ID NO: 731599 - RNA, 19 nt, Homo sapiens
gcagugagcccuuggauuc

SEQ ID NO: 731600 - RNA, 19 nt, Homo sapiens
caucgacccugacucuaua

SEQ ID NO: 731601 - RNA, 19 nt, Homo sapiens
gggaagaagccaagccuua

SEQ ID NO: 731602 - RNA, 19 nt, Homo sapiens
guaauggaaggaaaucuua

SEQ ID NO: 731603 - RNA, 19 nt, Homo sapiens
ggaggaaguuggccagaau

SEQ ID NO: 731604 - RNA, 19 nt, Homo sapiens
gugcagggauuuccaaaga

SEQ ID NO: 731605 - RNA, 19 nt, Homo sapiens
ggagagacuuguuaggaau

SEQ ID NO: 731606 - RNA, 19 nt, Homo sapiens
gggagagacuuguuaggaa

SEQ ID NO: 731607 - RNA, 19 nt, Homo sapiens
gaagaugggaccucucuga

SEQ ID NO: 731608 - RNA, 19 nt, Homo sapiens
gacaaugggucguauaucu

SEQ ID NO: 731609 - RNA, 19 nt, Homo sapiens
uuacauagcuugggaguca

SEQ ID NO: 731610 - RNA, 19 nt, Homo sapiens
gaacaucgacccugacucu

SEQ ID NO: 731611 - RNA, 19 nt, Homo sapiens
gaaauaauguacucuugcu

SEQ ID NO: 731612 - RNA, 19 nt, Homo sapiens
ccacaucuguaccaaauca

SEQ ID NO: 731613 - RNA, 19 nt, Homo sapiens
gaugggaccucucugaaag

SEQ ID NO: 731614 - RNA, 19 nt, Homo sapiens
cugaaugaaucuagugaua

SEQ ID NO: 731615 - RNA, 19 nt, Homo sapiens
gaagucagcauccguaaca

SEQ ID NO: 731616 - RNA, 19 nt, Homo sapiens
gaacauaaaggugucaaau

SEQ ID NO: 731617 - RNA, 19 nt, Homo sapiens
gcaauaaucgcuuccuuca

SEQ ID NO: 731618 - RNA, 19 nt, Homo sapiens
gaugaauguuguuaaggaa

SEQ ID NO: 731619 - RNA, 19 nt, Homo sapiens
ggaugaacuguaugaaaua

SEQ ID NO: 731620 - RNA, 19 nt, Homo sapiens
acuagaagauguugugauu

SEQ ID NO: 731621 - RNA, 19 nt, Homo sapiens
gcacacagcauucugaucu

SEQ ID NO: 731622 - RNA, 19 nt, Homo sapiens
gcacacgguuggguagauu

SEQ ID NO: 731623 - RNA, 19 nt, Homo sapiens
cagcugcuccuugauauua

SEQ ID NO: 731624 - RNA, 19 nt, Homo sapiens
uggaugaacuguaugaaau

SEQ ID NO: 731625 - RNA, 19 nt, Homo sapiens
ucacuguguuucugaauga

SEQ ID NO: 731626 - RNA, 19 nt, Homo sapiens
ugaugaaguuacagcaaua

SEQ ID NO: 731627 - RNA, 19 nt, Homo sapiens
ccauugaacuuaccuuaca

SEQ ID NO: 731628 - RNA, 19 nt, Homo sapiens
ggugaccucugucgaauca

SEQ ID NO: 731629 - RNA, 19 nt, Homo sapiens
gaagaccacauacaggaaa

SEQ ID NO: 731630 - RNA, 19 nt, Homo sapiens
ugacuuggcuucuggucuu

SEQ ID NO: 731631 - RNA, 19 nt, Homo sapiens
gauauuaaccuuuguacag

SEQ ID NO: 731632 - RNA, 19 nt, Homo sapiens
ccaaagcccaugguaauuu

SEQ ID NO: 731633 - RNA, 19 nt, Homo sapiens
caucaucuuuggcugcuuu

SEQ ID NO: 731634 - RNA, 19 nt, Homo sapiens
guaccagccugccuugaug

SEQ ID NO: 731635 - RNA, 19 nt, Homo sapiens
caaagcaccagaugaaugu

SEQ ID NO: 731636 - RNA, 19 nt, Homo sapiens
guucaggaauugcagcauu

SEQ ID NO: 731637 - RNA, 19 nt, Homo sapiens
uugcuaagaugccuguuaa

SEQ ID NO: 731638 - RNA, 19 nt, Homo sapiens
gagacaggaccaaagcaua

SEQ ID NO: 731639 - RNA, 19 nt, Homo sapiens
gugaggaacuacaaaauaa

SEQ ID NO: 731640 - RNA, 19 nt, Homo sapiens
augaagagaucgugucuga

SEQ ID NO: 731641 - RNA, 19 nt, Homo sapiens
ccagaugaauguuguuaag

SEQ ID NO: 731642 - RNA, 19 nt, Homo sapiens
gauuuacaguggcgauuau

SEQ ID NO: 731643 - RNA, 19 nt, Homo sapiens
uaacaccucugccuuacca

SEQ ID NO: 731644 - RNA, 19 nt, Homo sapiens
cuagguguguguauagaaa

SEQ ID NO: 731645 - RNA, 19 nt, Homo sapiens
uaccacaucuguaccaaau

SEQ ID NO: 731646 - RNA, 19 nt, Homo sapiens
ucgaggaguuucucaguga

SEQ ID NO: 731647 - RNA, 19 nt, Homo sapiens
gagcucggaucucuguuca

SEQ ID NO: 731648 - RNA, 19 nt, Homo sapiens
gcagcaggauggagaacug

SEQ ID NO: 731649 - RNA, 19 nt, Homo sapiens
ugaccucugucgaaucaaa

SEQ ID NO: 731650 - RNA, 19 nt, Homo sapiens
gagaaccgaucccuuagac

SEQ ID NO: 731651 - RNA, 19 nt, Homo sapiens
ccagaaccaugagauguau

SEQ ID NO: 731652 - RNA, 19 nt, Homo sapiens
cugcauacuuacuuacuuu

SEQ ID NO: 731653 - RNA, 19 nt, Homo sapiens
gagugcagaucaacaucaa

SEQ ID NO: 731654 - RNA, 19 nt, Homo sapiens
ggagauggcggucuucagu

SEQ ID NO: 731655 - RNA, 19 nt, Homo sapiens
ugacggagauggcggucuu

SEQ ID NO: 731656 - RNA, 19 nt, Homo sapiens
gaaguuacagcaauaaucg

SEQ ID NO: 731657 - RNA, 19 nt, Homo sapiens
guggaaagaugggaaggaa

SEQ ID NO: 731658 - RNA, 19 nt, Homo sapiens
gacgguacauccugaaugg

SEQ ID NO: 731659 - RNA, 19 nt, Homo sapiens
gcucggaucucuguucaag

SEQ ID NO: 731660 - RNA, 19 nt, Homo sapiens
ccaaagcaccagaugaaug

SEQ ID NO: 731661 - RNA, 19 nt, Homo sapiens
cuaagaugccuguuaaaug

SEQ ID NO: 731662 - RNA, 19 nt, Homo sapiens
gcuaagaugccuguuaaau

SEQ ID NO: 731663 - RNA, 19 nt, Homo sapiens
ugaagaccaugaaguugga

SEQ ID NO: 731664 - RNA, 19 nt, Homo sapiens
gggagucagugaggaacua

SEQ ID NO: 731665 - RNA, 19 nt, Homo sapiens
gaguugggcccuucaguga

SEQ ID NO: 731666 - RNA, 19 nt, Homo sapiens
gaucaacaucaaagcaauu

SEQ ID NO: 731667 - RNA, 19 nt, Homo sapiens
ggacuuccucacuuuacua

SEQ ID NO: 731668 - RNA, 19 nt, Homo sapiens
agaugaauguuguuaagga

SEQ ID NO: 731669 - RNA, 19 nt, Homo sapiens
ggucuguaauggaaggaaa

SEQ ID NO: 731670 - RNA, 19 nt, Homo sapiens
guauuugucuuccuuacca

SEQ ID NO: 731671 - RNA, 19 nt, Homo sapiens
cuggagaaccgaucccuua

SEQ ID NO: 731672 - RNA, 19 nt, Homo sapiens
accaugagauguaugacua

SEQ ID NO: 731673 - RNA, 19 nt, Homo sapiens
gguguuuccugcaugaaug

SEQ ID NO: 731674 - RNA, 19 nt, Homo sapiens
ggucuugauguauuugaua

SEQ ID NO: 731675 - RNA, 19 nt, Homo sapiens
cuucuggucuugauguauu

SEQ ID NO: 731676 - RNA, 19 nt, Homo sapiens
uaucugagcaacaggaauu

SEQ ID NO: 731677 - RNA, 19 nt, Homo sapiens
ggaagaccacauacaggaa

SEQ ID NO: 731678 - RNA, 19 nt, Homo sapiens
ggacacauaauacuuucug

SEQ ID NO: 731679 - RNA, 19 nt, Homo sapiens
ccaauuguaccugauguuu

SEQ ID NO: 731680 - RNA, 19 nt, Homo sapiens
aaagugaugugugggcauu

SEQ ID NO: 731681 - RNA, 19 nt, Homo sapiens
caaagcccaugguaauuuu

SEQ ID NO: 731682 - RNA, 19 nt, Homo sapiens
uaccaggacaccacaauuu

SEQ ID NO: 731683 - RNA, 19 nt, Homo sapiens
caacaacaauggugaggaa

SEQ ID NO: 731684 - RNA, 19 nt, Homo sapiens
gaaacgauagcaucucuga

SEQ ID NO: 731685 - RNA, 19 nt, Homo sapiens
gaaauaagcacugggagau

SEQ ID NO: 731686 - RNA, 19 nt, Homo sapiens
ucacugagcugccuuuggu

SEQ ID NO: 731687 - RNA, 19 nt, Homo sapiens
ggacugugcucacuuccau

SEQ ID NO: 731688 - RNA, 19 nt, Homo sapiens
aagcugagguggaggguuu

SEQ ID NO: 731689 - RNA, 19 nt, Homo sapiens
ccagggaggagcagaauuu

SEQ ID NO: 731690 - RNA, 19 nt, Homo sapiens
acacagcgcucccaacucu

SEQ ID NO: 731691 - RNA, 19 nt, Homo sapiens
ggcagcagcuuggaagaaa

SEQ ID NO: 731692 - RNA, 19 nt, Homo sapiens
gaugguauaguguucuuaa

SEQ ID NO: 731693 - RNA, 19 nt, Homo sapiens
gaacagauuuuagcaacuu

SEQ ID NO: 731694 - RNA, 19 nt, Homo sapiens
gggccgaggcugagaagua

SEQ ID NO: 731695 - RNA, 19 nt, Homo sapiens
aauaagcacugggagauug

SEQ ID NO: 731696 - RNA, 19 nt, Homo sapiens
ggcaggcaguucauucuga

SEQ ID NO: 731697 - RNA, 19 nt, Homo sapiens
ggaagaaacgauagcaucu

SEQ ID NO: 731698 - RNA, 19 nt, Homo sapiens
uggcuacucucaacaacaa

SEQ ID NO: 731699 - RNA, 19 nt, Homo sapiens
ggacacagcgcucccaacu

SEQ ID NO: 731700 - RNA, 19 nt, Homo sapiens
cgaggacugugcucacuuc

SEQ ID NO: 731701 - RNA, 19 nt, Homo sapiens
gauagcaucucugaaagcu

SEQ ID NO: 731702 - RNA, 19 nt, Homo sapiens
cagcuuggaagaaacgaua

SEQ ID NO: 731703 - RNA, 19 nt, Homo sapiens
caaacacuguggcggagau

SEQ ID NO: 731704 - RNA, 19 nt, Homo sapiens
guauaguguucuuaagcuu

SEQ ID NO: 731705 - RNA, 19 nt, Homo sapiens
gguauaguguucuuaagcu

SEQ ID NO: 731706 - RNA, 19 nt, Homo sapiens
ugcaagaccugaagaaacu

SEQ ID NO: 731707 - RNA, 19 nt, Homo sapiens
caacuucaccucaaacacu

SEQ ID NO: 731708 - RNA, 19 nt, Homo sapiens
gcaugacaaggacguauga

SEQ ID NO: 731709 - RNA, 19 nt, Homo sapiens
gcacaaccaacgugggaau

SEQ ID NO: 731710 - RNA, 19 nt, Homo sapiens
aacgauagcaucucugaaa

SEQ ID NO: 731711 - RNA, 19 nt, Homo sapiens
uaucuaggcuccgcauaca

SEQ ID NO: 731712 - RNA, 19 nt, Homo sapiens
ccagguggcuacucucaac

SEQ ID NO: 731713 - RNA, 19 nt, Homo sapiens
aagaaacgauagcaucucu

SEQ ID NO: 731714 - RNA, 19 nt, Homo sapiens
uuagcaacuucaccucaaa

SEQ ID NO: 731715 - RNA, 19 nt, Homo sapiens
caucaucugugugguugga

SEQ ID NO: 731716 - RNA, 19 nt, Homo sapiens
gaaguggguggauggaaca

SEQ ID NO: 731717 - RNA, 19 nt, Homo sapiens
gcagaauuuuguccagaaa

SEQ ID NO: 731718 - RNA, 19 nt, Homo sapiens
ggucaucaucugugugguu

SEQ ID NO: 731719 - RNA, 19 nt, Homo sapiens
ugacaaggacguaugaaaa

SEQ ID NO: 731720 - RNA, 19 nt, Homo sapiens
ggccgaggcugagaaguac

SEQ ID NO: 731721 - RNA, 19 nt, Homo sapiens
ggcccaagcaugacaagga

SEQ ID NO: 731722 - RNA, 19 nt, Homo sapiens
gcggagauccaggcacuga

SEQ ID NO: 731723 - RNA, 19 nt, Homo sapiens
ccagacggcagguggaaug

SEQ ID NO: 731724 - RNA, 19 nt, Homo sapiens
gaagaaacgauagcaucuc

SEQ ID NO: 731725 - RNA, 19 nt, Homo sapiens
gggcagcagcuuggaagaa

SEQ ID NO: 731726 - RNA, 19 nt, Homo sapiens
ggugcaagaccugaagaaa

SEQ ID NO: 731727 - RNA, 19 nt, Homo sapiens
caagaccugaagaaacuga

SEQ ID NO: 731728 - RNA, 19 nt, Homo sapiens
gcgaccggcuuccagaacu

SEQ ID NO: 731729 - RNA, 19 nt, Homo sapiens
gaaguacugccagcugaag

SEQ ID NO: 731730 - RNA, 19 nt, Homo sapiens
gugcaagaccugaagaaac

SEQ ID NO: 731731 - RNA, 19 nt, Homo sapiens
gcagcagcuuggaagaaac

SEQ ID NO: 731732 - RNA, 19 nt, Homo sapiens
uuuagcaacuucaccucaa

SEQ ID NO: 731733 - RNA, 19 nt, Homo sapiens
ucaucugugugguuggauu

SEQ ID NO: 731734 - RNA, 19 nt, Homo sapiens
gcaggaacggcaggcaguu

SEQ ID NO: 731735 - RNA, 19 nt, Homo sapiens
cgaccggcuuccagaacug

SEQ ID NO: 731736 - RNA, 19 nt, Homo sapiens
gggaggagcagaauuuugu

SEQ ID NO: 731737 - RNA, 19 nt, Homo sapiens
aaauaagcacugggagauu

SEQ ID NO: 731738 - RNA, 19 nt, Homo sapiens
guaaauagcuuucuacuga

SEQ ID NO: 731739 - RNA, 19 nt, Homo sapiens
gcaagaaccucuccaagua

SEQ ID NO: 731740 - RNA, 19 nt, Homo sapiens
gagaaaggcuauuuagaaa

SEQ ID NO: 731741 - RNA, 19 nt, Homo sapiens
cuagagaccuuuaugcuua

SEQ ID NO: 731742 - RNA, 19 nt, Homo sapiens
ccacaaauguucagaaaga

SEQ ID NO: 731743 - RNA, 19 nt, Homo sapiens
gaccaaauguuacaagaaa

SEQ ID NO: 731744 - RNA, 19 nt, Homo sapiens
caaaguacacucagaauaa

SEQ ID NO: 731745 - RNA, 19 nt, Homo sapiens
gaucagauguggaagcaaa

SEQ ID NO: 731746 - RNA, 19 nt, Homo sapiens
gaacucaaagcuccacuua

SEQ ID NO: 731747 - RNA, 19 nt, Homo sapiens
gagaaugacccaucaguaa

SEQ ID NO: 731748 - RNA, 19 nt, Homo sapiens
ggagauauaguccuagaua

SEQ ID NO: 731749 - RNA, 19 nt, Homo sapiens
uaacacagaagcacucuua

SEQ ID NO: 731750 - RNA, 19 nt, Homo sapiens
gggauuagguaaaguaaga

SEQ ID NO: 731751 - RNA, 19 nt, Homo sapiens
uaaaugaacuucguaggaa

SEQ ID NO: 731752 - RNA, 19 nt, Homo sapiens
gcagugagcauuguucaua

SEQ ID NO: 731753 - RNA, 19 nt, Homo sapiens
guaaaguggguuagaaaua

SEQ ID NO: 731754 - RNA, 19 nt, Homo sapiens
gacagaaucucucacugaa

SEQ ID NO: 731755 - RNA, 19 nt, Homo sapiens
ggacagcauuugacuuuua

SEQ ID NO: 731756 - RNA, 19 nt, Homo sapiens
gaaucacucuccuuaccua

SEQ ID NO: 731757 - RNA, 19 nt, Homo sapiens
gaaugaagacaucucagua

SEQ ID NO: 731758 - RNA, 19 nt, Homo sapiens
uaaaugagguucaguacca

SEQ ID NO: 731759 - RNA, 19 nt, Homo sapiens
gcaugggccuuacuucuau

SEQ ID NO: 731760 - RNA, 19 nt, Homo sapiens
uaaggaagcagaaauagaa

SEQ ID NO: 731761 - RNA, 19 nt, Homo sapiens
caaauccagugaucuagaa

SEQ ID NO: 731762 - RNA, 19 nt, Homo sapiens
gaagaacuagagaccuuua

SEQ ID NO: 731763 - RNA, 19 nt, Homo sapiens
ugaaacagcagaagguaua

SEQ ID NO: 731764 - RNA, 19 nt, Homo sapiens
gagcauuguucauaugaga

SEQ ID NO: 731765 - RNA, 19 nt, Homo sapiens
gaaaacuccugaagaacua

SEQ ID NO: 731766 - RNA, 19 nt, Homo sapiens
gaaagucgugauccuagua

SEQ ID NO: 731767 - RNA, 19 nt, Homo sapiens
gugcaggacuaucuuggua

SEQ ID NO: 731768 - RNA, 19 nt, Homo sapiens
ggacagggaucacaaacac

SEQ ID NO: 731769 - RNA, 19 nt, Homo sapiens
gaagacaucucaguacacu

SEQ ID NO: 731770 - RNA, 19 nt, Homo sapiens
ggagaaugacccaucagua

SEQ ID NO: 731771 - RNA, 19 nt, Homo sapiens
gaaaggcuauuuagaaacc

SEQ ID NO: 731772 - RNA, 19 nt, Homo sapiens
agagaaaggcuauuuagaa

SEQ ID NO: 731773 - RNA, 19 nt, Homo sapiens
ggauauuucuugcuuuaag

SEQ ID NO: 731774 - RNA, 19 nt, Homo sapiens
ugggauauuucuugcuuua

SEQ ID NO: 731775 - RNA, 19 nt, Homo sapiens
cagcaaguauguucucaga

SEQ ID NO: 731776 - RNA, 19 nt, Homo sapiens
gaucaaaguacacucagaa

SEQ ID NO: 731777 - RNA, 19 nt, Homo sapiens
uagauagacuugagaagga

SEQ ID NO: 731778 - RNA, 19 nt, Homo sapiens
agaaggcgguguccgagua

SEQ ID NO: 731779 - RNA, 19 nt, Homo sapiens
ucaauauucuggcuaaauc

SEQ ID NO: 731780 - RNA, 19 nt, Homo sapiens
gaucugccaaucuucaaua

SEQ ID NO: 731781 - RNA, 19 nt, Homo sapiens
acauguagauuuggagaua

SEQ ID NO: 731782 - RNA, 19 nt, Homo sapiens
guaaaugaacuucguagga

SEQ ID NO: 731783 - RNA, 19 nt, Homo sapiens
caugaugggugcaggacua

SEQ ID NO: 731784 - RNA, 19 nt, Homo sapiens
gcuauacacucauuaucug

SEQ ID NO: 731785 - RNA, 19 nt, Homo sapiens
cagaagcuauacacucauu

SEQ ID NO: 731786 - RNA, 19 nt, Homo sapiens
uuucuugccuggauuuaua

SEQ ID NO: 731787 - RNA, 19 nt, Homo sapiens
aaucugagcugugggauau

SEQ ID NO: 731788 - RNA, 19 nt, Homo sapiens
ccagaaauguuuaguuacu

SEQ ID NO: 731789 - RNA, 19 nt, Homo sapiens
ggagauacugugaguuuga

SEQ ID NO: 731790 - RNA, 19 nt, Homo sapiens
gaucugggauuagguaaag

SEQ ID NO: 731791 - RNA, 19 nt, Homo sapiens
caauuugcaucaauggauu

SEQ ID NO: 731792 - RNA, 19 nt, Homo sapiens
acucaaagcuccacuuaag

SEQ ID NO: 731793 - RNA, 19 nt, Homo sapiens
gaaagaaggacagggauca

SEQ ID NO: 731794 - RNA, 19 nt, Homo sapiens
ucucuuugcugaauuaaug

SEQ ID NO: 731795 - RNA, 19 nt, Homo sapiens
caggacagcauuugacuuu

SEQ ID NO: 731796 - RNA, 19 nt, Homo sapiens
caacucagcaggacacaga

SEQ ID NO: 731797 - RNA, 19 nt, Homo sapiens
ggcaauucaugauguuaaa

SEQ ID NO: 731798 - RNA, 19 nt, Homo sapiens
caucuacacuaacacagaa

SEQ ID NO: 731799 - RNA, 19 nt, Homo sapiens
ucagagcgauaaaugaguu

SEQ ID NO: 731800 - RNA, 19 nt, Homo sapiens
ucaaaguacacucagaaua

SEQ ID NO: 731801 - RNA, 19 nt, Homo sapiens
uaaagcaguccuuaagaaa

SEQ ID NO: 731802 - RNA, 19 nt, Homo sapiens
gggccagugugaugacuuu

SEQ ID NO: 731803 - RNA, 19 nt, Homo sapiens
cauaaugucccauauuuca

SEQ ID NO: 731804 - RNA, 19 nt, Homo sapiens
acaagaaauucaagaagug

SEQ ID NO: 731805 - RNA, 19 nt, Homo sapiens
gcugcagucuugggaguua

SEQ ID NO: 731806 - RNA, 19 nt, Homo sapiens
gaagcuauacacucauuau

SEQ ID NO: 731807 - RNA, 19 nt, Homo sapiens
caagaaccucuccaaguaa

SEQ ID NO: 731808 - RNA, 19 nt, Homo sapiens
gagguucaguaccauaaug

SEQ ID NO: 731809 - RNA, 19 nt, Homo sapiens
guacuuugcaaucaucuuu

SEQ ID NO: 731810 - RNA, 19 nt, Homo sapiens
uuuaggagcugaaguagau

SEQ ID NO: 731811 - RNA, 19 nt, Homo sapiens
uaagggcaauucaugaugu

SEQ ID NO: 731812 - RNA, 19 nt, Homo sapiens
gggaagcccugaagcucuu

SEQ ID NO: 731813 - RNA, 19 nt, Homo sapiens
ugugagaucugugucuuaa

SEQ ID NO: 731814 - RNA, 19 nt, Homo sapiens
ugaucucuuugcugaauua

SEQ ID NO: 731815 - RNA, 19 nt, Homo sapiens
gcggcugggugaucucuuu

SEQ ID NO: 731816 - RNA, 19 nt, Homo sapiens
cagaaucucucacugaaac

SEQ ID NO: 731817 - RNA, 19 nt, Homo sapiens
ugaauugaaugaagacauc

SEQ ID NO: 731818 - RNA, 19 nt, Homo sapiens
ccacagaucugggauuagg

SEQ ID NO: 731819 - RNA, 19 nt, Homo sapiens
ggagucagagcgauaaaug

SEQ ID NO: 731820 - RNA, 19 nt, Homo sapiens
gaguauggaucaaaguaca

SEQ ID NO: 731821 - RNA, 19 nt, Homo sapiens
gaaggacagggaucacaaa

SEQ ID NO: 731822 - RNA, 19 nt, Homo sapiens
uuacuggaauggaaaucua

SEQ ID NO: 731823 - RNA, 19 nt, Homo sapiens
cugccaaucuucaauauuc

SEQ ID NO: 731824 - RNA, 19 nt, Homo sapiens
ugagucaaguaaaguugua

SEQ ID NO: 731825 - RNA, 19 nt, Homo sapiens
guuacaagaucauauuugg

SEQ ID NO: 731826 - RNA, 19 nt, Homo sapiens
ggaaagucgugauccuagu

SEQ ID NO: 731827 - RNA, 19 nt, Homo sapiens
gcguaaggaagcagaaaua

SEQ ID NO: 731828 - RNA, 19 nt, Homo sapiens
ggugaucucuuugcugaau

SEQ ID NO: 731829 - RNA, 19 nt, Homo sapiens
gaagauuucacuccaucaa

SEQ ID NO: 731830 - RNA, 19 nt, Homo sapiens
aaaguuuccuccucuccua

SEQ ID NO: 731831 - RNA, 19 nt, Homo sapiens
gaaguucgacauguagauu

SEQ ID NO: 731832 - RNA, 19 nt, Homo sapiens
ggaauggaaaucuaugaau

SEQ ID NO: 731833 - RNA, 19 nt, Homo sapiens
acuggaagauaaugcauuu

SEQ ID NO: 731834 - RNA, 19 nt, Homo sapiens
gagaucagauguggaagca

SEQ ID NO: 731835 - RNA, 19 nt, Homo sapiens
ucacucuccuuaccuaguu

SEQ ID NO: 731836 - RNA, 19 nt, Homo sapiens
gauccuaguacaaauguga

SEQ ID NO: 731837 - RNA, 19 nt, Homo sapiens
guaaggaagcagaaauaga

SEQ ID NO: 731838 - RNA, 19 nt, Homo sapiens
caaauuagaugucaacguu

SEQ ID NO: 731839 - RNA, 19 nt, Homo sapiens
gaaaguggauuaucuuaca

SEQ ID NO: 731840 - RNA, 19 nt, Homo sapiens
ggaaauguaugaacgagaa

SEQ ID NO: 731841 - RNA, 19 nt, Homo sapiens
ggaaaucugugaacuacaa

SEQ ID NO: 731842 - RNA, 19 nt, Homo sapiens
ucagagagauucuaagauu

SEQ ID NO: 731843 - RNA, 19 nt, Homo sapiens
ugaaacagauucucguuaa

SEQ ID NO: 731844 - RNA, 19 nt, Homo sapiens
aagcaaggcuagacauuua

SEQ ID NO: 731845 - RNA, 19 nt, Homo sapiens
gcagaagaauuaaguacaa

SEQ ID NO: 731846 - RNA, 19 nt, Homo sapiens
cgaaaugccucuagggaaa

SEQ ID NO: 731847 - RNA, 19 nt, Homo sapiens
gagaagagauguaugaaaa

SEQ ID NO: 731848 - RNA, 19 nt, Homo sapiens
gaaagaugccagcaaauau

SEQ ID NO: 731849 - RNA, 19 nt, Homo sapiens
agagcaaacuguuacuuua

SEQ ID NO: 731850 - RNA, 19 nt, Homo sapiens
gaagaucagcuuucuauuc

SEQ ID NO: 731851 - RNA, 19 nt, Homo sapiens
ggcauuagauuuagaacaa

SEQ ID NO: 731852 - RNA, 19 nt, Homo sapiens
uaauugagcuuaggagaaa

SEQ ID NO: 731853 - RNA, 19 nt, Homo sapiens
uauccuagcagaagaauua

SEQ ID NO: 731854 - RNA, 19 nt, Homo sapiens
gagauuagacaaccaauug

SEQ ID NO: 731855 - RNA, 19 nt, Homo sapiens
gaauuucuccaucaaagua

SEQ ID NO: 731856 - RNA, 19 nt, Homo sapiens
gaaagaugucagcaacuua

SEQ ID NO: 731857 - RNA, 19 nt, Homo sapiens
gaugucagcaacuuaaaua

SEQ ID NO: 731858 - RNA, 19 nt, Homo sapiens
caagagaacuaugauaaag

SEQ ID NO: 731859 - RNA, 19 nt, Homo sapiens
gcuagugaauccauuaaga

SEQ ID NO: 731860 - RNA, 19 nt, Homo sapiens
acagaaagaugccagcaaa

SEQ ID NO: 731861 - RNA, 19 nt, Homo sapiens
gcaccugaguggucuaaga

SEQ ID NO: 731862 - RNA, 19 nt, Homo sapiens
aaccaacacucuuuacuaa

SEQ ID NO: 731863 - RNA, 19 nt, Homo sapiens
ccaagaaauugaucaacuu

SEQ ID NO: 731864 - RNA, 19 nt, Homo sapiens
gaacuaugauaaagucaag

SEQ ID NO: 731865 - RNA, 19 nt, Homo sapiens
agaagcagcuacuaacauu

SEQ ID NO: 731866 - RNA, 19 nt, Homo sapiens
guacagagaacuacaacuu

SEQ ID NO: 731867 - RNA, 19 nt, Homo sapiens
uaaagagcaugaagacaau

SEQ ID NO: 731868 - RNA, 19 nt, Homo sapiens
gaaaggaaaucugugaacu

SEQ ID NO: 731869 - RNA, 19 nt, Homo sapiens
gaacaacuucuaaaucauc

SEQ ID NO: 731870 - RNA, 19 nt, Homo sapiens
agacaaaucuucagcuaag

SEQ ID NO: 731871 - RNA, 19 nt, Homo sapiens
caacaguuccuacggauga

SEQ ID NO: 731872 - RNA, 19 nt, Homo sapiens
gcuagacauuuaugagaaa

SEQ ID NO: 731873 - RNA, 19 nt, Homo sapiens
aaauugagcuaucccagaa

SEQ ID NO: 731874 - RNA, 19 nt, Homo sapiens
ugaagccucucacaugauu

SEQ ID NO: 731875 - RNA, 19 nt, Homo sapiens
cuaguucucuggaaucuga

SEQ ID NO: 731876 - RNA, 19 nt, Homo sapiens
gaaacuuaaugaugcacuu

SEQ ID NO: 731877 - RNA, 19 nt, Homo sapiens
caaaacaugugacagaaaa

SEQ ID NO: 731878 - RNA, 19 nt, Homo sapiens
gaagaggaucgccuugaaa

SEQ ID NO: 731879 - RNA, 19 nt, Homo sapiens
ugaagaggaucgccuugaa

SEQ ID NO: 731880 - RNA, 19 nt, Homo sapiens
gaggagaaacuuaaugaug

SEQ ID NO: 731881 - RNA, 19 nt, Homo sapiens
ccaauucgcuauuaaacca

SEQ ID NO: 731882 - RNA, 19 nt, Homo sapiens
gaaaggaccaaguaacaca

SEQ ID NO: 731883 - RNA, 19 nt, Homo sapiens
gaaagcaaaguaacagaau

SEQ ID NO: 731884 - RNA, 19 nt, Homo sapiens
agaacgaagugaauuauca

SEQ ID NO: 731885 - RNA, 19 nt, Homo sapiens
gacagaagagcaauauauu

SEQ ID NO: 731886 - RNA, 19 nt, Homo sapiens
ugacagaagagcaauauau

SEQ ID NO: 731887 - RNA, 19 nt, Homo sapiens
agaaagaugccagcaaaua

SEQ ID NO: 731888 - RNA, 19 nt, Homo sapiens
gaugaucgacaauuugaaa

SEQ ID NO: 731889 - RNA, 19 nt, Homo sapiens
uaaaucaucgugaggaauu

SEQ ID NO: 731890 - RNA, 19 nt, Homo sapiens
gauauuuccucaucagaag

SEQ ID NO: 731891 - RNA, 19 nt, Homo sapiens
cuaaagagcaugaagacaa

SEQ ID NO: 731892 - RNA, 19 nt, Homo sapiens
ucguuaagaugcauaguaa

SEQ ID NO: 731893 - RNA, 19 nt, Homo sapiens
gaaacagauucucguuaag

SEQ ID NO: 731894 - RNA, 19 nt, Homo sapiens
acagguaucucauugaauc

SEQ ID NO: 731895 - RNA, 19 nt, Homo sapiens
uuacagguaucucauugaa

SEQ ID NO: 731896 - RNA, 19 nt, Homo sapiens
gcaaacugcagaaauugaa

SEQ ID NO: 731897 - RNA, 19 nt, Homo sapiens
uaagaaaggaaaucuguga

SEQ ID NO: 731898 - RNA, 19 nt, Homo sapiens
gcuacuaacauugagauua

SEQ ID NO: 731899 - RNA, 19 nt, Homo sapiens
gaacgaagugaauuaucaa

SEQ ID NO: 731900 - RNA, 19 nt, Homo sapiens
gucaagagaacuaugauaa

SEQ ID NO: 731901 - RNA, 19 nt, Homo sapiens
gaauuggaggagaaacuua

SEQ ID NO: 731902 - RNA, 19 nt, Homo sapiens
cagcuuacuucucacuaaa

SEQ ID NO: 731903 - RNA, 19 nt, Homo sapiens
gaacucagagcaucaagca

SEQ ID NO: 731904 - RNA, 19 nt, Homo sapiens
guagucaccuuagagcaaa

SEQ ID NO: 731905 - RNA, 19 nt, Homo sapiens
agagacaaaucuucagcua

SEQ ID NO: 731906 - RNA, 19 nt, Homo sapiens
ggagaaacuuaaugaugca

SEQ ID NO: 731907 - RNA, 19 nt, Homo sapiens
gaucgacaauuugaaagug

SEQ ID NO: 731908 - RNA, 19 nt, Homo sapiens
agaaagaugucagcaacuu

SEQ ID NO: 731909 - RNA, 19 nt, Homo sapiens
uugcacaacuugagaaaga

SEQ ID NO: 731910 - RNA, 19 nt, Homo sapiens
cuaugaugaucgacaauuu

SEQ ID NO: 731911 - RNA, 19 nt, Homo sapiens
aaaccaacacucuuuacua

SEQ ID NO: 731912 - RNA, 19 nt, Homo sapiens
gacggaaucuauugcacaa

SEQ ID NO: 731913 - RNA, 19 nt, Homo sapiens
aaacuaugaugaucgacaa

SEQ ID NO: 731914 - RNA, 19 nt, Homo sapiens
gaaauugaucaacuucgaa

SEQ ID NO: 731915 - RNA, 19 nt, Homo sapiens
aaagugaacaucucuaguu

SEQ ID NO: 731916 - RNA, 19 nt, Homo sapiens
gagcaugaagacaauauau

SEQ ID NO: 731917 - RNA, 19 nt, Homo sapiens
aaagaugucagcaacuuaa

SEQ ID NO: 731918 - RNA, 19 nt, Homo sapiens
cagagagauucuaagauug

SEQ ID NO: 731919 - RNA, 19 nt, Homo sapiens
ucaacagccuuacagguau

SEQ ID NO: 731920 - RNA, 19 nt, Homo sapiens
gaggccaauucgcuauuaa

SEQ ID NO: 731921 - RNA, 19 nt, Homo sapiens
ggcuagacauuuaugagaa

SEQ ID NO: 731922 - RNA, 19 nt, Homo sapiens
acagagaacuacaacuuag

SEQ ID NO: 731923 - RNA, 19 nt, Homo sapiens
ggauaaugcuguggcugaa

SEQ ID NO: 731924 - RNA, 19 nt, Homo sapiens
gaaaaccaaccaagaaauu

SEQ ID NO: 731925 - RNA, 19 nt, Homo sapiens
gaacuagaacaaaucagau

SEQ ID NO: 731926 - RNA, 19 nt, Homo sapiens
gaaugugccuaaagagcau

SEQ ID NO: 731927 - RNA, 19 nt, Homo sapiens
gucagcaacuuaaauaaag

SEQ ID NO: 731928 - RNA, 19 nt, Homo sapiens
caagcaaggcuagacauuu

SEQ ID NO: 731929 - RNA, 19 nt, Homo sapiens
guaauugagcuuaggagaa

SEQ ID NO: 731930 - RNA, 19 nt, Homo sapiens
cuagagaagagauguauga

SEQ ID NO: 731931 - RNA, 19 nt, Homo sapiens
gagacaaaucuucagcuaa

SEQ ID NO: 731932 - RNA, 19 nt, Homo sapiens
gcaagaaaucucacacagu

SEQ ID NO: 731933 - RNA, 19 nt, Homo sapiens
gaaacagcaagaaaucuca

SEQ ID NO: 731934 - RNA, 19 nt, Homo sapiens
gaggaaacagcaagaaauc

SEQ ID NO: 731935 - RNA, 19 nt, Homo sapiens
gcaaacuguuacuuuacug

SEQ ID NO: 731936 - RNA, 19 nt, Homo sapiens
cuugaagccucucacauga

SEQ ID NO: 731937 - RNA, 19 nt, Homo sapiens
gugaauccauuaagaaagg

SEQ ID NO: 731938 - RNA, 19 nt, Homo sapiens
ugagaaagauugagaaugu

SEQ ID NO: 731939 - RNA, 19 nt, Homo sapiens
gaaguuggccgcaugaaga

SEQ ID NO: 731940 - RNA, 19 nt, Homo sapiens
gcaaauucaaguccuguua

SEQ ID NO: 731941 - RNA, 19 nt, Homo sapiens
ccaauaggauacaaaggaa

SEQ ID NO: 731942 - RNA, 19 nt, Homo sapiens
gagauguaguccagacaaa

SEQ ID NO: 731943 - RNA, 19 nt, Homo sapiens
aaucaucgauggacuucua

SEQ ID NO: 731944 - RNA, 19 nt, Homo sapiens
ggaagcaugugguguuugg

SEQ ID NO: 731945 - RNA, 19 nt, Homo sapiens
acaaauggcugucaguucu

SEQ ID NO: 731946 - RNA, 19 nt, Homo sapiens
gagaaagauugagaauguu

SEQ ID NO: 731947 - RNA, 19 nt, Homo sapiens
caaauucaaguccuguuaa

SEQ ID NO: 731948 - RNA, 19 nt, Homo sapiens
ggucauaaaggauuucaug

SEQ ID NO: 731949 - RNA, 19 nt, Homo sapiens
ccauggcgguggcaaauuc

SEQ ID NO: 731950 - RNA, 19 nt, Homo sapiens
uaagacggccgagaacuuu

SEQ ID NO: 731951 - RNA, 19 nt, Homo sapiens
guucuuugaugucaguauu

SEQ ID NO: 731952 - RNA, 19 nt, Homo sapiens
uugcagacguugugccuaa

SEQ ID NO: 731953 - RNA, 19 nt, Homo sapiens
gauguaguccagacaaaga

SEQ ID NO: 731954 - RNA, 19 nt, Homo sapiens
ggagaauucaggaaagaug

SEQ ID NO: 731955 - RNA, 19 nt, Homo sapiens
aaucaggccuucccuucuu

SEQ ID NO: 731956 - RNA, 19 nt, Homo sapiens
caagcuaccuguggugauc

SEQ ID NO: 731957 - RNA, 19 nt, Homo sapiens
ccacaggccccaacaauaa

SEQ ID NO: 731958 - RNA, 19 nt, Homo sapiens
caagagaccauggaagugu

SEQ ID NO: 731959 - RNA, 19 nt, Homo sapiens
caacaauaagcccaagcua

SEQ ID NO: 731960 - RNA, 19 nt, Homo sapiens
guacaaauggcugucaguu

SEQ ID NO: 731961 - RNA, 19 nt, Homo sapiens
gaugagaaagauugagaau

SEQ ID NO: 731962 - RNA, 19 nt, Homo sapiens
cgauggacuucuagugaug

SEQ ID NO: 731963 - RNA, 19 nt, Homo sapiens
gaaagaugggguuccaaua

SEQ ID NO: 731964 - RNA, 19 nt, Homo sapiens
ccauggaagugucagagau

SEQ ID NO: 731965 - RNA, 19 nt, Homo sapiens
ggagauguaguccagacaa

SEQ ID NO: 731966 - RNA, 19 nt, Homo sapiens
aaauggcugucaguucuuu

SEQ ID NO: 731967 - RNA, 19 nt, Homo sapiens
uaagugcgauuggcuggau

SEQ ID NO: 731968 - RNA, 19 nt, Homo sapiens
uuuaucaccugcucuaagu

SEQ ID NO: 731969 - RNA, 19 nt, Homo sapiens
ggcugucaguucuuuauca

SEQ ID NO: 731970 - RNA, 19 nt, Homo sapiens
ggaaguuggccgcaugaag

SEQ ID NO: 731971 - RNA, 19 nt, Homo sapiens
cuagugaugagaaagauug

SEQ ID NO: 731972 - RNA, 19 nt, Homo sapiens
acagggucauaaaggauuu

SEQ ID NO: 731973 - RNA, 19 nt, Homo sapiens
ccggagaauucaggaaaga

SEQ ID NO: 731974 - RNA, 19 nt, Homo sapiens
cuaagacggccgagaacuu

SEQ ID NO: 731975 - RNA, 19 nt, Homo sapiens
cauggaagugucagagauu

SEQ ID NO: 731976 - RNA, 19 nt, Homo sapiens
gaaucaggccuucccuucu

SEQ ID NO: 731977 - RNA, 19 nt, Homo sapiens
gugaugagaaagauugaga

SEQ ID NO: 731978 - RNA, 19 nt, Homo sapiens
ugggaagcaugugguguuu

SEQ ID NO: 731979 - RNA, 19 nt, Homo sapiens
gguguucuuugaugucagu

SEQ ID NO: 731980 - RNA, 19 nt, Homo sapiens
gcagacguugugccuaaga

SEQ ID NO: 731981 - RNA, 19 nt, Homo sapiens
ucgauggacuucuagugau

SEQ ID NO: 731982 - RNA, 19 nt, Homo sapiens
caccggagaauucaggaaa

SEQ ID NO: 731983 - RNA, 19 nt, Homo sapiens
ccagacaaagacugaauca

SEQ ID NO: 731984 - RNA, 19 nt, Homo sapiens
gauucaggguggagauuuu

SEQ ID NO: 731985 - RNA, 19 nt, Homo sapiens
uccaauaggauacaaagga

SEQ ID NO: 731986 - RNA, 19 nt, Homo sapiens
gaagugucagagauucaga

SEQ ID NO: 731987 - RNA, 19 nt, Homo sapiens
cgagcucuuugcagacguu

SEQ ID NO: 731988 - RNA, 19 nt, Homo sapiens
ggguggagauuuuguuaau

SEQ ID NO: 731989 - RNA, 19 nt, Homo sapiens
ccacagggucauaaaggau

SEQ ID NO: 731990 - RNA, 19 nt, Homo sapiens
agaaagauugagaauguuc

SEQ ID NO: 731991 - RNA, 19 nt, Homo sapiens
aaauucaaguccuguuaac

SEQ ID NO: 731992 - RNA, 19 nt, Homo sapiens
gcucuuugcagacguugug

SEQ ID NO: 731993 - RNA, 19 nt, Homo sapiens
caaauggcugucaguucuu

SEQ ID NO: 731994 - RNA, 19 nt, Homo sapiens
gauggacuucuagugauga

SEQ ID NO: 731995 - RNA, 19 nt, Homo sapiens
uauuggcggucaggaaguu

SEQ ID NO: 731996 - RNA, 19 nt, Homo sapiens
cacagggucauaaaggauu

SEQ ID NO: 731997 - RNA, 19 nt, Homo sapiens
gcaccggagaauucaggaa

SEQ ID NO: 731998 - RNA, 19 nt, Homo sapiens
gugguguucuuugauguca

SEQ ID NO: 731999 - RNA, 19 nt, Homo sapiens
uccacagggucauaaagga

SEQ ID NO: 732000 - RNA, 19 nt, Homo sapiens
ggacagagaacuacacuua

SEQ ID NO: 732001 - RNA, 19 nt, Homo sapiens
ccaaagagcuguugaacuu

SEQ ID NO: 732002 - RNA, 19 nt, Homo sapiens
gaauagaucuuucuggaau

SEQ ID NO: 732003 - RNA, 19 nt, Homo sapiens
gaagagagauccuguuucu

SEQ ID NO: 732004 - RNA, 19 nt, Homo sapiens
caaagaccauccaguuaua

SEQ ID NO: 732005 - RNA, 19 nt, Homo sapiens
gcaacaaacucuucgaugu

SEQ ID NO: 732006 - RNA, 19 nt, Homo sapiens
ugaaggagcuacaagguuu

SEQ ID NO: 732007 - RNA, 19 nt, Homo sapiens
gagaagaaauguggcagua

SEQ ID NO: 732008 - RNA, 19 nt, Homo sapiens
cuacagaccucuauguuga

SEQ ID NO: 732009 - RNA, 19 nt, Homo sapiens
gaacagcucuucagguuuu

SEQ ID NO: 732010 - RNA, 19 nt, Homo sapiens
gcauguagcucagugguuu

SEQ ID NO: 732011 - RNA, 19 nt, Homo sapiens
gggauaugaucaaguuaua

SEQ ID NO: 732012 - RNA, 19 nt, Homo sapiens
gaagaaauguggcaguagu

SEQ ID NO: 732013 - RNA, 19 nt, Homo sapiens
caacagugcauuagacaua

SEQ ID NO: 732014 - RNA, 19 nt, Homo sapiens
gcucagugguuuccaaauu

SEQ ID NO: 732015 - RNA, 19 nt, Homo sapiens
caacugggauugagucguu

SEQ ID NO: 732016 - RNA, 19 nt, Homo sapiens
caacuugcacuccacauua

SEQ ID NO: 732017 - RNA, 19 nt, Homo sapiens
gcaaagaccauccaguuau

SEQ ID NO: 732018 - RNA, 19 nt, Homo sapiens
aaacgaagacuuugaugua

SEQ ID NO: 732019 - RNA, 19 nt, Homo sapiens
gaaggagaauacccuaaau

SEQ ID NO: 732020 - RNA, 19 nt, Homo sapiens
aaagggauaugaucaaguu

SEQ ID NO: 732021 - RNA, 19 nt, Homo sapiens
ugacagacaccacuauuaa

SEQ ID NO: 732022 - RNA, 19 nt, Homo sapiens
ggaagaugaugcacaagau

SEQ ID NO: 732023 - RNA, 19 nt, Homo sapiens
gaagaugaugcacaagaua

SEQ ID NO: 732024 - RNA, 19 nt, Homo sapiens
uguaauugcugaacaacua

SEQ ID NO: 732025 - RNA, 19 nt, Homo sapiens
gcaagugaacuaaauguug

SEQ ID NO: 732026 - RNA, 19 nt, Homo sapiens
cggaacagcucuucagguu

SEQ ID NO: 732027 - RNA, 19 nt, Homo sapiens
ggagaauacccuaaauuau

SEQ ID NO: 732028 - RNA, 19 nt, Homo sapiens
gcuaacccauucauaguug

SEQ ID NO: 732029 - RNA, 19 nt, Homo sapiens
gauccuguuucucacauuu

SEQ ID NO: 732030 - RNA, 19 nt, Homo sapiens
ggaccaauauggagaaacu

SEQ ID NO: 732031 - RNA, 19 nt, Homo sapiens
ggaagcuuauguucaauca

SEQ ID NO: 732032 - RNA, 19 nt, Homo sapiens
caacaauacagucagcaua

SEQ ID NO: 732033 - RNA, 19 nt, Homo sapiens
gaacuuugaaggauacuau

SEQ ID NO: 732034 - RNA, 19 nt, Homo sapiens
ggaauagaagugauagaaa

SEQ ID NO: 732035 - RNA, 19 nt, Homo sapiens
guagacgaguaucugauuu

SEQ ID NO: 732036 - RNA, 19 nt, Homo sapiens
gaaguagagagauaacaaa

SEQ ID NO: 732037 - RNA, 19 nt, Homo sapiens
ggaaguagagagauaacaa

SEQ ID NO: 732038 - RNA, 19 nt, Homo sapiens
ccaggcaagugaacaugua

SEQ ID NO: 732039 - RNA, 19 nt, Homo sapiens
aaauuuggcugcacauuca

SEQ ID NO: 732040 - RNA, 19 nt, Homo sapiens
guaauugauuguucgguau

SEQ ID NO: 732041 - RNA, 19 nt, Homo sapiens
uagagaaggcaaagaauuu

SEQ ID NO: 732042 - RNA, 19 nt, Homo sapiens
cagcaucauuauucaguuu

SEQ ID NO: 732043 - RNA, 19 nt, Homo sapiens
ggcaaagaccauccaguua

SEQ ID NO: 732044 - RNA, 19 nt, Homo sapiens
gaacuacagaccucuaugu

SEQ ID NO: 732045 - RNA, 19 nt, Homo sapiens
ggcacuuucuucucaauuu

SEQ ID NO: 732046 - RNA, 19 nt, Homo sapiens
uggagaaacuuauggauca

SEQ ID NO: 732047 - RNA, 19 nt, Homo sapiens
ccuggaagcuuauguucaa

SEQ ID NO: 732048 - RNA, 19 nt, Homo sapiens
ugacaacacugaggcuauu

SEQ ID NO: 732049 - RNA, 19 nt, Homo sapiens
cugcuacuaucuacuauuu

SEQ ID NO: 732050 - RNA, 19 nt, Homo sapiens
guagagaaggcaaagaauu

SEQ ID NO: 732051 - RNA, 19 nt, Homo sapiens
gauacaaaccucacauuag

SEQ ID NO: 732052 - RNA, 19 nt, Homo sapiens
aggagaauacccuaaauua

SEQ ID NO: 732053 - RNA, 19 nt, Homo sapiens
gcaggcauuugaaggagaa

SEQ ID NO: 732054 - RNA, 19 nt, Homo sapiens
gcacuuucuucucaauuuc

SEQ ID NO: 732055 - RNA, 19 nt, Homo sapiens
gugcaacccuuacucacuu

SEQ ID NO: 732056 - RNA, 19 nt, Homo sapiens
cauggaagaugaugcacaa

SEQ ID NO: 732057 - RNA, 19 nt, Homo sapiens
gaagcaggcauuugaagga

SEQ ID NO: 732058 - RNA, 19 nt, Homo sapiens
gaacauguagccaguaguc

SEQ ID NO: 732059 - RNA, 19 nt, Homo sapiens
acgaguaucugauuuagga

SEQ ID NO: 732060 - RNA, 19 nt, Homo sapiens
ugauacaaaccucacauua

SEQ ID NO: 732061 - RNA, 19 nt, Homo sapiens
cuaugaggcugcuuaucua

SEQ ID NO: 732062 - RNA, 19 nt, Homo sapiens
gaggauuauucguaucuug

SEQ ID NO: 732063 - RNA, 19 nt, Homo sapiens
gaaggacagagaagaaaug

SEQ ID NO: 732064 - RNA, 19 nt, Homo sapiens
gauuaucuuucucaaggaa

SEQ ID NO: 732065 - RNA, 19 nt, Homo sapiens
gcacaacuagcaagacuuc

SEQ ID NO: 732066 - RNA, 19 nt, Homo sapiens
ugucugcucuucaguaaug

SEQ ID NO: 732067 - RNA, 19 nt, Homo sapiens
cugaugaacuugaugguau

SEQ ID NO: 732068 - RNA, 19 nt, Homo sapiens
gcacaagauauauucauuc

SEQ ID NO: 732069 - RNA, 19 nt, Homo sapiens
uacaacacauggaagauga

SEQ ID NO: 732070 - RNA, 19 nt, Homo sapiens
acagagaacuacacuuaca

SEQ ID NO: 732071 - RNA, 19 nt, Homo sapiens
gauauugugcuacuuuaga

SEQ ID NO: 732072 - RNA, 19 nt, Homo sapiens
guaauccuccuuccucuga

SEQ ID NO: 732073 - RNA, 19 nt, Homo sapiens
ggaauagaucuuucuggaa

SEQ ID NO: 732074 - RNA, 19 nt, Homo sapiens
uaugucugcucuucaguaa

SEQ ID NO: 732075 - RNA, 19 nt, Homo sapiens
auucauaguuggcaguuaa

SEQ ID NO: 732076 - RNA, 19 nt, Homo sapiens
gauugggccucuuacugaa

SEQ ID NO: 732077 - RNA, 19 nt, Homo sapiens
guggauggauauugugcua

SEQ ID NO: 732078 - RNA, 19 nt, Homo sapiens
gaacuugauuaucuuucuc

SEQ ID NO: 732079 - RNA, 19 nt, Homo sapiens
guugaaccauacaauaaga

SEQ ID NO: 732080 - RNA, 19 nt, Homo sapiens
guuggcaguuaaacacaua

SEQ ID NO: 732081 - RNA, 19 nt, Homo sapiens
gcaccaaucaguaacaaag

SEQ ID NO: 732082 - RNA, 19 nt, Homo sapiens
uaaguugcaccaaucagua

SEQ ID NO: 732083 - RNA, 19 nt, Homo sapiens
gauccuaucaacuugguuu

SEQ ID NO: 732084 - RNA, 19 nt, Homo sapiens
ugaggcugcuuaucuauca

SEQ ID NO: 732085 - RNA, 19 nt, Homo sapiens
guaaagacuuauacuucuc

SEQ ID NO: 732086 - RNA, 19 nt, Homo sapiens
caggaaauacugcagcuuu

SEQ ID NO: 732087 - RNA, 19 nt, Homo sapiens
ccaguguuguggauggaua

SEQ ID NO: 732088 - RNA, 19 nt, Homo sapiens
gcucuucaguaaugacaug

SEQ ID NO: 732089 - RNA, 19 nt, Homo sapiens
ugaaggagaauacccuaaa

SEQ ID NO: 732090 - RNA, 19 nt, Homo sapiens
ucucacauuuguuucauug

SEQ ID NO: 732091 - RNA, 19 nt, Homo sapiens
gacagacaccacuauuaaa

SEQ ID NO: 732092 - RNA, 19 nt, Homo sapiens
caaauuuggcugcacauuc

SEQ ID NO: 732093 - RNA, 19 nt, Homo sapiens
gguauuuccuaucgacguu

SEQ ID NO: 732094 - RNA, 19 nt, Homo sapiens
uggauauugugcuacuuua

SEQ ID NO: 732095 - RNA, 19 nt, Homo sapiens
ucagugguuuccaaauuug

SEQ ID NO: 732096 - RNA, 19 nt, Homo sapiens
gacguuuauuuaccucuuu

SEQ ID NO: 732097 - RNA, 19 nt, Homo sapiens
caucuccacuuugugcuaa

SEQ ID NO: 732098 - RNA, 19 nt, Homo sapiens
gagcuacaagguuucauug

SEQ ID NO: 732099 - RNA, 19 nt, Homo sapiens
ggagcuacaagguuucauu

SEQ ID NO: 732100 - RNA, 19 nt, Homo sapiens
uggaggcccuggagaauga

SEQ ID NO: 732101 - RNA, 19 nt, Homo sapiens
ccagugcuguuagaauaaa

SEQ ID NO: 732102 - RNA, 19 nt, Homo sapiens
ugucugaaguggacugugu

SEQ ID NO: 732103 - RNA, 19 nt, Homo sapiens
agaauuucaucacccaaug

SEQ ID NO: 732104 - RNA, 19 nt, Homo sapiens
gaaugacaacuuccaggau

SEQ ID NO: 732105 - RNA, 19 nt, Homo sapiens
gaagaaaacccgaggugau

SEQ ID NO: 732106 - RNA, 19 nt, Homo sapiens
ugccaaugguggagaagaa

SEQ ID NO: 732107 - RNA, 19 nt, Homo sapiens
ccccagugcuguuagaaua

SEQ ID NO: 732108 - RNA, 19 nt, Homo sapiens
ugcggacacuggaaagaaa

SEQ ID NO: 732109 - RNA, 19 nt, Homo sapiens
ccuggagaaugacaacuuc

SEQ ID NO: 732110 - RNA, 19 nt, Homo sapiens
acaguuguguugugccaau

SEQ ID NO: 732111 - RNA, 19 nt, Homo sapiens
ggugaucauuuuaaacuuc

SEQ ID NO: 732112 - RNA, 19 nt, Homo sapiens
cagaauuucaucacccaau

SEQ ID NO: 732113 - RNA, 19 nt, Homo sapiens
aaacccgaggugaucauuu

SEQ ID NO: 732114 - RNA, 19 nt, Homo sapiens
gcaaaguccugugaagaua

SEQ ID NO: 732115 - RNA, 19 nt, Homo sapiens
gguaaacucucuauaagug

SEQ ID NO: 732116 - RNA, 19 nt, Homo sapiens
gacuacagcuuuccuauau

SEQ ID NO: 732117 - RNA, 19 nt, Homo sapiens
ggacuacagcuuuccuaua

SEQ ID NO: 732118 - RNA, 19 nt, Homo sapiens
caaugaaugugcacuccua

SEQ ID NO: 732119 - RNA, 19 nt, Homo sapiens
ggacgugaaugacaacaca

SEQ ID NO: 732120 - RNA, 19 nt, Homo sapiens
guaaagcacuccggaucuu

SEQ ID NO: 732121 - RNA, 19 nt, Homo sapiens
aauaaugccuacuguguga

SEQ ID NO: 732122 - RNA, 19 nt, Homo sapiens
caacugaaucugcccguaa

SEQ ID NO: 732123 - RNA, 19 nt, Homo sapiens
caauaucucugugggaaug

SEQ ID NO: 732124 - RNA, 19 nt, Homo sapiens
ggaagaggaggaagaugaa

SEQ ID NO: 732125 - RNA, 19 nt, Homo sapiens
ccaggcagcuccacaugug

SEQ ID NO: 732126 - RNA, 19 nt, Homo sapiens
gaaugaacaagaagaacaa

SEQ ID NO: 732127 - RNA, 19 nt, Homo sapiens
guaaagaaacgugugagaa

SEQ ID NO: 732128 - RNA, 19 nt, Homo sapiens
guaaagagcagccagaacu

SEQ ID NO: 732129 - RNA, 19 nt, Homo sapiens
gugguaaacucucuauaag

SEQ ID NO: 732130 - RNA, 19 nt, Homo sapiens
gaccaggacuacagcuuuc

SEQ ID NO: 732131 - RNA, 19 nt, Homo sapiens
cauaacagcagaugccaaa

SEQ ID NO: 732132 - RNA, 19 nt, Homo sapiens
ggaaugauggagucaccua

SEQ ID NO: 732133 - RNA, 19 nt, Homo sapiens
gaugagcugugcccugaca

SEQ ID NO: 732134 - RNA, 19 nt, Homo sapiens
gguguucccucugugauga

SEQ ID NO: 732135 - RNA, 19 nt, Homo sapiens
ccaauaaugccuacugugu

SEQ ID NO: 732136 - RNA, 19 nt, Homo sapiens
gaccaauaaugccuacugu

SEQ ID NO: 732137 - RNA, 19 nt, Homo sapiens
guaauauggcuguaucaga

SEQ ID NO: 732138 - RNA, 19 nt, Homo sapiens
cuacagcuuuccuauaucu

SEQ ID NO: 732139 - RNA, 19 nt, Homo sapiens
gcuguaauauggcuguauc

SEQ ID NO: 732140 - RNA, 19 nt, Homo sapiens
cuccggaucuugcaacuga

SEQ ID NO: 732141 - RNA, 19 nt, Homo sapiens
guaccaaggcagauguaaa

SEQ ID NO: 732142 - RNA, 19 nt, Homo sapiens
augcaacgcuguaauaugg

SEQ ID NO: 732143 - RNA, 19 nt, Homo sapiens
ccuacugugugaccuguaa

SEQ ID NO: 732144 - RNA, 19 nt, Homo sapiens
cuauaaguguucaguguuc

SEQ ID NO: 732145 - RNA, 19 nt, Homo sapiens
guuguuguccguauuuaaa

SEQ ID NO: 732146 - RNA, 19 nt, Homo sapiens
aguguucaguguucacaua

SEQ ID NO: 732147 - RNA, 19 nt, Homo sapiens
uaaagaaacgugugagaac

SEQ ID NO: 732148 - RNA, 19 nt, Homo sapiens
gggaaaaccuaccgcaaug

SEQ ID NO: 732149 - RNA, 19 nt, Homo sapiens
agaccgaacugagcaagga

SEQ ID NO: 732150 - RNA, 19 nt, Homo sapiens
ccugagccauugauucuuc

SEQ ID NO: 732151 - RNA, 19 nt, Homo sapiens
uuuaugggauuucaagguu

SEQ ID NO: 732152 - RNA, 19 nt, Homo sapiens
aaaccuaccgcaaugaaug

SEQ ID NO: 732153 - RNA, 19 nt, Homo sapiens
agugguaaacucucuauaa

SEQ ID NO: 732154 - RNA, 19 nt, Homo sapiens
ggaccgaggaggacgugaa

SEQ ID NO: 732155 - RNA, 19 nt, Homo sapiens
ccgaggaggacgugaauga

SEQ ID NO: 732156 - RNA, 19 nt, Homo sapiens
caaaguccugugaagauau

SEQ ID NO: 732157 - RNA, 19 nt, Homo sapiens
cgaaugaacaagaagaaca

SEQ ID NO: 732158 - RNA, 19 nt, Homo sapiens
aaagcaaaguccugugaag

SEQ ID NO: 732159 - RNA, 19 nt, Homo sapiens
gaaugacaacacacucuuc

SEQ ID NO: 732160 - RNA, 19 nt, Homo sapiens
gcgcuguuguuguccguau

SEQ ID NO: 732161 - RNA, 19 nt, Homo sapiens
ggacuguggaccugggaaa

SEQ ID NO: 732162 - RNA, 19 nt, Homo sapiens
aaaaugcaacgcuguaaua

SEQ ID NO: 732163 - RNA, 19 nt, Homo sapiens
ucacugcaagucacauaaa

SEQ ID NO: 732164 - RNA, 19 nt, Homo sapiens
caaagcaaaguccugugaa

SEQ ID NO: 732165 - RNA, 19 nt, Homo sapiens
gaggaggacgugaaugaca

SEQ ID NO: 732166 - RNA, 19 nt, Homo sapiens
ccuaaaggcaagauguaaa

SEQ ID NO: 732167 - RNA, 19 nt, Homo sapiens
ggaagacaccgaggaagag

SEQ ID NO: 732168 - RNA, 19 nt, Homo sapiens
gaacugcuggcuccgucaa

SEQ ID NO: 732169 - RNA, 19 nt, Homo sapiens
gacaacacacucuucaagu

SEQ ID NO: 732170 - RNA, 19 nt, Homo sapiens
ugacaacacacucuucaag

SEQ ID NO: 732171 - RNA, 19 nt, Homo sapiens
aggaagaggaggaagauga

SEQ ID NO: 732172 - RNA, 19 nt, Homo sapiens
cggaagacaccgaggaaga

SEQ ID NO: 732173 - RNA, 19 nt, Homo sapiens
gaaugugcacuccuaaagg

SEQ ID NO: 732174 - RNA, 19 nt, Homo sapiens
gcuguuguuguccguauuu

SEQ ID NO: 732175 - RNA, 19 nt, Homo sapiens
aaaguccugugaagauauc

SEQ ID NO: 732176 - RNA, 19 nt, Homo sapiens
gaaaaccuaccgcaaugaa

SEQ ID NO: 732177 - RNA, 19 nt, Homo sapiens
ucaaguggaugauuuucaa

SEQ ID NO: 732178 - RNA, 19 nt, Homo sapiens
agaccaggacuacagcuuu

SEQ ID NO: 732179 - RNA, 19 nt, Homo sapiens
cuucugcgcuguuguuguc

SEQ ID NO: 732180 - RNA, 19 nt, Homo sapiens
cguaaaaccugagccauug

SEQ ID NO: 732181 - RNA, 19 nt, Homo sapiens
cagcgagugugccaugaag

SEQ ID NO: 732182 - RNA, 19 nt, Homo sapiens
aacugaaucugcccguaaa

SEQ ID NO: 732183 - RNA, 19 nt, Homo sapiens
gcgagugugccaugaagga

SEQ ID NO: 732184 - RNA, 19 nt, Homo sapiens
aggaggacgugaaugacaa

SEQ ID NO: 732185 - RNA, 19 nt, Homo sapiens
ugaaugugcacuccuaaag

SEQ ID NO: 732186 - RNA, 19 nt, Homo sapiens
gcuuuccuauaucuucuau

SEQ ID NO: 732187 - RNA, 19 nt, Homo sapiens
ccaacugcauccccuguaa

SEQ ID NO: 732188 - RNA, 19 nt, Homo sapiens
cuaaaggcaagauguaaag

SEQ ID NO: 732189 - RNA, 19 nt, Homo sapiens
ucagagggcuuugaaaaca

SEQ ID NO: 732190 - RNA, 19 nt, Homo sapiens
aaaccugagccauugauuc

SEQ ID NO: 732191 - RNA, 19 nt, Homo sapiens
guaaacucucuauaagugu

SEQ ID NO: 732192 - RNA, 19 nt, Homo sapiens
cugcugcucugccaguuca

SEQ ID NO: 732193 - RNA, 19 nt, Homo sapiens
gcaauaucucugugggaau

SEQ ID NO: 732194 - RNA, 19 nt, Homo sapiens
ccuauaucuucuauucuag

SEQ ID NO: 732195 - RNA, 19 nt, Homo sapiens
gaccgaggaggacgugaau

SEQ ID NO: 732196 - RNA, 19 nt, Homo sapiens
caggugugcuacuggaagu

SEQ ID NO: 732197 - RNA, 19 nt, Homo sapiens
ugaaugacaacacacucuu

SEQ ID NO: 732198 - RNA, 19 nt, Homo sapiens
uaaagagcagccagaacug

SEQ ID NO: 732199 - RNA, 19 nt, Homo sapiens
uauaaguguucaguguuca

SEQ ID NO: 732200 - RNA, 19 nt, Homo sapiens
cagcuuuccuauaucuucu

SEQ ID NO: 732201 - RNA, 19 nt, Homo sapiens
gccgaaugaacaagaagaa

SEQ ID NO: 732202 - RNA, 19 nt, Homo sapiens
aagaugaagaccaggacua

SEQ ID NO: 732203 - RNA, 19 nt, Homo sapiens
uaucagagggcuuugaaaa

SEQ ID NO: 732204 - RNA, 19 nt, Homo sapiens
uaaagcacuccggaucuug

SEQ ID NO: 732205 - RNA, 19 nt, Homo sapiens
aagcaaaguccugugaaga

SEQ ID NO: 732206 - RNA, 19 nt, Homo sapiens
uaaaggcaagauguaaaga

SEQ ID NO: 732207 - RNA, 19 nt, Homo sapiens
aaaugcaacgcuguaauau

SEQ ID NO: 732208 - RNA, 19 nt, Homo sapiens
cucuauaaguguucagugu

SEQ ID NO: 732209 - RNA, 19 nt, Homo sapiens
gagcugcuucugcgcuguu

SEQ ID NO: 732210 - RNA, 19 nt, Homo sapiens
gcaaaguccugugaagaua

SEQ ID NO: 732211 - RNA, 19 nt, Homo sapiens
gguaaacucucuauaagug

SEQ ID NO: 732212 - RNA, 19 nt, Homo sapiens
gacuacagcuuuccuauau

SEQ ID NO: 732213 - RNA, 19 nt, Homo sapiens
ggacuacagcuuuccuaua

SEQ ID NO: 732214 - RNA, 19 nt, Homo sapiens
caaugaaugugcacuccua

SEQ ID NO: 732215 - RNA, 19 nt, Homo sapiens
ggacgugaaugacaacaca

SEQ ID NO: 732216 - RNA, 19 nt, Homo sapiens
gcaacuccauuucggaaga

SEQ ID NO: 732217 - RNA, 19 nt, Homo sapiens
guaaagcacuccggaucuu

SEQ ID NO: 732218 - RNA, 19 nt, Homo sapiens
aauaaugccuacuguguga

SEQ ID NO: 732219 - RNA, 19 nt, Homo sapiens
caauaucucugugggaaug

SEQ ID NO: 732220 - RNA, 19 nt, Homo sapiens
ggaagaggaggaagaugaa

SEQ ID NO: 732221 - RNA, 19 nt, Homo sapiens
ccaggcagcuccacaugug

SEQ ID NO: 732222 - RNA, 19 nt, Homo sapiens
gaaugaacaagaagaacaa

SEQ ID NO: 732223 - RNA, 19 nt, Homo sapiens
guaaagaaacgugugagaa

SEQ ID NO: 732224 - RNA, 19 nt, Homo sapiens
guaaagagcagccagaacu

SEQ ID NO: 732225 - RNA, 19 nt, Homo sapiens
gugguaaacucucuauaag

SEQ ID NO: 732226 - RNA, 19 nt, Homo sapiens
gaccaggacuacagcuuuc

SEQ ID NO: 732227 - RNA, 19 nt, Homo sapiens
ggaaugauggagucaccua

SEQ ID NO: 732228 - RNA, 19 nt, Homo sapiens
gaugagcugugcccugaca

SEQ ID NO: 732229 - RNA, 19 nt, Homo sapiens
gguguucccucugugauga

SEQ ID NO: 732230 - RNA, 19 nt, Homo sapiens
ccaauaaugccuacugugu

SEQ ID NO: 732231 - RNA, 19 nt, Homo sapiens
gaccaauaaugccuacugu

SEQ ID NO: 732232 - RNA, 19 nt, Homo sapiens
cuacagcuuuccuauaucu

SEQ ID NO: 732233 - RNA, 19 nt, Homo sapiens
guaccaaggcagauguaaa

SEQ ID NO: 732234 - RNA, 19 nt, Homo sapiens
ccuacugugugaccuguaa

SEQ ID NO: 732235 - RNA, 19 nt, Homo sapiens
cuauaaguguucaguguuc

SEQ ID NO: 732236 - RNA, 19 nt, Homo sapiens
aguguucaguguucacaua

SEQ ID NO: 732237 - RNA, 19 nt, Homo sapiens
uaaagaaacgugugagaac

SEQ ID NO: 732238 - RNA, 19 nt, Homo sapiens
gggaaaaccuaccgcaaug

SEQ ID NO: 732239 - RNA, 19 nt, Homo sapiens
agaccgaacugagcaagga

SEQ ID NO: 732240 - RNA, 19 nt, Homo sapiens
uuuaugggauuucaagguu

SEQ ID NO: 732241 - RNA, 19 nt, Homo sapiens
aaaccuaccgcaaugaaug

SEQ ID NO: 732242 - RNA, 19 nt, Homo sapiens
agugguaaacucucuauaa

SEQ ID NO: 732243 - RNA, 19 nt, Homo sapiens
ggaccgaggaggacgugaa

SEQ ID NO: 732244 - RNA, 19 nt, Homo sapiens
ccgaggaggacgugaauga

SEQ ID NO: 732245 - RNA, 19 nt, Homo sapiens
caaaguccugugaagauau

SEQ ID NO: 732246 - RNA, 19 nt, Homo sapiens
cgaaugaacaagaagaaca

SEQ ID NO: 732247 - RNA, 19 nt, Homo sapiens
aaagcaaaguccugugaag

SEQ ID NO: 732248 - RNA, 19 nt, Homo sapiens
gaucuugcaacuccauuuc

SEQ ID NO: 732249 - RNA, 19 nt, Homo sapiens
gaaugacaacacacucuuc

SEQ ID NO: 732250 - RNA, 19 nt, Homo sapiens
ggacuguggaccugggaaa

SEQ ID NO: 732251 - RNA, 19 nt, Homo sapiens
caaagcaaaguccugugaa

SEQ ID NO: 732252 - RNA, 19 nt, Homo sapiens
gaggaggacgugaaugaca

SEQ ID NO: 732253 - RNA, 19 nt, Homo sapiens
ccuaaaggcaagauguaaa

SEQ ID NO: 732254 - RNA, 19 nt, Homo sapiens
ugacaacacacucuucaag

SEQ ID NO: 732255 - RNA, 19 nt, Homo sapiens
ggaagacaccgaggaagag

SEQ ID NO: 732256 - RNA, 19 nt, Homo sapiens
gaacugcuggcuccgucaa

SEQ ID NO: 732257 - RNA, 19 nt, Homo sapiens
gacaacacacucuucaagu

SEQ ID NO: 732258 - RNA, 19 nt, Homo sapiens
aggaagaggaggaagauga

SEQ ID NO: 732259 - RNA, 19 nt, Homo sapiens
cggaagacaccgaggaaga

SEQ ID NO: 732260 - RNA, 19 nt, Homo sapiens
gaaugugcacuccuaaagg

SEQ ID NO: 732261 - RNA, 19 nt, Homo sapiens
aaaguccugugaagauauc

SEQ ID NO: 732262 - RNA, 19 nt, Homo sapiens
gaaaaccuaccgcaaugaa

SEQ ID NO: 732263 - RNA, 19 nt, Homo sapiens
agaccaggacuacagcuuu

SEQ ID NO: 732264 - RNA, 19 nt, Homo sapiens
cagcgagugugccaugaag

SEQ ID NO: 732265 - RNA, 19 nt, Homo sapiens
ucaaguggaugauuuucaa

SEQ ID NO: 732266 - RNA, 19 nt, Homo sapiens
aggaggacgugaaugacaa

SEQ ID NO: 732267 - RNA, 19 nt, Homo sapiens
ggaucuugcaacuccauuu

SEQ ID NO: 732268 - RNA, 19 nt, Homo sapiens
gcgagugugccaugaagga

SEQ ID NO: 732269 - RNA, 19 nt, Homo sapiens
ugaaugugcacuccuaaag

SEQ ID NO: 732270 - RNA, 19 nt, Homo sapiens
gcuuuccuauaucuucuau

SEQ ID NO: 732271 - RNA, 19 nt, Homo sapiens
cuaaaggcaagauguaaag

SEQ ID NO: 732272 - RNA, 19 nt, Homo sapiens
ccaacugcauccccuguaa

SEQ ID NO: 732273 - RNA, 19 nt, Homo sapiens
guaaacucucuauaagugu

SEQ ID NO: 732274 - RNA, 19 nt, Homo sapiens
cugcugcucugccaguuca

SEQ ID NO: 732275 - RNA, 19 nt, Homo sapiens
gcaauaucucugugggaau

SEQ ID NO: 732276 - RNA, 19 nt, Homo sapiens
ugaaugacaacacacucuu

SEQ ID NO: 732277 - RNA, 19 nt, Homo sapiens
ccuauaucuucuauucuag

SEQ ID NO: 732278 - RNA, 19 nt, Homo sapiens
caggugugcuacuggaagu

SEQ ID NO: 732279 - RNA, 19 nt, Homo sapiens
gaccgaggaggacgugaau

SEQ ID NO: 732280 - RNA, 19 nt, Homo sapiens
uaaagagcagccagaacug

SEQ ID NO: 732281 - RNA, 19 nt, Homo sapiens
uauaaguguucaguguuca

SEQ ID NO: 732282 - RNA, 19 nt, Homo sapiens
cagcuuuccuauaucuucu

SEQ ID NO: 732283 - RNA, 19 nt, Homo sapiens
gccgaaugaacaagaagaa

SEQ ID NO: 732284 - RNA, 19 nt, Homo sapiens
aagaugaagaccaggacua

SEQ ID NO: 732285 - RNA, 19 nt, Homo sapiens
uaaagcacuccggaucuug

SEQ ID NO: 732286 - RNA, 19 nt, Homo sapiens
aagcaaaguccugugaaga

SEQ ID NO: 732287 - RNA, 19 nt, Homo sapiens
uaaaggcaagauguaaaga

SEQ ID NO: 732288 - RNA, 19 nt, Homo sapiens
cucuauaaguguucagugu

SEQ ID NO: 732289 - RNA, 19 nt, Homo sapiens
gcgagaaggucacacgauu

SEQ ID NO: 732290 - RNA, 19 nt, Homo sapiens
agaugaagaugaaguauga

SEQ ID NO: 732291 - RNA, 19 nt, Homo sapiens
gaagaugaaguaugacgaa

SEQ ID NO: 732292 - RNA, 19 nt, Homo sapiens
ccagaaggcuagaagaauc

SEQ ID NO: 732293 - RNA, 19 nt, Homo sapiens
gacaaggaccgguuucuga

SEQ ID NO: 732294 - RNA, 19 nt, Homo sapiens
caaacaagaauuagccaaa

SEQ ID NO: 732295 - RNA, 19 nt, Homo sapiens
gcacagaggcaccgcaaca

SEQ ID NO: 732296 - RNA, 19 nt, Homo sapiens
gcuagauaaugucaaacaa

SEQ ID NO: 732297 - RNA, 19 nt, Homo sapiens
gaugaaguaugacgaaagc

SEQ ID NO: 732298 - RNA, 19 nt, Homo sapiens
cuggagagcuugacauucu

SEQ ID NO: 732299 - RNA, 19 nt, Homo sapiens
caaggaggagaaaguguuu

SEQ ID NO: 732300 - RNA, 19 nt, Homo sapiens
gagaugaagaugaaguaug

SEQ ID NO: 732301 - RNA, 19 nt, Homo sapiens
caugauuucuggagagcuu

SEQ ID NO: 732302 - RNA, 19 nt, Homo sapiens
caaagacuggugcuaugaa

SEQ ID NO: 732303 - RNA, 19 nt, Homo sapiens
gcgaggugcuacggaagaa

SEQ ID NO: 732304 - RNA, 19 nt, Homo sapiens
ggccagaaggcuagaagaa

SEQ ID NO: 732305 - RNA, 19 nt, Homo sapiens
acaaggacuccaaguggua

SEQ ID NO: 732306 - RNA, 19 nt, Homo sapiens
ucaaggaggagaaaguguu

SEQ ID NO: 732307 - RNA, 19 nt, Homo sapiens
guuccauucucgcauccua

SEQ ID NO: 732308 - RNA, 19 nt, Homo sapiens
gagcugccacuguccaaau

SEQ ID NO: 732309 - RNA, 19 nt, Homo sapiens
ggugcuaugaagcuacuua

SEQ ID NO: 732310 - RNA, 19 nt, Homo sapiens
ucaaagacuggugcuauga

SEQ ID NO: 732311 - RNA, 19 nt, Homo sapiens
cggacaaggucaccgacuu

SEQ ID NO: 732312 - RNA, 19 nt, Homo sapiens
ggccagaaggaaauacaaa

SEQ ID NO: 732313 - RNA, 19 nt, Homo sapiens
ccaggaggccagaaggaaa

SEQ ID NO: 732314 - RNA, 19 nt, Homo sapiens
cuugcuagauaaugucaaa

SEQ ID NO: 732315 - RNA, 19 nt, Homo sapiens
cagcgacuccggaagagaa

SEQ ID NO: 732316 - RNA, 19 nt, Homo sapiens
ggaagagaacggaguuugc

SEQ ID NO: 732317 - RNA, 19 nt, Homo sapiens
aaagacuggugcuaugaag

SEQ ID NO: 732318 - RNA, 19 nt, Homo sapiens
acaaggaccgguuucugaa

SEQ ID NO: 732319 - RNA, 19 nt, Homo sapiens
caggacagcggccuucaga

SEQ ID NO: 732320 - RNA, 19 nt, Homo sapiens
aggcacagcuggugauggu

SEQ ID NO: 732321 - RNA, 19 nt, Homo sapiens
gcuaugaagcuacuuacag

SEQ ID NO: 732322 - RNA, 19 nt, Homo sapiens
ggaguuugcgggagauaag

SEQ ID NO: 732323 - RNA, 19 nt, Homo sapiens
ucacacgauucuccaacau

SEQ ID NO: 732324 - RNA, 19 nt, Homo sapiens
cucaaagacuggugcuaug

SEQ ID NO: 732325 - RNA, 19 nt, Homo sapiens
aagaugaaguaugacgaaa

SEQ ID NO: 732326 - RNA, 19 nt, Homo sapiens
ccacuguccaaaucauauu

SEQ ID NO: 732327 - RNA, 19 nt, Homo sapiens
cggaggugcucacggagau

SEQ ID NO: 732328 - RNA, 19 nt, Homo sapiens
ggguggaguccgugaagaa

SEQ ID NO: 732329 - RNA, 19 nt, Homo sapiens
uguccggcuugcuagauaa

SEQ ID NO: 732330 - RNA, 19 nt, Homo sapiens
ucucaaagacuggugcuau

SEQ ID NO: 732331 - RNA, 19 nt, Homo sapiens
acaaaaccaucgagucaga

SEQ ID NO: 732332 - RNA, 19 nt, Homo sapiens
cagaaggcuagaagaauca

SEQ ID NO: 732333 - RNA, 19 nt, Homo sapiens
gccagaaggcuagaagaau

SEQ ID NO: 732334 - RNA, 19 nt, Homo sapiens
ugaaacagugcgagaacga

SEQ ID NO: 732335 - RNA, 19 nt, Homo sapiens
cgagaaggucacacgauuc

SEQ ID NO: 732336 - RNA, 19 nt, Homo sapiens
caaggagggcguggaggaa

SEQ ID NO: 732337 - RNA, 19 nt, Homo sapiens
guccaaaucauauucuucu

SEQ ID NO: 732338 - RNA, 19 nt, Homo sapiens
cuguccggcuugcuagaua

SEQ ID NO: 732339 - RNA, 19 nt, Homo sapiens
gucacacgauucuccaaca

SEQ ID NO: 732340 - RNA, 19 nt, Homo sapiens
ucgagaugaagaugaagua

SEQ ID NO: 732341 - RNA, 19 nt, Homo sapiens
caggaggccagaaggaaau

SEQ ID NO: 732342 - RNA, 19 nt, Homo sapiens
gccacuguccaaaucauau

SEQ ID NO: 732343 - RNA, 19 nt, Homo sapiens
gaccuggccaugggaaaga

SEQ ID NO: 732344 - RNA, 19 nt, Homo sapiens
gacuggugcuaugaagcua

SEQ ID NO: 732345 - RNA, 19 nt, Homo sapiens
uaaguucaaggaggagaaa

SEQ ID NO: 732346 - RNA, 19 nt, Homo sapiens
cgggagauaaguucaagga

SEQ ID NO: 732347 - RNA, 19 nt, Homo sapiens
ccggcuugcuagauaaugu

SEQ ID NO: 732348 - RNA, 19 nt, Homo sapiens
ucaagcaccgagcagauuc

SEQ ID NO: 732349 - RNA, 19 nt, Homo sapiens
cggaagagaacggaguuug

SEQ ID NO: 732350 - RNA, 19 nt, Homo sapiens
ggaagaggcuggacuauau

SEQ ID NO: 732351 - RNA, 19 nt, Homo sapiens
ggagaaauaucaacagcua

SEQ ID NO: 732352 - RNA, 19 nt, Homo sapiens
cagaaggacuuaaguaaau

SEQ ID NO: 732353 - RNA, 19 nt, Homo sapiens
cagcugaaauuaagcgaua

SEQ ID NO: 732354 - RNA, 19 nt, Homo sapiens
gaaauuaagcgauacgaau

SEQ ID NO: 732355 - RNA, 19 nt, Homo sapiens
gcagaaacuugaagcacaa

SEQ ID NO: 732356 - RNA, 19 nt, Homo sapiens
gguccaacguggucuuuaa

SEQ ID NO: 732357 - RNA, 19 nt, Homo sapiens
uaucacagcugaaauuaag

SEQ ID NO: 732358 - RNA, 19 nt, Homo sapiens
agggagaaguggagaaaua

SEQ ID NO: 732359 - RNA, 19 nt, Homo sapiens
gaagcacaacuaacagaaa

SEQ ID NO: 732360 - RNA, 19 nt, Homo sapiens
gggaagaggcuggacuaua

SEQ ID NO: 732361 - RNA, 19 nt, Homo sapiens
gaaacuugaagcacaacua

SEQ ID NO: 732362 - RNA, 19 nt, Homo sapiens
caacguggucuuuaaacuu

SEQ ID NO: 732363 - RNA, 19 nt, Homo sapiens
cuacagaaggacuuaagua

SEQ ID NO: 732364 - RNA, 19 nt, Homo sapiens
gagaaguggagaaauauca

SEQ ID NO: 732365 - RNA, 19 nt, Homo sapiens
aaacuugaagcacaacuaa

SEQ ID NO: 732366 - RNA, 19 nt, Homo sapiens
uacagaaggacuuaaguaa

SEQ ID NO: 732367 - RNA, 19 nt, Homo sapiens
acagaaggacuuaaguaaa

SEQ ID NO: 732368 - RNA, 19 nt, Homo sapiens
gaagcuacagggagaagug

SEQ ID NO: 732369 - RNA, 19 nt, Homo sapiens
cuauaucacagcugaaauu

SEQ ID NO: 732370 - RNA, 19 nt, Homo sapiens
gcacaacuaacagaaaaua

SEQ ID NO: 732371 - RNA, 19 nt, Homo sapiens
gaagaggcuggacuauauc

SEQ ID NO: 732372 - RNA, 19 nt, Homo sapiens
gggagaaguggagaaauau

SEQ ID NO: 732373 - RNA, 19 nt, Homo sapiens
gacuauaucacagcugaaa

SEQ ID NO: 732374 - RNA, 19 nt, Homo sapiens
ccaacguggucuuuaaacu

SEQ ID NO: 732375 - RNA, 19 nt, Homo sapiens
aacguggucuuuaaacuuc

SEQ ID NO: 732376 - RNA, 19 nt, Homo sapiens
gaagaagcuacagggagaa

SEQ ID NO: 732377 - RNA, 19 nt, Homo sapiens
ggaacuggcccugcuggau

SEQ ID NO: 732378 - RNA, 19 nt, Homo sapiens
cggagcugauccagaagaa

SEQ ID NO: 732379 - RNA, 19 nt, Homo sapiens
ggagaaguggagaaauauc

SEQ ID NO: 732380 - RNA, 19 nt, Homo sapiens
aaauuaagcgauacgaauc

SEQ ID NO: 732381 - RNA, 19 nt, Homo sapiens
ugaaauuaagcgauacgaa

SEQ ID NO: 732382 - RNA, 19 nt, Homo sapiens
agaaauaucaacagcuaca

SEQ ID NO: 732383 - RNA, 19 nt, Homo sapiens
aagcacaacuaacagaaaa

SEQ ID NO: 732384 - RNA, 19 nt, Homo sapiens
ugaagcacaacuaacagaa

SEQ ID NO: 732385 - RNA, 19 nt, Homo sapiens
agaaggacuuaaguaaauc

SEQ ID NO: 732386 - RNA, 19 nt, Homo sapiens
aauaucaacagcuacagaa

SEQ ID NO: 732387 - RNA, 19 nt, Homo sapiens
aucaacagcuacagaagga

SEQ ID NO: 732388 - RNA, 19 nt, Homo sapiens
gaggcuggacuauaucaca

SEQ ID NO: 732389 - RNA, 19 nt, Homo sapiens
guccggugcuagucaaaca

SEQ ID NO: 732390 - RNA, 19 nt, Homo sapiens
gcgauacgaaucccagcuu

SEQ ID NO: 732391 - RNA, 19 nt, Homo sapiens
uagggaagaggcuggacua

SEQ ID NO: 732392 - RNA, 19 nt, Homo sapiens
gaaguggagaaauaucaac

SEQ ID NO: 732393 - RNA, 19 nt, Homo sapiens
aaauaucaacagcuacaga

SEQ ID NO: 732394 - RNA, 19 nt, Homo sapiens
guccaacguggucuuuaaa

SEQ ID NO: 732395 - RNA, 19 nt, Homo sapiens
uaauaucgugaaagaggaa

SEQ ID NO: 732396 - RNA, 19 nt, Homo sapiens
gcggagcugauccagaaga

SEQ ID NO: 732397 - RNA, 19 nt, Homo sapiens
gaacguaaaugcacuguuu

SEQ ID NO: 732398 - RNA, 19 nt, Homo sapiens
gaagauagcucucaagaac

SEQ ID NO: 732399 - RNA, 19 nt, Homo sapiens
gaacagcucuuauuucucu

SEQ ID NO: 732400 - RNA, 19 nt, Homo sapiens
gaaauucccuccaguuuua

SEQ ID NO: 732401 - RNA, 19 nt, Homo sapiens
gcacugagcuugccuacug

SEQ ID NO: 732402 - RNA, 19 nt, Homo sapiens
ggacuggacugccuugauu

SEQ ID NO: 732403 - RNA, 19 nt, Homo sapiens
uaaacaagcaguugacuua

SEQ ID NO: 732404 - RNA, 19 nt, Homo sapiens
gaaagaggcuuccugugau

SEQ ID NO: 732405 - RNA, 19 nt, Homo sapiens
ccaguuaucuccacaugua

SEQ ID NO: 732406 - RNA, 19 nt, Homo sapiens
uaacuucgcuacauaacaa

SEQ ID NO: 732407 - RNA, 19 nt, Homo sapiens
ggaaguaagccaauaagaa

SEQ ID NO: 732408 - RNA, 19 nt, Homo sapiens
ggagcauuaucuuuaguua

SEQ ID NO: 732409 - RNA, 19 nt, Homo sapiens
gaguuuagguguacacauu

SEQ ID NO: 732410 - RNA, 19 nt, Homo sapiens
guuguucccuuugaaauua

SEQ ID NO: 732411 - RNA, 19 nt, Homo sapiens
cuacagaaaugcaugaguu

SEQ ID NO: 732412 - RNA, 19 nt, Homo sapiens
ggacaaagccagugaugau

SEQ ID NO: 732413 - RNA, 19 nt, Homo sapiens
ccacauagcaggcgauuug

SEQ ID NO: 732414 - RNA, 19 nt, Homo sapiens
ggccaaagcggaauuaauu

SEQ ID NO: 732415 - RNA, 19 nt, Homo sapiens
gagaaaugcugaaaguaca

SEQ ID NO: 732416 - RNA, 19 nt, Homo sapiens
gaacauagcacugugaaag

SEQ ID NO: 732417 - RNA, 19 nt, Homo sapiens
aaacugguguuaugaagaa

SEQ ID NO: 732418 - RNA, 19 nt, Homo sapiens
gcuagcagcugccaguuau

SEQ ID NO: 732419 - RNA, 19 nt, Homo sapiens
gugagagacuguaguuaaa

SEQ ID NO: 732420 - RNA, 19 nt, Homo sapiens
uauaugaguuguucccuuu

SEQ ID NO: 732421 - RNA, 19 nt, Homo sapiens
aaacuuaagcugcaaauug

SEQ ID NO: 732422 - RNA, 19 nt, Homo sapiens
cucaagaacuuuggaaaua

SEQ ID NO: 732423 - RNA, 19 nt, Homo sapiens
uagaauaacuacugcacaa

SEQ ID NO: 732424 - RNA, 19 nt, Homo sapiens
ugagagaaaugcugaaagu

SEQ ID NO: 732425 - RNA, 19 nt, Homo sapiens
gaaguaagccaauaagaac

SEQ ID NO: 732426 - RNA, 19 nt, Homo sapiens
aaaagaagcugaaagagaa

SEQ ID NO: 732427 - RNA, 19 nt, Homo sapiens
gacuggaccuuagaagaua

SEQ ID NO: 732428 - RNA, 19 nt, Homo sapiens
gagcuugccuacugucaga

SEQ ID NO: 732429 - RNA, 19 nt, Homo sapiens
ugaccaggcucuaaugaga

SEQ ID NO: 732430 - RNA, 19 nt, Homo sapiens
guacacauuuacccaguug

SEQ ID NO: 732431 - RNA, 19 nt, Homo sapiens
agaaagaggcuuccuguga

SEQ ID NO: 732432 - RNA, 19 nt, Homo sapiens
gaacuugacagguuguguu

SEQ ID NO: 732433 - RNA, 19 nt, Homo sapiens
gggagaagcccuacacaug

SEQ ID NO: 732434 - RNA, 19 nt, Homo sapiens
aaagagacauuguucaucu

SEQ ID NO: 732435 - RNA, 19 nt, Homo sapiens
ugaugaagaugaaggagaa

SEQ ID NO: 732436 - RNA, 19 nt, Homo sapiens
gagcuguacuggcuucaug

SEQ ID NO: 732437 - RNA, 19 nt, Homo sapiens
agacugacaucuagcuuug

SEQ ID NO: 732438 - RNA, 19 nt, Homo sapiens
gcuuucauauggcuuaauu

SEQ ID NO: 732439 - RNA, 19 nt, Homo sapiens
caaaucguccugucacaaa

SEQ ID NO: 732440 - RNA, 19 nt, Homo sapiens
gagcaagucagaauagaga

SEQ ID NO: 732441 - RNA, 19 nt, Homo sapiens
gucuugcacuuacaaauaa

SEQ ID NO: 732442 - RNA, 19 nt, Homo sapiens
guuuagguguacacauuua

SEQ ID NO: 732443 - RNA, 19 nt, Homo sapiens
uauuaacgcuacagaaaug

SEQ ID NO: 732444 - RNA, 19 nt, Homo sapiens
guguugaacuguguguuua

SEQ ID NO: 732445 - RNA, 19 nt, Homo sapiens
gaaaugcuggauuaucuau

SEQ ID NO: 732446 - RNA, 19 nt, Homo sapiens
uuggaaaccugaaugcuuu

SEQ ID NO: 732447 - RNA, 19 nt, Homo sapiens
uggaagagaucuaaauucu

SEQ ID NO: 732448 - RNA, 19 nt, Homo sapiens
gcucuuaguugagucuuga

SEQ ID NO: 732449 - RNA, 19 nt, Homo sapiens
uagaauagcaugagaaucu

SEQ ID NO: 732450 - RNA, 19 nt, Homo sapiens
guugggauauuaacuuguu

SEQ ID NO: 732451 - RNA, 19 nt, Homo sapiens
ggcaagagcuuccaguacu

SEQ ID NO: 732452 - RNA, 19 nt, Homo sapiens
gagaagcccuacacaugca

SEQ ID NO: 732453 - RNA, 19 nt, Homo sapiens
gcucuuauuucucuucaca

SEQ ID NO: 732454 - RNA, 19 nt, Homo sapiens
guucagaaagugugcauuu

SEQ ID NO: 732455 - RNA, 19 nt, Homo sapiens
caugccagcucagaguuua

SEQ ID NO: 732456 - RNA, 19 nt, Homo sapiens
aacuuaagcugcaaauuga

SEQ ID NO: 732457 - RNA, 19 nt, Homo sapiens
gugaggaaguucagaaagu

SEQ ID NO: 732458 - RNA, 19 nt, Homo sapiens
cggcagauguugacugugu

SEQ ID NO: 732459 - RNA, 19 nt, Homo sapiens
ggucauaagccugauuaaa

SEQ ID NO: 732460 - RNA, 19 nt, Homo sapiens
cuugaagaguuucuaguuu

SEQ ID NO: 732461 - RNA, 19 nt, Homo sapiens
ugugggacauaauuugaua

SEQ ID NO: 732462 - RNA, 19 nt, Homo sapiens
aagauucuauggacugaaa

SEQ ID NO: 732463 - RNA, 19 nt, Homo sapiens
agauagcucucaagaacuu

SEQ ID NO: 732464 - RNA, 19 nt, Homo sapiens
uaaugacuaugacauggaa

SEQ ID NO: 732465 - RNA, 19 nt, Homo sapiens
gaacauccugcccagcaaa

SEQ ID NO: 732466 - RNA, 19 nt, Homo sapiens
caucuagcuuugacaauca

SEQ ID NO: 732467 - RNA, 19 nt, Homo sapiens
gaaacuguuaagcugaaua

SEQ ID NO: 732468 - RNA, 19 nt, Homo sapiens
guauaacuuuaacgaguga

SEQ ID NO: 732469 - RNA, 19 nt, Homo sapiens
cugaacagcucuuauuucu

SEQ ID NO: 732470 - RNA, 19 nt, Homo sapiens
gcccagugaugaagaugaa

SEQ ID NO: 732471 - RNA, 19 nt, Homo sapiens
gcucagaguuuagguguac

SEQ ID NO: 732472 - RNA, 19 nt, Homo sapiens
gcagugugcauuuauaaca

SEQ ID NO: 732473 - RNA, 19 nt, Homo sapiens
gcuuaaagauuugcaugug

SEQ ID NO: 732474 - RNA, 19 nt, Homo sapiens
uugauaacuucgcuacaua

SEQ ID NO: 732475 - RNA, 19 nt, Homo sapiens
gaauaacuacugcacaagu

SEQ ID NO: 732476 - RNA, 19 nt, Homo sapiens
aacaagcaguugacuuaaa

SEQ ID NO: 732477 - RNA, 19 nt, Homo sapiens
uagaaauucccuccaguuu

SEQ ID NO: 732478 - RNA, 19 nt, Homo sapiens
ugugcuaacugcaauaaau

SEQ ID NO: 732479 - RNA, 19 nt, Homo sapiens
ccuuggagcauuaucuuua

SEQ ID NO: 732480 - RNA, 19 nt, Homo sapiens
guguguugcuggacuguuu

SEQ ID NO: 732481 - RNA, 19 nt, Homo sapiens
aauaaggucuaugggagua

SEQ ID NO: 732482 - RNA, 19 nt, Homo sapiens
ggacugccuugauugacau

SEQ ID NO: 732483 - RNA, 19 nt, Homo sapiens
aaggaugguugaacaaguu

SEQ ID NO: 732484 - RNA, 19 nt, Homo sapiens
guagaaauucccuccaguu

SEQ ID NO: 732485 - RNA, 19 nt, Homo sapiens
gcaagagcuuccaguacuc

SEQ ID NO: 732486 - RNA, 19 nt, Homo sapiens
cuaauaacaggguacagua

SEQ ID NO: 732487 - RNA, 19 nt, Homo sapiens
ugucuugcacuuacaaaua

SEQ ID NO: 732488 - RNA, 19 nt, Homo sapiens
gagagaaaugcugaaagua

SEQ ID NO: 732489 - RNA, 19 nt, Homo sapiens
caaguuccacugugaguug

SEQ ID NO: 732490 - RNA, 19 nt, Homo sapiens
ugaagacaguauggaguuu

SEQ ID NO: 732491 - RNA, 19 nt, Homo sapiens
ggucuuguccgugugauuu

SEQ ID NO: 732492 - RNA, 19 nt, Homo sapiens
guugaacuguguguuuaaa

SEQ ID NO: 732493 - RNA, 19 nt, Homo sapiens
cugaaaugcuggauuaucu

SEQ ID NO: 732494 - RNA, 19 nt, Homo sapiens
ugucagagacuggaccuua

SEQ ID NO: 732495 - RNA, 19 nt, Homo sapiens
acauagcacugugaaagaa

SEQ ID NO: 732496 - RNA, 19 nt, Homo sapiens
gaacauguggaugcgauug

SEQ ID NO: 732497 - RNA, 19 nt, Homo sapiens
cgacauaucuuguuaacuu

SEQ ID NO: 732498 - RNA, 19 nt, Homo sapiens
gcaacgacauaucuuguua

SEQ ID NO: 732499 - RNA, 19 nt, Homo sapiens
ugagagcucuguacuuaua

SEQ ID NO: 732500 - RNA, 19 nt, Homo sapiens
gguaaaccaugucaucuuu

SEQ ID NO: 732501 - RNA, 19 nt, Homo sapiens
caacuguuccuccauauua

SEQ ID NO: 732502 - RNA, 19 nt, Homo sapiens
gagagaagcuucccaaagg

SEQ ID NO: 732503 - RNA, 19 nt, Homo sapiens
uauagugacucuacuguuu

SEQ ID NO: 732504 - RNA, 19 nt, Homo sapiens
aagcaaaggugaaggauga

SEQ ID NO: 732505 - RNA, 19 nt, Homo sapiens
ugguacagcucuucauuua

SEQ ID NO: 732506 - RNA, 19 nt, Homo sapiens
gguugucucugcacuauuu

SEQ ID NO: 732507 - RNA, 19 nt, Homo sapiens
uaacacugccucuuucaua

SEQ ID NO: 732508 - RNA, 19 nt, Homo sapiens
uuugagagcucuguacuua

SEQ ID NO: 732509 - RNA, 19 nt, Homo sapiens
guacagcucuucauuuacu

SEQ ID NO: 732510 - RNA, 19 nt, Homo sapiens
caugucaucuuuacaaugu

SEQ ID NO: 732511 - RNA, 19 nt, Homo sapiens
caagaugccuccacauuuu

SEQ ID NO: 732512 - RNA, 19 nt, Homo sapiens
ccaagaugccuccacauuu

SEQ ID NO: 732513 - RNA, 19 nt, Homo sapiens
gcauagacuugacuuccuu

SEQ ID NO: 732514 - RNA, 19 nt, Homo sapiens
aaucagcuguguuagguaa

SEQ ID NO: 732515 - RNA, 19 nt, Homo sapiens
gaaagggcaaguaccacua

SEQ ID NO: 732516 - RNA, 19 nt, Homo sapiens
guacaguccugauuauugc

SEQ ID NO: 732517 - RNA, 19 nt, Homo sapiens
acacuuccuuguugucuuu

SEQ ID NO: 732518 - RNA, 19 nt, Homo sapiens
gagaucagcucgguugucu

SEQ ID NO: 732519 - RNA, 19 nt, Homo sapiens
uaaccaauuucaccucugu

SEQ ID NO: 732520 - RNA, 19 nt, Homo sapiens
aaacucaggcuuucuguug

SEQ ID NO: 732521 - RNA, 19 nt, Homo sapiens
gagauggugucacuuaaaa

SEQ ID NO: 732522 - RNA, 19 nt, Homo sapiens
gcucgucuucucugucuua

SEQ ID NO: 732523 - RNA, 19 nt, Homo sapiens
cccaagagcauugaaauuu

SEQ ID NO: 732524 - RNA, 19 nt, Homo sapiens
gagccaagauuccuguuuu

SEQ ID NO: 732525 - RNA, 19 nt, Homo sapiens
agacuugacuuccuuaaac

SEQ ID NO: 732526 - RNA, 19 nt, Homo sapiens
ggagagaagcuucccaaag

SEQ ID NO: 732527 - RNA, 19 nt, Homo sapiens
ccaagagcauugaaauuuu

SEQ ID NO: 732528 - RNA, 19 nt, Homo sapiens
cugccucuuucauaaauua

SEQ ID NO: 732529 - RNA, 19 nt, Homo sapiens
uaaaccagcuccuccaaaa

SEQ ID NO: 732530 - RNA, 19 nt, Homo sapiens
ucucugcacuauuuacuga

SEQ ID NO: 732531 - RNA, 19 nt, Homo sapiens
guucuugauucccuugauu

SEQ ID NO: 732532 - RNA, 19 nt, Homo sapiens
gggcaaguaccacuaauag

SEQ ID NO: 732533 - RNA, 19 nt, Homo sapiens
aaaccgagaugccucuaca

SEQ ID NO: 732534 - RNA, 19 nt, Homo sapiens
uacuuaggccuuugaaaua

SEQ ID NO: 732535 - RNA, 19 nt, Homo sapiens
aacacugccucuuucauaa

SEQ ID NO: 732536 - RNA, 19 nt, Homo sapiens
uuacuuaggccuuugaaau

SEQ ID NO: 732537 - RNA, 19 nt, Homo sapiens
aaacaaacccaagagcauu

SEQ ID NO: 732538 - RNA, 19 nt, Homo sapiens
ccugauuauugcaacuuua

SEQ ID NO: 732539 - RNA, 19 nt, Homo sapiens
acaguacaguccugauuau

SEQ ID NO: 732540 - RNA, 19 nt, Homo sapiens
caacgacauaucuuguuaa

SEQ ID NO: 732541 - RNA, 19 nt, Homo sapiens
ugacucuacuguuugaaau

SEQ ID NO: 732542 - RNA, 19 nt, Homo sapiens
uaaaggugauaaagcaaag

SEQ ID NO: 732543 - RNA, 19 nt, Homo sapiens
caaacaaacccaagagcau

SEQ ID NO: 732544 - RNA, 19 nt, Homo sapiens
ucaccucugucuccaguau

SEQ ID NO: 732545 - RNA, 19 nt, Homo sapiens
uacaguacaguccugauua

SEQ ID NO: 732546 - RNA, 19 nt, Homo sapiens
acauuugucuuuagucugu

SEQ ID NO: 732547 - RNA, 19 nt, Homo sapiens
ucacauuugucuuuagucu

SEQ ID NO: 732548 - RNA, 19 nt, Homo sapiens
uaacaaaacucaggcuuuc

SEQ ID NO: 732549 - RNA, 19 nt, Homo sapiens
gaaauaagggaaaauagga

SEQ ID NO: 732550 - RNA, 19 nt, Homo sapiens
cagcucgguugucugcuaa

SEQ ID NO: 732551 - RNA, 19 nt, Homo sapiens
ucagcucgguugucugcua

SEQ ID NO: 732552 - RNA, 19 nt, Homo sapiens
caagagcauugaaauuuug

SEQ ID NO: 732553 - RNA, 19 nt, Homo sapiens
aaacagcaacgacauaucu

SEQ ID NO: 732554 - RNA, 19 nt, Homo sapiens
ccuaaaaucagcuguguua

SEQ ID NO: 732555 - RNA, 19 nt, Homo sapiens
guacuuauagugacucuac

SEQ ID NO: 732556 - RNA, 19 nt, Homo sapiens
cgagauggugucacuuaaa

SEQ ID NO: 732557 - RNA, 19 nt, Homo sapiens
ucgagauggugucacuuaa

SEQ ID NO: 732558 - RNA, 19 nt, Homo sapiens
ggacagaagcacccaacag

SEQ ID NO: 732559 - RNA, 19 nt, Homo sapiens
aauguugucuuccaauaca

SEQ ID NO: 732560 - RNA, 19 nt, Homo sapiens
ugucaucuuuacaauguug

SEQ ID NO: 732561 - RNA, 19 nt, Homo sapiens
aaaaggagaugcuaaaggu

SEQ ID NO: 732562 - RNA, 19 nt, Homo sapiens
ccacuaauaggguguaucu

SEQ ID NO: 732563 - RNA, 19 nt, Homo sapiens
gaugccaagugaaauguac

SEQ ID NO: 732564 - RNA, 19 nt, Homo sapiens
cuaaaggugauaaagcaaa

SEQ ID NO: 732565 - RNA, 19 nt, Homo sapiens
ggguguaucucagaaacug

SEQ ID NO: 732566 - RNA, 19 nt, Homo sapiens
uagugacucuacuguuuga

SEQ ID NO: 732567 - RNA, 19 nt, Homo sapiens
agccaacuguuccuccaua

SEQ ID NO: 732568 - RNA, 19 nt, Homo sapiens
uggagugucuuggcuauuc

SEQ ID NO: 732569 - RNA, 19 nt, Homo sapiens
gugguugucucugcacuau

SEQ ID NO: 732570 - RNA, 19 nt, Homo sapiens
ucaaagugggccugagaaa

SEQ ID NO: 732571 - RNA, 19 nt, Homo sapiens
aaaggccucugcaaagaag

SEQ ID NO: 732572 - RNA, 19 nt, Homo sapiens
agucuguccugaacugauu

SEQ ID NO: 732573 - RNA, 19 nt, Homo sapiens
uuacugccuuguggaaauu

SEQ ID NO: 732574 - RNA, 19 nt, Homo sapiens
cacggaagccuuacagugu

SEQ ID NO: 732575 - RNA, 19 nt, Homo sapiens
aaagggcaaguaccacuaa

SEQ ID NO: 732576 - RNA, 19 nt, Homo sapiens
gcauugaaauuuugauugg

SEQ ID NO: 732577 - RNA, 19 nt, Homo sapiens
gccaacuguuccuccauau

SEQ ID NO: 732578 - RNA, 19 nt, Homo sapiens
ccuuucacauuugucuuua

SEQ ID NO: 732579 - RNA, 19 nt, Homo sapiens
cugcugaaaguaaauguuu

SEQ ID NO: 732580 - RNA, 19 nt, Homo sapiens
gaggggaguuuggaaauug

SEQ ID NO: 732581 - RNA, 19 nt, Homo sapiens
uccaauacaugaauauggu

SEQ ID NO: 732582 - RNA, 19 nt, Homo sapiens
cuaccaugcccaagagaaa

SEQ ID NO: 732583 - RNA, 19 nt, Homo sapiens
ucuccaguaucaccacaaa

SEQ ID NO: 732584 - RNA, 19 nt, Homo sapiens
gauuauugcaacuuuagga

SEQ ID NO: 732585 - RNA, 19 nt, Homo sapiens
ggaguuuggaaauuguaaa

SEQ ID NO: 732586 - RNA, 19 nt, Homo sapiens
ggaggggaguuuggaaauu

SEQ ID NO: 732587 - RNA, 19 nt, Homo sapiens
acuuaggccuuugaaauau

SEQ ID NO: 732588 - RNA, 19 nt, Homo sapiens
gaauaugguacagcucuuc

SEQ ID NO: 732589 - RNA, 19 nt, Homo sapiens
ccaauacaugaauauggua

SEQ ID NO: 732590 - RNA, 19 nt, Homo sapiens
aggaaaaggucugauaaaa

SEQ ID NO: 732591 - RNA, 19 nt, Homo sapiens
ggagaugcuaaaggugaua

SEQ ID NO: 732592 - RNA, 19 nt, Homo sapiens
gcugaauacaaauugguuu

SEQ ID NO: 732593 - RNA, 19 nt, Homo sapiens
aaccagagcccaggccuaa

SEQ ID NO: 732594 - RNA, 19 nt, Homo sapiens
aauaggguguaucucagaa

SEQ ID NO: 732595 - RNA, 19 nt, Homo sapiens
acuaauaggguguaucuca

SEQ ID NO: 732596 - RNA, 19 nt, Homo sapiens
ggagugucuuggcuauucu

SEQ ID NO: 732597 - RNA, 19 nt, Homo sapiens
ugaccgaacuggacacuaa

SEQ ID NO: 732598 - RNA, 19 nt, Homo sapiens
ugacgggcaucaucucuua

SEQ ID NO: 732599 - RNA, 19 nt, Homo sapiens
uaaagugacugcugugguu

SEQ ID NO: 732600 - RNA, 19 nt, Homo sapiens
gaacuggacacuaaagaug

SEQ ID NO: 732601 - RNA, 19 nt, Homo sapiens
ugacaugucugggaaagaa

SEQ ID NO: 732602 - RNA, 19 nt, Homo sapiens
ggacuucucccuugugguu

SEQ ID NO: 732603 - RNA, 19 nt, Homo sapiens
aagaugaggcugagcauua

SEQ ID NO: 732604 - RNA, 19 nt, Homo sapiens
ccagggagcuccacaggau

SEQ ID NO: 732605 - RNA, 19 nt, Homo sapiens
gaagauggaugccccuuug

SEQ ID NO: 732606 - RNA, 19 nt, Homo sapiens
gaggcccacuuccuucuuu

SEQ ID NO: 732607 - RNA, 19 nt, Homo sapiens
acacugaacugggcucuug

SEQ ID NO: 732608 - RNA, 19 nt, Homo sapiens
gaggagguccgcacacuug

SEQ ID NO: 732609 - RNA, 19 nt, Homo sapiens
gaaaggugacagacgauuc

SEQ ID NO: 732610 - RNA, 19 nt, Homo sapiens
ggacucccaccaagaaaga

SEQ ID NO: 732611 - RNA, 19 nt, Homo sapiens
uggaugcccugcugaagaa

SEQ ID NO: 732612 - RNA, 19 nt, Homo sapiens
ucagugugccgcauacuaa

SEQ ID NO: 732613 - RNA, 19 nt, Homo sapiens
ccgcacacuugaggaguua

SEQ ID NO: 732614 - RNA, 19 nt, Homo sapiens
ccaagauccaggaauauga

SEQ ID NO: 732615 - RNA, 19 nt, Homo sapiens
ggccaugagugaguugaaa

SEQ ID NO: 732616 - RNA, 19 nt, Homo sapiens
caagauccaggaauaugaa

SEQ ID NO: 732617 - RNA, 19 nt, Homo sapiens
agaacaagcccuucagugu

SEQ ID NO: 732618 - RNA, 19 nt, Homo sapiens
agcccaagauccaggaaua

SEQ ID NO: 732619 - RNA, 19 nt, Homo sapiens
ggacgccuuucgcaagauc

SEQ ID NO: 732620 - RNA, 19 nt, Homo sapiens
gaagaugaggcugagcauu

SEQ ID NO: 732621 - RNA, 19 nt, Homo sapiens
caucaaggaggagcuaauu

SEQ ID NO: 732622 - RNA, 19 nt, Homo sapiens
gcucgaggcccaccuucuu

SEQ ID NO: 732623 - RNA, 19 nt, Homo sapiens
ggauaagaaaggugacaga

SEQ ID NO: 732624 - RNA, 19 nt, Homo sapiens
caagaagaaaggccucaug

SEQ ID NO: 732625 - RNA, 19 nt, Homo sapiens
cgacuggcaggauaagaaa

SEQ ID NO: 732626 - RNA, 19 nt, Homo sapiens
ucaaauggcggcagucucu

SEQ ID NO: 732627 - RNA, 19 nt, Homo sapiens
gcccacaaccgcaccaaga

SEQ ID NO: 732628 - RNA, 19 nt, Homo sapiens
gaagggaaggcaggacaug

SEQ ID NO: 732629 - RNA, 19 nt, Homo sapiens
caagaagcagaaacuggaa

SEQ ID NO: 732630 - RNA, 19 nt, Homo sapiens
ggaagcccaagaagcagaa

SEQ ID NO: 732631 - RNA, 19 nt, Homo sapiens
gcaguuccacgacuucaag

SEQ ID NO: 732632 - RNA, 19 nt, Homo sapiens
cagaggacuccgaggauga

SEQ ID NO: 732633 - RNA, 19 nt, Homo sapiens
gcccuacugugcugacauc

SEQ ID NO: 732634 - RNA, 19 nt, Homo sapiens
guggaugcccugcugaaga

SEQ ID NO: 732635 - RNA, 19 nt, Homo sapiens
ggcuguggcugacaagaag

SEQ ID NO: 732636 - RNA, 19 nt, Homo sapiens
ugacagacgauuccugaag

SEQ ID NO: 732637 - RNA, 19 nt, Homo sapiens
agucugaggcccagcauga

SEQ ID NO: 732638 - RNA, 19 nt, Homo sapiens
ccauuaaacagucccacuu

SEQ ID NO: 732639 - RNA, 19 nt, Homo sapiens
ucugaaggcgggacauuug

SEQ ID NO: 732640 - RNA, 19 nt, Homo sapiens
gccuagcucuguacaacca

SEQ ID NO: 732641 - RNA, 19 nt, Homo sapiens
aggcugagcauuacaagau

SEQ ID NO: 732642 - RNA, 19 nt, Homo sapiens
cgaacuggacacuaaagau

SEQ ID NO: 732643 - RNA, 19 nt, Homo sapiens
gaccgaacuggacacuaaa

SEQ ID NO: 732644 - RNA, 19 nt, Homo sapiens
caggacggcccaaauccaa

SEQ ID NO: 732645 - RNA, 19 nt, Homo sapiens
ucgagaccaugaacuugga

SEQ ID NO: 732646 - RNA, 19 nt, Homo sapiens
gcucuugacgggcaucauc

SEQ ID NO: 732647 - RNA, 19 nt, Homo sapiens
gggugucccuagagaacga

SEQ ID NO: 732648 - RNA, 19 nt, Homo sapiens
ggcaucaucucuuaauccu

SEQ ID NO: 732649 - RNA, 19 nt, Homo sapiens
ccgacuggcaggauaagaa

SEQ ID NO: 732650 - RNA, 19 nt, Homo sapiens
ucaccgacuggcaggauaa

SEQ ID NO: 732651 - RNA, 19 nt, Homo sapiens
uauccugggccaugaguga

SEQ ID NO: 732652 - RNA, 19 nt, Homo sapiens
gccuguggcugucccucaa

SEQ ID NO: 732653 - RNA, 19 nt, Homo sapiens
ucaaggaggagcuaauugc

SEQ ID NO: 732654 - RNA, 19 nt, Homo sapiens
gcaucaaggaggagcuaau

SEQ ID NO: 732655 - RNA, 19 nt, Homo sapiens
gaacagccggaagauggau

SEQ ID NO: 732656 - RNA, 19 nt, Homo sapiens
gcugagcugaaggcacuua

SEQ ID NO: 732657 - RNA, 19 nt, Homo sapiens
ugagguccuugcugagcuu

SEQ ID NO: 732658 - RNA, 19 nt, Homo sapiens
ggacacuaaagauguggau

SEQ ID NO: 732659 - RNA, 19 nt, Homo sapiens
cauuaaacagucccacuuc

SEQ ID NO: 732660 - RNA, 19 nt, Homo sapiens
ggaagggaaggcaggacau

SEQ ID NO: 732661 - RNA, 19 nt, Homo sapiens
ggaggcccacuuccuucuu

SEQ ID NO: 732662 - RNA, 19 nt, Homo sapiens
gugagagcauccugaagcu

SEQ ID NO: 732663 - RNA, 19 nt, Homo sapiens
agaugaggcugagcauuac

SEQ ID NO: 732664 - RNA, 19 nt, Homo sapiens
ccaugagugaguugaaaga

SEQ ID NO: 732665 - RNA, 19 nt, Homo sapiens
ugaccgaacuggacacuaa

SEQ ID NO: 732666 - RNA, 19 nt, Homo sapiens
ugacgggcaucaucucuua

SEQ ID NO: 732667 - RNA, 19 nt, Homo sapiens
gaacuggacacuaaagaug

SEQ ID NO: 732668 - RNA, 19 nt, Homo sapiens
ugacaugucugggaaagaa

SEQ ID NO: 732669 - RNA, 19 nt, Homo sapiens
aagaugaggcugagcauua

SEQ ID NO: 732670 - RNA, 19 nt, Homo sapiens
ccagggagcuccacaggau

SEQ ID NO: 732671 - RNA, 19 nt, Homo sapiens
gagcugagacugcaccauu

SEQ ID NO: 732672 - RNA, 19 nt, Homo sapiens
gaagauggaugccccuuug

SEQ ID NO: 732673 - RNA, 19 nt, Homo sapiens
gagugaaacugcaucucaa

SEQ ID NO: 732674 - RNA, 19 nt, Homo sapiens
aauccuggcuggccucuaa

SEQ ID NO: 732675 - RNA, 19 nt, Homo sapiens
acacugaacugggcucuug

SEQ ID NO: 732676 - RNA, 19 nt, Homo sapiens
guacaguuuaguaguguua

SEQ ID NO: 732677 - RNA, 19 nt, Homo sapiens
gaggagguccgcacacuug

SEQ ID NO: 732678 - RNA, 19 nt, Homo sapiens
ggagugcaguggcaugauc

SEQ ID NO: 732679 - RNA, 19 nt, Homo sapiens
uuacgcuucuuaaccauuu

SEQ ID NO: 732680 - RNA, 19 nt, Homo sapiens
gaaaggugacagacgauuc

SEQ ID NO: 732681 - RNA, 19 nt, Homo sapiens
uggaugcccugcugaagaa

SEQ ID NO: 732682 - RNA, 19 nt, Homo sapiens
ccaaacaaauucugauucc

SEQ ID NO: 732683 - RNA, 19 nt, Homo sapiens
ucagugugccgcauacuaa

SEQ ID NO: 732684 - RNA, 19 nt, Homo sapiens
ccgcacacuugaggaguua

SEQ ID NO: 732685 - RNA, 19 nt, Homo sapiens
ccaagauccaggaauauga

SEQ ID NO: 732686 - RNA, 19 nt, Homo sapiens
ggccaugagugaguugaaa

SEQ ID NO: 732687 - RNA, 19 nt, Homo sapiens
caagauccaggaauaugaa

SEQ ID NO: 732688 - RNA, 19 nt, Homo sapiens
uuaguaguguuacccauau

SEQ ID NO: 732689 - RNA, 19 nt, Homo sapiens
ugacugaccgauugauuug

SEQ ID NO: 732690 - RNA, 19 nt, Homo sapiens
gguaugucccaaacaaauu

SEQ ID NO: 732691 - RNA, 19 nt, Homo sapiens
agaacaagcccuucagugu

SEQ ID NO: 732692 - RNA, 19 nt, Homo sapiens
agcccaagauccaggaaua

SEQ ID NO: 732693 - RNA, 19 nt, Homo sapiens
gugacugaccgauugauuu

SEQ ID NO: 732694 - RNA, 19 nt, Homo sapiens
ccaccacgcccagcuaauu

SEQ ID NO: 732695 - RNA, 19 nt, Homo sapiens
gaagaugaggcugagcauu

SEQ ID NO: 732696 - RNA, 19 nt, Homo sapiens
gcucgaggcccaccuucuu

SEQ ID NO: 732697 - RNA, 19 nt, Homo sapiens
ccgauugauuugauuuguu

SEQ ID NO: 732698 - RNA, 19 nt, Homo sapiens
ccggguaugucccaaacaa

SEQ ID NO: 732699 - RNA, 19 nt, Homo sapiens
caucaaggaggagcuaauu

SEQ ID NO: 732700 - RNA, 19 nt, Homo sapiens
ggauaagaaaggugacaga

SEQ ID NO: 732701 - RNA, 19 nt, Homo sapiens
caagaagaaaggccucaug

SEQ ID NO: 732702 - RNA, 19 nt, Homo sapiens
cgacuggcaggauaagaaa

SEQ ID NO: 732703 - RNA, 19 nt, Homo sapiens
ggccacggcuagucaccuu

SEQ ID NO: 732704 - RNA, 19 nt, Homo sapiens
gcccacaaccgcaccaaga

SEQ ID NO: 732705 - RNA, 19 nt, Homo sapiens
ggcaggagaaucaguugaa

SEQ ID NO: 732706 - RNA, 19 nt, Homo sapiens
ggguaugucccaaacaaau

SEQ ID NO: 732707 - RNA, 19 nt, Homo sapiens
acaacaggcuuuccaaucc

SEQ ID NO: 732708 - RNA, 19 nt, Homo sapiens
gaagggaaggcaggacaug

SEQ ID NO: 732709 - RNA, 19 nt, Homo sapiens
aguauauucuccaccuaaa

SEQ ID NO: 732710 - RNA, 19 nt, Homo sapiens
uuacccauauucacauugu

SEQ ID NO: 732711 - RNA, 19 nt, Homo sapiens
caguauauucuccaccuaa

SEQ ID NO: 732712 - RNA, 19 nt, Homo sapiens
gcaggagaaucaguugaac

SEQ ID NO: 732713 - RNA, 19 nt, Homo sapiens
caccacgcccagcuaauuu

SEQ ID NO: 732714 - RNA, 19 nt, Homo sapiens
caagaagcagaaacuggaa

SEQ ID NO: 732715 - RNA, 19 nt, Homo sapiens
ggaagcccaagaagcagaa

SEQ ID NO: 732716 - RNA, 19 nt, Homo sapiens
gcaguuccacgacuucaag

SEQ ID NO: 732717 - RNA, 19 nt, Homo sapiens
ucaguauauucuccaccua

SEQ ID NO: 732718 - RNA, 19 nt, Homo sapiens
caacaggcuuuccaauccu

SEQ ID NO: 732719 - RNA, 19 nt, Homo sapiens
cagaggacuccgaggauga

SEQ ID NO: 732720 - RNA, 19 nt, Homo sapiens
gcccuacugugcugacauc

SEQ ID NO: 732721 - RNA, 19 nt, Homo sapiens
aauuuacgcuucuuaacca

SEQ ID NO: 732722 - RNA, 19 nt, Homo sapiens
guggaugcccugcugaaga

SEQ ID NO: 732723 - RNA, 19 nt, Homo sapiens
ggcuguggcugacaagaag

SEQ ID NO: 732724 - RNA, 19 nt, Homo sapiens
ugacagacgauuccugaag

SEQ ID NO: 732725 - RNA, 19 nt, Homo sapiens
agagugaaacugcaucuca

SEQ ID NO: 732726 - RNA, 19 nt, Homo sapiens
caaagugccgggauuacag

SEQ ID NO: 732727 - RNA, 19 nt, Homo sapiens
caaacaaauucugauucca

SEQ ID NO: 732728 - RNA, 19 nt, Homo sapiens
ccaaagugccgggauuaca

SEQ ID NO: 732729 - RNA, 19 nt, Homo sapiens
guaugucccaaacaaauuc

SEQ ID NO: 732730 - RNA, 19 nt, Homo sapiens
ccauuaaacagucccacuu

SEQ ID NO: 732731 - RNA, 19 nt, Homo sapiens
agucugaggcccagcauga

SEQ ID NO: 732732 - RNA, 19 nt, Homo sapiens
ucugaaggcgggacauuug

SEQ ID NO: 732733 - RNA, 19 nt, Homo sapiens
uaaguguacaguuuaguag

SEQ ID NO: 732734 - RNA, 19 nt, Homo sapiens
aggcugagcauuacaagau

SEQ ID NO: 732735 - RNA, 19 nt, Homo sapiens
guaguguuacccauauuca

SEQ ID NO: 732736 - RNA, 19 nt, Homo sapiens
uagccaggauggucucgau

SEQ ID NO: 732737 - RNA, 19 nt, Homo sapiens
ggcaugaucucggcucacu

SEQ ID NO: 732738 - RNA, 19 nt, Homo sapiens
ugaccgauugauuugauuu

SEQ ID NO: 732739 - RNA, 19 nt, Homo sapiens
cgaacuggacacuaaagau

SEQ ID NO: 732740 - RNA, 19 nt, Homo sapiens
gaccgaacuggacacuaaa

SEQ ID NO: 732741 - RNA, 19 nt, Homo sapiens
caggacggcccaaauccaa

SEQ ID NO: 732742 - RNA, 19 nt, Homo sapiens
ucgagaccaugaacuugga

SEQ ID NO: 732743 - RNA, 19 nt, Homo sapiens
uauccugggccaugaguga

SEQ ID NO: 732744 - RNA, 19 nt, Homo sapiens
ggcaucaucucuuaauccu

SEQ ID NO: 732745 - RNA, 19 nt, Homo sapiens
caucugugacugaccgauu

SEQ ID NO: 732746 - RNA, 19 nt, Homo sapiens
gggugucccuagagaacga

SEQ ID NO: 732747 - RNA, 19 nt, Homo sapiens
gcucuugacgggcaucauc

SEQ ID NO: 732748 - RNA, 19 nt, Homo sapiens
ccgacuggcaggauaagaa

SEQ ID NO: 732749 - RNA, 19 nt, Homo sapiens
ucaccgacuggcaggauaa

SEQ ID NO: 732750 - RNA, 19 nt, Homo sapiens
uuuaguaguguuacccaua

SEQ ID NO: 732751 - RNA, 19 nt, Homo sapiens
aguguacaguuuaguagug

SEQ ID NO: 732752 - RNA, 19 nt, Homo sapiens
cgccuggccuaguuugguu

SEQ ID NO: 732753 - RNA, 19 nt, Homo sapiens
gaccgauugauuugauuug

SEQ ID NO: 732754 - RNA, 19 nt, Homo sapiens
uacaacaggcuuuccaauc

SEQ ID NO: 732755 - RNA, 19 nt, Homo sapiens
ucaaggaggagcuaauugc

SEQ ID NO: 732756 - RNA, 19 nt, Homo sapiens
gcaucaaggaggagcuaau

SEQ ID NO: 732757 - RNA, 19 nt, Homo sapiens
gaacagccggaagauggau

SEQ ID NO: 732758 - RNA, 19 nt, Homo sapiens
ugaggcaggagaaucaguu

SEQ ID NO: 732759 - RNA, 19 nt, Homo sapiens
gcugagcugaaggcacuua

SEQ ID NO: 732760 - RNA, 19 nt, Homo sapiens
ugagguccuugcugagcuu

SEQ ID NO: 732761 - RNA, 19 nt, Homo sapiens
cauuaaacagucccacuuc

SEQ ID NO: 732762 - RNA, 19 nt, Homo sapiens
ggacacuaaagauguggau

SEQ ID NO: 732763 - RNA, 19 nt, Homo sapiens
uaguaguguuacccauauu

SEQ ID NO: 732764 - RNA, 19 nt, Homo sapiens
guguacaguuuaguagugu

SEQ ID NO: 732765 - RNA, 19 nt, Homo sapiens
ugaccgaacuggacacuaa

SEQ ID NO: 732766 - RNA, 19 nt, Homo sapiens
ugacgggcaucaucucuua

SEQ ID NO: 732767 - RNA, 19 nt, Homo sapiens
gaacuggacacuaaagaug

SEQ ID NO: 732768 - RNA, 19 nt, Homo sapiens
ugacaugucugggaaagaa

SEQ ID NO: 732769 - RNA, 19 nt, Homo sapiens
aagaugaggcugagcauua

SEQ ID NO: 732770 - RNA, 19 nt, Homo sapiens
ccagggagcuccacaggau

SEQ ID NO: 732771 - RNA, 19 nt, Homo sapiens
gaagauggaugccccuuug

SEQ ID NO: 732772 - RNA, 19 nt, Homo sapiens
gagugaaacugcaucucaa

SEQ ID NO: 732773 - RNA, 19 nt, Homo sapiens
aauccuggcuggccucuaa

SEQ ID NO: 732774 - RNA, 19 nt, Homo sapiens
acacugaacugggcucuug

SEQ ID NO: 732775 - RNA, 19 nt, Homo sapiens
guacaguuuaguaguguua

SEQ ID NO: 732776 - RNA, 19 nt, Homo sapiens
gaggagguccgcacacuug

SEQ ID NO: 732777 - RNA, 19 nt, Homo sapiens
uuacgcuucuuaaccauuu

SEQ ID NO: 732778 - RNA, 19 nt, Homo sapiens
gaaaggugacagacgauuc

SEQ ID NO: 732779 - RNA, 19 nt, Homo sapiens
uggaugcccugcugaagaa

SEQ ID NO: 732780 - RNA, 19 nt, Homo sapiens
ccaaacaaauucugauucc

SEQ ID NO: 732781 - RNA, 19 nt, Homo sapiens
ucagugugccgcauacuaa

SEQ ID NO: 732782 - RNA, 19 nt, Homo sapiens
ccgcacacuugaggaguua

SEQ ID NO: 732783 - RNA, 19 nt, Homo sapiens
ccaagauccaggaauauga

SEQ ID NO: 732784 - RNA, 19 nt, Homo sapiens
ggccaugagugaguugaaa

SEQ ID NO: 732785 - RNA, 19 nt, Homo sapiens
caagauccaggaauaugaa

SEQ ID NO: 732786 - RNA, 19 nt, Homo sapiens
uuaguaguguuacccauau

SEQ ID NO: 732787 - RNA, 19 nt, Homo sapiens
ugacugaccgauugauuug

SEQ ID NO: 732788 - RNA, 19 nt, Homo sapiens
gguaugucccaaacaaauu

SEQ ID NO: 732789 - RNA, 19 nt, Homo sapiens
agaacaagcccuucagugu

SEQ ID NO: 732790 - RNA, 19 nt, Homo sapiens
agcccaagauccaggaaua

SEQ ID NO: 732791 - RNA, 19 nt, Homo sapiens
gugacugaccgauugauuu

SEQ ID NO: 732792 - RNA, 19 nt, Homo sapiens
gaagaugaggcugagcauu

SEQ ID NO: 732793 - RNA, 19 nt, Homo sapiens
ccgauugauuugauuuguu

SEQ ID NO: 732794 - RNA, 19 nt, Homo sapiens
ccggguaugucccaaacaa

SEQ ID NO: 732795 - RNA, 19 nt, Homo sapiens
caucaaggaggagcuaauu

SEQ ID NO: 732796 - RNA, 19 nt, Homo sapiens
gcucgaggcccaccuucuu

SEQ ID NO: 732797 - RNA, 19 nt, Homo sapiens
ggauaagaaaggugacaga

SEQ ID NO: 732798 - RNA, 19 nt, Homo sapiens
caagaagaaaggccucaug

SEQ ID NO: 732799 - RNA, 19 nt, Homo sapiens
cgacuggcaggauaagaaa

SEQ ID NO: 732800 - RNA, 19 nt, Homo sapiens
ggccacggcuagucaccuu

SEQ ID NO: 732801 - RNA, 19 nt, Homo sapiens
gcccacaaccgcaccaaga

SEQ ID NO: 732802 - RNA, 19 nt, Homo sapiens
ggguaugucccaaacaaau

SEQ ID NO: 732803 - RNA, 19 nt, Homo sapiens
acaacaggcuuuccaaucc

SEQ ID NO: 732804 - RNA, 19 nt, Homo sapiens
gaagggaaggcaggacaug

SEQ ID NO: 732805 - RNA, 19 nt, Homo sapiens
aguauauucuccaccuaaa

SEQ ID NO: 732806 - RNA, 19 nt, Homo sapiens
uuacccauauucacauugu

SEQ ID NO: 732807 - RNA, 19 nt, Homo sapiens
caguauauucuccaccuaa

SEQ ID NO: 732808 - RNA, 19 nt, Homo sapiens
caagaagcagaaacuggaa

SEQ ID NO: 732809 - RNA, 19 nt, Homo sapiens
ggaagcccaagaagcagaa

SEQ ID NO: 732810 - RNA, 19 nt, Homo sapiens
gcaguuccacgacuucaag

SEQ ID NO: 732811 - RNA, 19 nt, Homo sapiens
ucaguauauucuccaccua

SEQ ID NO: 732812 - RNA, 19 nt, Homo sapiens
caacaggcuuuccaauccu

SEQ ID NO: 732813 - RNA, 19 nt, Homo sapiens
cagaggacuccgaggauga

SEQ ID NO: 732814 - RNA, 19 nt, Homo sapiens
gcccuacugugcugacauc

SEQ ID NO: 732815 - RNA, 19 nt, Homo sapiens
aauuuacgcuucuuaacca

SEQ ID NO: 732816 - RNA, 19 nt, Homo sapiens
guggaugcccugcugaaga

SEQ ID NO: 732817 - RNA, 19 nt, Homo sapiens
ggcuguggcugacaagaag

SEQ ID NO: 732818 - RNA, 19 nt, Homo sapiens
ugacagacgauuccugaag

SEQ ID NO: 732819 - RNA, 19 nt, Homo sapiens
agagugaaacugcaucuca

SEQ ID NO: 732820 - RNA, 19 nt, Homo sapiens
caaacaaauucugauucca

SEQ ID NO: 732821 - RNA, 19 nt, Homo sapiens
ucugaaggcgggacauuug

SEQ ID NO: 732822 - RNA, 19 nt, Homo sapiens
guaugucccaaacaaauuc

SEQ ID NO: 732823 - RNA, 19 nt, Homo sapiens
agucugaggcccagcauga

SEQ ID NO: 732824 - RNA, 19 nt, Homo sapiens
ccauuaaacagucccacuu

SEQ ID NO: 732825 - RNA, 19 nt, Homo sapiens
uaaguguacaguuuaguag

SEQ ID NO: 732826 - RNA, 19 nt, Homo sapiens
aggcugagcauuacaagau

SEQ ID NO: 732827 - RNA, 19 nt, Homo sapiens
guaguguuacccauauuca

SEQ ID NO: 732828 - RNA, 19 nt, Homo sapiens
ugaccgauugauuugauuu

SEQ ID NO: 732829 - RNA, 19 nt, Homo sapiens
cgaacuggacacuaaagau

SEQ ID NO: 732830 - RNA, 19 nt, Homo sapiens
gaccgaacuggacacuaaa

SEQ ID NO: 732831 - RNA, 19 nt, Homo sapiens
caggacggcccaaauccaa

SEQ ID NO: 732832 - RNA, 19 nt, Homo sapiens
ucgagaccaugaacuugga

SEQ ID NO: 732833 - RNA, 19 nt, Homo sapiens
uauccugggccaugaguga

SEQ ID NO: 732834 - RNA, 19 nt, Homo sapiens
caucugugacugaccgauu

SEQ ID NO: 732835 - RNA, 19 nt, Homo sapiens
gcucuugacgggcaucauc

SEQ ID NO: 732836 - RNA, 19 nt, Homo sapiens
ggcaucaucucuuaauccu

SEQ ID NO: 732837 - RNA, 19 nt, Homo sapiens
gggugucccuagagaacga

SEQ ID NO: 732838 - RNA, 19 nt, Homo sapiens
ccgacuggcaggauaagaa

SEQ ID NO: 732839 - RNA, 19 nt, Homo sapiens
ucaccgacuggcaggauaa

SEQ ID NO: 732840 - RNA, 19 nt, Homo sapiens
uuuaguaguguuacccaua

SEQ ID NO: 732841 - RNA, 19 nt, Homo sapiens
aguguacaguuuaguagug

SEQ ID NO: 732842 - RNA, 19 nt, Homo sapiens
gaccgauugauuugauuug

SEQ ID NO: 732843 - RNA, 19 nt, Homo sapiens
uacaacaggcuuuccaauc

SEQ ID NO: 732844 - RNA, 19 nt, Homo sapiens
ucaaggaggagcuaauugc

SEQ ID NO: 732845 - RNA, 19 nt, Homo sapiens
gcaucaaggaggagcuaau

SEQ ID NO: 732846 - RNA, 19 nt, Homo sapiens
gaacagccggaagauggau

SEQ ID NO: 732847 - RNA, 19 nt, Homo sapiens
cauuaaacagucccacuuc

SEQ ID NO: 732848 - RNA, 19 nt, Homo sapiens
gcugagcugaaggcacuua

SEQ ID NO: 732849 - RNA, 19 nt, Homo sapiens
ugagguccuugcugagcuu

SEQ ID NO: 732850 - RNA, 19 nt, Homo sapiens
ggacacuaaagauguggau

SEQ ID NO: 732851 - RNA, 19 nt, Homo sapiens
uaguaguguuacccauauu

SEQ ID NO: 732852 - RNA, 19 nt, Homo sapiens
guguacaguuuaguagugu

SEQ ID NO: 732853 - RNA, 19 nt, Homo sapiens
ggaagggaaggcaggacau

SEQ ID NO: 732854 - RNA, 19 nt, Homo sapiens
ccaugagugaguugaaaga

SEQ ID NO: 732855 - RNA, 19 nt, Homo sapiens
agaugaggcugagcauuac

SEQ ID NO: 732856 - RNA, 19 nt, Homo sapiens
gaaauagccugccaaggaa

SEQ ID NO: 732857 - RNA, 19 nt, Homo sapiens
ggaaauagccugccaagga

SEQ ID NO: 732858 - RNA, 19 nt, Homo sapiens
gcagccagcucaucacaua

SEQ ID NO: 732859 - RNA, 19 nt, Homo sapiens
gcaaauagaccuuaacuuc

SEQ ID NO: 732860 - RNA, 19 nt, Homo sapiens
ccacugacauguuguuuaa

SEQ ID NO: 732861 - RNA, 19 nt, Homo sapiens
aaagaaagcugcaauuauc

SEQ ID NO: 732862 - RNA, 19 nt, Homo sapiens
gcgaauaacuaaauggaaa

SEQ ID NO: 732863 - RNA, 19 nt, Homo sapiens
gauagaggcuggguuguaa

SEQ ID NO: 732864 - RNA, 19 nt, Homo sapiens
gaaagaaagcugcaauuau

SEQ ID NO: 732865 - RNA, 19 nt, Homo sapiens
uuaagaaucuccaguguuu

SEQ ID NO: 732866 - RNA, 19 nt, Homo sapiens
ucaagagacugaucaaauu

SEQ ID NO: 732867 - RNA, 19 nt, Homo sapiens
gaaacccugucucuacuaa

SEQ ID NO: 732868 - RNA, 19 nt, Homo sapiens
gaagagcaaugaacucaag

SEQ ID NO: 732869 - RNA, 19 nt, Homo sapiens
gcacuggcaugaagcaaga

SEQ ID NO: 732870 - RNA, 19 nt, Homo sapiens
agaaauugcugcagaaugu

SEQ ID NO: 732871 - RNA, 19 nt, Homo sapiens
acaaugagaugcuucaaau

SEQ ID NO: 732872 - RNA, 19 nt, Homo sapiens
gaaugugaaugacacuuug

SEQ ID NO: 732873 - RNA, 19 nt, Homo sapiens
gaagcaacuugaagacaga

SEQ ID NO: 732874 - RNA, 19 nt, Homo sapiens
ugaaagaaagcugcaauua

SEQ ID NO: 732875 - RNA, 19 nt, Homo sapiens
ugacaggacuacaacuaaa

SEQ ID NO: 732876 - RNA, 19 nt, Homo sapiens
gaaagagaagguacagauu

SEQ ID NO: 732877 - RNA, 19 nt, Homo sapiens
caccacagcucuuguugaa

SEQ ID NO: 732878 - RNA, 19 nt, Homo sapiens
caacaucaccucugagaau

SEQ ID NO: 732879 - RNA, 19 nt, Homo sapiens
ggaaagagaagguacagau

SEQ ID NO: 732880 - RNA, 19 nt, Homo sapiens
gcaaugcgaauaacuaaau

SEQ ID NO: 732881 - RNA, 19 nt, Homo sapiens
gaaggaaccggaugggauu

SEQ ID NO: 732882 - RNA, 19 nt, Homo sapiens
guuaaggagucaucaaguu

SEQ ID NO: 732883 - RNA, 19 nt, Homo sapiens
gaagagcaaauagaccuua

SEQ ID NO: 732884 - RNA, 19 nt, Homo sapiens
ucaaagagacggaucaaga

SEQ ID NO: 732885 - RNA, 19 nt, Homo sapiens
gaccaauuaccuugaaaua

SEQ ID NO: 732886 - RNA, 19 nt, Homo sapiens
gcagaagcuccuugguuua

SEQ ID NO: 732887 - RNA, 19 nt, Homo sapiens
gaaauucuguguggcuuca

SEQ ID NO: 732888 - RNA, 19 nt, Homo sapiens
ucagaagauucagaacuua

SEQ ID NO: 732889 - RNA, 19 nt, Homo sapiens
gggcaaagcaagauaauag

SEQ ID NO: 732890 - RNA, 19 nt, Homo sapiens
ggaauacacgucuucagaa

SEQ ID NO: 732891 - RNA, 19 nt, Homo sapiens
gaccuuaacuucauuuuga

SEQ ID NO: 732892 - RNA, 19 nt, Homo sapiens
gaaaagggaauuaugagua

SEQ ID NO: 732893 - RNA, 19 nt, Homo sapiens
caaagagacggaucaagaa

SEQ ID NO: 732894 - RNA, 19 nt, Homo sapiens
cgaauauacuuuacaccaa

SEQ ID NO: 732895 - RNA, 19 nt, Homo sapiens
caaauagaccuuaacuuca

SEQ ID NO: 732896 - RNA, 19 nt, Homo sapiens
agauacagcucaucacgaa

SEQ ID NO: 732897 - RNA, 19 nt, Homo sapiens
gaaagaagaacaacagacu

SEQ ID NO: 732898 - RNA, 19 nt, Homo sapiens
gagaauaggagaaaugaag

SEQ ID NO: 732899 - RNA, 19 nt, Homo sapiens
ggucugcguucuccuaguu

SEQ ID NO: 732900 - RNA, 19 nt, Homo sapiens
uauauggacuuagcaacua

SEQ ID NO: 732901 - RNA, 19 nt, Homo sapiens
ggaagacguuacuuugaag

SEQ ID NO: 732902 - RNA, 19 nt, Homo sapiens
gcaauguuuccaagcuuua

SEQ ID NO: 732903 - RNA, 19 nt, Homo sapiens
ggucugacuuuaagaaucu

SEQ ID NO: 732904 - RNA, 19 nt, Homo sapiens
gaagccaccugcuccaucu

SEQ ID NO: 732905 - RNA, 19 nt, Homo sapiens
gaaggucugcguucuccua

SEQ ID NO: 732906 - RNA, 19 nt, Homo sapiens
caaagcaagauaauaguga

SEQ ID NO: 732907 - RNA, 19 nt, Homo sapiens
guacagauucagagacaaa

SEQ ID NO: 732908 - RNA, 19 nt, Homo sapiens
caacauuaaugaugaccau

SEQ ID NO: 732909 - RNA, 19 nt, Homo sapiens
agcagaagcuccuugguuu

SEQ ID NO: 732910 - RNA, 19 nt, Homo sapiens
uuaaggagucaucaaguua

SEQ ID NO: 732911 - RNA, 19 nt, Homo sapiens
ccagaaagcugugacaaaa

SEQ ID NO: 732912 - RNA, 19 nt, Homo sapiens
ggcccuauuuccagguuua

SEQ ID NO: 732913 - RNA, 19 nt, Homo sapiens
gcugccacaucuuuacuuu

SEQ ID NO: 732914 - RNA, 19 nt, Homo sapiens
gagagcaguuccaccuguu

SEQ ID NO: 732915 - RNA, 19 nt, Homo sapiens
agagacggaucaagaaaug

SEQ ID NO: 732916 - RNA, 19 nt, Homo sapiens
gcaguaagccaagaucaug

SEQ ID NO: 732917 - RNA, 19 nt, Homo sapiens
ggccaaggcaggagaauug

SEQ ID NO: 732918 - RNA, 19 nt, Homo sapiens
gucauuuccuuaguaguua

SEQ ID NO: 732919 - RNA, 19 nt, Homo sapiens
ccuuggaacuucauacuau

SEQ ID NO: 732920 - RNA, 19 nt, Homo sapiens
gaucaaauugugagaggaa

SEQ ID NO: 732921 - RNA, 19 nt, Homo sapiens
gguuguaaguaguaaguga

SEQ ID NO: 732922 - RNA, 19 nt, Homo sapiens
cuaccagacuuacugaguu

SEQ ID NO: 732923 - RNA, 19 nt, Homo sapiens
aggaagacguuacuuugaa

SEQ ID NO: 732924 - RNA, 19 nt, Homo sapiens
ggacuacaacuaaaacaua

SEQ ID NO: 732925 - RNA, 19 nt, Homo sapiens
gauaauagugaugaucgua

SEQ ID NO: 732926 - RNA, 19 nt, Homo sapiens
gcaaagcaagauaauagug

SEQ ID NO: 732927 - RNA, 19 nt, Homo sapiens
cagaagcuccuugguuuaa

SEQ ID NO: 732928 - RNA, 19 nt, Homo sapiens
ggagaaagaagaacaacag

SEQ ID NO: 732929 - RNA, 19 nt, Homo sapiens
gaagguacagauucagaga

SEQ ID NO: 732930 - RNA, 19 nt, Homo sapiens
gcacaccacagcucuuguu

SEQ ID NO: 732931 - RNA, 19 nt, Homo sapiens
uaggagaaaugaagcaaca

SEQ ID NO: 732932 - RNA, 19 nt, Homo sapiens
aaugagaugcuucaaauga

SEQ ID NO: 732933 - RNA, 19 nt, Homo sapiens
ccaagggucuucaggugau

SEQ ID NO: 732934 - RNA, 19 nt, Homo sapiens
gcaagauaauagugaugau

SEQ ID NO: 732935 - RNA, 19 nt, Homo sapiens
cggaugggauuuaggaguu

SEQ ID NO: 732936 - RNA, 19 nt, Homo sapiens
caagagacugaucaaauug

SEQ ID NO: 732937 - RNA, 19 nt, Homo sapiens
gaggaucggagacaaguga

SEQ ID NO: 732938 - RNA, 19 nt, Homo sapiens
ucuggaggcuggagaaaga

SEQ ID NO: 732939 - RNA, 19 nt, Homo sapiens
guguauaacagacuucuuu

SEQ ID NO: 732940 - RNA, 19 nt, Homo sapiens
ggaaaaccuucaagaccua

SEQ ID NO: 732941 - RNA, 19 nt, Homo sapiens
gaggcuggguuguaaguag

SEQ ID NO: 732942 - RNA, 19 nt, Homo sapiens
caagcaaagugugagagaa

SEQ ID NO: 732943 - RNA, 19 nt, Homo sapiens
uaauagugaugaucguaug

SEQ ID NO: 732944 - RNA, 19 nt, Homo sapiens
ggaugggauuuaggaguuu

SEQ ID NO: 732945 - RNA, 19 nt, Homo sapiens
aagagaagguacagauuca

SEQ ID NO: 732946 - RNA, 19 nt, Homo sapiens
gcaccaagaagaugaugga

SEQ ID NO: 732947 - RNA, 19 nt, Homo sapiens
gcuguuggcaguucuuauu

SEQ ID NO: 732948 - RNA, 19 nt, Homo sapiens
gaauauauggacuuagcaa

SEQ ID NO: 732949 - RNA, 19 nt, Homo sapiens
cagcaaugcgaauaacuaa

SEQ ID NO: 732950 - RNA, 19 nt, Homo sapiens
agcagaauaugccaucuuu

SEQ ID NO: 732951 - RNA, 19 nt, Homo sapiens
agugaaggguagcagaaua

SEQ ID NO: 732952 - RNA, 19 nt, Homo sapiens
gagaaaugaagcaacaguu

SEQ ID NO: 732953 - RNA, 19 nt, Homo sapiens
ucaggaagacguuacuuug

SEQ ID NO: 732954 - RNA, 19 nt, Homo sapiens
acaagugacucguggauac

SEQ ID NO: 732955 - RNA, 19 nt, Homo sapiens
gcucaucacgaacuaauuc

SEQ ID NO: 732956 - RNA, 19 nt, Homo sapiens
agaaagagauggagaagau

SEQ ID NO: 732957 - RNA, 19 nt, Homo sapiens
gaaaccaaauuagacaaga

SEQ ID NO: 732958 - RNA, 19 nt, Homo sapiens
cgacugggcuuacuacaag

SEQ ID NO: 732959 - RNA, 19 nt, Homo sapiens
ccagguggaugccgaagaa

SEQ ID NO: 732960 - RNA, 19 nt, Homo sapiens
gagaagaugaagaacuuaa

SEQ ID NO: 732961 - RNA, 19 nt, Homo sapiens
uggagaagaugaagaacuu

SEQ ID NO: 732962 - RNA, 19 nt, Homo sapiens
caaaauggcugggcgaaaa

SEQ ID NO: 732963 - RNA, 19 nt, Homo sapiens
ggccaggauuguagaauau

SEQ ID NO: 732964 - RNA, 19 nt, Homo sapiens
gcgaaaacuugcucuaaaa

SEQ ID NO: 732965 - RNA, 19 nt, Homo sapiens
ccaggauuguagaauauga

SEQ ID NO: 732966 - RNA, 19 nt, Homo sapiens
uggaugacuuugagaagaa

SEQ ID NO: 732967 - RNA, 19 nt, Homo sapiens
aggccaggauuguagaaua

SEQ ID NO: 732968 - RNA, 19 nt, Homo sapiens
guggaugacuuugagaaga

SEQ ID NO: 732969 - RNA, 19 nt, Homo sapiens
uugaucagaugaccauuga

SEQ ID NO: 732970 - RNA, 19 nt, Homo sapiens
ggagaagaugaagaacuua

SEQ ID NO: 732971 - RNA, 19 nt, Homo sapiens
uacacauucuggacauuaa

SEQ ID NO: 732972 - RNA, 19 nt, Homo sapiens
ggugaaggaucccaaaaug

SEQ ID NO: 732973 - RNA, 19 nt, Homo sapiens
aaagagauggagaagauga

SEQ ID NO: 732974 - RNA, 19 nt, Homo sapiens
gaaguuuaaugcgcugaag

SEQ ID NO: 732975 - RNA, 19 nt, Homo sapiens
cugaaauccuggaaugaga

SEQ ID NO: 732976 - RNA, 19 nt, Homo sapiens
uuacacauucuggacauua

SEQ ID NO: 732977 - RNA, 19 nt, Homo sapiens
ggcgaaaacuugcucuaaa

SEQ ID NO: 732978 - RNA, 19 nt, Homo sapiens
ucaaaggccaggauuguag

SEQ ID NO: 732979 - RNA, 19 nt, Homo sapiens
gaagcucuggcccuuguau

SEQ ID NO: 732980 - RNA, 19 nt, Homo sapiens
gaaagagauggagaagaug

SEQ ID NO: 732981 - RNA, 19 nt, Homo sapiens
gugggugucucucucaaag

SEQ ID NO: 732982 - RNA, 19 nt, Homo sapiens
gagaaagagauggagaaga

SEQ ID NO: 732983 - RNA, 19 nt, Homo sapiens
caaaggccaggauuguaga

SEQ ID NO: 732984 - RNA, 19 nt, Homo sapiens
ucccugaaauccuggaaug

SEQ ID NO: 732985 - RNA, 19 nt, Homo sapiens
gaugaagaacuuaauucca

SEQ ID NO: 732986 - RNA, 19 nt, Homo sapiens
agauggagaagaugaagaa

SEQ ID NO: 732987 - RNA, 19 nt, Homo sapiens
ccuccagguuggcugcuuu

SEQ ID NO: 732988 - RNA, 19 nt, Homo sapiens
aggaagcucuggcccuugu

SEQ ID NO: 732989 - RNA, 19 nt, Homo sapiens
gccagaggauaaauauacu

SEQ ID NO: 732990 - RNA, 19 nt, Homo sapiens
gagauggagaagaugaaga

SEQ ID NO: 732991 - RNA, 19 nt, Homo sapiens
gagugggugucucucucaa

SEQ ID NO: 732992 - RNA, 19 nt, Homo sapiens
uguagaauaugagaaagag

SEQ ID NO: 732993 - RNA, 19 nt, Homo sapiens
aaaaggccauugcuaguuc

SEQ ID NO: 732994 - RNA, 19 nt, Homo sapiens
ggaugacuuugagaagaag

SEQ ID NO: 732995 - RNA, 19 nt, Homo sapiens
ugccagaggauaaauauac

SEQ ID NO: 732996 - RNA, 19 nt, Homo sapiens
uauuacacauucuggacau

SEQ ID NO: 732997 - RNA, 19 nt, Homo sapiens
gaucauaccccagaaccaa

SEQ ID NO: 732998 - RNA, 19 nt, Homo sapiens
ucucaaaggccaggauugu

SEQ ID NO: 732999 - RNA, 19 nt, Homo sapiens
gagaauccaccagcuaucg

SEQ ID NO: 733000 - RNA, 19 nt, Homo sapiens
ccugagaauccaccagcua

SEQ ID NO: 733001 - RNA, 19 nt, Homo sapiens
caaaaggccauugcuaguu

SEQ ID NO: 733002 - RNA, 19 nt, Homo sapiens
gaauggagaucaacuauac

SEQ ID NO: 733003 - RNA, 19 nt, Homo sapiens
ggacuucuguguauauguu

SEQ ID NO: 733004 - RNA, 19 nt, Homo sapiens
gcaaaucuuuauagccuuu

SEQ ID NO: 733005 - RNA, 19 nt, Homo sapiens
caagagauacgcaacauaa

SEQ ID NO: 733006 - RNA, 19 nt, Homo sapiens
caaaaccacugcuaaguua

SEQ ID NO: 733007 - RNA, 19 nt, Homo sapiens
agagauaacuucaccaaga

SEQ ID NO: 733008 - RNA, 19 nt, Homo sapiens
caauaaacaugcuccugaa

SEQ ID NO: 733009 - RNA, 19 nt, Homo sapiens
gcauagccacucaguauuu

SEQ ID NO: 733010 - RNA, 19 nt, Homo sapiens
gagauaacuucaccaagau

SEQ ID NO: 733011 - RNA, 19 nt, Homo sapiens
uaaaugcuaucaagaguag

SEQ ID NO: 733012 - RNA, 19 nt, Homo sapiens
agaaggagcuagcugaaau

SEQ ID NO: 733013 - RNA, 19 nt, Homo sapiens
guagaacuuuguagcugua

SEQ ID NO: 733014 - RNA, 19 nt, Homo sapiens
gaaggagcuagcugaaaua

SEQ ID NO: 733015 - RNA, 19 nt, Homo sapiens
gacaguggaccaagagaua

SEQ ID NO: 733016 - RNA, 19 nt, Homo sapiens
caacuggagucccgcuuug

SEQ ID NO: 733017 - RNA, 19 nt, Homo sapiens
ggagcuagcugaaauaacc

SEQ ID NO: 733018 - RNA, 19 nt, Homo sapiens
uaauuuguaugcaguguga

SEQ ID NO: 733019 - RNA, 19 nt, Homo sapiens
gguaaaugcuaucaagagu

SEQ ID NO: 733020 - RNA, 19 nt, Homo sapiens
gagauacgcaacauaauuc

SEQ ID NO: 733021 - RNA, 19 nt, Homo sapiens
ccugaagucuaccaaauau

SEQ ID NO: 733022 - RNA, 19 nt, Homo sapiens
accaagauguccagugaua

SEQ ID NO: 733023 - RNA, 19 nt, Homo sapiens
aaagguaaaugcuaucaag

SEQ ID NO: 733024 - RNA, 19 nt, Homo sapiens
ucacugugcugcaaaucuu

SEQ ID NO: 733025 - RNA, 19 nt, Homo sapiens
auaugaaggugguguguuu

SEQ ID NO: 733026 - RNA, 19 nt, Homo sapiens
gcuaaguuauccacuagug

SEQ ID NO: 733027 - RNA, 19 nt, Homo sapiens
guaaaugcuaucaagagua

SEQ ID NO: 733028 - RNA, 19 nt, Homo sapiens
gagaucaacuauacuuggu

SEQ ID NO: 733029 - RNA, 19 nt, Homo sapiens
acaccaaacucucuagcaa

SEQ ID NO: 733030 - RNA, 19 nt, Homo sapiens
gcaaagguccgaugaugag

SEQ ID NO: 733031 - RNA, 19 nt, Homo sapiens
gagcagaacacgacaggau

SEQ ID NO: 733032 - RNA, 19 nt, Homo sapiens
aagcauagccacucaguau

SEQ ID NO: 733033 - RNA, 19 nt, Homo sapiens
uaucaagaguagaacuuug

SEQ ID NO: 733034 - RNA, 19 nt, Homo sapiens
caagagauaacuucaccaa

SEQ ID NO: 733035 - RNA, 19 nt, Homo sapiens
ggacauccuuaaagacaac

SEQ ID NO: 733036 - RNA, 19 nt, Homo sapiens
uagcugaaauaacccuuga

SEQ ID NO: 733037 - RNA, 19 nt, Homo sapiens
agagauacgcaacauaauu

SEQ ID NO: 733038 - RNA, 19 nt, Homo sapiens
guauuaaacccagaucuau

SEQ ID NO: 733039 - RNA, 19 nt, Homo sapiens
cauagccacucaguauuug

SEQ ID NO: 733040 - RNA, 19 nt, Homo sapiens
guccugaagucuaccaaau

SEQ ID NO: 733041 - RNA, 19 nt, Homo sapiens
cuuuguagcuguagauuag

SEQ ID NO: 733042 - RNA, 19 nt, Homo sapiens
gaacuuuguagcuguagau

SEQ ID NO: 733043 - RNA, 19 nt, Homo sapiens
caauacggacuucugugua

SEQ ID NO: 733044 - RNA, 19 nt, Homo sapiens
gaagcauagccacucagua

SEQ ID NO: 733045 - RNA, 19 nt, Homo sapiens
gaagaacaagaggaaagaa

SEQ ID NO: 733046 - RNA, 19 nt, Homo sapiens
ugaauggagaucaacuaua

SEQ ID NO: 733047 - RNA, 19 nt, Homo sapiens
ccuaaaggagauaacauuu

SEQ ID NO: 733048 - RNA, 19 nt, Homo sapiens
ccaagagauacgcaacaua

SEQ ID NO: 733049 - RNA, 19 nt, Homo sapiens
gcagaacacgacaggauag

SEQ ID NO: 733050 - RNA, 19 nt, Homo sapiens
guuauccacuagugcuaaa

SEQ ID NO: 733051 - RNA, 19 nt, Homo sapiens
gcaaaaccacugcuaaguu

SEQ ID NO: 733052 - RNA, 19 nt, Homo sapiens
guaugugguucaugcuguu

SEQ ID NO: 733053 - RNA, 19 nt, Homo sapiens
ggauacugguccugaaguc

SEQ ID NO: 733054 - RNA, 19 nt, Homo sapiens
gccagacaguggaccaaga

SEQ ID NO: 733055 - RNA, 19 nt, Homo sapiens
ggcaaagguccgaugauga

SEQ ID NO: 733056 - RNA, 19 nt, Homo sapiens
gccuaaaggagauaacauu

SEQ ID NO: 733057 - RNA, 19 nt, Homo sapiens
aggcaaagguccgaugaug

SEQ ID NO: 733058 - RNA, 19 nt, Homo sapiens
uguauuaaacccagaucua

SEQ ID NO: 733059 - RNA, 19 nt, Homo sapiens
gcuguagauuaguuauguu

SEQ ID NO: 733060 - RNA, 19 nt, Homo sapiens
gucuggacauccuuaaaga

SEQ ID NO: 733061 - RNA, 19 nt, Homo sapiens
gaucuauuucugaguaugu

SEQ ID NO: 733062 - RNA, 19 nt, Homo sapiens
gauaacuucaccaagaugu

SEQ ID NO: 733063 - RNA, 19 nt, Homo sapiens
uuuaagccaccaaagguua

SEQ ID NO: 733064 - RNA, 19 nt, Homo sapiens
cuaaaagaauucagaagga

SEQ ID NO: 733065 - RNA, 19 nt, Homo sapiens
uccagagccugaagaacaa

SEQ ID NO: 733066 - RNA, 19 nt, Homo sapiens
ugaaauaacccuugauccu

SEQ ID NO: 733067 - RNA, 19 nt, Homo sapiens
ucaagaguagaacuuugua

SEQ ID NO: 733068 - RNA, 19 nt, Homo sapiens
cgcaacauaauucacauaa

SEQ ID NO: 733069 - RNA, 19 nt, Homo sapiens
ggaagcauagccacucagu

SEQ ID NO: 733070 - RNA, 19 nt, Homo sapiens
gcugaaauaacccuugauc

SEQ ID NO: 733071 - RNA, 19 nt, Homo sapiens
caccagcaguggcaguuca

SEQ ID NO: 733072 - RNA, 19 nt, Homo sapiens
caccaaacucucuagcaaa

SEQ ID NO: 733073 - RNA, 19 nt, Homo sapiens
gcuaucaagaguagaacuu

SEQ ID NO: 733074 - RNA, 19 nt, Homo sapiens
gcagugugaaggagcagaa

SEQ ID NO: 733075 - RNA, 19 nt, Homo sapiens
ugaagaacaagaggaaaga

SEQ ID NO: 733076 - RNA, 19 nt, Homo sapiens
caagauguccagugauagg

SEQ ID NO: 733077 - RNA, 19 nt, Homo sapiens
aagaacaagaggaaagaaa

SEQ ID NO: 733078 - RNA, 19 nt, Homo sapiens
ccaccggguucuguauaug

SEQ ID NO: 733079 - RNA, 19 nt, Homo sapiens
cagaaggagcuagcugaaa

SEQ ID NO: 733080 - RNA, 19 nt, Homo sapiens
ggauuuccuuuuacccuuu

SEQ ID NO: 733081 - RNA, 19 nt, Homo sapiens
acugcuaaguuauccacua

SEQ ID NO: 733082 - RNA, 19 nt, Homo sapiens
uaugaauggagaucaacua

SEQ ID NO: 733083 - RNA, 19 nt, Homo sapiens
cugcuaaguuauccacuag

SEQ ID NO: 733084 - RNA, 19 nt, Homo sapiens
cuaggaauuaugucauuug

SEQ ID NO: 733085 - RNA, 19 nt, Homo sapiens
ccacucaguauuugaccaa

SEQ ID NO: 733086 - RNA, 19 nt, Homo sapiens
gaaucuaucacugcaacau

SEQ ID NO: 733087 - RNA, 19 nt, Homo sapiens
cuccagagccugaagaaca

SEQ ID NO: 733088 - RNA, 19 nt, Homo sapiens
auacugguccugaagucua

SEQ ID NO: 733089 - RNA, 19 nt, Homo sapiens
acaauacggacuucugugu

SEQ ID NO: 733090 - RNA, 19 nt, Homo sapiens
uccugaagucuaccaaaua

SEQ ID NO: 733091 - RNA, 19 nt, Homo sapiens
gugcugcaaaucuuuauag

SEQ ID NO: 733092 - RNA, 19 nt, Homo sapiens
gaccaagagauacgcaaca

SEQ ID NO: 733093 - RNA, 19 nt, Homo sapiens
caacagucagggagucauc

SEQ ID NO: 733094 - RNA, 19 nt, Homo sapiens
cauuuaagccaccaaaggu

SEQ ID NO: 733095 - RNA, 19 nt, Homo sapiens
ggauaucacauuuucauca

SEQ ID NO: 733096 - RNA, 19 nt, Homo sapiens
caccggguucuguauauga

SEQ ID NO: 733097 - RNA, 19 nt, Homo sapiens
agagagcaccugauguauc

SEQ ID NO: 733098 - RNA, 19 nt, Homo sapiens
uuaccuuugucaguuugua

SEQ ID NO: 733099 - RNA, 19 nt, Homo sapiens
uuacaauacggacuucugu

SEQ ID NO: 733100 - RNA, 19 nt, Homo sapiens
gacaggauagccagacagu

SEQ ID NO: 733101 - RNA, 19 nt, Homo sapiens
aaaccacugcuaaguuauc

SEQ ID NO: 733102 - RNA, 19 nt, Homo sapiens
gaaggaaucucggcuuuau

SEQ ID NO: 733103 - RNA, 19 nt, Homo sapiens
gaaaguuugugaguguuua

SEQ ID NO: 733104 - RNA, 19 nt, Homo sapiens
ccaacaaacuacaaaggua

SEQ ID NO: 733105 - RNA, 19 nt, Homo sapiens
gcucucauguguaauguuu

SEQ ID NO: 733106 - RNA, 19 nt, Homo sapiens
ggucaaaggucaacauucu

SEQ ID NO: 733107 - RNA, 19 nt, Homo sapiens
gcucucauguuccuuguuu

SEQ ID NO: 733108 - RNA, 19 nt, Homo sapiens
uauaccagcuguucucuuu

SEQ ID NO: 733109 - RNA, 19 nt, Homo sapiens
ggagaucauuaaagaagaa

SEQ ID NO: 733110 - RNA, 19 nt, Homo sapiens
gcugccaccuucacaguua

SEQ ID NO: 733111 - RNA, 19 nt, Homo sapiens
ccacgggcaugacuuuauu

SEQ ID NO: 733112 - RNA, 19 nt, Homo sapiens
ggaauauucucuaucuucu

SEQ ID NO: 733113 - RNA, 19 nt, Homo sapiens
cccaaaugauucucuuaua

SEQ ID NO: 733114 - RNA, 19 nt, Homo sapiens
ggauacagcuagacuucga

SEQ ID NO: 733115 - RNA, 19 nt, Homo sapiens
caaaggccuugaagccaaa

SEQ ID NO: 733116 - RNA, 19 nt, Homo sapiens
guucaucauuggugcagua

SEQ ID NO: 733117 - RNA, 19 nt, Homo sapiens
ucagucaagucccaauaaa

SEQ ID NO: 733118 - RNA, 19 nt, Homo sapiens
ccacaaauguuacccucau

SEQ ID NO: 733119 - RNA, 19 nt, Homo sapiens
ugacagcaaugacaguguu

SEQ ID NO: 733120 - RNA, 19 nt, Homo sapiens
gaaucaauccuuucauuac

SEQ ID NO: 733121 - RNA, 19 nt, Homo sapiens
caacaaacuacaaagguau

SEQ ID NO: 733122 - RNA, 19 nt, Homo sapiens
gaaaauuguucacccaaau

SEQ ID NO: 733123 - RNA, 19 nt, Homo sapiens
gcuguucucuuucccugaa

SEQ ID NO: 733124 - RNA, 19 nt, Homo sapiens
aaacauugcugaaaaccua

SEQ ID NO: 733125 - RNA, 19 nt, Homo sapiens
gcaguuggacuaaugugaa

SEQ ID NO: 733126 - RNA, 19 nt, Homo sapiens
guugucaccuuaauuguca

SEQ ID NO: 733127 - RNA, 19 nt, Homo sapiens
aaugaaaguuugugagugu

SEQ ID NO: 733128 - RNA, 19 nt, Homo sapiens
gagcaaaauuuaggaauga

SEQ ID NO: 733129 - RNA, 19 nt, Homo sapiens
gguggcaguuggacuaaug

SEQ ID NO: 733130 - RNA, 19 nt, Homo sapiens
ugagacgccuucccaugaa

SEQ ID NO: 733131 - RNA, 19 nt, Homo sapiens
cgagggugguuuccaguga

SEQ ID NO: 733132 - RNA, 19 nt, Homo sapiens
gagacgccuucccaugaaa

SEQ ID NO: 733133 - RNA, 19 nt, Homo sapiens
gacuucagguugaugagaa

SEQ ID NO: 733134 - RNA, 19 nt, Homo sapiens
caugcuggcugguuggauu

SEQ ID NO: 733135 - RNA, 19 nt, Homo sapiens
guaagacguuuuggaauaa

SEQ ID NO: 733136 - RNA, 19 nt, Homo sapiens
gaaucucggcuuuauggaa

SEQ ID NO: 733137 - RNA, 19 nt, Homo sapiens
uacaagcccuggucaguca

SEQ ID NO: 733138 - RNA, 19 nt, Homo sapiens
uaaugggacucuacaaagg

SEQ ID NO: 733139 - RNA, 19 nt, Homo sapiens
caguuggacuaaugugaaa

SEQ ID NO: 733140 - RNA, 19 nt, Homo sapiens
ggaauaaugggacucuaca

SEQ ID NO: 733141 - RNA, 19 nt, Homo sapiens
gcuccaauuuugucuauuu

SEQ ID NO: 733142 - RNA, 19 nt, Homo sapiens
gcugaagcgugcacaccaa

SEQ ID NO: 733143 - RNA, 19 nt, Homo sapiens
ucaaagcacucugggucaa

SEQ ID NO: 733144 - RNA, 19 nt, Homo sapiens
aauaaauggucagcacaaa

SEQ ID NO: 733145 - RNA, 19 nt, Homo sapiens
ucaauccuuucauuacgaa

SEQ ID NO: 733146 - RNA, 19 nt, Homo sapiens
ccucauugcuguuggucuu

SEQ ID NO: 733147 - RNA, 19 nt, Homo sapiens
uggaaaagaucucguaguu

SEQ ID NO: 733148 - RNA, 19 nt, Homo sapiens
aguaagacguuuuggaaua

SEQ ID NO: 733149 - RNA, 19 nt, Homo sapiens
aaucucggcuuuauggaau

SEQ ID NO: 733150 - RNA, 19 nt, Homo sapiens
ggagcaaaauuuaggaaug

SEQ ID NO: 733151 - RNA, 19 nt, Homo sapiens
caggagugguuaauguguu

SEQ ID NO: 733152 - RNA, 19 nt, Homo sapiens
gaucauuaaagaagaagga

SEQ ID NO: 733153 - RNA, 19 nt, Homo sapiens
ggucagucaagucccaaua

SEQ ID NO: 733154 - RNA, 19 nt, Homo sapiens
gguucuaggacaaauuuaa

SEQ ID NO: 733155 - RNA, 19 nt, Homo sapiens
ccucacugcugcucucaug

SEQ ID NO: 733156 - RNA, 19 nt, Homo sapiens
aauaaugggacucuacaaa

SEQ ID NO: 733157 - RNA, 19 nt, Homo sapiens
uaaagaaacggaugaagcu

SEQ ID NO: 733158 - RNA, 19 nt, Homo sapiens
ugaagacauuguaccaaca

SEQ ID NO: 733159 - RNA, 19 nt, Homo sapiens
caauaaauggucagcacaa

SEQ ID NO: 733160 - RNA, 19 nt, Homo sapiens
agucaagucccaauaaaug

SEQ ID NO: 733161 - RNA, 19 nt, Homo sapiens
gaccuguugucaccuuaau

SEQ ID NO: 733162 - RNA, 19 nt, Homo sapiens
uggcacauuucccucauug

SEQ ID NO: 733163 - RNA, 19 nt, Homo sapiens
ugaaggaaucucggcuuua

SEQ ID NO: 733164 - RNA, 19 nt, Homo sapiens
ccagugauuuccagucucu

SEQ ID NO: 733165 - RNA, 19 nt, Homo sapiens
cagguucuaggacaaauuu

SEQ ID NO: 733166 - RNA, 19 nt, Homo sapiens
guuccuuguuuaugagaaa

SEQ ID NO: 733167 - RNA, 19 nt, Homo sapiens
ugugaguguuuauugguuu

SEQ ID NO: 733168 - RNA, 19 nt, Homo sapiens
ugagugaagagaagugauu

SEQ ID NO: 733169 - RNA, 19 nt, Homo sapiens
gaauaaugggacucuacaa

SEQ ID NO: 733170 - RNA, 19 nt, Homo sapiens
uacagucaauucugagguu

SEQ ID NO: 733171 - RNA, 19 nt, Homo sapiens
aagaaacggaugaagcuuu

SEQ ID NO: 733172 - RNA, 19 nt, Homo sapiens
cagcuagacuucgacuuca

SEQ ID NO: 733173 - RNA, 19 nt, Homo sapiens
gacuucgacuucagguuga

SEQ ID NO: 733174 - RNA, 19 nt, Homo sapiens
uccuggagaucauuaaaga

SEQ ID NO: 733175 - RNA, 19 nt, Homo sapiens
cggaauauucucuaucuuc

SEQ ID NO: 733176 - RNA, 19 nt, Homo sapiens
aaacagaacauugggaagu

SEQ ID NO: 733177 - RNA, 19 nt, Homo sapiens
uugcaggagugguuaaugu

SEQ ID NO: 733178 - RNA, 19 nt, Homo sapiens
gcacauuucccucauugcu

SEQ ID NO: 733179 - RNA, 19 nt, Homo sapiens
gguaaacaccagacugaag

SEQ ID NO: 733180 - RNA, 19 nt, Homo sapiens
gcaggagugguuaaugugu

SEQ ID NO: 733181 - RNA, 19 nt, Homo sapiens
gagggugguuuccagugau

SEQ ID NO: 733182 - RNA, 19 nt, Homo sapiens
uuaaauauaccagcuguuc

SEQ ID NO: 733183 - RNA, 19 nt, Homo sapiens
ggaccuguugucaccuuaa

SEQ ID NO: 733184 - RNA, 19 nt, Homo sapiens
augaaggaaucucggcuuu

SEQ ID NO: 733185 - RNA, 19 nt, Homo sapiens
ucacccaaaugauucucuu

SEQ ID NO: 733186 - RNA, 19 nt, Homo sapiens
ugaaaguuugugaguguuu

SEQ ID NO: 733187 - RNA, 19 nt, Homo sapiens
guaauucugcucaaauacu

SEQ ID NO: 733188 - RNA, 19 nt, Homo sapiens
ggaagcgugacagcaauga

SEQ ID NO: 733189 - RNA, 19 nt, Homo sapiens
cugagacgccuucccauga

SEQ ID NO: 733190 - RNA, 19 nt, Homo sapiens
uggcuuccgugcuguccua

SEQ ID NO: 733191 - RNA, 19 nt, Homo sapiens
ccuguugucaccuuaauug

SEQ ID NO: 733192 - RNA, 19 nt, Homo sapiens
gaagugauucucccuugac

SEQ ID NO: 733193 - RNA, 19 nt, Homo sapiens
ucacugcugcucucauguu

SEQ ID NO: 733194 - RNA, 19 nt, Homo sapiens
uggagaucauuaaagaaga

SEQ ID NO: 733195 - RNA, 19 nt, Homo sapiens
ucucguaguuggguuuguu

SEQ ID NO: 733196 - RNA, 19 nt, Homo sapiens
caaagcacucugggucaaa

SEQ ID NO: 733197 - RNA, 19 nt, Homo sapiens
agucucugcugcuccaauu

SEQ ID NO: 733198 - RNA, 19 nt, Homo sapiens
gucagucaagucccaauaa

SEQ ID NO: 733199 - RNA, 19 nt, Homo sapiens
acauguaauucugcucaaa

SEQ ID NO: 733200 - RNA, 19 nt, Homo sapiens
guuugggcgucauagacua

SEQ ID NO: 733201 - RNA, 19 nt, Homo sapiens
acgguacagucaauucuga

SEQ ID NO: 733202 - RNA, 19 nt, Homo sapiens
gcaaugugcuguuaaagua

SEQ ID NO: 733203 - RNA, 19 nt, Homo sapiens
gggaagagcugccaauauu

SEQ ID NO: 733204 - RNA, 19 nt, Homo sapiens
gaaguaagauuggaucaaa

SEQ ID NO: 733205 - RNA, 19 nt, Homo sapiens
gaagagcugccaauauuua

SEQ ID NO: 733206 - RNA, 19 nt, Homo sapiens
gcaacgagcugauggcauu

SEQ ID NO: 733207 - RNA, 19 nt, Homo sapiens
aaacuuaccugacacuuaa

SEQ ID NO: 733208 - RNA, 19 nt, Homo sapiens
ugacaaaguucaccaaauu

SEQ ID NO: 733209 - RNA, 19 nt, Homo sapiens
ccaacuaccuuacugguua

SEQ ID NO: 733210 - RNA, 19 nt, Homo sapiens
gaagagcacagaacaauuu

SEQ ID NO: 733211 - RNA, 19 nt, Homo sapiens
gauguuguguguucuguua

SEQ ID NO: 733212 - RNA, 19 nt, Homo sapiens
ccacaaaguuauucaaguu

SEQ ID NO: 733213 - RNA, 19 nt, Homo sapiens
guugauagcugcugccuuu

SEQ ID NO: 733214 - RNA, 19 nt, Homo sapiens
gcaauuucuuguuucguua

SEQ ID NO: 733215 - RNA, 19 nt, Homo sapiens
gauaauaccuaaagaugca

SEQ ID NO: 733216 - RNA, 19 nt, Homo sapiens
gcaccaaagucagucauaa

SEQ ID NO: 733217 - RNA, 19 nt, Homo sapiens
gcaaaugacuucugagacu

SEQ ID NO: 733218 - RNA, 19 nt, Homo sapiens
gcaccacgcuucugauugu

SEQ ID NO: 733219 - RNA, 19 nt, Homo sapiens
gaaaguguccucaaugaug

SEQ ID NO: 733220 - RNA, 19 nt, Homo sapiens
caaagucagucauaagaga

SEQ ID NO: 733221 - RNA, 19 nt, Homo sapiens
gcaugucucugaaugugua

SEQ ID NO: 733222 - RNA, 19 nt, Homo sapiens
gaugaugauucugaucuua

SEQ ID NO: 733223 - RNA, 19 nt, Homo sapiens
guucagggcacuugauuua

SEQ ID NO: 733224 - RNA, 19 nt, Homo sapiens
ggaaacaguucugaagaug

SEQ ID NO: 733225 - RNA, 19 nt, Homo sapiens
gaaagaugaugauucugau

SEQ ID NO: 733226 - RNA, 19 nt, Homo sapiens
caaugaugcuguugccaua

SEQ ID NO: 733227 - RNA, 19 nt, Homo sapiens
guaaauacuucgcaugaca

SEQ ID NO: 733228 - RNA, 19 nt, Homo sapiens
gcaggaaucccucccauga

SEQ ID NO: 733229 - RNA, 19 nt, Homo sapiens
gguacaacuuugaucauaa

SEQ ID NO: 733230 - RNA, 19 nt, Homo sapiens
gugaaaguguccucaauga

SEQ ID NO: 733231 - RNA, 19 nt, Homo sapiens
uaagguuucuuggcauuua

SEQ ID NO: 733232 - RNA, 19 nt, Homo sapiens
gaacugcucuuggacuugu

SEQ ID NO: 733233 - RNA, 19 nt, Homo sapiens
gcaucuaucugugcuauug

SEQ ID NO: 733234 - RNA, 19 nt, Homo sapiens
ggugacagcuuuagugaca

SEQ ID NO: 733235 - RNA, 19 nt, Homo sapiens
gaagugcagucaaguccaa

SEQ ID NO: 733236 - RNA, 19 nt, Homo sapiens
uuacugaccucacuuuaug

SEQ ID NO: 733237 - RNA, 19 nt, Homo sapiens
gaagguaacgggacaacuu

SEQ ID NO: 733238 - RNA, 19 nt, Homo sapiens
ggaaacugauaaagcuuga

SEQ ID NO: 733239 - RNA, 19 nt, Homo sapiens
gaagaaauuuguacuaccu

SEQ ID NO: 733240 - RNA, 19 nt, Homo sapiens
gaacuggucauucgaggaa

SEQ ID NO: 733241 - RNA, 19 nt, Homo sapiens
gaaaggagaacuaccaaag

SEQ ID NO: 733242 - RNA, 19 nt, Homo sapiens
ugacuguucuugcuauauu

SEQ ID NO: 733243 - RNA, 19 nt, Homo sapiens
gcuugaacguugcaucuuu

SEQ ID NO: 733244 - RNA, 19 nt, Homo sapiens
ccaguuagaacauugauuu

SEQ ID NO: 733245 - RNA, 19 nt, Homo sapiens
agacaacagucacaccuuu

SEQ ID NO: 733246 - RNA, 19 nt, Homo sapiens
gcauucauguuccgaguga

SEQ ID NO: 733247 - RNA, 19 nt, Homo sapiens
gaaccuacgcguuugaaug

SEQ ID NO: 733248 - RNA, 19 nt, Homo sapiens
gcaaacacuccuugagauu

SEQ ID NO: 733249 - RNA, 19 nt, Homo sapiens
gcagcaggguggcuccuuu

SEQ ID NO: 733250 - RNA, 19 nt, Homo sapiens
uaaacuuaccugacacuua

SEQ ID NO: 733251 - RNA, 19 nt, Homo sapiens
gggaaacaguucugaagau

SEQ ID NO: 733252 - RNA, 19 nt, Homo sapiens
gacaaaguucaccaaauua

SEQ ID NO: 733253 - RNA, 19 nt, Homo sapiens
cgagugauguaaauaaugu

SEQ ID NO: 733254 - RNA, 19 nt, Homo sapiens
agacuuuccucuccucuaa

SEQ ID NO: 733255 - RNA, 19 nt, Homo sapiens
uucaguaacucgucuauuu

SEQ ID NO: 733256 - RNA, 19 nt, Homo sapiens
agcauugccuuaaaucuua

SEQ ID NO: 733257 - RNA, 19 nt, Homo sapiens
guacacuguuguucagaaa

SEQ ID NO: 733258 - RNA, 19 nt, Homo sapiens
ucacagcgauguucaaguc

SEQ ID NO: 733259 - RNA, 19 nt, Homo sapiens
ccuuaaaucuuauccaguu

SEQ ID NO: 733260 - RNA, 19 nt, Homo sapiens
gaacuuacugugucuaauc

SEQ ID NO: 733261 - RNA, 19 nt, Homo sapiens
guaaagagaauggugguuu

SEQ ID NO: 733262 - RNA, 19 nt, Homo sapiens
gcagagagugcuuggcuuu

SEQ ID NO: 733263 - RNA, 19 nt, Homo sapiens
guugaaagaugaugauucu

SEQ ID NO: 733264 - RNA, 19 nt, Homo sapiens
gguagaagaaguaagauug

SEQ ID NO: 733265 - RNA, 19 nt, Homo sapiens
ggaagagcugccaauauuu

SEQ ID NO: 733266 - RNA, 19 nt, Homo sapiens
aaaucugccuucauacuuu

SEQ ID NO: 733267 - RNA, 19 nt, Homo sapiens
uaaagagaauggugguuuc

SEQ ID NO: 733268 - RNA, 19 nt, Homo sapiens
cagccuaagcuuacuaaua

SEQ ID NO: 733269 - RNA, 19 nt, Homo sapiens
gacaucaguuugacauaug

SEQ ID NO: 733270 - RNA, 19 nt, Homo sapiens
ugaaagaugaugauucuga

SEQ ID NO: 733271 - RNA, 19 nt, Homo sapiens
uaacccaacauuuguagua

SEQ ID NO: 733272 - RNA, 19 nt, Homo sapiens
ugaaugaacuuugaugaag

SEQ ID NO: 733273 - RNA, 19 nt, Homo sapiens
ugaaacaccugaaugaacu

SEQ ID NO: 733274 - RNA, 19 nt, Homo sapiens
ucagggcacuugauuuaga

SEQ ID NO: 733275 - RNA, 19 nt, Homo sapiens
gaaagcacagauucauuga

SEQ ID NO: 733276 - RNA, 19 nt, Homo sapiens
ugacaucaguuugacauau

SEQ ID NO: 733277 - RNA, 19 nt, Homo sapiens
gaaaccggccuggcuauga

SEQ ID NO: 733278 - RNA, 19 nt, Homo sapiens
caaggagauuuaugggaaa

SEQ ID NO: 733279 - RNA, 19 nt, Homo sapiens
aauaauguauggcugugua

SEQ ID NO: 733280 - RNA, 19 nt, Homo sapiens
ugaguagcauugccuuaaa

SEQ ID NO: 733281 - RNA, 19 nt, Homo sapiens
gagacaugguccagccuaa

SEQ ID NO: 733282 - RNA, 19 nt, Homo sapiens
ccacugcaaugcugucaug

SEQ ID NO: 733283 - RNA, 19 nt, Homo sapiens
cuaccuuacugguuacuuu

SEQ ID NO: 733284 - RNA, 19 nt, Homo sapiens
gcuaugauuuauggucuuu

SEQ ID NO: 733285 - RNA, 19 nt, Homo sapiens
uuacaguucucaaggaaga

SEQ ID NO: 733286 - RNA, 19 nt, Homo sapiens
gaucuuauucucaaugaug

SEQ ID NO: 733287 - RNA, 19 nt, Homo sapiens
caaacacuccuugagauuu

SEQ ID NO: 733288 - RNA, 19 nt, Homo sapiens
ggaagagcacagaacaauu

SEQ ID NO: 733289 - RNA, 19 nt, Homo sapiens
gaauggugguuucagagau

SEQ ID NO: 733290 - RNA, 19 nt, Homo sapiens
ugacagcuuuagugacaaa

SEQ ID NO: 733291 - RNA, 19 nt, Homo sapiens
aaucugccuucauacuuua

SEQ ID NO: 733292 - RNA, 19 nt, Homo sapiens
gaguagcauugccuuaaau

SEQ ID NO: 733293 - RNA, 19 nt, Homo sapiens
caaaugacuucugagacuu

SEQ ID NO: 733294 - RNA, 19 nt, Homo sapiens
gcgccaaccugcucaucuu

SEQ ID NO: 733295 - RNA, 19 nt, Homo sapiens
aaagaaggcugcaaaugac

SEQ ID NO: 733296 - RNA, 19 nt, Homo sapiens
guacaacuuugaucauaac

SEQ ID NO: 733297 - RNA, 19 nt, Homo sapiens
caggguggcuccuuugugu

SEQ ID NO: 733298 - RNA, 19 nt, Homo sapiens
gaccaagaccguagaagga

SEQ ID NO: 733299 - RNA, 19 nt, Homo sapiens
gagggaguguuauuuccuu

SEQ ID NO: 733300 - RNA, 19 nt, Homo sapiens
caggaacaguugaaagaug

SEQ ID NO: 733301 - RNA, 19 nt, Homo sapiens
acaagcacauuauacguau

SEQ ID NO: 733302 - RNA, 19 nt, Homo sapiens
gcaagaagcuuugauugaa

SEQ ID NO: 733303 - RNA, 19 nt, Homo sapiens
gugcuuaucugaaaucuaa

SEQ ID NO: 733304 - RNA, 19 nt, Homo sapiens
caacugagcuggaucaagu

SEQ ID NO: 733305 - RNA, 19 nt, Homo sapiens
gaaggaggaugauaaagau

SEQ ID NO: 733306 - RNA, 19 nt, Homo sapiens
uaaaggagcugagauuuca

SEQ ID NO: 733307 - RNA, 19 nt, Homo sapiens
gauuggagcugaugauguu

SEQ ID NO: 733308 - RNA, 19 nt, Homo sapiens
uaagaauacuccuguaaga

SEQ ID NO: 733309 - RNA, 19 nt, Homo sapiens
caagaagcuuugauugaaa

SEQ ID NO: 733310 - RNA, 19 nt, Homo sapiens
gugaaaagcuggucaaauu

SEQ ID NO: 733311 - RNA, 19 nt, Homo sapiens
gugcuaaauuggcaucaua

SEQ ID NO: 733312 - RNA, 19 nt, Homo sapiens
gauaagaauacuccuguaa

SEQ ID NO: 733313 - RNA, 19 nt, Homo sapiens
cgacaucagugaagaagau

SEQ ID NO: 733314 - RNA, 19 nt, Homo sapiens
ggcaucauaugucaaguuu

SEQ ID NO: 733315 - RNA, 19 nt, Homo sapiens
agaauacuccuguaagaua

SEQ ID NO: 733316 - RNA, 19 nt, Homo sapiens
ggauaagaauacuccugua

SEQ ID NO: 733317 - RNA, 19 nt, Homo sapiens
uggaauugcucggaaguua

SEQ ID NO: 733318 - RNA, 19 nt, Homo sapiens
cuuaaugccuggaaacaaa

SEQ ID NO: 733319 - RNA, 19 nt, Homo sapiens
gauguugaagcauuuguua

SEQ ID NO: 733320 - RNA, 19 nt, Homo sapiens
ugaaagauccaaaugcauu

SEQ ID NO: 733321 - RNA, 19 nt, Homo sapiens
cugcugagcuucgugcuua

SEQ ID NO: 733322 - RNA, 19 nt, Homo sapiens
aaggcgagcuuauucauga

SEQ ID NO: 733323 - RNA, 19 nt, Homo sapiens
guacgagcauugaaagauc

SEQ ID NO: 733324 - RNA, 19 nt, Homo sapiens
gcaagaacuucagauugga

SEQ ID NO: 733325 - RNA, 19 nt, Homo sapiens
ggaggaugauaaagauguu

SEQ ID NO: 733326 - RNA, 19 nt, Homo sapiens
gaauacuccuguaagauac

SEQ ID NO: 733327 - RNA, 19 nt, Homo sapiens
gcagcaagaacuucagauu

SEQ ID NO: 733328 - RNA, 19 nt, Homo sapiens
ugaccaccuucuuacuuua

SEQ ID NO: 733329 - RNA, 19 nt, Homo sapiens
ggugaacgcccgucucuga

SEQ ID NO: 733330 - RNA, 19 nt, Homo sapiens
ugaaggaggaugauaaaga

SEQ ID NO: 733331 - RNA, 19 nt, Homo sapiens
ggucaaauuucgcgaaggu

SEQ ID NO: 733332 - RNA, 19 nt, Homo sapiens
gcacacaucggacauuugg

SEQ ID NO: 733333 - RNA, 19 nt, Homo sapiens
gaaaaguaguugucaguca

SEQ ID NO: 733334 - RNA, 19 nt, Homo sapiens
guugaagcauuuguuauug

SEQ ID NO: 733335 - RNA, 19 nt, Homo sapiens
gaauggcaguagaaaauaa

SEQ ID NO: 733336 - RNA, 19 nt, Homo sapiens
ucacuuggccuguuacaug

SEQ ID NO: 733337 - RNA, 19 nt, Homo sapiens
uagcacacaucggacauuu

SEQ ID NO: 733338 - RNA, 19 nt, Homo sapiens
ggaaauuucuuuugacaca

SEQ ID NO: 733339 - RNA, 19 nt, Homo sapiens
ugauucacuuggccuguua

SEQ ID NO: 733340 - RNA, 19 nt, Homo sapiens
gaaguuacacagaggacaa

SEQ ID NO: 733341 - RNA, 19 nt, Homo sapiens
ccacagguguauuguacga

SEQ ID NO: 733342 - RNA, 19 nt, Homo sapiens
guguauugcagccuuauua

SEQ ID NO: 733343 - RNA, 19 nt, Homo sapiens
gcccacagguguauuguac

SEQ ID NO: 733344 - RNA, 19 nt, Homo sapiens
acuggaaucucaccacuga

SEQ ID NO: 733345 - RNA, 19 nt, Homo sapiens
cagcaagaacuucagauug

SEQ ID NO: 733346 - RNA, 19 nt, Homo sapiens
uaaauuggcaucauauguc

SEQ ID NO: 733347 - RNA, 19 nt, Homo sapiens
gcacuuguggauuguaaga

SEQ ID NO: 733348 - RNA, 19 nt, Homo sapiens
cugaugauguugaagcauu

SEQ ID NO: 733349 - RNA, 19 nt, Homo sapiens
gcuucgugcuuaucugaaa

SEQ ID NO: 733350 - RNA, 19 nt, Homo sapiens
ugagcuggaucaaguuaga

SEQ ID NO: 733351 - RNA, 19 nt, Homo sapiens
aaagugugaugaacagugu

SEQ ID NO: 733352 - RNA, 19 nt, Homo sapiens
gaaggcgagcuuauucaug

SEQ ID NO: 733353 - RNA, 19 nt, Homo sapiens
caaaagucaugguggaauu

SEQ ID NO: 733354 - RNA, 19 nt, Homo sapiens
uaaaguggcagcaucuugu

SEQ ID NO: 733355 - RNA, 19 nt, Homo sapiens
gagcuucgugcuuaucuga

SEQ ID NO: 733356 - RNA, 19 nt, Homo sapiens
ugaugauguugaagcauuu

SEQ ID NO: 733357 - RNA, 19 nt, Homo sapiens
aaauuggcaucauauguca

SEQ ID NO: 733358 - RNA, 19 nt, Homo sapiens
gagcuuauucaugaucuuu

SEQ ID NO: 733359 - RNA, 19 nt, Homo sapiens
uggacuucauguugauuua

SEQ ID NO: 733360 - RNA, 19 nt, Homo sapiens
auugaaagccuaugugaaa

SEQ ID NO: 733361 - RNA, 19 nt, Homo sapiens
gaacucggaagguggacuu

SEQ ID NO: 733362 - RNA, 19 nt, Homo sapiens
gaccaccuucuuacuuuaa

SEQ ID NO: 733363 - RNA, 19 nt, Homo sapiens
uugaccaccuucuuacuuu

SEQ ID NO: 733364 - RNA, 19 nt, Homo sapiens
aagguggacuucauguuga

SEQ ID NO: 733365 - RNA, 19 nt, Homo sapiens
gaauugcucggaaguuaca

SEQ ID NO: 733366 - RNA, 19 nt, Homo sapiens
guauugcagccuuauuaaa

SEQ ID NO: 733367 - RNA, 19 nt, Homo sapiens
agacugcaguuguuaagca

SEQ ID NO: 733368 - RNA, 19 nt, Homo sapiens
agcaagaacuucagauugg

SEQ ID NO: 733369 - RNA, 19 nt, Homo sapiens
cacuuggccuguuacauga

SEQ ID NO: 733370 - RNA, 19 nt, Homo sapiens
gcacacccuuuuaagacua

SEQ ID NO: 733371 - RNA, 19 nt, Homo sapiens
caacuguaugacacacuua

SEQ ID NO: 733372 - RNA, 19 nt, Homo sapiens
acacaucggacauuuggaa

SEQ ID NO: 733373 - RNA, 19 nt, Homo sapiens
cuaaaggagcugagauuuc

SEQ ID NO: 733374 - RNA, 19 nt, Homo sapiens
agacuucauugauucacuu

SEQ ID NO: 733375 - RNA, 19 nt, Homo sapiens
agagugaugcugcuucaaa

SEQ ID NO: 733376 - RNA, 19 nt, Homo sapiens
ugaagccugugaugugugu

SEQ ID NO: 733377 - RNA, 19 nt, Homo sapiens
ggaaggcgagcuuauucau

SEQ ID NO: 733378 - RNA, 19 nt, Homo sapiens
gagcauugaaagauccaaa

SEQ ID NO: 733379 - RNA, 19 nt, Homo sapiens
acaguguauugcagccuua

SEQ ID NO: 733380 - RNA, 19 nt, Homo sapiens
gauugaaagccuaugugaa

SEQ ID NO: 733381 - RNA, 19 nt, Homo sapiens
ggaaccagacaagcaagaa

SEQ ID NO: 733382 - RNA, 19 nt, Homo sapiens
aaaguaguugucagucaua

SEQ ID NO: 733383 - RNA, 19 nt, Homo sapiens
cuaaauuggcaucauaugu

SEQ ID NO: 733384 - RNA, 19 nt, Homo sapiens
acaacuguaugacacacuu

SEQ ID NO: 733385 - RNA, 19 nt, Homo sapiens
augaggcacuuguggauug

SEQ ID NO: 733386 - RNA, 19 nt, Homo sapiens
uggaaucucaccacugaaa

SEQ ID NO: 733387 - RNA, 19 nt, Homo sapiens
gaaccagacaagcaagaag

SEQ ID NO: 733388 - RNA, 19 nt, Homo sapiens
ugugguaucccuacucuug

SEQ ID NO: 733389 - RNA, 19 nt, Homo sapiens
gagugaugcugcuucaaaa

SEQ ID NO: 733390 - RNA, 19 nt, Homo sapiens
gcaacaacuguaugacaca

SEQ ID NO: 733391 - RNA, 19 nt, Homo sapiens
guaguugucagucauagca

SEQ ID NO: 733392 - RNA, 19 nt, Homo sapiens
gacugcaguuguuaagcaa

SEQ ID NO: 733393 - RNA, 19 nt, Homo sapiens
caaauuucgcgaaggugaa

SEQ ID NO: 733394 - RNA, 19 nt, Homo sapiens
ggaauggcaguagaaaaua

SEQ ID NO: 733395 - RNA, 19 nt, Homo sapiens
gggaauggcaguagaaaau

SEQ ID NO: 733396 - RNA, 19 nt, Homo sapiens
uauugaagccugugaugug

SEQ ID NO: 733397 - RNA, 19 nt, Homo sapiens
gaugaacagugugguaucc

SEQ ID NO: 733398 - RNA, 19 nt, Homo sapiens
gauaaagauguugaaagug

SEQ ID NO: 733399 - RNA, 19 nt, Homo sapiens
aggcacuuguggauuguaa

SEQ ID NO: 733400 - RNA, 19 nt, Homo sapiens
ugauugaaagccuauguga

SEQ ID NO: 733401 - RNA, 19 nt, Homo sapiens
gaucagacccagagaaaag

SEQ ID NO: 733402 - RNA, 19 nt, Homo sapiens
gaacagcgcuaccccuuaa

SEQ ID NO: 733403 - RNA, 19 nt, Homo sapiens
ccacugaguuugccuucua

SEQ ID NO: 733404 - RNA, 19 nt, Homo sapiens
ccaccaggguucccaaaga

SEQ ID NO: 733405 - RNA, 19 nt, Homo sapiens
gcaauuaugccaccuugga

SEQ ID NO: 733406 - RNA, 19 nt, Homo sapiens
gcaauaaucacgauaacca

SEQ ID NO: 733407 - RNA, 19 nt, Homo sapiens
gaacccaccaggucccuuu

SEQ ID NO: 733408 - RNA, 19 nt, Homo sapiens
gagcugggagcgauuuaaa

SEQ ID NO: 733409 - RNA, 19 nt, Homo sapiens
caccaggguucccaaagaa

SEQ ID NO: 733410 - RNA, 19 nt, Homo sapiens
cuaacaaguucaucaccaa

SEQ ID NO: 733411 - RNA, 19 nt, Homo sapiens
gacaagaggcgcaagaucu

SEQ ID NO: 733412 - RNA, 19 nt, Homo sapiens
gaugccugcugucaacuau

SEQ ID NO: 733413 - RNA, 19 nt, Homo sapiens
gccaaggacucugcugaga

SEQ ID NO: 733414 - RNA, 19 nt, Homo sapiens
guaugcggcuaacaaguuc

SEQ ID NO: 733415 - RNA, 19 nt, Homo sapiens
gggaguaugcggcuaacaa

SEQ ID NO: 733416 - RNA, 19 nt, Homo sapiens
gcugaugccugcugucaac

SEQ ID NO: 733417 - RNA, 19 nt, Homo sapiens
ggacaagaggcgcaagauc

SEQ ID NO: 733418 - RNA, 19 nt, Homo sapiens
acaaguucaucaccaagga

SEQ ID NO: 733419 - RNA, 19 nt, Homo sapiens
ggucaaagagaagaagguu

SEQ ID NO: 733420 - RNA, 19 nt, Homo sapiens
ggaguaugcggcuaacaag

SEQ ID NO: 733421 - RNA, 19 nt, Homo sapiens
gcccagucauaaucauuca

SEQ ID NO: 733422 - RNA, 19 nt, Homo sapiens
ggauggagccaaggauauc

SEQ ID NO: 733423 - RNA, 19 nt, Homo sapiens
ggagaaccgcgacaugacu

SEQ ID NO: 733424 - RNA, 19 nt, Homo sapiens
guggcaauaaucacgauaa

SEQ ID NO: 733425 - RNA, 19 nt, Homo sapiens
accacgcuauggccaguua

SEQ ID NO: 733426 - RNA, 19 nt, Homo sapiens
aaucauucauccucacagu

SEQ ID NO: 733427 - RNA, 19 nt, Homo sapiens
ucccggagcucgcugaaac

SEQ ID NO: 733428 - RNA, 19 nt, Homo sapiens
aguaugcggcuaacaaguu

SEQ ID NO: 733429 - RNA, 19 nt, Homo sapiens
agaaacgcauuccguacag

SEQ ID NO: 733430 - RNA, 19 nt, Homo sapiens
cgggauauccgggaaccua

SEQ ID NO: 733431 - RNA, 19 nt, Homo sapiens
cagcucccgugccuuaugg

SEQ ID NO: 733432 - RNA, 19 nt, Homo sapiens
cauccucacaguggcaaua

SEQ ID NO: 733433 - RNA, 19 nt, Homo sapiens
gcgacaugacucccuguug

SEQ ID NO: 733434 - RNA, 19 nt, Homo sapiens
aagaaacgcauuccguaca

SEQ ID NO: 733435 - RNA, 19 nt, Homo sapiens
gcgagcugggagcgauuua

SEQ ID NO: 733436 - RNA, 19 nt, Homo sapiens
ucgccaaggugaagaacag

SEQ ID NO: 733437 - RNA, 19 nt, Homo sapiens
gaaaugaauugaagucuga

SEQ ID NO: 733438 - RNA, 19 nt, Homo sapiens
gaacaucccugagcuauug

SEQ ID NO: 733439 - RNA, 19 nt, Homo sapiens
ggacuuaggugcuuugugu

SEQ ID NO: 733440 - RNA, 19 nt, Homo sapiens
caacaguacuaugcaauuu

SEQ ID NO: 733441 - RNA, 19 nt, Homo sapiens
ugaaggcugucaacuauaa

SEQ ID NO: 733442 - RNA, 19 nt, Homo sapiens
cgagaucgcauucauguua

SEQ ID NO: 733443 - RNA, 19 nt, Homo sapiens
cgaacgauuucccaaguua

SEQ ID NO: 733444 - RNA, 19 nt, Homo sapiens
guaaauaguccuuggauau

SEQ ID NO: 733445 - RNA, 19 nt, Homo sapiens
gaugacaugucuagcauug

SEQ ID NO: 733446 - RNA, 19 nt, Homo sapiens
ggaagaggcgguucuggua

SEQ ID NO: 733447 - RNA, 19 nt, Homo sapiens
ggaaauauggugaaggaaa

SEQ ID NO: 733448 - RNA, 19 nt, Homo sapiens
gcugucaacuauaagauuu

SEQ ID NO: 733449 - RNA, 19 nt, Homo sapiens
ccaaagagccuucgcuaug

SEQ ID NO: 733450 - RNA, 19 nt, Homo sapiens
gcagaaaugugaagaagcu

SEQ ID NO: 733451 - RNA, 19 nt, Homo sapiens
gaaauauggugaaggaaac

SEQ ID NO: 733452 - RNA, 19 nt, Homo sapiens
gaaguggcauucaugaagu

SEQ ID NO: 733453 - RNA, 19 nt, Homo sapiens
gaaaugugaagaagcuuaa

SEQ ID NO: 733454 - RNA, 19 nt, Homo sapiens
gaacaaguagaacagcuaa

SEQ ID NO: 733455 - RNA, 19 nt, Homo sapiens
gcacacgcgucucaacguu

SEQ ID NO: 733456 - RNA, 19 nt, Homo sapiens
ccaauugccuuugauguug

SEQ ID NO: 733457 - RNA, 19 nt, Homo sapiens
ugacaugucuagcauuguu

SEQ ID NO: 733458 - RNA, 19 nt, Homo sapiens
ucagggcuauguauuguaa

SEQ ID NO: 733459 - RNA, 19 nt, Homo sapiens
ggaagaugauggagaugug

SEQ ID NO: 733460 - RNA, 19 nt, Homo sapiens
ucaaggaaguggacggaaa

SEQ ID NO: 733461 - RNA, 19 nt, Homo sapiens
cuauugaguuucacuauga

SEQ ID NO: 733462 - RNA, 19 nt, Homo sapiens
ggcuauguauuguaaauga

SEQ ID NO: 733463 - RNA, 19 nt, Homo sapiens
gaguuucacuaugagaaua

SEQ ID NO: 733464 - RNA, 19 nt, Homo sapiens
guggaaauauggugaagga

SEQ ID NO: 733465 - RNA, 19 nt, Homo sapiens
gaugggaccucaaagaacu

SEQ ID NO: 733466 - RNA, 19 nt, Homo sapiens
gcaacaguacuaugcaauu

SEQ ID NO: 733467 - RNA, 19 nt, Homo sapiens
ucaauggagucuucaagga

SEQ ID NO: 733468 - RNA, 19 nt, Homo sapiens
ugaggaagaugauggagau

SEQ ID NO: 733469 - RNA, 19 nt, Homo sapiens
ucaaaggccuccguucaga

SEQ ID NO: 733470 - RNA, 19 nt, Homo sapiens
gaagccagaacaaguagaa

SEQ ID NO: 733471 - RNA, 19 nt, Homo sapiens
gcaauucagggcuauguau

SEQ ID NO: 733472 - RNA, 19 nt, Homo sapiens
cugaagauccuaaaccuuu

SEQ ID NO: 733473 - RNA, 19 nt, Homo sapiens
aaggauagcagaaauguga

SEQ ID NO: 733474 - RNA, 19 nt, Homo sapiens
agggagcgcuugggaguua

SEQ ID NO: 733475 - RNA, 19 nt, Homo sapiens
gauauuaccgucugguugu

SEQ ID NO: 733476 - RNA, 19 nt, Homo sapiens
caaagagccuucgcuaugc

SEQ ID NO: 733477 - RNA, 19 nt, Homo sapiens
gcgaacgauuucccaaguu

SEQ ID NO: 733478 - RNA, 19 nt, Homo sapiens
gcagcuacccugaggauca

SEQ ID NO: 733479 - RNA, 19 nt, Homo sapiens
uguaaauaguccuuggaua

SEQ ID NO: 733480 - RNA, 19 nt, Homo sapiens
gacggaaagucccgggauu

SEQ ID NO: 733481 - RNA, 19 nt, Homo sapiens
ggugauacuuggcaugauc

SEQ ID NO: 733482 - RNA, 19 nt, Homo sapiens
gcccaggccuucacucauc

SEQ ID NO: 733483 - RNA, 19 nt, Homo sapiens
gaugaugaacgcguuaauu

SEQ ID NO: 733484 - RNA, 19 nt, Homo sapiens
gaacugaagccagaacaag

SEQ ID NO: 733485 - RNA, 19 nt, Homo sapiens
gagaaccgaaggauaucua

SEQ ID NO: 733486 - RNA, 19 nt, Homo sapiens
guuaauuucccucaaagaa

SEQ ID NO: 733487 - RNA, 19 nt, Homo sapiens
gaagaggcgguucugguau

SEQ ID NO: 733488 - RNA, 19 nt, Homo sapiens
uaaacuacccgaaggacuu

SEQ ID NO: 733489 - RNA, 19 nt, Homo sapiens
ggaaugccaguucugaaga

SEQ ID NO: 733490 - RNA, 19 nt, Homo sapiens
gacauaagcgcccagacaa

SEQ ID NO: 733491 - RNA, 19 nt, Homo sapiens
guuguugccuuccucaaug

SEQ ID NO: 733492 - RNA, 19 nt, Homo sapiens
gagcgggaauuggacaaga

SEQ ID NO: 733493 - RNA, 19 nt, Homo sapiens
caauugccuuugauguuga

SEQ ID NO: 733494 - RNA, 19 nt, Homo sapiens
gagaacaucccugagcuau

SEQ ID NO: 733495 - RNA, 19 nt, Homo sapiens
uaaagcugaucaugagcaa

SEQ ID NO: 733496 - RNA, 19 nt, Homo sapiens
caggaaauguugcaagcau

SEQ ID NO: 733497 - RNA, 19 nt, Homo sapiens
cagcuuagccgaguauuuc

SEQ ID NO: 733498 - RNA, 19 nt, Homo sapiens
gggaauuggacaagauaaa

SEQ ID NO: 733499 - RNA, 19 nt, Homo sapiens
ggccuucacucaucucaag

SEQ ID NO: 733500 - RNA, 19 nt, Homo sapiens
gacaacaacugggacuaca

SEQ ID NO: 733501 - RNA, 19 nt, Homo sapiens
gaaugccaguucugaagag

SEQ ID NO: 733502 - RNA, 19 nt, Homo sapiens
aagaggcgguucugguauu

SEQ ID NO: 733503 - RNA, 19 nt, Homo sapiens
caauggagucuucaaggaa

SEQ ID NO: 733504 - RNA, 19 nt, Homo sapiens
gcagcuuagccgaguauuu

SEQ ID NO: 733505 - RNA, 19 nt, Homo sapiens
uaaaggggcugaagcuaga

SEQ ID NO: 733506 - RNA, 19 nt, Homo sapiens
gcuauuguccuugaacuug

SEQ ID NO: 733507 - RNA, 19 nt, Homo sapiens
cagauuugguggcccagaa

SEQ ID NO: 733508 - RNA, 19 nt, Homo sapiens
cgaaggacuuaggugcuuu

SEQ ID NO: 733509 - RNA, 19 nt, Homo sapiens
uuguagaacugacacuaaa

SEQ ID NO: 733510 - RNA, 19 nt, Homo sapiens
agaaaugugaagaagcuua

SEQ ID NO: 733511 - RNA, 19 nt, Homo sapiens
cgggagaaccgaaggauau

SEQ ID NO: 733512 - RNA, 19 nt, Homo sapiens
ggaaaccguaggucuggaa

SEQ ID NO: 733513 - RNA, 19 nt, Homo sapiens
uagcagaaaugugaagaag

SEQ ID NO: 733514 - RNA, 19 nt, Homo sapiens
ccgaguauuucaaggauag

SEQ ID NO: 733515 - RNA, 19 nt, Homo sapiens
ggaauuggacaagauaaag

SEQ ID NO: 733516 - RNA, 19 nt, Homo sapiens
ccugagcuauuguccuuga

SEQ ID NO: 733517 - RNA, 19 nt, Homo sapiens
uaggugcuuuguguacuua

SEQ ID NO: 733518 - RNA, 19 nt, Homo sapiens
aaacuacccgaaggacuua

SEQ ID NO: 733519 - RNA, 19 nt, Homo sapiens
guacagcgaacacgaugau

SEQ ID NO: 733520 - RNA, 19 nt, Homo sapiens
gagcauuccuuucauuccu

SEQ ID NO: 733521 - RNA, 19 nt, Homo sapiens
ccugagcauuccuuucauu

SEQ ID NO: 733522 - RNA, 19 nt, Homo sapiens
ggaaacucccugugugaca

SEQ ID NO: 733523 - RNA, 19 nt, Homo sapiens
ugucuagcauuguucagaa

SEQ ID NO: 733524 - RNA, 19 nt, Homo sapiens
gaggaucauugaagagaac

SEQ ID NO: 733525 - RNA, 19 nt, Homo sapiens
gggcccaguucuucguuga

SEQ ID NO: 733526 - RNA, 19 nt, Homo sapiens
ccagaaguggcauucauga

SEQ ID NO: 733527 - RNA, 19 nt, Homo sapiens
cagagcagcaggaaauguu

SEQ ID NO: 733528 - RNA, 19 nt, Homo sapiens
ucaauuccuucgugguaga

SEQ ID NO: 733529 - RNA, 19 nt, Homo sapiens
cgucaauuccuucguggua

SEQ ID NO: 733530 - RNA, 19 nt, Homo sapiens
cagcgaacacgaugaugaa

SEQ ID NO: 733531 - RNA, 19 nt, Homo sapiens
gagauguggcaaugaguga

SEQ ID NO: 733532 - RNA, 19 nt, Homo sapiens
ugaagauccuaaaccuuuc

SEQ ID NO: 733533 - RNA, 19 nt, Homo sapiens
gaaggcacccaaccugaag

SEQ ID NO: 733534 - RNA, 19 nt, Homo sapiens
ccuauugaguuucacuaug

SEQ ID NO: 733535 - RNA, 19 nt, Homo sapiens
gagaucgcauucauguuac

SEQ ID NO: 733536 - RNA, 19 nt, Homo sapiens
gccgaguauuucaaggaua

SEQ ID NO: 733537 - RNA, 19 nt, Homo sapiens
gaaagaacguccagaccua

SEQ ID NO: 733538 - RNA, 19 nt, Homo sapiens
gcacauagaagcagcauuu

SEQ ID NO: 733539 - RNA, 19 nt, Homo sapiens
gaaucaaccugccgaauug

SEQ ID NO: 733540 - RNA, 19 nt, Homo sapiens
ggaaauaaaucuagaugca

SEQ ID NO: 733541 - RNA, 19 nt, Homo sapiens
ggaugaugcucaagaaauu

SEQ ID NO: 733542 - RNA, 19 nt, Homo sapiens
gaaccucacugaucuucuu

SEQ ID NO: 733543 - RNA, 19 nt, Homo sapiens
gcaaauacaggauauguug

SEQ ID NO: 733544 - RNA, 19 nt, Homo sapiens
ggauuuaacugcaaagcaa

SEQ ID NO: 733545 - RNA, 19 nt, Homo sapiens
gaaggaaucuccaaaaguu

SEQ ID NO: 733546 - RNA, 19 nt, Homo sapiens
gaaagauaaugcacgauuc

SEQ ID NO: 733547 - RNA, 19 nt, Homo sapiens
gugagaaucuuaaugauca

SEQ ID NO: 733548 - RNA, 19 nt, Homo sapiens
gcugauggauacuuucuuu

SEQ ID NO: 733549 - RNA, 19 nt, Homo sapiens
gauccuacaucuacacuug

SEQ ID NO: 733550 - RNA, 19 nt, Homo sapiens
gaaaggaccguguguguca

SEQ ID NO: 733551 - RNA, 19 nt, Homo sapiens
gagaugaaguguugugcaa

SEQ ID NO: 733552 - RNA, 19 nt, Homo sapiens
gcaaagcaaauacaggaua

SEQ ID NO: 733553 - RNA, 19 nt, Homo sapiens
cgacauaccuggaguucau

SEQ ID NO: 733554 - RNA, 19 nt, Homo sapiens
ggacggcucuagcuaguuc

SEQ ID NO: 733555 - RNA, 19 nt, Homo sapiens
ggcaugauauugagaaaga

SEQ ID NO: 733556 - RNA, 19 nt, Homo sapiens
caaagcaaauacaggauau

SEQ ID NO: 733557 - RNA, 19 nt, Homo sapiens
uagaaaggcuugauaacau

SEQ ID NO: 733558 - RNA, 19 nt, Homo sapiens
gagcacccauccuaacuga

SEQ ID NO: 733559 - RNA, 19 nt, Homo sapiens
uaauggagauuuccgaaug

SEQ ID NO: 733560 - RNA, 19 nt, Homo sapiens
aagcagacauuccaaagaa

SEQ ID NO: 733561 - RNA, 19 nt, Homo sapiens
gauaaugcacgauucauga

SEQ ID NO: 733562 - RNA, 19 nt, Homo sapiens
gaugaaguguugugcaaau

SEQ ID NO: 733563 - RNA, 19 nt, Homo sapiens
ggucauaaauguuuuggua

SEQ ID NO: 733564 - RNA, 19 nt, Homo sapiens
gaaaugcaacggugucaga

SEQ ID NO: 733565 - RNA, 19 nt, Homo sapiens
acacaugccuggaggaaga

SEQ ID NO: 733566 - RNA, 19 nt, Homo sapiens
gaagauugcaggagccauu

SEQ ID NO: 733567 - RNA, 19 nt, Homo sapiens
gauaugaaccucacugauc

SEQ ID NO: 733568 - RNA, 19 nt, Homo sapiens
gagauucuuucaacacuuc

SEQ ID NO: 733569 - RNA, 19 nt, Homo sapiens
acuaugagaugcuugcuaa

SEQ ID NO: 733570 - RNA, 19 nt, Homo sapiens
agaaaggcuugauaacauu

SEQ ID NO: 733571 - RNA, 19 nt, Homo sapiens
gggcagauguacagaguca

SEQ ID NO: 733572 - RNA, 19 nt, Homo sapiens
cagaggagccauccaguuu

SEQ ID NO: 733573 - RNA, 19 nt, Homo sapiens
gaaguguugugcaaaucuu

SEQ ID NO: 733574 - RNA, 19 nt, Homo sapiens
gaaggauggugcagguuca

SEQ ID NO: 733575 - RNA, 19 nt, Homo sapiens
gguuggagaugaauuaaag

SEQ ID NO: 733576 - RNA, 19 nt, Homo sapiens
gaaaguacuggcuaaaaua

SEQ ID NO: 733577 - RNA, 19 nt, Homo sapiens
ucucuacucuuacuccuuu

SEQ ID NO: 733578 - RNA, 19 nt, Homo sapiens
ccucugaucuuucucuaug

SEQ ID NO: 733579 - RNA, 19 nt, Homo sapiens
gcagcaggccaacuuguaa

SEQ ID NO: 733580 - RNA, 19 nt, Homo sapiens
ggacaugcccgaguaugaa

SEQ ID NO: 733581 - RNA, 19 nt, Homo sapiens
gauggauacuuucuuucaa

SEQ ID NO: 733582 - RNA, 19 nt, Homo sapiens
gaggagccauccaguuugu

SEQ ID NO: 733583 - RNA, 19 nt, Homo sapiens
caacacuucucucuucaag

SEQ ID NO: 733584 - RNA, 19 nt, Homo sapiens
gucacugcauugauauuua

SEQ ID NO: 733585 - RNA, 19 nt, Homo sapiens
ccaaggauuuaacugcaaa

SEQ ID NO: 733586 - RNA, 19 nt, Homo sapiens
gcuaagcugugaaggaauc

SEQ ID NO: 733587 - RNA, 19 nt, Homo sapiens
agaccuaccuccuguacaa

SEQ ID NO: 733588 - RNA, 19 nt, Homo sapiens
gccaggaucaugcuguuua

SEQ ID NO: 733589 - RNA, 19 nt, Homo sapiens
caucucagacacacaauaa

SEQ ID NO: 733590 - RNA, 19 nt, Homo sapiens
caguuuauguuccaucuga

SEQ ID NO: 733591 - RNA, 19 nt, Homo sapiens
gcuggaggcuacaagaaug

SEQ ID NO: 733592 - RNA, 19 nt, Homo sapiens
uaacaacaguccugaugag

SEQ ID NO: 733593 - RNA, 19 nt, Homo sapiens
gcguaucucugaaugugaa

SEQ ID NO: 733594 - RNA, 19 nt, Homo sapiens
ggugucagauuguguucaa

SEQ ID NO: 733595 - RNA, 19 nt, Homo sapiens
gauagcagcagcauucuag

SEQ ID NO: 733596 - RNA, 19 nt, Homo sapiens
gagccaggaucaugcuguu

SEQ ID NO: 733597 - RNA, 19 nt, Homo sapiens
ggucugaucacauuuggaa

SEQ ID NO: 733598 - RNA, 19 nt, Homo sapiens
ugaaucaaccugccgaauu

SEQ ID NO: 733599 - RNA, 19 nt, Homo sapiens
aaagugaacccaucucaga

SEQ ID NO: 733600 - RNA, 19 nt, Homo sapiens
caucuacacuuggcaucua

SEQ ID NO: 733601 - RNA, 19 nt, Homo sapiens
acacuucucucuucaagca

SEQ ID NO: 733602 - RNA, 19 nt, Homo sapiens
ggagauucuuucaacacuu

SEQ ID NO: 733603 - RNA, 19 nt, Homo sapiens
caaccaagcacuaugagau

SEQ ID NO: 733604 - RNA, 19 nt, Homo sapiens
gaggacggcucuagcuagu

SEQ ID NO: 733605 - RNA, 19 nt, Homo sapiens
aaaucuagaugcagaaagu

SEQ ID NO: 733606 - RNA, 19 nt, Homo sapiens
gaaauugggcagauguaca

SEQ ID NO: 733607 - RNA, 19 nt, Homo sapiens
guucuuggcaugauauuga

SEQ ID NO: 733608 - RNA, 19 nt, Homo sapiens
ggugguuggagaugaauua

SEQ ID NO: 733609 - RNA, 19 nt, Homo sapiens
gcagaggagccauccaguu

SEQ ID NO: 733610 - RNA, 19 nt, Homo sapiens
uaggugagaaucuuaauga

SEQ ID NO: 733611 - RNA, 19 nt, Homo sapiens
cacaauaaccuguaugcuu

SEQ ID NO: 733612 - RNA, 19 nt, Homo sapiens
uuucaacacuucucucuuc

SEQ ID NO: 733613 - RNA, 19 nt, Homo sapiens
guagauguuuaugugcuuu

SEQ ID NO: 733614 - RNA, 19 nt, Homo sapiens
gagccaguacucuuggaua

SEQ ID NO: 733615 - RNA, 19 nt, Homo sapiens
gacaguauaacaaagaaga

SEQ ID NO: 733616 - RNA, 19 nt, Homo sapiens
gcagaaaguacuggcuaaa

SEQ ID NO: 733617 - RNA, 19 nt, Homo sapiens
gaggauacaaccaggaaau

SEQ ID NO: 733618 - RNA, 19 nt, Homo sapiens
ggucacugcauugauauuu

SEQ ID NO: 733619 - RNA, 19 nt, Homo sapiens
ucgaacagcugcaaauggu

SEQ ID NO: 733620 - RNA, 19 nt, Homo sapiens
agaaagauaaugcacgauu

SEQ ID NO: 733621 - RNA, 19 nt, Homo sapiens
cgacaacucauccgacugu

SEQ ID NO: 733622 - RNA, 19 nt, Homo sapiens
aauaugaaccugugcuuug

SEQ ID NO: 733623 - RNA, 19 nt, Homo sapiens
gcauggugguuggagauga

SEQ ID NO: 733624 - RNA, 19 nt, Homo sapiens
gcauaucugaggugaauca

SEQ ID NO: 733625 - RNA, 19 nt, Homo sapiens
gacacacaauaaccuguau

SEQ ID NO: 733626 - RNA, 19 nt, Homo sapiens
uagguuaucagauuccuuu

SEQ ID NO: 733627 - RNA, 19 nt, Homo sapiens
ggcauuuggugcuacuuug

SEQ ID NO: 733628 - RNA, 19 nt, Homo sapiens
gguguggcuuuguccauug

SEQ ID NO: 733629 - RNA, 19 nt, Homo sapiens
ucacaagauugauaugaac

SEQ ID NO: 733630 - RNA, 19 nt, Homo sapiens
gaaaggcuugauaacauuc

SEQ ID NO: 733631 - RNA, 19 nt, Homo sapiens
caagcagacauuccaaaga

SEQ ID NO: 733632 - RNA, 19 nt, Homo sapiens
caaagagucccugcagaug

SEQ ID NO: 733633 - RNA, 19 nt, Homo sapiens
aggcauaucugaggugaau

SEQ ID NO: 733634 - RNA, 19 nt, Homo sapiens
ucaguuuccuccagcuuau

SEQ ID NO: 733635 - RNA, 19 nt, Homo sapiens
aaacuuugggccuguaauu

SEQ ID NO: 733636 - RNA, 19 nt, Homo sapiens
augcaacggugucagauug

SEQ ID NO: 733637 - RNA, 19 nt, Homo sapiens
gaaagaacguccagaccua

SEQ ID NO: 733638 - RNA, 19 nt, Homo sapiens
gcacauagaagcagcauuu

SEQ ID NO: 733639 - RNA, 19 nt, Homo sapiens
gaaucaaccugccgaauug

SEQ ID NO: 733640 - RNA, 19 nt, Homo sapiens
ggaaauaaaucuagaugca

SEQ ID NO: 733641 - RNA, 19 nt, Homo sapiens
ggaugaugcucaagaaauu

SEQ ID NO: 733642 - RNA, 19 nt, Homo sapiens
gaaccucacugaucuucuu

SEQ ID NO: 733643 - RNA, 19 nt, Homo sapiens
gcaaauacaggauauguug

SEQ ID NO: 733644 - RNA, 19 nt, Homo sapiens
ggauuuaacugcaaagcaa

SEQ ID NO: 733645 - RNA, 19 nt, Homo sapiens
gaaggaaucuccaaaaguu

SEQ ID NO: 733646 - RNA, 19 nt, Homo sapiens
gaaagauaaugcacgauuc

SEQ ID NO: 733647 - RNA, 19 nt, Homo sapiens
gugagaaucuuaaugauca

SEQ ID NO: 733648 - RNA, 19 nt, Homo sapiens
gcugauggauacuuucuuu

SEQ ID NO: 733649 - RNA, 19 nt, Homo sapiens
gauccuacaucuacacuug

SEQ ID NO: 733650 - RNA, 19 nt, Homo sapiens
gaaaggaccguguguguca

SEQ ID NO: 733651 - RNA, 19 nt, Homo sapiens
gagaugaaguguugugcaa

SEQ ID NO: 733652 - RNA, 19 nt, Homo sapiens
gcaaagcaaauacaggaua

SEQ ID NO: 733653 - RNA, 19 nt, Homo sapiens
cgacauaccuggaguucau

SEQ ID NO: 733654 - RNA, 19 nt, Homo sapiens
ggcaugauauugagaaaga

SEQ ID NO: 733655 - RNA, 19 nt, Homo sapiens
caaagcaaauacaggauau

SEQ ID NO: 733656 - RNA, 19 nt, Homo sapiens
uagaaaggcuugauaacau

SEQ ID NO: 733657 - RNA, 19 nt, Homo sapiens
gagcacccauccuaacuga

SEQ ID NO: 733658 - RNA, 19 nt, Homo sapiens
uaauggagauuuccgaaug

SEQ ID NO: 733659 - RNA, 19 nt, Homo sapiens
aagcagacauuccaaagaa

SEQ ID NO: 733660 - RNA, 19 nt, Homo sapiens
gauaaugcacgauucauga

SEQ ID NO: 733661 - RNA, 19 nt, Homo sapiens
gaugaaguguugugcaaau

SEQ ID NO: 733662 - RNA, 19 nt, Homo sapiens
ggucauaaauguuuuggua

SEQ ID NO: 733663 - RNA, 19 nt, Homo sapiens
gaaaugcaacggugucaga

SEQ ID NO: 733664 - RNA, 19 nt, Homo sapiens
acacaugccuggaggaaga

SEQ ID NO: 733665 - RNA, 19 nt, Homo sapiens
gaagauugcaggagccauu

SEQ ID NO: 733666 - RNA, 19 nt, Homo sapiens
gauaugaaccucacugauc

SEQ ID NO: 733667 - RNA, 19 nt, Homo sapiens
gagauucuuucaacacuuc

SEQ ID NO: 733668 - RNA, 19 nt, Homo sapiens
acuaugagaugcuugcuaa

SEQ ID NO: 733669 - RNA, 19 nt, Homo sapiens
agaaaggcuugauaacauu

SEQ ID NO: 733670 - RNA, 19 nt, Homo sapiens
gggcagauguacagaguca

SEQ ID NO: 733671 - RNA, 19 nt, Homo sapiens
cagaggagccauccaguuu

SEQ ID NO: 733672 - RNA, 19 nt, Homo sapiens
gaaguguugugcaaaucuu

SEQ ID NO: 733673 - RNA, 19 nt, Homo sapiens
gaaggauggugcagguuca

SEQ ID NO: 733674 - RNA, 19 nt, Homo sapiens
gguuggagaugaauuaaag

SEQ ID NO: 733675 - RNA, 19 nt, Homo sapiens
gaaaguacuggcuaaaaua

SEQ ID NO: 733676 - RNA, 19 nt, Homo sapiens
ucucuacucuuacuccuuu

SEQ ID NO: 733677 - RNA, 19 nt, Homo sapiens
ccucugaucuuucucuaug

SEQ ID NO: 733678 - RNA, 19 nt, Homo sapiens
gcagcaggccaacuuguaa

SEQ ID NO: 733679 - RNA, 19 nt, Homo sapiens
ggacaugcccgaguaugaa

SEQ ID NO: 733680 - RNA, 19 nt, Homo sapiens
gauggauacuuucuuucaa

SEQ ID NO: 733681 - RNA, 19 nt, Homo sapiens
gaggagccauccaguuugu

SEQ ID NO: 733682 - RNA, 19 nt, Homo sapiens
caacacuucucucuucaag

SEQ ID NO: 733683 - RNA, 19 nt, Homo sapiens
gucacugcauugauauuua

SEQ ID NO: 733684 - RNA, 19 nt, Homo sapiens
ccaaggauuuaacugcaaa

SEQ ID NO: 733685 - RNA, 19 nt, Homo sapiens
gcuaagcugugaaggaauc

SEQ ID NO: 733686 - RNA, 19 nt, Homo sapiens
agaccuaccuccuguacaa

SEQ ID NO: 733687 - RNA, 19 nt, Homo sapiens
gccaggaucaugcuguuua

SEQ ID NO: 733688 - RNA, 19 nt, Homo sapiens
caucucagacacacaauaa

SEQ ID NO: 733689 - RNA, 19 nt, Homo sapiens
caguuuauguuccaucuga

SEQ ID NO: 733690 - RNA, 19 nt, Homo sapiens
gcuggaggcuacaagaaug

SEQ ID NO: 733691 - RNA, 19 nt, Homo sapiens
uaacaacaguccugaugag

SEQ ID NO: 733692 - RNA, 19 nt, Homo sapiens
gcguaucucugaaugugaa

SEQ ID NO: 733693 - RNA, 19 nt, Homo sapiens
ggugucagauuguguucaa

SEQ ID NO: 733694 - RNA, 19 nt, Homo sapiens
gauagcagcagcauucuag

SEQ ID NO: 733695 - RNA, 19 nt, Homo sapiens
gagccaggaucaugcuguu

SEQ ID NO: 733696 - RNA, 19 nt, Homo sapiens
ggucugaucacauuuggaa

SEQ ID NO: 733697 - RNA, 19 nt, Homo sapiens
ugaaucaaccugccgaauu

SEQ ID NO: 733698 - RNA, 19 nt, Homo sapiens
aaagugaacccaucucaga

SEQ ID NO: 733699 - RNA, 19 nt, Homo sapiens
caucuacacuuggcaucua

SEQ ID NO: 733700 - RNA, 19 nt, Homo sapiens
acacuucucucuucaagca

SEQ ID NO: 733701 - RNA, 19 nt, Homo sapiens
ggagauucuuucaacacuu

SEQ ID NO: 733702 - RNA, 19 nt, Homo sapiens
caaccaagcacuaugagau

SEQ ID NO: 733703 - RNA, 19 nt, Homo sapiens
aaaucuagaugcagaaagu

SEQ ID NO: 733704 - RNA, 19 nt, Homo sapiens
gaaauugggcagauguaca

SEQ ID NO: 733705 - RNA, 19 nt, Homo sapiens
guucuuggcaugauauuga

SEQ ID NO: 733706 - RNA, 19 nt, Homo sapiens
ggugguuggagaugaauua

SEQ ID NO: 733707 - RNA, 19 nt, Homo sapiens
gcagaggagccauccaguu

SEQ ID NO: 733708 - RNA, 19 nt, Homo sapiens
uaggugagaaucuuaauga

SEQ ID NO: 733709 - RNA, 19 nt, Homo sapiens
cacaauaaccuguaugcuu

SEQ ID NO: 733710 - RNA, 19 nt, Homo sapiens
uuucaacacuucucucuuc

SEQ ID NO: 733711 - RNA, 19 nt, Homo sapiens
guagauguuuaugugcuuu

SEQ ID NO: 733712 - RNA, 19 nt, Homo sapiens
gagccaguacucuuggaua

SEQ ID NO: 733713 - RNA, 19 nt, Homo sapiens
gacaguauaacaaagaaga

SEQ ID NO: 733714 - RNA, 19 nt, Homo sapiens
gcagaaaguacuggcuaaa

SEQ ID NO: 733715 - RNA, 19 nt, Homo sapiens
gaggauacaaccaggaaau

SEQ ID NO: 733716 - RNA, 19 nt, Homo sapiens
ggucacugcauugauauuu

SEQ ID NO: 733717 - RNA, 19 nt, Homo sapiens
ucgaacagcugcaaauggu

SEQ ID NO: 733718 - RNA, 19 nt, Homo sapiens
agaaagauaaugcacgauu

SEQ ID NO: 733719 - RNA, 19 nt, Homo sapiens
aauaugaaccugugcuuug

SEQ ID NO: 733720 - RNA, 19 nt, Homo sapiens
cgacaacucauccgacugu

SEQ ID NO: 733721 - RNA, 19 nt, Homo sapiens
gcauggugguuggagauga

SEQ ID NO: 733722 - RNA, 19 nt, Homo sapiens
gcauaucugaggugaauca

SEQ ID NO: 733723 - RNA, 19 nt, Homo sapiens
gacacacaauaaccuguau

SEQ ID NO: 733724 - RNA, 19 nt, Homo sapiens
uagguuaucagauuccuuu

SEQ ID NO: 733725 - RNA, 19 nt, Homo sapiens
ggcauuuggugcuacuuug

SEQ ID NO: 733726 - RNA, 19 nt, Homo sapiens
gguguggcuuuguccauug

SEQ ID NO: 733727 - RNA, 19 nt, Homo sapiens
ucacaagauugauaugaac

SEQ ID NO: 733728 - RNA, 19 nt, Homo sapiens
gaaaggcuugauaacauuc

SEQ ID NO: 733729 - RNA, 19 nt, Homo sapiens
caagcagacauuccaaaga

SEQ ID NO: 733730 - RNA, 19 nt, Homo sapiens
caaagagucccugcagaug

SEQ ID NO: 733731 - RNA, 19 nt, Homo sapiens
aggcauaucugaggugaau

SEQ ID NO: 733732 - RNA, 19 nt, Homo sapiens
ucaguuuccuccagcuuau

SEQ ID NO: 733733 - RNA, 19 nt, Homo sapiens
aaacuuugggccuguaauu

SEQ ID NO: 733734 - RNA, 19 nt, Homo sapiens
augcaacggugucagauug

SEQ ID NO: 733735 - RNA, 19 nt, Homo sapiens
gaucuccauuucuucaagu

SEQ ID NO: 733736 - RNA, 19 nt, Homo sapiens
gguaaugggagauucuuuc

SEQ ID NO: 733737 - RNA, 19 nt, Homo sapiens
gaaagaacguccagaccua

SEQ ID NO: 733738 - RNA, 19 nt, Homo sapiens
gcacauagaagcagcauuu

SEQ ID NO: 733739 - RNA, 19 nt, Homo sapiens
gaaucaaccugccgaauug

SEQ ID NO: 733740 - RNA, 19 nt, Homo sapiens
gagcggaugucauauugua

SEQ ID NO: 733741 - RNA, 19 nt, Homo sapiens
ggaaauaaaucuagaugca

SEQ ID NO: 733742 - RNA, 19 nt, Homo sapiens
ggaugaugcucaagaaauu

SEQ ID NO: 733743 - RNA, 19 nt, Homo sapiens
gaaccucacugaucuucuu

SEQ ID NO: 733744 - RNA, 19 nt, Homo sapiens
gcaaauacaggauauguug

SEQ ID NO: 733745 - RNA, 19 nt, Homo sapiens
ggauuuaacugcaaagcaa

SEQ ID NO: 733746 - RNA, 19 nt, Homo sapiens
gaaggaaucuccaaaaguu

SEQ ID NO: 733747 - RNA, 19 nt, Homo sapiens
gaaagauaaugcacgauuc

SEQ ID NO: 733748 - RNA, 19 nt, Homo sapiens
gugagaaucuuaaugauca

SEQ ID NO: 733749 - RNA, 19 nt, Homo sapiens
gcugauggauacuuucuuu

SEQ ID NO: 733750 - RNA, 19 nt, Homo sapiens
gauccuacaucuacacuug

SEQ ID NO: 733751 - RNA, 19 nt, Homo sapiens
gaaaggaccguguguguca

SEQ ID NO: 733752 - RNA, 19 nt, Homo sapiens
gagaugaaguguugugcaa

SEQ ID NO: 733753 - RNA, 19 nt, Homo sapiens
gagacgagcggaugucaua

SEQ ID NO: 733754 - RNA, 19 nt, Homo sapiens
gcaaagcaaauacaggaua

SEQ ID NO: 733755 - RNA, 19 nt, Homo sapiens
cgacauaccuggaguucau

SEQ ID NO: 733756 - RNA, 19 nt, Homo sapiens
ggcaugauauugagaaaga

SEQ ID NO: 733757 - RNA, 19 nt, Homo sapiens
caaagcaaauacaggauau

SEQ ID NO: 733758 - RNA, 19 nt, Homo sapiens
uagaaaggcuugauaacau

SEQ ID NO: 733759 - RNA, 19 nt, Homo sapiens
gagcacccauccuaacuga

SEQ ID NO: 733760 - RNA, 19 nt, Homo sapiens
uaauggagauuuccgaaug

SEQ ID NO: 733761 - RNA, 19 nt, Homo sapiens
aagcagacauuccaaagaa

SEQ ID NO: 733762 - RNA, 19 nt, Homo sapiens
gauaaugcacgauucauga

SEQ ID NO: 733763 - RNA, 19 nt, Homo sapiens
gaugaaguguugugcaaau

SEQ ID NO: 733764 - RNA, 19 nt, Homo sapiens
ggucauaaauguuuuggua

SEQ ID NO: 733765 - RNA, 19 nt, Homo sapiens
gaaaugcaacggugucaga

SEQ ID NO: 733766 - RNA, 19 nt, Homo sapiens
acacaugccuggaggaaga

SEQ ID NO: 733767 - RNA, 19 nt, Homo sapiens
gaagauugcaggagccauu

SEQ ID NO: 733768 - RNA, 19 nt, Homo sapiens
gauaugaaccucacugauc

SEQ ID NO: 733769 - RNA, 19 nt, Homo sapiens
gagauucuuucaacacuuc

SEQ ID NO: 733770 - RNA, 19 nt, Homo sapiens
acuaugagaugcuugcuaa

SEQ ID NO: 733771 - RNA, 19 nt, Homo sapiens
agaaaggcuugauaacauu

SEQ ID NO: 733772 - RNA, 19 nt, Homo sapiens
gggcagauguacagaguca

SEQ ID NO: 733773 - RNA, 19 nt, Homo sapiens
cagaggagccauccaguuu

SEQ ID NO: 733774 - RNA, 19 nt, Homo sapiens
gaaguguugugcaaaucuu

SEQ ID NO: 733775 - RNA, 19 nt, Homo sapiens
gaaggauggugcagguuca

SEQ ID NO: 733776 - RNA, 19 nt, Homo sapiens
gguuggagaugaauuaaag

SEQ ID NO: 733777 - RNA, 19 nt, Homo sapiens
gaaaguacuggcuaaaaua

SEQ ID NO: 733778 - RNA, 19 nt, Homo sapiens
ucucuacucuuacuccuuu

SEQ ID NO: 733779 - RNA, 19 nt, Homo sapiens
ccucugaucuuucucuaug

SEQ ID NO: 733780 - RNA, 19 nt, Homo sapiens
gcagcaggccaacuuguaa

SEQ ID NO: 733781 - RNA, 19 nt, Homo sapiens
ggacaugcccgaguaugaa

SEQ ID NO: 733782 - RNA, 19 nt, Homo sapiens
gauggauacuuucuuucaa

SEQ ID NO: 733783 - RNA, 19 nt, Homo sapiens
gaggagccauccaguuugu

SEQ ID NO: 733784 - RNA, 19 nt, Homo sapiens
caacacuucucucuucaag

SEQ ID NO: 733785 - RNA, 19 nt, Homo sapiens
gucacugcauugauauuua

SEQ ID NO: 733786 - RNA, 19 nt, Homo sapiens
ccaaggauuuaacugcaaa

SEQ ID NO: 733787 - RNA, 19 nt, Homo sapiens
gcuaagcugugaaggaauc

SEQ ID NO: 733788 - RNA, 19 nt, Homo sapiens
agaccuaccuccuguacaa

SEQ ID NO: 733789 - RNA, 19 nt, Homo sapiens
gccaggaucaugcuguuua

SEQ ID NO: 733790 - RNA, 19 nt, Homo sapiens
caucucagacacacaauaa

SEQ ID NO: 733791 - RNA, 19 nt, Homo sapiens
caguuuauguuccaucuga

SEQ ID NO: 733792 - RNA, 19 nt, Homo sapiens
gcuggaggcuacaagaaug

SEQ ID NO: 733793 - RNA, 19 nt, Homo sapiens
uaacaacaguccugaugag

SEQ ID NO: 733794 - RNA, 19 nt, Homo sapiens
gcguaucucugaaugugaa

SEQ ID NO: 733795 - RNA, 19 nt, Homo sapiens
ggugucagauuguguucaa

SEQ ID NO: 733796 - RNA, 19 nt, Homo sapiens
gauagcagcagcauucuag

SEQ ID NO: 733797 - RNA, 19 nt, Homo sapiens
gagccaggaucaugcuguu

SEQ ID NO: 733798 - RNA, 19 nt, Homo sapiens
ggucugaucacauuuggaa

SEQ ID NO: 733799 - RNA, 19 nt, Homo sapiens
ugaaucaaccugccgaauu

SEQ ID NO: 733800 - RNA, 19 nt, Homo sapiens
aaagugaacccaucucaga

SEQ ID NO: 733801 - RNA, 19 nt, Homo sapiens
caucuacacuuggcaucua

SEQ ID NO: 733802 - RNA, 19 nt, Homo sapiens
acacuucucucuucaagca

SEQ ID NO: 733803 - RNA, 19 nt, Homo sapiens
ggagauucuuucaacacuu

SEQ ID NO: 733804 - RNA, 19 nt, Homo sapiens
caaccaagcacuaugagau

SEQ ID NO: 733805 - RNA, 19 nt, Homo sapiens
aaaucuagaugcagaaagu

SEQ ID NO: 733806 - RNA, 19 nt, Homo sapiens
gaaauugggcagauguaca

SEQ ID NO: 733807 - RNA, 19 nt, Homo sapiens
guucuuggcaugauauuga

SEQ ID NO: 733808 - RNA, 19 nt, Homo sapiens
ggugguuggagaugaauua

SEQ ID NO: 733809 - RNA, 19 nt, Homo sapiens
gcagaggagccauccaguu

SEQ ID NO: 733810 - RNA, 19 nt, Homo sapiens
uaggugagaaucuuaauga

SEQ ID NO: 733811 - RNA, 19 nt, Homo sapiens
cacaauaaccuguaugcuu

SEQ ID NO: 733812 - RNA, 19 nt, Homo sapiens
uuucaacacuucucucuuc

SEQ ID NO: 733813 - RNA, 19 nt, Homo sapiens
guagauguuuaugugcuuu

SEQ ID NO: 733814 - RNA, 19 nt, Homo sapiens
gagccaguacucuuggaua

SEQ ID NO: 733815 - RNA, 19 nt, Homo sapiens
gacaguauaacaaagaaga

SEQ ID NO: 733816 - RNA, 19 nt, Homo sapiens
gcagaaaguacuggcuaaa

SEQ ID NO: 733817 - RNA, 19 nt, Homo sapiens
gaggauacaaccaggaaau

SEQ ID NO: 733818 - RNA, 19 nt, Homo sapiens
ggucacugcauugauauuu

SEQ ID NO: 733819 - RNA, 19 nt, Homo sapiens
ucgaacagcugcaaauggu

SEQ ID NO: 733820 - RNA, 19 nt, Homo sapiens
agaaagauaaugcacgauu

SEQ ID NO: 733821 - RNA, 19 nt, Homo sapiens
cgacaacucauccgacugu

SEQ ID NO: 733822 - RNA, 19 nt, Homo sapiens
gcauggugguuggagauga

SEQ ID NO: 733823 - RNA, 19 nt, Homo sapiens
gcauaucugaggugaauca

SEQ ID NO: 733824 - RNA, 19 nt, Homo sapiens
aauaugaaccugugcuuug

SEQ ID NO: 733825 - RNA, 19 nt, Homo sapiens
gacacacaauaaccuguau

SEQ ID NO: 733826 - RNA, 19 nt, Homo sapiens
uagguuaucagauuccuuu

SEQ ID NO: 733827 - RNA, 19 nt, Homo sapiens
ggcauuuggugcuacuuug

SEQ ID NO: 733828 - RNA, 19 nt, Homo sapiens
gguguggcuuuguccauug

SEQ ID NO: 733829 - RNA, 19 nt, Homo sapiens
ucacaagauugauaugaac

SEQ ID NO: 733830 - RNA, 19 nt, Homo sapiens
gaaaggcuugauaacauuc

SEQ ID NO: 733831 - RNA, 19 nt, Homo sapiens
caagcagacauuccaaaga

SEQ ID NO: 733832 - RNA, 19 nt, Homo sapiens
caaagagucccugcagaug

SEQ ID NO: 733833 - RNA, 19 nt, Homo sapiens
aggcauaucugaggugaau

SEQ ID NO: 733834 - RNA, 19 nt, Homo sapiens
ucaguuuccuccagcuuau

SEQ ID NO: 733835 - RNA, 19 nt, Homo sapiens
aaacuuugggccuguaauu

SEQ ID NO: 733836 - RNA, 19 nt, Homo sapiens
augcaacggugucagauug

SEQ ID NO: 733837 - RNA, 19 nt, Homo sapiens
caacagauauugcucuaua

SEQ ID NO: 733838 - RNA, 19 nt, Homo sapiens
gaaucaaacuccacaauga

SEQ ID NO: 733839 - RNA, 19 nt, Homo sapiens
cauggaagaugaagauuua

SEQ ID NO: 733840 - RNA, 19 nt, Homo sapiens
caagauacauugacacuga

SEQ ID NO: 733841 - RNA, 19 nt, Homo sapiens
gaagauauguggacuuagu

SEQ ID NO: 733842 - RNA, 19 nt, Homo sapiens
caaagacaaugccaaauau

SEQ ID NO: 733843 - RNA, 19 nt, Homo sapiens
gaaagagagaccugacuua

SEQ ID NO: 733844 - RNA, 19 nt, Homo sapiens
ccaaacaacugcaggaaau

SEQ ID NO: 733845 - RNA, 19 nt, Homo sapiens
gaaaugcugucccaaccuu

SEQ ID NO: 733846 - RNA, 19 nt, Homo sapiens
cgauuuaguuggaauguuu

SEQ ID NO: 733847 - RNA, 19 nt, Homo sapiens
gauguuaguuuacaagugu

SEQ ID NO: 733848 - RNA, 19 nt, Homo sapiens
auaaagaccucaagggaaa

SEQ ID NO: 733849 - RNA, 19 nt, Homo sapiens
aaagacaccuuaagaagau

SEQ ID NO: 733850 - RNA, 19 nt, Homo sapiens
gaucugacccagucucuaa

SEQ ID NO: 733851 - RNA, 19 nt, Homo sapiens
agacaugcauggacaguuu

SEQ ID NO: 733852 - RNA, 19 nt, Homo sapiens
gguaaugggugauucuuuc

SEQ ID NO: 733853 - RNA, 19 nt, Homo sapiens
uggaagauauguggacuua

SEQ ID NO: 733854 - RNA, 19 nt, Homo sapiens
gacaaugccaaauauguua

SEQ ID NO: 733855 - RNA, 19 nt, Homo sapiens
acaaagacaaugccaaaua

SEQ ID NO: 733856 - RNA, 19 nt, Homo sapiens
gagcaccuauucuuacaga

SEQ ID NO: 733857 - RNA, 19 nt, Homo sapiens
ggcaugacauugacaaaga

SEQ ID NO: 733858 - RNA, 19 nt, Homo sapiens
cauauuaucgucaccauuu

SEQ ID NO: 733859 - RNA, 19 nt, Homo sapiens
ggauaugccugaguaugaa

SEQ ID NO: 733860 - RNA, 19 nt, Homo sapiens
cgagauggaguccgauuua

SEQ ID NO: 733861 - RNA, 19 nt, Homo sapiens
ggacacauucuuccagauu

SEQ ID NO: 733862 - RNA, 19 nt, Homo sapiens
gaucguggcaugacauuga

SEQ ID NO: 733863 - RNA, 19 nt, Homo sapiens
ggagaaugguucagguuca

SEQ ID NO: 733864 - RNA, 19 nt, Homo sapiens
gaaagaauccaugcagaug

SEQ ID NO: 733865 - RNA, 19 nt, Homo sapiens
uaaagacaccuuaagaaga

SEQ ID NO: 733866 - RNA, 19 nt, Homo sapiens
gacacauucuuccagauuu

SEQ ID NO: 733867 - RNA, 19 nt, Homo sapiens
ucagaugccuuugauauuc

SEQ ID NO: 733868 - RNA, 19 nt, Homo sapiens
caacuggccauguuauuga

SEQ ID NO: 733869 - RNA, 19 nt, Homo sapiens
ccacaaugacaaccuauuu

SEQ ID NO: 733870 - RNA, 19 nt, Homo sapiens
ggaauuauaaugagagcaa

SEQ ID NO: 733871 - RNA, 19 nt, Homo sapiens
gauuuccaaugccaagaua

SEQ ID NO: 733872 - RNA, 19 nt, Homo sapiens
cuacaaccuuagccauaua

SEQ ID NO: 733873 - RNA, 19 nt, Homo sapiens
gaacagguggcacauguca

SEQ ID NO: 733874 - RNA, 19 nt, Homo sapiens
gugguacgcuagaaauaaa

SEQ ID NO: 733875 - RNA, 19 nt, Homo sapiens
cagaugucauuaagucuuu

SEQ ID NO: 733876 - RNA, 19 nt, Homo sapiens
ggaguccgauuuaguugga

SEQ ID NO: 733877 - RNA, 19 nt, Homo sapiens
agaagaagguccagaugug

SEQ ID NO: 733878 - RNA, 19 nt, Homo sapiens
gaacugggcagaugcucaa

SEQ ID NO: 733879 - RNA, 19 nt, Homo sapiens
gugugucacucaauucuaa

SEQ ID NO: 733880 - RNA, 19 nt, Homo sapiens
cuucacagacucauaauaa

SEQ ID NO: 733881 - RNA, 19 nt, Homo sapiens
gacccagucucuaauuaug

SEQ ID NO: 733882 - RNA, 19 nt, Homo sapiens
gcuaggaacugggcagaug

SEQ ID NO: 733883 - RNA, 19 nt, Homo sapiens
ugacaaagacaaugccaaa

SEQ ID NO: 733884 - RNA, 19 nt, Homo sapiens
gcauggaagaugaagauuu

SEQ ID NO: 733885 - RNA, 19 nt, Homo sapiens
gauggaguccgauuuaguu

SEQ ID NO: 733886 - RNA, 19 nt, Homo sapiens
guauuaguaugguuugaga

SEQ ID NO: 733887 - RNA, 19 nt, Homo sapiens
aaacauugcugcaucuuuu

SEQ ID NO: 733888 - RNA, 19 nt, Homo sapiens
gaauggugguuggagauga

SEQ ID NO: 733889 - RNA, 19 nt, Homo sapiens
gggcggagaggacagauuu

SEQ ID NO: 733890 - RNA, 19 nt, Homo sapiens
gcugguauaucugaacuga

SEQ ID NO: 733891 - RNA, 19 nt, Homo sapiens
uguuauagcugguucuaga

SEQ ID NO: 733892 - RNA, 19 nt, Homo sapiens
caaccuuagccauauauuu

SEQ ID NO: 733893 - RNA, 19 nt, Homo sapiens
gaguugaagacaccuauaa

SEQ ID NO: 733894 - RNA, 19 nt, Homo sapiens
caccuauucuuacagauga

SEQ ID NO: 733895 - RNA, 19 nt, Homo sapiens
ggaagaugaagauuuacaa

SEQ ID NO: 733896 - RNA, 19 nt, Homo sapiens
agagagaccugacuuacca

SEQ ID NO: 733897 - RNA, 19 nt, Homo sapiens
gggcagaugcucaaacuca

SEQ ID NO: 733898 - RNA, 19 nt, Homo sapiens
agaccugacuuaccaccua

SEQ ID NO: 733899 - RNA, 19 nt, Homo sapiens
uaaaggacccugugugucu

SEQ ID NO: 733900 - RNA, 19 nt, Homo sapiens
gacaaccuauuuggaauuc

SEQ ID NO: 733901 - RNA, 19 nt, Homo sapiens
ugguauaucugaacugaau

SEQ ID NO: 733902 - RNA, 19 nt, Homo sapiens
aaauagagucugccucgua

SEQ ID NO: 733903 - RNA, 19 nt, Homo sapiens
guagauuaagcuggaauua

SEQ ID NO: 733904 - RNA, 19 nt, Homo sapiens
gcaccuauucuuacagaug

SEQ ID NO: 733905 - RNA, 19 nt, Homo sapiens
caauaguccugaugagagu

SEQ ID NO: 733906 - RNA, 19 nt, Homo sapiens
ggacagacagcucauucga

SEQ ID NO: 733907 - RNA, 19 nt, Homo sapiens
caaccuauuuggaauucau

SEQ ID NO: 733908 - RNA, 19 nt, Homo sapiens
ugguuggacuuauuacuuu

SEQ ID NO: 733909 - RNA, 19 nt, Homo sapiens
gcagaugucauuaagucuu

SEQ ID NO: 733910 - RNA, 19 nt, Homo sapiens
auacuugcauggaagauga

SEQ ID NO: 733911 - RNA, 19 nt, Homo sapiens
gcagaucguauucuucuca

SEQ ID NO: 733912 - RNA, 19 nt, Homo sapiens
gaucuucuuuccugcaagu

SEQ ID NO: 733913 - RNA, 19 nt, Homo sapiens
gucagaaauuuggagaaua

SEQ ID NO: 733914 - RNA, 19 nt, Homo sapiens
ggugguacgcuagaaauaa

SEQ ID NO: 733915 - RNA, 19 nt, Homo sapiens
gcagaaauaagaaucaaac

SEQ ID NO: 733916 - RNA, 19 nt, Homo sapiens
gcgagacccuuggccugua

SEQ ID NO: 733917 - RNA, 19 nt, Homo sapiens
caacagauucuuacaacca

SEQ ID NO: 733918 - RNA, 19 nt, Homo sapiens
gcacaugucaguggaagau

SEQ ID NO: 733919 - RNA, 19 nt, Homo sapiens
uacaagcccugaaagaauc

SEQ ID NO: 733920 - RNA, 19 nt, Homo sapiens
gauagcaguagcauucuug

SEQ ID NO: 733921 - RNA, 19 nt, Homo sapiens
cagagccgguucuucuuga

SEQ ID NO: 733922 - RNA, 19 nt, Homo sapiens
ccaaguuccuucagauuuu

SEQ ID NO: 733923 - RNA, 19 nt, Homo sapiens
gagauggaguccgauuuag

SEQ ID NO: 733924 - RNA, 19 nt, Homo sapiens
gcagaugcucaaacucaaa

SEQ ID NO: 733925 - RNA, 19 nt, Homo sapiens
caaccuuacuggaggauac

SEQ ID NO: 733926 - RNA, 19 nt, Homo sapiens
gccauguuauugauaucua

SEQ ID NO: 733927 - RNA, 19 nt, Homo sapiens
uaaucgagcugcuacaacu

SEQ ID NO: 733928 - RNA, 19 nt, Homo sapiens
gaaugguucagguucauga

SEQ ID NO: 733929 - RNA, 19 nt, Homo sapiens
ccucagaugccuuugauau

SEQ ID NO: 733930 - RNA, 19 nt, Homo sapiens
ccaccuaguuaugcuggua

SEQ ID NO: 733931 - RNA, 19 nt, Homo sapiens
acuuugggcuugcaacuuu

SEQ ID NO: 733932 - RNA, 19 nt, Homo sapiens
cagaugauguuaguuuaca

SEQ ID NO: 733933 - RNA, 19 nt, Homo sapiens
gaagucaggauaccaggau

SEQ ID NO: 733934 - RNA, 19 nt, Homo sapiens
uaacaauaguccugaugag

SEQ ID NO: 733935 - RNA, 19 nt, Homo sapiens
cgagugaccaccauugcua

SEQ ID NO: 733936 - RNA, 19 nt, Homo sapiens
gugauucuuucaauacuuc

SEQ ID NO: 733937 - RNA, 19 nt, Homo sapiens
gaagcagccucauuuguuu

SEQ ID NO: 733938 - RNA, 19 nt, Homo sapiens
gaggaucucauaacauuua

SEQ ID NO: 733939 - RNA, 19 nt, Homo sapiens
caucucaagucuucaauaa

SEQ ID NO: 733940 - RNA, 19 nt, Homo sapiens
caaaccagcuccuucaaga

SEQ ID NO: 733941 - RNA, 19 nt, Homo sapiens
gaauguacuucaucugguu

SEQ ID NO: 733942 - RNA, 19 nt, Homo sapiens
gauaagccuucccaguuga

SEQ ID NO: 733943 - RNA, 19 nt, Homo sapiens
agaagaagcagccucauuu

SEQ ID NO: 733944 - RNA, 19 nt, Homo sapiens
caagaagcuuugagcagaa

SEQ ID NO: 733945 - RNA, 19 nt, Homo sapiens
gaaauuccaugaucuugcu

SEQ ID NO: 733946 - RNA, 19 nt, Homo sapiens
gcagcucucuggcauguuc

SEQ ID NO: 733947 - RNA, 19 nt, Homo sapiens
gaagaagcagccucauuug

SEQ ID NO: 733948 - RNA, 19 nt, Homo sapiens
ugauaagccuucccaguug

SEQ ID NO: 733949 - RNA, 19 nt, Homo sapiens
ucucaagucuucaauaaag

SEQ ID NO: 733950 - RNA, 19 nt, Homo sapiens
ggagccaucugggauaaga

SEQ ID NO: 733951 - RNA, 19 nt, Homo sapiens
uccaugaucuugcuuauuc

SEQ ID NO: 733952 - RNA, 19 nt, Homo sapiens
caggagaaauuccaugauc

SEQ ID NO: 733953 - RNA, 19 nt, Homo sapiens
ggagaaauuccaugaucuu

SEQ ID NO: 733954 - RNA, 19 nt, Homo sapiens
gaagucccaucucaagucu

SEQ ID NO: 733955 - RNA, 19 nt, Homo sapiens
agaagcagccucauuuguu

SEQ ID NO: 733956 - RNA, 19 nt, Homo sapiens
gggcagcucucuggcaugu

SEQ ID NO: 733957 - RNA, 19 nt, Homo sapiens
caguuuauccuguaucauu

SEQ ID NO: 733958 - RNA, 19 nt, Homo sapiens
ggaagucccaucucaaguc

SEQ ID NO: 733959 - RNA, 19 nt, Homo sapiens
caucccaguuuauccugua

SEQ ID NO: 733960 - RNA, 19 nt, Homo sapiens
ccuagcccaucccaguuua

SEQ ID NO: 733961 - RNA, 19 nt, Homo sapiens
gcuggauucccucugauaa

SEQ ID NO: 733962 - RNA, 19 nt, Homo sapiens
gaagcuuugagcagaauga

SEQ ID NO: 733963 - RNA, 19 nt, Homo sapiens
cugauaagccuucccaguu

SEQ ID NO: 733964 - RNA, 19 nt, Homo sapiens
gagaaauuccaugaucuug

SEQ ID NO: 733965 - RNA, 19 nt, Homo sapiens
auaagacuuugacccauga

SEQ ID NO: 733966 - RNA, 19 nt, Homo sapiens
gagcugggcauccaagaag

SEQ ID NO: 733967 - RNA, 19 nt, Homo sapiens
acauuuaacuugaggaacu

SEQ ID NO: 733968 - RNA, 19 nt, Homo sapiens
ggagcugggcauccaagaa

SEQ ID NO: 733969 - RNA, 19 nt, Homo sapiens
caucugggauaagacuuug

SEQ ID NO: 733970 - RNA, 19 nt, Homo sapiens
ccaggcagcacaagccauu

SEQ ID NO: 733971 - RNA, 19 nt, Homo sapiens
gcuauagcaccagcucuuu

SEQ ID NO: 733972 - RNA, 19 nt, Homo sapiens
ugucuaaccaagaucuaua

SEQ ID NO: 733973 - RNA, 19 nt, Homo sapiens
aagaagaagcagccucauu

SEQ ID NO: 733974 - RNA, 19 nt, Homo sapiens
gaagucaaaccagcuccuu

SEQ ID NO: 733975 - RNA, 19 nt, Homo sapiens
ugugauggcuccucagcau

SEQ ID NO: 733976 - RNA, 19 nt, Homo sapiens
gcuuugagcagaaugaagu

SEQ ID NO: 733977 - RNA, 19 nt, Homo sapiens
ggcuuggcauggcuaaguu

SEQ ID NO: 733978 - RNA, 19 nt, Homo sapiens
ugauggcuccucagcauga

SEQ ID NO: 733979 - RNA, 19 nt, Homo sapiens
ccacauccucugaguugga

SEQ ID NO: 733980 - RNA, 19 nt, Homo sapiens
agucccaucucaagucuuc

SEQ ID NO: 733981 - RNA, 19 nt, Homo sapiens
agcaugaucaggagaaauu

SEQ ID NO: 733982 - RNA, 19 nt, Homo sapiens
ucccacauccucugaguug

SEQ ID NO: 733983 - RNA, 19 nt, Homo sapiens
ccaucugggauaagacuuu

SEQ ID NO: 733984 - RNA, 19 nt, Homo sapiens
cuccaugucuaaccaagau

SEQ ID NO: 733985 - RNA, 19 nt, Homo sapiens
ccaucucaagucuucaaua

SEQ ID NO: 733986 - RNA, 19 nt, Homo sapiens
cacauccucugaguuggaa

SEQ ID NO: 733987 - RNA, 19 nt, Homo sapiens
cccaguuuauccuguauca

SEQ ID NO: 733988 - RNA, 19 nt, Homo sapiens
cuggagccaucugggauaa

SEQ ID NO: 733989 - RNA, 19 nt, Homo sapiens
ugggcuggauucccucuga

SEQ ID NO: 733990 - RNA, 19 nt, Homo sapiens
caccagcucuuuggcucuu

SEQ ID NO: 733991 - RNA, 19 nt, Homo sapiens
ucagcaugaucaggagaaa

SEQ ID NO: 733992 - RNA, 19 nt, Homo sapiens
aaaccagcuccuucaagaa

SEQ ID NO: 733993 - RNA, 19 nt, Homo sapiens
cauuuaacuugaggaacuu

SEQ ID NO: 733994 - RNA, 19 nt, Homo sapiens
gggcauccaagaagaagca

SEQ ID NO: 733995 - RNA, 19 nt, Homo sapiens
aagaagcagccucauuugu

SEQ ID NO: 733996 - RNA, 19 nt, Homo sapiens
gcugggcauccaagaagaa

SEQ ID NO: 733997 - RNA, 19 nt, Homo sapiens
ggcuggauucccucugaua

SEQ ID NO: 733998 - RNA, 19 nt, Homo sapiens
gggcuggauucccucugau

SEQ ID NO: 733999 - RNA, 19 nt, Homo sapiens
ccacucaggaccucucaag

SEQ ID NO: 734000 - RNA, 19 nt, Homo sapiens
aagaagcuuugagcagaau

SEQ ID NO: 734001 - RNA, 19 nt, Homo sapiens
aggagaaauuccaugaucu

SEQ ID NO: 734002 - RNA, 19 nt, Homo sapiens
ggaaugaccuugugauuuc

SEQ ID NO: 734003 - RNA, 19 nt, Homo sapiens
gacagaagguugccacaua

SEQ ID NO: 734004 - RNA, 19 nt, Homo sapiens
ggaguaacauguuuaauca

SEQ ID NO: 734005 - RNA, 19 nt, Homo sapiens
ccacaucuccuaaaucuua

SEQ ID NO: 734006 - RNA, 19 nt, Homo sapiens
gaaugacgcugccaccuuu

SEQ ID NO: 734007 - RNA, 19 nt, Homo sapiens
ggacaggaaugaccuugug

SEQ ID NO: 734008 - RNA, 19 nt, Homo sapiens
agacugagcugaaacaagu

SEQ ID NO: 734009 - RNA, 19 nt, Homo sapiens
gauccaaguuaaucacuga

SEQ ID NO: 734010 - RNA, 19 nt, Homo sapiens
gaaacaaguggcuuacauu

SEQ ID NO: 734011 - RNA, 19 nt, Homo sapiens
ggagacccaugcagaaaug

SEQ ID NO: 734012 - RNA, 19 nt, Homo sapiens
gaaaugaacauacuuaucc

SEQ ID NO: 734013 - RNA, 19 nt, Homo sapiens
uggauugggugaagucaua

SEQ ID NO: 734014 - RNA, 19 nt, Homo sapiens
cagaugaccagaagacaua

SEQ ID NO: 734015 - RNA, 19 nt, Homo sapiens
ggauggugauuauagagaa

SEQ ID NO: 734016 - RNA, 19 nt, Homo sapiens
gaacuucaagcauacauca

SEQ ID NO: 734017 - RNA, 19 nt, Homo sapiens
cacugaaccugcagaaauu

SEQ ID NO: 734018 - RNA, 19 nt, Homo sapiens
aaacaaguggcuuacauuu

SEQ ID NO: 734019 - RNA, 19 nt, Homo sapiens
ggaguuggaaggaaagaaa

SEQ ID NO: 734020 - RNA, 19 nt, Homo sapiens
gggagagugccaacaauuu

SEQ ID NO: 734021 - RNA, 19 nt, Homo sapiens
gaucaacucccaggacauu

SEQ ID NO: 734022 - RNA, 19 nt, Homo sapiens
gggaaaguaaacuccauua

SEQ ID NO: 734023 - RNA, 19 nt, Homo sapiens
ccacauauaccucagugaa

SEQ ID NO: 734024 - RNA, 19 nt, Homo sapiens
ugaaacaaguggcuuacau

SEQ ID NO: 734025 - RNA, 19 nt, Homo sapiens
ugccaacaauuuccauuaa

SEQ ID NO: 734026 - RNA, 19 nt, Homo sapiens
gggaguaacauguuuaauc

SEQ ID NO: 734027 - RNA, 19 nt, Homo sapiens
gaagcagaauggccaacau

SEQ ID NO: 734028 - RNA, 19 nt, Homo sapiens
ucacugaaccugcagaaau

SEQ ID NO: 734029 - RNA, 19 nt, Homo sapiens
ggaaaguaaacuccauuau

SEQ ID NO: 734030 - RNA, 19 nt, Homo sapiens
acagaagguugccacauau

SEQ ID NO: 734031 - RNA, 19 nt, Homo sapiens
ggagagugccaacaauuuc

SEQ ID NO: 734032 - RNA, 19 nt, Homo sapiens
aagcauacaucaaggaaca

SEQ ID NO: 734033 - RNA, 19 nt, Homo sapiens
ggucuuaaaggacuacaaa

SEQ ID NO: 734034 - RNA, 19 nt, Homo sapiens
uuaaaggacuacaaacaca

SEQ ID NO: 734035 - RNA, 19 nt, Homo sapiens
cuaacagggucuuaaagga

SEQ ID NO: 734036 - RNA, 19 nt, Homo sapiens
acauauaccucagugaaga

SEQ ID NO: 734037 - RNA, 19 nt, Homo sapiens
gccaacaauuuccauuaau

SEQ ID NO: 734038 - RNA, 19 nt, Homo sapiens
ugggugaagucauauuuga

SEQ ID NO: 734039 - RNA, 19 nt, Homo sapiens
ucccaaaccugguccuuau

SEQ ID NO: 734040 - RNA, 19 nt, Homo sapiens
caucugaaaugaacauacu

SEQ ID NO: 734041 - RNA, 19 nt, Homo sapiens
ucaggauggugauuauaga

SEQ ID NO: 734042 - RNA, 19 nt, Homo sapiens
gugccaacaauuuccauua

SEQ ID NO: 734043 - RNA, 19 nt, Homo sapiens
ggacauucaaauccaggua

SEQ ID NO: 734044 - RNA, 19 nt, Homo sapiens
gaacauuuggagugaacuu

SEQ ID NO: 734045 - RNA, 19 nt, Homo sapiens
ccucagugaagaugcauua

SEQ ID NO: 734046 - RNA, 19 nt, Homo sapiens
gaaugaccuugugauuuca

SEQ ID NO: 734047 - RNA, 19 nt, Homo sapiens
uucaggaaauccaaacuuu

SEQ ID NO: 734048 - RNA, 19 nt, Homo sapiens
ccaagucccacaucuccua

SEQ ID NO: 734049 - RNA, 19 nt, Homo sapiens
aagcaucccugcccuugga

SEQ ID NO: 734050 - RNA, 19 nt, Homo sapiens
gauggugauuauagagaau

SEQ ID NO: 734051 - RNA, 19 nt, Homo sapiens
caaaagggcuccgccaugu

SEQ ID NO: 734052 - RNA, 19 nt, Homo sapiens
gcacuucugaaacccauau

SEQ ID NO: 734053 - RNA, 19 nt, Homo sapiens
cagcgggcuuuccuucuga

SEQ ID NO: 734054 - RNA, 19 nt, Homo sapiens
acaaguggcuuacauuuuc

SEQ ID NO: 734055 - RNA, 19 nt, Homo sapiens
ggagaguggaguaccaaga

SEQ ID NO: 734056 - RNA, 19 nt, Homo sapiens
acacuaacagggucuuaaa

SEQ ID NO: 734057 - RNA, 19 nt, Homo sapiens
cagaagguugccacauaua

SEQ ID NO: 734058 - RNA, 19 nt, Homo sapiens
gacauucaaauccagguaa

SEQ ID NO: 734059 - RNA, 19 nt, Homo sapiens
agaaauggagaguggagua

SEQ ID NO: 734060 - RNA, 19 nt, Homo sapiens
ucccacaucuccuaaaucu

SEQ ID NO: 734061 - RNA, 19 nt, Homo sapiens
uaaccagggagaagcaauu

SEQ ID NO: 734062 - RNA, 19 nt, Homo sapiens
cggaaaagauucaggaaau

SEQ ID NO: 734063 - RNA, 19 nt, Homo sapiens
acaagcugauggacaguau

SEQ ID NO: 734064 - RNA, 19 nt, Homo sapiens
gagaagcaauuacaaaagg

SEQ ID NO: 734065 - RNA, 19 nt, Homo sapiens
ccagcgggcuuuccuucug

SEQ ID NO: 734066 - RNA, 19 nt, Homo sapiens
caagacagcaugggaugga

SEQ ID NO: 734067 - RNA, 19 nt, Homo sapiens
cagugaagaugcauuagac

SEQ ID NO: 734068 - RNA, 19 nt, Homo sapiens
caggaaugaccuugugauu

SEQ ID NO: 734069 - RNA, 19 nt, Homo sapiens
ucuccuaaaucuuauccuu

SEQ ID NO: 734070 - RNA, 19 nt, Homo sapiens
ccagggccaccuccacuuu

SEQ ID NO: 734071 - RNA, 19 nt, Homo sapiens
gaaccugcagaaauuaugg

SEQ ID NO: 734072 - RNA, 19 nt, Homo sapiens
ugaagaugcauuagacugu

SEQ ID NO: 734073 - RNA, 19 nt, Homo sapiens
guaccaagaggacaggaau

SEQ ID NO: 734074 - RNA, 19 nt, Homo sapiens
caaggagggcaaacucaau

SEQ ID NO: 734075 - RNA, 19 nt, Homo sapiens
caacuuaaccagggagaag

SEQ ID NO: 734076 - RNA, 19 nt, Homo sapiens
cgaccacggauuugcauug

SEQ ID NO: 734077 - RNA, 19 nt, Homo sapiens
gauggccucucaguaccaa

SEQ ID NO: 734078 - RNA, 19 nt, Homo sapiens
gcagaauggccaacaugca

SEQ ID NO: 734079 - RNA, 19 nt, Homo sapiens
gggcagcgaagcagaaugg

SEQ ID NO: 734080 - RNA, 19 nt, Homo sapiens
aggaaugaccuugugauuu

SEQ ID NO: 734081 - RNA, 19 nt, Homo sapiens
gagaguggaguaccaagag

SEQ ID NO: 734082 - RNA, 19 nt, Homo sapiens
ccagggagaagcaauuaca

SEQ ID NO: 734083 - RNA, 19 nt, Homo sapiens
ugaaugacgcugccaccuu

SEQ ID NO: 734084 - RNA, 19 nt, Homo sapiens
ccaaaccugguccuuaugu

SEQ ID NO: 734085 - RNA, 19 nt, Homo sapiens
ucagugaagaugcauuaga

SEQ ID NO: 734086 - RNA, 19 nt, Homo sapiens
acaguaugguggccgaguu

SEQ ID NO: 734087 - RNA, 19 nt, Homo sapiens
gugaagucauauuugaaca

SEQ ID NO: 734088 - RNA, 19 nt, Homo sapiens
ggacuacaaacacagugau

SEQ ID NO: 734089 - RNA, 19 nt, Homo sapiens
gacaagcugauggacagua

SEQ ID NO: 734090 - RNA, 19 nt, Homo sapiens
aagaugcauuagacuguga

SEQ ID NO: 734091 - RNA, 19 nt, Homo sapiens
ccauuauaauugacaacug

SEQ ID NO: 734092 - RNA, 19 nt, Homo sapiens
ucaaggagggcaaacucaa

SEQ ID NO: 734093 - RNA, 19 nt, Homo sapiens
aaagggcuccgccauguca

SEQ ID NO: 734094 - RNA, 19 nt, Homo sapiens
gggagaagcaauuacaaaa

SEQ ID NO: 734095 - RNA, 19 nt, Homo sapiens
cguggaagccuuugacaag

SEQ ID NO: 734096 - RNA, 19 nt, Homo sapiens
gaccuugugauuucagaga

SEQ ID NO: 734097 - RNA, 19 nt, Homo sapiens
gaaauggagaguggaguac

SEQ ID NO: 734098 - RNA, 19 nt, Homo sapiens
uguuggaguuggaaggaaa

SEQ ID NO: 734099 - RNA, 19 nt, Homo sapiens
gcuccgccaugucacagau

SEQ ID NO: 734100 - RNA, 19 nt, Homo sapiens
uuucgagaaugaaggcaaa

SEQ ID NO: 734101 - RNA, 19 nt, Homo sapiens
ucaagcauacaucaaggaa

SEQ ID NO: 734102 - RNA, 19 nt, Homo sapiens
ggacagagcugcaggcuua

SEQ ID NO: 734103 - RNA, 19 nt, Homo sapiens
ugacagaaauugcuggaua

SEQ ID NO: 734104 - RNA, 19 nt, Homo sapiens
gaagaucaguaaagagauu

SEQ ID NO: 734105 - RNA, 19 nt, Homo sapiens
gcuuauggcuucugucuaa

SEQ ID NO: 734106 - RNA, 19 nt, Homo sapiens
acaaagauguggauaagaa

SEQ ID NO: 734107 - RNA, 19 nt, Homo sapiens
gcagcaaguuguuuaauca

SEQ ID NO: 734108 - RNA, 19 nt, Homo sapiens
guagauaacuguaagaaac

SEQ ID NO: 734109 - RNA, 19 nt, Homo sapiens
gacagaaauugcuggauaa

SEQ ID NO: 734110 - RNA, 19 nt, Homo sapiens
uaagaaacuuggccuggua

SEQ ID NO: 734111 - RNA, 19 nt, Homo sapiens
gcagaguacuugaagauca

SEQ ID NO: 734112 - RNA, 19 nt, Homo sapiens
gcacugcuaauguaaauuu

SEQ ID NO: 734113 - RNA, 19 nt, Homo sapiens
ggagccagcuguacuugaa

SEQ ID NO: 734114 - RNA, 19 nt, Homo sapiens
ggaauuaacagaucagaau

SEQ ID NO: 734115 - RNA, 19 nt, Homo sapiens
ucaaagaagugauaaccuu

SEQ ID NO: 734116 - RNA, 19 nt, Homo sapiens
guaaggaugucaaaguuca

SEQ ID NO: 734117 - RNA, 19 nt, Homo sapiens
guacaaagauguggauaag

SEQ ID NO: 734118 - RNA, 19 nt, Homo sapiens
ccacacagguuugaaguug

SEQ ID NO: 734119 - RNA, 19 nt, Homo sapiens
agaauucccuggauuguga

SEQ ID NO: 734120 - RNA, 19 nt, Homo sapiens
ugaaacauguaucugauga

SEQ ID NO: 734121 - RNA, 19 nt, Homo sapiens
gcacuguucgcgcagauua

SEQ ID NO: 734122 - RNA, 19 nt, Homo sapiens
gcagaaacaugcggagaug

SEQ ID NO: 734123 - RNA, 19 nt, Homo sapiens
gaaugaugccgccauguuu

SEQ ID NO: 734124 - RNA, 19 nt, Homo sapiens
gaaacagguggcuuacaua

SEQ ID NO: 734125 - RNA, 19 nt, Homo sapiens
gcaagaauucccuggauug

SEQ ID NO: 734126 - RNA, 19 nt, Homo sapiens
gaaccgaggcagcaaguug

SEQ ID NO: 734127 - RNA, 19 nt, Homo sapiens
gguuacagcuucucagugu

SEQ ID NO: 734128 - RNA, 19 nt, Homo sapiens
gagcaagaauucccuggau

SEQ ID NO: 734129 - RNA, 19 nt, Homo sapiens
caagaacccugcccugaag

SEQ ID NO: 734130 - RNA, 19 nt, Homo sapiens
uagacugggucaaagcuua

SEQ ID NO: 734131 - RNA, 19 nt, Homo sapiens
gagagauuguccugugauu

SEQ ID NO: 734132 - RNA, 19 nt, Homo sapiens
agcagaagcugguguguuu

SEQ ID NO: 734133 - RNA, 19 nt, Homo sapiens
gcggugacuuuaaugaauu

SEQ ID NO: 734134 - RNA, 19 nt, Homo sapiens
ugaaacagguggcuuacau

SEQ ID NO: 734135 - RNA, 19 nt, Homo sapiens
gagcugcaggcuuacauua

SEQ ID NO: 734136 - RNA, 19 nt, Homo sapiens
caguaaggaugucaaaguu

SEQ ID NO: 734137 - RNA, 19 nt, Homo sapiens
cugagcaggugguccauua

SEQ ID NO: 734138 - RNA, 19 nt, Homo sapiens
uuaaggaacugccgacuag

SEQ ID NO: 734139 - RNA, 19 nt, Homo sapiens
ccugaggccuguggaaaua

SEQ ID NO: 734140 - RNA, 19 nt, Homo sapiens
gagauuguccugugauuuc

SEQ ID NO: 734141 - RNA, 19 nt, Homo sapiens
gcaggaaggugcagcuuuu

SEQ ID NO: 734142 - RNA, 19 nt, Homo sapiens
gcccuuaugugaaagaaau

SEQ ID NO: 734143 - RNA, 19 nt, Homo sapiens
acagguggcuuacauauac

SEQ ID NO: 734144 - RNA, 19 nt, Homo sapiens
ggacaaacacuuaccaaaa

SEQ ID NO: 734145 - RNA, 19 nt, Homo sapiens
cauuauggcugacaugcaa

SEQ ID NO: 734146 - RNA, 19 nt, Homo sapiens
ggacuggccuggagcaaaa

SEQ ID NO: 734147 - RNA, 19 nt, Homo sapiens
caucuagcauuccauacaa

SEQ ID NO: 734148 - RNA, 19 nt, Homo sapiens
ggacugaugaugcauuuua

SEQ ID NO: 734149 - RNA, 19 nt, Homo sapiens
gacaaacacuuaccaaaau

SEQ ID NO: 734150 - RNA, 19 nt, Homo sapiens
caaaccgaguccucaaaga

SEQ ID NO: 734151 - RNA, 19 nt, Homo sapiens
ucucagagcagaucaaaga

SEQ ID NO: 734152 - RNA, 19 nt, Homo sapiens
gcaccuuccuauagagaug

SEQ ID NO: 734153 - RNA, 19 nt, Homo sapiens
agaaggcggugacuuuaau

SEQ ID NO: 734154 - RNA, 19 nt, Homo sapiens
gaaauagucagugccaaau

SEQ ID NO: 734155 - RNA, 19 nt, Homo sapiens
gaaggagccagcuguacuu

SEQ ID NO: 734156 - RNA, 19 nt, Homo sapiens
ugucuucacugccuccuuu

SEQ ID NO: 734157 - RNA, 19 nt, Homo sapiens
gauagcaggucaguugauc

SEQ ID NO: 734158 - RNA, 19 nt, Homo sapiens
gagcagaucaaagaaguga

SEQ ID NO: 734159 - RNA, 19 nt, Homo sapiens
gguaaagugccaaccauau

SEQ ID NO: 734160 - RNA, 19 nt, Homo sapiens
cagagcagaucaaagaagu

SEQ ID NO: 734161 - RNA, 19 nt, Homo sapiens
gaaaacagucccuggaauu

SEQ ID NO: 734162 - RNA, 19 nt, Homo sapiens
gaugaugcauuuuagcuuu

SEQ ID NO: 734163 - RNA, 19 nt, Homo sapiens
ugucaaaguucagguaaug

SEQ ID NO: 734164 - RNA, 19 nt, Homo sapiens
cgaggcagcaaguuguuua

SEQ ID NO: 734165 - RNA, 19 nt, Homo sapiens
caacaguaaggaugucaaa

SEQ ID NO: 734166 - RNA, 19 nt, Homo sapiens
caaaucaagggcaaaauua

SEQ ID NO: 734167 - RNA, 19 nt, Homo sapiens
aaacauguaucugaugaca

SEQ ID NO: 734168 - RNA, 19 nt, Homo sapiens
cauuacacaugcccugaaa

SEQ ID NO: 734169 - RNA, 19 nt, Homo sapiens
gcauguagacugggucaaa

SEQ ID NO: 734170 - RNA, 19 nt, Homo sapiens
ccucuaggacaaacacuua

SEQ ID NO: 734171 - RNA, 19 nt, Homo sapiens
uaggacugaugaugcauuu

SEQ ID NO: 734172 - RNA, 19 nt, Homo sapiens
gcucugagaagcacagcua

SEQ ID NO: 734173 - RNA, 19 nt, Homo sapiens
ggcggugacuuuaaugaau

SEQ ID NO: 734174 - RNA, 19 nt, Homo sapiens
ugaaauagucagugccaaa

SEQ ID NO: 734175 - RNA, 19 nt, Homo sapiens
caaacgagccacaaagaag

SEQ ID NO: 734176 - RNA, 19 nt, Homo sapiens
ucaaagaguacaaagaugu

SEQ ID NO: 734177 - RNA, 19 nt, Homo sapiens
ggcagcaaguuguuuaauc

SEQ ID NO: 734178 - RNA, 19 nt, Homo sapiens
aaacagucccuggaauuaa

SEQ ID NO: 734179 - RNA, 19 nt, Homo sapiens
gccaguccauucuuaagga

SEQ ID NO: 734180 - RNA, 19 nt, Homo sapiens
gcaggucaguugaucuucu

SEQ ID NO: 734181 - RNA, 19 nt, Homo sapiens
gagcaugaagguagcagaa

SEQ ID NO: 734182 - RNA, 19 nt, Homo sapiens
gaauuaacagaucagaaug

SEQ ID NO: 734183 - RNA, 19 nt, Homo sapiens
caugaagacucacaagaac

SEQ ID NO: 734184 - RNA, 19 nt, Homo sapiens
ccuauaagcauuccuuuua

SEQ ID NO: 734185 - RNA, 19 nt, Homo sapiens
uacagaaggcggugacuuu

SEQ ID NO: 734186 - RNA, 19 nt, Homo sapiens
guaaagugccaaccauauc

SEQ ID NO: 734187 - RNA, 19 nt, Homo sapiens
uggagauaaucaacaguaa

SEQ ID NO: 734188 - RNA, 19 nt, Homo sapiens
ccaaacgagccacaaagaa

SEQ ID NO: 734189 - RNA, 19 nt, Homo sapiens
gcugaggcuuggccaucua

SEQ ID NO: 734190 - RNA, 19 nt, Homo sapiens
ccaaccauauccaucaaca

SEQ ID NO: 734191 - RNA, 19 nt, Homo sapiens
guggagauaaucaacagua

SEQ ID NO: 734192 - RNA, 19 nt, Homo sapiens
aaacagguggcuuacauau

SEQ ID NO: 734193 - RNA, 19 nt, Homo sapiens
uuuccaaccuggugauuga

SEQ ID NO: 734194 - RNA, 19 nt, Homo sapiens
ugaggccuguggaaauaaa

SEQ ID NO: 734195 - RNA, 19 nt, Homo sapiens
gcccagcaccuuccuauag

SEQ ID NO: 734196 - RNA, 19 nt, Homo sapiens
gagaugguccacacagguu

SEQ ID NO: 734197 - RNA, 19 nt, Homo sapiens
cagaaggcggugacuuuaa

SEQ ID NO: 734198 - RNA, 19 nt, Homo sapiens
gaugucaaaguucagguaa

SEQ ID NO: 734199 - RNA, 19 nt, Homo sapiens
gagauaaucaacaguaagg

SEQ ID NO: 734200 - RNA, 19 nt, Homo sapiens
gcaaaucaagggcaaaauu

SEQ ID NO: 734201 - RNA, 19 nt, Homo sapiens
ccucaaagaguacaaagau

SEQ ID NO: 734202 - RNA, 19 nt, Homo sapiens
ggaggaagauucgaaauaa

SEQ ID NO: 734203 - RNA, 19 nt, Homo sapiens
caacugaccucccugaaca

SEQ ID NO: 734204 - RNA, 19 nt, Homo sapiens
gaacaggugaggaaagaaa

SEQ ID NO: 734205 - RNA, 19 nt, Homo sapiens
gaggaagauucgaaauaaa

SEQ ID NO: 734206 - RNA, 19 nt, Homo sapiens
gaaauacacagcccagaau

SEQ ID NO: 734207 - RNA, 19 nt, Homo sapiens
ccaagccucuucucaguug

SEQ ID NO: 734208 - RNA, 19 nt, Homo sapiens
gggaacaggugaggaaaga

SEQ ID NO: 734209 - RNA, 19 nt, Homo sapiens
agagcagggucuugaaaua

SEQ ID NO: 734210 - RNA, 19 nt, Homo sapiens
uaagacagaggaacaaauu

SEQ ID NO: 734211 - RNA, 19 nt, Homo sapiens
aaauggagcuggaauugga

SEQ ID NO: 734212 - RNA, 19 nt, Homo sapiens
aggcaaaucucacaaggaa

SEQ ID NO: 734213 - RNA, 19 nt, Homo sapiens
gaauuugucccuucuagau

SEQ ID NO: 734214 - RNA, 19 nt, Homo sapiens
gggaaacugucucuaugga

SEQ ID NO: 734215 - RNA, 19 nt, Homo sapiens
aaacacaccacacuuaaug

SEQ ID NO: 734216 - RNA, 19 nt, Homo sapiens
agaggaaaguggagauuug

SEQ ID NO: 734217 - RNA, 19 nt, Homo sapiens
ggacggcucagacugugua

SEQ ID NO: 734218 - RNA, 19 nt, Homo sapiens
uaaaagaucugcucaagag

SEQ ID NO: 734219 - RNA, 19 nt, Homo sapiens
ucaaacacaccacacuuaa

SEQ ID NO: 734220 - RNA, 19 nt, Homo sapiens
agaagagucuauuggagaa

SEQ ID NO: 734221 - RNA, 19 nt, Homo sapiens
agucagaagugccgaaaga

SEQ ID NO: 734222 - RNA, 19 nt, Homo sapiens
auauggagcuucagaacaa

SEQ ID NO: 734223 - RNA, 19 nt, Homo sapiens
ugaccucccugaacauuuc

SEQ ID NO: 734224 - RNA, 19 nt, Homo sapiens
cagauacucaggcuagaua

SEQ ID NO: 734225 - RNA, 19 nt, Homo sapiens
cuuccugccugcugcauua

SEQ ID NO: 734226 - RNA, 19 nt, Homo sapiens
caagagagccgcaggaaaa

SEQ ID NO: 734227 - RNA, 19 nt, Homo sapiens
cuauggaucuagagaguga

SEQ ID NO: 734228 - RNA, 19 nt, Homo sapiens
gccauucccugaccucuuc

SEQ ID NO: 734229 - RNA, 19 nt, Homo sapiens
ccagaugacuccacagcau

SEQ ID NO: 734230 - RNA, 19 nt, Homo sapiens
cggaggaagauucgaaaua

SEQ ID NO: 734231 - RNA, 19 nt, Homo sapiens
ccaaauggagcuggaauug

SEQ ID NO: 734232 - RNA, 19 nt, Homo sapiens
gcuauguacuccucugaca

SEQ ID NO: 734233 - RNA, 19 nt, Homo sapiens
gaacaaaguacagcuucug

SEQ ID NO: 734234 - RNA, 19 nt, Homo sapiens
ggagagggcuauggaaagc

SEQ ID NO: 734235 - RNA, 19 nt, Homo sapiens
ugaaauacacagcccagaa

SEQ ID NO: 734236 - RNA, 19 nt, Homo sapiens
ccaucuguguccaaauaaa

SEQ ID NO: 734237 - RNA, 19 nt, Homo sapiens
ggcuaguacugacagauga

SEQ ID NO: 734238 - RNA, 19 nt, Homo sapiens
gagagugagagcuguagaa

SEQ ID NO: 734239 - RNA, 19 nt, Homo sapiens
gagagcagggucuugaaau

SEQ ID NO: 734240 - RNA, 19 nt, Homo sapiens
cagaugacuccacagcaua

SEQ ID NO: 734241 - RNA, 19 nt, Homo sapiens
agacacuuccucucacuaa

SEQ ID NO: 734242 - RNA, 19 nt, Homo sapiens
gaauguaccuggggaaauc

SEQ ID NO: 734243 - RNA, 19 nt, Homo sapiens
caaacacaccacacuuaau

SEQ ID NO: 734244 - RNA, 19 nt, Homo sapiens
caggcuagauaugaggaua

SEQ ID NO: 734245 - RNA, 19 nt, Homo sapiens
gaauauggagcuucagaac

SEQ ID NO: 734246 - RNA, 19 nt, Homo sapiens
aaauacacagcccagaaua

SEQ ID NO: 734247 - RNA, 19 nt, Homo sapiens
ggaacaaauucugaaacgu

SEQ ID NO: 734248 - RNA, 19 nt, Homo sapiens
ggugaggaaagaaauaaau

SEQ ID NO: 734249 - RNA, 19 nt, Homo sapiens
gaaaagaggggacccagau

SEQ ID NO: 734250 - RNA, 19 nt, Homo sapiens
acugggaaguagaugauuu

SEQ ID NO: 734251 - RNA, 19 nt, Homo sapiens
caccacacuuaauggcuuu

SEQ ID NO: 734252 - RNA, 19 nt, Homo sapiens
cucaaacacaccacacuua

SEQ ID NO: 734253 - RNA, 19 nt, Homo sapiens
gcucaaacacaccacacuu

SEQ ID NO: 734254 - RNA, 19 nt, Homo sapiens
gcacccaagccucuucuca

SEQ ID NO: 734255 - RNA, 19 nt, Homo sapiens
guagagggacaguggauag

SEQ ID NO: 734256 - RNA, 19 nt, Homo sapiens
ucacuaagacagaggaaca

SEQ ID NO: 734257 - RNA, 19 nt, Homo sapiens
ggauggcuuccuacuggua

SEQ ID NO: 734258 - RNA, 19 nt, Homo sapiens
ggcuagaacucuuccuuuu

SEQ ID NO: 734259 - RNA, 19 nt, Homo sapiens
gggcuuauucugccugaga

SEQ ID NO: 734260 - RNA, 19 nt, Homo sapiens
gaggagaagagucuauugg

SEQ ID NO: 734261 - RNA, 19 nt, Homo sapiens
guuggaggcugaggagaau

SEQ ID NO: 734262 - RNA, 19 nt, Homo sapiens
cagcgucguugaacauucu

SEQ ID NO: 734263 - RNA, 19 nt, Homo sapiens
ucagggaacaggugaggaa

SEQ ID NO: 734264 - RNA, 19 nt, Homo sapiens
gcccacccuuuccguaguu

SEQ ID NO: 734265 - RNA, 19 nt, Homo sapiens
gagcagggucuugaaauac

SEQ ID NO: 734266 - RNA, 19 nt, Homo sapiens
caggugaggaaagaaauaa

SEQ ID NO: 734267 - RNA, 19 nt, Homo sapiens
ugucugggcuucggacguu

SEQ ID NO: 734268 - RNA, 19 nt, Homo sapiens
ggccauggugauugagaua

SEQ ID NO: 734269 - RNA, 19 nt, Homo sapiens
cagaauauggagcuucaga

SEQ ID NO: 734270 - RNA, 19 nt, Homo sapiens
ugaaacgugugcggaggaa

SEQ ID NO: 734271 - RNA, 19 nt, Homo sapiens
ggaaacugucucuauggau

SEQ ID NO: 734272 - RNA, 19 nt, Homo sapiens
acgggaaacugucucuaug

SEQ ID NO: 734273 - RNA, 19 nt, Homo sapiens
gacagauacucaggcuaga

SEQ ID NO: 734274 - RNA, 19 nt, Homo sapiens
ccauggugauugagauauc

SEQ ID NO: 734275 - RNA, 19 nt, Homo sapiens
cccagaauauggagcuuca

SEQ ID NO: 734276 - RNA, 19 nt, Homo sapiens
aaacgugugcggaggaaga

SEQ ID NO: 734277 - RNA, 19 nt, Homo sapiens
ccccaucuguguccaaaua

SEQ ID NO: 734278 - RNA, 19 nt, Homo sapiens
uagaucaacugaggaaacu

SEQ ID NO: 734279 - RNA, 19 nt, Homo sapiens
auacacagcccagaauaug

SEQ ID NO: 734280 - RNA, 19 nt, Homo sapiens
gaugaggagaagagucuau

SEQ ID NO: 734281 - RNA, 19 nt, Homo sapiens
ugacagaugaggagaagag

SEQ ID NO: 734282 - RNA, 19 nt, Homo sapiens
gaacuccaagucccacagu

SEQ ID NO: 734283 - RNA, 19 nt, Homo sapiens
auacucaggcuagauauga

SEQ ID NO: 734284 - RNA, 19 nt, Homo sapiens
gcagucagaagugccgaaa

SEQ ID NO: 734285 - RNA, 19 nt, Homo sapiens
acacagcccagaauaugga

SEQ ID NO: 734286 - RNA, 19 nt, Homo sapiens
ucaagagagccgcaggaaa

SEQ ID NO: 734287 - RNA, 19 nt, Homo sapiens
acaggugaggaaagaaaua

SEQ ID NO: 734288 - RNA, 19 nt, Homo sapiens
uuagagagcagggucuuga

SEQ ID NO: 734289 - RNA, 19 nt, Homo sapiens
gagcgacugggaaguagau

SEQ ID NO: 734290 - RNA, 19 nt, Homo sapiens
uagaggaaaguggagauuu

SEQ ID NO: 734291 - RNA, 19 nt, Homo sapiens
cagcuccugugcccuguca

SEQ ID NO: 734292 - RNA, 19 nt, Homo sapiens
cgacugggaaguagaugau

SEQ ID NO: 734293 - RNA, 19 nt, Homo sapiens
gauacucaggcuagauaug

SEQ ID NO: 734294 - RNA, 19 nt, Homo sapiens
uccaggccauggugauuga

SEQ ID NO: 734295 - RNA, 19 nt, Homo sapiens
ccggagagggcuauggaaa

SEQ ID NO: 734296 - RNA, 19 nt, Homo sapiens
agacagaggaacaaauucu

SEQ ID NO: 734297 - RNA, 19 nt, Homo sapiens
acacuuccucucacuaaga

SEQ ID NO: 734298 - RNA, 19 nt, Homo sapiens
cagaugaggagaagagucu

SEQ ID NO: 734299 - RNA, 19 nt, Homo sapiens
cagcugagcauggaguguu

SEQ ID NO: 734300 - RNA, 19 nt, Homo sapiens
ggagcuucagaacaaagua

SEQ ID NO: 734301 - RNA, 19 nt, Homo sapiens
agugagagcuguagaaaag

SEQ ID NO: 734302 - RNA, 19 nt, Homo sapiens
gcgaagagauggagauugg

SEQ ID NO: 734303 - RNA, 19 nt, Homo sapiens
agacugagcuuccaugaca

SEQ ID NO: 734304 - RNA, 19 nt, Homo sapiens
ucucacagcuggguuuaua

SEQ ID NO: 734305 - RNA, 19 nt, Homo sapiens
gaaggaggauggcgaagag

SEQ ID NO: 734306 - RNA, 19 nt, Homo sapiens
cauaauugcugaagagauc

SEQ ID NO: 734307 - RNA, 19 nt, Homo sapiens
gaagcgcccagcccaauuu

SEQ ID NO: 734308 - RNA, 19 nt, Homo sapiens
acuggaagcuucacaaaga

SEQ ID NO: 734309 - RNA, 19 nt, Homo sapiens
ggaccaggaugcagucaca

SEQ ID NO: 734310 - RNA, 19 nt, Homo sapiens
cugaagaccuguaugacuu

SEQ ID NO: 734311 - RNA, 19 nt, Homo sapiens
caucauaauugcugaagag

SEQ ID NO: 734312 - RNA, 19 nt, Homo sapiens
gcaaacaggcauucucaca

SEQ ID NO: 734313 - RNA, 19 nt, Homo sapiens
gaugguugcugcuaugaag

SEQ ID NO: 734314 - RNA, 19 nt, Homo sapiens
acaauggccugggcucuaa

SEQ ID NO: 734315 - RNA, 19 nt, Homo sapiens
gcacuggaagcuucacaaa

SEQ ID NO: 734316 - RNA, 19 nt, Homo sapiens
gcacccaggcuuuagagaa

SEQ ID NO: 734317 - RNA, 19 nt, Homo sapiens
caaacccuuucauaccuuu

SEQ ID NO: 734318 - RNA, 19 nt, Homo sapiens
aauaggcgaugaggagaua

SEQ ID NO: 734319 - RNA, 19 nt, Homo sapiens
uuacaguggucaucauaau

SEQ ID NO: 734320 - RNA, 19 nt, Homo sapiens
ggccugggcucuaacaucu

SEQ ID NO: 734321 - RNA, 19 nt, Homo sapiens
gaugaggagauaccagaaa

SEQ ID NO: 734322 - RNA, 19 nt, Homo sapiens
gcaccugccacucggguaa

SEQ ID NO: 734323 - RNA, 19 nt, Homo sapiens
ugagaugguugcugcuaug

SEQ ID NO: 734324 - RNA, 19 nt, Homo sapiens
ggccucaaacccuuucaua

SEQ ID NO: 734325 - RNA, 19 nt, Homo sapiens
aagggcaacuccacacuga

SEQ ID NO: 734326 - RNA, 19 nt, Homo sapiens
uaacaucuuccgccugcua

SEQ ID NO: 734327 - RNA, 19 nt, Homo sapiens
ccaguucuaucuuucucuu

SEQ ID NO: 734328 - RNA, 19 nt, Homo sapiens
aaccaccaguucuaucuuu

SEQ ID NO: 734329 - RNA, 19 nt, Homo sapiens
cuacggguccucucuauuc

SEQ ID NO: 734330 - RNA, 19 nt, Homo sapiens
gcaucucagugaccuguuc

SEQ ID NO: 734331 - RNA, 19 nt, Homo sapiens
guacaaccuagcccugaaa

SEQ ID NO: 734332 - RNA, 19 nt, Homo sapiens
gaaguggcuuguggagcuu

SEQ ID NO: 734333 - RNA, 19 nt, Homo sapiens
ucaaacccuuucauaccuu

SEQ ID NO: 734334 - RNA, 19 nt, Homo sapiens
acaguggucaucauaauug

SEQ ID NO: 734335 - RNA, 19 nt, Homo sapiens
cccaggccuucgcagauua

SEQ ID NO: 734336 - RNA, 19 nt, Homo sapiens
gagaagcgcccagcccaau

SEQ ID NO: 734337 - RNA, 19 nt, Homo sapiens
gguccucucuauucguguu

SEQ ID NO: 734338 - RNA, 19 nt, Homo sapiens
gguuacaguggucaucaua

SEQ ID NO: 734339 - RNA, 19 nt, Homo sapiens
cagcaaacaggcauucuca

SEQ ID NO: 734340 - RNA, 19 nt, Homo sapiens
agaccuguaugacuucguu

SEQ ID NO: 734341 - RNA, 19 nt, Homo sapiens
cagcuggguuuauagucuu

SEQ ID NO: 734342 - RNA, 19 nt, Homo sapiens
ggaagcuucacaaagauuc

SEQ ID NO: 734343 - RNA, 19 nt, Homo sapiens
ggaggauggcgaagagaug

SEQ ID NO: 734344 - RNA, 19 nt, Homo sapiens
ggccuucgcagauuauguu

SEQ ID NO: 734345 - RNA, 19 nt, Homo sapiens
gcaguuggagaugggauuu

SEQ ID NO: 734346 - RNA, 19 nt, Homo sapiens
cacccaggcuuuagagaag

SEQ ID NO: 734347 - RNA, 19 nt, Homo sapiens
caccugcgccucuuccaaa

SEQ ID NO: 734348 - RNA, 19 nt, Homo sapiens
gcaggcggaacagaccuua

SEQ ID NO: 734349 - RNA, 19 nt, Homo sapiens
gaggcagcccugacacuau

SEQ ID NO: 734350 - RNA, 19 nt, Homo sapiens
cagauuauguuagcaccau

SEQ ID NO: 734351 - RNA, 19 nt, Homo sapiens
aggcagcccugacacuaug

SEQ ID NO: 734352 - RNA, 19 nt, Homo sapiens
ccuuggagcuauucacagu

SEQ ID NO: 734353 - RNA, 19 nt, Homo sapiens
ggaugcugcugagcgaugu

SEQ ID NO: 734354 - RNA, 19 nt, Homo sapiens
caaccuagcccugaaaaga

SEQ ID NO: 734355 - RNA, 19 nt, Homo sapiens
ccugggcucuaacaucuuc

SEQ ID NO: 734356 - RNA, 19 nt, Homo sapiens
uauuguggcuggcgagaag

SEQ ID NO: 734357 - RNA, 19 nt, Homo sapiens
gagugaagccaagcagaug

SEQ ID NO: 734358 - RNA, 19 nt, Homo sapiens
gggcaacuccacacugaag

SEQ ID NO: 734359 - RNA, 19 nt, Homo sapiens
caguuccacucuccacaga

SEQ ID NO: 734360 - RNA, 19 nt, Homo sapiens
cccaggcuuuagagaagua

SEQ ID NO: 734361 - RNA, 19 nt, Homo sapiens
ucccaggccuucgcagauu

SEQ ID NO: 734362 - RNA, 19 nt, Homo sapiens
guuacaguggucaucauaa

SEQ ID NO: 734363 - RNA, 19 nt, Homo sapiens
acagcuggguuuauagucu

SEQ ID NO: 734364 - RNA, 19 nt, Homo sapiens
gagaugguugcugcuauga

SEQ ID NO: 734365 - RNA, 19 nt, Homo sapiens
cccaauuucugccugagau

SEQ ID NO: 734366 - RNA, 19 nt, Homo sapiens
ccaaccaccaguucuaucu

SEQ ID NO: 734367 - RNA, 19 nt, Homo sapiens
uggcagauguuuucucaga

SEQ ID NO: 734368 - RNA, 19 nt, Homo sapiens
cugcugugcuccguucuga

SEQ ID NO: 734369 - RNA, 19 nt, Homo sapiens
gccucacacucuccuacaa

SEQ ID NO: 734370 - RNA, 19 nt, Homo sapiens
uuggagcuauucacaguuc

SEQ ID NO: 734371 - RNA, 19 nt, Homo sapiens
cugcugggcuuaccacacu

SEQ ID NO: 734372 - RNA, 19 nt, Homo sapiens
ucacagcuggguuuauagu

SEQ ID NO: 734373 - RNA, 19 nt, Homo sapiens
caaccaccaguucuaucuu

SEQ ID NO: 734374 - RNA, 19 nt, Homo sapiens
uauguuagcaccaugugau

SEQ ID NO: 734375 - RNA, 19 nt, Homo sapiens
aaagacugagcuuccauga

SEQ ID NO: 734376 - RNA, 19 nt, Homo sapiens
ccuggauagugccaccuuu

SEQ ID NO: 734377 - RNA, 19 nt, Homo sapiens
uacaguggucaucauaauu

SEQ ID NO: 734378 - RNA, 19 nt, Homo sapiens
gagguuacaguggucauca

SEQ ID NO: 734379 - RNA, 19 nt, Homo sapiens
cuucuucuacauccucaua

SEQ ID NO: 734380 - RNA, 19 nt, Homo sapiens
cugagaugguugcugcuau

SEQ ID NO: 734381 - RNA, 19 nt, Homo sapiens
gcgcccagcccaauuucug

SEQ ID NO: 734382 - RNA, 19 nt, Homo sapiens
gcugugcuccguucugaag

SEQ ID NO: 734383 - RNA, 19 nt, Homo sapiens
gcugagcuccuggguguca

SEQ ID NO: 734384 - RNA, 19 nt, Homo sapiens
gaugaggcccagcaaacag

SEQ ID NO: 734385 - RNA, 19 nt, Homo sapiens
aguucuaucuuucucuuuc

SEQ ID NO: 734386 - RNA, 19 nt, Homo sapiens
uacaaacgggcaccagcua

SEQ ID NO: 734387 - RNA, 19 nt, Homo sapiens
gauucauccuccucucucu

SEQ ID NO: 734388 - RNA, 19 nt, Homo sapiens
aguacaaccuagcccugaa

SEQ ID NO: 734389 - RNA, 19 nt, Homo sapiens
ccacauaauaggcgaugag

SEQ ID NO: 734390 - RNA, 19 nt, Homo sapiens
gcuacggguccucucuauu

SEQ ID NO: 734391 - RNA, 19 nt, Homo sapiens
gagcugacacgugcuaucg

SEQ ID NO: 734392 - RNA, 19 nt, Homo sapiens
agaggcagcccugacacua

SEQ ID NO: 734393 - RNA, 19 nt, Homo sapiens
gcucagaaaucauagaaga

SEQ ID NO: 734394 - RNA, 19 nt, Homo sapiens
caacaagaccaguaugaua

SEQ ID NO: 734395 - RNA, 19 nt, Homo sapiens
gaggagacaugaaauaugg

SEQ ID NO: 734396 - RNA, 19 nt, Homo sapiens
ggaacaacgagaccaguua

SEQ ID NO: 734397 - RNA, 19 nt, Homo sapiens
guucaaggaugcacuguau

SEQ ID NO: 734398 - RNA, 19 nt, Homo sapiens
ugucuaagcuucgaaacua

SEQ ID NO: 734399 - RNA, 19 nt, Homo sapiens
ccacuuaaaugugaaggaa

SEQ ID NO: 734400 - RNA, 19 nt, Homo sapiens
gaacuuugaccuugugaau

SEQ ID NO: 734401 - RNA, 19 nt, Homo sapiens
cauauaugcuguagagaau

SEQ ID NO: 734402 - RNA, 19 nt, Homo sapiens
caacaggaagcaaaugaaa

SEQ ID NO: 734403 - RNA, 19 nt, Homo sapiens
ggaagauucuccguucaau

SEQ ID NO: 734404 - RNA, 19 nt, Homo sapiens
cacagagacugaccagauu

SEQ ID NO: 734405 - RNA, 19 nt, Homo sapiens
uauaugcuguagagaauga

SEQ ID NO: 734406 - RNA, 19 nt, Homo sapiens
ccacagagacugaccagau

SEQ ID NO: 734407 - RNA, 19 nt, Homo sapiens
gugagaagcacaccuuuga

SEQ ID NO: 734408 - RNA, 19 nt, Homo sapiens
gaacaacgagaccaguuag

SEQ ID NO: 734409 - RNA, 19 nt, Homo sapiens
gaggagggaggaaagauga

SEQ ID NO: 734410 - RNA, 19 nt, Homo sapiens
ugaaucggcuacagucuca

SEQ ID NO: 734411 - RNA, 19 nt, Homo sapiens
ucgagaagcugcacgagau

SEQ ID NO: 734412 - RNA, 19 nt, Homo sapiens
guggauagaauaagcauau

SEQ ID NO: 734413 - RNA, 19 nt, Homo sapiens
gaacguaccaagaguagac

SEQ ID NO: 734414 - RNA, 19 nt, Homo sapiens
gcaacaggaagcaaaugaa

SEQ ID NO: 734415 - RNA, 19 nt, Homo sapiens
cgacuucucgucaggcuuu

SEQ ID NO: 734416 - RNA, 19 nt, Homo sapiens
gagcaaaagucggaagauu

SEQ ID NO: 734417 - RNA, 19 nt, Homo sapiens
guagagaaugagcauauga

SEQ ID NO: 734418 - RNA, 19 nt, Homo sapiens
gagaagcacaccuuugaca

SEQ ID NO: 734419 - RNA, 19 nt, Homo sapiens
cgagaccaguuagaacgua

SEQ ID NO: 734420 - RNA, 19 nt, Homo sapiens
gaaggaacaacagcaacaa

SEQ ID NO: 734421 - RNA, 19 nt, Homo sapiens
uuagggauguggauagaau

SEQ ID NO: 734422 - RNA, 19 nt, Homo sapiens
gaagauucuccguucaaug

SEQ ID NO: 734423 - RNA, 19 nt, Homo sapiens
ggaccuugcuaaacuccau

SEQ ID NO: 734424 - RNA, 19 nt, Homo sapiens
acaagaccaguaugauaua

SEQ ID NO: 734425 - RNA, 19 nt, Homo sapiens
ugaacguucucaucggauu

SEQ ID NO: 734426 - RNA, 19 nt, Homo sapiens
ccagaacuuugaccuugug

SEQ ID NO: 734427 - RNA, 19 nt, Homo sapiens
gaccagauuggcucagaaa

SEQ ID NO: 734428 - RNA, 19 nt, Homo sapiens
gcaacaagaccaguaugau

SEQ ID NO: 734429 - RNA, 19 nt, Homo sapiens
agaaugagcauaugaaucg

SEQ ID NO: 734430 - RNA, 19 nt, Homo sapiens
gagaaugagcauaugaauc

SEQ ID NO: 734431 - RNA, 19 nt, Homo sapiens
ggaggagggaggaaagaug

SEQ ID NO: 734432 - RNA, 19 nt, Homo sapiens
ggauguggauagaauaagc

SEQ ID NO: 734433 - RNA, 19 nt, Homo sapiens
gccgaggagacaugaaaua

SEQ ID NO: 734434 - RNA, 19 nt, Homo sapiens
gaggaggagcuacguuaug

SEQ ID NO: 734435 - RNA, 19 nt, Homo sapiens
ggaggaggagcuacguuau

SEQ ID NO: 734436 - RNA, 19 nt, Homo sapiens
ggagggaggaaagaugaaa

SEQ ID NO: 734437 - RNA, 19 nt, Homo sapiens
uggaggaggagcuacguua

SEQ ID NO: 734438 - RNA, 19 nt, Homo sapiens
aacaagaccaguaugauau

SEQ ID NO: 734439 - RNA, 19 nt, Homo sapiens
ucaaggaugcacuguauag

SEQ ID NO: 734440 - RNA, 19 nt, Homo sapiens
gugaaugcaugauguuagg

SEQ ID NO: 734441 - RNA, 19 nt, Homo sapiens
gaacguucucaucggauug

SEQ ID NO: 734442 - RNA, 19 nt, Homo sapiens
gauguuagggauguggaua

SEQ ID NO: 734443 - RNA, 19 nt, Homo sapiens
ggaccagaacuuugaccuu

SEQ ID NO: 734444 - RNA, 19 nt, Homo sapiens
guuagaacguaccaagagu

SEQ ID NO: 734445 - RNA, 19 nt, Homo sapiens
aagauucuccguucaaugu

SEQ ID NO: 734446 - RNA, 19 nt, Homo sapiens
ccagaaaagugacaaccaa

SEQ ID NO: 734447 - RNA, 19 nt, Homo sapiens
cgaggagacaugaaauaug

SEQ ID NO: 734448 - RNA, 19 nt, Homo sapiens
gcaaucacuggcuggagaa

SEQ ID NO: 734449 - RNA, 19 nt, Homo sapiens
agugaaaacuugagcaaaa

SEQ ID NO: 734450 - RNA, 19 nt, Homo sapiens
gggaacaacgagaccaguu

SEQ ID NO: 734451 - RNA, 19 nt, Homo sapiens
augaaacgcuggcagagau

SEQ ID NO: 734452 - RNA, 19 nt, Homo sapiens
gaaaagugacaaccaacaa

SEQ ID NO: 734453 - RNA, 19 nt, Homo sapiens
ugaccagauuggcucagaa

SEQ ID NO: 734454 - RNA, 19 nt, Homo sapiens
guagacugguaaacacaag

SEQ ID NO: 734455 - RNA, 19 nt, Homo sapiens
ccaaaguauugaacguucu

SEQ ID NO: 734456 - RNA, 19 nt, Homo sapiens
gcauaugaaucggcuacag

SEQ ID NO: 734457 - RNA, 19 nt, Homo sapiens
uagagaaugagcauaugaa

SEQ ID NO: 734458 - RNA, 19 nt, Homo sapiens
caacgagaccaguuagaac

SEQ ID NO: 734459 - RNA, 19 nt, Homo sapiens
acaacgagaccaguuagaa

SEQ ID NO: 734460 - RNA, 19 nt, Homo sapiens
ggauugccacagagacuga

SEQ ID NO: 734461 - RNA, 19 nt, Homo sapiens
ggaacaacagcaacaagac

SEQ ID NO: 734462 - RNA, 19 nt, Homo sapiens
ugaaggaacaacagcaaca

SEQ ID NO: 734463 - RNA, 19 nt, Homo sapiens
uaaaugugaaggaacaaca

SEQ ID NO: 734464 - RNA, 19 nt, Homo sapiens
uuagaacguaccaagagua

SEQ ID NO: 734465 - RNA, 19 nt, Homo sapiens
acuuaaaugugaaggaaca

SEQ ID NO: 734466 - RNA, 19 nt, Homo sapiens
cugcugcuuuccauuauca

SEQ ID NO: 734467 - RNA, 19 nt, Homo sapiens
cggccuccaugaagaccua

SEQ ID NO: 734468 - RNA, 19 nt, Homo sapiens
ccgaggagacaugaaauau

SEQ ID NO: 734469 - RNA, 19 nt, Homo sapiens
cugguaaacacaagugaaa

SEQ ID NO: 734470 - RNA, 19 nt, Homo sapiens
agaguagacugguaaacac

SEQ ID NO: 734471 - RNA, 19 nt, Homo sapiens
gggcugacaguucaaggau

SEQ ID NO: 734472 - RNA, 19 nt, Homo sapiens
uccguucaauguccagaaa

SEQ ID NO: 734473 - RNA, 19 nt, Homo sapiens
gcaaaagucggaagauucu

SEQ ID NO: 734474 - RNA, 19 nt, Homo sapiens
aagaguagacugguaaaca

SEQ ID NO: 734475 - RNA, 19 nt, Homo sapiens
ccaagaguagacugguaaa

SEQ ID NO: 734476 - RNA, 19 nt, Homo sapiens
uguagagaaugagcauaug

SEQ ID NO: 734477 - RNA, 19 nt, Homo sapiens
caagguaauaaaugcuguu

SEQ ID NO: 734478 - RNA, 19 nt, Homo sapiens
acuuugaccuugugaaugc

SEQ ID NO: 734479 - RNA, 19 nt, Homo sapiens
cauaugaaucggcuacagu

SEQ ID NO: 734480 - RNA, 19 nt, Homo sapiens
aaaugcuguuuaugacuuc

SEQ ID NO: 734481 - RNA, 19 nt, Homo sapiens
aggaacaacagcaacaaga

SEQ ID NO: 734482 - RNA, 19 nt, Homo sapiens
ccuugugaaugcaugaugu

SEQ ID NO: 734483 - RNA, 19 nt, Homo sapiens
ucgcagccauugaacuucu

SEQ ID NO: 734484 - RNA, 19 nt, Homo sapiens
gaguagacugguaaacaca

SEQ ID NO: 734485 - RNA, 19 nt, Homo sapiens
ggaggccgaggagacauga

SEQ ID NO: 734486 - RNA, 19 nt, Homo sapiens
ggacaaugcuuaguuauaa

SEQ ID NO: 734487 - RNA, 19 nt, Homo sapiens
gaaaccaagucauaugaaa

SEQ ID NO: 734488 - RNA, 19 nt, Homo sapiens
agaggaacauggcauauua

SEQ ID NO: 734489 - RNA, 19 nt, Homo sapiens
gaagacauaggcuaaauuu

SEQ ID NO: 734490 - RNA, 19 nt, Homo sapiens
gcucacaccuuucuacuga

SEQ ID NO: 734491 - RNA, 19 nt, Homo sapiens
gaacauggcauauuauaag

SEQ ID NO: 734492 - RNA, 19 nt, Homo sapiens
guucauagcugccuuucuu

SEQ ID NO: 734493 - RNA, 19 nt, Homo sapiens
gcaguucaguucuuuaaug

SEQ ID NO: 734494 - RNA, 19 nt, Homo sapiens
gaacauccaucacagacau

SEQ ID NO: 734495 - RNA, 19 nt, Homo sapiens
gcaguucgcuuacuucaag

SEQ ID NO: 734496 - RNA, 19 nt, Homo sapiens
ugaggacaaugcuuaguua

SEQ ID NO: 734497 - RNA, 19 nt, Homo sapiens
agaaggagcuguaugacuu

SEQ ID NO: 734498 - RNA, 19 nt, Homo sapiens
agcagaaccugguguauua

SEQ ID NO: 734499 - RNA, 19 nt, Homo sapiens
ucaaggacuucaaggauuu

SEQ ID NO: 734500 - RNA, 19 nt, Homo sapiens
gcuauccgguugagaaauu

SEQ ID NO: 734501 - RNA, 19 nt, Homo sapiens
uuaaagaccuggaaaccaa

SEQ ID NO: 734502 - RNA, 19 nt, Homo sapiens
agccagagcugucuaguuu

SEQ ID NO: 734503 - RNA, 19 nt, Homo sapiens
gagaaguuguggaauaugu

SEQ ID NO: 734504 - RNA, 19 nt, Homo sapiens
guucaguucuuuaauguga

SEQ ID NO: 734505 - RNA, 19 nt, Homo sapiens
gcccagaccugaagcaguu

SEQ ID NO: 734506 - RNA, 19 nt, Homo sapiens
aaacauuccuagaagauga

SEQ ID NO: 734507 - RNA, 19 nt, Homo sapiens
ucacaauggucuucacuug

SEQ ID NO: 734508 - RNA, 19 nt, Homo sapiens
ggucugacuuguaccaauu

SEQ ID NO: 734509 - RNA, 19 nt, Homo sapiens
ggugagaacuggagaacau

SEQ ID NO: 734510 - RNA, 19 nt, Homo sapiens
gaaagaugguggaagacau

SEQ ID NO: 734511 - RNA, 19 nt, Homo sapiens
ccuagaagaugauaauugu

SEQ ID NO: 734512 - RNA, 19 nt, Homo sapiens
ucagcuaucugcucuuuga

SEQ ID NO: 734513 - RNA, 19 nt, Homo sapiens
ggcacgcgcuggacaagua

SEQ ID NO: 734514 - RNA, 19 nt, Homo sapiens
gggagaaguuguggaauau

SEQ ID NO: 734515 - RNA, 19 nt, Homo sapiens
gaaaaccuccuuuggcuua

SEQ ID NO: 734516 - RNA, 19 nt, Homo sapiens
cuuuacaccugucuucuua

SEQ ID NO: 734517 - RNA, 19 nt, Homo sapiens
ggaacauggcauauuauaa

SEQ ID NO: 734518 - RNA, 19 nt, Homo sapiens
ccagggagaucaaggacuu

SEQ ID NO: 734519 - RNA, 19 nt, Homo sapiens
cgggaaagaugguggaaga

SEQ ID NO: 734520 - RNA, 19 nt, Homo sapiens
agggagaaguuguggaaua

SEQ ID NO: 734521 - RNA, 19 nt, Homo sapiens
uaucauuacuugcaguuug

SEQ ID NO: 734522 - RNA, 19 nt, Homo sapiens
ccagagcugucuaguuuca

SEQ ID NO: 734523 - RNA, 19 nt, Homo sapiens
gagccugccuuuccuaucu

SEQ ID NO: 734524 - RNA, 19 nt, Homo sapiens
gcuaucugcucuuugauca

SEQ ID NO: 734525 - RNA, 19 nt, Homo sapiens
ggaagacauaggcuaaauu

SEQ ID NO: 734526 - RNA, 19 nt, Homo sapiens
agucuucucuggcuuguuu

SEQ ID NO: 734527 - RNA, 19 nt, Homo sapiens
gaucaaggacuucaaggau

SEQ ID NO: 734528 - RNA, 19 nt, Homo sapiens
gaaggagcuguaugacuuu

SEQ ID NO: 734529 - RNA, 19 nt, Homo sapiens
ggauuucuaccuuuccaua

SEQ ID NO: 734530 - RNA, 19 nt, Homo sapiens
ugaacgaccugaagaaugc

SEQ ID NO: 734531 - RNA, 19 nt, Homo sapiens
gaaaugaugaagaggaaca

SEQ ID NO: 734532 - RNA, 19 nt, Homo sapiens
uauaauggaugaugaugag

SEQ ID NO: 734533 - RNA, 19 nt, Homo sapiens
ugaccacacuccagaagga

SEQ ID NO: 734534 - RNA, 19 nt, Homo sapiens
ggaaaccaagucauaugaa

SEQ ID NO: 734535 - RNA, 19 nt, Homo sapiens
agacauaggcuaaauuucu

SEQ ID NO: 734536 - RNA, 19 nt, Homo sapiens
aaagaugguggaagacaua

SEQ ID NO: 734537 - RNA, 19 nt, Homo sapiens
gauggagucucgcucucuu

SEQ ID NO: 734538 - RNA, 19 nt, Homo sapiens
gcaguuugccuauuauaag

SEQ ID NO: 734539 - RNA, 19 nt, Homo sapiens
gaaccucaccccaguuaua

SEQ ID NO: 734540 - RNA, 19 nt, Homo sapiens
caaguugaguagagagugu

SEQ ID NO: 734541 - RNA, 19 nt, Homo sapiens
gacauaggcuaaauuucuc

SEQ ID NO: 734542 - RNA, 19 nt, Homo sapiens
ccacagugcugggauuaca

SEQ ID NO: 734543 - RNA, 19 nt, Homo sapiens
caggaaacacagauucuuu

SEQ ID NO: 734544 - RNA, 19 nt, Homo sapiens
gaagcaguucaguucuuua

SEQ ID NO: 734545 - RNA, 19 nt, Homo sapiens
ggaaacacagauucuuugu

SEQ ID NO: 734546 - RNA, 19 nt, Homo sapiens
ggagaacauccaucacaga

SEQ ID NO: 734547 - RNA, 19 nt, Homo sapiens
gagcagugcgggcauacaa

SEQ ID NO: 734548 - RNA, 19 nt, Homo sapiens
ugaagaggaacauggcaua

SEQ ID NO: 734549 - RNA, 19 nt, Homo sapiens
guuauaagucuccgaguug

SEQ ID NO: 734550 - RNA, 19 nt, Homo sapiens
ucacuuggucugacuugua

SEQ ID NO: 734551 - RNA, 19 nt, Homo sapiens
gguggaagacauaggcuaa

SEQ ID NO: 734552 - RNA, 19 nt, Homo sapiens
acuugcaguuugccuauua

SEQ ID NO: 734553 - RNA, 19 nt, Homo sapiens
gaggcuauccgguugagaa

SEQ ID NO: 734554 - RNA, 19 nt, Homo sapiens
uagcagaucauuauguaga

SEQ ID NO: 734555 - RNA, 19 nt, Homo sapiens
gaagaggaacauggcauau

SEQ ID NO: 734556 - RNA, 19 nt, Homo sapiens
caaauaaucuccccaaagc

SEQ ID NO: 734557 - RNA, 19 nt, Homo sapiens
cagcagaaccugguguauu

SEQ ID NO: 734558 - RNA, 19 nt, Homo sapiens
acaauggucuucacuuggu

SEQ ID NO: 734559 - RNA, 19 nt, Homo sapiens
ggaaagaugguggaagaca

SEQ ID NO: 734560 - RNA, 19 nt, Homo sapiens
cauguucacaccuaucuuu

SEQ ID NO: 734561 - RNA, 19 nt, Homo sapiens
caccucauguucacaccua

SEQ ID NO: 734562 - RNA, 19 nt, Homo sapiens
guaugacuuugcuaaggaa

SEQ ID NO: 734563 - RNA, 19 nt, Homo sapiens
caguucaguucuuuaaugu

SEQ ID NO: 734564 - RNA, 19 nt, Homo sapiens
gccgaggacuacauuaaag

SEQ ID NO: 734565 - RNA, 19 nt, Homo sapiens
uguaugacuuugcuaagga

SEQ ID NO: 734566 - RNA, 19 nt, Homo sapiens
agagcugucuaguuucauu

SEQ ID NO: 734567 - RNA, 19 nt, Homo sapiens
ccuacaaguuccugcaguu

SEQ ID NO: 734568 - RNA, 19 nt, Homo sapiens
guuggccgaucccauuuga

SEQ ID NO: 734569 - RNA, 19 nt, Homo sapiens
ggaugaugaugagggagaa

SEQ ID NO: 734570 - RNA, 19 nt, Homo sapiens
acgaaaugaugaagaggaa

SEQ ID NO: 734571 - RNA, 19 nt, Homo sapiens
ggacuucaaggauuucuac

SEQ ID NO: 734572 - RNA, 19 nt, Homo sapiens
gugccgaggacuacauuaa

SEQ ID NO: 734573 - RNA, 19 nt, Homo sapiens
ucgcuuacuucaaggcaaa

SEQ ID NO: 734574 - RNA, 19 nt, Homo sapiens
gaaagccagagcugucuag

SEQ ID NO: 734575 - RNA, 19 nt, Homo sapiens
gcaucagccucccgaguac

SEQ ID NO: 734576 - RNA, 19 nt, Homo sapiens
agucagcuaucugcucuuu

SEQ ID NO: 734577 - RNA, 19 nt, Homo sapiens
gcagaaauguggcuuuugc

SEQ ID NO: 734578 - RNA, 19 nt, Homo sapiens
gaguguagagugcagaaau

SEQ ID NO: 734579 - RNA, 19 nt, Homo sapiens
uuacaccugucuucuuauc

SEQ ID NO: 734580 - RNA, 19 nt, Homo sapiens
cacagauucuuuguccuuu

SEQ ID NO: 734581 - RNA, 19 nt, Homo sapiens
aagcaguucaguucuuuaa

SEQ ID NO: 734582 - RNA, 19 nt, Homo sapiens
caguuugccuauuauaagu

SEQ ID NO: 734583 - RNA, 19 nt, Homo sapiens
gcagaucauuauguagaag

SEQ ID NO: 734584 - RNA, 19 nt, Homo sapiens
ggagaucaaggacuucaag

SEQ ID NO: 734585 - RNA, 19 nt, Homo sapiens
ugacuuguaccaauucuag

SEQ ID NO: 734586 - RNA, 19 nt, Homo sapiens
gaacaaagccacacuucua

SEQ ID NO: 734587 - RNA, 19 nt, Homo sapiens
ugagaaagcuggaccuaua

SEQ ID NO: 734588 - RNA, 19 nt, Homo sapiens
caauagagguuaugcguuu

SEQ ID NO: 734589 - RNA, 19 nt, Homo sapiens
ugaaugggcugauccuaua

SEQ ID NO: 734590 - RNA, 19 nt, Homo sapiens
ggagaucucuggaaacaug

SEQ ID NO: 734591 - RNA, 19 nt, Homo sapiens
ccaagugugucuuuaauau

SEQ ID NO: 734592 - RNA, 19 nt, Homo sapiens
gagaggaggugcccaacaa

SEQ ID NO: 734593 - RNA, 19 nt, Homo sapiens
gauauccuccagauuauua

SEQ ID NO: 734594 - RNA, 19 nt, Homo sapiens
gaucagaaacucacccuaa

SEQ ID NO: 734595 - RNA, 19 nt, Homo sapiens
gcaguuauccauucagaaa

SEQ ID NO: 734596 - RNA, 19 nt, Homo sapiens
gauacuacuucugcaguua

SEQ ID NO: 734597 - RNA, 19 nt, Homo sapiens
gauuaugcguucauucauu

SEQ ID NO: 734598 - RNA, 19 nt, Homo sapiens
ggaaagaacaggcuacaca

SEQ ID NO: 734599 - RNA, 19 nt, Homo sapiens
cagaacauguuaauggaaa

SEQ ID NO: 734600 - RNA, 19 nt, Homo sapiens
aaacauggcuacagaacau

SEQ ID NO: 734601 - RNA, 19 nt, Homo sapiens
caagauuucccuuuaugua

SEQ ID NO: 734602 - RNA, 19 nt, Homo sapiens
uaacagagggucuuacaga

SEQ ID NO: 734603 - RNA, 19 nt, Homo sapiens
guuaugcguuugucacuuu

SEQ ID NO: 734604 - RNA, 19 nt, Homo sapiens
ggaccaaaguagcagauuc

SEQ ID NO: 734605 - RNA, 19 nt, Homo sapiens
ccaguaguguuuagauuug

SEQ ID NO: 734606 - RNA, 19 nt, Homo sapiens
gcacauagugauuuagaug

SEQ ID NO: 734607 - RNA, 19 nt, Homo sapiens
gaagagcccauggauacua

SEQ ID NO: 734608 - RNA, 19 nt, Homo sapiens
guaaauugauacacaacug

SEQ ID NO: 734609 - RNA, 19 nt, Homo sapiens
gcuagaauaagguaaauug

SEQ ID NO: 734610 - RNA, 19 nt, Homo sapiens
ccauuuggcuguaguguca

SEQ ID NO: 734611 - RNA, 19 nt, Homo sapiens
aaacucacccuaaaucuga

SEQ ID NO: 734612 - RNA, 19 nt, Homo sapiens
ggaccuauaugggaucuuc

SEQ ID NO: 734613 - RNA, 19 nt, Homo sapiens
gggcugauccuauagaaga

SEQ ID NO: 734614 - RNA, 19 nt, Homo sapiens
acagugaucucucucaugu

SEQ ID NO: 734615 - RNA, 19 nt, Homo sapiens
caaaguagcagauucuagu

SEQ ID NO: 734616 - RNA, 19 nt, Homo sapiens
ggcaagauuucccuuuaug

SEQ ID NO: 734617 - RNA, 19 nt, Homo sapiens
gaacgagugaagaaguuaa

SEQ ID NO: 734618 - RNA, 19 nt, Homo sapiens
ucaggaggcuguuaaacug

SEQ ID NO: 734619 - RNA, 19 nt, Homo sapiens
gaacuuugaccuaauuugg

SEQ ID NO: 734620 - RNA, 19 nt, Homo sapiens
gaaaaggcauuuagucagu

SEQ ID NO: 734621 - RNA, 19 nt, Homo sapiens
ggauacuacuucugcaguu

SEQ ID NO: 734622 - RNA, 19 nt, Homo sapiens
gggcaacaguggaaguaga

SEQ ID NO: 734623 - RNA, 19 nt, Homo sapiens
ccaaccggaugacaagaaa

SEQ ID NO: 734624 - RNA, 19 nt, Homo sapiens
uaauggaaaugguacugaa

SEQ ID NO: 734625 - RNA, 19 nt, Homo sapiens
ucaaggcuauggaagaaau

SEQ ID NO: 734626 - RNA, 19 nt, Homo sapiens
uauaugggaucuucgucua

SEQ ID NO: 734627 - RNA, 19 nt, Homo sapiens
gaacaggcuacacacuuga

SEQ ID NO: 734628 - RNA, 19 nt, Homo sapiens
uaaagacagugaucucucu

SEQ ID NO: 734629 - RNA, 19 nt, Homo sapiens
gaaacucacccuaaaucug

SEQ ID NO: 734630 - RNA, 19 nt, Homo sapiens
agaacaggcuacacacuug

SEQ ID NO: 734631 - RNA, 19 nt, Homo sapiens
ucaacgauguuuccaguag

SEQ ID NO: 734632 - RNA, 19 nt, Homo sapiens
gagcagcgagcacgcguuu

SEQ ID NO: 734633 - RNA, 19 nt, Homo sapiens
ggaggugcccaacaacaaa

SEQ ID NO: 734634 - RNA, 19 nt, Homo sapiens
guuaaugagugguaaaguc

SEQ ID NO: 734635 - RNA, 19 nt, Homo sapiens
gaugaaagagcuauugaag

SEQ ID NO: 734636 - RNA, 19 nt, Homo sapiens
cuacagaacauguuaaugg

SEQ ID NO: 734637 - RNA, 19 nt, Homo sapiens
cuggcaagauuucccuuua

SEQ ID NO: 734638 - RNA, 19 nt, Homo sapiens
gacgauuacuacuauuaug

SEQ ID NO: 734639 - RNA, 19 nt, Homo sapiens
gcaguucuucaacaguuua

SEQ ID NO: 734640 - RNA, 19 nt, Homo sapiens
guagaggugguuauggaua

SEQ ID NO: 734641 - RNA, 19 nt, Homo sapiens
ggaacgagugaagaaguua

SEQ ID NO: 734642 - RNA, 19 nt, Homo sapiens
gagguuauggcaaagguaa

SEQ ID NO: 734643 - RNA, 19 nt, Homo sapiens
uaagaaaggccgagagaag

SEQ ID NO: 734644 - RNA, 19 nt, Homo sapiens
aaaccaagugugucuuuaa

SEQ ID NO: 734645 - RNA, 19 nt, Homo sapiens
aaaggcauuuagucaguuu

SEQ ID NO: 734646 - RNA, 19 nt, Homo sapiens
uagaggugguuauggauau

SEQ ID NO: 734647 - RNA, 19 nt, Homo sapiens
ugucaaggcuauggaagaa

SEQ ID NO: 734648 - RNA, 19 nt, Homo sapiens
gagaaagcuggaccuauau

SEQ ID NO: 734649 - RNA, 19 nt, Homo sapiens
ggaaagcgcaaagcugaug

SEQ ID NO: 734650 - RNA, 19 nt, Homo sapiens
gagaucuauuugaggauga

SEQ ID NO: 734651 - RNA, 19 nt, Homo sapiens
uuucagacauugcuugaug

SEQ ID NO: 734652 - RNA, 19 nt, Homo sapiens
gauguuuccaguaguguuu

SEQ ID NO: 734653 - RNA, 19 nt, Homo sapiens
ggucagcagccuucuguug

SEQ ID NO: 734654 - RNA, 19 nt, Homo sapiens
aguagcagauucuaguaaa

SEQ ID NO: 734655 - RNA, 19 nt, Homo sapiens
ccacagaaaguugcugaaa

SEQ ID NO: 734656 - RNA, 19 nt, Homo sapiens
gcuguagugucaacgaugu

SEQ ID NO: 734657 - RNA, 19 nt, Homo sapiens
ucaaguccauuuggcugua

SEQ ID NO: 734658 - RNA, 19 nt, Homo sapiens
aaauuuggcucaaguccau

SEQ ID NO: 734659 - RNA, 19 nt, Homo sapiens
uacagaacauguuaaugga

SEQ ID NO: 734660 - RNA, 19 nt, Homo sapiens
ggaagaaaugaauggcaaa

SEQ ID NO: 734661 - RNA, 19 nt, Homo sapiens
uuaaggcacucuuggaaag

SEQ ID NO: 734662 - RNA, 19 nt, Homo sapiens
gaaacauggcuacagaaca

SEQ ID NO: 734663 - RNA, 19 nt, Homo sapiens
gcuccaagguggugaucau

SEQ ID NO: 734664 - RNA, 19 nt, Homo sapiens
gaacauguuaauggaaaug

SEQ ID NO: 734665 - RNA, 19 nt, Homo sapiens
cccaagagaucuauuugag

SEQ ID NO: 734666 - RNA, 19 nt, Homo sapiens
uggcaguucuucaacaguu

SEQ ID NO: 734667 - RNA, 19 nt, Homo sapiens
gcaagauuucccuuuaugu

SEQ ID NO: 734668 - RNA, 19 nt, Homo sapiens
ccaagguggugaucauucu

SEQ ID NO: 734669 - RNA, 19 nt, Homo sapiens
gaaaugaauggcaaagacu

SEQ ID NO: 734670 - RNA, 19 nt, Homo sapiens
agaaaugaauggcaaagac

SEQ ID NO: 734671 - RNA, 19 nt, Homo sapiens
gaaacuggaacgagugaag

SEQ ID NO: 734672 - RNA, 19 nt, Homo sapiens
caaccuugccaauacugua

SEQ ID NO: 734673 - RNA, 19 nt, Homo sapiens
guagguuaaugagugguaa

SEQ ID NO: 734674 - RNA, 19 nt, Homo sapiens
aaacaagggaccaaaguag

SEQ ID NO: 734675 - RNA, 19 nt, Homo sapiens
guuuagauuuggugucuuc

SEQ ID NO: 734676 - RNA, 19 nt, Homo sapiens
cagaaacucacccuaaauc

SEQ ID NO: 734677 - RNA, 19 nt, Homo sapiens
caaguuggagcuagaggaa

SEQ ID NO: 734678 - RNA, 19 nt, Homo sapiens
uuugugggcucuauuccua

SEQ ID NO: 734679 - RNA, 19 nt, Homo sapiens
ccacuggacagaggaagua

SEQ ID NO: 734680 - RNA, 19 nt, Homo sapiens
agugaucucucucauguuc

SEQ ID NO: 734681 - RNA, 19 nt, Homo sapiens
caacgauguuuccaguagu

SEQ ID NO: 734682 - RNA, 19 nt, Homo sapiens
uggcaagauuucccuuuau

SEQ ID NO: 734683 - RNA, 19 nt, Homo sapiens
guggugaucauucugguaa

SEQ ID NO: 734684 - RNA, 19 nt, Homo sapiens
uggaacgagugaagaaguu

SEQ ID NO: 734685 - RNA, 19 nt, Homo sapiens
cuggaaacauggcuacaga

SEQ ID NO: 734686 - RNA, 19 nt, Homo sapiens
gcagauauguguggcauuu

SEQ ID NO: 734687 - RNA, 19 nt, Homo sapiens
gaaaggcagugcugucugu

SEQ ID NO: 734688 - RNA, 19 nt, Homo sapiens
ugaaacagaugcaggagaa

SEQ ID NO: 734689 - RNA, 19 nt, Homo sapiens
gaugagaucaagaagauuu

SEQ ID NO: 734690 - RNA, 19 nt, Homo sapiens
gaagugaccauuuggaugu

SEQ ID NO: 734691 - RNA, 19 nt, Homo sapiens
ucacugaguucucuggauu

SEQ ID NO: 734692 - RNA, 19 nt, Homo sapiens
gcaaagucgucaccuaugg

SEQ ID NO: 734693 - RNA, 19 nt, Homo sapiens
guccagaccuuccugauuc

SEQ ID NO: 734694 - RNA, 19 nt, Homo sapiens
ugaguucucuggauuuguu

SEQ ID NO: 734695 - RNA, 19 nt, Homo sapiens
ccaccagacuugcauuuca

SEQ ID NO: 734696 - RNA, 19 nt, Homo sapiens
cugccuugcucgucaauua

SEQ ID NO: 734697 - RNA, 19 nt, Homo sapiens
ucacacaucccaucgacua

SEQ ID NO: 734698 - RNA, 19 nt, Homo sapiens
caacuucgcagaccucaug

SEQ ID NO: 734699 - RNA, 19 nt, Homo sapiens
ggacaugguggaaucaguu

SEQ ID NO: 734700 - RNA, 19 nt, Homo sapiens
cuaaaggaguggacauugu

SEQ ID NO: 734701 - RNA, 19 nt, Homo sapiens
ucaagaagauuuccccuaa

SEQ ID NO: 734702 - RNA, 19 nt, Homo sapiens
uggaugagaucaagaagau

SEQ ID NO: 734703 - RNA, 19 nt, Homo sapiens
cagcugccuuuguguguuu

SEQ ID NO: 734704 - RNA, 19 nt, Homo sapiens
guugggaagugaccauuug

SEQ ID NO: 734705 - RNA, 19 nt, Homo sapiens
gggagaaguugggaagcua

SEQ ID NO: 734706 - RNA, 19 nt, Homo sapiens
gcucgucaauuacauuaca

SEQ ID NO: 734707 - RNA, 19 nt, Homo sapiens
cauuucagccucugucaua

SEQ ID NO: 734708 - RNA, 19 nt, Homo sapiens
ggccagagaaggagaacua

SEQ ID NO: 734709 - RNA, 19 nt, Homo sapiens
gggaagcuacguucuguug

SEQ ID NO: 734710 - RNA, 19 nt, Homo sapiens
gggcaaagucgucaccuau

SEQ ID NO: 734711 - RNA, 19 nt, Homo sapiens
ucacaacucugggaaggau

SEQ ID NO: 734712 - RNA, 19 nt, Homo sapiens
ugaagagguugggaaguga

SEQ ID NO: 734713 - RNA, 19 nt, Homo sapiens
gaaguugggaagcuacguu

SEQ ID NO: 734714 - RNA, 19 nt, Homo sapiens
gcagugcugucuguuucuu

SEQ ID NO: 734715 - RNA, 19 nt, Homo sapiens
ggagggaggauccuguuuc

SEQ ID NO: 734716 - RNA, 19 nt, Homo sapiens
guaccugucucucccuagu

SEQ ID NO: 734717 - RNA, 19 nt, Homo sapiens
gaaacgucagcucaggaua

SEQ ID NO: 734718 - RNA, 19 nt, Homo sapiens
ggccaugaccuuugaggaa

SEQ ID NO: 734719 - RNA, 19 nt, Homo sapiens
aaacgucagcucaggauau

SEQ ID NO: 734720 - RNA, 19 nt, Homo sapiens
gggcuacaaccuccugaaa

SEQ ID NO: 734721 - RNA, 19 nt, Homo sapiens
gagcagggaaguacagagu

SEQ ID NO: 734722 - RNA, 19 nt, Homo sapiens
gagaccgggugaugguguu

SEQ ID NO: 734723 - RNA, 19 nt, Homo sapiens
cugaagagguugggaagug

SEQ ID NO: 734724 - RNA, 19 nt, Homo sapiens
gcugaugccaugaaacaga

SEQ ID NO: 734725 - RNA, 19 nt, Homo sapiens
gcccggacaugguggaauc

SEQ ID NO: 734726 - RNA, 19 nt, Homo sapiens
uggagaaugugacaguguu

SEQ ID NO: 734727 - RNA, 19 nt, Homo sapiens
gcuacaaccuccugaaacc

SEQ ID NO: 734728 - RNA, 19 nt, Homo sapiens
gccguacaguggagaaugu

SEQ ID NO: 734729 - RNA, 19 nt, Homo sapiens
cgacugacuacguggauga

SEQ ID NO: 734730 - RNA, 19 nt, Homo sapiens
acgaggcacugaaggagaa

SEQ ID NO: 734731 - RNA, 19 nt, Homo sapiens
ggauuagggaggguuauug

SEQ ID NO: 734732 - RNA, 19 nt, Homo sapiens
ccucagccuugcagauaug

SEQ ID NO: 734733 - RNA, 19 nt, Homo sapiens
cccagugccuuccuuguuc

SEQ ID NO: 734734 - RNA, 19 nt, Homo sapiens
ucaccucugccucaucuuu

SEQ ID NO: 734735 - RNA, 19 nt, Homo sapiens
gggcaagguccuccugguu

SEQ ID NO: 734736 - RNA, 19 nt, Homo sapiens
gaagauuuccccuaaagga

SEQ ID NO: 734737 - RNA, 19 nt, Homo sapiens
gagauggagcagggaagua

SEQ ID NO: 734738 - RNA, 19 nt, Homo sapiens
caacuucuuaagcacaauu

SEQ ID NO: 734739 - RNA, 19 nt, Homo sapiens
ccuacaugguccucuuuga

SEQ ID NO: 734740 - RNA, 19 nt, Homo sapiens
cugaggccaugaccuuuga

SEQ ID NO: 734741 - RNA, 19 nt, Homo sapiens
aggcagugcugucuguuuc

SEQ ID NO: 734742 - RNA, 19 nt, Homo sapiens
caagaagauuuccccuaaa

SEQ ID NO: 734743 - RNA, 19 nt, Homo sapiens
cacaucccaucgacuauca

SEQ ID NO: 734744 - RNA, 19 nt, Homo sapiens
gcaagcacgaggcacugaa

SEQ ID NO: 734745 - RNA, 19 nt, Homo sapiens
gagggaggauccuguuucc

SEQ ID NO: 734746 - RNA, 19 nt, Homo sapiens
aaacagaugcaggagaaga

SEQ ID NO: 734747 - RNA, 19 nt, Homo sapiens
cuacguggaugagaucaag

SEQ ID NO: 734748 - RNA, 19 nt, Homo sapiens
gggaagugaccauuuggau

SEQ ID NO: 734749 - RNA, 19 nt, Homo sapiens
agaagaaugugggcaaggu

SEQ ID NO: 734750 - RNA, 19 nt, Homo sapiens
caaagucgucaccuaugga

SEQ ID NO: 734751 - RNA, 19 nt, Homo sapiens
ugaaacccaugggcaaagu

SEQ ID NO: 734752 - RNA, 19 nt, Homo sapiens
cagccuacaugguccucuu

SEQ ID NO: 734753 - RNA, 19 nt, Homo sapiens
cuacugccuucucaaagca

SEQ ID NO: 734754 - RNA, 19 nt, Homo sapiens
gcccuacugccuucucaaa

SEQ ID NO: 734755 - RNA, 19 nt, Homo sapiens
gcugugcacucuccaucca

SEQ ID NO: 734756 - RNA, 19 nt, Homo sapiens
agauauguguggcauuuac

SEQ ID NO: 734757 - RNA, 19 nt, Homo sapiens
aaccugugcuugugugugu

SEQ ID NO: 734758 - RNA, 19 nt, Homo sapiens
caaccagggccacaucaag

SEQ ID NO: 734759 - RNA, 19 nt, Homo sapiens
guacaaccagggccacauc

SEQ ID NO: 734760 - RNA, 19 nt, Homo sapiens
guguguuugugucaauaaa

SEQ ID NO: 734761 - RNA, 19 nt, Homo sapiens
uauggugguugaggagaaa

SEQ ID NO: 734762 - RNA, 19 nt, Homo sapiens
cuucuuccaucuccagguu

SEQ ID NO: 734763 - RNA, 19 nt, Homo sapiens
gcacauuccccuugcaguu

SEQ ID NO: 734764 - RNA, 19 nt, Homo sapiens
cuauggugguugaggagaa

SEQ ID NO: 734765 - RNA, 19 nt, Homo sapiens
ggcaaagucgucaccuaug

SEQ ID NO: 734766 - RNA, 19 nt, Homo sapiens
uuaucaaacucagcccaaa

SEQ ID NO: 734767 - RNA, 19 nt, Homo sapiens
ugggcaaagucgucaccua

SEQ ID NO: 734768 - RNA, 19 nt, Homo sapiens
ggagauggagcagggaagu

SEQ ID NO: 734769 - RNA, 19 nt, Homo sapiens
gggagggaggauccuguuu

SEQ ID NO: 734770 - RNA, 19 nt, Homo sapiens
ucagugccuuagcaacgaa

SEQ ID NO: 734771 - RNA, 19 nt, Homo sapiens
ggccaccagacuugcauuu

SEQ ID NO: 734772 - RNA, 19 nt, Homo sapiens
uuacauuacagccuacaug

SEQ ID NO: 734773 - RNA, 19 nt, Homo sapiens
cagauauguguggcauuua

SEQ ID NO: 734774 - RNA, 19 nt, Homo sapiens
cccaacuucuuaagcacaa

SEQ ID NO: 734775 - RNA, 19 nt, Homo sapiens
ucgacuaucacacgacuga

SEQ ID NO: 734776 - RNA, 19 nt, Homo sapiens
ggagaaugugacaguguuc

SEQ ID NO: 734777 - RNA, 19 nt, Homo sapiens
ugccaugucccgucucuau

SEQ ID NO: 734778 - RNA, 19 nt, Homo sapiens
gguugggaagugaccauuu

SEQ ID NO: 734779 - RNA, 19 nt, Homo sapiens
caccagacuugcauuucag

SEQ ID NO: 734780 - RNA, 19 nt, Homo sapiens
ccuaaaggaguggacauug

SEQ ID NO: 734781 - RNA, 19 nt, Homo sapiens
caaccaaaauggggacuuc

SEQ ID NO: 734782 - RNA, 19 nt, Homo sapiens
aacgucagcucaggauaug

SEQ ID NO: 734783 - RNA, 19 nt, Homo sapiens
ugaaacgucagcucaggau

SEQ ID NO: 734784 - RNA, 19 nt, Homo sapiens
uucagccucugucauaaug

SEQ ID NO: 734785 - RNA, 19 nt, Homo sapiens
aaggagaacuagggcaagu

SEQ ID NO: 734786 - RNA, 19 nt, Homo sapiens
gaacugugcugacuuggaa

SEQ ID NO: 734787 - RNA, 19 nt, Homo sapiens
gacggaaggucguuuguuu

SEQ ID NO: 734788 - RNA, 19 nt, Homo sapiens
gcgcacugcuguucagaua

SEQ ID NO: 734789 - RNA, 19 nt, Homo sapiens
gcacuggacuugcuuaaac

SEQ ID NO: 734790 - RNA, 19 nt, Homo sapiens
uaagaacugugcugacuug

SEQ ID NO: 734791 - RNA, 19 nt, Homo sapiens
guacuugugucauccagaa

SEQ ID NO: 734792 - RNA, 19 nt, Homo sapiens
ucacagacacgcagauuaa

SEQ ID NO: 734793 - RNA, 19 nt, Homo sapiens
ucggagagcucaaagagaa

SEQ ID NO: 734794 - RNA, 19 nt, Homo sapiens
cagggacgcuguucucuau

SEQ ID NO: 734795 - RNA, 19 nt, Homo sapiens
cuacaucacccgcuacuuu

SEQ ID NO: 734796 - RNA, 19 nt, Homo sapiens
acacgcagauuaagaggaa

SEQ ID NO: 734797 - RNA, 19 nt, Homo sapiens
caacagaaaccaccugaca

SEQ ID NO: 734798 - RNA, 19 nt, Homo sapiens
cuaaagagcaccaagcuau

SEQ ID NO: 734799 - RNA, 19 nt, Homo sapiens
ccugaaauauucugagguu

SEQ ID NO: 734800 - RNA, 19 nt, Homo sapiens
ugaagggccuggauuaucu

SEQ ID NO: 734801 - RNA, 19 nt, Homo sapiens
agacauacauugccacgau

SEQ ID NO: 734802 - RNA, 19 nt, Homo sapiens
cauaaguacuugugucauc

SEQ ID NO: 734803 - RNA, 19 nt, Homo sapiens
gcacugcuguucagauagg

SEQ ID NO: 734804 - RNA, 19 nt, Homo sapiens
gaaggugcccugugcuaug

SEQ ID NO: 734805 - RNA, 19 nt, Homo sapiens
gcaccaagcuauggaucau

SEQ ID NO: 734806 - RNA, 19 nt, Homo sapiens
gggcaucgauaaccacaca

SEQ ID NO: 734807 - RNA, 19 nt, Homo sapiens
cugaggagcucuucaccaa

SEQ ID NO: 734808 - RNA, 19 nt, Homo sapiens
guacugugucugcucauaa

SEQ ID NO: 734809 - RNA, 19 nt, Homo sapiens
gguacugugucugcucaua

SEQ ID NO: 734810 - RNA, 19 nt, Homo sapiens
ggccauagauuugccuugu

SEQ ID NO: 734811 - RNA, 19 nt, Homo sapiens
caugauggccauagauuug

SEQ ID NO: 734812 - RNA, 19 nt, Homo sapiens
cauaagaacugugcugacu

SEQ ID NO: 734813 - RNA, 19 nt, Homo sapiens
ucaauaaagaccugacuug

SEQ ID NO: 734814 - RNA, 19 nt, Homo sapiens
ugaggacucugacauugau

SEQ ID NO: 734815 - RNA, 19 nt, Homo sapiens
ucaaagagaagcacaagca

SEQ ID NO: 734816 - RNA, 19 nt, Homo sapiens
ggagcagggugacgugaag

SEQ ID NO: 734817 - RNA, 19 nt, Homo sapiens
gaagcgcacugcuguucag

SEQ ID NO: 734818 - RNA, 19 nt, Homo sapiens
gagcucaucgaccgcuaua

SEQ ID NO: 734819 - RNA, 19 nt, Homo sapiens
uacuuuggcuccuaccuaa

SEQ ID NO: 734820 - RNA, 19 nt, Homo sapiens
gagcuacgccugggucuuc

SEQ ID NO: 734821 - RNA, 19 nt, Homo sapiens
ccaaggcgcagagcaacua

SEQ ID NO: 734822 - RNA, 19 nt, Homo sapiens
ggaaggugcccugugcuau

SEQ ID NO: 734823 - RNA, 19 nt, Homo sapiens
gcucaucgaccgcuauaag

SEQ ID NO: 734824 - RNA, 19 nt, Homo sapiens
ggacggaaggucguuuguu

SEQ ID NO: 734825 - RNA, 19 nt, Homo sapiens
gcacagcaagcccuucaag

SEQ ID NO: 734826 - RNA, 19 nt, Homo sapiens
uauggaucaucauggagua

SEQ ID NO: 734827 - RNA, 19 nt, Homo sapiens
ccacacagcaagcuucaca

SEQ ID NO: 734828 - RNA, 19 nt, Homo sapiens
ucugaggacucugacauug

SEQ ID NO: 734829 - RNA, 19 nt, Homo sapiens
gcaucgauaaccacacaaa

SEQ ID NO: 734830 - RNA, 19 nt, Homo sapiens
caagauccaccgagacauc

SEQ ID NO: 734831 - RNA, 19 nt, Homo sapiens
uagcagggcagcucacaga

SEQ ID NO: 734832 - RNA, 19 nt, Homo sapiens
caaagcugccaacgugcua

SEQ ID NO: 734833 - RNA, 19 nt, Homo sapiens
uaaagagcaccaagcuaug

SEQ ID NO: 734834 - RNA, 19 nt, Homo sapiens
aauaaagaccugacuugga

SEQ ID NO: 734835 - RNA, 19 nt, Homo sapiens
gcuauaagcgcuggaaguc

SEQ ID NO: 734836 - RNA, 19 nt, Homo sapiens
agauuaagaggaacacauu

SEQ ID NO: 734837 - RNA, 19 nt, Homo sapiens
gugcagagguuuucacaca

SEQ ID NO: 734838 - RNA, 19 nt, Homo sapiens
ucuacaagggcaucgauaa

SEQ ID NO: 734839 - RNA, 19 nt, Homo sapiens
gcucacagacacgcagauu

SEQ ID NO: 734840 - RNA, 19 nt, Homo sapiens
uggaggaggccgaggauga

SEQ ID NO: 734841 - RNA, 19 nt, Homo sapiens
gauccaccgagacaucaaa

SEQ ID NO: 734842 - RNA, 19 nt, Homo sapiens
acagaaaccaccugacauc

SEQ ID NO: 734843 - RNA, 19 nt, Homo sapiens
gcgaggaguccagcucuga

SEQ ID NO: 734844 - RNA, 19 nt, Homo sapiens
gaagcacaaguucaucaca

SEQ ID NO: 734845 - RNA, 19 nt, Homo sapiens
gcacuccgaacgcaagauc

SEQ ID NO: 734846 - RNA, 19 nt, Homo sapiens
gaauuacuuguuuccugaa

SEQ ID NO: 734847 - RNA, 19 nt, Homo sapiens
cauccagaauguuuuguuu

SEQ ID NO: 734848 - RNA, 19 nt, Homo sapiens
ucgauaaccacacaaagga

SEQ ID NO: 734849 - RNA, 19 nt, Homo sapiens
acaagggcaucgauaacca

SEQ ID NO: 734850 - RNA, 19 nt, Homo sapiens
gagaggccccugccacuuu

SEQ ID NO: 734851 - RNA, 19 nt, Homo sapiens
cugaaauauucugagguua

SEQ ID NO: 734852 - RNA, 19 nt, Homo sapiens
gccauagauuugccuugug

SEQ ID NO: 734853 - RNA, 19 nt, Homo sapiens
gggacgcuguucucuaugc

SEQ ID NO: 734854 - RNA, 19 nt, Homo sapiens
aggaugagaucgaggacau

SEQ ID NO: 734855 - RNA, 19 nt, Homo sapiens
gcagggcagcucacagaca

SEQ ID NO: 734856 - RNA, 19 nt, Homo sapiens
cuacuuuggcuccuaccua

SEQ ID NO: 734857 - RNA, 19 nt, Homo sapiens
ucagggacgcuguucucua

SEQ ID NO: 734858 - RNA, 19 nt, Homo sapiens
ggacauccagcaggagauc

SEQ ID NO: 734859 - RNA, 19 nt, Homo sapiens
accaagcuauggaucauca

SEQ ID NO: 734860 - RNA, 19 nt, Homo sapiens
ugugucauccagaauguuu

SEQ ID NO: 734861 - RNA, 19 nt, Homo sapiens
gcucugaggacucugacau

SEQ ID NO: 734862 - RNA, 19 nt, Homo sapiens
acagacacgcagauuaaga

SEQ ID NO: 734863 - RNA, 19 nt, Homo sapiens
acgugaagcuggcggacuu

SEQ ID NO: 734864 - RNA, 19 nt, Homo sapiens
ggagcgagugcagagguuu

SEQ ID NO: 734865 - RNA, 19 nt, Homo sapiens
ggugguggccaucaagauc

SEQ ID NO: 734866 - RNA, 19 nt, Homo sapiens
aaggugcccugugcuaugu

SEQ ID NO: 734867 - RNA, 19 nt, Homo sapiens
cagcacagcaagcccuuca

SEQ ID NO: 734868 - RNA, 19 nt, Homo sapiens
ccacgauccugcgggagau

SEQ ID NO: 734869 - RNA, 19 nt, Homo sapiens
caagcuauggaucaucaug

SEQ ID NO: 734870 - RNA, 19 nt, Homo sapiens
agaccaaggcgcagagcaa

SEQ ID NO: 734871 - RNA, 19 nt, Homo sapiens
uacaucacccgcuacuuug

SEQ ID NO: 734872 - RNA, 19 nt, Homo sapiens
ccuaaagagcaccaagcua

SEQ ID NO: 734873 - RNA, 19 nt, Homo sapiens
gcccugcacaguucacaga

SEQ ID NO: 734874 - RNA, 19 nt, Homo sapiens
gaggugguggccaucaaga

SEQ ID NO: 734875 - RNA, 19 nt, Homo sapiens
cccugccacuuucaauaaa

SEQ ID NO: 734876 - RNA, 19 nt, Homo sapiens
gauuaagaggaacacauuc

SEQ ID NO: 734877 - RNA, 19 nt, Homo sapiens
gaaagaagcugaacuugaa

SEQ ID NO: 734878 - RNA, 19 nt, Homo sapiens
gaacagcaguccuaucaaa

SEQ ID NO: 734879 - RNA, 19 nt, Homo sapiens
ggaaaugucugaugaugaa

SEQ ID NO: 734880 - RNA, 19 nt, Homo sapiens
caaacaagcugaggaaauu

SEQ ID NO: 734881 - RNA, 19 nt, Homo sapiens
gaaauucgcaacauucaua

SEQ ID NO: 734882 - RNA, 19 nt, Homo sapiens
acucaaagaugacaaguua

SEQ ID NO: 734883 - RNA, 19 nt, Homo sapiens
ggaaaugacuggaguugga

SEQ ID NO: 734884 - RNA, 19 nt, Homo sapiens
ugacaaauguuccaaaguu

SEQ ID NO: 734885 - RNA, 19 nt, Homo sapiens
gacaaauguuccaaaguua

SEQ ID NO: 734886 - RNA, 19 nt, Homo sapiens
ggacaagcauagaaaguga

SEQ ID NO: 734887 - RNA, 19 nt, Homo sapiens
ggaaucagccuuaguauca

SEQ ID NO: 734888 - RNA, 19 nt, Homo sapiens
gaaagcaaguauccaguau

SEQ ID NO: 734889 - RNA, 19 nt, Homo sapiens
cagaaucacuuguaaauag

SEQ ID NO: 734890 - RNA, 19 nt, Homo sapiens
aaagagaaauugccucaaa

SEQ ID NO: 734891 - RNA, 19 nt, Homo sapiens
gagauggucuuuauugugu

SEQ ID NO: 734892 - RNA, 19 nt, Homo sapiens
ggcagaaggauuuauauua

SEQ ID NO: 734893 - RNA, 19 nt, Homo sapiens
gaaaagagauggaaauucu

SEQ ID NO: 734894 - RNA, 19 nt, Homo sapiens
uaucaaaucugaacgugaa

SEQ ID NO: 734895 - RNA, 19 nt, Homo sapiens
gcaacagcaucuacucaaa

SEQ ID NO: 734896 - RNA, 19 nt, Homo sapiens
gcagagauggucuuuauug

SEQ ID NO: 734897 - RNA, 19 nt, Homo sapiens
gcacuaaguccucugugua

SEQ ID NO: 734898 - RNA, 19 nt, Homo sapiens
uaaaugagaugccaguagu

SEQ ID NO: 734899 - RNA, 19 nt, Homo sapiens
gaaagcugcccaugagaaa

SEQ ID NO: 734900 - RNA, 19 nt, Homo sapiens
gagcaagcauugaauacau

SEQ ID NO: 734901 - RNA, 19 nt, Homo sapiens
gcaguccuaucaaaucuga

SEQ ID NO: 734902 - RNA, 19 nt, Homo sapiens
gcgaauacccucuugagaa

SEQ ID NO: 734903 - RNA, 19 nt, Homo sapiens
gaagaugacccuaacaaag

SEQ ID NO: 734904 - RNA, 19 nt, Homo sapiens
cgagaaagcugcccaugag

SEQ ID NO: 734905 - RNA, 19 nt, Homo sapiens
gugaggcuuucuacaaaua

SEQ ID NO: 734906 - RNA, 19 nt, Homo sapiens
guacugcuguaaauacuau

SEQ ID NO: 734907 - RNA, 19 nt, Homo sapiens
caacaagcccugcaaggaa

SEQ ID NO: 734908 - RNA, 19 nt, Homo sapiens
aagcaaguauccaguauga

SEQ ID NO: 734909 - RNA, 19 nt, Homo sapiens
cuagauguguuuacagaaa

SEQ ID NO: 734910 - RNA, 19 nt, Homo sapiens
caaagccaauggagaguau

SEQ ID NO: 734911 - RNA, 19 nt, Homo sapiens
gaauacaucuguuccuacu

SEQ ID NO: 734912 - RNA, 19 nt, Homo sapiens
aaauggaaaugucugauga

SEQ ID NO: 734913 - RNA, 19 nt, Homo sapiens
ugagaaagauauggaagaa

SEQ ID NO: 734914 - RNA, 19 nt, Homo sapiens
gucaauugguugucuuuaa

SEQ ID NO: 734915 - RNA, 19 nt, Homo sapiens
gaacuacaggcccuaaaga

SEQ ID NO: 734916 - RNA, 19 nt, Homo sapiens
gcaaacaagcugaggaaau

SEQ ID NO: 734917 - RNA, 19 nt, Homo sapiens
ccaguaguguucaaaguug

SEQ ID NO: 734918 - RNA, 19 nt, Homo sapiens
aggcagagauggucuuuau

SEQ ID NO: 734919 - RNA, 19 nt, Homo sapiens
cgaauacccucuugagaag

SEQ ID NO: 734920 - RNA, 19 nt, Homo sapiens
gaaauggaaaugucugaug

SEQ ID NO: 734921 - RNA, 19 nt, Homo sapiens
gagucucaauugaagauaa

SEQ ID NO: 734922 - RNA, 19 nt, Homo sapiens
ccaguagaccaguaaauaa

SEQ ID NO: 734923 - RNA, 19 nt, Homo sapiens
gaagaaaugacagaaacaa

SEQ ID NO: 734924 - RNA, 19 nt, Homo sapiens
gagaagaugacccuaacaa

SEQ ID NO: 734925 - RNA, 19 nt, Homo sapiens
ugaggaaucagccuuagua

SEQ ID NO: 734926 - RNA, 19 nt, Homo sapiens
ugaggaaauucgcaacauu

SEQ ID NO: 734927 - RNA, 19 nt, Homo sapiens
auacaucuguuccuacuug

SEQ ID NO: 734928 - RNA, 19 nt, Homo sapiens
gcaacaagcccugcaagga

SEQ ID NO: 734929 - RNA, 19 nt, Homo sapiens
gcaaaaguccugaugcuaa

SEQ ID NO: 734930 - RNA, 19 nt, Homo sapiens
ggacuccugaagauaaaua

SEQ ID NO: 734931 - RNA, 19 nt, Homo sapiens
gguggugguugugguauuu

SEQ ID NO: 734932 - RNA, 19 nt, Homo sapiens
gcaugugaguggacccauu

SEQ ID NO: 734933 - RNA, 19 nt, Homo sapiens
aaagaaagaagcugaacuu

SEQ ID NO: 734934 - RNA, 19 nt, Homo sapiens
gauaguggcuguguaccau

SEQ ID NO: 734935 - RNA, 19 nt, Homo sapiens
caaaggagaaguucaagca

SEQ ID NO: 734936 - RNA, 19 nt, Homo sapiens
gguggaaaguaaacagaga

SEQ ID NO: 734937 - RNA, 19 nt, Homo sapiens
agaaagaagcugaacuuga

SEQ ID NO: 734938 - RNA, 19 nt, Homo sapiens
uagaagaaaugacagaaac

SEQ ID NO: 734939 - RNA, 19 nt, Homo sapiens
ggagaggucaaccgucgua

SEQ ID NO: 734940 - RNA, 19 nt, Homo sapiens
gaagaagaaauggaaaugu

SEQ ID NO: 734941 - RNA, 19 nt, Homo sapiens
gcaaagccaauggagagua

SEQ ID NO: 734942 - RNA, 19 nt, Homo sapiens
gggauuaucuccacauucc

SEQ ID NO: 734943 - RNA, 19 nt, Homo sapiens
gauagcgaauacccucuug

SEQ ID NO: 734944 - RNA, 19 nt, Homo sapiens
aagaugacccuaacaaaga

SEQ ID NO: 734945 - RNA, 19 nt, Homo sapiens
gcgagaagaagaaauggaa

SEQ ID NO: 734946 - RNA, 19 nt, Homo sapiens
gcacacaguggcagaagga

SEQ ID NO: 734947 - RNA, 19 nt, Homo sapiens
gcaaguauccaguaugacu

SEQ ID NO: 734948 - RNA, 19 nt, Homo sapiens
caaaaguccugaugcuaaa

SEQ ID NO: 734949 - RNA, 19 nt, Homo sapiens
gcaggcccuuucuggaauu

SEQ ID NO: 734950 - RNA, 19 nt, Homo sapiens
ccaauaacuucuacuccau

SEQ ID NO: 734951 - RNA, 19 nt, Homo sapiens
cuacaggcccuaaagagaa

SEQ ID NO: 734952 - RNA, 19 nt, Homo sapiens
gcaagaacaaggcaaaguc

SEQ ID NO: 734953 - RNA, 19 nt, Homo sapiens
aagaagaaauggaaauguc

SEQ ID NO: 734954 - RNA, 19 nt, Homo sapiens
gagaagaagaaauggaaau

SEQ ID NO: 734955 - RNA, 19 nt, Homo sapiens
gaggaaauucgcaacauuc

SEQ ID NO: 734956 - RNA, 19 nt, Homo sapiens
cagagauggucuuuauugu

SEQ ID NO: 734957 - RNA, 19 nt, Homo sapiens
caguagaccaguaaauaaa

SEQ ID NO: 734958 - RNA, 19 nt, Homo sapiens
caugagagcagcacuaagu

SEQ ID NO: 734959 - RNA, 19 nt, Homo sapiens
gacagcaccucgaacuaca

SEQ ID NO: 734960 - RNA, 19 nt, Homo sapiens
gaagcugaccuaaaucucu

SEQ ID NO: 734961 - RNA, 19 nt, Homo sapiens
gaguggacccauucagaaa

SEQ ID NO: 734962 - RNA, 19 nt, Homo sapiens
aaaagaaacugaggaauca

SEQ ID NO: 734963 - RNA, 19 nt, Homo sapiens
cacaguggcagaaggauuu

SEQ ID NO: 734964 - RNA, 19 nt, Homo sapiens
agaaagcaaguauccagua

SEQ ID NO: 734965 - RNA, 19 nt, Homo sapiens
gcagauaguggcuguguac

SEQ ID NO: 734966 - RNA, 19 nt, Homo sapiens
ggacagcaccucgaacuac

SEQ ID NO: 734967 - RNA, 19 nt, Homo sapiens
caaaccaggauagcgaaua

SEQ ID NO: 734968 - RNA, 19 nt, Homo sapiens
ucaaaguccaagaggaaua

SEQ ID NO: 734969 - RNA, 19 nt, Homo sapiens
cagagaagaugacccuaac

SEQ ID NO: 734970 - RNA, 19 nt, Homo sapiens
caagcaagaacaaggcaaa

SEQ ID NO: 734971 - RNA, 19 nt, Homo sapiens
guaaaugagaugccaguag

SEQ ID NO: 734972 - RNA, 19 nt, Homo sapiens
auaaugagcuaggguuugu

SEQ ID NO: 734973 - RNA, 19 nt, Homo sapiens
cccaguagaccaguaaaua

SEQ ID NO: 734974 - RNA, 19 nt, Homo sapiens
uacaggcccuaaagagaaa

SEQ ID NO: 734975 - RNA, 19 nt, Homo sapiens
cagcaguccuaucaaaucu

SEQ ID NO: 734976 - RNA, 19 nt, Homo sapiens
ggacccauucagaaacuuu

SEQ ID NO: 734977 - RNA, 19 nt, Homo sapiens
gaaaugaacuguacuaauc

SEQ ID NO: 734978 - RNA, 19 nt, Homo sapiens
gaacaaagcugcccaugug

SEQ ID NO: 734979 - RNA, 19 nt, Homo sapiens
ccagagaucuuugaaguua

SEQ ID NO: 734980 - RNA, 19 nt, Homo sapiens
gaaaagagcuguaaacaug

SEQ ID NO: 734981 - RNA, 19 nt, Homo sapiens
gaacaaggcuuugaaacug

SEQ ID NO: 734982 - RNA, 19 nt, Homo sapiens
ggaaggugcugaugcagua

SEQ ID NO: 734983 - RNA, 19 nt, Homo sapiens
gaaggagccuggacucuga

SEQ ID NO: 734984 - RNA, 19 nt, Homo sapiens
gaacuguacuaaucccuuu

SEQ ID NO: 734985 - RNA, 19 nt, Homo sapiens
ggaucgaccucucuacaua

SEQ ID NO: 734986 - RNA, 19 nt, Homo sapiens
gaugagaucuguggaacua

SEQ ID NO: 734987 - RNA, 19 nt, Homo sapiens
gaagugauguggcauuugu

SEQ ID NO: 734988 - RNA, 19 nt, Homo sapiens
ccaaggagaugaaagaaga

SEQ ID NO: 734989 - RNA, 19 nt, Homo sapiens
gaaauaagccagagaucuu

SEQ ID NO: 734990 - RNA, 19 nt, Homo sapiens
caacaacugccacgacuua

SEQ ID NO: 734991 - RNA, 19 nt, Homo sapiens
uaagugaacuagaccagua

SEQ ID NO: 734992 - RNA, 19 nt, Homo sapiens
ugacaugguucuuggauuu

SEQ ID NO: 734993 - RNA, 19 nt, Homo sapiens
ggauugcgcugaagacuau

SEQ ID NO: 734994 - RNA, 19 nt, Homo sapiens
gaaagacgaugagaucugu

SEQ ID NO: 734995 - RNA, 19 nt, Homo sapiens
gcagagacguuaaugaaag

SEQ ID NO: 734996 - RNA, 19 nt, Homo sapiens
gagagaaggacaaacauuu

SEQ ID NO: 734997 - RNA, 19 nt, Homo sapiens
gaacaagggcccagcauuc

SEQ ID NO: 734998 - RNA, 19 nt, Homo sapiens
gacaucaagucaagaguaa

SEQ ID NO: 734999 - RNA, 19 nt, Homo sapiens
ggaaagagagauuuguaaa

SEQ ID NO: 735000 - RNA, 19 nt, Homo sapiens
gaagaggacagacaaauca

SEQ ID NO: 735001 - RNA, 19 nt, Homo sapiens
ugaauacgguucuggauga

SEQ ID NO: 735002 - RNA, 19 nt, Homo sapiens
gagacggacucgauucauu

SEQ ID NO: 735003 - RNA, 19 nt, Homo sapiens
ugaaaucccacguguauaa

SEQ ID NO: 735004 - RNA, 19 nt, Homo sapiens
gcuaugcccugucucugua

SEQ ID NO: 735005 - RNA, 19 nt, Homo sapiens
ugagacagcccaagaaauu

SEQ ID NO: 735006 - RNA, 19 nt, Homo sapiens
gaccggacccagaacauua

SEQ ID NO: 735007 - RNA, 19 nt, Homo sapiens
aaacccaacuccucauaaa

SEQ ID NO: 735008 - RNA, 19 nt, Homo sapiens
agauaugcgugaaggauua

SEQ ID NO: 735009 - RNA, 19 nt, Homo sapiens
gguaaaggauugugugaag

SEQ ID NO: 735010 - RNA, 19 nt, Homo sapiens
gcgagagucugaugauuuc

SEQ ID NO: 735011 - RNA, 19 nt, Homo sapiens
gauauuggaccuacaaaug

SEQ ID NO: 735012 - RNA, 19 nt, Homo sapiens
cgagguggcccgagaauuu

SEQ ID NO: 735013 - RNA, 19 nt, Homo sapiens
aaucagagcuuugagauca

SEQ ID NO: 735014 - RNA, 19 nt, Homo sapiens
gcacuuugcauguuuauca

SEQ ID NO: 735015 - RNA, 19 nt, Homo sapiens
caacuccucugaccgcauu

SEQ ID NO: 735016 - RNA, 19 nt, Homo sapiens
gcaaaguuaugaccuugau

SEQ ID NO: 735017 - RNA, 19 nt, Homo sapiens
ccaguuagacacauacaua

SEQ ID NO: 735018 - RNA, 19 nt, Homo sapiens
uacaauggcuggaugagaa

SEQ ID NO: 735019 - RNA, 19 nt, Homo sapiens
agaaagaccaccuguguaa

SEQ ID NO: 735020 - RNA, 19 nt, Homo sapiens
ggagucaagugccaugaga

SEQ ID NO: 735021 - RNA, 19 nt, Homo sapiens
gccauuacaugaaacaaga

SEQ ID NO: 735022 - RNA, 19 nt, Homo sapiens
cagcauuacuuucuucaga

SEQ ID NO: 735023 - RNA, 19 nt, Homo sapiens
uguaaugacucuaugcaaa

SEQ ID NO: 735024 - RNA, 19 nt, Homo sapiens
ggacucugaucccucugua

SEQ ID NO: 735025 - RNA, 19 nt, Homo sapiens
gcuacacgcacuucucuua

SEQ ID NO: 735026 - RNA, 19 nt, Homo sapiens
caucuuugcuguuguuaau

SEQ ID NO: 735027 - RNA, 19 nt, Homo sapiens
gcagacagcggguauguuc

SEQ ID NO: 735028 - RNA, 19 nt, Homo sapiens
gagauaagaaggauggauu

SEQ ID NO: 735029 - RNA, 19 nt, Homo sapiens
gcugaaaucccacguguau

SEQ ID NO: 735030 - RNA, 19 nt, Homo sapiens
gaaggacaaacauuucuga

SEQ ID NO: 735031 - RNA, 19 nt, Homo sapiens
cgugaaggauuacugcuuu

SEQ ID NO: 735032 - RNA, 19 nt, Homo sapiens
gaaugaagguacaagaacu

SEQ ID NO: 735033 - RNA, 19 nt, Homo sapiens
cccaagaaauuguggauga

SEQ ID NO: 735034 - RNA, 19 nt, Homo sapiens
gggaggagaaguuccauuu

SEQ ID NO: 735035 - RNA, 19 nt, Homo sapiens
gaaacccaacuccucauaa

SEQ ID NO: 735036 - RNA, 19 nt, Homo sapiens
acucaaggaucacauggua

SEQ ID NO: 735037 - RNA, 19 nt, Homo sapiens
ugacgcacuuugcauguuu

SEQ ID NO: 735038 - RNA, 19 nt, Homo sapiens
ccuggaagguguacuuuga

SEQ ID NO: 735039 - RNA, 19 nt, Homo sapiens
gagaaagaccaccugugua

SEQ ID NO: 735040 - RNA, 19 nt, Homo sapiens
gcauugaguccauauauca

SEQ ID NO: 735041 - RNA, 19 nt, Homo sapiens
gagaaugcaucuucaccau

SEQ ID NO: 735042 - RNA, 19 nt, Homo sapiens
ugaacaagauaacuucuag

SEQ ID NO: 735043 - RNA, 19 nt, Homo sapiens
gcccagaucugcagucucu

SEQ ID NO: 735044 - RNA, 19 nt, Homo sapiens
gcugagccaucuuuccaaa

SEQ ID NO: 735045 - RNA, 19 nt, Homo sapiens
ccaaggagcugagccaucu

SEQ ID NO: 735046 - RNA, 19 nt, Homo sapiens
gaaggaggcagcaugugaa

SEQ ID NO: 735047 - RNA, 19 nt, Homo sapiens
ucaaagcccugagaagaau

SEQ ID NO: 735048 - RNA, 19 nt, Homo sapiens
gagaauuugugaaacucaa

SEQ ID NO: 735049 - RNA, 19 nt, Homo sapiens
cagaagugauguggcauuu

SEQ ID NO: 735050 - RNA, 19 nt, Homo sapiens
gggaaagagagauuuguaa

SEQ ID NO: 735051 - RNA, 19 nt, Homo sapiens
gauuguaucaugaguagaa

SEQ ID NO: 735052 - RNA, 19 nt, Homo sapiens
uaagagagaaggacaaaca

SEQ ID NO: 735053 - RNA, 19 nt, Homo sapiens
ggaugagaaugaggaugua

SEQ ID NO: 735054 - RNA, 19 nt, Homo sapiens
gcaccacuccucauaacuu

SEQ ID NO: 735055 - RNA, 19 nt, Homo sapiens
gagcugacaaugaguauuc

SEQ ID NO: 735056 - RNA, 19 nt, Homo sapiens
guucuuggauuuccucugu

SEQ ID NO: 735057 - RNA, 19 nt, Homo sapiens
gacugucccuugaguagaa

SEQ ID NO: 735058 - RNA, 19 nt, Homo sapiens
ggacgauccugugggagaa

SEQ ID NO: 735059 - RNA, 19 nt, Homo sapiens
gaggaaacacggaaucuca

SEQ ID NO: 735060 - RNA, 19 nt, Homo sapiens
gaugagacagcccaagaaa

SEQ ID NO: 735061 - RNA, 19 nt, Homo sapiens
gcauuaaggugcguguaug

SEQ ID NO: 735062 - RNA, 19 nt, Homo sapiens
gaagcagaguguacuggau

SEQ ID NO: 735063 - RNA, 19 nt, Homo sapiens
ggagggcucuauggcauug

SEQ ID NO: 735064 - RNA, 19 nt, Homo sapiens
ggaggaagccagauauugg

SEQ ID NO: 735065 - RNA, 19 nt, Homo sapiens
ccuaugaguugcagauaug

SEQ ID NO: 735066 - RNA, 19 nt, Homo sapiens
gcaaugggcugaagaaaac

SEQ ID NO: 735067 - RNA, 19 nt, Homo sapiens
cacggaaucucacuccaaa

SEQ ID NO: 735068 - RNA, 19 nt, Homo sapiens
gcaguaugcagacaucuug

SEQ ID NO: 735069 - RNA, 19 nt, Homo sapiens
gaagguacaagaacugcaa

SEQ ID NO: 735070 - RNA, 19 nt, Homo sapiens
gaggagaaguuccauuuug

SEQ ID NO: 735071 - RNA, 19 nt, Homo sapiens
guuaugaccuugauuaucc

SEQ ID NO: 735072 - RNA, 19 nt, Homo sapiens
cagauuguaucaugaguag

SEQ ID NO: 735073 - RNA, 19 nt, Homo sapiens
gauaagaagaggaaguuca

SEQ ID NO: 735074 - RNA, 19 nt, Homo sapiens
gugaagagcacaacuguag

SEQ ID NO: 735075 - RNA, 19 nt, Homo sapiens
ggaacgagauaagaaggau

SEQ ID NO: 735076 - RNA, 19 nt, Homo sapiens
uaaaagugcugacuacaug

SEQ ID NO: 735077 - RNA, 19 nt, Homo sapiens
ggacaaggguugaauauga

SEQ ID NO: 735078 - RNA, 19 nt, Homo sapiens
ggaaauagccauaguuaua

SEQ ID NO: 735079 - RNA, 19 nt, Homo sapiens
gaucagaagugacuauuaa

SEQ ID NO: 735080 - RNA, 19 nt, Homo sapiens
ugacaaaugugcaaucuua

SEQ ID NO: 735081 - RNA, 19 nt, Homo sapiens
gcacaggaaugauugguaa

SEQ ID NO: 735082 - RNA, 19 nt, Homo sapiens
ggauuuggcuacacacuua

SEQ ID NO: 735083 - RNA, 19 nt, Homo sapiens
gcagugagcuggacaacuu

SEQ ID NO: 735084 - RNA, 19 nt, Homo sapiens
gaaccucgcucaaggagaa

SEQ ID NO: 735085 - RNA, 19 nt, Homo sapiens
guaagaagguguauucaga

SEQ ID NO: 735086 - RNA, 19 nt, Homo sapiens
gaccuaauuuguagacuua

SEQ ID NO: 735087 - RNA, 19 nt, Homo sapiens
guugagaacuuauguguuu

SEQ ID NO: 735088 - RNA, 19 nt, Homo sapiens
ccaggaagcucaucagaaa

SEQ ID NO: 735089 - RNA, 19 nt, Homo sapiens
gaaagagaaugcacuacuu

SEQ ID NO: 735090 - RNA, 19 nt, Homo sapiens
gaagguguauucagaaguu

SEQ ID NO: 735091 - RNA, 19 nt, Homo sapiens
caacgaacuuugaugauga

SEQ ID NO: 735092 - RNA, 19 nt, Homo sapiens
ggagauugauagagccuua

SEQ ID NO: 735093 - RNA, 19 nt, Homo sapiens
uaaugaaccucaacuugua

SEQ ID NO: 735094 - RNA, 19 nt, Homo sapiens
ugagagggcuguuaacauu

SEQ ID NO: 735095 - RNA, 19 nt, Homo sapiens
gcacagcaguuuccauuuc

SEQ ID NO: 735096 - RNA, 19 nt, Homo sapiens
ggagagcugugucuauuug

SEQ ID NO: 735097 - RNA, 19 nt, Homo sapiens
aagaagagcugaugaacaa

SEQ ID NO: 735098 - RNA, 19 nt, Homo sapiens
gaacagccauaccuucaau

SEQ ID NO: 735099 - RNA, 19 nt, Homo sapiens
gaucaaagaacaagagaaa

SEQ ID NO: 735100 - RNA, 19 nt, Homo sapiens
ggaagcauguuuauucugu

SEQ ID NO: 735101 - RNA, 19 nt, Homo sapiens
gaaagcauccugccuauag

SEQ ID NO: 735102 - RNA, 19 nt, Homo sapiens
gcagauaucacgacagauu

SEQ ID NO: 735103 - RNA, 19 nt, Homo sapiens
gaaagagucuccaguuacu

SEQ ID NO: 735104 - RNA, 19 nt, Homo sapiens
ugauagagccuuaggaaua

SEQ ID NO: 735105 - RNA, 19 nt, Homo sapiens
gaauggauaugauuaagca

SEQ ID NO: 735106 - RNA, 19 nt, Homo sapiens
gcaacgaacuuugaugaug

SEQ ID NO: 735107 - RNA, 19 nt, Homo sapiens
gaagaaagagaaugcacua

SEQ ID NO: 735108 - RNA, 19 nt, Homo sapiens
gcaagaagaguucccauga

SEQ ID NO: 735109 - RNA, 19 nt, Homo sapiens
caaaguccaucaaagaaga

SEQ ID NO: 735110 - RNA, 19 nt, Homo sapiens
ggagaaccaugcucuuguu

SEQ ID NO: 735111 - RNA, 19 nt, Homo sapiens
caacuaagacuucaacuuc

SEQ ID NO: 735112 - RNA, 19 nt, Homo sapiens
gaagaggagggucaugaua

SEQ ID NO: 735113 - RNA, 19 nt, Homo sapiens
ggaauguccugaccaacuu

SEQ ID NO: 735114 - RNA, 19 nt, Homo sapiens
caacacaggcaccuauuaa

SEQ ID NO: 735115 - RNA, 19 nt, Homo sapiens
agacagauccugccaguaa

SEQ ID NO: 735116 - RNA, 19 nt, Homo sapiens
gcuauuugcuagauaaaga

SEQ ID NO: 735117 - RNA, 19 nt, Homo sapiens
cagcacagcuccuggauca

SEQ ID NO: 735118 - RNA, 19 nt, Homo sapiens
caagaagaguucccaugaa

SEQ ID NO: 735119 - RNA, 19 nt, Homo sapiens
caagaaagcgcaaggaaug

SEQ ID NO: 735120 - RNA, 19 nt, Homo sapiens
cagaaucgccagccacuua

SEQ ID NO: 735121 - RNA, 19 nt, Homo sapiens
caugcaagauccaaacuuu

SEQ ID NO: 735122 - RNA, 19 nt, Homo sapiens
gcaaauucgucagaucaaa

SEQ ID NO: 735123 - RNA, 19 nt, Homo sapiens
ggagcugccucuucucuug

SEQ ID NO: 735124 - RNA, 19 nt, Homo sapiens
ggaaggcaacguuguguuu

SEQ ID NO: 735125 - RNA, 19 nt, Homo sapiens
cuucaaaccugacaaaugu

SEQ ID NO: 735126 - RNA, 19 nt, Homo sapiens
gcugauauguguucaagau

SEQ ID NO: 735127 - RNA, 19 nt, Homo sapiens
ggauuggcauucagucaaa

SEQ ID NO: 735128 - RNA, 19 nt, Homo sapiens
gccaaagucuauaguaaau

SEQ ID NO: 735129 - RNA, 19 nt, Homo sapiens
uauagcaucuugcauguug

SEQ ID NO: 735130 - RNA, 19 nt, Homo sapiens
gcaaaguuaaggcuugaua

SEQ ID NO: 735131 - RNA, 19 nt, Homo sapiens
gaggcaaccuguucccaaa

SEQ ID NO: 735132 - RNA, 19 nt, Homo sapiens
guaacaacaugaacaucaa

SEQ ID NO: 735133 - RNA, 19 nt, Homo sapiens
ggacagcggccuaguuaug

SEQ ID NO: 735134 - RNA, 19 nt, Homo sapiens
acaacaagcuccuccaaau

SEQ ID NO: 735135 - RNA, 19 nt, Homo sapiens
ggaagccacugaauccaau

SEQ ID NO: 735136 - RNA, 19 nt, Homo sapiens
cacaguaucuaagguauaa

SEQ ID NO: 735137 - RNA, 19 nt, Homo sapiens
uagcagauaucacgacaga

SEQ ID NO: 735138 - RNA, 19 nt, Homo sapiens
ccagguaagcccuuuauuu

SEQ ID NO: 735139 - RNA, 19 nt, Homo sapiens
gaaaccagguaagcccuuu

SEQ ID NO: 735140 - RNA, 19 nt, Homo sapiens
ucacagagcacuuuuaaua

SEQ ID NO: 735141 - RNA, 19 nt, Homo sapiens
gaucagacagcuugaauca

SEQ ID NO: 735142 - RNA, 19 nt, Homo sapiens
aaugugaacuugacucuga

SEQ ID NO: 735143 - RNA, 19 nt, Homo sapiens
gaagaguucccaugaagga

SEQ ID NO: 735144 - RNA, 19 nt, Homo sapiens
caaagucuauaguaaaugg

SEQ ID NO: 735145 - RNA, 19 nt, Homo sapiens
gagcaaaguuaaggcuuga

SEQ ID NO: 735146 - RNA, 19 nt, Homo sapiens
caugucagauugaauguau

SEQ ID NO: 735147 - RNA, 19 nt, Homo sapiens
caggaaauagccauaguua

SEQ ID NO: 735148 - RNA, 19 nt, Homo sapiens
gagaaucuguguccuaugc

SEQ ID NO: 735149 - RNA, 19 nt, Homo sapiens
aaggauaccugcuuuggaa

SEQ ID NO: 735150 - RNA, 19 nt, Homo sapiens
ucaccugaaucaugaauug

SEQ ID NO: 735151 - RNA, 19 nt, Homo sapiens
uauagggccaucugaauua

SEQ ID NO: 735152 - RNA, 19 nt, Homo sapiens
gaauauagggccaucugaa

SEQ ID NO: 735153 - RNA, 19 nt, Homo sapiens
aaacagcacugcgaauuuc

SEQ ID NO: 735154 - RNA, 19 nt, Homo sapiens
gaacccaggucaggacaug

SEQ ID NO: 735155 - RNA, 19 nt, Homo sapiens
gaaucuguguccuaugcua

SEQ ID NO: 735156 - RNA, 19 nt, Homo sapiens
gggaggaccugguaagaag

SEQ ID NO: 735157 - RNA, 19 nt, Homo sapiens
gccgauuucucuuggauuu

SEQ ID NO: 735158 - RNA, 19 nt, Homo sapiens
gaagcaaauucgucagauc

SEQ ID NO: 735159 - RNA, 19 nt, Homo sapiens
gauagagccuuaggaauac

SEQ ID NO: 735160 - RNA, 19 nt, Homo sapiens
ggaaauuuagggaacagua

SEQ ID NO: 735161 - RNA, 19 nt, Homo sapiens
ucagucaaaucuaucguuu

SEQ ID NO: 735162 - RNA, 19 nt, Homo sapiens
caaagaagaaggagaagau

SEQ ID NO: 735163 - RNA, 19 nt, Homo sapiens
caaccaaaguccaucaaag

SEQ ID NO: 735164 - RNA, 19 nt, Homo sapiens
uuacuaagcaggccacuuu

SEQ ID NO: 735165 - RNA, 19 nt, Homo sapiens
gccaguguguuuaaauuga

SEQ ID NO: 735166 - RNA, 19 nt, Homo sapiens
uaucuggccuugcggaauu

SEQ ID NO: 735167 - RNA, 19 nt, Homo sapiens
aacaaagacuccacaggua

SEQ ID NO: 735168 - RNA, 19 nt, Homo sapiens
ugauauguguucaagauga

SEQ ID NO: 735169 - RNA, 19 nt, Homo sapiens
gaaagacuacauguuacua

SEQ ID NO: 735170 - RNA, 19 nt, Homo sapiens
gaaccagccaaaucaacua

SEQ ID NO: 735171 - RNA, 19 nt, Homo sapiens
gcaaagggcagaccaaacu

SEQ ID NO: 735172 - RNA, 19 nt, Homo sapiens
gccagccacuuaccaauug

SEQ ID NO: 735173 - RNA, 19 nt, Homo sapiens
gaaucagcaucucuucuuc

SEQ ID NO: 735174 - RNA, 19 nt, Homo sapiens
acacaacacggaaauauug

SEQ ID NO: 735175 - RNA, 19 nt, Homo sapiens
gauaggaaaccaaggaaau

SEQ ID NO: 735176 - RNA, 19 nt, Homo sapiens
gaaccucaacuuguaauau

SEQ ID NO: 735177 - RNA, 19 nt, Homo sapiens
gaugagugcuacaacuaua

SEQ ID NO: 735178 - RNA, 19 nt, Homo sapiens
ggacgugccucuccuacug

SEQ ID NO: 735179 - RNA, 19 nt, Homo sapiens
ccagugaugcuguaguuua

SEQ ID NO: 735180 - RNA, 19 nt, Homo sapiens
ggggaaagcugacggauga

SEQ ID NO: 735181 - RNA, 19 nt, Homo sapiens
ggcuggagcuggacacuga

SEQ ID NO: 735182 - RNA, 19 nt, Homo sapiens
ggacucuacuuucuauuuu

SEQ ID NO: 735183 - RNA, 19 nt, Homo sapiens
ggccagugaugcuguaguu

SEQ ID NO: 735184 - RNA, 19 nt, Homo sapiens
gccaagauguggagaacug

SEQ ID NO: 735185 - RNA, 19 nt, Homo sapiens
gggcuggacuuucagagau

SEQ ID NO: 735186 - RNA, 19 nt, Homo sapiens
ggaagcaccuccuguaccu

SEQ ID NO: 735187 - RNA, 19 nt, Homo sapiens
gggacucuacuuucuauuu

SEQ ID NO: 735188 - RNA, 19 nt, Homo sapiens
cccgagaccucccugauga

SEQ ID NO: 735189 - RNA, 19 nt, Homo sapiens
cauggugacugccaagaug

SEQ ID NO: 735190 - RNA, 19 nt, Homo sapiens
gaugauguccugaccuuca

SEQ ID NO: 735191 - RNA, 19 nt, Homo sapiens
cuacaacuauauucguguu

SEQ ID NO: 735192 - RNA, 19 nt, Homo sapiens
agagauuccugaccuugaa

SEQ ID NO: 735193 - RNA, 19 nt, Homo sapiens
gaacuugggcuggacuuuc

SEQ ID NO: 735194 - RNA, 19 nt, Homo sapiens
ucaagguacuuccccauua

SEQ ID NO: 735195 - RNA, 19 nt, Homo sapiens
gaccaugucuacuucuucu

SEQ ID NO: 735196 - RNA, 19 nt, Homo sapiens
caacuauauucguguucuu

SEQ ID NO: 735197 - RNA, 19 nt, Homo sapiens
gagccuccgcuucccaaua

SEQ ID NO: 735198 - RNA, 19 nt, Homo sapiens
ccgcguagcccgaguaugu

SEQ ID NO: 735199 - RNA, 19 nt, Homo sapiens
ggagucagagguuuccuau

SEQ ID NO: 735200 - RNA, 19 nt, Homo sapiens
gcaggagggugaggaacug

SEQ ID NO: 735201 - RNA, 19 nt, Homo sapiens
gaaccggaccuugcuagug

SEQ ID NO: 735202 - RNA, 19 nt, Homo sapiens
ucagugagccagcauuuca

SEQ ID NO: 735203 - RNA, 19 nt, Homo sapiens
ggccggagguugccuuucu

SEQ ID NO: 735204 - RNA, 19 nt, Homo sapiens
ggagcuguuuggcuucuca

SEQ ID NO: 735205 - RNA, 19 nt, Homo sapiens
ggaugagugcuacaacuau

SEQ ID NO: 735206 - RNA, 19 nt, Homo sapiens
uggccgcucugcucucuuu

SEQ ID NO: 735207 - RNA, 19 nt, Homo sapiens
ccaaguaugacuccaagug

SEQ ID NO: 735208 - RNA, 19 nt, Homo sapiens
caacguggccaucuuugca

SEQ ID NO: 735209 - RNA, 19 nt, Homo sapiens
gaagcggacagcccaaaca

SEQ ID NO: 735210 - RNA, 19 nt, Homo sapiens
ccaggccagugaugcugua

SEQ ID NO: 735211 - RNA, 19 nt, Homo sapiens
gcagcuaugggauaacuuc

SEQ ID NO: 735212 - RNA, 19 nt, Homo sapiens
guggagaacugugcuguac

SEQ ID NO: 735213 - RNA, 19 nt, Homo sapiens
cgccucggguuuauuuauu

SEQ ID NO: 735214 - RNA, 19 nt, Homo sapiens
gaagccaagauguggagaa

SEQ ID NO: 735215 - RNA, 19 nt, Homo sapiens
ccaacaaguaucuaacaug

SEQ ID NO: 735216 - RNA, 19 nt, Homo sapiens
ggccuggacuccugugucu

SEQ ID NO: 735217 - RNA, 19 nt, Homo sapiens
agucagagguuuccuaucc

SEQ ID NO: 735218 - RNA, 19 nt, Homo sapiens
ggguuuauuuauugacugu

SEQ ID NO: 735219 - RNA, 19 nt, Homo sapiens
ccucggguuuauuuauuga

SEQ ID NO: 735220 - RNA, 19 nt, Homo sapiens
caagguacuuccccauuau

SEQ ID NO: 735221 - RNA, 19 nt, Homo sapiens
ggcuggacuuucagagauu

SEQ ID NO: 735222 - RNA, 19 nt, Homo sapiens
gccucggguuuauuuauug

SEQ ID NO: 735223 - RNA, 19 nt, Homo sapiens
caaacagcacgacggauca

SEQ ID NO: 735224 - RNA, 19 nt, Homo sapiens
cacaguaacaucacaguca

SEQ ID NO: 735225 - RNA, 19 nt, Homo sapiens
cuauauucguguucuuguu

SEQ ID NO: 735226 - RNA, 19 nt, Homo sapiens
cggaugagugcuacaacua

SEQ ID NO: 735227 - RNA, 19 nt, Homo sapiens
cugaugauguccugaccuu

SEQ ID NO: 735228 - RNA, 19 nt, Homo sapiens
cgaggucucuguggaggau

SEQ ID NO: 735229 - RNA, 19 nt, Homo sapiens
ggaaccagaacaggaacaa

SEQ ID NO: 735230 - RNA, 19 nt, Homo sapiens
gaucuggugggacugaugu

SEQ ID NO: 735231 - RNA, 19 nt, Homo sapiens
gcguagcccgaguauguaa

SEQ ID NO: 735232 - RNA, 19 nt, Homo sapiens
cagugaugcuguaguuuac

SEQ ID NO: 735233 - RNA, 19 nt, Homo sapiens
gcagagggcagccuguacu

SEQ ID NO: 735234 - RNA, 19 nt, Homo sapiens
ugccgcagcuaugggauaa

SEQ ID NO: 735235 - RNA, 19 nt, Homo sapiens
ccgggaagcaccuccugua

SEQ ID NO: 735236 - RNA, 19 nt, Homo sapiens
acaguaacaucacagucau

SEQ ID NO: 735237 - RNA, 19 nt, Homo sapiens
agaccucccugaugauguc

SEQ ID NO: 735238 - RNA, 19 nt, Homo sapiens
gcagcaggagggugaggaa

SEQ ID NO: 735239 - RNA, 19 nt, Homo sapiens
uaacauggagaagccaaga

SEQ ID NO: 735240 - RNA, 19 nt, Homo sapiens
gcuggugcccaacaaguau

SEQ ID NO: 735241 - RNA, 19 nt, Homo sapiens
cagagauuccugaccuuga

SEQ ID NO: 735242 - RNA, 19 nt, Homo sapiens
aagcccgucuccucaguga

SEQ ID NO: 735243 - RNA, 19 nt, Homo sapiens
ugagauugagcguggguuu

SEQ ID NO: 735244 - RNA, 19 nt, Homo sapiens
ugagugcuacaacuauauu

SEQ ID NO: 735245 - RNA, 19 nt, Homo sapiens
gugccucuccuacugugua

SEQ ID NO: 735246 - RNA, 19 nt, Homo sapiens
ucaccacccuggaggaacu

SEQ ID NO: 735247 - RNA, 19 nt, Homo sapiens
gaggagcuguuuggcuucu

SEQ ID NO: 735248 - RNA, 19 nt, Homo sapiens
ccucuacucacucucacua

SEQ ID NO: 735249 - RNA, 19 nt, Homo sapiens
gagauugagcguggguuug

SEQ ID NO: 735250 - RNA, 19 nt, Homo sapiens
gcccaacaaguaucuaaca

SEQ ID NO: 735251 - RNA, 19 nt, Homo sapiens
ggcuggugcccaacaagua

SEQ ID NO: 735252 - RNA, 19 nt, Homo sapiens
ccaguguggccgcagcuuu

SEQ ID NO: 735253 - RNA, 19 nt, Homo sapiens
gcauggugacugccaagau

SEQ ID NO: 735254 - RNA, 19 nt, Homo sapiens
ccuggacuccugugucuga

SEQ ID NO: 735255 - RNA, 19 nt, Homo sapiens
ggaaagcugacggaugagu

SEQ ID NO: 735256 - RNA, 19 nt, Homo sapiens
gaagagugggaggugagaa

SEQ ID NO: 735257 - RNA, 19 nt, Homo sapiens
ggaaccaggaauccaugga

SEQ ID NO: 735258 - RNA, 19 nt, Homo sapiens
uaccaccugucacccauca

SEQ ID NO: 735259 - RNA, 19 nt, Homo sapiens
aacuugggcuggacuuuca

SEQ ID NO: 735260 - RNA, 19 nt, Homo sapiens
guccaacguggccaucuuu

SEQ ID NO: 735261 - RNA, 19 nt, Homo sapiens
uggcuucucaggacccaua

SEQ ID NO: 735262 - RNA, 19 nt, Homo sapiens
gcuggacuuucagagauuc

SEQ ID NO: 735263 - RNA, 19 nt, Homo sapiens
ucaaggagcagaggagucu

SEQ ID NO: 735264 - RNA, 19 nt, Homo sapiens
gugcccaacaaguaucuaa

SEQ ID NO: 735265 - RNA, 19 nt, Homo sapiens
ucaccacccagaccaauag

SEQ ID NO: 735266 - RNA, 19 nt, Homo sapiens
cccgaauccuggagucaga

SEQ ID NO: 735267 - RNA, 19 nt, Homo sapiens
ccaugucuacuucuucuuc

SEQ ID NO: 735268 - RNA, 19 nt, Homo sapiens
agccacagcugcggauuuc

SEQ ID NO: 735269 - RNA, 19 nt, Homo sapiens
agauugagcguggguuuga

SEQ ID NO: 735270 - RNA, 19 nt, Homo sapiens
ccuucuaccuggaugagau

SEQ ID NO: 735271 - RNA, 19 nt, Homo sapiens
cccaacaaguaucuaacau

SEQ ID NO: 735272 - RNA, 19 nt, Homo sapiens
uauauucguguucuuguuc

SEQ ID NO: 735273 - RNA, 19 nt, Homo sapiens
ggacgcucuucaggacguu

SEQ ID NO: 735274 - RNA, 19 nt, Homo sapiens
gggaagcggacagcccaaa

SEQ ID NO: 735275 - RNA, 19 nt, Homo sapiens
gaaccacuaucccguguuu

SEQ ID NO: 735276 - RNA, 19 nt, Homo sapiens
gggaugcucuucacagcua

SEQ ID NO: 735277 - RNA, 19 nt, Homo sapiens
gggacuaccugaaccacua

SEQ ID NO: 735278 - RNA, 19 nt, Homo sapiens
aagcugaccuggagaucua

SEQ ID NO: 735279 - RNA, 19 nt, Homo sapiens
gggcagccaugucuacuuc

SEQ ID NO: 735280 - RNA, 19 nt, Homo sapiens
agauugcgauggaguuuaa

SEQ ID NO: 735281 - RNA, 19 nt, Homo sapiens
gguggcagcuguguuugaa

SEQ ID NO: 735282 - RNA, 19 nt, Homo sapiens
gggcgagugucgaaacuuc

SEQ ID NO: 735283 - RNA, 19 nt, Homo sapiens
gcagccaugucuacuucuu

SEQ ID NO: 735284 - RNA, 19 nt, Homo sapiens
gagacaacaucagcgguau

SEQ ID NO: 735285 - RNA, 19 nt, Homo sapiens
ggacagggacaaccucuac

SEQ ID NO: 735286 - RNA, 19 nt, Homo sapiens
ggagauugcgauggaguuu

SEQ ID NO: 735287 - RNA, 19 nt, Homo sapiens
auaaacgugugucggauga

SEQ ID NO: 735288 - RNA, 19 nt, Homo sapiens
gagauugcgauggaguuua

SEQ ID NO: 735289 - RNA, 19 nt, Homo sapiens
cagcuacuguuaccgacuu

SEQ ID NO: 735290 - RNA, 19 nt, Homo sapiens
agacucccauuucuacuuc

SEQ ID NO: 735291 - RNA, 19 nt, Homo sapiens
gagacucccauuucuacuu

SEQ ID NO: 735292 - RNA, 19 nt, Homo sapiens
gucaagacccacccucuga

SEQ ID NO: 735293 - RNA, 19 nt, Homo sapiens
cggcucaacugcucuguac

SEQ ID NO: 735294 - RNA, 19 nt, Homo sapiens
ugaaacaugacuccaagug

SEQ ID NO: 735295 - RNA, 19 nt, Homo sapiens
caagacccacccucugaug

SEQ ID NO: 735296 - RNA, 19 nt, Homo sapiens
ggacuaccugaaccacuau

SEQ ID NO: 735297 - RNA, 19 nt, Homo sapiens
caaacaggagggcgagugu

SEQ ID NO: 735298 - RNA, 19 nt, Homo sapiens
aaacgugugucggaugaag

SEQ ID NO: 735299 - RNA, 19 nt, Homo sapiens
gagggcgagugucgaaacu

SEQ ID NO: 735300 - RNA, 19 nt, Homo sapiens
gaagcugaccuggagaucu

SEQ ID NO: 735301 - RNA, 19 nt, Homo sapiens
caauguugcccucuucucu

SEQ ID NO: 735302 - RNA, 19 nt, Homo sapiens
ccaugucuacuucuucuuc

SEQ ID NO: 735303 - RNA, 19 nt, Homo sapiens
gacaacaucagcgguaugg

SEQ ID NO: 735304 - RNA, 19 nt, Homo sapiens
ucuccgaggugccgguuag

SEQ ID NO: 735305 - RNA, 19 nt, Homo sapiens
cgucugggcguguguguca

SEQ ID NO: 735306 - RNA, 19 nt, Homo sapiens
ccgacuuccuagccauuga

SEQ ID NO: 735307 - RNA, 19 nt, Homo sapiens
cccaagcacgccaauguug

SEQ ID NO: 735308 - RNA, 19 nt, Homo sapiens
gugcgccaacuacagcaua

SEQ ID NO: 735309 - RNA, 19 nt, Homo sapiens
caggagggcgagugucgaa

SEQ ID NO: 735310 - RNA, 19 nt, Homo sapiens
gaggugccgguuaggaguu

SEQ ID NO: 735311 - RNA, 19 nt, Homo sapiens
uccgggagauugcgaugga

SEQ ID NO: 735312 - RNA, 19 nt, Homo sapiens
gaaccacuaucccguguuu

SEQ ID NO: 735313 - RNA, 19 nt, Homo sapiens
ggccacagcugcagaccua

SEQ ID NO: 735314 - RNA, 19 nt, Homo sapiens
gggaugcucuucacagcua

SEQ ID NO: 735315 - RNA, 19 nt, Homo sapiens
gggacuaccugaaccacua

SEQ ID NO: 735316 - RNA, 19 nt, Homo sapiens
ggacuuugcuauggauuug

SEQ ID NO: 735317 - RNA, 19 nt, Homo sapiens
aagcugaccuggagaucua

SEQ ID NO: 735318 - RNA, 19 nt, Homo sapiens
gggcagccaugucuacuuc

SEQ ID NO: 735319 - RNA, 19 nt, Homo sapiens
agauugcgauggaguuuaa

SEQ ID NO: 735320 - RNA, 19 nt, Homo sapiens
ggccagcaccucaggcuua

SEQ ID NO: 735321 - RNA, 19 nt, Homo sapiens
gcgcguagguuuugguuuu

SEQ ID NO: 735322 - RNA, 19 nt, Homo sapiens
gcuauggauuugagguuga

SEQ ID NO: 735323 - RNA, 19 nt, Homo sapiens
gguggcagcuguguuugaa

SEQ ID NO: 735324 - RNA, 19 nt, Homo sapiens
gggcgagugucgaaacuuc

SEQ ID NO: 735325 - RNA, 19 nt, Homo sapiens
gggaggacuuugcuaugga

SEQ ID NO: 735326 - RNA, 19 nt, Homo sapiens
uggaggaguuugagaccua

SEQ ID NO: 735327 - RNA, 19 nt, Homo sapiens
gcagccaugucuacuucuu

SEQ ID NO: 735328 - RNA, 19 nt, Homo sapiens
ggaggacuuugcuauggau

SEQ ID NO: 735329 - RNA, 19 nt, Homo sapiens
gagacaacaucagcgguau

SEQ ID NO: 735330 - RNA, 19 nt, Homo sapiens
ggacagggacaaccucuac

SEQ ID NO: 735331 - RNA, 19 nt, Homo sapiens
ggagauugcgauggaguuu

SEQ ID NO: 735332 - RNA, 19 nt, Homo sapiens
auaaacgugugucggauga

SEQ ID NO: 735333 - RNA, 19 nt, Homo sapiens
gcaccagagccgccuuuga

SEQ ID NO: 735334 - RNA, 19 nt, Homo sapiens
cgacggcuccugcaucuuc

SEQ ID NO: 735335 - RNA, 19 nt, Homo sapiens
gagauugcgauggaguuua

SEQ ID NO: 735336 - RNA, 19 nt, Homo sapiens
cagcuacuguuaccgacuu

SEQ ID NO: 735337 - RNA, 19 nt, Homo sapiens
agacucccauuucuacuuc

SEQ ID NO: 735338 - RNA, 19 nt, Homo sapiens
gagacucccauuucuacuu

SEQ ID NO: 735339 - RNA, 19 nt, Homo sapiens
gucaagacccacccucuga

SEQ ID NO: 735340 - RNA, 19 nt, Homo sapiens
cggcucaacugcucuguac

SEQ ID NO: 735341 - RNA, 19 nt, Homo sapiens
ggacgucugggcucagugu

SEQ ID NO: 735342 - RNA, 19 nt, Homo sapiens
ugaaacaugacuccaagug

SEQ ID NO: 735343 - RNA, 19 nt, Homo sapiens
ccgagugggugcucaaguc

SEQ ID NO: 735344 - RNA, 19 nt, Homo sapiens
ucggugaaccugcugguaa

SEQ ID NO: 735345 - RNA, 19 nt, Homo sapiens
caccagagccgccuuugag

SEQ ID NO: 735346 - RNA, 19 nt, Homo sapiens
caagacccacccucugaug

SEQ ID NO: 735347 - RNA, 19 nt, Homo sapiens
gcugugggcguguguguca

SEQ ID NO: 735348 - RNA, 19 nt, Homo sapiens
ggacuaccugaaccacuau

SEQ ID NO: 735349 - RNA, 19 nt, Homo sapiens
ccacaaggaagcacaacca

SEQ ID NO: 735350 - RNA, 19 nt, Homo sapiens
caaacaggagggcgagugu

SEQ ID NO: 735351 - RNA, 19 nt, Homo sapiens
aaacgugugucggaugaag

SEQ ID NO: 735352 - RNA, 19 nt, Homo sapiens
cgggaggacuuugcuaugg

SEQ ID NO: 735353 - RNA, 19 nt, Homo sapiens
cgucugggcucagugucuu

SEQ ID NO: 735354 - RNA, 19 nt, Homo sapiens
gaagcugaccuggagaucu

SEQ ID NO: 735355 - RNA, 19 nt, Homo sapiens
gagggcgagugucgaaacu

SEQ ID NO: 735356 - RNA, 19 nt, Homo sapiens
gguguaugaagaacuguau

SEQ ID NO: 735357 - RNA, 19 nt, Homo sapiens
caauguugcccucuucucu

SEQ ID NO: 735358 - RNA, 19 nt, Homo sapiens
gcgggaggacuuugcuaug

SEQ ID NO: 735359 - RNA, 19 nt, Homo sapiens
ccaugucuacuucuucuuc

SEQ ID NO: 735360 - RNA, 19 nt, Homo sapiens
gacaacaucagcgguaugg

SEQ ID NO: 735361 - RNA, 19 nt, Homo sapiens
ucuccgaggugccgguuag

SEQ ID NO: 735362 - RNA, 19 nt, Homo sapiens
gccagcaccucaggcuuag

SEQ ID NO: 735363 - RNA, 19 nt, Homo sapiens
ccgacuuccuagccauuga

SEQ ID NO: 735364 - RNA, 19 nt, Homo sapiens
cccaagcacgccaauguug

SEQ ID NO: 735365 - RNA, 19 nt, Homo sapiens
caggagggcgagugucgaa

SEQ ID NO: 735366 - RNA, 19 nt, Homo sapiens
gugcgccaacuacagcaua

SEQ ID NO: 735367 - RNA, 19 nt, Homo sapiens
gaggugccgguuaggaguu

SEQ ID NO: 735368 - RNA, 19 nt, Homo sapiens
uccgggagauugcgaugga

SEQ ID NO: 735369 - RNA, 19 nt, Homo sapiens
gaaccacuaucccguguuu

SEQ ID NO: 735370 - RNA, 19 nt, Homo sapiens
gggaugcucuucacagcua

SEQ ID NO: 735371 - RNA, 19 nt, Homo sapiens
gggacuaccugaaccacua

SEQ ID NO: 735372 - RNA, 19 nt, Homo sapiens
aagcugaccuggagaucua

SEQ ID NO: 735373 - RNA, 19 nt, Homo sapiens
gggcagccaugucuacuuc

SEQ ID NO: 735374 - RNA, 19 nt, Homo sapiens
agauugcgauggaguuuaa

SEQ ID NO: 735375 - RNA, 19 nt, Homo sapiens
ggccagcaccucaggcuua

SEQ ID NO: 735376 - RNA, 19 nt, Homo sapiens
gguggcagcuguguuugaa

SEQ ID NO: 735377 - RNA, 19 nt, Homo sapiens
gggcgagugucgaaacuuc

SEQ ID NO: 735378 - RNA, 19 nt, Homo sapiens
uggaggaguuugagaccua

SEQ ID NO: 735379 - RNA, 19 nt, Homo sapiens
gcagccaugucuacuucuu

SEQ ID NO: 735380 - RNA, 19 nt, Homo sapiens
gagacaacaucagcgguau

SEQ ID NO: 735381 - RNA, 19 nt, Homo sapiens
ggacagggacaaccucuac

SEQ ID NO: 735382 - RNA, 19 nt, Homo sapiens
ggagauugcgauggaguuu

SEQ ID NO: 735383 - RNA, 19 nt, Homo sapiens
auaaacgugugucggauga

SEQ ID NO: 735384 - RNA, 19 nt, Homo sapiens
gcaccagagccgccuuuga

SEQ ID NO: 735385 - RNA, 19 nt, Homo sapiens
cgacggcuccugcaucuuc

SEQ ID NO: 735386 - RNA, 19 nt, Homo sapiens
gagauugcgauggaguuua

SEQ ID NO: 735387 - RNA, 19 nt, Homo sapiens
cagcuacuguuaccgacuu

SEQ ID NO: 735388 - RNA, 19 nt, Homo sapiens
agacucccauuucuacuuc

SEQ ID NO: 735389 - RNA, 19 nt, Homo sapiens
gagacucccauuucuacuu

SEQ ID NO: 735390 - RNA, 19 nt, Homo sapiens
gucaagacccacccucuga

SEQ ID NO: 735391 - RNA, 19 nt, Homo sapiens
cggcucaacugcucuguac

SEQ ID NO: 735392 - RNA, 19 nt, Homo sapiens
ggacgucugggcucagugu

SEQ ID NO: 735393 - RNA, 19 nt, Homo sapiens
ugaaacaugacuccaagug

SEQ ID NO: 735394 - RNA, 19 nt, Homo sapiens
ucggugaaccugcugguaa

SEQ ID NO: 735395 - RNA, 19 nt, Homo sapiens
caccagagccgccuuugag

SEQ ID NO: 735396 - RNA, 19 nt, Homo sapiens
caagacccacccucugaug

SEQ ID NO: 735397 - RNA, 19 nt, Homo sapiens
ggacuaccugaaccacuau

SEQ ID NO: 735398 - RNA, 19 nt, Homo sapiens
caaacaggagggcgagugu

SEQ ID NO: 735399 - RNA, 19 nt, Homo sapiens
aaacgugugucggaugaag

SEQ ID NO: 735400 - RNA, 19 nt, Homo sapiens
cgucugggcucagugucuu

SEQ ID NO: 735401 - RNA, 19 nt, Homo sapiens
gaagcugaccuggagaucu

SEQ ID NO: 735402 - RNA, 19 nt, Homo sapiens
gagggcgagugucgaaacu

SEQ ID NO: 735403 - RNA, 19 nt, Homo sapiens
gguguaugaagaacuguau

SEQ ID NO: 735404 - RNA, 19 nt, Homo sapiens
caauguugcccucuucucu

SEQ ID NO: 735405 - RNA, 19 nt, Homo sapiens
ccaugucuacuucuucuuc

SEQ ID NO: 735406 - RNA, 19 nt, Homo sapiens
gacaacaucagcgguaugg

SEQ ID NO: 735407 - RNA, 19 nt, Homo sapiens
ucuccgaggugccgguuag

SEQ ID NO: 735408 - RNA, 19 nt, Homo sapiens
gccagcaccucaggcuuag

SEQ ID NO: 735409 - RNA, 19 nt, Homo sapiens
ccgacuuccuagccauuga

SEQ ID NO: 735410 - RNA, 19 nt, Homo sapiens
cccaagcacgccaauguug

SEQ ID NO: 735411 - RNA, 19 nt, Homo sapiens
gugcgccaacuacagcaua

SEQ ID NO: 735412 - RNA, 19 nt, Homo sapiens
caggagggcgagugucgaa

SEQ ID NO: 735413 - RNA, 19 nt, Homo sapiens
gaggugccgguuaggaguu

SEQ ID NO: 735414 - RNA, 19 nt, Homo sapiens
uccgggagauugcgaugga

SEQ ID NO: 735415 - RNA, 19 nt, Homo sapiens
ggaauggaguuaccacuga

SEQ ID NO: 735416 - RNA, 19 nt, Homo sapiens
gaauggcguuccuuucuaa

SEQ ID NO: 735417 - RNA, 19 nt, Homo sapiens
gaaagaguacguguaaaua

SEQ ID NO: 735418 - RNA, 19 nt, Homo sapiens
gcagaugucuccucuuugu

SEQ ID NO: 735419 - RNA, 19 nt, Homo sapiens
cagcagaugucuccucuuu

SEQ ID NO: 735420 - RNA, 19 nt, Homo sapiens
ggacaucaguuuacucauc

SEQ ID NO: 735421 - RNA, 19 nt, Homo sapiens
uaagagaccuggccacaug

SEQ ID NO: 735422 - RNA, 19 nt, Homo sapiens
gagaaaagcuccuaaagug

SEQ ID NO: 735423 - RNA, 19 nt, Homo sapiens
guacugaggugacacaagu

SEQ ID NO: 735424 - RNA, 19 nt, Homo sapiens
ggacgaaugucacaauuuu

SEQ ID NO: 735425 - RNA, 19 nt, Homo sapiens
caaccuuacucuaaauuug

SEQ ID NO: 735426 - RNA, 19 nt, Homo sapiens
gcaaaugaccacuagugua

SEQ ID NO: 735427 - RNA, 19 nt, Homo sapiens
cgaaaucuacuucuucuuu

SEQ ID NO: 735428 - RNA, 19 nt, Homo sapiens
caaaugaccacuaguguau

SEQ ID NO: 735429 - RNA, 19 nt, Homo sapiens
gaaccucgcuuccaaucuc

SEQ ID NO: 735430 - RNA, 19 nt, Homo sapiens
ggaagaaaggcaagaaaga

SEQ ID NO: 735431 - RNA, 19 nt, Homo sapiens
ccacugagaugccaaaggu

SEQ ID NO: 735432 - RNA, 19 nt, Homo sapiens
caagaaagaggacgaaugu

SEQ ID NO: 735433 - RNA, 19 nt, Homo sapiens
aaagauacguuugcaauca

SEQ ID NO: 735434 - RNA, 19 nt, Homo sapiens
gagagugcaucaccaacaa

SEQ ID NO: 735435 - RNA, 19 nt, Homo sapiens
uugaagaucuggccuuauu

SEQ ID NO: 735436 - RNA, 19 nt, Homo sapiens
gaggacgaaugucacaauu

SEQ ID NO: 735437 - RNA, 19 nt, Homo sapiens
guucaucccuggugcuuga

SEQ ID NO: 735438 - RNA, 19 nt, Homo sapiens
caucugaacuccuguaaac

SEQ ID NO: 735439 - RNA, 19 nt, Homo sapiens
caugaaagaguacguguaa

SEQ ID NO: 735440 - RNA, 19 nt, Homo sapiens
ggacaccaucuucgcuuua

SEQ ID NO: 735441 - RNA, 19 nt, Homo sapiens
gcuggaggccuucuuguuu

SEQ ID NO: 735442 - RNA, 19 nt, Homo sapiens
caauuacucuguucuccuu

SEQ ID NO: 735443 - RNA, 19 nt, Homo sapiens
ggacuugcccugccuggaa

SEQ ID NO: 735444 - RNA, 19 nt, Homo sapiens
cuucaaggauuaaaugaga

SEQ ID NO: 735445 - RNA, 19 nt, Homo sapiens
ggucuuggccugugaaugu

SEQ ID NO: 735446 - RNA, 19 nt, Homo sapiens
gaacuccuguaaaccuuca

SEQ ID NO: 735447 - RNA, 19 nt, Homo sapiens
gggacuggcuggcuucuuc

SEQ ID NO: 735448 - RNA, 19 nt, Homo sapiens
ggaauuaucaguggcuuug

SEQ ID NO: 735449 - RNA, 19 nt, Homo sapiens
ccacaaccuuacucuaaau

SEQ ID NO: 735450 - RNA, 19 nt, Homo sapiens
aaugaccacuaguguauaa

SEQ ID NO: 735451 - RNA, 19 nt, Homo sapiens
gcaagaaagaggacgaaug

SEQ ID NO: 735452 - RNA, 19 nt, Homo sapiens
uaaagagccuggagaacgu

SEQ ID NO: 735453 - RNA, 19 nt, Homo sapiens
ggagacuucccgagcauuu

SEQ ID NO: 735454 - RNA, 19 nt, Homo sapiens
ugaaagaguacguguaaau

SEQ ID NO: 735455 - RNA, 19 nt, Homo sapiens
ccucucaccuccucacuug

SEQ ID NO: 735456 - RNA, 19 nt, Homo sapiens
gacgaaaucuacuucuucu

SEQ ID NO: 735457 - RNA, 19 nt, Homo sapiens
ggcagcagccugugaacua

SEQ ID NO: 735458 - RNA, 19 nt, Homo sapiens
gcacugaggccaaguuagg

SEQ ID NO: 735459 - RNA, 19 nt, Homo sapiens
gggccgaugcuuaggaaua

SEQ ID NO: 735460 - RNA, 19 nt, Homo sapiens
gggaacuucuggcuagaga

SEQ ID NO: 735461 - RNA, 19 nt, Homo sapiens
gaagaaaggcaagaaagag

SEQ ID NO: 735462 - RNA, 19 nt, Homo sapiens
ugucacagcugcuuucucu

SEQ ID NO: 735463 - RNA, 19 nt, Homo sapiens
ucugaguucucuuugagua

SEQ ID NO: 735464 - RNA, 19 nt, Homo sapiens
ucagagaacuaaaacauga

SEQ ID NO: 735465 - RNA, 19 nt, Homo sapiens
gggacaccaucuucgcuuu

SEQ ID NO: 735466 - RNA, 19 nt, Homo sapiens
gaggcugacuccugucuca

SEQ ID NO: 735467 - RNA, 19 nt, Homo sapiens
caggguugcuucaaggauu

SEQ ID NO: 735468 - RNA, 19 nt, Homo sapiens
ggccgaugcuuaggaauau

SEQ ID NO: 735469 - RNA, 19 nt, Homo sapiens
ugacacaagugaauacaac

SEQ ID NO: 735470 - RNA, 19 nt, Homo sapiens
gacaucaguuuacucaucu

SEQ ID NO: 735471 - RNA, 19 nt, Homo sapiens
uggacucccugaaauugua

SEQ ID NO: 735472 - RNA, 19 nt, Homo sapiens
uacgagcaguauaaagaua

SEQ ID NO: 735473 - RNA, 19 nt, Homo sapiens
uuuagacccuguagccaua

SEQ ID NO: 735474 - RNA, 19 nt, Homo sapiens
gaacuucuggcuagagaca

SEQ ID NO: 735475 - RNA, 19 nt, Homo sapiens
gcaugggcauccugugugu

SEQ ID NO: 735476 - RNA, 19 nt, Homo sapiens
agaaagaggacgaauguca

SEQ ID NO: 735477 - RNA, 19 nt, Homo sapiens
gcuaugacuuugcuuucug

SEQ ID NO: 735478 - RNA, 19 nt, Homo sapiens
uaguaucuguucucucuga

SEQ ID NO: 735479 - RNA, 19 nt, Homo sapiens
gacaccaucuucgcuuuau

SEQ ID NO: 735480 - RNA, 19 nt, Homo sapiens
gcugagcucuauguguauu

SEQ ID NO: 735481 - RNA, 19 nt, Homo sapiens
ucaaggccuuaacaaaguu

SEQ ID NO: 735482 - RNA, 19 nt, Homo sapiens
cccacaaccuuacucuaaa

SEQ ID NO: 735483 - RNA, 19 nt, Homo sapiens
gaauggucccuucagagaa

SEQ ID NO: 735484 - RNA, 19 nt, Homo sapiens
ugagaaaucagaacugcuu

SEQ ID NO: 735485 - RNA, 19 nt, Homo sapiens
gcaggauguugcugugcuu

SEQ ID NO: 735486 - RNA, 19 nt, Homo sapiens
cgacgaaaucuacuucuuc

SEQ ID NO: 735487 - RNA, 19 nt, Homo sapiens
gugacacccuugcccuaaa

SEQ ID NO: 735488 - RNA, 19 nt, Homo sapiens
gggcaaaugaccacuagug

SEQ ID NO: 735489 - RNA, 19 nt, Homo sapiens
gaggugacacaagugaaua

SEQ ID NO: 735490 - RNA, 19 nt, Homo sapiens
guugagaacaugaaauugu

SEQ ID NO: 735491 - RNA, 19 nt, Homo sapiens
caguugagaacaugaaauu

SEQ ID NO: 735492 - RNA, 19 nt, Homo sapiens
ggagagugcaucaccaaca

SEQ ID NO: 735493 - RNA, 19 nt, Homo sapiens
acacauacaauuacucugu

SEQ ID NO: 735494 - RNA, 19 nt, Homo sapiens
uuccuuggcucccauuaaa

SEQ ID NO: 735495 - RNA, 19 nt, Homo sapiens
ggcguugccugcagaacuu

SEQ ID NO: 735496 - RNA, 19 nt, Homo sapiens
cacauacaauuacucuguu

SEQ ID NO: 735497 - RNA, 19 nt, Homo sapiens
uaucuugggcccauuaguu

SEQ ID NO: 735498 - RNA, 19 nt, Homo sapiens
uuuaguaucuguucucucu

SEQ ID NO: 735499 - RNA, 19 nt, Homo sapiens
cagcaucccugacucucau

SEQ ID NO: 735500 - RNA, 19 nt, Homo sapiens
gaacguccaguaguguuug

SEQ ID NO: 735501 - RNA, 19 nt, Homo sapiens
gcuacuaucucugcugucu

SEQ ID NO: 735502 - RNA, 19 nt, Homo sapiens
cauacgagcgcauuaaagu

SEQ ID NO: 735503 - RNA, 19 nt, Homo sapiens
gaagauggagacgacgaaa

SEQ ID NO: 735504 - RNA, 19 nt, Homo sapiens
ggacggagccaauuaucac

SEQ ID NO: 735505 - RNA, 19 nt, Homo sapiens
cccagaaccucgcuuccaa

SEQ ID NO: 735506 - RNA, 19 nt, Homo sapiens
uaacaucugaacuccugua

SEQ ID NO: 735507 - RNA, 19 nt, Homo sapiens
gccagaccuuugccugauu

SEQ ID NO: 735508 - RNA, 19 nt, Homo sapiens
ugaguucucuuugaguaug

SEQ ID NO: 735509 - RNA, 19 nt, Homo sapiens
gcaguggcuuugguggauu

SEQ ID NO: 735510 - RNA, 19 nt, Homo sapiens
ccaguaguguuugaaguuc

SEQ ID NO: 735511 - RNA, 19 nt, Homo sapiens
gacauagagucagcagaug

SEQ ID NO: 735512 - RNA, 19 nt, Homo sapiens
gcuggucacuacagauaca

SEQ ID NO: 735513 - RNA, 19 nt, Homo sapiens
gaccacugcccugagguua

SEQ ID NO: 735514 - RNA, 19 nt, Homo sapiens
ugagugauuacuuggauuu

SEQ ID NO: 735515 - RNA, 19 nt, Homo sapiens
gaacugaaaugcucccaaa

SEQ ID NO: 735516 - RNA, 19 nt, Homo sapiens
gaaaguacccaaauaaaug

SEQ ID NO: 735517 - RNA, 19 nt, Homo sapiens
gcaauaaacucuggauguu

SEQ ID NO: 735518 - RNA, 19 nt, Homo sapiens
gaacaucuccuuucucuuc

SEQ ID NO: 735519 - RNA, 19 nt, Homo sapiens
gaaguuaccggcagcauuu

SEQ ID NO: 735520 - RNA, 19 nt, Homo sapiens
gaaggugccuguguucuau

SEQ ID NO: 735521 - RNA, 19 nt, Homo sapiens
ggaaaguacccaaauaaau

SEQ ID NO: 735522 - RNA, 19 nt, Homo sapiens
ccaagugggugcgcuauaa

SEQ ID NO: 735523 - RNA, 19 nt, Homo sapiens
ucaguccucuugucuauuu

SEQ ID NO: 735524 - RNA, 19 nt, Homo sapiens
gagaaaaccauguaucuua

SEQ ID NO: 735525 - RNA, 19 nt, Homo sapiens
caagaaagaugugaacuac

SEQ ID NO: 735526 - RNA, 19 nt, Homo sapiens
ggacagcgauggcauuugc

SEQ ID NO: 735527 - RNA, 19 nt, Homo sapiens
ucacugagcugcccacuac

SEQ ID NO: 735528 - RNA, 19 nt, Homo sapiens
gacagaagguaguaggauu

SEQ ID NO: 735529 - RNA, 19 nt, Homo sapiens
ccaaauaaaugagaagcuu

SEQ ID NO: 735530 - RNA, 19 nt, Homo sapiens
agaagcaguuguguuaaua

SEQ ID NO: 735531 - RNA, 19 nt, Homo sapiens
uacagaagcaguuguguua

SEQ ID NO: 735532 - RNA, 19 nt, Homo sapiens
ggaggugucuguggaguau

SEQ ID NO: 735533 - RNA, 19 nt, Homo sapiens
aaaugaagauggcaaagga

SEQ ID NO: 735534 - RNA, 19 nt, Homo sapiens
agacgcagauggagacuga

SEQ ID NO: 735535 - RNA, 19 nt, Homo sapiens
ggagaggguuaagaacaaa

SEQ ID NO: 735536 - RNA, 19 nt, Homo sapiens
caaagaagggcaacagguu

SEQ ID NO: 735537 - RNA, 19 nt, Homo sapiens
cagaagcaguuguguuaau

SEQ ID NO: 735538 - RNA, 19 nt, Homo sapiens
agaagaagcccaagucaga

SEQ ID NO: 735539 - RNA, 19 nt, Homo sapiens
guaguaggauugccaccaa

SEQ ID NO: 735540 - RNA, 19 nt, Homo sapiens
gauaggauuugaccauuuu

SEQ ID NO: 735541 - RNA, 19 nt, Homo sapiens
ccaaagaucgucaucaaca

SEQ ID NO: 735542 - RNA, 19 nt, Homo sapiens
gcacagcggaacugaaaug

SEQ ID NO: 735543 - RNA, 19 nt, Homo sapiens
ggaugggacugucuaugau

SEQ ID NO: 735544 - RNA, 19 nt, Homo sapiens
gacaacaggcccagguuaa

SEQ ID NO: 735545 - RNA, 19 nt, Homo sapiens
ugauaggauuugaccauuu

SEQ ID NO: 735546 - RNA, 19 nt, Homo sapiens
ggaagaagaagcccaaguc

SEQ ID NO: 735547 - RNA, 19 nt, Homo sapiens
gaagugaacccaucaucuc

SEQ ID NO: 735548 - RNA, 19 nt, Homo sapiens
acacauccgucaugguuga

SEQ ID NO: 735549 - RNA, 19 nt, Homo sapiens
gucagaaccuccugugaga

SEQ ID NO: 735550 - RNA, 19 nt, Homo sapiens
ugacuugguuucucuuugu

SEQ ID NO: 735551 - RNA, 19 nt, Homo sapiens
gcuaugagaccgagcaaga

SEQ ID NO: 735552 - RNA, 19 nt, Homo sapiens
gaagaagaagcccaaguca

SEQ ID NO: 735553 - RNA, 19 nt, Homo sapiens
gcaacagguuugucuaugc

SEQ ID NO: 735554 - RNA, 19 nt, Homo sapiens
cccaucaucucccgaaauu

SEQ ID NO: 735555 - RNA, 19 nt, Homo sapiens
guacccaaauaaaugagaa

SEQ ID NO: 735556 - RNA, 19 nt, Homo sapiens
ucaagaaagaugugaacua

SEQ ID NO: 735557 - RNA, 19 nt, Homo sapiens
gaagcagcaugagguguau

SEQ ID NO: 735558 - RNA, 19 nt, Homo sapiens
aaccaaagaucgucaucaa

SEQ ID NO: 735559 - RNA, 19 nt, Homo sapiens
ccagguuaaucaagaaaga

SEQ ID NO: 735560 - RNA, 19 nt, Homo sapiens
ccucaguccucuugucuau

SEQ ID NO: 735561 - RNA, 19 nt, Homo sapiens
gaacaaaacggucuuccaa

SEQ ID NO: 735562 - RNA, 19 nt, Homo sapiens
ggaaguuaccggcagcauu

SEQ ID NO: 735563 - RNA, 19 nt, Homo sapiens
uacaccagcuccuugaauu

SEQ ID NO: 735564 - RNA, 19 nt, Homo sapiens
ggguugagccugugacuug

SEQ ID NO: 735565 - RNA, 19 nt, Homo sapiens
ggaccuugcagaagaaaug

SEQ ID NO: 735566 - RNA, 19 nt, Homo sapiens
gagccuaguuucguguuug

SEQ ID NO: 735567 - RNA, 19 nt, Homo sapiens
cgucaugguugauggagaa

SEQ ID NO: 735568 - RNA, 19 nt, Homo sapiens
uuaagauucucagggauaa

SEQ ID NO: 735569 - RNA, 19 nt, Homo sapiens
gguaacuuaucgccuguug

SEQ ID NO: 735570 - RNA, 19 nt, Homo sapiens
ugaaggagacguuaguaga

SEQ ID NO: 735571 - RNA, 19 nt, Homo sapiens
ggucgccucuaccugauga

SEQ ID NO: 735572 - RNA, 19 nt, Homo sapiens
agccagacaucuacaacua

SEQ ID NO: 735573 - RNA, 19 nt, Homo sapiens
cugaggaccuugcagaaga

SEQ ID NO: 735574 - RNA, 19 nt, Homo sapiens
gaagauggcaaaggaagau

SEQ ID NO: 735575 - RNA, 19 nt, Homo sapiens
cagagugccucaacuacau

SEQ ID NO: 735576 - RNA, 19 nt, Homo sapiens
ccacuguccugaagaugug

SEQ ID NO: 735577 - RNA, 19 nt, Homo sapiens
ccacagcugucggucagaa

SEQ ID NO: 735578 - RNA, 19 nt, Homo sapiens
ggagagauuuucuuucugu

SEQ ID NO: 735579 - RNA, 19 nt, Homo sapiens
cagauuggcacgaaccuuu

SEQ ID NO: 735580 - RNA, 19 nt, Homo sapiens
gaaggagacguuaguagag

SEQ ID NO: 735581 - RNA, 19 nt, Homo sapiens
gaggagaggguuaagaaca

SEQ ID NO: 735582 - RNA, 19 nt, Homo sapiens
cagaggagaggguuaagaa

SEQ ID NO: 735583 - RNA, 19 nt, Homo sapiens
cgagcacgcuguucacauc

SEQ ID NO: 735584 - RNA, 19 nt, Homo sapiens
cuacacauccgucaugguu

SEQ ID NO: 735585 - RNA, 19 nt, Homo sapiens
aagaggaccuucccacauc

SEQ ID NO: 735586 - RNA, 19 nt, Homo sapiens
ccagacagugcuugaaauu

SEQ ID NO: 735587 - RNA, 19 nt, Homo sapiens
agacagagugccucaacua

SEQ ID NO: 735588 - RNA, 19 nt, Homo sapiens
gaagcaguuguguuaauau

SEQ ID NO: 735589 - RNA, 19 nt, Homo sapiens
agaaagaugugaacuacac

SEQ ID NO: 735590 - RNA, 19 nt, Homo sapiens
uuacguugcuuaagauucu

SEQ ID NO: 735591 - RNA, 19 nt, Homo sapiens
ggaccucuguuggcugaga

SEQ ID NO: 735592 - RNA, 19 nt, Homo sapiens
gacaaccgccuccucaugu

SEQ ID NO: 735593 - RNA, 19 nt, Homo sapiens
gcacauccugcgaaccaaa

SEQ ID NO: 735594 - RNA, 19 nt, Homo sapiens
aaagaagggcaacagguuu

SEQ ID NO: 735595 - RNA, 19 nt, Homo sapiens
ugaaggugccuguguucua

SEQ ID NO: 735596 - RNA, 19 nt, Homo sapiens
guauacauuuggaaaguac

SEQ ID NO: 735597 - RNA, 19 nt, Homo sapiens
gcacgaaccuuuucuucca

SEQ ID NO: 735598 - RNA, 19 nt, Homo sapiens
uaacuuaucgccuguuguc

SEQ ID NO: 735599 - RNA, 19 nt, Homo sapiens
ccaagcacguccuggaagu

SEQ ID NO: 735600 - RNA, 19 nt, Homo sapiens
caacagguuugucuaugcu

SEQ ID NO: 735601 - RNA, 19 nt, Homo sapiens
ggaagugaacccaucaucu

SEQ ID NO: 735602 - RNA, 19 nt, Homo sapiens
gagcugcccacuacuggaa

SEQ ID NO: 735603 - RNA, 19 nt, Homo sapiens
agaagcagcaugaggugua

SEQ ID NO: 735604 - RNA, 19 nt, Homo sapiens
gaaccaaagaucgucauca

SEQ ID NO: 735605 - RNA, 19 nt, Homo sapiens
ggcaacagguuugucuaug

SEQ ID NO: 735606 - RNA, 19 nt, Homo sapiens
gcacgcuguucacaucauc

SEQ ID NO: 735607 - RNA, 19 nt, Homo sapiens
agacaacaggcccagguua

SEQ ID NO: 735608 - RNA, 19 nt, Homo sapiens
ugaggaccuugcagaagaa

SEQ ID NO: 735609 - RNA, 19 nt, Homo sapiens
gaggcggucuucgcuguga

SEQ ID NO: 735610 - RNA, 19 nt, Homo sapiens
guacuucguuuuacuuuuc

SEQ ID NO: 735611 - RNA, 19 nt, Homo sapiens
agcaugagguguauuggaa

SEQ ID NO: 735612 - RNA, 19 nt, Homo sapiens
gcucggcccuacuaauugg

SEQ ID NO: 735613 - RNA, 19 nt, Homo sapiens
gcccagacagugcuugaaa

SEQ ID NO: 735614 - RNA, 19 nt, Homo sapiens
aagugaaggugguuccaaa

SEQ ID NO: 735615 - RNA, 19 nt, Homo sapiens
gaacauaacucugcugaau

SEQ ID NO: 735616 - RNA, 19 nt, Homo sapiens
ggaaagagguuaagcugaa

SEQ ID NO: 735617 - RNA, 19 nt, Homo sapiens
guagcaaacugaugacuuu

SEQ ID NO: 735618 - RNA, 19 nt, Homo sapiens
caaaugcucugucuucaau

SEQ ID NO: 735619 - RNA, 19 nt, Homo sapiens
gagauaccauguccuguuu

SEQ ID NO: 735620 - RNA, 19 nt, Homo sapiens
gaacugaucaacauaauuc

SEQ ID NO: 735621 - RNA, 19 nt, Homo sapiens
caacuucaguacucaaauu

SEQ ID NO: 735622 - RNA, 19 nt, Homo sapiens
cagaugauguugucacuuu

SEQ ID NO: 735623 - RNA, 19 nt, Homo sapiens
uaaaggcccucaucaauag

SEQ ID NO: 735624 - RNA, 19 nt, Homo sapiens
caagaagcuuugaguguuu

SEQ ID NO: 735625 - RNA, 19 nt, Homo sapiens
gaagacggcauuuaaaguu

SEQ ID NO: 735626 - RNA, 19 nt, Homo sapiens
acagaaaugugucaaugua

SEQ ID NO: 735627 - RNA, 19 nt, Homo sapiens
gcucgaauauguccuaaug

SEQ ID NO: 735628 - RNA, 19 nt, Homo sapiens
ccaaggaguucccagauga

SEQ ID NO: 735629 - RNA, 19 nt, Homo sapiens
gaaacacacuuugaugaau

SEQ ID NO: 735630 - RNA, 19 nt, Homo sapiens
gaaccuauguuuguagaug

SEQ ID NO: 735631 - RNA, 19 nt, Homo sapiens
gaagcaguuugguuuauau

SEQ ID NO: 735632 - RNA, 19 nt, Homo sapiens
cagcugaaauugugcagua

SEQ ID NO: 735633 - RNA, 19 nt, Homo sapiens
gaaacccacugacucaaug

SEQ ID NO: 735634 - RNA, 19 nt, Homo sapiens
caagaccucugaauacuuc

SEQ ID NO: 735635 - RNA, 19 nt, Homo sapiens
gcacgaaacagauucauuc

SEQ ID NO: 735636 - RNA, 19 nt, Homo sapiens
gaacuuuguccguguaauu

SEQ ID NO: 735637 - RNA, 19 nt, Homo sapiens
uuauguagcuugacaauuc

SEQ ID NO: 735638 - RNA, 19 nt, Homo sapiens
uaagcugaaugaacgaaua

SEQ ID NO: 735639 - RNA, 19 nt, Homo sapiens
caaaugaugcuaaggugua

SEQ ID NO: 735640 - RNA, 19 nt, Homo sapiens
uaacucugcugaauguaaa

SEQ ID NO: 735641 - RNA, 19 nt, Homo sapiens
caguaacgguguuuaguuu

SEQ ID NO: 735642 - RNA, 19 nt, Homo sapiens
uaagaaucaugcuccuaua

SEQ ID NO: 735643 - RNA, 19 nt, Homo sapiens
aaaccaagaccucugaaua

SEQ ID NO: 735644 - RNA, 19 nt, Homo sapiens
uugcauaucugaagaaaug

SEQ ID NO: 735645 - RNA, 19 nt, Homo sapiens
ugaaauaucuuccccuuuu

SEQ ID NO: 735646 - RNA, 19 nt, Homo sapiens
gcgcugagauuccuuuaca

SEQ ID NO: 735647 - RNA, 19 nt, Homo sapiens
gaacugaaaugagcaugca

SEQ ID NO: 735648 - RNA, 19 nt, Homo sapiens
ggucuuaugcuuccauuaa

SEQ ID NO: 735649 - RNA, 19 nt, Homo sapiens
ucagaaaugcagaugauua

SEQ ID NO: 735650 - RNA, 19 nt, Homo sapiens
gaaucaugcuccuauaaca

SEQ ID NO: 735651 - RNA, 19 nt, Homo sapiens
ggaaccauccucucaugua

SEQ ID NO: 735652 - RNA, 19 nt, Homo sapiens
ugaauuagaggauguguuu

SEQ ID NO: 735653 - RNA, 19 nt, Homo sapiens
caugauugcucgaauaugu

SEQ ID NO: 735654 - RNA, 19 nt, Homo sapiens
aaaggaagacggcauuuaa

SEQ ID NO: 735655 - RNA, 19 nt, Homo sapiens
uaacaaaugcucugucuuc

SEQ ID NO: 735656 - RNA, 19 nt, Homo sapiens
gaaaugcagcugaaauugu

SEQ ID NO: 735657 - RNA, 19 nt, Homo sapiens
cgaaacagauucauuccau

SEQ ID NO: 735658 - RNA, 19 nt, Homo sapiens
uuaaaggcccucaucaaua

SEQ ID NO: 735659 - RNA, 19 nt, Homo sapiens
caaaauggcuggcaaagau

SEQ ID NO: 735660 - RNA, 19 nt, Homo sapiens
ugaagcaguuugguuuaua

SEQ ID NO: 735661 - RNA, 19 nt, Homo sapiens
gaucaggaccggauauaug

SEQ ID NO: 735662 - RNA, 19 nt, Homo sapiens
ccaagcaagaguuuauuua

SEQ ID NO: 735663 - RNA, 19 nt, Homo sapiens
gaaaaggacuggagacaca

SEQ ID NO: 735664 - RNA, 19 nt, Homo sapiens
ucacauaagcccaaacuga

SEQ ID NO: 735665 - RNA, 19 nt, Homo sapiens
ggugaaaucaucagaaaga

SEQ ID NO: 735666 - RNA, 19 nt, Homo sapiens
guuaucaccuuccaaacaa

SEQ ID NO: 735667 - RNA, 19 nt, Homo sapiens
gaagugaguuuuacacgaa

SEQ ID NO: 735668 - RNA, 19 nt, Homo sapiens
gaaccauccucucauguac

SEQ ID NO: 735669 - RNA, 19 nt, Homo sapiens
gaaagagguuaagcugaau

SEQ ID NO: 735670 - RNA, 19 nt, Homo sapiens
ggagauaccauguccuguu

SEQ ID NO: 735671 - RNA, 19 nt, Homo sapiens
aaagauagcuguggaucga

SEQ ID NO: 735672 - RNA, 19 nt, Homo sapiens
uaacuugcauaucugaaga

SEQ ID NO: 735673 - RNA, 19 nt, Homo sapiens
ugacauaacaccaaacuuc

SEQ ID NO: 735674 - RNA, 19 nt, Homo sapiens
gcaguuugguuuauauucu

SEQ ID NO: 735675 - RNA, 19 nt, Homo sapiens
cagaaaugcagaugauuaa

SEQ ID NO: 735676 - RNA, 19 nt, Homo sapiens
gaucagccgugugugugua

SEQ ID NO: 735677 - RNA, 19 nt, Homo sapiens
uaagugaaccuauguuugu

SEQ ID NO: 735678 - RNA, 19 nt, Homo sapiens
gagcaugcauuuucuugua

SEQ ID NO: 735679 - RNA, 19 nt, Homo sapiens
ggacagaugcugcuauuuu

SEQ ID NO: 735680 - RNA, 19 nt, Homo sapiens
gaacuucgagaaaccaaga

SEQ ID NO: 735681 - RNA, 19 nt, Homo sapiens
gguauuccuuuccugcuuu

SEQ ID NO: 735682 - RNA, 19 nt, Homo sapiens
gaaacaggaggaaucaguu

SEQ ID NO: 735683 - RNA, 19 nt, Homo sapiens
ggagaugaaucacagaaaa

SEQ ID NO: 735684 - RNA, 19 nt, Homo sapiens
gcagaugauuaaccaauac

SEQ ID NO: 735685 - RNA, 19 nt, Homo sapiens
gcugaaugaacgaauaaua

SEQ ID NO: 735686 - RNA, 19 nt, Homo sapiens
gccagcaucuacaaucaaa

SEQ ID NO: 735687 - RNA, 19 nt, Homo sapiens
caauauaagucaagaagcu

SEQ ID NO: 735688 - RNA, 19 nt, Homo sapiens
ggauauaugugggaagcaa

SEQ ID NO: 735689 - RNA, 19 nt, Homo sapiens
gccaaucuauucucaaagu

SEQ ID NO: 735690 - RNA, 19 nt, Homo sapiens
ggaccaaguuuucaugauu

SEQ ID NO: 735691 - RNA, 19 nt, Homo sapiens
gcacugcagcgcugagauu

SEQ ID NO: 735692 - RNA, 19 nt, Homo sapiens
guaacgguguuuaguuuua

SEQ ID NO: 735693 - RNA, 19 nt, Homo sapiens
ggugauuacuccugaagug

SEQ ID NO: 735694 - RNA, 19 nt, Homo sapiens
caaagacacucggcagcaa

SEQ ID NO: 735695 - RNA, 19 nt, Homo sapiens
aaaugcagcugaaauugug

SEQ ID NO: 735696 - RNA, 19 nt, Homo sapiens
cagaaaugcagcugaaauu

SEQ ID NO: 735697 - RNA, 19 nt, Homo sapiens
cguguugguuggaguauuu

SEQ ID NO: 735698 - RNA, 19 nt, Homo sapiens
ccauguaccuaauccaaau

SEQ ID NO: 735699 - RNA, 19 nt, Homo sapiens
gaccuuuguuuccuuauuc

SEQ ID NO: 735700 - RNA, 19 nt, Homo sapiens
gcauucagccacucagaaa

SEQ ID NO: 735701 - RNA, 19 nt, Homo sapiens
caaaggaucagccgugugu

SEQ ID NO: 735702 - RNA, 19 nt, Homo sapiens
cagaaacacacuuugauga

SEQ ID NO: 735703 - RNA, 19 nt, Homo sapiens
gaacagagggaggagauca

SEQ ID NO: 735704 - RNA, 19 nt, Homo sapiens
gagcaggguugcggagcua

SEQ ID NO: 735705 - RNA, 19 nt, Homo sapiens
ggaagacggcauuuaaagu

SEQ ID NO: 735706 - RNA, 19 nt, Homo sapiens
guuaaaggcccucaucaau

SEQ ID NO: 735707 - RNA, 19 nt, Homo sapiens
auacagaaaugcagcugaa

SEQ ID NO: 735708 - RNA, 19 nt, Homo sapiens
cuacaaguacacaaagaua

SEQ ID NO: 735709 - RNA, 19 nt, Homo sapiens
uacguucacuggucucuaa

SEQ ID NO: 735710 - RNA, 19 nt, Homo sapiens
aaaccagucucagauauca

SEQ ID NO: 735711 - RNA, 19 nt, Homo sapiens
ccauaucccugugguauuc

SEQ ID NO: 735712 - RNA, 19 nt, Homo sapiens
gaugaagacggcccagaaa

SEQ ID NO: 735713 - RNA, 19 nt, Homo sapiens
gcuaagugaaccuauguuu

SEQ ID NO: 735714 - RNA, 19 nt, Homo sapiens
gagaucagaggaccaaguu

SEQ ID NO: 735715 - RNA, 19 nt, Homo sapiens
gcuguuaccucaauucuua

SEQ ID NO: 735716 - RNA, 19 nt, Homo sapiens
gcagaaagccugaaagaaa

SEQ ID NO: 735717 - RNA, 19 nt, Homo sapiens
uaaggaagcugaagaaaug

SEQ ID NO: 735718 - RNA, 19 nt, Homo sapiens
ucaagaagcucaugauuug

SEQ ID NO: 735719 - RNA, 19 nt, Homo sapiens
ggaaaggacugucagauuc

SEQ ID NO: 735720 - RNA, 19 nt, Homo sapiens
ggagugugcuuuaggauuu

SEQ ID NO: 735721 - RNA, 19 nt, Homo sapiens
gaccagaggcuuuagauua

SEQ ID NO: 735722 - RNA, 19 nt, Homo sapiens
gaccagcacuucugacuuu

SEQ ID NO: 735723 - RNA, 19 nt, Homo sapiens
aaauaaagcugcacucuau

SEQ ID NO: 735724 - RNA, 19 nt, Homo sapiens
guagggauguuuaggauaa

SEQ ID NO: 735725 - RNA, 19 nt, Homo sapiens
gaagaauaauacccuauga

SEQ ID NO: 735726 - RNA, 19 nt, Homo sapiens
gaugguaacugugugauuu

SEQ ID NO: 735727 - RNA, 19 nt, Homo sapiens
uaagaaggcagaacaguua

SEQ ID NO: 735728 - RNA, 19 nt, Homo sapiens
ggaaugucaugguaaauug

SEQ ID NO: 735729 - RNA, 19 nt, Homo sapiens
gcucagacauauauggaua

SEQ ID NO: 735730 - RNA, 19 nt, Homo sapiens
uaaaguugcuucagucuug

SEQ ID NO: 735731 - RNA, 19 nt, Homo sapiens
gaccucaguuaaccaauua

SEQ ID NO: 735732 - RNA, 19 nt, Homo sapiens
gcagaaagagcuauuggua

SEQ ID NO: 735733 - RNA, 19 nt, Homo sapiens
ucaaugcaguuaacaagua

SEQ ID NO: 735734 - RNA, 19 nt, Homo sapiens
guacagugaugcugagaaa

SEQ ID NO: 735735 - RNA, 19 nt, Homo sapiens
gauaggcuuuguauacuuu

SEQ ID NO: 735736 - RNA, 19 nt, Homo sapiens
guucaugacuuggcuguua

SEQ ID NO: 735737 - RNA, 19 nt, Homo sapiens
gaacagaggcugcuucaag

SEQ ID NO: 735738 - RNA, 19 nt, Homo sapiens
caacagcucaugaagauuu

SEQ ID NO: 735739 - RNA, 19 nt, Homo sapiens
gcaguagaauguuguguga

SEQ ID NO: 735740 - RNA, 19 nt, Homo sapiens
uaaccagcauugugauaua

SEQ ID NO: 735741 - RNA, 19 nt, Homo sapiens
gaaggagugugcuuuagga

SEQ ID NO: 735742 - RNA, 19 nt, Homo sapiens
ggcugaaacuuuauacaua

SEQ ID NO: 735743 - RNA, 19 nt, Homo sapiens
guauagcucugggaaauuu

SEQ ID NO: 735744 - RNA, 19 nt, Homo sapiens
gacauuugcuucaucauug

SEQ ID NO: 735745 - RNA, 19 nt, Homo sapiens
gcagguaccguuuguguaa

SEQ ID NO: 735746 - RNA, 19 nt, Homo sapiens
gaacucaacuuagcucaca

SEQ ID NO: 735747 - RNA, 19 nt, Homo sapiens
ugacuuggcuguuaaagau

SEQ ID NO: 735748 - RNA, 19 nt, Homo sapiens
uagaggagauugcaauuga

SEQ ID NO: 735749 - RNA, 19 nt, Homo sapiens
ggaccucaguuaaccaauu

SEQ ID NO: 735750 - RNA, 19 nt, Homo sapiens
ggauuaaucuccagcuuca

SEQ ID NO: 735751 - RNA, 19 nt, Homo sapiens
gcacauacagcauuuccua

SEQ ID NO: 735752 - RNA, 19 nt, Homo sapiens
ccagucagguuauuuaaug

SEQ ID NO: 735753 - RNA, 19 nt, Homo sapiens
ggaccagccuaauguagaa

SEQ ID NO: 735754 - RNA, 19 nt, Homo sapiens
gcagaacaguuaauuaaac

SEQ ID NO: 735755 - RNA, 19 nt, Homo sapiens
gaaauggaaacugcaaaua

SEQ ID NO: 735756 - RNA, 19 nt, Homo sapiens
gcugcgaucuuagaaauaa

SEQ ID NO: 735757 - RNA, 19 nt, Homo sapiens
gaacuucccaaccuuguuu

SEQ ID NO: 735758 - RNA, 19 nt, Homo sapiens
gcaguuaacaaguauauug

SEQ ID NO: 735759 - RNA, 19 nt, Homo sapiens
guguugaucuguaauguaa

SEQ ID NO: 735760 - RNA, 19 nt, Homo sapiens
cugauacacugcuagauua

SEQ ID NO: 735761 - RNA, 19 nt, Homo sapiens
uaacagguaucauuaacug

SEQ ID NO: 735762 - RNA, 19 nt, Homo sapiens
guauaggaaugucauggua

SEQ ID NO: 735763 - RNA, 19 nt, Homo sapiens
gcauuuaaguucccuagga

SEQ ID NO: 735764 - RNA, 19 nt, Homo sapiens
acaacuaggucauuucauu

SEQ ID NO: 735765 - RNA, 19 nt, Homo sapiens
gcucauaacagguaucauu

SEQ ID NO: 735766 - RNA, 19 nt, Homo sapiens
aaacaugauugaagccuuu

SEQ ID NO: 735767 - RNA, 19 nt, Homo sapiens
guaacugugugauuuagaa

SEQ ID NO: 735768 - RNA, 19 nt, Homo sapiens
cagaggcuuuagauuauua

SEQ ID NO: 735769 - RNA, 19 nt, Homo sapiens
agaaucagaugcugcagua

SEQ ID NO: 735770 - RNA, 19 nt, Homo sapiens
guacugagagcuuuggaua

SEQ ID NO: 735771 - RNA, 19 nt, Homo sapiens
gccuuuggcugaaacuuua

SEQ ID NO: 735772 - RNA, 19 nt, Homo sapiens
ccauuuggcugcuccuuaa

SEQ ID NO: 735773 - RNA, 19 nt, Homo sapiens
gauaugacuuaaugugcua

SEQ ID NO: 735774 - RNA, 19 nt, Homo sapiens
ucaguuaauugcagucuaa

SEQ ID NO: 735775 - RNA, 19 nt, Homo sapiens
ugaaagagaugaagcaaac

SEQ ID NO: 735776 - RNA, 19 nt, Homo sapiens
ggaccaguguugaucugua

SEQ ID NO: 735777 - RNA, 19 nt, Homo sapiens
ucaugggccuauauauuua

SEQ ID NO: 735778 - RNA, 19 nt, Homo sapiens
gaccaguguugaucuguaa

SEQ ID NO: 735779 - RNA, 19 nt, Homo sapiens
caaccacucuauauuacaa

SEQ ID NO: 735780 - RNA, 19 nt, Homo sapiens
gugaaugaaugcuacguuu

SEQ ID NO: 735781 - RNA, 19 nt, Homo sapiens
gaaauuacgagaaaguguu

SEQ ID NO: 735782 - RNA, 19 nt, Homo sapiens
gauuaucgaggucucauua

SEQ ID NO: 735783 - RNA, 19 nt, Homo sapiens
gcaccugucuucacuccaa

SEQ ID NO: 735784 - RNA, 19 nt, Homo sapiens
agaaagagcuauugguauc

SEQ ID NO: 735785 - RNA, 19 nt, Homo sapiens
ccauaaaucucaggaaugu

SEQ ID NO: 735786 - RNA, 19 nt, Homo sapiens
agauggaaauguuagguua

SEQ ID NO: 735787 - RNA, 19 nt, Homo sapiens
uguagaaggugguuauuug

SEQ ID NO: 735788 - RNA, 19 nt, Homo sapiens
gugcaguccuuccugauuu

SEQ ID NO: 735789 - RNA, 19 nt, Homo sapiens
gaucggcaauauucaguga

SEQ ID NO: 735790 - RNA, 19 nt, Homo sapiens
caucuggcuucuuuauaua

SEQ ID NO: 735791 - RNA, 19 nt, Homo sapiens
gaaaugcacaucaaagcaa

SEQ ID NO: 735792 - RNA, 19 nt, Homo sapiens
gaaagaguaaauugacgua

SEQ ID NO: 735793 - RNA, 19 nt, Homo sapiens
guuauuugcaguccuauua

SEQ ID NO: 735794 - RNA, 19 nt, Homo sapiens
gaaagauccccuaauaaua

SEQ ID NO: 735795 - RNA, 19 nt, Homo sapiens
gccauaagcaagucuauaa

SEQ ID NO: 735796 - RNA, 19 nt, Homo sapiens
acgagaaaguguuugaaua

SEQ ID NO: 735797 - RNA, 19 nt, Homo sapiens
gcaauugggaagaaacuuu

SEQ ID NO: 735798 - RNA, 19 nt, Homo sapiens
caucaaagcaauucagauu

SEQ ID NO: 735799 - RNA, 19 nt, Homo sapiens
gucagucuguugcaauuua

SEQ ID NO: 735800 - RNA, 19 nt, Homo sapiens
gcugaaacuuuauacauag

SEQ ID NO: 735801 - RNA, 19 nt, Homo sapiens
uaucaccacugcuuuaaug

SEQ ID NO: 735802 - RNA, 19 nt, Homo sapiens
gaacaaacaacaggaaauc

SEQ ID NO: 735803 - RNA, 19 nt, Homo sapiens
cuaacaaucuuuacgugaa

SEQ ID NO: 735804 - RNA, 19 nt, Homo sapiens
uacagaggcugcgaucuua

SEQ ID NO: 735805 - RNA, 19 nt, Homo sapiens
gaauggauguguguugaau

SEQ ID NO: 735806 - RNA, 19 nt, Homo sapiens
ggagucaaauggaaagauc

SEQ ID NO: 735807 - RNA, 19 nt, Homo sapiens
caaacaacaggaaaucuuu

SEQ ID NO: 735808 - RNA, 19 nt, Homo sapiens
gcuggaauuugcauugaaa

SEQ ID NO: 735809 - RNA, 19 nt, Homo sapiens
ugacguacuugcaguuuau

SEQ ID NO: 735810 - RNA, 19 nt, Homo sapiens
gauguuuacuacaagcuuu

SEQ ID NO: 735811 - RNA, 19 nt, Homo sapiens
gauacaaccacucuauauu

SEQ ID NO: 735812 - RNA, 19 nt, Homo sapiens
ggauacaaccacucuauau

SEQ ID NO: 735813 - RNA, 19 nt, Homo sapiens
caaauaaagcugcacucua

SEQ ID NO: 735814 - RNA, 19 nt, Homo sapiens
gcagugaacacaugccaaa

SEQ ID NO: 735815 - RNA, 19 nt, Homo sapiens
ggaaggaggugguggaaca

SEQ ID NO: 735816 - RNA, 19 nt, Homo sapiens
gaacaagggcugcugaaga

SEQ ID NO: 735817 - RNA, 19 nt, Homo sapiens
gaagaaagcccaggauuca

SEQ ID NO: 735818 - RNA, 19 nt, Homo sapiens
cggagaagcugcuggagua

SEQ ID NO: 735819 - RNA, 19 nt, Homo sapiens
auauuuggcuucucucuua

SEQ ID NO: 735820 - RNA, 19 nt, Homo sapiens
gaauauauuuggcuucucu

SEQ ID NO: 735821 - RNA, 19 nt, Homo sapiens
uagcaaaggucaccgagaa

SEQ ID NO: 735822 - RNA, 19 nt, Homo sapiens
gcaagaaacgcaagucaga

SEQ ID NO: 735823 - RNA, 19 nt, Homo sapiens
gaggugaggucgugcuuug

SEQ ID NO: 735824 - RNA, 19 nt, Homo sapiens
agaacaagcugcagaagga

SEQ ID NO: 735825 - RNA, 19 nt, Homo sapiens
gaugaaauaugcccugaag

SEQ ID NO: 735826 - RNA, 19 nt, Homo sapiens
aaagccgacuugaauauaa

SEQ ID NO: 735827 - RNA, 19 nt, Homo sapiens
gaccugcucucuuugcaaa

SEQ ID NO: 735828 - RNA, 19 nt, Homo sapiens
ggaaggaagaggaggcuaa

SEQ ID NO: 735829 - RNA, 19 nt, Homo sapiens
ucgcagaccuccuguugaa

SEQ ID NO: 735830 - RNA, 19 nt, Homo sapiens
ggaaggcccugguggacau

SEQ ID NO: 735831 - RNA, 19 nt, Homo sapiens
gagacgugauccgccauua

SEQ ID NO: 735832 - RNA, 19 nt, Homo sapiens
gaagcacagucgcgaguuc

SEQ ID NO: 735833 - RNA, 19 nt, Homo sapiens
cgaccgcuauggccuauug

SEQ ID NO: 735834 - RNA, 19 nt, Homo sapiens
caacagaagcucagagagu

SEQ ID NO: 735835 - RNA, 19 nt, Homo sapiens
ccagugaggaugagaauga

SEQ ID NO: 735836 - RNA, 19 nt, Homo sapiens
gaggaaauggaucaucuuu

SEQ ID NO: 735837 - RNA, 19 nt, Homo sapiens
caaagccgacuugaauaua

SEQ ID NO: 735838 - RNA, 19 nt, Homo sapiens
gguccgagaugaaauaugc

SEQ ID NO: 735839 - RNA, 19 nt, Homo sapiens
gcaccaacaaccagaagaa

SEQ ID NO: 735840 - RNA, 19 nt, Homo sapiens
gaaggaagaggaggcuaaa

SEQ ID NO: 735841 - RNA, 19 nt, Homo sapiens
ggaacaggacaaaggcuaa

SEQ ID NO: 735842 - RNA, 19 nt, Homo sapiens
cgacagcacugagcuccuu

SEQ ID NO: 735843 - RNA, 19 nt, Homo sapiens
gaagaaggcaaugcugaga

SEQ ID NO: 735844 - RNA, 19 nt, Homo sapiens
ggaaaagucugggagagaa

SEQ ID NO: 735845 - RNA, 19 nt, Homo sapiens
aacaagggcugcugaagau

SEQ ID NO: 735846 - RNA, 19 nt, Homo sapiens
gagccucgccagccucuuu

SEQ ID NO: 735847 - RNA, 19 nt, Homo sapiens
caaagcacccguucuccuu

SEQ ID NO: 735848 - RNA, 19 nt, Homo sapiens
ccccagagauggacgauua

SEQ ID NO: 735849 - RNA, 19 nt, Homo sapiens
gcuauggccuauugaagca

SEQ ID NO: 735850 - RNA, 19 nt, Homo sapiens
ccucacaguucccauguuc

SEQ ID NO: 735851 - RNA, 19 nt, Homo sapiens
gcagaccuccuguugaauc

SEQ ID NO: 735852 - RNA, 19 nt, Homo sapiens
gugaaccuauucucagaug

SEQ ID NO: 735853 - RNA, 19 nt, Homo sapiens
gcucaaggaagacaaguuc

SEQ ID NO: 735854 - RNA, 19 nt, Homo sapiens
ccaccgcccucuaccacuu

SEQ ID NO: 735855 - RNA, 19 nt, Homo sapiens
gacaacagaagcucagaga

SEQ ID NO: 735856 - RNA, 19 nt, Homo sapiens
gcauccaccuccucaaguc

SEQ ID NO: 735857 - RNA, 19 nt, Homo sapiens
ucacaaagaagcccacauc

SEQ ID NO: 735858 - RNA, 19 nt, Homo sapiens
gcacugcuaagcucccaaa

SEQ ID NO: 735859 - RNA, 19 nt, Homo sapiens
cgacuugaauauaauacuc

SEQ ID NO: 735860 - RNA, 19 nt, Homo sapiens
ccagaucccugagacaaag

SEQ ID NO: 735861 - RNA, 19 nt, Homo sapiens
ucccaaagcaguucaaguu

SEQ ID NO: 735862 - RNA, 19 nt, Homo sapiens
caggucggcuggugaagga

SEQ ID NO: 735863 - RNA, 19 nt, Homo sapiens
aagcacagccugagccauu

SEQ ID NO: 735864 - RNA, 19 nt, Homo sapiens
ggaaggugaggacaacaga

SEQ ID NO: 735865 - RNA, 19 nt, Homo sapiens
ugacggacgauucugauga

SEQ ID NO: 735866 - RNA, 19 nt, Homo sapiens
gagcguguuuggccacauc

SEQ ID NO: 735867 - RNA, 19 nt, Homo sapiens
gcagugccuucuucagucu

SEQ ID NO: 735868 - RNA, 19 nt, Homo sapiens
gagcaggagacgcgacuug

SEQ ID NO: 735869 - RNA, 19 nt, Homo sapiens
gcuaguggccuucucaucu

SEQ ID NO: 735870 - RNA, 19 nt, Homo sapiens
augagaagcugaccuugga

SEQ ID NO: 735871 - RNA, 19 nt, Homo sapiens
ccaagcagcccgagaaugc

SEQ ID NO: 735872 - RNA, 19 nt, Homo sapiens
cgaagaagcgcaagaaacg

SEQ ID NO: 735873 - RNA, 19 nt, Homo sapiens
cagaagaaagcccaggauu

SEQ ID NO: 735874 - RNA, 19 nt, Homo sapiens
gccuggcgcucaaggaaga

SEQ ID NO: 735875 - RNA, 19 nt, Homo sapiens
gcccugaagcgucuaauca

SEQ ID NO: 735876 - RNA, 19 nt, Homo sapiens
ugaccaagcagcccgagaa

SEQ ID NO: 735877 - RNA, 19 nt, Homo sapiens
ugucagcagugccuucuuc

SEQ ID NO: 735878 - RNA, 19 nt, Homo sapiens
agaaagcacaggugaggaa

SEQ ID NO: 735879 - RNA, 19 nt, Homo sapiens
agaagaaggaugccaagga

SEQ ID NO: 735880 - RNA, 19 nt, Homo sapiens
gcacagucgcgaguucuug

SEQ ID NO: 735881 - RNA, 19 nt, Homo sapiens
agaagcugcuggaguaucu

SEQ ID NO: 735882 - RNA, 19 nt, Homo sapiens
gagaggacagugagaacga

SEQ ID NO: 735883 - RNA, 19 nt, Homo sapiens
gaaggugaggacaacagaa

SEQ ID NO: 735884 - RNA, 19 nt, Homo sapiens
uggaucaucuuucgauugg

SEQ ID NO: 735885 - RNA, 19 nt, Homo sapiens
ccagccagcuaccuguguu

SEQ ID NO: 735886 - RNA, 19 nt, Homo sapiens
ggacuucuucugggacauu

SEQ ID NO: 735887 - RNA, 19 nt, Homo sapiens
ccccaaaacugcagaagaa

SEQ ID NO: 735888 - RNA, 19 nt, Homo sapiens
uagaggugcugguggagau

SEQ ID NO: 735889 - RNA, 19 nt, Homo sapiens
ggauucaucgcuccacaug

SEQ ID NO: 735890 - RNA, 19 nt, Homo sapiens
agaagaaagcccaggauuc

SEQ ID NO: 735891 - RNA, 19 nt, Homo sapiens
gaccaggaggcacugauga

SEQ ID NO: 735892 - RNA, 19 nt, Homo sapiens
ggaccaggaggcacugaug

SEQ ID NO: 735893 - RNA, 19 nt, Homo sapiens
auacgcaagcuguuucuaa

SEQ ID NO: 735894 - RNA, 19 nt, Homo sapiens
aggcaaggcugucuuuggu

SEQ ID NO: 735895 - RNA, 19 nt, Homo sapiens
agacacaggagaagcagaa

SEQ ID NO: 735896 - RNA, 19 nt, Homo sapiens
gcagcuaauucuggaugug

SEQ ID NO: 735897 - RNA, 19 nt, Homo sapiens
gaccuccuguugaaucaca

SEQ ID NO: 735898 - RNA, 19 nt, Homo sapiens
uggaggaggccuugacuga

SEQ ID NO: 735899 - RNA, 19 nt, Homo sapiens
gaaacgcaagucagaggau

SEQ ID NO: 735900 - RNA, 19 nt, Homo sapiens
caaaggucaccgagaacuu

SEQ ID NO: 735901 - RNA, 19 nt, Homo sapiens
gcgcuacugccacgacuug

SEQ ID NO: 735902 - RNA, 19 nt, Homo sapiens
gacggacgauucugaugag

SEQ ID NO: 735903 - RNA, 19 nt, Homo sapiens
caacgugaccaccgugaca

SEQ ID NO: 735904 - RNA, 19 nt, Homo sapiens
ccgugaaccuauucucaga

SEQ ID NO: 735905 - RNA, 19 nt, Homo sapiens
gacgaagaagcgcaagaaa

SEQ ID NO: 735906 - RNA, 19 nt, Homo sapiens
ggagugcucgcccucuuuc

SEQ ID NO: 735907 - RNA, 19 nt, Homo sapiens
cuaguggccuucucaucug

SEQ ID NO: 735908 - RNA, 19 nt, Homo sapiens
ggugggauccgugaaccua

SEQ ID NO: 735909 - RNA, 19 nt, Homo sapiens
cgaggaaggugaggacaac

SEQ ID NO: 735910 - RNA, 19 nt, Homo sapiens
ggacaagagcgaggaaggu

SEQ ID NO: 735911 - RNA, 19 nt, Homo sapiens
cagaccuccuguugaauca

SEQ ID NO: 735912 - RNA, 19 nt, Homo sapiens
cagcagugccuucuucagu

SEQ ID NO: 735913 - RNA, 19 nt, Homo sapiens
ugggauccgugaaccuauu

SEQ ID NO: 735914 - RNA, 19 nt, Homo sapiens
gaacaggacaaaggcuaag

SEQ ID NO: 735915 - RNA, 19 nt, Homo sapiens
gaagauuguuggugaauuu

SEQ ID NO: 735916 - RNA, 19 nt, Homo sapiens
gauaugaacuugaggaaga

SEQ ID NO: 735917 - RNA, 19 nt, Homo sapiens
gcagaggucuccaaacuga

SEQ ID NO: 735918 - RNA, 19 nt, Homo sapiens
ggauauaugugucgcagua

SEQ ID NO: 735919 - RNA, 19 nt, Homo sapiens
ggugagcgcuguaaucuga

SEQ ID NO: 735920 - RNA, 19 nt, Homo sapiens
uaacauuccuccuccaauu

SEQ ID NO: 735921 - RNA, 19 nt, Homo sapiens
gaaauaacagagagaauga

SEQ ID NO: 735922 - RNA, 19 nt, Homo sapiens
ggacaguguuuagauauug

SEQ ID NO: 735923 - RNA, 19 nt, Homo sapiens
gcagacgugcuacaauuua

SEQ ID NO: 735924 - RNA, 19 nt, Homo sapiens
gauacucacuguuaccauu

SEQ ID NO: 735925 - RNA, 19 nt, Homo sapiens
gaagagaggaaauaacaga

SEQ ID NO: 735926 - RNA, 19 nt, Homo sapiens
gggaguagcuaguuugcuu

SEQ ID NO: 735927 - RNA, 19 nt, Homo sapiens
ggacaaacccuguguaucg

SEQ ID NO: 735928 - RNA, 19 nt, Homo sapiens
gagaagagaggaaauaaca

SEQ ID NO: 735929 - RNA, 19 nt, Homo sapiens
cgaaaggccuucagacaca

SEQ ID NO: 735930 - RNA, 19 nt, Homo sapiens
ggaaauaacagagagaaug

SEQ ID NO: 735931 - RNA, 19 nt, Homo sapiens
ucaggacaguguuuagaua

SEQ ID NO: 735932 - RNA, 19 nt, Homo sapiens
acacagacguuaggcauuu

SEQ ID NO: 735933 - RNA, 19 nt, Homo sapiens
gaaugagggcagagaauuu

SEQ ID NO: 735934 - RNA, 19 nt, Homo sapiens
gaucaaaucugggaaugag

SEQ ID NO: 735935 - RNA, 19 nt, Homo sapiens
gccaagacaucaacgaaug

SEQ ID NO: 735936 - RNA, 19 nt, Homo sapiens
gaauguuccuggauccuau

SEQ ID NO: 735937 - RNA, 19 nt, Homo sapiens
agaaggcuauguaaacaaa

SEQ ID NO: 735938 - RNA, 19 nt, Homo sapiens
ggacgagugugcaacagau

SEQ ID NO: 735939 - RNA, 19 nt, Homo sapiens
cagcuggacuuggaaauga

SEQ ID NO: 735940 - RNA, 19 nt, Homo sapiens
gaagauggcguucauugca

SEQ ID NO: 735941 - RNA, 19 nt, Homo sapiens
gaaaugaucacugucaaca

SEQ ID NO: 735942 - RNA, 19 nt, Homo sapiens
acacagagaaggcuaugua

SEQ ID NO: 735943 - RNA, 19 nt, Homo sapiens
ggaaugagggcagagaauu

SEQ ID NO: 735944 - RNA, 19 nt, Homo sapiens
gaccagcccuuuaccaucu

SEQ ID NO: 735945 - RNA, 19 nt, Homo sapiens
guauaacgguuuaauucug

SEQ ID NO: 735946 - RNA, 19 nt, Homo sapiens
gaaaauagauuagguuugc

SEQ ID NO: 735947 - RNA, 19 nt, Homo sapiens
gauaccagauggaugaaag

SEQ ID NO: 735948 - RNA, 19 nt, Homo sapiens
uuucaaggccuucaguuua

SEQ ID NO: 735949 - RNA, 19 nt, Homo sapiens
acucucaccuguacuauug

SEQ ID NO: 735950 - RNA, 19 nt, Homo sapiens
acucucagcuccaaacuau

SEQ ID NO: 735951 - RNA, 19 nt, Homo sapiens
gagugcagcuucucugagu

SEQ ID NO: 735952 - RNA, 19 nt, Homo sapiens
gaaggccagugcuuagaca

SEQ ID NO: 735953 - RNA, 19 nt, Homo sapiens
ggccagugcuuagacauug

SEQ ID NO: 735954 - RNA, 19 nt, Homo sapiens
gaugaaagcaaccaaugug

SEQ ID NO: 735955 - RNA, 19 nt, Homo sapiens
ucaguuguccuuaaauuug

SEQ ID NO: 735956 - RNA, 19 nt, Homo sapiens
ccucuuauaugccgcuuug

SEQ ID NO: 735957 - RNA, 19 nt, Homo sapiens
gacaguguuuagauauuga

SEQ ID NO: 735958 - RNA, 19 nt, Homo sapiens
ggacaugccaggaauaaaa

SEQ ID NO: 735959 - RNA, 19 nt, Homo sapiens
gcagagaccagcccuuuac

SEQ ID NO: 735960 - RNA, 19 nt, Homo sapiens
ugaggagucuagccaguug

SEQ ID NO: 735961 - RNA, 19 nt, Homo sapiens
gugcaaaccugcgucaaca

SEQ ID NO: 735962 - RNA, 19 nt, Homo sapiens
caugauguguguuaaccaa

SEQ ID NO: 735963 - RNA, 19 nt, Homo sapiens
aaaccugcgucaacaccua

SEQ ID NO: 735964 - RNA, 19 nt, Homo sapiens
cagcagcucugugcgaaug

SEQ ID NO: 735965 - RNA, 19 nt, Homo sapiens
aaaaggauacucacuguua

SEQ ID NO: 735966 - RNA, 19 nt, Homo sapiens
gaaugcagaggucuccaaa

SEQ ID NO: 735967 - RNA, 19 nt, Homo sapiens
ucaacacugucaucaacuu

SEQ ID NO: 735968 - RNA, 19 nt, Homo sapiens
agagaaggcuauguaaaca

SEQ ID NO: 735969 - RNA, 19 nt, Homo sapiens
ggcguucauugcagugaua

SEQ ID NO: 735970 - RNA, 19 nt, Homo sapiens
caaccaauguguggaugug

SEQ ID NO: 735971 - RNA, 19 nt, Homo sapiens
gacaaacccuguguaucga

SEQ ID NO: 735972 - RNA, 19 nt, Homo sapiens
gaaguuucaguuguccuua

SEQ ID NO: 735973 - RNA, 19 nt, Homo sapiens
aaccgaagcugccaagaca

SEQ ID NO: 735974 - RNA, 19 nt, Homo sapiens
ugaggaagauggcguucau

SEQ ID NO: 735975 - RNA, 19 nt, Homo sapiens
gaauggcuuugaccuggau

SEQ ID NO: 735976 - RNA, 19 nt, Homo sapiens
caugcuauguucugucuuc

SEQ ID NO: 735977 - RNA, 19 nt, Homo sapiens
gaguuccucugccaacaug

SEQ ID NO: 735978 - RNA, 19 nt, Homo sapiens
guuuaauucugucuuguuc

SEQ ID NO: 735979 - RNA, 19 nt, Homo sapiens
ccagcuguguccagacuga

SEQ ID NO: 735980 - RNA, 19 nt, Homo sapiens
cugagucuauguucaaaga

SEQ ID NO: 735981 - RNA, 19 nt, Homo sapiens
ggucugagucuauguucaa

SEQ ID NO: 735982 - RNA, 19 nt, Homo sapiens
caggagaagagaggaaaua

SEQ ID NO: 735983 - RNA, 19 nt, Homo sapiens
gaaugucgcuaugguuacu

SEQ ID NO: 735984 - RNA, 19 nt, Homo sapiens
ggaugaaagcaaccaaugu

SEQ ID NO: 735985 - RNA, 19 nt, Homo sapiens
gaucuccaggccucuuaua

SEQ ID NO: 735986 - RNA, 19 nt, Homo sapiens
gaaaggccuucagacacau

SEQ ID NO: 735987 - RNA, 19 nt, Homo sapiens
ggacaggagaagagaggaa

SEQ ID NO: 735988 - RNA, 19 nt, Homo sapiens
uauguucugucuucccaaa

SEQ ID NO: 735989 - RNA, 19 nt, Homo sapiens
gagaaggcuauguaaacaa

SEQ ID NO: 735990 - RNA, 19 nt, Homo sapiens
cagagaaggcuauguaaac

SEQ ID NO: 735991 - RNA, 19 nt, Homo sapiens
gcaccaagggacaggagaa

SEQ ID NO: 735992 - RNA, 19 nt, Homo sapiens
gugcuuagacauugaugaa

SEQ ID NO: 735993 - RNA, 19 nt, Homo sapiens
ucaaggccuucaguuuauu

SEQ ID NO: 735994 - RNA, 19 nt, Homo sapiens
uucaaggccuucaguuuau

SEQ ID NO: 735995 - RNA, 19 nt, Homo sapiens
ggaguagcuaguuugcuuu

SEQ ID NO: 735996 - RNA, 19 nt, Homo sapiens
agaaugagagcgacacaga

SEQ ID NO: 735997 - RNA, 19 nt, Homo sapiens
gaggaaauaacagagagaa

SEQ ID NO: 735998 - RNA, 19 nt, Homo sapiens
ugucaacacugucaucaac

SEQ ID NO: 735999 - RNA, 19 nt, Homo sapiens
guuccuggauccuauucuu

SEQ ID NO: 736000 - RNA, 19 nt, Homo sapiens
gagagcgacacagacguua

SEQ ID NO: 736001 - RNA, 19 nt, Homo sapiens
guauguguccugcugagaa

SEQ ID NO: 736002 - RNA, 19 nt, Homo sapiens
gcagcucugugcgaauguu

SEQ ID NO: 736003 - RNA, 19 nt, Homo sapiens
caaacuaucccacgaucuc

SEQ ID NO: 736004 - RNA, 19 nt, Homo sapiens
ggaaugcagaggucuccaa

SEQ ID NO: 736005 - RNA, 19 nt, Homo sapiens
gaagagggcuaagcaaaac

SEQ ID NO: 736006 - RNA, 19 nt, Homo sapiens
cgacugcggauauaugugu

SEQ ID NO: 736007 - RNA, 19 nt, Homo sapiens
gcugugacccaggauauga

SEQ ID NO: 736008 - RNA, 19 nt, Homo sapiens
uggcggguauuuaugcauu

SEQ ID NO: 736009 - RNA, 19 nt, Homo sapiens
caaggccuucaguuuauuu

SEQ ID NO: 736010 - RNA, 19 nt, Homo sapiens
agugauaaccgcuguaugu

SEQ ID NO: 736011 - RNA, 19 nt, Homo sapiens
gacccaggauaugaacuug

SEQ ID NO: 736012 - RNA, 19 nt, Homo sapiens
caacaccuacggcucuuuc

SEQ ID NO: 736013 - RNA, 19 nt, Homo sapiens
gaugaaugucgcuaugguu

SEQ ID NO: 736014 - RNA, 19 nt, Homo sapiens
caguuguccuuaaauuugu

SEQ ID NO: 736015 - RNA, 19 nt, Homo sapiens
gcacugaucuggcugaauu

SEQ ID NO: 736016 - RNA, 19 nt, Homo sapiens
ugaaaugccuguucuuuga

SEQ ID NO: 736017 - RNA, 19 nt, Homo sapiens
ggaagugccugaagacguu

SEQ ID NO: 736018 - RNA, 19 nt, Homo sapiens
gcucguaucuggaggaaga

SEQ ID NO: 736019 - RNA, 19 nt, Homo sapiens
ggaagagauugccagguaa

SEQ ID NO: 736020 - RNA, 19 nt, Homo sapiens
acucuaagcugaaccauga

SEQ ID NO: 736021 - RNA, 19 nt, Homo sapiens
ccucccaacuaacuaauua

SEQ ID NO: 736022 - RNA, 19 nt, Homo sapiens
aaucggcacugacaaagua

SEQ ID NO: 736023 - RNA, 19 nt, Homo sapiens
gaagacguuuagacacaaa

SEQ ID NO: 736024 - RNA, 19 nt, Homo sapiens
aggaagagauugccaggua

SEQ ID NO: 736025 - RNA, 19 nt, Homo sapiens
gaauuaacgugggauggaa

SEQ ID NO: 736026 - RNA, 19 nt, Homo sapiens
guacaaauaauccaccuau

SEQ ID NO: 736027 - RNA, 19 nt, Homo sapiens
gaagagauugccagguaaa

SEQ ID NO: 736028 - RNA, 19 nt, Homo sapiens
gggauggaauggaaucgaa

SEQ ID NO: 736029 - RNA, 19 nt, Homo sapiens
gcagagaacgugggaguga

SEQ ID NO: 736030 - RNA, 19 nt, Homo sapiens
caggaacucucacauucuu

SEQ ID NO: 736031 - RNA, 19 nt, Homo sapiens
gugcuguccuucuuuauuc

SEQ ID NO: 736032 - RNA, 19 nt, Homo sapiens
gcauggacuuguguaagaa

SEQ ID NO: 736033 - RNA, 19 nt, Homo sapiens
caucagcgccugugcaaau

SEQ ID NO: 736034 - RNA, 19 nt, Homo sapiens
ccugugcuguccuucuuua

SEQ ID NO: 736035 - RNA, 19 nt, Homo sapiens
ggaacuguaugaaggugau

SEQ ID NO: 736036 - RNA, 19 nt, Homo sapiens
ggcaagauccgaauuuaca

SEQ ID NO: 736037 - RNA, 19 nt, Homo sapiens
ggaaucgaaccaagugcua

SEQ ID NO: 736038 - RNA, 19 nt, Homo sapiens
ggaugaaacaaacuuacaa

SEQ ID NO: 736039 - RNA, 19 nt, Homo sapiens
gcacugacaaaguacaaau

SEQ ID NO: 736040 - RNA, 19 nt, Homo sapiens
cacaacaaguggcaaagga

SEQ ID NO: 736041 - RNA, 19 nt, Homo sapiens
ccacagcuccgacccaugu

SEQ ID NO: 736042 - RNA, 19 nt, Homo sapiens
gugaucaucuccaacucaa

SEQ ID NO: 736043 - RNA, 19 nt, Homo sapiens
gugaaaugccuguucuuug

SEQ ID NO: 736044 - RNA, 19 nt, Homo sapiens
ugcauggacuuguguaaga

SEQ ID NO: 736045 - RNA, 19 nt, Homo sapiens
ucacuugcauggacuugug

SEQ ID NO: 736046 - RNA, 19 nt, Homo sapiens
agaauauguuugugggaaa

SEQ ID NO: 736047 - RNA, 19 nt, Homo sapiens
ccaguggcaucuccucuca

SEQ ID NO: 736048 - RNA, 19 nt, Homo sapiens
caaauaauccaccuaucca

SEQ ID NO: 736049 - RNA, 19 nt, Homo sapiens
cugaagacguuuagacaca

SEQ ID NO: 736050 - RNA, 19 nt, Homo sapiens
caaaggacacagcuagcaa

SEQ ID NO: 736051 - RNA, 19 nt, Homo sapiens
gcaagauccgaauuuacaa

SEQ ID NO: 736052 - RNA, 19 nt, Homo sapiens
uggcugaauuccuggauau

SEQ ID NO: 736053 - RNA, 19 nt, Homo sapiens
gaccgagugugcucaugug

SEQ ID NO: 736054 - RNA, 19 nt, Homo sapiens
ugacgugucccuucucuuc

SEQ ID NO: 736055 - RNA, 19 nt, Homo sapiens
cucaggaacucucacauuc

SEQ ID NO: 736056 - RNA, 19 nt, Homo sapiens
gcaaaggacacagcuagca

SEQ ID NO: 736057 - RNA, 19 nt, Homo sapiens
gaacgugggagugaucauc

SEQ ID NO: 736058 - RNA, 19 nt, Homo sapiens
guguguagcagcagguaua

SEQ ID NO: 736059 - RNA, 19 nt, Homo sapiens
gaauggaaucgaaccaagu

SEQ ID NO: 736060 - RNA, 19 nt, Homo sapiens
gaucaucuccaacucaacu

SEQ ID NO: 736061 - RNA, 19 nt, Homo sapiens
ugaagacguuuagacacaa

SEQ ID NO: 736062 - RNA, 19 nt, Homo sapiens
ucugcugccucccaacuaa

SEQ ID NO: 736063 - RNA, 19 nt, Homo sapiens
cgacccauguguuggcaau

SEQ ID NO: 736064 - RNA, 19 nt, Homo sapiens
ccucaggaacucucacauu

SEQ ID NO: 736065 - RNA, 19 nt, Homo sapiens
gaauuucagucugccacau

SEQ ID NO: 736066 - RNA, 19 nt, Homo sapiens
gaauauguuugugggaaaa

SEQ ID NO: 736067 - RNA, 19 nt, Homo sapiens
gcuagcaacgggcuggaaa

SEQ ID NO: 736068 - RNA, 19 nt, Homo sapiens
guacgagcgcugccugaug

SEQ ID NO: 736069 - RNA, 19 nt, Homo sapiens
uguaagaacaggcucguau

SEQ ID NO: 736070 - RNA, 19 nt, Homo sapiens
gggaugaaacaaacuuaca

SEQ ID NO: 736071 - RNA, 19 nt, Homo sapiens
auaauccaccuauccagua

SEQ ID NO: 736072 - RNA, 19 nt, Homo sapiens
uggaacagcacaacaagug

SEQ ID NO: 736073 - RNA, 19 nt, Homo sapiens
caagauccgaauuuacaau

SEQ ID NO: 736074 - RNA, 19 nt, Homo sapiens
cgugaaaugccuguucuuu

SEQ ID NO: 736075 - RNA, 19 nt, Homo sapiens
uaauccaccuauccaguag

SEQ ID NO: 736076 - RNA, 19 nt, Homo sapiens
gcgauccugugcuguccuu

SEQ ID NO: 736077 - RNA, 19 nt, Homo sapiens
gaacuguaugaaggugaua

SEQ ID NO: 736078 - RNA, 19 nt, Homo sapiens
auggcaagauccgaauuua

SEQ ID NO: 736079 - RNA, 19 nt, Homo sapiens
caaauggcaagauccgaau

SEQ ID NO: 736080 - RNA, 19 nt, Homo sapiens
aguaugggauguagacaca

SEQ ID NO: 736081 - RNA, 19 nt, Homo sapiens
guaagaacaggcucguauc

SEQ ID NO: 736082 - RNA, 19 nt, Homo sapiens
uaaaaucggcacugacaaa

SEQ ID NO: 736083 - RNA, 19 nt, Homo sapiens
cagcacaacaaguggcaaa

SEQ ID NO: 736084 - RNA, 19 nt, Homo sapiens
aauggcaacuccuggaaca

SEQ ID NO: 736085 - RNA, 19 nt, Homo sapiens
cuacgcaguaugauccuuu

SEQ ID NO: 736086 - RNA, 19 nt, Homo sapiens
gccauggcccaguugguaa

SEQ ID NO: 736087 - RNA, 19 nt, Homo sapiens
guaaaaguaugggauguag

SEQ ID NO: 736088 - RNA, 19 nt, Homo sapiens
uaagaacaggcucguaucu

SEQ ID NO: 736089 - RNA, 19 nt, Homo sapiens
gcagcagguauacaggaaa

SEQ ID NO: 736090 - RNA, 19 nt, Homo sapiens
uggcaaugcugauccuuuu

SEQ ID NO: 736091 - RNA, 19 nt, Homo sapiens
ggaacucucacauucuuuu

SEQ ID NO: 736092 - RNA, 19 nt, Homo sapiens
cgagggagccgugaaaugc

SEQ ID NO: 736093 - RNA, 19 nt, Homo sapiens
gcugaaccaugagaaucug

SEQ ID NO: 736094 - RNA, 19 nt, Homo sapiens
gcacaacaaguggcaaagg

SEQ ID NO: 736095 - RNA, 19 nt, Homo sapiens
aacgugggauggaauggaa

SEQ ID NO: 736096 - RNA, 19 nt, Homo sapiens
ggccugauuccugcagaua

SEQ ID NO: 736097 - RNA, 19 nt, Homo sapiens
cuucaagcaucccaaagag

SEQ ID NO: 736098 - RNA, 19 nt, Homo sapiens
agcgagggcuggugaaagu

SEQ ID NO: 736099 - RNA, 19 nt, Homo sapiens
cagcagguauacaggaaaa

SEQ ID NO: 736100 - RNA, 19 nt, Homo sapiens
gcacugauggccuggucau

SEQ ID NO: 736101 - RNA, 19 nt, Homo sapiens
gggcuccugugaguggauu

SEQ ID NO: 736102 - RNA, 19 nt, Homo sapiens
gcacauuugcuaaaagaau

SEQ ID NO: 736103 - RNA, 19 nt, Homo sapiens
ggcaacagaauuucagucu

SEQ ID NO: 736104 - RNA, 19 nt, Homo sapiens
gccgugaaaugccuguucu

SEQ ID NO: 736105 - RNA, 19 nt, Homo sapiens
uaagcugaaccaugagaau

SEQ ID NO: 736106 - RNA, 19 nt, Homo sapiens
cacugacaaaguacaaaua

SEQ ID NO: 736107 - RNA, 19 nt, Homo sapiens
cagagaacgugggagugau

SEQ ID NO: 736108 - RNA, 19 nt, Homo sapiens
aauggcaagauccgaauuu

SEQ ID NO: 736109 - RNA, 19 nt, Homo sapiens
gaaaugccuguucuuugac

SEQ ID NO: 736110 - RNA, 19 nt, Homo sapiens
acauugccauggcccaguu

SEQ ID NO: 736111 - RNA, 19 nt, Homo sapiens
ugccauggcccaguuggua

SEQ ID NO: 736112 - RNA, 19 nt, Homo sapiens
cuggcugaauuccuggaua

SEQ ID NO: 736113 - RNA, 19 nt, Homo sapiens
acaaauaauccaccuaucc

SEQ ID NO: 736114 - RNA, 19 nt, Homo sapiens
uacaaauaauccaccuauc

SEQ ID NO: 736115 - RNA, 19 nt, Homo sapiens
gaaauucucucuaagugua

SEQ ID NO: 736116 - RNA, 19 nt, Homo sapiens
ugaaaugccuguucuuuga

SEQ ID NO: 736117 - RNA, 19 nt, Homo sapiens
ggaagugccugaagacguu

SEQ ID NO: 736118 - RNA, 19 nt, Homo sapiens
gaacgaagaaugaguacaa

SEQ ID NO: 736119 - RNA, 19 nt, Homo sapiens
gaacagaagaugaaagaga

SEQ ID NO: 736120 - RNA, 19 nt, Homo sapiens
gcucguaucuggaggaaga

SEQ ID NO: 736121 - RNA, 19 nt, Homo sapiens
cagaggagguuucuaguug

SEQ ID NO: 736122 - RNA, 19 nt, Homo sapiens
ggaauucacuccgguguau

SEQ ID NO: 736123 - RNA, 19 nt, Homo sapiens
ggaagagauugccagguaa

SEQ ID NO: 736124 - RNA, 19 nt, Homo sapiens
gaauuugccuaucccugua

SEQ ID NO: 736125 - RNA, 19 nt, Homo sapiens
gagagucuguauccaguaa

SEQ ID NO: 736126 - RNA, 19 nt, Homo sapiens
gcacacaucccuuccuuug

SEQ ID NO: 736127 - RNA, 19 nt, Homo sapiens
gagcaauccuccuauagau

SEQ ID NO: 736128 - RNA, 19 nt, Homo sapiens
gaggaaccauggaggaauu

SEQ ID NO: 736129 - RNA, 19 nt, Homo sapiens
gcgcacggcuucauucaga

SEQ ID NO: 736130 - RNA, 19 nt, Homo sapiens
aagccaagaugaaggaaua

SEQ ID NO: 736131 - RNA, 19 nt, Homo sapiens
caagugaccaguucaauug

SEQ ID NO: 736132 - RNA, 19 nt, Homo sapiens
gggaagagcaugcguguga

SEQ ID NO: 736133 - RNA, 19 nt, Homo sapiens
ggagacguuuguaauagaa

SEQ ID NO: 736134 - RNA, 19 nt, Homo sapiens
cagguucucuggcagcuua

SEQ ID NO: 736135 - RNA, 19 nt, Homo sapiens
ucauggaaauucucucuaa

SEQ ID NO: 736136 - RNA, 19 nt, Homo sapiens
gaagacguuuagacacaaa

SEQ ID NO: 736137 - RNA, 19 nt, Homo sapiens
aggaagagauugccaggua

SEQ ID NO: 736138 - RNA, 19 nt, Homo sapiens
uaagaaugcuggauagaca

SEQ ID NO: 736139 - RNA, 19 nt, Homo sapiens
gaauuauacucucuuacug

SEQ ID NO: 736140 - RNA, 19 nt, Homo sapiens
auacagcccuugauccuuu

SEQ ID NO: 736141 - RNA, 19 nt, Homo sapiens
guugaucgguugagauuga

SEQ ID NO: 736142 - RNA, 19 nt, Homo sapiens
gaagagaugcagaugaugu

SEQ ID NO: 736143 - RNA, 19 nt, Homo sapiens
gagcaauguucucauguuc

SEQ ID NO: 736144 - RNA, 19 nt, Homo sapiens
gaaccagauuaccuucuug

SEQ ID NO: 736145 - RNA, 19 nt, Homo sapiens
ucucagggcucaaucaaga

SEQ ID NO: 736146 - RNA, 19 nt, Homo sapiens
gagauaggcuuuccaucca

SEQ ID NO: 736147 - RNA, 19 nt, Homo sapiens
ugauagcugugucaucuaa

SEQ ID NO: 736148 - RNA, 19 nt, Homo sapiens
gaacggccucgcaucuaua

SEQ ID NO: 736149 - RNA, 19 nt, Homo sapiens
gaugugaaacgaaccagua

SEQ ID NO: 736150 - RNA, 19 nt, Homo sapiens
gaaaauagucucauggaaa

SEQ ID NO: 736151 - RNA, 19 nt, Homo sapiens
uaaacaaacugugauccaa

SEQ ID NO: 736152 - RNA, 19 nt, Homo sapiens
ugaaagcgauacccguuga

SEQ ID NO: 736153 - RNA, 19 nt, Homo sapiens
ggaccaaggcgaauuauac

SEQ ID NO: 736154 - RNA, 19 nt, Homo sapiens
ggaucaaccucagcaagaa

SEQ ID NO: 736155 - RNA, 19 nt, Homo sapiens
caggaucaaugacauauca

SEQ ID NO: 736156 - RNA, 19 nt, Homo sapiens
gaagagauugccagguaaa

SEQ ID NO: 736157 - RNA, 19 nt, Homo sapiens
gggagacguuuguaauaga

SEQ ID NO: 736158 - RNA, 19 nt, Homo sapiens
caugcuagcuccacaagug

SEQ ID NO: 736159 - RNA, 19 nt, Homo sapiens
caauuccuccugacuguua

SEQ ID NO: 736160 - RNA, 19 nt, Homo sapiens
ggacaucauacaagugaaa

SEQ ID NO: 736161 - RNA, 19 nt, Homo sapiens
ugagagaggagaacaauau

SEQ ID NO: 736162 - RNA, 19 nt, Homo sapiens
uauaacaggucccggauca

SEQ ID NO: 736163 - RNA, 19 nt, Homo sapiens
ccgaagagaugcagaugau

SEQ ID NO: 736164 - RNA, 19 nt, Homo sapiens
gcacauaaaguggcaguau

SEQ ID NO: 736165 - RNA, 19 nt, Homo sapiens
gauccuaauuaugccaaua

SEQ ID NO: 736166 - RNA, 19 nt, Homo sapiens
aaucaaggcucaagaaugc

SEQ ID NO: 736167 - RNA, 19 nt, Homo sapiens
gaaucaaggcucaagaaug

SEQ ID NO: 736168 - RNA, 19 nt, Homo sapiens
aaaccagccuugggaaauu

SEQ ID NO: 736169 - RNA, 19 nt, Homo sapiens
gcaauccuccuauagaugu

SEQ ID NO: 736170 - RNA, 19 nt, Homo sapiens
ugaaacauccgaaguggaa

SEQ ID NO: 736171 - RNA, 19 nt, Homo sapiens
ccauccaccucuccaagua

SEQ ID NO: 736172 - RNA, 19 nt, Homo sapiens
cagccacccugucucuuaa

SEQ ID NO: 736173 - RNA, 19 nt, Homo sapiens
gaaagggcugugugcagua

SEQ ID NO: 736174 - RNA, 19 nt, Homo sapiens
gcaauguucucauguucca

SEQ ID NO: 736175 - RNA, 19 nt, Homo sapiens
ggcgaauuauacucucuua

SEQ ID NO: 736176 - RNA, 19 nt, Homo sapiens
gcauggacuuguguaagaa

SEQ ID NO: 736177 - RNA, 19 nt, Homo sapiens
gaagagcaugcgugugaaa

SEQ ID NO: 736178 - RNA, 19 nt, Homo sapiens
aaacaaggacaauuggaaa

SEQ ID NO: 736179 - RNA, 19 nt, Homo sapiens
gacacacccugaacaagug

SEQ ID NO: 736180 - RNA, 19 nt, Homo sapiens
ccacacagggaaaggauuu

SEQ ID NO: 736181 - RNA, 19 nt, Homo sapiens
ggagaaggagcaccaggaa

SEQ ID NO: 736182 - RNA, 19 nt, Homo sapiens
gagaccaagugaccaguuc

SEQ ID NO: 736183 - RNA, 19 nt, Homo sapiens
ggaagagcaugcgugugaa

SEQ ID NO: 736184 - RNA, 19 nt, Homo sapiens
gcaaauaccgagacuucau

SEQ ID NO: 736185 - RNA, 19 nt, Homo sapiens
acacaucccuuccuuuguc

SEQ ID NO: 736186 - RNA, 19 nt, Homo sapiens
cacccugucucuuaagaaa

SEQ ID NO: 736187 - RNA, 19 nt, Homo sapiens
ccaagugaccaguucaauu

SEQ ID NO: 736188 - RNA, 19 nt, Homo sapiens
ugagaacgaagaaugagua

SEQ ID NO: 736189 - RNA, 19 nt, Homo sapiens
acacugaguucgugcuguu

SEQ ID NO: 736190 - RNA, 19 nt, Homo sapiens
gaaacugcagcccaacuug

SEQ ID NO: 736191 - RNA, 19 nt, Homo sapiens
uacgaucccugcaaucuau

SEQ ID NO: 736192 - RNA, 19 nt, Homo sapiens
gcucacugcugccaaugug

SEQ ID NO: 736193 - RNA, 19 nt, Homo sapiens
guucucauguuccaguuug

SEQ ID NO: 736194 - RNA, 19 nt, Homo sapiens
cagcaaauaccgagacuuc

SEQ ID NO: 736195 - RNA, 19 nt, Homo sapiens
guugugaaguccuccuuga

SEQ ID NO: 736196 - RNA, 19 nt, Homo sapiens
ucacagaggagguuucuag

SEQ ID NO: 736197 - RNA, 19 nt, Homo sapiens
agaacggccucgcaucuau

SEQ ID NO: 736198 - RNA, 19 nt, Homo sapiens
ccaguaugcaggucauuaa

SEQ ID NO: 736199 - RNA, 19 nt, Homo sapiens
guuaauagaggaacuucaa

SEQ ID NO: 736200 - RNA, 19 nt, Homo sapiens
uggaaauucucucuaagug

SEQ ID NO: 736201 - RNA, 19 nt, Homo sapiens
gagcaugcgugugaaacau

SEQ ID NO: 736202 - RNA, 19 nt, Homo sapiens
uaagguuucuaucccaguu

SEQ ID NO: 736203 - RNA, 19 nt, Homo sapiens
cagcacacaucccuuccuu

SEQ ID NO: 736204 - RNA, 19 nt, Homo sapiens
uagaacagaagaugaaaga

SEQ ID NO: 736205 - RNA, 19 nt, Homo sapiens
guacgaucccugcaaucua

SEQ ID NO: 736206 - RNA, 19 nt, Homo sapiens
ggaaucaaggcucaagaau

SEQ ID NO: 736207 - RNA, 19 nt, Homo sapiens
ggaaauucucucuaagugu

SEQ ID NO: 736208 - RNA, 19 nt, Homo sapiens
gugaaaugccuguucuuug

SEQ ID NO: 736209 - RNA, 19 nt, Homo sapiens
ugcauggacuuguguaaga

SEQ ID NO: 736210 - RNA, 19 nt, Homo sapiens
ucacuugcauggacuugug

SEQ ID NO: 736211 - RNA, 19 nt, Homo sapiens
aaccagccuugggaaauua

SEQ ID NO: 736212 - RNA, 19 nt, Homo sapiens
gaacuuggacaaaauguau

SEQ ID NO: 736213 - RNA, 19 nt, Homo sapiens
cuucagcaguguuaauaga

SEQ ID NO: 736214 - RNA, 19 nt, Homo sapiens
agaagaauaaggagaaaga

SEQ ID NO: 736215 - RNA, 19 nt, Homo sapiens
gagaaucccuucaaagaaa

SEQ ID NO: 736216 - RNA, 19 nt, Homo sapiens
gacugcaccuucuucaaua

SEQ ID NO: 736217 - RNA, 19 nt, Homo sapiens
ggagaaucccuucaaagaa

SEQ ID NO: 736218 - RNA, 19 nt, Homo sapiens
ggacugcaccuucuucaau

SEQ ID NO: 736219 - RNA, 19 nt, Homo sapiens
ccaauggacuacaggaaga

SEQ ID NO: 736220 - RNA, 19 nt, Homo sapiens
ggucugacguguccaagug

SEQ ID NO: 736221 - RNA, 19 nt, Homo sapiens
aagagcagcuagacaacua

SEQ ID NO: 736222 - RNA, 19 nt, Homo sapiens
ggaacaagcagaccaucuu

SEQ ID NO: 736223 - RNA, 19 nt, Homo sapiens
caagaucuaugacuucaac

SEQ ID NO: 736224 - RNA, 19 nt, Homo sapiens
cccgagagcucaaggcaaa

SEQ ID NO: 736225 - RNA, 19 nt, Homo sapiens
gaacaagcagaccaucuuc

SEQ ID NO: 736226 - RNA, 19 nt, Homo sapiens
cuucaacacugacaacuuc

SEQ ID NO: 736227 - RNA, 19 nt, Homo sapiens
ccucagcacuuuccacauc

SEQ ID NO: 736228 - RNA, 19 nt, Homo sapiens
caaacuaugccuucaagau

SEQ ID NO: 736229 - RNA, 19 nt, Homo sapiens
ucuaugacuucaacacuga

SEQ ID NO: 736230 - RNA, 19 nt, Homo sapiens
gugaacuccugguaguaaa

SEQ ID NO: 736231 - RNA, 19 nt, Homo sapiens
aacgagcuaugcaaucuuu

SEQ ID NO: 736232 - RNA, 19 nt, Homo sapiens
gguuuacaccacaaauaua

SEQ ID NO: 736233 - RNA, 19 nt, Homo sapiens
ggguuuacaccacaaauau

SEQ ID NO: 736234 - RNA, 19 nt, Homo sapiens
caacgacuuuguggacaug

SEQ ID NO: 736235 - RNA, 19 nt, Homo sapiens
ugacuucgaggacaugauu

SEQ ID NO: 736236 - RNA, 19 nt, Homo sapiens
ggacacugccgaggcugua

SEQ ID NO: 736237 - RNA, 19 nt, Homo sapiens
aaacuaugccuucaagauc

SEQ ID NO: 736238 - RNA, 19 nt, Homo sapiens
ccgaagagcagcuagacaa

SEQ ID NO: 736239 - RNA, 19 nt, Homo sapiens
uuaacgagcuaugcaaucu

SEQ ID NO: 736240 - RNA, 19 nt, Homo sapiens
cgacuuuguggacauguuu

SEQ ID NO: 736241 - RNA, 19 nt, Homo sapiens
gcugggcuuugcugacuuc

SEQ ID NO: 736242 - RNA, 19 nt, Homo sapiens
caagcugcauucgcgauuc

SEQ ID NO: 736243 - RNA, 19 nt, Homo sapiens
aggaggagguggugcuugu

SEQ ID NO: 736244 - RNA, 19 nt, Homo sapiens
ccuucaagaucuaugacuu

SEQ ID NO: 736245 - RNA, 19 nt, Homo sapiens
gaagagcagcuagacaacu

SEQ ID NO: 736246 - RNA, 19 nt, Homo sapiens
gagcucaaggcaaacuaug

SEQ ID NO: 736247 - RNA, 19 nt, Homo sapiens
ugugaacuccugguaguaa

SEQ ID NO: 736248 - RNA, 19 nt, Homo sapiens
gauuugugaacuccuggua

SEQ ID NO: 736249 - RNA, 19 nt, Homo sapiens
uaccaggacugcaccuucu

SEQ ID NO: 736250 - RNA, 19 nt, Homo sapiens
caacacugacaacuucauc

SEQ ID NO: 736251 - RNA, 19 nt, Homo sapiens
gaucuaugacuucaacacu

SEQ ID NO: 736252 - RNA, 19 nt, Homo sapiens
ucaacgacuuuguggacau

SEQ ID NO: 736253 - RNA, 19 nt, Homo sapiens
gaggagguggugcuugugu

SEQ ID NO: 736254 - RNA, 19 nt, Homo sapiens
cuaagucagagcuggauga

SEQ ID NO: 736255 - RNA, 19 nt, Homo sapiens
acuaugccuucaagaucua

SEQ ID NO: 736256 - RNA, 19 nt, Homo sapiens
gcaaacuaugccuucaaga

SEQ ID NO: 736257 - RNA, 19 nt, Homo sapiens
acugcaccuucuucaauaa

SEQ ID NO: 736258 - RNA, 19 nt, Homo sapiens
guccuuuccuacuccagaa

SEQ ID NO: 736259 - RNA, 19 nt, Homo sapiens
uauauccuguggcccuuuc

SEQ ID NO: 736260 - RNA, 19 nt, Homo sapiens
ugcauucgcgauucuauga

SEQ ID NO: 736261 - RNA, 19 nt, Homo sapiens
gagagcucaaggcaaacua

SEQ ID NO: 736262 - RNA, 19 nt, Homo sapiens
ccuccaagcuccccaggaa

SEQ ID NO: 736263 - RNA, 19 nt, Homo sapiens
agaaucccuucaaagaaag

SEQ ID NO: 736264 - RNA, 19 nt, Homo sapiens
ugaagcagcucaucgacaa

SEQ ID NO: 736265 - RNA, 19 nt, Homo sapiens
gcagucgccuguccaagga

SEQ ID NO: 736266 - RNA, 19 nt, Homo sapiens
gacaucaagucccauuaug

SEQ ID NO: 736267 - RNA, 19 nt, Homo sapiens
ccucacugcuguugucauu

SEQ ID NO: 736268 - RNA, 19 nt, Homo sapiens
ccaucaaccucucugaguu

SEQ ID NO: 736269 - RNA, 19 nt, Homo sapiens
ggaggagucugacauugac

SEQ ID NO: 736270 - RNA, 19 nt, Homo sapiens
gaugaugacggaaccuuga

SEQ ID NO: 736271 - RNA, 19 nt, Homo sapiens
ccaaagacagccuuagcuu

SEQ ID NO: 736272 - RNA, 19 nt, Homo sapiens
gccagcuccuuuaagauug

SEQ ID NO: 736273 - RNA, 19 nt, Homo sapiens
ugacggaaccuugaacaga

SEQ ID NO: 736274 - RNA, 19 nt, Homo sapiens
gaaccaucaaccucucuga

SEQ ID NO: 736275 - RNA, 19 nt, Homo sapiens
ugacguuccugacgaagca

SEQ ID NO: 736276 - RNA, 19 nt, Homo sapiens
gaggacacacggcuuagug

SEQ ID NO: 736277 - RNA, 19 nt, Homo sapiens
ggcgaggacacacggcuua

SEQ ID NO: 736278 - RNA, 19 nt, Homo sapiens
gcugagcuguggccaaggu

SEQ ID NO: 736279 - RNA, 19 nt, Homo sapiens
caaggucaagccuguguug

SEQ ID NO: 736280 - RNA, 19 nt, Homo sapiens
gacuuugccagcuccuuua

SEQ ID NO: 736281 - RNA, 19 nt, Homo sapiens
ucacugcuguugucauugc

SEQ ID NO: 736282 - RNA, 19 nt, Homo sapiens
uuugccagcuccuuuaaga

SEQ ID NO: 736283 - RNA, 19 nt, Homo sapiens
agacaucaagucccauuau

SEQ ID NO: 736284 - RNA, 19 nt, Homo sapiens
ucuuugacuuugaugauga

SEQ ID NO: 736285 - RNA, 19 nt, Homo sapiens
ugccagcuccuuuaagauu

SEQ ID NO: 736286 - RNA, 19 nt, Homo sapiens
aagacagccuuagcuuuga

SEQ ID NO: 736287 - RNA, 19 nt, Homo sapiens
agacuuugccagcuccuuu

SEQ ID NO: 736288 - RNA, 19 nt, Homo sapiens
uggaggagucugacauuga

SEQ ID NO: 736289 - RNA, 19 nt, Homo sapiens
ccgcaucuuugacuuugau

SEQ ID NO: 736290 - RNA, 19 nt, Homo sapiens
gcagggucuucuccacauc

SEQ ID NO: 736291 - RNA, 19 nt, Homo sapiens
ccagacaucaagucccauu

SEQ ID NO: 736292 - RNA, 19 nt, Homo sapiens
ccagcuccuuuaagauugu

SEQ ID NO: 736293 - RNA, 19 nt, Homo sapiens
gaaccuugaacagagaaga

SEQ ID NO: 736294 - RNA, 19 nt, Homo sapiens
ccguuuguguuuguacuaa

SEQ ID NO: 736295 - RNA, 19 nt, Homo sapiens
ugucauugcuccguuugug

SEQ ID NO: 736296 - RNA, 19 nt, Homo sapiens
caucaaccucucugaguuc

SEQ ID NO: 736297 - RNA, 19 nt, Homo sapiens
aggagcugcuggccgagua

SEQ ID NO: 736298 - RNA, 19 nt, Homo sapiens
ugagccggcuggugaacug

SEQ ID NO: 736299 - RNA, 19 nt, Homo sapiens
gaugacggaaccuugaaca

SEQ ID NO: 736300 - RNA, 19 nt, Homo sapiens
guuuguguuuguacuaauc

SEQ ID NO: 736301 - RNA, 19 nt, Homo sapiens
cagacaucaagucccauua

SEQ ID NO: 736302 - RNA, 19 nt, Homo sapiens
cuuuaagauuguccuguga

SEQ ID NO: 736303 - RNA, 19 nt, Homo sapiens
cuggcacccuguccaagaa

SEQ ID NO: 736304 - RNA, 19 nt, Homo sapiens
gacauugacagggauggaa

SEQ ID NO: 736305 - RNA, 19 nt, Homo sapiens
cuuagugcgucugagauga

SEQ ID NO: 736306 - RNA, 19 nt, Homo sapiens
gcuuagugcgucugagaug

SEQ ID NO: 736307 - RNA, 19 nt, Homo sapiens
gagcuguggccaaggucaa

SEQ ID NO: 736308 - RNA, 19 nt, Homo sapiens
ggaaaggccuuaugugugu

SEQ ID NO: 736309 - RNA, 19 nt, Homo sapiens
gaagaaaggccuuaugaau

SEQ ID NO: 736310 - RNA, 19 nt, Homo sapiens
gcaaaucuguccucauuca

SEQ ID NO: 736311 - RNA, 19 nt, Homo sapiens
gaauguagcaaauccuuua

SEQ ID NO: 736312 - RNA, 19 nt, Homo sapiens
gcaaauccuuuagcuguaa

SEQ ID NO: 736313 - RNA, 19 nt, Homo sapiens
gaaaucguuuagucagaua

SEQ ID NO: 736314 - RNA, 19 nt, Homo sapiens
gaagaaaucaugaauaguc

SEQ ID NO: 736315 - RNA, 19 nt, Homo sapiens
gggaaauccuuuagccaua

SEQ ID NO: 736316 - RNA, 19 nt, Homo sapiens
gagaaaggccuuaugaaug

SEQ ID NO: 736317 - RNA, 19 nt, Homo sapiens
gagaaaggccuuaugaaug

SEQ ID NO: 736318 - RNA, 19 nt, Homo sapiens
gcagggagaucaggaaaga

SEQ ID NO: 736319 - RNA, 19 nt, Homo sapiens
acaaguaccugauuuggaa

SEQ ID NO: 736320 - RNA, 19 nt, Homo sapiens
agccauagcuccaaccuua

SEQ ID NO: 736321 - RNA, 19 nt, Homo sapiens
agaaaggccuuaugaaugu

SEQ ID NO: 736322 - RNA, 19 nt, Homo sapiens
ggagaaaggccuuaugaau

SEQ ID NO: 736323 - RNA, 19 nt, Homo sapiens
ggagaaaggccuuaugaau

SEQ ID NO: 736324 - RNA, 19 nt, Homo sapiens
gcgaagauguaaccucauu

SEQ ID NO: 736325 - RNA, 19 nt, Homo sapiens
guacugagaauaugcaauu

SEQ ID NO: 736326 - RNA, 19 nt, Homo sapiens
cugcaaaucuguccucauu

SEQ ID NO: 736327 - RNA, 19 nt, Homo sapiens
gggaaauccuuuagccaaa

SEQ ID NO: 736328 - RNA, 19 nt, Homo sapiens
ccaaaguucuagccucauu

SEQ ID NO: 736329 - RNA, 19 nt, Homo sapiens
ggagaaaggccuuaugagu

SEQ ID NO: 736330 - RNA, 19 nt, Homo sapiens
ggagaaagacccuaugagu

SEQ ID NO: 736331 - RNA, 19 nt, Homo sapiens
ggagaaagaccucaugagu

SEQ ID NO: 736332 - RNA, 19 nt, Homo sapiens
ggaaaucguuuagucagau

SEQ ID NO: 736333 - RNA, 19 nt, Homo sapiens
ccagagaguucacauugga

SEQ ID NO: 736334 - RNA, 19 nt, Homo sapiens
cuacuccaguuucauuaua

SEQ ID NO: 736335 - RNA, 19 nt, Homo sapiens
gaaaguccacagugaagaa

SEQ ID NO: 736336 - RNA, 19 nt, Homo sapiens
gaaaucaugaauagucuga

SEQ ID NO: 736337 - RNA, 19 nt, Homo sapiens
ggaagucauuuaagcaaag

SEQ ID NO: 736338 - RNA, 19 nt, Homo sapiens
gagaaaagccuuagcugua

SEQ ID NO: 736339 - RNA, 19 nt, Homo sapiens
ggaaauccuuuagccauag

SEQ ID NO: 736340 - RNA, 19 nt, Homo sapiens
gggaagucauuuaagcaaa

SEQ ID NO: 736341 - RNA, 19 nt, Homo sapiens
gaaagcauguacgcgaaga

SEQ ID NO: 736342 - RNA, 19 nt, Homo sapiens
ccacauagacacacuuguu

SEQ ID NO: 736343 - RNA, 19 nt, Homo sapiens
caaauaacaguaacaagug

SEQ ID NO: 736344 - RNA, 19 nt, Homo sapiens
ccaaauaacaguaacaagu

SEQ ID NO: 736345 - RNA, 19 nt, Homo sapiens
cuuccucucugacaaguua

SEQ ID NO: 736346 - RNA, 19 nt, Homo sapiens
gaaugugggaaauccuuua

SEQ ID NO: 736347 - RNA, 19 nt, Homo sapiens
gaaugugggaaauccuuua

SEQ ID NO: 736348 - RNA, 19 nt, Homo sapiens
agaaaggccuuaugaaugc

SEQ ID NO: 736349 - RNA, 19 nt, Homo sapiens
gaaugugggaaaucguuua

SEQ ID NO: 736350 - RNA, 19 nt, Homo sapiens
agaaaggccuuaugaaugc

SEQ ID NO: 736351 - RNA, 19 nt, Homo sapiens
gaagauguaaccucauuca

SEQ ID NO: 736352 - RNA, 19 nt, Homo sapiens
gcauguacgcgaagaugua

SEQ ID NO: 736353 - RNA, 19 nt, Homo sapiens
gaccagagaauccucacua

SEQ ID NO: 736354 - RNA, 19 nt, Homo sapiens
ggaguacaccugugagaga

SEQ ID NO: 736355 - RNA, 19 nt, Homo sapiens
gcaauuuccuuuuagugua

SEQ ID NO: 736356 - RNA, 19 nt, Homo sapiens
gggaaaucguuuagucaga

SEQ ID NO: 736357 - RNA, 19 nt, Homo sapiens
agagacaaguaccugauuu

SEQ ID NO: 736358 - RNA, 19 nt, Homo sapiens
gagaauaugcaauuuccuu

SEQ ID NO: 736359 - RNA, 19 nt, Homo sapiens
ggaaauccuuuggcugcaa

SEQ ID NO: 736360 - RNA, 19 nt, Homo sapiens
gcgaaugugggaaaucuuu

SEQ ID NO: 736361 - RNA, 19 nt, Homo sapiens
gggaaugugggaaaucuuu

SEQ ID NO: 736362 - RNA, 19 nt, Homo sapiens
gugaagaaaggccuuauga

SEQ ID NO: 736363 - RNA, 19 nt, Homo sapiens
gcuccaaccuuaagaacca

SEQ ID NO: 736364 - RNA, 19 nt, Homo sapiens
ggcagaagccguaucaugu

SEQ ID NO: 736365 - RNA, 19 nt, Homo sapiens
guucuagccucauucaaca

SEQ ID NO: 736366 - RNA, 19 nt, Homo sapiens
aagaaaggccuuaugaaug

SEQ ID NO: 736367 - RNA, 19 nt, Homo sapiens
gagaagccaaauaacagua

SEQ ID NO: 736368 - RNA, 19 nt, Homo sapiens
uaacaugccauuuagaaag

SEQ ID NO: 736369 - RNA, 19 nt, Homo sapiens
gauauacagugggcggauu

SEQ ID NO: 736370 - RNA, 19 nt, Homo sapiens
ggagaaagaccuguugagu

SEQ ID NO: 736371 - RNA, 19 nt, Homo sapiens
agccuuagcuguacugaga

SEQ ID NO: 736372 - RNA, 19 nt, Homo sapiens
agagaauccucacuagaga

SEQ ID NO: 736373 - RNA, 19 nt, Homo sapiens
cccaacaucuaaggauaua

SEQ ID NO: 736374 - RNA, 19 nt, Homo sapiens
caucaagacgccacucaaa

SEQ ID NO: 736375 - RNA, 19 nt, Homo sapiens
ugagguuucuccaucaaga

SEQ ID NO: 736376 - RNA, 19 nt, Homo sapiens
caacaucuaaggauauaca

SEQ ID NO: 736377 - RNA, 19 nt, Homo sapiens
ccaguuucauuauacauca

SEQ ID NO: 736378 - RNA, 19 nt, Homo sapiens
gagagacaaguaccugauu

SEQ ID NO: 736379 - RNA, 19 nt, Homo sapiens
caccagagaguucacauug

SEQ ID NO: 736380 - RNA, 19 nt, Homo sapiens
cuguaaaucuaaccucauu

SEQ ID NO: 736381 - RNA, 19 nt, Homo sapiens
gagaguucauacuggagaa

SEQ ID NO: 736382 - RNA, 19 nt, Homo sapiens
ugugacaccuccauggauu

SEQ ID NO: 736383 - RNA, 19 nt, Homo sapiens
gaacccaauaugaguguug

SEQ ID NO: 736384 - RNA, 19 nt, Homo sapiens
ggacuugacccagcuuugu

SEQ ID NO: 736385 - RNA, 19 nt, Homo sapiens
gagacaaguaccugauuug

SEQ ID NO: 736386 - RNA, 19 nt, Homo sapiens
gaaaggccuuaugaaugug

SEQ ID NO: 736387 - RNA, 19 nt, Homo sapiens
gaaaguucacacuggagaa

SEQ ID NO: 736388 - RNA, 19 nt, Homo sapiens
caauagccauaggaaaguu

SEQ ID NO: 736389 - RNA, 19 nt, Homo sapiens
caucagagaguucauacug

SEQ ID NO: 736390 - RNA, 19 nt, Homo sapiens
ccagagaacccaauaugag

SEQ ID NO: 736391 - RNA, 19 nt, Homo sapiens
gaagccguaucaugucuac

SEQ ID NO: 736392 - RNA, 19 nt, Homo sapiens
uuaaacaccugagaguuca

SEQ ID NO: 736393 - RNA, 19 nt, Homo sapiens
ggaaugugggaaauccuuu

SEQ ID NO: 736394 - RNA, 19 nt, Homo sapiens
cauuauacaucagagaguu

SEQ ID NO: 736395 - RNA, 19 nt, Homo sapiens
ccagaaaguccacagugaa

SEQ ID NO: 736396 - RNA, 19 nt, Homo sapiens
gcagaguucacacgggaaa

SEQ ID NO: 736397 - RNA, 19 nt, Homo sapiens
cagauauacagccucaaua

SEQ ID NO: 736398 - RNA, 19 nt, Homo sapiens
gcuagaagaaaucaugaau

SEQ ID NO: 736399 - RNA, 19 nt, Homo sapiens
uuucucaccugccauuuau

SEQ ID NO: 736400 - RNA, 19 nt, Homo sapiens
ugaaggaguacaccuguga

SEQ ID NO: 736401 - RNA, 19 nt, Homo sapiens
cuacuacuccaguuucauu

SEQ ID NO: 736402 - RNA, 19 nt, Homo sapiens
gccagagaacccaauauga

SEQ ID NO: 736403 - RNA, 19 nt, Homo sapiens
uguggacacugccucguuu

SEQ ID NO: 736404 - RNA, 19 nt, Homo sapiens
gcagaagccguaucauguc

SEQ ID NO: 736405 - RNA, 19 nt, Homo sapiens
ugaagaaaggccuuaugaa

SEQ ID NO: 736406 - RNA, 19 nt, Homo sapiens
ucaagacgccacucaaaca

SEQ ID NO: 736407 - RNA, 19 nt, Homo sapiens
cagagaauccucacuagag

SEQ ID NO: 736408 - RNA, 19 nt, Homo sapiens
ggacgaagcugacagaaug

SEQ ID NO: 736409 - RNA, 19 nt, Homo sapiens
ggaaagagguguugagauc

SEQ ID NO: 736410 - RNA, 19 nt, Homo sapiens
gaaagagauuggguacuua

SEQ ID NO: 736411 - RNA, 19 nt, Homo sapiens
ccagagagcuuaucaaagu

SEQ ID NO: 736412 - RNA, 19 nt, Homo sapiens
guacuuaccuuguauugga

SEQ ID NO: 736413 - RNA, 19 nt, Homo sapiens
gagauuggguacuuaauga

SEQ ID NO: 736414 - RNA, 19 nt, Homo sapiens
uagcaaggcugacaccaua

SEQ ID NO: 736415 - RNA, 19 nt, Homo sapiens
cuauacagcucaagaauau

SEQ ID NO: 736416 - RNA, 19 nt, Homo sapiens
cuaccaauaugauagguua

SEQ ID NO: 736417 - RNA, 19 nt, Homo sapiens
ccaaacagcucagaggauu

SEQ ID NO: 736418 - RNA, 19 nt, Homo sapiens
gaaggaaggagacgccuaa

SEQ ID NO: 736419 - RNA, 19 nt, Homo sapiens
gaagaugucaaguuuguga

SEQ ID NO: 736420 - RNA, 19 nt, Homo sapiens
gaucagcacuuuacagaac

SEQ ID NO: 736421 - RNA, 19 nt, Homo sapiens
gaaagaaggagauuacagu

SEQ ID NO: 736422 - RNA, 19 nt, Homo sapiens
caacaaggguaccgccuau

SEQ ID NO: 736423 - RNA, 19 nt, Homo sapiens
agaauucacugccagguuu

SEQ ID NO: 736424 - RNA, 19 nt, Homo sapiens
gaagaaauaauggcugaaa

SEQ ID NO: 736425 - RNA, 19 nt, Homo sapiens
ggauuuccguuggcucuua

SEQ ID NO: 736426 - RNA, 19 nt, Homo sapiens
uggcaaauguucuagauug

SEQ ID NO: 736427 - RNA, 19 nt, Homo sapiens
ggaagacguuggcguaucu

SEQ ID NO: 736428 - RNA, 19 nt, Homo sapiens
uguggaagaugucaaguuu

SEQ ID NO: 736429 - RNA, 19 nt, Homo sapiens
agaaagagauuggguacuu

SEQ ID NO: 736430 - RNA, 19 nt, Homo sapiens
gcagguggccgaugacuau

SEQ ID NO: 736431 - RNA, 19 nt, Homo sapiens
cagcagacuuaauuacauu

SEQ ID NO: 736432 - RNA, 19 nt, Homo sapiens
ucccagaucucuauccuuu

SEQ ID NO: 736433 - RNA, 19 nt, Homo sapiens
uaacuucccacaauaugua

SEQ ID NO: 736434 - RNA, 19 nt, Homo sapiens
gcuauacagcucaagaaua

SEQ ID NO: 736435 - RNA, 19 nt, Homo sapiens
gcacccauccuuauugcua

SEQ ID NO: 736436 - RNA, 19 nt, Homo sapiens
gaagaaauuugguaauccu

SEQ ID NO: 736437 - RNA, 19 nt, Homo sapiens
agacaagagucaaccagaa

SEQ ID NO: 736438 - RNA, 19 nt, Homo sapiens
guggaugucugcauggaaa

SEQ ID NO: 736439 - RNA, 19 nt, Homo sapiens
gcugacagaaugcuugaua

SEQ ID NO: 736440 - RNA, 19 nt, Homo sapiens
gaucaacuaugacuaucca

SEQ ID NO: 736441 - RNA, 19 nt, Homo sapiens
ccacaacauccuccagaua

SEQ ID NO: 736442 - RNA, 19 nt, Homo sapiens
gcagauuaguuagaauuca

SEQ ID NO: 736443 - RNA, 19 nt, Homo sapiens
ccaacuaauggaagaaaua

SEQ ID NO: 736444 - RNA, 19 nt, Homo sapiens
caaauguucuagauugaag

SEQ ID NO: 736445 - RNA, 19 nt, Homo sapiens
ggcaaauguucuagauuga

SEQ ID NO: 736446 - RNA, 19 nt, Homo sapiens
uggaagaugucaaguuugu

SEQ ID NO: 736447 - RNA, 19 nt, Homo sapiens
acaaagagacgcugugaug

SEQ ID NO: 736448 - RNA, 19 nt, Homo sapiens
ggcccaaucugucuaguuc

SEQ ID NO: 736449 - RNA, 19 nt, Homo sapiens
cgauagagcugguuaugcu

SEQ ID NO: 736450 - RNA, 19 nt, Homo sapiens
ggccagagagcuuaucaaa

SEQ ID NO: 736451 - RNA, 19 nt, Homo sapiens
gacaagagucaaccagaaa

SEQ ID NO: 736452 - RNA, 19 nt, Homo sapiens
ccgauguacuuaccuugua

SEQ ID NO: 736453 - RNA, 19 nt, Homo sapiens
cacaauauguaauggaugu

SEQ ID NO: 736454 - RNA, 19 nt, Homo sapiens
uaauggauguguugaugga

SEQ ID NO: 736455 - RNA, 19 nt, Homo sapiens
caugcuaacuucccacaau

SEQ ID NO: 736456 - RNA, 19 nt, Homo sapiens
uaaaugaaaccacucaagu

SEQ ID NO: 736457 - RNA, 19 nt, Homo sapiens
gauugaagaguacuuguau

SEQ ID NO: 736458 - RNA, 19 nt, Homo sapiens
ccgaagaaauuugguaauc

SEQ ID NO: 736459 - RNA, 19 nt, Homo sapiens
aaacaggccagagagcuua

SEQ ID NO: 736460 - RNA, 19 nt, Homo sapiens
gcaaauguucuagauugaa

SEQ ID NO: 736461 - RNA, 19 nt, Homo sapiens
gaugagcuacgccgaaaga

SEQ ID NO: 736462 - RNA, 19 nt, Homo sapiens
caacaaucccaaucugaug

SEQ ID NO: 736463 - RNA, 19 nt, Homo sapiens
gaacagcccguagcaccaa

SEQ ID NO: 736464 - RNA, 19 nt, Homo sapiens
ccagcagacuuaauuacau

SEQ ID NO: 736465 - RNA, 19 nt, Homo sapiens
gaugucaaguuugugauca

SEQ ID NO: 736466 - RNA, 19 nt, Homo sapiens
agagaugguuggccagcua

SEQ ID NO: 736467 - RNA, 19 nt, Homo sapiens
ugagugagcuccccaaguu

SEQ ID NO: 736468 - RNA, 19 nt, Homo sapiens
cuggacgucugauagauuu

SEQ ID NO: 736469 - RNA, 19 nt, Homo sapiens
cgaugacuauggcaaaugu

SEQ ID NO: 736470 - RNA, 19 nt, Homo sapiens
gaaccaacuccaauucagu

SEQ ID NO: 736471 - RNA, 19 nt, Homo sapiens
gggagauguuuguccuaaa

SEQ ID NO: 736472 - RNA, 19 nt, Homo sapiens
caaacagcucagaggauua

SEQ ID NO: 736473 - RNA, 19 nt, Homo sapiens
ucaugcagauuaguuagaa

SEQ ID NO: 736474 - RNA, 19 nt, Homo sapiens
caaagagacgcugugauga

SEQ ID NO: 736475 - RNA, 19 nt, Homo sapiens
uguucuagauugaagagua

SEQ ID NO: 736476 - RNA, 19 nt, Homo sapiens
gcacuuauggagcuaguag

SEQ ID NO: 736477 - RNA, 19 nt, Homo sapiens
aaagagauuggguacuuaa

SEQ ID NO: 736478 - RNA, 19 nt, Homo sapiens
cgaaggaugcgcagagaug

SEQ ID NO: 736479 - RNA, 19 nt, Homo sapiens
aauaauggcugaaaaggaa

SEQ ID NO: 736480 - RNA, 19 nt, Homo sapiens
gcacaagcaggccaauaca

SEQ ID NO: 736481 - RNA, 19 nt, Homo sapiens
gagcacaagcaggccaaua

SEQ ID NO: 736482 - RNA, 19 nt, Homo sapiens
ggcuagauguggaagaugu

SEQ ID NO: 736483 - RNA, 19 nt, Homo sapiens
aaagagguguugagaucug

SEQ ID NO: 736484 - RNA, 19 nt, Homo sapiens
uacagcagguggccgauga

SEQ ID NO: 736485 - RNA, 19 nt, Homo sapiens
uguaauggauguguugaug

SEQ ID NO: 736486 - RNA, 19 nt, Homo sapiens
ggaaggagacgccuaaacc

SEQ ID NO: 736487 - RNA, 19 nt, Homo sapiens
gcaaggcugacaccauaug

SEQ ID NO: 736488 - RNA, 19 nt, Homo sapiens
ccaauacaccuauggucaa

SEQ ID NO: 736489 - RNA, 19 nt, Homo sapiens
gauuaugugcaccguauug

SEQ ID NO: 736490 - RNA, 19 nt, Homo sapiens
ggaaguagcaaggcugaca

SEQ ID NO: 736491 - RNA, 19 nt, Homo sapiens
cgauguacuuaccuuguau

SEQ ID NO: 736492 - RNA, 19 nt, Homo sapiens
augcuaacuucccacaaua

SEQ ID NO: 736493 - RNA, 19 nt, Homo sapiens
gaaguucacagagcucuag

SEQ ID NO: 736494 - RNA, 19 nt, Homo sapiens
caccauaugagguugauga

SEQ ID NO: 736495 - RNA, 19 nt, Homo sapiens
gggaagacguuggcguauc

SEQ ID NO: 736496 - RNA, 19 nt, Homo sapiens
guaaaugaaaccacucaag

SEQ ID NO: 736497 - RNA, 19 nt, Homo sapiens
ggagcuaccaauaugauag

SEQ ID NO: 736498 - RNA, 19 nt, Homo sapiens
gcugacaccauaugagguu

SEQ ID NO: 736499 - RNA, 19 nt, Homo sapiens
aaacagcucagaggauuau

SEQ ID NO: 736500 - RNA, 19 nt, Homo sapiens
ggauuuccuucgugauuac

SEQ ID NO: 736501 - RNA, 19 nt, Homo sapiens
ugacagaaugcuugauaug

SEQ ID NO: 736502 - RNA, 19 nt, Homo sapiens
ccagaucucuauccuuuug

SEQ ID NO: 736503 - RNA, 19 nt, Homo sapiens
aaucuucgccgauguacuu

SEQ ID NO: 736504 - RNA, 19 nt, Homo sapiens
acaaaucuucgccgaugua

SEQ ID NO: 736505 - RNA, 19 nt, Homo sapiens
uguggaacauccggaagua

SEQ ID NO: 736506 - RNA, 19 nt, Homo sapiens
uauggcaaauguucuagau

SEQ ID NO: 736507 - RNA, 19 nt, Homo sapiens
aggauuaugugcaccguau

SEQ ID NO: 736508 - RNA, 19 nt, Homo sapiens
gaaaauagguguguacuua

SEQ ID NO: 736509 - RNA, 19 nt, Homo sapiens
gaagugauuuggccucaua

SEQ ID NO: 736510 - RNA, 19 nt, Homo sapiens
guaaugugcucuuguaauu

SEQ ID NO: 736511 - RNA, 19 nt, Homo sapiens
gaaauaaccuugaguugag

SEQ ID NO: 736512 - RNA, 19 nt, Homo sapiens
ccagagagcuuaucaaagu

SEQ ID NO: 736513 - RNA, 19 nt, Homo sapiens
cuauacagcucaagaauau

SEQ ID NO: 736514 - RNA, 19 nt, Homo sapiens
cuaccaauaugauagguua

SEQ ID NO: 736515 - RNA, 19 nt, Homo sapiens
ccaaacagcucagaggauu

SEQ ID NO: 736516 - RNA, 19 nt, Homo sapiens
ugaaacaaguccugaguug

SEQ ID NO: 736517 - RNA, 19 nt, Homo sapiens
gaagaugucaaguuuguga

SEQ ID NO: 736518 - RNA, 19 nt, Homo sapiens
caacagaguagaagugauu

SEQ ID NO: 736519 - RNA, 19 nt, Homo sapiens
caacaaggguaccgccuau

SEQ ID NO: 736520 - RNA, 19 nt, Homo sapiens
agaauucacugccagguuu

SEQ ID NO: 736521 - RNA, 19 nt, Homo sapiens
uguggaagaugucaaguuu

SEQ ID NO: 736522 - RNA, 19 nt, Homo sapiens
cagcagacuuaauuacauu

SEQ ID NO: 736523 - RNA, 19 nt, Homo sapiens
gcuauacagcucaagaaua

SEQ ID NO: 736524 - RNA, 19 nt, Homo sapiens
gauuuggccucauaacuuc

SEQ ID NO: 736525 - RNA, 19 nt, Homo sapiens
aaacaaguccugaguugaa

SEQ ID NO: 736526 - RNA, 19 nt, Homo sapiens
ggauguuucugcaaaggaa

SEQ ID NO: 736527 - RNA, 19 nt, Homo sapiens
ugaaauaaccuugaguuga

SEQ ID NO: 736528 - RNA, 19 nt, Homo sapiens
gcaggaguuuggauguuug

SEQ ID NO: 736529 - RNA, 19 nt, Homo sapiens
ccacguucuuuggcuauua

SEQ ID NO: 736530 - RNA, 19 nt, Homo sapiens
gaucaacuaugacuaucca

SEQ ID NO: 736531 - RNA, 19 nt, Homo sapiens
gcagauuaguuagaauuca

SEQ ID NO: 736532 - RNA, 19 nt, Homo sapiens
ggaaucaguaauccucuuu

SEQ ID NO: 736533 - RNA, 19 nt, Homo sapiens
ggcaggaguuuggauguuu

SEQ ID NO: 736534 - RNA, 19 nt, Homo sapiens
aaugugcucuuguaauuga

SEQ ID NO: 736535 - RNA, 19 nt, Homo sapiens
uggaagaugucaaguuugu

SEQ ID NO: 736536 - RNA, 19 nt, Homo sapiens
cgauagagcugguuaugcu

SEQ ID NO: 736537 - RNA, 19 nt, Homo sapiens
ggccagagagcuuaucaaa

SEQ ID NO: 736538 - RNA, 19 nt, Homo sapiens
gaaacaaguccugaguuga

SEQ ID NO: 736539 - RNA, 19 nt, Homo sapiens
uggaagauguggaagaugu

SEQ ID NO: 736540 - RNA, 19 nt, Homo sapiens
gcucuacucaguuucuuaa

SEQ ID NO: 736541 - RNA, 19 nt, Homo sapiens
uaaaugaaaccacucaagu

SEQ ID NO: 736542 - RNA, 19 nt, Homo sapiens
caaguccugaguugaaaua

SEQ ID NO: 736543 - RNA, 19 nt, Homo sapiens
cacacugacucaucauuga

SEQ ID NO: 736544 - RNA, 19 nt, Homo sapiens
uaacuccugucaguauauu

SEQ ID NO: 736545 - RNA, 19 nt, Homo sapiens
aaacaggccagagagcuua

SEQ ID NO: 736546 - RNA, 19 nt, Homo sapiens
guuguuggcauguccuuua

SEQ ID NO: 736547 - RNA, 19 nt, Homo sapiens
ggauaguacuggaauuugc

SEQ ID NO: 736548 - RNA, 19 nt, Homo sapiens
gugacugguuuaaagguaa

SEQ ID NO: 736549 - RNA, 19 nt, Homo sapiens
caacaaucccaaucugaug

SEQ ID NO: 736550 - RNA, 19 nt, Homo sapiens
gaacagcccguagcaccaa

SEQ ID NO: 736551 - RNA, 19 nt, Homo sapiens
ccagcagacuuaauuacau

SEQ ID NO: 736552 - RNA, 19 nt, Homo sapiens
gaugucaaguuugugauca

SEQ ID NO: 736553 - RNA, 19 nt, Homo sapiens
uguaacuccugucaguaua

SEQ ID NO: 736554 - RNA, 19 nt, Homo sapiens
caaacagcucagaggauua

SEQ ID NO: 736555 - RNA, 19 nt, Homo sapiens
aguguaaugugcucuugua

SEQ ID NO: 736556 - RNA, 19 nt, Homo sapiens
ucaugcagauuaguuagaa

SEQ ID NO: 736557 - RNA, 19 nt, Homo sapiens
gcacuuauggagcuaguag

SEQ ID NO: 736558 - RNA, 19 nt, Homo sapiens
ucauugacguggaagaugu

SEQ ID NO: 736559 - RNA, 19 nt, Homo sapiens
gauccuauuuccuaugcau

SEQ ID NO: 736560 - RNA, 19 nt, Homo sapiens
cuuaacagcuuuggcucua

SEQ ID NO: 736561 - RNA, 19 nt, Homo sapiens
gcacaagcaggccaauaca

SEQ ID NO: 736562 - RNA, 19 nt, Homo sapiens
gagcacaagcaggccaaua

SEQ ID NO: 736563 - RNA, 19 nt, Homo sapiens
uuacuaacuucaccuucuu

SEQ ID NO: 736564 - RNA, 19 nt, Homo sapiens
gguguguacuuaacagcuu

SEQ ID NO: 736565 - RNA, 19 nt, Homo sapiens
uaaaggauaguacuggaau

SEQ ID NO: 736566 - RNA, 19 nt, Homo sapiens
gggcuugguaguacaguaa

SEQ ID NO: 736567 - RNA, 19 nt, Homo sapiens
ccaauacaccuauggucaa

SEQ ID NO: 736568 - RNA, 19 nt, Homo sapiens
gauuaugugcaccguauug

SEQ ID NO: 736569 - RNA, 19 nt, Homo sapiens
cacguucuuuggcuauuaa

SEQ ID NO: 736570 - RNA, 19 nt, Homo sapiens
ccuacacacugacucauca

SEQ ID NO: 736571 - RNA, 19 nt, Homo sapiens
guaaaggauaguacuggaa

SEQ ID NO: 736572 - RNA, 19 nt, Homo sapiens
gaaguucacagagcucuag

SEQ ID NO: 736573 - RNA, 19 nt, Homo sapiens
acaucaaccuacacacuga

SEQ ID NO: 736574 - RNA, 19 nt, Homo sapiens
ugauuuggccucauaacuu

SEQ ID NO: 736575 - RNA, 19 nt, Homo sapiens
uaauuucccaggucacgua

SEQ ID NO: 736576 - RNA, 19 nt, Homo sapiens
guaaaugaaaccacucaag

SEQ ID NO: 736577 - RNA, 19 nt, Homo sapiens
ggagcuaccaauaugauag

SEQ ID NO: 736578 - RNA, 19 nt, Homo sapiens
aaacagcucagaggauuau

SEQ ID NO: 736579 - RNA, 19 nt, Homo sapiens
aaaggauaguacuggaauu

SEQ ID NO: 736580 - RNA, 19 nt, Homo sapiens
aggauuaugugcaccguau

SEQ ID NO: 736581 - RNA, 19 nt, Homo sapiens
ugugacugguuuaaaggua

SEQ ID NO: 736582 - RNA, 19 nt, Homo sapiens
caauacaccuauggucaag

SEQ ID NO: 736583 - RNA, 19 nt, Homo sapiens
ccaacaaucccaaucugau

SEQ ID NO: 736584 - RNA, 19 nt, Homo sapiens
caaccuacacacugacuca

SEQ ID NO: 736585 - RNA, 19 nt, Homo sapiens
caaccaucgugauuugucu

SEQ ID NO: 736586 - RNA, 19 nt, Homo sapiens
gcaggccaauacaccuaug

SEQ ID NO: 736587 - RNA, 19 nt, Homo sapiens
uaauggcaguggcuaugga

SEQ ID NO: 736588 - RNA, 19 nt, Homo sapiens
guugaaauaaccuugaguu

SEQ ID NO: 736589 - RNA, 19 nt, Homo sapiens
caggucacguagacaauca

SEQ ID NO: 736590 - RNA, 19 nt, Homo sapiens
uaacagcuuuggcucuacu

SEQ ID NO: 736591 - RNA, 19 nt, Homo sapiens
gauagagcugguuaugcua

SEQ ID NO: 736592 - RNA, 19 nt, Homo sapiens
gaguugaaauaaccuugag

SEQ ID NO: 736593 - RNA, 19 nt, Homo sapiens
ccaggcuucucccaacaga

SEQ ID NO: 736594 - RNA, 19 nt, Homo sapiens
aaauagguguguacuuaac

SEQ ID NO: 736595 - RNA, 19 nt, Homo sapiens
gccaacaaucccaaucuga

SEQ ID NO: 736596 - RNA, 19 nt, Homo sapiens
caacuaugacuauccaaac

SEQ ID NO: 736597 - RNA, 19 nt, Homo sapiens
ucaacuaugacuauccaaa

SEQ ID NO: 736598 - RNA, 19 nt, Homo sapiens
cguggaagauguggaagau

SEQ ID NO: 736599 - RNA, 19 nt, Homo sapiens
ugacguggaagauguggaa

SEQ ID NO: 736600 - RNA, 19 nt, Homo sapiens
ccacuuuguucuauguucu

SEQ ID NO: 736601 - RNA, 19 nt, Homo sapiens
uuaccacuuuguucuaugu

SEQ ID NO: 736602 - RNA, 19 nt, Homo sapiens
guuuaccacuuuguucuau

SEQ ID NO: 736603 - RNA, 19 nt, Homo sapiens
guuauguuguugguagauu

SEQ ID NO: 736604 - RNA, 19 nt, Homo sapiens
gacuccagcagacuuaauu

SEQ ID NO: 736605 - RNA, 19 nt, Homo sapiens
ccagcaguuuagugggaua

SEQ ID NO: 736606 - RNA, 19 nt, Homo sapiens
cagagagcuuaucaaagug

SEQ ID NO: 736607 - RNA, 19 nt, Homo sapiens
gaagauguggaagauguca

SEQ ID NO: 736608 - RNA, 19 nt, Homo sapiens
gcacauaugcggccaguca

SEQ ID NO: 736609 - RNA, 19 nt, Homo sapiens
ggagcuggcuguaccuaga

SEQ ID NO: 736610 - RNA, 19 nt, Homo sapiens
ccacaacucccgugaagaa

SEQ ID NO: 736611 - RNA, 19 nt, Homo sapiens
gcaggaagagccagcagua

SEQ ID NO: 736612 - RNA, 19 nt, Homo sapiens
gcacauacauacguguugu

SEQ ID NO: 736613 - RNA, 19 nt, Homo sapiens
ccacugcugucauaucaga

SEQ ID NO: 736614 - RNA, 19 nt, Homo sapiens
uagaagagauggucaacuc

SEQ ID NO: 736615 - RNA, 19 nt, Homo sapiens
gaacgcggcauccaucuca

SEQ ID NO: 736616 - RNA, 19 nt, Homo sapiens
aaagaaacuugcuggacaa

SEQ ID NO: 736617 - RNA, 19 nt, Homo sapiens
caacucccgugaagaagga

SEQ ID NO: 736618 - RNA, 19 nt, Homo sapiens
ggccacugcugucauauca

SEQ ID NO: 736619 - RNA, 19 nt, Homo sapiens
ccacaaaccaggccaagau

SEQ ID NO: 736620 - RNA, 19 nt, Homo sapiens
agaggccacugcugucaua

SEQ ID NO: 736621 - RNA, 19 nt, Homo sapiens
gcggcacucuguacaagaa

SEQ ID NO: 736622 - RNA, 19 nt, Homo sapiens
ggaccuauucggacugauu

SEQ ID NO: 736623 - RNA, 19 nt, Homo sapiens
guacagucccaccgaguuu

SEQ ID NO: 736624 - RNA, 19 nt, Homo sapiens
agaaugaacugcccacaac

SEQ ID NO: 736625 - RNA, 19 nt, Homo sapiens
gcaagaaggagaaugaacu

SEQ ID NO: 736626 - RNA, 19 nt, Homo sapiens
ccgagaagcugccacaaac

SEQ ID NO: 736627 - RNA, 19 nt, Homo sapiens
gcagaggugaccacaguga

SEQ ID NO: 736628 - RNA, 19 nt, Homo sapiens
auacauacguguugugucu

SEQ ID NO: 736629 - RNA, 19 nt, Homo sapiens
ggaaggaucaccagcacau

SEQ ID NO: 736630 - RNA, 19 nt, Homo sapiens
gagaaugaacugcccacaa

SEQ ID NO: 736631 - RNA, 19 nt, Homo sapiens
gaaggaucaccagcacaua

SEQ ID NO: 736632 - RNA, 19 nt, Homo sapiens
gaucgcaccguuuccagaa

SEQ ID NO: 736633 - RNA, 19 nt, Homo sapiens
ccaagaacaucacauugcu

SEQ ID NO: 736634 - RNA, 19 nt, Homo sapiens
gcccacaacucccgugaag

SEQ ID NO: 736635 - RNA, 19 nt, Homo sapiens
gccacaaggucaacuacug

SEQ ID NO: 736636 - RNA, 19 nt, Homo sapiens
ucgcagaggugaccacagu

SEQ ID NO: 736637 - RNA, 19 nt, Homo sapiens
guacggugccggaacauca

SEQ ID NO: 736638 - RNA, 19 nt, Homo sapiens
gcaaggacuggaaggauca

SEQ ID NO: 736639 - RNA, 19 nt, Homo sapiens
uguugugucugucaauaaa

SEQ ID NO: 736640 - RNA, 19 nt, Homo sapiens
gcgacgacaugaccuuaag

SEQ ID NO: 736641 - RNA, 19 nt, Homo sapiens
ugauucggcuucccacuuc

SEQ ID NO: 736642 - RNA, 19 nt, Homo sapiens
ggaagagccagcaguaagg

SEQ ID NO: 736643 - RNA, 19 nt, Homo sapiens
gaacaucacauugcuucca

SEQ ID NO: 736644 - RNA, 19 nt, Homo sapiens
ggagaccaccgggcugaaa

SEQ ID NO: 736645 - RNA, 19 nt, Homo sapiens
gcauccaucucaggacaug

SEQ ID NO: 736646 - RNA, 19 nt, Homo sapiens
cguguugugucugucaaua

SEQ ID NO: 736647 - RNA, 19 nt, Homo sapiens
ggagaaggugaccguguga

SEQ ID NO: 736648 - RNA, 19 nt, Homo sapiens
cugaaagcgugauggagaa

SEQ ID NO: 736649 - RNA, 19 nt, Homo sapiens
gaagagccagcaguaagga

SEQ ID NO: 736650 - RNA, 19 nt, Homo sapiens
gaaguccacguggcugaaa

SEQ ID NO: 736651 - RNA, 19 nt, Homo sapiens
gggaagguaaagaaacuug

SEQ ID NO: 736652 - RNA, 19 nt, Homo sapiens
gugggaagguaaagaaacu

SEQ ID NO: 736653 - RNA, 19 nt, Homo sapiens
ggugugggaagguaaagaa

SEQ ID NO: 736654 - RNA, 19 nt, Homo sapiens
gagaagcugccacaaacca

SEQ ID NO: 736655 - RNA, 19 nt, Homo sapiens
caagaaggagaaugaacug

SEQ ID NO: 736656 - RNA, 19 nt, Homo sapiens
gguccucagucuccuccaa

SEQ ID NO: 736657 - RNA, 19 nt, Homo sapiens
gagcuggcuguaccuagaa

SEQ ID NO: 736658 - RNA, 19 nt, Homo sapiens
gguacagucccaccgaguu

SEQ ID NO: 736659 - RNA, 19 nt, Homo sapiens
gguaggacggcccuucaga

SEQ ID NO: 736660 - RNA, 19 nt, Homo sapiens
ugaggacucggaccuauuc

SEQ ID NO: 736661 - RNA, 19 nt, Homo sapiens
gucugucaauaaaguguaa

SEQ ID NO: 736662 - RNA, 19 nt, Homo sapiens
gaagacgcuguuugagcaa

SEQ ID NO: 736663 - RNA, 19 nt, Homo sapiens
ggcgcaagaaggagaauga

SEQ ID NO: 736664 - RNA, 19 nt, Homo sapiens
aguaaggacuggaaaagaa

SEQ ID NO: 736665 - RNA, 19 nt, Homo sapiens
cagcggcacucuguacaag

SEQ ID NO: 736666 - RNA, 19 nt, Homo sapiens
aagagauggucaacuccuu

SEQ ID NO: 736667 - RNA, 19 nt, Homo sapiens
ggcuguaccuagaagagau

SEQ ID NO: 736668 - RNA, 19 nt, Homo sapiens
cgugaggacucggaccuau

SEQ ID NO: 736669 - RNA, 19 nt, Homo sapiens
guaggacggcccuucagau

SEQ ID NO: 736670 - RNA, 19 nt, Homo sapiens
cauguucugucugguagga

SEQ ID NO: 736671 - RNA, 19 nt, Homo sapiens
gccagcaccuaccgagaag

SEQ ID NO: 736672 - RNA, 19 nt, Homo sapiens
caagaacaucacauugcuu

SEQ ID NO: 736673 - RNA, 19 nt, Homo sapiens
gaagguaaagaaacuugcu

SEQ ID NO: 736674 - RNA, 19 nt, Homo sapiens
caggaagagccagcaguaa

SEQ ID NO: 736675 - RNA, 19 nt, Homo sapiens
aaagguggaacuaaauaca

SEQ ID NO: 736676 - RNA, 19 nt, Homo sapiens
acauacguguugugucugu

SEQ ID NO: 736677 - RNA, 19 nt, Homo sapiens
gaccuauucggacugauuc

SEQ ID NO: 736678 - RNA, 19 nt, Homo sapiens
gacgacaugaccuuaagug

SEQ ID NO: 736679 - RNA, 19 nt, Homo sapiens
caacgucacaucccaaaau

SEQ ID NO: 736680 - RNA, 19 nt, Homo sapiens
gccaacgucacaucccaaa

SEQ ID NO: 736681 - RNA, 19 nt, Homo sapiens
guagaggccacugcuguca

SEQ ID NO: 736682 - RNA, 19 nt, Homo sapiens
aaggaucaccagcacauau

SEQ ID NO: 736683 - RNA, 19 nt, Homo sapiens
ccaagcaugccagcaccua

SEQ ID NO: 736684 - RNA, 19 nt, Homo sapiens
gucaacuccuugcucaaca

SEQ ID NO: 736685 - RNA, 19 nt, Homo sapiens
ccaaaauaguguugacauc

SEQ ID NO: 736686 - RNA, 19 nt, Homo sapiens
gcacuccugugaggcuuuu

SEQ ID NO: 736687 - RNA, 19 nt, Homo sapiens
acugggacccuucugugua

SEQ ID NO: 736688 - RNA, 19 nt, Homo sapiens
aaagcgugauggagaaggu

SEQ ID NO: 736689 - RNA, 19 nt, Homo sapiens
gugaggacucggaccuauu

SEQ ID NO: 736690 - RNA, 19 nt, Homo sapiens
gcgcaagaaggagaaugaa

SEQ ID NO: 736691 - RNA, 19 nt, Homo sapiens
ugauugucguccacacaga

SEQ ID NO: 736692 - RNA, 19 nt, Homo sapiens
gcaauuccauucauuugua

SEQ ID NO: 736693 - RNA, 19 nt, Homo sapiens
gaagaauacugaccugaga

SEQ ID NO: 736694 - RNA, 19 nt, Homo sapiens
ggacuucccugccgaaaug

SEQ ID NO: 736695 - RNA, 19 nt, Homo sapiens
gaggcgaauucuacaguua

SEQ ID NO: 736696 - RNA, 19 nt, Homo sapiens
gcccuuaguucaguuauuu

SEQ ID NO: 736697 - RNA, 19 nt, Homo sapiens
gauggaggcugaagucaag

SEQ ID NO: 736698 - RNA, 19 nt, Homo sapiens
gaagaugacuauggagaag

SEQ ID NO: 736699 - RNA, 19 nt, Homo sapiens
caacccaacgugaugaaua

SEQ ID NO: 736700 - RNA, 19 nt, Homo sapiens
gaagcaggguuuucauuuu

SEQ ID NO: 736701 - RNA, 19 nt, Homo sapiens
agugacagcucaguucuua

SEQ ID NO: 736702 - RNA, 19 nt, Homo sapiens
gaccagaucccaccaaaca

SEQ ID NO: 736703 - RNA, 19 nt, Homo sapiens
ccaacgugaugaauauuug

SEQ ID NO: 736704 - RNA, 19 nt, Homo sapiens
gugagauucugaaaccuaa

SEQ ID NO: 736705 - RNA, 19 nt, Homo sapiens
cccaaauucucguuucuuu

SEQ ID NO: 736706 - RNA, 19 nt, Homo sapiens
gagaggaggcccagugaga

SEQ ID NO: 736707 - RNA, 19 nt, Homo sapiens
cuagaaagaagaauacuga

SEQ ID NO: 736708 - RNA, 19 nt, Homo sapiens
ggaggcgaauucuacaguu

SEQ ID NO: 736709 - RNA, 19 nt, Homo sapiens
gaaaccagccuaagacacu

SEQ ID NO: 736710 - RNA, 19 nt, Homo sapiens
gcuggaagaucacgaguac

SEQ ID NO: 736711 - RNA, 19 nt, Homo sapiens
gaagacaagcagcagaaga

SEQ ID NO: 736712 - RNA, 19 nt, Homo sapiens
gagcagaacggccucuaug

SEQ ID NO: 736713 - RNA, 19 nt, Homo sapiens
uaacaggaaaccagccuaa

SEQ ID NO: 736714 - RNA, 19 nt, Homo sapiens
cuguagcugugaauuguua

SEQ ID NO: 736715 - RNA, 19 nt, Homo sapiens
aacaagagcuacuccuuca

SEQ ID NO: 736716 - RNA, 19 nt, Homo sapiens
ggaacaagagcuacuccuu

SEQ ID NO: 736717 - RNA, 19 nt, Homo sapiens
ggaaaggccaggagaagag

SEQ ID NO: 736718 - RNA, 19 nt, Homo sapiens
ucgacaagcucgcccaguu

SEQ ID NO: 736719 - RNA, 19 nt, Homo sapiens
ccauucauuuguacagaaa

SEQ ID NO: 736720 - RNA, 19 nt, Homo sapiens
ugguuuaggucuagaaaga

SEQ ID NO: 736721 - RNA, 19 nt, Homo sapiens
gagauucugaaaccuaauu

SEQ ID NO: 736722 - RNA, 19 nt, Homo sapiens
ggaggagcaugugcaggaa

SEQ ID NO: 736723 - RNA, 19 nt, Homo sapiens
gaggaagauugcagugaca

SEQ ID NO: 736724 - RNA, 19 nt, Homo sapiens
gggauaagugggaccagua

SEQ ID NO: 736725 - RNA, 19 nt, Homo sapiens
agaacggccucuaugaguu

SEQ ID NO: 736726 - RNA, 19 nt, Homo sapiens
gaggaggcccagugagauu

SEQ ID NO: 736727 - RNA, 19 nt, Homo sapiens
gagaacaaaggccaucaga

SEQ ID NO: 736728 - RNA, 19 nt, Homo sapiens
gaccaggagcuucgaaaug

SEQ ID NO: 736729 - RNA, 19 nt, Homo sapiens
agacccagcuagacaugaa

SEQ ID NO: 736730 - RNA, 19 nt, Homo sapiens
ugcaaaaucuuccaacuuu

SEQ ID NO: 736731 - RNA, 19 nt, Homo sapiens
acaagauucuaacaggaaa

SEQ ID NO: 736732 - RNA, 19 nt, Homo sapiens
gauaagugggaccaguaua

SEQ ID NO: 736733 - RNA, 19 nt, Homo sapiens
ucgugaagcuggaagauca

SEQ ID NO: 736734 - RNA, 19 nt, Homo sapiens
ccagugagauucugaaacc

SEQ ID NO: 736735 - RNA, 19 nt, Homo sapiens
ggaggaaaggccaggagaa

SEQ ID NO: 736736 - RNA, 19 nt, Homo sapiens
ggaaacaagauucuaacag

SEQ ID NO: 736737 - RNA, 19 nt, Homo sapiens
gcagauggaggcugaaguc

SEQ ID NO: 736738 - RNA, 19 nt, Homo sapiens
cacgugcuguuaguaauuu

SEQ ID NO: 736739 - RNA, 19 nt, Homo sapiens
uugagaagaugacuaugga

SEQ ID NO: 736740 - RNA, 19 nt, Homo sapiens
gccuuccacuccaucauuu

SEQ ID NO: 736741 - RNA, 19 nt, Homo sapiens
auaagugggaccaguauaa

SEQ ID NO: 736742 - RNA, 19 nt, Homo sapiens
gaggagacccagcuagaca

SEQ ID NO: 736743 - RNA, 19 nt, Homo sapiens
aacccaacgugaugaauau

SEQ ID NO: 736744 - RNA, 19 nt, Homo sapiens
caagagcuacuccuucauc

SEQ ID NO: 736745 - RNA, 19 nt, Homo sapiens
gcagaacggccucuaugag

SEQ ID NO: 736746 - RNA, 19 nt, Homo sapiens
uaagugggaccaguauaaa

SEQ ID NO: 736747 - RNA, 19 nt, Homo sapiens
ggauaagugggaccaguau

SEQ ID NO: 736748 - RNA, 19 nt, Homo sapiens
gcucggagaagagaacaaa

SEQ ID NO: 736749 - RNA, 19 nt, Homo sapiens
acucaaggcucggagaaga

SEQ ID NO: 736750 - RNA, 19 nt, Homo sapiens
gcaagccucccauccagau

SEQ ID NO: 736751 - RNA, 19 nt, Homo sapiens
ggugcaauuccauucauuu

SEQ ID NO: 736752 - RNA, 19 nt, Homo sapiens
ggcccgaguuugagaagau

SEQ ID NO: 736753 - RNA, 19 nt, Homo sapiens
caccucaucuaccugauca

SEQ ID NO: 736754 - RNA, 19 nt, Homo sapiens
cugcuggucuggguucuaa

SEQ ID NO: 736755 - RNA, 19 nt, Homo sapiens
uaugaguucuuccgagcaa

SEQ ID NO: 736756 - RNA, 19 nt, Homo sapiens
uggaagaucacgaguacaa

SEQ ID NO: 736757 - RNA, 19 nt, Homo sapiens
caacgugaugaauauuuga

SEQ ID NO: 736758 - RNA, 19 nt, Homo sapiens
acaggaaaccagccuaaga

SEQ ID NO: 736759 - RNA, 19 nt, Homo sapiens
accaggagcuucgaaaugu

SEQ ID NO: 736760 - RNA, 19 nt, Homo sapiens
gcgaagugaagcaggguuu

SEQ ID NO: 736761 - RNA, 19 nt, Homo sapiens
ugacagcucaguucuuaca

SEQ ID NO: 736762 - RNA, 19 nt, Homo sapiens
guaauuucuuguggauuuc

SEQ ID NO: 736763 - RNA, 19 nt, Homo sapiens
cuuguggauuucauuguuu

SEQ ID NO: 736764 - RNA, 19 nt, Homo sapiens
gugcaauuccauucauuug

SEQ ID NO: 736765 - RNA, 19 nt, Homo sapiens
gagagccacaggaagagaa

SEQ ID NO: 736766 - RNA, 19 nt, Homo sapiens
cagaacggccucuaugagu

SEQ ID NO: 736767 - RNA, 19 nt, Homo sapiens
acaagccuuuggacccuaa

SEQ ID NO: 736768 - RNA, 19 nt, Homo sapiens
ccacccucaucaacgagua

SEQ ID NO: 736769 - RNA, 19 nt, Homo sapiens
gcugugaauuguuaaaaug

SEQ ID NO: 736770 - RNA, 19 nt, Homo sapiens
ucucggagcagauccaaga

SEQ ID NO: 736771 - RNA, 19 nt, Homo sapiens
gaggaaaggccaggagaag

SEQ ID NO: 736772 - RNA, 19 nt, Homo sapiens
ggagcagaacggccucuau

SEQ ID NO: 736773 - RNA, 19 nt, Homo sapiens
cuacugcaccagcuucuug

SEQ ID NO: 736774 - RNA, 19 nt, Homo sapiens
ucuuguggauuucauuguu

SEQ ID NO: 736775 - RNA, 19 nt, Homo sapiens
ccagggacgaguguaagua

SEQ ID NO: 736776 - RNA, 19 nt, Homo sapiens
gcuggucuggguucuaauu

SEQ ID NO: 736777 - RNA, 19 nt, Homo sapiens
gacaugaacgaguuugaca

SEQ ID NO: 736778 - RNA, 19 nt, Homo sapiens
ggcccuuaguucaguuauu

SEQ ID NO: 736779 - RNA, 19 nt, Homo sapiens
ugaaaccuaauucuucgaa

SEQ ID NO: 736780 - RNA, 19 nt, Homo sapiens
guuuaggucuagaaagaag

SEQ ID NO: 736781 - RNA, 19 nt, Homo sapiens
ccaaugugcccuacuucga

SEQ ID NO: 736782 - RNA, 19 nt, Homo sapiens
cagcagcacccgcaguuca

SEQ ID NO: 736783 - RNA, 19 nt, Homo sapiens
agacgcagcacgaggaguu

SEQ ID NO: 736784 - RNA, 19 nt, Homo sapiens
gaaggacaaccccaaauuc

SEQ ID NO: 736785 - RNA, 19 nt, Homo sapiens
agaagaugacuauggagaa

SEQ ID NO: 736786 - RNA, 19 nt, Homo sapiens
gggaaacaagauucuaaca

SEQ ID NO: 736787 - RNA, 19 nt, Homo sapiens
guagccauuugcuguuauc

SEQ ID NO: 736788 - RNA, 19 nt, Homo sapiens
gagaacuaccgcaggaaca

SEQ ID NO: 736789 - RNA, 19 nt, Homo sapiens
ggagacccagcuagacaug

SEQ ID NO: 736790 - RNA, 19 nt, Homo sapiens
caaugugcccuacuucgau

SEQ ID NO: 736791 - RNA, 19 nt, Homo sapiens
ccaccacccagccugauga

SEQ ID NO: 736792 - RNA, 19 nt, Homo sapiens
ggacagcucugauggaaua

SEQ ID NO: 736793 - RNA, 19 nt, Homo sapiens
gcuaugaacucuccaaagu

SEQ ID NO: 736794 - RNA, 19 nt, Homo sapiens
caacaaacgucuggaugaa

SEQ ID NO: 736795 - RNA, 19 nt, Homo sapiens
gaaaucaccagcaucaaga

SEQ ID NO: 736796 - RNA, 19 nt, Homo sapiens
ggaagcugcugaucgaguu

SEQ ID NO: 736797 - RNA, 19 nt, Homo sapiens
auaagacacuguacuauga

SEQ ID NO: 736798 - RNA, 19 nt, Homo sapiens
gacguaagaacaagaguua

SEQ ID NO: 736799 - RNA, 19 nt, Homo sapiens
cacaggaacucaccacauu

SEQ ID NO: 736800 - RNA, 19 nt, Homo sapiens
gaagaacauugagugcauu

SEQ ID NO: 736801 - RNA, 19 nt, Homo sapiens
ccacagaucaccaucaaug

SEQ ID NO: 736802 - RNA, 19 nt, Homo sapiens
gggaagaccuugccaaucc

SEQ ID NO: 736803 - RNA, 19 nt, Homo sapiens
acagagggcuggugauugu

SEQ ID NO: 736804 - RNA, 19 nt, Homo sapiens
acaaacgucuggaugaaug

SEQ ID NO: 736805 - RNA, 19 nt, Homo sapiens
caacggaagacuacaaugu

SEQ ID NO: 736806 - RNA, 19 nt, Homo sapiens
ggccacagaucaccaucaa

SEQ ID NO: 736807 - RNA, 19 nt, Homo sapiens
gaccaagugugaccuacga

SEQ ID NO: 736808 - RNA, 19 nt, Homo sapiens
caggacagcucugauggaa

SEQ ID NO: 736809 - RNA, 19 nt, Homo sapiens
guacagagggcuggugauu

SEQ ID NO: 736810 - RNA, 19 nt, Homo sapiens
caauguggccugcauccua

SEQ ID NO: 736811 - RNA, 19 nt, Homo sapiens
ugaagaacauugagugcau

SEQ ID NO: 736812 - RNA, 19 nt, Homo sapiens
ccacauugccuguccucua

SEQ ID NO: 736813 - RNA, 19 nt, Homo sapiens
ucaaucucaucaacuacua

SEQ ID NO: 736814 - RNA, 19 nt, Homo sapiens
ggacguaagaacaagaguu

SEQ ID NO: 736815 - RNA, 19 nt, Homo sapiens
ggugggugcuggcugcaaa

SEQ ID NO: 736816 - RNA, 19 nt, Homo sapiens
gaaccaggacaacgaagau

SEQ ID NO: 736817 - RNA, 19 nt, Homo sapiens
aauguggccugcauccuaa

SEQ ID NO: 736818 - RNA, 19 nt, Homo sapiens
cacagacccuuuccucuuc

SEQ ID NO: 736819 - RNA, 19 nt, Homo sapiens
ucccagaaccugugucuuu

SEQ ID NO: 736820 - RNA, 19 nt, Homo sapiens
ucaacaaacgucuggauga

SEQ ID NO: 736821 - RNA, 19 nt, Homo sapiens
guaagaacaagaguuauuc

SEQ ID NO: 736822 - RNA, 19 nt, Homo sapiens
cguaagaacaagaguuauu

SEQ ID NO: 736823 - RNA, 19 nt, Homo sapiens
gaacauugagugcauugag

SEQ ID NO: 736824 - RNA, 19 nt, Homo sapiens
cccaaggacuggagcaaga

SEQ ID NO: 736825 - RNA, 19 nt, Homo sapiens
ggcaccaucuccuucuuug

SEQ ID NO: 736826 - RNA, 19 nt, Homo sapiens
cgaauuguuugggcacuga

SEQ ID NO: 736827 - RNA, 19 nt, Homo sapiens
gcuucaaccugcccaagga

SEQ ID NO: 736828 - RNA, 19 nt, Homo sapiens
gagggcuggugauuguaaa

SEQ ID NO: 736829 - RNA, 19 nt, Homo sapiens
ucaccagcaucaagaagga

SEQ ID NO: 736830 - RNA, 19 nt, Homo sapiens
ggaaccaggacaacgaaga

SEQ ID NO: 736831 - RNA, 19 nt, Homo sapiens
aaauuucuggcuucucuua

SEQ ID NO: 736832 - RNA, 19 nt, Homo sapiens
acacagacccuuuccucuu

SEQ ID NO: 736833 - RNA, 19 nt, Homo sapiens
augaaugggugacgcauga

SEQ ID NO: 736834 - RNA, 19 nt, Homo sapiens
ccacugcagcucccacaaa

SEQ ID NO: 736835 - RNA, 19 nt, Homo sapiens
caagaguuauucccagaac

SEQ ID NO: 736836 - RNA, 19 nt, Homo sapiens
guaccucaaucucaucaac

SEQ ID NO: 736837 - RNA, 19 nt, Homo sapiens
aguguuuccuugaccauaa

SEQ ID NO: 736838 - RNA, 19 nt, Homo sapiens
gagauugauggacguaaga

SEQ ID NO: 736839 - RNA, 19 nt, Homo sapiens
ugaucgaguucagcuauga

SEQ ID NO: 736840 - RNA, 19 nt, Homo sapiens
gaaagaaucaacggaagac

SEQ ID NO: 736841 - RNA, 19 nt, Homo sapiens
cacauugccuguccucuac

SEQ ID NO: 736842 - RNA, 19 nt, Homo sapiens
gaagguggaggugguuuca

SEQ ID NO: 736843 - RNA, 19 nt, Homo sapiens
gaucaccaucaaugagauu

SEQ ID NO: 736844 - RNA, 19 nt, Homo sapiens
cagaucaccaucaaugaga

SEQ ID NO: 736845 - RNA, 19 nt, Homo sapiens
gggcaccaucuccuucuuu

SEQ ID NO: 736846 - RNA, 19 nt, Homo sapiens
caaccaccgcucaacgaaa

SEQ ID NO: 736847 - RNA, 19 nt, Homo sapiens
ugaaaucaccagcaucaag

SEQ ID NO: 736848 - RNA, 19 nt, Homo sapiens
aagaaucaacggaagacua

SEQ ID NO: 736849 - RNA, 19 nt, Homo sapiens
ugagauugauggacguaag

SEQ ID NO: 736850 - RNA, 19 nt, Homo sapiens
ccacuggcugugcacguua

SEQ ID NO: 736851 - RNA, 19 nt, Homo sapiens
ggcuggaccuaaagaagau

SEQ ID NO: 736852 - RNA, 19 nt, Homo sapiens
gggcucagaccaacuccaa

SEQ ID NO: 736853 - RNA, 19 nt, Homo sapiens
gccaguacauccucacacu

SEQ ID NO: 736854 - RNA, 19 nt, Homo sapiens
ggccuccuauccuaucgaa

SEQ ID NO: 736855 - RNA, 19 nt, Homo sapiens
gccguagucucaagugucu

SEQ ID NO: 736856 - RNA, 19 nt, Homo sapiens
agaaagaaucaacggaaga

SEQ ID NO: 736857 - RNA, 19 nt, Homo sapiens
guacauccucacacuguca

SEQ ID NO: 736858 - RNA, 19 nt, Homo sapiens
gcgggaagaccuugccaau

SEQ ID NO: 736859 - RNA, 19 nt, Homo sapiens
ggagccaggcagcugugua

SEQ ID NO: 736860 - RNA, 19 nt, Homo sapiens
gcaccaucuccuucuuuga

SEQ ID NO: 736861 - RNA, 19 nt, Homo sapiens
cggcuggaccuaaagaaga

SEQ ID NO: 736862 - RNA, 19 nt, Homo sapiens
ucacccggaugaagaacau

SEQ ID NO: 736863 - RNA, 19 nt, Homo sapiens
ggaagguggaggugguuuc

SEQ ID NO: 736864 - RNA, 19 nt, Homo sapiens
caccaucaaugagauuagu

SEQ ID NO: 736865 - RNA, 19 nt, Homo sapiens
ccacaggaacucaccacau

SEQ ID NO: 736866 - RNA, 19 nt, Homo sapiens
guuaugggguuuccaccua

SEQ ID NO: 736867 - RNA, 19 nt, Homo sapiens
gagcggcuggaccuaaaga

SEQ ID NO: 736868 - RNA, 19 nt, Homo sapiens
ccaaccaccgcucaacgaa

SEQ ID NO: 736869 - RNA, 19 nt, Homo sapiens
gagccaggcagcuguguac

SEQ ID NO: 736870 - RNA, 19 nt, Homo sapiens
accucaaucucaucaacua

SEQ ID NO: 736871 - RNA, 19 nt, Homo sapiens
ccaucaaugagauuaguga

SEQ ID NO: 736872 - RNA, 19 nt, Homo sapiens
guaagggcuuccacaucgu

SEQ ID NO: 736873 - RNA, 19 nt, Homo sapiens
ccauaagacacuguacuau

SEQ ID NO: 736874 - RNA, 19 nt, Homo sapiens
cuacguccauuacauugac

SEQ ID NO: 736875 - RNA, 19 nt, Homo sapiens
caugagcggcuggaccuaa

SEQ ID NO: 736876 - RNA, 19 nt, Homo sapiens
ccaaggagaaagaaucaac

SEQ ID NO: 736877 - RNA, 19 nt, Homo sapiens
ucuacgucaugacagagua

SEQ ID NO: 736878 - RNA, 19 nt, Homo sapiens
cuccaggcaaugagauuua

SEQ ID NO: 736879 - RNA, 19 nt, Homo sapiens
agagggcuggugauuguaa

SEQ ID NO: 736880 - RNA, 19 nt, Homo sapiens
cacugcagcucccacaaag

SEQ ID NO: 736881 - RNA, 19 nt, Homo sapiens
cacagaucaccaucaauga

SEQ ID NO: 736882 - RNA, 19 nt, Homo sapiens
ugucuucagcgucauuuga

SEQ ID NO: 736883 - RNA, 19 nt, Homo sapiens
ugcaguaccucaaucucau

SEQ ID NO: 736884 - RNA, 19 nt, Homo sapiens
augagcggcuggaccuaaa

SEQ ID NO: 736885 - RNA, 19 nt, Homo sapiens
gcggaaccaggacaacgaa

SEQ ID NO: 736886 - RNA, 19 nt, Homo sapiens
accauaagacacuguacua

SEQ ID NO: 736887 - RNA, 19 nt, Homo sapiens
gagcgugaaggacaucagu

SEQ ID NO: 736888 - RNA, 19 nt, Homo sapiens
gcgaaaaucgaauuguuug

SEQ ID NO: 736889 - RNA, 19 nt, Homo sapiens
aagcgaaaaucgaauuguu

SEQ ID NO: 736890 - RNA, 19 nt, Homo sapiens
aaccaccgcucaacgaaac

SEQ ID NO: 736891 - RNA, 19 nt, Homo sapiens
gaucacacuccgcuucaac

SEQ ID NO: 736892 - RNA, 19 nt, Homo sapiens
guacuuugcuccauuguua

SEQ ID NO: 736893 - RNA, 19 nt, Homo sapiens
gaagaacgacgaacuauaa

SEQ ID NO: 736894 - RNA, 19 nt, Homo sapiens
gaaauugucuugaauaagg

SEQ ID NO: 736895 - RNA, 19 nt, Homo sapiens
gagcagaaccugaacagaa

SEQ ID NO: 736896 - RNA, 19 nt, Homo sapiens
ggaaguaaaucuggaagga

SEQ ID NO: 736897 - RNA, 19 nt, Homo sapiens
ggacagaagcggccuuuga

SEQ ID NO: 736898 - RNA, 19 nt, Homo sapiens
gaaggauucucacucguau

SEQ ID NO: 736899 - RNA, 19 nt, Homo sapiens
caaaagacauugaagcuaa

SEQ ID NO: 736900 - RNA, 19 nt, Homo sapiens
gaagguggccauugucaaa

SEQ ID NO: 736901 - RNA, 19 nt, Homo sapiens
gauaaucuccucaaccauu

SEQ ID NO: 736902 - RNA, 19 nt, Homo sapiens
ggaguugugugcagacuug

SEQ ID NO: 736903 - RNA, 19 nt, Homo sapiens
cagcaagcauggcgauuaa

SEQ ID NO: 736904 - RNA, 19 nt, Homo sapiens
ggacagcgcagaagaggaa

SEQ ID NO: 736905 - RNA, 19 nt, Homo sapiens
gggcaugguucucaauuau

SEQ ID NO: 736906 - RNA, 19 nt, Homo sapiens
ccaccuggcuggaggauga

SEQ ID NO: 736907 - RNA, 19 nt, Homo sapiens
gcagaaacuucaggacuug

SEQ ID NO: 736908 - RNA, 19 nt, Homo sapiens
ggaaggauucucacucgua

SEQ ID NO: 736909 - RNA, 19 nt, Homo sapiens
ggaaucuacucucaccaaa

SEQ ID NO: 736910 - RNA, 19 nt, Homo sapiens
gcaugguucucaauuauuc

SEQ ID NO: 736911 - RNA, 19 nt, Homo sapiens
caaaggcuacgcuacguua

SEQ ID NO: 736912 - RNA, 19 nt, Homo sapiens
ccacagugauguugaagga

SEQ ID NO: 736913 - RNA, 19 nt, Homo sapiens
uaacaccacugcccagaau

SEQ ID NO: 736914 - RNA, 19 nt, Homo sapiens
gcagcaagcauggcgauua

SEQ ID NO: 736915 - RNA, 19 nt, Homo sapiens
gaaaugagucuggaugaga

SEQ ID NO: 736916 - RNA, 19 nt, Homo sapiens
uaaggaaucucggaggaaa

SEQ ID NO: 736917 - RNA, 19 nt, Homo sapiens
gaugacaacguuagagaaa

SEQ ID NO: 736918 - RNA, 19 nt, Homo sapiens
caaaggaugugcgggagaa

SEQ ID NO: 736919 - RNA, 19 nt, Homo sapiens
gagagaccauggugugaau

SEQ ID NO: 736920 - RNA, 19 nt, Homo sapiens
caucaaggcucacuucaac

SEQ ID NO: 736921 - RNA, 19 nt, Homo sapiens
caagaaguauccugacuac

SEQ ID NO: 736922 - RNA, 19 nt, Homo sapiens
gaagaugcagagcccauuu

SEQ ID NO: 736923 - RNA, 19 nt, Homo sapiens
guauuuggcucccagaauc

SEQ ID NO: 736924 - RNA, 19 nt, Homo sapiens
acacugagccuuuggaguu

SEQ ID NO: 736925 - RNA, 19 nt, Homo sapiens
ccauggaaauugucuugaa

SEQ ID NO: 736926 - RNA, 19 nt, Homo sapiens
gaacagaaagaacaaucga

SEQ ID NO: 736927 - RNA, 19 nt, Homo sapiens
gugccuaucugugcucuuu

SEQ ID NO: 736928 - RNA, 19 nt, Homo sapiens
uggaagcguucauauuuga

SEQ ID NO: 736929 - RNA, 19 nt, Homo sapiens
aaacuuggcaacaccauuu

SEQ ID NO: 736930 - RNA, 19 nt, Homo sapiens
gacagaagcggccuuugaa

SEQ ID NO: 736931 - RNA, 19 nt, Homo sapiens
caauuauucucguucucua

SEQ ID NO: 736932 - RNA, 19 nt, Homo sapiens
gcaagcauggcgauuaaga

SEQ ID NO: 736933 - RNA, 19 nt, Homo sapiens
cgugcaagcucugucauaa

SEQ ID NO: 736934 - RNA, 19 nt, Homo sapiens
ccaugaagguggccauugu

SEQ ID NO: 736935 - RNA, 19 nt, Homo sapiens
gaggcagacugugcacuuu

SEQ ID NO: 736936 - RNA, 19 nt, Homo sapiens
uggcagagaugggaccuaa

SEQ ID NO: 736937 - RNA, 19 nt, Homo sapiens
ugacaacguuagagaaagu

SEQ ID NO: 736938 - RNA, 19 nt, Homo sapiens
gagaaaaggccacagaaaa

SEQ ID NO: 736939 - RNA, 19 nt, Homo sapiens
gcccuacccucaacgcaaa

SEQ ID NO: 736940 - RNA, 19 nt, Homo sapiens
gcagaccuguuggcacuga

SEQ ID NO: 736941 - RNA, 19 nt, Homo sapiens
ugacucguguggaauuuga

SEQ ID NO: 736942 - RNA, 19 nt, Homo sapiens
gagccucaguuaccagguu

SEQ ID NO: 736943 - RNA, 19 nt, Homo sapiens
ccuguucccuacccauaua

SEQ ID NO: 736944 - RNA, 19 nt, Homo sapiens
ugaagaacgacgaacuaua

SEQ ID NO: 736945 - RNA, 19 nt, Homo sapiens
gagaugacaacguuagaga

SEQ ID NO: 736946 - RNA, 19 nt, Homo sapiens
cuuggaagcguucauauuu

SEQ ID NO: 736947 - RNA, 19 nt, Homo sapiens
uugaaggccugauggauga

SEQ ID NO: 736948 - RNA, 19 nt, Homo sapiens
ugcaguaccucugugguua

SEQ ID NO: 736949 - RNA, 19 nt, Homo sapiens
ccaccacuucuauuuauuu

SEQ ID NO: 736950 - RNA, 19 nt, Homo sapiens
agcagaaccugaacagaaa

SEQ ID NO: 736951 - RNA, 19 nt, Homo sapiens
ccaccacagugauguugaa

SEQ ID NO: 736952 - RNA, 19 nt, Homo sapiens
gcucuuggcagaccuguug

SEQ ID NO: 736953 - RNA, 19 nt, Homo sapiens
gaucgugacccugaaagaa

SEQ ID NO: 736954 - RNA, 19 nt, Homo sapiens
ucguauggcuggccucaaa

SEQ ID NO: 736955 - RNA, 19 nt, Homo sapiens
ucaauaaggccaaguuuac

SEQ ID NO: 736956 - RNA, 19 nt, Homo sapiens
cauggaaauugucuugaau

SEQ ID NO: 736957 - RNA, 19 nt, Homo sapiens
ugccaacgcugaccacaug

SEQ ID NO: 736958 - RNA, 19 nt, Homo sapiens
ccucagcuauggugucuuc

SEQ ID NO: 736959 - RNA, 19 nt, Homo sapiens
ugggcaugguucucaauua

SEQ ID NO: 736960 - RNA, 19 nt, Homo sapiens
gcucgcagcugcaguucuc

SEQ ID NO: 736961 - RNA, 19 nt, Homo sapiens
ugcaagcucugucauaauc

SEQ ID NO: 736962 - RNA, 19 nt, Homo sapiens
gcaguaccucugugguuaa

SEQ ID NO: 736963 - RNA, 19 nt, Homo sapiens
cagaagcggccuuugaaga

SEQ ID NO: 736964 - RNA, 19 nt, Homo sapiens
caaggagaaugguacugau

SEQ ID NO: 736965 - RNA, 19 nt, Homo sapiens
agaaguauccugacuacga

SEQ ID NO: 736966 - RNA, 19 nt, Homo sapiens
ugaccacagugaagcuaaa

SEQ ID NO: 736967 - RNA, 19 nt, Homo sapiens
ggagugcccauggaaauug

SEQ ID NO: 736968 - RNA, 19 nt, Homo sapiens
ccacauggcacagauugaa

SEQ ID NO: 736969 - RNA, 19 nt, Homo sapiens
cagagcagcccaucaagga

SEQ ID NO: 736970 - RNA, 19 nt, Homo sapiens
ggagagaccauggugugaa

SEQ ID NO: 736971 - RNA, 19 nt, Homo sapiens
gugagucccuaucccaaga

SEQ ID NO: 736972 - RNA, 19 nt, Homo sapiens
agaagcggccuuugaagaa

SEQ ID NO: 736973 - RNA, 19 nt, Homo sapiens
caggagacacugagccuuu

SEQ ID NO: 736974 - RNA, 19 nt, Homo sapiens
ucacugagguggagaugac

SEQ ID NO: 736975 - RNA, 19 nt, Homo sapiens
ggagaaugguacugauacu

SEQ ID NO: 736976 - RNA, 19 nt, Homo sapiens
ccaaggagaaugguacuga

SEQ ID NO: 736977 - RNA, 19 nt, Homo sapiens
ucaagaaguauccugacua

SEQ ID NO: 736978 - RNA, 19 nt, Homo sapiens
gcagugaguccaugaaggu

SEQ ID NO: 736979 - RNA, 19 nt, Homo sapiens
ccacugcccucagcuaugg

SEQ ID NO: 736980 - RNA, 19 nt, Homo sapiens
ucaaagugcugcagcucau

SEQ ID NO: 736981 - RNA, 19 nt, Homo sapiens
gaugcugguuggacagguu

SEQ ID NO: 736982 - RNA, 19 nt, Homo sapiens
cauugaagcuaagaugaug

SEQ ID NO: 736983 - RNA, 19 nt, Homo sapiens
ucgauaaucuccucaacca

SEQ ID NO: 736984 - RNA, 19 nt, Homo sapiens
ggguggagcugguuguucu

SEQ ID NO: 736985 - RNA, 19 nt, Homo sapiens
gcccagaaaccaagugaga

SEQ ID NO: 736986 - RNA, 19 nt, Homo sapiens
caauaaacggguacucuuc

SEQ ID NO: 736987 - RNA, 19 nt, Homo sapiens
aaaugagucuggaugagau

SEQ ID NO: 736988 - RNA, 19 nt, Homo sapiens
cacugagccuuuggaguua

SEQ ID NO: 736989 - RNA, 19 nt, Homo sapiens
uagaggagcgcaagaagug

SEQ ID NO: 736990 - RNA, 19 nt, Homo sapiens
gaagcguucauauuugaga

SEQ ID NO: 736991 - RNA, 19 nt, Homo sapiens
gguggagucuguauuugag

SEQ ID NO: 736992 - RNA, 19 nt, Homo sapiens
gcaaaguucuucaaaguga

SEQ ID NO: 736993 - RNA, 19 nt, Homo sapiens
gcagaaacauguaauugaa

SEQ ID NO: 736994 - RNA, 19 nt, Homo sapiens
gcaaugcagucaaauaaug

SEQ ID NO: 736995 - RNA, 19 nt, Homo sapiens
gcgaauacgugauaacauu

SEQ ID NO: 736996 - RNA, 19 nt, Homo sapiens
gaagaaguauuggaagaaa

SEQ ID NO: 736997 - RNA, 19 nt, Homo sapiens
gcucuucagucuuuaauuu

SEQ ID NO: 736998 - RNA, 19 nt, Homo sapiens
agagaaagcugauauggaa

SEQ ID NO: 736999 - RNA, 19 nt, Homo sapiens
gaaaagagguguugccaaa

SEQ ID NO: 737000 - RNA, 19 nt, Homo sapiens
gaagauguguauaauagga

SEQ ID NO: 737001 - RNA, 19 nt, Homo sapiens
ugacugggaugaagaagua

SEQ ID NO: 737002 - RNA, 19 nt, Homo sapiens
gaagaagaguuuauucaag

SEQ ID NO: 737003 - RNA, 19 nt, Homo sapiens
gaagcaauauuuccauuca

SEQ ID NO: 737004 - RNA, 19 nt, Homo sapiens
gcaagaagauccauaugag

SEQ ID NO: 737005 - RNA, 19 nt, Homo sapiens
caacauggauggagaucuu

SEQ ID NO: 737006 - RNA, 19 nt, Homo sapiens
ugaagaaguugaagacaaa

SEQ ID NO: 737007 - RNA, 19 nt, Homo sapiens
gauacaagcuaaggaauau

SEQ ID NO: 737008 - RNA, 19 nt, Homo sapiens
acacuuggcugagauauuu

SEQ ID NO: 737009 - RNA, 19 nt, Homo sapiens
gaagauccauaugaguaua

SEQ ID NO: 737010 - RNA, 19 nt, Homo sapiens
gaagaggagacaaauguaa

SEQ ID NO: 737011 - RNA, 19 nt, Homo sapiens
gaugauaugugaauacagu

SEQ ID NO: 737012 - RNA, 19 nt, Homo sapiens
acaauaguguggaugaaua

SEQ ID NO: 737013 - RNA, 19 nt, Homo sapiens
aagaaaugccguugaauua

SEQ ID NO: 737014 - RNA, 19 nt, Homo sapiens
gaacugguaugguggaagu

SEQ ID NO: 737015 - RNA, 19 nt, Homo sapiens
gaacuguugcacauuguua

SEQ ID NO: 737016 - RNA, 19 nt, Homo sapiens
gagaagcaauauuuccauu

SEQ ID NO: 737017 - RNA, 19 nt, Homo sapiens
gaacaucagcugaccaaau

SEQ ID NO: 737018 - RNA, 19 nt, Homo sapiens
gagaucuuccgaacuauua

SEQ ID NO: 737019 - RNA, 19 nt, Homo sapiens
ggauugcuuugaauacuuu

SEQ ID NO: 737020 - RNA, 19 nt, Homo sapiens
ugaauacagucaagaggua

SEQ ID NO: 737021 - RNA, 19 nt, Homo sapiens
ccacaugugaggccuauua

SEQ ID NO: 737022 - RNA, 19 nt, Homo sapiens
ugacagacccgaacuuuga

SEQ ID NO: 737023 - RNA, 19 nt, Homo sapiens
gaagagcuguggcaagaag

SEQ ID NO: 737024 - RNA, 19 nt, Homo sapiens
uaagaaagcagaagagaga

SEQ ID NO: 737025 - RNA, 19 nt, Homo sapiens
gaggagauuucaagugaug

SEQ ID NO: 737026 - RNA, 19 nt, Homo sapiens
cggaagauguguauaauag

SEQ ID NO: 737027 - RNA, 19 nt, Homo sapiens
agaagaagauugaacaaca

SEQ ID NO: 737028 - RNA, 19 nt, Homo sapiens
agagaugccugucaaaguu

SEQ ID NO: 737029 - RNA, 19 nt, Homo sapiens
uaagaaaugccguugaauu

SEQ ID NO: 737030 - RNA, 19 nt, Homo sapiens
guacuccacuugaccuuga

SEQ ID NO: 737031 - RNA, 19 nt, Homo sapiens
gcauuuaguucuuugaagu

SEQ ID NO: 737032 - RNA, 19 nt, Homo sapiens
gauugaagauaaagagaug

SEQ ID NO: 737033 - RNA, 19 nt, Homo sapiens
gcagaugaagccacacaua

SEQ ID NO: 737034 - RNA, 19 nt, Homo sapiens
gcagucaaauaauggaaga

SEQ ID NO: 737035 - RNA, 19 nt, Homo sapiens
gaagaagauugaacaacag

SEQ ID NO: 737036 - RNA, 19 nt, Homo sapiens
gaauucaguugccucacaa

SEQ ID NO: 737037 - RNA, 19 nt, Homo sapiens
uuacuaaugucauccagaa

SEQ ID NO: 737038 - RNA, 19 nt, Homo sapiens
agaagagccugauugaaga

SEQ ID NO: 737039 - RNA, 19 nt, Homo sapiens
gaaaugccguugaauuagc

SEQ ID NO: 737040 - RNA, 19 nt, Homo sapiens
cauaaugagcucaaucuaa

SEQ ID NO: 737041 - RNA, 19 nt, Homo sapiens
caaagaagaagauugaaca

SEQ ID NO: 737042 - RNA, 19 nt, Homo sapiens
caagcaaugcagucaaaua

SEQ ID NO: 737043 - RNA, 19 nt, Homo sapiens
gaccggaagauguguauaa

SEQ ID NO: 737044 - RNA, 19 nt, Homo sapiens
gugaauaaccaaaccauga

SEQ ID NO: 737045 - RNA, 19 nt, Homo sapiens
caaccaguccuacaagauu

SEQ ID NO: 737046 - RNA, 19 nt, Homo sapiens
cacaagcucugauaacugu

SEQ ID NO: 737047 - RNA, 19 nt, Homo sapiens
gaaagcugauauggaagaa

SEQ ID NO: 737048 - RNA, 19 nt, Homo sapiens
aaaucgaccuccugcagua

SEQ ID NO: 737049 - RNA, 19 nt, Homo sapiens
cgaagaagagccugauuga

SEQ ID NO: 737050 - RNA, 19 nt, Homo sapiens
ucuaagaaaugccguugaa

SEQ ID NO: 737051 - RNA, 19 nt, Homo sapiens
ccacuugaccuugacaaua

SEQ ID NO: 737052 - RNA, 19 nt, Homo sapiens
gcaggucugugcuacuaga

SEQ ID NO: 737053 - RNA, 19 nt, Homo sapiens
uccagaagaugauauguga

SEQ ID NO: 737054 - RNA, 19 nt, Homo sapiens
gagccugauugaagauaaa

SEQ ID NO: 737055 - RNA, 19 nt, Homo sapiens
auaaugagcucaaucuaag

SEQ ID NO: 737056 - RNA, 19 nt, Homo sapiens
aaauggagcuguuucuaca

SEQ ID NO: 737057 - RNA, 19 nt, Homo sapiens
gcacauugaugaggaugau

SEQ ID NO: 737058 - RNA, 19 nt, Homo sapiens
ugaagaacauggugacaca

SEQ ID NO: 737059 - RNA, 19 nt, Homo sapiens
ccauuuaccugaagaacau

SEQ ID NO: 737060 - RNA, 19 nt, Homo sapiens
gaugaaugauacagauugu

SEQ ID NO: 737061 - RNA, 19 nt, Homo sapiens
caggaacuguugcacauug

SEQ ID NO: 737062 - RNA, 19 nt, Homo sapiens
aagaagauccauaugagua

SEQ ID NO: 737063 - RNA, 19 nt, Homo sapiens
uauuguagcucggcucuuu

SEQ ID NO: 737064 - RNA, 19 nt, Homo sapiens
auaauucggucuccagauu

SEQ ID NO: 737065 - RNA, 19 nt, Homo sapiens
agaacauggugacacaaua

SEQ ID NO: 737066 - RNA, 19 nt, Homo sapiens
aacaucagcugaccaaaug

SEQ ID NO: 737067 - RNA, 19 nt, Homo sapiens
cagggaggcuucaccuuug

SEQ ID NO: 737068 - RNA, 19 nt, Homo sapiens
gacccgaaguugcggauug

SEQ ID NO: 737069 - RNA, 19 nt, Homo sapiens
gcacauuguuagagagaca

SEQ ID NO: 737070 - RNA, 19 nt, Homo sapiens
auaaagagaugccugucaa

SEQ ID NO: 737071 - RNA, 19 nt, Homo sapiens
gcccagacucucuuauaua

SEQ ID NO: 737072 - RNA, 19 nt, Homo sapiens
gagaaccucuuauaauagc

SEQ ID NO: 737073 - RNA, 19 nt, Homo sapiens
uaacauuguggaaggaaua

SEQ ID NO: 737074 - RNA, 19 nt, Homo sapiens
ggaugaagaaguauuggaa

SEQ ID NO: 737075 - RNA, 19 nt, Homo sapiens
ucacaacccuggaccuauc

SEQ ID NO: 737076 - RNA, 19 nt, Homo sapiens
agauacagauaccuuacua

SEQ ID NO: 737077 - RNA, 19 nt, Homo sapiens
uaacaguuguagaagauca

SEQ ID NO: 737078 - RNA, 19 nt, Homo sapiens
uggcaaaguucuucaaagu

SEQ ID NO: 737079 - RNA, 19 nt, Homo sapiens
uuuaugcacuuguucagua

SEQ ID NO: 737080 - RNA, 19 nt, Homo sapiens
aagcaaugcagucaaauaa

SEQ ID NO: 737081 - RNA, 19 nt, Homo sapiens
aaccaguccuacaagauua

SEQ ID NO: 737082 - RNA, 19 nt, Homo sapiens
cuacauacuuuagaacgaa

SEQ ID NO: 737083 - RNA, 19 nt, Homo sapiens
guacuacaacccugauuug

SEQ ID NO: 737084 - RNA, 19 nt, Homo sapiens
ggcaagaagauccauauga

SEQ ID NO: 737085 - RNA, 19 nt, Homo sapiens
gaaagcagaagagagagaa

SEQ ID NO: 737086 - RNA, 19 nt, Homo sapiens
ggaagaaaaugaggagauu

SEQ ID NO: 737087 - RNA, 19 nt, Homo sapiens
gaacauggugacacaauac

SEQ ID NO: 737088 - RNA, 19 nt, Homo sapiens
gagaagaugcagaguguca

SEQ ID NO: 737089 - RNA, 19 nt, Homo sapiens
uguagaagaucauaaagag

SEQ ID NO: 737090 - RNA, 19 nt, Homo sapiens
gaagaagagccugauugaa

SEQ ID NO: 737091 - RNA, 19 nt, Homo sapiens
guuaucaaauccugacaga

SEQ ID NO: 737092 - RNA, 19 nt, Homo sapiens
gaagaugucugauugauga

SEQ ID NO: 737093 - RNA, 19 nt, Homo sapiens
gaacagggauguaccuaau

SEQ ID NO: 737094 - RNA, 19 nt, Homo sapiens
gcacacaagucucugaauu

SEQ ID NO: 737095 - RNA, 19 nt, Homo sapiens
ggaagaagaugaugcugaa

SEQ ID NO: 737096 - RNA, 19 nt, Homo sapiens
gcaagaauauuuggagauu

SEQ ID NO: 737097 - RNA, 19 nt, Homo sapiens
aaucuucgcuucccuaaua

SEQ ID NO: 737098 - RNA, 19 nt, Homo sapiens
gaagugggccuuacauauu

SEQ ID NO: 737099 - RNA, 19 nt, Homo sapiens
ggaagcagccuuagaaaga

SEQ ID NO: 737100 - RNA, 19 nt, Homo sapiens
gaagaucgccauuguauuc

SEQ ID NO: 737101 - RNA, 19 nt, Homo sapiens
caagagagguuaagacaag

SEQ ID NO: 737102 - RNA, 19 nt, Homo sapiens
acaagaagaugucugauug

SEQ ID NO: 737103 - RNA, 19 nt, Homo sapiens
gcauaugauuggcucuuua

SEQ ID NO: 737104 - RNA, 19 nt, Homo sapiens
caacaagugucuccacaga

SEQ ID NO: 737105 - RNA, 19 nt, Homo sapiens
caacagaaccugacagaau

SEQ ID NO: 737106 - RNA, 19 nt, Homo sapiens
gcaagaagacccuuacgaa

SEQ ID NO: 737107 - RNA, 19 nt, Homo sapiens
gaagauaacccuguugaug

SEQ ID NO: 737108 - RNA, 19 nt, Homo sapiens
agaagacccuuacgaauau

SEQ ID NO: 737109 - RNA, 19 nt, Homo sapiens
gaauacauguugcagaauc

SEQ ID NO: 737110 - RNA, 19 nt, Homo sapiens
ggaaagagguacugcaaaa

SEQ ID NO: 737111 - RNA, 19 nt, Homo sapiens
ggauguaccuaaugaaaca

SEQ ID NO: 737112 - RNA, 19 nt, Homo sapiens
caaauucagugcuccaguu

SEQ ID NO: 737113 - RNA, 19 nt, Homo sapiens
caauugcagcuuuguauua

SEQ ID NO: 737114 - RNA, 19 nt, Homo sapiens
gcuggguacuucacuauuu

SEQ ID NO: 737115 - RNA, 19 nt, Homo sapiens
aagaagacccuuacgaaua

SEQ ID NO: 737116 - RNA, 19 nt, Homo sapiens
gaaccugacagaauggaua

SEQ ID NO: 737117 - RNA, 19 nt, Homo sapiens
gaucuucuaugcucuuguu

SEQ ID NO: 737118 - RNA, 19 nt, Homo sapiens
uagaaagacugacaagaga

SEQ ID NO: 737119 - RNA, 19 nt, Homo sapiens
ucaaacagccuuagagcua

SEQ ID NO: 737120 - RNA, 19 nt, Homo sapiens
ugaguuaucucuuucuuuc

SEQ ID NO: 737121 - RNA, 19 nt, Homo sapiens
gaacagauaccccaaguuu

SEQ ID NO: 737122 - RNA, 19 nt, Homo sapiens
gaagaagaucgccauugua

SEQ ID NO: 737123 - RNA, 19 nt, Homo sapiens
gaauugaguuaucucuuuc

SEQ ID NO: 737124 - RNA, 19 nt, Homo sapiens
gugaagaaguuacuccuau

SEQ ID NO: 737125 - RNA, 19 nt, Homo sapiens
gaagauuucauuucuccua

SEQ ID NO: 737126 - RNA, 19 nt, Homo sapiens
gaaguuugauguguuugaa

SEQ ID NO: 737127 - RNA, 19 nt, Homo sapiens
ggguacagcuuacuacaug

SEQ ID NO: 737128 - RNA, 19 nt, Homo sapiens
gcaugaaguuugauguguu

SEQ ID NO: 737129 - RNA, 19 nt, Homo sapiens
gaauucuucuuugccuuua

SEQ ID NO: 737130 - RNA, 19 nt, Homo sapiens
gaagaaguuacuccuauug

SEQ ID NO: 737131 - RNA, 19 nt, Homo sapiens
agaagaagaucgccauugu

SEQ ID NO: 737132 - RNA, 19 nt, Homo sapiens
gaaaguggaagcugccauu

SEQ ID NO: 737133 - RNA, 19 nt, Homo sapiens
gcaaagggcguggcauuga

SEQ ID NO: 737134 - RNA, 19 nt, Homo sapiens
caacacugcuccagauuac

SEQ ID NO: 737135 - RNA, 19 nt, Homo sapiens
caugaaguuugauguguuu

SEQ ID NO: 737136 - RNA, 19 nt, Homo sapiens
gaauauauacgcaugaagu

SEQ ID NO: 737137 - RNA, 19 nt, Homo sapiens
ucuaugcucuuguucagua

SEQ ID NO: 737138 - RNA, 19 nt, Homo sapiens
gaagacccuuacgaauaua

SEQ ID NO: 737139 - RNA, 19 nt, Homo sapiens
gaacugauaaaccaacaga

SEQ ID NO: 737140 - RNA, 19 nt, Homo sapiens
ggagcggaguccauuggua

SEQ ID NO: 737141 - RNA, 19 nt, Homo sapiens
uagcaacucuggcugauca

SEQ ID NO: 737142 - RNA, 19 nt, Homo sapiens
ugaagaaguuacuccuauu

SEQ ID NO: 737143 - RNA, 19 nt, Homo sapiens
gagaaaugccugugaaagu

SEQ ID NO: 737144 - RNA, 19 nt, Homo sapiens
gaucagaaccuucaaacag

SEQ ID NO: 737145 - RNA, 19 nt, Homo sapiens
guaagauccugacucugaa

SEQ ID NO: 737146 - RNA, 19 nt, Homo sapiens
aaaguaagauccugacucu

SEQ ID NO: 737147 - RNA, 19 nt, Homo sapiens
gaugggaccugaucaugca

SEQ ID NO: 737148 - RNA, 19 nt, Homo sapiens
gaagaugggcaagaauauu

SEQ ID NO: 737149 - RNA, 19 nt, Homo sapiens
ugaugaagcugaagaugau

SEQ ID NO: 737150 - RNA, 19 nt, Homo sapiens
gaaugacagugaugaugau

SEQ ID NO: 737151 - RNA, 19 nt, Homo sapiens
cacaguggcuuaaugaugu

SEQ ID NO: 737152 - RNA, 19 nt, Homo sapiens
caagauggcuuugauuacu

SEQ ID NO: 737153 - RNA, 19 nt, Homo sapiens
uggaauacauguugcagaa

SEQ ID NO: 737154 - RNA, 19 nt, Homo sapiens
gauggagcccugcauauga

SEQ ID NO: 737155 - RNA, 19 nt, Homo sapiens
ggaauucuucuuugccuuu

SEQ ID NO: 737156 - RNA, 19 nt, Homo sapiens
uaagcaggcuggugaagau

SEQ ID NO: 737157 - RNA, 19 nt, Homo sapiens
ccacaccuacuacucaaua

SEQ ID NO: 737158 - RNA, 19 nt, Homo sapiens
gcaaaagacuaugggauuu

SEQ ID NO: 737159 - RNA, 19 nt, Homo sapiens
gugccaaguucuuucaauu

SEQ ID NO: 737160 - RNA, 19 nt, Homo sapiens
acaagugucuccacagaug

SEQ ID NO: 737161 - RNA, 19 nt, Homo sapiens
gcucucaccuggaagaauc

SEQ ID NO: 737162 - RNA, 19 nt, Homo sapiens
guauuggccugaucgagaa

SEQ ID NO: 737163 - RNA, 19 nt, Homo sapiens
gcauggaggauacaaauuc

SEQ ID NO: 737164 - RNA, 19 nt, Homo sapiens
ccaaggaguauaaugaauu

SEQ ID NO: 737165 - RNA, 19 nt, Homo sapiens
uagaagccauuauccauuc

SEQ ID NO: 737166 - RNA, 19 nt, Homo sapiens
acaaggagaagcaauauau

SEQ ID NO: 737167 - RNA, 19 nt, Homo sapiens
acagggauguaccuaauga

SEQ ID NO: 737168 - RNA, 19 nt, Homo sapiens
ccauugcccuucaaguauu

SEQ ID NO: 737169 - RNA, 19 nt, Homo sapiens
agaaaugccugugaaagug

SEQ ID NO: 737170 - RNA, 19 nt, Homo sapiens
gauuggcucuuuagcugaa

SEQ ID NO: 737171 - RNA, 19 nt, Homo sapiens
ggcauuauccaagauguua

SEQ ID NO: 737172 - RNA, 19 nt, Homo sapiens
aagugggccuuacauauuu

SEQ ID NO: 737173 - RNA, 19 nt, Homo sapiens
gaagagcagcccaugaauc

SEQ ID NO: 737174 - RNA, 19 nt, Homo sapiens
gcacugacucacggucuua

SEQ ID NO: 737175 - RNA, 19 nt, Homo sapiens
auaaagagauaacccaaca

SEQ ID NO: 737176 - RNA, 19 nt, Homo sapiens
cuauaaagaucagauggaa

SEQ ID NO: 737177 - RNA, 19 nt, Homo sapiens
acaggcagguguuaucuau

SEQ ID NO: 737178 - RNA, 19 nt, Homo sapiens
gaugggagguaccuuagag

SEQ ID NO: 737179 - RNA, 19 nt, Homo sapiens
aagauaacccuguugauga

SEQ ID NO: 737180 - RNA, 19 nt, Homo sapiens
ugaugaagauugggaagaa

SEQ ID NO: 737181 - RNA, 19 nt, Homo sapiens
ugacagugaugaugaugau

SEQ ID NO: 737182 - RNA, 19 nt, Homo sapiens
gcaauugcagcuuuguauu

SEQ ID NO: 737183 - RNA, 19 nt, Homo sapiens
gagaagaugcagaguguca

SEQ ID NO: 737184 - RNA, 19 nt, Homo sapiens
gcagugaacuaggcuacau

SEQ ID NO: 737185 - RNA, 19 nt, Homo sapiens
caagaagacccuuacgaau

SEQ ID NO: 737186 - RNA, 19 nt, Homo sapiens
guagaagccauuauccauu

SEQ ID NO: 737187 - RNA, 19 nt, Homo sapiens
gaaggcuauuccacaauca

SEQ ID NO: 737188 - RNA, 19 nt, Homo sapiens
guuaccagauucuuacaga

SEQ ID NO: 737189 - RNA, 19 nt, Homo sapiens
gugaagagcuuguguuccu

SEQ ID NO: 737190 - RNA, 19 nt, Homo sapiens
gcugugugcuuguagugaa

SEQ ID NO: 737191 - RNA, 19 nt, Homo sapiens
ccagggaugaauugaguua

SEQ ID NO: 737192 - RNA, 19 nt, Homo sapiens
gcaaacaaaugcaguauug

SEQ ID NO: 737193 - RNA, 19 nt, Homo sapiens
gaaagaaucuggaugucau

SEQ ID NO: 737194 - RNA, 19 nt, Homo sapiens
ggaagcggcugcugagauu

SEQ ID NO: 737195 - RNA, 19 nt, Homo sapiens
ggacauaucugccauugac

SEQ ID NO: 737196 - RNA, 19 nt, Homo sapiens
ucaccaaccuggccaagua

SEQ ID NO: 737197 - RNA, 19 nt, Homo sapiens
gagaagaaacgcuuaaaga

SEQ ID NO: 737198 - RNA, 19 nt, Homo sapiens
ggagagauaccacgaaaga

SEQ ID NO: 737199 - RNA, 19 nt, Homo sapiens
gaagaaacgcuuaaagaag

SEQ ID NO: 737200 - RNA, 19 nt, Homo sapiens
cuaggaagcuggagaaaca

SEQ ID NO: 737201 - RNA, 19 nt, Homo sapiens
gccagagccuacacacuua

SEQ ID NO: 737202 - RNA, 19 nt, Homo sapiens
ggagaagcuucgagaacaa

SEQ ID NO: 737203 - RNA, 19 nt, Homo sapiens
ggacaucaauaccuucucu

SEQ ID NO: 737204 - RNA, 19 nt, Homo sapiens
cuaugagacuggagagaua

SEQ ID NO: 737205 - RNA, 19 nt, Homo sapiens
gggagaagcuucgagaaca

SEQ ID NO: 737206 - RNA, 19 nt, Homo sapiens
gccauugacuugauaaaca

SEQ ID NO: 737207 - RNA, 19 nt, Homo sapiens
cgacuguccuucuaugaga

SEQ ID NO: 737208 - RNA, 19 nt, Homo sapiens
uaccugcgcuccaagauga

SEQ ID NO: 737209 - RNA, 19 nt, Homo sapiens
caacgacaaugccacauac

SEQ ID NO: 737210 - RNA, 19 nt, Homo sapiens
agaagaaacgcuuaaagaa

SEQ ID NO: 737211 - RNA, 19 nt, Homo sapiens
gaaucuggaugucaugaag

SEQ ID NO: 737212 - RNA, 19 nt, Homo sapiens
uggaggagcugacaaugga

SEQ ID NO: 737213 - RNA, 19 nt, Homo sapiens
aagcaucccaggaagauua

SEQ ID NO: 737214 - RNA, 19 nt, Homo sapiens
gagcgacuguccuucuaug

SEQ ID NO: 737215 - RNA, 19 nt, Homo sapiens
ggagaaacaggagaagaaa

SEQ ID NO: 737216 - RNA, 19 nt, Homo sapiens
cugcugagauuacuaggaa

SEQ ID NO: 737217 - RNA, 19 nt, Homo sapiens
ccauaaagcaucccaggaa

SEQ ID NO: 737218 - RNA, 19 nt, Homo sapiens
agaggaaauucuccaaaga

SEQ ID NO: 737219 - RNA, 19 nt, Homo sapiens
ugaaggaaguggaggagau

SEQ ID NO: 737220 - RNA, 19 nt, Homo sapiens
gcaccaguauucccaagag

SEQ ID NO: 737221 - RNA, 19 nt, Homo sapiens
ccagucguguggugucuuu

SEQ ID NO: 737222 - RNA, 19 nt, Homo sapiens
ugauaaacaucgagagcuu

SEQ ID NO: 737223 - RNA, 19 nt, Homo sapiens
ccaaggaggaaacaguuaa

SEQ ID NO: 737224 - RNA, 19 nt, Homo sapiens
aaggaggaguugaugagua

SEQ ID NO: 737225 - RNA, 19 nt, Homo sapiens
gagcagcugccaagaacaa

SEQ ID NO: 737226 - RNA, 19 nt, Homo sapiens
ugaaccggguggacaauau

SEQ ID NO: 737227 - RNA, 19 nt, Homo sapiens
cccgauaccuggcaaacaa

SEQ ID NO: 737228 - RNA, 19 nt, Homo sapiens
ucaggagaauggaauggaa

SEQ ID NO: 737229 - RNA, 19 nt, Homo sapiens
ggccaaggcuaaggcuauu

SEQ ID NO: 737230 - RNA, 19 nt, Homo sapiens
gaagaucaucaacgacaau

SEQ ID NO: 737231 - RNA, 19 nt, Homo sapiens
ggaagacccaucuaucucu

SEQ ID NO: 737232 - RNA, 19 nt, Homo sapiens
ggagaagaaacgcuuaaag

SEQ ID NO: 737233 - RNA, 19 nt, Homo sapiens
ccaggaagauuagaaugca

SEQ ID NO: 737234 - RNA, 19 nt, Homo sapiens
acacuuaccugcgcuccaa

SEQ ID NO: 737235 - RNA, 19 nt, Homo sapiens
ggaaaccgaagggaacuga

SEQ ID NO: 737236 - RNA, 19 nt, Homo sapiens
ucaacgacaaugccacaua

SEQ ID NO: 737237 - RNA, 19 nt, Homo sapiens
gugcccguguucccaauaa

SEQ ID NO: 737238 - RNA, 19 nt, Homo sapiens
aagaggaaauucuccaaag

SEQ ID NO: 737239 - RNA, 19 nt, Homo sapiens
uggaccagcuggauaagga

SEQ ID NO: 737240 - RNA, 19 nt, Homo sapiens
cgucugcacuuccacaauc

SEQ ID NO: 737241 - RNA, 19 nt, Homo sapiens
gagauaccacgaaagaauc

SEQ ID NO: 737242 - RNA, 19 nt, Homo sapiens
agagauaccacgaaagaau

SEQ ID NO: 737243 - RNA, 19 nt, Homo sapiens
caaauuccacagcaucguu

SEQ ID NO: 737244 - RNA, 19 nt, Homo sapiens
gaaccggguggacaauaug

SEQ ID NO: 737245 - RNA, 19 nt, Homo sapiens
cuggagagauaccacgaaa

SEQ ID NO: 737246 - RNA, 19 nt, Homo sapiens
aagagcgacuguccuucua

SEQ ID NO: 737247 - RNA, 19 nt, Homo sapiens
ccauugacuugauaaacau

SEQ ID NO: 737248 - RNA, 19 nt, Homo sapiens
ggaacugaaugaggacaag

SEQ ID NO: 737249 - RNA, 19 nt, Homo sapiens
ugaagaucaucaacgacaa

SEQ ID NO: 737250 - RNA, 19 nt, Homo sapiens
gaggaaauucuccaaagag

SEQ ID NO: 737251 - RNA, 19 nt, Homo sapiens
gaaucgauugcuucucuga

SEQ ID NO: 737252 - RNA, 19 nt, Homo sapiens
ggaggaaacaguuaaugac

SEQ ID NO: 737253 - RNA, 19 nt, Homo sapiens
ucagaaaacagcaguagua

SEQ ID NO: 737254 - RNA, 19 nt, Homo sapiens
uaaagcaucccaggaagau

SEQ ID NO: 737255 - RNA, 19 nt, Homo sapiens
acagaagucgguccaagaa

SEQ ID NO: 737256 - RNA, 19 nt, Homo sapiens
ggaggcaggccacagaagu

SEQ ID NO: 737257 - RNA, 19 nt, Homo sapiens
gcccucgcgucuucagaaa

SEQ ID NO: 737258 - RNA, 19 nt, Homo sapiens
uggagaaacaggagaagaa

SEQ ID NO: 737259 - RNA, 19 nt, Homo sapiens
cgaaagaaucuggauguca

SEQ ID NO: 737260 - RNA, 19 nt, Homo sapiens
gcacgucucaucgcacaug

SEQ ID NO: 737261 - RNA, 19 nt, Homo sapiens
cgccagagccuacacacuu

SEQ ID NO: 737262 - RNA, 19 nt, Homo sapiens
uguggugucuuuaucugaa

SEQ ID NO: 737263 - RNA, 19 nt, Homo sapiens
uaucugccauugacuugau

SEQ ID NO: 737264 - RNA, 19 nt, Homo sapiens
gggccaaggcuaaggcuau

SEQ ID NO: 737265 - RNA, 19 nt, Homo sapiens
gaagaggcgguuggcaaga

SEQ ID NO: 737266 - RNA, 19 nt, Homo sapiens
aaagaggaaauucuccaaa

SEQ ID NO: 737267 - RNA, 19 nt, Homo sapiens
gaugaguagcgaucuugaa

SEQ ID NO: 737268 - RNA, 19 nt, Homo sapiens
gaggugcccacgaguguau

SEQ ID NO: 737269 - RNA, 19 nt, Homo sapiens
acgaaucgauugcuucucu

SEQ ID NO: 737270 - RNA, 19 nt, Homo sapiens
ggcuaaggcuauucuggau

SEQ ID NO: 737271 - RNA, 19 nt, Homo sapiens
caucccagguugccuugga

SEQ ID NO: 737272 - RNA, 19 nt, Homo sapiens
cgucuugcccaguuuauug

SEQ ID NO: 737273 - RNA, 19 nt, Homo sapiens
gccacauacugccgucuug

SEQ ID NO: 737274 - RNA, 19 nt, Homo sapiens
uuccggagcuggugaagau

SEQ ID NO: 737275 - RNA, 19 nt, Homo sapiens
caucaauaccuucucuaug

SEQ ID NO: 737276 - RNA, 19 nt, Homo sapiens
gcagcuccaagaagaagaa

SEQ ID NO: 737277 - RNA, 19 nt, Homo sapiens
agaagucgguccaagaaaa

SEQ ID NO: 737278 - RNA, 19 nt, Homo sapiens
aggaggaguugaugaguag

SEQ ID NO: 737279 - RNA, 19 nt, Homo sapiens
gaagcggcugcugagauua

SEQ ID NO: 737280 - RNA, 19 nt, Homo sapiens
ccgagcagcugccaagaac

SEQ ID NO: 737281 - RNA, 19 nt, Homo sapiens
gauaaggacaucaauaccu

SEQ ID NO: 737282 - RNA, 19 nt, Homo sapiens
aagauuagaaugcaaaugg

SEQ ID NO: 737283 - RNA, 19 nt, Homo sapiens
gaagauuagaaugcaaaug

SEQ ID NO: 737284 - RNA, 19 nt, Homo sapiens
gcuauucccgugccaaagu

SEQ ID NO: 737285 - RNA, 19 nt, Homo sapiens
agacccaucuaucucuuuc

SEQ ID NO: 737286 - RNA, 19 nt, Homo sapiens
caugaaggaagcaaugguu

SEQ ID NO: 737287 - RNA, 19 nt, Homo sapiens
gaagcuucgagaacaaguu

SEQ ID NO: 737288 - RNA, 19 nt, Homo sapiens
ggaggagucauagcugaga

SEQ ID NO: 737289 - RNA, 19 nt, Homo sapiens
gaaggaaguggaggagauc

SEQ ID NO: 737290 - RNA, 19 nt, Homo sapiens
cgcaauacaggaggaguua

SEQ ID NO: 737291 - RNA, 19 nt, Homo sapiens
agaaacgcuuaaagaagga

SEQ ID NO: 737292 - RNA, 19 nt, Homo sapiens
caagaaggcugcagagaua

SEQ ID NO: 737293 - RNA, 19 nt, Homo sapiens
ggccaaagcuaauuuauuu

SEQ ID NO: 737294 - RNA, 19 nt, Homo sapiens
gggaagagcuaccacuuua

SEQ ID NO: 737295 - RNA, 19 nt, Homo sapiens
gcaaauaacuagagacuuc

SEQ ID NO: 737296 - RNA, 19 nt, Homo sapiens
ccaaauaacuucacagcua

SEQ ID NO: 737297 - RNA, 19 nt, Homo sapiens
ggaaaggaauggaacuuaa

SEQ ID NO: 737298 - RNA, 19 nt, Homo sapiens
gaauugugguugaugauua

SEQ ID NO: 737299 - RNA, 19 nt, Homo sapiens
gcacugcgcguuccuauua

SEQ ID NO: 737300 - RNA, 19 nt, Homo sapiens
gaccuggagucaauaauua

SEQ ID NO: 737301 - RNA, 19 nt, Homo sapiens
agacaagacuccagaauuu

SEQ ID NO: 737302 - RNA, 19 nt, Homo sapiens
gaacagcuuugauuaacuu

SEQ ID NO: 737303 - RNA, 19 nt, Homo sapiens
ggacaaggaauaaugaaua

SEQ ID NO: 737304 - RNA, 19 nt, Homo sapiens
ccaaaggauucucagauua

SEQ ID NO: 737305 - RNA, 19 nt, Homo sapiens
uaagacaacuuggccauua

SEQ ID NO: 737306 - RNA, 19 nt, Homo sapiens
gaaauuacauccagagucu

SEQ ID NO: 737307 - RNA, 19 nt, Homo sapiens
gaggcaauuuccaauauua

SEQ ID NO: 737308 - RNA, 19 nt, Homo sapiens
aaagagaucuggagacuga

SEQ ID NO: 737309 - RNA, 19 nt, Homo sapiens
gaagaugcuuucuaacuau

SEQ ID NO: 737310 - RNA, 19 nt, Homo sapiens
gaggacaucugaaaucuau

SEQ ID NO: 737311 - RNA, 19 nt, Homo sapiens
gguguuagcugauuguauu

SEQ ID NO: 737312 - RNA, 19 nt, Homo sapiens
caaacaaaguuaccaauuc

SEQ ID NO: 737313 - RNA, 19 nt, Homo sapiens
ucagcaaucuccaguauaa

SEQ ID NO: 737314 - RNA, 19 nt, Homo sapiens
caagaaaggacaaggaaua

SEQ ID NO: 737315 - RNA, 19 nt, Homo sapiens
uuucagaucucccaaauuu

SEQ ID NO: 737316 - RNA, 19 nt, Homo sapiens
uaauaaagcuugucaggau

SEQ ID NO: 737317 - RNA, 19 nt, Homo sapiens
gaaguugauugucccuuaa

SEQ ID NO: 737318 - RNA, 19 nt, Homo sapiens
ggucaucacuggauuuaga

SEQ ID NO: 737319 - RNA, 19 nt, Homo sapiens
uuacacagcuccagaguga

SEQ ID NO: 737320 - RNA, 19 nt, Homo sapiens
uaacacaucccuauagaaa

SEQ ID NO: 737321 - RNA, 19 nt, Homo sapiens
ggauuuacaucuuaggaaa

SEQ ID NO: 737322 - RNA, 19 nt, Homo sapiens
ccuuugagcuuuauucuaa

SEQ ID NO: 737323 - RNA, 19 nt, Homo sapiens
gaaaggacaaggaauaaug

SEQ ID NO: 737324 - RNA, 19 nt, Homo sapiens
gaaauuaaagggaaaggaa

SEQ ID NO: 737325 - RNA, 19 nt, Homo sapiens
cgaauuacauugaguuugu

SEQ ID NO: 737326 - RNA, 19 nt, Homo sapiens
agaaagaccuggagucaau

SEQ ID NO: 737327 - RNA, 19 nt, Homo sapiens
gaguugagcuauauaaaca

SEQ ID NO: 737328 - RNA, 19 nt, Homo sapiens
ugacaugccugaacaacuu

SEQ ID NO: 737329 - RNA, 19 nt, Homo sapiens
ccaauucucuuaacucugu

SEQ ID NO: 737330 - RNA, 19 nt, Homo sapiens
gaaacaugaugcugccaaa

SEQ ID NO: 737331 - RNA, 19 nt, Homo sapiens
ggaggaggcucuugaugau

SEQ ID NO: 737332 - RNA, 19 nt, Homo sapiens
gccaaaggauucucagauu

SEQ ID NO: 737333 - RNA, 19 nt, Homo sapiens
ugacaaggaugcuaaaaua

SEQ ID NO: 737334 - RNA, 19 nt, Homo sapiens
gaaauggccagucgugauu

SEQ ID NO: 737335 - RNA, 19 nt, Homo sapiens
gauauaauuucccuaguag

SEQ ID NO: 737336 - RNA, 19 nt, Homo sapiens
guaggaauauggauaagau

SEQ ID NO: 737337 - RNA, 19 nt, Homo sapiens
gcaugcaccugacuuucua

SEQ ID NO: 737338 - RNA, 19 nt, Homo sapiens
gcaaacaaaguuaccaauu

SEQ ID NO: 737339 - RNA, 19 nt, Homo sapiens
cgauuuagguguuccauug

SEQ ID NO: 737340 - RNA, 19 nt, Homo sapiens
ggaaauaacauguauacuc

SEQ ID NO: 737341 - RNA, 19 nt, Homo sapiens
gauucaagcuucuguaaca

SEQ ID NO: 737342 - RNA, 19 nt, Homo sapiens
gcacagacacucuugaugu

SEQ ID NO: 737343 - RNA, 19 nt, Homo sapiens
uggaacaucugcaccauaa

SEQ ID NO: 737344 - RNA, 19 nt, Homo sapiens
ccacuggguuuauuucuug

SEQ ID NO: 737345 - RNA, 19 nt, Homo sapiens
aaacaggaaugucaucaga

SEQ ID NO: 737346 - RNA, 19 nt, Homo sapiens
gaaggacagucugguuaaa

SEQ ID NO: 737347 - RNA, 19 nt, Homo sapiens
aagcugaccuuucuaauuc

SEQ ID NO: 737348 - RNA, 19 nt, Homo sapiens
gaaaaugugugugaucuuu

SEQ ID NO: 737349 - RNA, 19 nt, Homo sapiens
uauaagaaccgcaaugaaa

SEQ ID NO: 737350 - RNA, 19 nt, Homo sapiens
gcaaagggcaaauuauaau

SEQ ID NO: 737351 - RNA, 19 nt, Homo sapiens
gaauaaagagcccgcugua

SEQ ID NO: 737352 - RNA, 19 nt, Homo sapiens
ucaauaaacaccagaguaa

SEQ ID NO: 737353 - RNA, 19 nt, Homo sapiens
ggagugaagugugggcuaa

SEQ ID NO: 737354 - RNA, 19 nt, Homo sapiens
acagguaucucgugcauga

SEQ ID NO: 737355 - RNA, 19 nt, Homo sapiens
ggaaugucaucagagauuu

SEQ ID NO: 737356 - RNA, 19 nt, Homo sapiens
agaaguugauugucccuua

SEQ ID NO: 737357 - RNA, 19 nt, Homo sapiens
uaaagagcccgcuguaauu

SEQ ID NO: 737358 - RNA, 19 nt, Homo sapiens
guaauccaguugcuguuaa

SEQ ID NO: 737359 - RNA, 19 nt, Homo sapiens
caagggauguaccucguuu

SEQ ID NO: 737360 - RNA, 19 nt, Homo sapiens
aaagaugacuguguaaaug

SEQ ID NO: 737361 - RNA, 19 nt, Homo sapiens
aauggaagcuggaguguga

SEQ ID NO: 737362 - RNA, 19 nt, Homo sapiens
uggaaggauuuacaucuua

SEQ ID NO: 737363 - RNA, 19 nt, Homo sapiens
gaugaaagguagaccaagu

SEQ ID NO: 737364 - RNA, 19 nt, Homo sapiens
guagaauugugguugauga

SEQ ID NO: 737365 - RNA, 19 nt, Homo sapiens
guaagaagcuauguaaacu

SEQ ID NO: 737366 - RNA, 19 nt, Homo sapiens
gcgauuugcuucugauaau

SEQ ID NO: 737367 - RNA, 19 nt, Homo sapiens
caaagucaggugaaauaua

SEQ ID NO: 737368 - RNA, 19 nt, Homo sapiens
cguggaagcuucuaaacuu

SEQ ID NO: 737369 - RNA, 19 nt, Homo sapiens
cgauauccguuauaaagaa

SEQ ID NO: 737370 - RNA, 19 nt, Homo sapiens
agaugaaacugaagaagaa

SEQ ID NO: 737371 - RNA, 19 nt, Homo sapiens
ggaugcuccucagauauua

SEQ ID NO: 737372 - RNA, 19 nt, Homo sapiens
gaaugaggaacaagacuuu

SEQ ID NO: 737373 - RNA, 19 nt, Homo sapiens
cacugaagcugcaucuaua

SEQ ID NO: 737374 - RNA, 19 nt, Homo sapiens
acagagaaauuuccuuguu

SEQ ID NO: 737375 - RNA, 19 nt, Homo sapiens
cuaauuguguucaugguuu

SEQ ID NO: 737376 - RNA, 19 nt, Homo sapiens
aaacauuagugcgguauuu

SEQ ID NO: 737377 - RNA, 19 nt, Homo sapiens
gcauggaauuggccagaaa

SEQ ID NO: 737378 - RNA, 19 nt, Homo sapiens
guuguaagcuuuuguagua

SEQ ID NO: 737379 - RNA, 19 nt, Homo sapiens
gcgaggaagugcuaagaug

SEQ ID NO: 737380 - RNA, 19 nt, Homo sapiens
cuucuuagcugucacuuug

SEQ ID NO: 737381 - RNA, 19 nt, Homo sapiens
caucagcaaucuccaguau

SEQ ID NO: 737382 - RNA, 19 nt, Homo sapiens
gaacuugaccgaccagaca

SEQ ID NO: 737383 - RNA, 19 nt, Homo sapiens
gaagcuauguaaacugaca

SEQ ID NO: 737384 - RNA, 19 nt, Homo sapiens
gaaugaaacaggaauguca

SEQ ID NO: 737385 - RNA, 19 nt, Homo sapiens
gcugacugguaucuauuua

SEQ ID NO: 737386 - RNA, 19 nt, Homo sapiens
ggaaggucaucacuggauu

SEQ ID NO: 737387 - RNA, 19 nt, Homo sapiens
aagaagcuauguaaacuga

SEQ ID NO: 737388 - RNA, 19 nt, Homo sapiens
cuucaagccuuuaggaauu

SEQ ID NO: 737389 - RNA, 19 nt, Homo sapiens
ucacugacauaaaguugaa

SEQ ID NO: 737390 - RNA, 19 nt, Homo sapiens
ggaaggauuuacaucuuag

SEQ ID NO: 737391 - RNA, 19 nt, Homo sapiens
uaauguaucccaaaccuaa

SEQ ID NO: 737392 - RNA, 19 nt, Homo sapiens
gcaaauagcuccuguguca

SEQ ID NO: 737393 - RNA, 19 nt, Homo sapiens
guagauaucuguugaguaa

SEQ ID NO: 737394 - RNA, 19 nt, Homo sapiens
uaagaacucuggaugaaua

SEQ ID NO: 737395 - RNA, 19 nt, Homo sapiens
caaagccucucgugucuua

SEQ ID NO: 737396 - RNA, 19 nt, Homo sapiens
gaaaacagcucccuauuug

SEQ ID NO: 737397 - RNA, 19 nt, Homo sapiens
caaauuugcuucuauggaa

SEQ ID NO: 737398 - RNA, 19 nt, Homo sapiens
gaacugcauuugauuaaag

SEQ ID NO: 737399 - RNA, 19 nt, Homo sapiens
ggcaggagcuccauucuug

SEQ ID NO: 737400 - RNA, 19 nt, Homo sapiens
ucaguuggguggcaaauuu

SEQ ID NO: 737401 - RNA, 19 nt, Homo sapiens
gcagcugacuucaauauag

SEQ ID NO: 737402 - RNA, 19 nt, Homo sapiens
acaaucaugugcaacuuua

SEQ ID NO: 737403 - RNA, 19 nt, Homo sapiens
ccacgcagcugacuucaau

SEQ ID NO: 737404 - RNA, 19 nt, Homo sapiens
gcagaugcaauuaagguua

SEQ ID NO: 737405 - RNA, 19 nt, Homo sapiens
gcagaugcaauuaagguua

SEQ ID NO: 737406 - RNA, 19 nt, Homo sapiens
gaagagcaguugaagugau

SEQ ID NO: 737407 - RNA, 19 nt, Homo sapiens
uaauaucggugguuuacuu

SEQ ID NO: 737408 - RNA, 19 nt, Homo sapiens
acacagcccugcucgguuu

SEQ ID NO: 737409 - RNA, 19 nt, Homo sapiens
gggaagauugugauuauuu

SEQ ID NO: 737410 - RNA, 19 nt, Homo sapiens
gcccagaacugcauuugau

SEQ ID NO: 737411 - RNA, 19 nt, Homo sapiens
ucucgugucuuacaaguuu

SEQ ID NO: 737412 - RNA, 19 nt, Homo sapiens
gugggaagauugugauuau

SEQ ID NO: 737413 - RNA, 19 nt, Homo sapiens
aacaccagcuuuaucaaua

SEQ ID NO: 737414 - RNA, 19 nt, Homo sapiens
gaugguuucugacauugaa

SEQ ID NO: 737415 - RNA, 19 nt, Homo sapiens
gaaaagaaauccaagaacu

SEQ ID NO: 737416 - RNA, 19 nt, Homo sapiens
aggaauaccuaaugccuuu

SEQ ID NO: 737417 - RNA, 19 nt, Homo sapiens
ccagaacugcauuugauua

SEQ ID NO: 737418 - RNA, 19 nt, Homo sapiens
ggcugugucucccucauua

SEQ ID NO: 737419 - RNA, 19 nt, Homo sapiens
cagaagagcaguugaagug

SEQ ID NO: 737420 - RNA, 19 nt, Homo sapiens
agaaggccgugaagcauuu

SEQ ID NO: 737421 - RNA, 19 nt, Homo sapiens
ggacauacuguacuagaug

SEQ ID NO: 737422 - RNA, 19 nt, Homo sapiens
ccacgugguugauaauugu

SEQ ID NO: 737423 - RNA, 19 nt, Homo sapiens
aaagaggugugcuucaguu

SEQ ID NO: 737424 - RNA, 19 nt, Homo sapiens
gcagcaagguauucaagca

SEQ ID NO: 737425 - RNA, 19 nt, Homo sapiens
gaaugccagugaccuauag

SEQ ID NO: 737426 - RNA, 19 nt, Homo sapiens
ggaaugccagugaccuaua

SEQ ID NO: 737427 - RNA, 19 nt, Homo sapiens
ggagcuccauucuuguuug

SEQ ID NO: 737428 - RNA, 19 nt, Homo sapiens
ugaagcauuuacacucuuu

SEQ ID NO: 737429 - RNA, 19 nt, Homo sapiens
gcuaacaccagcuuuauca

SEQ ID NO: 737430 - RNA, 19 nt, Homo sapiens
ugaagugauuuaugcuuga

SEQ ID NO: 737431 - RNA, 19 nt, Homo sapiens
uaaaggagacacucagaug

SEQ ID NO: 737432 - RNA, 19 nt, Homo sapiens
gagcaguugaagugauuua

SEQ ID NO: 737433 - RNA, 19 nt, Homo sapiens
cauauuccauuuguccuuu

SEQ ID NO: 737434 - RNA, 19 nt, Homo sapiens
ggagcagccuacuauaucu

SEQ ID NO: 737435 - RNA, 19 nt, Homo sapiens
ccugaugguuucugacauu

SEQ ID NO: 737436 - RNA, 19 nt, Homo sapiens
gagagcagcagcaagguau

SEQ ID NO: 737437 - RNA, 19 nt, Homo sapiens
gaagugauuuaugcuugau

SEQ ID NO: 737438 - RNA, 19 nt, Homo sapiens
cagaacugcauuugauuaa

SEQ ID NO: 737439 - RNA, 19 nt, Homo sapiens
aaacagcucccuauuugau

SEQ ID NO: 737440 - RNA, 19 nt, Homo sapiens
aagagcaguugaagugauu

SEQ ID NO: 737441 - RNA, 19 nt, Homo sapiens
uuuaagaacucuggaugaa

SEQ ID NO: 737442 - RNA, 19 nt, Homo sapiens
ggcaggaacucuggcuuug

SEQ ID NO: 737443 - RNA, 19 nt, Homo sapiens
ccacaggaauaccuaaugc

SEQ ID NO: 737444 - RNA, 19 nt, Homo sapiens
ugauaauugucuucaguug

SEQ ID NO: 737445 - RNA, 19 nt, Homo sapiens
cuaauauuaugguccuuga

SEQ ID NO: 737446 - RNA, 19 nt, Homo sapiens
aaacuccuaucaucuucaa

SEQ ID NO: 737447 - RNA, 19 nt, Homo sapiens
gaaccuuucccaccuguag

SEQ ID NO: 737448 - RNA, 19 nt, Homo sapiens
ugucuucaguugcugcuaa

SEQ ID NO: 737449 - RNA, 19 nt, Homo sapiens
guugauaauugucuucagu

SEQ ID NO: 737450 - RNA, 19 nt, Homo sapiens
gagaaccaguugggcuuug

SEQ ID NO: 737451 - RNA, 19 nt, Homo sapiens
gaaagaggugugcuucagu

SEQ ID NO: 737452 - RNA, 19 nt, Homo sapiens
ggaucuuacugucuuaugg

SEQ ID NO: 737453 - RNA, 19 nt, Homo sapiens
cagcugacuucaauauagu

SEQ ID NO: 737454 - RNA, 19 nt, Homo sapiens
caaaugacuugcaguuucc

SEQ ID NO: 737455 - RNA, 19 nt, Homo sapiens
gaggaaugcagcccuguug

SEQ ID NO: 737456 - RNA, 19 nt, Homo sapiens
gcaguugaagugauuuaug

SEQ ID NO: 737457 - RNA, 19 nt, Homo sapiens
uaagacaaauucccaucca

SEQ ID NO: 737458 - RNA, 19 nt, Homo sapiens
aaauggagcagccuacuau

SEQ ID NO: 737459 - RNA, 19 nt, Homo sapiens
uaacaccagcuuuaucaau

SEQ ID NO: 737460 - RNA, 19 nt, Homo sapiens
agacaaauucccauccaaa

SEQ ID NO: 737461 - RNA, 19 nt, Homo sapiens
ugaggaucuuacugucuua

SEQ ID NO: 737462 - RNA, 19 nt, Homo sapiens
gcaccuccauuuguucauc

SEQ ID NO: 737463 - RNA, 19 nt, Homo sapiens
cggguugacugucuuuguu

SEQ ID NO: 737464 - RNA, 19 nt, Homo sapiens
gaaauccaagaacuacaga

SEQ ID NO: 737465 - RNA, 19 nt, Homo sapiens
aggaggcucucaguagaua

SEQ ID NO: 737466 - RNA, 19 nt, Homo sapiens
agacugggaugccuucaag

SEQ ID NO: 737467 - RNA, 19 nt, Homo sapiens
cuacagaagagcaguugaa

SEQ ID NO: 737468 - RNA, 19 nt, Homo sapiens
gaagcauuuacacucuuua

SEQ ID NO: 737469 - RNA, 19 nt, Homo sapiens
gagcagccuacuauaucua

SEQ ID NO: 737470 - RNA, 19 nt, Homo sapiens
gaaugcagcccuguugauc

SEQ ID NO: 737471 - RNA, 19 nt, Homo sapiens
ggaaugcagcccuguugau

SEQ ID NO: 737472 - RNA, 19 nt, Homo sapiens
uaaacccuguauccuguga

SEQ ID NO: 737473 - RNA, 19 nt, Homo sapiens
gcccugcucgguuugauuu

SEQ ID NO: 737474 - RNA, 19 nt, Homo sapiens
aaauagcuccugugucaga

SEQ ID NO: 737475 - RNA, 19 nt, Homo sapiens
gaaugaauauagguagacu

SEQ ID NO: 737476 - RNA, 19 nt, Homo sapiens
uggcuucagcuaaguauuu

SEQ ID NO: 737477 - RNA, 19 nt, Homo sapiens
cagaaggccgugaagcauu

SEQ ID NO: 737478 - RNA, 19 nt, Homo sapiens
agaaaaugcucauggaguu

SEQ ID NO: 737479 - RNA, 19 nt, Homo sapiens
ccucuggcuuccugauaaa

SEQ ID NO: 737480 - RNA, 19 nt, Homo sapiens
guggagaacaggauugguu

SEQ ID NO: 737481 - RNA, 19 nt, Homo sapiens
cuuaagguguccagagaug

SEQ ID NO: 737482 - RNA, 19 nt, Homo sapiens
caguugaagugauuuaugc

SEQ ID NO: 737483 - RNA, 19 nt, Homo sapiens
uacuuaagguguccagaga

SEQ ID NO: 737484 - RNA, 19 nt, Homo sapiens
gaacucuggaugaauacau

SEQ ID NO: 737485 - RNA, 19 nt, Homo sapiens
uccaagaacuacagaagag

SEQ ID NO: 737486 - RNA, 19 nt, Homo sapiens
gugaagcauuuacacucuu

SEQ ID NO: 737487 - RNA, 19 nt, Homo sapiens
gaaggccgugaagcauuua

SEQ ID NO: 737488 - RNA, 19 nt, Homo sapiens
uugaggaucuuacugucuu

SEQ ID NO: 737489 - RNA, 19 nt, Homo sapiens
cucaguagauaucuguuga

SEQ ID NO: 737490 - RNA, 19 nt, Homo sapiens
cacugaggcuuccguaaca

SEQ ID NO: 737491 - RNA, 19 nt, Homo sapiens
guaaaggagacacucagau

SEQ ID NO: 737492 - RNA, 19 nt, Homo sapiens
cgagaaaggucuagaauua

SEQ ID NO: 737493 - RNA, 19 nt, Homo sapiens
ccacgaagcucaagcagaa

SEQ ID NO: 737494 - RNA, 19 nt, Homo sapiens
ggacaucaccgacacauuu

SEQ ID NO: 737495 - RNA, 19 nt, Homo sapiens
gcuauggagugaaauauuu

SEQ ID NO: 737496 - RNA, 19 nt, Homo sapiens
gaagaggauugcagaaaug

SEQ ID NO: 737497 - RNA, 19 nt, Homo sapiens
ccaauggcaugguguauuu

SEQ ID NO: 737498 - RNA, 19 nt, Homo sapiens
gauugaagaugaucgaauu

SEQ ID NO: 737499 - RNA, 19 nt, Homo sapiens
gaaacaaauucacgaggaa

SEQ ID NO: 737500 - RNA, 19 nt, Homo sapiens
ggaaaucaguuagcuaaau

SEQ ID NO: 737501 - RNA, 19 nt, Homo sapiens
agacaaggauugaagauga

SEQ ID NO: 737502 - RNA, 19 nt, Homo sapiens
gaaguugggaaaucaguua

SEQ ID NO: 737503 - RNA, 19 nt, Homo sapiens
gaacagcaucugaaacaaa

SEQ ID NO: 737504 - RNA, 19 nt, Homo sapiens
ucaguuagcuaaauucaga

SEQ ID NO: 737505 - RNA, 19 nt, Homo sapiens
gggagcagcuuaagcaguu

SEQ ID NO: 737506 - RNA, 19 nt, Homo sapiens
ggacaagccuagggaauuc

SEQ ID NO: 737507 - RNA, 19 nt, Homo sapiens
ggagucgucuuuaaugaga

SEQ ID NO: 737508 - RNA, 19 nt, Homo sapiens
gaauggaccacuucuugua

SEQ ID NO: 737509 - RNA, 19 nt, Homo sapiens
caucauacauagcuucuug

SEQ ID NO: 737510 - RNA, 19 nt, Homo sapiens
acagaucccucuaaacaaa

SEQ ID NO: 737511 - RNA, 19 nt, Homo sapiens
gcagaugccucagacagaa

SEQ ID NO: 737512 - RNA, 19 nt, Homo sapiens
aauaugagguguucaguga

SEQ ID NO: 737513 - RNA, 19 nt, Homo sapiens
caaacaaccgucagcguua

SEQ ID NO: 737514 - RNA, 19 nt, Homo sapiens
gauggcggcuggaacauga

SEQ ID NO: 737515 - RNA, 19 nt, Homo sapiens
guauuuggaugccaccuuu

SEQ ID NO: 737516 - RNA, 19 nt, Homo sapiens
ccagagaagacacgaauaa

SEQ ID NO: 737517 - RNA, 19 nt, Homo sapiens
ugaagaggauugcagaaau

SEQ ID NO: 737518 - RNA, 19 nt, Homo sapiens
gagaagacacgaauaaucu

SEQ ID NO: 737519 - RNA, 19 nt, Homo sapiens
gaauugaggcuuuacuuca

SEQ ID NO: 737520 - RNA, 19 nt, Homo sapiens
caaacuuucugucuucuca

SEQ ID NO: 737521 - RNA, 19 nt, Homo sapiens
cagaacgauugaugaagua

SEQ ID NO: 737522 - RNA, 19 nt, Homo sapiens
caacaaagcaaaccucaag

SEQ ID NO: 737523 - RNA, 19 nt, Homo sapiens
cuacagaucccucuaaaca

SEQ ID NO: 737524 - RNA, 19 nt, Homo sapiens
uaaaccaggugacaucugu

SEQ ID NO: 737525 - RNA, 19 nt, Homo sapiens
gagauaucccuguucagua

SEQ ID NO: 737526 - RNA, 19 nt, Homo sapiens
gaauuacggagucaacaaa

SEQ ID NO: 737527 - RNA, 19 nt, Homo sapiens
gaggccagaugacaaguau

SEQ ID NO: 737528 - RNA, 19 nt, Homo sapiens
ccuagggaauuccagauaa

SEQ ID NO: 737529 - RNA, 19 nt, Homo sapiens
uuaggaagcuggucaugga

SEQ ID NO: 737530 - RNA, 19 nt, Homo sapiens
ccaaggacuuucagaaucu

SEQ ID NO: 737531 - RNA, 19 nt, Homo sapiens
gcaugaagcgccaaagaug

SEQ ID NO: 737532 - RNA, 19 nt, Homo sapiens
ucagaaaugcuacugcuuu

SEQ ID NO: 737533 - RNA, 19 nt, Homo sapiens
ucaaggugcuggugaagau

SEQ ID NO: 737534 - RNA, 19 nt, Homo sapiens
uacaaagccuugauugaau

SEQ ID NO: 737535 - RNA, 19 nt, Homo sapiens
cauuaagucuucugucuuc

SEQ ID NO: 737536 - RNA, 19 nt, Homo sapiens
uaacaacccgugcuuugaa

SEQ ID NO: 737537 - RNA, 19 nt, Homo sapiens
gcagcuauggagugaaaua

SEQ ID NO: 737538 - RNA, 19 nt, Homo sapiens
gaucgaaaccugccagaca

SEQ ID NO: 737539 - RNA, 19 nt, Homo sapiens
uuacaaagccuugauugaa

SEQ ID NO: 737540 - RNA, 19 nt, Homo sapiens
aaagggcaacucugacuua

SEQ ID NO: 737541 - RNA, 19 nt, Homo sapiens
ccaaauucuugcauacaga

SEQ ID NO: 737542 - RNA, 19 nt, Homo sapiens
gcucccaggucauuaggaa

SEQ ID NO: 737543 - RNA, 19 nt, Homo sapiens
gcagaaaugacagauauca

SEQ ID NO: 737544 - RNA, 19 nt, Homo sapiens
uugcagaaaugacagauau

SEQ ID NO: 737545 - RNA, 19 nt, Homo sapiens
ggcagcagaucuacgagaa

SEQ ID NO: 737546 - RNA, 19 nt, Homo sapiens
ugacaaguaucacgagaag

SEQ ID NO: 737547 - RNA, 19 nt, Homo sapiens
cagcagcucugguggagau

SEQ ID NO: 737548 - RNA, 19 nt, Homo sapiens
ggagauaucccuguucagu

SEQ ID NO: 737549 - RNA, 19 nt, Homo sapiens
gcguggcgauggaacagua

SEQ ID NO: 737550 - RNA, 19 nt, Homo sapiens
ugaauuacgugggugaaug

SEQ ID NO: 737551 - RNA, 19 nt, Homo sapiens
gaacccaccauaccuguca

SEQ ID NO: 737552 - RNA, 19 nt, Homo sapiens
caaagcaaaccucaagaug

SEQ ID NO: 737553 - RNA, 19 nt, Homo sapiens
aagcugacuuuaucgauga

SEQ ID NO: 737554 - RNA, 19 nt, Homo sapiens
acagaacgauugaugaagu

SEQ ID NO: 737555 - RNA, 19 nt, Homo sapiens
aaauaaagggcaacucuga

SEQ ID NO: 737556 - RNA, 19 nt, Homo sapiens
ccaggaagagguucauuga

SEQ ID NO: 737557 - RNA, 19 nt, Homo sapiens
acaaaggaauggaccacuu

SEQ ID NO: 737558 - RNA, 19 nt, Homo sapiens
ggagcucgccaauggaauu

SEQ ID NO: 737559 - RNA, 19 nt, Homo sapiens
ccugacagcuggagauauc

SEQ ID NO: 737560 - RNA, 19 nt, Homo sapiens
gagaugaagggagcguuua

SEQ ID NO: 737561 - RNA, 19 nt, Homo sapiens
cacaggagccagguauuua

SEQ ID NO: 737562 - RNA, 19 nt, Homo sapiens
cuguggagcucuugaaguu

SEQ ID NO: 737563 - RNA, 19 nt, Homo sapiens
gacaaggauugaagaugau

SEQ ID NO: 737564 - RNA, 19 nt, Homo sapiens
ugucuucacucuugacuuc

SEQ ID NO: 737565 - RNA, 19 nt, Homo sapiens
aggaagcacugagcaaauu

SEQ ID NO: 737566 - RNA, 19 nt, Homo sapiens
cgacgaagccaaacuuucu

SEQ ID NO: 737567 - RNA, 19 nt, Homo sapiens
ggacccaaauacaauagag

SEQ ID NO: 737568 - RNA, 19 nt, Homo sapiens
ccagaucaugccagucuua

SEQ ID NO: 737569 - RNA, 19 nt, Homo sapiens
gugauaauaugagguguuc

SEQ ID NO: 737570 - RNA, 19 nt, Homo sapiens
gaaaugacagauaucaaac

SEQ ID NO: 737571 - RNA, 19 nt, Homo sapiens
gaagacacgaauaaucugu

SEQ ID NO: 737572 - RNA, 19 nt, Homo sapiens
gcugcggccuucuugacua

SEQ ID NO: 737573 - RNA, 19 nt, Homo sapiens
ggaauggaccacuucuugu

SEQ ID NO: 737574 - RNA, 19 nt, Homo sapiens
gagacaggcagcagaucua

SEQ ID NO: 737575 - RNA, 19 nt, Homo sapiens
gggacaagccuagggaauu

SEQ ID NO: 737576 - RNA, 19 nt, Homo sapiens
uagaacagcaucugaaaca

SEQ ID NO: 737577 - RNA, 19 nt, Homo sapiens
gcucugcaguauaaacuag

SEQ ID NO: 737578 - RNA, 19 nt, Homo sapiens
guacugguguuccucacau

SEQ ID NO: 737579 - RNA, 19 nt, Homo sapiens
agacaucgacgaagccaaa

SEQ ID NO: 737580 - RNA, 19 nt, Homo sapiens
ggacaguacugguguuccu

SEQ ID NO: 737581 - RNA, 19 nt, Homo sapiens
gaucaugccagucuuaaaa

SEQ ID NO: 737582 - RNA, 19 nt, Homo sapiens
cagcagaucuacgagaaag

SEQ ID NO: 737583 - RNA, 19 nt, Homo sapiens
agacagaacgauugaugaa

SEQ ID NO: 737584 - RNA, 19 nt, Homo sapiens
aaggagucgucuuuaauga

SEQ ID NO: 737585 - RNA, 19 nt, Homo sapiens
gaugacugccaaauucuug

SEQ ID NO: 737586 - RNA, 19 nt, Homo sapiens
gcucacccaugaugacaca

SEQ ID NO: 737587 - RNA, 19 nt, Homo sapiens
ccaagggauuguggagaaa

SEQ ID NO: 737588 - RNA, 19 nt, Homo sapiens
gagggaggccuacuuuagu

SEQ ID NO: 737589 - RNA, 19 nt, Homo sapiens
cacauuaagucuucugucu

SEQ ID NO: 737590 - RNA, 19 nt, Homo sapiens
ggauucauuugcuacagau

SEQ ID NO: 737591 - RNA, 19 nt, Homo sapiens
cccaaggacuuucagaauc

SEQ ID NO: 737592 - RNA, 19 nt, Homo sapiens
cgagaaaggucuagaauua

SEQ ID NO: 737593 - RNA, 19 nt, Homo sapiens
ccacgaagcucaagcagaa

SEQ ID NO: 737594 - RNA, 19 nt, Homo sapiens
gcuauggagugaaauauuu

SEQ ID NO: 737595 - RNA, 19 nt, Homo sapiens
gaagaggauugcagaaaug

SEQ ID NO: 737596 - RNA, 19 nt, Homo sapiens
ccaauggcaugguguauuu

SEQ ID NO: 737597 - RNA, 19 nt, Homo sapiens
gaaaggauuugaagaugau

SEQ ID NO: 737598 - RNA, 19 nt, Homo sapiens
ggaaaucaguuagcuaaau

SEQ ID NO: 737599 - RNA, 19 nt, Homo sapiens
uaagugaucucucaacaau

SEQ ID NO: 737600 - RNA, 19 nt, Homo sapiens
gaaguugggaaaucaguua

SEQ ID NO: 737601 - RNA, 19 nt, Homo sapiens
ucaguuagcuaaauucaga

SEQ ID NO: 737602 - RNA, 19 nt, Homo sapiens
aaacagggcuaaaguaagu

SEQ ID NO: 737603 - RNA, 19 nt, Homo sapiens
gagaaaggauuugaagaug

SEQ ID NO: 737604 - RNA, 19 nt, Homo sapiens
ggguaaggguuuauaacua

SEQ ID NO: 737605 - RNA, 19 nt, Homo sapiens
gaauggaccacuucuugua

SEQ ID NO: 737606 - RNA, 19 nt, Homo sapiens
gcagaugccucagacagaa

SEQ ID NO: 737607 - RNA, 19 nt, Homo sapiens
aauaugagguguucaguga

SEQ ID NO: 737608 - RNA, 19 nt, Homo sapiens
gguaaggguuuauaacuag

SEQ ID NO: 737609 - RNA, 19 nt, Homo sapiens
agugaucucucaacaauuu

SEQ ID NO: 737610 - RNA, 19 nt, Homo sapiens
cuaguaaucuguugguuau

SEQ ID NO: 737611 - RNA, 19 nt, Homo sapiens
ugaagaggauugcagaaau

SEQ ID NO: 737612 - RNA, 19 nt, Homo sapiens
uaaacaaucaucuguggua

SEQ ID NO: 737613 - RNA, 19 nt, Homo sapiens
gaauugaggcuuuacuuca

SEQ ID NO: 737614 - RNA, 19 nt, Homo sapiens
agaaaggauuugaagauga

SEQ ID NO: 737615 - RNA, 19 nt, Homo sapiens
caaacuuucugucuucuca

SEQ ID NO: 737616 - RNA, 19 nt, Homo sapiens
acaaucaucugugguauau

SEQ ID NO: 737617 - RNA, 19 nt, Homo sapiens
cagaacgauugaugaagua

SEQ ID NO: 737618 - RNA, 19 nt, Homo sapiens
caacaaagcaaaccucaag

SEQ ID NO: 737619 - RNA, 19 nt, Homo sapiens
ccaaagaauuacaugacuu

SEQ ID NO: 737620 - RNA, 19 nt, Homo sapiens
gagauaucccuguucagua

SEQ ID NO: 737621 - RNA, 19 nt, Homo sapiens
gaauuacggagucaacaaa

SEQ ID NO: 737622 - RNA, 19 nt, Homo sapiens
gaggccagaugacaaguau

SEQ ID NO: 737623 - RNA, 19 nt, Homo sapiens
uuaggaagcuggucaugga

SEQ ID NO: 737624 - RNA, 19 nt, Homo sapiens
gcaugaagcgccaaagaug

SEQ ID NO: 737625 - RNA, 19 nt, Homo sapiens
ucagaaaugcuacugcuuu

SEQ ID NO: 737626 - RNA, 19 nt, Homo sapiens
ucaaggugcuggugaagau

SEQ ID NO: 737627 - RNA, 19 nt, Homo sapiens
ugaaguaguugagaaagga

SEQ ID NO: 737628 - RNA, 19 nt, Homo sapiens
uaacaacccgugcuuugaa

SEQ ID NO: 737629 - RNA, 19 nt, Homo sapiens
gcagcuauggagugaaaua

SEQ ID NO: 737630 - RNA, 19 nt, Homo sapiens
gaucgaaaccugccagaca

SEQ ID NO: 737631 - RNA, 19 nt, Homo sapiens
uaucaagucugggcuguug

SEQ ID NO: 737632 - RNA, 19 nt, Homo sapiens
ccaaauucuugcauacaga

SEQ ID NO: 737633 - RNA, 19 nt, Homo sapiens
gcucccaggucauuaggaa

SEQ ID NO: 737634 - RNA, 19 nt, Homo sapiens
gcagaaaugacagauauca

SEQ ID NO: 737635 - RNA, 19 nt, Homo sapiens
uugcagaaaugacagauau

SEQ ID NO: 737636 - RNA, 19 nt, Homo sapiens
ggcagcagaucuacgagaa

SEQ ID NO: 737637 - RNA, 19 nt, Homo sapiens
ugacaaguaucacgagaag

SEQ ID NO: 737638 - RNA, 19 nt, Homo sapiens
cagcagcucugguggagau

SEQ ID NO: 737639 - RNA, 19 nt, Homo sapiens
ggagauaucccuguucagu

SEQ ID NO: 737640 - RNA, 19 nt, Homo sapiens
ugaauuacgugggugaaug

SEQ ID NO: 737641 - RNA, 19 nt, Homo sapiens
acagaacgauugaugaagu

SEQ ID NO: 737642 - RNA, 19 nt, Homo sapiens
gaacccaccauaccuguca

SEQ ID NO: 737643 - RNA, 19 nt, Homo sapiens
caaagcaaaccucaagaug

SEQ ID NO: 737644 - RNA, 19 nt, Homo sapiens
aagcugacuuuaucgauga

SEQ ID NO: 737645 - RNA, 19 nt, Homo sapiens
ccaggaagagguucauuga

SEQ ID NO: 737646 - RNA, 19 nt, Homo sapiens
acaaaggaauggaccacuu

SEQ ID NO: 737647 - RNA, 19 nt, Homo sapiens
ggagcucgccaauggaauu

SEQ ID NO: 737648 - RNA, 19 nt, Homo sapiens
ccugacagcuggagauauc

SEQ ID NO: 737649 - RNA, 19 nt, Homo sapiens
guaaucuguugguuauuuc

SEQ ID NO: 737650 - RNA, 19 nt, Homo sapiens
ugagaaaggauuugaagau

SEQ ID NO: 737651 - RNA, 19 nt, Homo sapiens
cuguggagcucuugaaguu

SEQ ID NO: 737652 - RNA, 19 nt, Homo sapiens
cgacgaagccaaacuuucu

SEQ ID NO: 737653 - RNA, 19 nt, Homo sapiens
ggacccaaauacaauagag

SEQ ID NO: 737654 - RNA, 19 nt, Homo sapiens
ccagaucaugccagucuua

SEQ ID NO: 737655 - RNA, 19 nt, Homo sapiens
gugauaauaugagguguuc

SEQ ID NO: 737656 - RNA, 19 nt, Homo sapiens
gaaaugacagauaucaaac

SEQ ID NO: 737657 - RNA, 19 nt, Homo sapiens
gcugcggccuucuugacua

SEQ ID NO: 737658 - RNA, 19 nt, Homo sapiens
caaaacagggcuaaaguaa

SEQ ID NO: 737659 - RNA, 19 nt, Homo sapiens
ggaauggaccacuucuugu

SEQ ID NO: 737660 - RNA, 19 nt, Homo sapiens
gagacaggcagcagaucua

SEQ ID NO: 737661 - RNA, 19 nt, Homo sapiens
agacaucgacgaagccaaa

SEQ ID NO: 737662 - RNA, 19 nt, Homo sapiens
gaaaucuuccuuccaguac

SEQ ID NO: 737663 - RNA, 19 nt, Homo sapiens
uagcuuaacuggcauuuug

SEQ ID NO: 737664 - RNA, 19 nt, Homo sapiens
gaucaugccagucuuaaaa

SEQ ID NO: 737665 - RNA, 19 nt, Homo sapiens
cagcagaucuacgagaaag

SEQ ID NO: 737666 - RNA, 19 nt, Homo sapiens
agacagaacgauugaugaa

SEQ ID NO: 737667 - RNA, 19 nt, Homo sapiens
gaugacugccaaauucuug

SEQ ID NO: 737668 - RNA, 19 nt, Homo sapiens
gcauacagaaauucgagaa

SEQ ID NO: 737669 - RNA, 19 nt, Homo sapiens
ccucauagacagaacgauu

SEQ ID NO: 737670 - RNA, 19 nt, Homo sapiens
aaacaaucaucugugguau

SEQ ID NO: 737671 - RNA, 19 nt, Homo sapiens
caaaggaauggaccacuuc

SEQ ID NO: 737672 - RNA, 19 nt, Homo sapiens
guaagugaucucucaacaa

SEQ ID NO: 737673 - RNA, 19 nt, Homo sapiens
caauggaauuccugacucu

SEQ ID NO: 737674 - RNA, 19 nt, Homo sapiens
ggccagaugacaaguauca

SEQ ID NO: 737675 - RNA, 19 nt, Homo sapiens
agacagugccugcaggaaa

SEQ ID NO: 737676 - RNA, 19 nt, Homo sapiens
ugggaaaucaguuagcuaa

SEQ ID NO: 737677 - RNA, 19 nt, Homo sapiens
cacaggagcccgagacaau

SEQ ID NO: 737678 - RNA, 19 nt, Homo sapiens
acucacacauggacaccua

SEQ ID NO: 737679 - RNA, 19 nt, Homo sapiens
agauaucccuguucaguac

SEQ ID NO: 737680 - RNA, 19 nt, Homo sapiens
aagccaaacuuucugucuu

SEQ ID NO: 737681 - RNA, 19 nt, Homo sapiens
gccaaauucuugcauacag

SEQ ID NO: 737682 - RNA, 19 nt, Homo sapiens
aagcaucggucggaguaaa

SEQ ID NO: 737683 - RNA, 19 nt, Homo sapiens
gaggauugcagaaaugaca

SEQ ID NO: 737684 - RNA, 19 nt, Homo sapiens
gacagugccugcaggaaaa

SEQ ID NO: 737685 - RNA, 19 nt, Homo sapiens
aacgauugaugaaguaguu

SEQ ID NO: 737686 - RNA, 19 nt, Homo sapiens
ccuggcagaugaagacuca

SEQ ID NO: 737687 - RNA, 19 nt, Homo sapiens
agaagcaucggucggagua

SEQ ID NO: 737688 - RNA, 19 nt, Homo sapiens
ugaugcagcuauggaguga

SEQ ID NO: 737689 - RNA, 19 nt, Homo sapiens
gauauugaacccaccauac

SEQ ID NO: 737690 - RNA, 19 nt, Homo sapiens
ugaagaugaucgaauugag

SEQ ID NO: 737691 - RNA, 19 nt, Homo sapiens
gucagaagccucauagaca

SEQ ID NO: 737692 - RNA, 19 nt, Homo sapiens
ccaaaguucuugaucaaua

SEQ ID NO: 737693 - RNA, 19 nt, Homo sapiens
ccaaggacauuaaggguua

SEQ ID NO: 737694 - RNA, 19 nt, Homo sapiens
agaagaagcugaacgagua

SEQ ID NO: 737695 - RNA, 19 nt, Homo sapiens
gagauugguuccuacuuua

SEQ ID NO: 737696 - RNA, 19 nt, Homo sapiens
ggagauugguuccuacuuu

SEQ ID NO: 737697 - RNA, 19 nt, Homo sapiens
gaucaaagguuuucacuaa

SEQ ID NO: 737698 - RNA, 19 nt, Homo sapiens
gaagauaacaauuggugua

SEQ ID NO: 737699 - RNA, 19 nt, Homo sapiens
caacaucccugguuacaag

SEQ ID NO: 737700 - RNA, 19 nt, Homo sapiens
ggacgaagauaacaauugg

SEQ ID NO: 737701 - RNA, 19 nt, Homo sapiens
ucacagcucuuccuuacuu

SEQ ID NO: 737702 - RNA, 19 nt, Homo sapiens
ccaacacacucgagucuuu

SEQ ID NO: 737703 - RNA, 19 nt, Homo sapiens
agagaaagcuggucaucaa

SEQ ID NO: 737704 - RNA, 19 nt, Homo sapiens
ggucaaaggacgaagauaa

SEQ ID NO: 737705 - RNA, 19 nt, Homo sapiens
gaauugaugguaucuguuu

SEQ ID NO: 737706 - RNA, 19 nt, Homo sapiens
gcugagaucugggacauga

SEQ ID NO: 737707 - RNA, 19 nt, Homo sapiens
gaaccucagugaauguaug

SEQ ID NO: 737708 - RNA, 19 nt, Homo sapiens
uugcagaucuaaagaagua

SEQ ID NO: 737709 - RNA, 19 nt, Homo sapiens
gaugucgucuuccuauuga

SEQ ID NO: 737710 - RNA, 19 nt, Homo sapiens
gaacaagcagcaaaugaga

SEQ ID NO: 737711 - RNA, 19 nt, Homo sapiens
ggucaucaaugcugcuuug

SEQ ID NO: 737712 - RNA, 19 nt, Homo sapiens
gugaauguauggacccuaa

SEQ ID NO: 737713 - RNA, 19 nt, Homo sapiens
uagccaagguguuuaauuc

SEQ ID NO: 737714 - RNA, 19 nt, Homo sapiens
gccagaggauucaacauga

SEQ ID NO: 737715 - RNA, 19 nt, Homo sapiens
gaucuaaaucucaaacuga

SEQ ID NO: 737716 - RNA, 19 nt, Homo sapiens
gcagagauguggagcaacu

SEQ ID NO: 737717 - RNA, 19 nt, Homo sapiens
caaaugagauaugggaauc

SEQ ID NO: 737718 - RNA, 19 nt, Homo sapiens
ucuaugaguuugaagauug

SEQ ID NO: 737719 - RNA, 19 nt, Homo sapiens
aaacugauguguuggagau

SEQ ID NO: 737720 - RNA, 19 nt, Homo sapiens
gaaagcuggucaucaaugc

SEQ ID NO: 737721 - RNA, 19 nt, Homo sapiens
caccuuggguugcaaugua

SEQ ID NO: 737722 - RNA, 19 nt, Homo sapiens
gcagauaagaagcuccuuu

SEQ ID NO: 737723 - RNA, 19 nt, Homo sapiens
gaaauaauggcggcagcua

SEQ ID NO: 737724 - RNA, 19 nt, Homo sapiens
guuacaagcuuggcugcua

SEQ ID NO: 737725 - RNA, 19 nt, Homo sapiens
gagcaagcccgcagagaug

SEQ ID NO: 737726 - RNA, 19 nt, Homo sapiens
gguugugucugucaaaugu

SEQ ID NO: 737727 - RNA, 19 nt, Homo sapiens
ggaucuaaaucucaaacug

SEQ ID NO: 737728 - RNA, 19 nt, Homo sapiens
gaacgaguaucggcuggau

SEQ ID NO: 737729 - RNA, 19 nt, Homo sapiens
ggcaugaguugacccagaa

SEQ ID NO: 737730 - RNA, 19 nt, Homo sapiens
ugagacacaucacauuugu

SEQ ID NO: 737731 - RNA, 19 nt, Homo sapiens
gugcugguuuccuugcuua

SEQ ID NO: 737732 - RNA, 19 nt, Homo sapiens
ccaagguguuuaauucuuc

SEQ ID NO: 737733 - RNA, 19 nt, Homo sapiens
ggauggccuuugaggaauu

SEQ ID NO: 737734 - RNA, 19 nt, Homo sapiens
cuacagugauuucuuccaa

SEQ ID NO: 737735 - RNA, 19 nt, Homo sapiens
ccacuucuacuauugguuu

SEQ ID NO: 737736 - RNA, 19 nt, Homo sapiens
gcuauuggaacacuguaua

SEQ ID NO: 737737 - RNA, 19 nt, Homo sapiens
gccaagguguuuaauucuu

SEQ ID NO: 737738 - RNA, 19 nt, Homo sapiens
ggauuugacacauuuguug

SEQ ID NO: 737739 - RNA, 19 nt, Homo sapiens
caagaucuccuacuccaau

SEQ ID NO: 737740 - RNA, 19 nt, Homo sapiens
gagaacauggugcugguuu

SEQ ID NO: 737741 - RNA, 19 nt, Homo sapiens
acaagcagcaaaugagaua

SEQ ID NO: 737742 - RNA, 19 nt, Homo sapiens
ggauuucuuucacgguuug

SEQ ID NO: 737743 - RNA, 19 nt, Homo sapiens
aagugaagcuuccagaaau

SEQ ID NO: 737744 - RNA, 19 nt, Homo sapiens
gcucuuccuuacuucuuaa

SEQ ID NO: 737745 - RNA, 19 nt, Homo sapiens
gcaaaugagauaugggaau

SEQ ID NO: 737746 - RNA, 19 nt, Homo sapiens
ccaguucagagcuaaauaa

SEQ ID NO: 737747 - RNA, 19 nt, Homo sapiens
caaugcugcuuugggauuu

SEQ ID NO: 737748 - RNA, 19 nt, Homo sapiens
gcccacagauggaguagca

SEQ ID NO: 737749 - RNA, 19 nt, Homo sapiens
uaugaucccuguaacuuag

SEQ ID NO: 737750 - RNA, 19 nt, Homo sapiens
ggaacaagcagcaaaugag

SEQ ID NO: 737751 - RNA, 19 nt, Homo sapiens
gaacgagaaggauuuaacu

SEQ ID NO: 737752 - RNA, 19 nt, Homo sapiens
gaagaaaccaaagcagcaa

SEQ ID NO: 737753 - RNA, 19 nt, Homo sapiens
ggagcaagcccgcagagau

SEQ ID NO: 737754 - RNA, 19 nt, Homo sapiens
caaguaugaugagaacaug

SEQ ID NO: 737755 - RNA, 19 nt, Homo sapiens
ccagcucgcuuaacauugg

SEQ ID NO: 737756 - RNA, 19 nt, Homo sapiens
cauuaaggguuauuacuac

SEQ ID NO: 737757 - RNA, 19 nt, Homo sapiens
gaagcucccaaggacauua

SEQ ID NO: 737758 - RNA, 19 nt, Homo sapiens
aagguuagcugagucauca

SEQ ID NO: 737759 - RNA, 19 nt, Homo sapiens
gaguuuaccucucauucag

SEQ ID NO: 737760 - RNA, 19 nt, Homo sapiens
gggauuucuuucacgguuu

SEQ ID NO: 737761 - RNA, 19 nt, Homo sapiens
gauggccuuugaggaauuu

SEQ ID NO: 737762 - RNA, 19 nt, Homo sapiens
caaaggacgaagauaacaa

SEQ ID NO: 737763 - RNA, 19 nt, Homo sapiens
ugaucaauaugaacgagaa

SEQ ID NO: 737764 - RNA, 19 nt, Homo sapiens
ggcagccucucuaugaguu

SEQ ID NO: 737765 - RNA, 19 nt, Homo sapiens
uagcccagauuguccuaaa

SEQ ID NO: 737766 - RNA, 19 nt, Homo sapiens
gugcauaugauaaucuuug

SEQ ID NO: 737767 - RNA, 19 nt, Homo sapiens
gccuuggccuugcuauuga

SEQ ID NO: 737768 - RNA, 19 nt, Homo sapiens
gugacgaucggaugaauga

SEQ ID NO: 737769 - RNA, 19 nt, Homo sapiens
uggaauugaugguaucugu

SEQ ID NO: 737770 - RNA, 19 nt, Homo sapiens
ccgcagagauguggagcaa

SEQ ID NO: 737771 - RNA, 19 nt, Homo sapiens
agucaucaguggaucuaaa

SEQ ID NO: 737772 - RNA, 19 nt, Homo sapiens
gaguagcaguuuccagucu

SEQ ID NO: 737773 - RNA, 19 nt, Homo sapiens
gaagaagcugaacgaguau

SEQ ID NO: 737774 - RNA, 19 nt, Homo sapiens
caagguguuuaauucuuca

SEQ ID NO: 737775 - RNA, 19 nt, Homo sapiens
caaccucucuugggcuugu

SEQ ID NO: 737776 - RNA, 19 nt, Homo sapiens
uugccaacaucccugguua

SEQ ID NO: 737777 - RNA, 19 nt, Homo sapiens
cuccugggcucaucgcuuu

SEQ ID NO: 737778 - RNA, 19 nt, Homo sapiens
gugaacuucuccaguguca

SEQ ID NO: 737779 - RNA, 19 nt, Homo sapiens
ucaacaaguuccuccucuu

SEQ ID NO: 737780 - RNA, 19 nt, Homo sapiens
ugacuggucuuacauugcu

SEQ ID NO: 737781 - RNA, 19 nt, Homo sapiens
ugccuuggauguuggguuu

SEQ ID NO: 737782 - RNA, 19 nt, Homo sapiens
gguccuagcagcccacaga

SEQ ID NO: 737783 - RNA, 19 nt, Homo sapiens
gaacacuguauaacaccaa

SEQ ID NO: 737784 - RNA, 19 nt, Homo sapiens
gcugcuacuucugcaauga

SEQ ID NO: 737785 - RNA, 19 nt, Homo sapiens
gacauggucugaagaaacc

SEQ ID NO: 737786 - RNA, 19 nt, Homo sapiens
gcauuuagcccagauuguc

SEQ ID NO: 737787 - RNA, 19 nt, Homo sapiens
agucacagcucuuccuuac

SEQ ID NO: 737788 - RNA, 19 nt, Homo sapiens
ccagagaccggaccuugga

SEQ ID NO: 737789 - RNA, 19 nt, Homo sapiens
ggacauuaaggguuauuac

SEQ ID NO: 737790 - RNA, 19 nt, Homo sapiens
uuugggauuugacacauuu

SEQ ID NO: 737791 - RNA, 19 nt, Homo sapiens
gcaguuggaugggaaaaga

SEQ ID NO: 737792 - RNA, 19 nt, Homo sapiens
ggacgauccuccuccaaga

SEQ ID NO: 737793 - RNA, 19 nt, Homo sapiens
agacagcccucuugcagaa

SEQ ID NO: 737794 - RNA, 19 nt, Homo sapiens
acucagacguggauaaaga

SEQ ID NO: 737795 - RNA, 19 nt, Homo sapiens
gucaggaacucgacucaga

SEQ ID NO: 737796 - RNA, 19 nt, Homo sapiens
cgacugaggcggagacgaa

SEQ ID NO: 737797 - RNA, 19 nt, Homo sapiens
agacguggauaaagauaau

SEQ ID NO: 737798 - RNA, 19 nt, Homo sapiens
cugcguggcuugucaggaa

SEQ ID NO: 737799 - RNA, 19 nt, Homo sapiens
gcacacagacagcccucuu

SEQ ID NO: 737800 - RNA, 19 nt, Homo sapiens
gucauggccugcacacaga

SEQ ID NO: 737801 - RNA, 19 nt, Homo sapiens
cgacucagacguggauaaa

SEQ ID NO: 737802 - RNA, 19 nt, Homo sapiens
ugcagcagcuacagcacua

SEQ ID NO: 737803 - RNA, 19 nt, Homo sapiens
gauccuccuccaagacaaa

SEQ ID NO: 737804 - RNA, 19 nt, Homo sapiens
cagacguggauaaagauaa

SEQ ID NO: 737805 - RNA, 19 nt, Homo sapiens
ucagacguggauaaagaua

SEQ ID NO: 737806 - RNA, 19 nt, Homo sapiens
ccagcuguguggccuuauc

SEQ ID NO: 737807 - RNA, 19 nt, Homo sapiens
acuaucugcugcgcgguua

SEQ ID NO: 737808 - RNA, 19 nt, Homo sapiens
gcagcuacagcacuaagag

SEQ ID NO: 737809 - RNA, 19 nt, Homo sapiens
acaaacagcggaaaaucua

SEQ ID NO: 737810 - RNA, 19 nt, Homo sapiens
aagagaagccccugagaaa

SEQ ID NO: 737811 - RNA, 19 nt, Homo sapiens
ccugcugugccuccaaaua

SEQ ID NO: 737812 - RNA, 19 nt, Homo sapiens
ggacuuggauacugauuau

SEQ ID NO: 737813 - RNA, 19 nt, Homo sapiens
gaaagaggcggaagauguu

SEQ ID NO: 737814 - RNA, 19 nt, Homo sapiens
ggucgcuccugcaguauua

SEQ ID NO: 737815 - RNA, 19 nt, Homo sapiens
ccaaugaucccaagacaaa

SEQ ID NO: 737816 - RNA, 19 nt, Homo sapiens
gaaaguggcagacucaaag

SEQ ID NO: 737817 - RNA, 19 nt, Homo sapiens
caaagcagaugcccucuac

SEQ ID NO: 737818 - RNA, 19 nt, Homo sapiens
gaacgucacccagguauuc

SEQ ID NO: 737819 - RNA, 19 nt, Homo sapiens
ugaacucccugucacauga

SEQ ID NO: 737820 - RNA, 19 nt, Homo sapiens
cauccuacuuccucaauga

SEQ ID NO: 737821 - RNA, 19 nt, Homo sapiens
ggcggaagauguuauaugg

SEQ ID NO: 737822 - RNA, 19 nt, Homo sapiens
ggaccaggccgugaagaaa

SEQ ID NO: 737823 - RNA, 19 nt, Homo sapiens
agaaagaggcggaagaugu

SEQ ID NO: 737824 - RNA, 19 nt, Homo sapiens
uggagaaacugcaggacuu

SEQ ID NO: 737825 - RNA, 19 nt, Homo sapiens
gaaaggcuguuugcgaaaa

SEQ ID NO: 737826 - RNA, 19 nt, Homo sapiens
gcacguggagccuguguuc

SEQ ID NO: 737827 - RNA, 19 nt, Homo sapiens
ggaaaggcuguuugcgaaa

SEQ ID NO: 737828 - RNA, 19 nt, Homo sapiens
ggagaaagaggcggaagau

SEQ ID NO: 737829 - RNA, 19 nt, Homo sapiens
ggucuacgccaucuguuau

SEQ ID NO: 737830 - RNA, 19 nt, Homo sapiens
agaccauccuggagaaaga

SEQ ID NO: 737831 - RNA, 19 nt, Homo sapiens
ggucaaggccaaagcagau

SEQ ID NO: 737832 - RNA, 19 nt, Homo sapiens
gagcuggagagagacaaua

SEQ ID NO: 737833 - RNA, 19 nt, Homo sapiens
gaccaggccgugaagaaau

SEQ ID NO: 737834 - RNA, 19 nt, Homo sapiens
cuccaaaccucaucucuac

SEQ ID NO: 737835 - RNA, 19 nt, Homo sapiens
ggagaaacugcaggacuug

SEQ ID NO: 737836 - RNA, 19 nt, Homo sapiens
ugaaaguggcagacucaaa

SEQ ID NO: 737837 - RNA, 19 nt, Homo sapiens
guucuucccaccgauauuu

SEQ ID NO: 737838 - RNA, 19 nt, Homo sapiens
ggaagaucacauccuacuu

SEQ ID NO: 737839 - RNA, 19 nt, Homo sapiens
gagggacucaggaagauca

SEQ ID NO: 737840 - RNA, 19 nt, Homo sapiens
gaaacugcaggacuuggau

SEQ ID NO: 737841 - RNA, 19 nt, Homo sapiens
gcgcagcugcagcaaaguu

SEQ ID NO: 737842 - RNA, 19 nt, Homo sapiens
gcugaaaguggcagacuca

SEQ ID NO: 737843 - RNA, 19 nt, Homo sapiens
caggagggacucaggaaga

SEQ ID NO: 737844 - RNA, 19 nt, Homo sapiens
gggaccaggccgugaagaa

SEQ ID NO: 737845 - RNA, 19 nt, Homo sapiens
caaccugaacucccuguca

SEQ ID NO: 737846 - RNA, 19 nt, Homo sapiens
ucaaauacaaccugaacuc

SEQ ID NO: 737847 - RNA, 19 nt, Homo sapiens
ugcaggacuuggauacuga

SEQ ID NO: 737848 - RNA, 19 nt, Homo sapiens
ccaaagcagaugcccucua

SEQ ID NO: 737849 - RNA, 19 nt, Homo sapiens
acucaaagacccuauugga

SEQ ID NO: 737850 - RNA, 19 nt, Homo sapiens
aaacugcaggacuuggaua

SEQ ID NO: 737851 - RNA, 19 nt, Homo sapiens
gcaaaguuuucccgggauu

SEQ ID NO: 737852 - RNA, 19 nt, Homo sapiens
ggucaaauacaaccugaac

SEQ ID NO: 737853 - RNA, 19 nt, Homo sapiens
aaagaggcggaagauguua

SEQ ID NO: 737854 - RNA, 19 nt, Homo sapiens
uagggaugccagagacaua

SEQ ID NO: 737855 - RNA, 19 nt, Homo sapiens
gagcgggaaaggcuguuug

SEQ ID NO: 737856 - RNA, 19 nt, Homo sapiens
aauggcaguucguggagaa

SEQ ID NO: 737857 - RNA, 19 nt, Homo sapiens
aggcgcagcugcagcaaag

SEQ ID NO: 737858 - RNA, 19 nt, Homo sapiens
caacccagacauuaaaauu

SEQ ID NO: 737859 - RNA, 19 nt, Homo sapiens
ggacucaggaagaucacau

SEQ ID NO: 737860 - RNA, 19 nt, Homo sapiens
agaggcggaagauguuaua

SEQ ID NO: 737861 - RNA, 19 nt, Homo sapiens
gagaaagaggcggaagaug

SEQ ID NO: 737862 - RNA, 19 nt, Homo sapiens
gaugugcugucuccaaacc

SEQ ID NO: 737863 - RNA, 19 nt, Homo sapiens
ucuacgccaucuguuauug

SEQ ID NO: 737864 - RNA, 19 nt, Homo sapiens
ucuccaaaccucaucucua

SEQ ID NO: 737865 - RNA, 19 nt, Homo sapiens
cugcaggacuuggauacug

SEQ ID NO: 737866 - RNA, 19 nt, Homo sapiens
agacucaaagacccuauug

SEQ ID NO: 737867 - RNA, 19 nt, Homo sapiens
gaacucccugucacaugau

SEQ ID NO: 737868 - RNA, 19 nt, Homo sapiens
ccaaaccucaucucuacca

SEQ ID NO: 737869 - RNA, 19 nt, Homo sapiens
ggaggaggcugaugcuuua

SEQ ID NO: 737870 - RNA, 19 nt, Homo sapiens
gcacacaccuucuuuguag

SEQ ID NO: 737871 - RNA, 19 nt, Homo sapiens
gggaggacauggcuaagua

SEQ ID NO: 737872 - RNA, 19 nt, Homo sapiens
ggacauggcuaaguacaga

SEQ ID NO: 737873 - RNA, 19 nt, Homo sapiens
caauaaaggucgugaagau

SEQ ID NO: 737874 - RNA, 19 nt, Homo sapiens
gaacacagccccaguaguu

SEQ ID NO: 737875 - RNA, 19 nt, Homo sapiens
ggaggcugaugcuuuaaau

SEQ ID NO: 737876 - RNA, 19 nt, Homo sapiens
gggaggaggcugaugcuuu

SEQ ID NO: 737877 - RNA, 19 nt, Homo sapiens
ggaggaagaggaagaggaa

SEQ ID NO: 737878 - RNA, 19 nt, Homo sapiens
gaagaggccuugggaccau

SEQ ID NO: 737879 - RNA, 19 nt, Homo sapiens
ccucucggcucccgcauuu

SEQ ID NO: 737880 - RNA, 19 nt, Homo sapiens
acaagggccuggacucaga

SEQ ID NO: 737881 - RNA, 19 nt, Homo sapiens
gagcugccgugcugacugu

SEQ ID NO: 737882 - RNA, 19 nt, Homo sapiens
gagggccuauuaccaguug

SEQ ID NO: 737883 - RNA, 19 nt, Homo sapiens
ccaaagcccuugaccuacu

SEQ ID NO: 737884 - RNA, 19 nt, Homo sapiens
gaccagcuuuguccacuca

SEQ ID NO: 737885 - RNA, 19 nt, Homo sapiens
ggaagaggaagaggaagaa

SEQ ID NO: 737886 - RNA, 19 nt, Homo sapiens
cagagaggaucaagagaag

SEQ ID NO: 737887 - RNA, 19 nt, Homo sapiens
gcaauaaaggucgugaaga

SEQ ID NO: 737888 - RNA, 19 nt, Homo sapiens
ucagagaggaucaagagaa

SEQ ID NO: 737889 - RNA, 19 nt, Homo sapiens
ccuauuaccaguugaagaa

SEQ ID NO: 737890 - RNA, 19 nt, Homo sapiens
ugaguguccugcucuucua

SEQ ID NO: 737891 - RNA, 19 nt, Homo sapiens
gcugaugcuuuaaaugaag

SEQ ID NO: 737892 - RNA, 19 nt, Homo sapiens
gauguggccacuugacuug

SEQ ID NO: 737893 - RNA, 19 nt, Homo sapiens
ggaggaggaggaagaggaa

SEQ ID NO: 737894 - RNA, 19 nt, Homo sapiens
gcucagagaggaucaagag

SEQ ID NO: 737895 - RNA, 19 nt, Homo sapiens
ggcugaugcuuuaaaugaa

SEQ ID NO: 737896 - RNA, 19 nt, Homo sapiens
ggacauccagcgcuucauc

SEQ ID NO: 737897 - RNA, 19 nt, Homo sapiens
gucgggagcccuacaacua

SEQ ID NO: 737898 - RNA, 19 nt, Homo sapiens
gaagaggaagaggaagaaa

SEQ ID NO: 737899 - RNA, 19 nt, Homo sapiens
gcuaaguacagacgaaugu

SEQ ID NO: 737900 - RNA, 19 nt, Homo sapiens
cugcagcccuggacagaug

SEQ ID NO: 737901 - RNA, 19 nt, Homo sapiens
cagcugaggcggcuacaug

SEQ ID NO: 737902 - RNA, 19 nt, Homo sapiens
aggcugaugcuuuaaauga

SEQ ID NO: 737903 - RNA, 19 nt, Homo sapiens
agacgaaugucgggaguuc

SEQ ID NO: 737904 - RNA, 19 nt, Homo sapiens
cagcuccggugucgagaau

SEQ ID NO: 737905 - RNA, 19 nt, Homo sapiens
caaagcccuugaccuacug

SEQ ID NO: 737906 - RNA, 19 nt, Homo sapiens
agccaaagcccuugaccua

SEQ ID NO: 737907 - RNA, 19 nt, Homo sapiens
ggauguggccacuugacuu

SEQ ID NO: 737908 - RNA, 19 nt, Homo sapiens
uugaggauguggccacuug

SEQ ID NO: 737909 - RNA, 19 nt, Homo sapiens
gagaggaucaagagaagag

SEQ ID NO: 737910 - RNA, 19 nt, Homo sapiens
gcagcacacaccuucuuug

SEQ ID NO: 737911 - RNA, 19 nt, Homo sapiens
ccacucagcacucuucucu

SEQ ID NO: 737912 - RNA, 19 nt, Homo sapiens
acucagcacucuucucucu

SEQ ID NO: 737913 - RNA, 19 nt, Homo sapiens
cagcacacaccuucuuugu

SEQ ID NO: 737914 - RNA, 19 nt, Homo sapiens
uagaaaauguccugagugu

SEQ ID NO: 737915 - RNA, 19 nt, Homo sapiens
ccgcagcgccauagaagga

SEQ ID NO: 737916 - RNA, 19 nt, Homo sapiens
gaggacauccagcgcuuca

SEQ ID NO: 737917 - RNA, 19 nt, Homo sapiens
gcccuccuccucccaguuu

SEQ ID NO: 737918 - RNA, 19 nt, Homo sapiens
caguuucucccucuuauuc

SEQ ID NO: 737919 - RNA, 19 nt, Homo sapiens
gcagcuggcuaaggaugca

SEQ ID NO: 737920 - RNA, 19 nt, Homo sapiens
uaaaggucgugaagaucuc

SEQ ID NO: 737921 - RNA, 19 nt, Homo sapiens
ccugaggcacuuagagaaa

SEQ ID NO: 737922 - RNA, 19 nt, Homo sapiens
gcucaggugggcaaucugu

SEQ ID NO: 737923 - RNA, 19 nt, Homo sapiens
cccagucugugcaauaaag

SEQ ID NO: 737924 - RNA, 19 nt, Homo sapiens
cucccagucugugcaauaa

SEQ ID NO: 737925 - RNA, 19 nt, Homo sapiens
caaucugucccaggcuaua

SEQ ID NO: 737926 - RNA, 19 nt, Homo sapiens
gcaaucugucccaggcuau

SEQ ID NO: 737927 - RNA, 19 nt, Homo sapiens
ggcagcacacaccuucuuu

SEQ ID NO: 737928 - RNA, 19 nt, Homo sapiens
cccaguuucucccucuuau

SEQ ID NO: 737929 - RNA, 19 nt, Homo sapiens
gcggacuccucuaccucaa

SEQ ID NO: 737930 - RNA, 19 nt, Homo sapiens
cuacaagggccuggacuca

SEQ ID NO: 737931 - RNA, 19 nt, Homo sapiens
caccagaggguccaagaca

SEQ ID NO: 737932 - RNA, 19 nt, Homo sapiens
cacaggaggaggaggaaga

SEQ ID NO: 737933 - RNA, 19 nt, Homo sapiens
uccucuaccucaacgauga

SEQ ID NO: 737934 - RNA, 19 nt, Homo sapiens
acacuggccuggagcuacu

SEQ ID NO: 737935 - RNA, 19 nt, Homo sapiens
ccagaggguccaagacaag

SEQ ID NO: 737936 - RNA, 19 nt, Homo sapiens
gcagaugcgggaggacaug

SEQ ID NO: 737937 - RNA, 19 nt, Homo sapiens
ccauagaaggagagcaaga

SEQ ID NO: 737938 - RNA, 19 nt, Homo sapiens
gcagucagggugcuaagcu

SEQ ID NO: 737939 - RNA, 19 nt, Homo sapiens
ggaagaugauggcagauua

SEQ ID NO: 737940 - RNA, 19 nt, Homo sapiens
gaacauguccggucuaaga

SEQ ID NO: 737941 - RNA, 19 nt, Homo sapiens
gagaagaccauccaccuua

SEQ ID NO: 737942 - RNA, 19 nt, Homo sapiens
gagcugcccuuguuucuug

SEQ ID NO: 737943 - RNA, 19 nt, Homo sapiens
ggaaagagacuggaagaug

SEQ ID NO: 737944 - RNA, 19 nt, Homo sapiens
gcaaugaucgagacuaaga

SEQ ID NO: 737945 - RNA, 19 nt, Homo sapiens
caucagaaagggcaacuua

SEQ ID NO: 737946 - RNA, 19 nt, Homo sapiens
aagcaaugaucgagacuaa

SEQ ID NO: 737947 - RNA, 19 nt, Homo sapiens
caacgaacacaucuucuga

SEQ ID NO: 737948 - RNA, 19 nt, Homo sapiens
gggauuuaaugaccuuuga

SEQ ID NO: 737949 - RNA, 19 nt, Homo sapiens
ccaacucuauguuucuuug

SEQ ID NO: 737950 - RNA, 19 nt, Homo sapiens
ugagaugaguagaguaaga

SEQ ID NO: 737951 - RNA, 19 nt, Homo sapiens
agacccagauugugacuug

SEQ ID NO: 737952 - RNA, 19 nt, Homo sapiens
guauauugcccaacucuau

SEQ ID NO: 737953 - RNA, 19 nt, Homo sapiens
gcagagauggcucccaaug

SEQ ID NO: 737954 - RNA, 19 nt, Homo sapiens
uggguaggaugaaguauau

SEQ ID NO: 737955 - RNA, 19 nt, Homo sapiens
ugaaguauauugcccaacu

SEQ ID NO: 737956 - RNA, 19 nt, Homo sapiens
agaagccucucaucuuaug

SEQ ID NO: 737957 - RNA, 19 nt, Homo sapiens
gguaggaugaaguauauug

SEQ ID NO: 737958 - RNA, 19 nt, Homo sapiens
agaaugagaugaguagagu

SEQ ID NO: 737959 - RNA, 19 nt, Homo sapiens
gcagauuacggcaucagaa

SEQ ID NO: 737960 - RNA, 19 nt, Homo sapiens
gcacaagugaaagcaauga

SEQ ID NO: 737961 - RNA, 19 nt, Homo sapiens
aagaacauguccggucuaa

SEQ ID NO: 737962 - RNA, 19 nt, Homo sapiens
ggauggguaggaugaagua

SEQ ID NO: 737963 - RNA, 19 nt, Homo sapiens
gaugaguagaguaagauuu

SEQ ID NO: 737964 - RNA, 19 nt, Homo sapiens
gagacuaagacggguauaa

SEQ ID NO: 737965 - RNA, 19 nt, Homo sapiens
gaggaaugggauuuaauga

SEQ ID NO: 737966 - RNA, 19 nt, Homo sapiens
gaaagggcaacuuacucuu

SEQ ID NO: 737967 - RNA, 19 nt, Homo sapiens
augaggagcugcccuuguu

SEQ ID NO: 737968 - RNA, 19 nt, Homo sapiens
cgaggaaugggauuuaaug

SEQ ID NO: 737969 - RNA, 19 nt, Homo sapiens
gaaguauauugcccaacuc

SEQ ID NO: 737970 - RNA, 19 nt, Homo sapiens
cagauuacggcaucagaaa

SEQ ID NO: 737971 - RNA, 19 nt, Homo sapiens
aaugagaugaguagaguaa

SEQ ID NO: 737972 - RNA, 19 nt, Homo sapiens
gacuugcaauggaaagaga

SEQ ID NO: 737973 - RNA, 19 nt, Homo sapiens
gaagaugauggcagauuac

SEQ ID NO: 737974 - RNA, 19 nt, Homo sapiens
gggaagaugauggcagauu

SEQ ID NO: 737975 - RNA, 19 nt, Homo sapiens
ccugagacccagauuguga

SEQ ID NO: 737976 - RNA, 19 nt, Homo sapiens
gagaaugagaugaguagag

SEQ ID NO: 737977 - RNA, 19 nt, Homo sapiens
agagauggcucccaaugcu

SEQ ID NO: 737978 - RNA, 19 nt, Homo sapiens
gauuuaaugaccuuugaug

SEQ ID NO: 737979 - RNA, 19 nt, Homo sapiens
gcugggcuccaagaucuua

SEQ ID NO: 737980 - RNA, 19 nt, Homo sapiens
gcccaacucuauguuucuu

SEQ ID NO: 737981 - RNA, 19 nt, Homo sapiens
gaaugagaugaguagagua

SEQ ID NO: 737982 - RNA, 19 nt, Homo sapiens
uggcacaagugaaagcaau

SEQ ID NO: 737983 - RNA, 19 nt, Homo sapiens
gagaugaguagaguaagau

SEQ ID NO: 737984 - RNA, 19 nt, Homo sapiens
ggugggauggguaggauga

SEQ ID NO: 737985 - RNA, 19 nt, Homo sapiens
agacuaagacggguauaau

SEQ ID NO: 737986 - RNA, 19 nt, Homo sapiens
ccauccaccuuacccugaa

SEQ ID NO: 737987 - RNA, 19 nt, Homo sapiens
gaggagcugcccuuguuuc

SEQ ID NO: 737988 - RNA, 19 nt, Homo sapiens
gugcaggaccagguucuuu

SEQ ID NO: 737989 - RNA, 19 nt, Homo sapiens
aaagggcaacuuacucuuc

SEQ ID NO: 737990 - RNA, 19 nt, Homo sapiens
gacuaagacggguauaauc

SEQ ID NO: 737991 - RNA, 19 nt, Homo sapiens
gaugccaacccauaugaca

SEQ ID NO: 737992 - RNA, 19 nt, Homo sapiens
agaagaccauccaccuuac

SEQ ID NO: 737993 - RNA, 19 nt, Homo sapiens
gaugaggagcugcccuugu

SEQ ID NO: 737994 - RNA, 19 nt, Homo sapiens
uaaugagaaugagaugagu

SEQ ID NO: 737995 - RNA, 19 nt, Homo sapiens
agaaagggcaacuuacucu

SEQ ID NO: 737996 - RNA, 19 nt, Homo sapiens
ucagaaagggcaacuuacu

SEQ ID NO: 737997 - RNA, 19 nt, Homo sapiens
cauccaccuuacccugaaa

SEQ ID NO: 737998 - RNA, 19 nt, Homo sapiens
gauuacggcaucagaaagg

SEQ ID NO: 737999 - RNA, 19 nt, Homo sapiens
caauggaaagagacuggaa

SEQ ID NO: 738000 - RNA, 19 nt, Homo sapiens
uccgaggaaugggauuuaa

SEQ ID NO: 738001 - RNA, 19 nt, Homo sapiens
gagauggcucccaaugcuu

SEQ ID NO: 738002 - RNA, 19 nt, Homo sapiens
acaaagagaagaccaucca

SEQ ID NO: 738003 - RNA, 19 nt, Homo sapiens
caacucuauguuucuuuga

SEQ ID NO: 738004 - RNA, 19 nt, Homo sapiens
ccuuugaugccaacccaua

SEQ ID NO: 738005 - RNA, 19 nt, Homo sapiens
acuggaagaugggaagaug

SEQ ID NO: 738006 - RNA, 19 nt, Homo sapiens
ccagcucaguggcacaagu

SEQ ID NO: 738007 - RNA, 19 nt, Homo sapiens
augaguagaguaagauuug

SEQ ID NO: 738008 - RNA, 19 nt, Homo sapiens
uuaaugagaaugagaugag

SEQ ID NO: 738009 - RNA, 19 nt, Homo sapiens
ucaacgaacacaucuucug

SEQ ID NO: 738010 - RNA, 19 nt, Homo sapiens
uauauugcccaacucuaug

SEQ ID NO: 738011 - RNA, 19 nt, Homo sapiens
ggagcugcccuuguuucuu

SEQ ID NO: 738012 - RNA, 19 nt, Homo sapiens
cagaaagggcaacuuacuc

SEQ ID NO: 738013 - RNA, 19 nt, Homo sapiens
gcucaguggcacaagugaa

SEQ ID NO: 738014 - RNA, 19 nt, Homo sapiens
gcagaagaguauuaagaaa

SEQ ID NO: 738015 - RNA, 19 nt, Homo sapiens
gcgaagaccuggagaaaca

SEQ ID NO: 738016 - RNA, 19 nt, Homo sapiens
uaagaaagaugcucaaguc

SEQ ID NO: 738017 - RNA, 19 nt, Homo sapiens
gcaaacaggacucaucuga

SEQ ID NO: 738018 - RNA, 19 nt, Homo sapiens
guacagcgcccacgcauuc

SEQ ID NO: 738019 - RNA, 19 nt, Homo sapiens
ccaaugcagaagaguauua

SEQ ID NO: 738020 - RNA, 19 nt, Homo sapiens
gagcccagcuggugacaag

SEQ ID NO: 738021 - RNA, 19 nt, Homo sapiens
gagcgaagaccuggagaaa

SEQ ID NO: 738022 - RNA, 19 nt, Homo sapiens
acagaggccuggacaagga

SEQ ID NO: 738023 - RNA, 19 nt, Homo sapiens
cgacagaggcagacacaga

SEQ ID NO: 738024 - RNA, 19 nt, Homo sapiens
gggcagggaacgguuauuu

SEQ ID NO: 738025 - RNA, 19 nt, Homo sapiens
gugagagcccggaagauuu

SEQ ID NO: 738026 - RNA, 19 nt, Homo sapiens
ggaacugucacgacuggaa

SEQ ID NO: 738027 - RNA, 19 nt, Homo sapiens
cgagcgacaugucccuuug

SEQ ID NO: 738028 - RNA, 19 nt, Homo sapiens
cagcagugccgcagcguuu

SEQ ID NO: 738029 - RNA, 19 nt, Homo sapiens
gacagaggcagacacagaa

SEQ ID NO: 738030 - RNA, 19 nt, Homo sapiens
gaugaugugagaagaguuc

SEQ ID NO: 738031 - RNA, 19 nt, Homo sapiens
cagaagaguauuaagaaag

SEQ ID NO: 738032 - RNA, 19 nt, Homo sapiens
caaugcagaagaguauuaa

SEQ ID NO: 738033 - RNA, 19 nt, Homo sapiens
ucacgucggugcugaacag

SEQ ID NO: 738034 - RNA, 19 nt, Homo sapiens
gcccaaugcagaagaguau

SEQ ID NO: 738035 - RNA, 19 nt, Homo sapiens
gaugugagaagaguucaga

SEQ ID NO: 738036 - RNA, 19 nt, Homo sapiens
gaagaccuggagaaacaga

SEQ ID NO: 738037 - RNA, 19 nt, Homo sapiens
gcagaggaggcaccuguag

SEQ ID NO: 738038 - RNA, 19 nt, Homo sapiens
ugugagagcccggaagauu

SEQ ID NO: 738039 - RNA, 19 nt, Homo sapiens
gaaacagaacgcggcucua

SEQ ID NO: 738040 - RNA, 19 nt, Homo sapiens
caaacaggacucaucugau

SEQ ID NO: 738041 - RNA, 19 nt, Homo sapiens
ugcagaagaguauuaagaa

SEQ ID NO: 738042 - RNA, 19 nt, Homo sapiens
ggagugaacacgggaacug

SEQ ID NO: 738043 - RNA, 19 nt, Homo sapiens
ugagagcccggaagauuuc

SEQ ID NO: 738044 - RNA, 19 nt, Homo sapiens
gcgagcgacaugucccuuu

SEQ ID NO: 738045 - RNA, 19 nt, Homo sapiens
aaacagaacgcggcucuac

SEQ ID NO: 738046 - RNA, 19 nt, Homo sapiens
ccaaagcgagcgacauguc

SEQ ID NO: 738047 - RNA, 19 nt, Homo sapiens
gcccagaagagccgacaga

SEQ ID NO: 738048 - RNA, 19 nt, Homo sapiens
ggcccaaugcagaagagua

SEQ ID NO: 738049 - RNA, 19 nt, Homo sapiens
gcauuccaccaaccucaug

SEQ ID NO: 738050 - RNA, 19 nt, Homo sapiens
agacagaggccuggacaag

SEQ ID NO: 738051 - RNA, 19 nt, Homo sapiens
augcagaagaguauuaaga

SEQ ID NO: 738052 - RNA, 19 nt, Homo sapiens
gcaggcccaaugcagaaga

SEQ ID NO: 738053 - RNA, 19 nt, Homo sapiens
ggcagaggaggcaccugua

SEQ ID NO: 738054 - RNA, 19 nt, Homo sapiens
ucaaagugcugacaaauaa

SEQ ID NO: 738055 - RNA, 19 nt, Homo sapiens
ucccaaagcucccaaauua

SEQ ID NO: 738056 - RNA, 19 nt, Homo sapiens
gcaaacaaauucuggaaau

SEQ ID NO: 738057 - RNA, 19 nt, Homo sapiens
gaaagaaaauggugaauug

SEQ ID NO: 738058 - RNA, 19 nt, Homo sapiens
guacugguguugaauauga

SEQ ID NO: 738059 - RNA, 19 nt, Homo sapiens
aaauaaagcuucugugaug

SEQ ID NO: 738060 - RNA, 19 nt, Homo sapiens
caacauacccucagcugua

SEQ ID NO: 738061 - RNA, 19 nt, Homo sapiens
uaaagaagaucucaaccuu

SEQ ID NO: 738062 - RNA, 19 nt, Homo sapiens
gcaagcagaugguggaaau

SEQ ID NO: 738063 - RNA, 19 nt, Homo sapiens
agaagcaucugaagaacua

SEQ ID NO: 738064 - RNA, 19 nt, Homo sapiens
gaaacaaacaggaagcaaa

SEQ ID NO: 738065 - RNA, 19 nt, Homo sapiens
gaaaggaaacaaacaggaa

SEQ ID NO: 738066 - RNA, 19 nt, Homo sapiens
cuaaagaacucccucaagu

SEQ ID NO: 738067 - RNA, 19 nt, Homo sapiens
gcacgauuauggcucauug

SEQ ID NO: 738068 - RNA, 19 nt, Homo sapiens
gcuagaagcaucugaagaa

SEQ ID NO: 738069 - RNA, 19 nt, Homo sapiens
ccaaagugcuggaauuuac

SEQ ID NO: 738070 - RNA, 19 nt, Homo sapiens
gcacagaugaacgaaguua

SEQ ID NO: 738071 - RNA, 19 nt, Homo sapiens
gcugggagcugggauuuga

SEQ ID NO: 738072 - RNA, 19 nt, Homo sapiens
gaagccaugaguucaguua

SEQ ID NO: 738073 - RNA, 19 nt, Homo sapiens
gauuggauauugugaagga

SEQ ID NO: 738074 - RNA, 19 nt, Homo sapiens
ccaaagcucccaaauuaga

SEQ ID NO: 738075 - RNA, 19 nt, Homo sapiens
cauaggaggacuugauaua

SEQ ID NO: 738076 - RNA, 19 nt, Homo sapiens
gguggaaauucuucacaaa

SEQ ID NO: 738077 - RNA, 19 nt, Homo sapiens
caggauggguaacuuuaaa

SEQ ID NO: 738078 - RNA, 19 nt, Homo sapiens
ugaagguguuccugaagua

SEQ ID NO: 738079 - RNA, 19 nt, Homo sapiens
guuggaagcugaagguguu

SEQ ID NO: 738080 - RNA, 19 nt, Homo sapiens
gcaccaccaugcccaccua

SEQ ID NO: 738081 - RNA, 19 nt, Homo sapiens
ugaaggaacugaaagaaaa

SEQ ID NO: 738082 - RNA, 19 nt, Homo sapiens
ggaggacuugauauaauua

SEQ ID NO: 738083 - RNA, 19 nt, Homo sapiens
ggaaauucuucacaaacau

SEQ ID NO: 738084 - RNA, 19 nt, Homo sapiens
gguagcacgcugcaaguua

SEQ ID NO: 738085 - RNA, 19 nt, Homo sapiens
uuagagacauucagauuca

SEQ ID NO: 738086 - RNA, 19 nt, Homo sapiens
ggcgaaaccucauaucuac

SEQ ID NO: 738087 - RNA, 19 nt, Homo sapiens
uaggaggacuugauauaau

SEQ ID NO: 738088 - RNA, 19 nt, Homo sapiens
gaaaccucauaucuacaaa

SEQ ID NO: 738089 - RNA, 19 nt, Homo sapiens
gaauugcugccuauacuga

SEQ ID NO: 738090 - RNA, 19 nt, Homo sapiens
gaaguucggcaaggauuaa

SEQ ID NO: 738091 - RNA, 19 nt, Homo sapiens
cuucugaaaugaccuggua

SEQ ID NO: 738092 - RNA, 19 nt, Homo sapiens
acaaauaaagcuucuguga

SEQ ID NO: 738093 - RNA, 19 nt, Homo sapiens
cugaagaacuagauacaau

SEQ ID NO: 738094 - RNA, 19 nt, Homo sapiens
ccucaaguuucauuuguga

SEQ ID NO: 738095 - RNA, 19 nt, Homo sapiens
cauacagcuuugucugaua

SEQ ID NO: 738096 - RNA, 19 nt, Homo sapiens
guagcacgcugcaaguuag

SEQ ID NO: 738097 - RNA, 19 nt, Homo sapiens
uggcagaguuagcuaaaga

SEQ ID NO: 738098 - RNA, 19 nt, Homo sapiens
gugcacagaugaacgaagu

SEQ ID NO: 738099 - RNA, 19 nt, Homo sapiens
aaauaguacugguguugaa

SEQ ID NO: 738100 - RNA, 19 nt, Homo sapiens
cagcuuugucugauauuua

SEQ ID NO: 738101 - RNA, 19 nt, Homo sapiens
ggauucagcaaacaaauuc

SEQ ID NO: 738102 - RNA, 19 nt, Homo sapiens
caaauaaagcuucugugau

SEQ ID NO: 738103 - RNA, 19 nt, Homo sapiens
aggaggacuugauauaauu

SEQ ID NO: 738104 - RNA, 19 nt, Homo sapiens
uugaagaaauugacucaug

SEQ ID NO: 738105 - RNA, 19 nt, Homo sapiens
ugaagaaguucggcaagga

SEQ ID NO: 738106 - RNA, 19 nt, Homo sapiens
caccaugcccaccuaauuu

SEQ ID NO: 738107 - RNA, 19 nt, Homo sapiens
uggaaauucuucacaaaca

SEQ ID NO: 738108 - RNA, 19 nt, Homo sapiens
caauggcucgugcuuguaa

SEQ ID NO: 738109 - RNA, 19 nt, Homo sapiens
ccaccaugcccaccuaauu

SEQ ID NO: 738110 - RNA, 19 nt, Homo sapiens
gugaaggaacugaaagaaa

SEQ ID NO: 738111 - RNA, 19 nt, Homo sapiens
cgaaaccucauaucuacaa

SEQ ID NO: 738112 - RNA, 19 nt, Homo sapiens
auacagcuuugucugauau

SEQ ID NO: 738113 - RNA, 19 nt, Homo sapiens
gugggaggauuggauauug

SEQ ID NO: 738114 - RNA, 19 nt, Homo sapiens
gaaguuggaagcugaaggu

SEQ ID NO: 738115 - RNA, 19 nt, Homo sapiens
gugaauugcugccuauacu

SEQ ID NO: 738116 - RNA, 19 nt, Homo sapiens
gaagaaguucggcaaggau

SEQ ID NO: 738117 - RNA, 19 nt, Homo sapiens
gcucauaggaggacuugau

SEQ ID NO: 738118 - RNA, 19 nt, Homo sapiens
gaguggaguugcccaaguc

SEQ ID NO: 738119 - RNA, 19 nt, Homo sapiens
ccacacuggcuuugaggua

SEQ ID NO: 738120 - RNA, 19 nt, Homo sapiens
ccgauuagauggugcacau

SEQ ID NO: 738121 - RNA, 19 nt, Homo sapiens
uggcgaaaccucauaucua

SEQ ID NO: 738122 - RNA, 19 nt, Homo sapiens
guauccaccuuucugaauc

SEQ ID NO: 738123 - RNA, 19 nt, Homo sapiens
gcagaugguggaaauucuu

SEQ ID NO: 738124 - RNA, 19 nt, Homo sapiens
gagaccagccugagcaaca

SEQ ID NO: 738125 - RNA, 19 nt, Homo sapiens
ggauggguaacuuuaaaga

SEQ ID NO: 738126 - RNA, 19 nt, Homo sapiens
ggagcuagaagcaucugaa

SEQ ID NO: 738127 - RNA, 19 nt, Homo sapiens
gcgcuaaugaacaucuuaa

SEQ ID NO: 738128 - RNA, 19 nt, Homo sapiens
uauauuggaggaugaagaa

SEQ ID NO: 738129 - RNA, 19 nt, Homo sapiens
gcuaaugaacaucuuaaag

SEQ ID NO: 738130 - RNA, 19 nt, Homo sapiens
gcacgcugcaaguuaguga

SEQ ID NO: 738131 - RNA, 19 nt, Homo sapiens
uuagcucuguucccacuuu

SEQ ID NO: 738132 - RNA, 19 nt, Homo sapiens
cgaaguuauggcagaguua

SEQ ID NO: 738133 - RNA, 19 nt, Homo sapiens
gaagguguuccugaaguau

SEQ ID NO: 738134 - RNA, 19 nt, Homo sapiens
ugacaaauaaagcuucugu

SEQ ID NO: 738135 - RNA, 19 nt, Homo sapiens
cucaaagugcugacaaaua

SEQ ID NO: 738136 - RNA, 19 nt, Homo sapiens
uuagaaaugguguggcuuu

SEQ ID NO: 738137 - RNA, 19 nt, Homo sapiens
ucauacagcuuugucugau

SEQ ID NO: 738138 - RNA, 19 nt, Homo sapiens
ccaggauggguaacuuuaa

SEQ ID NO: 738139 - RNA, 19 nt, Homo sapiens
gguauccaccuuucugaau

SEQ ID NO: 738140 - RNA, 19 nt, Homo sapiens
uaguacugguguugaauau

SEQ ID NO: 738141 - RNA, 19 nt, Homo sapiens
uaaauaguacugguguuga

SEQ ID NO: 738142 - RNA, 19 nt, Homo sapiens
cuaaauaguacugguguug

SEQ ID NO: 738143 - RNA, 19 nt, Homo sapiens
ucugugaugcucuuuauga

SEQ ID NO: 738144 - RNA, 19 nt, Homo sapiens
cuaccuauccucagcucua

SEQ ID NO: 738145 - RNA, 19 nt, Homo sapiens
ucaccaggauggguaacuu

SEQ ID NO: 738146 - RNA, 19 nt, Homo sapiens
cagcaaacaaauucuggaa

SEQ ID NO: 738147 - RNA, 19 nt, Homo sapiens
ggaaacaaacaggaagcaa

SEQ ID NO: 738148 - RNA, 19 nt, Homo sapiens
caaagugcugacaaauaaa

SEQ ID NO: 738149 - RNA, 19 nt, Homo sapiens
gcucccaaauuagaggaaa

SEQ ID NO: 738150 - RNA, 19 nt, Homo sapiens
ggacuugauauaauuaagg

SEQ ID NO: 738151 - RNA, 19 nt, Homo sapiens
gaaguuauggcagaguuag

SEQ ID NO: 738152 - RNA, 19 nt, Homo sapiens
caaguuagugaguggaguu

SEQ ID NO: 738153 - RNA, 19 nt, Homo sapiens
ucagacacaagcugcagua

SEQ ID NO: 738154 - RNA, 19 nt, Homo sapiens
ggaaugagccagauguuua

SEQ ID NO: 738155 - RNA, 19 nt, Homo sapiens
gcauaaagccucuguagaa

SEQ ID NO: 738156 - RNA, 19 nt, Homo sapiens
ggagacagcuguacguugu

SEQ ID NO: 738157 - RNA, 19 nt, Homo sapiens
ggacaaagggacuugauuu

SEQ ID NO: 738158 - RNA, 19 nt, Homo sapiens
uccaagagcugacaacuga

SEQ ID NO: 738159 - RNA, 19 nt, Homo sapiens
ugaagaagcugggaaagug

SEQ ID NO: 738160 - RNA, 19 nt, Homo sapiens
caacucauguccaauacug

SEQ ID NO: 738161 - RNA, 19 nt, Homo sapiens
uaaagccucuguagaagau

SEQ ID NO: 738162 - RNA, 19 nt, Homo sapiens
gcaaggugcaccagcuaua

SEQ ID NO: 738163 - RNA, 19 nt, Homo sapiens
ggacuugauuucucagauc

SEQ ID NO: 738164 - RNA, 19 nt, Homo sapiens
caaagggacuugauuucuc

SEQ ID NO: 738165 - RNA, 19 nt, Homo sapiens
gaagaugcagauacacaaa

SEQ ID NO: 738166 - RNA, 19 nt, Homo sapiens
gauaugaaucuggagaaua

SEQ ID NO: 738167 - RNA, 19 nt, Homo sapiens
caacuguuucugaccauua

SEQ ID NO: 738168 - RNA, 19 nt, Homo sapiens
ccagauagcagccuuguca

SEQ ID NO: 738169 - RNA, 19 nt, Homo sapiens
gacaauaccacccucuuga

SEQ ID NO: 738170 - RNA, 19 nt, Homo sapiens
ggacaauaccacccucuug

SEQ ID NO: 738171 - RNA, 19 nt, Homo sapiens
gaacgagauugccaagcau

SEQ ID NO: 738172 - RNA, 19 nt, Homo sapiens
guaauacuguacaacuguu

SEQ ID NO: 738173 - RNA, 19 nt, Homo sapiens
auagcagccuugucacuua

SEQ ID NO: 738174 - RNA, 19 nt, Homo sapiens
gaaugagccagauguuuau

SEQ ID NO: 738175 - RNA, 19 nt, Homo sapiens
gaagaagcugggaaaguga

SEQ ID NO: 738176 - RNA, 19 nt, Homo sapiens
gaacuuugccagcauugau

SEQ ID NO: 738177 - RNA, 19 nt, Homo sapiens
ugaacgagauugccaagca

SEQ ID NO: 738178 - RNA, 19 nt, Homo sapiens
caagaggacaggauaugaa

SEQ ID NO: 738179 - RNA, 19 nt, Homo sapiens
gagcaagccaugcaguuug

SEQ ID NO: 738180 - RNA, 19 nt, Homo sapiens
ggauaugaaucuggagaau

SEQ ID NO: 738181 - RNA, 19 nt, Homo sapiens
aaagggacuugauuucuca

SEQ ID NO: 738182 - RNA, 19 nt, Homo sapiens
ccuugucacuuaugaacua

SEQ ID NO: 738183 - RNA, 19 nt, Homo sapiens
aaaccaagaggacaggaua

SEQ ID NO: 738184 - RNA, 19 nt, Homo sapiens
ugagccagauguuuaugaa

SEQ ID NO: 738185 - RNA, 19 nt, Homo sapiens
gagagggucugggagugaa

SEQ ID NO: 738186 - RNA, 19 nt, Homo sapiens
ggaugaagaagcugggaaa

SEQ ID NO: 738187 - RNA, 19 nt, Homo sapiens
gcagccuugucacuuauga

SEQ ID NO: 738188 - RNA, 19 nt, Homo sapiens
gaauacagagugguagcua

SEQ ID NO: 738189 - RNA, 19 nt, Homo sapiens
cauaaagccucuguagaag

SEQ ID NO: 738190 - RNA, 19 nt, Homo sapiens
gaccagaugcugcaaucaa

SEQ ID NO: 738191 - RNA, 19 nt, Homo sapiens
caacaaagaacagcaaagg

SEQ ID NO: 738192 - RNA, 19 nt, Homo sapiens
gacaaagggacuugauuuc

SEQ ID NO: 738193 - RNA, 19 nt, Homo sapiens
gauagcagccuugucacuu

SEQ ID NO: 738194 - RNA, 19 nt, Homo sapiens
uuaugaaacuagcgaccua

SEQ ID NO: 738195 - RNA, 19 nt, Homo sapiens
ugggaaaggugaacgagau

SEQ ID NO: 738196 - RNA, 19 nt, Homo sapiens
ggaguucgaugcguuugca

SEQ ID NO: 738197 - RNA, 19 nt, Homo sapiens
ucucagaucguauuggaaa

SEQ ID NO: 738198 - RNA, 19 nt, Homo sapiens
gagcugacaagcacaagug

SEQ ID NO: 738199 - RNA, 19 nt, Homo sapiens
ggaaagugagcacauuugg

SEQ ID NO: 738200 - RNA, 19 nt, Homo sapiens
gggaaagugagcacauuug

SEQ ID NO: 738201 - RNA, 19 nt, Homo sapiens
gcagaugauugcuaauucc

SEQ ID NO: 738202 - RNA, 19 nt, Homo sapiens
cgaccuaccugaggaugau

SEQ ID NO: 738203 - RNA, 19 nt, Homo sapiens
gggaccagaugcugcaauc

SEQ ID NO: 738204 - RNA, 19 nt, Homo sapiens
gaggacaggauaugaaucu

SEQ ID NO: 738205 - RNA, 19 nt, Homo sapiens
ccauggcggacccuaaaua

SEQ ID NO: 738206 - RNA, 19 nt, Homo sapiens
gauaccacccagcagauga

SEQ ID NO: 738207 - RNA, 19 nt, Homo sapiens
uagcagccuugucacuuau

SEQ ID NO: 738208 - RNA, 19 nt, Homo sapiens
ggagagggucugggaguga

SEQ ID NO: 738209 - RNA, 19 nt, Homo sapiens
cagacaaccaugcgugaaa

SEQ ID NO: 738210 - RNA, 19 nt, Homo sapiens
caccagcuauaugaaacua

SEQ ID NO: 738211 - RNA, 19 nt, Homo sapiens
caggacaaguucucucaag

SEQ ID NO: 738212 - RNA, 19 nt, Homo sapiens
gaugcugcaaucaaccuua

SEQ ID NO: 738213 - RNA, 19 nt, Homo sapiens
ccaagaggacaggauauga

SEQ ID NO: 738214 - RNA, 19 nt, Homo sapiens
cgagcaagccaugcaguuu

SEQ ID NO: 738215 - RNA, 19 nt, Homo sapiens
agacagcuguacguuguga

SEQ ID NO: 738216 - RNA, 19 nt, Homo sapiens
ggaaaggugaacgagauug

SEQ ID NO: 738217 - RNA, 19 nt, Homo sapiens
gagcuggugcagagacuug

SEQ ID NO: 738218 - RNA, 19 nt, Homo sapiens
gagauugccaagcauaaag

SEQ ID NO: 738219 - RNA, 19 nt, Homo sapiens
gagacuuccugcucaucug

SEQ ID NO: 738220 - RNA, 19 nt, Homo sapiens
gggacuugauuucucagau

SEQ ID NO: 738221 - RNA, 19 nt, Homo sapiens
caaguucaaggacaagaga

SEQ ID NO: 738222 - RNA, 19 nt, Homo sapiens
ugccaacucauguccaaua

SEQ ID NO: 738223 - RNA, 19 nt, Homo sapiens
gguuuccccuuuacuauaa

SEQ ID NO: 738224 - RNA, 19 nt, Homo sapiens
uggaacacaucauugucaa

SEQ ID NO: 738225 - RNA, 19 nt, Homo sapiens
caaggugcaccagcuauau

SEQ ID NO: 738226 - RNA, 19 nt, Homo sapiens
ggacaaguucucucaagcu

SEQ ID NO: 738227 - RNA, 19 nt, Homo sapiens
ucgaugcguuugcacaaga

SEQ ID NO: 738228 - RNA, 19 nt, Homo sapiens
gggacaaagggacuugauu

SEQ ID NO: 738229 - RNA, 19 nt, Homo sapiens
ccagccacaugccaacuca

SEQ ID NO: 738230 - RNA, 19 nt, Homo sapiens
gugcaccagcuauaugaaa

SEQ ID NO: 738231 - RNA, 19 nt, Homo sapiens
gaaaggugaacgagauugc

SEQ ID NO: 738232 - RNA, 19 nt, Homo sapiens
gcccuagaccuugcaguuu

SEQ ID NO: 738233 - RNA, 19 nt, Homo sapiens
gcagacaaccaugcgugaa

SEQ ID NO: 738234 - RNA, 19 nt, Homo sapiens
cgagauugccaagcauaaa

SEQ ID NO: 738235 - RNA, 19 nt, Homo sapiens
gggaaaggugaacgagauu

SEQ ID NO: 738236 - RNA, 19 nt, Homo sapiens
uacagaguguccugggaaa

SEQ ID NO: 738237 - RNA, 19 nt, Homo sapiens
ucacuuaugaacuacauuc

SEQ ID NO: 738238 - RNA, 19 nt, Homo sapiens
ucaagacgacagugaagga

SEQ ID NO: 738239 - RNA, 19 nt, Homo sapiens
gaaucuggagaauaugaga

SEQ ID NO: 738240 - RNA, 19 nt, Homo sapiens
ugaugaauacagaguggua

SEQ ID NO: 738241 - RNA, 19 nt, Homo sapiens
ugaucaggaugcucagaau

SEQ ID NO: 738242 - RNA, 19 nt, Homo sapiens
uuucucagaucguauugga

SEQ ID NO: 738243 - RNA, 19 nt, Homo sapiens
cuugauuucucagaucgua

SEQ ID NO: 738244 - RNA, 19 nt, Homo sapiens
guggcugacuguaauacug

SEQ ID NO: 738245 - RNA, 19 nt, Homo sapiens
ggaaggauugggucuuguc

SEQ ID NO: 738246 - RNA, 19 nt, Homo sapiens
gugaaaaccuggccacagu

SEQ ID NO: 738247 - RNA, 19 nt, Homo sapiens
gagccagauguuuaugaaa

SEQ ID NO: 738248 - RNA, 19 nt, Homo sapiens
ugaaggagucagccacaga

SEQ ID NO: 738249 - RNA, 19 nt, Homo sapiens
guggaacacaucauuguca

SEQ ID NO: 738250 - RNA, 19 nt, Homo sapiens
uugaugaacggaugaagaa

SEQ ID NO: 738251 - RNA, 19 nt, Homo sapiens
aacuguuucugaccauuaa

SEQ ID NO: 738252 - RNA, 19 nt, Homo sapiens
uagaagaugcagauacaca

SEQ ID NO: 738253 - RNA, 19 nt, Homo sapiens
ggagacuuccugcucaucu

SEQ ID NO: 738254 - RNA, 19 nt, Homo sapiens
gaagaagaauuuggacuug

SEQ ID NO: 738255 - RNA, 19 nt, Homo sapiens
caucuaaacuuaaguggaa

SEQ ID NO: 738256 - RNA, 19 nt, Homo sapiens
ugaagaagaugaugaagau

SEQ ID NO: 738257 - RNA, 19 nt, Homo sapiens
ucucacacaucuaaacuua

SEQ ID NO: 738258 - RNA, 19 nt, Homo sapiens
ccaaagagccaaagaauag

SEQ ID NO: 738259 - RNA, 19 nt, Homo sapiens
ugaugaagaugaagaugua

SEQ ID NO: 738260 - RNA, 19 nt, Homo sapiens
gggcuuaacagcugaauuu

SEQ ID NO: 738261 - RNA, 19 nt, Homo sapiens
ggacgacgaugaagucagu

SEQ ID NO: 738262 - RNA, 19 nt, Homo sapiens
ccaaaucucacacaucuaa

SEQ ID NO: 738263 - RNA, 19 nt, Homo sapiens
aaagguagcugugauacaa

SEQ ID NO: 738264 - RNA, 19 nt, Homo sapiens
cagaugaccugcagaaaca

SEQ ID NO: 738265 - RNA, 19 nt, Homo sapiens
ggaagaaggugggaaaggu

SEQ ID NO: 738266 - RNA, 19 nt, Homo sapiens
ugaaggagaagaugauuaa

SEQ ID NO: 738267 - RNA, 19 nt, Homo sapiens
ggaguuugaugaagaagau

SEQ ID NO: 738268 - RNA, 19 nt, Homo sapiens
gaauaguuccugugacauu

SEQ ID NO: 738269 - RNA, 19 nt, Homo sapiens
caaagaauaguuccuguga

SEQ ID NO: 738270 - RNA, 19 nt, Homo sapiens
ggaagaagaauuuggacuu

SEQ ID NO: 738271 - RNA, 19 nt, Homo sapiens
caagcugccuaaauugaaa

SEQ ID NO: 738272 - RNA, 19 nt, Homo sapiens
uuaccaaccugaaugacua

SEQ ID NO: 738273 - RNA, 19 nt, Homo sapiens
gaagaggaguuugaugaag

SEQ ID NO: 738274 - RNA, 19 nt, Homo sapiens
ggacgaagaaggagaagau

SEQ ID NO: 738275 - RNA, 19 nt, Homo sapiens
ugaagaagaugaagaugag

SEQ ID NO: 738276 - RNA, 19 nt, Homo sapiens
ucacacaucuaaacuuaag

SEQ ID NO: 738277 - RNA, 19 nt, Homo sapiens
cgaugaggauggugaagaa

SEQ ID NO: 738278 - RNA, 19 nt, Homo sapiens
cuuaacagcugaauuugug

SEQ ID NO: 738279 - RNA, 19 nt, Homo sapiens
uguaagcguuguuagguuu

SEQ ID NO: 738280 - RNA, 19 nt, Homo sapiens
ggaggaagaaggugggaaa

SEQ ID NO: 738281 - RNA, 19 nt, Homo sapiens
ugaaagauaucagcaccuu

SEQ ID NO: 738282 - RNA, 19 nt, Homo sapiens
cagcugaauuugugaacuu

SEQ ID NO: 738283 - RNA, 19 nt, Homo sapiens
gaaaagaggaagagagaaa

SEQ ID NO: 738284 - RNA, 19 nt, Homo sapiens
ggaggaagaagaauuugga

SEQ ID NO: 738285 - RNA, 19 nt, Homo sapiens
aagaggaguuugaugaaga

SEQ ID NO: 738286 - RNA, 19 nt, Homo sapiens
aagaauaguuccugugaca

SEQ ID NO: 738287 - RNA, 19 nt, Homo sapiens
ggaaaguuaaguuugaaga

SEQ ID NO: 738288 - RNA, 19 nt, Homo sapiens
agaagaugaugaagaugaa

SEQ ID NO: 738289 - RNA, 19 nt, Homo sapiens
ggaggaggacgaagaagga

SEQ ID NO: 738290 - RNA, 19 nt, Homo sapiens
ugaggaggaagaagaauuu

SEQ ID NO: 738291 - RNA, 19 nt, Homo sapiens
gggaugaggacgacgauga

SEQ ID NO: 738292 - RNA, 19 nt, Homo sapiens
aagaagaggaguuugauga

SEQ ID NO: 738293 - RNA, 19 nt, Homo sapiens
gaucucaguuucaaaucuc

SEQ ID NO: 738294 - RNA, 19 nt, Homo sapiens
gcggaaaguuaaguuugaa

SEQ ID NO: 738295 - RNA, 19 nt, Homo sapiens
gaagaagaggaguuugaug

SEQ ID NO: 738296 - RNA, 19 nt, Homo sapiens
gaguuccucaguuuaauaa

SEQ ID NO: 738297 - RNA, 19 nt, Homo sapiens
gacaauugcaaaucaaaug

SEQ ID NO: 738298 - RNA, 19 nt, Homo sapiens
acuuagaguuccucaguuu

SEQ ID NO: 738299 - RNA, 19 nt, Homo sapiens
ggacaauugcaaaucaaau

SEQ ID NO: 738300 - RNA, 19 nt, Homo sapiens
cgaaauaaacaguuacucu

SEQ ID NO: 738301 - RNA, 19 nt, Homo sapiens
ggacacccacccacccaaa

SEQ ID NO: 738302 - RNA, 19 nt, Homo sapiens
agaagaauuuggacuugau

SEQ ID NO: 738303 - RNA, 19 nt, Homo sapiens
gugaagaagaggaguuuga

SEQ ID NO: 738304 - RNA, 19 nt, Homo sapiens
ggaggacgaagaaggagaa

SEQ ID NO: 738305 - RNA, 19 nt, Homo sapiens
gagagagugucuucaagcu

SEQ ID NO: 738306 - RNA, 19 nt, Homo sapiens
guggauagcugugauuggu

SEQ ID NO: 738307 - RNA, 19 nt, Homo sapiens
cgagguggaugguguggau

SEQ ID NO: 738308 - RNA, 19 nt, Homo sapiens
ggacuucaccccaacaaaa

SEQ ID NO: 738309 - RNA, 19 nt, Homo sapiens
uuagaguuccucaguuuaa

SEQ ID NO: 738310 - RNA, 19 nt, Homo sapiens
gcuccgcucccgugaguaa

SEQ ID NO: 738311 - RNA, 19 nt, Homo sapiens
cgcggaaaguuaaguuuga

SEQ ID NO: 738312 - RNA, 19 nt, Homo sapiens
ggaugaggacgacgaugaa

SEQ ID NO: 738313 - RNA, 19 nt, Homo sapiens
aagaagaugaugaagauga

SEQ ID NO: 738314 - RNA, 19 nt, Homo sapiens
gaaaguuaaguuugaagag

SEQ ID NO: 738315 - RNA, 19 nt, Homo sapiens
agaggaguuugaugaagaa

SEQ ID NO: 738316 - RNA, 19 nt, Homo sapiens
ggaugaagaggaggaagaa

SEQ ID NO: 738317 - RNA, 19 nt, Homo sapiens
aagaagaauuuggacuuga

SEQ ID NO: 738318 - RNA, 19 nt, Homo sapiens
agaaggagaagaugaggaa

SEQ ID NO: 738319 - RNA, 19 nt, Homo sapiens
ccaagcugccuaaauugaa

SEQ ID NO: 738320 - RNA, 19 nt, Homo sapiens
cgucuguggcuaccaguua

SEQ ID NO: 738321 - RNA, 19 nt, Homo sapiens
cccaaagagccaaagaaua

SEQ ID NO: 738322 - RNA, 19 nt, Homo sapiens
gaagaauuuggacuugaug

SEQ ID NO: 738323 - RNA, 19 nt, Homo sapiens
cugaaugacuaccgagaga

SEQ ID NO: 738324 - RNA, 19 nt, Homo sapiens
aauuuggacuugaugaaga

SEQ ID NO: 738325 - RNA, 19 nt, Homo sapiens
ugaagucagugaggaggaa

SEQ ID NO: 738326 - RNA, 19 nt, Homo sapiens
gccuggaccucuuuaacug

SEQ ID NO: 738327 - RNA, 19 nt, Homo sapiens
gaaggugggaaaggugaaa

SEQ ID NO: 738328 - RNA, 19 nt, Homo sapiens
aagaugaggaugaggauga

SEQ ID NO: 738329 - RNA, 19 nt, Homo sapiens
uuggacugcucauggauuu

SEQ ID NO: 738330 - RNA, 19 nt, Homo sapiens
ugaagaugaagauguagaa

SEQ ID NO: 738331 - RNA, 19 nt, Homo sapiens
aggagaagaugauuaagac

SEQ ID NO: 738332 - RNA, 19 nt, Homo sapiens
gaauuuggacuugaugaag

SEQ ID NO: 738333 - RNA, 19 nt, Homo sapiens
ucagugaggaggaagaaga

SEQ ID NO: 738334 - RNA, 19 nt, Homo sapiens
uuccaaaucucacacaucu

SEQ ID NO: 738335 - RNA, 19 nt, Homo sapiens
cccggcagcuguucgagaa

SEQ ID NO: 738336 - RNA, 19 nt, Homo sapiens
gugaggaggaagaagaauu

SEQ ID NO: 738337 - RNA, 19 nt, Homo sapiens
cugaauuugugaacuuaga

SEQ ID NO: 738338 - RNA, 19 nt, Homo sapiens
ggacgaugaggauggugaa

SEQ ID NO: 738339 - RNA, 19 nt, Homo sapiens
uggaugguguggaugaaga

SEQ ID NO: 738340 - RNA, 19 nt, Homo sapiens
gaaugacuaccgagagagu

SEQ ID NO: 738341 - RNA, 19 nt, Homo sapiens
aaggagaagaugauuaaga

SEQ ID NO: 738342 - RNA, 19 nt, Homo sapiens
gaugaaggagaagaugauu

SEQ ID NO: 738343 - RNA, 19 nt, Homo sapiens
ugaugaagaagaugaugaa

SEQ ID NO: 738344 - RNA, 19 nt, Homo sapiens
agaagaggaguuugaugaa

SEQ ID NO: 738345 - RNA, 19 nt, Homo sapiens
uaacagcugaauuugugaa

SEQ ID NO: 738346 - RNA, 19 nt, Homo sapiens
cuuggacaauugcaaauca

SEQ ID NO: 738347 - RNA, 19 nt, Homo sapiens
uuggaggucuggacauguu

SEQ ID NO: 738348 - RNA, 19 nt, Homo sapiens
ggaagacgaggacgaugag

SEQ ID NO: 738349 - RNA, 19 nt, Homo sapiens
cgaagaaggagaagaugag

SEQ ID NO: 738350 - RNA, 19 nt, Homo sapiens
cuacuuggauggcuaugac

SEQ ID NO: 738351 - RNA, 19 nt, Homo sapiens
guggaaauaaacugaaaga

SEQ ID NO: 738352 - RNA, 19 nt, Homo sapiens
auaaacaguuacucuuugg

SEQ ID NO: 738353 - RNA, 19 nt, Homo sapiens
agaguuccucaguuuaaua

SEQ ID NO: 738354 - RNA, 19 nt, Homo sapiens
guaguuaggccauucauuu

SEQ ID NO: 738355 - RNA, 19 nt, Homo sapiens
ggaacuggauccuaccuau

SEQ ID NO: 738356 - RNA, 19 nt, Homo sapiens
aagaaucccuccauuguug

SEQ ID NO: 738357 - RNA, 19 nt, Homo sapiens
gcucauaucuguucuucag

SEQ ID NO: 738358 - RNA, 19 nt, Homo sapiens
gaagaaucccuccauuguu

SEQ ID NO: 738359 - RNA, 19 nt, Homo sapiens
ccaggucacuuuguaauau

SEQ ID NO: 738360 - RNA, 19 nt, Homo sapiens
gugcacagauucacaagga

SEQ ID NO: 738361 - RNA, 19 nt, Homo sapiens
ggagugauaucuguucuag

SEQ ID NO: 738362 - RNA, 19 nt, Homo sapiens
aagagucaauugcuucuaa

SEQ ID NO: 738363 - RNA, 19 nt, Homo sapiens
ggaacauuaugauccagaa

SEQ ID NO: 738364 - RNA, 19 nt, Homo sapiens
ugagcaugcuggagugaua

SEQ ID NO: 738365 - RNA, 19 nt, Homo sapiens
guaagaaaggaucauguuu

SEQ ID NO: 738366 - RNA, 19 nt, Homo sapiens
gagcagcacuuggaagaca

SEQ ID NO: 738367 - RNA, 19 nt, Homo sapiens
gcgggacccugucagauga

SEQ ID NO: 738368 - RNA, 19 nt, Homo sapiens
caggucacuuuguaauaua

SEQ ID NO: 738369 - RNA, 19 nt, Homo sapiens
gcacuuggaagacacaaug

SEQ ID NO: 738370 - RNA, 19 nt, Homo sapiens
gaaaggaucauguuuugaa

SEQ ID NO: 738371 - RNA, 19 nt, Homo sapiens
ugaagaaucccuccauugu

SEQ ID NO: 738372 - RNA, 19 nt, Homo sapiens
gaagacacaaugaagaauc

SEQ ID NO: 738373 - RNA, 19 nt, Homo sapiens
guuaggccauucauuuaau

SEQ ID NO: 738374 - RNA, 19 nt, Homo sapiens
gaacauuaugauccagaaa

SEQ ID NO: 738375 - RNA, 19 nt, Homo sapiens
uaguuaggccauucauuua

SEQ ID NO: 738376 - RNA, 19 nt, Homo sapiens
gaacuggauccuaccuaug

SEQ ID NO: 738377 - RNA, 19 nt, Homo sapiens
ggauggaggcgaccuugga

SEQ ID NO: 738378 - RNA, 19 nt, Homo sapiens
auaaaucuguuuggaggaa

SEQ ID NO: 738379 - RNA, 19 nt, Homo sapiens
aagaaaggaucauguuuug

SEQ ID NO: 738380 - RNA, 19 nt, Homo sapiens
uggaagacacaaugaagaa

SEQ ID NO: 738381 - RNA, 19 nt, Homo sapiens
ggaagacacaaugaagaau

SEQ ID NO: 738382 - RNA, 19 nt, Homo sapiens
ugucuagaaucagauaaug

SEQ ID NO: 738383 - RNA, 19 nt, Homo sapiens
uaaaucuguuuggaggaaa

SEQ ID NO: 738384 - RNA, 19 nt, Homo sapiens
uguggugugucuagaauca

SEQ ID NO: 738385 - RNA, 19 nt, Homo sapiens
gcagguccaggucacuuug

SEQ ID NO: 738386 - RNA, 19 nt, Homo sapiens
acauuaugauccagaaaca

SEQ ID NO: 738387 - RNA, 19 nt, Homo sapiens
gguccaggucacuuuguaa

SEQ ID NO: 738388 - RNA, 19 nt, Homo sapiens
gucaauugcuucuaaugcu

SEQ ID NO: 738389 - RNA, 19 nt, Homo sapiens
ccuguggugugucuagaau

SEQ ID NO: 738390 - RNA, 19 nt, Homo sapiens
aguaagaaaggaucauguu

SEQ ID NO: 738391 - RNA, 19 nt, Homo sapiens
agagucaauugcuucuaau

SEQ ID NO: 738392 - RNA, 19 nt, Homo sapiens
ccuuauagaacuacuaaag

SEQ ID NO: 738393 - RNA, 19 nt, Homo sapiens
ucuugaugcucauaucugu

SEQ ID NO: 738394 - RNA, 19 nt, Homo sapiens
gcacaaaauggccucuuga

SEQ ID NO: 738395 - RNA, 19 nt, Homo sapiens
ugauauuccuguggugugu

SEQ ID NO: 738396 - RNA, 19 nt, Homo sapiens
caaugaagaaucccuccau

SEQ ID NO: 738397 - RNA, 19 nt, Homo sapiens
cuauggaccgcuaucaaga

SEQ ID NO: 738398 - RNA, 19 nt, Homo sapiens
gagcaugcuggagugauau

SEQ ID NO: 738399 - RNA, 19 nt, Homo sapiens
uggagcagcacuuggaaga

SEQ ID NO: 738400 - RNA, 19 nt, Homo sapiens
aguuaggccauucauuuaa

SEQ ID NO: 738401 - RNA, 19 nt, Homo sapiens
gaccuuggagcagcacuug

SEQ ID NO: 738402 - RNA, 19 nt, Homo sapiens
ggaaagggaugguguuuau

SEQ ID NO: 738403 - RNA, 19 nt, Homo sapiens
gacauaaacuguacagaaa

SEQ ID NO: 738404 - RNA, 19 nt, Homo sapiens
gcggagacauuuacgaaua

SEQ ID NO: 738405 - RNA, 19 nt, Homo sapiens
caagggagcuguugcaaau

SEQ ID NO: 738406 - RNA, 19 nt, Homo sapiens
gaaagacacaucaaugaaa

SEQ ID NO: 738407 - RNA, 19 nt, Homo sapiens
caaagacggugcccgauga

SEQ ID NO: 738408 - RNA, 19 nt, Homo sapiens
agaaguaucugagacauaa

SEQ ID NO: 738409 - RNA, 19 nt, Homo sapiens
gaacaagugugacgaucug

SEQ ID NO: 738410 - RNA, 19 nt, Homo sapiens
gagaauaucaugaaacaga

SEQ ID NO: 738411 - RNA, 19 nt, Homo sapiens
cagcaaagauuuacaaagg

SEQ ID NO: 738412 - RNA, 19 nt, Homo sapiens
cgacaucccucccucauca

SEQ ID NO: 738413 - RNA, 19 nt, Homo sapiens
gacauauccugcucucuaa

SEQ ID NO: 738414 - RNA, 19 nt, Homo sapiens
ggaauuuauugcuaucuug

SEQ ID NO: 738415 - RNA, 19 nt, Homo sapiens
ggaaagacacaucaaugaa

SEQ ID NO: 738416 - RNA, 19 nt, Homo sapiens
gaagagagaccagagaguu

SEQ ID NO: 738417 - RNA, 19 nt, Homo sapiens
caaagcccguggagaauga

SEQ ID NO: 738418 - RNA, 19 nt, Homo sapiens
agacacagcuauugagaga

SEQ ID NO: 738419 - RNA, 19 nt, Homo sapiens
ggagacauuuacgaauaua

SEQ ID NO: 738420 - RNA, 19 nt, Homo sapiens
ggagcuggauggaugacua

SEQ ID NO: 738421 - RNA, 19 nt, Homo sapiens
gaacucauccuccacaaca

SEQ ID NO: 738422 - RNA, 19 nt, Homo sapiens
gcacagcaguggacaaggu

SEQ ID NO: 738423 - RNA, 19 nt, Homo sapiens
ggauggaugacuacgauua

SEQ ID NO: 738424 - RNA, 19 nt, Homo sapiens
acacagaguccaucuaauu

SEQ ID NO: 738425 - RNA, 19 nt, Homo sapiens
gcaacaaagucaugaacuc

SEQ ID NO: 738426 - RNA, 19 nt, Homo sapiens
gcacacagcaaguuuguca

SEQ ID NO: 738427 - RNA, 19 nt, Homo sapiens
cuaagggaauuuauugcua

SEQ ID NO: 738428 - RNA, 19 nt, Homo sapiens
ugagagacagcuacaauaa

SEQ ID NO: 738429 - RNA, 19 nt, Homo sapiens
uuacaaagcccguggagaa

SEQ ID NO: 738430 - RNA, 19 nt, Homo sapiens
ccacaaccaucaacaccaa

SEQ ID NO: 738431 - RNA, 19 nt, Homo sapiens
gaucuggaccgguuuguga

SEQ ID NO: 738432 - RNA, 19 nt, Homo sapiens
uaaaggcucucgggacuug

SEQ ID NO: 738433 - RNA, 19 nt, Homo sapiens
gaacuggccagguccuuga

SEQ ID NO: 738434 - RNA, 19 nt, Homo sapiens
uagcaugacuuauucuugu

SEQ ID NO: 738435 - RNA, 19 nt, Homo sapiens
agaaagagcuauuggaaaa

SEQ ID NO: 738436 - RNA, 19 nt, Homo sapiens
gaacgacgcauaugauguc

SEQ ID NO: 738437 - RNA, 19 nt, Homo sapiens
agaaugacaucucgaagug

SEQ ID NO: 738438 - RNA, 19 nt, Homo sapiens
gacaggccauggcuacgua

SEQ ID NO: 738439 - RNA, 19 nt, Homo sapiens
caacagaagcucuaucaag

SEQ ID NO: 738440 - RNA, 19 nt, Homo sapiens
gaaaugcccagcuguucaa

SEQ ID NO: 738441 - RNA, 19 nt, Homo sapiens
ucaaaccagccaugacuua

SEQ ID NO: 738442 - RNA, 19 nt, Homo sapiens
gagagacagcuacaauaaa

SEQ ID NO: 738443 - RNA, 19 nt, Homo sapiens
ccacggcccugcaggaaau

SEQ ID NO: 738444 - RNA, 19 nt, Homo sapiens
agacauauccugcucucua

SEQ ID NO: 738445 - RNA, 19 nt, Homo sapiens
auccaagucucgauaguua

SEQ ID NO: 738446 - RNA, 19 nt, Homo sapiens
ccaagcagcucaccacaac

SEQ ID NO: 738447 - RNA, 19 nt, Homo sapiens
cugccgaaaugaaguauaa

SEQ ID NO: 738448 - RNA, 19 nt, Homo sapiens
caccagauccugagucaaa

SEQ ID NO: 738449 - RNA, 19 nt, Homo sapiens
gggaugguguuuaugaugu

SEQ ID NO: 738450 - RNA, 19 nt, Homo sapiens
gaugguggcugugcucguu

SEQ ID NO: 738451 - RNA, 19 nt, Homo sapiens
cuacacagaguccaucuaa

SEQ ID NO: 738452 - RNA, 19 nt, Homo sapiens
ucauggaacuauagagcua

SEQ ID NO: 738453 - RNA, 19 nt, Homo sapiens
gaauauauauguggaucca

SEQ ID NO: 738454 - RNA, 19 nt, Homo sapiens
ggcauagcaugacuuauuc

SEQ ID NO: 738455 - RNA, 19 nt, Homo sapiens
agacauaaacuguacagaa

SEQ ID NO: 738456 - RNA, 19 nt, Homo sapiens
guucuuauguauacacaga

SEQ ID NO: 738457 - RNA, 19 nt, Homo sapiens
ccuggcagcuugcaucuga

SEQ ID NO: 738458 - RNA, 19 nt, Homo sapiens
gggugaagcuucugauugg

SEQ ID NO: 738459 - RNA, 19 nt, Homo sapiens
aaacugaccaucuuaaaca

SEQ ID NO: 738460 - RNA, 19 nt, Homo sapiens
uggaaauacugucugguuu

SEQ ID NO: 738461 - RNA, 19 nt, Homo sapiens
gggaauuuauugcuaucuu

SEQ ID NO: 738462 - RNA, 19 nt, Homo sapiens
ugucuuaacuaguguagga

SEQ ID NO: 738463 - RNA, 19 nt, Homo sapiens
ugggaagcauaguuuauuu

SEQ ID NO: 738464 - RNA, 19 nt, Homo sapiens
aacagaagcucuaucaagu

SEQ ID NO: 738465 - RNA, 19 nt, Homo sapiens
acaaaggcguaucagacua

SEQ ID NO: 738466 - RNA, 19 nt, Homo sapiens
gaacaagagauuacaaagc

SEQ ID NO: 738467 - RNA, 19 nt, Homo sapiens
gcuggucccugaauaucuu

SEQ ID NO: 738468 - RNA, 19 nt, Homo sapiens
caaaauaggggaaugguuu

SEQ ID NO: 738469 - RNA, 19 nt, Homo sapiens
ccagcugguuauaauauug

SEQ ID NO: 738470 - RNA, 19 nt, Homo sapiens
aaauacaacugugacauuc

SEQ ID NO: 738471 - RNA, 19 nt, Homo sapiens
gcaaguagaggccuuucug

SEQ ID NO: 738472 - RNA, 19 nt, Homo sapiens
uguucaaucuucugcauuu

SEQ ID NO: 738473 - RNA, 19 nt, Homo sapiens
aggcauagcaugacuuauu

SEQ ID NO: 738474 - RNA, 19 nt, Homo sapiens
ccaggacauucgcaacaaa

SEQ ID NO: 738475 - RNA, 19 nt, Homo sapiens
aaagggaugguguuuauga

SEQ ID NO: 738476 - RNA, 19 nt, Homo sapiens
agagacagcuacaauaaaa

SEQ ID NO: 738477 - RNA, 19 nt, Homo sapiens
ugaauuacgaagcaccuua

SEQ ID NO: 738478 - RNA, 19 nt, Homo sapiens
ugucugaugcauuucauua

SEQ ID NO: 738479 - RNA, 19 nt, Homo sapiens
ugaguguucuuauguauac

SEQ ID NO: 738480 - RNA, 19 nt, Homo sapiens
cggagacauuuacgaauau

SEQ ID NO: 738481 - RNA, 19 nt, Homo sapiens
ggagauggcaacguucuga

SEQ ID NO: 738482 - RNA, 19 nt, Homo sapiens
cugaauaucuuggccauca

SEQ ID NO: 738483 - RNA, 19 nt, Homo sapiens
cacagaguccaucuaauuu

SEQ ID NO: 738484 - RNA, 19 nt, Homo sapiens
aauauucacuuuggugcua

SEQ ID NO: 738485 - RNA, 19 nt, Homo sapiens
guguucaccuuccaaauca

SEQ ID NO: 738486 - RNA, 19 nt, Homo sapiens
gaagcauaguuuauuugca

SEQ ID NO: 738487 - RNA, 19 nt, Homo sapiens
gcuugcaucugaagaaugg

SEQ ID NO: 738488 - RNA, 19 nt, Homo sapiens
ggaucaaccgauugucuuu

SEQ ID NO: 738489 - RNA, 19 nt, Homo sapiens
gauaucccuccuucucaua

SEQ ID NO: 738490 - RNA, 19 nt, Homo sapiens
uaucuugcaccuucuuuaa

SEQ ID NO: 738491 - RNA, 19 nt, Homo sapiens
caaaggcguaucagacuau

SEQ ID NO: 738492 - RNA, 19 nt, Homo sapiens
gaggccaggaccacaguua

SEQ ID NO: 738493 - RNA, 19 nt, Homo sapiens
agagagaccagagaguuua

SEQ ID NO: 738494 - RNA, 19 nt, Homo sapiens
ugugagacccauuucauuu

SEQ ID NO: 738495 - RNA, 19 nt, Homo sapiens
cagaaagagcuauuggaaa

SEQ ID NO: 738496 - RNA, 19 nt, Homo sapiens
acagaaagagcuauuggaa

SEQ ID NO: 738497 - RNA, 19 nt, Homo sapiens
uggaaagacacaucaauga

SEQ ID NO: 738498 - RNA, 19 nt, Homo sapiens
gcucucagaacgacgcaua

SEQ ID NO: 738499 - RNA, 19 nt, Homo sapiens
ccacggcacccaagaacaa

SEQ ID NO: 738500 - RNA, 19 nt, Homo sapiens
cuauagagcuaccagacau

SEQ ID NO: 738501 - RNA, 19 nt, Homo sapiens
ugaggcauagcaugacuua

SEQ ID NO: 738502 - RNA, 19 nt, Homo sapiens
gaauuagucugauaaguga

SEQ ID NO: 738503 - RNA, 19 nt, Homo sapiens
uggcagugaucaauuauua

SEQ ID NO: 738504 - RNA, 19 nt, Homo sapiens
guacuugguuugcuaagaa

SEQ ID NO: 738505 - RNA, 19 nt, Homo sapiens
ggacggcgauguuaauuac

SEQ ID NO: 738506 - RNA, 19 nt, Homo sapiens
cuaagaacguguaugcuuu

SEQ ID NO: 738507 - RNA, 19 nt, Homo sapiens
gguaugaacugcgggaauu

SEQ ID NO: 738508 - RNA, 19 nt, Homo sapiens
gaaguaacacgaagaagug

SEQ ID NO: 738509 - RNA, 19 nt, Homo sapiens
gaaaacagauaauggaguu

SEQ ID NO: 738510 - RNA, 19 nt, Homo sapiens
aaugggagcuccuuuguga

SEQ ID NO: 738511 - RNA, 19 nt, Homo sapiens
uguaugcuuugcugaauua

SEQ ID NO: 738512 - RNA, 19 nt, Homo sapiens
caacauugcugccgauacu

SEQ ID NO: 738513 - RNA, 19 nt, Homo sapiens
gaaagaaguaacacgaaga

SEQ ID NO: 738514 - RNA, 19 nt, Homo sapiens
ggagcuccuuugugaguuu

SEQ ID NO: 738515 - RNA, 19 nt, Homo sapiens
gggaugggacgcugauaua

SEQ ID NO: 738516 - RNA, 19 nt, Homo sapiens
augggacgcugauauaaua

SEQ ID NO: 738517 - RNA, 19 nt, Homo sapiens
aagaagugguggaaaugua

SEQ ID NO: 738518 - RNA, 19 nt, Homo sapiens
auauggcagugaucaauua

SEQ ID NO: 738519 - RNA, 19 nt, Homo sapiens
gagcggaccuuggccuuuc

SEQ ID NO: 738520 - RNA, 19 nt, Homo sapiens
ugaauuagucugauaagug

SEQ ID NO: 738521 - RNA, 19 nt, Homo sapiens
gcuaagaaccuaagaacgu

SEQ ID NO: 738522 - RNA, 19 nt, Homo sapiens
caaacaagccgcuccuaca

SEQ ID NO: 738523 - RNA, 19 nt, Homo sapiens
ccaaagacagacagaauca

SEQ ID NO: 738524 - RNA, 19 nt, Homo sapiens
agugacagcuccuuucuuc

SEQ ID NO: 738525 - RNA, 19 nt, Homo sapiens
gaagaagugguggaaaugu

SEQ ID NO: 738526 - RNA, 19 nt, Homo sapiens
agaguggccugcaguccua

SEQ ID NO: 738527 - RNA, 19 nt, Homo sapiens
gauauaauaggguagaaag

SEQ ID NO: 738528 - RNA, 19 nt, Homo sapiens
ggaugggacgcugauauaa

SEQ ID NO: 738529 - RNA, 19 nt, Homo sapiens
acaagccgcuccuacacuu

SEQ ID NO: 738530 - RNA, 19 nt, Homo sapiens
caagucauauggcagugau

SEQ ID NO: 738531 - RNA, 19 nt, Homo sapiens
acgaagaagugguggaaau

SEQ ID NO: 738532 - RNA, 19 nt, Homo sapiens
gaugggacgcugauauaau

SEQ ID NO: 738533 - RNA, 19 nt, Homo sapiens
ucccacaucugcccacuga

SEQ ID NO: 738534 - RNA, 19 nt, Homo sapiens
gaagugguggaaauguaaa

SEQ ID NO: 738535 - RNA, 19 nt, Homo sapiens
aaagaaguaacacgaagaa

SEQ ID NO: 738536 - RNA, 19 nt, Homo sapiens
uugcugaauuagucugaua

SEQ ID NO: 738537 - RNA, 19 nt, Homo sapiens
cagaagguuuggagugaca

SEQ ID NO: 738538 - RNA, 19 nt, Homo sapiens
agaagugguggaaauguaa

SEQ ID NO: 738539 - RNA, 19 nt, Homo sapiens
uaagaacguguaugcuuug

SEQ ID NO: 738540 - RNA, 19 nt, Homo sapiens
ccuaagaacguguaugcuu

SEQ ID NO: 738541 - RNA, 19 nt, Homo sapiens
cagauggccuccaaagacu

SEQ ID NO: 738542 - RNA, 19 nt, Homo sapiens
guguaugcuuugcugaauu

SEQ ID NO: 738543 - RNA, 19 nt, Homo sapiens
gagcccaugucuucuucga

SEQ ID NO: 738544 - RNA, 19 nt, Homo sapiens
uggacaaaguacuugguuu

SEQ ID NO: 738545 - RNA, 19 nt, Homo sapiens
cgaaagggagccaaacaag

SEQ ID NO: 738546 - RNA, 19 nt, Homo sapiens
gcagcucaaugccuacaac

SEQ ID NO: 738547 - RNA, 19 nt, Homo sapiens
aguccuaccugcuccaguu

SEQ ID NO: 738548 - RNA, 19 nt, Homo sapiens
agaaguaacacgaagaagu

SEQ ID NO: 738549 - RNA, 19 nt, Homo sapiens
gaaugggagcuccuuugug

SEQ ID NO: 738550 - RNA, 19 nt, Homo sapiens
cauauggcagugaucaauu

SEQ ID NO: 738551 - RNA, 19 nt, Homo sapiens
cgaagaagugguggaaaug

SEQ ID NO: 738552 - RNA, 19 nt, Homo sapiens
ucagauggccuccaaagac

SEQ ID NO: 738553 - RNA, 19 nt, Homo sapiens
uagaaagaaguaacacgaa

SEQ ID NO: 738554 - RNA, 19 nt, Homo sapiens
auaauaggguagaaagaag

SEQ ID NO: 738555 - RNA, 19 nt, Homo sapiens
agaaggggcuggauugaug

SEQ ID NO: 738556 - RNA, 19 nt, Homo sapiens
ccacaucugcccacugaag

SEQ ID NO: 738557 - RNA, 19 nt, Homo sapiens
guccggagccucaacuuca

SEQ ID NO: 738558 - RNA, 19 nt, Homo sapiens
uagagcccaugucuucuuc

SEQ ID NO: 738559 - RNA, 19 nt, Homo sapiens
ggagcggaccuuggccuuu

SEQ ID NO: 738560 - RNA, 19 nt, Homo sapiens
ugacagcuccuuucuucuc

SEQ ID NO: 738561 - RNA, 19 nt, Homo sapiens
accagaagguuuggaguga

SEQ ID NO: 738562 - RNA, 19 nt, Homo sapiens
gugaaugggagcuccuuug

SEQ ID NO: 738563 - RNA, 19 nt, Homo sapiens
ggcagugaucaauuauuaa

SEQ ID NO: 738564 - RNA, 19 nt, Homo sapiens
gguggacggcgauguuaau

SEQ ID NO: 738565 - RNA, 19 nt, Homo sapiens
ugaaugggagcuccuuugu

SEQ ID NO: 738566 - RNA, 19 nt, Homo sapiens
gacuucauaugcuccagau

SEQ ID NO: 738567 - RNA, 19 nt, Homo sapiens
uggacggcgauguuaauua

SEQ ID NO: 738568 - RNA, 19 nt, Homo sapiens
cagguggacggcgauguua

SEQ ID NO: 738569 - RNA, 19 nt, Homo sapiens
gggagcuccuuugugaguu

SEQ ID NO: 738570 - RNA, 19 nt, Homo sapiens
ccaacaccacgaucauuca

SEQ ID NO: 738571 - RNA, 19 nt, Homo sapiens
aaaguacuugguuugcuaa

SEQ ID NO: 738572 - RNA, 19 nt, Homo sapiens
agccucaacuucaggaugu

SEQ ID NO: 738573 - RNA, 19 nt, Homo sapiens
cguguaugcuuugcugaau

SEQ ID NO: 738574 - RNA, 19 nt, Homo sapiens
gaaccuaagaacguguaug

SEQ ID NO: 738575 - RNA, 19 nt, Homo sapiens
gauggccuccaaagacuuc

SEQ ID NO: 738576 - RNA, 19 nt, Homo sapiens
aauaggguagaaagaagua

SEQ ID NO: 738577 - RNA, 19 nt, Homo sapiens
cgccucagauggccuccaa

SEQ ID NO: 738578 - RNA, 19 nt, Homo sapiens
ggccuccaaagacuucaua

SEQ ID NO: 738579 - RNA, 19 nt, Homo sapiens
acacgaagaagugguggaa

SEQ ID NO: 738580 - RNA, 19 nt, Homo sapiens
gcugauauaauaggguaga

SEQ ID NO: 738581 - RNA, 19 nt, Homo sapiens
augcuuugcugaauuaguc

SEQ ID NO: 738582 - RNA, 19 nt, Homo sapiens
ggagagguggacaaaguac

SEQ ID NO: 738583 - RNA, 19 nt, Homo sapiens
gagcuccuuugugaguuuc

SEQ ID NO: 738584 - RNA, 19 nt, Homo sapiens
uccaaagacuucauaugcu

SEQ ID NO: 738585 - RNA, 19 nt, Homo sapiens
cuagagcccaugucuucuu

SEQ ID NO: 738586 - RNA, 19 nt, Homo sapiens
gacaacauugcugccgaua

SEQ ID NO: 738587 - RNA, 19 nt, Homo sapiens
ucugcccacugaagauuug

SEQ ID NO: 738588 - RNA, 19 nt, Homo sapiens
gacaccaacaccacgauca

SEQ ID NO: 738589 - RNA, 19 nt, Homo sapiens
gacaauggcuggaaaauua

SEQ ID NO: 738590 - RNA, 19 nt, Homo sapiens
gaagaacuguacuacuuug

SEQ ID NO: 738591 - RNA, 19 nt, Homo sapiens
gagagggccuggaaauuau

SEQ ID NO: 738592 - RNA, 19 nt, Homo sapiens
gaacuguacuacuuugaau

SEQ ID NO: 738593 - RNA, 19 nt, Homo sapiens
cagcagccaucuuguugua

SEQ ID NO: 738594 - RNA, 19 nt, Homo sapiens
ugacgauggugguuucuuu

SEQ ID NO: 738595 - RNA, 19 nt, Homo sapiens
cgaauuauauuugccaaug

SEQ ID NO: 738596 - RNA, 19 nt, Homo sapiens
agagagggccuggaaauua

SEQ ID NO: 738597 - RNA, 19 nt, Homo sapiens
cuacaucuuugccacagua

SEQ ID NO: 738598 - RNA, 19 nt, Homo sapiens
ggacuuccaccuagaauuc

SEQ ID NO: 738599 - RNA, 19 nt, Homo sapiens
aaacuuaccacuacuauca

SEQ ID NO: 738600 - RNA, 19 nt, Homo sapiens
gcagccaucuuguuguaug

SEQ ID NO: 738601 - RNA, 19 nt, Homo sapiens
ccauggagaccgaauuaua

SEQ ID NO: 738602 - RNA, 19 nt, Homo sapiens
uugaagaacuguacuacuu

SEQ ID NO: 738603 - RNA, 19 nt, Homo sapiens
uaacucagcagccaucuug

SEQ ID NO: 738604 - RNA, 19 nt, Homo sapiens
ugaauugugugauggcauu

SEQ ID NO: 738605 - RNA, 19 nt, Homo sapiens
ucaggaaacuuaccacuac

SEQ ID NO: 738606 - RNA, 19 nt, Homo sapiens
ggagaccgaauuauauuug

SEQ ID NO: 738607 - RNA, 19 nt, Homo sapiens
guacuacuuugaauuugug

SEQ ID NO: 738608 - RNA, 19 nt, Homo sapiens
guagaugacuugccaaucc

SEQ ID NO: 738609 - RNA, 19 nt, Homo sapiens
ccaccagucucuucucugu

SEQ ID NO: 738610 - RNA, 19 nt, Homo sapiens
guucuucggcuacuccuua

SEQ ID NO: 738611 - RNA, 19 nt, Homo sapiens
gcacuggcauuauugucau

SEQ ID NO: 738612 - RNA, 19 nt, Homo sapiens
guuacgaccugacgaguuc

SEQ ID NO: 738613 - RNA, 19 nt, Homo sapiens
uaaaguucauccgguauau

SEQ ID NO: 738614 - RNA, 19 nt, Homo sapiens
gaacaacgccagccccuuu

SEQ ID NO: 738615 - RNA, 19 nt, Homo sapiens
ccacacagccacaagauag

SEQ ID NO: 738616 - RNA, 19 nt, Homo sapiens
ccgaauggcugagucuuug

SEQ ID NO: 738617 - RNA, 19 nt, Homo sapiens
gcuguucucucccuuucuu

SEQ ID NO: 738618 - RNA, 19 nt, Homo sapiens
ccauugcacucaccuacuu

SEQ ID NO: 738619 - RNA, 19 nt, Homo sapiens
caacaugucuggggcagua

SEQ ID NO: 738620 - RNA, 19 nt, Homo sapiens
ggaaaauuauccauacaga

SEQ ID NO: 738621 - RNA, 19 nt, Homo sapiens
ggaaacuuaccacuacuau

SEQ ID NO: 738622 - RNA, 19 nt, Homo sapiens
uggcagaacuauugcuguu

SEQ ID NO: 738623 - RNA, 19 nt, Homo sapiens
gaauggcugagucuuugua

SEQ ID NO: 738624 - RNA, 19 nt, Homo sapiens
uaaguugccuuuaguuuug

SEQ ID NO: 738625 - RNA, 19 nt, Homo sapiens
guacggcauccucuucuuu

SEQ ID NO: 738626 - RNA, 19 nt, Homo sapiens
ggugguuucuuuccucgaa

SEQ ID NO: 738627 - RNA, 19 nt, Homo sapiens
cauggagaccgaauuauau

SEQ ID NO: 738628 - RNA, 19 nt, Homo sapiens
ugaagaacuguacuacuuu

SEQ ID NO: 738629 - RNA, 19 nt, Homo sapiens
gaagauacgucacaaaagc

SEQ ID NO: 738630 - RNA, 19 nt, Homo sapiens
aaagugggacccuaccaua

SEQ ID NO: 738631 - RNA, 19 nt, Homo sapiens
ccaccggccucuucaucuu

SEQ ID NO: 738632 - RNA, 19 nt, Homo sapiens
gcccugaccugcugcaucu

SEQ ID NO: 738633 - RNA, 19 nt, Homo sapiens
ccacagcuuggauggguua

SEQ ID NO: 738634 - RNA, 19 nt, Homo sapiens
gagaagauacgucacaaaa

SEQ ID NO: 738635 - RNA, 19 nt, Homo sapiens
uaccauaacccucaggaaa

SEQ ID NO: 738636 - RNA, 19 nt, Homo sapiens
cugauugacugaauugugu

SEQ ID NO: 738637 - RNA, 19 nt, Homo sapiens
guggugaacucagugcauu

SEQ ID NO: 738638 - RNA, 19 nt, Homo sapiens
caagauggacugaguucug

SEQ ID NO: 738639 - RNA, 19 nt, Homo sapiens
cuaaaguucauccgguaua

SEQ ID NO: 738640 - RNA, 19 nt, Homo sapiens
uggaaggcgugacacacua

SEQ ID NO: 738641 - RNA, 19 nt, Homo sapiens
uccgguauaucuauguuaa

SEQ ID NO: 738642 - RNA, 19 nt, Homo sapiens
gcccuuggcacuggcauua

SEQ ID NO: 738643 - RNA, 19 nt, Homo sapiens
uggcugagucuuuguauga

SEQ ID NO: 738644 - RNA, 19 nt, Homo sapiens
gccuggaaauuauaaaucu

SEQ ID NO: 738645 - RNA, 19 nt, Homo sapiens
cugcugcccugagaagaua

SEQ ID NO: 738646 - RNA, 19 nt, Homo sapiens
ccagucugcugcccugaga

SEQ ID NO: 738647 - RNA, 19 nt, Homo sapiens
gcgacccuguuauucugua

SEQ ID NO: 738648 - RNA, 19 nt, Homo sapiens
gucgggagcaguacacuuu

SEQ ID NO: 738649 - RNA, 19 nt, Homo sapiens
ccuuggcacuggcauuauu

SEQ ID NO: 738650 - RNA, 19 nt, Homo sapiens
gcugagucuuuguaugaga

SEQ ID NO: 738651 - RNA, 19 nt, Homo sapiens
acuccuuacucacugguua

SEQ ID NO: 738652 - RNA, 19 nt, Homo sapiens
auaggacucuggacccauu

SEQ ID NO: 738653 - RNA, 19 nt, Homo sapiens
gcgccaggccauugaagaa

SEQ ID NO: 738654 - RNA, 19 nt, Homo sapiens
ggcgaucugugcugagugu

SEQ ID NO: 738655 - RNA, 19 nt, Homo sapiens
cuacuuugaauuuguggua

SEQ ID NO: 738656 - RNA, 19 nt, Homo sapiens
gggugacaauggcuggaaa

SEQ ID NO: 738657 - RNA, 19 nt, Homo sapiens
uugaauuugugguagauga

SEQ ID NO: 738658 - RNA, 19 nt, Homo sapiens
guucauccgguauaucuau

SEQ ID NO: 738659 - RNA, 19 nt, Homo sapiens
ggcauccucuucuuugucu

SEQ ID NO: 738660 - RNA, 19 nt, Homo sapiens
gcgcgguuccacugccuua

SEQ ID NO: 738661 - RNA, 19 nt, Homo sapiens
gacgaguuccuaggccuua

SEQ ID NO: 738662 - RNA, 19 nt, Homo sapiens
cagcuuggauggguuacga

SEQ ID NO: 738663 - RNA, 19 nt, Homo sapiens
cagagagggccuggaaauu

SEQ ID NO: 738664 - RNA, 19 nt, Homo sapiens
gauggacugaguucuguau

SEQ ID NO: 738665 - RNA, 19 nt, Homo sapiens
cauccgguauaucuauguu

SEQ ID NO: 738666 - RNA, 19 nt, Homo sapiens
gaaacuuaccacuacuauc

SEQ ID NO: 738667 - RNA, 19 nt, Homo sapiens
caaccauccugcugcuucu

SEQ ID NO: 738668 - RNA, 19 nt, Homo sapiens
ccaccuagaauuccaugga

SEQ ID NO: 738669 - RNA, 19 nt, Homo sapiens
aagauggacugaguucugu

SEQ ID NO: 738670 - RNA, 19 nt, Homo sapiens
gggcuugcaucuccauugc

SEQ ID NO: 738671 - RNA, 19 nt, Homo sapiens
gcacugcugggcauguuca

SEQ ID NO: 738672 - RNA, 19 nt, Homo sapiens
ccauaacccucaggaaacu

SEQ ID NO: 738673 - RNA, 19 nt, Homo sapiens
uccacugccuuaaggauga

SEQ ID NO: 738674 - RNA, 19 nt, Homo sapiens
gagaccgaauuauauuugc

SEQ ID NO: 738675 - RNA, 19 nt, Homo sapiens
cggcgacccuguuauucug

SEQ ID NO: 738676 - RNA, 19 nt, Homo sapiens
gagggccuggaaauuauaa

SEQ ID NO: 738677 - RNA, 19 nt, Homo sapiens
gcauuguugccuucccuuu

SEQ ID NO: 738678 - RNA, 19 nt, Homo sapiens
ccaucucuguggagcugua

SEQ ID NO: 738679 - RNA, 19 nt, Homo sapiens
ucaacuccauggugcuugu

SEQ ID NO: 738680 - RNA, 19 nt, Homo sapiens
gcugggcaccaucuccuuu

SEQ ID NO: 738681 - RNA, 19 nt, Homo sapiens
gccacacagccacaagaua

SEQ ID NO: 738682 - RNA, 19 nt, Homo sapiens
gggaaaacguggagaagag

SEQ ID NO: 738683 - RNA, 19 nt, Homo sapiens
ucaccuacuuccaguuguc

SEQ ID NO: 738684 - RNA, 19 nt, Homo sapiens
ccacuucuaccggcagauu

SEQ ID NO: 738685 - RNA, 19 nt, Homo sapiens
ccauugaagaacuguacua

SEQ ID NO: 738686 - RNA, 19 nt, Homo sapiens
ugagaagauacgucacaaa

SEQ ID NO: 738687 - RNA, 19 nt, Homo sapiens
cuguauggcagaacuauug

SEQ ID NO: 738688 - RNA, 19 nt, Homo sapiens
caaagugggacccuaccau

SEQ ID NO: 738689 - RNA, 19 nt, Homo sapiens
caacugaaauuaucgcuuu

SEQ ID NO: 738690 - RNA, 19 nt, Homo sapiens
gagcugaaguuaacugauu

SEQ ID NO: 738691 - RNA, 19 nt, Homo sapiens
cuggaaagcugaaguauuu

SEQ ID NO: 738692 - RNA, 19 nt, Homo sapiens
gaaguuaacugauuaucgu

SEQ ID NO: 738693 - RNA, 19 nt, Homo sapiens
ucaauaaaguucacgguuu

SEQ ID NO: 738694 - RNA, 19 nt, Homo sapiens
ggacuaugguguauaccua

SEQ ID NO: 738695 - RNA, 19 nt, Homo sapiens
cgacagacuugaagaauuc

SEQ ID NO: 738696 - RNA, 19 nt, Homo sapiens
ggaauccuaagacaaauua

SEQ ID NO: 738697 - RNA, 19 nt, Homo sapiens
gcugaaguauuucgauaaa

SEQ ID NO: 738698 - RNA, 19 nt, Homo sapiens
cauuuggccuggauuaaua

SEQ ID NO: 738699 - RNA, 19 nt, Homo sapiens
ugugaucgauggagaauuu

SEQ ID NO: 738700 - RNA, 19 nt, Homo sapiens
caauaaaguucacgguuuc

SEQ ID NO: 738701 - RNA, 19 nt, Homo sapiens
gcgacagacuugaagaauu

SEQ ID NO: 738702 - RNA, 19 nt, Homo sapiens
ucgauaaacugaauugaga

SEQ ID NO: 738703 - RNA, 19 nt, Homo sapiens
aaaguucacgguuucauua

SEQ ID NO: 738704 - RNA, 19 nt, Homo sapiens
ccacuugauuucacauuug

SEQ ID NO: 738705 - RNA, 19 nt, Homo sapiens
ggagaggcaucccggguau

SEQ ID NO: 738706 - RNA, 19 nt, Homo sapiens
ggauuccacuucuuucaga

SEQ ID NO: 738707 - RNA, 19 nt, Homo sapiens
ggaaggaacagcugugauc

SEQ ID NO: 738708 - RNA, 19 nt, Homo sapiens
aagcugaaguauuucgaua

SEQ ID NO: 738709 - RNA, 19 nt, Homo sapiens
ucaaaggacuaugguguau

SEQ ID NO: 738710 - RNA, 19 nt, Homo sapiens
gacaaauuacucugaauga

SEQ ID NO: 738711 - RNA, 19 nt, Homo sapiens
gaaacaauaaucccagauc

SEQ ID NO: 738712 - RNA, 19 nt, Homo sapiens
caauaaggauuccacuucu

SEQ ID NO: 738713 - RNA, 19 nt, Homo sapiens
ccaauaaggauuccacuuc

SEQ ID NO: 738714 - RNA, 19 nt, Homo sapiens
caaauuacucugaaugauc

SEQ ID NO: 738715 - RNA, 19 nt, Homo sapiens
gaaaccugguagugaaaca

SEQ ID NO: 738716 - RNA, 19 nt, Homo sapiens
ccacuucuuucagauuuga

SEQ ID NO: 738717 - RNA, 19 nt, Homo sapiens
aaaggacuaugguguauac

SEQ ID NO: 738718 - RNA, 19 nt, Homo sapiens
guagcaugcucuguugauu

SEQ ID NO: 738719 - RNA, 19 nt, Homo sapiens
auucacaguuuacccauuu

SEQ ID NO: 738720 - RNA, 19 nt, Homo sapiens
cauuauugaugacaaagga

SEQ ID NO: 738721 - RNA, 19 nt, Homo sapiens
cuggaaaccugguagugaa

SEQ ID NO: 738722 - RNA, 19 nt, Homo sapiens
gaugagacacuacguuugg

SEQ ID NO: 738723 - RNA, 19 nt, Homo sapiens
uaaaguucacgguuucauu

SEQ ID NO: 738724 - RNA, 19 nt, Homo sapiens
ugacaaacacggagaaguc

SEQ ID NO: 738725 - RNA, 19 nt, Homo sapiens
ggacucaggccacacucuu

SEQ ID NO: 738726 - RNA, 19 nt, Homo sapiens
cgugggaaauacuugguuu

SEQ ID NO: 738727 - RNA, 19 nt, Homo sapiens
caaaggacuaugguguaua

SEQ ID NO: 738728 - RNA, 19 nt, Homo sapiens
gauucacaguuuacccauu

SEQ ID NO: 738729 - RNA, 19 nt, Homo sapiens
gcuggaaagcugaaguauu

SEQ ID NO: 738730 - RNA, 19 nt, Homo sapiens
gcuggaaaccugguaguga

SEQ ID NO: 738731 - RNA, 19 nt, Homo sapiens
guucaagcauuccaguaca

SEQ ID NO: 738732 - RNA, 19 nt, Homo sapiens
cccaucagaucucaaagga

SEQ ID NO: 738733 - RNA, 19 nt, Homo sapiens
gugguagcaugcucuguug

SEQ ID NO: 738734 - RNA, 19 nt, Homo sapiens
uuaugaugcuugaaaguuc

SEQ ID NO: 738735 - RNA, 19 nt, Homo sapiens
ggaugagacacuacguuug

SEQ ID NO: 738736 - RNA, 19 nt, Homo sapiens
auaaggauuccacuucuuu

SEQ ID NO: 738737 - RNA, 19 nt, Homo sapiens
cugauuaucgugggaaaua

SEQ ID NO: 738738 - RNA, 19 nt, Homo sapiens
cuacgcggguggacaagug

SEQ ID NO: 738739 - RNA, 19 nt, Homo sapiens
gaggucucuucauuauuga

SEQ ID NO: 738740 - RNA, 19 nt, Homo sapiens
gacucaggccacacucuua

SEQ ID NO: 738741 - RNA, 19 nt, Homo sapiens
guuaugaugcuugaaaguu

SEQ ID NO: 738742 - RNA, 19 nt, Homo sapiens
cuaagacaaauuacucuga

SEQ ID NO: 738743 - RNA, 19 nt, Homo sapiens
uuucagauuugacccauca

SEQ ID NO: 738744 - RNA, 19 nt, Homo sapiens
cccacuugauuucacauuu

SEQ ID NO: 738745 - RNA, 19 nt, Homo sapiens
gaaguauuucgauaaacug

SEQ ID NO: 738746 - RNA, 19 nt, Homo sapiens
gacacuacguuugguucaa

SEQ ID NO: 738747 - RNA, 19 nt, Homo sapiens
agacaaauuacucugaaug

SEQ ID NO: 738748 - RNA, 19 nt, Homo sapiens
aauaaggauuccacuucuu

SEQ ID NO: 738749 - RNA, 19 nt, Homo sapiens
ugacccaucagaucucaaa

SEQ ID NO: 738750 - RNA, 19 nt, Homo sapiens
gaccacucccugcaccuaa

SEQ ID NO: 738751 - RNA, 19 nt, Homo sapiens
uggaugagacacuacguuu

SEQ ID NO: 738752 - RNA, 19 nt, Homo sapiens
gaauuuaaggagcugaagu

SEQ ID NO: 738753 - RNA, 19 nt, Homo sapiens
agcugaaguuaacugauua

SEQ ID NO: 738754 - RNA, 19 nt, Homo sapiens
ccugguagugaaacaauaa

SEQ ID NO: 738755 - RNA, 19 nt, Homo sapiens
aggaacagcugugaucgau

SEQ ID NO: 738756 - RNA, 19 nt, Homo sapiens
uuccacuucuuucagauuu

SEQ ID NO: 738757 - RNA, 19 nt, Homo sapiens
gagaauuuaaggagcugaa

SEQ ID NO: 738758 - RNA, 19 nt, Homo sapiens
guucacgguuucauuacca

SEQ ID NO: 738759 - RNA, 19 nt, Homo sapiens
agcaugcucuguugauuca

SEQ ID NO: 738760 - RNA, 19 nt, Homo sapiens
gauuugacccaucagaucu

SEQ ID NO: 738761 - RNA, 19 nt, Homo sapiens
gaucgauggagaauuuaag

SEQ ID NO: 738762 - RNA, 19 nt, Homo sapiens
uacguuugguucaagcauu

SEQ ID NO: 738763 - RNA, 19 nt, Homo sapiens
cacuugauuucacauuugu

SEQ ID NO: 738764 - RNA, 19 nt, Homo sapiens
ccauuuggccuggauuaau

SEQ ID NO: 738765 - RNA, 19 nt, Homo sapiens
caugcucuguugauucaca

SEQ ID NO: 738766 - RNA, 19 nt, Homo sapiens
gguagcaugcucuguugau

SEQ ID NO: 738767 - RNA, 19 nt, Homo sapiens
guguccaacugaaauuauc

SEQ ID NO: 738768 - RNA, 19 nt, Homo sapiens
acacuacguuugguucaag

SEQ ID NO: 738769 - RNA, 19 nt, Homo sapiens
cucaaaggacuauggugua

SEQ ID NO: 738770 - RNA, 19 nt, Homo sapiens
uagcaugcucuguugauuc

SEQ ID NO: 738771 - RNA, 19 nt, Homo sapiens
aauuuaaggagcugaaguu

SEQ ID NO: 738772 - RNA, 19 nt, Homo sapiens
acauuuguguguccaacug

SEQ ID NO: 738773 - RNA, 19 nt, Homo sapiens
cuacccacuugauuucaca

SEQ ID NO: 738774 - RNA, 19 nt, Homo sapiens
uaugaugcuugaaaguucu

SEQ ID NO: 738775 - RNA, 19 nt, Homo sapiens
cgauaaacugaauugagaa

SEQ ID NO: 738776 - RNA, 19 nt, Homo sapiens
ggucucuucauuauugaug

SEQ ID NO: 738777 - RNA, 19 nt, Homo sapiens
gaucucaaaggacuauggu

SEQ ID NO: 738778 - RNA, 19 nt, Homo sapiens
gauuccacuucuuucagau

SEQ ID NO: 738779 - RNA, 19 nt, Homo sapiens
gccaauaaggauuccacuu

SEQ ID NO: 738780 - RNA, 19 nt, Homo sapiens
gaagacaacuggaguggua

SEQ ID NO: 738781 - RNA, 19 nt, Homo sapiens
ggaaauggaucacacgauu

SEQ ID NO: 738782 - RNA, 19 nt, Homo sapiens
agaacaaacuggagaauaa

SEQ ID NO: 738783 - RNA, 19 nt, Homo sapiens
aaagauagcuguuuaggau

SEQ ID NO: 738784 - RNA, 19 nt, Homo sapiens
ucuagaaucuguacccuua

SEQ ID NO: 738785 - RNA, 19 nt, Homo sapiens
ccaauugaaugauuucgua

SEQ ID NO: 738786 - RNA, 19 nt, Homo sapiens
gaacauggacguuaauauc

SEQ ID NO: 738787 - RNA, 19 nt, Homo sapiens
cuaaaucccuagaauugua

SEQ ID NO: 738788 - RNA, 19 nt, Homo sapiens
ugaaaaggcuguuaaagua

SEQ ID NO: 738789 - RNA, 19 nt, Homo sapiens
gaaagaaggaaaugaaugu

SEQ ID NO: 738790 - RNA, 19 nt, Homo sapiens
gaagaaacucucuguaugu

SEQ ID NO: 738791 - RNA, 19 nt, Homo sapiens
cuauuuaccuugcacauuu

SEQ ID NO: 738792 - RNA, 19 nt, Homo sapiens
ugaagaaacucucuguaug

SEQ ID NO: 738793 - RNA, 19 nt, Homo sapiens
ccauaugccuuuauagcua

SEQ ID NO: 738794 - RNA, 19 nt, Homo sapiens
gcacguaccacccaauuau

SEQ ID NO: 738795 - RNA, 19 nt, Homo sapiens
ucagcaaagugaaggaaua

SEQ ID NO: 738796 - RNA, 19 nt, Homo sapiens
uuucguagcugaaguagaa

SEQ ID NO: 738797 - RNA, 19 nt, Homo sapiens
gaucacacgauuucuuuaa

SEQ ID NO: 738798 - RNA, 19 nt, Homo sapiens
gcaaugaugugcugcuucu

SEQ ID NO: 738799 - RNA, 19 nt, Homo sapiens
uuagguuucuguagcauua

SEQ ID NO: 738800 - RNA, 19 nt, Homo sapiens
ggaagaaggcaucaacaga

SEQ ID NO: 738801 - RNA, 19 nt, Homo sapiens
gaacaaacuggagaauaaa

SEQ ID NO: 738802 - RNA, 19 nt, Homo sapiens
gcacaaggaggacaauaau

SEQ ID NO: 738803 - RNA, 19 nt, Homo sapiens
acaaccauaugccuuuaua

SEQ ID NO: 738804 - RNA, 19 nt, Homo sapiens
ucaacagacucacugacua

SEQ ID NO: 738805 - RNA, 19 nt, Homo sapiens
uagcugaaguagaaacauu

SEQ ID NO: 738806 - RNA, 19 nt, Homo sapiens
uguaaugugugggauauaa

SEQ ID NO: 738807 - RNA, 19 nt, Homo sapiens
ucacguguguuuaugaaau

SEQ ID NO: 738808 - RNA, 19 nt, Homo sapiens
ggacaccgaugggcauugu

SEQ ID NO: 738809 - RNA, 19 nt, Homo sapiens
gcaacaauacgauuaucuu

SEQ ID NO: 738810 - RNA, 19 nt, Homo sapiens
acccacauaugaagaauaa

SEQ ID NO: 738811 - RNA, 19 nt, Homo sapiens
gacauggucuagaaucugu

SEQ ID NO: 738812 - RNA, 19 nt, Homo sapiens
cuacagccaugaucuuuag

SEQ ID NO: 738813 - RNA, 19 nt, Homo sapiens
cagcagaaauugaguugca

SEQ ID NO: 738814 - RNA, 19 nt, Homo sapiens
ggacaauaauagcugaucu

SEQ ID NO: 738815 - RNA, 19 nt, Homo sapiens
gaugugcugcuucugauuu

SEQ ID NO: 738816 - RNA, 19 nt, Homo sapiens
gcugagaacauggacguua

SEQ ID NO: 738817 - RNA, 19 nt, Homo sapiens
caacagacucacugacuau

SEQ ID NO: 738818 - RNA, 19 nt, Homo sapiens
acgcaaagcugagaacaug

SEQ ID NO: 738819 - RNA, 19 nt, Homo sapiens
gaaguuucacguguguuua

SEQ ID NO: 738820 - RNA, 19 nt, Homo sapiens
gaauaagaagcaaugaugu

SEQ ID NO: 738821 - RNA, 19 nt, Homo sapiens
gcugaaguagaaacauuua

SEQ ID NO: 738822 - RNA, 19 nt, Homo sapiens
gaagaacgcaaagcugaga

SEQ ID NO: 738823 - RNA, 19 nt, Homo sapiens
uuacaaccauaugccuuua

SEQ ID NO: 738824 - RNA, 19 nt, Homo sapiens
gaacauuuagaaagaagga

SEQ ID NO: 738825 - RNA, 19 nt, Homo sapiens
gacuauaucagcaaaguga

SEQ ID NO: 738826 - RNA, 19 nt, Homo sapiens
caacuggagugguacuuac

SEQ ID NO: 738827 - RNA, 19 nt, Homo sapiens
gagaacauggacguuaaua

SEQ ID NO: 738828 - RNA, 19 nt, Homo sapiens
gaauuaugauagcaugagu

SEQ ID NO: 738829 - RNA, 19 nt, Homo sapiens
ccucagaaaccgaaagaaa

SEQ ID NO: 738830 - RNA, 19 nt, Homo sapiens
cugagaacauggacguuaa

SEQ ID NO: 738831 - RNA, 19 nt, Homo sapiens
gagugguacuuacugaaga

SEQ ID NO: 738832 - RNA, 19 nt, Homo sapiens
uaagaugguuacagcuaug

SEQ ID NO: 738833 - RNA, 19 nt, Homo sapiens
gaaaucuaaugggaaaugg

SEQ ID NO: 738834 - RNA, 19 nt, Homo sapiens
gcauguauaggccgaacua

SEQ ID NO: 738835 - RNA, 19 nt, Homo sapiens
cugagucccuucaacauga

SEQ ID NO: 738836 - RNA, 19 nt, Homo sapiens
gcaaagcugagaacaugga

SEQ ID NO: 738837 - RNA, 19 nt, Homo sapiens
agauagcuguuuaggauau

SEQ ID NO: 738838 - RNA, 19 nt, Homo sapiens
gaaacaggaggugcacgua

SEQ ID NO: 738839 - RNA, 19 nt, Homo sapiens
gaggagucauggucuuugu

SEQ ID NO: 738840 - RNA, 19 nt, Homo sapiens
ggcacaaggaggacaauaa

SEQ ID NO: 738841 - RNA, 19 nt, Homo sapiens
guuccuaaaucccuagaau

SEQ ID NO: 738842 - RNA, 19 nt, Homo sapiens
gcaaccugcucuauuacca

SEQ ID NO: 738843 - RNA, 19 nt, Homo sapiens
ccaccacccuccuauugug

SEQ ID NO: 738844 - RNA, 19 nt, Homo sapiens
gagagaagaccucagaaac

SEQ ID NO: 738845 - RNA, 19 nt, Homo sapiens
caaagugaaggaauaaaca

SEQ ID NO: 738846 - RNA, 19 nt, Homo sapiens
gaucuuuagcacagugaua

SEQ ID NO: 738847 - RNA, 19 nt, Homo sapiens
agaauaagaagcaaugaug

SEQ ID NO: 738848 - RNA, 19 nt, Homo sapiens
acaaggaggacaauaauag

SEQ ID NO: 738849 - RNA, 19 nt, Homo sapiens
acuggaacauuuagaaaga

SEQ ID NO: 738850 - RNA, 19 nt, Homo sapiens
ccuauugugucugaaguuu

SEQ ID NO: 738851 - RNA, 19 nt, Homo sapiens
gcaaagugaaggaauaaac

SEQ ID NO: 738852 - RNA, 19 nt, Homo sapiens
gaaggcaucaacagacuca

SEQ ID NO: 738853 - RNA, 19 nt, Homo sapiens
ccuuugcuguugauguuua

SEQ ID NO: 738854 - RNA, 19 nt, Homo sapiens
uuggcgagcuauuuccuua

SEQ ID NO: 738855 - RNA, 19 nt, Homo sapiens
gaaguagaaacauuuaggu

SEQ ID NO: 738856 - RNA, 19 nt, Homo sapiens
gcuagacauuagaauuaug

SEQ ID NO: 738857 - RNA, 19 nt, Homo sapiens
cuuuauagcuagacauuag

SEQ ID NO: 738858 - RNA, 19 nt, Homo sapiens
cagacucacugacuauauc

SEQ ID NO: 738859 - RNA, 19 nt, Homo sapiens
gcauuaaauugugaagaca

SEQ ID NO: 738860 - RNA, 19 nt, Homo sapiens
uuaagaugguuacagcuau

SEQ ID NO: 738861 - RNA, 19 nt, Homo sapiens
ucagagagaagaccucaga

SEQ ID NO: 738862 - RNA, 19 nt, Homo sapiens
ucuauuaccagaccaacua

SEQ ID NO: 738863 - RNA, 19 nt, Homo sapiens
ggaucacacgauuucuuua

SEQ ID NO: 738864 - RNA, 19 nt, Homo sapiens
ggaauaaacauaacuuacc

SEQ ID NO: 738865 - RNA, 19 nt, Homo sapiens
gauagcuguuuaggauauu

SEQ ID NO: 738866 - RNA, 19 nt, Homo sapiens
cagcaaagugaaggaauaa

SEQ ID NO: 738867 - RNA, 19 nt, Homo sapiens
guuacaaccauaugccuuu

SEQ ID NO: 738868 - RNA, 19 nt, Homo sapiens
ccaugaugauuuccauugu

SEQ ID NO: 738869 - RNA, 19 nt, Homo sapiens
uguauguccuagaauaaga

SEQ ID NO: 738870 - RNA, 19 nt, Homo sapiens
caugaugauuuccauugug

SEQ ID NO: 738871 - RNA, 19 nt, Homo sapiens
cacaaggaggacaauaaua

SEQ ID NO: 738872 - RNA, 19 nt, Homo sapiens
guaaugugugggauauaaa

SEQ ID NO: 738873 - RNA, 19 nt, Homo sapiens
caucauguguuagccuguu

SEQ ID NO: 738874 - RNA, 19 nt, Homo sapiens
cugaagaaacucucuguau

SEQ ID NO: 738875 - RNA, 19 nt, Homo sapiens
gguacuuacugaagaaacu

SEQ ID NO: 738876 - RNA, 19 nt, Homo sapiens
uacagcaacaauacgauua

SEQ ID NO: 738877 - RNA, 19 nt, Homo sapiens
gccaugaugauuuccauug

SEQ ID NO: 738878 - RNA, 19 nt, Homo sapiens
agagagaagaccucagaaa

SEQ ID NO: 738879 - RNA, 19 nt, Homo sapiens
ggagugguacuuacugaag

SEQ ID NO: 738880 - RNA, 19 nt, Homo sapiens
gaagaaagcucucaaguug

SEQ ID NO: 738881 - RNA, 19 nt, Homo sapiens
gcugaagacugaauuguaa

SEQ ID NO: 738882 - RNA, 19 nt, Homo sapiens
gaagaaauccugggaauug

SEQ ID NO: 738883 - RNA, 19 nt, Homo sapiens
ggacuauggugcuguauau

SEQ ID NO: 738884 - RNA, 19 nt, Homo sapiens
gaacacacccugaagaaau

SEQ ID NO: 738885 - RNA, 19 nt, Homo sapiens
ugucuucacucuauacuua

SEQ ID NO: 738886 - RNA, 19 nt, Homo sapiens
gaauugaccuuguaaucga

SEQ ID NO: 738887 - RNA, 19 nt, Homo sapiens
aacaaacccuugaugauua

SEQ ID NO: 738888 - RNA, 19 nt, Homo sapiens
gaaagccucuggcaaguag

SEQ ID NO: 738889 - RNA, 19 nt, Homo sapiens
guuaaugucuucacucuau

SEQ ID NO: 738890 - RNA, 19 nt, Homo sapiens
gaaauuggcagagcaguuu

SEQ ID NO: 738891 - RNA, 19 nt, Homo sapiens
guagaaaggucauccaaag

SEQ ID NO: 738892 - RNA, 19 nt, Homo sapiens
cugauuagguuaugguuua

SEQ ID NO: 738893 - RNA, 19 nt, Homo sapiens
caacaaacccuugaugauu

SEQ ID NO: 738894 - RNA, 19 nt, Homo sapiens
guacuggagugaaauaaau

SEQ ID NO: 738895 - RNA, 19 nt, Homo sapiens
ucaaguugcugaagacuga

SEQ ID NO: 738896 - RNA, 19 nt, Homo sapiens
gccaacaugugacuaauug

SEQ ID NO: 738897 - RNA, 19 nt, Homo sapiens
gaaauaaauucagccaaca

SEQ ID NO: 738898 - RNA, 19 nt, Homo sapiens
gacacgagcuuaaucaaca

SEQ ID NO: 738899 - RNA, 19 nt, Homo sapiens
cuaaaguacuggagugaaa

SEQ ID NO: 738900 - RNA, 19 nt, Homo sapiens
cagucaagcuuuaaagaaa

SEQ ID NO: 738901 - RNA, 19 nt, Homo sapiens
gugaggaaauccagaguug

SEQ ID NO: 738902 - RNA, 19 nt, Homo sapiens
guacacacuuucauuuagu

SEQ ID NO: 738903 - RNA, 19 nt, Homo sapiens
ugagaagacuggcuagugu

SEQ ID NO: 738904 - RNA, 19 nt, Homo sapiens
gguacacacuuucauuuag

SEQ ID NO: 738905 - RNA, 19 nt, Homo sapiens
cuagaugacuguaaguaga

SEQ ID NO: 738906 - RNA, 19 nt, Homo sapiens
ccaaauaggauuaaacaca

SEQ ID NO: 738907 - RNA, 19 nt, Homo sapiens
gcaacaaacccuugaugau

SEQ ID NO: 738908 - RNA, 19 nt, Homo sapiens
ggacucagacauaugaaga

SEQ ID NO: 738909 - RNA, 19 nt, Homo sapiens
aaaggacucucgacccaaa

SEQ ID NO: 738910 - RNA, 19 nt, Homo sapiens
agucaaaccuggagccaaa

SEQ ID NO: 738911 - RNA, 19 nt, Homo sapiens
gaccaaagaccaaguuauc

SEQ ID NO: 738912 - RNA, 19 nt, Homo sapiens
gcucucaaguugcugaaga

SEQ ID NO: 738913 - RNA, 19 nt, Homo sapiens
gaaaggucauccaaagaac

SEQ ID NO: 738914 - RNA, 19 nt, Homo sapiens
acucuaagguacacacuuu

SEQ ID NO: 738915 - RNA, 19 nt, Homo sapiens
uuacgaaccugcagauaca

SEQ ID NO: 738916 - RNA, 19 nt, Homo sapiens
gugaaaggcuguggcauca

SEQ ID NO: 738917 - RNA, 19 nt, Homo sapiens
gaacaucugcacuccugaa

SEQ ID NO: 738918 - RNA, 19 nt, Homo sapiens
ugaagaaagcucucaaguu

SEQ ID NO: 738919 - RNA, 19 nt, Homo sapiens
gcaggugggugaggaaauc

SEQ ID NO: 738920 - RNA, 19 nt, Homo sapiens
agauggagaucagagguua

SEQ ID NO: 738921 - RNA, 19 nt, Homo sapiens
ggaaagccucuggcaagua

SEQ ID NO: 738922 - RNA, 19 nt, Homo sapiens
ucacaucacuaccuagagu

SEQ ID NO: 738923 - RNA, 19 nt, Homo sapiens
gaaaguguuugcugaaaau

SEQ ID NO: 738924 - RNA, 19 nt, Homo sapiens
gaagaccaaagaccaaguu

SEQ ID NO: 738925 - RNA, 19 nt, Homo sapiens
ugaaacaacugacaaacac

SEQ ID NO: 738926 - RNA, 19 nt, Homo sapiens
agaaaggucauccaaagaa

SEQ ID NO: 738927 - RNA, 19 nt, Homo sapiens
caccacagguucucacuag

SEQ ID NO: 738928 - RNA, 19 nt, Homo sapiens
guaaucgauuugucuguca

SEQ ID NO: 738929 - RNA, 19 nt, Homo sapiens
uaagguacacacuuucauu

SEQ ID NO: 738930 - RNA, 19 nt, Homo sapiens
aaaggguggugacguguug

SEQ ID NO: 738931 - RNA, 19 nt, Homo sapiens
caacaugugacuaauugga

SEQ ID NO: 738932 - RNA, 19 nt, Homo sapiens
ggagaaaauuccaguguca

SEQ ID NO: 738933 - RNA, 19 nt, Homo sapiens
guacaugugugaaaacaau

SEQ ID NO: 738934 - RNA, 19 nt, Homo sapiens
ccaggauuauguuuguuga

SEQ ID NO: 738935 - RNA, 19 nt, Homo sapiens
aaacaccuuucuccugaug

SEQ ID NO: 738936 - RNA, 19 nt, Homo sapiens
aagaaaguguuugcugaaa

SEQ ID NO: 738937 - RNA, 19 nt, Homo sapiens
acaaacccuugaugauuau

SEQ ID NO: 738938 - RNA, 19 nt, Homo sapiens
caaguagcuuucuccuuca

SEQ ID NO: 738939 - RNA, 19 nt, Homo sapiens
gggaaagccucuggcaagu

SEQ ID NO: 738940 - RNA, 19 nt, Homo sapiens
agucaacucuggccaggaa

SEQ ID NO: 738941 - RNA, 19 nt, Homo sapiens
uggcuaguguggaagcaua

SEQ ID NO: 738942 - RNA, 19 nt, Homo sapiens
aaagaaauccagaaauugg

SEQ ID NO: 738943 - RNA, 19 nt, Homo sapiens
gggaauugaccuuguaauc

SEQ ID NO: 738944 - RNA, 19 nt, Homo sapiens
ccugggaauugaccuugua

SEQ ID NO: 738945 - RNA, 19 nt, Homo sapiens
ggagaucagagguuacuag

SEQ ID NO: 738946 - RNA, 19 nt, Homo sapiens
gugacuaauuggaagaaga

SEQ ID NO: 738947 - RNA, 19 nt, Homo sapiens
ggaauugaccuuguaaucg

SEQ ID NO: 738948 - RNA, 19 nt, Homo sapiens
ggccaggaacucuaaggua

SEQ ID NO: 738949 - RNA, 19 nt, Homo sapiens
guagacacgagcuuaauca

SEQ ID NO: 738950 - RNA, 19 nt, Homo sapiens
gaugaagaccaaagaccaa

SEQ ID NO: 738951 - RNA, 19 nt, Homo sapiens
caaguguacaugugugaaa

SEQ ID NO: 738952 - RNA, 19 nt, Homo sapiens
gaagacugaauuguaaaga

SEQ ID NO: 738953 - RNA, 19 nt, Homo sapiens
cuauggugcuguauauaau

SEQ ID NO: 738954 - RNA, 19 nt, Homo sapiens
aagaaauccugggaauuga

SEQ ID NO: 738955 - RNA, 19 nt, Homo sapiens
agaaagcucucaaguugcu

SEQ ID NO: 738956 - RNA, 19 nt, Homo sapiens
agaauuguguguuaauguc

SEQ ID NO: 738957 - RNA, 19 nt, Homo sapiens
aaauucagccaacauguga

SEQ ID NO: 738958 - RNA, 19 nt, Homo sapiens
aaaguacuggagugaaaua

SEQ ID NO: 738959 - RNA, 19 nt, Homo sapiens
cugucaagguccuaaagua

SEQ ID NO: 738960 - RNA, 19 nt, Homo sapiens
gauuauucaucacuuggau

SEQ ID NO: 738961 - RNA, 19 nt, Homo sapiens
cugaagaaauccugggaau

SEQ ID NO: 738962 - RNA, 19 nt, Homo sapiens
agaccaaguuaucaucuca

SEQ ID NO: 738963 - RNA, 19 nt, Homo sapiens
caacuuggucuuucacagu

SEQ ID NO: 738964 - RNA, 19 nt, Homo sapiens
gaagcucuauauaaaucca

SEQ ID NO: 738965 - RNA, 19 nt, Homo sapiens
uaaauucagccaacaugug

SEQ ID NO: 738966 - RNA, 19 nt, Homo sapiens
cauaugaagaagcucuaua

SEQ ID NO: 738967 - RNA, 19 nt, Homo sapiens
ccacacagucaagcuuuaa

SEQ ID NO: 738968 - RNA, 19 nt, Homo sapiens
aaagaaaguguuugcugaa

SEQ ID NO: 738969 - RNA, 19 nt, Homo sapiens
ucagacauaugaagaagcu

SEQ ID NO: 738970 - RNA, 19 nt, Homo sapiens
ugacccaucucugacaguu

SEQ ID NO: 738971 - RNA, 19 nt, Homo sapiens
ugcaguaucuguugcuugu

SEQ ID NO: 738972 - RNA, 19 nt, Homo sapiens
acuauggugcuguauauaa

SEQ ID NO: 738973 - RNA, 19 nt, Homo sapiens
cacagguucucacuagaug

SEQ ID NO: 738974 - RNA, 19 nt, Homo sapiens
caaagaccaaguuaucauc

SEQ ID NO: 738975 - RNA, 19 nt, Homo sapiens
ccaaagaccaaguuaucau

SEQ ID NO: 738976 - RNA, 19 nt, Homo sapiens
ggacaagacaaaaccaaaa

SEQ ID NO: 738977 - RNA, 19 nt, Homo sapiens
cccacacagucaagcuuua

SEQ ID NO: 738978 - RNA, 19 nt, Homo sapiens
gguuaugguuuaauguuac

SEQ ID NO: 738979 - RNA, 19 nt, Homo sapiens
gguggugacguguugauga

SEQ ID NO: 738980 - RNA, 19 nt, Homo sapiens
gcaagauugucgcaaauuu

SEQ ID NO: 738981 - RNA, 19 nt, Homo sapiens
ucacucaagucucuauuua

SEQ ID NO: 738982 - RNA, 19 nt, Homo sapiens
gcccaaugcucuuuaacua

SEQ ID NO: 738983 - RNA, 19 nt, Homo sapiens
gcacgacucauuucuguuu

SEQ ID NO: 738984 - RNA, 19 nt, Homo sapiens
caagcaagauugucgcaaa

SEQ ID NO: 738985 - RNA, 19 nt, Homo sapiens
ggugaaagcucaugaacuc

SEQ ID NO: 738986 - RNA, 19 nt, Homo sapiens
gagcacgacucauuucugu

SEQ ID NO: 738987 - RNA, 19 nt, Homo sapiens
gaagugcacaucuauaaga

SEQ ID NO: 738988 - RNA, 19 nt, Homo sapiens
gugcaggucucgacucuga

SEQ ID NO: 738989 - RNA, 19 nt, Homo sapiens
ucagaaagaugguguuugg

SEQ ID NO: 738990 - RNA, 19 nt, Homo sapiens
ggacacaucacagguauug

SEQ ID NO: 738991 - RNA, 19 nt, Homo sapiens
gugcacaucuauaagaaga

SEQ ID NO: 738992 - RNA, 19 nt, Homo sapiens
ugagggagauauguaaauu

SEQ ID NO: 738993 - RNA, 19 nt, Homo sapiens
gaccuucgucuccaaguua

SEQ ID NO: 738994 - RNA, 19 nt, Homo sapiens
aaacacauaucacgccaau

SEQ ID NO: 738995 - RNA, 19 nt, Homo sapiens
gcuccuaagugugucauuu

SEQ ID NO: 738996 - RNA, 19 nt, Homo sapiens
cuggugauccugagaauua

SEQ ID NO: 738997 - RNA, 19 nt, Homo sapiens
gaucaugugacuucaaaug

SEQ ID NO: 738998 - RNA, 19 nt, Homo sapiens
acucaagucucuauuuaug

SEQ ID NO: 738999 - RNA, 19 nt, Homo sapiens
caaauuugcugugggaagu

SEQ ID NO: 739000 - RNA, 19 nt, Homo sapiens
gaaagcucaugaacucaag

SEQ ID NO: 739001 - RNA, 19 nt, Homo sapiens
uagcaucacucaagucucu

SEQ ID NO: 739002 - RNA, 19 nt, Homo sapiens
cagaauagcaucacucaag

SEQ ID NO: 739003 - RNA, 19 nt, Homo sapiens
gcacaacggacacaucaca

SEQ ID NO: 739004 - RNA, 19 nt, Homo sapiens
gagcacaacggacacauca

SEQ ID NO: 739005 - RNA, 19 nt, Homo sapiens
uggagacgcugcaccagaa

SEQ ID NO: 739006 - RNA, 19 nt, Homo sapiens
ggaaguggagcacgacuca

SEQ ID NO: 739007 - RNA, 19 nt, Homo sapiens
ccagcuuucucuccuuuga

SEQ ID NO: 739008 - RNA, 19 nt, Homo sapiens
gcacaucuauaagaagaac

SEQ ID NO: 739009 - RNA, 19 nt, Homo sapiens
ccaugacaauuugggauuu

SEQ ID NO: 739010 - RNA, 19 nt, Homo sapiens
cgauuucauuccauucuug

SEQ ID NO: 739011 - RNA, 19 nt, Homo sapiens
ucaagucucuauuuaugag

SEQ ID NO: 739012 - RNA, 19 nt, Homo sapiens
gacaagagagccacaacug

SEQ ID NO: 739013 - RNA, 19 nt, Homo sapiens
agaaagaugguguuuggaa

SEQ ID NO: 739014 - RNA, 19 nt, Homo sapiens
gagccaaucaccugucaug

SEQ ID NO: 739015 - RNA, 19 nt, Homo sapiens
agggagauauguaaauugu

SEQ ID NO: 739016 - RNA, 19 nt, Homo sapiens
gcagcaggaucaugugacu

SEQ ID NO: 739017 - RNA, 19 nt, Homo sapiens
gcgauuucauuccauucuu

SEQ ID NO: 739018 - RNA, 19 nt, Homo sapiens
agaauagcaucacucaagu

SEQ ID NO: 739019 - RNA, 19 nt, Homo sapiens
cuaagugugucauuugucu

SEQ ID NO: 739020 - RNA, 19 nt, Homo sapiens
ugggugagcaagcacauua

SEQ ID NO: 739021 - RNA, 19 nt, Homo sapiens
acgaagugcacaucuauaa

SEQ ID NO: 739022 - RNA, 19 nt, Homo sapiens
gagcauccaacgcaacaug

SEQ ID NO: 739023 - RNA, 19 nt, Homo sapiens
gcugcccaaugcucuuuaa

SEQ ID NO: 739024 - RNA, 19 nt, Homo sapiens
aggaucaugugacuucaaa

SEQ ID NO: 739025 - RNA, 19 nt, Homo sapiens
cgacucauuucuguuuguu

SEQ ID NO: 739026 - RNA, 19 nt, Homo sapiens
ucacgaagugcacaucuau

SEQ ID NO: 739027 - RNA, 19 nt, Homo sapiens
ccacaguccucagcuugga

SEQ ID NO: 739028 - RNA, 19 nt, Homo sapiens
aagcuucucuuuaaguagu

SEQ ID NO: 739029 - RNA, 19 nt, Homo sapiens
gagacgcugcaccagaaua

SEQ ID NO: 739030 - RNA, 19 nt, Homo sapiens
gagggagauauguaaauug

SEQ ID NO: 739031 - RNA, 19 nt, Homo sapiens
cuucaaaugcagaguguuu

SEQ ID NO: 739032 - RNA, 19 nt, Homo sapiens
ggugagcaagcacauuaaa

SEQ ID NO: 739033 - RNA, 19 nt, Homo sapiens
acacauaucacgccaaugc

SEQ ID NO: 739034 - RNA, 19 nt, Homo sapiens
aagcaagauugucgcaaau

SEQ ID NO: 739035 - RNA, 19 nt, Homo sapiens
uuuaugagguggacaagca

SEQ ID NO: 739036 - RNA, 19 nt, Homo sapiens
gcgaccgcauugucacuug

SEQ ID NO: 739037 - RNA, 19 nt, Homo sapiens
caagagcgaccgcauuguc

SEQ ID NO: 739038 - RNA, 19 nt, Homo sapiens
ugaccuucgucuccaaguu

SEQ ID NO: 739039 - RNA, 19 nt, Homo sapiens
gacuucaaaugcagagugu

SEQ ID NO: 739040 - RNA, 19 nt, Homo sapiens
ucaugugacuucaaaugca

SEQ ID NO: 739041 - RNA, 19 nt, Homo sapiens
gaauaaugucacugcauca

SEQ ID NO: 739042 - RNA, 19 nt, Homo sapiens
ugaaagcucaugaacucaa

SEQ ID NO: 739043 - RNA, 19 nt, Homo sapiens
gagguggacaagcaagauu

SEQ ID NO: 739044 - RNA, 19 nt, Homo sapiens
gcaccagaauagcaucacu

SEQ ID NO: 739045 - RNA, 19 nt, Homo sapiens
acaagagagccacaacuga

SEQ ID NO: 739046 - RNA, 19 nt, Homo sapiens
aagugcacaucuauaagaa

SEQ ID NO: 739047 - RNA, 19 nt, Homo sapiens
gggugagggagauauguaa

SEQ ID NO: 739048 - RNA, 19 nt, Homo sapiens
gcuccacaguccucagcuu

SEQ ID NO: 739049 - RNA, 19 nt, Homo sapiens
uuuguuacuuugagucuga

SEQ ID NO: 739050 - RNA, 19 nt, Homo sapiens
cauccagcaugacaaacug

SEQ ID NO: 739051 - RNA, 19 nt, Homo sapiens
ggacaagagagccacaacu

SEQ ID NO: 739052 - RNA, 19 nt, Homo sapiens
gcagcaagaugccuuuugg

SEQ ID NO: 739053 - RNA, 19 nt, Homo sapiens
gcaggaucaugugacuuca

SEQ ID NO: 739054 - RNA, 19 nt, Homo sapiens
ggugagggagauauguaaa

SEQ ID NO: 739055 - RNA, 19 nt, Homo sapiens
caugacaauuugggauuuc

SEQ ID NO: 739056 - RNA, 19 nt, Homo sapiens
gccaugacaauuugggauu

SEQ ID NO: 739057 - RNA, 19 nt, Homo sapiens
uagagccaaucaccuguca

SEQ ID NO: 739058 - RNA, 19 nt, Homo sapiens
caugacugcugcccaaugc

SEQ ID NO: 739059 - RNA, 19 nt, Homo sapiens
gaaacacugaaaacacaua

SEQ ID NO: 739060 - RNA, 19 nt, Homo sapiens
gaagccagccccaaggaaa

SEQ ID NO: 739061 - RNA, 19 nt, Homo sapiens
ccuccgccauccagcauga

SEQ ID NO: 739062 - RNA, 19 nt, Homo sapiens
gaauagcaucacucaaguc

SEQ ID NO: 739063 - RNA, 19 nt, Homo sapiens
caccgugucuguugcugau

SEQ ID NO: 739064 - RNA, 19 nt, Homo sapiens
ucccagcuuucucuccuuu

SEQ ID NO: 739065 - RNA, 19 nt, Homo sapiens
cccaagagcgaccgcauug

SEQ ID NO: 739066 - RNA, 19 nt, Homo sapiens
ccaaguuagauauuccaaa

SEQ ID NO: 739067 - RNA, 19 nt, Homo sapiens
ggagcacgacucauuucug

SEQ ID NO: 739068 - RNA, 19 nt, Homo sapiens
gaagccaacccuggugauc

SEQ ID NO: 739069 - RNA, 19 nt, Homo sapiens
gauuucauuccauucuuga

SEQ ID NO: 739070 - RNA, 19 nt, Homo sapiens
guggcacgauggcgaggaa

SEQ ID NO: 739071 - RNA, 19 nt, Homo sapiens
ggaacagggaucguacuca

SEQ ID NO: 739072 - RNA, 19 nt, Homo sapiens
caagauugucgcaaauuuu

SEQ ID NO: 739073 - RNA, 19 nt, Homo sapiens
acucauuucuguuuguuac

SEQ ID NO: 739074 - RNA, 19 nt, Homo sapiens
cgaccgcauugucacuugu

SEQ ID NO: 739075 - RNA, 19 nt, Homo sapiens
cugccuacauuaaagaagu

SEQ ID NO: 739076 - RNA, 19 nt, Homo sapiens
aaguggagcacgacucauu

SEQ ID NO: 739077 - RNA, 19 nt, Homo sapiens
gugagggagauauguaaau

SEQ ID NO: 739078 - RNA, 19 nt, Homo sapiens
gcaucacucaagucucuau

SEQ ID NO: 739079 - RNA, 19 nt, Homo sapiens
cagggaucguacucagauu

SEQ ID NO: 739080 - RNA, 19 nt, Homo sapiens
ggaguucuguuaugugaua

SEQ ID NO: 739081 - RNA, 19 nt, Homo sapiens
gugaauggcugguuagaaa

SEQ ID NO: 739082 - RNA, 19 nt, Homo sapiens
gaucguuacucuguauuua

SEQ ID NO: 739083 - RNA, 19 nt, Homo sapiens
gugcaaacauuucaacuug

SEQ ID NO: 739084 - RNA, 19 nt, Homo sapiens
gagauuaugugcugaaguc

SEQ ID NO: 739085 - RNA, 19 nt, Homo sapiens
gaaguuauauaccuaagcu

SEQ ID NO: 739086 - RNA, 19 nt, Homo sapiens
agccaagguugaagaauua

SEQ ID NO: 739087 - RNA, 19 nt, Homo sapiens
uaacacccaucaccaaauc

SEQ ID NO: 739088 - RNA, 19 nt, Homo sapiens
ucaacuugcuauccucuaa

SEQ ID NO: 739089 - RNA, 19 nt, Homo sapiens
gcuggagggugcaaacauu

SEQ ID NO: 739090 - RNA, 19 nt, Homo sapiens
ggagggauuuguucguguu

SEQ ID NO: 739091 - RNA, 19 nt, Homo sapiens
aagccaagguugaagaauu

SEQ ID NO: 739092 - RNA, 19 nt, Homo sapiens
ugacuacgccucugccuuu

SEQ ID NO: 739093 - RNA, 19 nt, Homo sapiens
cagcauggccgaaacagaa

SEQ ID NO: 739094 - RNA, 19 nt, Homo sapiens
gcuaauucacuacauguaa

SEQ ID NO: 739095 - RNA, 19 nt, Homo sapiens
gcagaauaaauccgucuuu

SEQ ID NO: 739096 - RNA, 19 nt, Homo sapiens
aaguaaacauugugccuuu

SEQ ID NO: 739097 - RNA, 19 nt, Homo sapiens
agauggaacugcuggagaa

SEQ ID NO: 739098 - RNA, 19 nt, Homo sapiens
cgacgaggaagcuuauaaa

SEQ ID NO: 739099 - RNA, 19 nt, Homo sapiens
cauugugccuuuacuacuu

SEQ ID NO: 739100 - RNA, 19 nt, Homo sapiens
aaagaugaauggacaacuc

SEQ ID NO: 739101 - RNA, 19 nt, Homo sapiens
guucagagccugguuauac

SEQ ID NO: 739102 - RNA, 19 nt, Homo sapiens
aaaugugaaucaagaagug

SEQ ID NO: 739103 - RNA, 19 nt, Homo sapiens
cagaagcccugucgaagcu

SEQ ID NO: 739104 - RNA, 19 nt, Homo sapiens
caagagacaagcagaugga

SEQ ID NO: 739105 - RNA, 19 nt, Homo sapiens
gcugaacaauguggugaga

SEQ ID NO: 739106 - RNA, 19 nt, Homo sapiens
aaacauugugccuuuacua

SEQ ID NO: 739107 - RNA, 19 nt, Homo sapiens
ggaaagcgcauggcucucu

SEQ ID NO: 739108 - RNA, 19 nt, Homo sapiens
ggccuggaguucuguuaug

SEQ ID NO: 739109 - RNA, 19 nt, Homo sapiens
cuaaaggagcugauaaauc

SEQ ID NO: 739110 - RNA, 19 nt, Homo sapiens
cuuaugaccgugcaaauga

SEQ ID NO: 739111 - RNA, 19 nt, Homo sapiens
gaccgugguuagagcaaug

SEQ ID NO: 739112 - RNA, 19 nt, Homo sapiens
ccucaggcauccauuccaa

SEQ ID NO: 739113 - RNA, 19 nt, Homo sapiens
uggaacugcuggagaacaa

SEQ ID NO: 739114 - RNA, 19 nt, Homo sapiens
cuggaguucuguuauguga

SEQ ID NO: 739115 - RNA, 19 nt, Homo sapiens
agaaguagaagccaagguu

SEQ ID NO: 739116 - RNA, 19 nt, Homo sapiens
ugccuuuacuacuucuuua

SEQ ID NO: 739117 - RNA, 19 nt, Homo sapiens
ggcacaauaaucuguaauu

SEQ ID NO: 739118 - RNA, 19 nt, Homo sapiens
cuacgccucugccuuucaa

SEQ ID NO: 739119 - RNA, 19 nt, Homo sapiens
ucaugucucugaguuacaa

SEQ ID NO: 739120 - RNA, 19 nt, Homo sapiens
gagacaagcagauggaacu

SEQ ID NO: 739121 - RNA, 19 nt, Homo sapiens
gacuucaggaugcagaaua

SEQ ID NO: 739122 - RNA, 19 nt, Homo sapiens
caacuugcuauccucuaaa

SEQ ID NO: 739123 - RNA, 19 nt, Homo sapiens
ggugcaaacauuucaacuu

SEQ ID NO: 739124 - RNA, 19 nt, Homo sapiens
agucacagcagccaugaaa

SEQ ID NO: 739125 - RNA, 19 nt, Homo sapiens
acuucaggaugcagaauaa

SEQ ID NO: 739126 - RNA, 19 nt, Homo sapiens
gaaucucgcccaggugaau

SEQ ID NO: 739127 - RNA, 19 nt, Homo sapiens
ggagggugcaaacauuuca

SEQ ID NO: 739128 - RNA, 19 nt, Homo sapiens
gcucugcucuaaaauuguu

SEQ ID NO: 739129 - RNA, 19 nt, Homo sapiens
cagagccugguuauacaua

SEQ ID NO: 739130 - RNA, 19 nt, Homo sapiens
aggcauccauuccaaucaa

SEQ ID NO: 739131 - RNA, 19 nt, Homo sapiens
aaagauuugucagcccuau

SEQ ID NO: 739132 - RNA, 19 nt, Homo sapiens
guuaugugauaggcaagaa

SEQ ID NO: 739133 - RNA, 19 nt, Homo sapiens
guauuuaggccuggaguuc

SEQ ID NO: 739134 - RNA, 19 nt, Homo sapiens
ccucuaaaggagcugauaa

SEQ ID NO: 739135 - RNA, 19 nt, Homo sapiens
ggccugcuuugaaaugcuu

SEQ ID NO: 739136 - RNA, 19 nt, Homo sapiens
acaaguuaagggagaagua

SEQ ID NO: 739137 - RNA, 19 nt, Homo sapiens
ucaggaugcagaauaaauc

SEQ ID NO: 739138 - RNA, 19 nt, Homo sapiens
gcucuaaaauuguugacau

SEQ ID NO: 739139 - RNA, 19 nt, Homo sapiens
ucgacgaggaagcuuauaa

SEQ ID NO: 739140 - RNA, 19 nt, Homo sapiens
caaguuaagggagaaguag

SEQ ID NO: 739141 - RNA, 19 nt, Homo sapiens
augcuugucugcagaguca

SEQ ID NO: 739142 - RNA, 19 nt, Homo sapiens
gucagcauguuuuaacuuu

SEQ ID NO: 739143 - RNA, 19 nt, Homo sapiens
gguaauuucagggucuaaa

SEQ ID NO: 739144 - RNA, 19 nt, Homo sapiens
ggugaauggcugguuagaa

SEQ ID NO: 739145 - RNA, 19 nt, Homo sapiens
gccuggaguucuguuaugu

SEQ ID NO: 739146 - RNA, 19 nt, Homo sapiens
ggaggauuaaauaaaggaa

SEQ ID NO: 739147 - RNA, 19 nt, Homo sapiens
gggaggauuaaauaaagga

SEQ ID NO: 739148 - RNA, 19 nt, Homo sapiens
ugggcacaauaaucuguaa

SEQ ID NO: 739149 - RNA, 19 nt, Homo sapiens
ucagcccuaucucaaacuu

SEQ ID NO: 739150 - RNA, 19 nt, Homo sapiens
ugucagcccuaucucaaac

SEQ ID NO: 739151 - RNA, 19 nt, Homo sapiens
ggugagaccaagagacaag

SEQ ID NO: 739152 - RNA, 19 nt, Homo sapiens
uagaagccaagguugaaga

SEQ ID NO: 739153 - RNA, 19 nt, Homo sapiens
uuugaucguuacucuguau

SEQ ID NO: 739154 - RNA, 19 nt, Homo sapiens
uugaaaaguuggaugacua

SEQ ID NO: 739155 - RNA, 19 nt, Homo sapiens
agagccugguuauacauau

SEQ ID NO: 739156 - RNA, 19 nt, Homo sapiens
gugguucagagccugguua

SEQ ID NO: 739157 - RNA, 19 nt, Homo sapiens
cuuaacacccaucaccaaa

SEQ ID NO: 739158 - RNA, 19 nt, Homo sapiens
gaccaagagacaagcagau

SEQ ID NO: 739159 - RNA, 19 nt, Homo sapiens
ccaagguugaagaauuaaa

SEQ ID NO: 739160 - RNA, 19 nt, Homo sapiens
gugccuuuacuacuucuuu

SEQ ID NO: 739161 - RNA, 19 nt, Homo sapiens
cagcauguuuuaacuuugu

SEQ ID NO: 739162 - RNA, 19 nt, Homo sapiens
caucaccaaaucgguaauu

SEQ ID NO: 739163 - RNA, 19 nt, Homo sapiens
caaaguccauggauucaau

SEQ ID NO: 739164 - RNA, 19 nt, Homo sapiens
caagauggccuucuacaau

SEQ ID NO: 739165 - RNA, 19 nt, Homo sapiens
augaagaucuugcgucuaa

SEQ ID NO: 739166 - RNA, 19 nt, Homo sapiens
uaggagggcuuuuaauuua

SEQ ID NO: 739167 - RNA, 19 nt, Homo sapiens
cgggaaaucuccacugaug

SEQ ID NO: 739168 - RNA, 19 nt, Homo sapiens
gagguaggcugggagcaaa

SEQ ID NO: 739169 - RNA, 19 nt, Homo sapiens
ccaguucagucuccacauu

SEQ ID NO: 739170 - RNA, 19 nt, Homo sapiens
gcuggacccuucuaauuca

SEQ ID NO: 739171 - RNA, 19 nt, Homo sapiens
gggcuggacccuucuaauu

SEQ ID NO: 739172 - RNA, 19 nt, Homo sapiens
gaagaucuugcgucuaaug

SEQ ID NO: 739173 - RNA, 19 nt, Homo sapiens
ccacuuauucuccuauuug

SEQ ID NO: 739174 - RNA, 19 nt, Homo sapiens
ccaguggagucucuuccua

SEQ ID NO: 739175 - RNA, 19 nt, Homo sapiens
gccaaacccucuuccuugu

SEQ ID NO: 739176 - RNA, 19 nt, Homo sapiens
gaacgagaaaccacaaugg

SEQ ID NO: 739177 - RNA, 19 nt, Homo sapiens
gguggugacuaucugaaga

SEQ ID NO: 739178 - RNA, 19 nt, Homo sapiens
caagacuucuacugcaaga

SEQ ID NO: 739179 - RNA, 19 nt, Homo sapiens
aagauggccuucuacaaug

SEQ ID NO: 739180 - RNA, 19 nt, Homo sapiens
caccuucccucccagugua

SEQ ID NO: 739181 - RNA, 19 nt, Homo sapiens
ggacucauccauucuuugg

SEQ ID NO: 739182 - RNA, 19 nt, Homo sapiens
caaacccucuuccuugucu

SEQ ID NO: 739183 - RNA, 19 nt, Homo sapiens
cgacagagacagagacaca

SEQ ID NO: 739184 - RNA, 19 nt, Homo sapiens
ggaacgagaaaccacaaug

SEQ ID NO: 739185 - RNA, 19 nt, Homo sapiens
gauaggagggcuuuuaauu

SEQ ID NO: 739186 - RNA, 19 nt, Homo sapiens
gagcucuccucccaucugu

SEQ ID NO: 739187 - RNA, 19 nt, Homo sapiens
gaaaauaaagagagagaga

SEQ ID NO: 739188 - RNA, 19 nt, Homo sapiens
ucgagaacaugaagaucuu

SEQ ID NO: 739189 - RNA, 19 nt, Homo sapiens
auaaagagagagagagaaa

SEQ ID NO: 739190 - RNA, 19 nt, Homo sapiens
ggagggcuuuuaauuuauu

SEQ ID NO: 739191 - RNA, 19 nt, Homo sapiens
ccauagucauguccuccua

SEQ ID NO: 739192 - RNA, 19 nt, Homo sapiens
gcuccaugcugcccuucaa

SEQ ID NO: 739193 - RNA, 19 nt, Homo sapiens
gaagggcugacaccagaug

SEQ ID NO: 739194 - RNA, 19 nt, Homo sapiens
gagcuuuccucagcaccuu

SEQ ID NO: 739195 - RNA, 19 nt, Homo sapiens
uggagucucuuccuaugug

SEQ ID NO: 739196 - RNA, 19 nt, Homo sapiens
ggagguaggcugggagcaa

SEQ ID NO: 739197 - RNA, 19 nt, Homo sapiens
aaauaaagagagagagaga

SEQ ID NO: 739198 - RNA, 19 nt, Homo sapiens
gagguggccagaauggauu

SEQ ID NO: 739199 - RNA, 19 nt, Homo sapiens
uaaugcugcuccacaucaa

SEQ ID NO: 739200 - RNA, 19 nt, Homo sapiens
ugaagugaauguggauaca

SEQ ID NO: 739201 - RNA, 19 nt, Homo sapiens
gggccaaacccucuuccuu

SEQ ID NO: 739202 - RNA, 19 nt, Homo sapiens
ggcuggacccuucuaauuc

SEQ ID NO: 739203 - RNA, 19 nt, Homo sapiens
ucgcagcccuauguuguug

SEQ ID NO: 739204 - RNA, 19 nt, Homo sapiens
ucaagauggccuucuacaa

SEQ ID NO: 739205 - RNA, 19 nt, Homo sapiens
ucagagagacagcagaaag

SEQ ID NO: 739206 - RNA, 19 nt, Homo sapiens
cuuauucuccuauuuggaa

SEQ ID NO: 739207 - RNA, 19 nt, Homo sapiens
cguggcgccuuccaucuug

SEQ ID NO: 739208 - RNA, 19 nt, Homo sapiens
ccacaucaaauaccuguac

SEQ ID NO: 739209 - RNA, 19 nt, Homo sapiens
ucuccuauuuggaaucuuc

SEQ ID NO: 739210 - RNA, 19 nt, Homo sapiens
uccgggaaaucuccacuga

SEQ ID NO: 739211 - RNA, 19 nt, Homo sapiens
uggauucaauggacucauc

SEQ ID NO: 739212 - RNA, 19 nt, Homo sapiens
gugagggucuggguguuuc

SEQ ID NO: 739213 - RNA, 19 nt, Homo sapiens
gcagcccuauguuguuguc

SEQ ID NO: 739214 - RNA, 19 nt, Homo sapiens
ccucagagagacagcagaa

SEQ ID NO: 739215 - RNA, 19 nt, Homo sapiens
caacgucgagaacaugaag

SEQ ID NO: 739216 - RNA, 19 nt, Homo sapiens
cauaguacaguucuucagu

SEQ ID NO: 739217 - RNA, 19 nt, Homo sapiens
caguucagucuccacauuu

SEQ ID NO: 739218 - RNA, 19 nt, Homo sapiens
ccuauguggucuucucuac

SEQ ID NO: 739219 - RNA, 19 nt, Homo sapiens
cuaaugcugcuccacauca

SEQ ID NO: 739220 - RNA, 19 nt, Homo sapiens
ccucaucuccagugacuca

SEQ ID NO: 739221 - RNA, 19 nt, Homo sapiens
ggcacuccaugcucacugu

SEQ ID NO: 739222 - RNA, 19 nt, Homo sapiens
caccauuccuaccgcuaug

SEQ ID NO: 739223 - RNA, 19 nt, Homo sapiens
uuuggaaucuucaacuucu

SEQ ID NO: 739224 - RNA, 19 nt, Homo sapiens
ccuauguuguugucuccaa

SEQ ID NO: 739225 - RNA, 19 nt, Homo sapiens
ccucgcagcccuauguugu

SEQ ID NO: 739226 - RNA, 19 nt, Homo sapiens
ccacauuucugguuuucug

SEQ ID NO: 739227 - RNA, 19 nt, Homo sapiens
cccacuuauucuccuauuu

SEQ ID NO: 739228 - RNA, 19 nt, Homo sapiens
gccaagcgcgagcuacugu

SEQ ID NO: 739229 - RNA, 19 nt, Homo sapiens
aguggagucucuuccuaug

SEQ ID NO: 739230 - RNA, 19 nt, Homo sapiens
gcaacgucgagaacaugaa

SEQ ID NO: 739231 - RNA, 19 nt, Homo sapiens
accaagacuucuacugcaa

SEQ ID NO: 739232 - RNA, 19 nt, Homo sapiens
caggagucaucuucaucga

SEQ ID NO: 739233 - RNA, 19 nt, Homo sapiens
uggcaggagucaucuucau

SEQ ID NO: 739234 - RNA, 19 nt, Homo sapiens
ccaccauuccuaccgcuau

SEQ ID NO: 739235 - RNA, 19 nt, Homo sapiens
ggggauaggagggcuuuua

SEQ ID NO: 739236 - RNA, 19 nt, Homo sapiens
cuaauucagaggucucaug

SEQ ID NO: 739237 - RNA, 19 nt, Homo sapiens
gcuggcaggagucaucuuc

SEQ ID NO: 739238 - RNA, 19 nt, Homo sapiens
caaaguccauggauucaau

SEQ ID NO: 739239 - RNA, 19 nt, Homo sapiens
caagauggccuucuacaau

SEQ ID NO: 739240 - RNA, 19 nt, Homo sapiens
augaagaucuugcgucuaa

SEQ ID NO: 739241 - RNA, 19 nt, Homo sapiens
uaggagggcuuuuaauuua

SEQ ID NO: 739242 - RNA, 19 nt, Homo sapiens
cgggaaaucuccacugaug

SEQ ID NO: 739243 - RNA, 19 nt, Homo sapiens
gcguauggcuccaaaucaa

SEQ ID NO: 739244 - RNA, 19 nt, Homo sapiens
gagguaggcugggagcaaa

SEQ ID NO: 739245 - RNA, 19 nt, Homo sapiens
ccaguucagucuccacauu

SEQ ID NO: 739246 - RNA, 19 nt, Homo sapiens
gcuggacccuucuaauuca

SEQ ID NO: 739247 - RNA, 19 nt, Homo sapiens
gggcuggacccuucuaauu

SEQ ID NO: 739248 - RNA, 19 nt, Homo sapiens
gaagaucuugcgucuaaug

SEQ ID NO: 739249 - RNA, 19 nt, Homo sapiens
ccacuuauucuccuauuug

SEQ ID NO: 739250 - RNA, 19 nt, Homo sapiens
ccaguggagucucuuccua

SEQ ID NO: 739251 - RNA, 19 nt, Homo sapiens
gccaaacccucuuccuugu

SEQ ID NO: 739252 - RNA, 19 nt, Homo sapiens
gaacgagaaaccacaaugg

SEQ ID NO: 739253 - RNA, 19 nt, Homo sapiens
gguggugacuaucugaaga

SEQ ID NO: 739254 - RNA, 19 nt, Homo sapiens
caagacuucuacugcaaga

SEQ ID NO: 739255 - RNA, 19 nt, Homo sapiens
aagauggccuucuacaaug

SEQ ID NO: 739256 - RNA, 19 nt, Homo sapiens
gugguuagguggccagaau

SEQ ID NO: 739257 - RNA, 19 nt, Homo sapiens
caccuucccucccagugua

SEQ ID NO: 739258 - RNA, 19 nt, Homo sapiens
gcuaaaacuugacggaaaa

SEQ ID NO: 739259 - RNA, 19 nt, Homo sapiens
ggacucauccauucuuugg

SEQ ID NO: 739260 - RNA, 19 nt, Homo sapiens
caaacccucuuccuugucu

SEQ ID NO: 739261 - RNA, 19 nt, Homo sapiens
ggaacgagaaaccacaaug

SEQ ID NO: 739262 - RNA, 19 nt, Homo sapiens
gauaggagggcuuuuaauu

SEQ ID NO: 739263 - RNA, 19 nt, Homo sapiens
gagcucuccucccaucugu

SEQ ID NO: 739264 - RNA, 19 nt, Homo sapiens
ucgagaacaugaagaucuu

SEQ ID NO: 739265 - RNA, 19 nt, Homo sapiens
ggagggcuuuuaauuuauu

SEQ ID NO: 739266 - RNA, 19 nt, Homo sapiens
ccauagucauguccuccua

SEQ ID NO: 739267 - RNA, 19 nt, Homo sapiens
gcuccaugcugcccuucaa

SEQ ID NO: 739268 - RNA, 19 nt, Homo sapiens
gaagggcugacaccagaug

SEQ ID NO: 739269 - RNA, 19 nt, Homo sapiens
gagcuuuccucagcaccuu

SEQ ID NO: 739270 - RNA, 19 nt, Homo sapiens
uggagucucuuccuaugug

SEQ ID NO: 739271 - RNA, 19 nt, Homo sapiens
ggagguaggcugggagcaa

SEQ ID NO: 739272 - RNA, 19 nt, Homo sapiens
uaaugcugcuccacaucaa

SEQ ID NO: 739273 - RNA, 19 nt, Homo sapiens
ugaagugaauguggauaca

SEQ ID NO: 739274 - RNA, 19 nt, Homo sapiens
gggccaaacccucuuccuu

SEQ ID NO: 739275 - RNA, 19 nt, Homo sapiens
ggcuggacccuucuaauuc

SEQ ID NO: 739276 - RNA, 19 nt, Homo sapiens
ucgcagcccuauguuguug

SEQ ID NO: 739277 - RNA, 19 nt, Homo sapiens
ucaagauggccuucuacaa

SEQ ID NO: 739278 - RNA, 19 nt, Homo sapiens
cuuauucuccuauuuggaa

SEQ ID NO: 739279 - RNA, 19 nt, Homo sapiens
cguggcgccuuccaucuug

SEQ ID NO: 739280 - RNA, 19 nt, Homo sapiens
ccacaucaaauaccuguac

SEQ ID NO: 739281 - RNA, 19 nt, Homo sapiens
ucuccuauuuggaaucuuc

SEQ ID NO: 739282 - RNA, 19 nt, Homo sapiens
uccgggaaaucuccacuga

SEQ ID NO: 739283 - RNA, 19 nt, Homo sapiens
ggcuaaaacuugacggaaa

SEQ ID NO: 739284 - RNA, 19 nt, Homo sapiens
uggauucaauggacucauc

SEQ ID NO: 739285 - RNA, 19 nt, Homo sapiens
gugagggucuggguguuuc

SEQ ID NO: 739286 - RNA, 19 nt, Homo sapiens
gcagcccuauguuguuguc

SEQ ID NO: 739287 - RNA, 19 nt, Homo sapiens
caacgucgagaacaugaag

SEQ ID NO: 739288 - RNA, 19 nt, Homo sapiens
cauaguacaguucuucagu

SEQ ID NO: 739289 - RNA, 19 nt, Homo sapiens
caguucagucuccacauuu

SEQ ID NO: 739290 - RNA, 19 nt, Homo sapiens
gcuccaaaucaacucauug

SEQ ID NO: 739291 - RNA, 19 nt, Homo sapiens
ccuauguggucuucucuac

SEQ ID NO: 739292 - RNA, 19 nt, Homo sapiens
cuaaugcugcuccacauca

SEQ ID NO: 739293 - RNA, 19 nt, Homo sapiens
ggcuccaaaucaacucauu

SEQ ID NO: 739294 - RNA, 19 nt, Homo sapiens
ccucaucuccagugacuca

SEQ ID NO: 739295 - RNA, 19 nt, Homo sapiens
ggcacuccaugcucacugu

SEQ ID NO: 739296 - RNA, 19 nt, Homo sapiens
uuuggaaucuucaacuucu

SEQ ID NO: 739297 - RNA, 19 nt, Homo sapiens
ccuauguuguugucuccaa

SEQ ID NO: 739298 - RNA, 19 nt, Homo sapiens
ccucgcagcccuauguugu

SEQ ID NO: 739299 - RNA, 19 nt, Homo sapiens
ccacauuucugguuuucug

SEQ ID NO: 739300 - RNA, 19 nt, Homo sapiens
cccacuuauucuccuauuu

SEQ ID NO: 739301 - RNA, 19 nt, Homo sapiens
gccaagcgcgagcuacugu

SEQ ID NO: 739302 - RNA, 19 nt, Homo sapiens
aguggagucucuuccuaug

SEQ ID NO: 739303 - RNA, 19 nt, Homo sapiens
accaagacuucuacugcaa

SEQ ID NO: 739304 - RNA, 19 nt, Homo sapiens
caggagucaucuucaucga

SEQ ID NO: 739305 - RNA, 19 nt, Homo sapiens
uggcaggagucaucuucau

SEQ ID NO: 739306 - RNA, 19 nt, Homo sapiens
gcaacgucgagaacaugaa

SEQ ID NO: 739307 - RNA, 19 nt, Homo sapiens
ggggauaggagggcuuuua

SEQ ID NO: 739308 - RNA, 19 nt, Homo sapiens
cuaauucagaggucucaug

SEQ ID NO: 739309 - RNA, 19 nt, Homo sapiens
gcuggcaggagucaucuuc

SEQ ID NO: 739310 - RNA, 19 nt, Homo sapiens
gagcugggaugauaaagau

SEQ ID NO: 739311 - RNA, 19 nt, Homo sapiens
uaaacacacucuuggaagu

SEQ ID NO: 739312 - RNA, 19 nt, Homo sapiens
ucugggagcugggaugaua

SEQ ID NO: 739313 - RNA, 19 nt, Homo sapiens
gugcgaagcuucaaguacu

SEQ ID NO: 739314 - RNA, 19 nt, Homo sapiens
ggagcugggaugauaaaga

SEQ ID NO: 739315 - RNA, 19 nt, Homo sapiens
uauaaacacacucuuggaa

SEQ ID NO: 739316 - RNA, 19 nt, Homo sapiens
gcugggaugauaaagauga

SEQ ID NO: 739317 - RNA, 19 nt, Homo sapiens
ggucagggagaaccucaaa

SEQ ID NO: 739318 - RNA, 19 nt, Homo sapiens
ccgugggccucaucaugua

SEQ ID NO: 739319 - RNA, 19 nt, Homo sapiens
guggagaacaugagcauca

SEQ ID NO: 739320 - RNA, 19 nt, Homo sapiens
acgccaaggucgcccugua

SEQ ID NO: 739321 - RNA, 19 nt, Homo sapiens
ggaccaccuuccuccacau

SEQ ID NO: 739322 - RNA, 19 nt, Homo sapiens
cagagcauccuggacauga

SEQ ID NO: 739323 - RNA, 19 nt, Homo sapiens
ccucccggcuuccaaauac

SEQ ID NO: 739324 - RNA, 19 nt, Homo sapiens
ucagggagaaccucaaagu

SEQ ID NO: 739325 - RNA, 19 nt, Homo sapiens
ucuacaacaccaagaagaa

SEQ ID NO: 739326 - RNA, 19 nt, Homo sapiens
gcgaagcuucaaguacuuu

SEQ ID NO: 739327 - RNA, 19 nt, Homo sapiens
agggagaaccucaaagugu

SEQ ID NO: 739328 - RNA, 19 nt, Homo sapiens
gccggacgguggagaacau

SEQ ID NO: 739329 - RNA, 19 nt, Homo sapiens
gaagcuucaaguacuuuua

SEQ ID NO: 739330 - RNA, 19 nt, Homo sapiens
gaggccagacgcacacugu

SEQ ID NO: 739331 - RNA, 19 nt, Homo sapiens
gggaccugcugccuuuuaa

SEQ ID NO: 739332 - RNA, 19 nt, Homo sapiens
ccucaaaguguggaucuau

SEQ ID NO: 739333 - RNA, 19 nt, Homo sapiens
ggaauuaucucuacaguga

SEQ ID NO: 739334 - RNA, 19 nt, Homo sapiens
gcagccagauguuugaaua

SEQ ID NO: 739335 - RNA, 19 nt, Homo sapiens
gaagaaaccucggccauca

SEQ ID NO: 739336 - RNA, 19 nt, Homo sapiens
gaaauaagagggccauaug

SEQ ID NO: 739337 - RNA, 19 nt, Homo sapiens
ggacugcgcagguuaacua

SEQ ID NO: 739338 - RNA, 19 nt, Homo sapiens
ccagagguauaacugaaua

SEQ ID NO: 739339 - RNA, 19 nt, Homo sapiens
ggugguagaugaaagcaaa

SEQ ID NO: 739340 - RNA, 19 nt, Homo sapiens
caaaagaccuccuauuaau

SEQ ID NO: 739341 - RNA, 19 nt, Homo sapiens
gggaucauguuaaguagaa

SEQ ID NO: 739342 - RNA, 19 nt, Homo sapiens
uuuauaaccucaccaauga

SEQ ID NO: 739343 - RNA, 19 nt, Homo sapiens
agaaggagaugaagauugu

SEQ ID NO: 739344 - RNA, 19 nt, Homo sapiens
gaguagagccagagguaua

SEQ ID NO: 739345 - RNA, 19 nt, Homo sapiens
ggaguacaguggcauaauc

SEQ ID NO: 739346 - RNA, 19 nt, Homo sapiens
caaguaaguuucuccgaau

SEQ ID NO: 739347 - RNA, 19 nt, Homo sapiens
gaugaaagcaaagcaagua

SEQ ID NO: 739348 - RNA, 19 nt, Homo sapiens
ccugauagcuguauuaaaa

SEQ ID NO: 739349 - RNA, 19 nt, Homo sapiens
ggagagaggauacacaugu

SEQ ID NO: 739350 - RNA, 19 nt, Homo sapiens
gccagauguuugaauauuu

SEQ ID NO: 739351 - RNA, 19 nt, Homo sapiens
cagagaaacuaccauuuua

SEQ ID NO: 739352 - RNA, 19 nt, Homo sapiens
ucaaucuccugaccucaua

SEQ ID NO: 739353 - RNA, 19 nt, Homo sapiens
agagaaagacugguuauuu

SEQ ID NO: 739354 - RNA, 19 nt, Homo sapiens
agagaaagcuuuauaaccu

SEQ ID NO: 739355 - RNA, 19 nt, Homo sapiens
gaacuacaggugugcacua

SEQ ID NO: 739356 - RNA, 19 nt, Homo sapiens
gcacucccuucuucccuuu

SEQ ID NO: 739357 - RNA, 19 nt, Homo sapiens
aaucuaggcuugcuguuug

SEQ ID NO: 739358 - RNA, 19 nt, Homo sapiens
gcuauucaguuguugcuau

SEQ ID NO: 739359 - RNA, 19 nt, Homo sapiens
ggagacagccgcucaccuu

SEQ ID NO: 739360 - RNA, 19 nt, Homo sapiens
ccaagaaagccaaguguga

SEQ ID NO: 739361 - RNA, 19 nt, Homo sapiens
uaacagagaaacuaccauu

SEQ ID NO: 739362 - RNA, 19 nt, Homo sapiens
ccaucucacugcaauguuu

SEQ ID NO: 739363 - RNA, 19 nt, Homo sapiens
aagcaaagcaaguaaguuu

SEQ ID NO: 739364 - RNA, 19 nt, Homo sapiens
gaagacaaagagagauuga

SEQ ID NO: 739365 - RNA, 19 nt, Homo sapiens
caacagcaaauauacuuga

SEQ ID NO: 739366 - RNA, 19 nt, Homo sapiens
gaaagcaaagcaaguaagu

SEQ ID NO: 739367 - RNA, 19 nt, Homo sapiens
cauaugacguggcaaaucu

SEQ ID NO: 739368 - RNA, 19 nt, Homo sapiens
uaucaaagacuccacaaug

SEQ ID NO: 739369 - RNA, 19 nt, Homo sapiens
gauuuagucugcauaacug

SEQ ID NO: 739370 - RNA, 19 nt, Homo sapiens
caccuuggcuauucaguug

SEQ ID NO: 739371 - RNA, 19 nt, Homo sapiens
cguaaggucuuugaaauag

SEQ ID NO: 739372 - RNA, 19 nt, Homo sapiens
ugagauagggucuuuguug

SEQ ID NO: 739373 - RNA, 19 nt, Homo sapiens
uaaggucuuugaaauagga

SEQ ID NO: 739374 - RNA, 19 nt, Homo sapiens
caaagacuccacaaugaga

SEQ ID NO: 739375 - RNA, 19 nt, Homo sapiens
cuauuaauguggcgauuga

SEQ ID NO: 739376 - RNA, 19 nt, Homo sapiens
ccucaccaaugaauacaaa

SEQ ID NO: 739377 - RNA, 19 nt, Homo sapiens
ccaaagugcugggauuaca

SEQ ID NO: 739378 - RNA, 19 nt, Homo sapiens
caucuggucucuuccuuca

SEQ ID NO: 739379 - RNA, 19 nt, Homo sapiens
caaacauugucguucagaa

SEQ ID NO: 739380 - RNA, 19 nt, Homo sapiens
gcaaaggaaagaauguaau

SEQ ID NO: 739381 - RNA, 19 nt, Homo sapiens
agacaaagagagauugaaa

SEQ ID NO: 739382 - RNA, 19 nt, Homo sapiens
cauauugcuugcacacauu

SEQ ID NO: 739383 - RNA, 19 nt, Homo sapiens
gacuuuaguuccucuuguu

SEQ ID NO: 739384 - RNA, 19 nt, Homo sapiens
ggaaaaucaagaccaauua

SEQ ID NO: 739385 - RNA, 19 nt, Homo sapiens
acaaagagagauugaaaug

SEQ ID NO: 739386 - RNA, 19 nt, Homo sapiens
caacaaacgaaaccuagug

SEQ ID NO: 739387 - RNA, 19 nt, Homo sapiens
ugucagcacucccuucuuc

SEQ ID NO: 739388 - RNA, 19 nt, Homo sapiens
gaaaagaaacaggaaauug

SEQ ID NO: 739389 - RNA, 19 nt, Homo sapiens
caaagagagauugaaauga

SEQ ID NO: 739390 - RNA, 19 nt, Homo sapiens
uacguaaggucuuugaaau

SEQ ID NO: 739391 - RNA, 19 nt, Homo sapiens
gguuauuucuccuuugugu

SEQ ID NO: 739392 - RNA, 19 nt, Homo sapiens
aaagaccuccuauuaaugu

SEQ ID NO: 739393 - RNA, 19 nt, Homo sapiens
gcaaagcaaguaaguuucu

SEQ ID NO: 739394 - RNA, 19 nt, Homo sapiens
aaugggaucauguuaagua

SEQ ID NO: 739395 - RNA, 19 nt, Homo sapiens
uaagagagaaagacugguu

SEQ ID NO: 739396 - RNA, 19 nt, Homo sapiens
aaacaacaaacgaaaccua

SEQ ID NO: 739397 - RNA, 19 nt, Homo sapiens
ggauccaucucacugcaau

SEQ ID NO: 739398 - RNA, 19 nt, Homo sapiens
cuucacaacuuugccaauu

SEQ ID NO: 739399 - RNA, 19 nt, Homo sapiens
gcaagagaaagacaacugu

SEQ ID NO: 739400 - RNA, 19 nt, Homo sapiens
uagcaaagcaucggacuga

SEQ ID NO: 739401 - RNA, 19 nt, Homo sapiens
gcaaaucugcaaaggaaag

SEQ ID NO: 739402 - RNA, 19 nt, Homo sapiens
acaaugagaagguauacaa

SEQ ID NO: 739403 - RNA, 19 nt, Homo sapiens
aucaaagacuccacaauga

SEQ ID NO: 739404 - RNA, 19 nt, Homo sapiens
accaguagcuguuucugaa

SEQ ID NO: 739405 - RNA, 19 nt, Homo sapiens
cuagucaacuggagguaga

SEQ ID NO: 739406 - RNA, 19 nt, Homo sapiens
cuacguaaggucuuugaaa

SEQ ID NO: 739407 - RNA, 19 nt, Homo sapiens
cuaaagugcugggauuaca

SEQ ID NO: 739408 - RNA, 19 nt, Homo sapiens
guucaucagccacaacaaa

SEQ ID NO: 739409 - RNA, 19 nt, Homo sapiens
ucaaaagaccuccuauuaa

SEQ ID NO: 739410 - RNA, 19 nt, Homo sapiens
gaaacuaccauuuuacuuc

SEQ ID NO: 739411 - RNA, 19 nt, Homo sapiens
aauuacaucuggucucuuc

SEQ ID NO: 739412 - RNA, 19 nt, Homo sapiens
gagagaaagacugguuauu

SEQ ID NO: 739413 - RNA, 19 nt, Homo sapiens
cacaaauucuggugguaga

SEQ ID NO: 739414 - RNA, 19 nt, Homo sapiens
agaagaagacaaagagaga

SEQ ID NO: 739415 - RNA, 19 nt, Homo sapiens
auaaugggaucauguuaag

SEQ ID NO: 739416 - RNA, 19 nt, Homo sapiens
aaccaaacauugucguuca

SEQ ID NO: 739417 - RNA, 19 nt, Homo sapiens
aagcuucuuucauguauuc

SEQ ID NO: 739418 - RNA, 19 nt, Homo sapiens
gagaagguauacaauuucc

SEQ ID NO: 739419 - RNA, 19 nt, Homo sapiens
gagacggacugcgcagguu

SEQ ID NO: 739420 - RNA, 19 nt, Homo sapiens
gagguauaacugaauaaga

SEQ ID NO: 739421 - RNA, 19 nt, Homo sapiens
gaaaccuagugaagcaucu

SEQ ID NO: 739422 - RNA, 19 nt, Homo sapiens
caaacgaaaccuagugaag

SEQ ID NO: 739423 - RNA, 19 nt, Homo sapiens
gcucuaugauguuguugca

SEQ ID NO: 739424 - RNA, 19 nt, Homo sapiens
gaauaguugggaauuggaa

SEQ ID NO: 739425 - RNA, 19 nt, Homo sapiens
ccgaaucccuagucaacug

SEQ ID NO: 739426 - RNA, 19 nt, Homo sapiens
agauugaaaugaagcuguu

SEQ ID NO: 739427 - RNA, 19 nt, Homo sapiens
ggauuuagucugcauaacu

SEQ ID NO: 739428 - RNA, 19 nt, Homo sapiens
ucauaucguugacuuuaag

SEQ ID NO: 739429 - RNA, 19 nt, Homo sapiens
caagagaaagacaacuguu

SEQ ID NO: 739430 - RNA, 19 nt, Homo sapiens
uauagaauuuguggaagga

SEQ ID NO: 739431 - RNA, 19 nt, Homo sapiens
agauguacuuuaagagaga

SEQ ID NO: 739432 - RNA, 19 nt, Homo sapiens
cagaaggagaugaagauug

SEQ ID NO: 739433 - RNA, 19 nt, Homo sapiens
aaagaagccuugaaacuaa

SEQ ID NO: 739434 - RNA, 19 nt, Homo sapiens
gaacaccacugacuuugug

SEQ ID NO: 739435 - RNA, 19 nt, Homo sapiens
gcaggcuucuguaacauua

SEQ ID NO: 739436 - RNA, 19 nt, Homo sapiens
ccaaaguaaucuugcauaa

SEQ ID NO: 739437 - RNA, 19 nt, Homo sapiens
uaaagaagccuugaaacua

SEQ ID NO: 739438 - RNA, 19 nt, Homo sapiens
ggagggaacugcuguuagu

SEQ ID NO: 739439 - RNA, 19 nt, Homo sapiens
gcauaaacuugucauguca

SEQ ID NO: 739440 - RNA, 19 nt, Homo sapiens
gaacaacccauacaucauc

SEQ ID NO: 739441 - RNA, 19 nt, Homo sapiens
gaagaucugucaaaaccua

SEQ ID NO: 739442 - RNA, 19 nt, Homo sapiens
uccaaacccuaauaagaua

SEQ ID NO: 739443 - RNA, 19 nt, Homo sapiens
gcauugcuguugauauuag

SEQ ID NO: 739444 - RNA, 19 nt, Homo sapiens
guaaagaagccuugaaacu

SEQ ID NO: 739445 - RNA, 19 nt, Homo sapiens
gugaagacgucguugaaca

SEQ ID NO: 739446 - RNA, 19 nt, Homo sapiens
ggaaaccacccaaaaguaa

SEQ ID NO: 739447 - RNA, 19 nt, Homo sapiens
cgagaccucugguugugaa

SEQ ID NO: 739448 - RNA, 19 nt, Homo sapiens
caucgugaguuccaggauu

SEQ ID NO: 739449 - RNA, 19 nt, Homo sapiens
gauaaggaaaccacccaaa

SEQ ID NO: 739450 - RNA, 19 nt, Homo sapiens
caugaucaccucacacuug

SEQ ID NO: 739451 - RNA, 19 nt, Homo sapiens
gcgaggauaugcacuucau

SEQ ID NO: 739452 - RNA, 19 nt, Homo sapiens
gacgagaccucugguugug

SEQ ID NO: 739453 - RNA, 19 nt, Homo sapiens
gaagugucccugccuguca

SEQ ID NO: 739454 - RNA, 19 nt, Homo sapiens
aaagaaagcagagagaaau

SEQ ID NO: 739455 - RNA, 19 nt, Homo sapiens
caguuaagccuaagcagaa

SEQ ID NO: 739456 - RNA, 19 nt, Homo sapiens
gagcgaggauaugcacuuc

SEQ ID NO: 739457 - RNA, 19 nt, Homo sapiens
ccucacacuugauucaguu

SEQ ID NO: 739458 - RNA, 19 nt, Homo sapiens
uguuaguucugguguguaa

SEQ ID NO: 739459 - RNA, 19 nt, Homo sapiens
gaaagcagagagaaaugca

SEQ ID NO: 739460 - RNA, 19 nt, Homo sapiens
ugucauacaguuugugaaa

SEQ ID NO: 739461 - RNA, 19 nt, Homo sapiens
gcuguuaguucuggugugu

SEQ ID NO: 739462 - RNA, 19 nt, Homo sapiens
uugauucaguuaagccuaa

SEQ ID NO: 739463 - RNA, 19 nt, Homo sapiens
gggaaaauuuagagacuga

SEQ ID NO: 739464 - RNA, 19 nt, Homo sapiens
ucauacaguuugugaaagg

SEQ ID NO: 739465 - RNA, 19 nt, Homo sapiens
agacugaaccucuggaaag

SEQ ID NO: 739466 - RNA, 19 nt, Homo sapiens
aaacuugucaugucauaca

SEQ ID NO: 739467 - RNA, 19 nt, Homo sapiens
ugcauaaacuugucauguc

SEQ ID NO: 739468 - RNA, 19 nt, Homo sapiens
ggucggcaggcuucuguaa

SEQ ID NO: 739469 - RNA, 19 nt, Homo sapiens
agucaagccugccaugauc

SEQ ID NO: 739470 - RNA, 19 nt, Homo sapiens
ugaagacgucguugaacaa

SEQ ID NO: 739471 - RNA, 19 nt, Homo sapiens
gagacugaaccucuggaaa

SEQ ID NO: 739472 - RNA, 19 nt, Homo sapiens
uuaaagcuauuggacuuca

SEQ ID NO: 739473 - RNA, 19 nt, Homo sapiens
cgaaguaagagccaucauc

SEQ ID NO: 739474 - RNA, 19 nt, Homo sapiens
gaagaaaacagaugcuaag

SEQ ID NO: 739475 - RNA, 19 nt, Homo sapiens
gaagccuugaaacuaauaa

SEQ ID NO: 739476 - RNA, 19 nt, Homo sapiens
aagaagccuugaaacuaau

SEQ ID NO: 739477 - RNA, 19 nt, Homo sapiens
ccaaacccuaauaagauaa

SEQ ID NO: 739478 - RNA, 19 nt, Homo sapiens
gauucgccaucgugaguuc

SEQ ID NO: 739479 - RNA, 19 nt, Homo sapiens
augaucaccucacacuuga

SEQ ID NO: 739480 - RNA, 19 nt, Homo sapiens
ugucaugucauacaguuug

SEQ ID NO: 739481 - RNA, 19 nt, Homo sapiens
ucggcaggcuucuguaaca

SEQ ID NO: 739482 - RNA, 19 nt, Homo sapiens
ggcugcagcuccucaagca

SEQ ID NO: 739483 - RNA, 19 nt, Homo sapiens
gaaaccacccaaaaguaaa

SEQ ID NO: 739484 - RNA, 19 nt, Homo sapiens
ugucaaaaccuaagagaaa

SEQ ID NO: 739485 - RNA, 19 nt, Homo sapiens
cauuggcguuaacgaaguu

SEQ ID NO: 739486 - RNA, 19 nt, Homo sapiens
cuugucaugucauacaguu

SEQ ID NO: 739487 - RNA, 19 nt, Homo sapiens
guaaucuugcauaaacuug

SEQ ID NO: 739488 - RNA, 19 nt, Homo sapiens
uuccaaacccuaauaagau

SEQ ID NO: 739489 - RNA, 19 nt, Homo sapiens
uugaacaacccauacauca

SEQ ID NO: 739490 - RNA, 19 nt, Homo sapiens
aaggagggaacugcuguua

SEQ ID NO: 739491 - RNA, 19 nt, Homo sapiens
caugucauacaguuuguga

SEQ ID NO: 739492 - RNA, 19 nt, Homo sapiens
cuaauaagauaaggaaacc

SEQ ID NO: 739493 - RNA, 19 nt, Homo sapiens
ucacacuugauucaguuaa

SEQ ID NO: 739494 - RNA, 19 nt, Homo sapiens
ucaccucacacuugauuca

SEQ ID NO: 739495 - RNA, 19 nt, Homo sapiens
aucgugaguuccaggauuu

SEQ ID NO: 739496 - RNA, 19 nt, Homo sapiens
auuccaaacccuaauaaga

SEQ ID NO: 739497 - RNA, 19 nt, Homo sapiens
ugauuccaaacccuaauaa

SEQ ID NO: 739498 - RNA, 19 nt, Homo sapiens
agacgagaccucugguugu

SEQ ID NO: 739499 - RNA, 19 nt, Homo sapiens
uccaaaguaaucuugcaua

SEQ ID NO: 739500 - RNA, 19 nt, Homo sapiens
ggcaggcuucuguaacauu

SEQ ID NO: 739501 - RNA, 19 nt, Homo sapiens
guucugguguguaaaucag

SEQ ID NO: 739502 - RNA, 19 nt, Homo sapiens
cauacaguuugugaaagga

SEQ ID NO: 739503 - RNA, 19 nt, Homo sapiens
ccuaauaagauaaggaaac

SEQ ID NO: 739504 - RNA, 19 nt, Homo sapiens
gacugaaccucuggaaagc

SEQ ID NO: 739505 - RNA, 19 nt, Homo sapiens
guaccauggcuucaagaca

SEQ ID NO: 739506 - RNA, 19 nt, Homo sapiens
gaacagaaguauugcauua

SEQ ID NO: 739507 - RNA, 19 nt, Homo sapiens
gaagagaguugguuauuau

SEQ ID NO: 739508 - RNA, 19 nt, Homo sapiens
ggaagagaguugguuauua

SEQ ID NO: 739509 - RNA, 19 nt, Homo sapiens
guagaaggauuguauauga

SEQ ID NO: 739510 - RNA, 19 nt, Homo sapiens
guacauaugugccuuguga

SEQ ID NO: 739511 - RNA, 19 nt, Homo sapiens
caacauaugugguacaaau

SEQ ID NO: 739512 - RNA, 19 nt, Homo sapiens
gaagcuaaaugguggcuaa

SEQ ID NO: 739513 - RNA, 19 nt, Homo sapiens
gaggaacacuucaacauau

SEQ ID NO: 739514 - RNA, 19 nt, Homo sapiens
ggaugagucugguuuguuu

SEQ ID NO: 739515 - RNA, 19 nt, Homo sapiens
gaaggaagcggcuaacuau

SEQ ID NO: 739516 - RNA, 19 nt, Homo sapiens
uagcaucucuaaagaagua

SEQ ID NO: 739517 - RNA, 19 nt, Homo sapiens
ggaagagaauccagguauu

SEQ ID NO: 739518 - RNA, 19 nt, Homo sapiens
gaagagaauccagguauuu

SEQ ID NO: 739519 - RNA, 19 nt, Homo sapiens
aagaagaacugauugaaga

SEQ ID NO: 739520 - RNA, 19 nt, Homo sapiens
agauagagcugccugcuuu

SEQ ID NO: 739521 - RNA, 19 nt, Homo sapiens
cagaagaagccauuauaua

SEQ ID NO: 739522 - RNA, 19 nt, Homo sapiens
caaauggucuucaacaucu

SEQ ID NO: 739523 - RNA, 19 nt, Homo sapiens
ggaaggaagcggcuaacua

SEQ ID NO: 739524 - RNA, 19 nt, Homo sapiens
gagaguugguuauuauguu

SEQ ID NO: 739525 - RNA, 19 nt, Homo sapiens
ccagugcuauuccugcuua

SEQ ID NO: 739526 - RNA, 19 nt, Homo sapiens
ggaacuauuuguccucuuc

SEQ ID NO: 739527 - RNA, 19 nt, Homo sapiens
acaaggcauuucuggauua

SEQ ID NO: 739528 - RNA, 19 nt, Homo sapiens
gacagaagaagccauuaua

SEQ ID NO: 739529 - RNA, 19 nt, Homo sapiens
gaagacagaagaagccauu

SEQ ID NO: 739530 - RNA, 19 nt, Homo sapiens
guauaaacuucgccucauu

SEQ ID NO: 739531 - RNA, 19 nt, Homo sapiens
guucaccucuaaucuguuu

SEQ ID NO: 739532 - RNA, 19 nt, Homo sapiens
ugugauugcugcugcuuua

SEQ ID NO: 739533 - RNA, 19 nt, Homo sapiens
caucauuccuucucuuguu

SEQ ID NO: 739534 - RNA, 19 nt, Homo sapiens
guagaucaaugcaugaaca

SEQ ID NO: 739535 - RNA, 19 nt, Homo sapiens
gaaugcacuugcuucuauu

SEQ ID NO: 739536 - RNA, 19 nt, Homo sapiens
gaucaaugcaugaacagaa

SEQ ID NO: 739537 - RNA, 19 nt, Homo sapiens
aaacuucgccucauuuaau

SEQ ID NO: 739538 - RNA, 19 nt, Homo sapiens
gaacacuauggaaucaaua

SEQ ID NO: 739539 - RNA, 19 nt, Homo sapiens
aaacuguggugaauggaaa

SEQ ID NO: 739540 - RNA, 19 nt, Homo sapiens
uguuauacgugccacaaua

SEQ ID NO: 739541 - RNA, 19 nt, Homo sapiens
gaugucacaccauuucuaa

SEQ ID NO: 739542 - RNA, 19 nt, Homo sapiens
gguguaaagguuuguuaua

SEQ ID NO: 739543 - RNA, 19 nt, Homo sapiens
ggacaaauucauaaagcuu

SEQ ID NO: 739544 - RNA, 19 nt, Homo sapiens
caaggcauuucuggauuaa

SEQ ID NO: 739545 - RNA, 19 nt, Homo sapiens
gguuaaggcagcagcuuua

SEQ ID NO: 739546 - RNA, 19 nt, Homo sapiens
guaaagguuuguuauacgu

SEQ ID NO: 739547 - RNA, 19 nt, Homo sapiens
gaagaagccauuauauacu

SEQ ID NO: 739548 - RNA, 19 nt, Homo sapiens
gaucuuacagucaaggaaa

SEQ ID NO: 739549 - RNA, 19 nt, Homo sapiens
gaacuuuuguacacacuaa

SEQ ID NO: 739550 - RNA, 19 nt, Homo sapiens
ggaacaaacagaggaagaa

SEQ ID NO: 739551 - RNA, 19 nt, Homo sapiens
agaggaacacuucaacaua

SEQ ID NO: 739552 - RNA, 19 nt, Homo sapiens
ugagaaggaugcuuauuuu

SEQ ID NO: 739553 - RNA, 19 nt, Homo sapiens
agaagaagccauuauauac

SEQ ID NO: 739554 - RNA, 19 nt, Homo sapiens
uuucuuggauuguuggaua

SEQ ID NO: 739555 - RNA, 19 nt, Homo sapiens
gcuccugcuuaccaucuua

SEQ ID NO: 739556 - RNA, 19 nt, Homo sapiens
gagcauccuuagccagaga

SEQ ID NO: 739557 - RNA, 19 nt, Homo sapiens
ccuuaacuccuuaguauuu

SEQ ID NO: 739558 - RNA, 19 nt, Homo sapiens
gaaaacuaaugacagugua

SEQ ID NO: 739559 - RNA, 19 nt, Homo sapiens
ggagaaagaagagaagugu

SEQ ID NO: 739560 - RNA, 19 nt, Homo sapiens
ggcagcagcuuuagcaucu

SEQ ID NO: 739561 - RNA, 19 nt, Homo sapiens
cagguuaugugguguaaag

SEQ ID NO: 739562 - RNA, 19 nt, Homo sapiens
agccagagaauauucauua

SEQ ID NO: 739563 - RNA, 19 nt, Homo sapiens
cuccuuaacuccuuaguau

SEQ ID NO: 739564 - RNA, 19 nt, Homo sapiens
caaauggugucaguaugga

SEQ ID NO: 739565 - RNA, 19 nt, Homo sapiens
gaaaagugcggacaaauuc

SEQ ID NO: 739566 - RNA, 19 nt, Homo sapiens
guaacucggcguuucauug

SEQ ID NO: 739567 - RNA, 19 nt, Homo sapiens
uggauaaucagacuucuuu

SEQ ID NO: 739568 - RNA, 19 nt, Homo sapiens
aaagagagcaagaacaugu

SEQ ID NO: 739569 - RNA, 19 nt, Homo sapiens
ucagacugcuucaggaaau

SEQ ID NO: 739570 - RNA, 19 nt, Homo sapiens
gagcauggccgaggaguca

SEQ ID NO: 739571 - RNA, 19 nt, Homo sapiens
guuaugugguguaaagguu

SEQ ID NO: 739572 - RNA, 19 nt, Homo sapiens
gaacauguggaucuuugau

SEQ ID NO: 739573 - RNA, 19 nt, Homo sapiens
ggaaaagugcggacaaauu

SEQ ID NO: 739574 - RNA, 19 nt, Homo sapiens
ccuaagugagcaauaauuu

SEQ ID NO: 739575 - RNA, 19 nt, Homo sapiens
gccagagaauauucauuau

SEQ ID NO: 739576 - RNA, 19 nt, Homo sapiens
gaucuaaauaaaccacgua

SEQ ID NO: 739577 - RNA, 19 nt, Homo sapiens
ugaaagagagcaagaacau

SEQ ID NO: 739578 - RNA, 19 nt, Homo sapiens
ucaggaaauuguagaucaa

SEQ ID NO: 739579 - RNA, 19 nt, Homo sapiens
ugaacacuauggaaucaau

SEQ ID NO: 739580 - RNA, 19 nt, Homo sapiens
guaguagaaggauuguaua

SEQ ID NO: 739581 - RNA, 19 nt, Homo sapiens
caaauuacaagaacgaucu

SEQ ID NO: 739582 - RNA, 19 nt, Homo sapiens
uacaaggcauuucuggauu

SEQ ID NO: 739583 - RNA, 19 nt, Homo sapiens
ucgcaaggcucguguaacu

SEQ ID NO: 739584 - RNA, 19 nt, Homo sapiens
uuacaggcaucccguagug

SEQ ID NO: 739585 - RNA, 19 nt, Homo sapiens
guguaaagguuuguuauac

SEQ ID NO: 739586 - RNA, 19 nt, Homo sapiens
gaucuuugauaggauuguu

SEQ ID NO: 739587 - RNA, 19 nt, Homo sapiens
aggagucacugaacacuau

SEQ ID NO: 739588 - RNA, 19 nt, Homo sapiens
agaguugguuauuauguug

SEQ ID NO: 739589 - RNA, 19 nt, Homo sapiens
gcaaccagaaccucuuguu

SEQ ID NO: 739590 - RNA, 19 nt, Homo sapiens
cauuugauguucauuugga

SEQ ID NO: 739591 - RNA, 19 nt, Homo sapiens
uauaaacuucgccucauuu

SEQ ID NO: 739592 - RNA, 19 nt, Homo sapiens
gcugcugcuuuaaaggaua

SEQ ID NO: 739593 - RNA, 19 nt, Homo sapiens
gauugcugcugcuuuaaag

SEQ ID NO: 739594 - RNA, 19 nt, Homo sapiens
uuacucaaauggucuucaa

SEQ ID NO: 739595 - RNA, 19 nt, Homo sapiens
gauaggauuguuaccaaau

SEQ ID NO: 739596 - RNA, 19 nt, Homo sapiens
ugauaggauuguuaccaaa

SEQ ID NO: 739597 - RNA, 19 nt, Homo sapiens
gcagagaggacucaagacu

SEQ ID NO: 739598 - RNA, 19 nt, Homo sapiens
caacauggagaaugcacuu

SEQ ID NO: 739599 - RNA, 19 nt, Homo sapiens
aagcaguacuuuaccuguu

SEQ ID NO: 739600 - RNA, 19 nt, Homo sapiens
cuuccuaagugagcaauaa

SEQ ID NO: 739601 - RNA, 19 nt, Homo sapiens
ccaauugugugaccaugag

SEQ ID NO: 739602 - RNA, 19 nt, Homo sapiens
caacuacaacaucguuuca

SEQ ID NO: 739603 - RNA, 19 nt, Homo sapiens
guggaucuuugauaggauu

SEQ ID NO: 739604 - RNA, 19 nt, Homo sapiens
gaaagagagcaagaacaug

SEQ ID NO: 739605 - RNA, 19 nt, Homo sapiens
gcggacaaauucauaaagc

SEQ ID NO: 739606 - RNA, 19 nt, Homo sapiens
gcauuaaacuagagccuua

SEQ ID NO: 739607 - RNA, 19 nt, Homo sapiens
gaagguagcauaaacaaau

SEQ ID NO: 739608 - RNA, 19 nt, Homo sapiens
caacauggcuuuccuagcu

SEQ ID NO: 739609 - RNA, 19 nt, Homo sapiens
guugggcucucaauaauuu

SEQ ID NO: 739610 - RNA, 19 nt, Homo sapiens
agauggagcugaaauuaaa

SEQ ID NO: 739611 - RNA, 19 nt, Homo sapiens
ggaaacaacaacaaacaaa

SEQ ID NO: 739612 - RNA, 19 nt, Homo sapiens
gacauuagcuggcgucuac

SEQ ID NO: 739613 - RNA, 19 nt, Homo sapiens
gacuaaaccauuugcauua

SEQ ID NO: 739614 - RNA, 19 nt, Homo sapiens
uaccauagcuuuaagauac

SEQ ID NO: 739615 - RNA, 19 nt, Homo sapiens
gagaugauacgguguuaaa

SEQ ID NO: 739616 - RNA, 19 nt, Homo sapiens
agaccuagcucuuuucuua

SEQ ID NO: 739617 - RNA, 19 nt, Homo sapiens
caaagccauuucuguacua

SEQ ID NO: 739618 - RNA, 19 nt, Homo sapiens
caagacaggcuaguucaua

SEQ ID NO: 739619 - RNA, 19 nt, Homo sapiens
caaacugaauguguaacua

SEQ ID NO: 739620 - RNA, 19 nt, Homo sapiens
ugagugaacugcuaauaca

SEQ ID NO: 739621 - RNA, 19 nt, Homo sapiens
ccugauggcugcagucuau

SEQ ID NO: 739622 - RNA, 19 nt, Homo sapiens
gaacaacauggcuuuccua

SEQ ID NO: 739623 - RNA, 19 nt, Homo sapiens
acacuucuguugugguuaa

SEQ ID NO: 739624 - RNA, 19 nt, Homo sapiens
uguacuaacuguucucuug

SEQ ID NO: 739625 - RNA, 19 nt, Homo sapiens
gaaacaagacaggcuaguu

SEQ ID NO: 739626 - RNA, 19 nt, Homo sapiens
gagaaacagcuucaaagga

SEQ ID NO: 739627 - RNA, 19 nt, Homo sapiens
aagacaggcuaguucauaa

SEQ ID NO: 739628 - RNA, 19 nt, Homo sapiens
uaacaagguuugggacaau

SEQ ID NO: 739629 - RNA, 19 nt, Homo sapiens
guaacaagguuugggacaa

SEQ ID NO: 739630 - RNA, 19 nt, Homo sapiens
gaagcuaucugagugaacu

SEQ ID NO: 739631 - RNA, 19 nt, Homo sapiens
guacucuucuuguaugugu

SEQ ID NO: 739632 - RNA, 19 nt, Homo sapiens
gaaaccagcccaagcuaca

SEQ ID NO: 739633 - RNA, 19 nt, Homo sapiens
gcuuuaagauacacaagga

SEQ ID NO: 739634 - RNA, 19 nt, Homo sapiens
ucagugcgguuauguggaa

SEQ ID NO: 739635 - RNA, 19 nt, Homo sapiens
gagaguuauugguguguga

SEQ ID NO: 739636 - RNA, 19 nt, Homo sapiens
guacacagacaacaucaug

SEQ ID NO: 739637 - RNA, 19 nt, Homo sapiens
uuucauaacucggacaauu

SEQ ID NO: 739638 - RNA, 19 nt, Homo sapiens
caguaaugcuguuuggauu

SEQ ID NO: 739639 - RNA, 19 nt, Homo sapiens
acagauaacacucaccuuu

SEQ ID NO: 739640 - RNA, 19 nt, Homo sapiens
uauuaugucugguuuguca

SEQ ID NO: 739641 - RNA, 19 nt, Homo sapiens
guucagauacuucucuuug

SEQ ID NO: 739642 - RNA, 19 nt, Homo sapiens
cagauggagcugaaauuaa

SEQ ID NO: 739643 - RNA, 19 nt, Homo sapiens
aaacaagacaggcuaguuc

SEQ ID NO: 739644 - RNA, 19 nt, Homo sapiens
gugaacugcuaauacagaa

SEQ ID NO: 739645 - RNA, 19 nt, Homo sapiens
cuacacuucuguugugguu

SEQ ID NO: 739646 - RNA, 19 nt, Homo sapiens
guauugugcucaggauuug

SEQ ID NO: 739647 - RNA, 19 nt, Homo sapiens
cgcuauagcuauugcugua

SEQ ID NO: 739648 - RNA, 19 nt, Homo sapiens
caggcuaguucauaaacaa

SEQ ID NO: 739649 - RNA, 19 nt, Homo sapiens
agacuaaaccauuugcauu

SEQ ID NO: 739650 - RNA, 19 nt, Homo sapiens
ggagaaacagcuucaaagg

SEQ ID NO: 739651 - RNA, 19 nt, Homo sapiens
gaugauacacauuucuuca

SEQ ID NO: 739652 - RNA, 19 nt, Homo sapiens
gaaacaacaacaaacaaac

SEQ ID NO: 739653 - RNA, 19 nt, Homo sapiens
cuauagcuauugcuguauu

SEQ ID NO: 739654 - RNA, 19 nt, Homo sapiens
ccucuacacuucuguugug

SEQ ID NO: 739655 - RNA, 19 nt, Homo sapiens
ccaaagccauuucuguacu

SEQ ID NO: 739656 - RNA, 19 nt, Homo sapiens
cugcuaauacagaaacuua

SEQ ID NO: 739657 - RNA, 19 nt, Homo sapiens
ccauuugcauuaaacuaga

SEQ ID NO: 739658 - RNA, 19 nt, Homo sapiens
ugucugguuugucaucuuu

SEQ ID NO: 739659 - RNA, 19 nt, Homo sapiens
ggagcugaaauuaaagaaa

SEQ ID NO: 739660 - RNA, 19 nt, Homo sapiens
guguaucacagaaguuaua

SEQ ID NO: 739661 - RNA, 19 nt, Homo sapiens
gaacugcuaauacagaaac

SEQ ID NO: 739662 - RNA, 19 nt, Homo sapiens
caacaaacaaacgaagcua

SEQ ID NO: 739663 - RNA, 19 nt, Homo sapiens
caacaaggagaaacagcuu

SEQ ID NO: 739664 - RNA, 19 nt, Homo sapiens
cagauaacacucaccuuug

SEQ ID NO: 739665 - RNA, 19 nt, Homo sapiens
acaagaggcagaaacaaga

SEQ ID NO: 739666 - RNA, 19 nt, Homo sapiens
caaaggagagaguuauugg

SEQ ID NO: 739667 - RNA, 19 nt, Homo sapiens
ccuggguacucuucuugua

SEQ ID NO: 739668 - RNA, 19 nt, Homo sapiens
cagacaacaucaugaaagg

SEQ ID NO: 739669 - RNA, 19 nt, Homo sapiens
acacagacaacaucaugaa

SEQ ID NO: 739670 - RNA, 19 nt, Homo sapiens
gcaggaguauauuuugaaa

SEQ ID NO: 739671 - RNA, 19 nt, Homo sapiens
caaacgaagcuaucugagu

SEQ ID NO: 739672 - RNA, 19 nt, Homo sapiens
gcgguuauguggaaacaac

SEQ ID NO: 739673 - RNA, 19 nt, Homo sapiens
acuagagccuuaagucaau

SEQ ID NO: 739674 - RNA, 19 nt, Homo sapiens
uaaacuagagccuuaaguc

SEQ ID NO: 739675 - RNA, 19 nt, Homo sapiens
cuucuguugugguuaagua

SEQ ID NO: 739676 - RNA, 19 nt, Homo sapiens
cagggauuauugugacauu

SEQ ID NO: 739677 - RNA, 19 nt, Homo sapiens
guuagaugauacacauuuc

SEQ ID NO: 739678 - RNA, 19 nt, Homo sapiens
ugccaaagccauuucugua

SEQ ID NO: 739679 - RNA, 19 nt, Homo sapiens
ggcaugaucagugcgguua

SEQ ID NO: 739680 - RNA, 19 nt, Homo sapiens
aaacuagagccuuaaguca

SEQ ID NO: 739681 - RNA, 19 nt, Homo sapiens
cacaaggacaucagacaaa

SEQ ID NO: 739682 - RNA, 19 nt, Homo sapiens
caaauuacaguggguuuca

SEQ ID NO: 739683 - RNA, 19 nt, Homo sapiens
ggaaauucagcaauaaacu

SEQ ID NO: 739684 - RNA, 19 nt, Homo sapiens
gacaagacacuacauccau

SEQ ID NO: 739685 - RNA, 19 nt, Homo sapiens
guuuggcgcuauagcuauu

SEQ ID NO: 739686 - RNA, 19 nt, Homo sapiens
uuuccuagcucuuagcaau

SEQ ID NO: 739687 - RNA, 19 nt, Homo sapiens
uaaagugccaaagccauuu

SEQ ID NO: 739688 - RNA, 19 nt, Homo sapiens
ggacaucagacaaagaacu

SEQ ID NO: 739689 - RNA, 19 nt, Homo sapiens
uuacaguggguuucaguuu

SEQ ID NO: 739690 - RNA, 19 nt, Homo sapiens
ucaaaggagagaguuauug

SEQ ID NO: 739691 - RNA, 19 nt, Homo sapiens
gaguucagauacuucucuu

SEQ ID NO: 739692 - RNA, 19 nt, Homo sapiens
gauuugcaggaguauauuu

SEQ ID NO: 739693 - RNA, 19 nt, Homo sapiens
cugaauguguaacuaacuu

SEQ ID NO: 739694 - RNA, 19 nt, Homo sapiens
uguccuagcagcauaaaga

SEQ ID NO: 739695 - RNA, 19 nt, Homo sapiens
aaagccauuucuguacuaa

SEQ ID NO: 739696 - RNA, 19 nt, Homo sapiens
cagaagguagcauaaacaa

SEQ ID NO: 739697 - RNA, 19 nt, Homo sapiens
cagcggccauuguccuuuc

SEQ ID NO: 739698 - RNA, 19 nt, Homo sapiens
gauuccguguacugcuuua

SEQ ID NO: 739699 - RNA, 19 nt, Homo sapiens
acaaggacaucagacaaag

SEQ ID NO: 739700 - RNA, 19 nt, Homo sapiens
guuaagugugccaucguua

SEQ ID NO: 739701 - RNA, 19 nt, Homo sapiens
gcaaauuacaguggguuuc

SEQ ID NO: 739702 - RNA, 19 nt, Homo sapiens
ccauuucuguacuaacugu

SEQ ID NO: 739703 - RNA, 19 nt, Homo sapiens
uuaaagugccaaagccauu

SEQ ID NO: 739704 - RNA, 19 nt, Homo sapiens
uggagaugauacgguguua

SEQ ID NO: 739705 - RNA, 19 nt, Homo sapiens
caugaucagugcgguuaug

SEQ ID NO: 739706 - RNA, 19 nt, Homo sapiens
ccacugaaauugccuauua

SEQ ID NO: 739707 - RNA, 19 nt, Homo sapiens
guaaagaugucaauaggaa

SEQ ID NO: 739708 - RNA, 19 nt, Homo sapiens
cagagaagcucauuuaguu

SEQ ID NO: 739709 - RNA, 19 nt, Homo sapiens
aaagggaagugauaucaua

SEQ ID NO: 739710 - RNA, 19 nt, Homo sapiens
ucaccauccuuuacuauua

SEQ ID NO: 739711 - RNA, 19 nt, Homo sapiens
ggaacgcuaugcccuagua

SEQ ID NO: 739712 - RNA, 19 nt, Homo sapiens
gaaauugccuauuacucuu

SEQ ID NO: 739713 - RNA, 19 nt, Homo sapiens
gaaggacuauuaauuccaa

SEQ ID NO: 739714 - RNA, 19 nt, Homo sapiens
ggccuuggauuagaaauua

SEQ ID NO: 739715 - RNA, 19 nt, Homo sapiens
gcaagugaguuugguguuu

SEQ ID NO: 739716 - RNA, 19 nt, Homo sapiens
gcaacugccuggauguauu

SEQ ID NO: 739717 - RNA, 19 nt, Homo sapiens
caagaacucugcacagcaa

SEQ ID NO: 739718 - RNA, 19 nt, Homo sapiens
caaucaaguucucaaguaa

SEQ ID NO: 739719 - RNA, 19 nt, Homo sapiens
acaaucaaguucucaagua

SEQ ID NO: 739720 - RNA, 19 nt, Homo sapiens
gauuagaaauuaccacuca

SEQ ID NO: 739721 - RNA, 19 nt, Homo sapiens
gguguuguauacuucauua

SEQ ID NO: 739722 - RNA, 19 nt, Homo sapiens
ggaggccguuucaaccuua

SEQ ID NO: 739723 - RNA, 19 nt, Homo sapiens
agagggaggucuucaauga

SEQ ID NO: 739724 - RNA, 19 nt, Homo sapiens
gaacuaggauagaugugau

SEQ ID NO: 739725 - RNA, 19 nt, Homo sapiens
gggaauaacaugauacuau

SEQ ID NO: 739726 - RNA, 19 nt, Homo sapiens
cagacuaccuccguuauaa

SEQ ID NO: 739727 - RNA, 19 nt, Homo sapiens
ggaauuguguacuccgaaa

SEQ ID NO: 739728 - RNA, 19 nt, Homo sapiens
ggacgggucucccuuaaac

SEQ ID NO: 739729 - RNA, 19 nt, Homo sapiens
ucacauaugucuguaucua

SEQ ID NO: 739730 - RNA, 19 nt, Homo sapiens
gguuuaguguucuguauuu

SEQ ID NO: 739731 - RNA, 19 nt, Homo sapiens
acauuggucuuucuacaua

SEQ ID NO: 739732 - RNA, 19 nt, Homo sapiens
ggauggaaauauguucuaa

SEQ ID NO: 739733 - RNA, 19 nt, Homo sapiens
gaagauccacaaucaaguu

SEQ ID NO: 739734 - RNA, 19 nt, Homo sapiens
gcauacaaccugagccuuu

SEQ ID NO: 739735 - RNA, 19 nt, Homo sapiens
gacauacucauuugguuua

SEQ ID NO: 739736 - RNA, 19 nt, Homo sapiens
caugauggauggaaauaug

SEQ ID NO: 739737 - RNA, 19 nt, Homo sapiens
gcuaugcugcuaucuauaa

SEQ ID NO: 739738 - RNA, 19 nt, Homo sapiens
aaagaacacuagcuaagga

SEQ ID NO: 739739 - RNA, 19 nt, Homo sapiens
ggauaagaauaggucauuu

SEQ ID NO: 739740 - RNA, 19 nt, Homo sapiens
gaaucuagauaggugcuuu

SEQ ID NO: 739741 - RNA, 19 nt, Homo sapiens
guaacuaggccauuuguau

SEQ ID NO: 739742 - RNA, 19 nt, Homo sapiens
cagaaucaucuacauguua

SEQ ID NO: 739743 - RNA, 19 nt, Homo sapiens
ggcaauauuuguucugguu

SEQ ID NO: 739744 - RNA, 19 nt, Homo sapiens
uaugagagcuaauuuaagg

SEQ ID NO: 739745 - RNA, 19 nt, Homo sapiens
caccauccuuuacuauuaa

SEQ ID NO: 739746 - RNA, 19 nt, Homo sapiens
gaaauuaccacucaguuuu

SEQ ID NO: 739747 - RNA, 19 nt, Homo sapiens
caaagucgacauacucauu

SEQ ID NO: 739748 - RNA, 19 nt, Homo sapiens
uaacuaggccauuuguauu

SEQ ID NO: 739749 - RNA, 19 nt, Homo sapiens
guacauuggucuuucuaca

SEQ ID NO: 739750 - RNA, 19 nt, Homo sapiens
uauguugucuucagaauca

SEQ ID NO: 739751 - RNA, 19 nt, Homo sapiens
ugaaaguacuauggaauga

SEQ ID NO: 739752 - RNA, 19 nt, Homo sapiens
gaaagucacaaguuacugu

SEQ ID NO: 739753 - RNA, 19 nt, Homo sapiens
accagaaagucacaaguua

SEQ ID NO: 739754 - RNA, 19 nt, Homo sapiens
ggaaagggaagugauauca

SEQ ID NO: 739755 - RNA, 19 nt, Homo sapiens
ccuuaaaucugccuuuguu

SEQ ID NO: 739756 - RNA, 19 nt, Homo sapiens
gaagcucauuuaguuagaa

SEQ ID NO: 739757 - RNA, 19 nt, Homo sapiens
guagaaaagugcuguuuga

SEQ ID NO: 739758 - RNA, 19 nt, Homo sapiens
ccaaggggcugcuaguaua

SEQ ID NO: 739759 - RNA, 19 nt, Homo sapiens
gaagccugcuaaaugaaga

SEQ ID NO: 739760 - RNA, 19 nt, Homo sapiens
gcaucugccucuauucaau

SEQ ID NO: 739761 - RNA, 19 nt, Homo sapiens
uaagguguacguaucauuu

SEQ ID NO: 739762 - RNA, 19 nt, Homo sapiens
ccacagacuaccuccguua

SEQ ID NO: 739763 - RNA, 19 nt, Homo sapiens
ugaaauuuauccaguaugg

SEQ ID NO: 739764 - RNA, 19 nt, Homo sapiens
uuugaagccugcuaaauga

SEQ ID NO: 739765 - RNA, 19 nt, Homo sapiens
gagagugaauggcaucaag

SEQ ID NO: 739766 - RNA, 19 nt, Homo sapiens
caaguaaagaugucaauag

SEQ ID NO: 739767 - RNA, 19 nt, Homo sapiens
ggucacauaugucuguauc

SEQ ID NO: 739768 - RNA, 19 nt, Homo sapiens
ggagccagaaguaaaguuu

SEQ ID NO: 739769 - RNA, 19 nt, Homo sapiens
caacugccuggauguauuu

SEQ ID NO: 739770 - RNA, 19 nt, Homo sapiens
cgacauacucauuugguuu

SEQ ID NO: 739771 - RNA, 19 nt, Homo sapiens
ggaacuaggauagauguga

SEQ ID NO: 739772 - RNA, 19 nt, Homo sapiens
ugaagagacuuaagaaagc

SEQ ID NO: 739773 - RNA, 19 nt, Homo sapiens
caaagcagcacaugguguu

SEQ ID NO: 739774 - RNA, 19 nt, Homo sapiens
guuugcaguugguuauaua

SEQ ID NO: 739775 - RNA, 19 nt, Homo sapiens
uaacugggguauuaacuuu

SEQ ID NO: 739776 - RNA, 19 nt, Homo sapiens
gcuuuuaacugggguauua

SEQ ID NO: 739777 - RNA, 19 nt, Homo sapiens
gagaagcucauuuaguuag

SEQ ID NO: 739778 - RNA, 19 nt, Homo sapiens
ccauugugacgauuauuua

SEQ ID NO: 739779 - RNA, 19 nt, Homo sapiens
cugaaugucaucucucuua

SEQ ID NO: 739780 - RNA, 19 nt, Homo sapiens
aaucugccuuuguuucuaa

SEQ ID NO: 739781 - RNA, 19 nt, Homo sapiens
gacaggaacuaggauagau

SEQ ID NO: 739782 - RNA, 19 nt, Homo sapiens
cagaggagccagaaguaaa

SEQ ID NO: 739783 - RNA, 19 nt, Homo sapiens
ggacaggaacuaggauaga

SEQ ID NO: 739784 - RNA, 19 nt, Homo sapiens
ucccagagaagcucauuua

SEQ ID NO: 739785 - RNA, 19 nt, Homo sapiens
ugacuaauaccuuguguuc

SEQ ID NO: 739786 - RNA, 19 nt, Homo sapiens
gcccuaguauuugguguaa

SEQ ID NO: 739787 - RNA, 19 nt, Homo sapiens
auagaaugcugaacucaau

SEQ ID NO: 739788 - RNA, 19 nt, Homo sapiens
gugauuucauuaccaaguu

SEQ ID NO: 739789 - RNA, 19 nt, Homo sapiens
guguacguaucauuucuaa

SEQ ID NO: 739790 - RNA, 19 nt, Homo sapiens
gcacucaucgcugugguuu

SEQ ID NO: 739791 - RNA, 19 nt, Homo sapiens
ucagaaucaucuacauguu

SEQ ID NO: 739792 - RNA, 19 nt, Homo sapiens
ucgcuaugcugcuaucuau

SEQ ID NO: 739793 - RNA, 19 nt, Homo sapiens
acaaguuacugucgaagug

SEQ ID NO: 739794 - RNA, 19 nt, Homo sapiens
gccuggauguauuugauuu

SEQ ID NO: 739795 - RNA, 19 nt, Homo sapiens
gcacagcaacugccuggau

SEQ ID NO: 739796 - RNA, 19 nt, Homo sapiens
ucaguguuaugaagaaaug

SEQ ID NO: 739797 - RNA, 19 nt, Homo sapiens
gcuaugcccuaguauuugg

SEQ ID NO: 739798 - RNA, 19 nt, Homo sapiens
gaagagacuuaagaaagcu

SEQ ID NO: 739799 - RNA, 19 nt, Homo sapiens
uaacagcaucugccucuau

SEQ ID NO: 739800 - RNA, 19 nt, Homo sapiens
agagcuaauuuaaggauga

SEQ ID NO: 739801 - RNA, 19 nt, Homo sapiens
agaaauuaccacucaguuu

SEQ ID NO: 739802 - RNA, 19 nt, Homo sapiens
ugaaauugccuauuacucu

SEQ ID NO: 739803 - RNA, 19 nt, Homo sapiens
gggauaagaauaggucauu

SEQ ID NO: 739804 - RNA, 19 nt, Homo sapiens
uagaugugauuccugcauu

SEQ ID NO: 739805 - RNA, 19 nt, Homo sapiens
uaggacgggucucccuuaa

SEQ ID NO: 739806 - RNA, 19 nt, Homo sapiens
gcaaauaccugccguuuau

SEQ ID NO: 739807 - RNA, 19 nt, Homo sapiens
gguaaacgcugguguggua

SEQ ID NO: 739808 - RNA, 19 nt, Homo sapiens
gaaagguucacguaaauuu

SEQ ID NO: 739809 - RNA, 19 nt, Homo sapiens
ccagauagauggaagaaau

SEQ ID NO: 739810 - RNA, 19 nt, Homo sapiens
caacuaauuuccagauaga

SEQ ID NO: 739811 - RNA, 19 nt, Homo sapiens
gagcaaauagggaaucuaa

SEQ ID NO: 739812 - RNA, 19 nt, Homo sapiens
ggaagagaguuaccaggaa

SEQ ID NO: 739813 - RNA, 19 nt, Homo sapiens
uacaacagaucaagaagua

SEQ ID NO: 739814 - RNA, 19 nt, Homo sapiens
cgugauagauaccaguuua

SEQ ID NO: 739815 - RNA, 19 nt, Homo sapiens
ugacagauguuguaaucaa

SEQ ID NO: 739816 - RNA, 19 nt, Homo sapiens
aaacuuggauuugcucuuu

SEQ ID NO: 739817 - RNA, 19 nt, Homo sapiens
caacugggauaucugagaa

SEQ ID NO: 739818 - RNA, 19 nt, Homo sapiens
ggauuuauguucuguaucu

SEQ ID NO: 739819 - RNA, 19 nt, Homo sapiens
gaacauuguaguacuugua

SEQ ID NO: 739820 - RNA, 19 nt, Homo sapiens
gugcagggaugacauauuc

SEQ ID NO: 739821 - RNA, 19 nt, Homo sapiens
gaaaagauccugcaaaauc

SEQ ID NO: 739822 - RNA, 19 nt, Homo sapiens
ucacaucacagaagauuaa

SEQ ID NO: 739823 - RNA, 19 nt, Homo sapiens
uagaggaaguccaaagaaa

SEQ ID NO: 739824 - RNA, 19 nt, Homo sapiens
gaugccagcucuauucaau

SEQ ID NO: 739825 - RNA, 19 nt, Homo sapiens
gggaggaaauuaucaacug

SEQ ID NO: 739826 - RNA, 19 nt, Homo sapiens
gaagaaaugcauagaacau

SEQ ID NO: 739827 - RNA, 19 nt, Homo sapiens
ggcugcagaugacuucuua

SEQ ID NO: 739828 - RNA, 19 nt, Homo sapiens
gaaaguaugcuuccaucau

SEQ ID NO: 739829 - RNA, 19 nt, Homo sapiens
uaaauuuccucacaucaca

SEQ ID NO: 739830 - RNA, 19 nt, Homo sapiens
ucacguaaauuuccucaca

SEQ ID NO: 739831 - RNA, 19 nt, Homo sapiens
ggaggaaauuaucaacugu

SEQ ID NO: 739832 - RNA, 19 nt, Homo sapiens
gauagcauggauuugauua

SEQ ID NO: 739833 - RNA, 19 nt, Homo sapiens
guccauggauuccguaaug

SEQ ID NO: 739834 - RNA, 19 nt, Homo sapiens
gcaaauagggaaucuaagg

SEQ ID NO: 739835 - RNA, 19 nt, Homo sapiens
caacagaucaagaaguaug

SEQ ID NO: 739836 - RNA, 19 nt, Homo sapiens
caaagagaaguaucuaaga

SEQ ID NO: 739837 - RNA, 19 nt, Homo sapiens
ccucucagaugauaguaaa

SEQ ID NO: 739838 - RNA, 19 nt, Homo sapiens
cgggaaagauggcaaauac

SEQ ID NO: 739839 - RNA, 19 nt, Homo sapiens
ugucuaggaugaagaaaug

SEQ ID NO: 739840 - RNA, 19 nt, Homo sapiens
uaacauucgugauagauac

SEQ ID NO: 739841 - RNA, 19 nt, Homo sapiens
gcagugacaacucguuuga

SEQ ID NO: 739842 - RNA, 19 nt, Homo sapiens
uaucaacugugcacaagga

SEQ ID NO: 739843 - RNA, 19 nt, Homo sapiens
gcagggaugacauauucua

SEQ ID NO: 739844 - RNA, 19 nt, Homo sapiens
ggacuuaaagacaauggaa

SEQ ID NO: 739845 - RNA, 19 nt, Homo sapiens
aaauauaacuccccaacua

SEQ ID NO: 739846 - RNA, 19 nt, Homo sapiens
gaaacuaggacuauguaca

SEQ ID NO: 739847 - RNA, 19 nt, Homo sapiens
agaaguaucuaagaccaaa

SEQ ID NO: 739848 - RNA, 19 nt, Homo sapiens
gcucugagacgaaugcuau

SEQ ID NO: 739849 - RNA, 19 nt, Homo sapiens
gguccaagcuagaggaagu

SEQ ID NO: 739850 - RNA, 19 nt, Homo sapiens
cuaucucuauucaggauua

SEQ ID NO: 739851 - RNA, 19 nt, Homo sapiens
ccaacuaauuuccagauag

SEQ ID NO: 739852 - RNA, 19 nt, Homo sapiens
aaaguaugcuuccaucauc

SEQ ID NO: 739853 - RNA, 19 nt, Homo sapiens
gaugaagaaaugcauagaa

SEQ ID NO: 739854 - RNA, 19 nt, Homo sapiens
guaacauucgugauagaua

SEQ ID NO: 739855 - RNA, 19 nt, Homo sapiens
ucaagggccuacucuaaca

SEQ ID NO: 739856 - RNA, 19 nt, Homo sapiens
aaucaagggccuacucuaa

SEQ ID NO: 739857 - RNA, 19 nt, Homo sapiens
guaaaggauguucuaauuc

SEQ ID NO: 739858 - RNA, 19 nt, Homo sapiens
ucucggugguuagcaauua

SEQ ID NO: 739859 - RNA, 19 nt, Homo sapiens
caauacuucuccucucaga

SEQ ID NO: 739860 - RNA, 19 nt, Homo sapiens
ugggauaucugagaaguau

SEQ ID NO: 739861 - RNA, 19 nt, Homo sapiens
uaauacaacugggauaucu

SEQ ID NO: 739862 - RNA, 19 nt, Homo sapiens
gaauggaaacuaggacuau

SEQ ID NO: 739863 - RNA, 19 nt, Homo sapiens
ucugacaucucggugguua

SEQ ID NO: 739864 - RNA, 19 nt, Homo sapiens
ccaaagagaaguaucuaag

SEQ ID NO: 739865 - RNA, 19 nt, Homo sapiens
cauaugcggaagagaguua

SEQ ID NO: 739866 - RNA, 19 nt, Homo sapiens
aaagagaaguaucuaagac

SEQ ID NO: 739867 - RNA, 19 nt, Homo sapiens
gcuaugggcugcagaugac

SEQ ID NO: 739868 - RNA, 19 nt, Homo sapiens
gcuggacccuguaaaggau

SEQ ID NO: 739869 - RNA, 19 nt, Homo sapiens
gauuugcucuuucugacau

SEQ ID NO: 739870 - RNA, 19 nt, Homo sapiens
gaugacuucuuagaggauu

SEQ ID NO: 739871 - RNA, 19 nt, Homo sapiens
uagcauggauuugauuaca

SEQ ID NO: 739872 - RNA, 19 nt, Homo sapiens
ggauaucugagaaguauag

SEQ ID NO: 739873 - RNA, 19 nt, Homo sapiens
gauuauggacuuaaagaca

SEQ ID NO: 739874 - RNA, 19 nt, Homo sapiens
cagauagauggaagaaaua

SEQ ID NO: 739875 - RNA, 19 nt, Homo sapiens
gugaagaucauauuauugg

SEQ ID NO: 739876 - RNA, 19 nt, Homo sapiens
gcuagaggaaguccaaaga

SEQ ID NO: 739877 - RNA, 19 nt, Homo sapiens
gcgaagauucacuggauga

SEQ ID NO: 739878 - RNA, 19 nt, Homo sapiens
ggacuauguacaccagaaa

SEQ ID NO: 739879 - RNA, 19 nt, Homo sapiens
cuugacagauguuguaauc

SEQ ID NO: 739880 - RNA, 19 nt, Homo sapiens
aaucuaagggaggaaauua

SEQ ID NO: 739881 - RNA, 19 nt, Homo sapiens
guggauagcauggauuuga

SEQ ID NO: 739882 - RNA, 19 nt, Homo sapiens
ccaguuuaaucccauggaa

SEQ ID NO: 739883 - RNA, 19 nt, Homo sapiens
cuacagacaguacaacaga

SEQ ID NO: 739884 - RNA, 19 nt, Homo sapiens
cauagaacauuguaguacu

SEQ ID NO: 739885 - RNA, 19 nt, Homo sapiens
gauagauaccaguuuaauc

SEQ ID NO: 739886 - RNA, 19 nt, Homo sapiens
ggaaagauggcaaauaccu

SEQ ID NO: 739887 - RNA, 19 nt, Homo sapiens
cuugagaacuuaugaacca

SEQ ID NO: 739888 - RNA, 19 nt, Homo sapiens
gaaucuaagggaggaaauu

SEQ ID NO: 739889 - RNA, 19 nt, Homo sapiens
ccaaagggauguguuuuau

SEQ ID NO: 739890 - RNA, 19 nt, Homo sapiens
ggauagcauggauuugauu

SEQ ID NO: 739891 - RNA, 19 nt, Homo sapiens
guucaacaaauacgaauuc

SEQ ID NO: 739892 - RNA, 19 nt, Homo sapiens
gaucccugguucaacaaau

SEQ ID NO: 739893 - RNA, 19 nt, Homo sapiens
ucauugagcucaggaagag

SEQ ID NO: 739894 - RNA, 19 nt, Homo sapiens
guaauggaguuuugcuuga

SEQ ID NO: 739895 - RNA, 19 nt, Homo sapiens
cccaacuaauuuccagaua

SEQ ID NO: 739896 - RNA, 19 nt, Homo sapiens
gcauagaacauuguaguac

SEQ ID NO: 739897 - RNA, 19 nt, Homo sapiens
gaccaaagagaaguaucua

SEQ ID NO: 739898 - RNA, 19 nt, Homo sapiens
guacaacagaucaagaagu

SEQ ID NO: 739899 - RNA, 19 nt, Homo sapiens
cuaauucuuucugcucuga

SEQ ID NO: 739900 - RNA, 19 nt, Homo sapiens
uggcuuugcucacucaugu

SEQ ID NO: 739901 - RNA, 19 nt, Homo sapiens
gacagauguuguaaucaag

SEQ ID NO: 739902 - RNA, 19 nt, Homo sapiens
acgaaaagauccugcaaaa

SEQ ID NO: 739903 - RNA, 19 nt, Homo sapiens
ucacucauguggauagcau

SEQ ID NO: 739904 - RNA, 19 nt, Homo sapiens
gaaggacagaauucauugu

SEQ ID NO: 739905 - RNA, 19 nt, Homo sapiens
uaucuugaacgguaacauu

SEQ ID NO: 739906 - RNA, 19 nt, Homo sapiens
gagaauggauuguggguua

SEQ ID NO: 739907 - RNA, 19 nt, Homo sapiens
gagggaauauguccaauua

SEQ ID NO: 739908 - RNA, 19 nt, Homo sapiens
gagaguaucuaguuaauca

SEQ ID NO: 739909 - RNA, 19 nt, Homo sapiens
ggagacuguuggaguauua

SEQ ID NO: 739910 - RNA, 19 nt, Homo sapiens
gagcauaugugcaacuuau

SEQ ID NO: 739911 - RNA, 19 nt, Homo sapiens
gaagaaaccuggggacuua

SEQ ID NO: 739912 - RNA, 19 nt, Homo sapiens
gaucauaauucagaaggua

SEQ ID NO: 739913 - RNA, 19 nt, Homo sapiens
gugcuagcauuuauuguua

SEQ ID NO: 739914 - RNA, 19 nt, Homo sapiens
gggaauauguccaauuaau

SEQ ID NO: 739915 - RNA, 19 nt, Homo sapiens
gcagauaucuaaguaagug

SEQ ID NO: 739916 - RNA, 19 nt, Homo sapiens
guacagcaguuuacaacaa

SEQ ID NO: 739917 - RNA, 19 nt, Homo sapiens
gguggaagcucagaaauug

SEQ ID NO: 739918 - RNA, 19 nt, Homo sapiens
aaaccuaacuguccgaauu

SEQ ID NO: 739919 - RNA, 19 nt, Homo sapiens
aaauaugacucucuuggua

SEQ ID NO: 739920 - RNA, 19 nt, Homo sapiens
ggaaugaugcuuuguaugu

SEQ ID NO: 739921 - RNA, 19 nt, Homo sapiens
uuacaugacucuaagacua

SEQ ID NO: 739922 - RNA, 19 nt, Homo sapiens
gaaaagcuauugagaguau

SEQ ID NO: 739923 - RNA, 19 nt, Homo sapiens
ggacuuaguuagguagauu

SEQ ID NO: 739924 - RNA, 19 nt, Homo sapiens
ccagaaacuuuaugucuau

SEQ ID NO: 739925 - RNA, 19 nt, Homo sapiens
gaaccagacuuacuaacca

SEQ ID NO: 739926 - RNA, 19 nt, Homo sapiens
gugcagagcauuaacuaua

SEQ ID NO: 739927 - RNA, 19 nt, Homo sapiens
uauaaaugcucgagaguug

SEQ ID NO: 739928 - RNA, 19 nt, Homo sapiens
gauuguggguuauuuauuc

SEQ ID NO: 739929 - RNA, 19 nt, Homo sapiens
augguuaccuucugaauua

SEQ ID NO: 739930 - RNA, 19 nt, Homo sapiens
ggaaagagggcaaacuaga

SEQ ID NO: 739931 - RNA, 19 nt, Homo sapiens
auaaagaccuuggagcaua

SEQ ID NO: 739932 - RNA, 19 nt, Homo sapiens
ccucauaacuuccuuccaa

SEQ ID NO: 739933 - RNA, 19 nt, Homo sapiens
acaacacacuggaugauuu

SEQ ID NO: 739934 - RNA, 19 nt, Homo sapiens
guuaaucagugcaguaguu

SEQ ID NO: 739935 - RNA, 19 nt, Homo sapiens
gaccaaaucuccaacuuuu

SEQ ID NO: 739936 - RNA, 19 nt, Homo sapiens
gggaauauugccagaguua

SEQ ID NO: 739937 - RNA, 19 nt, Homo sapiens
cuauggaacugaucuaaga

SEQ ID NO: 739938 - RNA, 19 nt, Homo sapiens
acaaagugcuagcauuuau

SEQ ID NO: 739939 - RNA, 19 nt, Homo sapiens
ugacaaagugcuagcauuu

SEQ ID NO: 739940 - RNA, 19 nt, Homo sapiens
ggaccaaaucuccaacuuu

SEQ ID NO: 739941 - RNA, 19 nt, Homo sapiens
uaucaguuguugcauguaa

SEQ ID NO: 739942 - RNA, 19 nt, Homo sapiens
aaaggcagcucagaagauu

SEQ ID NO: 739943 - RNA, 19 nt, Homo sapiens
caagacagaaagaucauaa

SEQ ID NO: 739944 - RNA, 19 nt, Homo sapiens
gaguuaaccugaccaccaa

SEQ ID NO: 739945 - RNA, 19 nt, Homo sapiens
uaaagaccuuggagcauau

SEQ ID NO: 739946 - RNA, 19 nt, Homo sapiens
aagauuagaaccagacuua

SEQ ID NO: 739947 - RNA, 19 nt, Homo sapiens
gccuggaacuuguaagaaa

SEQ ID NO: 739948 - RNA, 19 nt, Homo sapiens
gaguuagggugaaagagaa

SEQ ID NO: 739949 - RNA, 19 nt, Homo sapiens
ggaguuagggugaaagaga

SEQ ID NO: 739950 - RNA, 19 nt, Homo sapiens
ggaauucacagcucauguu

SEQ ID NO: 739951 - RNA, 19 nt, Homo sapiens
aaaccuugcugguguaugu

SEQ ID NO: 739952 - RNA, 19 nt, Homo sapiens
gacaaagugcuagcauuua

SEQ ID NO: 739953 - RNA, 19 nt, Homo sapiens
ccauguagcaccacuaauu

SEQ ID NO: 739954 - RNA, 19 nt, Homo sapiens
guauagggauucuuuguac

SEQ ID NO: 739955 - RNA, 19 nt, Homo sapiens
cuaaugcugccuauaauaa

SEQ ID NO: 739956 - RNA, 19 nt, Homo sapiens
ccagggagcuguggucaug

SEQ ID NO: 739957 - RNA, 19 nt, Homo sapiens
guauguggcagauaaguaa

SEQ ID NO: 739958 - RNA, 19 nt, Homo sapiens
gaaugaugcuuuguaugug

SEQ ID NO: 739959 - RNA, 19 nt, Homo sapiens
guaagcuguuuaggaguua

SEQ ID NO: 739960 - RNA, 19 nt, Homo sapiens
guacaacaccgggaauauu

SEQ ID NO: 739961 - RNA, 19 nt, Homo sapiens
gagguggagauaagaaaua

SEQ ID NO: 739962 - RNA, 19 nt, Homo sapiens
caaauaaaucccagaagga

SEQ ID NO: 739963 - RNA, 19 nt, Homo sapiens
aaauagucuucuccacuua

SEQ ID NO: 739964 - RNA, 19 nt, Homo sapiens
uagagaagcuugagacacu

SEQ ID NO: 739965 - RNA, 19 nt, Homo sapiens
ucuguaaagugcugaguuu

SEQ ID NO: 739966 - RNA, 19 nt, Homo sapiens
caucuagucuuugucuauu

SEQ ID NO: 739967 - RNA, 19 nt, Homo sapiens
gugcuaaacacuugguaua

SEQ ID NO: 739968 - RNA, 19 nt, Homo sapiens
uggaugauuugcuauugua

SEQ ID NO: 739969 - RNA, 19 nt, Homo sapiens
gagaaaucguggcucugaa

SEQ ID NO: 739970 - RNA, 19 nt, Homo sapiens
acacugaacuggacuucga

SEQ ID NO: 739971 - RNA, 19 nt, Homo sapiens
ugcagagcauuaacuauaa

SEQ ID NO: 739972 - RNA, 19 nt, Homo sapiens
gagguucugugucccaguu

SEQ ID NO: 739973 - RNA, 19 nt, Homo sapiens
cuauaggauuggcaguuua

SEQ ID NO: 739974 - RNA, 19 nt, Homo sapiens
gcaccuggaaugaugcuuu

SEQ ID NO: 739975 - RNA, 19 nt, Homo sapiens
guuaacauggugauuagua

SEQ ID NO: 739976 - RNA, 19 nt, Homo sapiens
gggauucuuuguacaggaa

SEQ ID NO: 739977 - RNA, 19 nt, Homo sapiens
gacagaaagaucauaauuc

SEQ ID NO: 739978 - RNA, 19 nt, Homo sapiens
uggcaagcauauugacuuu

SEQ ID NO: 739979 - RNA, 19 nt, Homo sapiens
gaagugaaggagauggaaa

SEQ ID NO: 739980 - RNA, 19 nt, Homo sapiens
cagcucauguucuuucuca

SEQ ID NO: 739981 - RNA, 19 nt, Homo sapiens
cauaaaguuucuggucaaa

SEQ ID NO: 739982 - RNA, 19 nt, Homo sapiens
aaccaucguuauagacaua

SEQ ID NO: 739983 - RNA, 19 nt, Homo sapiens
gggcaaacuagacauugua

SEQ ID NO: 739984 - RNA, 19 nt, Homo sapiens
guggagauaagaaauauga

SEQ ID NO: 739985 - RNA, 19 nt, Homo sapiens
gaugugggaccuccaauuc

SEQ ID NO: 739986 - RNA, 19 nt, Homo sapiens
guggaacgcuuggaauuca

SEQ ID NO: 739987 - RNA, 19 nt, Homo sapiens
caccagaacagaagagauu

SEQ ID NO: 739988 - RNA, 19 nt, Homo sapiens
gcucgagaguugcggauca

SEQ ID NO: 739989 - RNA, 19 nt, Homo sapiens
caaacaaaggacuguauug

SEQ ID NO: 739990 - RNA, 19 nt, Homo sapiens
gaaauaugacucucuuggu

SEQ ID NO: 739991 - RNA, 19 nt, Homo sapiens
ucuauaggauuggcaguuu

SEQ ID NO: 739992 - RNA, 19 nt, Homo sapiens
gugacaaagugcuagcauu

SEQ ID NO: 739993 - RNA, 19 nt, Homo sapiens
gaugguuaccuucugaauu

SEQ ID NO: 739994 - RNA, 19 nt, Homo sapiens
uauaaaccaucugcuucua

SEQ ID NO: 739995 - RNA, 19 nt, Homo sapiens
caacacacuggaugauuug

SEQ ID NO: 739996 - RNA, 19 nt, Homo sapiens
guucaaguccuagucuaua

SEQ ID NO: 739997 - RNA, 19 nt, Homo sapiens
guuaccuucugaauuauga

SEQ ID NO: 739998 - RNA, 19 nt, Homo sapiens
gaccagaaacuuuaugucu

SEQ ID NO: 739999 - RNA, 19 nt, Homo sapiens
gugaugugcuucugugcuu

SEQ ID NO: 740000 - RNA, 19 nt, Homo sapiens
guagugguacagcaguuua

SEQ ID NO: 740001 - RNA, 19 nt, Homo sapiens
gagaguugcggaucaccua

SEQ ID NO: 740002 - RNA, 19 nt, Homo sapiens
gaaaucguggcucugaaga

SEQ ID NO: 740003 - RNA, 19 nt, Homo sapiens
gaguggaacgcuuggaauu

SEQ ID NO: 740004 - RNA, 19 nt, Homo sapiens
gggaccaaaucuccaacuu

SEQ ID NO: 740005 - RNA, 19 nt, Homo sapiens
gcaagacagaaagaucaua

SEQ ID NO: 740006 - RNA, 19 nt, Homo sapiens
gaacauguggcuugaauua

SEQ ID NO: 740007 - RNA, 19 nt, Homo sapiens
guagauauccucugcuuaa

SEQ ID NO: 740008 - RNA, 19 nt, Homo sapiens
ggaggcagauggaacuuga

SEQ ID NO: 740009 - RNA, 19 nt, Homo sapiens
caaaggaauccauguagua

SEQ ID NO: 740010 - RNA, 19 nt, Homo sapiens
gggaaugguuguccaagaa

SEQ ID NO: 740011 - RNA, 19 nt, Homo sapiens
gcugauauuuccacuaaga

SEQ ID NO: 740012 - RNA, 19 nt, Homo sapiens
gcaaaggaauccauguagu

SEQ ID NO: 740013 - RNA, 19 nt, Homo sapiens
agagaaagauucccugaug

SEQ ID NO: 740014 - RNA, 19 nt, Homo sapiens
gaauggauacaaagaauga

SEQ ID NO: 740015 - RNA, 19 nt, Homo sapiens
ggaagaagaacaagucaau

SEQ ID NO: 740016 - RNA, 19 nt, Homo sapiens
ucacuacggaggagaauua

SEQ ID NO: 740017 - RNA, 19 nt, Homo sapiens
gcucaagucugaacucuac

SEQ ID NO: 740018 - RNA, 19 nt, Homo sapiens
gaacuuccccauacaaaua

SEQ ID NO: 740019 - RNA, 19 nt, Homo sapiens
caagcugaauggauacaaa

SEQ ID NO: 740020 - RNA, 19 nt, Homo sapiens
gaaaucauagucuggaaga

SEQ ID NO: 740021 - RNA, 19 nt, Homo sapiens
caauaaaguugagcaaaca

SEQ ID NO: 740022 - RNA, 19 nt, Homo sapiens
ggacucugguaucuaauuc

SEQ ID NO: 740023 - RNA, 19 nt, Homo sapiens
ggaguuugcauucuuauuc

SEQ ID NO: 740024 - RNA, 19 nt, Homo sapiens
gggagaagauguuugaaaa

SEQ ID NO: 740025 - RNA, 19 nt, Homo sapiens
aaacugacucugcuaauga

SEQ ID NO: 740026 - RNA, 19 nt, Homo sapiens
gaauccauguaguagauau

SEQ ID NO: 740027 - RNA, 19 nt, Homo sapiens
gcaugaggacuaugugaaa

SEQ ID NO: 740028 - RNA, 19 nt, Homo sapiens
gcauuuaaagggugaugua

SEQ ID NO: 740029 - RNA, 19 nt, Homo sapiens
gcacuugggagaagauguu

SEQ ID NO: 740030 - RNA, 19 nt, Homo sapiens
gaagaagaacaagucaauu

SEQ ID NO: 740031 - RNA, 19 nt, Homo sapiens
ccuagacgcuucauugauc

SEQ ID NO: 740032 - RNA, 19 nt, Homo sapiens
cgacaucucugcuucucau

SEQ ID NO: 740033 - RNA, 19 nt, Homo sapiens
gaguuugcauucuuauuca

SEQ ID NO: 740034 - RNA, 19 nt, Homo sapiens
acacauguauccuuucaca

SEQ ID NO: 740035 - RNA, 19 nt, Homo sapiens
uggcuugaauuaagaagaa

SEQ ID NO: 740036 - RNA, 19 nt, Homo sapiens
augcugauauuuccacuaa

SEQ ID NO: 740037 - RNA, 19 nt, Homo sapiens
ugauggaaguauugagaaa

SEQ ID NO: 740038 - RNA, 19 nt, Homo sapiens
aagaagaacaagucaauug

SEQ ID NO: 740039 - RNA, 19 nt, Homo sapiens
uauauacacuuggaguuug

SEQ ID NO: 740040 - RNA, 19 nt, Homo sapiens
ggaaugguuguccaagaaa

SEQ ID NO: 740041 - RNA, 19 nt, Homo sapiens
cauagaauacucagggaaa

SEQ ID NO: 740042 - RNA, 19 nt, Homo sapiens
acucacagcacccuauaua

SEQ ID NO: 740043 - RNA, 19 nt, Homo sapiens
gaaagaacuuccccauaca

SEQ ID NO: 740044 - RNA, 19 nt, Homo sapiens
caaagaaugauggaaguau

SEQ ID NO: 740045 - RNA, 19 nt, Homo sapiens
ucacacauuugccuugaca

SEQ ID NO: 740046 - RNA, 19 nt, Homo sapiens
ucacagcacccuauauaca

SEQ ID NO: 740047 - RNA, 19 nt, Homo sapiens
aaauaaggcaugaggacua

SEQ ID NO: 740048 - RNA, 19 nt, Homo sapiens
cauguggcuugaauuaaga

SEQ ID NO: 740049 - RNA, 19 nt, Homo sapiens
cccucaagcugaauggaua

SEQ ID NO: 740050 - RNA, 19 nt, Homo sapiens
acauguggcuugaauuaag

SEQ ID NO: 740051 - RNA, 19 nt, Homo sapiens
cuuggaguuugcauucuua

SEQ ID NO: 740052 - RNA, 19 nt, Homo sapiens
uagauauccucugcuuaaa

SEQ ID NO: 740053 - RNA, 19 nt, Homo sapiens
guuccaguguuuaagagaa

SEQ ID NO: 740054 - RNA, 19 nt, Homo sapiens
cugaauggauacaaagaau

SEQ ID NO: 740055 - RNA, 19 nt, Homo sapiens
uaguagauauccucugcuu

SEQ ID NO: 740056 - RNA, 19 nt, Homo sapiens
ugaucgaauucaaaucuug

SEQ ID NO: 740057 - RNA, 19 nt, Homo sapiens
ucuaccaguuccaguguuu

SEQ ID NO: 740058 - RNA, 19 nt, Homo sapiens
gacaaacuucuuucacuca

SEQ ID NO: 740059 - RNA, 19 nt, Homo sapiens
aauaaggcaugaggacuau

SEQ ID NO: 740060 - RNA, 19 nt, Homo sapiens
ccauacaaauaaggcauga

SEQ ID NO: 740061 - RNA, 19 nt, Homo sapiens
uacaaagaaugauggaagu

SEQ ID NO: 740062 - RNA, 19 nt, Homo sapiens
gagcucaagucugaacucu

SEQ ID NO: 740063 - RNA, 19 nt, Homo sapiens
cuacggaggagaauuaagu

SEQ ID NO: 740064 - RNA, 19 nt, Homo sapiens
aggaauccauguaguagau

SEQ ID NO: 740065 - RNA, 19 nt, Homo sapiens
cagccucucuccaguccaa

SEQ ID NO: 740066 - RNA, 19 nt, Homo sapiens
agaaagaacuuccccauac

SEQ ID NO: 740067 - RNA, 19 nt, Homo sapiens
gcugaauggauacaaagaa

SEQ ID NO: 740068 - RNA, 19 nt, Homo sapiens
aaacuucuuucacucacau

SEQ ID NO: 740069 - RNA, 19 nt, Homo sapiens
uguauccuuucacacauuu

SEQ ID NO: 740070 - RNA, 19 nt, Homo sapiens
ggaauccauguaguagaua

SEQ ID NO: 740071 - RNA, 19 nt, Homo sapiens
cuauauacacuuggaguuu

SEQ ID NO: 740072 - RNA, 19 nt, Homo sapiens
gagaaagaacuuccccaua

SEQ ID NO: 740073 - RNA, 19 nt, Homo sapiens
ucaagcuucuucacucaca

SEQ ID NO: 740074 - RNA, 19 nt, Homo sapiens
gauauuuccacuaagaaca

SEQ ID NO: 740075 - RNA, 19 nt, Homo sapiens
ucacucacagcacccuaua

SEQ ID NO: 740076 - RNA, 19 nt, Homo sapiens
guguagauguguccaagag

SEQ ID NO: 740077 - RNA, 19 nt, Homo sapiens
gaaugguuguccaagaaaa

SEQ ID NO: 740078 - RNA, 19 nt, Homo sapiens
gggacucugguaucuaauu

SEQ ID NO: 740079 - RNA, 19 nt, Homo sapiens
caaacuucuuucacucaca

SEQ ID NO: 740080 - RNA, 19 nt, Homo sapiens
gaaaacaauggaaugagaa

SEQ ID NO: 740081 - RNA, 19 nt, Homo sapiens
agaaaacaauggaaugaga

SEQ ID NO: 740082 - RNA, 19 nt, Homo sapiens
ccaguuccaguguuuaaga

SEQ ID NO: 740083 - RNA, 19 nt, Homo sapiens
uugaacauguggcuugaau

SEQ ID NO: 740084 - RNA, 19 nt, Homo sapiens
ccacuaagaacaccugcau

SEQ ID NO: 740085 - RNA, 19 nt, Homo sapiens
aagauucccugaugcugau

SEQ ID NO: 740086 - RNA, 19 nt, Homo sapiens
ggcaaaggaauccauguag

SEQ ID NO: 740087 - RNA, 19 nt, Homo sapiens
acuaagaacaccugcauuc

SEQ ID NO: 740088 - RNA, 19 nt, Homo sapiens
aagaaaucauagucuggaa

SEQ ID NO: 740089 - RNA, 19 nt, Homo sapiens
ugggaaugguuguccaaga

SEQ ID NO: 740090 - RNA, 19 nt, Homo sapiens
acacuuggaguuugcauuc

SEQ ID NO: 740091 - RNA, 19 nt, Homo sapiens
ggcaugaggacuaugugaa

SEQ ID NO: 740092 - RNA, 19 nt, Homo sapiens
acgcuucauugaucgaauu

SEQ ID NO: 740093 - RNA, 19 nt, Homo sapiens
ccccagacuucauagaaua

SEQ ID NO: 740094 - RNA, 19 nt, Homo sapiens
aggcaaaggaauccaugua

SEQ ID NO: 740095 - RNA, 19 nt, Homo sapiens
uaaggcaugaggacuaugu

SEQ ID NO: 740096 - RNA, 19 nt, Homo sapiens
aagaaugauggaaguauug

SEQ ID NO: 740097 - RNA, 19 nt, Homo sapiens
acaaagaaugauggaagua

SEQ ID NO: 740098 - RNA, 19 nt, Homo sapiens
acucugguaucuaauucuu

SEQ ID NO: 740099 - RNA, 19 nt, Homo sapiens
ucagggaaagcauuuaaag

SEQ ID NO: 740100 - RNA, 19 nt, Homo sapiens
uuaauagcauucgaagauc

SEQ ID NO: 740101 - RNA, 19 nt, Homo sapiens
acucaagcuucuucacuca

SEQ ID NO: 740102 - RNA, 19 nt, Homo sapiens
gcucuggauuuuaguuuug

SEQ ID NO: 740103 - RNA, 19 nt, Homo sapiens
ugggagaagauguuugaaa

SEQ ID NO: 740104 - RNA, 19 nt, Homo sapiens
uaccaguuccaguguuuaa

SEQ ID NO: 740105 - RNA, 19 nt, Homo sapiens
uucuuucacucacaucuuu

SEQ ID NO: 740106 - RNA, 19 nt, Homo sapiens
gaacauagcuguauagguu

SEQ ID NO: 740107 - RNA, 19 nt, Homo sapiens
gcaaagaccuguaugugaa

SEQ ID NO: 740108 - RNA, 19 nt, Homo sapiens
gaaagaggcucaucacugu

SEQ ID NO: 740109 - RNA, 19 nt, Homo sapiens
gaacucuccugcaucauua

SEQ ID NO: 740110 - RNA, 19 nt, Homo sapiens
ggauaaguguuguguauaa

SEQ ID NO: 740111 - RNA, 19 nt, Homo sapiens
gaugaaaccugcaacugua

SEQ ID NO: 740112 - RNA, 19 nt, Homo sapiens
cgaaagagcaguauauuaa

SEQ ID NO: 740113 - RNA, 19 nt, Homo sapiens
caacuugacuucugugaaa

SEQ ID NO: 740114 - RNA, 19 nt, Homo sapiens
ggaggaagauucaucagaa

SEQ ID NO: 740115 - RNA, 19 nt, Homo sapiens
gcaagacgguguaguguga

SEQ ID NO: 740116 - RNA, 19 nt, Homo sapiens
gugaagcucuugccuauuu

SEQ ID NO: 740117 - RNA, 19 nt, Homo sapiens
caacuacgacugugauuua

SEQ ID NO: 740118 - RNA, 19 nt, Homo sapiens
gaauguauguugaugagaa

SEQ ID NO: 740119 - RNA, 19 nt, Homo sapiens
gcacaucccuugacugcuu

SEQ ID NO: 740120 - RNA, 19 nt, Homo sapiens
ggaacgagaugccuauguu

SEQ ID NO: 740121 - RNA, 19 nt, Homo sapiens
ggacauuccuagaagguuu

SEQ ID NO: 740122 - RNA, 19 nt, Homo sapiens
gugagaacauguuacaaua

SEQ ID NO: 740123 - RNA, 19 nt, Homo sapiens
ucaaaucugucauugcaua

SEQ ID NO: 740124 - RNA, 19 nt, Homo sapiens
gaacaugccaggagugauu

SEQ ID NO: 740125 - RNA, 19 nt, Homo sapiens
ggagaucacuucaauaagg

SEQ ID NO: 740126 - RNA, 19 nt, Homo sapiens
ggauggaaaugcaauaguu

SEQ ID NO: 740127 - RNA, 19 nt, Homo sapiens
ucaaugcaaucaagcaaua

SEQ ID NO: 740128 - RNA, 19 nt, Homo sapiens
gcaacuaccuugggaauuc

SEQ ID NO: 740129 - RNA, 19 nt, Homo sapiens
gcacaaagcaaaccaacaa

SEQ ID NO: 740130 - RNA, 19 nt, Homo sapiens
caaguuagauguacgaaca

SEQ ID NO: 740131 - RNA, 19 nt, Homo sapiens
gaacugugaugacacugaa

SEQ ID NO: 740132 - RNA, 19 nt, Homo sapiens
gaaguggccuccuuguguu

SEQ ID NO: 740133 - RNA, 19 nt, Homo sapiens
gaaaugcaauaguugacuu

SEQ ID NO: 740134 - RNA, 19 nt, Homo sapiens
ggcaugagaucuugaaaug

SEQ ID NO: 740135 - RNA, 19 nt, Homo sapiens
gagaacauguuacaauauc

SEQ ID NO: 740136 - RNA, 19 nt, Homo sapiens
gaaauacagcagagacuuu

SEQ ID NO: 740137 - RNA, 19 nt, Homo sapiens
ggaugacccugagcaauuu

SEQ ID NO: 740138 - RNA, 19 nt, Homo sapiens
gcucacggaucaggaaaua

SEQ ID NO: 740139 - RNA, 19 nt, Homo sapiens
gcagaagauuguggagaua

SEQ ID NO: 740140 - RNA, 19 nt, Homo sapiens
ggaaucggaugcacaagga

SEQ ID NO: 740141 - RNA, 19 nt, Homo sapiens
ggagucugcuucauuucua

SEQ ID NO: 740142 - RNA, 19 nt, Homo sapiens
gcagauauccacauagaga

SEQ ID NO: 740143 - RNA, 19 nt, Homo sapiens
caagauacauagaaugcaa

SEQ ID NO: 740144 - RNA, 19 nt, Homo sapiens
cauugaagcugacaaguau

SEQ ID NO: 740145 - RNA, 19 nt, Homo sapiens
gaggaagauucaucagaaa

SEQ ID NO: 740146 - RNA, 19 nt, Homo sapiens
gaacgucaguugaagacau

SEQ ID NO: 740147 - RNA, 19 nt, Homo sapiens
guagucacaucugccauua

SEQ ID NO: 740148 - RNA, 19 nt, Homo sapiens
gaaaccauuugcaguuguu

SEQ ID NO: 740149 - RNA, 19 nt, Homo sapiens
gcaguggugugucaaacaa

SEQ ID NO: 740150 - RNA, 19 nt, Homo sapiens
uaaggcaacucuccaugaa

SEQ ID NO: 740151 - RNA, 19 nt, Homo sapiens
ggagauagcgcaagguuca

SEQ ID NO: 740152 - RNA, 19 nt, Homo sapiens
ggaaacggauggccucuac

SEQ ID NO: 740153 - RNA, 19 nt, Homo sapiens
cuacaguggucucgaauau

SEQ ID NO: 740154 - RNA, 19 nt, Homo sapiens
agacaacuguucaggauga

SEQ ID NO: 740155 - RNA, 19 nt, Homo sapiens
gaugagaaccgcagggauu

SEQ ID NO: 740156 - RNA, 19 nt, Homo sapiens
gaucagggcauguauaagu

SEQ ID NO: 740157 - RNA, 19 nt, Homo sapiens
gguacaaauugcuuagaaa

SEQ ID NO: 740158 - RNA, 19 nt, Homo sapiens
ccagaccacuugccacauu

SEQ ID NO: 740159 - RNA, 19 nt, Homo sapiens
aaacaaccaucccacaugu

SEQ ID NO: 740160 - RNA, 19 nt, Homo sapiens
ggaccaacuugacuucugu

SEQ ID NO: 740161 - RNA, 19 nt, Homo sapiens
gcgcaagguucaacaagga

SEQ ID NO: 740162 - RNA, 19 nt, Homo sapiens
caucuuggaucucagaaug

SEQ ID NO: 740163 - RNA, 19 nt, Homo sapiens
caugagaucuugaaaugca

SEQ ID NO: 740164 - RNA, 19 nt, Homo sapiens
gggaauuccuggcaugaga

SEQ ID NO: 740165 - RNA, 19 nt, Homo sapiens
ccacucaccuggaccaugu

SEQ ID NO: 740166 - RNA, 19 nt, Homo sapiens
guccuagcguauucaauua

SEQ ID NO: 740167 - RNA, 19 nt, Homo sapiens
gacagaaccugagagaguu

SEQ ID NO: 740168 - RNA, 19 nt, Homo sapiens
agaagucacucuccuugaa

SEQ ID NO: 740169 - RNA, 19 nt, Homo sapiens
ccgaaucgccugcaucuuu

SEQ ID NO: 740170 - RNA, 19 nt, Homo sapiens
ccagacaacuguucaggau

SEQ ID NO: 740171 - RNA, 19 nt, Homo sapiens
ggacaugagcugggaauga

SEQ ID NO: 740172 - RNA, 19 nt, Homo sapiens
gcacaucucgugaaguuuc

SEQ ID NO: 740173 - RNA, 19 nt, Homo sapiens
ugcagaaacucaucgcaua

SEQ ID NO: 740174 - RNA, 19 nt, Homo sapiens
uggcacaucucgugaaguu

SEQ ID NO: 740175 - RNA, 19 nt, Homo sapiens
gcucuugccuauuucauca

SEQ ID NO: 740176 - RNA, 19 nt, Homo sapiens
gaaacucccugagcaacug

SEQ ID NO: 740177 - RNA, 19 nt, Homo sapiens
cuacgacugugauuuaaau

SEQ ID NO: 740178 - RNA, 19 nt, Homo sapiens
ugagagaguucuaggugaa

SEQ ID NO: 740179 - RNA, 19 nt, Homo sapiens
agucacaucugccauuaaa

SEQ ID NO: 740180 - RNA, 19 nt, Homo sapiens
cuguauagguuugugauua

SEQ ID NO: 740181 - RNA, 19 nt, Homo sapiens
cagugaagcucuugccuau

SEQ ID NO: 740182 - RNA, 19 nt, Homo sapiens
gaauugauacagaccauug

SEQ ID NO: 740183 - RNA, 19 nt, Homo sapiens
caaacaagauaaugaacag

SEQ ID NO: 740184 - RNA, 19 nt, Homo sapiens
ccaaaagauugaccgauua

SEQ ID NO: 740185 - RNA, 19 nt, Homo sapiens
ccucuacgcuguuccauca

SEQ ID NO: 740186 - RNA, 19 nt, Homo sapiens
gugaaauuaugcaguuuga

SEQ ID NO: 740187 - RNA, 19 nt, Homo sapiens
ugauguauuugcacaauug

SEQ ID NO: 740188 - RNA, 19 nt, Homo sapiens
gagcaacugucagagaaau

SEQ ID NO: 740189 - RNA, 19 nt, Homo sapiens
gaauauggcaugugauugg

SEQ ID NO: 740190 - RNA, 19 nt, Homo sapiens
cgacuacaguggucucgaa

SEQ ID NO: 740191 - RNA, 19 nt, Homo sapiens
cgaaucgccugcaucuuug

SEQ ID NO: 740192 - RNA, 19 nt, Homo sapiens
gcagaugcccaguguguug

SEQ ID NO: 740193 - RNA, 19 nt, Homo sapiens
gaagucacucuccuugaaa

SEQ ID NO: 740194 - RNA, 19 nt, Homo sapiens
cuacuugugugaaauuaug

SEQ ID NO: 740195 - RNA, 19 nt, Homo sapiens
ggagauaucauacuacaac

SEQ ID NO: 740196 - RNA, 19 nt, Homo sapiens
aaagacagauggccagcuu

SEQ ID NO: 740197 - RNA, 19 nt, Homo sapiens
gaauguagcuagugaaaag

SEQ ID NO: 740198 - RNA, 19 nt, Homo sapiens
gaguaucucucaagcaucu

SEQ ID NO: 740199 - RNA, 19 nt, Homo sapiens
caucacagucuccaacuaa

SEQ ID NO: 740200 - RNA, 19 nt, Homo sapiens
gggcaagucuaaacccaau

SEQ ID NO: 740201 - RNA, 19 nt, Homo sapiens
ggaugaaaccugcaacugu

SEQ ID NO: 740202 - RNA, 19 nt, Homo sapiens
uaucuuugcuguugacuca

SEQ ID NO: 740203 - RNA, 19 nt, Homo sapiens
ucucgaauauggcauguga

SEQ ID NO: 740204 - RNA, 19 nt, Homo sapiens
gaucugggcgugaaagaga

SEQ ID NO: 740205 - RNA, 19 nt, Homo sapiens
ccaaaucuacuaagcagaa

SEQ ID NO: 740206 - RNA, 19 nt, Homo sapiens
gaacaggucuccaacaauu

SEQ ID NO: 740207 - RNA, 19 nt, Homo sapiens
ccaaagaacuauagaugua

SEQ ID NO: 740208 - RNA, 19 nt, Homo sapiens
gaucacaaauggaugguua

SEQ ID NO: 740209 - RNA, 19 nt, Homo sapiens
uaacaaaucuggcaugguu

SEQ ID NO: 740210 - RNA, 19 nt, Homo sapiens
gaacuacgauccaagauuc

SEQ ID NO: 740211 - RNA, 19 nt, Homo sapiens
gaacaggaacuugguauua

SEQ ID NO: 740212 - RNA, 19 nt, Homo sapiens
ggaaacagauagcaaguau

SEQ ID NO: 740213 - RNA, 19 nt, Homo sapiens
gaacuugcauuccaaacaa

SEQ ID NO: 740214 - RNA, 19 nt, Homo sapiens
gcaagacaaugagcaguua

SEQ ID NO: 740215 - RNA, 19 nt, Homo sapiens
guaacuaccugucacauau

SEQ ID NO: 740216 - RNA, 19 nt, Homo sapiens
gagguuagauuuacuggaa

SEQ ID NO: 740217 - RNA, 19 nt, Homo sapiens
guacagaauuuaacguuga

SEQ ID NO: 740218 - RNA, 19 nt, Homo sapiens
gugagaacauguuacaaua

SEQ ID NO: 740219 - RNA, 19 nt, Homo sapiens
ggagagagaugcauauguc

SEQ ID NO: 740220 - RNA, 19 nt, Homo sapiens
ugucaagcauuccguauua

SEQ ID NO: 740221 - RNA, 19 nt, Homo sapiens
caagauaccuagaaugcaa

SEQ ID NO: 740222 - RNA, 19 nt, Homo sapiens
ggagaagggacuacuauaa

SEQ ID NO: 740223 - RNA, 19 nt, Homo sapiens
gcagaaagccuguuuaaac

SEQ ID NO: 740224 - RNA, 19 nt, Homo sapiens
gagaugcgguggacuuuga

SEQ ID NO: 740225 - RNA, 19 nt, Homo sapiens
ggaauaggcagcuacagua

SEQ ID NO: 740226 - RNA, 19 nt, Homo sapiens
gaugauagauugucagucu

SEQ ID NO: 740227 - RNA, 19 nt, Homo sapiens
ggaagcaauucgacuuauu

SEQ ID NO: 740228 - RNA, 19 nt, Homo sapiens
uauaggaacuggagugaaa

SEQ ID NO: 740229 - RNA, 19 nt, Homo sapiens
aaacagugaugggaacuua

SEQ ID NO: 740230 - RNA, 19 nt, Homo sapiens
aaacauauggccacacuua

SEQ ID NO: 740231 - RNA, 19 nt, Homo sapiens
gaggaaauguggacuggaa

SEQ ID NO: 740232 - RNA, 19 nt, Homo sapiens
ggacaaaugagauguuuau

SEQ ID NO: 740233 - RNA, 19 nt, Homo sapiens
caaauguccucgcauaguu

SEQ ID NO: 740234 - RNA, 19 nt, Homo sapiens
ggccgacacuucaacaaua

SEQ ID NO: 740235 - RNA, 19 nt, Homo sapiens
gaagaagucagcaaaauua

SEQ ID NO: 740236 - RNA, 19 nt, Homo sapiens
gcauucagcuggagagaga

SEQ ID NO: 740237 - RNA, 19 nt, Homo sapiens
caaacacccugagacaaua

SEQ ID NO: 740238 - RNA, 19 nt, Homo sapiens
gagaagggacuacuauaaa

SEQ ID NO: 740239 - RNA, 19 nt, Homo sapiens
caaccaaggucuguggaua

SEQ ID NO: 740240 - RNA, 19 nt, Homo sapiens
gauagaauauucacaggau

SEQ ID NO: 740241 - RNA, 19 nt, Homo sapiens
uaucagccaucuauaauga

SEQ ID NO: 740242 - RNA, 19 nt, Homo sapiens
gcaguuacuucuauccauu

SEQ ID NO: 740243 - RNA, 19 nt, Homo sapiens
gagaacauguuacaauauc

SEQ ID NO: 740244 - RNA, 19 nt, Homo sapiens
ucaaugaaguucuuagaga

SEQ ID NO: 740245 - RNA, 19 nt, Homo sapiens
gguauaagaugugcaauca

SEQ ID NO: 740246 - RNA, 19 nt, Homo sapiens
ucacauauuucucuuagga

SEQ ID NO: 740247 - RNA, 19 nt, Homo sapiens
gagcagaaagccuguuuaa

SEQ ID NO: 740248 - RNA, 19 nt, Homo sapiens
uagcacagaugguuaauuc

SEQ ID NO: 740249 - RNA, 19 nt, Homo sapiens
uuacaguggucucgaauuu

SEQ ID NO: 740250 - RNA, 19 nt, Homo sapiens
gaucauauaucccaagaac

SEQ ID NO: 740251 - RNA, 19 nt, Homo sapiens
gcagcaucaucaucuguua

SEQ ID NO: 740252 - RNA, 19 nt, Homo sapiens
gcaguaacaucacaacaca

SEQ ID NO: 740253 - RNA, 19 nt, Homo sapiens
guuuaaagcucaugcauca

SEQ ID NO: 740254 - RNA, 19 nt, Homo sapiens
cuacaaggcuagauggaaa

SEQ ID NO: 740255 - RNA, 19 nt, Homo sapiens
uauaagaugugcaaucaga

SEQ ID NO: 740256 - RNA, 19 nt, Homo sapiens
gaacuaacaaucccuacaa

SEQ ID NO: 740257 - RNA, 19 nt, Homo sapiens
acaaauggaugguuauuca

SEQ ID NO: 740258 - RNA, 19 nt, Homo sapiens
ucacucagaugcuaaaugu

SEQ ID NO: 740259 - RNA, 19 nt, Homo sapiens
gcuacuggacugcuuauua

SEQ ID NO: 740260 - RNA, 19 nt, Homo sapiens
uuaauaagguuggguguaa

SEQ ID NO: 740261 - RNA, 19 nt, Homo sapiens
ugaguaauguucaggaauu

SEQ ID NO: 740262 - RNA, 19 nt, Homo sapiens
ugaaucaccucaacuuaga

SEQ ID NO: 740263 - RNA, 19 nt, Homo sapiens
gaacaagggauagauuuau

SEQ ID NO: 740264 - RNA, 19 nt, Homo sapiens
ggaacuugguauuaacaaa

SEQ ID NO: 740265 - RNA, 19 nt, Homo sapiens
acagugaguuccgguauua

SEQ ID NO: 740266 - RNA, 19 nt, Homo sapiens
gauauuggccgacaaggaa

SEQ ID NO: 740267 - RNA, 19 nt, Homo sapiens
gaaagaagaugcagaaaac

SEQ ID NO: 740268 - RNA, 19 nt, Homo sapiens
ggaagaagacgaagaacau

SEQ ID NO: 740269 - RNA, 19 nt, Homo sapiens
ggauacagcuuauguuuug

SEQ ID NO: 740270 - RNA, 19 nt, Homo sapiens
caccacaccugaagauauu

SEQ ID NO: 740271 - RNA, 19 nt, Homo sapiens
gaacuugguaugaguaaug

SEQ ID NO: 740272 - RNA, 19 nt, Homo sapiens
caaauugagguguucuuua

SEQ ID NO: 740273 - RNA, 19 nt, Homo sapiens
augcaggucuguaauauaa

SEQ ID NO: 740274 - RNA, 19 nt, Homo sapiens
aaacuuacccaaagaacua

SEQ ID NO: 740275 - RNA, 19 nt, Homo sapiens
cuacuacccucucuuaugu

SEQ ID NO: 740276 - RNA, 19 nt, Homo sapiens
cagcgaccauugauucuuu

SEQ ID NO: 740277 - RNA, 19 nt, Homo sapiens
ccaagaauguuuagucuac

SEQ ID NO: 740278 - RNA, 19 nt, Homo sapiens
ggcaugagauucugaagug

SEQ ID NO: 740279 - RNA, 19 nt, Homo sapiens
aaacuaugacugugacuua

SEQ ID NO: 740280 - RNA, 19 nt, Homo sapiens
aaacuugaaucacugcaaa

SEQ ID NO: 740281 - RNA, 19 nt, Homo sapiens
gaacguagcaccugaagac

SEQ ID NO: 740282 - RNA, 19 nt, Homo sapiens
gaaaugaaacagaagaaca

SEQ ID NO: 740283 - RNA, 19 nt, Homo sapiens
guauucaggucauugugua

SEQ ID NO: 740284 - RNA, 19 nt, Homo sapiens
caccucaacuuagauauuu

SEQ ID NO: 740285 - RNA, 19 nt, Homo sapiens
gaguucagcugcagauaau

SEQ ID NO: 740286 - RNA, 19 nt, Homo sapiens
ucagacagaugaaggaguu

SEQ ID NO: 740287 - RNA, 19 nt, Homo sapiens
guccaaauguccucgcaua

SEQ ID NO: 740288 - RNA, 19 nt, Homo sapiens
gagaugcaggucuguaaua

SEQ ID NO: 740289 - RNA, 19 nt, Homo sapiens
ugaucaagaugaaagcaua

SEQ ID NO: 740290 - RNA, 19 nt, Homo sapiens
gaauagagguaucaaugac

SEQ ID NO: 740291 - RNA, 19 nt, Homo sapiens
caacaugacuuuucaggaa

SEQ ID NO: 740292 - RNA, 19 nt, Homo sapiens
ggaguaaggaucaguaugu

SEQ ID NO: 740293 - RNA, 19 nt, Homo sapiens
uuacaucccucugcucuuu

SEQ ID NO: 740294 - RNA, 19 nt, Homo sapiens
agagaugagugaaaucaaa

SEQ ID NO: 740295 - RNA, 19 nt, Homo sapiens
cgaaguguaugguugaaug

SEQ ID NO: 740296 - RNA, 19 nt, Homo sapiens
gaauugugcucugaugguu

SEQ ID NO: 740297 - RNA, 19 nt, Homo sapiens
guaaagaugcuuagaaguc

SEQ ID NO: 740298 - RNA, 19 nt, Homo sapiens
uaagaaagaagaugcagaa

SEQ ID NO: 740299 - RNA, 19 nt, Homo sapiens
gacaacaacuugcaaucau

SEQ ID NO: 740300 - RNA, 19 nt, Homo sapiens
ccaauucucuuugaguuau

SEQ ID NO: 740301 - RNA, 19 nt, Homo sapiens
caaaauaugugucugauag

SEQ ID NO: 740302 - RNA, 19 nt, Homo sapiens
gauagcaaguauucaggaa

SEQ ID NO: 740303 - RNA, 19 nt, Homo sapiens
agugaaaccucgauacauu

SEQ ID NO: 740304 - RNA, 19 nt, Homo sapiens
ggaguucagcugcagauaa

SEQ ID NO: 740305 - RNA, 19 nt, Homo sapiens
ccagugaaaucaaagacaa

SEQ ID NO: 740306 - RNA, 19 nt, Homo sapiens
gcaaagagaucaaugagaa

SEQ ID NO: 740307 - RNA, 19 nt, Homo sapiens
caucagagcuugugaauga

SEQ ID NO: 740308 - RNA, 19 nt, Homo sapiens
ucacagagcccuaacauua

SEQ ID NO: 740309 - RNA, 19 nt, Homo sapiens
cuacagagauuccuuauau

SEQ ID NO: 740310 - RNA, 19 nt, Homo sapiens
uaaggaagcuguacaaugu

SEQ ID NO: 740311 - RNA, 19 nt, Homo sapiens
gauaggaaguugugugaaa

SEQ ID NO: 740312 - RNA, 19 nt, Homo sapiens
gggcuuaccuuguggcaua

SEQ ID NO: 740313 - RNA, 19 nt, Homo sapiens
gaagaucgauggcucugaa

SEQ ID NO: 740314 - RNA, 19 nt, Homo sapiens
gaaccuauccucuguaaga

SEQ ID NO: 740315 - RNA, 19 nt, Homo sapiens
gaauguaaaucucuagguu

SEQ ID NO: 740316 - RNA, 19 nt, Homo sapiens
acacaaagguuucucugua

SEQ ID NO: 740317 - RNA, 19 nt, Homo sapiens
caucagacauuuccuuuga

SEQ ID NO: 740318 - RNA, 19 nt, Homo sapiens
gcagagaccuggagaagag

SEQ ID NO: 740319 - RNA, 19 nt, Homo sapiens
cagagaaaccugagaauuu

SEQ ID NO: 740320 - RNA, 19 nt, Homo sapiens
ggaggagacuugugcgaaa

SEQ ID NO: 740321 - RNA, 19 nt, Homo sapiens
caagggcacuccagaaaga

SEQ ID NO: 740322 - RNA, 19 nt, Homo sapiens
gaagcugugugucaucauu

SEQ ID NO: 740323 - RNA, 19 nt, Homo sapiens
ucacaccacucucaucaaa

SEQ ID NO: 740324 - RNA, 19 nt, Homo sapiens
caacuuuccugccaaugaa

SEQ ID NO: 740325 - RNA, 19 nt, Homo sapiens
ccagauaguuuauaugagu

SEQ ID NO: 740326 - RNA, 19 nt, Homo sapiens
gcagaaagaauguaaaucu

SEQ ID NO: 740327 - RNA, 19 nt, Homo sapiens
aucaagagcuuuccucaua

SEQ ID NO: 740328 - RNA, 19 nt, Homo sapiens
ugaguacccugaagauauu

SEQ ID NO: 740329 - RNA, 19 nt, Homo sapiens
gugaagggaucaugaccua

SEQ ID NO: 740330 - RNA, 19 nt, Homo sapiens
cagaaugccuaucaagcua

SEQ ID NO: 740331 - RNA, 19 nt, Homo sapiens
gaacaucccagcaucuuca

SEQ ID NO: 740332 - RNA, 19 nt, Homo sapiens
gagcuuuccucauaucuca

SEQ ID NO: 740333 - RNA, 19 nt, Homo sapiens
cagcagaguuccaagaugu

SEQ ID NO: 740334 - RNA, 19 nt, Homo sapiens
uaagucugcucccauugua

SEQ ID NO: 740335 - RNA, 19 nt, Homo sapiens
ggagagcaccaaagaaaga

SEQ ID NO: 740336 - RNA, 19 nt, Homo sapiens
ccucauaucucagaaccua

SEQ ID NO: 740337 - RNA, 19 nt, Homo sapiens
ggagaugccaguaggcuaa

SEQ ID NO: 740338 - RNA, 19 nt, Homo sapiens
gaucgugucugcccugcuu

SEQ ID NO: 740339 - RNA, 19 nt, Homo sapiens
aaaccgaaaugugaacuuu

SEQ ID NO: 740340 - RNA, 19 nt, Homo sapiens
gaaagucccugagcauguc

SEQ ID NO: 740341 - RNA, 19 nt, Homo sapiens
uaagauagcaucagagcuu

SEQ ID NO: 740342 - RNA, 19 nt, Homo sapiens
uggcagagcugggagauga

SEQ ID NO: 740343 - RNA, 19 nt, Homo sapiens
uaaggaagauaggaaguug

SEQ ID NO: 740344 - RNA, 19 nt, Homo sapiens
cauuguaggugaccaagaa

SEQ ID NO: 740345 - RNA, 19 nt, Homo sapiens
gaagggaucaugaccuaug

SEQ ID NO: 740346 - RNA, 19 nt, Homo sapiens
ucaguaagauagcaucaga

SEQ ID NO: 740347 - RNA, 19 nt, Homo sapiens
ccagaaagauugcauuuug

SEQ ID NO: 740348 - RNA, 19 nt, Homo sapiens
guucaaacccggagaauca

SEQ ID NO: 740349 - RNA, 19 nt, Homo sapiens
caaaguugaugucuauucu

SEQ ID NO: 740350 - RNA, 19 nt, Homo sapiens
gcaaggacguaaaauuaaa

SEQ ID NO: 740351 - RNA, 19 nt, Homo sapiens
agacaaggcugagaguuau

SEQ ID NO: 740352 - RNA, 19 nt, Homo sapiens
ccucacgaaucuagucaua

SEQ ID NO: 740353 - RNA, 19 nt, Homo sapiens
guacuacagagauuccuua

SEQ ID NO: 740354 - RNA, 19 nt, Homo sapiens
gugagcacauuaucaaaga

SEQ ID NO: 740355 - RNA, 19 nt, Homo sapiens
gccaugaaaucugaaacua

SEQ ID NO: 740356 - RNA, 19 nt, Homo sapiens
acaccacucucaucaaaga

SEQ ID NO: 740357 - RNA, 19 nt, Homo sapiens
caagcuauccauaaugaaa

SEQ ID NO: 740358 - RNA, 19 nt, Homo sapiens
aaacaaaugugucuaucag

SEQ ID NO: 740359 - RNA, 19 nt, Homo sapiens
gcaucuucauugacuuuaa

SEQ ID NO: 740360 - RNA, 19 nt, Homo sapiens
cagaagcuguccugcagaa

SEQ ID NO: 740361 - RNA, 19 nt, Homo sapiens
cgaugaaucuugccuuaag

SEQ ID NO: 740362 - RNA, 19 nt, Homo sapiens
gcauaaaacucagcagaaa

SEQ ID NO: 740363 - RNA, 19 nt, Homo sapiens
ugacaagccuccuucuaag

SEQ ID NO: 740364 - RNA, 19 nt, Homo sapiens
gcaaaguugaugucuauuc

SEQ ID NO: 740365 - RNA, 19 nt, Homo sapiens
gaagcuguccugcagaaug

SEQ ID NO: 740366 - RNA, 19 nt, Homo sapiens
aagacaaggcugagaguua

SEQ ID NO: 740367 - RNA, 19 nt, Homo sapiens
gaagaguacagcagaguuc

SEQ ID NO: 740368 - RNA, 19 nt, Homo sapiens
caagagcuuuccucauauc

SEQ ID NO: 740369 - RNA, 19 nt, Homo sapiens
gauagugaagacaacaaua

SEQ ID NO: 740370 - RNA, 19 nt, Homo sapiens
aaacucagcagaaagaaug

SEQ ID NO: 740371 - RNA, 19 nt, Homo sapiens
gaaagacaggguccagaug

SEQ ID NO: 740372 - RNA, 19 nt, Homo sapiens
gugguucacuauuccagua

SEQ ID NO: 740373 - RNA, 19 nt, Homo sapiens
aagguugacugguuacaaa

SEQ ID NO: 740374 - RNA, 19 nt, Homo sapiens
ucaagagcuuuccucauau

SEQ ID NO: 740375 - RNA, 19 nt, Homo sapiens
caaccuaacggacacaguu

SEQ ID NO: 740376 - RNA, 19 nt, Homo sapiens
caaugaaccuccuguagcu

SEQ ID NO: 740377 - RNA, 19 nt, Homo sapiens
ucaaggagagcaccaaaga

SEQ ID NO: 740378 - RNA, 19 nt, Homo sapiens
gagcucaaugucccuauuu

SEQ ID NO: 740379 - RNA, 19 nt, Homo sapiens
gaaaugagaggcacaucag

SEQ ID NO: 740380 - RNA, 19 nt, Homo sapiens
gacaugucaucuugugcua

SEQ ID NO: 740381 - RNA, 19 nt, Homo sapiens
ugucagcaaucacaaccua

SEQ ID NO: 740382 - RNA, 19 nt, Homo sapiens
cccgaugaaucuugccuua

SEQ ID NO: 740383 - RNA, 19 nt, Homo sapiens
aaugugaacuuugccauga

SEQ ID NO: 740384 - RNA, 19 nt, Homo sapiens
uguaauguuugccaagaaa

SEQ ID NO: 740385 - RNA, 19 nt, Homo sapiens
cuaacagugugguaucuga

SEQ ID NO: 740386 - RNA, 19 nt, Homo sapiens
cagaaaagguugacugguu

SEQ ID NO: 740387 - RNA, 19 nt, Homo sapiens
ggaacagccaguuaaggaa

SEQ ID NO: 740388 - RNA, 19 nt, Homo sapiens
guuugaaucucguaaugga

SEQ ID NO: 740389 - RNA, 19 nt, Homo sapiens
gaugacaagccuccuucua

SEQ ID NO: 740390 - RNA, 19 nt, Homo sapiens
aaggagagcaccaaagaaa

SEQ ID NO: 740391 - RNA, 19 nt, Homo sapiens
agaaaagguugacugguua

SEQ ID NO: 740392 - RNA, 19 nt, Homo sapiens
ccacggugauugucagcaa

SEQ ID NO: 740393 - RNA, 19 nt, Homo sapiens
gaacuuugccaugaaaucu

SEQ ID NO: 740394 - RNA, 19 nt, Homo sapiens
caggaaagcccaagacaag

SEQ ID NO: 740395 - RNA, 19 nt, Homo sapiens
auaaggaaguguuugaauc

SEQ ID NO: 740396 - RNA, 19 nt, Homo sapiens
cacaaagguuucucuguag

SEQ ID NO: 740397 - RNA, 19 nt, Homo sapiens
augcaaaguugaugucuau

SEQ ID NO: 740398 - RNA, 19 nt, Homo sapiens
ggccuucccagauaguuua

SEQ ID NO: 740399 - RNA, 19 nt, Homo sapiens
ccaugaaaucugaaacuaa

SEQ ID NO: 740400 - RNA, 19 nt, Homo sapiens
gagguggucucggaucuca

SEQ ID NO: 740401 - RNA, 19 nt, Homo sapiens
gugaaagacacaaccauug

SEQ ID NO: 740402 - RNA, 19 nt, Homo sapiens
gacuuuacggcuucuguua

SEQ ID NO: 740403 - RNA, 19 nt, Homo sapiens
guuucucuguagacuauua

SEQ ID NO: 740404 - RNA, 19 nt, Homo sapiens
uaacggacacaguucagaa

SEQ ID NO: 740405 - RNA, 19 nt, Homo sapiens
gaugaaucuugccuuaagu

SEQ ID NO: 740406 - RNA, 19 nt, Homo sapiens
gggaggagcugcagaugga

SEQ ID NO: 740407 - RNA, 19 nt, Homo sapiens
gcaacuauguguucguguu

SEQ ID NO: 740408 - RNA, 19 nt, Homo sapiens
ggagggaucccgccuuuga

SEQ ID NO: 740409 - RNA, 19 nt, Homo sapiens
gcagauggaacccguguga

SEQ ID NO: 740410 - RNA, 19 nt, Homo sapiens
gcagaaggaccagcagaaa

SEQ ID NO: 740411 - RNA, 19 nt, Homo sapiens
agaaggaccagcagaaaga

SEQ ID NO: 740412 - RNA, 19 nt, Homo sapiens
ccuguuacauucucuaucu

SEQ ID NO: 740413 - RNA, 19 nt, Homo sapiens
ccagagcaacuauguguuc

SEQ ID NO: 740414 - RNA, 19 nt, Homo sapiens
gaucccgccuuugaaaaua

SEQ ID NO: 740415 - RNA, 19 nt, Homo sapiens
gagcccagagcaucaguau

SEQ ID NO: 740416 - RNA, 19 nt, Homo sapiens
aguccaagcuugugcucuu

SEQ ID NO: 740417 - RNA, 19 nt, Homo sapiens
uacgcaacguggaguacua

SEQ ID NO: 740418 - RNA, 19 nt, Homo sapiens
guccaagcuugugcucuuu

SEQ ID NO: 740419 - RNA, 19 nt, Homo sapiens
uaccagagcaacuaugugu

SEQ ID NO: 740420 - RNA, 19 nt, Homo sapiens
guacuaccagagcaacuau

SEQ ID NO: 740421 - RNA, 19 nt, Homo sapiens
caacuauguguucguguuc

SEQ ID NO: 740422 - RNA, 19 nt, Homo sapiens
gagggaucccgccuuugaa

SEQ ID NO: 740423 - RNA, 19 nt, Homo sapiens
gaacccgugugaggugucu

SEQ ID NO: 740424 - RNA, 19 nt, Homo sapiens
gaaggaccagcagaaagau

SEQ ID NO: 740425 - RNA, 19 nt, Homo sapiens
ggaccagcagcgcuucuca

SEQ ID NO: 740426 - RNA, 19 nt, Homo sapiens
cagaaggaccagcagaaag

SEQ ID NO: 740427 - RNA, 19 nt, Homo sapiens
caacaucucugccaaguau

SEQ ID NO: 740428 - RNA, 19 nt, Homo sapiens
cagcauaucuuugugaauu

SEQ ID NO: 740429 - RNA, 19 nt, Homo sapiens
cgaagaaacuccagaacug

SEQ ID NO: 740430 - RNA, 19 nt, Homo sapiens
ucacuaagcccuucacaaa

SEQ ID NO: 740431 - RNA, 19 nt, Homo sapiens
ggacaguucuucagcaaca

SEQ ID NO: 740432 - RNA, 19 nt, Homo sapiens
caacaucuccggcaucuug

SEQ ID NO: 740433 - RNA, 19 nt, Homo sapiens
ugaagaaugugaccuacaa

SEQ ID NO: 740434 - RNA, 19 nt, Homo sapiens
ugaaauugaugcaguccua

SEQ ID NO: 740435 - RNA, 19 nt, Homo sapiens
aagggaagauucucuguuu

SEQ ID NO: 740436 - RNA, 19 nt, Homo sapiens
ccaacaagacccagauuaa

SEQ ID NO: 740437 - RNA, 19 nt, Homo sapiens
aaaguuaucagccaaauug

SEQ ID NO: 740438 - RNA, 19 nt, Homo sapiens
cggcuacacugauagauga

SEQ ID NO: 740439 - RNA, 19 nt, Homo sapiens
ugagaccuuugauaacaua

SEQ ID NO: 740440 - RNA, 19 nt, Homo sapiens
uaaccaagauugaacuucu

SEQ ID NO: 740441 - RNA, 19 nt, Homo sapiens
gaacgucaaucaccaacac

SEQ ID NO: 740442 - RNA, 19 nt, Homo sapiens
agaagaccaucaacacuga

SEQ ID NO: 740443 - RNA, 19 nt, Homo sapiens
gagaucauaacccagcuua

SEQ ID NO: 740444 - RNA, 19 nt, Homo sapiens
agcaacagcucuauuaugu

SEQ ID NO: 740445 - RNA, 19 nt, Homo sapiens
ucucggauuucucuacuuu

SEQ ID NO: 740446 - RNA, 19 nt, Homo sapiens
gggaucaaguggucagaga

SEQ ID NO: 740447 - RNA, 19 nt, Homo sapiens
aaauugcaaugaacgauga

SEQ ID NO: 740448 - RNA, 19 nt, Homo sapiens
gggauugggagauugauuu

SEQ ID NO: 740449 - RNA, 19 nt, Homo sapiens
ucaacuggcuguccguguu

SEQ ID NO: 740450 - RNA, 19 nt, Homo sapiens
ccugagaccuuugauaaca

SEQ ID NO: 740451 - RNA, 19 nt, Homo sapiens
gcauaucuuugugaauuuc

SEQ ID NO: 740452 - RNA, 19 nt, Homo sapiens
gaaauugaugcaguccuaa

SEQ ID NO: 740453 - RNA, 19 nt, Homo sapiens
cagauuaacgucacuguuc

SEQ ID NO: 740454 - RNA, 19 nt, Homo sapiens
gaucaaguggucagagaga

SEQ ID NO: 740455 - RNA, 19 nt, Homo sapiens
gauaacauaaccauuagca

SEQ ID NO: 740456 - RNA, 19 nt, Homo sapiens
aggagaacaucgccaaaug

SEQ ID NO: 740457 - RNA, 19 nt, Homo sapiens
gagcuuccacuucaagaau

SEQ ID NO: 740458 - RNA, 19 nt, Homo sapiens
gagccacuguccaugacuu

SEQ ID NO: 740459 - RNA, 19 nt, Homo sapiens
gcaaagagaccaacaaaac

SEQ ID NO: 740460 - RNA, 19 nt, Homo sapiens
gccagcauaucuuugugaa

SEQ ID NO: 740461 - RNA, 19 nt, Homo sapiens
caggacaguucuucagcaa

SEQ ID NO: 740462 - RNA, 19 nt, Homo sapiens
gcaccuguaaccaagauug

SEQ ID NO: 740463 - RNA, 19 nt, Homo sapiens
caacacugauuuccccuuu

SEQ ID NO: 740464 - RNA, 19 nt, Homo sapiens
cuccacggcuacacugaua

SEQ ID NO: 740465 - RNA, 19 nt, Homo sapiens
gggaugccgucgucuccaa

SEQ ID NO: 740466 - RNA, 19 nt, Homo sapiens
gcaacaucucugccaagua

SEQ ID NO: 740467 - RNA, 19 nt, Homo sapiens
gagagggcuuauccacuca

SEQ ID NO: 740468 - RNA, 19 nt, Homo sapiens
ggucgccacugucaucaag

SEQ ID NO: 740469 - RNA, 19 nt, Homo sapiens
gcaggucgccacugucauc

SEQ ID NO: 740470 - RNA, 19 nt, Homo sapiens
ucagccaaauugcaaugaa

SEQ ID NO: 740471 - RNA, 19 nt, Homo sapiens
caugguguccucuucauug

SEQ ID NO: 740472 - RNA, 19 nt, Homo sapiens
cagcaacagcucuauuaug

SEQ ID NO: 740473 - RNA, 19 nt, Homo sapiens
caagggauugggagauuga

SEQ ID NO: 740474 - RNA, 19 nt, Homo sapiens
ggaaucggcgugauaacca

SEQ ID NO: 740475 - RNA, 19 nt, Homo sapiens
ccaugaagaaugugaccua

SEQ ID NO: 740476 - RNA, 19 nt, Homo sapiens
aagcaaagagaccaacaaa

SEQ ID NO: 740477 - RNA, 19 nt, Homo sapiens
gauuuuacuucucggauuu

SEQ ID NO: 740478 - RNA, 19 nt, Homo sapiens
gagauuugcuccccauuag

SEQ ID NO: 740479 - RNA, 19 nt, Homo sapiens
caacaagacccagauuaac

SEQ ID NO: 740480 - RNA, 19 nt, Homo sapiens
guccaugacuucuucaacu

SEQ ID NO: 740481 - RNA, 19 nt, Homo sapiens
gaucggagugaguucagaa

SEQ ID NO: 740482 - RNA, 19 nt, Homo sapiens
cuccugagaccuuugauaa

SEQ ID NO: 740483 - RNA, 19 nt, Homo sapiens
cagaugcgcugcugcuacu

SEQ ID NO: 740484 - RNA, 19 nt, Homo sapiens
gaaucggcgugauaaccau

SEQ ID NO: 740485 - RNA, 19 nt, Homo sapiens
gugguugccugaucaugau

SEQ ID NO: 740486 - RNA, 19 nt, Homo sapiens
ggucagagagagacaccaa

SEQ ID NO: 740487 - RNA, 19 nt, Homo sapiens
gaaccuacccacucuucag

SEQ ID NO: 740488 - RNA, 19 nt, Homo sapiens
guuaucagccaaauugcaa

SEQ ID NO: 740489 - RNA, 19 nt, Homo sapiens
gauucucuguuucuuccaa

SEQ ID NO: 740490 - RNA, 19 nt, Homo sapiens
gggaagauucucuguuucu

SEQ ID NO: 740491 - RNA, 19 nt, Homo sapiens
gcuccugagaccuuugaua

SEQ ID NO: 740492 - RNA, 19 nt, Homo sapiens
cgaaugcacggccuuguag

SEQ ID NO: 740493 - RNA, 19 nt, Homo sapiens
ccgaaugcacggccuugua

SEQ ID NO: 740494 - RNA, 19 nt, Homo sapiens
ggcaccaucuugcucauac

SEQ ID NO: 740495 - RNA, 19 nt, Homo sapiens
cccauuaccucgagaucau

SEQ ID NO: 740496 - RNA, 19 nt, Homo sapiens
gaacuucugccguccuacu

SEQ ID NO: 740497 - RNA, 19 nt, Homo sapiens
caagaagaccaucaacacu

SEQ ID NO: 740498 - RNA, 19 nt, Homo sapiens
ggagaacaucgccaaaugc

SEQ ID NO: 740499 - RNA, 19 nt, Homo sapiens
ggagagcuuccacuucaag

SEQ ID NO: 740500 - RNA, 19 nt, Homo sapiens
acuguucccucgacugcua

SEQ ID NO: 740501 - RNA, 19 nt, Homo sapiens
caggagccacuguccauga

SEQ ID NO: 740502 - RNA, 19 nt, Homo sapiens
uaacacugaggcaccugua

SEQ ID NO: 740503 - RNA, 19 nt, Homo sapiens
uucagcaacagcucuauua

SEQ ID NO: 740504 - RNA, 19 nt, Homo sapiens
ugauagaugagcccacuga

SEQ ID NO: 740505 - RNA, 19 nt, Homo sapiens
ggaugguccuugaguuuug

SEQ ID NO: 740506 - RNA, 19 nt, Homo sapiens
ucaagaagaccaucaacac

SEQ ID NO: 740507 - RNA, 19 nt, Homo sapiens
ucgccacugucaucaagaa

SEQ ID NO: 740508 - RNA, 19 nt, Homo sapiens
ucaagauccugggcucugu

SEQ ID NO: 740509 - RNA, 19 nt, Homo sapiens
caaggagaacaucgccaaa

SEQ ID NO: 740510 - RNA, 19 nt, Homo sapiens
gcaugguguccucuucauu

SEQ ID NO: 740511 - RNA, 19 nt, Homo sapiens
ggagauugauuuuacuucu

SEQ ID NO: 740512 - RNA, 19 nt, Homo sapiens
ccacugucaucaagaagac

SEQ ID NO: 740513 - RNA, 19 nt, Homo sapiens
acuaagcccuucacaaagc

SEQ ID NO: 740514 - RNA, 19 nt, Homo sapiens
ggagaucggagugaguuca

SEQ ID NO: 740515 - RNA, 19 nt, Homo sapiens
gucaaucaccaacacuauu

SEQ ID NO: 740516 - RNA, 19 nt, Homo sapiens
caaagggaagauucucugu

SEQ ID NO: 740517 - RNA, 19 nt, Homo sapiens
acauaaccauuagcagaga

SEQ ID NO: 740518 - RNA, 19 nt, Homo sapiens
ccucuucauugcucacugu

SEQ ID NO: 740519 - RNA, 19 nt, Homo sapiens
caacaaaacagauaacacu

SEQ ID NO: 740520 - RNA, 19 nt, Homo sapiens
agaaugugaccuacaagga

SEQ ID NO: 740521 - RNA, 19 nt, Homo sapiens
uucugaaagucaucacuaa

SEQ ID NO: 740522 - RNA, 19 nt, Homo sapiens
cggagugaguucagaagag

SEQ ID NO: 740523 - RNA, 19 nt, Homo sapiens
ucagcaugguguccucuuc

SEQ ID NO: 740524 - RNA, 19 nt, Homo sapiens
acagcucuauuauguccaa

SEQ ID NO: 740525 - RNA, 19 nt, Homo sapiens
ccacggcuacacugauaga

SEQ ID NO: 740526 - RNA, 19 nt, Homo sapiens
aaagggaagauucucuguu

SEQ ID NO: 740527 - RNA, 19 nt, Homo sapiens
caaagaagaugaccagaga

SEQ ID NO: 740528 - RNA, 19 nt, Homo sapiens
cgaaagagcaguucagaua

SEQ ID NO: 740529 - RNA, 19 nt, Homo sapiens
uaauauagcuccagaugaa

SEQ ID NO: 740530 - RNA, 19 nt, Homo sapiens
ggaaggagauuguuaacuc

SEQ ID NO: 740531 - RNA, 19 nt, Homo sapiens
gaagauaaauaugcagaug

SEQ ID NO: 740532 - RNA, 19 nt, Homo sapiens
gaagaaggagcuagaagaa

SEQ ID NO: 740533 - RNA, 19 nt, Homo sapiens
caagauagaugcagcugau

SEQ ID NO: 740534 - RNA, 19 nt, Homo sapiens
cagaagaccauccaagaua

SEQ ID NO: 740535 - RNA, 19 nt, Homo sapiens
gaaagaauccagaugaagu

SEQ ID NO: 740536 - RNA, 19 nt, Homo sapiens
ggagccaaauuuacaggua

SEQ ID NO: 740537 - RNA, 19 nt, Homo sapiens
gaaagaagaaggagcuaga

SEQ ID NO: 740538 - RNA, 19 nt, Homo sapiens
ggaggcauauagaaugaaa

SEQ ID NO: 740539 - RNA, 19 nt, Homo sapiens
gaaauggaggcauauagaa

SEQ ID NO: 740540 - RNA, 19 nt, Homo sapiens
caaauucugccuacuauga

SEQ ID NO: 740541 - RNA, 19 nt, Homo sapiens
ggaaauggaggcauauaga

SEQ ID NO: 740542 - RNA, 19 nt, Homo sapiens
gaaagaaagcauccuggaa

SEQ ID NO: 740543 - RNA, 19 nt, Homo sapiens
ugacaugccuggacagaau

SEQ ID NO: 740544 - RNA, 19 nt, Homo sapiens
ggaaccaaauucucagaug

SEQ ID NO: 740545 - RNA, 19 nt, Homo sapiens
gggcaaugcuccugcagaa

SEQ ID NO: 740546 - RNA, 19 nt, Homo sapiens
gaaaugaguuuggaagaac

SEQ ID NO: 740547 - RNA, 19 nt, Homo sapiens
ucaaagaacagcagaaaga

SEQ ID NO: 740548 - RNA, 19 nt, Homo sapiens
gaaacuccaagaggaauua

SEQ ID NO: 740549 - RNA, 19 nt, Homo sapiens
ggaagcggccuuacaauag

SEQ ID NO: 740550 - RNA, 19 nt, Homo sapiens
ucauggagcugcaucaaga

SEQ ID NO: 740551 - RNA, 19 nt, Homo sapiens
ggaauuagccucaggaaaa

SEQ ID NO: 740552 - RNA, 19 nt, Homo sapiens
ugaagaguaugccaaaguu

SEQ ID NO: 740553 - RNA, 19 nt, Homo sapiens
gaagagggaucgguggaau

SEQ ID NO: 740554 - RNA, 19 nt, Homo sapiens
agagaggacuggagaaaga

SEQ ID NO: 740555 - RNA, 19 nt, Homo sapiens
ucugaggaguguauuauaa

SEQ ID NO: 740556 - RNA, 19 nt, Homo sapiens
aaagaaagcauccuggaaa

SEQ ID NO: 740557 - RNA, 19 nt, Homo sapiens
caagggaucugaagugcau

SEQ ID NO: 740558 - RNA, 19 nt, Homo sapiens
gaucugaagugcaucuaca

SEQ ID NO: 740559 - RNA, 19 nt, Homo sapiens
gagaagaggaaccaaauuc

SEQ ID NO: 740560 - RNA, 19 nt, Homo sapiens
caacugauguuugacuaug

SEQ ID NO: 740561 - RNA, 19 nt, Homo sapiens
agaaggagcuagaagaaca

SEQ ID NO: 740562 - RNA, 19 nt, Homo sapiens
aagaggaaauggaggcaua

SEQ ID NO: 740563 - RNA, 19 nt, Homo sapiens
ucagugccaugguauauug

SEQ ID NO: 740564 - RNA, 19 nt, Homo sapiens
gaaggagauuguuaacucu

SEQ ID NO: 740565 - RNA, 19 nt, Homo sapiens
ggaugaagauaaauaugca

SEQ ID NO: 740566 - RNA, 19 nt, Homo sapiens
gaagaaccaaagaagauga

SEQ ID NO: 740567 - RNA, 19 nt, Homo sapiens
uauaaguccuucaaaguca

SEQ ID NO: 740568 - RNA, 19 nt, Homo sapiens
gaagaacacaugaaaauug

SEQ ID NO: 740569 - RNA, 19 nt, Homo sapiens
gaauccagaugaagugagu

SEQ ID NO: 740570 - RNA, 19 nt, Homo sapiens
gagauuggcuuggauucug

SEQ ID NO: 740571 - RNA, 19 nt, Homo sapiens
agaaaugaguuuggaagaa

SEQ ID NO: 740572 - RNA, 19 nt, Homo sapiens
gaaagagcaguucagauag

SEQ ID NO: 740573 - RNA, 19 nt, Homo sapiens
guacacaggagauaccauu

SEQ ID NO: 740574 - RNA, 19 nt, Homo sapiens
gaagaugaggaugaagaua

SEQ ID NO: 740575 - RNA, 19 nt, Homo sapiens
cagcucaucuggagaaugg

SEQ ID NO: 740576 - RNA, 19 nt, Homo sapiens
aaaguaugguggccaagaa

SEQ ID NO: 740577 - RNA, 19 nt, Homo sapiens
gaacauugaaagcccagaa

SEQ ID NO: 740578 - RNA, 19 nt, Homo sapiens
gcaaugcuccugcagaagu

SEQ ID NO: 740579 - RNA, 19 nt, Homo sapiens
gcuguugccugcucuaagu

SEQ ID NO: 740580 - RNA, 19 nt, Homo sapiens
gcaaugagagagaauccuu

SEQ ID NO: 740581 - RNA, 19 nt, Homo sapiens
agaugaggaugaagauaaa

SEQ ID NO: 740582 - RNA, 19 nt, Homo sapiens
ggagaagaggaaccaaauu

SEQ ID NO: 740583 - RNA, 19 nt, Homo sapiens
gaacauguccagccucaac

SEQ ID NO: 740584 - RNA, 19 nt, Homo sapiens
cugcagaaguugaugaaga

SEQ ID NO: 740585 - RNA, 19 nt, Homo sapiens
agaugcagcugauacauuc

SEQ ID NO: 740586 - RNA, 19 nt, Homo sapiens
caggaaagaauccagauga

SEQ ID NO: 740587 - RNA, 19 nt, Homo sapiens
guucagauagugaugauga

SEQ ID NO: 740588 - RNA, 19 nt, Homo sapiens
cuagagcuguuguauaagu

SEQ ID NO: 740589 - RNA, 19 nt, Homo sapiens
aagaugaggaugaagauaa

SEQ ID NO: 740590 - RNA, 19 nt, Homo sapiens
ccagagaccacaaccagaa

SEQ ID NO: 740591 - RNA, 19 nt, Homo sapiens
agaaguugaugaagaagga

SEQ ID NO: 740592 - RNA, 19 nt, Homo sapiens
agauagugaugaugaagaa

SEQ ID NO: 740593 - RNA, 19 nt, Homo sapiens
aaagagcaguucagauagu

SEQ ID NO: 740594 - RNA, 19 nt, Homo sapiens
caaaugcugucacucuuuu

SEQ ID NO: 740595 - RNA, 19 nt, Homo sapiens
caaagaacagcagaaagaa

SEQ ID NO: 740596 - RNA, 19 nt, Homo sapiens
cacaggagauaccauuuca

SEQ ID NO: 740597 - RNA, 19 nt, Homo sapiens
gaagcggccuuacaauagc

SEQ ID NO: 740598 - RNA, 19 nt, Homo sapiens
ggauacaaaugcugucacu

SEQ ID NO: 740599 - RNA, 19 nt, Homo sapiens
gaagauccacaaucacaca

SEQ ID NO: 740600 - RNA, 19 nt, Homo sapiens
gaagaccauccaagauaga

SEQ ID NO: 740601 - RNA, 19 nt, Homo sapiens
gaauuacuguccggaaucu

SEQ ID NO: 740602 - RNA, 19 nt, Homo sapiens
caaaggagcaugugaaaau

SEQ ID NO: 740603 - RNA, 19 nt, Homo sapiens
ugcagaaguugaugaagaa

SEQ ID NO: 740604 - RNA, 19 nt, Homo sapiens
agaagaccauccaagauag

SEQ ID NO: 740605 - RNA, 19 nt, Homo sapiens
ggaagaaccaaagaagaug

SEQ ID NO: 740606 - RNA, 19 nt, Homo sapiens
ugagagaccuaggcgaguu

SEQ ID NO: 740607 - RNA, 19 nt, Homo sapiens
gcugggaaggagauuguua

SEQ ID NO: 740608 - RNA, 19 nt, Homo sapiens
gcucagacacaguuguuug

SEQ ID NO: 740609 - RNA, 19 nt, Homo sapiens
caaugagagagaauccuua

SEQ ID NO: 740610 - RNA, 19 nt, Homo sapiens
ugaggaauuuagauccaaa

SEQ ID NO: 740611 - RNA, 19 nt, Homo sapiens
gaagaggaaccaaauucuc

SEQ ID NO: 740612 - RNA, 19 nt, Homo sapiens
guggaguacucaagacaug

SEQ ID NO: 740613 - RNA, 19 nt, Homo sapiens
guauaaguccuucaaaguc

SEQ ID NO: 740614 - RNA, 19 nt, Homo sapiens
caaugcuccugcagaaguu

SEQ ID NO: 740615 - RNA, 19 nt, Homo sapiens
gggagaagaggaaccaaau

SEQ ID NO: 740616 - RNA, 19 nt, Homo sapiens
gaagaguaugccaaaguug

SEQ ID NO: 740617 - RNA, 19 nt, Homo sapiens
uggcuacaauccagaagaa

SEQ ID NO: 740618 - RNA, 19 nt, Homo sapiens
guaugaaacucgagaaccu

SEQ ID NO: 740619 - RNA, 19 nt, Homo sapiens
aggaagcggccuuacaaua

SEQ ID NO: 740620 - RNA, 19 nt, Homo sapiens
ggaaagaauccagaugaag

SEQ ID NO: 740621 - RNA, 19 nt, Homo sapiens
gaggaaauggaggcauaua

SEQ ID NO: 740622 - RNA, 19 nt, Homo sapiens
ucaaggagaccaugcagau

SEQ ID NO: 740623 - RNA, 19 nt, Homo sapiens
caggagauaccauuucaau

SEQ ID NO: 740624 - RNA, 19 nt, Homo sapiens
aggaaagaauccagaugaa

SEQ ID NO: 740625 - RNA, 19 nt, Homo sapiens
gagaauccuuaugccaaug

SEQ ID NO: 740626 - RNA, 19 nt, Homo sapiens
caugucagccacaguugua

SEQ ID NO: 740627 - RNA, 19 nt, Homo sapiens
cguggaagauggcuugaua

SEQ ID NO: 740628 - RNA, 19 nt, Homo sapiens
gaagauggcuugauaaaac

SEQ ID NO: 740629 - RNA, 19 nt, Homo sapiens
caccuaagcuuccauguag

SEQ ID NO: 740630 - RNA, 19 nt, Homo sapiens
gaaccaccaugaucuugga

SEQ ID NO: 740631 - RNA, 19 nt, Homo sapiens
gaaucaggcccauuaaaga

SEQ ID NO: 740632 - RNA, 19 nt, Homo sapiens
gcaacaggcuggcggagau

SEQ ID NO: 740633 - RNA, 19 nt, Homo sapiens
gaacguggaguacaacauc

SEQ ID NO: 740634 - RNA, 19 nt, Homo sapiens
ggaagauggacgagaauga

SEQ ID NO: 740635 - RNA, 19 nt, Homo sapiens
gugggaggaucgugaauga

SEQ ID NO: 740636 - RNA, 19 nt, Homo sapiens
uacgagaucuucagcauca

SEQ ID NO: 740637 - RNA, 19 nt, Homo sapiens
uagcagcuuuguacacuga

SEQ ID NO: 740638 - RNA, 19 nt, Homo sapiens
gccaagacccacaaucuga

SEQ ID NO: 740639 - RNA, 19 nt, Homo sapiens
gaucuuggaccacgucuuc

SEQ ID NO: 740640 - RNA, 19 nt, Homo sapiens
ucacacuacuggagcaaga

SEQ ID NO: 740641 - RNA, 19 nt, Homo sapiens
gcaggaggaaccaccauga

SEQ ID NO: 740642 - RNA, 19 nt, Homo sapiens
uuaaagacgucuggguuug

SEQ ID NO: 740643 - RNA, 19 nt, Homo sapiens
gcacagcacagaagaucau

SEQ ID NO: 740644 - RNA, 19 nt, Homo sapiens
gaaugacgaccaguccuuu

SEQ ID NO: 740645 - RNA, 19 nt, Homo sapiens
gaaggugcuuggcggucuu

SEQ ID NO: 740646 - RNA, 19 nt, Homo sapiens
gacaccggcugacgacuuc

SEQ ID NO: 740647 - RNA, 19 nt, Homo sapiens
aaagacgucuggguuugaa

SEQ ID NO: 740648 - RNA, 19 nt, Homo sapiens
ggaggaaccaccaugaucu

SEQ ID NO: 740649 - RNA, 19 nt, Homo sapiens
caguacaaaugcugccaaa

SEQ ID NO: 740650 - RNA, 19 nt, Homo sapiens
gcagcgacagccagaugua

SEQ ID NO: 740651 - RNA, 19 nt, Homo sapiens
acacuguccucuuauuaca

SEQ ID NO: 740652 - RNA, 19 nt, Homo sapiens
ugaaucaggcccauuaaag

SEQ ID NO: 740653 - RNA, 19 nt, Homo sapiens
gcuccaacaucaccucucu

SEQ ID NO: 740654 - RNA, 19 nt, Homo sapiens
aaacauucccggacuuugu

SEQ ID NO: 740655 - RNA, 19 nt, Homo sapiens
gaagauggacgagaaugag

SEQ ID NO: 740656 - RNA, 19 nt, Homo sapiens
acaccuaagcuuccaugua

SEQ ID NO: 740657 - RNA, 19 nt, Homo sapiens
guacaaaugcugccaaaau

SEQ ID NO: 740658 - RNA, 19 nt, Homo sapiens
ccacauggcagggacaaug

SEQ ID NO: 740659 - RNA, 19 nt, Homo sapiens
cugggaagauggacgagaa

SEQ ID NO: 740660 - RNA, 19 nt, Homo sapiens
uaaagacgucuggguuuga

SEQ ID NO: 740661 - RNA, 19 nt, Homo sapiens
cagaccaccucaccugcuu

SEQ ID NO: 740662 - RNA, 19 nt, Homo sapiens
gcagagggguggucguguu

SEQ ID NO: 740663 - RNA, 19 nt, Homo sapiens
uggaggcccuggucaagga

SEQ ID NO: 740664 - RNA, 19 nt, Homo sapiens
gaggaaccaccaugaucuu

SEQ ID NO: 740665 - RNA, 19 nt, Homo sapiens
uggaagauggcuugauaaa

SEQ ID NO: 740666 - RNA, 19 nt, Homo sapiens
gaaguuuugcgauccuuua

SEQ ID NO: 740667 - RNA, 19 nt, Homo sapiens
ccaagacccacaaucugaa

SEQ ID NO: 740668 - RNA, 19 nt, Homo sapiens
ggcaugagagcaucaagga

SEQ ID NO: 740669 - RNA, 19 nt, Homo sapiens
gugaaucaggcccauuaaa

SEQ ID NO: 740670 - RNA, 19 nt, Homo sapiens
gaaaacauucccggacuuu

SEQ ID NO: 740671 - RNA, 19 nt, Homo sapiens
ggaggacgggaagauguuu

SEQ ID NO: 740672 - RNA, 19 nt, Homo sapiens
uccguaggcuucuuaguag

SEQ ID NO: 740673 - RNA, 19 nt, Homo sapiens
uuccguaggcuucuuagua

SEQ ID NO: 740674 - RNA, 19 nt, Homo sapiens
ucaccucucucuccuagac

SEQ ID NO: 740675 - RNA, 19 nt, Homo sapiens
gcguugacguccacacaag

SEQ ID NO: 740676 - RNA, 19 nt, Homo sapiens
ucgcaggccugggaggaaa

SEQ ID NO: 740677 - RNA, 19 nt, Homo sapiens
gaguggcugugggcucuga

SEQ ID NO: 740678 - RNA, 19 nt, Homo sapiens
uguacgagaucuucagcau

SEQ ID NO: 740679 - RNA, 19 nt, Homo sapiens
gauggacgagaaugaguuc

SEQ ID NO: 740680 - RNA, 19 nt, Homo sapiens
ggacccaucagaacuuggu

SEQ ID NO: 740681 - RNA, 19 nt, Homo sapiens
caagagccccucaagagaa

SEQ ID NO: 740682 - RNA, 19 nt, Homo sapiens
cgacgcacagcacagaaga

SEQ ID NO: 740683 - RNA, 19 nt, Homo sapiens
gacgggaagauguuuguca

SEQ ID NO: 740684 - RNA, 19 nt, Homo sapiens
ggaagauggcuugauaaaa

SEQ ID NO: 740685 - RNA, 19 nt, Homo sapiens
ucgauggucugggagaaau

SEQ ID NO: 740686 - RNA, 19 nt, Homo sapiens
ggacaacuucgcgcugauc

SEQ ID NO: 740687 - RNA, 19 nt, Homo sapiens
agaaggcugugggcaagga

SEQ ID NO: 740688 - RNA, 19 nt, Homo sapiens
acagccagauguacgagau

SEQ ID NO: 740689 - RNA, 19 nt, Homo sapiens
gaacuccuuccuggucuuc

SEQ ID NO: 740690 - RNA, 19 nt, Homo sapiens
ugaaugacgaccaguccuu

SEQ ID NO: 740691 - RNA, 19 nt, Homo sapiens
ugacaccggcugacgacuu

SEQ ID NO: 740692 - RNA, 19 nt, Homo sapiens
guccucuuauuacagauug

SEQ ID NO: 740693 - RNA, 19 nt, Homo sapiens
guggaagauggcuugauaa

SEQ ID NO: 740694 - RNA, 19 nt, Homo sapiens
cuucagggacccaucagaa

SEQ ID NO: 740695 - RNA, 19 nt, Homo sapiens
gaggugggaggaucgugaa

SEQ ID NO: 740696 - RNA, 19 nt, Homo sapiens
caaacugcccgcuguacgu

SEQ ID NO: 740697 - RNA, 19 nt, Homo sapiens
cuuaguagcagcuuuguac

SEQ ID NO: 740698 - RNA, 19 nt, Homo sapiens
gauaaaacaaaucggagaa

SEQ ID NO: 740699 - RNA, 19 nt, Homo sapiens
gugcgcaaccuacaucagu

SEQ ID NO: 740700 - RNA, 19 nt, Homo sapiens
cgagggcaccaacggcauu

SEQ ID NO: 740701 - RNA, 19 nt, Homo sapiens
ccgcagccuucgucacauc

SEQ ID NO: 740702 - RNA, 19 nt, Homo sapiens
gugcagcgacagccagaug

SEQ ID NO: 740703 - RNA, 19 nt, Homo sapiens
uacaaaugcugccaaaauc

SEQ ID NO: 740704 - RNA, 19 nt, Homo sapiens
gaugugcacguggaagaug

SEQ ID NO: 740705 - RNA, 19 nt, Homo sapiens
ucaaggagaagggugugaa

SEQ ID NO: 740706 - RNA, 19 nt, Homo sapiens
uaaacaggcuggugaauua

SEQ ID NO: 740707 - RNA, 19 nt, Homo sapiens
gauaggagcaacccuguaa

SEQ ID NO: 740708 - RNA, 19 nt, Homo sapiens
gcaguaaccaguucaaguu

SEQ ID NO: 740709 - RNA, 19 nt, Homo sapiens
gacauuagauccaggagau

SEQ ID NO: 740710 - RNA, 19 nt, Homo sapiens
gaggagauguuucauuguc

SEQ ID NO: 740711 - RNA, 19 nt, Homo sapiens
gcuggaggauuguaaaugu

SEQ ID NO: 740712 - RNA, 19 nt, Homo sapiens
gaugacuccuccaagauga

SEQ ID NO: 740713 - RNA, 19 nt, Homo sapiens
agaagaggaugacauuaga

SEQ ID NO: 740714 - RNA, 19 nt, Homo sapiens
ccaagaagaggaugacauu

SEQ ID NO: 740715 - RNA, 19 nt, Homo sapiens
gagaauugguguaagacau

SEQ ID NO: 740716 - RNA, 19 nt, Homo sapiens
gcagugagccgagaucaug

SEQ ID NO: 740717 - RNA, 19 nt, Homo sapiens
gcagugcucacgccuguaa

SEQ ID NO: 740718 - RNA, 19 nt, Homo sapiens
agacaucacaaucccauua

SEQ ID NO: 740719 - RNA, 19 nt, Homo sapiens
ggaugccugugaagaaaga

SEQ ID NO: 740720 - RNA, 19 nt, Homo sapiens
gugaacagcuacuacucuu

SEQ ID NO: 740721 - RNA, 19 nt, Homo sapiens
cuaagaaacuucacaucag

SEQ ID NO: 740722 - RNA, 19 nt, Homo sapiens
guacuuggagaacuuacua

SEQ ID NO: 740723 - RNA, 19 nt, Homo sapiens
guaaccaguucaaguugga

SEQ ID NO: 740724 - RNA, 19 nt, Homo sapiens
caagugcaguaaccaguuc

SEQ ID NO: 740725 - RNA, 19 nt, Homo sapiens
gcucacgccuguaauacca

SEQ ID NO: 740726 - RNA, 19 nt, Homo sapiens
ggccugcacuccacacaau

SEQ ID NO: 740727 - RNA, 19 nt, Homo sapiens
gcaggaagaauugcuugaa

SEQ ID NO: 740728 - RNA, 19 nt, Homo sapiens
caagaagaggaugacauua

SEQ ID NO: 740729 - RNA, 19 nt, Homo sapiens
ggaagugugucuuuugaau

SEQ ID NO: 740730 - RNA, 19 nt, Homo sapiens
aaaccagccuuagacuauu

SEQ ID NO: 740731 - RNA, 19 nt, Homo sapiens
uccugaagcuuccuaagaa

SEQ ID NO: 740732 - RNA, 19 nt, Homo sapiens
caaaacuccaucucuauua

SEQ ID NO: 740733 - RNA, 19 nt, Homo sapiens
aaacuagccuggccaacgu

SEQ ID NO: 740734 - RNA, 19 nt, Homo sapiens
ggaugacuccuccaagaug

SEQ ID NO: 740735 - RNA, 19 nt, Homo sapiens
gaauugguguaagacauca

SEQ ID NO: 740736 - RNA, 19 nt, Homo sapiens
ccuaagaaacuucacauca

SEQ ID NO: 740737 - RNA, 19 nt, Homo sapiens
gaagcuuccuaagaaacuu

SEQ ID NO: 740738 - RNA, 19 nt, Homo sapiens
ccagggaacuccgaugaag

SEQ ID NO: 740739 - RNA, 19 nt, Homo sapiens
ccugaagcuuccuaagaaa

SEQ ID NO: 740740 - RNA, 19 nt, Homo sapiens
caucacaaucccauuauuc

SEQ ID NO: 740741 - RNA, 19 nt, Homo sapiens
ccgcccaguuugagaauug

SEQ ID NO: 740742 - RNA, 19 nt, Homo sapiens
uuugagaauugguguaaga

SEQ ID NO: 740743 - RNA, 19 nt, Homo sapiens
aaccagccuuagacuauuu

SEQ ID NO: 740744 - RNA, 19 nt, Homo sapiens
gcaaaacuccaucucuauu

SEQ ID NO: 740745 - RNA, 19 nt, Homo sapiens
cacuugaggucaggaguuu

SEQ ID NO: 740746 - RNA, 19 nt, Homo sapiens
gaacuuacuacgucuagcu

SEQ ID NO: 740747 - RNA, 19 nt, Homo sapiens
gaagaggaugacauuagau

SEQ ID NO: 740748 - RNA, 19 nt, Homo sapiens
gagcaacccuguaaaacca

SEQ ID NO: 740749 - RNA, 19 nt, Homo sapiens
gaggcaggcggaucacuug

SEQ ID NO: 740750 - RNA, 19 nt, Homo sapiens
guggguacuuggagaacuu

SEQ ID NO: 740751 - RNA, 19 nt, Homo sapiens
aagaagaggaugacauuag

SEQ ID NO: 740752 - RNA, 19 nt, Homo sapiens
cacaaucccauuauucaga

SEQ ID NO: 740753 - RNA, 19 nt, Homo sapiens
ggagaacuuacuacgucua

SEQ ID NO: 740754 - RNA, 19 nt, Homo sapiens
uaccagaucuccgucaagu

SEQ ID NO: 740755 - RNA, 19 nt, Homo sapiens
uuaaacaggcuggugaauu

SEQ ID NO: 740756 - RNA, 19 nt, Homo sapiens
cuggaggauuguaaaugua

SEQ ID NO: 740757 - RNA, 19 nt, Homo sapiens
ucaaggaggugaaaaugau

SEQ ID NO: 740758 - RNA, 19 nt, Homo sapiens
gaugugauccgugugaaca

SEQ ID NO: 740759 - RNA, 19 nt, Homo sapiens
ggauaggagcaacccugua

SEQ ID NO: 740760 - RNA, 19 nt, Homo sapiens
caggaagaauugcuugaac

SEQ ID NO: 740761 - RNA, 19 nt, Homo sapiens
acacaaugcaacagaguga

SEQ ID NO: 740762 - RNA, 19 nt, Homo sapiens
gacaucacaaucccauuau

SEQ ID NO: 740763 - RNA, 19 nt, Homo sapiens
gguguaagacaucacaauc

SEQ ID NO: 740764 - RNA, 19 nt, Homo sapiens
acgucuagcuggaggauug

SEQ ID NO: 740765 - RNA, 19 nt, Homo sapiens
gucgagagcagucaugaug

SEQ ID NO: 740766 - RNA, 19 nt, Homo sapiens
uggcaaaacuccaucucua

SEQ ID NO: 740767 - RNA, 19 nt, Homo sapiens
gugucuagcucaagaacuc

SEQ ID NO: 740768 - RNA, 19 nt, Homo sapiens
gauacaacagaggagauaa

SEQ ID NO: 740769 - RNA, 19 nt, Homo sapiens
guccugaagcuuccuaaga

SEQ ID NO: 740770 - RNA, 19 nt, Homo sapiens
ccagggaaacucauucaag

SEQ ID NO: 740771 - RNA, 19 nt, Homo sapiens
ggaguggaaacgcuuguag

SEQ ID NO: 740772 - RNA, 19 nt, Homo sapiens
acaucacaaucccauuauu

SEQ ID NO: 740773 - RNA, 19 nt, Homo sapiens
gagaacuuacuacgucuag

SEQ ID NO: 740774 - RNA, 19 nt, Homo sapiens
ugaguccgguggguacuug

SEQ ID NO: 740775 - RNA, 19 nt, Homo sapiens
gaugauuauaggacaaguu

SEQ ID NO: 740776 - RNA, 19 nt, Homo sapiens
caggaugauuauaggacaa

SEQ ID NO: 740777 - RNA, 19 nt, Homo sapiens
acaaugcaacagagugaaa

SEQ ID NO: 740778 - RNA, 19 nt, Homo sapiens
cagcuacuacucuugguau

SEQ ID NO: 740779 - RNA, 19 nt, Homo sapiens
ggaacuccgaugaaguguu

SEQ ID NO: 740780 - RNA, 19 nt, Homo sapiens
uguaauaccagcacuuugg

SEQ ID NO: 740781 - RNA, 19 nt, Homo sapiens
agauacaacagaggagaua

SEQ ID NO: 740782 - RNA, 19 nt, Homo sapiens
gagauacaacagaggagau

SEQ ID NO: 740783 - RNA, 19 nt, Homo sapiens
ucaagugcaguaaccaguu

SEQ ID NO: 740784 - RNA, 19 nt, Homo sapiens
acaaagucguggacaacca

SEQ ID NO: 740785 - RNA, 19 nt, Homo sapiens
gccgaggcaggaagaauug

SEQ ID NO: 740786 - RNA, 19 nt, Homo sapiens
ccuguaauaccagcacuuu

SEQ ID NO: 740787 - RNA, 19 nt, Homo sapiens
ggaagaauugcuugaaccu

SEQ ID NO: 740788 - RNA, 19 nt, Homo sapiens
ucacuugaggucaggaguu

SEQ ID NO: 740789 - RNA, 19 nt, Homo sapiens
gaaccaagaagaggaugac

SEQ ID NO: 740790 - RNA, 19 nt, Homo sapiens
aaacaaagucguggacaac

SEQ ID NO: 740791 - RNA, 19 nt, Homo sapiens
gcgagugaaccaagaagag

SEQ ID NO: 740792 - RNA, 19 nt, Homo sapiens
guucugcuucuuuggugua

SEQ ID NO: 740793 - RNA, 19 nt, Homo sapiens
aaaacaaagucguggacaa

SEQ ID NO: 740794 - RNA, 19 nt, Homo sapiens
aaaaccagccuuagacuau

SEQ ID NO: 740795 - RNA, 19 nt, Homo sapiens
gugggaggauggugauugc

SEQ ID NO: 740796 - RNA, 19 nt, Homo sapiens
gcagugacauguacgagaa

SEQ ID NO: 740797 - RNA, 19 nt, Homo sapiens
ggacugcagugacauguac

SEQ ID NO: 740798 - RNA, 19 nt, Homo sapiens
ccuaaugacagaaugaaua

SEQ ID NO: 740799 - RNA, 19 nt, Homo sapiens
ugaaggcugugccgucguu

SEQ ID NO: 740800 - RNA, 19 nt, Homo sapiens
cgcaggaggucuucgagaa

SEQ ID NO: 740801 - RNA, 19 nt, Homo sapiens
caccagcugugccauguuc

SEQ ID NO: 740802 - RNA, 19 nt, Homo sapiens
uagcguccauugccuguuc

SEQ ID NO: 740803 - RNA, 19 nt, Homo sapiens
ugacauguacgagaaagug

SEQ ID NO: 740804 - RNA, 19 nt, Homo sapiens
gugggcagaugcugauugg

SEQ ID NO: 740805 - RNA, 19 nt, Homo sapiens
gaccaagcgacuccuguuc

SEQ ID NO: 740806 - RNA, 19 nt, Homo sapiens
cccaaagccuggcccuaca

SEQ ID NO: 740807 - RNA, 19 nt, Homo sapiens
gcagugacauguacgagaa

SEQ ID NO: 740808 - RNA, 19 nt, Homo sapiens
ggacugcagugacauguac

SEQ ID NO: 740809 - RNA, 19 nt, Homo sapiens
ccuaaugacagaaugaaua

SEQ ID NO: 740810 - RNA, 19 nt, Homo sapiens
caccagcugugccauguuc

SEQ ID NO: 740811 - RNA, 19 nt, Homo sapiens
uagcguccauugccuguuc

SEQ ID NO: 740812 - RNA, 19 nt, Homo sapiens
ugacauguacgagaaagug

SEQ ID NO: 740813 - RNA, 19 nt, Homo sapiens
ccaagaggcugaagaaagu

SEQ ID NO: 740814 - RNA, 19 nt, Homo sapiens
ccaaauauaugccaacaac

SEQ ID NO: 740815 - RNA, 19 nt, Homo sapiens
gaccugugcuccaaguuug

SEQ ID NO: 740816 - RNA, 19 nt, Homo sapiens
gauccugggccaaauauau

SEQ ID NO: 740817 - RNA, 19 nt, Homo sapiens
ggaccugugcuccaaguuu

SEQ ID NO: 740818 - RNA, 19 nt, Homo sapiens
gggcagccaucuacgacaa

SEQ ID NO: 740819 - RNA, 19 nt, Homo sapiens
gugagauccuggacaagaa

SEQ ID NO: 740820 - RNA, 19 nt, Homo sapiens
acagugagauccuggacaa

SEQ ID NO: 740821 - RNA, 19 nt, Homo sapiens
ggaagccacagcuguuuga

SEQ ID NO: 740822 - RNA, 19 nt, Homo sapiens
cgacaaguacaaggaauuu

SEQ ID NO: 740823 - RNA, 19 nt, Homo sapiens
cgagaguucuacagugaga

SEQ ID NO: 740824 - RNA, 19 nt, Homo sapiens
gggccaaguucaagaucaa

SEQ ID NO: 740825 - RNA, 19 nt, Homo sapiens
cgaugccucuacacaagua

SEQ ID NO: 740826 - RNA, 19 nt, Homo sapiens
ccacucccgugcacuauag

SEQ ID NO: 740827 - RNA, 19 nt, Homo sapiens
gccaggcccuuugcacuga

SEQ ID NO: 740828 - RNA, 19 nt, Homo sapiens
ggaggaggccauugagaag

SEQ ID NO: 740829 - RNA, 19 nt, Homo sapiens
gaggaccugugcuccaagu

SEQ ID NO: 740830 - RNA, 19 nt, Homo sapiens
aaauauaugccaacaacga

SEQ ID NO: 740831 - RNA, 19 nt, Homo sapiens
ggaggagaaggacccugua

SEQ ID NO: 740832 - RNA, 19 nt, Homo sapiens
gcccauucccaucuacuuu

SEQ ID NO: 740833 - RNA, 19 nt, Homo sapiens
gaccaacaggcccagcuuu

SEQ ID NO: 740834 - RNA, 19 nt, Homo sapiens
agcgagaguucuacaguga

SEQ ID NO: 740835 - RNA, 19 nt, Homo sapiens
ggccaaauauaugccaaca

SEQ ID NO: 740836 - RNA, 19 nt, Homo sapiens
guggguggauccugguuuc

SEQ ID NO: 740837 - RNA, 19 nt, Homo sapiens
cuuacgggcucgacuuuua

SEQ ID NO: 740838 - RNA, 19 nt, Homo sapiens
uggaggaggccauugagaa

SEQ ID NO: 740839 - RNA, 19 nt, Homo sapiens
gcagccaucuacgacaagu

SEQ ID NO: 740840 - RNA, 19 nt, Homo sapiens
cgcgaugccucuacacaag

SEQ ID NO: 740841 - RNA, 19 nt, Homo sapiens
cuacgacaaguacaaggaa

SEQ ID NO: 740842 - RNA, 19 nt, Homo sapiens
ucuccaagaggcugaagaa

SEQ ID NO: 740843 - RNA, 19 nt, Homo sapiens
gcuggauccugggccaaau

SEQ ID NO: 740844 - RNA, 19 nt, Homo sapiens
ggacauugcugacaacuuu

SEQ ID NO: 740845 - RNA, 19 nt, Homo sapiens
gaaagacaaugcugagaua

SEQ ID NO: 740846 - RNA, 19 nt, Homo sapiens
ccaaguaccugcgggauua

SEQ ID NO: 740847 - RNA, 19 nt, Homo sapiens
ccacaaacauucucaacaa

SEQ ID NO: 740848 - RNA, 19 nt, Homo sapiens
gaucgugucuguagaugaa

SEQ ID NO: 740849 - RNA, 19 nt, Homo sapiens
ggagggccaucaagaauga

SEQ ID NO: 740850 - RNA, 19 nt, Homo sapiens
gaagaaggcagauaaagug

SEQ ID NO: 740851 - RNA, 19 nt, Homo sapiens
gcaaagcaacaauuucuaa

SEQ ID NO: 740852 - RNA, 19 nt, Homo sapiens
gcaacaauuucuaaugaug

SEQ ID NO: 740853 - RNA, 19 nt, Homo sapiens
ccacccagcuggcaguuaa

SEQ ID NO: 740854 - RNA, 19 nt, Homo sapiens
uagagaagauccaucauuc

SEQ ID NO: 740855 - RNA, 19 nt, Homo sapiens
ugaauaagcuuccaaaaug

SEQ ID NO: 740856 - RNA, 19 nt, Homo sapiens
gauaagaguccacacaguu

SEQ ID NO: 740857 - RNA, 19 nt, Homo sapiens
gaucugaagaggacaauga

SEQ ID NO: 740858 - RNA, 19 nt, Homo sapiens
ggaacauucucuaugacaa

SEQ ID NO: 740859 - RNA, 19 nt, Homo sapiens
gaguagacaucaacaacga

SEQ ID NO: 740860 - RNA, 19 nt, Homo sapiens
agacaaugcugagauaaga

SEQ ID NO: 740861 - RNA, 19 nt, Homo sapiens
ugaugaugcucgaugauuu

SEQ ID NO: 740862 - RNA, 19 nt, Homo sapiens
ugacaaugcuggcuuugau

SEQ ID NO: 740863 - RNA, 19 nt, Homo sapiens
ccacaccaguuauccuauu

SEQ ID NO: 740864 - RNA, 19 nt, Homo sapiens
gaucaucauucgagcuuuc

SEQ ID NO: 740865 - RNA, 19 nt, Homo sapiens
guucugugcuggccgagua

SEQ ID NO: 740866 - RNA, 19 nt, Homo sapiens
ccacacaguugaggauuau

SEQ ID NO: 740867 - RNA, 19 nt, Homo sapiens
gaggcgagagguacaauuu

SEQ ID NO: 740868 - RNA, 19 nt, Homo sapiens
gcugguagcugguguugca

SEQ ID NO: 740869 - RNA, 19 nt, Homo sapiens
gaugccagguguuugaaga

SEQ ID NO: 740870 - RNA, 19 nt, Homo sapiens
gaauaagcuuccaaaauga

SEQ ID NO: 740871 - RNA, 19 nt, Homo sapiens
cauucucuaugacaaguua

SEQ ID NO: 740872 - RNA, 19 nt, Homo sapiens
gaugauuugcugcagcuua

SEQ ID NO: 740873 - RNA, 19 nt, Homo sapiens
gccaagacaugcaccuuca

SEQ ID NO: 740874 - RNA, 19 nt, Homo sapiens
ccacaauucugaaacuucu

SEQ ID NO: 740875 - RNA, 19 nt, Homo sapiens
ccaaaguugucuuguccaa

SEQ ID NO: 740876 - RNA, 19 nt, Homo sapiens
gguguugcauucaagaaga

SEQ ID NO: 740877 - RNA, 19 nt, Homo sapiens
ggugguggaugcagugaug

SEQ ID NO: 740878 - RNA, 19 nt, Homo sapiens
ggugauugcugaggcugua

SEQ ID NO: 740879 - RNA, 19 nt, Homo sapiens
gagccaaaguugucuuguc

SEQ ID NO: 740880 - RNA, 19 nt, Homo sapiens
aguggaacauucucuauga

SEQ ID NO: 740881 - RNA, 19 nt, Homo sapiens
gcugacaacuuugaagcuu

SEQ ID NO: 740882 - RNA, 19 nt, Homo sapiens
ccaguuauccuauugaaag

SEQ ID NO: 740883 - RNA, 19 nt, Homo sapiens
gaaacccuauguggaggaa

SEQ ID NO: 740884 - RNA, 19 nt, Homo sapiens
ugaaacuucuugauguugu

SEQ ID NO: 740885 - RNA, 19 nt, Homo sapiens
caagacaugcaccuucauu

SEQ ID NO: 740886 - RNA, 19 nt, Homo sapiens
guugaaagcugagaaagac

SEQ ID NO: 740887 - RNA, 19 nt, Homo sapiens
guggagcccucgaggauuc

SEQ ID NO: 740888 - RNA, 19 nt, Homo sapiens
aaaguugucuuguccaaac

SEQ ID NO: 740889 - RNA, 19 nt, Homo sapiens
gaacauucucuaugacaag

SEQ ID NO: 740890 - RNA, 19 nt, Homo sapiens
gaugcugaguggaacauuc

SEQ ID NO: 740891 - RNA, 19 nt, Homo sapiens
gaugaugcucgaugauuug

SEQ ID NO: 740892 - RNA, 19 nt, Homo sapiens
agaggaagcugcuggaaaa

SEQ ID NO: 740893 - RNA, 19 nt, Homo sapiens
gcaguuaacaagaucaaag

SEQ ID NO: 740894 - RNA, 19 nt, Homo sapiens
cgggauuacucaaggacua

SEQ ID NO: 740895 - RNA, 19 nt, Homo sapiens
cgaggauucucagcuggua

SEQ ID NO: 740896 - RNA, 19 nt, Homo sapiens
ugaagaaggcagauaaagu

SEQ ID NO: 740897 - RNA, 19 nt, Homo sapiens
uggcuugguuacuucauuu

SEQ ID NO: 740898 - RNA, 19 nt, Homo sapiens
caaacauucucaacaagcu

SEQ ID NO: 740899 - RNA, 19 nt, Homo sapiens
gaaacuucuugauguuguc

SEQ ID NO: 740900 - RNA, 19 nt, Homo sapiens
ucugaaacuucuugauguu

SEQ ID NO: 740901 - RNA, 19 nt, Homo sapiens
gguauggaguagacaucaa

SEQ ID NO: 740902 - RNA, 19 nt, Homo sapiens
cuugcuggcugcagaguuu

SEQ ID NO: 740903 - RNA, 19 nt, Homo sapiens
uccacacaguugaggauua

SEQ ID NO: 740904 - RNA, 19 nt, Homo sapiens
caccaguuauccuauugaa

SEQ ID NO: 740905 - RNA, 19 nt, Homo sapiens
gauggcaccaccucaguga

SEQ ID NO: 740906 - RNA, 19 nt, Homo sapiens
gauuaucaggcaauuguug

SEQ ID NO: 740907 - RNA, 19 nt, Homo sapiens
gguagcugguguugcauuc

SEQ ID NO: 740908 - RNA, 19 nt, Homo sapiens
ggaagcugcuggaaaagug

SEQ ID NO: 740909 - RNA, 19 nt, Homo sapiens
gcccacaccaguuauccua

SEQ ID NO: 740910 - RNA, 19 nt, Homo sapiens
ucaggagggccaucaagaa

SEQ ID NO: 740911 - RNA, 19 nt, Homo sapiens
uuagagaagauccaucauu

SEQ ID NO: 740912 - RNA, 19 nt, Homo sapiens
uaugacaaguuagagaaga

SEQ ID NO: 740913 - RNA, 19 nt, Homo sapiens
uagcugguguugcauucaa

SEQ ID NO: 740914 - RNA, 19 nt, Homo sapiens
augauuugcugcagcuuaa

SEQ ID NO: 740915 - RNA, 19 nt, Homo sapiens
cagaggaagcugcuggaaa

SEQ ID NO: 740916 - RNA, 19 nt, Homo sapiens
caaggaagggguaguaauu

SEQ ID NO: 740917 - RNA, 19 nt, Homo sapiens
gcgccgagcaguuuaugga

SEQ ID NO: 740918 - RNA, 19 nt, Homo sapiens
caguuauccuauugaaaga

SEQ ID NO: 740919 - RNA, 19 nt, Homo sapiens
gggauguggccacccagua

SEQ ID NO: 740920 - RNA, 19 nt, Homo sapiens
agaggcaaagcaacaauuu

SEQ ID NO: 740921 - RNA, 19 nt, Homo sapiens
cagugaugaugcucgauga

SEQ ID NO: 740922 - RNA, 19 nt, Homo sapiens
ugguagacauugccaaauc

SEQ ID NO: 740923 - RNA, 19 nt, Homo sapiens
ggcaaagcaacaauuucua

SEQ ID NO: 740924 - RNA, 19 nt, Homo sapiens
cacaccaguuauccuauug

SEQ ID NO: 740925 - RNA, 19 nt, Homo sapiens
gagcggucccugcaugaug

SEQ ID NO: 740926 - RNA, 19 nt, Homo sapiens
gaguggaacauucucuaug

SEQ ID NO: 740927 - RNA, 19 nt, Homo sapiens
uaagaguccacacaguuga

SEQ ID NO: 740928 - RNA, 19 nt, Homo sapiens
gagaaagacaaugcugaga

SEQ ID NO: 740929 - RNA, 19 nt, Homo sapiens
guuaacaagaucaaagaga

SEQ ID NO: 740930 - RNA, 19 nt, Homo sapiens
gcuauggugcggaucaaug

SEQ ID NO: 740931 - RNA, 19 nt, Homo sapiens
cugacaacuuugaagcuuu

SEQ ID NO: 740932 - RNA, 19 nt, Homo sapiens
cacaaacauucucaacaag

SEQ ID NO: 740933 - RNA, 19 nt, Homo sapiens
gugugacaaugcuggcuuu

SEQ ID NO: 740934 - RNA, 19 nt, Homo sapiens
gaaagcugagaaagacaau

SEQ ID NO: 740935 - RNA, 19 nt, Homo sapiens
caucaacaacgaggacauu

SEQ ID NO: 740936 - RNA, 19 nt, Homo sapiens
ggccacaauucugaaacuu

SEQ ID NO: 740937 - RNA, 19 nt, Homo sapiens
caggagggccaucaagaau

SEQ ID NO: 740938 - RNA, 19 nt, Homo sapiens
cgaguugaaagcugagaaa

SEQ ID NO: 740939 - RNA, 19 nt, Homo sapiens
gggccacaauucugaaacu

SEQ ID NO: 740940 - RNA, 19 nt, Homo sapiens
acgaggacauugcugacaa

SEQ ID NO: 740941 - RNA, 19 nt, Homo sapiens
ccgaguaccugaggaggau

SEQ ID NO: 740942 - RNA, 19 nt, Homo sapiens
agaaagacaaugcugagau

SEQ ID NO: 740943 - RNA, 19 nt, Homo sapiens
ugaaagcugagaaagacaa

SEQ ID NO: 740944 - RNA, 19 nt, Homo sapiens
gaaaauagaugauguggua

SEQ ID NO: 740945 - RNA, 19 nt, Homo sapiens
gaagagagagccuauauuu

SEQ ID NO: 740946 - RNA, 19 nt, Homo sapiens
gcauuacacuuucugaaua

SEQ ID NO: 740947 - RNA, 19 nt, Homo sapiens
aaacagacauggauaauca

SEQ ID NO: 740948 - RNA, 19 nt, Homo sapiens
gcauuugccugaaguugua

SEQ ID NO: 740949 - RNA, 19 nt, Homo sapiens
gcauugaaaucuugacuga

SEQ ID NO: 740950 - RNA, 19 nt, Homo sapiens
caaaggugguuucucagua

SEQ ID NO: 740951 - RNA, 19 nt, Homo sapiens
ggaagaagaucaccuuggu

SEQ ID NO: 740952 - RNA, 19 nt, Homo sapiens
gguaaacacucgauaaucu

SEQ ID NO: 740953 - RNA, 19 nt, Homo sapiens
ugacagagaaacuuuguua

SEQ ID NO: 740954 - RNA, 19 nt, Homo sapiens
gagaagacauugaauucau

SEQ ID NO: 740955 - RNA, 19 nt, Homo sapiens
cuaacaaacuggugauuga

SEQ ID NO: 740956 - RNA, 19 nt, Homo sapiens
gcaaacugcucaagauuac

SEQ ID NO: 740957 - RNA, 19 nt, Homo sapiens
gcugagcgcuccauucaug

SEQ ID NO: 740958 - RNA, 19 nt, Homo sapiens
ggugguauuuccaacauuu

SEQ ID NO: 740959 - RNA, 19 nt, Homo sapiens
caugaugcccuauguguua

SEQ ID NO: 740960 - RNA, 19 nt, Homo sapiens
gcuggguucugcugaguua

SEQ ID NO: 740961 - RNA, 19 nt, Homo sapiens
gucuaaggcucaagauaua

SEQ ID NO: 740962 - RNA, 19 nt, Homo sapiens
gagaagagagagccuauau

SEQ ID NO: 740963 - RNA, 19 nt, Homo sapiens
uaaaugcagugaugaaagu

SEQ ID NO: 740964 - RNA, 19 nt, Homo sapiens
gaacugagugacagagaaa

SEQ ID NO: 740965 - RNA, 19 nt, Homo sapiens
ggaacugagugacagagaa

SEQ ID NO: 740966 - RNA, 19 nt, Homo sapiens
gaagauuauuuccucugaa

SEQ ID NO: 740967 - RNA, 19 nt, Homo sapiens
uaacugacuagcaccauua

SEQ ID NO: 740968 - RNA, 19 nt, Homo sapiens
agaguuggcccuagcauua

SEQ ID NO: 740969 - RNA, 19 nt, Homo sapiens
gaucuugcauuacacuuuc

SEQ ID NO: 740970 - RNA, 19 nt, Homo sapiens
guuauucguuguuuaguga

SEQ ID NO: 740971 - RNA, 19 nt, Homo sapiens
ggcaaacugcucaagauua

SEQ ID NO: 740972 - RNA, 19 nt, Homo sapiens
cugaggaggucaauuuaaa

SEQ ID NO: 740973 - RNA, 19 nt, Homo sapiens
ccaauuuacugcugacaug

SEQ ID NO: 740974 - RNA, 19 nt, Homo sapiens
ugaaagagaagacauugaa

SEQ ID NO: 740975 - RNA, 19 nt, Homo sapiens
agagagagccuauauuuua

SEQ ID NO: 740976 - RNA, 19 nt, Homo sapiens
gaguguaaaugcagugaug

SEQ ID NO: 740977 - RNA, 19 nt, Homo sapiens
caagccaguugcucauauu

SEQ ID NO: 740978 - RNA, 19 nt, Homo sapiens
gagagagccuauauuuuaa

SEQ ID NO: 740979 - RNA, 19 nt, Homo sapiens
gaggucaauuuaaaugguu

SEQ ID NO: 740980 - RNA, 19 nt, Homo sapiens
gaauauucacgaacacuga

SEQ ID NO: 740981 - RNA, 19 nt, Homo sapiens
ggaggucaauuuaaauggu

SEQ ID NO: 740982 - RNA, 19 nt, Homo sapiens
uagcugaggaggucaauuu

SEQ ID NO: 740983 - RNA, 19 nt, Homo sapiens
aaaggugguuucucaguau

SEQ ID NO: 740984 - RNA, 19 nt, Homo sapiens
ucgauaaucuggauaacug

SEQ ID NO: 740985 - RNA, 19 nt, Homo sapiens
uuagugaucuugcauuaca

SEQ ID NO: 740986 - RNA, 19 nt, Homo sapiens
ucuuagugaucuugcauua

SEQ ID NO: 740987 - RNA, 19 nt, Homo sapiens
agauugggcuuauucaguu

SEQ ID NO: 740988 - RNA, 19 nt, Homo sapiens
ggacaauugaugacuguga

SEQ ID NO: 740989 - RNA, 19 nt, Homo sapiens
ccaagccaguugcucauau

SEQ ID NO: 740990 - RNA, 19 nt, Homo sapiens
gccugaaguuguauugaaa

SEQ ID NO: 740991 - RNA, 19 nt, Homo sapiens
ugagugguauggaauccua

SEQ ID NO: 740992 - RNA, 19 nt, Homo sapiens
gaaagagaagacauugaau

SEQ ID NO: 740993 - RNA, 19 nt, Homo sapiens
caagucugcuuucuccaau

SEQ ID NO: 740994 - RNA, 19 nt, Homo sapiens
aaagggcauugaaaucuug

SEQ ID NO: 740995 - RNA, 19 nt, Homo sapiens
gaggaggucaauuuaaaug

SEQ ID NO: 740996 - RNA, 19 nt, Homo sapiens
uauuguggcuggaauggaa

SEQ ID NO: 740997 - RNA, 19 nt, Homo sapiens
acaaacuggugauugaaga

SEQ ID NO: 740998 - RNA, 19 nt, Homo sapiens
uugcuuaucugcucccaaa

SEQ ID NO: 740999 - RNA, 19 nt, Homo sapiens
cagauccgcuucagcaaca

SEQ ID NO: 741000 - RNA, 19 nt, Homo sapiens
caucauuucugagucauuc

SEQ ID NO: 741001 - RNA, 19 nt, Homo sapiens
ccauuaugaucaccaguau

SEQ ID NO: 741002 - RNA, 19 nt, Homo sapiens
gugcuaccauucugaaaca

SEQ ID NO: 741003 - RNA, 19 nt, Homo sapiens
gauugggcuuauucaguuu

SEQ ID NO: 741004 - RNA, 19 nt, Homo sapiens
gcccuagcauuaacugaau

SEQ ID NO: 741005 - RNA, 19 nt, Homo sapiens
gcugaggaggucaauuuaa

SEQ ID NO: 741006 - RNA, 19 nt, Homo sapiens
uaaucuggauaacugacua

SEQ ID NO: 741007 - RNA, 19 nt, Homo sapiens
gaaacuguucggagcauuc

SEQ ID NO: 741008 - RNA, 19 nt, Homo sapiens
aaaggugauguaaccauua

SEQ ID NO: 741009 - RNA, 19 nt, Homo sapiens
ugucuaaggcucaagauau

SEQ ID NO: 741010 - RNA, 19 nt, Homo sapiens
ggucauuccaucuacacua

SEQ ID NO: 741011 - RNA, 19 nt, Homo sapiens
ggaggucauuccaucuaca

SEQ ID NO: 741012 - RNA, 19 nt, Homo sapiens
caaaugcaaguauuacauc

SEQ ID NO: 741013 - RNA, 19 nt, Homo sapiens
cuaccauucugaaacaaau

SEQ ID NO: 741014 - RNA, 19 nt, Homo sapiens
gacagagaaacuuuguuaa

SEQ ID NO: 741015 - RNA, 19 nt, Homo sapiens
ccacaucaguagucaucau

SEQ ID NO: 741016 - RNA, 19 nt, Homo sapiens
uacaguaacagaacuaaga

SEQ ID NO: 741017 - RNA, 19 nt, Homo sapiens
agguggugcuccagaaaua

SEQ ID NO: 741018 - RNA, 19 nt, Homo sapiens
aagagaagacauugaauuc

SEQ ID NO: 741019 - RNA, 19 nt, Homo sapiens
aaucuugacugacaugucu

SEQ ID NO: 741020 - RNA, 19 nt, Homo sapiens
ugccugaaguuguauugaa

SEQ ID NO: 741021 - RNA, 19 nt, Homo sapiens
aaucccauuucuacaguaa

SEQ ID NO: 741022 - RNA, 19 nt, Homo sapiens
guaaaugcagugaugaaag

SEQ ID NO: 741023 - RNA, 19 nt, Homo sapiens
cugacuagcaccauuauga

SEQ ID NO: 741024 - RNA, 19 nt, Homo sapiens
gaagcugagcgcuccauuc

SEQ ID NO: 741025 - RNA, 19 nt, Homo sapiens
auugaaaucuugacugaca

SEQ ID NO: 741026 - RNA, 19 nt, Homo sapiens
gggcuuggucuuccaguug

SEQ ID NO: 741027 - RNA, 19 nt, Homo sapiens
uuuaaaugguucuggcaaa

SEQ ID NO: 741028 - RNA, 19 nt, Homo sapiens
cauggauaaucaaauagug

SEQ ID NO: 741029 - RNA, 19 nt, Homo sapiens
gaaaagggcauugaaaucu

SEQ ID NO: 741030 - RNA, 19 nt, Homo sapiens
gaguuggcccuagcauuaa

SEQ ID NO: 741031 - RNA, 19 nt, Homo sapiens
uaacaaacuggugauugaa

SEQ ID NO: 741032 - RNA, 19 nt, Homo sapiens
uggcauaaccagaguugaa

SEQ ID NO: 741033 - RNA, 19 nt, Homo sapiens
agugucaaauucuggcaua

SEQ ID NO: 741034 - RNA, 19 nt, Homo sapiens
aaacugcaggcauuaaugu

SEQ ID NO: 741035 - RNA, 19 nt, Homo sapiens
agucugcuuucuccaauga

SEQ ID NO: 741036 - RNA, 19 nt, Homo sapiens
ugagugacagagaaacuuu

SEQ ID NO: 741037 - RNA, 19 nt, Homo sapiens
uggcuggaauggaagaaga

SEQ ID NO: 741038 - RNA, 19 nt, Homo sapiens
guaaacacucgauaaucug

SEQ ID NO: 741039 - RNA, 19 nt, Homo sapiens
gucauuccaucuacacuag

SEQ ID NO: 741040 - RNA, 19 nt, Homo sapiens
ggcauaaccagaguugaaa

SEQ ID NO: 741041 - RNA, 19 nt, Homo sapiens
uagaugaugugguaaacac

SEQ ID NO: 741042 - RNA, 19 nt, Homo sapiens
aagcugagcgcuccauuca

SEQ ID NO: 741043 - RNA, 19 nt, Homo sapiens
gcagugaugaaagugauug

SEQ ID NO: 741044 - RNA, 19 nt, Homo sapiens
caaagaagcuguugcaaug

SEQ ID NO: 741045 - RNA, 19 nt, Homo sapiens
gaaauugccucuaccuuug

SEQ ID NO: 741046 - RNA, 19 nt, Homo sapiens
ggagaaaguugaacguauu

SEQ ID NO: 741047 - RNA, 19 nt, Homo sapiens
gaagcagaaucuuuaauug

SEQ ID NO: 741048 - RNA, 19 nt, Homo sapiens
ugacacagcuugccaauag

SEQ ID NO: 741049 - RNA, 19 nt, Homo sapiens
gcaauggagucuuaugcua

SEQ ID NO: 741050 - RNA, 19 nt, Homo sapiens
ggaggaggcuguucugaga

SEQ ID NO: 741051 - RNA, 19 nt, Homo sapiens
gaaguuaaauuccgucaag

SEQ ID NO: 741052 - RNA, 19 nt, Homo sapiens
gcacaacauuauccucaaa

SEQ ID NO: 741053 - RNA, 19 nt, Homo sapiens
ggaagcagaaucuuuaauu

SEQ ID NO: 741054 - RNA, 19 nt, Homo sapiens
caucauagcugacaaugca

SEQ ID NO: 741055 - RNA, 19 nt, Homo sapiens
gaccuucgcuuuaacauag

SEQ ID NO: 741056 - RNA, 19 nt, Homo sapiens
aaaguuagcuguagaagca

SEQ ID NO: 741057 - RNA, 19 nt, Homo sapiens
gcagauuccuauuuagaug

SEQ ID NO: 741058 - RNA, 19 nt, Homo sapiens
ggaaacgugucccugauca

SEQ ID NO: 741059 - RNA, 19 nt, Homo sapiens
guaaaggacucuagaacag

SEQ ID NO: 741060 - RNA, 19 nt, Homo sapiens
ggaggaaguuuggcagauu

SEQ ID NO: 741061 - RNA, 19 nt, Homo sapiens
uagcugaccuucgcuuuaa

SEQ ID NO: 741062 - RNA, 19 nt, Homo sapiens
gcucagggcugcucacagu

SEQ ID NO: 741063 - RNA, 19 nt, Homo sapiens
cagcucgucugacuucuuu

SEQ ID NO: 741064 - RNA, 19 nt, Homo sapiens
ugaaauugccucuaccuuu

SEQ ID NO: 741065 - RNA, 19 nt, Homo sapiens
ugucaaggguucaagauga

SEQ ID NO: 741066 - RNA, 19 nt, Homo sapiens
gaaggcaccauuggagaua

SEQ ID NO: 741067 - RNA, 19 nt, Homo sapiens
ggcaggagcugaugaagag

SEQ ID NO: 741068 - RNA, 19 nt, Homo sapiens
uaaagaagacuguggaauc

SEQ ID NO: 741069 - RNA, 19 nt, Homo sapiens
cuaaagcacugagaauguu

SEQ ID NO: 741070 - RNA, 19 nt, Homo sapiens
cccauuauauccuuaaguu

SEQ ID NO: 741071 - RNA, 19 nt, Homo sapiens
uuuggcagauuccuauuua

SEQ ID NO: 741072 - RNA, 19 nt, Homo sapiens
gcagaaucuuuaauugcaa

SEQ ID NO: 741073 - RNA, 19 nt, Homo sapiens
gauggugccacuauucuaa

SEQ ID NO: 741074 - RNA, 19 nt, Homo sapiens
gcaauaccacugcuggauu

SEQ ID NO: 741075 - RNA, 19 nt, Homo sapiens
gaggaaguuuggcagauuc

SEQ ID NO: 741076 - RNA, 19 nt, Homo sapiens
gaagcuaggaggaaguuug

SEQ ID NO: 741077 - RNA, 19 nt, Homo sapiens
ggaggcaauucauauuauc

SEQ ID NO: 741078 - RNA, 19 nt, Homo sapiens
caauggagucuuaugcuaa

SEQ ID NO: 741079 - RNA, 19 nt, Homo sapiens
caauagaacaccaggcaaa

SEQ ID NO: 741080 - RNA, 19 nt, Homo sapiens
aaaggacucuagaacaguu

SEQ ID NO: 741081 - RNA, 19 nt, Homo sapiens
aagggaagcagaaucuuua

SEQ ID NO: 741082 - RNA, 19 nt, Homo sapiens
gaaaguugaacguauucuu

SEQ ID NO: 741083 - RNA, 19 nt, Homo sapiens
uaagggaagcagaaucuuu

SEQ ID NO: 741084 - RNA, 19 nt, Homo sapiens
aaagaagacuguggaaucu

SEQ ID NO: 741085 - RNA, 19 nt, Homo sapiens
gcuaaagcacugagaaugu

SEQ ID NO: 741086 - RNA, 19 nt, Homo sapiens
ggugaggcuuguaccauug

SEQ ID NO: 741087 - RNA, 19 nt, Homo sapiens
cuauugagcaugcagauuu

SEQ ID NO: 741088 - RNA, 19 nt, Homo sapiens
gaagacaaacucauucacu

SEQ ID NO: 741089 - RNA, 19 nt, Homo sapiens
ggagaagacaaacucauuc

SEQ ID NO: 741090 - RNA, 19 nt, Homo sapiens
guuuaucggugcccauuau

SEQ ID NO: 741091 - RNA, 19 nt, Homo sapiens
aagacaaacucauucacuu

SEQ ID NO: 741092 - RNA, 19 nt, Homo sapiens
gaaguuuggcagauuccua

SEQ ID NO: 741093 - RNA, 19 nt, Homo sapiens
aauggagucuuaugcuaaa

SEQ ID NO: 741094 - RNA, 19 nt, Homo sapiens
agacaaacucauucacuuu

SEQ ID NO: 741095 - RNA, 19 nt, Homo sapiens
gagaagacaaacucauuca

SEQ ID NO: 741096 - RNA, 19 nt, Homo sapiens
guuaaauuccgucaagauu

SEQ ID NO: 741097 - RNA, 19 nt, Homo sapiens
gcuguugaguucugcaguu

SEQ ID NO: 741098 - RNA, 19 nt, Homo sapiens
caaugauggugccacuauu

SEQ ID NO: 741099 - RNA, 19 nt, Homo sapiens
agaagacuguggaaucugu

SEQ ID NO: 741100 - RNA, 19 nt, Homo sapiens
gaaauagaacaugcggaaa

SEQ ID NO: 741101 - RNA, 19 nt, Homo sapiens
ggaccaguuucuagcaaag

SEQ ID NO: 741102 - RNA, 19 nt, Homo sapiens
gaacuggugaagcuuggaa

SEQ ID NO: 741103 - RNA, 19 nt, Homo sapiens
uggaggcaauucauauuau

SEQ ID NO: 741104 - RNA, 19 nt, Homo sapiens
ccucaaaacuucuuacuca

SEQ ID NO: 741105 - RNA, 19 nt, Homo sapiens
gaauauugcgggcacaaca

SEQ ID NO: 741106 - RNA, 19 nt, Homo sapiens
ccaaugauggugccacuau

SEQ ID NO: 741107 - RNA, 19 nt, Homo sapiens
caaagcggcacccaggaaa

SEQ ID NO: 741108 - RNA, 19 nt, Homo sapiens
ggaaggcaccauuggagau

SEQ ID NO: 741109 - RNA, 19 nt, Homo sapiens
uagaacaccaggcaaagaa

SEQ ID NO: 741110 - RNA, 19 nt, Homo sapiens
gauggcacuaccucuguua

SEQ ID NO: 741111 - RNA, 19 nt, Homo sapiens
agaugccucucuuauggua

SEQ ID NO: 741112 - RNA, 19 nt, Homo sapiens
ccaaaggcauggacaaaau

SEQ ID NO: 741113 - RNA, 19 nt, Homo sapiens
aaagguugcagaaauagaa

SEQ ID NO: 741114 - RNA, 19 nt, Homo sapiens
caaaacuucuuacucauca

SEQ ID NO: 741115 - RNA, 19 nt, Homo sapiens
ggacaaaauucuucuaagc

SEQ ID NO: 741116 - RNA, 19 nt, Homo sapiens
aagaagcuguugcaaugga

SEQ ID NO: 741117 - RNA, 19 nt, Homo sapiens
gaacgccuagcucuuguca

SEQ ID NO: 741118 - RNA, 19 nt, Homo sapiens
aggagaaaguugaacguau

SEQ ID NO: 741119 - RNA, 19 nt, Homo sapiens
gcaccuguuaacaucuuua

SEQ ID NO: 741120 - RNA, 19 nt, Homo sapiens
caauccagcagcuaaaguu

SEQ ID NO: 741121 - RNA, 19 nt, Homo sapiens
cuguugcaauggagucuua

SEQ ID NO: 741122 - RNA, 19 nt, Homo sapiens
uggugaagcuuggaaguug

SEQ ID NO: 741123 - RNA, 19 nt, Homo sapiens
ugucauggcuauugagcau

SEQ ID NO: 741124 - RNA, 19 nt, Homo sapiens
gagaaaguugaacguauuc

SEQ ID NO: 741125 - RNA, 19 nt, Homo sapiens
cuggaggcaauucauauua

SEQ ID NO: 741126 - RNA, 19 nt, Homo sapiens
ggaaccauggcgucccuuu

SEQ ID NO: 741127 - RNA, 19 nt, Homo sapiens
ucaagaugaugaaguuggu

SEQ ID NO: 741128 - RNA, 19 nt, Homo sapiens
gaaccauggcgucccuuuc

SEQ ID NO: 741129 - RNA, 19 nt, Homo sapiens
guggugaaauugccucuac

SEQ ID NO: 741130 - RNA, 19 nt, Homo sapiens
acgccuagcucuugucaca

SEQ ID NO: 741131 - RNA, 19 nt, Homo sapiens
aaaugaaggagaaaguuga

SEQ ID NO: 741132 - RNA, 19 nt, Homo sapiens
ccgucaagauuuaaugaau

SEQ ID NO: 741133 - RNA, 19 nt, Homo sapiens
ugaagcagcagaggugauu

SEQ ID NO: 741134 - RNA, 19 nt, Homo sapiens
ugaagcagaaagaucauug

SEQ ID NO: 741135 - RNA, 19 nt, Homo sapiens
uggagaagacaaacucauu

SEQ ID NO: 741136 - RNA, 19 nt, Homo sapiens
ggcacaacauuauccucaa

SEQ ID NO: 741137 - RNA, 19 nt, Homo sapiens
guugaguucugcaguugau

SEQ ID NO: 741138 - RNA, 19 nt, Homo sapiens
uuagcugaccuucgcuuua

SEQ ID NO: 741139 - RNA, 19 nt, Homo sapiens
ucaaagcggcacccaggaa

SEQ ID NO: 741140 - RNA, 19 nt, Homo sapiens
gacacagcuugccaauaga

SEQ ID NO: 741141 - RNA, 19 nt, Homo sapiens
agaugaagcagaaagauca

SEQ ID NO: 741142 - RNA, 19 nt, Homo sapiens
uaucgaggaagucaugauu

SEQ ID NO: 741143 - RNA, 19 nt, Homo sapiens
gcauggaauaaauugcuuu

SEQ ID NO: 741144 - RNA, 19 nt, Homo sapiens
gaucguuucucaucucuaa

SEQ ID NO: 741145 - RNA, 19 nt, Homo sapiens
gcgaauaucccucuauaaa

SEQ ID NO: 741146 - RNA, 19 nt, Homo sapiens
ggaauuaacugcccuaucc

SEQ ID NO: 741147 - RNA, 19 nt, Homo sapiens
ccaaugguauccagugauu

SEQ ID NO: 741148 - RNA, 19 nt, Homo sapiens
ggacugcgguucuguggau

SEQ ID NO: 741149 - RNA, 19 nt, Homo sapiens
ugaauaaacuaccagugaa

SEQ ID NO: 741150 - RNA, 19 nt, Homo sapiens
ugucuuaggugguuucauu

SEQ ID NO: 741151 - RNA, 19 nt, Homo sapiens
ggauggaguuauaaaggaa

SEQ ID NO: 741152 - RNA, 19 nt, Homo sapiens
aagcgaauaucccucuaua

SEQ ID NO: 741153 - RNA, 19 nt, Homo sapiens
guacagaucguuucucauc

SEQ ID NO: 741154 - RNA, 19 nt, Homo sapiens
gaauaaacuaccagugaaa

SEQ ID NO: 741155 - RNA, 19 nt, Homo sapiens
gacuugcucuccaauggua

SEQ ID NO: 741156 - RNA, 19 nt, Homo sapiens
ggaaaucccaguacagauc

SEQ ID NO: 741157 - RNA, 19 nt, Homo sapiens
gaauaucccucuauaaaac

SEQ ID NO: 741158 - RNA, 19 nt, Homo sapiens
accuauagcuaccugaaua

SEQ ID NO: 741159 - RNA, 19 nt, Homo sapiens
caguacagaucguuucuca

SEQ ID NO: 741160 - RNA, 19 nt, Homo sapiens
gcaaaggacagucuuacag

SEQ ID NO: 741161 - RNA, 19 nt, Homo sapiens
uucuacaccuggaaauuua

SEQ ID NO: 741162 - RNA, 19 nt, Homo sapiens
gagcuuggaacuucguuau

SEQ ID NO: 741163 - RNA, 19 nt, Homo sapiens
cugaauaaacuaccaguga

SEQ ID NO: 741164 - RNA, 19 nt, Homo sapiens
cuuaggugguuucauuaaa

SEQ ID NO: 741165 - RNA, 19 nt, Homo sapiens
cggugcaucuggccaauga

SEQ ID NO: 741166 - RNA, 19 nt, Homo sapiens
gguuguaagaguggaauua

SEQ ID NO: 741167 - RNA, 19 nt, Homo sapiens
ccuggaaauuuacucuuga

SEQ ID NO: 741168 - RNA, 19 nt, Homo sapiens
uggauggaguuauaaagga

SEQ ID NO: 741169 - RNA, 19 nt, Homo sapiens
gguuagcagauguuuaauu

SEQ ID NO: 741170 - RNA, 19 nt, Homo sapiens
uugguuagcagauguuuaa

SEQ ID NO: 741171 - RNA, 19 nt, Homo sapiens
ucucagugguugucucaug

SEQ ID NO: 741172 - RNA, 19 nt, Homo sapiens
aguggcaacuucaggauga

SEQ ID NO: 741173 - RNA, 19 nt, Homo sapiens
gccaaugagucugcugaga

SEQ ID NO: 741174 - RNA, 19 nt, Homo sapiens
ggaguuauaaaggaaguga

SEQ ID NO: 741175 - RNA, 19 nt, Homo sapiens
gguugucucaugucucuuu

SEQ ID NO: 741176 - RNA, 19 nt, Homo sapiens
gugacuugcucuccaaugg

SEQ ID NO: 741177 - RNA, 19 nt, Homo sapiens
guuguaagaguggaauuaa

SEQ ID NO: 741178 - RNA, 19 nt, Homo sapiens
gggcgucccaguucccuuu

SEQ ID NO: 741179 - RNA, 19 nt, Homo sapiens
gugguugucucaugucucu

SEQ ID NO: 741180 - RNA, 19 nt, Homo sapiens
aagacaagaccuauagcua

SEQ ID NO: 741181 - RNA, 19 nt, Homo sapiens
gcaacuucaggaugacaaa

SEQ ID NO: 741182 - RNA, 19 nt, Homo sapiens
auagcuaccugaauaaacu

SEQ ID NO: 741183 - RNA, 19 nt, Homo sapiens
ugagcaaaggacagucuua

SEQ ID NO: 741184 - RNA, 19 nt, Homo sapiens
acagugacuugcucuccaa

SEQ ID NO: 741185 - RNA, 19 nt, Homo sapiens
auaaaggaagugaauguga

SEQ ID NO: 741186 - RNA, 19 nt, Homo sapiens
gagcaaaggacagucuuac

SEQ ID NO: 741187 - RNA, 19 nt, Homo sapiens
gugguggaguggcaacuuc

SEQ ID NO: 741188 - RNA, 19 nt, Homo sapiens
cgaauaucccucuauaaaa

SEQ ID NO: 741189 - RNA, 19 nt, Homo sapiens
cuggaaauuuacucuugaa

SEQ ID NO: 741190 - RNA, 19 nt, Homo sapiens
ccuauagcuaccugaauaa

SEQ ID NO: 741191 - RNA, 19 nt, Homo sapiens
caccuucaccagcaauauu

SEQ ID NO: 741192 - RNA, 19 nt, Homo sapiens
ugucuugucuucugcaaaa

SEQ ID NO: 741193 - RNA, 19 nt, Homo sapiens
ucucuaagugccucauuga

SEQ ID NO: 741194 - RNA, 19 nt, Homo sapiens
gcuuggaacuucguuaucc

SEQ ID NO: 741195 - RNA, 19 nt, Homo sapiens
uucuguggauggaguuaua

SEQ ID NO: 741196 - RNA, 19 nt, Homo sapiens
ggaguggcaacuucaggau

SEQ ID NO: 741197 - RNA, 19 nt, Homo sapiens
guaagaguggaauuaacug

SEQ ID NO: 741198 - RNA, 19 nt, Homo sapiens
gagccugaugguuguaaga

SEQ ID NO: 741199 - RNA, 19 nt, Homo sapiens
accuggaaauuuacucuug

SEQ ID NO: 741200 - RNA, 19 nt, Homo sapiens
uaacuuguggccucuuucu

SEQ ID NO: 741201 - RNA, 19 nt, Homo sapiens
ccagugauucguugaagag

SEQ ID NO: 741202 - RNA, 19 nt, Homo sapiens
cuccaaugguauccaguga

SEQ ID NO: 741203 - RNA, 19 nt, Homo sapiens
ugaagaagaugguggauaa

SEQ ID NO: 741204 - RNA, 19 nt, Homo sapiens
gaaauuucaugaggaggua

SEQ ID NO: 741205 - RNA, 19 nt, Homo sapiens
ccagagaaguguuuccaau

SEQ ID NO: 741206 - RNA, 19 nt, Homo sapiens
ggaccugucugacgauagu

SEQ ID NO: 741207 - RNA, 19 nt, Homo sapiens
agaauaaagugucaagcaa

SEQ ID NO: 741208 - RNA, 19 nt, Homo sapiens
gagaauaaagugucaagca

SEQ ID NO: 741209 - RNA, 19 nt, Homo sapiens
gauaagcccacccagagaa

SEQ ID NO: 741210 - RNA, 19 nt, Homo sapiens
gagcccaccugcgugauga

SEQ ID NO: 741211 - RNA, 19 nt, Homo sapiens
ggagguaucagucuagagu

SEQ ID NO: 741212 - RNA, 19 nt, Homo sapiens
agguaucagucuagaguua

SEQ ID NO: 741213 - RNA, 19 nt, Homo sapiens
gaggagguaucagucuaga

SEQ ID NO: 741214 - RNA, 19 nt, Homo sapiens
cgcgacgucugcagaaauu

SEQ ID NO: 741215 - RNA, 19 nt, Homo sapiens
ggauaagcccacccagaga

SEQ ID NO: 741216 - RNA, 19 nt, Homo sapiens
agagaaguguuuccaaugc

SEQ ID NO: 741217 - RNA, 19 nt, Homo sapiens
gagaaguguuuccaaugcu

SEQ ID NO: 741218 - RNA, 19 nt, Homo sapiens
guacuacgaccuggcaaga

SEQ ID NO: 741219 - RNA, 19 nt, Homo sapiens
agaauccacucuccagucu

SEQ ID NO: 741220 - RNA, 19 nt, Homo sapiens
cagagaaguguuuccaaug

SEQ ID NO: 741221 - RNA, 19 nt, Homo sapiens
agggugaccuguugaccaa

SEQ ID NO: 741222 - RNA, 19 nt, Homo sapiens
caccuuguccuguggaaga

SEQ ID NO: 741223 - RNA, 19 nt, Homo sapiens
cgacgucugcagaaauuuc

SEQ ID NO: 741224 - RNA, 19 nt, Homo sapiens
gcgcgacgucugcagaaau

SEQ ID NO: 741225 - RNA, 19 nt, Homo sapiens
gagcugggccgugacuaca

SEQ ID NO: 741226 - RNA, 19 nt, Homo sapiens
augaggagguaucagucua

SEQ ID NO: 741227 - RNA, 19 nt, Homo sapiens
gaagaagaugguggauaag

SEQ ID NO: 741228 - RNA, 19 nt, Homo sapiens
cauaaaacagggugugaaa

SEQ ID NO: 741229 - RNA, 19 nt, Homo sapiens
ggugaccuguugaccaaaa

SEQ ID NO: 741230 - RNA, 19 nt, Homo sapiens
ugaagaagaugguggauaa

SEQ ID NO: 741231 - RNA, 19 nt, Homo sapiens
ggaauaaagugucaagcaa

SEQ ID NO: 741232 - RNA, 19 nt, Homo sapiens
gaaauuucaugaggaggua

SEQ ID NO: 741233 - RNA, 19 nt, Homo sapiens
ccagagaaguguuuccaau

SEQ ID NO: 741234 - RNA, 19 nt, Homo sapiens
ggaccugucugacgauagu

SEQ ID NO: 741235 - RNA, 19 nt, Homo sapiens
aauaaagugucaagcaaga

SEQ ID NO: 741236 - RNA, 19 nt, Homo sapiens
gauaagcccacccagagaa

SEQ ID NO: 741237 - RNA, 19 nt, Homo sapiens
ggagguaucagucuagagu

SEQ ID NO: 741238 - RNA, 19 nt, Homo sapiens
uaaagugucaagcaagauu

SEQ ID NO: 741239 - RNA, 19 nt, Homo sapiens
agguaucagucuagaguua

SEQ ID NO: 741240 - RNA, 19 nt, Homo sapiens
gaggagguaucagucuaga

SEQ ID NO: 741241 - RNA, 19 nt, Homo sapiens
gggaauaaagugucaagca

SEQ ID NO: 741242 - RNA, 19 nt, Homo sapiens
cgcgacgucugcagaaauu

SEQ ID NO: 741243 - RNA, 19 nt, Homo sapiens
ggauaagcccacccagaga

SEQ ID NO: 741244 - RNA, 19 nt, Homo sapiens
agagaaguguuuccaaugc

SEQ ID NO: 741245 - RNA, 19 nt, Homo sapiens
gaagggagaguggauuugg

SEQ ID NO: 741246 - RNA, 19 nt, Homo sapiens
gagaaguguuuccaaugcu

SEQ ID NO: 741247 - RNA, 19 nt, Homo sapiens
agaauccacucuccagucu

SEQ ID NO: 741248 - RNA, 19 nt, Homo sapiens
cagagaaguguuuccaaug

SEQ ID NO: 741249 - RNA, 19 nt, Homo sapiens
ggaagggagaguggauuug

SEQ ID NO: 741250 - RNA, 19 nt, Homo sapiens
guacuacgacccggcaaga

SEQ ID NO: 741251 - RNA, 19 nt, Homo sapiens
agggugaccuguugaccaa

SEQ ID NO: 741252 - RNA, 19 nt, Homo sapiens
ggcccacacugucuaggau

SEQ ID NO: 741253 - RNA, 19 nt, Homo sapiens
caccuuguccuguggaaga

SEQ ID NO: 741254 - RNA, 19 nt, Homo sapiens
cgacgucugcagaaauuuc

SEQ ID NO: 741255 - RNA, 19 nt, Homo sapiens
aaagugucaagcaagauuu

SEQ ID NO: 741256 - RNA, 19 nt, Homo sapiens
ccaagggcaagaacacuuc

SEQ ID NO: 741257 - RNA, 19 nt, Homo sapiens
gcgcgacgucugcagaaau

SEQ ID NO: 741258 - RNA, 19 nt, Homo sapiens
gagcugggccgugacuaca

SEQ ID NO: 741259 - RNA, 19 nt, Homo sapiens
uggaagggagaguggauuu

SEQ ID NO: 741260 - RNA, 19 nt, Homo sapiens
augaggagguaucagucua

SEQ ID NO: 741261 - RNA, 19 nt, Homo sapiens
cccacacugucuaggauug

SEQ ID NO: 741262 - RNA, 19 nt, Homo sapiens
gaagaagaugguggauaag

SEQ ID NO: 741263 - RNA, 19 nt, Homo sapiens
ggugaccuguugaccaaaa

SEQ ID NO: 741264 - RNA, 19 nt, Homo sapiens
gagcagagaucauaaccaa

SEQ ID NO: 741265 - RNA, 19 nt, Homo sapiens
gaagaacucaccaagauuu

SEQ ID NO: 741266 - RNA, 19 nt, Homo sapiens
ccuaaagacugacacauuu

SEQ ID NO: 741267 - RNA, 19 nt, Homo sapiens
ggagagcccugucaaguca

SEQ ID NO: 741268 - RNA, 19 nt, Homo sapiens
gcacuacuguauuuccuuu

SEQ ID NO: 741269 - RNA, 19 nt, Homo sapiens
gaagagguguugaagagau

SEQ ID NO: 741270 - RNA, 19 nt, Homo sapiens
gggagaaucuagcaucuga

SEQ ID NO: 741271 - RNA, 19 nt, Homo sapiens
gaucugcauuugcugauuu

SEQ ID NO: 741272 - RNA, 19 nt, Homo sapiens
ccacugaggaguuggauua

SEQ ID NO: 741273 - RNA, 19 nt, Homo sapiens
uagaagaacucaccaagau

SEQ ID NO: 741274 - RNA, 19 nt, Homo sapiens
gaagauaugagaagaugaa

SEQ ID NO: 741275 - RNA, 19 nt, Homo sapiens
aagcaggccuuguaccuua

SEQ ID NO: 741276 - RNA, 19 nt, Homo sapiens
cagaaacuccuaugaaauu

SEQ ID NO: 741277 - RNA, 19 nt, Homo sapiens
uacagaaacuccuaugaaa

SEQ ID NO: 741278 - RNA, 19 nt, Homo sapiens
uaaggagacuaucagaauu

SEQ ID NO: 741279 - RNA, 19 nt, Homo sapiens
cgaagaagcaggccuugua

SEQ ID NO: 741280 - RNA, 19 nt, Homo sapiens
cguaugcacuacuguauuu

SEQ ID NO: 741281 - RNA, 19 nt, Homo sapiens
guacuuacaccuuugauau

SEQ ID NO: 741282 - RNA, 19 nt, Homo sapiens
ccucagaguuccuguauca

SEQ ID NO: 741283 - RNA, 19 nt, Homo sapiens
aaaggacgcuggagcagaa

SEQ ID NO: 741284 - RNA, 19 nt, Homo sapiens
ccaacaaucauacaacuuu

SEQ ID NO: 741285 - RNA, 19 nt, Homo sapiens
gaaacagaccaccaagaaa

SEQ ID NO: 741286 - RNA, 19 nt, Homo sapiens
gauaugagaagaugaagga

SEQ ID NO: 741287 - RNA, 19 nt, Homo sapiens
caacaaucauacaacuuug

SEQ ID NO: 741288 - RNA, 19 nt, Homo sapiens
cagaagcgauugaaauuac

SEQ ID NO: 741289 - RNA, 19 nt, Homo sapiens
ggaguuggauuacagaaac

SEQ ID NO: 741290 - RNA, 19 nt, Homo sapiens
gagcagaagaauaaagaaa

SEQ ID NO: 741291 - RNA, 19 nt, Homo sapiens
gaaagcaggcgggaaguga

SEQ ID NO: 741292 - RNA, 19 nt, Homo sapiens
ggaccuagaggcugacaaa

SEQ ID NO: 741293 - RNA, 19 nt, Homo sapiens
cagaagauaugagaagaug

SEQ ID NO: 741294 - RNA, 19 nt, Homo sapiens
gaaaauuggcuccuccuua

SEQ ID NO: 741295 - RNA, 19 nt, Homo sapiens
ccuuguaccuuauguuuga

SEQ ID NO: 741296 - RNA, 19 nt, Homo sapiens
uuuaagacauccucuaaga

SEQ ID NO: 741297 - RNA, 19 nt, Homo sapiens
gcaaugaguuccgauucug

SEQ ID NO: 741298 - RNA, 19 nt, Homo sapiens
gauagaggacgaacagaga

SEQ ID NO: 741299 - RNA, 19 nt, Homo sapiens
ccagaaacaccaccaguga

SEQ ID NO: 741300 - RNA, 19 nt, Homo sapiens
ccguaaggcuggaguuuga

SEQ ID NO: 741301 - RNA, 19 nt, Homo sapiens
gcagugggacuuacaacuu

SEQ ID NO: 741302 - RNA, 19 nt, Homo sapiens
ugcauuugcugauuuguuu

SEQ ID NO: 741303 - RNA, 19 nt, Homo sapiens
gaucauaaccaaggagaga

SEQ ID NO: 741304 - RNA, 19 nt, Homo sapiens
agaaacagaccaccaagaa

SEQ ID NO: 741305 - RNA, 19 nt, Homo sapiens
ccaccaggaugccaagaga

SEQ ID NO: 741306 - RNA, 19 nt, Homo sapiens
gcaagccagugacuuugau

SEQ ID NO: 741307 - RNA, 19 nt, Homo sapiens
gcaaguugaccucagaguu

SEQ ID NO: 741308 - RNA, 19 nt, Homo sapiens
ggaaaacgcugccucuuac

SEQ ID NO: 741309 - RNA, 19 nt, Homo sapiens
ggacuuacaacuuggacuu

SEQ ID NO: 741310 - RNA, 19 nt, Homo sapiens
cuuaaggaguguaaacuug

SEQ ID NO: 741311 - RNA, 19 nt, Homo sapiens
gugagcagcuuuuggauuu

SEQ ID NO: 741312 - RNA, 19 nt, Homo sapiens
caaguugaccucagaguuc

SEQ ID NO: 741313 - RNA, 19 nt, Homo sapiens
gggaaaagcuaacucugaa

SEQ ID NO: 741314 - RNA, 19 nt, Homo sapiens
caagauuugugacgaacug

SEQ ID NO: 741315 - RNA, 19 nt, Homo sapiens
gaacucaccaagauuugug

SEQ ID NO: 741316 - RNA, 19 nt, Homo sapiens
ggaaaauaguggccgagua

SEQ ID NO: 741317 - RNA, 19 nt, Homo sapiens
gaaacuccuaugaaauuga

SEQ ID NO: 741318 - RNA, 19 nt, Homo sapiens
ggaggaaguccacggauuc

SEQ ID NO: 741319 - RNA, 19 nt, Homo sapiens
acauugagcuuguggauac

SEQ ID NO: 741320 - RNA, 19 nt, Homo sapiens
cuaaggagacuaucagaau

SEQ ID NO: 741321 - RNA, 19 nt, Homo sapiens
gagaagaccaucgcucaga

SEQ ID NO: 741322 - RNA, 19 nt, Homo sapiens
gaaaauaguggccgaguau

SEQ ID NO: 741323 - RNA, 19 nt, Homo sapiens
ucagaagcgauugaaauua

SEQ ID NO: 741324 - RNA, 19 nt, Homo sapiens
uuacagaaacuccuaugaa

SEQ ID NO: 741325 - RNA, 19 nt, Homo sapiens
gagaaucuagcaucugaga

SEQ ID NO: 741326 - RNA, 19 nt, Homo sapiens
cagugggacuuacaacuug

SEQ ID NO: 741327 - RNA, 19 nt, Homo sapiens
uaaacuugaucugcauuug

SEQ ID NO: 741328 - RNA, 19 nt, Homo sapiens
ccaguuccauggacagguu

SEQ ID NO: 741329 - RNA, 19 nt, Homo sapiens
gcaugacaguggaccuaga

SEQ ID NO: 741330 - RNA, 19 nt, Homo sapiens
gaaguggacgugcaugaca

SEQ ID NO: 741331 - RNA, 19 nt, Homo sapiens
ccaggaggaguuagaguuu

SEQ ID NO: 741332 - RNA, 19 nt, Homo sapiens
ugugaacacugcugcgaaa

SEQ ID NO: 741333 - RNA, 19 nt, Homo sapiens
agaaggaggagcagaggua

SEQ ID NO: 741334 - RNA, 19 nt, Homo sapiens
gagcccgacuuagcagaaa

SEQ ID NO: 741335 - RNA, 19 nt, Homo sapiens
cggaggaaguccacggauu

SEQ ID NO: 741336 - RNA, 19 nt, Homo sapiens
ccucagacgcuaagaauca

SEQ ID NO: 741337 - RNA, 19 nt, Homo sapiens
gaacauguacagcgugcau

SEQ ID NO: 741338 - RNA, 19 nt, Homo sapiens
gcaguacuaaggagacuau

SEQ ID NO: 741339 - RNA, 19 nt, Homo sapiens
gggaagugauggaaaugag

SEQ ID NO: 741340 - RNA, 19 nt, Homo sapiens
gggaugaccccaauuuuaa

SEQ ID NO: 741341 - RNA, 19 nt, Homo sapiens
cgagaaacuugacaacacu

SEQ ID NO: 741342 - RNA, 19 nt, Homo sapiens
ggcuggaguuugacuauuc

SEQ ID NO: 741343 - RNA, 19 nt, Homo sapiens
guaaacuugaucugcauuu

SEQ ID NO: 741344 - RNA, 19 nt, Homo sapiens
ggccuuguaccuuauguuu

SEQ ID NO: 741345 - RNA, 19 nt, Homo sapiens
ccagacaccugugaugagu

SEQ ID NO: 741346 - RNA, 19 nt, Homo sapiens
gcaacaggagccagaugaa

SEQ ID NO: 741347 - RNA, 19 nt, Homo sapiens
caacuuggacuuugacaac

SEQ ID NO: 741348 - RNA, 19 nt, Homo sapiens
gaccuuggccuugcccuuu

SEQ ID NO: 741349 - RNA, 19 nt, Homo sapiens
uugauuguaugcaguacua

SEQ ID NO: 741350 - RNA, 19 nt, Homo sapiens
caccaagauuugugacgaa

SEQ ID NO: 741351 - RNA, 19 nt, Homo sapiens
gcaagaaugaagagguguu

SEQ ID NO: 741352 - RNA, 19 nt, Homo sapiens
guggugcacuugacuaucu

SEQ ID NO: 741353 - RNA, 19 nt, Homo sapiens
gaagaagcaggccuuguac

SEQ ID NO: 741354 - RNA, 19 nt, Homo sapiens
ggcaaugaguuccgauucu

SEQ ID NO: 741355 - RNA, 19 nt, Homo sapiens
ggcgggaagugauggaaau

SEQ ID NO: 741356 - RNA, 19 nt, Homo sapiens
cgccagagcagagaucaua

SEQ ID NO: 741357 - RNA, 19 nt, Homo sapiens
gaagcuggccaggcagauu

SEQ ID NO: 741358 - RNA, 19 nt, Homo sapiens
gaagcaggccuuguaccuu

SEQ ID NO: 741359 - RNA, 19 nt, Homo sapiens
agaaacuccuaugaaauug

SEQ ID NO: 741360 - RNA, 19 nt, Homo sapiens
ccuagaggcugacaaacag

SEQ ID NO: 741361 - RNA, 19 nt, Homo sapiens
cagcucaccuucuaaaucc

SEQ ID NO: 741362 - RNA, 19 nt, Homo sapiens
aaacagaccaccaagaaac

SEQ ID NO: 741363 - RNA, 19 nt, Homo sapiens
uaaggaguguaaacuugau

SEQ ID NO: 741364 - RNA, 19 nt, Homo sapiens
gaacagagaugaugauuca

SEQ ID NO: 741365 - RNA, 19 nt, Homo sapiens
gaagagcacucaggacuua

SEQ ID NO: 741366 - RNA, 19 nt, Homo sapiens
gaacugguaugaaggagaa

SEQ ID NO: 741367 - RNA, 19 nt, Homo sapiens
gaucagaacugguaugaag

SEQ ID NO: 741368 - RNA, 19 nt, Homo sapiens
gagaagcuauugcuaaguu

SEQ ID NO: 741369 - RNA, 19 nt, Homo sapiens
ccaagagcauuuacgaaua

SEQ ID NO: 741370 - RNA, 19 nt, Homo sapiens
guagaaauguccuucagaa

SEQ ID NO: 741371 - RNA, 19 nt, Homo sapiens
gaagggagauauuguuuac

SEQ ID NO: 741372 - RNA, 19 nt, Homo sapiens
gagccaaauuugacuuuaa

SEQ ID NO: 741373 - RNA, 19 nt, Homo sapiens
caagagcauuuacgaauau

SEQ ID NO: 741374 - RNA, 19 nt, Homo sapiens
gacgauggaugguuuguug

SEQ ID NO: 741375 - RNA, 19 nt, Homo sapiens
ggaauccacggaagaauuu

SEQ ID NO: 741376 - RNA, 19 nt, Homo sapiens
agaaugagagccaaauuua

SEQ ID NO: 741377 - RNA, 19 nt, Homo sapiens
caaaccaggugaauggaaa

SEQ ID NO: 741378 - RNA, 19 nt, Homo sapiens
agucaaaccucacaagauu

SEQ ID NO: 741379 - RNA, 19 nt, Homo sapiens
gagaaugagagccaaauuu

SEQ ID NO: 741380 - RNA, 19 nt, Homo sapiens
aaacagauccacaaacuga

SEQ ID NO: 741381 - RNA, 19 nt, Homo sapiens
gguacaagacuauguuuaa

SEQ ID NO: 741382 - RNA, 19 nt, Homo sapiens
ccaaagcuguuaugaaugg

SEQ ID NO: 741383 - RNA, 19 nt, Homo sapiens
ccaggugaauggaaacuuu

SEQ ID NO: 741384 - RNA, 19 nt, Homo sapiens
ucaaaccucacaagauuua

SEQ ID NO: 741385 - RNA, 19 nt, Homo sapiens
uauaccagcugauuacuug

SEQ ID NO: 741386 - RNA, 19 nt, Homo sapiens
gaagucaagcucagaaaga

SEQ ID NO: 741387 - RNA, 19 nt, Homo sapiens
gaagcuauugcuaaguuua

SEQ ID NO: 741388 - RNA, 19 nt, Homo sapiens
gcaaugggcaagacaaaga

SEQ ID NO: 741389 - RNA, 19 nt, Homo sapiens
gauccugucucagaaagaa

SEQ ID NO: 741390 - RNA, 19 nt, Homo sapiens
ucacuagcuuggagaauga

SEQ ID NO: 741391 - RNA, 19 nt, Homo sapiens
gagcaaaggaugacaguag

SEQ ID NO: 741392 - RNA, 19 nt, Homo sapiens
gucaagggcucuagaagug

SEQ ID NO: 741393 - RNA, 19 nt, Homo sapiens
ccaguccucuacuaaauga

SEQ ID NO: 741394 - RNA, 19 nt, Homo sapiens
gaaaugcccagcccucuuc

SEQ ID NO: 741395 - RNA, 19 nt, Homo sapiens
gcagaagggagauauuguu

SEQ ID NO: 741396 - RNA, 19 nt, Homo sapiens
agagacuccuggauauaua

SEQ ID NO: 741397 - RNA, 19 nt, Homo sapiens
gcagagcccaagagcauuu

SEQ ID NO: 741398 - RNA, 19 nt, Homo sapiens
gagcaggacucagcaccaa

SEQ ID NO: 741399 - RNA, 19 nt, Homo sapiens
ggagauaucguugauguca

SEQ ID NO: 741400 - RNA, 19 nt, Homo sapiens
acagaaugaugaugaguug

SEQ ID NO: 741401 - RNA, 19 nt, Homo sapiens
uuccaaagcuguuaugaau

SEQ ID NO: 741402 - RNA, 19 nt, Homo sapiens
gaaugagagccaaauuuau

SEQ ID NO: 741403 - RNA, 19 nt, Homo sapiens
ggauuccaguccucuacua

SEQ ID NO: 741404 - RNA, 19 nt, Homo sapiens
uaauggugauacacaagua

SEQ ID NO: 741405 - RNA, 19 nt, Homo sapiens
gaaugaugaugaguuggaa

SEQ ID NO: 741406 - RNA, 19 nt, Homo sapiens
uuaaacagauccacaaacu

SEQ ID NO: 741407 - RNA, 19 nt, Homo sapiens
gauggaugguuuguuggua

SEQ ID NO: 741408 - RNA, 19 nt, Homo sapiens
gcaccuacaucgagcuucu

SEQ ID NO: 741409 - RNA, 19 nt, Homo sapiens
caauugugcucuugcaaca

SEQ ID NO: 741410 - RNA, 19 nt, Homo sapiens
gcaacuauguaaaaccuuu

SEQ ID NO: 741411 - RNA, 19 nt, Homo sapiens
caagaaggacaaagcaguu

SEQ ID NO: 741412 - RNA, 19 nt, Homo sapiens
gggagauauuguuuacauu

SEQ ID NO: 741413 - RNA, 19 nt, Homo sapiens
cagaaucgccaagacauuu

SEQ ID NO: 741414 - RNA, 19 nt, Homo sapiens
aaauugaucagaacuggua

SEQ ID NO: 741415 - RNA, 19 nt, Homo sapiens
ggagaaugagagccaaauu

SEQ ID NO: 741416 - RNA, 19 nt, Homo sapiens
cuucagagacuccuggaua

SEQ ID NO: 741417 - RNA, 19 nt, Homo sapiens
caagaggucggccacacua

SEQ ID NO: 741418 - RNA, 19 nt, Homo sapiens
uaagcgauguuuccaugga

SEQ ID NO: 741419 - RNA, 19 nt, Homo sapiens
ggagucaaaccucacaaga

SEQ ID NO: 741420 - RNA, 19 nt, Homo sapiens
cagaagggagauauuguuu

SEQ ID NO: 741421 - RNA, 19 nt, Homo sapiens
ucaaaagacugguacaaga

SEQ ID NO: 741422 - RNA, 19 nt, Homo sapiens
gaaagcaaaccaggugaau

SEQ ID NO: 741423 - RNA, 19 nt, Homo sapiens
cagcucugcuuccacuaaa

SEQ ID NO: 741424 - RNA, 19 nt, Homo sapiens
gggaauuucuucagagacu

SEQ ID NO: 741425 - RNA, 19 nt, Homo sapiens
aaacgacucaguagccuuu

SEQ ID NO: 741426 - RNA, 19 nt, Homo sapiens
gcaacacaaucgagaacag

SEQ ID NO: 741427 - RNA, 19 nt, Homo sapiens
uaucguugaugucauggaa

SEQ ID NO: 741428 - RNA, 19 nt, Homo sapiens
agacauggauccuacaaaa

SEQ ID NO: 741429 - RNA, 19 nt, Homo sapiens
gcuauauaccacagaauga

SEQ ID NO: 741430 - RNA, 19 nt, Homo sapiens
cuuuaaagcucagacacua

SEQ ID NO: 741431 - RNA, 19 nt, Homo sapiens
aaagugagaugagcuacau

SEQ ID NO: 741432 - RNA, 19 nt, Homo sapiens
caaccuuccuucugacaag

SEQ ID NO: 741433 - RNA, 19 nt, Homo sapiens
gcaaaccaggugaauggaa

SEQ ID NO: 741434 - RNA, 19 nt, Homo sapiens
agaagggagauauuguuua

SEQ ID NO: 741435 - RNA, 19 nt, Homo sapiens
gaugaugauucagaucugu

SEQ ID NO: 741436 - RNA, 19 nt, Homo sapiens
ggaaaugcccagcccucuu

SEQ ID NO: 741437 - RNA, 19 nt, Homo sapiens
agauaucguugaugucaug

SEQ ID NO: 741438 - RNA, 19 nt, Homo sapiens
agaaauguccuucagaaag

SEQ ID NO: 741439 - RNA, 19 nt, Homo sapiens
cagagaugaugauucagau

SEQ ID NO: 741440 - RNA, 19 nt, Homo sapiens
uuaaagcucagacacuaaa

SEQ ID NO: 741441 - RNA, 19 nt, Homo sapiens
gugcagagcccaagagcau

SEQ ID NO: 741442 - RNA, 19 nt, Homo sapiens
aaagacugguacaagacua

SEQ ID NO: 741443 - RNA, 19 nt, Homo sapiens
uggagaagcuauugcuaag

SEQ ID NO: 741444 - RNA, 19 nt, Homo sapiens
agagccaaauuugacuuua

SEQ ID NO: 741445 - RNA, 19 nt, Homo sapiens
ggaaacccggcaacacgaa

SEQ ID NO: 741446 - RNA, 19 nt, Homo sapiens
gaaacccggcaacacgaaa

SEQ ID NO: 741447 - RNA, 19 nt, Homo sapiens
gcaagacaaagacauggau

SEQ ID NO: 741448 - RNA, 19 nt, Homo sapiens
cagagacuccuggauauau

SEQ ID NO: 741449 - RNA, 19 nt, Homo sapiens
ucagagacuccuggauaua

SEQ ID NO: 741450 - RNA, 19 nt, Homo sapiens
aaacugaacagagaugaug

SEQ ID NO: 741451 - RNA, 19 nt, Homo sapiens
uccacaaacugaacagaga

SEQ ID NO: 741452 - RNA, 19 nt, Homo sapiens
ggacuuaagcgauguuucc

SEQ ID NO: 741453 - RNA, 19 nt, Homo sapiens
gacaaagacauggauccua

SEQ ID NO: 741454 - RNA, 19 nt, Homo sapiens
gagucaaaccucacaagau

SEQ ID NO: 741455 - RNA, 19 nt, Homo sapiens
agaagcuauugcuaaguuu

SEQ ID NO: 741456 - RNA, 19 nt, Homo sapiens
aagucaagcucagaaagaa

SEQ ID NO: 741457 - RNA, 19 nt, Homo sapiens
gugcugaugccaauggaaa

SEQ ID NO: 741458 - RNA, 19 nt, Homo sapiens
cauugacggugugaaggua

SEQ ID NO: 741459 - RNA, 19 nt, Homo sapiens
caaaaucuccccuuucugu

SEQ ID NO: 741460 - RNA, 19 nt, Homo sapiens
uuucagauccugucucaga

SEQ ID NO: 741461 - RNA, 19 nt, Homo sapiens
caaggcaucuuccccauca

SEQ ID NO: 741462 - RNA, 19 nt, Homo sapiens
ggugauacacaaguagaaa

SEQ ID NO: 741463 - RNA, 19 nt, Homo sapiens
ccucuucacucgcugucaa

SEQ ID NO: 741464 - RNA, 19 nt, Homo sapiens
gaacagagaugaugauuca

SEQ ID NO: 741465 - RNA, 19 nt, Homo sapiens
aaacagagauuuccaauug

SEQ ID NO: 741466 - RNA, 19 nt, Homo sapiens
gaagagcacucaggacuua

SEQ ID NO: 741467 - RNA, 19 nt, Homo sapiens
gaaagaaacugccacuaau

SEQ ID NO: 741468 - RNA, 19 nt, Homo sapiens
gaacaccucuuuaaauaca

SEQ ID NO: 741469 - RNA, 19 nt, Homo sapiens
ggaaagaaacugccacuaa

SEQ ID NO: 741470 - RNA, 19 nt, Homo sapiens
guaccuaccuuguauagaa

SEQ ID NO: 741471 - RNA, 19 nt, Homo sapiens
gagaugagcuacauugaug

SEQ ID NO: 741472 - RNA, 19 nt, Homo sapiens
gaacugguaugaaggagaa

SEQ ID NO: 741473 - RNA, 19 nt, Homo sapiens
gaucagaacugguaugaag

SEQ ID NO: 741474 - RNA, 19 nt, Homo sapiens
uaaaggaagucaugaaguu

SEQ ID NO: 741475 - RNA, 19 nt, Homo sapiens
gagaagcuauugcuaaguu

SEQ ID NO: 741476 - RNA, 19 nt, Homo sapiens
ccaagagcauuuacgaaua

SEQ ID NO: 741477 - RNA, 19 nt, Homo sapiens
gcaguggauugauuugaua

SEQ ID NO: 741478 - RNA, 19 nt, Homo sapiens
ucacaacucuguccaauuc

SEQ ID NO: 741479 - RNA, 19 nt, Homo sapiens
guagaaauguccuucagaa

SEQ ID NO: 741480 - RNA, 19 nt, Homo sapiens
gaagugggacuguaaauau

SEQ ID NO: 741481 - RNA, 19 nt, Homo sapiens
gagcagaguuagccagaaa

SEQ ID NO: 741482 - RNA, 19 nt, Homo sapiens
gauguucagugauucauuu

SEQ ID NO: 741483 - RNA, 19 nt, Homo sapiens
gaagggagauauuguuuac

SEQ ID NO: 741484 - RNA, 19 nt, Homo sapiens
gcagaugaguggaggcuuu

SEQ ID NO: 741485 - RNA, 19 nt, Homo sapiens
gagccaaauuugacuuuaa

SEQ ID NO: 741486 - RNA, 19 nt, Homo sapiens
caagagcauuuacgaauau

SEQ ID NO: 741487 - RNA, 19 nt, Homo sapiens
cauccaagcucacaaauag

SEQ ID NO: 741488 - RNA, 19 nt, Homo sapiens
acagagaaguguuguguuu

SEQ ID NO: 741489 - RNA, 19 nt, Homo sapiens
ccaaauaacucaccuacag

SEQ ID NO: 741490 - RNA, 19 nt, Homo sapiens
caacuagggugcuggaaga

SEQ ID NO: 741491 - RNA, 19 nt, Homo sapiens
ggagccagcugauccugua

SEQ ID NO: 741492 - RNA, 19 nt, Homo sapiens
gagaaugagagacaaauuu

SEQ ID NO: 741493 - RNA, 19 nt, Homo sapiens
gacgauggaugguuuguug

SEQ ID NO: 741494 - RNA, 19 nt, Homo sapiens
ggaauccacggaagaauuu

SEQ ID NO: 741495 - RNA, 19 nt, Homo sapiens
gcauauaucucagaauuac

SEQ ID NO: 741496 - RNA, 19 nt, Homo sapiens
guucauagcuggaaauacu

SEQ ID NO: 741497 - RNA, 19 nt, Homo sapiens
caagagagacugugauaug

SEQ ID NO: 741498 - RNA, 19 nt, Homo sapiens
agucaaaccucacaagauu

SEQ ID NO: 741499 - RNA, 19 nt, Homo sapiens
cuauuuaucugcagucgua

SEQ ID NO: 741500 - RNA, 19 nt, Homo sapiens
gaaacaagaaacagagauu

SEQ ID NO: 741501 - RNA, 19 nt, Homo sapiens
agagaaguguuguguuuaa

SEQ ID NO: 741502 - RNA, 19 nt, Homo sapiens
ggaggaagcaucauucaug

SEQ ID NO: 741503 - RNA, 19 nt, Homo sapiens
ggaaauuucuucagagacu

SEQ ID NO: 741504 - RNA, 19 nt, Homo sapiens
aaacagauccacaaacuga

SEQ ID NO: 741505 - RNA, 19 nt, Homo sapiens
gguacaagacuauguuuaa

SEQ ID NO: 741506 - RNA, 19 nt, Homo sapiens
agaaagcauugucauauug

SEQ ID NO: 741507 - RNA, 19 nt, Homo sapiens
ccaagccugucuaagguua

SEQ ID NO: 741508 - RNA, 19 nt, Homo sapiens
uguauuggcuaauguguuu

SEQ ID NO: 741509 - RNA, 19 nt, Homo sapiens
gcagauggccaagcagaua

SEQ ID NO: 741510 - RNA, 19 nt, Homo sapiens
ucaaaccucacaagauuua

SEQ ID NO: 741511 - RNA, 19 nt, Homo sapiens
uauaccagcugauuacuug

SEQ ID NO: 741512 - RNA, 19 nt, Homo sapiens
gaagucaagcucagaaaga

SEQ ID NO: 741513 - RNA, 19 nt, Homo sapiens
ccaauuugcccgucuuuaa

SEQ ID NO: 741514 - RNA, 19 nt, Homo sapiens
ucucuuagauccugaguga

SEQ ID NO: 741515 - RNA, 19 nt, Homo sapiens
gagaaacgcacacaagguu

SEQ ID NO: 741516 - RNA, 19 nt, Homo sapiens
gaagcuauugcuaaguuua

SEQ ID NO: 741517 - RNA, 19 nt, Homo sapiens
ccaaagcugugaugaaugg

SEQ ID NO: 741518 - RNA, 19 nt, Homo sapiens
gcagucguauuaaguccua

SEQ ID NO: 741519 - RNA, 19 nt, Homo sapiens
cugcauauaucucagaauu

SEQ ID NO: 741520 - RNA, 19 nt, Homo sapiens
ugucuaagguuacugugua

SEQ ID NO: 741521 - RNA, 19 nt, Homo sapiens
gcaaugggcaagacaaaga

SEQ ID NO: 741522 - RNA, 19 nt, Homo sapiens
ucuagagucuuuacaggua

SEQ ID NO: 741523 - RNA, 19 nt, Homo sapiens
cauauugccaucuccauua

SEQ ID NO: 741524 - RNA, 19 nt, Homo sapiens
acacaagguuugcccauga

SEQ ID NO: 741525 - RNA, 19 nt, Homo sapiens
ucucuaaacucucaucuuc

SEQ ID NO: 741526 - RNA, 19 nt, Homo sapiens
gagaaguguuguguuuaaa

SEQ ID NO: 741527 - RNA, 19 nt, Homo sapiens
gauccugucucagaaagaa

SEQ ID NO: 741528 - RNA, 19 nt, Homo sapiens
acaaauaggaguagcaauu

SEQ ID NO: 741529 - RNA, 19 nt, Homo sapiens
ucacuagcuuggagaauga

SEQ ID NO: 741530 - RNA, 19 nt, Homo sapiens
gagcaaaggaugacaguag

SEQ ID NO: 741531 - RNA, 19 nt, Homo sapiens
gaggaaagguaacucugau

SEQ ID NO: 741532 - RNA, 19 nt, Homo sapiens
guaaagccacauuugcaua

SEQ ID NO: 741533 - RNA, 19 nt, Homo sapiens
ggacuguauuggcuaaugu

SEQ ID NO: 741534 - RNA, 19 nt, Homo sapiens
ccaguccucuacuaaauga

SEQ ID NO: 741535 - RNA, 19 nt, Homo sapiens
gaaaugcccagcccucuuc

SEQ ID NO: 741536 - RNA, 19 nt, Homo sapiens
aaagguaacucugaucuca

SEQ ID NO: 741537 - RNA, 19 nt, Homo sapiens
ccauguaccuaccuuguau

SEQ ID NO: 741538 - RNA, 19 nt, Homo sapiens
gggagccacuucagccuuu

SEQ ID NO: 741539 - RNA, 19 nt, Homo sapiens
gccaagggcuacagaagug

SEQ ID NO: 741540 - RNA, 19 nt, Homo sapiens
ggaggaaagguaacucuga

SEQ ID NO: 741541 - RNA, 19 nt, Homo sapiens
ugagacaaauacagaaaug

SEQ ID NO: 741542 - RNA, 19 nt, Homo sapiens
aaucugaccugaagcauag

SEQ ID NO: 741543 - RNA, 19 nt, Homo sapiens
gcagaagggagauauuguu

SEQ ID NO: 741544 - RNA, 19 nt, Homo sapiens
agagacuccuggauauaua

SEQ ID NO: 741545 - RNA, 19 nt, Homo sapiens
gcagagcccaagagcauuu

SEQ ID NO: 741546 - RNA, 19 nt, Homo sapiens
gagcaggacucagcaccaa

SEQ ID NO: 741547 - RNA, 19 nt, Homo sapiens
cuaagguuacuguguauua

SEQ ID NO: 741548 - RNA, 19 nt, Homo sapiens
ggacagagaaguguugugu

SEQ ID NO: 741549 - RNA, 19 nt, Homo sapiens
ggagauaucguugauguca

SEQ ID NO: 741550 - RNA, 19 nt, Homo sapiens
acagaaugaugaugaguug

SEQ ID NO: 741551 - RNA, 19 nt, Homo sapiens
uggaagaaccuuugucuga

SEQ ID NO: 741552 - RNA, 19 nt, Homo sapiens
gcccaagaaugcaacaaga

SEQ ID NO: 741553 - RNA, 19 nt, Homo sapiens
uaauggugauacacaagua

SEQ ID NO: 741554 - RNA, 19 nt, Homo sapiens
gaaugaugaugaguuggaa

SEQ ID NO: 741555 - RNA, 19 nt, Homo sapiens
uuaaacagauccacaaacu

SEQ ID NO: 741556 - RNA, 19 nt, Homo sapiens
aaauagccauuguaaagug

SEQ ID NO: 741557 - RNA, 19 nt, Homo sapiens
ucacgucgccuuccuaugu

SEQ ID NO: 741558 - RNA, 19 nt, Homo sapiens
acaaauacccaucuuagga

SEQ ID NO: 741559 - RNA, 19 nt, Homo sapiens
caccaugaguucugaaugu

SEQ ID NO: 741560 - RNA, 19 nt, Homo sapiens
gauggaugguuuguuggua

SEQ ID NO: 741561 - RNA, 19 nt, Homo sapiens
uaacucaccuacagauuuu

SEQ ID NO: 741562 - RNA, 19 nt, Homo sapiens
gaaggaauuccaaauaacu

SEQ ID NO: 741563 - RNA, 19 nt, Homo sapiens
auaaugugcuuaagaagug

SEQ ID NO: 741564 - RNA, 19 nt, Homo sapiens
agaggaaacuguugagaaa

SEQ ID NO: 741565 - RNA, 19 nt, Homo sapiens
gcucugcccuugaccugua

SEQ ID NO: 741566 - RNA, 19 nt, Homo sapiens
gaaagggagggcucacuga

SEQ ID NO: 741567 - RNA, 19 nt, Homo sapiens
gaucaggaggcaucauuga

SEQ ID NO: 741568 - RNA, 19 nt, Homo sapiens
ggcauucaauaaaguguau

SEQ ID NO: 741569 - RNA, 19 nt, Homo sapiens
guucaacacccucuucaug

SEQ ID NO: 741570 - RNA, 19 nt, Homo sapiens
caaaccuucucuccuguca

SEQ ID NO: 741571 - RNA, 19 nt, Homo sapiens
gaagaggaaacuguugaga

SEQ ID NO: 741572 - RNA, 19 nt, Homo sapiens
caggaccuccacaccauua

SEQ ID NO: 741573 - RNA, 19 nt, Homo sapiens
caaaugccaggaagaggaa

SEQ ID NO: 741574 - RNA, 19 nt, Homo sapiens
ccacaccauuaacaagaug

SEQ ID NO: 741575 - RNA, 19 nt, Homo sapiens
acuacgagaugcucaagga

SEQ ID NO: 741576 - RNA, 19 nt, Homo sapiens
ccaggaagaggaaacuguu

SEQ ID NO: 741577 - RNA, 19 nt, Homo sapiens
ggccagcucugcauuugac

SEQ ID NO: 741578 - RNA, 19 nt, Homo sapiens
cguacucuaucuuccauuc

SEQ ID NO: 741579 - RNA, 19 nt, Homo sapiens
aagaggaaacuguugagaa

SEQ ID NO: 741580 - RNA, 19 nt, Homo sapiens
uagaucaggaggcaucauu

SEQ ID NO: 741581 - RNA, 19 nt, Homo sapiens
ucaaggaggagcaggaagu

SEQ ID NO: 741582 - RNA, 19 nt, Homo sapiens
ugaccuguauuccacuuac

SEQ ID NO: 741583 - RNA, 19 nt, Homo sapiens
cugagaaccaucccgguaa

SEQ ID NO: 741584 - RNA, 19 nt, Homo sapiens
ggaagaggaaacuguugag

SEQ ID NO: 741585 - RNA, 19 nt, Homo sapiens
caggagcucugcccuugac

SEQ ID NO: 741586 - RNA, 19 nt, Homo sapiens
ugacaaaugccaggaagag

SEQ ID NO: 741587 - RNA, 19 nt, Homo sapiens
ugaagucuagggacaggaa

SEQ ID NO: 741588 - RNA, 19 nt, Homo sapiens
cgucaucaucccaguguug

SEQ ID NO: 741589 - RNA, 19 nt, Homo sapiens
gaccuccacaccauuaaca

SEQ ID NO: 741590 - RNA, 19 nt, Homo sapiens
ugagaaccaucccgguaac

SEQ ID NO: 741591 - RNA, 19 nt, Homo sapiens
gcaucuucaugaccauucu

SEQ ID NO: 741592 - RNA, 19 nt, Homo sapiens
ugccugggcuucauagcau

SEQ ID NO: 741593 - RNA, 19 nt, Homo sapiens
caaaugaguuguucucuug

SEQ ID NO: 741594 - RNA, 19 nt, Homo sapiens
ggaagguuguugaugguua

SEQ ID NO: 741595 - RNA, 19 nt, Homo sapiens
gaaaggaauuaaaggagaa

SEQ ID NO: 741596 - RNA, 19 nt, Homo sapiens
caaaggagaugauggugaa

SEQ ID NO: 741597 - RNA, 19 nt, Homo sapiens
gaagauaccggaaauuugu

SEQ ID NO: 741598 - RNA, 19 nt, Homo sapiens
gagaagaacuacagggaau

SEQ ID NO: 741599 - RNA, 19 nt, Homo sapiens
caagacaucuaugaaguuu

SEQ ID NO: 741600 - RNA, 19 nt, Homo sapiens
ggaugaagcugccaacaca

SEQ ID NO: 741601 - RNA, 19 nt, Homo sapiens
gcaaugauaagaucuuuga

SEQ ID NO: 741602 - RNA, 19 nt, Homo sapiens
aaauggagcucuugaaauc

SEQ ID NO: 741603 - RNA, 19 nt, Homo sapiens
guacaagggcuuucuguga

SEQ ID NO: 741604 - RNA, 19 nt, Homo sapiens
cgagauaguugguugucua

SEQ ID NO: 741605 - RNA, 19 nt, Homo sapiens
gacacagagugccaucuua

SEQ ID NO: 741606 - RNA, 19 nt, Homo sapiens
gacaguacauguucacaga

SEQ ID NO: 741607 - RNA, 19 nt, Homo sapiens
uagggaaacugaagagaaa

SEQ ID NO: 741608 - RNA, 19 nt, Homo sapiens
ggacaacuggauauuagua

SEQ ID NO: 741609 - RNA, 19 nt, Homo sapiens
gagcaaugauaagaucuuu

SEQ ID NO: 741610 - RNA, 19 nt, Homo sapiens
gauaagaucuuugaaucca

SEQ ID NO: 741611 - RNA, 19 nt, Homo sapiens
guggauaauuucccaguuu

SEQ ID NO: 741612 - RNA, 19 nt, Homo sapiens
ucuguaggcucacaccuua

SEQ ID NO: 741613 - RNA, 19 nt, Homo sapiens
ggaagauaccggaaauuug

SEQ ID NO: 741614 - RNA, 19 nt, Homo sapiens
caaagcagguacugucugu

SEQ ID NO: 741615 - RNA, 19 nt, Homo sapiens
gcccaaagccagacaugua

SEQ ID NO: 741616 - RNA, 19 nt, Homo sapiens
uuacaugggucuugagaga

SEQ ID NO: 741617 - RNA, 19 nt, Homo sapiens
ccaaguaggugcuuugaac

SEQ ID NO: 741618 - RNA, 19 nt, Homo sapiens
uggauaauuucccaguuua

SEQ ID NO: 741619 - RNA, 19 nt, Homo sapiens
caacauagcuagaaaaugc

SEQ ID NO: 741620 - RNA, 19 nt, Homo sapiens
gggaaagcauggcaaagug

SEQ ID NO: 741621 - RNA, 19 nt, Homo sapiens
cagaccauguggaaugaua

SEQ ID NO: 741622 - RNA, 19 nt, Homo sapiens
gcacagacauagaaaugcu

SEQ ID NO: 741623 - RNA, 19 nt, Homo sapiens
agacaucuaugaaguuugu

SEQ ID NO: 741624 - RNA, 19 nt, Homo sapiens
uaacauauaccaaguaggu

SEQ ID NO: 741625 - RNA, 19 nt, Homo sapiens
acucaucgcugacuauguu

SEQ ID NO: 741626 - RNA, 19 nt, Homo sapiens
cccaauaacucgccagguu

SEQ ID NO: 741627 - RNA, 19 nt, Homo sapiens
acacuccacugcagaacua

SEQ ID NO: 741628 - RNA, 19 nt, Homo sapiens
gcagauggaaugacacaga

SEQ ID NO: 741629 - RNA, 19 nt, Homo sapiens
cuaugaaguuugucaagaa

SEQ ID NO: 741630 - RNA, 19 nt, Homo sapiens
ggccauggcuauacuugga

SEQ ID NO: 741631 - RNA, 19 nt, Homo sapiens
gaagguuguugaugguuag

SEQ ID NO: 741632 - RNA, 19 nt, Homo sapiens
ucaaaugaguuguucucuu

SEQ ID NO: 741633 - RNA, 19 nt, Homo sapiens
ccauguggaaugauaaaua

SEQ ID NO: 741634 - RNA, 19 nt, Homo sapiens
ccauguacuuugucuguga

SEQ ID NO: 741635 - RNA, 19 nt, Homo sapiens
ggaagaagggugacaaagg

SEQ ID NO: 741636 - RNA, 19 nt, Homo sapiens
ugaaguuugucaagaaugu

SEQ ID NO: 741637 - RNA, 19 nt, Homo sapiens
caacuggauauuaguauug

SEQ ID NO: 741638 - RNA, 19 nt, Homo sapiens
ucacuaacauauaccaagu

SEQ ID NO: 741639 - RNA, 19 nt, Homo sapiens
gaguuguucucuugguauu

SEQ ID NO: 741640 - RNA, 19 nt, Homo sapiens
gagucaacauagcuagaaa

SEQ ID NO: 741641 - RNA, 19 nt, Homo sapiens
ucugugaguucaucaagaa

SEQ ID NO: 741642 - RNA, 19 nt, Homo sapiens
aaggagaacugggugauau

SEQ ID NO: 741643 - RNA, 19 nt, Homo sapiens
caucuuaccauguacuuug

SEQ ID NO: 741644 - RNA, 19 nt, Homo sapiens
cgauuucacuaacauauac

SEQ ID NO: 741645 - RNA, 19 nt, Homo sapiens
gaucuaucgauuucacuaa

SEQ ID NO: 741646 - RNA, 19 nt, Homo sapiens
aaaaggagauccaggagaa

SEQ ID NO: 741647 - RNA, 19 nt, Homo sapiens
cuucugaucuaucgauuuc

SEQ ID NO: 741648 - RNA, 19 nt, Homo sapiens
cauguggaaugauaaauac

SEQ ID NO: 741649 - RNA, 19 nt, Homo sapiens
guuguucucuugguauuug

SEQ ID NO: 741650 - RNA, 19 nt, Homo sapiens
gaccgucauuacaguuauu

SEQ ID NO: 741651 - RNA, 19 nt, Homo sapiens
gugaguucaucaagaagaa

SEQ ID NO: 741652 - RNA, 19 nt, Homo sapiens
ggagggacaguacauguuc

SEQ ID NO: 741653 - RNA, 19 nt, Homo sapiens
gcagguacugucugugauu

SEQ ID NO: 741654 - RNA, 19 nt, Homo sapiens
gggaaacugaagagaaauu

SEQ ID NO: 741655 - RNA, 19 nt, Homo sapiens
uggaagauaccggaaauuu

SEQ ID NO: 741656 - RNA, 19 nt, Homo sapiens
cauccuugcuucgaagaaa

SEQ ID NO: 741657 - RNA, 19 nt, Homo sapiens
cuucgaagaaaccaauuua

SEQ ID NO: 741658 - RNA, 19 nt, Homo sapiens
cauccuacguauuugcuau

SEQ ID NO: 741659 - RNA, 19 nt, Homo sapiens
gaagaaaccaauuuauccu

SEQ ID NO: 741660 - RNA, 19 nt, Homo sapiens
acaugggucuugagagaga

SEQ ID NO: 741661 - RNA, 19 nt, Homo sapiens
ucuaugaaguuugucaaga

SEQ ID NO: 741662 - RNA, 19 nt, Homo sapiens
gcucaagacaucuaugaag

SEQ ID NO: 741663 - RNA, 19 nt, Homo sapiens
gaaccacagcaaugaaugg

SEQ ID NO: 741664 - RNA, 19 nt, Homo sapiens
ugaauggcuuugcauccuu

SEQ ID NO: 741665 - RNA, 19 nt, Homo sapiens
ggaaacugaagagaaauuc

SEQ ID NO: 741666 - RNA, 19 nt, Homo sapiens
ucaagacaucuaugaaguu

SEQ ID NO: 741667 - RNA, 19 nt, Homo sapiens
cagguuacaugggucuuga

SEQ ID NO: 741668 - RNA, 19 nt, Homo sapiens
ucccucauccuacguauuu

SEQ ID NO: 741669 - RNA, 19 nt, Homo sapiens
cgaagaaaccaauuuaucc

SEQ ID NO: 741670 - RNA, 19 nt, Homo sapiens
gagggacaguacauguuca

SEQ ID NO: 741671 - RNA, 19 nt, Homo sapiens
ggaaccacagcaaugaaug

SEQ ID NO: 741672 - RNA, 19 nt, Homo sapiens
gaccauguggaaugauaaa

SEQ ID NO: 741673 - RNA, 19 nt, Homo sapiens
cuagcuuugugucuuguuu

SEQ ID NO: 741674 - RNA, 19 nt, Homo sapiens
ugaggaaccacagcaauga

SEQ ID NO: 741675 - RNA, 19 nt, Homo sapiens
gaacuauagcaacuggaau

SEQ ID NO: 741676 - RNA, 19 nt, Homo sapiens
gaaagggagggacaguaca

SEQ ID NO: 741677 - RNA, 19 nt, Homo sapiens
acacacucaucgcugacua

SEQ ID NO: 741678 - RNA, 19 nt, Homo sapiens
cuaacccacugcaggauuc

SEQ ID NO: 741679 - RNA, 19 nt, Homo sapiens
gagucugggucuggauauu

SEQ ID NO: 741680 - RNA, 19 nt, Homo sapiens
uuggacaacuggauauuag

SEQ ID NO: 741681 - RNA, 19 nt, Homo sapiens
gguacugucugugauugug

SEQ ID NO: 741682 - RNA, 19 nt, Homo sapiens
ggagaucggggcaauauug

SEQ ID NO: 741683 - RNA, 19 nt, Homo sapiens
cuauauagucacacuuuga

SEQ ID NO: 741684 - RNA, 19 nt, Homo sapiens
ccuauauagucacacuuug

SEQ ID NO: 741685 - RNA, 19 nt, Homo sapiens
gucugggucuggauauuga

SEQ ID NO: 741686 - RNA, 19 nt, Homo sapiens
gaggaaccacagcaaugaa

SEQ ID NO: 741687 - RNA, 19 nt, Homo sapiens
gcucuuuugugaugauuuu

SEQ ID NO: 741688 - RNA, 19 nt, Homo sapiens
gcuagaaaaugcuaaacug

SEQ ID NO: 741689 - RNA, 19 nt, Homo sapiens
guacuuugucugugaguuc

SEQ ID NO: 741690 - RNA, 19 nt, Homo sapiens
gggagggacaguacauguu

SEQ ID NO: 741691 - RNA, 19 nt, Homo sapiens
ugucugugauuguggaaga

SEQ ID NO: 741692 - RNA, 19 nt, Homo sapiens
ucgaagaaaccaauuuauc

SEQ ID NO: 741693 - RNA, 19 nt, Homo sapiens
gaacagaauuggagcagaa

SEQ ID NO: 741694 - RNA, 19 nt, Homo sapiens
gaacacuuccgcugucuua

SEQ ID NO: 741695 - RNA, 19 nt, Homo sapiens
ggaagaccauccucucaga

SEQ ID NO: 741696 - RNA, 19 nt, Homo sapiens
ccaccuacuuggaaacaua

SEQ ID NO: 741697 - RNA, 19 nt, Homo sapiens
gaaacaaaucuucuucuug

SEQ ID NO: 741698 - RNA, 19 nt, Homo sapiens
ggaaccaacuggcguuugu

SEQ ID NO: 741699 - RNA, 19 nt, Homo sapiens
gaacaagaguguggcaaag

SEQ ID NO: 741700 - RNA, 19 nt, Homo sapiens
gcacucaccuuccaaaucc

SEQ ID NO: 741701 - RNA, 19 nt, Homo sapiens
gaccagacuuuguccaaug

SEQ ID NO: 741702 - RNA, 19 nt, Homo sapiens
gcucagauccaccuacuug

SEQ ID NO: 741703 - RNA, 19 nt, Homo sapiens
ccugcuacauugacuauaa

SEQ ID NO: 741704 - RNA, 19 nt, Homo sapiens
agaaugcucucaucacuca

SEQ ID NO: 741705 - RNA, 19 nt, Homo sapiens
caagaaugcucucaucacu

SEQ ID NO: 741706 - RNA, 19 nt, Homo sapiens
uaagacacagggaguauuu

SEQ ID NO: 741707 - RNA, 19 nt, Homo sapiens
ggucccagcuccagaggaa

SEQ ID NO: 741708 - RNA, 19 nt, Homo sapiens
gaagggucuuggucaaugu

SEQ ID NO: 741709 - RNA, 19 nt, Homo sapiens
acaagaguguggcaaagaa

SEQ ID NO: 741710 - RNA, 19 nt, Homo sapiens
gcugcucuguugaugcuua

SEQ ID NO: 741711 - RNA, 19 nt, Homo sapiens
guggaagccucaagcaaga

SEQ ID NO: 741712 - RNA, 19 nt, Homo sapiens
aauaacugguggauuguaa

SEQ ID NO: 741713 - RNA, 19 nt, Homo sapiens
caauguaggugcugauguc

SEQ ID NO: 741714 - RNA, 19 nt, Homo sapiens
ccacuugauucuagucuuc

SEQ ID NO: 741715 - RNA, 19 nt, Homo sapiens
gcccuucgcuggaaagaca

SEQ ID NO: 741716 - RNA, 19 nt, Homo sapiens
gcaggaaccucagcuucau

SEQ ID NO: 741717 - RNA, 19 nt, Homo sapiens
gauguccagugcugcauga

SEQ ID NO: 741718 - RNA, 19 nt, Homo sapiens
auaaagauauuccgugucu

SEQ ID NO: 741719 - RNA, 19 nt, Homo sapiens
gcgaagaaauguccaugac

SEQ ID NO: 741720 - RNA, 19 nt, Homo sapiens
ggccuugggagguuauuua

SEQ ID NO: 741721 - RNA, 19 nt, Homo sapiens
caaggugugucauccauac

SEQ ID NO: 741722 - RNA, 19 nt, Homo sapiens
ugaagggucuuggucaaug

SEQ ID NO: 741723 - RNA, 19 nt, Homo sapiens
gaggucuccugcuacauug

SEQ ID NO: 741724 - RNA, 19 nt, Homo sapiens
uaucaagaaugcucucauc

SEQ ID NO: 741725 - RNA, 19 nt, Homo sapiens
gcuccaugccuuugucuuu

SEQ ID NO: 741726 - RNA, 19 nt, Homo sapiens
agacguggcugagugaaau

SEQ ID NO: 741727 - RNA, 19 nt, Homo sapiens
gcugcaggguggaguuuga

SEQ ID NO: 741728 - RNA, 19 nt, Homo sapiens
aaagacagcugggacaucu

SEQ ID NO: 741729 - RNA, 19 nt, Homo sapiens
gaagugaugacucggaaca

SEQ ID NO: 741730 - RNA, 19 nt, Homo sapiens
gaggaacgucuuugggaaa

SEQ ID NO: 741731 - RNA, 19 nt, Homo sapiens
uugaaaagcucucugauga

SEQ ID NO: 741732 - RNA, 19 nt, Homo sapiens
cgaaaacacuagaacaaga

SEQ ID NO: 741733 - RNA, 19 nt, Homo sapiens
cuugggagguuauuuagga

SEQ ID NO: 741734 - RNA, 19 nt, Homo sapiens
ucaaguacauggguguguu

SEQ ID NO: 741735 - RNA, 19 nt, Homo sapiens
gagcuccacuuuucucauu

SEQ ID NO: 741736 - RNA, 19 nt, Homo sapiens
ggugacggcugacaucaac

SEQ ID NO: 741737 - RNA, 19 nt, Homo sapiens
gaaccaacuggcguuugua

SEQ ID NO: 741738 - RNA, 19 nt, Homo sapiens
acaccaauauugccuacug

SEQ ID NO: 741739 - RNA, 19 nt, Homo sapiens
cagcuuagagggaggacua

SEQ ID NO: 741740 - RNA, 19 nt, Homo sapiens
ucucugagcuggugguucu

SEQ ID NO: 741741 - RNA, 19 nt, Homo sapiens
gacccgauccuccuucaug

SEQ ID NO: 741742 - RNA, 19 nt, Homo sapiens
acacagggaguauuucaga

SEQ ID NO: 741743 - RNA, 19 nt, Homo sapiens
ucucagagguccgcuuugu

SEQ ID NO: 741744 - RNA, 19 nt, Homo sapiens
gaaauugugaacagaggau

SEQ ID NO: 741745 - RNA, 19 nt, Homo sapiens
gcagugggcaucaaguaca

SEQ ID NO: 741746 - RNA, 19 nt, Homo sapiens
uguccuaccugaaguucuu

SEQ ID NO: 741747 - RNA, 19 nt, Homo sapiens
gggcuugcaugucauuguc

SEQ ID NO: 741748 - RNA, 19 nt, Homo sapiens
gaaagacagcugggacauc

SEQ ID NO: 741749 - RNA, 19 nt, Homo sapiens
acauggguguguucacgua

SEQ ID NO: 741750 - RNA, 19 nt, Homo sapiens
gagguuauuuaggaggauu

SEQ ID NO: 741751 - RNA, 19 nt, Homo sapiens
gcuugcaugucauugucua

SEQ ID NO: 741752 - RNA, 19 nt, Homo sapiens
gagaccagacuuuguccaa

SEQ ID NO: 741753 - RNA, 19 nt, Homo sapiens
ggagcagaauacaguagca

SEQ ID NO: 741754 - RNA, 19 nt, Homo sapiens
gccugguccuugcuaauug

SEQ ID NO: 741755 - RNA, 19 nt, Homo sapiens
gcguaggagucaucgacaa

SEQ ID NO: 741756 - RNA, 19 nt, Homo sapiens
ggacaccuaccccaugaua

SEQ ID NO: 741757 - RNA, 19 nt, Homo sapiens
gugcagugggcaucaagua

SEQ ID NO: 741758 - RNA, 19 nt, Homo sapiens
gagacguggcugagugaaa

SEQ ID NO: 741759 - RNA, 19 nt, Homo sapiens
acacuuccgcugucuuaaa

SEQ ID NO: 741760 - RNA, 19 nt, Homo sapiens
ucuggagacuggaaauugu

SEQ ID NO: 741761 - RNA, 19 nt, Homo sapiens
cuacauugacuauaacauc

SEQ ID NO: 741762 - RNA, 19 nt, Homo sapiens
ccagcaaccugagcaaguc

SEQ ID NO: 741763 - RNA, 19 nt, Homo sapiens
uguacuuacuguucuucua

SEQ ID NO: 741764 - RNA, 19 nt, Homo sapiens
gugcuggccuugggagguu

SEQ ID NO: 741765 - RNA, 19 nt, Homo sapiens
ggccugguccuugcuaauu

SEQ ID NO: 741766 - RNA, 19 nt, Homo sapiens
cuacuuggaaacauaguga

SEQ ID NO: 741767 - RNA, 19 nt, Homo sapiens
gcgcucagauccaccuacu

SEQ ID NO: 741768 - RNA, 19 nt, Homo sapiens
gaaccucuggagacuggaa

SEQ ID NO: 741769 - RNA, 19 nt, Homo sapiens
acugguggauuguaaagga

SEQ ID NO: 741770 - RNA, 19 nt, Homo sapiens
gugcccugcuggcuucauu

SEQ ID NO: 741771 - RNA, 19 nt, Homo sapiens
gaacgucuuugggaaaccu

SEQ ID NO: 741772 - RNA, 19 nt, Homo sapiens
guucuucuacguccacuug

SEQ ID NO: 741773 - RNA, 19 nt, Homo sapiens
guacuuacuguucuucuac

SEQ ID NO: 741774 - RNA, 19 nt, Homo sapiens
ugacaggggucgcuuguuc

SEQ ID NO: 741775 - RNA, 19 nt, Homo sapiens
agaacaagaguguggcaaa

SEQ ID NO: 741776 - RNA, 19 nt, Homo sapiens
gaggauucgauggcaauuu

SEQ ID NO: 741777 - RNA, 19 nt, Homo sapiens
gacuggaaauugugaacag

SEQ ID NO: 741778 - RNA, 19 nt, Homo sapiens
ggaggacuagcucggauca

SEQ ID NO: 741779 - RNA, 19 nt, Homo sapiens
agacagcugggacaucuug

SEQ ID NO: 741780 - RNA, 19 nt, Homo sapiens
ggaaagacagcugggacau

SEQ ID NO: 741781 - RNA, 19 nt, Homo sapiens
cagucaaggcuaaugcuuu

SEQ ID NO: 741782 - RNA, 19 nt, Homo sapiens
caugaaacaaaucuucuuc

SEQ ID NO: 741783 - RNA, 19 nt, Homo sapiens
ccaacuggcguuuguaaaa

SEQ ID NO: 741784 - RNA, 19 nt, Homo sapiens
ucagcuucauggcgagauu

SEQ ID NO: 741785 - RNA, 19 nt, Homo sapiens
uauuggccguguuguccua

SEQ ID NO: 741786 - RNA, 19 nt, Homo sapiens
agucaaggcuaaugcuuuu

SEQ ID NO: 741787 - RNA, 19 nt, Homo sapiens
gagcagaauacaguagcaa

SEQ ID NO: 741788 - RNA, 19 nt, Homo sapiens
ucaaggugugucauccaua

SEQ ID NO: 741789 - RNA, 19 nt, Homo sapiens
agacacagggaguauuuca

SEQ ID NO: 741790 - RNA, 19 nt, Homo sapiens
cacuuccgcugucuuaaag

SEQ ID NO: 741791 - RNA, 19 nt, Homo sapiens
acaccuaccccaugauaua

SEQ ID NO: 741792 - RNA, 19 nt, Homo sapiens
cagacuuuguccaauguag

SEQ ID NO: 741793 - RNA, 19 nt, Homo sapiens
gaagagaaguuuaagaaug

SEQ ID NO: 741794 - RNA, 19 nt, Homo sapiens
gcagcucucuggacauuaa

SEQ ID NO: 741795 - RNA, 19 nt, Homo sapiens
acacacaacucagcuauaa

SEQ ID NO: 741796 - RNA, 19 nt, Homo sapiens
ugaagacgcugcugcugua

SEQ ID NO: 741797 - RNA, 19 nt, Homo sapiens
gagaaacacccacgagaaa

SEQ ID NO: 741798 - RNA, 19 nt, Homo sapiens
uaagucaccugaaauagga

SEQ ID NO: 741799 - RNA, 19 nt, Homo sapiens
ggaagaaggcacucaccua

SEQ ID NO: 741800 - RNA, 19 nt, Homo sapiens
uaaagaaacacaaggagaa

SEQ ID NO: 741801 - RNA, 19 nt, Homo sapiens
gcaggagccucgcuucauc

SEQ ID NO: 741802 - RNA, 19 nt, Homo sapiens
gccagccgcucaacaacua

SEQ ID NO: 741803 - RNA, 19 nt, Homo sapiens
gagcgaagaaguccuauca

SEQ ID NO: 741804 - RNA, 19 nt, Homo sapiens
ccgcugcccucacuacuuu

SEQ ID NO: 741805 - RNA, 19 nt, Homo sapiens
uuuaccagcucaauaagua

SEQ ID NO: 741806 - RNA, 19 nt, Homo sapiens
ccaaacaacgccuccagua

SEQ ID NO: 741807 - RNA, 19 nt, Homo sapiens
uuacgaagcagaaaugauu

SEQ ID NO: 741808 - RNA, 19 nt, Homo sapiens
acacggucaucuuuacaua

SEQ ID NO: 741809 - RNA, 19 nt, Homo sapiens
aaaccucauuuccagauuu

SEQ ID NO: 741810 - RNA, 19 nt, Homo sapiens
ccagggaaauucucaccaa

SEQ ID NO: 741811 - RNA, 19 nt, Homo sapiens
aagcagagcucggcagaga

SEQ ID NO: 741812 - RNA, 19 nt, Homo sapiens
ggagaacccacuacaaaca

SEQ ID NO: 741813 - RNA, 19 nt, Homo sapiens
acccugagcugucuuguug

SEQ ID NO: 741814 - RNA, 19 nt, Homo sapiens
ggacacaaacuuuuaugua

SEQ ID NO: 741815 - RNA, 19 nt, Homo sapiens
gaggucaaguugcgcauca

SEQ ID NO: 741816 - RNA, 19 nt, Homo sapiens
ggaagagaaguuuaagaau

SEQ ID NO: 741817 - RNA, 19 nt, Homo sapiens
ucaacuugcucucgaagga

SEQ ID NO: 741818 - RNA, 19 nt, Homo sapiens
ucaauaaguacuacacuga

SEQ ID NO: 741819 - RNA, 19 nt, Homo sapiens
gcgagacgccgguguauag

SEQ ID NO: 741820 - RNA, 19 nt, Homo sapiens
gcucucuggacauuaauua

SEQ ID NO: 741821 - RNA, 19 nt, Homo sapiens
uuauguaagucaccugaaa

SEQ ID NO: 741822 - RNA, 19 nt, Homo sapiens
caacaacuaccacaugaag

SEQ ID NO: 741823 - RNA, 19 nt, Homo sapiens
uggaagagaaguuuaagaa

SEQ ID NO: 741824 - RNA, 19 nt, Homo sapiens
caaacaaacccaguccaaa

SEQ ID NO: 741825 - RNA, 19 nt, Homo sapiens
cgagaaacacccacgagaa

SEQ ID NO: 741826 - RNA, 19 nt, Homo sapiens
gaaugaaccacugaauguu

SEQ ID NO: 741827 - RNA, 19 nt, Homo sapiens
aaggagaacccacuacaaa

SEQ ID NO: 741828 - RNA, 19 nt, Homo sapiens
aaacgggcgugcucucuca

SEQ ID NO: 741829 - RNA, 19 nt, Homo sapiens
gcgcaccgccucuuucgaa

SEQ ID NO: 741830 - RNA, 19 nt, Homo sapiens
ggucaucuuuacauaucaa

SEQ ID NO: 741831 - RNA, 19 nt, Homo sapiens
agaaugaaccacugaaugu

SEQ ID NO: 741832 - RNA, 19 nt, Homo sapiens
gagaacccacuacaaacaa

SEQ ID NO: 741833 - RNA, 19 nt, Homo sapiens
gcucaacaacuaccacaug

SEQ ID NO: 741834 - RNA, 19 nt, Homo sapiens
gaaacaagugccucucagu

SEQ ID NO: 741835 - RNA, 19 nt, Homo sapiens
gggaaauucucaccaaucc

SEQ ID NO: 741836 - RNA, 19 nt, Homo sapiens
gauguuaaacguucucagu

SEQ ID NO: 741837 - RNA, 19 nt, Homo sapiens
ugaauguugucaccaagug

SEQ ID NO: 741838 - RNA, 19 nt, Homo sapiens
ccacugaauguuucgcuuu

SEQ ID NO: 741839 - RNA, 19 nt, Homo sapiens
gcuauaaacagcagaaacu

SEQ ID NO: 741840 - RNA, 19 nt, Homo sapiens
gagguuggccagggaaauu

SEQ ID NO: 741841 - RNA, 19 nt, Homo sapiens
gggauguggucaagaugau

SEQ ID NO: 741842 - RNA, 19 nt, Homo sapiens
gagugaaaguagggcuuaa

SEQ ID NO: 741843 - RNA, 19 nt, Homo sapiens
caucuaagccuaaccuuuu

SEQ ID NO: 741844 - RNA, 19 nt, Homo sapiens
ucgcagcucucuggacauu

SEQ ID NO: 741845 - RNA, 19 nt, Homo sapiens
gaggaaaacugcgauaaca

SEQ ID NO: 741846 - RNA, 19 nt, Homo sapiens
caaacaacgccuccaguag

SEQ ID NO: 741847 - RNA, 19 nt, Homo sapiens
ccugagcugucuuguugaa

SEQ ID NO: 741848 - RNA, 19 nt, Homo sapiens
ugaaacccaagguacauuu

SEQ ID NO: 741849 - RNA, 19 nt, Homo sapiens
guaagucaccugaaauagg

SEQ ID NO: 741850 - RNA, 19 nt, Homo sapiens
caaggagaacccacuacaa

SEQ ID NO: 741851 - RNA, 19 nt, Homo sapiens
cucaacaacuaccacauga

SEQ ID NO: 741852 - RNA, 19 nt, Homo sapiens
aaacaaacccaguccaaac

SEQ ID NO: 741853 - RNA, 19 nt, Homo sapiens
agaacccacuacaaacaaa

SEQ ID NO: 741854 - RNA, 19 nt, Homo sapiens
ggccgaaggguucaacuug

SEQ ID NO: 741855 - RNA, 19 nt, Homo sapiens
guaagauccgcucgcguuu

SEQ ID NO: 741856 - RNA, 19 nt, Homo sapiens
ucucggacgugcucaagga

SEQ ID NO: 741857 - RNA, 19 nt, Homo sapiens
aaugaaccacugaauguuu

SEQ ID NO: 741858 - RNA, 19 nt, Homo sapiens
gacacacaacucagcuaua

SEQ ID NO: 741859 - RNA, 19 nt, Homo sapiens
gggccaaaaguauaaauua

SEQ ID NO: 741860 - RNA, 19 nt, Homo sapiens
gcucaggccaagcugguuu

SEQ ID NO: 741861 - RNA, 19 nt, Homo sapiens
uaaaaggucacacaaaaga

SEQ ID NO: 741862 - RNA, 19 nt, Homo sapiens
caacgccuccaguaggaaa

SEQ ID NO: 741863 - RNA, 19 nt, Homo sapiens
aauuugagguggugcucua

SEQ ID NO: 741864 - RNA, 19 nt, Homo sapiens
gcagacaucuaagccuaac

SEQ ID NO: 741865 - RNA, 19 nt, Homo sapiens
gaagagacgagaccaacac

SEQ ID NO: 741866 - RNA, 19 nt, Homo sapiens
uuggaucccucaacguauu

SEQ ID NO: 741867 - RNA, 19 nt, Homo sapiens
gaaagagggaaaaggaaaa

SEQ ID NO: 741868 - RNA, 19 nt, Homo sapiens
aaucucggcugcagacauc

SEQ ID NO: 741869 - RNA, 19 nt, Homo sapiens
gcguggaagagaaguuuaa

SEQ ID NO: 741870 - RNA, 19 nt, Homo sapiens
ccaaaagccuggacaaacu

SEQ ID NO: 741871 - RNA, 19 nt, Homo sapiens
cagggaaauucucaccaau

SEQ ID NO: 741872 - RNA, 19 nt, Homo sapiens
gcgguuugcaccuaaagaa

SEQ ID NO: 741873 - RNA, 19 nt, Homo sapiens
caacgcaagcaacgacuuc

SEQ ID NO: 741874 - RNA, 19 nt, Homo sapiens
caaaaugaaacccaaggua

SEQ ID NO: 741875 - RNA, 19 nt, Homo sapiens
aaauaggaauccggcagaa

SEQ ID NO: 741876 - RNA, 19 nt, Homo sapiens
gcuguacgagugcgagaaa

SEQ ID NO: 741877 - RNA, 19 nt, Homo sapiens
gaugggcgucuucaacuuc

SEQ ID NO: 741878 - RNA, 19 nt, Homo sapiens
caagccggcuacgguauca

SEQ ID NO: 741879 - RNA, 19 nt, Homo sapiens
gcacacggucaucuuuaca

SEQ ID NO: 741880 - RNA, 19 nt, Homo sapiens
uaagaaugaaccacugaau

SEQ ID NO: 741881 - RNA, 19 nt, Homo sapiens
caccuacacugagcgaaga

SEQ ID NO: 741882 - RNA, 19 nt, Homo sapiens
gagagcaacccaaccaaaa

SEQ ID NO: 741883 - RNA, 19 nt, Homo sapiens
gcuggggacugcuugaaaa

SEQ ID NO: 741884 - RNA, 19 nt, Homo sapiens
gcccaaccucgaccucuuu

SEQ ID NO: 741885 - RNA, 19 nt, Homo sapiens
gaaacacccacgagaaacg

SEQ ID NO: 741886 - RNA, 19 nt, Homo sapiens
ccuuggaucccucaacgua

SEQ ID NO: 741887 - RNA, 19 nt, Homo sapiens
aacaacgccuccaguagga

SEQ ID NO: 741888 - RNA, 19 nt, Homo sapiens
gccugaauguugucaccaa

SEQ ID NO: 741889 - RNA, 19 nt, Homo sapiens
acaaacaaacccaguccaa

SEQ ID NO: 741890 - RNA, 19 nt, Homo sapiens
acacaacucagcuauaaac

SEQ ID NO: 741891 - RNA, 19 nt, Homo sapiens
agacgcugcugcuguacga

SEQ ID NO: 741892 - RNA, 19 nt, Homo sapiens
ggagaaccgccugcugaug

SEQ ID NO: 741893 - RNA, 19 nt, Homo sapiens
cgaaguuacucaaggauuu

SEQ ID NO: 741894 - RNA, 19 nt, Homo sapiens
gaagauggcagaagcuguu

SEQ ID NO: 741895 - RNA, 19 nt, Homo sapiens
gaucacaucaucauugcua

SEQ ID NO: 741896 - RNA, 19 nt, Homo sapiens
gaaagagauucugcuguca

SEQ ID NO: 741897 - RNA, 19 nt, Homo sapiens
gagaugcaucccaguguua

SEQ ID NO: 741898 - RNA, 19 nt, Homo sapiens
gaauauggaaucacaagug

SEQ ID NO: 741899 - RNA, 19 nt, Homo sapiens
cgaccuggguggaaaccua

SEQ ID NO: 741900 - RNA, 19 nt, Homo sapiens
ccgcaugacuggaggaaga

SEQ ID NO: 741901 - RNA, 19 nt, Homo sapiens
gcaucccaguguuauguaa

SEQ ID NO: 741902 - RNA, 19 nt, Homo sapiens
gaaggaauccccuggaaaa

SEQ ID NO: 741903 - RNA, 19 nt, Homo sapiens
ggcagaagcuguucaaaau

SEQ ID NO: 741904 - RNA, 19 nt, Homo sapiens
gucaaguacuuuaacauca

SEQ ID NO: 741905 - RNA, 19 nt, Homo sapiens
ccacgacgauggcggcaau

SEQ ID NO: 741906 - RNA, 19 nt, Homo sapiens
cgagaugcaucccaguguu

SEQ ID NO: 741907 - RNA, 19 nt, Homo sapiens
ggaggacacgggcaccuuu

SEQ ID NO: 741908 - RNA, 19 nt, Homo sapiens
gcaaauaaagaggguacuu

SEQ ID NO: 741909 - RNA, 19 nt, Homo sapiens
ccaguguuauguaaagaug

SEQ ID NO: 741910 - RNA, 19 nt, Homo sapiens
cacaugcucugaggaggua

SEQ ID NO: 741911 - RNA, 19 nt, Homo sapiens
gaaguuacucaaggauuug

SEQ ID NO: 741912 - RNA, 19 nt, Homo sapiens
caggucagcgggacuauga

SEQ ID NO: 741913 - RNA, 19 nt, Homo sapiens
ucuaucacgcccauuauaa

SEQ ID NO: 741914 - RNA, 19 nt, Homo sapiens
uagagcacauggcaucuca

SEQ ID NO: 741915 - RNA, 19 nt, Homo sapiens
ggagaaggcugggguagau

SEQ ID NO: 741916 - RNA, 19 nt, Homo sapiens
gaagucugaauuuggagaa

SEQ ID NO: 741917 - RNA, 19 nt, Homo sapiens
ugggaggccugauccaaga

SEQ ID NO: 741918 - RNA, 19 nt, Homo sapiens
gauggacuacgacaauguu

SEQ ID NO: 741919 - RNA, 19 nt, Homo sapiens
cagaagcuguucaaaauca

SEQ ID NO: 741920 - RNA, 19 nt, Homo sapiens
gacaggcugcugaggguaa

SEQ ID NO: 741921 - RNA, 19 nt, Homo sapiens
gcgaaguuacucaaggauu

SEQ ID NO: 741922 - RNA, 19 nt, Homo sapiens
gccgaucacaucaucauug

SEQ ID NO: 741923 - RNA, 19 nt, Homo sapiens
caaaggugggaaagagauu

SEQ ID NO: 741924 - RNA, 19 nt, Homo sapiens
caacgcaggcgaaguuacu

SEQ ID NO: 741925 - RNA, 19 nt, Homo sapiens
cuaucacgcccauuauaaa

SEQ ID NO: 741926 - RNA, 19 nt, Homo sapiens
ggagcauguugaggucuau

SEQ ID NO: 741927 - RNA, 19 nt, Homo sapiens
cacgguggcuggacgagau

SEQ ID NO: 741928 - RNA, 19 nt, Homo sapiens
gcucugaggagguagucaa

SEQ ID NO: 741929 - RNA, 19 nt, Homo sapiens
ucacgcccauuauaaacca

SEQ ID NO: 741930 - RNA, 19 nt, Homo sapiens
cagaucugauggacuacga

SEQ ID NO: 741931 - RNA, 19 nt, Homo sapiens
cuuggaauauggaaucaca

SEQ ID NO: 741932 - RNA, 19 nt, Homo sapiens
ccaaaggugggaaagagau

SEQ ID NO: 741933 - RNA, 19 nt, Homo sapiens
gauggcagaagcuguucaa

SEQ ID NO: 741934 - RNA, 19 nt, Homo sapiens
aggcgaaguuacucaagga

SEQ ID NO: 741935 - RNA, 19 nt, Homo sapiens
gggcuggacaccaccauca

SEQ ID NO: 741936 - RNA, 19 nt, Homo sapiens
ggaauauggaaucacaagu

SEQ ID NO: 741937 - RNA, 19 nt, Homo sapiens
gucuaucacgcccauuaua

SEQ ID NO: 741938 - RNA, 19 nt, Homo sapiens
ccacaucuacgccauuggu

SEQ ID NO: 741939 - RNA, 19 nt, Homo sapiens
gaggacacgggcaccuuug

SEQ ID NO: 741940 - RNA, 19 nt, Homo sapiens
gaugacgaccuggguggaa

SEQ ID NO: 741941 - RNA, 19 nt, Homo sapiens
ggucuaucacgcccauuau

SEQ ID NO: 741942 - RNA, 19 nt, Homo sapiens
ggacagaaaagucaaguac

SEQ ID NO: 741943 - RNA, 19 nt, Homo sapiens
aaaaucacgugaaauccuu

SEQ ID NO: 741944 - RNA, 19 nt, Homo sapiens
aggagcauguugaggucua

SEQ ID NO: 741945 - RNA, 19 nt, Homo sapiens
gccaaaggugggaaagaga

SEQ ID NO: 741946 - RNA, 19 nt, Homo sapiens
cacgugaaauccuugaacu

SEQ ID NO: 741947 - RNA, 19 nt, Homo sapiens
ggacuacguggaaccuucu

SEQ ID NO: 741948 - RNA, 19 nt, Homo sapiens
uguccuccauggucauaga

SEQ ID NO: 741949 - RNA, 19 nt, Homo sapiens
gcuggacaccaccaucaug

SEQ ID NO: 741950 - RNA, 19 nt, Homo sapiens
ccgaucacaucaucauugc

SEQ ID NO: 741951 - RNA, 19 nt, Homo sapiens
gucagccgaucacaucauc

SEQ ID NO: 741952 - RNA, 19 nt, Homo sapiens
ugccaaaggugggaaagag

SEQ ID NO: 741953 - RNA, 19 nt, Homo sapiens
ggucagcgggacuaugauc

SEQ ID NO: 741954 - RNA, 19 nt, Homo sapiens
ucugauggacuacgacaau

SEQ ID NO: 741955 - RNA, 19 nt, Homo sapiens
gcaaagaauuagguaguaa

SEQ ID NO: 741956 - RNA, 19 nt, Homo sapiens
cgaaguuacucaaggauuu

SEQ ID NO: 741957 - RNA, 19 nt, Homo sapiens
gguaguaaauuuagaggaa

SEQ ID NO: 741958 - RNA, 19 nt, Homo sapiens
gaagauggcagaagcuguu

SEQ ID NO: 741959 - RNA, 19 nt, Homo sapiens
gaucacaucaucauugcua

SEQ ID NO: 741960 - RNA, 19 nt, Homo sapiens
ggcaaagaauuagguagua

SEQ ID NO: 741961 - RNA, 19 nt, Homo sapiens
gaaagagauucugcuguca

SEQ ID NO: 741962 - RNA, 19 nt, Homo sapiens
gagaugcaucccaguguua

SEQ ID NO: 741963 - RNA, 19 nt, Homo sapiens
gaauauggaaucacaagug

SEQ ID NO: 741964 - RNA, 19 nt, Homo sapiens
guacugagacagaagaaga

SEQ ID NO: 741965 - RNA, 19 nt, Homo sapiens
cgaccuggguggaaaccua

SEQ ID NO: 741966 - RNA, 19 nt, Homo sapiens
ccgcaugacuggaggaaga

SEQ ID NO: 741967 - RNA, 19 nt, Homo sapiens
gcaucccaguguuauguaa

SEQ ID NO: 741968 - RNA, 19 nt, Homo sapiens
gaaggaauccccuggaaaa

SEQ ID NO: 741969 - RNA, 19 nt, Homo sapiens
ggcagaagcuguucaaaau

SEQ ID NO: 741970 - RNA, 19 nt, Homo sapiens
gucaaguacuuuaacauca

SEQ ID NO: 741971 - RNA, 19 nt, Homo sapiens
cgagaugcaucccaguguu

SEQ ID NO: 741972 - RNA, 19 nt, Homo sapiens
gaaugguacuacagagauc

SEQ ID NO: 741973 - RNA, 19 nt, Homo sapiens
ggaggacacgggcaccuuu

SEQ ID NO: 741974 - RNA, 19 nt, Homo sapiens
ggaaugguacuacagagau

SEQ ID NO: 741975 - RNA, 19 nt, Homo sapiens
gcaaauaaagaggguacuu

SEQ ID NO: 741976 - RNA, 19 nt, Homo sapiens
ccaguguuauguaaagaug

SEQ ID NO: 741977 - RNA, 19 nt, Homo sapiens
gcauuguacugagacagaa

SEQ ID NO: 741978 - RNA, 19 nt, Homo sapiens
cacaugcucugaggaggua

SEQ ID NO: 741979 - RNA, 19 nt, Homo sapiens
gaaguuacucaaggauuug

SEQ ID NO: 741980 - RNA, 19 nt, Homo sapiens
caggucagcgggacuauga

SEQ ID NO: 741981 - RNA, 19 nt, Homo sapiens
ucuaucacgcccauuauaa

SEQ ID NO: 741982 - RNA, 19 nt, Homo sapiens
uagagcacauggcaucuca

SEQ ID NO: 741983 - RNA, 19 nt, Homo sapiens
ggagaaggcugggguagau

SEQ ID NO: 741984 - RNA, 19 nt, Homo sapiens
gaagucugaauuuggagaa

SEQ ID NO: 741985 - RNA, 19 nt, Homo sapiens
ugggaggccugauccaaga

SEQ ID NO: 741986 - RNA, 19 nt, Homo sapiens
gauggacuacgacaauguu

SEQ ID NO: 741987 - RNA, 19 nt, Homo sapiens
cagaagcuguucaaaauca

SEQ ID NO: 741988 - RNA, 19 nt, Homo sapiens
gacaauuaaaggcaaagaa

SEQ ID NO: 741989 - RNA, 19 nt, Homo sapiens
gacaggcugcugaggguaa

SEQ ID NO: 741990 - RNA, 19 nt, Homo sapiens
gcgaaguuacucaaggauu

SEQ ID NO: 741991 - RNA, 19 nt, Homo sapiens
gccgaucacaucaucauug

SEQ ID NO: 741992 - RNA, 19 nt, Homo sapiens
caaaggugggaaagagauu

SEQ ID NO: 741993 - RNA, 19 nt, Homo sapiens
caacgcaggcgaaguuacu

SEQ ID NO: 741994 - RNA, 19 nt, Homo sapiens
cuaucacgcccauuauaaa

SEQ ID NO: 741995 - RNA, 19 nt, Homo sapiens
ggagcauguugaggucuau

SEQ ID NO: 741996 - RNA, 19 nt, Homo sapiens
cacgguggcuggacgagau

SEQ ID NO: 741997 - RNA, 19 nt, Homo sapiens
uuagaggaaugguacuaca

SEQ ID NO: 741998 - RNA, 19 nt, Homo sapiens
ugagguaaagggccaguga

SEQ ID NO: 741999 - RNA, 19 nt, Homo sapiens
gcucugaggagguagucaa

SEQ ID NO: 742000 - RNA, 19 nt, Homo sapiens
ggacaauuaaaggcaaaga

SEQ ID NO: 742001 - RNA, 19 nt, Homo sapiens
uaaaggcaaagaauuaggu

SEQ ID NO: 742002 - RNA, 19 nt, Homo sapiens
ucacgcccauuauaaacca

SEQ ID NO: 742003 - RNA, 19 nt, Homo sapiens
cagaucugauggacuacga

SEQ ID NO: 742004 - RNA, 19 nt, Homo sapiens
cuuggaauauggaaucaca

SEQ ID NO: 742005 - RNA, 19 nt, Homo sapiens
ccaaaggugggaaagagau

SEQ ID NO: 742006 - RNA, 19 nt, Homo sapiens
gauggcagaagcuguucaa

SEQ ID NO: 742007 - RNA, 19 nt, Homo sapiens
aggcgaaguuacucaagga

SEQ ID NO: 742008 - RNA, 19 nt, Homo sapiens
aaaggcaaagaauuaggua

SEQ ID NO: 742009 - RNA, 19 nt, Homo sapiens
gggcuggacaccaccauca

SEQ ID NO: 742010 - RNA, 19 nt, Homo sapiens
ggaauauggaaucacaagu

SEQ ID NO: 742011 - RNA, 19 nt, Homo sapiens
gcucaggucagcgggacua

SEQ ID NO: 742012 - RNA, 19 nt, Homo sapiens
gucuaucacgcccauuaua

SEQ ID NO: 742013 - RNA, 19 nt, Homo sapiens
ccacaucuacgccauuggu

SEQ ID NO: 742014 - RNA, 19 nt, Homo sapiens
gaggacacgggcaccuuug

SEQ ID NO: 742015 - RNA, 19 nt, Homo sapiens
gaugacgaccuggguggaa

SEQ ID NO: 742016 - RNA, 19 nt, Homo sapiens
ggucuaucacgcccauuau

SEQ ID NO: 742017 - RNA, 19 nt, Homo sapiens
ggacagaaaagucaaguac

SEQ ID NO: 742018 - RNA, 19 nt, Homo sapiens
aaaaucacgugaaauccuu

SEQ ID NO: 742019 - RNA, 19 nt, Homo sapiens
agaggaaugguacuacaga

SEQ ID NO: 742020 - RNA, 19 nt, Homo sapiens
aggagcauguugaggucua

SEQ ID NO: 742021 - RNA, 19 nt, Homo sapiens
ggacuacguggaaccuucu

SEQ ID NO: 742022 - RNA, 19 nt, Homo sapiens
gccaaaggugggaaagaga

SEQ ID NO: 742023 - RNA, 19 nt, Homo sapiens
cacgugaaauccuugaacu

SEQ ID NO: 742024 - RNA, 19 nt, Homo sapiens
uguccuccauggucauaga

SEQ ID NO: 742025 - RNA, 19 nt, Homo sapiens
gcuggacaccaccaucaug

SEQ ID NO: 742026 - RNA, 19 nt, Homo sapiens
ccgaucacaucaucauugc

SEQ ID NO: 742027 - RNA, 19 nt, Homo sapiens
gucagccgaucacaucauc

SEQ ID NO: 742028 - RNA, 19 nt, Homo sapiens
ugccaaaggugggaaagag

SEQ ID NO: 742029 - RNA, 19 nt, Homo sapiens
ucugauggacuacgacaau

SEQ ID NO: 742030 - RNA, 19 nt, Homo sapiens
ggucagcgggacuaugauc

SEQ ID NO: 742031 - RNA, 19 nt, Homo sapiens
gccaguagcuugcagagua

SEQ ID NO: 742032 - RNA, 19 nt, Homo sapiens
cgaaguuacucaaggauuu

SEQ ID NO: 742033 - RNA, 19 nt, Homo sapiens
gaagauggcagaagcuguu

SEQ ID NO: 742034 - RNA, 19 nt, Homo sapiens
gaucacaucaucauugcua

SEQ ID NO: 742035 - RNA, 19 nt, Homo sapiens
gaaagagauucugcuguca

SEQ ID NO: 742036 - RNA, 19 nt, Homo sapiens
gagaugcaucccaguguua

SEQ ID NO: 742037 - RNA, 19 nt, Homo sapiens
gaauauggaaucacaagug

SEQ ID NO: 742038 - RNA, 19 nt, Homo sapiens
cgaccuggguggaaaccua

SEQ ID NO: 742039 - RNA, 19 nt, Homo sapiens
ccgcaugacuggaggaaga

SEQ ID NO: 742040 - RNA, 19 nt, Homo sapiens
gcaucccaguguuauguaa

SEQ ID NO: 742041 - RNA, 19 nt, Homo sapiens
gaaggaauccccuggaaaa

SEQ ID NO: 742042 - RNA, 19 nt, Homo sapiens
ggcagaagcuguucaaaau

SEQ ID NO: 742043 - RNA, 19 nt, Homo sapiens
uagacacgaugacaccuuu

SEQ ID NO: 742044 - RNA, 19 nt, Homo sapiens
gucaaguacuuuaacauca

SEQ ID NO: 742045 - RNA, 19 nt, Homo sapiens
cgagaugcaucccaguguu

SEQ ID NO: 742046 - RNA, 19 nt, Homo sapiens
ggaggacacgggcaccuuu

SEQ ID NO: 742047 - RNA, 19 nt, Homo sapiens
gcaaauaaagaggguacuu

SEQ ID NO: 742048 - RNA, 19 nt, Homo sapiens
ccaguguuauguaaagaug

SEQ ID NO: 742049 - RNA, 19 nt, Homo sapiens
cacaugcucugaggaggua

SEQ ID NO: 742050 - RNA, 19 nt, Homo sapiens
gaaguuacucaaggauuug

SEQ ID NO: 742051 - RNA, 19 nt, Homo sapiens
caggucagcgggacuauga

SEQ ID NO: 742052 - RNA, 19 nt, Homo sapiens
ucuaucacgcccauuauaa

SEQ ID NO: 742053 - RNA, 19 nt, Homo sapiens
uagagcacauggcaucuca

SEQ ID NO: 742054 - RNA, 19 nt, Homo sapiens
ggagaaggcugggguagau

SEQ ID NO: 742055 - RNA, 19 nt, Homo sapiens
gaagucugaauuuggagaa

SEQ ID NO: 742056 - RNA, 19 nt, Homo sapiens
ugggaggccugauccaaga

SEQ ID NO: 742057 - RNA, 19 nt, Homo sapiens
gauggacuacgacaauguu

SEQ ID NO: 742058 - RNA, 19 nt, Homo sapiens
cagaagcuguucaaaauca

SEQ ID NO: 742059 - RNA, 19 nt, Homo sapiens
gacaggcugcugaggguaa

SEQ ID NO: 742060 - RNA, 19 nt, Homo sapiens
ccaguagcuugcagaguag

SEQ ID NO: 742061 - RNA, 19 nt, Homo sapiens
gcgaaguuacucaaggauu

SEQ ID NO: 742062 - RNA, 19 nt, Homo sapiens
gccgaucacaucaucauug

SEQ ID NO: 742063 - RNA, 19 nt, Homo sapiens
caaaggugggaaagagauu

SEQ ID NO: 742064 - RNA, 19 nt, Homo sapiens
caacgcaggcgaaguuacu

SEQ ID NO: 742065 - RNA, 19 nt, Homo sapiens
cuaucacgcccauuauaaa

SEQ ID NO: 742066 - RNA, 19 nt, Homo sapiens
ggagcauguugaggucuau

SEQ ID NO: 742067 - RNA, 19 nt, Homo sapiens
cacgguggcuggacgagau

SEQ ID NO: 742068 - RNA, 19 nt, Homo sapiens
gcucugaggagguagucaa

SEQ ID NO: 742069 - RNA, 19 nt, Homo sapiens
ucacgcccauuauaaacca

SEQ ID NO: 742070 - RNA, 19 nt, Homo sapiens
cagaucugauggacuacga

SEQ ID NO: 742071 - RNA, 19 nt, Homo sapiens
cuuggaauauggaaucaca

SEQ ID NO: 742072 - RNA, 19 nt, Homo sapiens
ccaaaggugggaaagagau

SEQ ID NO: 742073 - RNA, 19 nt, Homo sapiens
gauggcagaagcuguucaa

SEQ ID NO: 742074 - RNA, 19 nt, Homo sapiens
aggcgaaguuacucaagga

SEQ ID NO: 742075 - RNA, 19 nt, Homo sapiens
gggcuggacaccaccauca

SEQ ID NO: 742076 - RNA, 19 nt, Homo sapiens
ggaauauggaaucacaagu

SEQ ID NO: 742077 - RNA, 19 nt, Homo sapiens
guagacacgaugacaccuu

SEQ ID NO: 742078 - RNA, 19 nt, Homo sapiens
gucuaucacgcccauuaua

SEQ ID NO: 742079 - RNA, 19 nt, Homo sapiens
ccacaucuacgccauuggu

SEQ ID NO: 742080 - RNA, 19 nt, Homo sapiens
gaggacacgggcaccuuug

SEQ ID NO: 742081 - RNA, 19 nt, Homo sapiens
gaugacgaccuggguggaa

SEQ ID NO: 742082 - RNA, 19 nt, Homo sapiens
ggucuaucacgcccauuau

SEQ ID NO: 742083 - RNA, 19 nt, Homo sapiens
ggacagaaaagucaaguac

SEQ ID NO: 742084 - RNA, 19 nt, Homo sapiens
aaaaucacgugaaauccuu

SEQ ID NO: 742085 - RNA, 19 nt, Homo sapiens
aggagcauguugaggucua

SEQ ID NO: 742086 - RNA, 19 nt, Homo sapiens
gccaaaggugggaaagaga

SEQ ID NO: 742087 - RNA, 19 nt, Homo sapiens
cacgugaaauccuugaacu

SEQ ID NO: 742088 - RNA, 19 nt, Homo sapiens
ggacuacguggaaccuucu

SEQ ID NO: 742089 - RNA, 19 nt, Homo sapiens
uguccuccauggucauaga

SEQ ID NO: 742090 - RNA, 19 nt, Homo sapiens
gcuggacaccaccaucaug

SEQ ID NO: 742091 - RNA, 19 nt, Homo sapiens
ccgaucacaucaucauugc

SEQ ID NO: 742092 - RNA, 19 nt, Homo sapiens
gucagccgaucacaucauc

SEQ ID NO: 742093 - RNA, 19 nt, Homo sapiens
ugccaaaggugggaaagag

SEQ ID NO: 742094 - RNA, 19 nt, Homo sapiens
guacuuccccucucuacuu

SEQ ID NO: 742095 - RNA, 19 nt, Homo sapiens
ucugauggacuacgacaau

SEQ ID NO: 742096 - RNA, 19 nt, Homo sapiens
ggucagcgggacuaugauc

SEQ ID NO: 742097 - RNA, 19 nt, Homo sapiens
cagaagagaucaucaagga

SEQ ID NO: 742098 - RNA, 19 nt, Homo sapiens
gaggaaauuucuuuacuuc

SEQ ID NO: 742099 - RNA, 19 nt, Homo sapiens
gaauacagacugcauuuua

SEQ ID NO: 742100 - RNA, 19 nt, Homo sapiens
gagcaugcaagaugaaauu

SEQ ID NO: 742101 - RNA, 19 nt, Homo sapiens
ggcaagggcuacuaugaug

SEQ ID NO: 742102 - RNA, 19 nt, Homo sapiens
gcaaucacauggauauggu

SEQ ID NO: 742103 - RNA, 19 nt, Homo sapiens
guaaagcaaaguaugugua

SEQ ID NO: 742104 - RNA, 19 nt, Homo sapiens
ggauuacuacagccaaaua

SEQ ID NO: 742105 - RNA, 19 nt, Homo sapiens
aagaugaaauugagacaga

SEQ ID NO: 742106 - RNA, 19 nt, Homo sapiens
gggcuacuaugaugccuau

SEQ ID NO: 742107 - RNA, 19 nt, Homo sapiens
uagaugaaguccuuuacga

SEQ ID NO: 742108 - RNA, 19 nt, Homo sapiens
gaaggugauugcccacagu

SEQ ID NO: 742109 - RNA, 19 nt, Homo sapiens
caauagaagugugaauagu

SEQ ID NO: 742110 - RNA, 19 nt, Homo sapiens
ccagagcaaucacauggau

SEQ ID NO: 742111 - RNA, 19 nt, Homo sapiens
cagaggaaauuucuuuacu

SEQ ID NO: 742112 - RNA, 19 nt, Homo sapiens
caccagaggaaauuucuuu

SEQ ID NO: 742113 - RNA, 19 nt, Homo sapiens
gaaauugagacagaagaga

SEQ ID NO: 742114 - RNA, 19 nt, Homo sapiens
gagaguaaagcaaaguaug

SEQ ID NO: 742115 - RNA, 19 nt, Homo sapiens
gugaauacagacugcauuu

SEQ ID NO: 742116 - RNA, 19 nt, Homo sapiens
gacuugaucucaucuucau

SEQ ID NO: 742117 - RNA, 19 nt, Homo sapiens
gauuacuacagccaaauaa

SEQ ID NO: 742118 - RNA, 19 nt, Homo sapiens
cgacaugaagguagaugaa

SEQ ID NO: 742119 - RNA, 19 nt, Homo sapiens
gggacuugaucucaucuuc

SEQ ID NO: 742120 - RNA, 19 nt, Homo sapiens
gagaucaucaaggacauuu

SEQ ID NO: 742121 - RNA, 19 nt, Homo sapiens
auagaagugugaauaguag

SEQ ID NO: 742122 - RNA, 19 nt, Homo sapiens
ccaauagaagugugaauag

SEQ ID NO: 742123 - RNA, 19 nt, Homo sapiens
ggacuugaucucaucuuca

SEQ ID NO: 742124 - RNA, 19 nt, Homo sapiens
gauauggugagaauagaau

SEQ ID NO: 742125 - RNA, 19 nt, Homo sapiens
gcaugcaagaugaaauuga

SEQ ID NO: 742126 - RNA, 19 nt, Homo sapiens
gggcaagggcuacuaugau

SEQ ID NO: 742127 - RNA, 19 nt, Homo sapiens
ggauauggugagaauagaa

SEQ ID NO: 742128 - RNA, 19 nt, Homo sapiens
acauggauauggugagaau

SEQ ID NO: 742129 - RNA, 19 nt, Homo sapiens
cccaaaacauccuggaaua

SEQ ID NO: 742130 - RNA, 19 nt, Homo sapiens
caugcaagaugaaauugag

SEQ ID NO: 742131 - RNA, 19 nt, Homo sapiens
aauagaaucaccagaggaa

SEQ ID NO: 742132 - RNA, 19 nt, Homo sapiens
agacagaagagaucaucaa

SEQ ID NO: 742133 - RNA, 19 nt, Homo sapiens
gaagugugaauaguagaau

SEQ ID NO: 742134 - RNA, 19 nt, Homo sapiens
cuacuaugaugccuaucug

SEQ ID NO: 742135 - RNA, 19 nt, Homo sapiens
uagaaucaccagaggaaau

SEQ ID NO: 742136 - RNA, 19 nt, Homo sapiens
acaugaagguagaugaagu

SEQ ID NO: 742137 - RNA, 19 nt, Homo sapiens
agaaucaccagaggaaauu

SEQ ID NO: 742138 - RNA, 19 nt, Homo sapiens
gaguaaagcaaaguaugug

SEQ ID NO: 742139 - RNA, 19 nt, Homo sapiens
agaguaaagcaaaguaugu

SEQ ID NO: 742140 - RNA, 19 nt, Homo sapiens
augaaguccuuuacgaaga

SEQ ID NO: 742141 - RNA, 19 nt, Homo sapiens
gcaagaugaaauugagaca

SEQ ID NO: 742142 - RNA, 19 nt, Homo sapiens
agccaaauaaucaguguuu

SEQ ID NO: 742143 - RNA, 19 nt, Homo sapiens
uuacuacagccaaauaauc

SEQ ID NO: 742144 - RNA, 19 nt, Homo sapiens
ugccaggccuuggguuuga

SEQ ID NO: 742145 - RNA, 19 nt, Homo sapiens
agagcaaucacauggauau

SEQ ID NO: 742146 - RNA, 19 nt, Homo sapiens
accaauagaagugugaaua

SEQ ID NO: 742147 - RNA, 19 nt, Homo sapiens
ugaaguccuuuacgaagac

SEQ ID NO: 742148 - RNA, 19 nt, Homo sapiens
gacagaagagaucaucaag

SEQ ID NO: 742149 - RNA, 19 nt, Homo sapiens
gaaucaccagaggaaauuu

SEQ ID NO: 742150 - RNA, 19 nt, Homo sapiens
uuucugagcaugcaagaug

SEQ ID NO: 742151 - RNA, 19 nt, Homo sapiens
uacuacagccaaauaauca

SEQ ID NO: 742152 - RNA, 19 nt, Homo sapiens
agaugaaguccuuuacgaa

SEQ ID NO: 742153 - RNA, 19 nt, Homo sapiens
ccagaggaaauuucuuuac

SEQ ID NO: 742154 - RNA, 19 nt, Homo sapiens
agaugaaauugagacagaa

SEQ ID NO: 742155 - RNA, 19 nt, Homo sapiens
gcuacuaugaugccuaucu

SEQ ID NO: 742156 - RNA, 19 nt, Homo sapiens
aaauugagacagaagagau

SEQ ID NO: 742157 - RNA, 19 nt, Homo sapiens
cagagcaaucacauggaua

SEQ ID NO: 742158 - RNA, 19 nt, Homo sapiens
agaagugugaauaguagaa

SEQ ID NO: 742159 - RNA, 19 nt, Homo sapiens
ugagaguaaagcaaaguau

SEQ ID NO: 742160 - RNA, 19 nt, Homo sapiens
gcccacagugaguaucaaa

SEQ ID NO: 742161 - RNA, 19 nt, Homo sapiens
aaaacgacaugaagguaga

SEQ ID NO: 742162 - RNA, 19 nt, Homo sapiens
gaugaaauugagacagaag

SEQ ID NO: 742163 - RNA, 19 nt, Homo sapiens
gguaccgguuccagagcaa

SEQ ID NO: 742164 - RNA, 19 nt, Homo sapiens
cuggauuacuacagccaaa

SEQ ID NO: 742165 - RNA, 19 nt, Homo sapiens
uggauauggugagaauaga

SEQ ID NO: 742166 - RNA, 19 nt, Homo sapiens
guagagcuguucuuaaauu

SEQ ID NO: 742167 - RNA, 19 nt, Homo sapiens
gaagguagagcuguucuua

SEQ ID NO: 742168 - RNA, 19 nt, Homo sapiens
uagagucgcuguugaagaa

SEQ ID NO: 742169 - RNA, 19 nt, Homo sapiens
gcaagaagaagaaguacaa

SEQ ID NO: 742170 - RNA, 19 nt, Homo sapiens
gagagaagguagagcuguu

SEQ ID NO: 742171 - RNA, 19 nt, Homo sapiens
agguagagcuguucuuaaa

SEQ ID NO: 742172 - RNA, 19 nt, Homo sapiens
gcagacggacgaagagauu

SEQ ID NO: 742173 - RNA, 19 nt, Homo sapiens
ggaugaaucugaggacaca

SEQ ID NO: 742174 - RNA, 19 nt, Homo sapiens
gcagcaguuugacuucuug

SEQ ID NO: 742175 - RNA, 19 nt, Homo sapiens
cgagcaagaagaagaagua

SEQ ID NO: 742176 - RNA, 19 nt, Homo sapiens
gaagaggacgaagaagauu

SEQ ID NO: 742177 - RNA, 19 nt, Homo sapiens
cgaagaccaugaccacauc

SEQ ID NO: 742178 - RNA, 19 nt, Homo sapiens
ggaagacaaccacauggau

SEQ ID NO: 742179 - RNA, 19 nt, Homo sapiens
gggaagaggagacaucaca

SEQ ID NO: 742180 - RNA, 19 nt, Homo sapiens
ugaagaggacgaagaagau

SEQ ID NO: 742181 - RNA, 19 nt, Homo sapiens
ggaagaggagacaucacaa

SEQ ID NO: 742182 - RNA, 19 nt, Homo sapiens
gagcagcaguuugacuucu

SEQ ID NO: 742183 - RNA, 19 nt, Homo sapiens
aagaggacgaagaagauua

SEQ ID NO: 742184 - RNA, 19 nt, Homo sapiens
gaccacaucccaccugaag

SEQ ID NO: 742185 - RNA, 19 nt, Homo sapiens
gaagaggagacaucacaac

SEQ ID NO: 742186 - RNA, 19 nt, Homo sapiens
gggaagacaaccacaugga

SEQ ID NO: 742187 - RNA, 19 nt, Homo sapiens
gcgaagaccaugaccacau

SEQ ID NO: 742188 - RNA, 19 nt, Homo sapiens
ugaugaagaggacgaagaa

SEQ ID NO: 742189 - RNA, 19 nt, Homo sapiens
ccacaucccaccugaagca

SEQ ID NO: 742190 - RNA, 19 nt, Homo sapiens
gagaugccgagcaagaaga

SEQ ID NO: 742191 - RNA, 19 nt, Homo sapiens
ggcggugccugucaucauc

SEQ ID NO: 742192 - RNA, 19 nt, Homo sapiens
gaccauagccccuuuuagu

SEQ ID NO: 742193 - RNA, 19 nt, Homo sapiens
acucggagcaggaggauga

SEQ ID NO: 742194 - RNA, 19 nt, Homo sapiens
gaacgaaaagcaaggacaa

SEQ ID NO: 742195 - RNA, 19 nt, Homo sapiens
acgaagagauugggaaggu

SEQ ID NO: 742196 - RNA, 19 nt, Homo sapiens
ggagcaggaggaugaaucu

SEQ ID NO: 742197 - RNA, 19 nt, Homo sapiens
gguagagcuguucuuaaau

SEQ ID NO: 742198 - RNA, 19 nt, Homo sapiens
aagaagauuacgacuccua

SEQ ID NO: 742199 - RNA, 19 nt, Homo sapiens
gaggacacagauacugaug

SEQ ID NO: 742200 - RNA, 19 nt, Homo sapiens
gggaaucucagugucuguu

SEQ ID NO: 742201 - RNA, 19 nt, Homo sapiens
gaaaagcaaggacaagaag

SEQ ID NO: 742202 - RNA, 19 nt, Homo sapiens
ggagcagcaguuugacuuc

SEQ ID NO: 742203 - RNA, 19 nt, Homo sapiens
ggaccugguggcaucuguu

SEQ ID NO: 742204 - RNA, 19 nt, Homo sapiens
ggaaauaaaucugcaauug

SEQ ID NO: 742205 - RNA, 19 nt, Homo sapiens
gagagcaagucaagaaaua

SEQ ID NO: 742206 - RNA, 19 nt, Homo sapiens
ugaaagagcuugcugguau

SEQ ID NO: 742207 - RNA, 19 nt, Homo sapiens
ggaacucgaugcuuucuuu

SEQ ID NO: 742208 - RNA, 19 nt, Homo sapiens
acucaaagcuaaucagaua

SEQ ID NO: 742209 - RNA, 19 nt, Homo sapiens
caagaugccucuaaagaug

SEQ ID NO: 742210 - RNA, 19 nt, Homo sapiens
ugacagcaguggcuuuaua

SEQ ID NO: 742211 - RNA, 19 nt, Homo sapiens
gaaagaagcaggagagcaa

SEQ ID NO: 742212 - RNA, 19 nt, Homo sapiens
agaaggaacucgaugcuuu

SEQ ID NO: 742213 - RNA, 19 nt, Homo sapiens
aaacuuccuucuccaauuu

SEQ ID NO: 742214 - RNA, 19 nt, Homo sapiens
aggcuaaacuggaagaaua

SEQ ID NO: 742215 - RNA, 19 nt, Homo sapiens
gaaagagcuugcugguaug

SEQ ID NO: 742216 - RNA, 19 nt, Homo sapiens
caaauggugugcuauucuu

SEQ ID NO: 742217 - RNA, 19 nt, Homo sapiens
ggguggaccuugauaaguu

SEQ ID NO: 742218 - RNA, 19 nt, Homo sapiens
gauggucgguuggaucuaa

SEQ ID NO: 742219 - RNA, 19 nt, Homo sapiens
gaaauaaaucugcaauugg

SEQ ID NO: 742220 - RNA, 19 nt, Homo sapiens
gaaaaucuuugccuacuau

SEQ ID NO: 742221 - RNA, 19 nt, Homo sapiens
gcagcugagugcauucauu

SEQ ID NO: 742222 - RNA, 19 nt, Homo sapiens
cuaaucagauagcgaaaga

SEQ ID NO: 742223 - RNA, 19 nt, Homo sapiens
gagcuggcuuugugucuug

SEQ ID NO: 742224 - RNA, 19 nt, Homo sapiens
guucuuaucugaggaugaa

SEQ ID NO: 742225 - RNA, 19 nt, Homo sapiens
agacucagcuccccuguua

SEQ ID NO: 742226 - RNA, 19 nt, Homo sapiens
gauucuggcucuucaggaa

SEQ ID NO: 742227 - RNA, 19 nt, Homo sapiens
ggacagcagcguggaguuu

SEQ ID NO: 742228 - RNA, 19 nt, Homo sapiens
caacaguuacucaaagcua

SEQ ID NO: 742229 - RNA, 19 nt, Homo sapiens
gauggucgcauucggauga

SEQ ID NO: 742230 - RNA, 19 nt, Homo sapiens
ugacagaaauaaagauggu

SEQ ID NO: 742231 - RNA, 19 nt, Homo sapiens
ugaugaaacuggguacuga

SEQ ID NO: 742232 - RNA, 19 nt, Homo sapiens
uguagugucuguguuguuu

SEQ ID NO: 742233 - RNA, 19 nt, Homo sapiens
cauaaucccagacugcuuu

SEQ ID NO: 742234 - RNA, 19 nt, Homo sapiens
cagcaacaguuacucaaag

SEQ ID NO: 742235 - RNA, 19 nt, Homo sapiens
caaggauucuggcucuuca

SEQ ID NO: 742236 - RNA, 19 nt, Homo sapiens
uaaaugacuuagcaaggau

SEQ ID NO: 742237 - RNA, 19 nt, Homo sapiens
gcaccaugaugaagauuuu

SEQ ID NO: 742238 - RNA, 19 nt, Homo sapiens
gaaggaacucgaugcuuuc

SEQ ID NO: 742239 - RNA, 19 nt, Homo sapiens
cagcugagugcauucauuu

SEQ ID NO: 742240 - RNA, 19 nt, Homo sapiens
agucugagcuggcuuugug

SEQ ID NO: 742241 - RNA, 19 nt, Homo sapiens
gguuggaucuaaaugacuu

SEQ ID NO: 742242 - RNA, 19 nt, Homo sapiens
caggagagcaagucaagaa

SEQ ID NO: 742243 - RNA, 19 nt, Homo sapiens
ggucaugaaagcaaauuug

SEQ ID NO: 742244 - RNA, 19 nt, Homo sapiens
gacagcagcguggaguuua

SEQ ID NO: 742245 - RNA, 19 nt, Homo sapiens
gcugguauguucuuaucug

SEQ ID NO: 742246 - RNA, 19 nt, Homo sapiens
ccaagaugccucuaaagau

SEQ ID NO: 742247 - RNA, 19 nt, Homo sapiens
caaauuugcacaaggugaa

SEQ ID NO: 742248 - RNA, 19 nt, Homo sapiens
gaaacuggguacugaugac

SEQ ID NO: 742249 - RNA, 19 nt, Homo sapiens
ugaaagguguguggcauuc

SEQ ID NO: 742250 - RNA, 19 nt, Homo sapiens
ggagagcaagucaagaaau

SEQ ID NO: 742251 - RNA, 19 nt, Homo sapiens
gaacacagugggcaaacuc

SEQ ID NO: 742252 - RNA, 19 nt, Homo sapiens
gaucuugcugguagaauug

SEQ ID NO: 742253 - RNA, 19 nt, Homo sapiens
ugaucuugcugguagaauu

SEQ ID NO: 742254 - RNA, 19 nt, Homo sapiens
gaauacacuggcaccauga

SEQ ID NO: 742255 - RNA, 19 nt, Homo sapiens
uacccaagaugccucuaaa

SEQ ID NO: 742256 - RNA, 19 nt, Homo sapiens
cagcaguggcuuuauauca

SEQ ID NO: 742257 - RNA, 19 nt, Homo sapiens
aacaguuacucaaagcuaa

SEQ ID NO: 742258 - RNA, 19 nt, Homo sapiens
aauuguaucugugcauuga

SEQ ID NO: 742259 - RNA, 19 nt, Homo sapiens
agaauuguaucugugcauu

SEQ ID NO: 742260 - RNA, 19 nt, Homo sapiens
ggaaggcccagaaguggau

SEQ ID NO: 742261 - RNA, 19 nt, Homo sapiens
aaacuuucuucugcucuuu

SEQ ID NO: 742262 - RNA, 19 nt, Homo sapiens
ccuguaacuucaacauaga

SEQ ID NO: 742263 - RNA, 19 nt, Homo sapiens
gcaauccuguaacuucaac

SEQ ID NO: 742264 - RNA, 19 nt, Homo sapiens
ucagauagcgaaagaagca

SEQ ID NO: 742265 - RNA, 19 nt, Homo sapiens
gguggaccuugauaaguuc

SEQ ID NO: 742266 - RNA, 19 nt, Homo sapiens
gcaaggauucuggcucuuc

SEQ ID NO: 742267 - RNA, 19 nt, Homo sapiens
ggccauuucugaggcuaaa

SEQ ID NO: 742268 - RNA, 19 nt, Homo sapiens
cugcugagcuccgcaacuu

SEQ ID NO: 742269 - RNA, 19 nt, Homo sapiens
gacagcaguggcuuuauau

SEQ ID NO: 742270 - RNA, 19 nt, Homo sapiens
gauaaguuccgcgagauuc

SEQ ID NO: 742271 - RNA, 19 nt, Homo sapiens
aagguuacauagaagagaa

SEQ ID NO: 742272 - RNA, 19 nt, Homo sapiens
gcguggaguuuaugcagau

SEQ ID NO: 742273 - RNA, 19 nt, Homo sapiens
guuuaugacuacccaagau

SEQ ID NO: 742274 - RNA, 19 nt, Homo sapiens
acacggucaugaaagcaaa

SEQ ID NO: 742275 - RNA, 19 nt, Homo sapiens
gaauuguaucugugcauug

SEQ ID NO: 742276 - RNA, 19 nt, Homo sapiens
gaaguggauggguuuguca

SEQ ID NO: 742277 - RNA, 19 nt, Homo sapiens
uaaaauggaugcuuguucu

SEQ ID NO: 742278 - RNA, 19 nt, Homo sapiens
uccgagaccucuuucuuca

SEQ ID NO: 742279 - RNA, 19 nt, Homo sapiens
cccaagaugccucuaaaga

SEQ ID NO: 742280 - RNA, 19 nt, Homo sapiens
gcgcuuugaugcggaugaa

SEQ ID NO: 742281 - RNA, 19 nt, Homo sapiens
uggcaauccuguaacuuca

SEQ ID NO: 742282 - RNA, 19 nt, Homo sapiens
uuacauagaagagaaggaa

SEQ ID NO: 742283 - RNA, 19 nt, Homo sapiens
uaaagauggucgguuggau

SEQ ID NO: 742284 - RNA, 19 nt, Homo sapiens
agagcuugcugguauguuc

SEQ ID NO: 742285 - RNA, 19 nt, Homo sapiens
ugggcaaacucacaaaugg

SEQ ID NO: 742286 - RNA, 19 nt, Homo sapiens
ggaacacagugggcaaacu

SEQ ID NO: 742287 - RNA, 19 nt, Homo sapiens
ccagcaacaguuacucaaa

SEQ ID NO: 742288 - RNA, 19 nt, Homo sapiens
uggaguuuaugcagauuug

SEQ ID NO: 742289 - RNA, 19 nt, Homo sapiens
gaaagccccuguguagugu

SEQ ID NO: 742290 - RNA, 19 nt, Homo sapiens
gaacucgaugcuuucuuuc

SEQ ID NO: 742291 - RNA, 19 nt, Homo sapiens
gcauucauuuugugcuuuu

SEQ ID NO: 742292 - RNA, 19 nt, Homo sapiens
gagaaggaacucgaugcuu

SEQ ID NO: 742293 - RNA, 19 nt, Homo sapiens
gcucuuacuauguuucugu

SEQ ID NO: 742294 - RNA, 19 nt, Homo sapiens
gaagcaggagagcaaguca

SEQ ID NO: 742295 - RNA, 19 nt, Homo sapiens
cucuaaagauggucgcauu

SEQ ID NO: 742296 - RNA, 19 nt, Homo sapiens
aaucugcaauuggaaacaa

SEQ ID NO: 742297 - RNA, 19 nt, Homo sapiens
aaagguguguggcauucau

SEQ ID NO: 742298 - RNA, 19 nt, Homo sapiens
uuacuauguuucugugauc

SEQ ID NO: 742299 - RNA, 19 nt, Homo sapiens
ggaugcuuguucuacugaa

SEQ ID NO: 742300 - RNA, 19 nt, Homo sapiens
ugaaacuggguacugauga

SEQ ID NO: 742301 - RNA, 19 nt, Homo sapiens
uccuguaacuucaacauag

SEQ ID NO: 742302 - RNA, 19 nt, Homo sapiens
ccucuuucuucaccacaaa

SEQ ID NO: 742303 - RNA, 19 nt, Homo sapiens
acagcagcguggaguuuau

SEQ ID NO: 742304 - RNA, 19 nt, Homo sapiens
gacccaaccacuugacuua

SEQ ID NO: 742305 - RNA, 19 nt, Homo sapiens
guaccauuccuuccucuua

SEQ ID NO: 742306 - RNA, 19 nt, Homo sapiens
gacuuaaucucacuuucuu

SEQ ID NO: 742307 - RNA, 19 nt, Homo sapiens
acacugcucuaguaccauu

SEQ ID NO: 742308 - RNA, 19 nt, Homo sapiens
cucagacacugcucuagua

SEQ ID NO: 742309 - RNA, 19 nt, Homo sapiens
ccaaccacuugacuuaauc

SEQ ID NO: 742310 - RNA, 19 nt, Homo sapiens
cccaaccacuugacuuaau

SEQ ID NO: 742311 - RNA, 19 nt, Homo sapiens
agacacugcucuaguacca

SEQ ID NO: 742312 - RNA, 19 nt, Homo sapiens
uaccauuccuuccucuuag

SEQ ID NO: 742313 - RNA, 19 nt, Homo sapiens
ugacuuaaucucacuuucu

SEQ ID NO: 742314 - RNA, 19 nt, Homo sapiens
ccugcuggaucgauacuuc

SEQ ID NO: 742315 - RNA, 19 nt, Homo sapiens
guacuucugcgggagcauu

SEQ ID NO: 742316 - RNA, 19 nt, Homo sapiens
ggaaauaccuggaaagaaa

SEQ ID NO: 742317 - RNA, 19 nt, Homo sapiens
gagaagaacuggaauagaa

SEQ ID NO: 742318 - RNA, 19 nt, Homo sapiens
gaaccaggauguaugaaua

SEQ ID NO: 742319 - RNA, 19 nt, Homo sapiens
uaaagaagcuggucagaga

SEQ ID NO: 742320 - RNA, 19 nt, Homo sapiens
gaacgacucuacaauguug

SEQ ID NO: 742321 - RNA, 19 nt, Homo sapiens
aaccacagcuuuagaauua

SEQ ID NO: 742322 - RNA, 19 nt, Homo sapiens
gagcacauguggaaguuua

SEQ ID NO: 742323 - RNA, 19 nt, Homo sapiens
gcaaugacuugaugaagaa

SEQ ID NO: 742324 - RNA, 19 nt, Homo sapiens
ggaauuagcaggucuuaaa

SEQ ID NO: 742325 - RNA, 19 nt, Homo sapiens
gauaaugacuagaacugua

SEQ ID NO: 742326 - RNA, 19 nt, Homo sapiens
gaagaaaugucaauaugag

SEQ ID NO: 742327 - RNA, 19 nt, Homo sapiens
gcauacaucuuacaaacaa

SEQ ID NO: 742328 - RNA, 19 nt, Homo sapiens
ucaaagauguucaggauga

SEQ ID NO: 742329 - RNA, 19 nt, Homo sapiens
ugaagaggcagauuuauua

SEQ ID NO: 742330 - RNA, 19 nt, Homo sapiens
ggaaagaucguccuacuug

SEQ ID NO: 742331 - RNA, 19 nt, Homo sapiens
cagcaaagcucauaucaca

SEQ ID NO: 742332 - RNA, 19 nt, Homo sapiens
aaacgucgauacacuauaa

SEQ ID NO: 742333 - RNA, 19 nt, Homo sapiens
ggaccgaagucaaugguuu

SEQ ID NO: 742334 - RNA, 19 nt, Homo sapiens
agaauuagaugcccuuaaa

SEQ ID NO: 742335 - RNA, 19 nt, Homo sapiens
gaacugagaaucaaagaga

SEQ ID NO: 742336 - RNA, 19 nt, Homo sapiens
gaaauuaagacgauacuug

SEQ ID NO: 742337 - RNA, 19 nt, Homo sapiens
gaaagauuaugacuggauu

SEQ ID NO: 742338 - RNA, 19 nt, Homo sapiens
gcaagaagaugaaagaaaa

SEQ ID NO: 742339 - RNA, 19 nt, Homo sapiens
gagaacgacucuacaaugu

SEQ ID NO: 742340 - RNA, 19 nt, Homo sapiens
agagagagcauacaucuua

SEQ ID NO: 742341 - RNA, 19 nt, Homo sapiens
uaaacaagcugaaguuaag

SEQ ID NO: 742342 - RNA, 19 nt, Homo sapiens
gaacuggaauagaaauugu

SEQ ID NO: 742343 - RNA, 19 nt, Homo sapiens
gagcauauauuccucaucu

SEQ ID NO: 742344 - RNA, 19 nt, Homo sapiens
gauaagaggauaaugacua

SEQ ID NO: 742345 - RNA, 19 nt, Homo sapiens
uagaagaccuugaccagaa

SEQ ID NO: 742346 - RNA, 19 nt, Homo sapiens
gguucgggcuucuaauuua

SEQ ID NO: 742347 - RNA, 19 nt, Homo sapiens
aaauaaagcucaagaagag

SEQ ID NO: 742348 - RNA, 19 nt, Homo sapiens
uggaagagcucaagagaga

SEQ ID NO: 742349 - RNA, 19 nt, Homo sapiens
gaagcaugcucaacaggaa

SEQ ID NO: 742350 - RNA, 19 nt, Homo sapiens
gaagagcgaugcaaugacu

SEQ ID NO: 742351 - RNA, 19 nt, Homo sapiens
gcuaucaaauccuaugaaa

SEQ ID NO: 742352 - RNA, 19 nt, Homo sapiens
gcagcugucucgugauauu

SEQ ID NO: 742353 - RNA, 19 nt, Homo sapiens
ggaagaaaugucaauauga

SEQ ID NO: 742354 - RNA, 19 nt, Homo sapiens
gagcauacaucuuacaaac

SEQ ID NO: 742355 - RNA, 19 nt, Homo sapiens
caaaggagcacauguggaa

SEQ ID NO: 742356 - RNA, 19 nt, Homo sapiens
caagcaacaagaagaauua

SEQ ID NO: 742357 - RNA, 19 nt, Homo sapiens
aaaccaagcccuaaauauu

SEQ ID NO: 742358 - RNA, 19 nt, Homo sapiens
gaauaaacaagcugaaguu

SEQ ID NO: 742359 - RNA, 19 nt, Homo sapiens
cuucaaaccugcuccaauu

SEQ ID NO: 742360 - RNA, 19 nt, Homo sapiens
uaaugaagauggagcagaa

SEQ ID NO: 742361 - RNA, 19 nt, Homo sapiens
ggacuugagauaacuaauu

SEQ ID NO: 742362 - RNA, 19 nt, Homo sapiens
uaugagagcuaugaaugua

SEQ ID NO: 742363 - RNA, 19 nt, Homo sapiens
ggaauuagaccaccacauc

SEQ ID NO: 742364 - RNA, 19 nt, Homo sapiens
gaacugaaacgucgauaca

SEQ ID NO: 742365 - RNA, 19 nt, Homo sapiens
gauaacagauggacugcau

SEQ ID NO: 742366 - RNA, 19 nt, Homo sapiens
ucucggaggugauguguuu

SEQ ID NO: 742367 - RNA, 19 nt, Homo sapiens
caauauggauaaugccaaa

SEQ ID NO: 742368 - RNA, 19 nt, Homo sapiens
gaaguuaagaagauggaua

SEQ ID NO: 742369 - RNA, 19 nt, Homo sapiens
ccaagacacuguaauuaag

SEQ ID NO: 742370 - RNA, 19 nt, Homo sapiens
gaaagaaacauaugaagcu

SEQ ID NO: 742371 - RNA, 19 nt, Homo sapiens
uauuagggauccugagaua

SEQ ID NO: 742372 - RNA, 19 nt, Homo sapiens
gaagaagaagagaauugua

SEQ ID NO: 742373 - RNA, 19 nt, Homo sapiens
aaaccaagcuccagcaaag

SEQ ID NO: 742374 - RNA, 19 nt, Homo sapiens
ccaggcagcuuccauuuua

SEQ ID NO: 742375 - RNA, 19 nt, Homo sapiens
ggagaacgacucuacaaug

SEQ ID NO: 742376 - RNA, 19 nt, Homo sapiens
caaaccugcuccaauuuau

SEQ ID NO: 742377 - RNA, 19 nt, Homo sapiens
uuaguggccuugucauuaa

SEQ ID NO: 742378 - RNA, 19 nt, Homo sapiens
gaaagucagauugaaguaa

SEQ ID NO: 742379 - RNA, 19 nt, Homo sapiens
gcaauggaguuugucuuug

SEQ ID NO: 742380 - RNA, 19 nt, Homo sapiens
gaucucuucuguucuguug

SEQ ID NO: 742381 - RNA, 19 nt, Homo sapiens
caugauaaauguagcugaa

SEQ ID NO: 742382 - RNA, 19 nt, Homo sapiens
gagguuugcugacccaaga

SEQ ID NO: 742383 - RNA, 19 nt, Homo sapiens
gaagaauugucugagaaug

SEQ ID NO: 742384 - RNA, 19 nt, Homo sapiens
acuuaucgcuuacaaauga

SEQ ID NO: 742385 - RNA, 19 nt, Homo sapiens
gcaaagguauccaaaaugu

SEQ ID NO: 742386 - RNA, 19 nt, Homo sapiens
gaacauuugagucguuuau

SEQ ID NO: 742387 - RNA, 19 nt, Homo sapiens
uaacaacccucacuuucuc

SEQ ID NO: 742388 - RNA, 19 nt, Homo sapiens
guacucauuucacacauuc

SEQ ID NO: 742389 - RNA, 19 nt, Homo sapiens
ucaaaccugcuccaauuua

SEQ ID NO: 742390 - RNA, 19 nt, Homo sapiens
gaagaagagaauuguagaa

SEQ ID NO: 742391 - RNA, 19 nt, Homo sapiens
ugagagcuaugaauguauu

SEQ ID NO: 742392 - RNA, 19 nt, Homo sapiens
gcaacaagaagaauuagau

SEQ ID NO: 742393 - RNA, 19 nt, Homo sapiens
agaaacauaugaagcucua

SEQ ID NO: 742394 - RNA, 19 nt, Homo sapiens
aggcuaagcugaaagaaau

SEQ ID NO: 742395 - RNA, 19 nt, Homo sapiens
guucaacaaugcaaacguu

SEQ ID NO: 742396 - RNA, 19 nt, Homo sapiens
uaauaaagaugcugaagcu

SEQ ID NO: 742397 - RNA, 19 nt, Homo sapiens
gcucagcgaguuaauacua

SEQ ID NO: 742398 - RNA, 19 nt, Homo sapiens
ggaugguguuucuacagua

SEQ ID NO: 742399 - RNA, 19 nt, Homo sapiens
gaaaugaaggagaaacuag

SEQ ID NO: 742400 - RNA, 19 nt, Homo sapiens
gcaaagcucauaucacaag

SEQ ID NO: 742401 - RNA, 19 nt, Homo sapiens
gaauauaaaccagaacuuc

SEQ ID NO: 742402 - RNA, 19 nt, Homo sapiens
gcuuacaaaugagcauaua

SEQ ID NO: 742403 - RNA, 19 nt, Homo sapiens
gagaaacuaggaagaaaug

SEQ ID NO: 742404 - RNA, 19 nt, Homo sapiens
gaaagagagcgagaacuga

SEQ ID NO: 742405 - RNA, 19 nt, Homo sapiens
ccaaacaggcucagaugaa

SEQ ID NO: 742406 - RNA, 19 nt, Homo sapiens
gucaaaugauggccuguaa

SEQ ID NO: 742407 - RNA, 19 nt, Homo sapiens
ggcugaagauaccaaagua

SEQ ID NO: 742408 - RNA, 19 nt, Homo sapiens
ucuguuggccuuaauguua

SEQ ID NO: 742409 - RNA, 19 nt, Homo sapiens
ccucaucucuuaacuaguc

SEQ ID NO: 742410 - RNA, 19 nt, Homo sapiens
guagccagauuuacucaau

SEQ ID NO: 742411 - RNA, 19 nt, Homo sapiens
gaugcagccuuggaucuuu

SEQ ID NO: 742412 - RNA, 19 nt, Homo sapiens
gcgaugcaaugacuugaug

SEQ ID NO: 742413 - RNA, 19 nt, Homo sapiens
uaacaacccuaaagaagcu

SEQ ID NO: 742414 - RNA, 19 nt, Homo sapiens
gcccaagacacuguaauua

SEQ ID NO: 742415 - RNA, 19 nt, Homo sapiens
gcagauuuauuacaaacca

SEQ ID NO: 742416 - RNA, 19 nt, Homo sapiens
ugaagcaucucaucuauua

SEQ ID NO: 742417 - RNA, 19 nt, Homo sapiens
gcagauggauugcaguaua

SEQ ID NO: 742418 - RNA, 19 nt, Homo sapiens
gaagauaacugaugcuuac

SEQ ID NO: 742419 - RNA, 19 nt, Homo sapiens
caaaugacuuucucaguuu

SEQ ID NO: 742420 - RNA, 19 nt, Homo sapiens
ggaagaagcuaacuaaugc

SEQ ID NO: 742421 - RNA, 19 nt, Homo sapiens
ggacuuaugucagguguuu

SEQ ID NO: 742422 - RNA, 19 nt, Homo sapiens
caacauagccgacuacaug

SEQ ID NO: 742423 - RNA, 19 nt, Homo sapiens
gauaagggcuggcguguca

SEQ ID NO: 742424 - RNA, 19 nt, Homo sapiens
gaacagacgccugacuuua

SEQ ID NO: 742425 - RNA, 19 nt, Homo sapiens
ccaaaugacuuucucaguu

SEQ ID NO: 742426 - RNA, 19 nt, Homo sapiens
ccaagaaugugcuuaagaa

SEQ ID NO: 742427 - RNA, 19 nt, Homo sapiens
ccauugaccuggccuauaa

SEQ ID NO: 742428 - RNA, 19 nt, Homo sapiens
gaagggaacuugacaacca

SEQ ID NO: 742429 - RNA, 19 nt, Homo sapiens
gcaaggaccugaagcaucu

SEQ ID NO: 742430 - RNA, 19 nt, Homo sapiens
gagauccgcugcauuguga

SEQ ID NO: 742431 - RNA, 19 nt, Homo sapiens
gaugaagacuggaaugaau

SEQ ID NO: 742432 - RNA, 19 nt, Homo sapiens
caauguauauguaggcuuu

SEQ ID NO: 742433 - RNA, 19 nt, Homo sapiens
ggauauggccggaguguuu

SEQ ID NO: 742434 - RNA, 19 nt, Homo sapiens
ggacuaugcugacaacauc

SEQ ID NO: 742435 - RNA, 19 nt, Homo sapiens
ccacaucacuggagccauu

SEQ ID NO: 742436 - RNA, 19 nt, Homo sapiens
agaaugagguuacuaagga

SEQ ID NO: 742437 - RNA, 19 nt, Homo sapiens
gaagauccaugagagcauu

SEQ ID NO: 742438 - RNA, 19 nt, Homo sapiens
ggacgggccuuacaucaca

SEQ ID NO: 742439 - RNA, 19 nt, Homo sapiens
ggagaaagcucgaaaaugg

SEQ ID NO: 742440 - RNA, 19 nt, Homo sapiens
agaaugugcuuaagaaguu

SEQ ID NO: 742441 - RNA, 19 nt, Homo sapiens
ugacagacuugguggauga

SEQ ID NO: 742442 - RNA, 19 nt, Homo sapiens
cagcaagccucucauacaa

SEQ ID NO: 742443 - RNA, 19 nt, Homo sapiens
ccagacaagacuacuauua

SEQ ID NO: 742444 - RNA, 19 nt, Homo sapiens
gcaagccucucauacaaca

SEQ ID NO: 742445 - RNA, 19 nt, Homo sapiens
ucaauacccucuuccagaa

SEQ ID NO: 742446 - RNA, 19 nt, Homo sapiens
uagaagaccuagaagauuc

SEQ ID NO: 742447 - RNA, 19 nt, Homo sapiens
gaagauguaugagaagauc

SEQ ID NO: 742448 - RNA, 19 nt, Homo sapiens
gagcauuguuauggacuua

SEQ ID NO: 742449 - RNA, 19 nt, Homo sapiens
aaacaucguuggcuauaau

SEQ ID NO: 742450 - RNA, 19 nt, Homo sapiens
gggcagcugugaugcauga

SEQ ID NO: 742451 - RNA, 19 nt, Homo sapiens
gcacaggcccucucacuuc

SEQ ID NO: 742452 - RNA, 19 nt, Homo sapiens
gaacuauggugagcucuuc

SEQ ID NO: 742453 - RNA, 19 nt, Homo sapiens
gcaccaccacccagaaaua

SEQ ID NO: 742454 - RNA, 19 nt, Homo sapiens
gagaagauguaugagaaga

SEQ ID NO: 742455 - RNA, 19 nt, Homo sapiens
gagauucccugggucauug

SEQ ID NO: 742456 - RNA, 19 nt, Homo sapiens
gaacacacacucuuuaagg

SEQ ID NO: 742457 - RNA, 19 nt, Homo sapiens
gaagaagaccagcucauuc

SEQ ID NO: 742458 - RNA, 19 nt, Homo sapiens
ggugauggauuugcuugua

SEQ ID NO: 742459 - RNA, 19 nt, Homo sapiens
ggaugaugaugaggaauuu

SEQ ID NO: 742460 - RNA, 19 nt, Homo sapiens
gaacguggcaucacugaca

SEQ ID NO: 742461 - RNA, 19 nt, Homo sapiens
gagagcgaguucauugauu

SEQ ID NO: 742462 - RNA, 19 nt, Homo sapiens
agaauaugauccuucgaua

SEQ ID NO: 742463 - RNA, 19 nt, Homo sapiens
ugacgggcauguaucgaua

SEQ ID NO: 742464 - RNA, 19 nt, Homo sapiens
gaaagaaagaaaucucguu

SEQ ID NO: 742465 - RNA, 19 nt, Homo sapiens
gaacaacgaucgggcaaaa

SEQ ID NO: 742466 - RNA, 19 nt, Homo sapiens
ggaacuugaugcacuggaa

SEQ ID NO: 742467 - RNA, 19 nt, Homo sapiens
guauauauuugcccauguu

SEQ ID NO: 742468 - RNA, 19 nt, Homo sapiens
gaaguucugcguuugacua

SEQ ID NO: 742469 - RNA, 19 nt, Homo sapiens
gaaguuccgccaugacaaa

SEQ ID NO: 742470 - RNA, 19 nt, Homo sapiens
ggauugcaguauauauuug

SEQ ID NO: 742471 - RNA, 19 nt, Homo sapiens
caacaugaaauaugagcua

SEQ ID NO: 742472 - RNA, 19 nt, Homo sapiens
ucuggaaccugaacaacua

SEQ ID NO: 742473 - RNA, 19 nt, Homo sapiens
gaaggcgagugcaauguca

SEQ ID NO: 742474 - RNA, 19 nt, Homo sapiens
gcucaagacuauuucaucu

SEQ ID NO: 742475 - RNA, 19 nt, Homo sapiens
gggcagcuguuccucaaga

SEQ ID NO: 742476 - RNA, 19 nt, Homo sapiens
ggagccaucuucaucuuca

SEQ ID NO: 742477 - RNA, 19 nt, Homo sapiens
caucucaucuauuaucguu

SEQ ID NO: 742478 - RNA, 19 nt, Homo sapiens
caacggagccaucuucauc

SEQ ID NO: 742479 - RNA, 19 nt, Homo sapiens
ggcacacacuggcuuauga

SEQ ID NO: 742480 - RNA, 19 nt, Homo sapiens
ccagacacguaucaagauu

SEQ ID NO: 742481 - RNA, 19 nt, Homo sapiens
gacaugaaccauacgaauu

SEQ ID NO: 742482 - RNA, 19 nt, Homo sapiens
ccaccucguuccaguauau

SEQ ID NO: 742483 - RNA, 19 nt, Homo sapiens
caccucaccugguaccaua

SEQ ID NO: 742484 - RNA, 19 nt, Homo sapiens
caacuacuucuaccuguuu

SEQ ID NO: 742485 - RNA, 19 nt, Homo sapiens
gauaggaggcauuucaaga

SEQ ID NO: 742486 - RNA, 19 nt, Homo sapiens
caacuaccguacagacaug

SEQ ID NO: 742487 - RNA, 19 nt, Homo sapiens
gcgcacagcucaguguuuc

SEQ ID NO: 742488 - RNA, 19 nt, Homo sapiens
caccuccacugcuuguuua

SEQ ID NO: 742489 - RNA, 19 nt, Homo sapiens
gauuaagccugcagacaca

SEQ ID NO: 742490 - RNA, 19 nt, Homo sapiens
gcauugaguucauggaucu

SEQ ID NO: 742491 - RNA, 19 nt, Homo sapiens
gaccaacacugcccacuac

SEQ ID NO: 742492 - RNA, 19 nt, Homo sapiens
caagacuacuauuacagaa

SEQ ID NO: 742493 - RNA, 19 nt, Homo sapiens
ccacugagccuuauuuguc

SEQ ID NO: 742494 - RNA, 19 nt, Homo sapiens
aggagaagcugcaggagaa

SEQ ID NO: 742495 - RNA, 19 nt, Homo sapiens
gaaauugagacaguacaaa

SEQ ID NO: 742496 - RNA, 19 nt, Homo sapiens
ggacaugaaccauacgaau

SEQ ID NO: 742497 - RNA, 19 nt, Homo sapiens
ggaggcauuucaagagaau

SEQ ID NO: 742498 - RNA, 19 nt, Homo sapiens
caacaagcauggcgaugag

SEQ ID NO: 742499 - RNA, 19 nt, Homo sapiens
agacaagacuacuauuaca

SEQ ID NO: 742500 - RNA, 19 nt, Homo sapiens
gcagcaagccucucauaca

SEQ ID NO: 742501 - RNA, 19 nt, Homo sapiens
gcaaugucaugcuggaauc

SEQ ID NO: 742502 - RNA, 19 nt, Homo sapiens
caaagacaguaacaaagca

SEQ ID NO: 742503 - RNA, 19 nt, Homo sapiens
cagauggauugcaguauau

SEQ ID NO: 742504 - RNA, 19 nt, Homo sapiens
gauccugacuugccagcuu

SEQ ID NO: 742505 - RNA, 19 nt, Homo sapiens
gggucaauguggauuauga

SEQ ID NO: 742506 - RNA, 19 nt, Homo sapiens
ccaaauugcaggauaccua

SEQ ID NO: 742507 - RNA, 19 nt, Homo sapiens
gggcccaaauugcaggaua

SEQ ID NO: 742508 - RNA, 19 nt, Homo sapiens
gggccaaguuccuggacua

SEQ ID NO: 742509 - RNA, 19 nt, Homo sapiens
cagaaauacuggauugaca

SEQ ID NO: 742510 - RNA, 19 nt, Homo sapiens
gaucguggcauuccucgaa

SEQ ID NO: 742511 - RNA, 19 nt, Homo sapiens
gaacaacgucgucaucaac

SEQ ID NO: 742512 - RNA, 19 nt, Homo sapiens
gccaagcgcuaugcagaaa

SEQ ID NO: 742513 - RNA, 19 nt, Homo sapiens
guaccauacucccaauguu

SEQ ID NO: 742514 - RNA, 19 nt, Homo sapiens
ccaagauugugaauaagug

SEQ ID NO: 742515 - RNA, 19 nt, Homo sapiens
caucagaggccugcaguuu

SEQ ID NO: 742516 - RNA, 19 nt, Homo sapiens
gaaacuggcuucuaugucu

SEQ ID NO: 742517 - RNA, 19 nt, Homo sapiens
ggaugaaacuggcuucuau

SEQ ID NO: 742518 - RNA, 19 nt, Homo sapiens
gaaaguuccgguccuauaa

SEQ ID NO: 742519 - RNA, 19 nt, Homo sapiens
gaccugaaguggacucuga

SEQ ID NO: 742520 - RNA, 19 nt, Homo sapiens
caacugggauuaaugaaac

SEQ ID NO: 742521 - RNA, 19 nt, Homo sapiens
gaggguggauucuauuugu

SEQ ID NO: 742522 - RNA, 19 nt, Homo sapiens
ggacacagccacccucuuc

SEQ ID NO: 742523 - RNA, 19 nt, Homo sapiens
caauguacgucacagaaau

SEQ ID NO: 742524 - RNA, 19 nt, Homo sapiens
ggaacaagaagcaccacua

SEQ ID NO: 742525 - RNA, 19 nt, Homo sapiens
gcaggguggugcuuucaga

SEQ ID NO: 742526 - RNA, 19 nt, Homo sapiens
gagccugagucgagagaaa

SEQ ID NO: 742527 - RNA, 19 nt, Homo sapiens
aaacaacugggauuaauga

SEQ ID NO: 742528 - RNA, 19 nt, Homo sapiens
gaguggaacugcagagaca

SEQ ID NO: 742529 - RNA, 19 nt, Homo sapiens
agauagaccugagaaaguu

SEQ ID NO: 742530 - RNA, 19 nt, Homo sapiens
gaacaagaagcaccacuac

SEQ ID NO: 742531 - RNA, 19 nt, Homo sapiens
ggaagucuccacgcacuaa

SEQ ID NO: 742532 - RNA, 19 nt, Homo sapiens
ugagaaaguuccgguccua

SEQ ID NO: 742533 - RNA, 19 nt, Homo sapiens
gcagauagaccugagaaag

SEQ ID NO: 742534 - RNA, 19 nt, Homo sapiens
gugacuggcuggagaagga

SEQ ID NO: 742535 - RNA, 19 nt, Homo sapiens
ccaaugugcuccgcuacuu

SEQ ID NO: 742536 - RNA, 19 nt, Homo sapiens
agaaaguuccgguccuaua

SEQ ID NO: 742537 - RNA, 19 nt, Homo sapiens
aggaagagguccacgacaa

SEQ ID NO: 742538 - RNA, 19 nt, Homo sapiens
ccaugccgcugcagauaga

SEQ ID NO: 742539 - RNA, 19 nt, Homo sapiens
ccugcauucuuuacacaua

SEQ ID NO: 742540 - RNA, 19 nt, Homo sapiens
uggcccaccugcauucuuu

SEQ ID NO: 742541 - RNA, 19 nt, Homo sapiens
cgagcugcauccagaagaa

SEQ ID NO: 742542 - RNA, 19 nt, Homo sapiens
gaccugggcaugccuguga

SEQ ID NO: 742543 - RNA, 19 nt, Homo sapiens
caccaugcaugacccaaga

SEQ ID NO: 742544 - RNA, 19 nt, Homo sapiens
gcuggccgcuguagcuuca

SEQ ID NO: 742545 - RNA, 19 nt, Homo sapiens
ggaggguggauucuauuug

SEQ ID NO: 742546 - RNA, 19 nt, Homo sapiens
ccaauguacgucacagaaa

SEQ ID NO: 742547 - RNA, 19 nt, Homo sapiens
cagauagaccugagaaagu

SEQ ID NO: 742548 - RNA, 19 nt, Homo sapiens
uggcucaccuggaggaaga

SEQ ID NO: 742549 - RNA, 19 nt, Homo sapiens
uggcuucuaugucucuaaa

SEQ ID NO: 742550 - RNA, 19 nt, Homo sapiens
gagcagagccaagcaacuc

SEQ ID NO: 742551 - RNA, 19 nt, Homo sapiens
ggaagagguccacgacaag

SEQ ID NO: 742552 - RNA, 19 nt, Homo sapiens
ccucuucucugccuuggau

SEQ ID NO: 742553 - RNA, 19 nt, Homo sapiens
caggcugcguguucuacua

SEQ ID NO: 742554 - RNA, 19 nt, Homo sapiens
aaauggccuuucucucuga

SEQ ID NO: 742555 - RNA, 19 nt, Homo sapiens
gcaggcgggacuuucguuu

SEQ ID NO: 742556 - RNA, 19 nt, Homo sapiens
gggaggguggauucuauuu

SEQ ID NO: 742557 - RNA, 19 nt, Homo sapiens
gcugaugacacuguaugua

SEQ ID NO: 742558 - RNA, 19 nt, Homo sapiens
uggauucuauuugugauga

SEQ ID NO: 742559 - RNA, 19 nt, Homo sapiens
guccacagguucacacucu

SEQ ID NO: 742560 - RNA, 19 nt, Homo sapiens
gguggugcuuucagacuuc

SEQ ID NO: 742561 - RNA, 19 nt, Homo sapiens
ggguggugcuuucagacuu

SEQ ID NO: 742562 - RNA, 19 nt, Homo sapiens
cgagugcuuuggccugguu

SEQ ID NO: 742563 - RNA, 19 nt, Homo sapiens
gcucgagacacucugcauu

SEQ ID NO: 742564 - RNA, 19 nt, Homo sapiens
gacgagcaguggcugucaa

SEQ ID NO: 742565 - RNA, 19 nt, Homo sapiens
gaugaaacuggcuucuaug

SEQ ID NO: 742566 - RNA, 19 nt, Homo sapiens
uaccagcgcuguggacauc

SEQ ID NO: 742567 - RNA, 19 nt, Homo sapiens
acaacugggauuaaugaaa

SEQ ID NO: 742568 - RNA, 19 nt, Homo sapiens
gaggugacacuccaagucu

SEQ ID NO: 742569 - RNA, 19 nt, Homo sapiens
gagacacucugcauuuccu

SEQ ID NO: 742570 - RNA, 19 nt, Homo sapiens
acaagaagcaccacuacag

SEQ ID NO: 742571 - RNA, 19 nt, Homo sapiens
gaccugcuccgugcuguga

SEQ ID NO: 742572 - RNA, 19 nt, Homo sapiens
ggguggauucuauuuguga

SEQ ID NO: 742573 - RNA, 19 nt, Homo sapiens
cugggaggguggauucuau

SEQ ID NO: 742574 - RNA, 19 nt, Homo sapiens
ggauggcucacccgggaaa

SEQ ID NO: 742575 - RNA, 19 nt, Homo sapiens
gacgcugaguccacagguu

SEQ ID NO: 742576 - RNA, 19 nt, Homo sapiens
ucgagacacucugcauuuc

SEQ ID NO: 742577 - RNA, 19 nt, Homo sapiens
caucgaaggaccaauguac

SEQ ID NO: 742578 - RNA, 19 nt, Homo sapiens
ccacacgcaccgagucaug

SEQ ID NO: 742579 - RNA, 19 nt, Homo sapiens
gccaggcaauauucucauc

SEQ ID NO: 742580 - RNA, 19 nt, Homo sapiens
ccugguaccugcagacacu

SEQ ID NO: 742581 - RNA, 19 nt, Homo sapiens
gagcugcauccagaagaaa

SEQ ID NO: 742582 - RNA, 19 nt, Homo sapiens
cuacuacccaccagacuca

SEQ ID NO: 742583 - RNA, 19 nt, Homo sapiens
gagaaaguuccgguccuau

SEQ ID NO: 742584 - RNA, 19 nt, Homo sapiens
ccagcgcuguggacaucuu

SEQ ID NO: 742585 - RNA, 19 nt, Homo sapiens
cgucaucgaaggaccaaug

SEQ ID NO: 742586 - RNA, 19 nt, Homo sapiens
ccacagaugaggugacacu

SEQ ID NO: 742587 - RNA, 19 nt, Homo sapiens
gccggaggccacacaaaug

SEQ ID NO: 742588 - RNA, 19 nt, Homo sapiens
gguggauucuauuugugau

SEQ ID NO: 742589 - RNA, 19 nt, Homo sapiens
caccugcauucuuuacaca

SEQ ID NO: 742590 - RNA, 19 nt, Homo sapiens
ccaccugcauucuuuacac

SEQ ID NO: 742591 - RNA, 19 nt, Homo sapiens
ccacagguucacacucuca

SEQ ID NO: 742592 - RNA, 19 nt, Homo sapiens
ccaccaaacaguccuacca

SEQ ID NO: 742593 - RNA, 19 nt, Homo sapiens
gcggauggcagccuguaca

SEQ ID NO: 742594 - RNA, 19 nt, Homo sapiens
ggugacacuccaagucuca

SEQ ID NO: 742595 - RNA, 19 nt, Homo sapiens
cucgagacacucugcauuu

SEQ ID NO: 742596 - RNA, 19 nt, Homo sapiens
gaccaauguacgucacaga

SEQ ID NO: 742597 - RNA, 19 nt, Homo sapiens
gaagccaggcaauauucuc

SEQ ID NO: 742598 - RNA, 19 nt, Homo sapiens
ggacgagcaguggcuguca

SEQ ID NO: 742599 - RNA, 19 nt, Homo sapiens
cauuggacaccacgagcua

SEQ ID NO: 742600 - RNA, 19 nt, Homo sapiens
aaacuaaacuggacaggua

SEQ ID NO: 742601 - RNA, 19 nt, Homo sapiens
ggagagagaugcuucaaau

SEQ ID NO: 742602 - RNA, 19 nt, Homo sapiens
gagaagcaaugggaauuua

SEQ ID NO: 742603 - RNA, 19 nt, Homo sapiens
gaauggagcgucaaacuaa

SEQ ID NO: 742604 - RNA, 19 nt, Homo sapiens
gaucuuaccuacaaugaau

SEQ ID NO: 742605 - RNA, 19 nt, Homo sapiens
gugaugaaguggagguuua

SEQ ID NO: 742606 - RNA, 19 nt, Homo sapiens
agacagagguggaaaguuc

SEQ ID NO: 742607 - RNA, 19 nt, Homo sapiens
ggagaggcauccauuaaca

SEQ ID NO: 742608 - RNA, 19 nt, Homo sapiens
ucaaauugguccacggaua

SEQ ID NO: 742609 - RNA, 19 nt, Homo sapiens
ggcaugaucuuaccuacaa

SEQ ID NO: 742610 - RNA, 19 nt, Homo sapiens
ccacauauaccuuggguuu

SEQ ID NO: 742611 - RNA, 19 nt, Homo sapiens
aaacagaccuuuggcuaug

SEQ ID NO: 742612 - RNA, 19 nt, Homo sapiens
caaauugguccacggauaa

SEQ ID NO: 742613 - RNA, 19 nt, Homo sapiens
gagagaugcuucaaauugg

SEQ ID NO: 742614 - RNA, 19 nt, Homo sapiens
gggugaaacuucuaagaga

SEQ ID NO: 742615 - RNA, 19 nt, Homo sapiens
ugagaaacauauugugaug

SEQ ID NO: 742616 - RNA, 19 nt, Homo sapiens
gcaaugggaauuuacauca

SEQ ID NO: 742617 - RNA, 19 nt, Homo sapiens
aagaugagccugacacaaa

SEQ ID NO: 742618 - RNA, 19 nt, Homo sapiens
gaaguggagauuaguguga

SEQ ID NO: 742619 - RNA, 19 nt, Homo sapiens
caaaggacauguggagauc

SEQ ID NO: 742620 - RNA, 19 nt, Homo sapiens
agagagaugcuucaaauug

SEQ ID NO: 742621 - RNA, 19 nt, Homo sapiens
ccaugcuccugcaacauua

SEQ ID NO: 742622 - RNA, 19 nt, Homo sapiens
gagagccgauggccaagug

SEQ ID NO: 742623 - RNA, 19 nt, Homo sapiens
agacugagcugugcaugga

SEQ ID NO: 742624 - RNA, 19 nt, Homo sapiens
caacgucucuggggaauuu

SEQ ID NO: 742625 - RNA, 19 nt, Homo sapiens
cgucccagcugcuaacuug

SEQ ID NO: 742626 - RNA, 19 nt, Homo sapiens
gcaaagggaaacuuaucuu

SEQ ID NO: 742627 - RNA, 19 nt, Homo sapiens
gaaaguuccacaugguaga

SEQ ID NO: 742628 - RNA, 19 nt, Homo sapiens
aagggaaacuuaucuucuu

SEQ ID NO: 742629 - RNA, 19 nt, Homo sapiens
ccaccaacgucaacaacug

SEQ ID NO: 742630 - RNA, 19 nt, Homo sapiens
gaagugaguaagcuugaug

SEQ ID NO: 742631 - RNA, 19 nt, Homo sapiens
gaaguggagguuuaaaucu

SEQ ID NO: 742632 - RNA, 19 nt, Homo sapiens
gagagagaugcuucaaauu

SEQ ID NO: 742633 - RNA, 19 nt, Homo sapiens
ugaauggagcgucaaacua

SEQ ID NO: 742634 - RNA, 19 nt, Homo sapiens
acauauaccuuggguuugu

SEQ ID NO: 742635 - RNA, 19 nt, Homo sapiens
uaaacagaccuuuggcuau

SEQ ID NO: 742636 - RNA, 19 nt, Homo sapiens
uacaaugaauggagaguca

SEQ ID NO: 742637 - RNA, 19 nt, Homo sapiens
caaagggaaacuuaucuuc

SEQ ID NO: 742638 - RNA, 19 nt, Homo sapiens
gaagcaaugggaauuuaca

SEQ ID NO: 742639 - RNA, 19 nt, Homo sapiens
guacuacuuugagggcauu

SEQ ID NO: 742640 - RNA, 19 nt, Homo sapiens
caaaucucguggccuuaau

SEQ ID NO: 742641 - RNA, 19 nt, Homo sapiens
uggaugaaguggagauuag

SEQ ID NO: 742642 - RNA, 19 nt, Homo sapiens
gcauuaaacagaccuuugg

SEQ ID NO: 742643 - RNA, 19 nt, Homo sapiens
gugugagccuugccaaaga

SEQ ID NO: 742644 - RNA, 19 nt, Homo sapiens
ggaagugaguaagcuugau

SEQ ID NO: 742645 - RNA, 19 nt, Homo sapiens
cuauggcgcacgcuuauuu

SEQ ID NO: 742646 - RNA, 19 nt, Homo sapiens
agggaaacuuaucuucuuu

SEQ ID NO: 742647 - RNA, 19 nt, Homo sapiens
ugaccuucaucgacaagaa

SEQ ID NO: 742648 - RNA, 19 nt, Homo sapiens
ugaaguggagguuuaaauc

SEQ ID NO: 742649 - RNA, 19 nt, Homo sapiens
gaauggagagucaguagac

SEQ ID NO: 742650 - RNA, 19 nt, Homo sapiens
aaucgcaaagggaaacuua

SEQ ID NO: 742651 - RNA, 19 nt, Homo sapiens
gagaggcauccauuaacaa

SEQ ID NO: 742652 - RNA, 19 nt, Homo sapiens
uggcagcgguacuacuuug

SEQ ID NO: 742653 - RNA, 19 nt, Homo sapiens
aaguggagguuuaaaucuu

SEQ ID NO: 742654 - RNA, 19 nt, Homo sapiens
gagaaacauauugugauga

SEQ ID NO: 742655 - RNA, 19 nt, Homo sapiens
agaugagccugacacaaau

SEQ ID NO: 742656 - RNA, 19 nt, Homo sapiens
uaagagaagcaaugggaau

SEQ ID NO: 742657 - RNA, 19 nt, Homo sapiens
gcuugcgacucacaggauu

SEQ ID NO: 742658 - RNA, 19 nt, Homo sapiens
gaaacauauugugaugaag

SEQ ID NO: 742659 - RNA, 19 nt, Homo sapiens
ccugagaaacauauuguga

SEQ ID NO: 742660 - RNA, 19 nt, Homo sapiens
ggcaauuucucuuuuaugu

SEQ ID NO: 742661 - RNA, 19 nt, Homo sapiens
gcagacagagguggaaagu

SEQ ID NO: 742662 - RNA, 19 nt, Homo sapiens
cugaggagcgcaaggcuaa

SEQ ID NO: 742663 - RNA, 19 nt, Homo sapiens
aaacagcguggaugaagug

SEQ ID NO: 742664 - RNA, 19 nt, Homo sapiens
acaaaucucguggccuuaa

SEQ ID NO: 742665 - RNA, 19 nt, Homo sapiens
aauggagcgucaaacuaaa

SEQ ID NO: 742666 - RNA, 19 nt, Homo sapiens
uaacaaucgcaaagggaaa

SEQ ID NO: 742667 - RNA, 19 nt, Homo sapiens
aguggagguuuaaaucuug

SEQ ID NO: 742668 - RNA, 19 nt, Homo sapiens
gagcuggugcaggccuuua

SEQ ID NO: 742669 - RNA, 19 nt, Homo sapiens
gaagcagacagagguggaa

SEQ ID NO: 742670 - RNA, 19 nt, Homo sapiens
caaugggaauuuacaucag

SEQ ID NO: 742671 - RNA, 19 nt, Homo sapiens
guggaugaaguggagauua

SEQ ID NO: 742672 - RNA, 19 nt, Homo sapiens
aaaugaagaaggcaagugu

SEQ ID NO: 742673 - RNA, 19 nt, Homo sapiens
ggcauuaaacagaccuuug

SEQ ID NO: 742674 - RNA, 19 nt, Homo sapiens
cuacuuugagggcauuaaa

SEQ ID NO: 742675 - RNA, 19 nt, Homo sapiens
ucaaaauccccacuuguaa

SEQ ID NO: 742676 - RNA, 19 nt, Homo sapiens
uuacaucagcacccucaaa

SEQ ID NO: 742677 - RNA, 19 nt, Homo sapiens
gaugaaguggagauuagug

SEQ ID NO: 742678 - RNA, 19 nt, Homo sapiens
acaaaggacauguggagau

SEQ ID NO: 742679 - RNA, 19 nt, Homo sapiens
guccagcucucuccugacu

SEQ ID NO: 742680 - RNA, 19 nt, Homo sapiens
ugacggaagugaguaagcu

SEQ ID NO: 742681 - RNA, 19 nt, Homo sapiens
agagaagcaaugggaauuu

SEQ ID NO: 742682 - RNA, 19 nt, Homo sapiens
caaagaugagccugacaca

SEQ ID NO: 742683 - RNA, 19 nt, Homo sapiens
gaaaacagcguggaugaag

SEQ ID NO: 742684 - RNA, 19 nt, Homo sapiens
gcacuggacggagagagau

SEQ ID NO: 742685 - RNA, 19 nt, Homo sapiens
gucaaaauccccacuugua

SEQ ID NO: 742686 - RNA, 19 nt, Homo sapiens
gaaggaagaaggggugaaa

SEQ ID NO: 742687 - RNA, 19 nt, Homo sapiens
caauuugucugaugaaaac

SEQ ID NO: 742688 - RNA, 19 nt, Homo sapiens
acaagaacggagagacuga

SEQ ID NO: 742689 - RNA, 19 nt, Homo sapiens
gcaugaucuuaccuacaau

SEQ ID NO: 742690 - RNA, 19 nt, Homo sapiens
aggcauccauuaacaaucg

SEQ ID NO: 742691 - RNA, 19 nt, Homo sapiens
cagugcagguucaaaauga

SEQ ID NO: 742692 - RNA, 19 nt, Homo sapiens
aaagggaaacuuaucuucu

SEQ ID NO: 742693 - RNA, 19 nt, Homo sapiens
cgacaagaacggagagacu

SEQ ID NO: 742694 - RNA, 19 nt, Homo sapiens
agugugaggugacggaagu

SEQ ID NO: 742695 - RNA, 19 nt, Homo sapiens
agagaugcuucaaauuggu

SEQ ID NO: 742696 - RNA, 19 nt, Homo sapiens
cccaugcuccugcaacauu

SEQ ID NO: 742697 - RNA, 19 nt, Homo sapiens
cuaagccugcuccuucaaa

SEQ ID NO: 742698 - RNA, 19 nt, Homo sapiens
aagagaagcaaugggaauu

SEQ ID NO: 742699 - RNA, 19 nt, Homo sapiens
cccaauuugucugaugaaa

SEQ ID NO: 742700 - RNA, 19 nt, Homo sapiens
ggacuauucuccauuauuu

SEQ ID NO: 742701 - RNA, 19 nt, Homo sapiens
gaacggagauuugagauau

SEQ ID NO: 742702 - RNA, 19 nt, Homo sapiens
gaaauuugcuugugauugu

SEQ ID NO: 742703 - RNA, 19 nt, Homo sapiens
gggcuugucuucaauguua

SEQ ID NO: 742704 - RNA, 19 nt, Homo sapiens
ggaaucgguuguuucauua

SEQ ID NO: 742705 - RNA, 19 nt, Homo sapiens
ggucauacauguggauaua

SEQ ID NO: 742706 - RNA, 19 nt, Homo sapiens
ucacucagcuuuauugcua

SEQ ID NO: 742707 - RNA, 19 nt, Homo sapiens
caaguaagcagcuauauug

SEQ ID NO: 742708 - RNA, 19 nt, Homo sapiens
gcacaaccuucagagaaua

SEQ ID NO: 742709 - RNA, 19 nt, Homo sapiens
gacggaagcuuugaaauug

SEQ ID NO: 742710 - RNA, 19 nt, Homo sapiens
gacacuaggugcaauuauu

SEQ ID NO: 742711 - RNA, 19 nt, Homo sapiens
ucacagacuuuaucaaugu

SEQ ID NO: 742712 - RNA, 19 nt, Homo sapiens
gaaauaauccagugacauc

SEQ ID NO: 742713 - RNA, 19 nt, Homo sapiens
cuacauagaccaaaguuaa

SEQ ID NO: 742714 - RNA, 19 nt, Homo sapiens
uggaauaacuuacaucuca

SEQ ID NO: 742715 - RNA, 19 nt, Homo sapiens
caaaucaguugccggacua

SEQ ID NO: 742716 - RNA, 19 nt, Homo sapiens
gauauccucuucucuuguu

SEQ ID NO: 742717 - RNA, 19 nt, Homo sapiens
ggacauucuucuuuguauu

SEQ ID NO: 742718 - RNA, 19 nt, Homo sapiens
gaccuuauccacuuguuua

SEQ ID NO: 742719 - RNA, 19 nt, Homo sapiens
aggaggagcuagauucaua

SEQ ID NO: 742720 - RNA, 19 nt, Homo sapiens
aaacagcauugcauugauu

SEQ ID NO: 742721 - RNA, 19 nt, Homo sapiens
aaagagaaaugccuagugu

SEQ ID NO: 742722 - RNA, 19 nt, Homo sapiens
gaaccagucuguggaaaca

SEQ ID NO: 742723 - RNA, 19 nt, Homo sapiens
uaauaugcuucguggaaua

SEQ ID NO: 742724 - RNA, 19 nt, Homo sapiens
gagcuagauucauauccua

SEQ ID NO: 742725 - RNA, 19 nt, Homo sapiens
uuaagagucucaucacuug

SEQ ID NO: 742726 - RNA, 19 nt, Homo sapiens
ggagcuugguggcuuaauu

SEQ ID NO: 742727 - RNA, 19 nt, Homo sapiens
agaaaugccuagugucuau

SEQ ID NO: 742728 - RNA, 19 nt, Homo sapiens
gcauugcauugauucagua

SEQ ID NO: 742729 - RNA, 19 nt, Homo sapiens
gagauguaccacuuucuua

SEQ ID NO: 742730 - RNA, 19 nt, Homo sapiens
ggacauauaauuccacauc

SEQ ID NO: 742731 - RNA, 19 nt, Homo sapiens
gaaucugggucauacaugu

SEQ ID NO: 742732 - RNA, 19 nt, Homo sapiens
uggaaucgguuguuucauu

SEQ ID NO: 742733 - RNA, 19 nt, Homo sapiens
ugagagacaugguuacugu

SEQ ID NO: 742734 - RNA, 19 nt, Homo sapiens
ggaauucuagcuccaauau

SEQ ID NO: 742735 - RNA, 19 nt, Homo sapiens
gcagcuauauuggugcuuu

SEQ ID NO: 742736 - RNA, 19 nt, Homo sapiens
ccucuucucuuguugguuu

SEQ ID NO: 742737 - RNA, 19 nt, Homo sapiens
ggaugaagcaaacuuagaa

SEQ ID NO: 742738 - RNA, 19 nt, Homo sapiens
gacuaaccaugaccuauga

SEQ ID NO: 742739 - RNA, 19 nt, Homo sapiens
cagcuaauuugaccaauca

SEQ ID NO: 742740 - RNA, 19 nt, Homo sapiens
ugacggaagcuuugaaauu

SEQ ID NO: 742741 - RNA, 19 nt, Homo sapiens
gauuugagauauccucuuc

SEQ ID NO: 742742 - RNA, 19 nt, Homo sapiens
gguuuccacucaaugguua

SEQ ID NO: 742743 - RNA, 19 nt, Homo sapiens
ucauagagauguaccacuu

SEQ ID NO: 742744 - RNA, 19 nt, Homo sapiens
ggacuaaccaugaccuaug

SEQ ID NO: 742745 - RNA, 19 nt, Homo sapiens
gcagauagugaaacacauu

SEQ ID NO: 742746 - RNA, 19 nt, Homo sapiens
gagcuugguggcuuaauuu

SEQ ID NO: 742747 - RNA, 19 nt, Homo sapiens
ggauaacuccuacugauuc

SEQ ID NO: 742748 - RNA, 19 nt, Homo sapiens
gguaauaugcuucguggaa

SEQ ID NO: 742749 - RNA, 19 nt, Homo sapiens
ugacugcuuugccacauuu

SEQ ID NO: 742750 - RNA, 19 nt, Homo sapiens
gagacaugguuacugugua

SEQ ID NO: 742751 - RNA, 19 nt, Homo sapiens
gcacuggguuuccacucaa

SEQ ID NO: 742752 - RNA, 19 nt, Homo sapiens
ucaaauacguagagcaaca

SEQ ID NO: 742753 - RNA, 19 nt, Homo sapiens
acacuaggugcaauuauua

SEQ ID NO: 742754 - RNA, 19 nt, Homo sapiens
ggaaacaaaugaugaaaag

SEQ ID NO: 742755 - RNA, 19 nt, Homo sapiens
caacucagacugcaauugu

SEQ ID NO: 742756 - RNA, 19 nt, Homo sapiens
gucauaaccauaccuauuu

SEQ ID NO: 742757 - RNA, 19 nt, Homo sapiens
ccaaacagcauugcauuga

SEQ ID NO: 742758 - RNA, 19 nt, Homo sapiens
gaccuaugauggaaauaau

SEQ ID NO: 742759 - RNA, 19 nt, Homo sapiens
gccaaauucucauguuuua

SEQ ID NO: 742760 - RNA, 19 nt, Homo sapiens
gggaaaagguuguuuaaag

SEQ ID NO: 742761 - RNA, 19 nt, Homo sapiens
ucauacagguagagguuaa

SEQ ID NO: 742762 - RNA, 19 nt, Homo sapiens
gguuaagguuagacuauau

SEQ ID NO: 742763 - RNA, 19 nt, Homo sapiens
ggaaacaauggaauaacuu

SEQ ID NO: 742764 - RNA, 19 nt, Homo sapiens
aaacugagcaucaacaaca

SEQ ID NO: 742765 - RNA, 19 nt, Homo sapiens
caugggauauuacagguau

SEQ ID NO: 742766 - RNA, 19 nt, Homo sapiens
acacgugggucauguagga

SEQ ID NO: 742767 - RNA, 19 nt, Homo sapiens
uuacugcugugaugucauu

SEQ ID NO: 742768 - RNA, 19 nt, Homo sapiens
ggcacaaccuucagagaau

SEQ ID NO: 742769 - RNA, 19 nt, Homo sapiens
guaauaugcuucguggaau

SEQ ID NO: 742770 - RNA, 19 nt, Homo sapiens
gagcaucaccugagauagu

SEQ ID NO: 742771 - RNA, 19 nt, Homo sapiens
caaacuacauagaccaaag

SEQ ID NO: 742772 - RNA, 19 nt, Homo sapiens
aaagugagagacaugguua

SEQ ID NO: 742773 - RNA, 19 nt, Homo sapiens
caaacagcauugcauugau

SEQ ID NO: 742774 - RNA, 19 nt, Homo sapiens
agacugcaauugugaugaa

SEQ ID NO: 742775 - RNA, 19 nt, Homo sapiens
caaauuaaagugagagaca

SEQ ID NO: 742776 - RNA, 19 nt, Homo sapiens
gcaauugugaugaaaguca

SEQ ID NO: 742777 - RNA, 19 nt, Homo sapiens
gauguaccacuuucuuauu

SEQ ID NO: 742778 - RNA, 19 nt, Homo sapiens
ccagugacaucucauagag

SEQ ID NO: 742779 - RNA, 19 nt, Homo sapiens
guucauggguaauaugcuu

SEQ ID NO: 742780 - RNA, 19 nt, Homo sapiens
uaaaggaaucugggucaua

SEQ ID NO: 742781 - RNA, 19 nt, Homo sapiens
gacauauaauuccacauca

SEQ ID NO: 742782 - RNA, 19 nt, Homo sapiens
uaauuggaaucgguuguuu

SEQ ID NO: 742783 - RNA, 19 nt, Homo sapiens
ggaaauuugcuugugauug

SEQ ID NO: 742784 - RNA, 19 nt, Homo sapiens
agagaaagauaucaaugca

SEQ ID NO: 742785 - RNA, 19 nt, Homo sapiens
caagagaaagauaucaaug

SEQ ID NO: 742786 - RNA, 19 nt, Homo sapiens
caccugagauagugggaaa

SEQ ID NO: 742787 - RNA, 19 nt, Homo sapiens
gaauucuagcuccaauaua

SEQ ID NO: 742788 - RNA, 19 nt, Homo sapiens
ggaaaagguuguuuaaagg

SEQ ID NO: 742789 - RNA, 19 nt, Homo sapiens
gagaaaugccuagugucua

SEQ ID NO: 742790 - RNA, 19 nt, Homo sapiens
gaguacucauuguuacauu

SEQ ID NO: 742791 - RNA, 19 nt, Homo sapiens
caagauacugcaauggauu

SEQ ID NO: 742792 - RNA, 19 nt, Homo sapiens
caucuaaggcuaacaucuu

SEQ ID NO: 742793 - RNA, 19 nt, Homo sapiens
ggauauuacagguauucua

SEQ ID NO: 742794 - RNA, 19 nt, Homo sapiens
agauaucaaugcaucagaa

SEQ ID NO: 742795 - RNA, 19 nt, Homo sapiens
gaggaauucuagcuccaau

SEQ ID NO: 742796 - RNA, 19 nt, Homo sapiens
caucuuauugggagucaua

SEQ ID NO: 742797 - RNA, 19 nt, Homo sapiens
guagaucuaagcacuauca

SEQ ID NO: 742798 - RNA, 19 nt, Homo sapiens
aaaggaaucugggucauac

SEQ ID NO: 742799 - RNA, 19 nt, Homo sapiens
ggagcuagauucauauccu

SEQ ID NO: 742800 - RNA, 19 nt, Homo sapiens
cgaauaaacugcuuuguga

SEQ ID NO: 742801 - RNA, 19 nt, Homo sapiens
ggaacaagguaauuugaaa

SEQ ID NO: 742802 - RNA, 19 nt, Homo sapiens
gaaaaugucuggaacaauu

SEQ ID NO: 742803 - RNA, 19 nt, Homo sapiens
ugaaaggacucaguaauuu

SEQ ID NO: 742804 - RNA, 19 nt, Homo sapiens
gaucacaacacaucaauaa

SEQ ID NO: 742805 - RNA, 19 nt, Homo sapiens
gaauucuccuugccaaaua

SEQ ID NO: 742806 - RNA, 19 nt, Homo sapiens
agauaaagcugaagaagaa

SEQ ID NO: 742807 - RNA, 19 nt, Homo sapiens
gaacacagugguacuauga

SEQ ID NO: 742808 - RNA, 19 nt, Homo sapiens
guaagaauguugcagaaga

SEQ ID NO: 742809 - RNA, 19 nt, Homo sapiens
gaaacacauuuauggcuuu

SEQ ID NO: 742810 - RNA, 19 nt, Homo sapiens
aaacauggcuaaagagaau

SEQ ID NO: 742811 - RNA, 19 nt, Homo sapiens
uguaugagguuguaaauga

SEQ ID NO: 742812 - RNA, 19 nt, Homo sapiens
gaagaacaccaaagaguga

SEQ ID NO: 742813 - RNA, 19 nt, Homo sapiens
caaauagucaucucucuaa

SEQ ID NO: 742814 - RNA, 19 nt, Homo sapiens
ggaccaaaggcaaauauaa

SEQ ID NO: 742815 - RNA, 19 nt, Homo sapiens
auaaugagguccaguauug

SEQ ID NO: 742816 - RNA, 19 nt, Homo sapiens
ggaagcauguuuacaccaa

SEQ ID NO: 742817 - RNA, 19 nt, Homo sapiens
gccaugagccaguuucuua

SEQ ID NO: 742818 - RNA, 19 nt, Homo sapiens
uaaacugacuuacccuaaa

SEQ ID NO: 742819 - RNA, 19 nt, Homo sapiens
ggaugaagaucaagauagu

SEQ ID NO: 742820 - RNA, 19 nt, Homo sapiens
ggaaauccugaauuacuua

SEQ ID NO: 742821 - RNA, 19 nt, Homo sapiens
uuaaauacaugccagaaga

SEQ ID NO: 742822 - RNA, 19 nt, Homo sapiens
ggcauuaacagaaccauua

SEQ ID NO: 742823 - RNA, 19 nt, Homo sapiens
ggagcugcuucgcuacuua

SEQ ID NO: 742824 - RNA, 19 nt, Homo sapiens
gaccaaaggcaaauauaaa

SEQ ID NO: 742825 - RNA, 19 nt, Homo sapiens
uaaacugcuuugugaagua

SEQ ID NO: 742826 - RNA, 19 nt, Homo sapiens
gcaaauagucaucucucua

SEQ ID NO: 742827 - RNA, 19 nt, Homo sapiens
caacauggauaaugaucug

SEQ ID NO: 742828 - RNA, 19 nt, Homo sapiens
gaaaggacucaguaauuug

SEQ ID NO: 742829 - RNA, 19 nt, Homo sapiens
caacacaucaauaaacuga

SEQ ID NO: 742830 - RNA, 19 nt, Homo sapiens
gguacucuauuccuuauau

SEQ ID NO: 742831 - RNA, 19 nt, Homo sapiens
uaagaauguugcagaagaa

SEQ ID NO: 742832 - RNA, 19 nt, Homo sapiens
ggaaagaaacggacaaagg

SEQ ID NO: 742833 - RNA, 19 nt, Homo sapiens
caacuaaaguacuaaacuc

SEQ ID NO: 742834 - RNA, 19 nt, Homo sapiens
uaacuaguaugaucaugug

SEQ ID NO: 742835 - RNA, 19 nt, Homo sapiens
gcaagaaccgcaaauaguc

SEQ ID NO: 742836 - RNA, 19 nt, Homo sapiens
ugaagacagugaauaugaa

SEQ ID NO: 742837 - RNA, 19 nt, Homo sapiens
gugaaaggacucaguaauu

SEQ ID NO: 742838 - RNA, 19 nt, Homo sapiens
ugauuccucugaaacuuua

SEQ ID NO: 742839 - RNA, 19 nt, Homo sapiens
uauaauggcugaaauaacg

SEQ ID NO: 742840 - RNA, 19 nt, Homo sapiens
agucaucucucuaaucuug

SEQ ID NO: 742841 - RNA, 19 nt, Homo sapiens
caucuuugguggugaacua

SEQ ID NO: 742842 - RNA, 19 nt, Homo sapiens
ccaaauaaccgugaaagga

SEQ ID NO: 742843 - RNA, 19 nt, Homo sapiens
ucacaaacaccagugcuua

SEQ ID NO: 742844 - RNA, 19 nt, Homo sapiens
caucagggcuguggcagaa

SEQ ID NO: 742845 - RNA, 19 nt, Homo sapiens
gaaagauaaagcugaagaa

SEQ ID NO: 742846 - RNA, 19 nt, Homo sapiens
gucaguaaguaauccauaa

SEQ ID NO: 742847 - RNA, 19 nt, Homo sapiens
ccagaagaaaucauguuua

SEQ ID NO: 742848 - RNA, 19 nt, Homo sapiens
gggcagugguuucacauca

SEQ ID NO: 742849 - RNA, 19 nt, Homo sapiens
gugaaaggaagcauguuua

SEQ ID NO: 742850 - RNA, 19 nt, Homo sapiens
ccaguugggucaagugguu

SEQ ID NO: 742851 - RNA, 19 nt, Homo sapiens
aagcguaccuccuauuuua

SEQ ID NO: 742852 - RNA, 19 nt, Homo sapiens
ucucuaaucuuguucuuca

SEQ ID NO: 742853 - RNA, 19 nt, Homo sapiens
uauaucaguucacccguaa

SEQ ID NO: 742854 - RNA, 19 nt, Homo sapiens
ccaaccauauuucacaaga

SEQ ID NO: 742855 - RNA, 19 nt, Homo sapiens
aaacaccagugcuuagaga

SEQ ID NO: 742856 - RNA, 19 nt, Homo sapiens
gaagaagaaacagaagaaa

SEQ ID NO: 742857 - RNA, 19 nt, Homo sapiens
cagaggaaguagauaugaa

SEQ ID NO: 742858 - RNA, 19 nt, Homo sapiens
auaugaagcugaaauguca

SEQ ID NO: 742859 - RNA, 19 nt, Homo sapiens
auacaaggguacucuauuc

SEQ ID NO: 742860 - RNA, 19 nt, Homo sapiens
guaugagguuguaaaugaa

SEQ ID NO: 742861 - RNA, 19 nt, Homo sapiens
ccacagaggaaguagauau

SEQ ID NO: 742862 - RNA, 19 nt, Homo sapiens
caagaggguguuaugcaua

SEQ ID NO: 742863 - RNA, 19 nt, Homo sapiens
gcagaacugucuccuuggu

SEQ ID NO: 742864 - RNA, 19 nt, Homo sapiens
guaaguaauccauaaagug

SEQ ID NO: 742865 - RNA, 19 nt, Homo sapiens
ugagccaguuucuuaauga

SEQ ID NO: 742866 - RNA, 19 nt, Homo sapiens
gcagagaaagauaauggaa

SEQ ID NO: 742867 - RNA, 19 nt, Homo sapiens
gguguuacguaugugauaa

SEQ ID NO: 742868 - RNA, 19 nt, Homo sapiens
gaucugaaccucacugucu

SEQ ID NO: 742869 - RNA, 19 nt, Homo sapiens
gaugauuccucugaaacuu

SEQ ID NO: 742870 - RNA, 19 nt, Homo sapiens
gccuacaacuaaaguacua

SEQ ID NO: 742871 - RNA, 19 nt, Homo sapiens
ggugaaaggaagcauguuu

SEQ ID NO: 742872 - RNA, 19 nt, Homo sapiens
ucaugaaucuuuccuugau

SEQ ID NO: 742873 - RNA, 19 nt, Homo sapiens
guaaaggaauacuuaaagc

SEQ ID NO: 742874 - RNA, 19 nt, Homo sapiens
gagaauccucccaugaauu

SEQ ID NO: 742875 - RNA, 19 nt, Homo sapiens
gaauaucugccaagacugu

SEQ ID NO: 742876 - RNA, 19 nt, Homo sapiens
aagagugaguaaaggaaua

SEQ ID NO: 742877 - RNA, 19 nt, Homo sapiens
gaacaccaaagagugagua

SEQ ID NO: 742878 - RNA, 19 nt, Homo sapiens
uccaggcccucuuacuuua

SEQ ID NO: 742879 - RNA, 19 nt, Homo sapiens
gcgaauaaacugcuuugug

SEQ ID NO: 742880 - RNA, 19 nt, Homo sapiens
aaaugaagauccagaaacu

SEQ ID NO: 742881 - RNA, 19 nt, Homo sapiens
cuaguaugaucauguguga

SEQ ID NO: 742882 - RNA, 19 nt, Homo sapiens
aaacaagccagcauuacaa

SEQ ID NO: 742883 - RNA, 19 nt, Homo sapiens
ggugauauuccacaagauu

SEQ ID NO: 742884 - RNA, 19 nt, Homo sapiens
guaaaugaagauccagaaa

SEQ ID NO: 742885 - RNA, 19 nt, Homo sapiens
ggauaaugaucuggagguu

SEQ ID NO: 742886 - RNA, 19 nt, Homo sapiens
gaggaugaagaucaagaua

SEQ ID NO: 742887 - RNA, 19 nt, Homo sapiens
gaguaagaaugaacaagag

SEQ ID NO: 742888 - RNA, 19 nt, Homo sapiens
gauaaugagguccaguauu

SEQ ID NO: 742889 - RNA, 19 nt, Homo sapiens
uggcugaaauaacgauaaa

SEQ ID NO: 742890 - RNA, 19 nt, Homo sapiens
guaauggaccaaaggcaaa

SEQ ID NO: 742891 - RNA, 19 nt, Homo sapiens
gaauaaacugcuuugugaa

SEQ ID NO: 742892 - RNA, 19 nt, Homo sapiens
ucaguuuggcugugucuua

SEQ ID NO: 742893 - RNA, 19 nt, Homo sapiens
ugaagaagaaacagaagaa

SEQ ID NO: 742894 - RNA, 19 nt, Homo sapiens
acuguaagacugacaauaa

SEQ ID NO: 742895 - RNA, 19 nt, Homo sapiens
gaagcauguuuacaccaau

SEQ ID NO: 742896 - RNA, 19 nt, Homo sapiens
aaagguguaugagguugua

SEQ ID NO: 742897 - RNA, 19 nt, Homo sapiens
ucacaagcguaccuccuau

SEQ ID NO: 742898 - RNA, 19 nt, Homo sapiens
gaaccaacgaagacaacaa

SEQ ID NO: 742899 - RNA, 19 nt, Homo sapiens
aaagagaauccucccauga

SEQ ID NO: 742900 - RNA, 19 nt, Homo sapiens
ggaaauguaucucagaaau

SEQ ID NO: 742901 - RNA, 19 nt, Homo sapiens
ccacauauguuauuuggaa

SEQ ID NO: 742902 - RNA, 19 nt, Homo sapiens
ggagauauuuccuuucuuc

SEQ ID NO: 742903 - RNA, 19 nt, Homo sapiens
gaaauugcuucucugaaau

SEQ ID NO: 742904 - RNA, 19 nt, Homo sapiens
gagaauaaguauagcuaga

SEQ ID NO: 742905 - RNA, 19 nt, Homo sapiens
gaacuucacggaacuuuau

SEQ ID NO: 742906 - RNA, 19 nt, Homo sapiens
guaacuggcucucuaggaa

SEQ ID NO: 742907 - RNA, 19 nt, Homo sapiens
ucaggaagguucucuuuga

SEQ ID NO: 742908 - RNA, 19 nt, Homo sapiens
gguaagagaugauuuccau

SEQ ID NO: 742909 - RNA, 19 nt, Homo sapiens
gaauaaguauagcuagaga

SEQ ID NO: 742910 - RNA, 19 nt, Homo sapiens
ggucaagacuggaugaugu

SEQ ID NO: 742911 - RNA, 19 nt, Homo sapiens
gaacaugugaggucagauu

SEQ ID NO: 742912 - RNA, 19 nt, Homo sapiens
gaacuugcuuguuuauagu

SEQ ID NO: 742913 - RNA, 19 nt, Homo sapiens
gaccauaagagaauaagua

SEQ ID NO: 742914 - RNA, 19 nt, Homo sapiens
guacauacuugcauuacau

SEQ ID NO: 742915 - RNA, 19 nt, Homo sapiens
agacacaggcaaaguauua

SEQ ID NO: 742916 - RNA, 19 nt, Homo sapiens
aaacauauaccaucuguga

SEQ ID NO: 742917 - RNA, 19 nt, Homo sapiens
cuucaacgauucuuucuuu

SEQ ID NO: 742918 - RNA, 19 nt, Homo sapiens
aaacugagccucucuacuu

SEQ ID NO: 742919 - RNA, 19 nt, Homo sapiens
uaggacaacuaaccaagua

SEQ ID NO: 742920 - RNA, 19 nt, Homo sapiens
guaagacacaggcaaagua

SEQ ID NO: 742921 - RNA, 19 nt, Homo sapiens
gaaagcagccaauaacaag

SEQ ID NO: 742922 - RNA, 19 nt, Homo sapiens
ccaugacucuccaguguuu

SEQ ID NO: 742923 - RNA, 19 nt, Homo sapiens
ggaaauguacacacagauu

SEQ ID NO: 742924 - RNA, 19 nt, Homo sapiens
cagauguugucacuuauuu

SEQ ID NO: 742925 - RNA, 19 nt, Homo sapiens
gaucuugggcccucacuuu

SEQ ID NO: 742926 - RNA, 19 nt, Homo sapiens
ccauugggauuccauugua

SEQ ID NO: 742927 - RNA, 19 nt, Homo sapiens
caagggaacuacgagcuuu

SEQ ID NO: 742928 - RNA, 19 nt, Homo sapiens
ugaacuugcuuguuuauag

SEQ ID NO: 742929 - RNA, 19 nt, Homo sapiens
gaugaggugcugaauguaa

SEQ ID NO: 742930 - RNA, 19 nt, Homo sapiens
gauauuuccuuucuucaag

SEQ ID NO: 742931 - RNA, 19 nt, Homo sapiens
gaaauuucccagccuauuc

SEQ ID NO: 742932 - RNA, 19 nt, Homo sapiens
ggaccgcauuggaagaauu

SEQ ID NO: 742933 - RNA, 19 nt, Homo sapiens
gcagaaagugccauauaga

SEQ ID NO: 742934 - RNA, 19 nt, Homo sapiens
uaaacaagaccauaagaga

SEQ ID NO: 742935 - RNA, 19 nt, Homo sapiens
guuaugcccuguuugcaaa

SEQ ID NO: 742936 - RNA, 19 nt, Homo sapiens
gaaauguacacacagauuc

SEQ ID NO: 742937 - RNA, 19 nt, Homo sapiens
ggaaacaggagcaggaaau

SEQ ID NO: 742938 - RNA, 19 nt, Homo sapiens
gcaguucuaucaucuaaaa

SEQ ID NO: 742939 - RNA, 19 nt, Homo sapiens
gaaauguaucucagaaaug

SEQ ID NO: 742940 - RNA, 19 nt, Homo sapiens
uacaugagcccuuaaggua

SEQ ID NO: 742941 - RNA, 19 nt, Homo sapiens
uaaccacaguugaagagaa

SEQ ID NO: 742942 - RNA, 19 nt, Homo sapiens
gaacaccuucuacagcaaa

SEQ ID NO: 742943 - RNA, 19 nt, Homo sapiens
aaauguacaugagcccuua

SEQ ID NO: 742944 - RNA, 19 nt, Homo sapiens
cgagagaagucgccuacug

SEQ ID NO: 742945 - RNA, 19 nt, Homo sapiens
uggaugaggugcugaaugu

SEQ ID NO: 742946 - RNA, 19 nt, Homo sapiens
cgaccuuucuuugugcuua

SEQ ID NO: 742947 - RNA, 19 nt, Homo sapiens
gcagggguguccaauauuu

SEQ ID NO: 742948 - RNA, 19 nt, Homo sapiens
ugauguaacuggcucucua

SEQ ID NO: 742949 - RNA, 19 nt, Homo sapiens
aaacaagaccauaagagaa

SEQ ID NO: 742950 - RNA, 19 nt, Homo sapiens
caggaaauguacacacaga

SEQ ID NO: 742951 - RNA, 19 nt, Homo sapiens
gaggugggcgcacgaguuu

SEQ ID NO: 742952 - RNA, 19 nt, Homo sapiens
aggcacagguuacucauga

SEQ ID NO: 742953 - RNA, 19 nt, Homo sapiens
ggaacuucacggaacuuua

SEQ ID NO: 742954 - RNA, 19 nt, Homo sapiens
ccaaguagacgaaacaagu

SEQ ID NO: 742955 - RNA, 19 nt, Homo sapiens
gcucucauguugcccuuau

SEQ ID NO: 742956 - RNA, 19 nt, Homo sapiens
gaucauauucagucuuuca

SEQ ID NO: 742957 - RNA, 19 nt, Homo sapiens
ggacaacuaaccaaguaga

SEQ ID NO: 742958 - RNA, 19 nt, Homo sapiens
gcugagcgagucacauuaa

SEQ ID NO: 742959 - RNA, 19 nt, Homo sapiens
aaagcagucuguuggagaa

SEQ ID NO: 742960 - RNA, 19 nt, Homo sapiens
ccaauaacaagaaaggaaa

SEQ ID NO: 742961 - RNA, 19 nt, Homo sapiens
gauuggcacuagcuaugaa

SEQ ID NO: 742962 - RNA, 19 nt, Homo sapiens
agaaacauauaccaucugu

SEQ ID NO: 742963 - RNA, 19 nt, Homo sapiens
guaugugcguguuuggaaa

SEQ ID NO: 742964 - RNA, 19 nt, Homo sapiens
gggcugagcgagucacauu

SEQ ID NO: 742965 - RNA, 19 nt, Homo sapiens
ucagaaacauauaccaucu

SEQ ID NO: 742966 - RNA, 19 nt, Homo sapiens
gaccacacccgucacaguu

SEQ ID NO: 742967 - RNA, 19 nt, Homo sapiens
acaagaccauaagagaaua

SEQ ID NO: 742968 - RNA, 19 nt, Homo sapiens
gagcgagucacauuaagga

SEQ ID NO: 742969 - RNA, 19 nt, Homo sapiens
ucucaguuguauuucguua

SEQ ID NO: 742970 - RNA, 19 nt, Homo sapiens
cauaguugaugagcuuaaa

SEQ ID NO: 742971 - RNA, 19 nt, Homo sapiens
uuauagcacuccgacauuu

SEQ ID NO: 742972 - RNA, 19 nt, Homo sapiens
ugaaagcagccaauaacaa

SEQ ID NO: 742973 - RNA, 19 nt, Homo sapiens
ugugacaguuccuaucaaa

SEQ ID NO: 742974 - RNA, 19 nt, Homo sapiens
gaugugacaguuccuauca

SEQ ID NO: 742975 - RNA, 19 nt, Homo sapiens
gaaacaggagcaggaaaug

SEQ ID NO: 742976 - RNA, 19 nt, Homo sapiens
ggcuacaccacauauguua

SEQ ID NO: 742977 - RNA, 19 nt, Homo sapiens
ucaguuguauuucguuauc

SEQ ID NO: 742978 - RNA, 19 nt, Homo sapiens
caaguagacgaaacaaguu

SEQ ID NO: 742979 - RNA, 19 nt, Homo sapiens
cgagauaaaggcagcuaaa

SEQ ID NO: 742980 - RNA, 19 nt, Homo sapiens
gcacagguuacucaugaug

SEQ ID NO: 742981 - RNA, 19 nt, Homo sapiens
uaaaggcacagguuacuca

SEQ ID NO: 742982 - RNA, 19 nt, Homo sapiens
ccagugacauuuaauucca

SEQ ID NO: 742983 - RNA, 19 nt, Homo sapiens
uauaccaucugugaagaaa

SEQ ID NO: 742984 - RNA, 19 nt, Homo sapiens
cgcagaaagugccauauag

SEQ ID NO: 742985 - RNA, 19 nt, Homo sapiens
ggucauuucugagcaucuu

SEQ ID NO: 742986 - RNA, 19 nt, Homo sapiens
uugagaggcuagaaacuga

SEQ ID NO: 742987 - RNA, 19 nt, Homo sapiens
gccaauaacaagaaaggaa

SEQ ID NO: 742988 - RNA, 19 nt, Homo sapiens
ccacacccgucacaguuca

SEQ ID NO: 742989 - RNA, 19 nt, Homo sapiens
aaccauaguugaugagcuu

SEQ ID NO: 742990 - RNA, 19 nt, Homo sapiens
uugcaguucuaucaucuaa

SEQ ID NO: 742991 - RNA, 19 nt, Homo sapiens
caccacauauguuauuugg

SEQ ID NO: 742992 - RNA, 19 nt, Homo sapiens
cuacaccacauauguuauu

SEQ ID NO: 742993 - RNA, 19 nt, Homo sapiens
gcaagaggaagucaaaauu

SEQ ID NO: 742994 - RNA, 19 nt, Homo sapiens
ugaggauggugguuaagga

SEQ ID NO: 742995 - RNA, 19 nt, Homo sapiens
uaagguaagagaugauuuc

SEQ ID NO: 742996 - RNA, 19 nt, Homo sapiens
guacaugagcccuuaaggu

SEQ ID NO: 742997 - RNA, 19 nt, Homo sapiens
cauugggauuccauuguaa

SEQ ID NO: 742998 - RNA, 19 nt, Homo sapiens
uaagacacaggcaaaguau

SEQ ID NO: 742999 - RNA, 19 nt, Homo sapiens
caaaaccuaucuuggcaaa

SEQ ID NO: 743000 - RNA, 19 nt, Homo sapiens
gcugugagcuccugacuga

SEQ ID NO: 743001 - RNA, 19 nt, Homo sapiens
gaagacacgauguuauuaa

SEQ ID NO: 743002 - RNA, 19 nt, Homo sapiens
ggucaaggcugcucaacug

SEQ ID NO: 743003 - RNA, 19 nt, Homo sapiens
ggacaccucugcacucaag

SEQ ID NO: 743004 - RNA, 19 nt, Homo sapiens
gaaaugccagagaaggaua

SEQ ID NO: 743005 - RNA, 19 nt, Homo sapiens
gugaagacacgauguuauu

SEQ ID NO: 743006 - RNA, 19 nt, Homo sapiens
caaggcugcucaacugguu

SEQ ID NO: 743007 - RNA, 19 nt, Homo sapiens
acgccaagcucuucaguga

SEQ ID NO: 743008 - RNA, 19 nt, Homo sapiens
gggaguacgugcugaccuu

SEQ ID NO: 743009 - RNA, 19 nt, Homo sapiens
cagagaaggauaacacauu

SEQ ID NO: 743010 - RNA, 19 nt, Homo sapiens
ugaagacacgauguuauua

SEQ ID NO: 743011 - RNA, 19 nt, Homo sapiens
agagaaggauaacacauuc

SEQ ID NO: 743012 - RNA, 19 nt, Homo sapiens
acaccgagcucuccuguac

SEQ ID NO: 743013 - RNA, 19 nt, Homo sapiens
gcacaaguucugccguuuc

SEQ ID NO: 743014 - RNA, 19 nt, Homo sapiens
gaaccaguacuccuucuac

SEQ ID NO: 743015 - RNA, 19 nt, Homo sapiens
gcggacaccucugcacuca

SEQ ID NO: 743016 - RNA, 19 nt, Homo sapiens
ggaaaugccagagaaggau

SEQ ID NO: 743017 - RNA, 19 nt, Homo sapiens
gagaugccgucagagaauc

SEQ ID NO: 743018 - RNA, 19 nt, Homo sapiens
cgagaugccgucagagaau

SEQ ID NO: 743019 - RNA, 19 nt, Homo sapiens
gacgcucucuggccgcuau

SEQ ID NO: 743020 - RNA, 19 nt, Homo sapiens
cagugaagacacgauguua

SEQ ID NO: 743021 - RNA, 19 nt, Homo sapiens
ccacggccagugucacgua

SEQ ID NO: 743022 - RNA, 19 nt, Homo sapiens
cagcggcagugacagcaau

SEQ ID NO: 743023 - RNA, 19 nt, Homo sapiens
caucgacucucugcagaag

SEQ ID NO: 743024 - RNA, 19 nt, Homo sapiens
uaacacauucguccucaag

SEQ ID NO: 743025 - RNA, 19 nt, Homo sapiens
caucacccuucgcagcuau

SEQ ID NO: 743026 - RNA, 19 nt, Homo sapiens
acacauucguccucaaggu

SEQ ID NO: 743027 - RNA, 19 nt, Homo sapiens
ggacacgccaagcucuuca

SEQ ID NO: 743028 - RNA, 19 nt, Homo sapiens
cacauucguccucaaggua

SEQ ID NO: 743029 - RNA, 19 nt, Homo sapiens
ccaacuuccuggacgucuu

SEQ ID NO: 743030 - RNA, 19 nt, Homo sapiens
gacacgauguuauuaaaag

SEQ ID NO: 743031 - RNA, 19 nt, Homo sapiens
ggucagcaucccacuguca

SEQ ID NO: 743032 - RNA, 19 nt, Homo sapiens
ucagugaagacacgauguu

SEQ ID NO: 743033 - RNA, 19 nt, Homo sapiens
caacuuccuggacgucuuc

SEQ ID NO: 743034 - RNA, 19 nt, Homo sapiens
ggcagugacagcaauaaca

SEQ ID NO: 743035 - RNA, 19 nt, Homo sapiens
gggacaacccagcuuacga

SEQ ID NO: 743036 - RNA, 19 nt, Homo sapiens
ugacaugcuccgccacuuc

SEQ ID NO: 743037 - RNA, 19 nt, Homo sapiens
gcagugacagcaauaacac

SEQ ID NO: 743038 - RNA, 19 nt, Homo sapiens
gugauccgccaaagugaga

SEQ ID NO: 743039 - RNA, 19 nt, Homo sapiens
ucgacucucugcagaagca

SEQ ID NO: 743040 - RNA, 19 nt, Homo sapiens
ccacugucagccaucauug

SEQ ID NO: 743041 - RNA, 19 nt, Homo sapiens
ugugagcuccugacugaug

SEQ ID NO: 743042 - RNA, 19 nt, Homo sapiens
gcacuaaagucuuggaaua

SEQ ID NO: 743043 - RNA, 19 nt, Homo sapiens
gguuguagcuccuguauua

SEQ ID NO: 743044 - RNA, 19 nt, Homo sapiens
ccacaucuaucccaaauuu

SEQ ID NO: 743045 - RNA, 19 nt, Homo sapiens
cagaauauguucaggauuu

SEQ ID NO: 743046 - RNA, 19 nt, Homo sapiens
gauccuaacuacuuuauga

SEQ ID NO: 743047 - RNA, 19 nt, Homo sapiens
guaauuaccugucccauca

SEQ ID NO: 743048 - RNA, 19 nt, Homo sapiens
guacaucugugucugcuaa

SEQ ID NO: 743049 - RNA, 19 nt, Homo sapiens
gagcucgccuguguaauua

SEQ ID NO: 743050 - RNA, 19 nt, Homo sapiens
guuagaugcuuauccuuua

SEQ ID NO: 743051 - RNA, 19 nt, Homo sapiens
gaagaugcuuggaaggaaa

SEQ ID NO: 743052 - RNA, 19 nt, Homo sapiens
ggaagaaauuauucagaga

SEQ ID NO: 743053 - RNA, 19 nt, Homo sapiens
gcagagacccugaaugguu

SEQ ID NO: 743054 - RNA, 19 nt, Homo sapiens
cuuaaagccuagaacauua

SEQ ID NO: 743055 - RNA, 19 nt, Homo sapiens
caagagaaauaccaagaau

SEQ ID NO: 743056 - RNA, 19 nt, Homo sapiens
guagaacuccggucaagua

SEQ ID NO: 743057 - RNA, 19 nt, Homo sapiens
ccaaauuucucuuauaugg

SEQ ID NO: 743058 - RNA, 19 nt, Homo sapiens
guaggaguauuauagcuuu

SEQ ID NO: 743059 - RNA, 19 nt, Homo sapiens
gggaugaaguuacucgaaa

SEQ ID NO: 743060 - RNA, 19 nt, Homo sapiens
ccaccuaguucacaggaua

SEQ ID NO: 743061 - RNA, 19 nt, Homo sapiens
ggaagaugcuuggaaggaa

SEQ ID NO: 743062 - RNA, 19 nt, Homo sapiens
gaacuccggucaaguaacu

SEQ ID NO: 743063 - RNA, 19 nt, Homo sapiens
acaguuagcuuucucacuu

SEQ ID NO: 743064 - RNA, 19 nt, Homo sapiens
guuuagguauggugauuua

SEQ ID NO: 743065 - RNA, 19 nt, Homo sapiens
gagggucacuuuucuaaua

SEQ ID NO: 743066 - RNA, 19 nt, Homo sapiens
ggagcucgccuguguaauu

SEQ ID NO: 743067 - RNA, 19 nt, Homo sapiens
gauagaagaagcuuaugaa

SEQ ID NO: 743068 - RNA, 19 nt, Homo sapiens
cagauuaccaagagaaaua

SEQ ID NO: 743069 - RNA, 19 nt, Homo sapiens
gggaacaaauggacagguu

SEQ ID NO: 743070 - RNA, 19 nt, Homo sapiens
uagcauggguugaaucgaa

SEQ ID NO: 743071 - RNA, 19 nt, Homo sapiens
caacugacuaacuucauua

SEQ ID NO: 743072 - RNA, 19 nt, Homo sapiens
ggacugaauaugaaguuaa

SEQ ID NO: 743073 - RNA, 19 nt, Homo sapiens
uggaugauauugaugauga

SEQ ID NO: 743074 - RNA, 19 nt, Homo sapiens
ccaugcaacuucaacauau

SEQ ID NO: 743075 - RNA, 19 nt, Homo sapiens
aaagaugucggacugaaua

SEQ ID NO: 743076 - RNA, 19 nt, Homo sapiens
ugucuaagcugucugugaa

SEQ ID NO: 743077 - RNA, 19 nt, Homo sapiens
aaacugcaguagagaugua

SEQ ID NO: 743078 - RNA, 19 nt, Homo sapiens
ugagauggacccagagaua

SEQ ID NO: 743079 - RNA, 19 nt, Homo sapiens
ggaacaaauggacagguua

SEQ ID NO: 743080 - RNA, 19 nt, Homo sapiens
gcauguaaauaguucuguu

SEQ ID NO: 743081 - RNA, 19 nt, Homo sapiens
ucaacugacuaacuucauu

SEQ ID NO: 743082 - RNA, 19 nt, Homo sapiens
gaacacaagagagcaagaa

SEQ ID NO: 743083 - RNA, 19 nt, Homo sapiens
gaaagauggauauggaaga

SEQ ID NO: 743084 - RNA, 19 nt, Homo sapiens
cagaugcuauuuacauaug

SEQ ID NO: 743085 - RNA, 19 nt, Homo sapiens
caugcaacuucaacauaua

SEQ ID NO: 743086 - RNA, 19 nt, Homo sapiens
ugacuaacuucauuaccuu

SEQ ID NO: 743087 - RNA, 19 nt, Homo sapiens
aaagauggauauggaagaa

SEQ ID NO: 743088 - RNA, 19 nt, Homo sapiens
aaggaaagauggauaugga

SEQ ID NO: 743089 - RNA, 19 nt, Homo sapiens
uccuauggaugacaauuua

SEQ ID NO: 743090 - RNA, 19 nt, Homo sapiens
uaugggagcucgccugugu

SEQ ID NO: 743091 - RNA, 19 nt, Homo sapiens
uacaacagaugaugcuuug

SEQ ID NO: 743092 - RNA, 19 nt, Homo sapiens
uggaauauaucaacaacug

SEQ ID NO: 743093 - RNA, 19 nt, Homo sapiens
cuaguugguuagaugcuua

SEQ ID NO: 743094 - RNA, 19 nt, Homo sapiens
cauaugcagaugcuauuua

SEQ ID NO: 743095 - RNA, 19 nt, Homo sapiens
ugaaugcccuguuuucuaa

SEQ ID NO: 743096 - RNA, 19 nt, Homo sapiens
gaugucggacugaauauga

SEQ ID NO: 743097 - RNA, 19 nt, Homo sapiens
ucaaagaugucggacugaa

SEQ ID NO: 743098 - RNA, 19 nt, Homo sapiens
cagguuauucuuccaguua

SEQ ID NO: 743099 - RNA, 19 nt, Homo sapiens
caacugauuuacauaugca

SEQ ID NO: 743100 - RNA, 19 nt, Homo sapiens
gcaaacugcaguagagaug

SEQ ID NO: 743101 - RNA, 19 nt, Homo sapiens
caacuuccgccaauugcua

SEQ ID NO: 743102 - RNA, 19 nt, Homo sapiens
aaucagagcguaagcgaaa

SEQ ID NO: 743103 - RNA, 19 nt, Homo sapiens
agaagaagcuuaugaaaag

SEQ ID NO: 743104 - RNA, 19 nt, Homo sapiens
ggccacaucuaucccaaau

SEQ ID NO: 743105 - RNA, 19 nt, Homo sapiens
acccuaaugucaaaucuuu

SEQ ID NO: 743106 - RNA, 19 nt, Homo sapiens
gguuagaugcuuauccuuu

SEQ ID NO: 743107 - RNA, 19 nt, Homo sapiens
gaggaugguugugaggauu

SEQ ID NO: 743108 - RNA, 19 nt, Homo sapiens
gcuccuguauuaaugucua

SEQ ID NO: 743109 - RNA, 19 nt, Homo sapiens
gcagaugcuauuuacauau

SEQ ID NO: 743110 - RNA, 19 nt, Homo sapiens
guauggugauuuagcagaa

SEQ ID NO: 743111 - RNA, 19 nt, Homo sapiens
gaacaaauggacagguuac

SEQ ID NO: 743112 - RNA, 19 nt, Homo sapiens
gcuaaacaaccaagacuuc

SEQ ID NO: 743113 - RNA, 19 nt, Homo sapiens
ugcagaugcuauuuacaua

SEQ ID NO: 743114 - RNA, 19 nt, Homo sapiens
ugucacaucuauaccaaau

SEQ ID NO: 743115 - RNA, 19 nt, Homo sapiens
ugauauugaugaugagaug

SEQ ID NO: 743116 - RNA, 19 nt, Homo sapiens
caacuucaacauauagaga

SEQ ID NO: 743117 - RNA, 19 nt, Homo sapiens
ccugagagcuccaccuagu

SEQ ID NO: 743118 - RNA, 19 nt, Homo sapiens
ccuaacuacuuuaugaaug

SEQ ID NO: 743119 - RNA, 19 nt, Homo sapiens
gagaucaagggaacaaaug

SEQ ID NO: 743120 - RNA, 19 nt, Homo sapiens
ggagaucaagggaacaaau

SEQ ID NO: 743121 - RNA, 19 nt, Homo sapiens
caaaaggauugcuuguaaa

SEQ ID NO: 743122 - RNA, 19 nt, Homo sapiens
ugguugaacucccagcuaa

SEQ ID NO: 743123 - RNA, 19 nt, Homo sapiens
gauguugaguuauguuacu

SEQ ID NO: 743124 - RNA, 19 nt, Homo sapiens
gccaauugcuacuucaaag

SEQ ID NO: 743125 - RNA, 19 nt, Homo sapiens
caacagaugaugcuuugca

SEQ ID NO: 743126 - RNA, 19 nt, Homo sapiens
ccaagagaaauaccaagaa

SEQ ID NO: 743127 - RNA, 19 nt, Homo sapiens
cagaugaugcuuugcaaga

SEQ ID NO: 743128 - RNA, 19 nt, Homo sapiens
gcuuguaaauaugcaugua

SEQ ID NO: 743129 - RNA, 19 nt, Homo sapiens
cacugaagauuuauuccaa

SEQ ID NO: 743130 - RNA, 19 nt, Homo sapiens
ugaaugccccugaauuuua

SEQ ID NO: 743131 - RNA, 19 nt, Homo sapiens
ggacccagagauagaagaa

SEQ ID NO: 743132 - RNA, 19 nt, Homo sapiens
gagcaugucggacgguuuc

SEQ ID NO: 743133 - RNA, 19 nt, Homo sapiens
agauggauauggaagaaau

SEQ ID NO: 743134 - RNA, 19 nt, Homo sapiens
caaauggacagguuacaag

SEQ ID NO: 743135 - RNA, 19 nt, Homo sapiens
cagagcagccuggcaguuu

SEQ ID NO: 743136 - RNA, 19 nt, Homo sapiens
augcagaugcuauuugaua

SEQ ID NO: 743137 - RNA, 19 nt, Homo sapiens
auaugcagaugcuauuuga

SEQ ID NO: 743138 - RNA, 19 nt, Homo sapiens
agagauagaagaagcuuau

SEQ ID NO: 743139 - RNA, 19 nt, Homo sapiens
gcagaguccaugcaacuuc

SEQ ID NO: 743140 - RNA, 19 nt, Homo sapiens
ucagguuggucuucgagaa

SEQ ID NO: 743141 - RNA, 19 nt, Homo sapiens
uuaaagaucaagcugcaaa

SEQ ID NO: 743142 - RNA, 19 nt, Homo sapiens
gaagcaggcugacaagaaa

SEQ ID NO: 743143 - RNA, 19 nt, Homo sapiens
ccaaggacuucuaacaaua

SEQ ID NO: 743144 - RNA, 19 nt, Homo sapiens
ucaauuugcugcucagaua

SEQ ID NO: 743145 - RNA, 19 nt, Homo sapiens
gaaacccugucucuacuaa

SEQ ID NO: 743146 - RNA, 19 nt, Homo sapiens
gauuaaagcugaguaugaa

SEQ ID NO: 743147 - RNA, 19 nt, Homo sapiens
ggagacagcuuucauugca

SEQ ID NO: 743148 - RNA, 19 nt, Homo sapiens
gaugaaacucugaggauua

SEQ ID NO: 743149 - RNA, 19 nt, Homo sapiens
gcucagauauuuggguuaa

SEQ ID NO: 743150 - RNA, 19 nt, Homo sapiens
caaggaaggauauaaguuu

SEQ ID NO: 743151 - RNA, 19 nt, Homo sapiens
acagaaugcucccaacuuu

SEQ ID NO: 743152 - RNA, 19 nt, Homo sapiens
caaaagaagucuacgaauu

SEQ ID NO: 743153 - RNA, 19 nt, Homo sapiens
gugaauaaaugcuucucua

SEQ ID NO: 743154 - RNA, 19 nt, Homo sapiens
acacauggauuuccuugaa

SEQ ID NO: 743155 - RNA, 19 nt, Homo sapiens
gccuguagcucuugguaua

SEQ ID NO: 743156 - RNA, 19 nt, Homo sapiens
ugaauuugguguugaugua

SEQ ID NO: 743157 - RNA, 19 nt, Homo sapiens
cuauugaguuucuuccuua

SEQ ID NO: 743158 - RNA, 19 nt, Homo sapiens
ggauuaaagcugaguauga

SEQ ID NO: 743159 - RNA, 19 nt, Homo sapiens
gaauaaaugcuucucuaga

SEQ ID NO: 743160 - RNA, 19 nt, Homo sapiens
gugaaaugauuccaauuga

SEQ ID NO: 743161 - RNA, 19 nt, Homo sapiens
cgacuaacagggacuauaa

SEQ ID NO: 743162 - RNA, 19 nt, Homo sapiens
gaauggguuugcagaagaa

SEQ ID NO: 743163 - RNA, 19 nt, Homo sapiens
aagcugcaaucucaaauaa

SEQ ID NO: 743164 - RNA, 19 nt, Homo sapiens
agaaggaucagcucaauuu

SEQ ID NO: 743165 - RNA, 19 nt, Homo sapiens
caagaaggccuguggaaau

SEQ ID NO: 743166 - RNA, 19 nt, Homo sapiens
gaagggcuccaaaugguaa

SEQ ID NO: 743167 - RNA, 19 nt, Homo sapiens
guacacugguugauaugaa

SEQ ID NO: 743168 - RNA, 19 nt, Homo sapiens
cagaauagaagaugucauu

SEQ ID NO: 743169 - RNA, 19 nt, Homo sapiens
gauuaacccuugaauuuac

SEQ ID NO: 743170 - RNA, 19 nt, Homo sapiens
caaauaaaaucaccaguug

SEQ ID NO: 743171 - RNA, 19 nt, Homo sapiens
uaacggacuuaaccucauu

SEQ ID NO: 743172 - RNA, 19 nt, Homo sapiens
aaacucauguguacuacuu

SEQ ID NO: 743173 - RNA, 19 nt, Homo sapiens
guaguucuuucucuauuga

SEQ ID NO: 743174 - RNA, 19 nt, Homo sapiens
acaaguaguucuuucucua

SEQ ID NO: 743175 - RNA, 19 nt, Homo sapiens
ggucacuacuauugaguuu

SEQ ID NO: 743176 - RNA, 19 nt, Homo sapiens
gauguaaccaccaaagaaa

SEQ ID NO: 743177 - RNA, 19 nt, Homo sapiens
gaaaaccgcacacauaaaa

SEQ ID NO: 743178 - RNA, 19 nt, Homo sapiens
gaaggaaaaucaagcaaga

SEQ ID NO: 743179 - RNA, 19 nt, Homo sapiens
gcaccgcagugugaaauga

SEQ ID NO: 743180 - RNA, 19 nt, Homo sapiens
caaggacuucuaacaauaa

SEQ ID NO: 743181 - RNA, 19 nt, Homo sapiens
cugauuaacccuugaauuu

SEQ ID NO: 743182 - RNA, 19 nt, Homo sapiens
ucaaggaugaugccaauaa

SEQ ID NO: 743183 - RNA, 19 nt, Homo sapiens
agaagucuacgaauuguua

SEQ ID NO: 743184 - RNA, 19 nt, Homo sapiens
gcucugaugugcuaugcuu

SEQ ID NO: 743185 - RNA, 19 nt, Homo sapiens
gaauagaagaugucauugu

SEQ ID NO: 743186 - RNA, 19 nt, Homo sapiens
uaacagggacuauaaucuu

SEQ ID NO: 743187 - RNA, 19 nt, Homo sapiens
cuacacaggcuauauuuga

SEQ ID NO: 743188 - RNA, 19 nt, Homo sapiens
ggacuuaaccucauuucuc

SEQ ID NO: 743189 - RNA, 19 nt, Homo sapiens
gcacaguggcucacaccua

SEQ ID NO: 743190 - RNA, 19 nt, Homo sapiens
caagucauguugguguuaa

SEQ ID NO: 743191 - RNA, 19 nt, Homo sapiens
gcauaaaggaccagaugaa

SEQ ID NO: 743192 - RNA, 19 nt, Homo sapiens
cgaguaacaucugcgcaua

SEQ ID NO: 743193 - RNA, 19 nt, Homo sapiens
gaauagcaacugguucuuu

SEQ ID NO: 743194 - RNA, 19 nt, Homo sapiens
uauguucgcuguccaugaa

SEQ ID NO: 743195 - RNA, 19 nt, Homo sapiens
gaacucauuuuccucguaa

SEQ ID NO: 743196 - RNA, 19 nt, Homo sapiens
gcagugagccuggaucaug

SEQ ID NO: 743197 - RNA, 19 nt, Homo sapiens
gugcaggguuguaguguug

SEQ ID NO: 743198 - RNA, 19 nt, Homo sapiens
caaggaugaugccaauaau

SEQ ID NO: 743199 - RNA, 19 nt, Homo sapiens
cgaagccuauccaugguuu

SEQ ID NO: 743200 - RNA, 19 nt, Homo sapiens
aagaaggccuguggaaauu

SEQ ID NO: 743201 - RNA, 19 nt, Homo sapiens
ugaauggguuugcagaaga

SEQ ID NO: 743202 - RNA, 19 nt, Homo sapiens
guagaaaaccgcacacaua

SEQ ID NO: 743203 - RNA, 19 nt, Homo sapiens
caagcaagaugaaaaggua

SEQ ID NO: 743204 - RNA, 19 nt, Homo sapiens
gaucgaagccaacagaaag

SEQ ID NO: 743205 - RNA, 19 nt, Homo sapiens
aaacugccuucaccagaaa

SEQ ID NO: 743206 - RNA, 19 nt, Homo sapiens
uagaagaugucauuguaca

SEQ ID NO: 743207 - RNA, 19 nt, Homo sapiens
gcuaguagagcuuuauguu

SEQ ID NO: 743208 - RNA, 19 nt, Homo sapiens
ggacugccacacauuggua

SEQ ID NO: 743209 - RNA, 19 nt, Homo sapiens
agggucaaauucaacauua

SEQ ID NO: 743210 - RNA, 19 nt, Homo sapiens
gucagaagcuugauuucau

SEQ ID NO: 743211 - RNA, 19 nt, Homo sapiens
gcucccaacuuuauucauc

SEQ ID NO: 743212 - RNA, 19 nt, Homo sapiens
gauguguggucuucucuuc

SEQ ID NO: 743213 - RNA, 19 nt, Homo sapiens
gaacuucgaguaacaucug

SEQ ID NO: 743214 - RNA, 19 nt, Homo sapiens
ggagaucgaagccaacaga

SEQ ID NO: 743215 - RNA, 19 nt, Homo sapiens
gaagauugaauuugguguu

SEQ ID NO: 743216 - RNA, 19 nt, Homo sapiens
caagugagggucaaauuca

SEQ ID NO: 743217 - RNA, 19 nt, Homo sapiens
gcacccaacaguagcguaa

SEQ ID NO: 743218 - RNA, 19 nt, Homo sapiens
aaacugcgagcaagcauuu

SEQ ID NO: 743219 - RNA, 19 nt, Homo sapiens
acaggaagcagguauuaaa

SEQ ID NO: 743220 - RNA, 19 nt, Homo sapiens
ccacacauugguaccuuua

SEQ ID NO: 743221 - RNA, 19 nt, Homo sapiens
ccacagacuucuuugaaaa

SEQ ID NO: 743222 - RNA, 19 nt, Homo sapiens
caaguugauugcccaagga

SEQ ID NO: 743223 - RNA, 19 nt, Homo sapiens
gcagcaccaugccgagcua

SEQ ID NO: 743224 - RNA, 19 nt, Homo sapiens
gacuuaaccucauuucucu

SEQ ID NO: 743225 - RNA, 19 nt, Homo sapiens
gccuuuaucauuccucuua

SEQ ID NO: 743226 - RNA, 19 nt, Homo sapiens
caccuaaaguggaguuguu

SEQ ID NO: 743227 - RNA, 19 nt, Homo sapiens
gcugcaaucucaaauaaaa

SEQ ID NO: 743228 - RNA, 19 nt, Homo sapiens
gcaguggcgugaucucagu

SEQ ID NO: 743229 - RNA, 19 nt, Homo sapiens
ggagugcaguggcgugauc

SEQ ID NO: 743230 - RNA, 19 nt, Homo sapiens
cuauauuucuccagacuug

SEQ ID NO: 743231 - RNA, 19 nt, Homo sapiens
cagccagccuuuaucauuc

SEQ ID NO: 743232 - RNA, 19 nt, Homo sapiens
ccagaaggaucagcucaau

SEQ ID NO: 743233 - RNA, 19 nt, Homo sapiens
gcaguggcaggcagaagua

SEQ ID NO: 743234 - RNA, 19 nt, Homo sapiens
gggauggcauuccuacugu

SEQ ID NO: 743235 - RNA, 19 nt, Homo sapiens
cccaaggacuucuaacaau

SEQ ID NO: 743236 - RNA, 19 nt, Homo sapiens
cagaaugcucccaacuuua

SEQ ID NO: 743237 - RNA, 19 nt, Homo sapiens
gcuagacaccaagauauuu

SEQ ID NO: 743238 - RNA, 19 nt, Homo sapiens
ugaagcaggcugacaagaa

SEQ ID NO: 743239 - RNA, 19 nt, Homo sapiens
gaaggccuguggaaauuuu

SEQ ID NO: 743240 - RNA, 19 nt, Homo sapiens
gcaccaugccgagcuaauu

SEQ ID NO: 743241 - RNA, 19 nt, Homo sapiens
ucacuacuauugaguuucu

SEQ ID NO: 743242 - RNA, 19 nt, Homo sapiens
acucagcgcugccaugaua

SEQ ID NO: 743243 - RNA, 19 nt, Homo sapiens
guccguaucuggagaauga

SEQ ID NO: 743244 - RNA, 19 nt, Homo sapiens
gaucagagcguccguaucu

SEQ ID NO: 743245 - RNA, 19 nt, Homo sapiens
ggacaucacugccuuugac

SEQ ID NO: 743246 - RNA, 19 nt, Homo sapiens
gugaagcucuggaccauca

SEQ ID NO: 743247 - RNA, 19 nt, Homo sapiens
gacuucagcugucucaaga

SEQ ID NO: 743248 - RNA, 19 nt, Homo sapiens
gugaagaguucggugcuaa

SEQ ID NO: 743249 - RNA, 19 nt, Homo sapiens
aaauugagccuuucuacaa

SEQ ID NO: 743250 - RNA, 19 nt, Homo sapiens
ggaccgugccuguguuuga

SEQ ID NO: 743251 - RNA, 19 nt, Homo sapiens
gcaccagagucaacauucu

SEQ ID NO: 743252 - RNA, 19 nt, Homo sapiens
uggacaaccugcugcauga

SEQ ID NO: 743253 - RNA, 19 nt, Homo sapiens
ggaggcugcugugcuguug

SEQ ID NO: 743254 - RNA, 19 nt, Homo sapiens
ccagggcuguacuuucuga

SEQ ID NO: 743255 - RNA, 19 nt, Homo sapiens
acaguucgcuggcuacagu

SEQ ID NO: 743256 - RNA, 19 nt, Homo sapiens
acacugagcggcacuuuca

SEQ ID NO: 743257 - RNA, 19 nt, Homo sapiens
ggacuucagcugucucaag

SEQ ID NO: 743258 - RNA, 19 nt, Homo sapiens
ucugacagcuggcgaccaa

SEQ ID NO: 743259 - RNA, 19 nt, Homo sapiens
gcugcugggugucuucuca

SEQ ID NO: 743260 - RNA, 19 nt, Homo sapiens
agccaggacugcacuguga

SEQ ID NO: 743261 - RNA, 19 nt, Homo sapiens
gagucaacauucuggaagu

SEQ ID NO: 743262 - RNA, 19 nt, Homo sapiens
gaacacagccccagacaac

SEQ ID NO: 743263 - RNA, 19 nt, Homo sapiens
ccacucagcgcugccauga

SEQ ID NO: 743264 - RNA, 19 nt, Homo sapiens
cuacacgccugcugcucuu

SEQ ID NO: 743265 - RNA, 19 nt, Homo sapiens
acaaccugcugcaugagaa

SEQ ID NO: 743266 - RNA, 19 nt, Homo sapiens
ggcguucugugaagaguuc

SEQ ID NO: 743267 - RNA, 19 nt, Homo sapiens
cgaggaccgugccuguguu

SEQ ID NO: 743268 - RNA, 19 nt, Homo sapiens
ucaagaacaacgagugugu

SEQ ID NO: 743269 - RNA, 19 nt, Homo sapiens
gaggaccgugccuguguuu

SEQ ID NO: 743270 - RNA, 19 nt, Homo sapiens
gcucaggguuccggucaca

SEQ ID NO: 743271 - RNA, 19 nt, Homo sapiens
caauagccccugccuaaaa

SEQ ID NO: 743272 - RNA, 19 nt, Homo sapiens
ccgggacccuagcagguuu

SEQ ID NO: 743273 - RNA, 19 nt, Homo sapiens
ggaggacaucacugccuuu

SEQ ID NO: 743274 - RNA, 19 nt, Homo sapiens
gacaaccugcugcaugaga

SEQ ID NO: 743275 - RNA, 19 nt, Homo sapiens
gacgucagccugccagauc

SEQ ID NO: 743276 - RNA, 19 nt, Homo sapiens
gugaggagguuuuggaugu

SEQ ID NO: 743277 - RNA, 19 nt, Homo sapiens
gaguguggcguucugugaa

SEQ ID NO: 743278 - RNA, 19 nt, Homo sapiens
gaggacaucacugccuuug

SEQ ID NO: 743279 - RNA, 19 nt, Homo sapiens
ucuggaccaucaagaacaa

SEQ ID NO: 743280 - RNA, 19 nt, Homo sapiens
ggccgugacaagauaugua

SEQ ID NO: 743281 - RNA, 19 nt, Homo sapiens
caucaagaacaacgagugu

SEQ ID NO: 743282 - RNA, 19 nt, Homo sapiens
gaccgugccuguguuugag

SEQ ID NO: 743283 - RNA, 19 nt, Homo sapiens
gacagccagucgggcauug

SEQ ID NO: 743284 - RNA, 19 nt, Homo sapiens
agcaagagcuggacaaccu

SEQ ID NO: 743285 - RNA, 19 nt, Homo sapiens
uggcaagagggcagcguua

SEQ ID NO: 743286 - RNA, 19 nt, Homo sapiens
gcaccucuucugcgucugu

SEQ ID NO: 743287 - RNA, 19 nt, Homo sapiens
gccgugacaagauauguau

SEQ ID NO: 743288 - RNA, 19 nt, Homo sapiens
aauugagccuuucuacaag

SEQ ID NO: 743289 - RNA, 19 nt, Homo sapiens
ggcaccgucugcugcucua

SEQ ID NO: 743290 - RNA, 19 nt, Homo sapiens
cuacgggacacaccacuuc

SEQ ID NO: 743291 - RNA, 19 nt, Homo sapiens
cggauggccucgugaagcu

SEQ ID NO: 743292 - RNA, 19 nt, Homo sapiens
gguuuuggauguccgguuu

SEQ ID NO: 743293 - RNA, 19 nt, Homo sapiens
ugugaagaguucggugcua

SEQ ID NO: 743294 - RNA, 19 nt, Homo sapiens
gcuucugcgucacguggaa

SEQ ID NO: 743295 - RNA, 19 nt, Homo sapiens
caucaacagcguggcuauu

SEQ ID NO: 743296 - RNA, 19 nt, Homo sapiens
ucaccucacuggccuucag

SEQ ID NO: 743297 - RNA, 19 nt, Homo sapiens
ggaaagggcuucucaugag

SEQ ID NO: 743298 - RNA, 19 nt, Homo sapiens
gaaggcagcucccgcauac

SEQ ID NO: 743299 - RNA, 19 nt, Homo sapiens
caacaggucuucacacaac

SEQ ID NO: 743300 - RNA, 19 nt, Homo sapiens
cagagaggcuuucccagaa

SEQ ID NO: 743301 - RNA, 19 nt, Homo sapiens
ccuaaucauuccagaagua

SEQ ID NO: 743302 - RNA, 19 nt, Homo sapiens
gcaggugggugguuaaggu

SEQ ID NO: 743303 - RNA, 19 nt, Homo sapiens
ggaaggcagcucccgcaua

SEQ ID NO: 743304 - RNA, 19 nt, Homo sapiens
gcuguguccuuaugucauu

SEQ ID NO: 743305 - RNA, 19 nt, Homo sapiens
gcucacacaugcagacaca

SEQ ID NO: 743306 - RNA, 19 nt, Homo sapiens
gggccaaggugcacaucaa

SEQ ID NO: 743307 - RNA, 19 nt, Homo sapiens
gggccgugcuguguccuua

SEQ ID NO: 743308 - RNA, 19 nt, Homo sapiens
cuucugcucucaucucuga

SEQ ID NO: 743309 - RNA, 19 nt, Homo sapiens
gcaagaaguggacauagag

SEQ ID NO: 743310 - RNA, 19 nt, Homo sapiens
ggacgacucagagcaagaa

SEQ ID NO: 743311 - RNA, 19 nt, Homo sapiens
acuggaggcugguuaaguu

SEQ ID NO: 743312 - RNA, 19 nt, Homo sapiens
agacacacccacucaugua

SEQ ID NO: 743313 - RNA, 19 nt, Homo sapiens
ccacuucgcaggugucaga

SEQ ID NO: 743314 - RNA, 19 nt, Homo sapiens
ccaaggugcacaucaagaa

SEQ ID NO: 743315 - RNA, 19 nt, Homo sapiens
guagccaauucccauauca

SEQ ID NO: 743316 - RNA, 19 nt, Homo sapiens
gcacagacgagccaaacuc

SEQ ID NO: 743317 - RNA, 19 nt, Homo sapiens
ucacacaacgagcuagaaa

SEQ ID NO: 743318 - RNA, 19 nt, Homo sapiens
guccuuaugucauuguaau

SEQ ID NO: 743319 - RNA, 19 nt, Homo sapiens
cuggugagcuggacagugu

SEQ ID NO: 743320 - RNA, 19 nt, Homo sapiens
aaagaagaaagccuaaaga

SEQ ID NO: 743321 - RNA, 19 nt, Homo sapiens
gcgggaggauggagcugaa

SEQ ID NO: 743322 - RNA, 19 nt, Homo sapiens
gucaaagugugccuugugu

SEQ ID NO: 743323 - RNA, 19 nt, Homo sapiens
caaggugcacaucaagaaa

SEQ ID NO: 743324 - RNA, 19 nt, Homo sapiens
ggccaucaccgugucuaua

SEQ ID NO: 743325 - RNA, 19 nt, Homo sapiens
ucccugcccucaauucuug

SEQ ID NO: 743326 - RNA, 19 nt, Homo sapiens
aagaaagccuaaagacucu

SEQ ID NO: 743327 - RNA, 19 nt, Homo sapiens
agcaagaaguggacauaga

SEQ ID NO: 743328 - RNA, 19 nt, Homo sapiens
aacaacaggucuucacaca

SEQ ID NO: 743329 - RNA, 19 nt, Homo sapiens
aggcgaggguuccagguuu

SEQ ID NO: 743330 - RNA, 19 nt, Homo sapiens
gucccgaggucacauguuc

SEQ ID NO: 743331 - RNA, 19 nt, Homo sapiens
cuaccugucaguccacaua

SEQ ID NO: 743332 - RNA, 19 nt, Homo sapiens
ggaaggcaaggcugucugu

SEQ ID NO: 743333 - RNA, 19 nt, Homo sapiens
cgacucagagcaagaagug

SEQ ID NO: 743334 - RNA, 19 nt, Homo sapiens
guuguugcguccuuguuug

SEQ ID NO: 743335 - RNA, 19 nt, Homo sapiens
cgacuucgccagggagaaa

SEQ ID NO: 743336 - RNA, 19 nt, Homo sapiens
aagugugccuugugucuug

SEQ ID NO: 743337 - RNA, 19 nt, Homo sapiens
caaagugugccuugugucu

SEQ ID NO: 743338 - RNA, 19 nt, Homo sapiens
ggaguggaccgaggaagga

SEQ ID NO: 743339 - RNA, 19 nt, Homo sapiens
gcagacagaagcagaacag

SEQ ID NO: 743340 - RNA, 19 nt, Homo sapiens
ggaggcugguuaaguugca

SEQ ID NO: 743341 - RNA, 19 nt, Homo sapiens
aggaaagggcuucucauga

SEQ ID NO: 743342 - RNA, 19 nt, Homo sapiens
uaggaaagggcuucucaug

SEQ ID NO: 743343 - RNA, 19 nt, Homo sapiens
ggggaaaauucgugucuau

SEQ ID NO: 743344 - RNA, 19 nt, Homo sapiens
gccgugcuguguccuuaug

SEQ ID NO: 743345 - RNA, 19 nt, Homo sapiens
gcucccgcauaccaggaua

SEQ ID NO: 743346 - RNA, 19 nt, Homo sapiens
ccaucaccgugucuauaga

SEQ ID NO: 743347 - RNA, 19 nt, Homo sapiens
ugaacuggaggcugguuaa

SEQ ID NO: 743348 - RNA, 19 nt, Homo sapiens
ggagcaucguuuccugaag

SEQ ID NO: 743349 - RNA, 19 nt, Homo sapiens
gccaucaccgugucuauag

SEQ ID NO: 743350 - RNA, 19 nt, Homo sapiens
ggcagccaaugaagacugu

SEQ ID NO: 743351 - RNA, 19 nt, Homo sapiens
ggcgaggguuccagguuuc

SEQ ID NO: 743352 - RNA, 19 nt, Homo sapiens
ccugcuugcucacuagaga

SEQ ID NO: 743353 - RNA, 19 nt, Homo sapiens
uagagggcauggaguuugg

SEQ ID NO: 743354 - RNA, 19 nt, Homo sapiens
cauagagggcauggaguuu

SEQ ID NO: 743355 - RNA, 19 nt, Homo sapiens
acauagagggcauggaguu

SEQ ID NO: 743356 - RNA, 19 nt, Homo sapiens
gagcaagaaguggacauag

SEQ ID NO: 743357 - RNA, 19 nt, Homo sapiens
ucacuagagagauggauuc

SEQ ID NO: 743358 - RNA, 19 nt, Homo sapiens
gaacuggaggcugguuaag

SEQ ID NO: 743359 - RNA, 19 nt, Homo sapiens
gugaacuggaggcugguua

SEQ ID NO: 743360 - RNA, 19 nt, Homo sapiens
cuagacacacccacucaug

SEQ ID NO: 743361 - RNA, 19 nt, Homo sapiens
ggaccgaggaaggaaggaa

SEQ ID NO: 743362 - RNA, 19 nt, Homo sapiens
gaaguauuaaacgucauug

SEQ ID NO: 743363 - RNA, 19 nt, Homo sapiens
ugucagcccuccaguucuc

SEQ ID NO: 743364 - RNA, 19 nt, Homo sapiens
gaggguuccagguuucaga

SEQ ID NO: 743365 - RNA, 19 nt, Homo sapiens
gggccugcuugcucacuag

SEQ ID NO: 743366 - RNA, 19 nt, Homo sapiens
ccaguaguccugccugucu

SEQ ID NO: 743367 - RNA, 19 nt, Homo sapiens
agagcaagaaguggacaua

SEQ ID NO: 743368 - RNA, 19 nt, Homo sapiens
cgugucagcccuccaguuc

SEQ ID NO: 743369 - RNA, 19 nt, Homo sapiens
gcagcaggagcaucguuuc

SEQ ID NO: 743370 - RNA, 19 nt, Homo sapiens
cgaacaacaggucuucaca

SEQ ID NO: 743371 - RNA, 19 nt, Homo sapiens
agaagaaagccuaaagacu

SEQ ID NO: 743372 - RNA, 19 nt, Homo sapiens
gccaaggugcacaucaaga

SEQ ID NO: 743373 - RNA, 19 nt, Homo sapiens
gcacccgccuuuccuuccu

SEQ ID NO: 743374 - RNA, 19 nt, Homo sapiens
ugccuugugucuuguguca

SEQ ID NO: 743375 - RNA, 19 nt, Homo sapiens
uagcuguuguugcguccuu

SEQ ID NO: 743376 - RNA, 19 nt, Homo sapiens
gcacacaccuguaaucgua

SEQ ID NO: 743377 - RNA, 19 nt, Homo sapiens
gaagagcacuggacuaaga

SEQ ID NO: 743378 - RNA, 19 nt, Homo sapiens
gagcgagacuccaucuuua

SEQ ID NO: 743379 - RNA, 19 nt, Homo sapiens
gcagucagaugaugagaug

SEQ ID NO: 743380 - RNA, 19 nt, Homo sapiens
agcagaaccugguguauua

SEQ ID NO: 743381 - RNA, 19 nt, Homo sapiens
ggccauagcagaucucuuu

SEQ ID NO: 743382 - RNA, 19 nt, Homo sapiens
gcagcaagaacuauuuauu

SEQ ID NO: 743383 - RNA, 19 nt, Homo sapiens
accaguaggugcucaauaa

SEQ ID NO: 743384 - RNA, 19 nt, Homo sapiens
caagguggguggaucacuu

SEQ ID NO: 743385 - RNA, 19 nt, Homo sapiens
caauguggguggcuacuuc

SEQ ID NO: 743386 - RNA, 19 nt, Homo sapiens
cagaguaccuggcagucuu

SEQ ID NO: 743387 - RNA, 19 nt, Homo sapiens
gcagcagcaagaacuauuu

SEQ ID NO: 743388 - RNA, 19 nt, Homo sapiens
acauguaccugcagucaga

SEQ ID NO: 743389 - RNA, 19 nt, Homo sapiens
gaaaccccaucucuacuaa

SEQ ID NO: 743390 - RNA, 19 nt, Homo sapiens
cagcagcaagaacuauuua

SEQ ID NO: 743391 - RNA, 19 nt, Homo sapiens
aguaggugcucaauaaaug

SEQ ID NO: 743392 - RNA, 19 nt, Homo sapiens
gcugcuggcuggagucuca

SEQ ID NO: 743393 - RNA, 19 nt, Homo sapiens
gcgagacuccaucuuuaaa

SEQ ID NO: 743394 - RNA, 19 nt, Homo sapiens
gcaguuugccuacuauaag

SEQ ID NO: 743395 - RNA, 19 nt, Homo sapiens
ggacugugaggccaauuug

SEQ ID NO: 743396 - RNA, 19 nt, Homo sapiens
gcaggagaaucgcuugaac

SEQ ID NO: 743397 - RNA, 19 nt, Homo sapiens
cauagcagaucucuuugca

SEQ ID NO: 743398 - RNA, 19 nt, Homo sapiens
ggaguucacccacauguac

SEQ ID NO: 743399 - RNA, 19 nt, Homo sapiens
gggaggaggccaugcucua

SEQ ID NO: 743400 - RNA, 19 nt, Homo sapiens
cagcagaaccugguguauu

SEQ ID NO: 743401 - RNA, 19 nt, Homo sapiens
agagcgagacuccaucuuu

SEQ ID NO: 743402 - RNA, 19 nt, Homo sapiens
gcucaauaaauguuuguug

SEQ ID NO: 743403 - RNA, 19 nt, Homo sapiens
gaccaguaggugcucaaua

SEQ ID NO: 743404 - RNA, 19 nt, Homo sapiens
cugaagagcacuggacuaa

SEQ ID NO: 743405 - RNA, 19 nt, Homo sapiens
gcuggagucucaggccaaa

SEQ ID NO: 743406 - RNA, 19 nt, Homo sapiens
uaucugacgccgaguuuga

SEQ ID NO: 743407 - RNA, 19 nt, Homo sapiens
gggcgcaguacgagaagua

SEQ ID NO: 743408 - RNA, 19 nt, Homo sapiens
gagcugaccgccaaguauc

SEQ ID NO: 743409 - RNA, 19 nt, Homo sapiens
cgacagagcgagacuccau

SEQ ID NO: 743410 - RNA, 19 nt, Homo sapiens
agccugaacucgcaugaga

SEQ ID NO: 743411 - RNA, 19 nt, Homo sapiens
gcacuacgcgcuguucaag

SEQ ID NO: 743412 - RNA, 19 nt, Homo sapiens
ugcgggagcugcuggaguu

SEQ ID NO: 743413 - RNA, 19 nt, Homo sapiens
ggacuucaaggacuucuac

SEQ ID NO: 743414 - RNA, 19 nt, Homo sapiens
ccuacuauaaguugaauga

SEQ ID NO: 743415 - RNA, 19 nt, Homo sapiens
gaaaucccagcuacucaag

SEQ ID NO: 743416 - RNA, 19 nt, Homo sapiens
ccagcuacaugcucuucga

SEQ ID NO: 743417 - RNA, 19 nt, Homo sapiens
ggugcucaauaaauguuug

SEQ ID NO: 743418 - RNA, 19 nt, Homo sapiens
caguuugccuacuauaagu

SEQ ID NO: 743419 - RNA, 19 nt, Homo sapiens
agugcaagguggacuguga

SEQ ID NO: 743420 - RNA, 19 nt, Homo sapiens
ccaguaggugcucaauaaa

SEQ ID NO: 743421 - RNA, 19 nt, Homo sapiens
ugaaaucccagcuacucaa

SEQ ID NO: 743422 - RNA, 19 nt, Homo sapiens
guaccacuaccugcaguuu

SEQ ID NO: 743423 - RNA, 19 nt, Homo sapiens
ggauggugguggcauugca

SEQ ID NO: 743424 - RNA, 19 nt, Homo sapiens
acaggauggugguggcauu

SEQ ID NO: 743425 - RNA, 19 nt, Homo sapiens
cugagaggccgaucacuug

SEQ ID NO: 743426 - RNA, 19 nt, Homo sapiens
gcugugaagcucuacaaca

SEQ ID NO: 743427 - RNA, 19 nt, Homo sapiens
agaccugccuggccaacau

SEQ ID NO: 743428 - RNA, 19 nt, Homo sapiens
cuacgaggagggcauguau

SEQ ID NO: 743429 - RNA, 19 nt, Homo sapiens
ccacauguaccugcaguca

SEQ ID NO: 743430 - RNA, 19 nt, Homo sapiens
cgagcugaccgccaaguau

SEQ ID NO: 743431 - RNA, 19 nt, Homo sapiens
uggagucucaggccaaauu

SEQ ID NO: 743432 - RNA, 19 nt, Homo sapiens
cgccaaguaucucaacuac

SEQ ID NO: 743433 - RNA, 19 nt, Homo sapiens
caguaggugcucaauaaau

SEQ ID NO: 743434 - RNA, 19 nt, Homo sapiens
ggagucucaggccaaauug

SEQ ID NO: 743435 - RNA, 19 nt, Homo sapiens
caccuguaaucccagcauu

SEQ ID NO: 743436 - RNA, 19 nt, Homo sapiens
ggcagcagcaagaacuauu

SEQ ID NO: 743437 - RNA, 19 nt, Homo sapiens
guaggugcucaauaaaugu

SEQ ID NO: 743438 - RNA, 19 nt, Homo sapiens
gcacugagaggccgaucac

SEQ ID NO: 743439 - RNA, 19 nt, Homo sapiens
uguaaucccagcacugaga

SEQ ID NO: 743440 - RNA, 19 nt, Homo sapiens
ccuguaaucccagcacuga

SEQ ID NO: 743441 - RNA, 19 nt, Homo sapiens
caaagguugcggugaacug

SEQ ID NO: 743442 - RNA, 19 nt, Homo sapiens
aaucccagcuacucaagag

SEQ ID NO: 743443 - RNA, 19 nt, Homo sapiens
cugaggaugcccuaucuga

SEQ ID NO: 743444 - RNA, 19 nt, Homo sapiens
cauccugccacuucuaugu

SEQ ID NO: 743445 - RNA, 19 nt, Homo sapiens
ucacuugaggucaggaguu

SEQ ID NO: 743446 - RNA, 19 nt, Homo sapiens
gaccuccgucucuacuaaa

SEQ ID NO: 743447 - RNA, 19 nt, Homo sapiens
gccugaggaugcccuaucu

SEQ ID NO: 743448 - RNA, 19 nt, Homo sapiens
uggccaccauguaccacua

SEQ ID NO: 743449 - RNA, 19 nt, Homo sapiens
ugagaggccgaucacuuga

SEQ ID NO: 743450 - RNA, 19 nt, Homo sapiens
cagccuggccaacaugaug

SEQ ID NO: 743451 - RNA, 19 nt, Homo sapiens
ggaggaggccaugcucuac

SEQ ID NO: 743452 - RNA, 19 nt, Homo sapiens
ccgccaaguaucucaacua

SEQ ID NO: 743453 - RNA, 19 nt, Homo sapiens
cacuugaggucaggaguuc

SEQ ID NO: 743454 - RNA, 19 nt, Homo sapiens
gcagcagaaccugguguau

SEQ ID NO: 743455 - RNA, 19 nt, Homo sapiens
gaacucuucuguaucuaaa

SEQ ID NO: 743456 - RNA, 19 nt, Homo sapiens
caauggagcugugaucaaa

SEQ ID NO: 743457 - RNA, 19 nt, Homo sapiens
ggacugcuuugcuggauug

SEQ ID NO: 743458 - RNA, 19 nt, Homo sapiens
gcacugagcaacuuuagga

SEQ ID NO: 743459 - RNA, 19 nt, Homo sapiens
gcaccaagacuuccuucua

SEQ ID NO: 743460 - RNA, 19 nt, Homo sapiens
caaaguugauuaacacaca

SEQ ID NO: 743461 - RNA, 19 nt, Homo sapiens
caccaagacuuccuucuau

SEQ ID NO: 743462 - RNA, 19 nt, Homo sapiens
ccacaucauuugaagcauu

SEQ ID NO: 743463 - RNA, 19 nt, Homo sapiens
gccagaauauaacuuaaga

SEQ ID NO: 743464 - RNA, 19 nt, Homo sapiens
ccaaugcacugagcgcuuu

SEQ ID NO: 743465 - RNA, 19 nt, Homo sapiens
gggagggucuggcacuuga

SEQ ID NO: 743466 - RNA, 19 nt, Homo sapiens
cuagauaacugcguacaug

SEQ ID NO: 743467 - RNA, 19 nt, Homo sapiens
gaacaugauaggcuuacuu

SEQ ID NO: 743468 - RNA, 19 nt, Homo sapiens
ggacaccacaucauuugaa

SEQ ID NO: 743469 - RNA, 19 nt, Homo sapiens
ggaagucccauuagagaug

SEQ ID NO: 743470 - RNA, 19 nt, Homo sapiens
cgaggucuguucaauauag

SEQ ID NO: 743471 - RNA, 19 nt, Homo sapiens
caacaucgaugcccaugac

SEQ ID NO: 743472 - RNA, 19 nt, Homo sapiens
ggguagagaaaucauauaa

SEQ ID NO: 743473 - RNA, 19 nt, Homo sapiens
uuacuucugcuccauaaua

SEQ ID NO: 743474 - RNA, 19 nt, Homo sapiens
gcuuacuucugcuccauaa

SEQ ID NO: 743475 - RNA, 19 nt, Homo sapiens
gaugucaccagguaauaaa

SEQ ID NO: 743476 - RNA, 19 nt, Homo sapiens
gaagucccauuagagaugu

SEQ ID NO: 743477 - RNA, 19 nt, Homo sapiens
caucgaggucuguucaaua

SEQ ID NO: 743478 - RNA, 19 nt, Homo sapiens
ggucagugccuauggauuc

SEQ ID NO: 743479 - RNA, 19 nt, Homo sapiens
agacuuccuucuaugguuu

SEQ ID NO: 743480 - RNA, 19 nt, Homo sapiens
aggaugaugucaccaggua

SEQ ID NO: 743481 - RNA, 19 nt, Homo sapiens
acaagcaacuacuggaaau

SEQ ID NO: 743482 - RNA, 19 nt, Homo sapiens
gacuauguauucagacuca

SEQ ID NO: 743483 - RNA, 19 nt, Homo sapiens
gagcaacuuuaggaaaugu

SEQ ID NO: 743484 - RNA, 19 nt, Homo sapiens
agaacucccucgucuccua

SEQ ID NO: 743485 - RNA, 19 nt, Homo sapiens
ccaugacuauguauucaga

SEQ ID NO: 743486 - RNA, 19 nt, Homo sapiens
gaagcauucuuucaaucca

SEQ ID NO: 743487 - RNA, 19 nt, Homo sapiens
agaagccucugccaguaaa

SEQ ID NO: 743488 - RNA, 19 nt, Homo sapiens
gauaacugcguacaugaug

SEQ ID NO: 743489 - RNA, 19 nt, Homo sapiens
ggucaaaggcaaacacaca

SEQ ID NO: 743490 - RNA, 19 nt, Homo sapiens
gguggaguguucagcaaga

SEQ ID NO: 743491 - RNA, 19 nt, Homo sapiens
ggaaaugucgguggagugu

SEQ ID NO: 743492 - RNA, 19 nt, Homo sapiens
ccagggacaccacaucauu

SEQ ID NO: 743493 - RNA, 19 nt, Homo sapiens
aaaugucgguggaguguuc

SEQ ID NO: 743494 - RNA, 19 nt, Homo sapiens
cugagcaacuuuaggaaau

SEQ ID NO: 743495 - RNA, 19 nt, Homo sapiens
cgaccacuauuucgaacga

SEQ ID NO: 743496 - RNA, 19 nt, Homo sapiens
ccucagacauccgcgacua

SEQ ID NO: 743497 - RNA, 19 nt, Homo sapiens
agagauguaucaccaccuu

SEQ ID NO: 743498 - RNA, 19 nt, Homo sapiens
cauaauaaagugggagaaa

SEQ ID NO: 743499 - RNA, 19 nt, Homo sapiens
gauuggcacugagcaacuu

SEQ ID NO: 743500 - RNA, 19 nt, Homo sapiens
gcccugauccucucaagug

SEQ ID NO: 743501 - RNA, 19 nt, Homo sapiens
gccuauggauucaucacaa

SEQ ID NO: 743502 - RNA, 19 nt, Homo sapiens
gcccaugacuauguauuca

SEQ ID NO: 743503 - RNA, 19 nt, Homo sapiens
uacuucugcuccauaauaa

SEQ ID NO: 743504 - RNA, 19 nt, Homo sapiens
cgaugcccaugacuaugua

SEQ ID NO: 743505 - RNA, 19 nt, Homo sapiens
caucgaugcccaugacuau

SEQ ID NO: 743506 - RNA, 19 nt, Homo sapiens
gcacuggggugaauucaag

SEQ ID NO: 743507 - RNA, 19 nt, Homo sapiens
ugaacacgaugaagaacuc

SEQ ID NO: 743508 - RNA, 19 nt, Homo sapiens
gaugaugucaccagguaau

SEQ ID NO: 743509 - RNA, 19 nt, Homo sapiens
aagcaacuacuggaaauuu

SEQ ID NO: 743510 - RNA, 19 nt, Homo sapiens
ccaggucagugccuaugga

SEQ ID NO: 743511 - RNA, 19 nt, Homo sapiens
gaccugcaguauaucuuca

SEQ ID NO: 743512 - RNA, 19 nt, Homo sapiens
caugauaggcuuacuucug

SEQ ID NO: 743513 - RNA, 19 nt, Homo sapiens
cccagaugcuaaagugauu

SEQ ID NO: 743514 - RNA, 19 nt, Homo sapiens
agacagcaguccaggucaa

SEQ ID NO: 743515 - RNA, 19 nt, Homo sapiens
gaugugggcaccaagacuu

SEQ ID NO: 743516 - RNA, 19 nt, Homo sapiens
gaugucaccaacaggauga

SEQ ID NO: 743517 - RNA, 19 nt, Homo sapiens
gacaccacaucauuugaag

SEQ ID NO: 743518 - RNA, 19 nt, Homo sapiens
ggggugaauucaagauuuu

SEQ ID NO: 743519 - RNA, 19 nt, Homo sapiens
cagcuuugcauaccuguga

SEQ ID NO: 743520 - RNA, 19 nt, Homo sapiens
ggaccugcaguauaucuuc

SEQ ID NO: 743521 - RNA, 19 nt, Homo sapiens
cagggacaccacaucauuu

SEQ ID NO: 743522 - RNA, 19 nt, Homo sapiens
ggaguguucagcaagauca

SEQ ID NO: 743523 - RNA, 19 nt, Homo sapiens
cacaucauuugaagcauuc

SEQ ID NO: 743524 - RNA, 19 nt, Homo sapiens
ccuguucaaucucuccauu

SEQ ID NO: 743525 - RNA, 19 nt, Homo sapiens
ucacaagcaacuacuggaa

SEQ ID NO: 743526 - RNA, 19 nt, Homo sapiens
acaauacaucucaaucuug

SEQ ID NO: 743527 - RNA, 19 nt, Homo sapiens
gagagugccaagcuguuug

SEQ ID NO: 743528 - RNA, 19 nt, Homo sapiens
ugagcaacuuuaggaaaug

SEQ ID NO: 743529 - RNA, 19 nt, Homo sapiens
aucgaggucuguucaauau

SEQ ID NO: 743530 - RNA, 19 nt, Homo sapiens
cacaagcaacuacuggaaa

SEQ ID NO: 743531 - RNA, 19 nt, Homo sapiens
gcucagagagugccaagcu

SEQ ID NO: 743532 - RNA, 19 nt, Homo sapiens
aagacuuccuucuaugguu

SEQ ID NO: 743533 - RNA, 19 nt, Homo sapiens
uagauaacugcguacauga

SEQ ID NO: 743534 - RNA, 19 nt, Homo sapiens
gcugagaucggccauucug

SEQ ID NO: 743535 - RNA, 19 nt, Homo sapiens
uaacugcguacaugaugga

SEQ ID NO: 743536 - RNA, 19 nt, Homo sapiens
ucaauggagcugugaucaa

SEQ ID NO: 743537 - RNA, 19 nt, Homo sapiens
gguaauaaaccuucauccu

SEQ ID NO: 743538 - RNA, 19 nt, Homo sapiens
ugaugucaccagguaauaa

SEQ ID NO: 743539 - RNA, 19 nt, Homo sapiens
gcuggguagagaaaucaua

SEQ ID NO: 743540 - RNA, 19 nt, Homo sapiens
gacuccaggacaccucuua

SEQ ID NO: 743541 - RNA, 19 nt, Homo sapiens
ucaucgaggucuguucaau

SEQ ID NO: 743542 - RNA, 19 nt, Homo sapiens
gaccuauauaugccuagua

SEQ ID NO: 743543 - RNA, 19 nt, Homo sapiens
ggcaacggaggcauucuga

SEQ ID NO: 743544 - RNA, 19 nt, Homo sapiens
gcaacggaggcauucugaa

SEQ ID NO: 743545 - RNA, 19 nt, Homo sapiens
gcugcuacauccggacuuc

SEQ ID NO: 743546 - RNA, 19 nt, Homo sapiens
ccaagacuuccuucuaugg

SEQ ID NO: 743547 - RNA, 19 nt, Homo sapiens
cgaauucuuggacaggaaa

SEQ ID NO: 743548 - RNA, 19 nt, Homo sapiens
uccaaggcaucgaauucuu

SEQ ID NO: 743549 - RNA, 19 nt, Homo sapiens
caccuucccuugccaacag

SEQ ID NO: 743550 - RNA, 19 nt, Homo sapiens
acugagcgcuuugcuucuu

SEQ ID NO: 743551 - RNA, 19 nt, Homo sapiens
caagcaacuacuggaaauu

SEQ ID NO: 743552 - RNA, 19 nt, Homo sapiens
aagcauucuuucaauccaa

SEQ ID NO: 743553 - RNA, 19 nt, Homo sapiens
caccacaucauuugaagca

SEQ ID NO: 743554 - RNA, 19 nt, Homo sapiens
gaugcuaaagugauucaag

SEQ ID NO: 743555 - RNA, 19 nt, Homo sapiens
ggaaauauuuggcuucaua

SEQ ID NO: 743556 - RNA, 19 nt, Homo sapiens
gcaaagagcugagcacauu

SEQ ID NO: 743557 - RNA, 19 nt, Homo sapiens
gaaggaauuugaagagaaa

SEQ ID NO: 743558 - RNA, 19 nt, Homo sapiens
gggagaaccuaaagaagua

SEQ ID NO: 743559 - RNA, 19 nt, Homo sapiens
caacugcgcucacugcaaa

SEQ ID NO: 743560 - RNA, 19 nt, Homo sapiens
gaauaugacucugcaaaga

SEQ ID NO: 743561 - RNA, 19 nt, Homo sapiens
gcaugacacuugcuuugua

SEQ ID NO: 743562 - RNA, 19 nt, Homo sapiens
ggacugaacauuugaaaga

SEQ ID NO: 743563 - RNA, 19 nt, Homo sapiens
gaaacccugucucuacuaa

SEQ ID NO: 743564 - RNA, 19 nt, Homo sapiens
cauagaagcuggugacaug

SEQ ID NO: 743565 - RNA, 19 nt, Homo sapiens
ggaaaggacaauaagauuu

SEQ ID NO: 743566 - RNA, 19 nt, Homo sapiens
gagaagagaaggaauuuga

SEQ ID NO: 743567 - RNA, 19 nt, Homo sapiens
gaaaggagcccuguauugu

SEQ ID NO: 743568 - RNA, 19 nt, Homo sapiens
caucagaggaccauucuua

SEQ ID NO: 743569 - RNA, 19 nt, Homo sapiens
aaacagcgcuacuuacuca

SEQ ID NO: 743570 - RNA, 19 nt, Homo sapiens
ccaggcaaauguaagaaua

SEQ ID NO: 743571 - RNA, 19 nt, Homo sapiens
caaacaacauggccuacaa

SEQ ID NO: 743572 - RNA, 19 nt, Homo sapiens
ggacaaacccagccaagug

SEQ ID NO: 743573 - RNA, 19 nt, Homo sapiens
caucuggacugcaugcuaa

SEQ ID NO: 743574 - RNA, 19 nt, Homo sapiens
caacauggccuacaauaag

SEQ ID NO: 743575 - RNA, 19 nt, Homo sapiens
caacucagcuuugggacaa

SEQ ID NO: 743576 - RNA, 19 nt, Homo sapiens
uguacaggcucuuugaaua

SEQ ID NO: 743577 - RNA, 19 nt, Homo sapiens
gaagauccuuggagaaguc

SEQ ID NO: 743578 - RNA, 19 nt, Homo sapiens
gcaagaagagacugauuga

SEQ ID NO: 743579 - RNA, 19 nt, Homo sapiens
ccaauuuccugauggacua

SEQ ID NO: 743580 - RNA, 19 nt, Homo sapiens
gagaaggaauuugaagaga

SEQ ID NO: 743581 - RNA, 19 nt, Homo sapiens
ggagaaaggagcccuguau

SEQ ID NO: 743582 - RNA, 19 nt, Homo sapiens
cagcauugauggaauaaau

SEQ ID NO: 743583 - RNA, 19 nt, Homo sapiens
caacaugccucugacaauc

SEQ ID NO: 743584 - RNA, 19 nt, Homo sapiens
gaaccuaaagaaguaguua

SEQ ID NO: 743585 - RNA, 19 nt, Homo sapiens
gaugugaauuucccauaga

SEQ ID NO: 743586 - RNA, 19 nt, Homo sapiens
guaagaaacaugcucauuc

SEQ ID NO: 743587 - RNA, 19 nt, Homo sapiens
gcagugagccaagaucgua

SEQ ID NO: 743588 - RNA, 19 nt, Homo sapiens
cugacaaucucuagucuaa

SEQ ID NO: 743589 - RNA, 19 nt, Homo sapiens
aaccaagucugaggaaaua

SEQ ID NO: 743590 - RNA, 19 nt, Homo sapiens
acugugagacugauuauua

SEQ ID NO: 743591 - RNA, 19 nt, Homo sapiens
ggagcgcuauacagaguuu

SEQ ID NO: 743592 - RNA, 19 nt, Homo sapiens
uggaauaaaugcacaagga

SEQ ID NO: 743593 - RNA, 19 nt, Homo sapiens
gaggaaauauuuggcuuca

SEQ ID NO: 743594 - RNA, 19 nt, Homo sapiens
gaaagcccauucggaacaa

SEQ ID NO: 743595 - RNA, 19 nt, Homo sapiens
ucacugggacugaacauuu

SEQ ID NO: 743596 - RNA, 19 nt, Homo sapiens
guacaggcucuuugaauau

SEQ ID NO: 743597 - RNA, 19 nt, Homo sapiens
gcacgagaaucacuugaac

SEQ ID NO: 743598 - RNA, 19 nt, Homo sapiens
cacaugaggucaggaguuu

SEQ ID NO: 743599 - RNA, 19 nt, Homo sapiens
agaaggaauuugaagagaa

SEQ ID NO: 743600 - RNA, 19 nt, Homo sapiens
guuagguaguuaugaguaa

SEQ ID NO: 743601 - RNA, 19 nt, Homo sapiens
ggaugugaauuucccauag

SEQ ID NO: 743602 - RNA, 19 nt, Homo sapiens
ucucagcauugauggaaua

SEQ ID NO: 743603 - RNA, 19 nt, Homo sapiens
ggugaacccuacugugaga

SEQ ID NO: 743604 - RNA, 19 nt, Homo sapiens
aaggagcccuguauuguga

SEQ ID NO: 743605 - RNA, 19 nt, Homo sapiens
gacccgagcauauuucauu

SEQ ID NO: 743606 - RNA, 19 nt, Homo sapiens
ggaauaaaugcacaaggaa

SEQ ID NO: 743607 - RNA, 19 nt, Homo sapiens
gacaaucucuagucuaaaa

SEQ ID NO: 743608 - RNA, 19 nt, Homo sapiens
ggaaagcccauucggaaca

SEQ ID NO: 743609 - RNA, 19 nt, Homo sapiens
ggacuuugagccauuagaa

SEQ ID NO: 743610 - RNA, 19 nt, Homo sapiens
gaagacuggcguccaagaa

SEQ ID NO: 743611 - RNA, 19 nt, Homo sapiens
gagaaaggagcccuguauu

SEQ ID NO: 743612 - RNA, 19 nt, Homo sapiens
caaaauggcccaccaagaa

SEQ ID NO: 743613 - RNA, 19 nt, Homo sapiens
ccugauggacuauuaaauu

SEQ ID NO: 743614 - RNA, 19 nt, Homo sapiens
uaguggcccugaaggaaua

SEQ ID NO: 743615 - RNA, 19 nt, Homo sapiens
ucucaaacagcgcuacuua

SEQ ID NO: 743616 - RNA, 19 nt, Homo sapiens
gaauaaaugcacaaggaau

SEQ ID NO: 743617 - RNA, 19 nt, Homo sapiens
gaagagaaggaauuugaag

SEQ ID NO: 743618 - RNA, 19 nt, Homo sapiens
gcgaccaccucaucacaug

SEQ ID NO: 743619 - RNA, 19 nt, Homo sapiens
gccaguaagagauguuaua

SEQ ID NO: 743620 - RNA, 19 nt, Homo sapiens
gagacgguuuggcauuuau

SEQ ID NO: 743621 - RNA, 19 nt, Homo sapiens
gacaaacccagccaaguga

SEQ ID NO: 743622 - RNA, 19 nt, Homo sapiens
aaagggagaaccuaaagaa

SEQ ID NO: 743623 - RNA, 19 nt, Homo sapiens
gaaaccccaucucuacuaa

SEQ ID NO: 743624 - RNA, 19 nt, Homo sapiens
ggucaggaguuugagauca

SEQ ID NO: 743625 - RNA, 19 nt, Homo sapiens
uaaaguaaagagacgguuu

SEQ ID NO: 743626 - RNA, 19 nt, Homo sapiens
caugacacuugcuuuguau

SEQ ID NO: 743627 - RNA, 19 nt, Homo sapiens
gguacuauaugccauggau

SEQ ID NO: 743628 - RNA, 19 nt, Homo sapiens
ggaagauccuuggagaagu

SEQ ID NO: 743629 - RNA, 19 nt, Homo sapiens
caaagaaggcaaauaacuc

SEQ ID NO: 743630 - RNA, 19 nt, Homo sapiens
agagacgguuuggcauuua

SEQ ID NO: 743631 - RNA, 19 nt, Homo sapiens
agaaaggagcccuguauug

SEQ ID NO: 743632 - RNA, 19 nt, Homo sapiens
gacugaacauuugaaagaa

SEQ ID NO: 743633 - RNA, 19 nt, Homo sapiens
gcaaggcagcccaggcaaa

SEQ ID NO: 743634 - RNA, 19 nt, Homo sapiens
aagagacgguuuggcauuu

SEQ ID NO: 743635 - RNA, 19 nt, Homo sapiens
caagucugaggaaauauuu

SEQ ID NO: 743636 - RNA, 19 nt, Homo sapiens
gagcugugcuaugagaaau

SEQ ID NO: 743637 - RNA, 19 nt, Homo sapiens
caacucagucucgcucuuu

SEQ ID NO: 743638 - RNA, 19 nt, Homo sapiens
aagaauaggcgaugugguu

SEQ ID NO: 743639 - RNA, 19 nt, Homo sapiens
cuucuuuccuuguuaggua

SEQ ID NO: 743640 - RNA, 19 nt, Homo sapiens
cugauggacuauuaaauuc

SEQ ID NO: 743641 - RNA, 19 nt, Homo sapiens
gaauguggucgaugccaaa

SEQ ID NO: 743642 - RNA, 19 nt, Homo sapiens
ccacuggcgucaucaaguc

SEQ ID NO: 743643 - RNA, 19 nt, Homo sapiens
gaagcccagaauaagauua

SEQ ID NO: 743644 - RNA, 19 nt, Homo sapiens
ggugaaacccugucucuac

SEQ ID NO: 743645 - RNA, 19 nt, Homo sapiens
aaaccaauuuccugaugga

SEQ ID NO: 743646 - RNA, 19 nt, Homo sapiens
gcagggcgguaaggauuuc

SEQ ID NO: 743647 - RNA, 19 nt, Homo sapiens
ugauuauuaugcccucuuu

SEQ ID NO: 743648 - RNA, 19 nt, Homo sapiens
guuaaaccugugcccauua

SEQ ID NO: 743649 - RNA, 19 nt, Homo sapiens
gacgguuuggcauuuauua

SEQ ID NO: 743650 - RNA, 19 nt, Homo sapiens
uuagaaccaugagcaacua

SEQ ID NO: 743651 - RNA, 19 nt, Homo sapiens
cgguaaggauuucaacaug

SEQ ID NO: 743652 - RNA, 19 nt, Homo sapiens
gcugugcuaugagaaauuc

SEQ ID NO: 743653 - RNA, 19 nt, Homo sapiens
ggaaacgaacuccgaugug

SEQ ID NO: 743654 - RNA, 19 nt, Homo sapiens
gcacugagcgcugguaaaa

SEQ ID NO: 743655 - RNA, 19 nt, Homo sapiens
ggacaccaauggagacaua

SEQ ID NO: 743656 - RNA, 19 nt, Homo sapiens
gcaagacgauggaguuuua

SEQ ID NO: 743657 - RNA, 19 nt, Homo sapiens
gaaaggacaacccaauuga

SEQ ID NO: 743658 - RNA, 19 nt, Homo sapiens
ccacaagaauggcacauau

SEQ ID NO: 743659 - RNA, 19 nt, Homo sapiens
caacacaucugcagaacca

SEQ ID NO: 743660 - RNA, 19 nt, Homo sapiens
gcacauaugagcuagugua

SEQ ID NO: 743661 - RNA, 19 nt, Homo sapiens
gagcucgucuuccguguug

SEQ ID NO: 743662 - RNA, 19 nt, Homo sapiens
ggacuuccauaaccauuca

SEQ ID NO: 743663 - RNA, 19 nt, Homo sapiens
gagagcggcuggcugcauu

SEQ ID NO: 743664 - RNA, 19 nt, Homo sapiens
caagaaugaaguuguagua

SEQ ID NO: 743665 - RNA, 19 nt, Homo sapiens
gaaugaaguuguaguaacg

SEQ ID NO: 743666 - RNA, 19 nt, Homo sapiens
gagcgccacugcacacgaa

SEQ ID NO: 743667 - RNA, 19 nt, Homo sapiens
gcuccuuccuguccuauau

SEQ ID NO: 743668 - RNA, 19 nt, Homo sapiens
gcccagagguccagccaau

SEQ ID NO: 743669 - RNA, 19 nt, Homo sapiens
gaauggcacauaugagcua

SEQ ID NO: 743670 - RNA, 19 nt, Homo sapiens
gcaaugggcaguucaaugc

SEQ ID NO: 743671 - RNA, 19 nt, Homo sapiens
cgaaaggacaacccaauug

SEQ ID NO: 743672 - RNA, 19 nt, Homo sapiens
gcccagagccugacgcuau

SEQ ID NO: 743673 - RNA, 19 nt, Homo sapiens
gaacacaucggcaguagcu

SEQ ID NO: 743674 - RNA, 19 nt, Homo sapiens
ggcaaccacugcuuuaaag

SEQ ID NO: 743675 - RNA, 19 nt, Homo sapiens
caacagccgcauccaggua

SEQ ID NO: 743676 - RNA, 19 nt, Homo sapiens
gaguuccucuucaaguuug

SEQ ID NO: 743677 - RNA, 19 nt, Homo sapiens
gaagggagaaaggugaauu

SEQ ID NO: 743678 - RNA, 19 nt, Homo sapiens
gcacaggcggcaaacgaaa

SEQ ID NO: 743679 - RNA, 19 nt, Homo sapiens
uaacggacuuccauaacca

SEQ ID NO: 743680 - RNA, 19 nt, Homo sapiens
guacagcacaggcggcaaa

SEQ ID NO: 743681 - RNA, 19 nt, Homo sapiens
acaagaauggcacauauga

SEQ ID NO: 743682 - RNA, 19 nt, Homo sapiens
cauaugagcuaguguacac

SEQ ID NO: 743683 - RNA, 19 nt, Homo sapiens
gacgcuauccuguccagua

SEQ ID NO: 743684 - RNA, 19 nt, Homo sapiens
ggacaacccaauugaggau

SEQ ID NO: 743685 - RNA, 19 nt, Homo sapiens
gcuggcaaccacugcuuua

SEQ ID NO: 743686 - RNA, 19 nt, Homo sapiens
ccaagggaguggccguaga

SEQ ID NO: 743687 - RNA, 19 nt, Homo sapiens
gcaacaaccaguguauuca

SEQ ID NO: 743688 - RNA, 19 nt, Homo sapiens
gcuguaagcaacaagaaug

SEQ ID NO: 743689 - RNA, 19 nt, Homo sapiens
ggcgaucggugcucaaucu

SEQ ID NO: 743690 - RNA, 19 nt, Homo sapiens
ccauaaccauucagagaag

SEQ ID NO: 743691 - RNA, 19 nt, Homo sapiens
guaguaacggacuuccaua

SEQ ID NO: 743692 - RNA, 19 nt, Homo sapiens
ucucggcacugcagaacaa

SEQ ID NO: 743693 - RNA, 19 nt, Homo sapiens
agaaugaaguuguaguaac

SEQ ID NO: 743694 - RNA, 19 nt, Homo sapiens
ccaaugagggccaguucaa

SEQ ID NO: 743695 - RNA, 19 nt, Homo sapiens
uaucaacacaucugcagaa

SEQ ID NO: 743696 - RNA, 19 nt, Homo sapiens
gaugugaagcgccguguca

SEQ ID NO: 743697 - RNA, 19 nt, Homo sapiens
guaacggacuuccauaacc

SEQ ID NO: 743698 - RNA, 19 nt, Homo sapiens
gaccucggauggccaugug

SEQ ID NO: 743699 - RNA, 19 nt, Homo sapiens
acaacccaauugaggauga

SEQ ID NO: 743700 - RNA, 19 nt, Homo sapiens
gguguacagugccgaugga

SEQ ID NO: 743701 - RNA, 19 nt, Homo sapiens
ccgcagcaauugccuuagu

SEQ ID NO: 743702 - RNA, 19 nt, Homo sapiens
caaguucaagaccaagauu

SEQ ID NO: 743703 - RNA, 19 nt, Homo sapiens
acauaauuguggcagacua

SEQ ID NO: 743704 - RNA, 19 nt, Homo sapiens
caccaauggagacauaauu

SEQ ID NO: 743705 - RNA, 19 nt, Homo sapiens
gcagccaugugcgccagaa

SEQ ID NO: 743706 - RNA, 19 nt, Homo sapiens
uguccuauaucaacacauc

SEQ ID NO: 743707 - RNA, 19 nt, Homo sapiens
uaguaacggacuuccauaa

SEQ ID NO: 743708 - RNA, 19 nt, Homo sapiens
gaccggaauggacauauca

SEQ ID NO: 743709 - RNA, 19 nt, Homo sapiens
gcuauccuguccaguaugc

SEQ ID NO: 743710 - RNA, 19 nt, Homo sapiens
gcaaguucaagaccaagau

SEQ ID NO: 743711 - RNA, 19 nt, Homo sapiens
uggcaaccacugcuuuaaa

SEQ ID NO: 743712 - RNA, 19 nt, Homo sapiens
guaagcaacaagaaugaag

SEQ ID NO: 743713 - RNA, 19 nt, Homo sapiens
cagcacaggcggcaaacga

SEQ ID NO: 743714 - RNA, 19 nt, Homo sapiens
ucagcgaccuggagaccau

SEQ ID NO: 743715 - RNA, 19 nt, Homo sapiens
cgauggaguuuuacuguga

SEQ ID NO: 743716 - RNA, 19 nt, Homo sapiens
guccgcagcaauugccuua

SEQ ID NO: 743717 - RNA, 19 nt, Homo sapiens
ggcaaugggcaguucaaug

SEQ ID NO: 743718 - RNA, 19 nt, Homo sapiens
gacagcaacaaccagugua

SEQ ID NO: 743719 - RNA, 19 nt, Homo sapiens
uaauuguggcagacuauga

SEQ ID NO: 743720 - RNA, 19 nt, Homo sapiens
acgcuauccuguccaguau

SEQ ID NO: 743721 - RNA, 19 nt, Homo sapiens
ccagagguccagccaaugg

SEQ ID NO: 743722 - RNA, 19 nt, Homo sapiens
ggagcggccacaugagaau

SEQ ID NO: 743723 - RNA, 19 nt, Homo sapiens
cgagggcaaugggcaguuc

SEQ ID NO: 743724 - RNA, 19 nt, Homo sapiens
agaccggaauggacauauc

SEQ ID NO: 743725 - RNA, 19 nt, Homo sapiens
uggcacauaugagcuagug

SEQ ID NO: 743726 - RNA, 19 nt, Homo sapiens
ccacugaccgccacuuugc

SEQ ID NO: 743727 - RNA, 19 nt, Homo sapiens
guagaccggaauggacaua

SEQ ID NO: 743728 - RNA, 19 nt, Homo sapiens
cauaauuguggcagacuau

SEQ ID NO: 743729 - RNA, 19 nt, Homo sapiens
caacaaccaguguauucag

SEQ ID NO: 743730 - RNA, 19 nt, Homo sapiens
ggccacugaccgccacuuu

SEQ ID NO: 743731 - RNA, 19 nt, Homo sapiens
cagcaacaaccaguguauu

SEQ ID NO: 743732 - RNA, 19 nt, Homo sapiens
caggaacacaucggcagua

SEQ ID NO: 743733 - RNA, 19 nt, Homo sapiens
acgaaaggacaacccaauu

SEQ ID NO: 743734 - RNA, 19 nt, Homo sapiens
cugcagaaccacuguaugg

SEQ ID NO: 743735 - RNA, 19 nt, Homo sapiens
cagugccgauggagaguuc

SEQ ID NO: 743736 - RNA, 19 nt, Homo sapiens
uccauaaccauucagagaa

SEQ ID NO: 743737 - RNA, 19 nt, Homo sapiens
guauucagguuuucuccaa

SEQ ID NO: 743738 - RNA, 19 nt, Homo sapiens
gugaagcgccgugucaagu

SEQ ID NO: 743739 - RNA, 19 nt, Homo sapiens
uaagcaacaagaaugaagu

SEQ ID NO: 743740 - RNA, 19 nt, Homo sapiens
cacaagaauggcacauaug

SEQ ID NO: 743741 - RNA, 19 nt, Homo sapiens
ggacaccaauggagacaua

SEQ ID NO: 743742 - RNA, 19 nt, Homo sapiens
gcaagacgauggaguuuua

SEQ ID NO: 743743 - RNA, 19 nt, Homo sapiens
gaaaggacaacccaauuga

SEQ ID NO: 743744 - RNA, 19 nt, Homo sapiens
ccacaagaauggcacauau

SEQ ID NO: 743745 - RNA, 19 nt, Homo sapiens
caacacaucugcagaacca

SEQ ID NO: 743746 - RNA, 19 nt, Homo sapiens
gcacauaugagcuagugua

SEQ ID NO: 743747 - RNA, 19 nt, Homo sapiens
gagcucgucuuccguguug

SEQ ID NO: 743748 - RNA, 19 nt, Homo sapiens
ggacuuccauaaccauuca

SEQ ID NO: 743749 - RNA, 19 nt, Homo sapiens
gagagcggcuggcugcauu

SEQ ID NO: 743750 - RNA, 19 nt, Homo sapiens
caagaaugaaguuguagua

SEQ ID NO: 743751 - RNA, 19 nt, Homo sapiens
gaaugaaguuguaguaacg

SEQ ID NO: 743752 - RNA, 19 nt, Homo sapiens
gagcgccacugcacacgaa

SEQ ID NO: 743753 - RNA, 19 nt, Homo sapiens
gcuccuuccuguccuauau

SEQ ID NO: 743754 - RNA, 19 nt, Homo sapiens
gcccagagguccagccaau

SEQ ID NO: 743755 - RNA, 19 nt, Homo sapiens
gaauggcacauaugagcua

SEQ ID NO: 743756 - RNA, 19 nt, Homo sapiens
gcaaugggcaguucaaugc

SEQ ID NO: 743757 - RNA, 19 nt, Homo sapiens
cgaaaggacaacccaauug

SEQ ID NO: 743758 - RNA, 19 nt, Homo sapiens
gcccagagccugacgcuau

SEQ ID NO: 743759 - RNA, 19 nt, Homo sapiens
gaacacaucggcaguagcu

SEQ ID NO: 743760 - RNA, 19 nt, Homo sapiens
ggcaaccacugcuuuaaag

SEQ ID NO: 743761 - RNA, 19 nt, Homo sapiens
caacagccgcauccaggua

SEQ ID NO: 743762 - RNA, 19 nt, Homo sapiens
gaguuccucuucaaguuug

SEQ ID NO: 743763 - RNA, 19 nt, Homo sapiens
gaagggagaaaggugaauu

SEQ ID NO: 743764 - RNA, 19 nt, Homo sapiens
gcacaggcggcaaacgaaa

SEQ ID NO: 743765 - RNA, 19 nt, Homo sapiens
uaacggacuuccauaacca

SEQ ID NO: 743766 - RNA, 19 nt, Homo sapiens
guacagcacaggcggcaaa

SEQ ID NO: 743767 - RNA, 19 nt, Homo sapiens
acaagaauggcacauauga

SEQ ID NO: 743768 - RNA, 19 nt, Homo sapiens
cauaugagcuaguguacac

SEQ ID NO: 743769 - RNA, 19 nt, Homo sapiens
gacgcuauccuguccagua

SEQ ID NO: 743770 - RNA, 19 nt, Homo sapiens
ggacaacccaauugaggau

SEQ ID NO: 743771 - RNA, 19 nt, Homo sapiens
gcuggcaaccacugcuuua

SEQ ID NO: 743772 - RNA, 19 nt, Homo sapiens
ccaagggaguggccguaga

SEQ ID NO: 743773 - RNA, 19 nt, Homo sapiens
gcaacaaccaguguauuca

SEQ ID NO: 743774 - RNA, 19 nt, Homo sapiens
gcuguaagcaacaagaaug

SEQ ID NO: 743775 - RNA, 19 nt, Homo sapiens
ggcgaucggugcucaaucu

SEQ ID NO: 743776 - RNA, 19 nt, Homo sapiens
ccauaaccauucagagaag

SEQ ID NO: 743777 - RNA, 19 nt, Homo sapiens
guaguaacggacuuccaua

SEQ ID NO: 743778 - RNA, 19 nt, Homo sapiens
ucucggcacugcagaacaa

SEQ ID NO: 743779 - RNA, 19 nt, Homo sapiens
agaaugaaguuguaguaac

SEQ ID NO: 743780 - RNA, 19 nt, Homo sapiens
ccaaugagggccaguucaa

SEQ ID NO: 743781 - RNA, 19 nt, Homo sapiens
uaucaacacaucugcagaa

SEQ ID NO: 743782 - RNA, 19 nt, Homo sapiens
gaugugaagcgccguguca

SEQ ID NO: 743783 - RNA, 19 nt, Homo sapiens
guaacggacuuccauaacc

SEQ ID NO: 743784 - RNA, 19 nt, Homo sapiens
gaccucggauggccaugug

SEQ ID NO: 743785 - RNA, 19 nt, Homo sapiens
acaacccaauugaggauga

SEQ ID NO: 743786 - RNA, 19 nt, Homo sapiens
gguguacagugccgaugga

SEQ ID NO: 743787 - RNA, 19 nt, Homo sapiens
ccgcagcaauugccuuagu

SEQ ID NO: 743788 - RNA, 19 nt, Homo sapiens
caaguucaagaccaagauu

SEQ ID NO: 743789 - RNA, 19 nt, Homo sapiens
acauaauuguggcagacua

SEQ ID NO: 743790 - RNA, 19 nt, Homo sapiens
caccaauggagacauaauu

SEQ ID NO: 743791 - RNA, 19 nt, Homo sapiens
gcagccaugugcgccagaa

SEQ ID NO: 743792 - RNA, 19 nt, Homo sapiens
uguccuauaucaacacauc

SEQ ID NO: 743793 - RNA, 19 nt, Homo sapiens
uaguaacggacuuccauaa

SEQ ID NO: 743794 - RNA, 19 nt, Homo sapiens
gaccggaauggacauauca

SEQ ID NO: 743795 - RNA, 19 nt, Homo sapiens
gcuauccuguccaguaugc

SEQ ID NO: 743796 - RNA, 19 nt, Homo sapiens
gcaaguucaagaccaagau

SEQ ID NO: 743797 - RNA, 19 nt, Homo sapiens
uggcaaccacugcuuuaaa

SEQ ID NO: 743798 - RNA, 19 nt, Homo sapiens
guaagcaacaagaaugaag

SEQ ID NO: 743799 - RNA, 19 nt, Homo sapiens
cagcacaggcggcaaacga

SEQ ID NO: 743800 - RNA, 19 nt, Homo sapiens
ucagcgaccuggagaccau

SEQ ID NO: 743801 - RNA, 19 nt, Homo sapiens
cgauggaguuuuacuguga

SEQ ID NO: 743802 - RNA, 19 nt, Homo sapiens
guccgcagcaauugccuua

SEQ ID NO: 743803 - RNA, 19 nt, Homo sapiens
ggcaaugggcaguucaaug

SEQ ID NO: 743804 - RNA, 19 nt, Homo sapiens
gacagcaacaaccagugua

SEQ ID NO: 743805 - RNA, 19 nt, Homo sapiens
uaauuguggcagacuauga

SEQ ID NO: 743806 - RNA, 19 nt, Homo sapiens
acgcuauccuguccaguau

SEQ ID NO: 743807 - RNA, 19 nt, Homo sapiens
ccagagguccagccaaugg

SEQ ID NO: 743808 - RNA, 19 nt, Homo sapiens
ggagcggccacaugagaau

SEQ ID NO: 743809 - RNA, 19 nt, Homo sapiens
cgagggcaaugggcaguuc

SEQ ID NO: 743810 - RNA, 19 nt, Homo sapiens
agaccggaauggacauauc

SEQ ID NO: 743811 - RNA, 19 nt, Homo sapiens
uggcacauaugagcuagug

SEQ ID NO: 743812 - RNA, 19 nt, Homo sapiens
ccacugaccgccacuuugc

SEQ ID NO: 743813 - RNA, 19 nt, Homo sapiens
guagaccggaauggacaua

SEQ ID NO: 743814 - RNA, 19 nt, Homo sapiens
cauaauuguggcagacuau

SEQ ID NO: 743815 - RNA, 19 nt, Homo sapiens
caacaaccaguguauucag

SEQ ID NO: 743816 - RNA, 19 nt, Homo sapiens
ggccacugaccgccacuuu

SEQ ID NO: 743817 - RNA, 19 nt, Homo sapiens
cagcaacaaccaguguauu

SEQ ID NO: 743818 - RNA, 19 nt, Homo sapiens
caggaacacaucggcagua

SEQ ID NO: 743819 - RNA, 19 nt, Homo sapiens
acgaaaggacaacccaauu

SEQ ID NO: 743820 - RNA, 19 nt, Homo sapiens
cugcagaaccacuguaugg

SEQ ID NO: 743821 - RNA, 19 nt, Homo sapiens
cagugccgauggagaguuc

SEQ ID NO: 743822 - RNA, 19 nt, Homo sapiens
uccauaaccauucagagaa

SEQ ID NO: 743823 - RNA, 19 nt, Homo sapiens
guauucagguuuucuccaa

SEQ ID NO: 743824 - RNA, 19 nt, Homo sapiens
gugaagcgccgugucaagu

SEQ ID NO: 743825 - RNA, 19 nt, Homo sapiens
uaagcaacaagaaugaagu

SEQ ID NO: 743826 - RNA, 19 nt, Homo sapiens
cacaagaauggcacauaug

SEQ ID NO: 743827 - RNA, 19 nt, Homo sapiens
ggacaccaauggagacaua

SEQ ID NO: 743828 - RNA, 19 nt, Homo sapiens
gcaagacgauggaguuuua

SEQ ID NO: 743829 - RNA, 19 nt, Homo sapiens
gaaaggacaacccaauuga

SEQ ID NO: 743830 - RNA, 19 nt, Homo sapiens
ccacaagaauggcacauau

SEQ ID NO: 743831 - RNA, 19 nt, Homo sapiens
caacacaucugcagaacca

SEQ ID NO: 743832 - RNA, 19 nt, Homo sapiens
gcacauaugagcuagugua

SEQ ID NO: 743833 - RNA, 19 nt, Homo sapiens
gagcucgucuuccguguug

SEQ ID NO: 743834 - RNA, 19 nt, Homo sapiens
ggacuuccauaaccauuca

SEQ ID NO: 743835 - RNA, 19 nt, Homo sapiens
caagaaugaaguuguagua

SEQ ID NO: 743836 - RNA, 19 nt, Homo sapiens
gaaugaaguuguaguaacg

SEQ ID NO: 743837 - RNA, 19 nt, Homo sapiens
gagcgccacugcacacgaa

SEQ ID NO: 743838 - RNA, 19 nt, Homo sapiens
gcuccuuccuguccuauau

SEQ ID NO: 743839 - RNA, 19 nt, Homo sapiens
gcccagagguccagccaau

SEQ ID NO: 743840 - RNA, 19 nt, Homo sapiens
gaauggcacauaugagcua

SEQ ID NO: 743841 - RNA, 19 nt, Homo sapiens
gcaaugggcaguucaaugc

SEQ ID NO: 743842 - RNA, 19 nt, Homo sapiens
cgaaaggacaacccaauug

SEQ ID NO: 743843 - RNA, 19 nt, Homo sapiens
gcccagagccugacgcuau

SEQ ID NO: 743844 - RNA, 19 nt, Homo sapiens
ggcaaccacugcuuuaaag

SEQ ID NO: 743845 - RNA, 19 nt, Homo sapiens
caacagccgcauccaggua

SEQ ID NO: 743846 - RNA, 19 nt, Homo sapiens
gaguuccucuucaaguuug

SEQ ID NO: 743847 - RNA, 19 nt, Homo sapiens
gaagggagaaaggugaauu

SEQ ID NO: 743848 - RNA, 19 nt, Homo sapiens
gcacaggcggcaaacgaaa

SEQ ID NO: 743849 - RNA, 19 nt, Homo sapiens
uaacggacuuccauaacca

SEQ ID NO: 743850 - RNA, 19 nt, Homo sapiens
guacagcacaggcggcaaa

SEQ ID NO: 743851 - RNA, 19 nt, Homo sapiens
acaagaauggcacauauga

SEQ ID NO: 743852 - RNA, 19 nt, Homo sapiens
cauaugagcuaguguacac

SEQ ID NO: 743853 - RNA, 19 nt, Homo sapiens
gacgcuauccuguccagua

SEQ ID NO: 743854 - RNA, 19 nt, Homo sapiens
ggacaacccaauugaggau

SEQ ID NO: 743855 - RNA, 19 nt, Homo sapiens
gcuggcaaccacugcuuua

SEQ ID NO: 743856 - RNA, 19 nt, Homo sapiens
ccaagggaguggccguaga

SEQ ID NO: 743857 - RNA, 19 nt, Homo sapiens
gcaacaaccaguguauuca

SEQ ID NO: 743858 - RNA, 19 nt, Homo sapiens
gcuguaagcaacaagaaug

SEQ ID NO: 743859 - RNA, 19 nt, Homo sapiens
ggcgaucggugcucaaucu

SEQ ID NO: 743860 - RNA, 19 nt, Homo sapiens
ccauaaccauucagagaag

SEQ ID NO: 743861 - RNA, 19 nt, Homo sapiens
guaguaacggacuuccaua

SEQ ID NO: 743862 - RNA, 19 nt, Homo sapiens
ucucggcacugcagaacaa

SEQ ID NO: 743863 - RNA, 19 nt, Homo sapiens
agaaugaaguuguaguaac

SEQ ID NO: 743864 - RNA, 19 nt, Homo sapiens
ccaaugagggccaguucaa

SEQ ID NO: 743865 - RNA, 19 nt, Homo sapiens
uaucaacacaucugcagaa

SEQ ID NO: 743866 - RNA, 19 nt, Homo sapiens
gaugugaagcgccguguca

SEQ ID NO: 743867 - RNA, 19 nt, Homo sapiens
guaacggacuuccauaacc

SEQ ID NO: 743868 - RNA, 19 nt, Homo sapiens
gaccucggauggccaugug

SEQ ID NO: 743869 - RNA, 19 nt, Homo sapiens
acaacccaauugaggauga

SEQ ID NO: 743870 - RNA, 19 nt, Homo sapiens
gguguacagugccgaugga

SEQ ID NO: 743871 - RNA, 19 nt, Homo sapiens
ccgcagcaauugccuuagu

SEQ ID NO: 743872 - RNA, 19 nt, Homo sapiens
caaguucaagaccaagauu

SEQ ID NO: 743873 - RNA, 19 nt, Homo sapiens
acauaauuguggcagacua

SEQ ID NO: 743874 - RNA, 19 nt, Homo sapiens
caccaauggagacauaauu

SEQ ID NO: 743875 - RNA, 19 nt, Homo sapiens
gcagccaugugcgccagaa

SEQ ID NO: 743876 - RNA, 19 nt, Homo sapiens
uguccuauaucaacacauc

SEQ ID NO: 743877 - RNA, 19 nt, Homo sapiens
uaguaacggacuuccauaa

SEQ ID NO: 743878 - RNA, 19 nt, Homo sapiens
gcuauccuguccaguaugc

SEQ ID NO: 743879 - RNA, 19 nt, Homo sapiens
gaccggaauggacauauca

SEQ ID NO: 743880 - RNA, 19 nt, Homo sapiens
gcaaguucaagaccaagau

SEQ ID NO: 743881 - RNA, 19 nt, Homo sapiens
uggcaaccacugcuuuaaa

SEQ ID NO: 743882 - RNA, 19 nt, Homo sapiens
guaagcaacaagaaugaag

SEQ ID NO: 743883 - RNA, 19 nt, Homo sapiens
cagcacaggcggcaaacga

SEQ ID NO: 743884 - RNA, 19 nt, Homo sapiens
guccgcagcaauugccuua

SEQ ID NO: 743885 - RNA, 19 nt, Homo sapiens
cgauggaguuuuacuguga

SEQ ID NO: 743886 - RNA, 19 nt, Homo sapiens
ggcaaugggcaguucaaug

SEQ ID NO: 743887 - RNA, 19 nt, Homo sapiens
gacagcaacaaccagugua

SEQ ID NO: 743888 - RNA, 19 nt, Homo sapiens
acgcuauccuguccaguau

SEQ ID NO: 743889 - RNA, 19 nt, Homo sapiens
uaauuguggcagacuauga

SEQ ID NO: 743890 - RNA, 19 nt, Homo sapiens
ccagagguccagccaaugg

SEQ ID NO: 743891 - RNA, 19 nt, Homo sapiens
cgagggcaaugggcaguuc

SEQ ID NO: 743892 - RNA, 19 nt, Homo sapiens
agaccggaauggacauauc

SEQ ID NO: 743893 - RNA, 19 nt, Homo sapiens
uggcacauaugagcuagug

SEQ ID NO: 743894 - RNA, 19 nt, Homo sapiens
ccacugaccgccacuuugc

SEQ ID NO: 743895 - RNA, 19 nt, Homo sapiens
guagaccggaauggacaua

SEQ ID NO: 743896 - RNA, 19 nt, Homo sapiens
cauaauuguggcagacuau

SEQ ID NO: 743897 - RNA, 19 nt, Homo sapiens
caacaaccaguguauucag

SEQ ID NO: 743898 - RNA, 19 nt, Homo sapiens
ggccacugaccgccacuuu

SEQ ID NO: 743899 - RNA, 19 nt, Homo sapiens
cagcaacaaccaguguauu

SEQ ID NO: 743900 - RNA, 19 nt, Homo sapiens
acgaaaggacaacccaauu

SEQ ID NO: 743901 - RNA, 19 nt, Homo sapiens
cugcagaaccacuguaugg

SEQ ID NO: 743902 - RNA, 19 nt, Homo sapiens
cagugccgauggagaguuc

SEQ ID NO: 743903 - RNA, 19 nt, Homo sapiens
uccauaaccauucagagaa

SEQ ID NO: 743904 - RNA, 19 nt, Homo sapiens
guauucagguuuucuccaa

SEQ ID NO: 743905 - RNA, 19 nt, Homo sapiens
gugaagcgccgugucaagu

SEQ ID NO: 743906 - RNA, 19 nt, Homo sapiens
uaagcaacaagaaugaagu

SEQ ID NO: 743907 - RNA, 19 nt, Homo sapiens
cacaagaauggcacauaug

SEQ ID NO: 743908 - RNA, 19 nt, Homo sapiens
gaaaugaucuuccacuuga

SEQ ID NO: 743909 - RNA, 19 nt, Homo sapiens
gcugagaucuguugaauaa

SEQ ID NO: 743910 - RNA, 19 nt, Homo sapiens
gaacuauacugcagauuau

SEQ ID NO: 743911 - RNA, 19 nt, Homo sapiens
gaagcaagcucugcagaaa

SEQ ID NO: 743912 - RNA, 19 nt, Homo sapiens
ggaacuauacugcagauua

SEQ ID NO: 743913 - RNA, 19 nt, Homo sapiens
gcacaguauuguaucauaa

SEQ ID NO: 743914 - RNA, 19 nt, Homo sapiens
gaaauguucuccauaucaa

SEQ ID NO: 743915 - RNA, 19 nt, Homo sapiens
gaugaaaccuuugcucuga

SEQ ID NO: 743916 - RNA, 19 nt, Homo sapiens
gaaaggaaagcccagauuu

SEQ ID NO: 743917 - RNA, 19 nt, Homo sapiens
gaguuaaccuguggcauua

SEQ ID NO: 743918 - RNA, 19 nt, Homo sapiens
ggaccaggcuaucauauca

SEQ ID NO: 743919 - RNA, 19 nt, Homo sapiens
gcacacugaugcuccuuaa

SEQ ID NO: 743920 - RNA, 19 nt, Homo sapiens
gaacuuacacuucaucugu

SEQ ID NO: 743921 - RNA, 19 nt, Homo sapiens
ggaacgagaaugaauauga

SEQ ID NO: 743922 - RNA, 19 nt, Homo sapiens
gaugguaaguucaagaaga

SEQ ID NO: 743923 - RNA, 19 nt, Homo sapiens
gggaggagcuuuacuaacu

SEQ ID NO: 743924 - RNA, 19 nt, Homo sapiens
gcccagagaugcuuaaauc

SEQ ID NO: 743925 - RNA, 19 nt, Homo sapiens
ugacuaagguaccugguuu

SEQ ID NO: 743926 - RNA, 19 nt, Homo sapiens
ccuuauagcugcacagaaa

SEQ ID NO: 743927 - RNA, 19 nt, Homo sapiens
ggaggagcuuuacuaacua

SEQ ID NO: 743928 - RNA, 19 nt, Homo sapiens
gcagaugauuguuguggaa

SEQ ID NO: 743929 - RNA, 19 nt, Homo sapiens
ggagagaacgucauccaaa

SEQ ID NO: 743930 - RNA, 19 nt, Homo sapiens
agacaacacuacaaacuga

SEQ ID NO: 743931 - RNA, 19 nt, Homo sapiens
ggaggaacgagaaugaaua

SEQ ID NO: 743932 - RNA, 19 nt, Homo sapiens
agaaggagaugguaaguuc

SEQ ID NO: 743933 - RNA, 19 nt, Homo sapiens
ugagaucuguugaauaaug

SEQ ID NO: 743934 - RNA, 19 nt, Homo sapiens
gccacagucuuaucaagua

SEQ ID NO: 743935 - RNA, 19 nt, Homo sapiens
uaagugggaacaaucauua

SEQ ID NO: 743936 - RNA, 19 nt, Homo sapiens
acagagaacuuacacuuca

SEQ ID NO: 743937 - RNA, 19 nt, Homo sapiens
ggaaauguucuccauauca

SEQ ID NO: 743938 - RNA, 19 nt, Homo sapiens
acuguaaucuugagucuaa

SEQ ID NO: 743939 - RNA, 19 nt, Homo sapiens
ggaaagcccagauuugaau

SEQ ID NO: 743940 - RNA, 19 nt, Homo sapiens
gaacgagaaugaauaugac

SEQ ID NO: 743941 - RNA, 19 nt, Homo sapiens
uacggacucuucagauuua

SEQ ID NO: 743942 - RNA, 19 nt, Homo sapiens
ccuaaucacuaguuucuug

SEQ ID NO: 743943 - RNA, 19 nt, Homo sapiens
gauacugccugcacuggaa

SEQ ID NO: 743944 - RNA, 19 nt, Homo sapiens
ucaggaaguuuacauugaa

SEQ ID NO: 743945 - RNA, 19 nt, Homo sapiens
ggacccaggcccuuucuuu

SEQ ID NO: 743946 - RNA, 19 nt, Homo sapiens
cagagaagauugcacaagu

SEQ ID NO: 743947 - RNA, 19 nt, Homo sapiens
ggaaaggaaagcccagauu

SEQ ID NO: 743948 - RNA, 19 nt, Homo sapiens
ugccugcacuggaauguua

SEQ ID NO: 743949 - RNA, 19 nt, Homo sapiens
ccucaugugcuuugaaaua

SEQ ID NO: 743950 - RNA, 19 nt, Homo sapiens
ucacuaguuucuuguauuc

SEQ ID NO: 743951 - RNA, 19 nt, Homo sapiens
acaaauaugccaccucaaa

SEQ ID NO: 743952 - RNA, 19 nt, Homo sapiens
cagagaugcuuaaauccaa

SEQ ID NO: 743953 - RNA, 19 nt, Homo sapiens
gauuugcaccuuucuguuu

SEQ ID NO: 743954 - RNA, 19 nt, Homo sapiens
cggaauaucuggagcucaa

SEQ ID NO: 743955 - RNA, 19 nt, Homo sapiens
gaagccauaagaagaaauu

SEQ ID NO: 743956 - RNA, 19 nt, Homo sapiens
uuaauauguuggcuccuua

SEQ ID NO: 743957 - RNA, 19 nt, Homo sapiens
ccaaccagauuccucauag

SEQ ID NO: 743958 - RNA, 19 nt, Homo sapiens
gauccaggccgcugaaguu

SEQ ID NO: 743959 - RNA, 19 nt, Homo sapiens
uauacggacucuucagauu

SEQ ID NO: 743960 - RNA, 19 nt, Homo sapiens
gcagcaacaucccuaacau

SEQ ID NO: 743961 - RNA, 19 nt, Homo sapiens
ggaaguuuacauugaauug

SEQ ID NO: 743962 - RNA, 19 nt, Homo sapiens
gagaucuguugaauaaugu

SEQ ID NO: 743963 - RNA, 19 nt, Homo sapiens
gagagaacgucauccaaaa

SEQ ID NO: 743964 - RNA, 19 nt, Homo sapiens
gcugugaagucuuaaagca

SEQ ID NO: 743965 - RNA, 19 nt, Homo sapiens
gaaaugccgcugugaaguc

SEQ ID NO: 743966 - RNA, 19 nt, Homo sapiens
gaaagcauccuuggucauc

SEQ ID NO: 743967 - RNA, 19 nt, Homo sapiens
gcauuggguugaugacugu

SEQ ID NO: 743968 - RNA, 19 nt, Homo sapiens
ugcaagagguggaaauguu

SEQ ID NO: 743969 - RNA, 19 nt, Homo sapiens
cauaucauguugccuuuca

SEQ ID NO: 743970 - RNA, 19 nt, Homo sapiens
ccacagccaccuccuugua

SEQ ID NO: 743971 - RNA, 19 nt, Homo sapiens
acagagggcuugguuugaa

SEQ ID NO: 743972 - RNA, 19 nt, Homo sapiens
gauagagccagcugucuga

SEQ ID NO: 743973 - RNA, 19 nt, Homo sapiens
ggccauugcuucuaacagu

SEQ ID NO: 743974 - RNA, 19 nt, Homo sapiens
ccagaagccauaagaagaa

SEQ ID NO: 743975 - RNA, 19 nt, Homo sapiens
agaagugguuaauauguug

SEQ ID NO: 743976 - RNA, 19 nt, Homo sapiens
ugaccucugugcuuucauu

SEQ ID NO: 743977 - RNA, 19 nt, Homo sapiens
ucauugaccucugugcuuu

SEQ ID NO: 743978 - RNA, 19 nt, Homo sapiens
ccagauuccucauagagau

SEQ ID NO: 743979 - RNA, 19 nt, Homo sapiens
caaccagauuccucauaga

SEQ ID NO: 743980 - RNA, 19 nt, Homo sapiens
gauacgauuugcaccuuuc

SEQ ID NO: 743981 - RNA, 19 nt, Homo sapiens
gaggaacgagaaugaauau

SEQ ID NO: 743982 - RNA, 19 nt, Homo sapiens
gccauugcuucuaacagua

SEQ ID NO: 743983 - RNA, 19 nt, Homo sapiens
gggcagccagugaauuuaa

SEQ ID NO: 743984 - RNA, 19 nt, Homo sapiens
cuaaacugcuacucaugaa

SEQ ID NO: 743985 - RNA, 19 nt, Homo sapiens
uauuaggacuggaagagaa

SEQ ID NO: 743986 - RNA, 19 nt, Homo sapiens
cgaauagaagugguuaaua

SEQ ID NO: 743987 - RNA, 19 nt, Homo sapiens
guucuuuaguucuccuuaa

SEQ ID NO: 743988 - RNA, 19 nt, Homo sapiens
gccaccuccuuguauguua

SEQ ID NO: 743989 - RNA, 19 nt, Homo sapiens
gagaugguaaguucaagaa

SEQ ID NO: 743990 - RNA, 19 nt, Homo sapiens
gaagacaaaacuccuuaua

SEQ ID NO: 743991 - RNA, 19 nt, Homo sapiens
ucaauaaaauccaccauga

SEQ ID NO: 743992 - RNA, 19 nt, Homo sapiens
caucaccucugucuaaagg

SEQ ID NO: 743993 - RNA, 19 nt, Homo sapiens
accaugagcugaaccaguu

SEQ ID NO: 743994 - RNA, 19 nt, Homo sapiens
guuaauauguuggcuccuu

SEQ ID NO: 743995 - RNA, 19 nt, Homo sapiens
acacugaugcuccuuaaga

SEQ ID NO: 743996 - RNA, 19 nt, Homo sapiens
ucuaaaggcccaaguccua

SEQ ID NO: 743997 - RNA, 19 nt, Homo sapiens
uucaagagaugacugagaa

SEQ ID NO: 743998 - RNA, 19 nt, Homo sapiens
gcaagagguggaaauguuc

SEQ ID NO: 743999 - RNA, 19 nt, Homo sapiens
gcagacaacacuacaaacu

SEQ ID NO: 744000 - RNA, 19 nt, Homo sapiens
caugugcuuugaaauauuc

SEQ ID NO: 744001 - RNA, 19 nt, Homo sapiens
gaggaacuauacugcagau

SEQ ID NO: 744002 - RNA, 19 nt, Homo sapiens
caaaagcuguugccccaaa

SEQ ID NO: 744003 - RNA, 19 nt, Homo sapiens
uggaaaaucuggaucauug

SEQ ID NO: 744004 - RNA, 19 nt, Homo sapiens
aaaggaaagcccagauuug

SEQ ID NO: 744005 - RNA, 19 nt, Homo sapiens
gcuuaaauccaaguuguuu

SEQ ID NO: 744006 - RNA, 19 nt, Homo sapiens
gugacuugcugcacaguau

SEQ ID NO: 744007 - RNA, 19 nt, Homo sapiens
cagaagccauaagaagaaa

SEQ ID NO: 744008 - RNA, 19 nt, Homo sapiens
gcacagagguuccuuaauu

SEQ ID NO: 744009 - RNA, 19 nt, Homo sapiens
uaacauaguuucaguguga

SEQ ID NO: 744010 - RNA, 19 nt, Homo sapiens
gauagggacuucaagagua

SEQ ID NO: 744011 - RNA, 19 nt, Homo sapiens
gaaaguggcuacaauccaa

SEQ ID NO: 744012 - RNA, 19 nt, Homo sapiens
gcacagcccuauucuaaau

SEQ ID NO: 744013 - RNA, 19 nt, Homo sapiens
gcugauagcugcuuagguu

SEQ ID NO: 744014 - RNA, 19 nt, Homo sapiens
guaccgaaaucguuaaauu

SEQ ID NO: 744015 - RNA, 19 nt, Homo sapiens
ggagaagguucaagagauu

SEQ ID NO: 744016 - RNA, 19 nt, Homo sapiens
gaaaguaauuugaccaagu

SEQ ID NO: 744017 - RNA, 19 nt, Homo sapiens
gaagaaaacccucccauua

SEQ ID NO: 744018 - RNA, 19 nt, Homo sapiens
gagauugccuccugucauu

SEQ ID NO: 744019 - RNA, 19 nt, Homo sapiens
cuaaaucgcuuaaacuaug

SEQ ID NO: 744020 - RNA, 19 nt, Homo sapiens
ccaaaucugagaacaauua

SEQ ID NO: 744021 - RNA, 19 nt, Homo sapiens
gcuauaagguggccaaauc

SEQ ID NO: 744022 - RNA, 19 nt, Homo sapiens
gagacuagacugaaacuuu

SEQ ID NO: 744023 - RNA, 19 nt, Homo sapiens
ccaaggauuuaccuaauug

SEQ ID NO: 744024 - RNA, 19 nt, Homo sapiens
uaagugugcuugcuuucua

SEQ ID NO: 744025 - RNA, 19 nt, Homo sapiens
gcaagcaaugguuagauua

SEQ ID NO: 744026 - RNA, 19 nt, Homo sapiens
aaacagagccuucgagcuu

SEQ ID NO: 744027 - RNA, 19 nt, Homo sapiens
gcgcuuaacccuuuacuga

SEQ ID NO: 744028 - RNA, 19 nt, Homo sapiens
gggagaagguucaagagau

SEQ ID NO: 744029 - RNA, 19 nt, Homo sapiens
gaguaguucugcucuuaaa

SEQ ID NO: 744030 - RNA, 19 nt, Homo sapiens
gcucuuggcaaacuucuua

SEQ ID NO: 744031 - RNA, 19 nt, Homo sapiens
ggacucuguuggacuguuu

SEQ ID NO: 744032 - RNA, 19 nt, Homo sapiens
cacagagguuccuuaauuu

SEQ ID NO: 744033 - RNA, 19 nt, Homo sapiens
cugcuuagguucuugagua

SEQ ID NO: 744034 - RNA, 19 nt, Homo sapiens
gggaggcccugagaacuaa

SEQ ID NO: 744035 - RNA, 19 nt, Homo sapiens
gauagaaggacuagcuaaa

SEQ ID NO: 744036 - RNA, 19 nt, Homo sapiens
ggccaaaucugagaacaau

SEQ ID NO: 744037 - RNA, 19 nt, Homo sapiens
gcaguuaaauggcgauggu

SEQ ID NO: 744038 - RNA, 19 nt, Homo sapiens
cuucaaagcuggacugagu

SEQ ID NO: 744039 - RNA, 19 nt, Homo sapiens
uaagaagcauacacaaauc

SEQ ID NO: 744040 - RNA, 19 nt, Homo sapiens
uuuaagacguucagaggua

SEQ ID NO: 744041 - RNA, 19 nt, Homo sapiens
gcacuggacuuacccucau

SEQ ID NO: 744042 - RNA, 19 nt, Homo sapiens
gacaguagguggcaaucga

SEQ ID NO: 744043 - RNA, 19 nt, Homo sapiens
gaagaagcggcauuggaaa

SEQ ID NO: 744044 - RNA, 19 nt, Homo sapiens
caacaccagccucaaacua

SEQ ID NO: 744045 - RNA, 19 nt, Homo sapiens
caagagauucauaagauug

SEQ ID NO: 744046 - RNA, 19 nt, Homo sapiens
cauaagaagcauacacaaa

SEQ ID NO: 744047 - RNA, 19 nt, Homo sapiens
caagcaaugguuagauuaa

SEQ ID NO: 744048 - RNA, 19 nt, Homo sapiens
auguaaagcuuccaguuaa

SEQ ID NO: 744049 - RNA, 19 nt, Homo sapiens
ccaugugggucaaacuaaa

SEQ ID NO: 744050 - RNA, 19 nt, Homo sapiens
uaacaaauccccuccuuaa

SEQ ID NO: 744051 - RNA, 19 nt, Homo sapiens
caccuuguauugcauaaga

SEQ ID NO: 744052 - RNA, 19 nt, Homo sapiens
aauguaaagcuuccaguua

SEQ ID NO: 744053 - RNA, 19 nt, Homo sapiens
aaacaaaccgguauugagu

SEQ ID NO: 744054 - RNA, 19 nt, Homo sapiens
caauugcguugcucaaauc

SEQ ID NO: 744055 - RNA, 19 nt, Homo sapiens
cagaucaaauguaaagcuu

SEQ ID NO: 744056 - RNA, 19 nt, Homo sapiens
cacugcagaucaaauguaa

SEQ ID NO: 744057 - RNA, 19 nt, Homo sapiens
guucagagguaagaaauac

SEQ ID NO: 744058 - RNA, 19 nt, Homo sapiens
caccagcgaugacgacuuc

SEQ ID NO: 744059 - RNA, 19 nt, Homo sapiens
agaagaagcggcauuggaa

SEQ ID NO: 744060 - RNA, 19 nt, Homo sapiens
ugugggcgcuuaacccuuu

SEQ ID NO: 744061 - RNA, 19 nt, Homo sapiens
uugaguaguucugcucuua

SEQ ID NO: 744062 - RNA, 19 nt, Homo sapiens
uugcacagcccuauucuaa

SEQ ID NO: 744063 - RNA, 19 nt, Homo sapiens
caacugacagccucauuuc

SEQ ID NO: 744064 - RNA, 19 nt, Homo sapiens
cuaauuuggcaguuuguua

SEQ ID NO: 744065 - RNA, 19 nt, Homo sapiens
auagggacuucaagaguaa

SEQ ID NO: 744066 - RNA, 19 nt, Homo sapiens
cacauaaucagaagagaaa

SEQ ID NO: 744067 - RNA, 19 nt, Homo sapiens
ccacgcaguuccucaugga

SEQ ID NO: 744068 - RNA, 19 nt, Homo sapiens
aauauacaguucaggcaaa

SEQ ID NO: 744069 - RNA, 19 nt, Homo sapiens
agcaggagcucaucaagga

SEQ ID NO: 744070 - RNA, 19 nt, Homo sapiens
aaaccggccuguacuccaa

SEQ ID NO: 744071 - RNA, 19 nt, Homo sapiens
gcaagcaggagcucaucaa

SEQ ID NO: 744072 - RNA, 19 nt, Homo sapiens
gauccgagccgagauguuc

SEQ ID NO: 744073 - RNA, 19 nt, Homo sapiens
uccaaggauuuaccuaauu

SEQ ID NO: 744074 - RNA, 19 nt, Homo sapiens
gcauggaggacgagaacaa

SEQ ID NO: 744075 - RNA, 19 nt, Homo sapiens
gauuuaacccuuuguggau

SEQ ID NO: 744076 - RNA, 19 nt, Homo sapiens
uagaaggacuagcuaaagg

SEQ ID NO: 744077 - RNA, 19 nt, Homo sapiens
gauagcugcuuagguucuu

SEQ ID NO: 744078 - RNA, 19 nt, Homo sapiens
gcucaccaacuccuuuauu

SEQ ID NO: 744079 - RNA, 19 nt, Homo sapiens
acaaaccgguauugagugu

SEQ ID NO: 744080 - RNA, 19 nt, Homo sapiens
auauguagcuugcgugcuu

SEQ ID NO: 744081 - RNA, 19 nt, Homo sapiens
uagcacagagguuccuuaa

SEQ ID NO: 744082 - RNA, 19 nt, Homo sapiens
caguuaaggagcuaaauga

SEQ ID NO: 744083 - RNA, 19 nt, Homo sapiens
agacuagacugaaacuuuu

SEQ ID NO: 744084 - RNA, 19 nt, Homo sapiens
uaucaacaccagccucaaa

SEQ ID NO: 744085 - RNA, 19 nt, Homo sapiens
ggaauuacaaacugaagag

SEQ ID NO: 744086 - RNA, 19 nt, Homo sapiens
aggcgucacugcaggaauu

SEQ ID NO: 744087 - RNA, 19 nt, Homo sapiens
uaaaaugcaccuuguauug

SEQ ID NO: 744088 - RNA, 19 nt, Homo sapiens
guucaagagauucauaaga

SEQ ID NO: 744089 - RNA, 19 nt, Homo sapiens
cuuagguucuugaguaguu

SEQ ID NO: 744090 - RNA, 19 nt, Homo sapiens
gagcagagcagagcaucga

SEQ ID NO: 744091 - RNA, 19 nt, Homo sapiens
uuaagacguucagagguaa

SEQ ID NO: 744092 - RNA, 19 nt, Homo sapiens
uaaacaaaccgguauugag

SEQ ID NO: 744093 - RNA, 19 nt, Homo sapiens
aagcugaccugggaagaga

SEQ ID NO: 744094 - RNA, 19 nt, Homo sapiens
gcuuaacccuuuacugacu

SEQ ID NO: 744095 - RNA, 19 nt, Homo sapiens
gaagcauacacaaaucaau

SEQ ID NO: 744096 - RNA, 19 nt, Homo sapiens
gcagcgucaucgguaguuu

SEQ ID NO: 744097 - RNA, 19 nt, Homo sapiens
ucacugcagaucaaaugua

SEQ ID NO: 744098 - RNA, 19 nt, Homo sapiens
cugacagccucauuucauu

SEQ ID NO: 744099 - RNA, 19 nt, Homo sapiens
gacuuacccucaucaccuu

SEQ ID NO: 744100 - RNA, 19 nt, Homo sapiens
caucaaggaguaccuggaa

SEQ ID NO: 744101 - RNA, 19 nt, Homo sapiens
ccaagaagaagcggcauug

SEQ ID NO: 744102 - RNA, 19 nt, Homo sapiens
gagcuuuucuuuggucuaa

SEQ ID NO: 744103 - RNA, 19 nt, Homo sapiens
ggugauagggacuucaaga

SEQ ID NO: 744104 - RNA, 19 nt, Homo sapiens
gacuugagcuccccagauu

SEQ ID NO: 744105 - RNA, 19 nt, Homo sapiens
ggaagcgacacccguggaa

SEQ ID NO: 744106 - RNA, 19 nt, Homo sapiens
ggcuuugguugguuucgua

SEQ ID NO: 744107 - RNA, 19 nt, Homo sapiens
ccagauugcaguuggaguu

SEQ ID NO: 744108 - RNA, 19 nt, Homo sapiens
caaauuagcucuacuccua

SEQ ID NO: 744109 - RNA, 19 nt, Homo sapiens
gcaaagaacuacagggauu

SEQ ID NO: 744110 - RNA, 19 nt, Homo sapiens
cuaaagagcugauauccuu

SEQ ID NO: 744111 - RNA, 19 nt, Homo sapiens
cgacaugacuuggaagaua

SEQ ID NO: 744112 - RNA, 19 nt, Homo sapiens
caacugagauaaaugcuau

SEQ ID NO: 744113 - RNA, 19 nt, Homo sapiens
acaagucucugcccaguua

SEQ ID NO: 744114 - RNA, 19 nt, Homo sapiens
cagcauaucuuuaaaugga

SEQ ID NO: 744115 - RNA, 19 nt, Homo sapiens
gcagaaaugaguauuauga

SEQ ID NO: 744116 - RNA, 19 nt, Homo sapiens
gaagauaagacuacuguga

SEQ ID NO: 744117 - RNA, 19 nt, Homo sapiens
gaauuuguuucaccucuuu

SEQ ID NO: 744118 - RNA, 19 nt, Homo sapiens
ggacagacuuaucuucaga

SEQ ID NO: 744119 - RNA, 19 nt, Homo sapiens
gaaagagaccuuggaguuu

SEQ ID NO: 744120 - RNA, 19 nt, Homo sapiens
ccacaugccugacaccaaa

SEQ ID NO: 744121 - RNA, 19 nt, Homo sapiens
ggagaagacugaacaagag

SEQ ID NO: 744122 - RNA, 19 nt, Homo sapiens
gacaugacuuggaagauaa

SEQ ID NO: 744123 - RNA, 19 nt, Homo sapiens
gaaauggaaucccaagaag

SEQ ID NO: 744124 - RNA, 19 nt, Homo sapiens
gcugagcucucuugucauu

SEQ ID NO: 744125 - RNA, 19 nt, Homo sapiens
gcacaguacuucugagaca

SEQ ID NO: 744126 - RNA, 19 nt, Homo sapiens
caacaagacaugauauuug

SEQ ID NO: 744127 - RNA, 19 nt, Homo sapiens
gcaacuggauuauacaaca

SEQ ID NO: 744128 - RNA, 19 nt, Homo sapiens
ccaauuggauccaggagaa

SEQ ID NO: 744129 - RNA, 19 nt, Homo sapiens
gaagauccuagaacagaua

SEQ ID NO: 744130 - RNA, 19 nt, Homo sapiens
gagccugacucucuuucua

SEQ ID NO: 744131 - RNA, 19 nt, Homo sapiens
ggagcaagaucuggagaaa

SEQ ID NO: 744132 - RNA, 19 nt, Homo sapiens
cuacauugcuccaaggaaa

SEQ ID NO: 744133 - RNA, 19 nt, Homo sapiens
gcaacaagacaugauauuu

SEQ ID NO: 744134 - RNA, 19 nt, Homo sapiens
caugggugcuuaucucuaa

SEQ ID NO: 744135 - RNA, 19 nt, Homo sapiens
cuaauaaacuucagcaucu

SEQ ID NO: 744136 - RNA, 19 nt, Homo sapiens
acagugggauaacuaauaa

SEQ ID NO: 744137 - RNA, 19 nt, Homo sapiens
aaacugaaagccagaauuu

SEQ ID NO: 744138 - RNA, 19 nt, Homo sapiens
ugacagcaguggcagauga

SEQ ID NO: 744139 - RNA, 19 nt, Homo sapiens
ccagaaaugucaugcaauc

SEQ ID NO: 744140 - RNA, 19 nt, Homo sapiens
agacuuaucuucagaacau

SEQ ID NO: 744141 - RNA, 19 nt, Homo sapiens
gagaagauccuagaacaga

SEQ ID NO: 744142 - RNA, 19 nt, Homo sapiens
uagagaaccuaacggcuaa

SEQ ID NO: 744143 - RNA, 19 nt, Homo sapiens
aaagagaccuuggaguuug

SEQ ID NO: 744144 - RNA, 19 nt, Homo sapiens
aaaccuaucuuucaggaau

SEQ ID NO: 744145 - RNA, 19 nt, Homo sapiens
acaagagucuaaagaagaa

SEQ ID NO: 744146 - RNA, 19 nt, Homo sapiens
ugaaagagaccuuggaguu

SEQ ID NO: 744147 - RNA, 19 nt, Homo sapiens
uaaaagagcuacagaguca

SEQ ID NO: 744148 - RNA, 19 nt, Homo sapiens
gcuagaaacuugucagcau

SEQ ID NO: 744149 - RNA, 19 nt, Homo sapiens
gaggagagccuggcagaaa

SEQ ID NO: 744150 - RNA, 19 nt, Homo sapiens
gaagauguggcgagugaaa

SEQ ID NO: 744151 - RNA, 19 nt, Homo sapiens
gcacacagacugacacauc

SEQ ID NO: 744152 - RNA, 19 nt, Homo sapiens
ccacuggccuggcuggaaa

SEQ ID NO: 744153 - RNA, 19 nt, Homo sapiens
ggaaagagaaaugagguuu

SEQ ID NO: 744154 - RNA, 19 nt, Homo sapiens
cgaguagcaucaaugguuu

SEQ ID NO: 744155 - RNA, 19 nt, Homo sapiens
uaacaagaggacagacuua

SEQ ID NO: 744156 - RNA, 19 nt, Homo sapiens
cagagaaacucacagucaa

SEQ ID NO: 744157 - RNA, 19 nt, Homo sapiens
gcauggagcuauggaggaa

SEQ ID NO: 744158 - RNA, 19 nt, Homo sapiens
ggaaaaccaucuaugagaa

SEQ ID NO: 744159 - RNA, 19 nt, Homo sapiens
gaaccuaacggcuaaacug

SEQ ID NO: 744160 - RNA, 19 nt, Homo sapiens
gacaaacagcauaucuuua

SEQ ID NO: 744161 - RNA, 19 nt, Homo sapiens
agacaaacagcauaucuuu

SEQ ID NO: 744162 - RNA, 19 nt, Homo sapiens
gaagugauacagcagaaug

SEQ ID NO: 744163 - RNA, 19 nt, Homo sapiens
ggaagaacagcaucaggaa

SEQ ID NO: 744164 - RNA, 19 nt, Homo sapiens
aggaagagauggcacuaaa

SEQ ID NO: 744165 - RNA, 19 nt, Homo sapiens
ggccagaaaugucaugcaa

SEQ ID NO: 744166 - RNA, 19 nt, Homo sapiens
aaggaaagccugagcagua

SEQ ID NO: 744167 - RNA, 19 nt, Homo sapiens
gcagcaacaagacaugaua

SEQ ID NO: 744168 - RNA, 19 nt, Homo sapiens
ucagaacauuucagucauu

SEQ ID NO: 744169 - RNA, 19 nt, Homo sapiens
gaaacugaaagccagaauu

SEQ ID NO: 744170 - RNA, 19 nt, Homo sapiens
caacauggacagccagcua

SEQ ID NO: 744171 - RNA, 19 nt, Homo sapiens
cugcugagcucucuuguca

SEQ ID NO: 744172 - RNA, 19 nt, Homo sapiens
gcauagagccaacugagau

SEQ ID NO: 744173 - RNA, 19 nt, Homo sapiens
cuacagggauugcuggaau

SEQ ID NO: 744174 - RNA, 19 nt, Homo sapiens
gaacacccucugccuaaug

SEQ ID NO: 744175 - RNA, 19 nt, Homo sapiens
gcaguacucucaaaagcua

SEQ ID NO: 744176 - RNA, 19 nt, Homo sapiens
gugcaaaggccaaacagaa

SEQ ID NO: 744177 - RNA, 19 nt, Homo sapiens
caaggaugcggcagagaua

SEQ ID NO: 744178 - RNA, 19 nt, Homo sapiens
gauacagagucuuggaugu

SEQ ID NO: 744179 - RNA, 19 nt, Homo sapiens
gauauuugaggcccguuua

SEQ ID NO: 744180 - RNA, 19 nt, Homo sapiens
ucaggacucugcagcgaaa

SEQ ID NO: 744181 - RNA, 19 nt, Homo sapiens
caaggacacuguagagaac

SEQ ID NO: 744182 - RNA, 19 nt, Homo sapiens
ggaacgugauguggcaauu

SEQ ID NO: 744183 - RNA, 19 nt, Homo sapiens
gaagauauucuguccacau

SEQ ID NO: 744184 - RNA, 19 nt, Homo sapiens
ggaggaaauuguagagcau

SEQ ID NO: 744185 - RNA, 19 nt, Homo sapiens
cuuaguaccuucugaaagu

SEQ ID NO: 744186 - RNA, 19 nt, Homo sapiens
ggacuuaguaccuucugaa

SEQ ID NO: 744187 - RNA, 19 nt, Homo sapiens
auaagacccugcucucuau

SEQ ID NO: 744188 - RNA, 19 nt, Homo sapiens
uauaagacccugcucucua

SEQ ID NO: 744189 - RNA, 19 nt, Homo sapiens
cuacaagagucuaaagaag

SEQ ID NO: 744190 - RNA, 19 nt, Homo sapiens
gaagugacaagagugcuuu

SEQ ID NO: 744191 - RNA, 19 nt, Homo sapiens
uaaacuggccagcaccaua

SEQ ID NO: 744192 - RNA, 19 nt, Homo sapiens
gcagagacaaacagcauau

SEQ ID NO: 744193 - RNA, 19 nt, Homo sapiens
gcuacaagagucuaaagaa

SEQ ID NO: 744194 - RNA, 19 nt, Homo sapiens
ccaugcaacuggauuauac

SEQ ID NO: 744195 - RNA, 19 nt, Homo sapiens
ucucaaguguggaagauau

SEQ ID NO: 744196 - RNA, 19 nt, Homo sapiens
gaaagccugagcaguagaa

SEQ ID NO: 744197 - RNA, 19 nt, Homo sapiens
agaaguugcugcuguaucu

SEQ ID NO: 744198 - RNA, 19 nt, Homo sapiens
gaggacagacuuaucuuca

SEQ ID NO: 744199 - RNA, 19 nt, Homo sapiens
uggcagaaaugaguauuau

SEQ ID NO: 744200 - RNA, 19 nt, Homo sapiens
caucaaugguuucccuuca

SEQ ID NO: 744201 - RNA, 19 nt, Homo sapiens
uaaaggagaagacugaaca

SEQ ID NO: 744202 - RNA, 19 nt, Homo sapiens
gaaccucaaggacacugua

SEQ ID NO: 744203 - RNA, 19 nt, Homo sapiens
cggcagagauaguguugga

SEQ ID NO: 744204 - RNA, 19 nt, Homo sapiens
gcaaggaugcggcagagau

SEQ ID NO: 744205 - RNA, 19 nt, Homo sapiens
cacagugggauaacuaaua

SEQ ID NO: 744206 - RNA, 19 nt, Homo sapiens
gcaccaagcacaguacuuc

SEQ ID NO: 744207 - RNA, 19 nt, Homo sapiens
gaagauguugguaggauuc

SEQ ID NO: 744208 - RNA, 19 nt, Homo sapiens
ccacaacacucaucuguca

SEQ ID NO: 744209 - RNA, 19 nt, Homo sapiens
cgacagagaugcugaaggu

SEQ ID NO: 744210 - RNA, 19 nt, Homo sapiens
ggacagugccuaccucuau

SEQ ID NO: 744211 - RNA, 19 nt, Homo sapiens
uaacuucucugccuuugug

SEQ ID NO: 744212 - RNA, 19 nt, Homo sapiens
ccacauccacauucuguua

SEQ ID NO: 744213 - RNA, 19 nt, Homo sapiens
gaacugccacugagcuaaa

SEQ ID NO: 744214 - RNA, 19 nt, Homo sapiens
ccacugagcuaaagauggu

SEQ ID NO: 744215 - RNA, 19 nt, Homo sapiens
caagggauggugcuucuuu

SEQ ID NO: 744216 - RNA, 19 nt, Homo sapiens
gagagggcuuugccuugaa

SEQ ID NO: 744217 - RNA, 19 nt, Homo sapiens
agagagggcuuugccuuga

SEQ ID NO: 744218 - RNA, 19 nt, Homo sapiens
caguggaggucccggauga

SEQ ID NO: 744219 - RNA, 19 nt, Homo sapiens
cagccuguguaagcuauua

SEQ ID NO: 744220 - RNA, 19 nt, Homo sapiens
ggguggagccucuguguga

SEQ ID NO: 744221 - RNA, 19 nt, Homo sapiens
gaguucaccugcccugugu

SEQ ID NO: 744222 - RNA, 19 nt, Homo sapiens
gaccugggcaucuccauug

SEQ ID NO: 744223 - RNA, 19 nt, Homo sapiens
ggacagcgaggcacacaca

SEQ ID NO: 744224 - RNA, 19 nt, Homo sapiens
ucaacugccugcucugcaa

SEQ ID NO: 744225 - RNA, 19 nt, Homo sapiens
ucaccugcccuguguguuu

SEQ ID NO: 744226 - RNA, 19 nt, Homo sapiens
aggaugaugucaaugaguu

SEQ ID NO: 744227 - RNA, 19 nt, Homo sapiens
ggacgagaagaccaagaaa

SEQ ID NO: 744228 - RNA, 19 nt, Homo sapiens
ucacagugcgcccugauau

SEQ ID NO: 744229 - RNA, 19 nt, Homo sapiens
cagagaugcugaaggugau

SEQ ID NO: 744230 - RNA, 19 nt, Homo sapiens
gcuaacuucucugccuuug

SEQ ID NO: 744231 - RNA, 19 nt, Homo sapiens
gggugcaccuucaucaaca

SEQ ID NO: 744232 - RNA, 19 nt, Homo sapiens
gacagugccuaccucuauc

SEQ ID NO: 744233 - RNA, 19 nt, Homo sapiens
gaacucuugcuaaccuguu

SEQ ID NO: 744234 - RNA, 19 nt, Homo sapiens
cacccaagcugucagaacu

SEQ ID NO: 744235 - RNA, 19 nt, Homo sapiens
gggcaucuccauugcugaa

SEQ ID NO: 744236 - RNA, 19 nt, Homo sapiens
agaggagccuggugcugaa

SEQ ID NO: 744237 - RNA, 19 nt, Homo sapiens
acacucaucugucaaacac

SEQ ID NO: 744238 - RNA, 19 nt, Homo sapiens
agagggcuuugccuugaaa

SEQ ID NO: 744239 - RNA, 19 nt, Homo sapiens
aggaggcgcugcgucagua

SEQ ID NO: 744240 - RNA, 19 nt, Homo sapiens
acagugcgcccugauauga

SEQ ID NO: 744241 - RNA, 19 nt, Homo sapiens
cguggaggaugcucagaug

SEQ ID NO: 744242 - RNA, 19 nt, Homo sapiens
ggauuaccagcgauuucua

SEQ ID NO: 744243 - RNA, 19 nt, Homo sapiens
gaggauuaccagcgauuuc

SEQ ID NO: 744244 - RNA, 19 nt, Homo sapiens
acaacacucaucugucaaa

SEQ ID NO: 744245 - RNA, 19 nt, Homo sapiens
gccagaucgugguacagaa

SEQ ID NO: 744246 - RNA, 19 nt, Homo sapiens
ccacuuucacuuucucuuc

SEQ ID NO: 744247 - RNA, 19 nt, Homo sapiens
cacacggccuggcugaguu

SEQ ID NO: 744248 - RNA, 19 nt, Homo sapiens
gacaguggcgucucucaag

SEQ ID NO: 744249 - RNA, 19 nt, Homo sapiens
ccggaugaggcgacaauuu

SEQ ID NO: 744250 - RNA, 19 nt, Homo sapiens
ggugcaccuucaucaacaa

SEQ ID NO: 744251 - RNA, 19 nt, Homo sapiens
cgacccggagguagcauuu

SEQ ID NO: 744252 - RNA, 19 nt, Homo sapiens
ccugaggccucuuggaacu

SEQ ID NO: 744253 - RNA, 19 nt, Homo sapiens
cagaacugccacugagcua

SEQ ID NO: 744254 - RNA, 19 nt, Homo sapiens
gaugaacugcaaggaguau

SEQ ID NO: 744255 - RNA, 19 nt, Homo sapiens
ugaggaugaugucaaugag

SEQ ID NO: 744256 - RNA, 19 nt, Homo sapiens
ccucuuggaacucuugcua

SEQ ID NO: 744257 - RNA, 19 nt, Homo sapiens
gccucugugugacuccaua

SEQ ID NO: 744258 - RNA, 19 nt, Homo sapiens
gcaucuccauugcugaaaa

SEQ ID NO: 744259 - RNA, 19 nt, Homo sapiens
gacgagaagaccaagaaag

SEQ ID NO: 744260 - RNA, 19 nt, Homo sapiens
caacacucaucugucaaac

SEQ ID NO: 744261 - RNA, 19 nt, Homo sapiens
ggugcuucuuugaggauga

SEQ ID NO: 744262 - RNA, 19 nt, Homo sapiens
aagggauggugcuucuuug

SEQ ID NO: 744263 - RNA, 19 nt, Homo sapiens
gauuaccagcgauuucuag

SEQ ID NO: 744264 - RNA, 19 nt, Homo sapiens
cggccuggcugugagaugu

SEQ ID NO: 744265 - RNA, 19 nt, Homo sapiens
cacgccagauggacgagaa

SEQ ID NO: 744266 - RNA, 19 nt, Homo sapiens
uggcgucucucaaggacau

SEQ ID NO: 744267 - RNA, 19 nt, Homo sapiens
acauccacauucuguuaga

SEQ ID NO: 744268 - RNA, 19 nt, Homo sapiens
ccuguguaagcuauuauaa

SEQ ID NO: 744269 - RNA, 19 nt, Homo sapiens
cggaugaggcgacaauuuu

SEQ ID NO: 744270 - RNA, 19 nt, Homo sapiens
caccugcccuguguguuuc

SEQ ID NO: 744271 - RNA, 19 nt, Homo sapiens
cuaccucuaucugcuguca

SEQ ID NO: 744272 - RNA, 19 nt, Homo sapiens
ccacaacacucaucuguca

SEQ ID NO: 744273 - RNA, 19 nt, Homo sapiens
cgacagagaugcugaaggu

SEQ ID NO: 744274 - RNA, 19 nt, Homo sapiens
ggacagugccuaccucuau

SEQ ID NO: 744275 - RNA, 19 nt, Homo sapiens
uaacuucucugccuuugug

SEQ ID NO: 744276 - RNA, 19 nt, Homo sapiens
ccacauccacauucuguua

SEQ ID NO: 744277 - RNA, 19 nt, Homo sapiens
gaacugccacugagcuaaa

SEQ ID NO: 744278 - RNA, 19 nt, Homo sapiens
ccacugagcuaaagauggu

SEQ ID NO: 744279 - RNA, 19 nt, Homo sapiens
caagggauggugcuucuuu

SEQ ID NO: 744280 - RNA, 19 nt, Homo sapiens
gagagggcuuugccuugaa

SEQ ID NO: 744281 - RNA, 19 nt, Homo sapiens
agagagggcuuugccuuga

SEQ ID NO: 744282 - RNA, 19 nt, Homo sapiens
caguggaggucccggauga

SEQ ID NO: 744283 - RNA, 19 nt, Homo sapiens
cagccuguguaagcuauua

SEQ ID NO: 744284 - RNA, 19 nt, Homo sapiens
ggguggagccucuguguga

SEQ ID NO: 744285 - RNA, 19 nt, Homo sapiens
gaguucaccugcccugugu

SEQ ID NO: 744286 - RNA, 19 nt, Homo sapiens
gaccugggcaucuccauug

SEQ ID NO: 744287 - RNA, 19 nt, Homo sapiens
ggacagcgaggcacacaca

SEQ ID NO: 744288 - RNA, 19 nt, Homo sapiens
caccucggcuggucccuuu

SEQ ID NO: 744289 - RNA, 19 nt, Homo sapiens
ucaacugccugcucugcaa

SEQ ID NO: 744290 - RNA, 19 nt, Homo sapiens
ucaccugcccuguguguuu

SEQ ID NO: 744291 - RNA, 19 nt, Homo sapiens
aggaugaugucaaugaguu

SEQ ID NO: 744292 - RNA, 19 nt, Homo sapiens
ggacgagaagaccaagaaa

SEQ ID NO: 744293 - RNA, 19 nt, Homo sapiens
ucacagugcgcccugauau

SEQ ID NO: 744294 - RNA, 19 nt, Homo sapiens
cagagaugcugaaggugau

SEQ ID NO: 744295 - RNA, 19 nt, Homo sapiens
gcuaacuucucugccuuug

SEQ ID NO: 744296 - RNA, 19 nt, Homo sapiens
gggugcaccuucaucaaca

SEQ ID NO: 744297 - RNA, 19 nt, Homo sapiens
gacagugccuaccucuauc

SEQ ID NO: 744298 - RNA, 19 nt, Homo sapiens
gaacucuugcuaaccuguu

SEQ ID NO: 744299 - RNA, 19 nt, Homo sapiens
cacccaagcugucagaacu

SEQ ID NO: 744300 - RNA, 19 nt, Homo sapiens
gggcaucuccauugcugaa

SEQ ID NO: 744301 - RNA, 19 nt, Homo sapiens
acacucaucugucaaacac

SEQ ID NO: 744302 - RNA, 19 nt, Homo sapiens
aggaggcgcugcgucagua

SEQ ID NO: 744303 - RNA, 19 nt, Homo sapiens
acagugcgcccugauauga

SEQ ID NO: 744304 - RNA, 19 nt, Homo sapiens
agagggcuuugccuugaaa

SEQ ID NO: 744305 - RNA, 19 nt, Homo sapiens
cguggaggaugcucagaug

SEQ ID NO: 744306 - RNA, 19 nt, Homo sapiens
ggauuaccagcgauuucua

SEQ ID NO: 744307 - RNA, 19 nt, Homo sapiens
gaggauuaccagcgauuuc

SEQ ID NO: 744308 - RNA, 19 nt, Homo sapiens
acaacacucaucugucaaa

SEQ ID NO: 744309 - RNA, 19 nt, Homo sapiens
gccagaucgugguacagaa

SEQ ID NO: 744310 - RNA, 19 nt, Homo sapiens
ccacuuucacuuucucuuc

SEQ ID NO: 744311 - RNA, 19 nt, Homo sapiens
cacacggccuggcugaguu

SEQ ID NO: 744312 - RNA, 19 nt, Homo sapiens
gacaguggcgucucucaag

SEQ ID NO: 744313 - RNA, 19 nt, Homo sapiens
ccggaugaggcgacaauuu

SEQ ID NO: 744314 - RNA, 19 nt, Homo sapiens
ggugcaccuucaucaacaa

SEQ ID NO: 744315 - RNA, 19 nt, Homo sapiens
cgacccggagguagcauuu

SEQ ID NO: 744316 - RNA, 19 nt, Homo sapiens
ccugaggccucuuggaacu

SEQ ID NO: 744317 - RNA, 19 nt, Homo sapiens
cagaacugccacugagcua

SEQ ID NO: 744318 - RNA, 19 nt, Homo sapiens
gaugaacugcaaggaguau

SEQ ID NO: 744319 - RNA, 19 nt, Homo sapiens
ugaggaugaugucaaugag

SEQ ID NO: 744320 - RNA, 19 nt, Homo sapiens
ccucuuggaacucuugcua

SEQ ID NO: 744321 - RNA, 19 nt, Homo sapiens
gccucugugugacuccaua

SEQ ID NO: 744322 - RNA, 19 nt, Homo sapiens
gcaucuccauugcugaaaa

SEQ ID NO: 744323 - RNA, 19 nt, Homo sapiens
gacgagaagaccaagaaag

SEQ ID NO: 744324 - RNA, 19 nt, Homo sapiens
caacacucaucugucaaac

SEQ ID NO: 744325 - RNA, 19 nt, Homo sapiens
ggugcuucuuugaggauga

SEQ ID NO: 744326 - RNA, 19 nt, Homo sapiens
aagggauggugcuucuuug

SEQ ID NO: 744327 - RNA, 19 nt, Homo sapiens
gauuaccagcgauuucuag

SEQ ID NO: 744328 - RNA, 19 nt, Homo sapiens
cacgccagauggacgagaa

SEQ ID NO: 744329 - RNA, 19 nt, Homo sapiens
cggccuggcugugagaugu

SEQ ID NO: 744330 - RNA, 19 nt, Homo sapiens
uggcgucucucaaggacau

SEQ ID NO: 744331 - RNA, 19 nt, Homo sapiens
acauccacauucuguuaga

SEQ ID NO: 744332 - RNA, 19 nt, Homo sapiens
ccuguguaagcuauuauaa

SEQ ID NO: 744333 - RNA, 19 nt, Homo sapiens
cggaugaggcgacaauuuu

SEQ ID NO: 744334 - RNA, 19 nt, Homo sapiens
caccugcccuguguguuuc

SEQ ID NO: 744335 - RNA, 19 nt, Homo sapiens
cuaccucuaucugcuguca

SEQ ID NO: 744336 - RNA, 19 nt, Homo sapiens
ccacaacacucaucuguca

SEQ ID NO: 744337 - RNA, 19 nt, Homo sapiens
cgacagagaugcugaaggu

SEQ ID NO: 744338 - RNA, 19 nt, Homo sapiens
ggacagugccuaccucuau

SEQ ID NO: 744339 - RNA, 19 nt, Homo sapiens
uaacuucucugccuuugug

SEQ ID NO: 744340 - RNA, 19 nt, Homo sapiens
ccacauccacauucuguua

SEQ ID NO: 744341 - RNA, 19 nt, Homo sapiens
caagaaagcagaggaaaug

SEQ ID NO: 744342 - RNA, 19 nt, Homo sapiens
gaacugccacugagcuaaa

SEQ ID NO: 744343 - RNA, 19 nt, Homo sapiens
ccacugagcuaaagauggu

SEQ ID NO: 744344 - RNA, 19 nt, Homo sapiens
gcaaugaagugugccaucu

SEQ ID NO: 744345 - RNA, 19 nt, Homo sapiens
caagggauggugcuucuuu

SEQ ID NO: 744346 - RNA, 19 nt, Homo sapiens
gaacagguggcaaugaagu

SEQ ID NO: 744347 - RNA, 19 nt, Homo sapiens
gagagggcuuugccuugaa

SEQ ID NO: 744348 - RNA, 19 nt, Homo sapiens
agagagggcuuugccuuga

SEQ ID NO: 744349 - RNA, 19 nt, Homo sapiens
caguggaggucccggauga

SEQ ID NO: 744350 - RNA, 19 nt, Homo sapiens
cagccuguguaagcuauua

SEQ ID NO: 744351 - RNA, 19 nt, Homo sapiens
ggguggagccucuguguga

SEQ ID NO: 744352 - RNA, 19 nt, Homo sapiens
gaguucaccugcccugugu

SEQ ID NO: 744353 - RNA, 19 nt, Homo sapiens
gaccugggcaucuccauug

SEQ ID NO: 744354 - RNA, 19 nt, Homo sapiens
ggacagcgaggcacacaca

SEQ ID NO: 744355 - RNA, 19 nt, Homo sapiens
ucaacugccugcucugcaa

SEQ ID NO: 744356 - RNA, 19 nt, Homo sapiens
ucaccugcccuguguguuu

SEQ ID NO: 744357 - RNA, 19 nt, Homo sapiens
aggaugaugucaaugaguu

SEQ ID NO: 744358 - RNA, 19 nt, Homo sapiens
ggacgagaagaccaagaaa

SEQ ID NO: 744359 - RNA, 19 nt, Homo sapiens
ucacagugcgcccugauau

SEQ ID NO: 744360 - RNA, 19 nt, Homo sapiens
cagagaugcugaaggugau

SEQ ID NO: 744361 - RNA, 19 nt, Homo sapiens
gcuaacuucucugccuuug

SEQ ID NO: 744362 - RNA, 19 nt, Homo sapiens
ccaagaaagcagaggaaau

SEQ ID NO: 744363 - RNA, 19 nt, Homo sapiens
gggugcaccuucaucaaca

SEQ ID NO: 744364 - RNA, 19 nt, Homo sapiens
gacagugccuaccucuauc

SEQ ID NO: 744365 - RNA, 19 nt, Homo sapiens
gaacucuugcuaaccuguu

SEQ ID NO: 744366 - RNA, 19 nt, Homo sapiens
cacccaagcugucagaacu

SEQ ID NO: 744367 - RNA, 19 nt, Homo sapiens
gggcaucuccauugcugaa

SEQ ID NO: 744368 - RNA, 19 nt, Homo sapiens
augaacagguggcaaugaa

SEQ ID NO: 744369 - RNA, 19 nt, Homo sapiens
gaugaacagguggcaauga

SEQ ID NO: 744370 - RNA, 19 nt, Homo sapiens
acacucaucugucaaacac

SEQ ID NO: 744371 - RNA, 19 nt, Homo sapiens
agagggcuuugccuugaaa

SEQ ID NO: 744372 - RNA, 19 nt, Homo sapiens
aggaggcgcugcgucagua

SEQ ID NO: 744373 - RNA, 19 nt, Homo sapiens
acagugcgcccugauauga

SEQ ID NO: 744374 - RNA, 19 nt, Homo sapiens
cguggaggaugcucagaug

SEQ ID NO: 744375 - RNA, 19 nt, Homo sapiens
gggaugaacagguggcaau

SEQ ID NO: 744376 - RNA, 19 nt, Homo sapiens
ggauuaccagcgauuucua

SEQ ID NO: 744377 - RNA, 19 nt, Homo sapiens
gaccaagaaagcagaggaa

SEQ ID NO: 744378 - RNA, 19 nt, Homo sapiens
gaggauuaccagcgauuuc

SEQ ID NO: 744379 - RNA, 19 nt, Homo sapiens
acaacacucaucugucaaa

SEQ ID NO: 744380 - RNA, 19 nt, Homo sapiens
gccagaucgugguacagaa

SEQ ID NO: 744381 - RNA, 19 nt, Homo sapiens
ccacuuucacuuucucuuc

SEQ ID NO: 744382 - RNA, 19 nt, Homo sapiens
gacaguggcgucucucaag

SEQ ID NO: 744383 - RNA, 19 nt, Homo sapiens
cacacggccuggcugaguu

SEQ ID NO: 744384 - RNA, 19 nt, Homo sapiens
ccggaugaggcgacaauuu

SEQ ID NO: 744385 - RNA, 19 nt, Homo sapiens
ggugcaccuucaucaacaa

SEQ ID NO: 744386 - RNA, 19 nt, Homo sapiens
cgacccggagguagcauuu

SEQ ID NO: 744387 - RNA, 19 nt, Homo sapiens
ccugaggccucuuggaacu

SEQ ID NO: 744388 - RNA, 19 nt, Homo sapiens
cagaacugccacugagcua

SEQ ID NO: 744389 - RNA, 19 nt, Homo sapiens
gaugaacugcaaggaguau

SEQ ID NO: 744390 - RNA, 19 nt, Homo sapiens
ugaggaugaugucaaugag

SEQ ID NO: 744391 - RNA, 19 nt, Homo sapiens
ccucuuggaacucuugcua

SEQ ID NO: 744392 - RNA, 19 nt, Homo sapiens
gccucugugugacuccaua

SEQ ID NO: 744393 - RNA, 19 nt, Homo sapiens
gacgagaagaccaagaaag

SEQ ID NO: 744394 - RNA, 19 nt, Homo sapiens
gcaucuccauugcugaaaa

SEQ ID NO: 744395 - RNA, 19 nt, Homo sapiens
caacacucaucugucaaac

SEQ ID NO: 744396 - RNA, 19 nt, Homo sapiens
ggugcuucuuugaggauga

SEQ ID NO: 744397 - RNA, 19 nt, Homo sapiens
aagggauggugcuucuuug

SEQ ID NO: 744398 - RNA, 19 nt, Homo sapiens
gauuaccagcgauuucuag

SEQ ID NO: 744399 - RNA, 19 nt, Homo sapiens
cacgccagauggacgagaa

SEQ ID NO: 744400 - RNA, 19 nt, Homo sapiens
cggccuggcugugagaugu

SEQ ID NO: 744401 - RNA, 19 nt, Homo sapiens
uggcgucucucaaggacau

SEQ ID NO: 744402 - RNA, 19 nt, Homo sapiens
acauccacauucuguuaga

SEQ ID NO: 744403 - RNA, 19 nt, Homo sapiens
ccuguguaagcuauuauaa

SEQ ID NO: 744404 - RNA, 19 nt, Homo sapiens
cggaugaggcgacaauuuu

SEQ ID NO: 744405 - RNA, 19 nt, Homo sapiens
caccugcccuguguguuuc

SEQ ID NO: 744406 - RNA, 19 nt, Homo sapiens
cuaccucuaucugcuguca

SEQ ID NO: 744407 - RNA, 19 nt, Homo sapiens
ccacaacacucaucuguca

SEQ ID NO: 744408 - RNA, 19 nt, Homo sapiens
cgacagagaugcugaaggu

SEQ ID NO: 744409 - RNA, 19 nt, Homo sapiens
ggacagugccuaccucuau

SEQ ID NO: 744410 - RNA, 19 nt, Homo sapiens
uaacuucucugccuuugug

SEQ ID NO: 744411 - RNA, 19 nt, Homo sapiens
ccacauccacauucuguua

SEQ ID NO: 744412 - RNA, 19 nt, Homo sapiens
caagaaagcagaggaaaug

SEQ ID NO: 744413 - RNA, 19 nt, Homo sapiens
gaacugccacugagcuaaa

SEQ ID NO: 744414 - RNA, 19 nt, Homo sapiens
ccacugagcuaaagauggu

SEQ ID NO: 744415 - RNA, 19 nt, Homo sapiens
gcaaugaagugugccaucu

SEQ ID NO: 744416 - RNA, 19 nt, Homo sapiens
caagggauggugcuucuuu

SEQ ID NO: 744417 - RNA, 19 nt, Homo sapiens
gaacagguggcaaugaagu

SEQ ID NO: 744418 - RNA, 19 nt, Homo sapiens
gagagggcuuugccuugaa

SEQ ID NO: 744419 - RNA, 19 nt, Homo sapiens
agagagggcuuugccuuga

SEQ ID NO: 744420 - RNA, 19 nt, Homo sapiens
caguggaggucccggauga

SEQ ID NO: 744421 - RNA, 19 nt, Homo sapiens
cagccuguguaagcuauua

SEQ ID NO: 744422 - RNA, 19 nt, Homo sapiens
ggguggagccucuguguga

SEQ ID NO: 744423 - RNA, 19 nt, Homo sapiens
gaguucaccugcccugugu

SEQ ID NO: 744424 - RNA, 19 nt, Homo sapiens
gaccugggcaucuccauug

SEQ ID NO: 744425 - RNA, 19 nt, Homo sapiens
ggacagcgaggcacacaca

SEQ ID NO: 744426 - RNA, 19 nt, Homo sapiens
ucaacugccugcucugcaa

SEQ ID NO: 744427 - RNA, 19 nt, Homo sapiens
ucaccugcccuguguguuu

SEQ ID NO: 744428 - RNA, 19 nt, Homo sapiens
aggaugaugucaaugaguu

SEQ ID NO: 744429 - RNA, 19 nt, Homo sapiens
ggacgagaagaccaagaaa

SEQ ID NO: 744430 - RNA, 19 nt, Homo sapiens
ucacagugcgcccugauau

SEQ ID NO: 744431 - RNA, 19 nt, Homo sapiens
cagagaugcugaaggugau

SEQ ID NO: 744432 - RNA, 19 nt, Homo sapiens
gcuaacuucucugccuuug

SEQ ID NO: 744433 - RNA, 19 nt, Homo sapiens
ccaagaaagcagaggaaau

SEQ ID NO: 744434 - RNA, 19 nt, Homo sapiens
gggugcaccuucaucaaca

SEQ ID NO: 744435 - RNA, 19 nt, Homo sapiens
gacagugccuaccucuauc

SEQ ID NO: 744436 - RNA, 19 nt, Homo sapiens
gaacucuugcuaaccuguu

SEQ ID NO: 744437 - RNA, 19 nt, Homo sapiens
cacccaagcugucagaacu

SEQ ID NO: 744438 - RNA, 19 nt, Homo sapiens
gggcaucuccauugcugaa

SEQ ID NO: 744439 - RNA, 19 nt, Homo sapiens
agaggagccuggugcugaa

SEQ ID NO: 744440 - RNA, 19 nt, Homo sapiens
augaacagguggcaaugaa

SEQ ID NO: 744441 - RNA, 19 nt, Homo sapiens
gaugaacagguggcaauga

SEQ ID NO: 744442 - RNA, 19 nt, Homo sapiens
acacucaucugucaaacac

SEQ ID NO: 744443 - RNA, 19 nt, Homo sapiens
agagggcuuugccuugaaa

SEQ ID NO: 744444 - RNA, 19 nt, Homo sapiens
aggaggcgcugcgucagua

SEQ ID NO: 744445 - RNA, 19 nt, Homo sapiens
acagugcgcccugauauga

SEQ ID NO: 744446 - RNA, 19 nt, Homo sapiens
cguggaggaugcucagaug

SEQ ID NO: 744447 - RNA, 19 nt, Homo sapiens
gggaugaacagguggcaau

SEQ ID NO: 744448 - RNA, 19 nt, Homo sapiens
ggauuaccagcgauuucua

SEQ ID NO: 744449 - RNA, 19 nt, Homo sapiens
gaccaagaaagcagaggaa

SEQ ID NO: 744450 - RNA, 19 nt, Homo sapiens
gaggauuaccagcgauuuc

SEQ ID NO: 744451 - RNA, 19 nt, Homo sapiens
acaacacucaucugucaaa

SEQ ID NO: 744452 - RNA, 19 nt, Homo sapiens
gccagaucgugguacagaa

SEQ ID NO: 744453 - RNA, 19 nt, Homo sapiens
ccacuuucacuuucucuuc

SEQ ID NO: 744454 - RNA, 19 nt, Homo sapiens
cacacggccuggcugaguu

SEQ ID NO: 744455 - RNA, 19 nt, Homo sapiens
gacaguggcgucucucaag

SEQ ID NO: 744456 - RNA, 19 nt, Homo sapiens
ccggaugaggcgacaauuu

SEQ ID NO: 744457 - RNA, 19 nt, Homo sapiens
ggugcaccuucaucaacaa

SEQ ID NO: 744458 - RNA, 19 nt, Homo sapiens
cgacccggagguagcauuu

SEQ ID NO: 744459 - RNA, 19 nt, Homo sapiens
ccugaggccucuuggaacu

SEQ ID NO: 744460 - RNA, 19 nt, Homo sapiens
cagaacugccacugagcua

SEQ ID NO: 744461 - RNA, 19 nt, Homo sapiens
gaugaacugcaaggaguau

SEQ ID NO: 744462 - RNA, 19 nt, Homo sapiens
ugaggaugaugucaaugag

SEQ ID NO: 744463 - RNA, 19 nt, Homo sapiens
ccucuuggaacucuugcua

SEQ ID NO: 744464 - RNA, 19 nt, Homo sapiens
gccucugugugacuccaua

SEQ ID NO: 744465 - RNA, 19 nt, Homo sapiens
gcaucuccauugcugaaaa

SEQ ID NO: 744466 - RNA, 19 nt, Homo sapiens
gacgagaagaccaagaaag

SEQ ID NO: 744467 - RNA, 19 nt, Homo sapiens
cacgccagauggacgagaa

SEQ ID NO: 744468 - RNA, 19 nt, Homo sapiens
caacacucaucugucaaac

SEQ ID NO: 744469 - RNA, 19 nt, Homo sapiens
ggugcuucuuugaggauga

SEQ ID NO: 744470 - RNA, 19 nt, Homo sapiens
aagggauggugcuucuuug

SEQ ID NO: 744471 - RNA, 19 nt, Homo sapiens
gauuaccagcgauuucuag

SEQ ID NO: 744472 - RNA, 19 nt, Homo sapiens
cggccuggcugugagaugu

SEQ ID NO: 744473 - RNA, 19 nt, Homo sapiens
uggcgucucucaaggacau

SEQ ID NO: 744474 - RNA, 19 nt, Homo sapiens
acauccacauucuguuaga

SEQ ID NO: 744475 - RNA, 19 nt, Homo sapiens
ccuguguaagcuauuauaa

SEQ ID NO: 744476 - RNA, 19 nt, Homo sapiens
cggaugaggcgacaauuuu

SEQ ID NO: 744477 - RNA, 19 nt, Homo sapiens
caccugcccuguguguuuc

SEQ ID NO: 744478 - RNA, 19 nt, Homo sapiens
cuaccucuaucugcuguca

SEQ ID NO: 744479 - RNA, 19 nt, Homo sapiens
gaaauuaaguagcucagaa

SEQ ID NO: 744480 - RNA, 19 nt, Homo sapiens
ggaggugguuccuuucuua

SEQ ID NO: 744481 - RNA, 19 nt, Homo sapiens
uuacaaaucugcugucauu

SEQ ID NO: 744482 - RNA, 19 nt, Homo sapiens
acacugggcuggauucaua

SEQ ID NO: 744483 - RNA, 19 nt, Homo sapiens
gaaagacacaguaaagaaa

SEQ ID NO: 744484 - RNA, 19 nt, Homo sapiens
gagaagcccuccuuagaug

SEQ ID NO: 744485 - RNA, 19 nt, Homo sapiens
gaaacuggauucuuuaaac

SEQ ID NO: 744486 - RNA, 19 nt, Homo sapiens
cuagaaagcuuuggaaguu

SEQ ID NO: 744487 - RNA, 19 nt, Homo sapiens
gaaggaagcagaggaauug

SEQ ID NO: 744488 - RNA, 19 nt, Homo sapiens
gaacauggccauccagcaa

SEQ ID NO: 744489 - RNA, 19 nt, Homo sapiens
gcuaacacaucccgaagaa

SEQ ID NO: 744490 - RNA, 19 nt, Homo sapiens
uaaacuaacugaccaugga

SEQ ID NO: 744491 - RNA, 19 nt, Homo sapiens
gagcgugguuggacuuuga

SEQ ID NO: 744492 - RNA, 19 nt, Homo sapiens
acaagaaccucucccaaga

SEQ ID NO: 744493 - RNA, 19 nt, Homo sapiens
ucagcuauccuucuaauuu

SEQ ID NO: 744494 - RNA, 19 nt, Homo sapiens
gaagaaggaagcagaggaa

SEQ ID NO: 744495 - RNA, 19 nt, Homo sapiens
uaacacaucccgaagaaug

SEQ ID NO: 744496 - RNA, 19 nt, Homo sapiens
ucacugcucuuaccagaug

SEQ ID NO: 744497 - RNA, 19 nt, Homo sapiens
caauaugaauggagcuuau

SEQ ID NO: 744498 - RNA, 19 nt, Homo sapiens
gaguugagauuauccgaau

SEQ ID NO: 744499 - RNA, 19 nt, Homo sapiens
gcucuggaguugagauuau

SEQ ID NO: 744500 - RNA, 19 nt, Homo sapiens
gggcaucaccugagaaaga

SEQ ID NO: 744501 - RNA, 19 nt, Homo sapiens
gagcaacucagaaaguauu

SEQ ID NO: 744502 - RNA, 19 nt, Homo sapiens
cagaaaguauucccacaau

SEQ ID NO: 744503 - RNA, 19 nt, Homo sapiens
uaaaggagauugcauuucc

SEQ ID NO: 744504 - RNA, 19 nt, Homo sapiens
gaugagcguuugaguccaa

SEQ ID NO: 744505 - RNA, 19 nt, Homo sapiens
ggagauugcauuucccaaa

SEQ ID NO: 744506 - RNA, 19 nt, Homo sapiens
caacuguaacucagaaauu

SEQ ID NO: 744507 - RNA, 19 nt, Homo sapiens
caacacagagaacgaagaa

SEQ ID NO: 744508 - RNA, 19 nt, Homo sapiens
gagauugcauuucccaaag

SEQ ID NO: 744509 - RNA, 19 nt, Homo sapiens
gcaaggauccaccucuguu

SEQ ID NO: 744510 - RNA, 19 nt, Homo sapiens
ggaaacuggauucuuuaaa

SEQ ID NO: 744511 - RNA, 19 nt, Homo sapiens
gcaaagugcugggucugau

SEQ ID NO: 744512 - RNA, 19 nt, Homo sapiens
gaaaagaaagacacaguaa

SEQ ID NO: 744513 - RNA, 19 nt, Homo sapiens
gaaaguauucccacaaucg

SEQ ID NO: 744514 - RNA, 19 nt, Homo sapiens
gcugaaggcagagcuguua

SEQ ID NO: 744515 - RNA, 19 nt, Homo sapiens
ccucucagcuauccuucua

SEQ ID NO: 744516 - RNA, 19 nt, Homo sapiens
gcaauaugaauggagcuua

SEQ ID NO: 744517 - RNA, 19 nt, Homo sapiens
cagcuauccuucuaauuuc

SEQ ID NO: 744518 - RNA, 19 nt, Homo sapiens
gaaaacugaugaggaauga

SEQ ID NO: 744519 - RNA, 19 nt, Homo sapiens
uggcauccauuuacucuga

SEQ ID NO: 744520 - RNA, 19 nt, Homo sapiens
gcucuuaccagaugauguu

SEQ ID NO: 744521 - RNA, 19 nt, Homo sapiens
cgguagaggugaaugaaga

SEQ ID NO: 744522 - RNA, 19 nt, Homo sapiens
gcccacaguuucuccaguu

SEQ ID NO: 744523 - RNA, 19 nt, Homo sapiens
agaaagacacaguaaagaa

SEQ ID NO: 744524 - RNA, 19 nt, Homo sapiens
guauaucacgcucuuuauu

SEQ ID NO: 744525 - RNA, 19 nt, Homo sapiens
uagaaagcuuuggaaguuu

SEQ ID NO: 744526 - RNA, 19 nt, Homo sapiens
cagaugauguugccagagu

SEQ ID NO: 744527 - RNA, 19 nt, Homo sapiens
acacagagaacgaagaaga

SEQ ID NO: 744528 - RNA, 19 nt, Homo sapiens
aaagaaagacacaguaaag

SEQ ID NO: 744529 - RNA, 19 nt, Homo sapiens
gaacgaagaagaacuuuuc

SEQ ID NO: 744530 - RNA, 19 nt, Homo sapiens
acaaguauaucacgcucuu

SEQ ID NO: 744531 - RNA, 19 nt, Homo sapiens
gaccagauuguuuggcuaa

SEQ ID NO: 744532 - RNA, 19 nt, Homo sapiens
guggagacauguggaauuc

SEQ ID NO: 744533 - RNA, 19 nt, Homo sapiens
gagaacauggucacccaaa

SEQ ID NO: 744534 - RNA, 19 nt, Homo sapiens
gaccuucgaugagcguuug

SEQ ID NO: 744535 - RNA, 19 nt, Homo sapiens
caggaaacuggauucuuua

SEQ ID NO: 744536 - RNA, 19 nt, Homo sapiens
aaagugcugggucugauua

SEQ ID NO: 744537 - RNA, 19 nt, Homo sapiens
caacagaagcagcagcaau

SEQ ID NO: 744538 - RNA, 19 nt, Homo sapiens
gaaggcaacauugaacaug

SEQ ID NO: 744539 - RNA, 19 nt, Homo sapiens
gaggguagcacaacagaag

SEQ ID NO: 744540 - RNA, 19 nt, Homo sapiens
cuugggaggugguuccuuu

SEQ ID NO: 744541 - RNA, 19 nt, Homo sapiens
gaaauuaaaggagauugca

SEQ ID NO: 744542 - RNA, 19 nt, Homo sapiens
guagugcgguagaggugaa

SEQ ID NO: 744543 - RNA, 19 nt, Homo sapiens
uauaucacgcucuuuauug

SEQ ID NO: 744544 - RNA, 19 nt, Homo sapiens
aaguauaucacgcucuuua

SEQ ID NO: 744545 - RNA, 19 nt, Homo sapiens
ccugaugucugaccaugga

SEQ ID NO: 744546 - RNA, 19 nt, Homo sapiens
agaagaacuuuuccucaua

SEQ ID NO: 744547 - RNA, 19 nt, Homo sapiens
auaucacgcucuuuauuga

SEQ ID NO: 744548 - RNA, 19 nt, Homo sapiens
ccauuugaccagauuguuu

SEQ ID NO: 744549 - RNA, 19 nt, Homo sapiens
guccaacaccuuccaagaa

SEQ ID NO: 744550 - RNA, 19 nt, Homo sapiens
gggaggugguuccuuucuu

SEQ ID NO: 744551 - RNA, 19 nt, Homo sapiens
aagcaacuguaacucagaa

SEQ ID NO: 744552 - RNA, 19 nt, Homo sapiens
guacuuccgcucuggaguu

SEQ ID NO: 744553 - RNA, 19 nt, Homo sapiens
aaacugaugaggaaugaau

SEQ ID NO: 744554 - RNA, 19 nt, Homo sapiens
cauccucuauaacaaguau

SEQ ID NO: 744555 - RNA, 19 nt, Homo sapiens
caacaccuuccaagaacaa

SEQ ID NO: 744556 - RNA, 19 nt, Homo sapiens
gcagccacgugacuguugu

SEQ ID NO: 744557 - RNA, 19 nt, Homo sapiens
guggaaaacugaugaggaa

SEQ ID NO: 744558 - RNA, 19 nt, Homo sapiens
gcucuuuauugagaaacua

SEQ ID NO: 744559 - RNA, 19 nt, Homo sapiens
gaagaacuuuuccucauac

SEQ ID NO: 744560 - RNA, 19 nt, Homo sapiens
ccucuacaauaaaguaaca

SEQ ID NO: 744561 - RNA, 19 nt, Homo sapiens
gaggugguuccuuucuuaa

SEQ ID NO: 744562 - RNA, 19 nt, Homo sapiens
gcaacuguaacucagaaau

SEQ ID NO: 744563 - RNA, 19 nt, Homo sapiens
gacuagaggagauuucuuc

SEQ ID NO: 744564 - RNA, 19 nt, Homo sapiens
ccacacagaccgcguuucu

SEQ ID NO: 744565 - RNA, 19 nt, Homo sapiens
gaucagcagggccucauca

SEQ ID NO: 744566 - RNA, 19 nt, Homo sapiens
uuaacagucucauccauac

SEQ ID NO: 744567 - RNA, 19 nt, Homo sapiens
gaagcagcagcaauuggaa

SEQ ID NO: 744568 - RNA, 19 nt, Homo sapiens
ccuucuaauuucucucuaa

SEQ ID NO: 744569 - RNA, 19 nt, Homo sapiens
ucucagcuauccuucuaau

SEQ ID NO: 744570 - RNA, 19 nt, Homo sapiens
ugaggaaggcaacauugaa

SEQ ID NO: 744571 - RNA, 19 nt, Homo sapiens
cuucuggauucaccaauug

SEQ ID NO: 744572 - RNA, 19 nt, Homo sapiens
ccauauacccuuccuucug

SEQ ID NO: 744573 - RNA, 19 nt, Homo sapiens
ggauccaccucuguucugu

SEQ ID NO: 744574 - RNA, 19 nt, Homo sapiens
ggaaggcaacauugaacau

SEQ ID NO: 744575 - RNA, 19 nt, Homo sapiens
gcaacacagagaacgaaga

SEQ ID NO: 744576 - RNA, 19 nt, Homo sapiens
caaagugcugggucugauu

SEQ ID NO: 744577 - RNA, 19 nt, Homo sapiens
gaugaggaaugaauuuacc

SEQ ID NO: 744578 - RNA, 19 nt, Homo sapiens
gaacuugguccugaugucu

SEQ ID NO: 744579 - RNA, 19 nt, Homo sapiens
caugagaucuucuugauuu

SEQ ID NO: 744580 - RNA, 19 nt, Homo sapiens
caaaagaugucccuaauaa

SEQ ID NO: 744581 - RNA, 19 nt, Homo sapiens
gagcuacuuugaauacaua

SEQ ID NO: 744582 - RNA, 19 nt, Homo sapiens
caaagaggcugaagaugau

SEQ ID NO: 744583 - RNA, 19 nt, Homo sapiens
gaaguagugugaucuuuca

SEQ ID NO: 744584 - RNA, 19 nt, Homo sapiens
gcaagaagaagcuggagua

SEQ ID NO: 744585 - RNA, 19 nt, Homo sapiens
ccaaagaggcugaagauga

SEQ ID NO: 744586 - RNA, 19 nt, Homo sapiens
gcacuuuggugacauuguu

SEQ ID NO: 744587 - RNA, 19 nt, Homo sapiens
gaccagaaguccuaacaga

SEQ ID NO: 744588 - RNA, 19 nt, Homo sapiens
uuauguagcuugagacaaa

SEQ ID NO: 744589 - RNA, 19 nt, Homo sapiens
gagacacccuccucuagaa

SEQ ID NO: 744590 - RNA, 19 nt, Homo sapiens
aaagacagcuccaacaagu

SEQ ID NO: 744591 - RNA, 19 nt, Homo sapiens
ggagagcagccacuucuuu

SEQ ID NO: 744592 - RNA, 19 nt, Homo sapiens
gaagggacacuuucggauu

SEQ ID NO: 744593 - RNA, 19 nt, Homo sapiens
gugaaucaacuuccacuua

SEQ ID NO: 744594 - RNA, 19 nt, Homo sapiens
ggauugugcugcucucguu

SEQ ID NO: 744595 - RNA, 19 nt, Homo sapiens
ugaaucaacuuccacuuag

SEQ ID NO: 744596 - RNA, 19 nt, Homo sapiens
gcagccacuucuuugcaua

SEQ ID NO: 744597 - RNA, 19 nt, Homo sapiens
caaaagacgucccuaacaa

SEQ ID NO: 744598 - RNA, 19 nt, Homo sapiens
aaagacggcucuaacaagu

SEQ ID NO: 744599 - RNA, 19 nt, Homo sapiens
gaaacacggcuaugaccaa

SEQ ID NO: 744600 - RNA, 19 nt, Homo sapiens
uaaccugucuagcaugaga

SEQ ID NO: 744601 - RNA, 19 nt, Homo sapiens
ggaagugcuuuucuacuaa

SEQ ID NO: 744602 - RNA, 19 nt, Homo sapiens
guucuucuguguucccuuu

SEQ ID NO: 744603 - RNA, 19 nt, Homo sapiens
gagcagaccucaaaagaca

SEQ ID NO: 744604 - RNA, 19 nt, Homo sapiens
aaacacggcuaugaccaaa

SEQ ID NO: 744605 - RNA, 19 nt, Homo sapiens
gagagcagccacuucuuug

SEQ ID NO: 744606 - RNA, 19 nt, Homo sapiens
gggaagcuuucuccucaug

SEQ ID NO: 744607 - RNA, 19 nt, Homo sapiens
gagacaaagugaaucaacu

SEQ ID NO: 744608 - RNA, 19 nt, Homo sapiens
ugacauuguucuucugugu

SEQ ID NO: 744609 - RNA, 19 nt, Homo sapiens
aaagacggcuccagcaagu

SEQ ID NO: 744610 - RNA, 19 nt, Homo sapiens
aaagaugucccuaauaagu

SEQ ID NO: 744611 - RNA, 19 nt, Homo sapiens
agacagcccuagcaaguca

SEQ ID NO: 744612 - RNA, 19 nt, Homo sapiens
gaaucaacuuccacuuagu

SEQ ID NO: 744613 - RNA, 19 nt, Homo sapiens
aaaguacugugaccugaga

SEQ ID NO: 744614 - RNA, 19 nt, Homo sapiens
ccagaaguccuaacagaau

SEQ ID NO: 744615 - RNA, 19 nt, Homo sapiens
gcucaccgcccaaagaaga

SEQ ID NO: 744616 - RNA, 19 nt, Homo sapiens
agacagcacuggcaaaucg

SEQ ID NO: 744617 - RNA, 19 nt, Homo sapiens
cagaaguccuaacagaaug

SEQ ID NO: 744618 - RNA, 19 nt, Homo sapiens
aaagacagcacuaguaagu

SEQ ID NO: 744619 - RNA, 19 nt, Homo sapiens
caaaagacagcacuaguaa

SEQ ID NO: 744620 - RNA, 19 nt, Homo sapiens
acacccuccucuagaauuu

SEQ ID NO: 744621 - RNA, 19 nt, Homo sapiens
ccgaaagcgucaagcaaga

SEQ ID NO: 744622 - RNA, 19 nt, Homo sapiens
ggaugugcccuacagaaga

SEQ ID NO: 744623 - RNA, 19 nt, Homo sapiens
gauuugaaguagugugauc

SEQ ID NO: 744624 - RNA, 19 nt, Homo sapiens
cuacagaagacauagaaga

SEQ ID NO: 744625 - RNA, 19 nt, Homo sapiens
uguguucccuuuauuuaug

SEQ ID NO: 744626 - RNA, 19 nt, Homo sapiens
aaagacagcccuagcaagu

SEQ ID NO: 744627 - RNA, 19 nt, Homo sapiens
aaagacagcccuagcaagu

SEQ ID NO: 744628 - RNA, 19 nt, Homo sapiens
ucaaagacuucagcagcaa

SEQ ID NO: 744629 - RNA, 19 nt, Homo sapiens
gccagugacuaccaacguu

SEQ ID NO: 744630 - RNA, 19 nt, Homo sapiens
cuauaucgcucaucacaac

SEQ ID NO: 744631 - RNA, 19 nt, Homo sapiens
ucuaaccugucuagcauga

SEQ ID NO: 744632 - RNA, 19 nt, Homo sapiens
gcaagucuaaccugucuag

SEQ ID NO: 744633 - RNA, 19 nt, Homo sapiens
ucuccaacccuucugauaa

SEQ ID NO: 744634 - RNA, 19 nt, Homo sapiens
gugcaagucuaaccugucu

SEQ ID NO: 744635 - RNA, 19 nt, Homo sapiens
ccucccugcugauuuguuu

SEQ ID NO: 744636 - RNA, 19 nt, Homo sapiens
gaaaagauguccgguucug

SEQ ID NO: 744637 - RNA, 19 nt, Homo sapiens
gcccaaagaagagaaagaa

SEQ ID NO: 744638 - RNA, 19 nt, Homo sapiens
ggcugaagaugaugauaca

SEQ ID NO: 744639 - RNA, 19 nt, Homo sapiens
gcaugagaucuucuugauu

SEQ ID NO: 744640 - RNA, 19 nt, Homo sapiens
cugcugauuuguuucuaaa

SEQ ID NO: 744641 - RNA, 19 nt, Homo sapiens
agcggaagaucauugcuuu

SEQ ID NO: 744642 - RNA, 19 nt, Homo sapiens
ucuuguggcuguccucuau

SEQ ID NO: 744643 - RNA, 19 nt, Homo sapiens
ccacuucuuugcauaucug

SEQ ID NO: 744644 - RNA, 19 nt, Homo sapiens
aagggacacuuucggauuc

SEQ ID NO: 744645 - RNA, 19 nt, Homo sapiens
gcccaaagaggcugaagau

SEQ ID NO: 744646 - RNA, 19 nt, Homo sapiens
caacccuucugauaacaag

SEQ ID NO: 744647 - RNA, 19 nt, Homo sapiens
ugaggccacugucccauca

SEQ ID NO: 744648 - RNA, 19 nt, Homo sapiens
ucuguguucccuuuauuua

SEQ ID NO: 744649 - RNA, 19 nt, Homo sapiens
uguccucccugcugauuug

SEQ ID NO: 744650 - RNA, 19 nt, Homo sapiens
gaugugcccuacagaagac

SEQ ID NO: 744651 - RNA, 19 nt, Homo sapiens
ccuggaggcucuaccaagu

SEQ ID NO: 744652 - RNA, 19 nt, Homo sapiens
gaagcuuucuccucaugcu

SEQ ID NO: 744653 - RNA, 19 nt, Homo sapiens
uggaagugcuuuucuacua

SEQ ID NO: 744654 - RNA, 19 nt, Homo sapiens
guccuugacuguggcauug

SEQ ID NO: 744655 - RNA, 19 nt, Homo sapiens
agucuaaccugucuagcau

SEQ ID NO: 744656 - RNA, 19 nt, Homo sapiens
gccaaugggcaaagagcua

SEQ ID NO: 744657 - RNA, 19 nt, Homo sapiens
guacggccuucugcaggaa

SEQ ID NO: 744658 - RNA, 19 nt, Homo sapiens
gaagaucauugcuuuuguc

SEQ ID NO: 744659 - RNA, 19 nt, Homo sapiens
gagcagccacuucuuugca

SEQ ID NO: 744660 - RNA, 19 nt, Homo sapiens
gaaagcgucaagcaagaag

SEQ ID NO: 744661 - RNA, 19 nt, Homo sapiens
ccaaagaagagaaagaaaa

SEQ ID NO: 744662 - RNA, 19 nt, Homo sapiens
gcaggaggaaguuaagucu

SEQ ID NO: 744663 - RNA, 19 nt, Homo sapiens
ugaaguagugugaucuuuc

SEQ ID NO: 744664 - RNA, 19 nt, Homo sapiens
uuaguuguaccgagcauaa

SEQ ID NO: 744665 - RNA, 19 nt, Homo sapiens
ccugcugauuuguuucuaa

SEQ ID NO: 744666 - RNA, 19 nt, Homo sapiens
ggaagaucauugcuuuugu

SEQ ID NO: 744667 - RNA, 19 nt, Homo sapiens
ucuggugacugcagccauu

SEQ ID NO: 744668 - RNA, 19 nt, Homo sapiens
gguucugccuccagugaga

SEQ ID NO: 744669 - RNA, 19 nt, Homo sapiens
caaagacuucagcagcaaa

SEQ ID NO: 744670 - RNA, 19 nt, Homo sapiens
cauagaagauggggaaaug

SEQ ID NO: 744671 - RNA, 19 nt, Homo sapiens
acacggcuaugaccaaagg

SEQ ID NO: 744672 - RNA, 19 nt, Homo sapiens
acauuguucuucuguguuc

SEQ ID NO: 744673 - RNA, 19 nt, Homo sapiens
caacaagcggaagaucauu

SEQ ID NO: 744674 - RNA, 19 nt, Homo sapiens
agcaugagaucuucuugau

SEQ ID NO: 744675 - RNA, 19 nt, Homo sapiens
guuucucucugcagaccua

SEQ ID NO: 744676 - RNA, 19 nt, Homo sapiens
gacacccuccucuagaauu

SEQ ID NO: 744677 - RNA, 19 nt, Homo sapiens
cggaggcgcagaccacaaa

SEQ ID NO: 744678 - RNA, 19 nt, Homo sapiens
cacaaaagaugucccuaau

SEQ ID NO: 744679 - RNA, 19 nt, Homo sapiens
gaaaguagcucgccaagau

SEQ ID NO: 744680 - RNA, 19 nt, Homo sapiens
gaauuuaccucaucucaca

SEQ ID NO: 744681 - RNA, 19 nt, Homo sapiens
ggacccagcuucccacuug

SEQ ID NO: 744682 - RNA, 19 nt, Homo sapiens
gcacagaauuuaccucauc

SEQ ID NO: 744683 - RNA, 19 nt, Homo sapiens
ggccagacauugagaguuu

SEQ ID NO: 744684 - RNA, 19 nt, Homo sapiens
gguaugaggagaugaauaa

SEQ ID NO: 744685 - RNA, 19 nt, Homo sapiens
ggacggagguuuggaagau

SEQ ID NO: 744686 - RNA, 19 nt, Homo sapiens
gcaagugucuauauguugu

SEQ ID NO: 744687 - RNA, 19 nt, Homo sapiens
gaugaccucuucgucuuua

SEQ ID NO: 744688 - RNA, 19 nt, Homo sapiens
caauaaaccucuaccucuu

SEQ ID NO: 744689 - RNA, 19 nt, Homo sapiens
ggaaguugaugcacagaau

SEQ ID NO: 744690 - RNA, 19 nt, Homo sapiens
uaaagaagaccauaccaaa

SEQ ID NO: 744691 - RNA, 19 nt, Homo sapiens
ggagggagaucaccaaagg

SEQ ID NO: 744692 - RNA, 19 nt, Homo sapiens
gggugaagcuugaggcaaa

SEQ ID NO: 744693 - RNA, 19 nt, Homo sapiens
cuaauagucugaaggaaga

SEQ ID NO: 744694 - RNA, 19 nt, Homo sapiens
uugcaucucugaaaucuuu

SEQ ID NO: 744695 - RNA, 19 nt, Homo sapiens
ggacgcaguacaugaagua

SEQ ID NO: 744696 - RNA, 19 nt, Homo sapiens
uaucuuacauguucucgaa

SEQ ID NO: 744697 - RNA, 19 nt, Homo sapiens
cagcaagugucuauauguu

SEQ ID NO: 744698 - RNA, 19 nt, Homo sapiens
gcacugggcccauuugaag

SEQ ID NO: 744699 - RNA, 19 nt, Homo sapiens
ccucagauuuguaauuguu

SEQ ID NO: 744700 - RNA, 19 nt, Homo sapiens
cuacagcuccucccucuuu

SEQ ID NO: 744701 - RNA, 19 nt, Homo sapiens
gagaagaaagccuugaguu

SEQ ID NO: 744702 - RNA, 19 nt, Homo sapiens
ggaagaggacggagguuug

SEQ ID NO: 744703 - RNA, 19 nt, Homo sapiens
gagaggaaagggaaucaaa

SEQ ID NO: 744704 - RNA, 19 nt, Homo sapiens
ccaaagaaaugaaaacaga

SEQ ID NO: 744705 - RNA, 19 nt, Homo sapiens
cagcagcucucacuguuca

SEQ ID NO: 744706 - RNA, 19 nt, Homo sapiens
cacaaaggauggacucuuc

SEQ ID NO: 744707 - RNA, 19 nt, Homo sapiens
ggacggugauccugaaagg

SEQ ID NO: 744708 - RNA, 19 nt, Homo sapiens
ucacugcccucaaggacaa

SEQ ID NO: 744709 - RNA, 19 nt, Homo sapiens
gaugagagaagcccaguuc

SEQ ID NO: 744710 - RNA, 19 nt, Homo sapiens
gaaagggaaucaaaagcuu

SEQ ID NO: 744711 - RNA, 19 nt, Homo sapiens
gaacaccaccacugugaca

SEQ ID NO: 744712 - RNA, 19 nt, Homo sapiens
gaacuggaaucuggaugag

SEQ ID NO: 744713 - RNA, 19 nt, Homo sapiens
ccacauggacaacaagcua

SEQ ID NO: 744714 - RNA, 19 nt, Homo sapiens
gcacccauguccaaucuac

SEQ ID NO: 744715 - RNA, 19 nt, Homo sapiens
agagguggcugagaaagaa

SEQ ID NO: 744716 - RNA, 19 nt, Homo sapiens
gaaguugaugcacagaauu

SEQ ID NO: 744717 - RNA, 19 nt, Homo sapiens
aagaagaccauaccaaaga

SEQ ID NO: 744718 - RNA, 19 nt, Homo sapiens
gacaacaagcuaaagaaga

SEQ ID NO: 744719 - RNA, 19 nt, Homo sapiens
ucagacauuuggccaguau

SEQ ID NO: 744720 - RNA, 19 nt, Homo sapiens
ccacacacauacacacaca

SEQ ID NO: 744721 - RNA, 19 nt, Homo sapiens
uaccucagauuuguaauug

SEQ ID NO: 744722 - RNA, 19 nt, Homo sapiens
caagcagaauggugguuug

SEQ ID NO: 744723 - RNA, 19 nt, Homo sapiens
gaguaaauaccucagaugu

SEQ ID NO: 744724 - RNA, 19 nt, Homo sapiens
ggacaacaagcuaaagaag

SEQ ID NO: 744725 - RNA, 19 nt, Homo sapiens
uugcagagguggcugagaa

SEQ ID NO: 744726 - RNA, 19 nt, Homo sapiens
gaagcccaguucuuguaug

SEQ ID NO: 744727 - RNA, 19 nt, Homo sapiens
gcagcaagugucuauaugu

SEQ ID NO: 744728 - RNA, 19 nt, Homo sapiens
acacacacacacacacaua

SEQ ID NO: 744729 - RNA, 19 nt, Homo sapiens
cagaacaccaccacuguga

SEQ ID NO: 744730 - RNA, 19 nt, Homo sapiens
cgaggaagcccuggaaugu

SEQ ID NO: 744731 - RNA, 19 nt, Homo sapiens
ccauuucccuccccuuuua

SEQ ID NO: 744732 - RNA, 19 nt, Homo sapiens
ggauuguccuggagaacug

SEQ ID NO: 744733 - RNA, 19 nt, Homo sapiens
caggacagccgaacuggaa

SEQ ID NO: 744734 - RNA, 19 nt, Homo sapiens
acaacaagcuaaagaagac

SEQ ID NO: 744735 - RNA, 19 nt, Homo sapiens
ccuggaauguucagcagaa

SEQ ID NO: 744736 - RNA, 19 nt, Homo sapiens
aggaagcccuggaauguuc

SEQ ID NO: 744737 - RNA, 19 nt, Homo sapiens
ccucuucuauuucuuaugg

SEQ ID NO: 744738 - RNA, 19 nt, Homo sapiens
gccuaaaccugcccacauc

SEQ ID NO: 744739 - RNA, 19 nt, Homo sapiens
gagaucaucaacaagaaga

SEQ ID NO: 744740 - RNA, 19 nt, Homo sapiens
gguuuggccuggagugaug

SEQ ID NO: 744741 - RNA, 19 nt, Homo sapiens
guggagaucaucaacaaga

SEQ ID NO: 744742 - RNA, 19 nt, Homo sapiens
ucaacugcgucuucucuca

SEQ ID NO: 744743 - RNA, 19 nt, Homo sapiens
caaccacucucaggaaagg

SEQ ID NO: 744744 - RNA, 19 nt, Homo sapiens
caucauggccaaacagauc

SEQ ID NO: 744745 - RNA, 19 nt, Homo sapiens
ggaugaccucuucgucuuu

SEQ ID NO: 744746 - RNA, 19 nt, Homo sapiens
uggaugaccucuucgucuu

SEQ ID NO: 744747 - RNA, 19 nt, Homo sapiens
guuccuggaugaccucuuc

SEQ ID NO: 744748 - RNA, 19 nt, Homo sapiens
aaacccaggcugcuucaaa

SEQ ID NO: 744749 - RNA, 19 nt, Homo sapiens
ggauggggaugaugaaguu

SEQ ID NO: 744750 - RNA, 19 nt, Homo sapiens
gucuauauguugugguuau

SEQ ID NO: 744751 - RNA, 19 nt, Homo sapiens
cauuggauccucucccuuu

SEQ ID NO: 744752 - RNA, 19 nt, Homo sapiens
ccagugaggagcccaguug

SEQ ID NO: 744753 - RNA, 19 nt, Homo sapiens
gaaguauuugcaucucuga

SEQ ID NO: 744754 - RNA, 19 nt, Homo sapiens
agaagaaagccuugaguuc

SEQ ID NO: 744755 - RNA, 19 nt, Homo sapiens
ucucagcccuccacacaca

SEQ ID NO: 744756 - RNA, 19 nt, Homo sapiens
caaagccaagcaagugauu

SEQ ID NO: 744757 - RNA, 19 nt, Homo sapiens
ccauuuggccagacauuga

SEQ ID NO: 744758 - RNA, 19 nt, Homo sapiens
gaggaagcccuggaauguu

SEQ ID NO: 744759 - RNA, 19 nt, Homo sapiens
cuccugugcuguaaagaaa

SEQ ID NO: 744760 - RNA, 19 nt, Homo sapiens
aaacagcccacucauccuu

SEQ ID NO: 744761 - RNA, 19 nt, Homo sapiens
ccacuuugccuacuguuag

SEQ ID NO: 744762 - RNA, 19 nt, Homo sapiens
cuaugcaggugugcuguuu

SEQ ID NO: 744763 - RNA, 19 nt, Homo sapiens
cgcaguacaugaaguaucu

SEQ ID NO: 744764 - RNA, 19 nt, Homo sapiens
ugguggagaucaucaacaa

SEQ ID NO: 744765 - RNA, 19 nt, Homo sapiens
cgaacuggaaucuggauga

SEQ ID NO: 744766 - RNA, 19 nt, Homo sapiens
gaagaccauaccaaagaug

SEQ ID NO: 744767 - RNA, 19 nt, Homo sapiens
agaagaccauaccaaagau

SEQ ID NO: 744768 - RNA, 19 nt, Homo sapiens
cuaaagaagaccauaccaa

SEQ ID NO: 744769 - RNA, 19 nt, Homo sapiens
aagcagggccagcagauga

SEQ ID NO: 744770 - RNA, 19 nt, Homo sapiens
uggcagcacucccuuaggu

SEQ ID NO: 744771 - RNA, 19 nt, Homo sapiens
gugcccagguucagaguca

SEQ ID NO: 744772 - RNA, 19 nt, Homo sapiens
gagugaugaugcagaugga

SEQ ID NO: 744773 - RNA, 19 nt, Homo sapiens
cagcguggcucgcauucag

SEQ ID NO: 744774 - RNA, 19 nt, Homo sapiens
gaagaggacggagguuugg

SEQ ID NO: 744775 - RNA, 19 nt, Homo sapiens
ccacagggcaucugcugau

SEQ ID NO: 744776 - RNA, 19 nt, Homo sapiens
ccaggccacuagucucuuc

SEQ ID NO: 744777 - RNA, 19 nt, Homo sapiens
cacaguguaucgacaaucu

SEQ ID NO: 744778 - RNA, 19 nt, Homo sapiens
cagcaaccacucucaggaa

SEQ ID NO: 744779 - RNA, 19 nt, Homo sapiens
gaaauaagguuaguaguga

SEQ ID NO: 744780 - RNA, 19 nt, Homo sapiens
ugaagaaucuggaaaguaa

SEQ ID NO: 744781 - RNA, 19 nt, Homo sapiens
ggaaauauaucugcgaauu

SEQ ID NO: 744782 - RNA, 19 nt, Homo sapiens
gcagagauauccgcuauaa

SEQ ID NO: 744783 - RNA, 19 nt, Homo sapiens
gaaagcaaacuucacaaua

SEQ ID NO: 744784 - RNA, 19 nt, Homo sapiens
uaacagcgcucaugaaugg

SEQ ID NO: 744785 - RNA, 19 nt, Homo sapiens
agaaugaaaugccucaaua

SEQ ID NO: 744786 - RNA, 19 nt, Homo sapiens
ugaaaugccucaauauaga

SEQ ID NO: 744787 - RNA, 19 nt, Homo sapiens
gcuaugaacuuuauugaca

SEQ ID NO: 744788 - RNA, 19 nt, Homo sapiens
gagcagagauauccgcuau

SEQ ID NO: 744789 - RNA, 19 nt, Homo sapiens
uaucaaagcuguuaagucu

SEQ ID NO: 744790 - RNA, 19 nt, Homo sapiens
caugaaguguggaaauaua

SEQ ID NO: 744791 - RNA, 19 nt, Homo sapiens
gauuagugcccuuauauaa

SEQ ID NO: 744792 - RNA, 19 nt, Homo sapiens
gaaaucuccuugaaagcaa

SEQ ID NO: 744793 - RNA, 19 nt, Homo sapiens
gaagggauccgauaaccaa

SEQ ID NO: 744794 - RNA, 19 nt, Homo sapiens
gaauaaaggacucucagaa

SEQ ID NO: 744795 - RNA, 19 nt, Homo sapiens
gcaguagcaucaauagguu

SEQ ID NO: 744796 - RNA, 19 nt, Homo sapiens
ggaaauaaaggaauaugga

SEQ ID NO: 744797 - RNA, 19 nt, Homo sapiens
uuagggagcagauaauuua

SEQ ID NO: 744798 - RNA, 19 nt, Homo sapiens
cagaguggcucgaauuuua

SEQ ID NO: 744799 - RNA, 19 nt, Homo sapiens
gaaauauaucugcgaauug

SEQ ID NO: 744800 - RNA, 19 nt, Homo sapiens
gcagaaacagcacgagaaa

SEQ ID NO: 744801 - RNA, 19 nt, Homo sapiens
ucaaagcuguuaagucugu

SEQ ID NO: 744802 - RNA, 19 nt, Homo sapiens
ggaauauggagcagagaua

SEQ ID NO: 744803 - RNA, 19 nt, Homo sapiens
ccagaauugugagaaauaa

SEQ ID NO: 744804 - RNA, 19 nt, Homo sapiens
agaauuaugucaccaguuc

SEQ ID NO: 744805 - RNA, 19 nt, Homo sapiens
ggacguagacuugcugcua

SEQ ID NO: 744806 - RNA, 19 nt, Homo sapiens
caaacagaacccaaugaua

SEQ ID NO: 744807 - RNA, 19 nt, Homo sapiens
aaacagaacccaaugauac

SEQ ID NO: 744808 - RNA, 19 nt, Homo sapiens
gauauccgcuauaaaagua

SEQ ID NO: 744809 - RNA, 19 nt, Homo sapiens
auaaaggacucucagaaug

SEQ ID NO: 744810 - RNA, 19 nt, Homo sapiens
gaaaugccucaauauagaa

SEQ ID NO: 744811 - RNA, 19 nt, Homo sapiens
ggauuagugcccuuauaua

SEQ ID NO: 744812 - RNA, 19 nt, Homo sapiens
gaagguguauaugcucuau

SEQ ID NO: 744813 - RNA, 19 nt, Homo sapiens
gaagacaaacauccacgaa

SEQ ID NO: 744814 - RNA, 19 nt, Homo sapiens
agagagcuaugaacuuuau

SEQ ID NO: 744815 - RNA, 19 nt, Homo sapiens
cauagaggaugcaggaaau

SEQ ID NO: 744816 - RNA, 19 nt, Homo sapiens
gaacacgaaaucuccuuga

SEQ ID NO: 744817 - RNA, 19 nt, Homo sapiens
gaaugaaaugccucaauau

SEQ ID NO: 744818 - RNA, 19 nt, Homo sapiens
aaucacagaccaaguaauu

SEQ ID NO: 744819 - RNA, 19 nt, Homo sapiens
gcaaacagaacccaaugau

SEQ ID NO: 744820 - RNA, 19 nt, Homo sapiens
gcaccuugaucuuggacuu

SEQ ID NO: 744821 - RNA, 19 nt, Homo sapiens
gacguagacuugcugcuau

SEQ ID NO: 744822 - RNA, 19 nt, Homo sapiens
ggaaucacagaccaaguaa

SEQ ID NO: 744823 - RNA, 19 nt, Homo sapiens
cuaccauacuuacuucaaa

SEQ ID NO: 744824 - RNA, 19 nt, Homo sapiens
uagacuugcugcuaugaaa

SEQ ID NO: 744825 - RNA, 19 nt, Homo sapiens
cacgaaaucuccuugaaag

SEQ ID NO: 744826 - RNA, 19 nt, Homo sapiens
gagaguggaacaugccuuu

SEQ ID NO: 744827 - RNA, 19 nt, Homo sapiens
gggauccgauaaccaagaa

SEQ ID NO: 744828 - RNA, 19 nt, Homo sapiens
gggauuagugcccuuauau

SEQ ID NO: 744829 - RNA, 19 nt, Homo sapiens
ucaguaagguagaguuauc

SEQ ID NO: 744830 - RNA, 19 nt, Homo sapiens
cacuguuccuucuuucuua

SEQ ID NO: 744831 - RNA, 19 nt, Homo sapiens
gccaguagaauaugaaaga

SEQ ID NO: 744832 - RNA, 19 nt, Homo sapiens
aaauauaucugcgaauugg

SEQ ID NO: 744833 - RNA, 19 nt, Homo sapiens
ugcaggaaauaaaggaaua

SEQ ID NO: 744834 - RNA, 19 nt, Homo sapiens
uuagugcccuuauauaaag

SEQ ID NO: 744835 - RNA, 19 nt, Homo sapiens
gagcuaugaacuuuauuga

SEQ ID NO: 744836 - RNA, 19 nt, Homo sapiens
ugacagaguggcucgaauu

SEQ ID NO: 744837 - RNA, 19 nt, Homo sapiens
ucacaauaauggacguaga

SEQ ID NO: 744838 - RNA, 19 nt, Homo sapiens
aaaguggagaugacgauua

SEQ ID NO: 744839 - RNA, 19 nt, Homo sapiens
ucauuugccucaucacaug

SEQ ID NO: 744840 - RNA, 19 nt, Homo sapiens
gaaaacaaaucuguaagca

SEQ ID NO: 744841 - RNA, 19 nt, Homo sapiens
caaacccaaugacuacugu

SEQ ID NO: 744842 - RNA, 19 nt, Homo sapiens
uagcaaagagugcaaacuu

SEQ ID NO: 744843 - RNA, 19 nt, Homo sapiens
aauaauggacguagacuug

SEQ ID NO: 744844 - RNA, 19 nt, Homo sapiens
gcacgagaaagcaaacaga

SEQ ID NO: 744845 - RNA, 19 nt, Homo sapiens
ucacagaccaaguaauuca

SEQ ID NO: 744846 - RNA, 19 nt, Homo sapiens
guucuucauuggacgcuuu

SEQ ID NO: 744847 - RNA, 19 nt, Homo sapiens
agaaauaagguuaguagug

SEQ ID NO: 744848 - RNA, 19 nt, Homo sapiens
gcaaacuucacaauaaugg

SEQ ID NO: 744849 - RNA, 19 nt, Homo sapiens
gacagaguggcucgaauuu

SEQ ID NO: 744850 - RNA, 19 nt, Homo sapiens
ucaguuggaucucuuaagg

SEQ ID NO: 744851 - RNA, 19 nt, Homo sapiens
gaaagggagaagacaaaca

SEQ ID NO: 744852 - RNA, 19 nt, Homo sapiens
uggaaucacagaccaagua

SEQ ID NO: 744853 - RNA, 19 nt, Homo sapiens
aaguggagaugacgauuau

SEQ ID NO: 744854 - RNA, 19 nt, Homo sapiens
uagaggugcuuaaccaaca

SEQ ID NO: 744855 - RNA, 19 nt, Homo sapiens
gcaauacgggccuuuuaua

SEQ ID NO: 744856 - RNA, 19 nt, Homo sapiens
gugaaagggagaagacaaa

SEQ ID NO: 744857 - RNA, 19 nt, Homo sapiens
ccaguagaauaugaaagaa

SEQ ID NO: 744858 - RNA, 19 nt, Homo sapiens
uuacuuagggagcagauaa

SEQ ID NO: 744859 - RNA, 19 nt, Homo sapiens
guggagaugacgauuauug

SEQ ID NO: 744860 - RNA, 19 nt, Homo sapiens
gaaaccauccugaauacac

SEQ ID NO: 744861 - RNA, 19 nt, Homo sapiens
gaagaaucuggaaaguaaa

SEQ ID NO: 744862 - RNA, 19 nt, Homo sapiens
gcucaugaaugggauuagu

SEQ ID NO: 744863 - RNA, 19 nt, Homo sapiens
ugauaggucaggagaguaa

SEQ ID NO: 744864 - RNA, 19 nt, Homo sapiens
ucagaaugcugguaaaaug

SEQ ID NO: 744865 - RNA, 19 nt, Homo sapiens
ccuccagaauugugagaaa

SEQ ID NO: 744866 - RNA, 19 nt, Homo sapiens
ugggauuagugcccuuaua

SEQ ID NO: 744867 - RNA, 19 nt, Homo sapiens
guuagaauuuacccuagau

SEQ ID NO: 744868 - RNA, 19 nt, Homo sapiens
acacgaaaucuccuugaaa

SEQ ID NO: 744869 - RNA, 19 nt, Homo sapiens
cauccugaauacacucauu

SEQ ID NO: 744870 - RNA, 19 nt, Homo sapiens
uggaagacauugaaaccau

SEQ ID NO: 744871 - RNA, 19 nt, Homo sapiens
gcgaauugggaaucaguaa

SEQ ID NO: 744872 - RNA, 19 nt, Homo sapiens
uuaaauuccuacaguccaa

SEQ ID NO: 744873 - RNA, 19 nt, Homo sapiens
gagaguaacagcgcucaug

SEQ ID NO: 744874 - RNA, 19 nt, Homo sapiens
guuaaaggcaggaauagca

SEQ ID NO: 744875 - RNA, 19 nt, Homo sapiens
cgaaaucuccuugaaagca

SEQ ID NO: 744876 - RNA, 19 nt, Homo sapiens
aucaauagguuguugucua

SEQ ID NO: 744877 - RNA, 19 nt, Homo sapiens
cgaagguggugagauuuca

SEQ ID NO: 744878 - RNA, 19 nt, Homo sapiens
agagauauccgcuauaaaa

SEQ ID NO: 744879 - RNA, 19 nt, Homo sapiens
ggacagacuugauuuguau

SEQ ID NO: 744880 - RNA, 19 nt, Homo sapiens
gacaagauauugaaaggua

SEQ ID NO: 744881 - RNA, 19 nt, Homo sapiens
ggaauaagaucuuguuucu

SEQ ID NO: 744882 - RNA, 19 nt, Homo sapiens
ggaggaauaugaugaagaa

SEQ ID NO: 744883 - RNA, 19 nt, Homo sapiens
gagaugaugccaagaaaua

SEQ ID NO: 744884 - RNA, 19 nt, Homo sapiens
ugaaacaccugaagaaaga

SEQ ID NO: 744885 - RNA, 19 nt, Homo sapiens
gaagaggacgugcugcuua

SEQ ID NO: 744886 - RNA, 19 nt, Homo sapiens
gaagaaagacaagauauug

SEQ ID NO: 744887 - RNA, 19 nt, Homo sapiens
gcacaccacucacuaauac

SEQ ID NO: 744888 - RNA, 19 nt, Homo sapiens
gcagugccuuucagaauuu

SEQ ID NO: 744889 - RNA, 19 nt, Homo sapiens
aaacaggaguugagagaaa

SEQ ID NO: 744890 - RNA, 19 nt, Homo sapiens
aaaguuaccugauguagug

SEQ ID NO: 744891 - RNA, 19 nt, Homo sapiens
uagcaaaggugaaaaguua

SEQ ID NO: 744892 - RNA, 19 nt, Homo sapiens
gagagaugaugccaagaaa

SEQ ID NO: 744893 - RNA, 19 nt, Homo sapiens
aagaauauaugcuggcuuu

SEQ ID NO: 744894 - RNA, 19 nt, Homo sapiens
guaaagaaggugaugauga

SEQ ID NO: 744895 - RNA, 19 nt, Homo sapiens
ggaauaugaugaagaagag

SEQ ID NO: 744896 - RNA, 19 nt, Homo sapiens
gauaaggaauaagaucuug

SEQ ID NO: 744897 - RNA, 19 nt, Homo sapiens
gaucuuguuucuguuguuu

SEQ ID NO: 744898 - RNA, 19 nt, Homo sapiens
gaagaauggauaccagauu

SEQ ID NO: 744899 - RNA, 19 nt, Homo sapiens
uauugaggcuguuggauuu

SEQ ID NO: 744900 - RNA, 19 nt, Homo sapiens
gaauauaugcuggcuuuga

SEQ ID NO: 744901 - RNA, 19 nt, Homo sapiens
aggagaaggugaagaauau

SEQ ID NO: 744902 - RNA, 19 nt, Homo sapiens
uaaagaaggugaugaugac

SEQ ID NO: 744903 - RNA, 19 nt, Homo sapiens
gaagguauaccaggaagaa

SEQ ID NO: 744904 - RNA, 19 nt, Homo sapiens
ccacucaucugguauaacu

SEQ ID NO: 744905 - RNA, 19 nt, Homo sapiens
gcacuucggcugcagaguu

SEQ ID NO: 744906 - RNA, 19 nt, Homo sapiens
uggaugaggcaaccuauua

SEQ ID NO: 744907 - RNA, 19 nt, Homo sapiens
gagcagugccuuucagaau

SEQ ID NO: 744908 - RNA, 19 nt, Homo sapiens
gaacaggaggaauaugaug

SEQ ID NO: 744909 - RNA, 19 nt, Homo sapiens
ccgcagaacaggaggaaua

SEQ ID NO: 744910 - RNA, 19 nt, Homo sapiens
gaaagaaggaagcaaagag

SEQ ID NO: 744911 - RNA, 19 nt, Homo sapiens
aagaauggauaccagauug

SEQ ID NO: 744912 - RNA, 19 nt, Homo sapiens
cagaacaggaggaauauga

SEQ ID NO: 744913 - RNA, 19 nt, Homo sapiens
gcccacgcuucgagacuua

SEQ ID NO: 744914 - RNA, 19 nt, Homo sapiens
gauaccagauuggagaaga

SEQ ID NO: 744915 - RNA, 19 nt, Homo sapiens
aauauaugcuggcuuugaa

SEQ ID NO: 744916 - RNA, 19 nt, Homo sapiens
gaugaugccaagaaauaaa

SEQ ID NO: 744917 - RNA, 19 nt, Homo sapiens
gagaaggugaagaauauau

SEQ ID NO: 744918 - RNA, 19 nt, Homo sapiens
caggagaaggugaagaaua

SEQ ID NO: 744919 - RNA, 19 nt, Homo sapiens
uggacagacuugauuugua

SEQ ID NO: 744920 - RNA, 19 nt, Homo sapiens
gaacauuuggacagacuug

SEQ ID NO: 744921 - RNA, 19 nt, Homo sapiens
gcgcagacgugaugacaac

SEQ ID NO: 744922 - RNA, 19 nt, Homo sapiens
gcuguuggauuuagcaaag

SEQ ID NO: 744923 - RNA, 19 nt, Homo sapiens
ucacuaauacugaagaugu

SEQ ID NO: 744924 - RNA, 19 nt, Homo sapiens
ucugauggcugggaauaaa

SEQ ID NO: 744925 - RNA, 19 nt, Homo sapiens
gaguugagagaaacaauga

SEQ ID NO: 744926 - RNA, 19 nt, Homo sapiens
ugacgaugaugccgcagaa

SEQ ID NO: 744927 - RNA, 19 nt, Homo sapiens
ggauuuagcaaaggugaaa

SEQ ID NO: 744928 - RNA, 19 nt, Homo sapiens
ugaugcagcuucugaacau

SEQ ID NO: 744929 - RNA, 19 nt, Homo sapiens
ugaaacaggaguugagaga

SEQ ID NO: 744930 - RNA, 19 nt, Homo sapiens
ggagaaggugaagaauaua

SEQ ID NO: 744931 - RNA, 19 nt, Homo sapiens
agagaaagaaggaagcaaa

SEQ ID NO: 744932 - RNA, 19 nt, Homo sapiens
gaaacaggaguugagagaa

SEQ ID NO: 744933 - RNA, 19 nt, Homo sapiens
aaagaaggaagcaaagaga

SEQ ID NO: 744934 - RNA, 19 nt, Homo sapiens
guugagagaaacaaugaaa

SEQ ID NO: 744935 - RNA, 19 nt, Homo sapiens
aagaggacgugcugcuuau

SEQ ID NO: 744936 - RNA, 19 nt, Homo sapiens
cacuucggcugcagaguuu

SEQ ID NO: 744937 - RNA, 19 nt, Homo sapiens
ggaguugagagaaacaaug

SEQ ID NO: 744938 - RNA, 19 nt, Homo sapiens
uaagaucuuguuucuguug

SEQ ID NO: 744939 - RNA, 19 nt, Homo sapiens
agaaggaagcaaagagaaa

SEQ ID NO: 744940 - RNA, 19 nt, Homo sapiens
ugaggaaaaugaagagaaa

SEQ ID NO: 744941 - RNA, 19 nt, Homo sapiens
ggcacaccacucacuaaua

SEQ ID NO: 744942 - RNA, 19 nt, Homo sapiens
ggaagaauggauaccagau

SEQ ID NO: 744943 - RNA, 19 nt, Homo sapiens
gaagcaaagagaaaaguaa

SEQ ID NO: 744944 - RNA, 19 nt, Homo sapiens
ggcaaaggcacaccacuca

SEQ ID NO: 744945 - RNA, 19 nt, Homo sapiens
ggugaaaaguuaccugaug

SEQ ID NO: 744946 - RNA, 19 nt, Homo sapiens
gugaugacaacauggauga

SEQ ID NO: 744947 - RNA, 19 nt, Homo sapiens
gcccacucaucugguauaa

SEQ ID NO: 744948 - RNA, 19 nt, Homo sapiens
gagaaagaaggaagcaaag

SEQ ID NO: 744949 - RNA, 19 nt, Homo sapiens
agcagugccuuucagaauu

SEQ ID NO: 744950 - RNA, 19 nt, Homo sapiens
agagagaugaugccaagaa

SEQ ID NO: 744951 - RNA, 19 nt, Homo sapiens
gaauggauaccagauugga

SEQ ID NO: 744952 - RNA, 19 nt, Homo sapiens
gaaaacaggagaaggugaa

SEQ ID NO: 744953 - RNA, 19 nt, Homo sapiens
uaccugauguaguguugaa

SEQ ID NO: 744954 - RNA, 19 nt, Homo sapiens
ugaagaagagcaagaagag

SEQ ID NO: 744955 - RNA, 19 nt, Homo sapiens
ggaagaggacgugcugcuu

SEQ ID NO: 744956 - RNA, 19 nt, Homo sapiens
cagacgugaugacaacaug

SEQ ID NO: 744957 - RNA, 19 nt, Homo sapiens
agaaggugaugaugacgau

SEQ ID NO: 744958 - RNA, 19 nt, Homo sapiens
gaagagaaagaaggaagca

SEQ ID NO: 744959 - RNA, 19 nt, Homo sapiens
ccugaagaaagacaagaua

SEQ ID NO: 744960 - RNA, 19 nt, Homo sapiens
gaagagcaagaagaggaaa

SEQ ID NO: 744961 - RNA, 19 nt, Homo sapiens
ugaugacgaugacgaugau

SEQ ID NO: 744962 - RNA, 19 nt, Homo sapiens
gcaaagagaaaaguaaaga

SEQ ID NO: 744963 - RNA, 19 nt, Homo sapiens
gaaggaagcaaagagaaaa

SEQ ID NO: 744964 - RNA, 19 nt, Homo sapiens
uacugaagauguguugaaa

SEQ ID NO: 744965 - RNA, 19 nt, Homo sapiens
ggagcagugccuuucagaa

SEQ ID NO: 744966 - RNA, 19 nt, Homo sapiens
ggaugaggcaaccuauuag

SEQ ID NO: 744967 - RNA, 19 nt, Homo sapiens
aagacaagauauugaaagg

SEQ ID NO: 744968 - RNA, 19 nt, Homo sapiens
ugguauaacugguucugau

SEQ ID NO: 744969 - RNA, 19 nt, Homo sapiens
uauugaaacaccugaagaa

SEQ ID NO: 744970 - RNA, 19 nt, Homo sapiens
gaaggugaagaauauaugc

SEQ ID NO: 744971 - RNA, 19 nt, Homo sapiens
gguauaacugguucugaug

SEQ ID NO: 744972 - RNA, 19 nt, Homo sapiens
gaugcagcuucugaacauu

SEQ ID NO: 744973 - RNA, 19 nt, Homo sapiens
gaauuugcccacucaucug

SEQ ID NO: 744974 - RNA, 19 nt, Homo sapiens
guuaccugauguaguguug

SEQ ID NO: 744975 - RNA, 19 nt, Homo sapiens
aaaggcacaccacucacua

SEQ ID NO: 744976 - RNA, 19 nt, Homo sapiens
guucugauggcugggaaua

SEQ ID NO: 744977 - RNA, 19 nt, Homo sapiens
ggaagcaaagagaaaagua

SEQ ID NO: 744978 - RNA, 19 nt, Homo sapiens
aggaauaugaugaagaaga

SEQ ID NO: 744979 - RNA, 19 nt, Homo sapiens
gagcauagccaacuugaua

SEQ ID NO: 744980 - RNA, 19 nt, Homo sapiens
ggacuaugcugaaguauca

SEQ ID NO: 744981 - RNA, 19 nt, Homo sapiens
gaaaggaggcaauuugaaa

SEQ ID NO: 744982 - RNA, 19 nt, Homo sapiens
gaagcacaguuacaagaaa

SEQ ID NO: 744983 - RNA, 19 nt, Homo sapiens
ggaagacuuugcaaugauu

SEQ ID NO: 744984 - RNA, 19 nt, Homo sapiens
gaaauuaagcucuguucuu

SEQ ID NO: 744985 - RNA, 19 nt, Homo sapiens
gaucacagcuccugaacgu

SEQ ID NO: 744986 - RNA, 19 nt, Homo sapiens
uauauaagaugcucucaga

SEQ ID NO: 744987 - RNA, 19 nt, Homo sapiens
guacaucuauacuaccaaa

SEQ ID NO: 744988 - RNA, 19 nt, Homo sapiens
uaacaucucuaagcaaguu

SEQ ID NO: 744989 - RNA, 19 nt, Homo sapiens
gcaaaggaggcaaaggaua

SEQ ID NO: 744990 - RNA, 19 nt, Homo sapiens
caacauaaccuggugaguu

SEQ ID NO: 744991 - RNA, 19 nt, Homo sapiens
uagagacccugaaacguaa

SEQ ID NO: 744992 - RNA, 19 nt, Homo sapiens
ccaggaccuucuauuuaua

SEQ ID NO: 744993 - RNA, 19 nt, Homo sapiens
gcuauaacaucucuaagca

SEQ ID NO: 744994 - RNA, 19 nt, Homo sapiens
gagaauaagcgucuacuag

SEQ ID NO: 744995 - RNA, 19 nt, Homo sapiens
caaaggaggcaaaggauau

SEQ ID NO: 744996 - RNA, 19 nt, Homo sapiens
uaagaguaauugcccauga

SEQ ID NO: 744997 - RNA, 19 nt, Homo sapiens
agacagugauccagaagaa

SEQ ID NO: 744998 - RNA, 19 nt, Homo sapiens
cuagagacccugaaacgua

SEQ ID NO: 744999 - RNA, 19 nt, Homo sapiens
cauggacuaugcugaagua

SEQ ID NO: 745000 - RNA, 19 nt, Homo sapiens
gcaagaccauggacuaugc

SEQ ID NO: 745001 - RNA, 19 nt, Homo sapiens
cuggagagcugauuguuga

SEQ ID NO: 745002 - RNA, 19 nt, Homo sapiens
caaccuccauaaggcauua

SEQ ID NO: 745003 - RNA, 19 nt, Homo sapiens
acauguaccugguuccuaa

SEQ ID NO: 745004 - RNA, 19 nt, Homo sapiens
guggaagacuuugcaauga

SEQ ID NO: 745005 - RNA, 19 nt, Homo sapiens
ccaaaacucuguacaguga

SEQ ID NO: 745006 - RNA, 19 nt, Homo sapiens
cgacagugguggaggaaug

SEQ ID NO: 745007 - RNA, 19 nt, Homo sapiens
gcuggcagaugauccacua

SEQ ID NO: 745008 - RNA, 19 nt, Homo sapiens
uacaaugacucaagcagaa

SEQ ID NO: 745009 - RNA, 19 nt, Homo sapiens
ggaagcacaguuacaagaa

SEQ ID NO: 745010 - RNA, 19 nt, Homo sapiens
uauaagaugcucucagaaa

SEQ ID NO: 745011 - RNA, 19 nt, Homo sapiens
gagauuaccacuuccucua

SEQ ID NO: 745012 - RNA, 19 nt, Homo sapiens
gaaacguaaugucaacaag

SEQ ID NO: 745013 - RNA, 19 nt, Homo sapiens
uugaggagcuucuguugaa

SEQ ID NO: 745014 - RNA, 19 nt, Homo sapiens
uaagcucuguucuuuguug

SEQ ID NO: 745015 - RNA, 19 nt, Homo sapiens
ggaggcaauuugaaaccaa

SEQ ID NO: 745016 - RNA, 19 nt, Homo sapiens
gaauguaugucaucaaccu

SEQ ID NO: 745017 - RNA, 19 nt, Homo sapiens
ggaggaauguaugucauca

SEQ ID NO: 745018 - RNA, 19 nt, Homo sapiens
gaggguagaagccaucauu

SEQ ID NO: 745019 - RNA, 19 nt, Homo sapiens
uccaggaccuucuauuuau

SEQ ID NO: 745020 - RNA, 19 nt, Homo sapiens
ugucagcuguugugaagaa

SEQ ID NO: 745021 - RNA, 19 nt, Homo sapiens
gaacgucagcagcuagaga

SEQ ID NO: 745022 - RNA, 19 nt, Homo sapiens
cauccaggaccuucuauuu

SEQ ID NO: 745023 - RNA, 19 nt, Homo sapiens
agaaacacauagagcagaa

SEQ ID NO: 745024 - RNA, 19 nt, Homo sapiens
cagaugaugggauuuauug

SEQ ID NO: 745025 - RNA, 19 nt, Homo sapiens
gaaauagaggagaugauca

SEQ ID NO: 745026 - RNA, 19 nt, Homo sapiens
ccacuagaguuuguuggaa

SEQ ID NO: 745027 - RNA, 19 nt, Homo sapiens
gauagaaaggaggcaauuu

SEQ ID NO: 745028 - RNA, 19 nt, Homo sapiens
agaauauuccgucuaguuu

SEQ ID NO: 745029 - RNA, 19 nt, Homo sapiens
caaagagaauaagcgucua

SEQ ID NO: 745030 - RNA, 19 nt, Homo sapiens
cacuagaguuuguuggaaa

SEQ ID NO: 745031 - RNA, 19 nt, Homo sapiens
gaaccaugcuccgaaugag

SEQ ID NO: 745032 - RNA, 19 nt, Homo sapiens
gccaagagaccaaaauaua

SEQ ID NO: 745033 - RNA, 19 nt, Homo sapiens
gaccauggacuaugcugaa

SEQ ID NO: 745034 - RNA, 19 nt, Homo sapiens
gcagaccggcucacagaga

SEQ ID NO: 745035 - RNA, 19 nt, Homo sapiens
uagaaaggaggcaauuuga

SEQ ID NO: 745036 - RNA, 19 nt, Homo sapiens
ugacucaagcagaaauuaa

SEQ ID NO: 745037 - RNA, 19 nt, Homo sapiens
aggccaaccuugacagauu

SEQ ID NO: 745038 - RNA, 19 nt, Homo sapiens
gcugaaguaucaaacacau

SEQ ID NO: 745039 - RNA, 19 nt, Homo sapiens
guggugugguggaguauga

SEQ ID NO: 745040 - RNA, 19 nt, Homo sapiens
auagccaacuugauagaaa

SEQ ID NO: 745041 - RNA, 19 nt, Homo sapiens
ccugucagcugcccgaaug

SEQ ID NO: 745042 - RNA, 19 nt, Homo sapiens
ucaugucacuccaggaaau

SEQ ID NO: 745043 - RNA, 19 nt, Homo sapiens
cagaugauccacuagaguu

SEQ ID NO: 745044 - RNA, 19 nt, Homo sapiens
uacauugagugcaccauga

SEQ ID NO: 745045 - RNA, 19 nt, Homo sapiens
aacguaaugucaacaaguu

SEQ ID NO: 745046 - RNA, 19 nt, Homo sapiens
aggcaaaggauaugcuaua

SEQ ID NO: 745047 - RNA, 19 nt, Homo sapiens
ggaggcaaaggauaugcua

SEQ ID NO: 745048 - RNA, 19 nt, Homo sapiens
gcuggagucuuacauugag

SEQ ID NO: 745049 - RNA, 19 nt, Homo sapiens
gcagcuagagacccugaaa

SEQ ID NO: 745050 - RNA, 19 nt, Homo sapiens
gguagaagccaucauugca

SEQ ID NO: 745051 - RNA, 19 nt, Homo sapiens
ggccaaccuugacagauuc

SEQ ID NO: 745052 - RNA, 19 nt, Homo sapiens
auuaagcucuguucuuugu

SEQ ID NO: 745053 - RNA, 19 nt, Homo sapiens
gaugaucacagcuccugaa

SEQ ID NO: 745054 - RNA, 19 nt, Homo sapiens
ucgcugugcuagaauauuc

SEQ ID NO: 745055 - RNA, 19 nt, Homo sapiens
gauuaccacuuccucuagu

SEQ ID NO: 745056 - RNA, 19 nt, Homo sapiens
cgaaccaugcuccgaauga

SEQ ID NO: 745057 - RNA, 19 nt, Homo sapiens
guaccuaccacugagaauu

SEQ ID NO: 745058 - RNA, 19 nt, Homo sapiens
agacacacacuuuguacaa

SEQ ID NO: 745059 - RNA, 19 nt, Homo sapiens
aaugucagcuguugugaag

SEQ ID NO: 745060 - RNA, 19 nt, Homo sapiens
aagagacagugauccagaa

SEQ ID NO: 745061 - RNA, 19 nt, Homo sapiens
caagaaauagaggagauga

SEQ ID NO: 745062 - RNA, 19 nt, Homo sapiens
ugaagaaagcccugugugu

SEQ ID NO: 745063 - RNA, 19 nt, Homo sapiens
uggaaagucuggcgacagu

SEQ ID NO: 745064 - RNA, 19 nt, Homo sapiens
gaacggcaaacugacaaug

SEQ ID NO: 745065 - RNA, 19 nt, Homo sapiens
uauugcgaaugcuuagaua

SEQ ID NO: 745066 - RNA, 19 nt, Homo sapiens
uacaagaaauagaggagau

SEQ ID NO: 745067 - RNA, 19 nt, Homo sapiens
aagcacaguuacaagaaau

SEQ ID NO: 745068 - RNA, 19 nt, Homo sapiens
gaagccaucauugcaucua

SEQ ID NO: 745069 - RNA, 19 nt, Homo sapiens
gcauagccaacuugauaga

SEQ ID NO: 745070 - RNA, 19 nt, Homo sapiens
gcagaagaaacacauagag

SEQ ID NO: 745071 - RNA, 19 nt, Homo sapiens
guaccugguuccuaaacuc

SEQ ID NO: 745072 - RNA, 19 nt, Homo sapiens
ggcagacacacacuuugua

SEQ ID NO: 745073 - RNA, 19 nt, Homo sapiens
auagaaaggaggcaauuug

SEQ ID NO: 745074 - RNA, 19 nt, Homo sapiens
acaagagcauagccaacuu

SEQ ID NO: 745075 - RNA, 19 nt, Homo sapiens
uggaagacuuugcaaugau

SEQ ID NO: 745076 - RNA, 19 nt, Homo sapiens
ggaguccaucugauaagaa

SEQ ID NO: 745077 - RNA, 19 nt, Homo sapiens
cugcuggagucuuacauug

SEQ ID NO: 745078 - RNA, 19 nt, Homo sapiens
gcacaguuacaagaaauag

SEQ ID NO: 745079 - RNA, 19 nt, Homo sapiens
uaacucaccuggcaucuua

SEQ ID NO: 745080 - RNA, 19 nt, Homo sapiens
ccacagagcucaccaacaa

SEQ ID NO: 745081 - RNA, 19 nt, Homo sapiens
gagguacacuugugaauaa

SEQ ID NO: 745082 - RNA, 19 nt, Homo sapiens
gcagagugcuuuaccaauu

SEQ ID NO: 745083 - RNA, 19 nt, Homo sapiens
aaacauagaugacuggauu

SEQ ID NO: 745084 - RNA, 19 nt, Homo sapiens
gaagauggaucgaguaaag

SEQ ID NO: 745085 - RNA, 19 nt, Homo sapiens
caucgaagcucuagaaaug

SEQ ID NO: 745086 - RNA, 19 nt, Homo sapiens
gaaagcagauaaggaauug

SEQ ID NO: 745087 - RNA, 19 nt, Homo sapiens
ggaaaggaaugcaaagaug

SEQ ID NO: 745088 - RNA, 19 nt, Homo sapiens
gcccagcaauggcaaauua

SEQ ID NO: 745089 - RNA, 19 nt, Homo sapiens
ucaaauggcuguacucaug

SEQ ID NO: 745090 - RNA, 19 nt, Homo sapiens
caacagaguagccaaauuu

SEQ ID NO: 745091 - RNA, 19 nt, Homo sapiens
gcaaugaauuucugaauac

SEQ ID NO: 745092 - RNA, 19 nt, Homo sapiens
ggcaaugaauuucugaaua

SEQ ID NO: 745093 - RNA, 19 nt, Homo sapiens
ggaauugucugaacacagu

SEQ ID NO: 745094 - RNA, 19 nt, Homo sapiens
gagaugaaccagauuauga

SEQ ID NO: 745095 - RNA, 19 nt, Homo sapiens
cagaguagccaaauuuaua

SEQ ID NO: 745096 - RNA, 19 nt, Homo sapiens
gaauuugccuaauaugaug

SEQ ID NO: 745097 - RNA, 19 nt, Homo sapiens
uggaagagcugauggaaga

SEQ ID NO: 745098 - RNA, 19 nt, Homo sapiens
ucaaccaccugucuucaua

SEQ ID NO: 745099 - RNA, 19 nt, Homo sapiens
ggaagaugaugggaaauau

SEQ ID NO: 745100 - RNA, 19 nt, Homo sapiens
gggaugacuuggugucuaa

SEQ ID NO: 745101 - RNA, 19 nt, Homo sapiens
agaaaugaauggaagauga

SEQ ID NO: 745102 - RNA, 19 nt, Homo sapiens
gcaacaagaugagcuaauc

SEQ ID NO: 745103 - RNA, 19 nt, Homo sapiens
gaugguauauucuguguca

SEQ ID NO: 745104 - RNA, 19 nt, Homo sapiens
guugaagucuuguugaauu

SEQ ID NO: 745105 - RNA, 19 nt, Homo sapiens
agacacaccugccuucauu

SEQ ID NO: 745106 - RNA, 19 nt, Homo sapiens
gaaaggaaugcaaagauga

SEQ ID NO: 745107 - RNA, 19 nt, Homo sapiens
uagcagcccucaauuguga

SEQ ID NO: 745108 - RNA, 19 nt, Homo sapiens
gcacaucauuucaagaagu

SEQ ID NO: 745109 - RNA, 19 nt, Homo sapiens
ggaaauguaugauccaacu

SEQ ID NO: 745110 - RNA, 19 nt, Homo sapiens
gcagauaaguagcaguuca

SEQ ID NO: 745111 - RNA, 19 nt, Homo sapiens
gaagaaauucgugucuaua

SEQ ID NO: 745112 - RNA, 19 nt, Homo sapiens
guacacucauucauuacua

SEQ ID NO: 745113 - RNA, 19 nt, Homo sapiens
uuaagacccucucaaacua

SEQ ID NO: 745114 - RNA, 19 nt, Homo sapiens
guggagagauguaugauuc

SEQ ID NO: 745115 - RNA, 19 nt, Homo sapiens
gaaaaucguugcuucagaa

SEQ ID NO: 745116 - RNA, 19 nt, Homo sapiens
gguuuguggugauuauuua

SEQ ID NO: 745117 - RNA, 19 nt, Homo sapiens
cauuagagcuuaagacaca

SEQ ID NO: 745118 - RNA, 19 nt, Homo sapiens
cuuguacacucauucauua

SEQ ID NO: 745119 - RNA, 19 nt, Homo sapiens
gaucacugguccuuucuug

SEQ ID NO: 745120 - RNA, 19 nt, Homo sapiens
cauggaauuucucacguua

SEQ ID NO: 745121 - RNA, 19 nt, Homo sapiens
uuaaagauguagacaguug

SEQ ID NO: 745122 - RNA, 19 nt, Homo sapiens
guacacuugugaauaaaga

SEQ ID NO: 745123 - RNA, 19 nt, Homo sapiens
uaacaggcuuagugaugua

SEQ ID NO: 745124 - RNA, 19 nt, Homo sapiens
uuacaugccuaccaauauu

SEQ ID NO: 745125 - RNA, 19 nt, Homo sapiens
ggaaauaugacuucaccaa

SEQ ID NO: 745126 - RNA, 19 nt, Homo sapiens
gaaucaccauuagagcuua

SEQ ID NO: 745127 - RNA, 19 nt, Homo sapiens
gguauauucugugucauuu

SEQ ID NO: 745128 - RNA, 19 nt, Homo sapiens
gggaugaggugacuauucu

SEQ ID NO: 745129 - RNA, 19 nt, Homo sapiens
aaacuacauugacagauug

SEQ ID NO: 745130 - RNA, 19 nt, Homo sapiens
ggaacacucuauaacaaag

SEQ ID NO: 745131 - RNA, 19 nt, Homo sapiens
ugaauacgguggaagucua

SEQ ID NO: 745132 - RNA, 19 nt, Homo sapiens
gcuuugagaugcaacaaga

SEQ ID NO: 745133 - RNA, 19 nt, Homo sapiens
ggaugucucucuucuccaa

SEQ ID NO: 745134 - RNA, 19 nt, Homo sapiens
gcagauaaggaauugguaa

SEQ ID NO: 745135 - RNA, 19 nt, Homo sapiens
guaacucuguaauuccuaa

SEQ ID NO: 745136 - RNA, 19 nt, Homo sapiens
caggaaagcaaaucaguuu

SEQ ID NO: 745137 - RNA, 19 nt, Homo sapiens
caguuuaucuguucauaug

SEQ ID NO: 745138 - RNA, 19 nt, Homo sapiens
uaacuggaacacucuauaa

SEQ ID NO: 745139 - RNA, 19 nt, Homo sapiens
aaaugacucuucccucaaa

SEQ ID NO: 745140 - RNA, 19 nt, Homo sapiens
ucaguuguguggaaaugua

SEQ ID NO: 745141 - RNA, 19 nt, Homo sapiens
ucugugagcuuggugguua

SEQ ID NO: 745142 - RNA, 19 nt, Homo sapiens
caaauaacacuuacuugug

SEQ ID NO: 745143 - RNA, 19 nt, Homo sapiens
gaauggccauaagcagaua

SEQ ID NO: 745144 - RNA, 19 nt, Homo sapiens
gaagucuuguugaauuaug

SEQ ID NO: 745145 - RNA, 19 nt, Homo sapiens
agaagaaauucgugucuau

SEQ ID NO: 745146 - RNA, 19 nt, Homo sapiens
gaguggcagucuucaguuu

SEQ ID NO: 745147 - RNA, 19 nt, Homo sapiens
ccucaaauguguacuaugg

SEQ ID NO: 745148 - RNA, 19 nt, Homo sapiens
ggagagauguaugauucaa

SEQ ID NO: 745149 - RNA, 19 nt, Homo sapiens
gaacagcagagaugaaugg

SEQ ID NO: 745150 - RNA, 19 nt, Homo sapiens
gguaaugcuugaagauaau

SEQ ID NO: 745151 - RNA, 19 nt, Homo sapiens
gcagguuuguggugauuau

SEQ ID NO: 745152 - RNA, 19 nt, Homo sapiens
caucugaaauaaggaauga

SEQ ID NO: 745153 - RNA, 19 nt, Homo sapiens
caaauggccacucagauga

SEQ ID NO: 745154 - RNA, 19 nt, Homo sapiens
ccaagagcccgauuucaaa

SEQ ID NO: 745155 - RNA, 19 nt, Homo sapiens
gaugggaaccuacuagaug

SEQ ID NO: 745156 - RNA, 19 nt, Homo sapiens
cuacucagcugaucacaag

SEQ ID NO: 745157 - RNA, 19 nt, Homo sapiens
guacucugccacuuuauuu

SEQ ID NO: 745158 - RNA, 19 nt, Homo sapiens
cuacacaccuaacuuaugg

SEQ ID NO: 745159 - RNA, 19 nt, Homo sapiens
cuaaauagcagcccucaau

SEQ ID NO: 745160 - RNA, 19 nt, Homo sapiens
gggcacaucauuucaagaa

SEQ ID NO: 745161 - RNA, 19 nt, Homo sapiens
guccuuggauuacuuaaga

SEQ ID NO: 745162 - RNA, 19 nt, Homo sapiens
guugguaacucuguaauuc

SEQ ID NO: 745163 - RNA, 19 nt, Homo sapiens
cagaagaaauucgugucua

SEQ ID NO: 745164 - RNA, 19 nt, Homo sapiens
cagagugcuuuaccaauug

SEQ ID NO: 745165 - RNA, 19 nt, Homo sapiens
gaacgauacaauccugaaa

SEQ ID NO: 745166 - RNA, 19 nt, Homo sapiens
gaucaaauggccacucaga

SEQ ID NO: 745167 - RNA, 19 nt, Homo sapiens
gagguaaugcuugaagaua

SEQ ID NO: 745168 - RNA, 19 nt, Homo sapiens
uggaauuucucacguuaaa

SEQ ID NO: 745169 - RNA, 19 nt, Homo sapiens
gaagcacacaggaaccuaa

SEQ ID NO: 745170 - RNA, 19 nt, Homo sapiens
aaugcuugcugcugauuua

SEQ ID NO: 745171 - RNA, 19 nt, Homo sapiens
gugcuacacaccuaacuua

SEQ ID NO: 745172 - RNA, 19 nt, Homo sapiens
caaagaugaaggucuguuu

SEQ ID NO: 745173 - RNA, 19 nt, Homo sapiens
gaacacaguagaacgauac

SEQ ID NO: 745174 - RNA, 19 nt, Homo sapiens
gaacuaaccguuguaaugc

SEQ ID NO: 745175 - RNA, 19 nt, Homo sapiens
gcuauaauccacauacaga

SEQ ID NO: 745176 - RNA, 19 nt, Homo sapiens
caagaugagcuaaucgaaa

SEQ ID NO: 745177 - RNA, 19 nt, Homo sapiens
aguaagaguuuaagcuuug

SEQ ID NO: 745178 - RNA, 19 nt, Homo sapiens
ggccauaagcagauaagua

SEQ ID NO: 745179 - RNA, 19 nt, Homo sapiens
ggaaagagguccuguguga

SEQ ID NO: 745180 - RNA, 19 nt, Homo sapiens
ggaauccacuguacacuua

SEQ ID NO: 745181 - RNA, 19 nt, Homo sapiens
gcagugaaguccugucuaa

SEQ ID NO: 745182 - RNA, 19 nt, Homo sapiens
uaaccugcauggugaauua

SEQ ID NO: 745183 - RNA, 19 nt, Homo sapiens
gaggaguacugcaaguuua

SEQ ID NO: 745184 - RNA, 19 nt, Homo sapiens
ggacacagcacacaaguau

SEQ ID NO: 745185 - RNA, 19 nt, Homo sapiens
gagcagagccucccagaug

SEQ ID NO: 745186 - RNA, 19 nt, Homo sapiens
gaagaaagacagccuagga

SEQ ID NO: 745187 - RNA, 19 nt, Homo sapiens
uaagaacacugaagacauc

SEQ ID NO: 745188 - RNA, 19 nt, Homo sapiens
caucagaacucaagugucu

SEQ ID NO: 745189 - RNA, 19 nt, Homo sapiens
cagaauggaugaccaggaa

SEQ ID NO: 745190 - RNA, 19 nt, Homo sapiens
gcaaaguuaucacggaauc

SEQ ID NO: 745191 - RNA, 19 nt, Homo sapiens
guacaggagugccgagaug

SEQ ID NO: 745192 - RNA, 19 nt, Homo sapiens
ucaaagcgguggcugaaau

SEQ ID NO: 745193 - RNA, 19 nt, Homo sapiens
gcacaguggccacaccaua

SEQ ID NO: 745194 - RNA, 19 nt, Homo sapiens
agaaauaacugcugauggu

SEQ ID NO: 745195 - RNA, 19 nt, Homo sapiens
gaugguagcuggcuuuuga

SEQ ID NO: 745196 - RNA, 19 nt, Homo sapiens
ucaagugucugccguuguu

SEQ ID NO: 745197 - RNA, 19 nt, Homo sapiens
gacaucaccuucccuagug

SEQ ID NO: 745198 - RNA, 19 nt, Homo sapiens
cguaugacaucacguuuga

SEQ ID NO: 745199 - RNA, 19 nt, Homo sapiens
gaagaggaguaugacauca

SEQ ID NO: 745200 - RNA, 19 nt, Homo sapiens
ggaggaguacugcaaguuu

SEQ ID NO: 745201 - RNA, 19 nt, Homo sapiens
ccaaaucucccucaucuuc

SEQ ID NO: 745202 - RNA, 19 nt, Homo sapiens
gaaauaacugcugauggua

SEQ ID NO: 745203 - RNA, 19 nt, Homo sapiens
gagggauccuuuccuucua

SEQ ID NO: 745204 - RNA, 19 nt, Homo sapiens
ggaaacaguuaaaaucuug

SEQ ID NO: 745205 - RNA, 19 nt, Homo sapiens
caccaaaucucccucaucu

SEQ ID NO: 745206 - RNA, 19 nt, Homo sapiens
ccaaggaagaggaguauga

SEQ ID NO: 745207 - RNA, 19 nt, Homo sapiens
gaugacaccagaagaguga

SEQ ID NO: 745208 - RNA, 19 nt, Homo sapiens
ugaaaagauugcagaguua

SEQ ID NO: 745209 - RNA, 19 nt, Homo sapiens
ggagggaggaaacaguuaa

SEQ ID NO: 745210 - RNA, 19 nt, Homo sapiens
ccaaagugcugggauuaca

SEQ ID NO: 745211 - RNA, 19 nt, Homo sapiens
acguagggcugaaggauaa

SEQ ID NO: 745212 - RNA, 19 nt, Homo sapiens
ccagauggcugaguuggau

SEQ ID NO: 745213 - RNA, 19 nt, Homo sapiens
gaccacaacuggcgauacu

SEQ ID NO: 745214 - RNA, 19 nt, Homo sapiens
cagcuacagugaugggauu

SEQ ID NO: 745215 - RNA, 19 nt, Homo sapiens
ggaagaggaguaugacauc

SEQ ID NO: 745216 - RNA, 19 nt, Homo sapiens
gcagggagacggaggaaca

SEQ ID NO: 745217 - RNA, 19 nt, Homo sapiens
ccaagggacagaagaaaga

SEQ ID NO: 745218 - RNA, 19 nt, Homo sapiens
gcaaguuuaagaacacuga

SEQ ID NO: 745219 - RNA, 19 nt, Homo sapiens
ucuccucucuguucaggua

SEQ ID NO: 745220 - RNA, 19 nt, Homo sapiens
aaaucucccucaucuucua

SEQ ID NO: 745221 - RNA, 19 nt, Homo sapiens
ccaugacucugguucacaa

SEQ ID NO: 745222 - RNA, 19 nt, Homo sapiens
ggagggauccuuuccuucu

SEQ ID NO: 745223 - RNA, 19 nt, Homo sapiens
ucuccaggcuccaggcuaa

SEQ ID NO: 745224 - RNA, 19 nt, Homo sapiens
ccgaguagcugggauuaca

SEQ ID NO: 745225 - RNA, 19 nt, Homo sapiens
gcacccaguuagacuugga

SEQ ID NO: 745226 - RNA, 19 nt, Homo sapiens
gaagagugaaggcagugaa

SEQ ID NO: 745227 - RNA, 19 nt, Homo sapiens
gacggagucucgcacuguu

SEQ ID NO: 745228 - RNA, 19 nt, Homo sapiens
ggacaaggaggcugaacuc

SEQ ID NO: 745229 - RNA, 19 nt, Homo sapiens
ccaggcagaucucaaacuc

SEQ ID NO: 745230 - RNA, 19 nt, Homo sapiens
ccacacccagcuaauguuu

SEQ ID NO: 745231 - RNA, 19 nt, Homo sapiens
gacuugggcugcacagauc

SEQ ID NO: 745232 - RNA, 19 nt, Homo sapiens
cuauguguuugcaguaauu

SEQ ID NO: 745233 - RNA, 19 nt, Homo sapiens
uaugcugccuucuggcuuu

SEQ ID NO: 745234 - RNA, 19 nt, Homo sapiens
gcgugguucucuugucuga

SEQ ID NO: 745235 - RNA, 19 nt, Homo sapiens
agaggaguaugacaucaga

SEQ ID NO: 745236 - RNA, 19 nt, Homo sapiens
gcuggagaacuauaagaaa

SEQ ID NO: 745237 - RNA, 19 nt, Homo sapiens
ggucaaagcgguggcugaa

SEQ ID NO: 745238 - RNA, 19 nt, Homo sapiens
cauggugaauuacugugaa

SEQ ID NO: 745239 - RNA, 19 nt, Homo sapiens
gugcuguucucuauguguu

SEQ ID NO: 745240 - RNA, 19 nt, Homo sapiens
gggagggaggaaacaguua

SEQ ID NO: 745241 - RNA, 19 nt, Homo sapiens
ucaaggcccaccuggagua

SEQ ID NO: 745242 - RNA, 19 nt, Homo sapiens
ucgggcauccgcaaaguua

SEQ ID NO: 745243 - RNA, 19 nt, Homo sapiens
aagaguggcugaaaagauu

SEQ ID NO: 745244 - RNA, 19 nt, Homo sapiens
gcuguucucuauguguuug

SEQ ID NO: 745245 - RNA, 19 nt, Homo sapiens
caauaugcguaugacauca

SEQ ID NO: 745246 - RNA, 19 nt, Homo sapiens
gugccgagauggagaagag

SEQ ID NO: 745247 - RNA, 19 nt, Homo sapiens
guagcuggcuuuugaaauc

SEQ ID NO: 745248 - RNA, 19 nt, Homo sapiens
cgggagggauccuuuccuu

SEQ ID NO: 745249 - RNA, 19 nt, Homo sapiens
caaaggcaucgaccggaaa

SEQ ID NO: 745250 - RNA, 19 nt, Homo sapiens
gcaccaaaucucccucauc

SEQ ID NO: 745251 - RNA, 19 nt, Homo sapiens
uggcugaguuggaucuaau

SEQ ID NO: 745252 - RNA, 19 nt, Homo sapiens
guaaugaguggccgagcuu

SEQ ID NO: 745253 - RNA, 19 nt, Homo sapiens
ccaauaugcguaugacauc

SEQ ID NO: 745254 - RNA, 19 nt, Homo sapiens
gagggaggaaacaguuaaa

SEQ ID NO: 745255 - RNA, 19 nt, Homo sapiens
gcauggugaauuacuguga

SEQ ID NO: 745256 - RNA, 19 nt, Homo sapiens
gccauucuccucucuguuc

SEQ ID NO: 745257 - RNA, 19 nt, Homo sapiens
cagcgcaaauauuggacuu

SEQ ID NO: 745258 - RNA, 19 nt, Homo sapiens
gacaucagaacucaagugu

SEQ ID NO: 745259 - RNA, 19 nt, Homo sapiens
aaagauugcagaguuauca

SEQ ID NO: 745260 - RNA, 19 nt, Homo sapiens
ccucccagauggcugaguu

SEQ ID NO: 745261 - RNA, 19 nt, Homo sapiens
ggaggaaacaguuaaaauc

SEQ ID NO: 745262 - RNA, 19 nt, Homo sapiens
gagcaguggcgcgaucuug

SEQ ID NO: 745263 - RNA, 19 nt, Homo sapiens
auauggugcuguucucuau

SEQ ID NO: 745264 - RNA, 19 nt, Homo sapiens
acacagcacacaaguaucu

SEQ ID NO: 745265 - RNA, 19 nt, Homo sapiens
uggcugaaaugcaguuugg

SEQ ID NO: 745266 - RNA, 19 nt, Homo sapiens
gaacaucaaacugcaaagc

SEQ ID NO: 745267 - RNA, 19 nt, Homo sapiens
cugaaaagauugcagaguu

SEQ ID NO: 745268 - RNA, 19 nt, Homo sapiens
ggagugccgagauggagaa

SEQ ID NO: 745269 - RNA, 19 nt, Homo sapiens
caaagcgguggcugaaaug

SEQ ID NO: 745270 - RNA, 19 nt, Homo sapiens
gugaacaucaaacugcaaa

SEQ ID NO: 745271 - RNA, 19 nt, Homo sapiens
cgcaucaggugaacaucaa

SEQ ID NO: 745272 - RNA, 19 nt, Homo sapiens
gcugaugguagcuggcuuu

SEQ ID NO: 745273 - RNA, 19 nt, Homo sapiens
guucagcgcaaauauugga

SEQ ID NO: 745274 - RNA, 19 nt, Homo sapiens
agcaggagcuggagaggau

SEQ ID NO: 745275 - RNA, 19 nt, Homo sapiens
gaauccacuguacacuuaa

SEQ ID NO: 745276 - RNA, 19 nt, Homo sapiens
cauauggugcuguucucua

SEQ ID NO: 745277 - RNA, 19 nt, Homo sapiens
gggauccuuuccuucuaug

SEQ ID NO: 745278 - RNA, 19 nt, Homo sapiens
gcaucugccaggacuguug

SEQ ID NO: 745279 - RNA, 19 nt, Homo sapiens
gggcauauguaucuuuaua

SEQ ID NO: 745280 - RNA, 19 nt, Homo sapiens
aaacgggacuuucuauuaa

SEQ ID NO: 745281 - RNA, 19 nt, Homo sapiens
gaacaaagaccaagaccaa

SEQ ID NO: 745282 - RNA, 19 nt, Homo sapiens
gagaagcaccuauugauaa

SEQ ID NO: 745283 - RNA, 19 nt, Homo sapiens
gcacagauccugaagaugu

SEQ ID NO: 745284 - RNA, 19 nt, Homo sapiens
gaaguuaaauggcacagau

SEQ ID NO: 745285 - RNA, 19 nt, Homo sapiens
agacaaagaugacugaaau

SEQ ID NO: 745286 - RNA, 19 nt, Homo sapiens
ggaagaauccaacugauga

SEQ ID NO: 745287 - RNA, 19 nt, Homo sapiens
aaagaggccuucaacauga

SEQ ID NO: 745288 - RNA, 19 nt, Homo sapiens
gaauccaacugaugaguau

SEQ ID NO: 745289 - RNA, 19 nt, Homo sapiens
gaaaugccuuugcuugcuu

SEQ ID NO: 745290 - RNA, 19 nt, Homo sapiens
guagcaggguggugugaua

SEQ ID NO: 745291 - RNA, 19 nt, Homo sapiens
agaagcaacuggcaccaua

SEQ ID NO: 745292 - RNA, 19 nt, Homo sapiens
caaagaggccuucaacaug

SEQ ID NO: 745293 - RNA, 19 nt, Homo sapiens
uggaugagcuguacagaga

SEQ ID NO: 745294 - RNA, 19 nt, Homo sapiens
guacagagaagcaccuauu

SEQ ID NO: 745295 - RNA, 19 nt, Homo sapiens
acaggaagauuacuugaga

SEQ ID NO: 745296 - RNA, 19 nt, Homo sapiens
agaagcaccuauugauaaa

SEQ ID NO: 745297 - RNA, 19 nt, Homo sapiens
ugagagagcugcugacaac

SEQ ID NO: 745298 - RNA, 19 nt, Homo sapiens
gcaccauacaggaagauua

SEQ ID NO: 745299 - RNA, 19 nt, Homo sapiens
uagaugccaugaugaauga

SEQ ID NO: 745300 - RNA, 19 nt, Homo sapiens
caauguguuugcuauguuu

SEQ ID NO: 745301 - RNA, 19 nt, Homo sapiens
gccauucccuuaggcuuua

SEQ ID NO: 745302 - RNA, 19 nt, Homo sapiens
caauaacugugggucuaua

SEQ ID NO: 745303 - RNA, 19 nt, Homo sapiens
caaggaagauuugcaugau

SEQ ID NO: 745304 - RNA, 19 nt, Homo sapiens
guaucuagaugccaugaug

SEQ ID NO: 745305 - RNA, 19 nt, Homo sapiens
ggaaguggaugagcuguac

SEQ ID NO: 745306 - RNA, 19 nt, Homo sapiens
gggaucgguuuacagauga

SEQ ID NO: 745307 - RNA, 19 nt, Homo sapiens
cauguuuggugagaaguua

SEQ ID NO: 745308 - RNA, 19 nt, Homo sapiens
gaucagaacagagaugguu

SEQ ID NO: 745309 - RNA, 19 nt, Homo sapiens
caaagacaaagaugacuga

SEQ ID NO: 745310 - RNA, 19 nt, Homo sapiens
aaggaagauuugcaugaua

SEQ ID NO: 745311 - RNA, 19 nt, Homo sapiens
ccugaaacauggagccaaa

SEQ ID NO: 745312 - RNA, 19 nt, Homo sapiens
ucaaagaggccuucaacau

SEQ ID NO: 745313 - RNA, 19 nt, Homo sapiens
ccaauguguuugcuauguu

SEQ ID NO: 745314 - RNA, 19 nt, Homo sapiens
cauccaauguguuugcuau

SEQ ID NO: 745315 - RNA, 19 nt, Homo sapiens
ugcauuuccuguuguauuu

SEQ ID NO: 745316 - RNA, 19 nt, Homo sapiens
agagaagcaccuauugaua

SEQ ID NO: 745317 - RNA, 19 nt, Homo sapiens
caacugaugaguaucuaga

SEQ ID NO: 745318 - RNA, 19 nt, Homo sapiens
aggaagauuugcaugauau

SEQ ID NO: 745319 - RNA, 19 nt, Homo sapiens
caaagaccaagaccaagaa

SEQ ID NO: 745320 - RNA, 19 nt, Homo sapiens
gacaaagaugacugaaaua

SEQ ID NO: 745321 - RNA, 19 nt, Homo sapiens
ucacacgcauccugaaaca

SEQ ID NO: 745322 - RNA, 19 nt, Homo sapiens
agucacagauucaggaguu

SEQ ID NO: 745323 - RNA, 19 nt, Homo sapiens
gagccaaagacaaagauga

SEQ ID NO: 745324 - RNA, 19 nt, Homo sapiens
uggcacagauccugaagau

SEQ ID NO: 745325 - RNA, 19 nt, Homo sapiens
gggaagaauccaacugaug

SEQ ID NO: 745326 - RNA, 19 nt, Homo sapiens
ugauaugcuugcuucauug

SEQ ID NO: 745327 - RNA, 19 nt, Homo sapiens
gaugagcuguacagagaag

SEQ ID NO: 745328 - RNA, 19 nt, Homo sapiens
caucagaaaugccuuugcu

SEQ ID NO: 745329 - RNA, 19 nt, Homo sapiens
acgggacuuucuauuaaua

SEQ ID NO: 745330 - RNA, 19 nt, Homo sapiens
cagagaagcaccuauugau

SEQ ID NO: 745331 - RNA, 19 nt, Homo sapiens
gagagcugcugacaaccau

SEQ ID NO: 745332 - RNA, 19 nt, Homo sapiens
acaaggaagauuugcauga

SEQ ID NO: 745333 - RNA, 19 nt, Homo sapiens
uugggcauauguaucuuua

SEQ ID NO: 745334 - RNA, 19 nt, Homo sapiens
ccuguuguauuuauucuca

SEQ ID NO: 745335 - RNA, 19 nt, Homo sapiens
acaaagaccaagaccaaga

SEQ ID NO: 745336 - RNA, 19 nt, Homo sapiens
gaagggugcucggauucuc

SEQ ID NO: 745337 - RNA, 19 nt, Homo sapiens
acauggagccaaagacaaa

SEQ ID NO: 745338 - RNA, 19 nt, Homo sapiens
aaacauggagccaaagaca

SEQ ID NO: 745339 - RNA, 19 nt, Homo sapiens
gcauuuccuguuguauuua

SEQ ID NO: 745340 - RNA, 19 nt, Homo sapiens
acacgcauccugaaacaug

SEQ ID NO: 745341 - RNA, 19 nt, Homo sapiens
cagaugaggaaguggauga

SEQ ID NO: 745342 - RNA, 19 nt, Homo sapiens
ucggaagggugcucggauu

SEQ ID NO: 745343 - RNA, 19 nt, Homo sapiens
ucaauuacaucgaguucac

SEQ ID NO: 745344 - RNA, 19 nt, Homo sapiens
acagagaagcaccuauuga

SEQ ID NO: 745345 - RNA, 19 nt, Homo sapiens
ccaccaccaugucgagcaa

SEQ ID NO: 745346 - RNA, 19 nt, Homo sapiens
ccaucaauuucaccauguu

SEQ ID NO: 745347 - RNA, 19 nt, Homo sapiens
ggucuauacagagucaaua

SEQ ID NO: 745348 - RNA, 19 nt, Homo sapiens
gggacuuucuauuaauauc

SEQ ID NO: 745349 - RNA, 19 nt, Homo sapiens
guauuuauucucagccauu

SEQ ID NO: 745350 - RNA, 19 nt, Homo sapiens
caaagaugacugaaauaac

SEQ ID NO: 745351 - RNA, 19 nt, Homo sapiens
aaaguuaguucggcucgau

SEQ ID NO: 745352 - RNA, 19 nt, Homo sapiens
uuuagcagcuuugcauuuc

SEQ ID NO: 745353 - RNA, 19 nt, Homo sapiens
cuagaugccaugaugaaug

SEQ ID NO: 745354 - RNA, 19 nt, Homo sapiens
agaauccaacugaugagua

SEQ ID NO: 745355 - RNA, 19 nt, Homo sapiens
cgacaaggaagauuugcau

SEQ ID NO: 745356 - RNA, 19 nt, Homo sapiens
ugaaacauggagccaaaga

SEQ ID NO: 745357 - RNA, 19 nt, Homo sapiens
guuuacagaugaggaagug

SEQ ID NO: 745358 - RNA, 19 nt, Homo sapiens
cauacaggaagauuacuug

SEQ ID NO: 745359 - RNA, 19 nt, Homo sapiens
ggggaucgguuuacagaug

SEQ ID NO: 745360 - RNA, 19 nt, Homo sapiens
ggaagauuugcaugauaug

SEQ ID NO: 745361 - RNA, 19 nt, Homo sapiens
caucgacaaggaagauuug

SEQ ID NO: 745362 - RNA, 19 nt, Homo sapiens
guagcugugccgggacuua

SEQ ID NO: 745363 - RNA, 19 nt, Homo sapiens
aaaugccuuugcuugcuuu

SEQ ID NO: 745364 - RNA, 19 nt, Homo sapiens
gaagaauccaacugaugag

SEQ ID NO: 745365 - RNA, 19 nt, Homo sapiens
guucaaagaggccuucaac

SEQ ID NO: 745366 - RNA, 19 nt, Homo sapiens
agaaaugccuuugcuugcu

SEQ ID NO: 745367 - RNA, 19 nt, Homo sapiens
uccaauguguuugcuaugu

SEQ ID NO: 745368 - RNA, 19 nt, Homo sapiens
gugggucuauacagaguca

SEQ ID NO: 745369 - RNA, 19 nt, Homo sapiens
gacuuaaccaccaccaugu

SEQ ID NO: 745370 - RNA, 19 nt, Homo sapiens
ccaauaacugugggucuau

SEQ ID NO: 745371 - RNA, 19 nt, Homo sapiens
cagcuuugcauuuccuguu

SEQ ID NO: 745372 - RNA, 19 nt, Homo sapiens
ccauacaggaagauuacuu

SEQ ID NO: 745373 - RNA, 19 nt, Homo sapiens
gaagcaacuggcaccauac

SEQ ID NO: 745374 - RNA, 19 nt, Homo sapiens
ucaucgacaaggaagauuu

SEQ ID NO: 745375 - RNA, 19 nt, Homo sapiens
cuuuggguauucugagauu

SEQ ID NO: 745376 - RNA, 19 nt, Homo sapiens
cacuuuggguauucugaga

SEQ ID NO: 745377 - RNA, 19 nt, Homo sapiens
aagacaaagaugacugaaa

SEQ ID NO: 745378 - RNA, 19 nt, Homo sapiens
gaaacauggagccaaagac

SEQ ID NO: 745379 - RNA, 19 nt, Homo sapiens
gcacugagcuccacccuuu

SEQ ID NO: 745380 - RNA, 19 nt, Homo sapiens
gaagaugguugguuucaug

SEQ ID NO: 745381 - RNA, 19 nt, Homo sapiens
gaauacauguucccgaauu

SEQ ID NO: 745382 - RNA, 19 nt, Homo sapiens
gcaaacagacuucggagua

SEQ ID NO: 745383 - RNA, 19 nt, Homo sapiens
caugagaccuggaaacaaa

SEQ ID NO: 745384 - RNA, 19 nt, Homo sapiens
gagaagagccaauuuaaca

SEQ ID NO: 745385 - RNA, 19 nt, Homo sapiens
gaucugaacaucccugaua

SEQ ID NO: 745386 - RNA, 19 nt, Homo sapiens
caacuccucugcuagauga

SEQ ID NO: 745387 - RNA, 19 nt, Homo sapiens
caacaacaaugugcaguga

SEQ ID NO: 745388 - RNA, 19 nt, Homo sapiens
gagggcagguguucauaaa

SEQ ID NO: 745389 - RNA, 19 nt, Homo sapiens
gaagagccaauuuaacaaa

SEQ ID NO: 745390 - RNA, 19 nt, Homo sapiens
gaauauuccuuacugaucu

SEQ ID NO: 745391 - RNA, 19 nt, Homo sapiens
gauaggaacuuuggaccuu

SEQ ID NO: 745392 - RNA, 19 nt, Homo sapiens
gcagugagcauguggaaga

SEQ ID NO: 745393 - RNA, 19 nt, Homo sapiens
gagccaauuuaacaaacua

SEQ ID NO: 745394 - RNA, 19 nt, Homo sapiens
acacuuaccuugccaaugg

SEQ ID NO: 745395 - RNA, 19 nt, Homo sapiens
ugaaguuacucgugucaaa

SEQ ID NO: 745396 - RNA, 19 nt, Homo sapiens
ucaaacugcuuaagaauac

SEQ ID NO: 745397 - RNA, 19 nt, Homo sapiens
guucuuagcacuuuaauuc

SEQ ID NO: 745398 - RNA, 19 nt, Homo sapiens
gagcugauuugauggacaa

SEQ ID NO: 745399 - RNA, 19 nt, Homo sapiens
caaauacugccaugagaaa

SEQ ID NO: 745400 - RNA, 19 nt, Homo sapiens
caacaacuccucugcuaga

SEQ ID NO: 745401 - RNA, 19 nt, Homo sapiens
gaaguugucaucagucaga

SEQ ID NO: 745402 - RNA, 19 nt, Homo sapiens
gagagagcuuucccuguga

SEQ ID NO: 745403 - RNA, 19 nt, Homo sapiens
cgaaccagcucugagauga

SEQ ID NO: 745404 - RNA, 19 nt, Homo sapiens
uaacaaacuaggaagauga

SEQ ID NO: 745405 - RNA, 19 nt, Homo sapiens
agacagcccuaucuuuaug

SEQ ID NO: 745406 - RNA, 19 nt, Homo sapiens
gcaagagccuucggguuca

SEQ ID NO: 745407 - RNA, 19 nt, Homo sapiens
ugacauggauggcucucaa

SEQ ID NO: 745408 - RNA, 19 nt, Homo sapiens
cggaguaccugcgcuauga

SEQ ID NO: 745409 - RNA, 19 nt, Homo sapiens
gcacuuuaauuccugucaa

SEQ ID NO: 745410 - RNA, 19 nt, Homo sapiens
gaaaaggagguucuuaaaa

SEQ ID NO: 745411 - RNA, 19 nt, Homo sapiens
ccucugacuuccuaaugua

SEQ ID NO: 745412 - RNA, 19 nt, Homo sapiens
guggaggugugugaaguua

SEQ ID NO: 745413 - RNA, 19 nt, Homo sapiens
ggcugaagaugguugguuu

SEQ ID NO: 745414 - RNA, 19 nt, Homo sapiens
acgcuuaaaucaugugaaa

SEQ ID NO: 745415 - RNA, 19 nt, Homo sapiens
cgucauuucuaacucuuaa

SEQ ID NO: 745416 - RNA, 19 nt, Homo sapiens
guggagaagagccaauuua

SEQ ID NO: 745417 - RNA, 19 nt, Homo sapiens
cagcgcccauguugugaua

SEQ ID NO: 745418 - RNA, 19 nt, Homo sapiens
gcaaucuccugggccuuaa

SEQ ID NO: 745419 - RNA, 19 nt, Homo sapiens
gagaugaguuggguagauc

SEQ ID NO: 745420 - RNA, 19 nt, Homo sapiens
gucagaggcaaucauauua

SEQ ID NO: 745421 - RNA, 19 nt, Homo sapiens
gcacuguguucuccuacug

SEQ ID NO: 745422 - RNA, 19 nt, Homo sapiens
ggcagcagaucaggucuaa

SEQ ID NO: 745423 - RNA, 19 nt, Homo sapiens
caacucaagagacaaagaa

SEQ ID NO: 745424 - RNA, 19 nt, Homo sapiens
ggaaacaaauaugaguaca

SEQ ID NO: 745425 - RNA, 19 nt, Homo sapiens
gaaagugugggcugaagau

SEQ ID NO: 745426 - RNA, 19 nt, Homo sapiens
guuaggagauagggauauu

SEQ ID NO: 745427 - RNA, 19 nt, Homo sapiens
cccaacaacuccucugcua

SEQ ID NO: 745428 - RNA, 19 nt, Homo sapiens
agaccaaggugcugacuca

SEQ ID NO: 745429 - RNA, 19 nt, Homo sapiens
caugcugacuuugagaaua

SEQ ID NO: 745430 - RNA, 19 nt, Homo sapiens
ucugccaucuuaaauguaa

SEQ ID NO: 745431 - RNA, 19 nt, Homo sapiens
ucaacagucucgucaaugg

SEQ ID NO: 745432 - RNA, 19 nt, Homo sapiens
gugauguucuuagcacuuu

SEQ ID NO: 745433 - RNA, 19 nt, Homo sapiens
guaaguccuuggaauugau

SEQ ID NO: 745434 - RNA, 19 nt, Homo sapiens
gagcuuucccugugauuau

SEQ ID NO: 745435 - RNA, 19 nt, Homo sapiens
gcaaagggguuuccucgau

SEQ ID NO: 745436 - RNA, 19 nt, Homo sapiens
cagcuuuaccuacuuguuu

SEQ ID NO: 745437 - RNA, 19 nt, Homo sapiens
gcuccucccugcuauaugg

SEQ ID NO: 745438 - RNA, 19 nt, Homo sapiens
ucucuaggguuaagccaaa

SEQ ID NO: 745439 - RNA, 19 nt, Homo sapiens
ugaaacuggucuacugugu

SEQ ID NO: 745440 - RNA, 19 nt, Homo sapiens
gauaguuucgggucaggua

SEQ ID NO: 745441 - RNA, 19 nt, Homo sapiens
caccuuagccucugacuuc

SEQ ID NO: 745442 - RNA, 19 nt, Homo sapiens
cagaagcuccucccugcua

SEQ ID NO: 745443 - RNA, 19 nt, Homo sapiens
ggucuaagcagcagaacau

SEQ ID NO: 745444 - RNA, 19 nt, Homo sapiens
cagaggcaaucauauuauc

SEQ ID NO: 745445 - RNA, 19 nt, Homo sapiens
cagaaguugucaucaguca

SEQ ID NO: 745446 - RNA, 19 nt, Homo sapiens
uacugugucucuaggguua

SEQ ID NO: 745447 - RNA, 19 nt, Homo sapiens
aaacuggucuacugugucu

SEQ ID NO: 745448 - RNA, 19 nt, Homo sapiens
ggaaaaggagguucuuaaa

SEQ ID NO: 745449 - RNA, 19 nt, Homo sapiens
ucucagaucuccuugaaaa

SEQ ID NO: 745450 - RNA, 19 nt, Homo sapiens
ggaugucauuccugaagau

SEQ ID NO: 745451 - RNA, 19 nt, Homo sapiens
ucagucagaggcaaucaua

SEQ ID NO: 745452 - RNA, 19 nt, Homo sapiens
caaauaugaguacaaguuc

SEQ ID NO: 745453 - RNA, 19 nt, Homo sapiens
gaccuggaaacaaauauga

SEQ ID NO: 745454 - RNA, 19 nt, Homo sapiens
ggaggugugugaaguuacu

SEQ ID NO: 745455 - RNA, 19 nt, Homo sapiens
ccaaauacugccaugagaa

SEQ ID NO: 745456 - RNA, 19 nt, Homo sapiens
aggaggaacucuugaucaa

SEQ ID NO: 745457 - RNA, 19 nt, Homo sapiens
gcucuacggucaucuuugc

SEQ ID NO: 745458 - RNA, 19 nt, Homo sapiens
uggagaagagccaauuuaa

SEQ ID NO: 745459 - RNA, 19 nt, Homo sapiens
cauauuaucucagggacau

SEQ ID NO: 745460 - RNA, 19 nt, Homo sapiens
uaaccagcggcguauauuu

SEQ ID NO: 745461 - RNA, 19 nt, Homo sapiens
cauguaaguccuuggaauu

SEQ ID NO: 745462 - RNA, 19 nt, Homo sapiens
ggacaauggagagagcuuu

SEQ ID NO: 745463 - RNA, 19 nt, Homo sapiens
aaacucaggcccauccauu

SEQ ID NO: 745464 - RNA, 19 nt, Homo sapiens
ggcaaucuccugggccuua

SEQ ID NO: 745465 - RNA, 19 nt, Homo sapiens
ucauggugauguucaagaa

SEQ ID NO: 745466 - RNA, 19 nt, Homo sapiens
caaacagacuucggaguac

SEQ ID NO: 745467 - RNA, 19 nt, Homo sapiens
gaagcuccucccugcuaua

SEQ ID NO: 745468 - RNA, 19 nt, Homo sapiens
aaaguuuccugcauguuca

SEQ ID NO: 745469 - RNA, 19 nt, Homo sapiens
uaguggaucugguggaugu

SEQ ID NO: 745470 - RNA, 19 nt, Homo sapiens
caaguucggcuuugagcuu

SEQ ID NO: 745471 - RNA, 19 nt, Homo sapiens
gauguucuuagcacuuuaa

SEQ ID NO: 745472 - RNA, 19 nt, Homo sapiens
guugaauauuccuuacuga

SEQ ID NO: 745473 - RNA, 19 nt, Homo sapiens
cggaguggcuaaagugcuu

SEQ ID NO: 745474 - RNA, 19 nt, Homo sapiens
ccagccaacucaagagaca

SEQ ID NO: 745475 - RNA, 19 nt, Homo sapiens
uguaaguccuuggaauuga

SEQ ID NO: 745476 - RNA, 19 nt, Homo sapiens
ucauguaaguccuuggaau

SEQ ID NO: 745477 - RNA, 19 nt, Homo sapiens
ggagaagagccaauuuaac

SEQ ID NO: 745478 - RNA, 19 nt, Homo sapiens
gcucaaacugcuuaagaau

SEQ ID NO: 745479 - RNA, 19 nt, Homo sapiens
gcacggagccuauuucgua

SEQ ID NO: 745480 - RNA, 19 nt, Homo sapiens
cagaugaccuucucaagua

SEQ ID NO: 745481 - RNA, 19 nt, Homo sapiens
gcacuuucguuucaucaua

SEQ ID NO: 745482 - RNA, 19 nt, Homo sapiens
cagaauagcucucaguuca

SEQ ID NO: 745483 - RNA, 19 nt, Homo sapiens
gaauagcucucaguucaug

SEQ ID NO: 745484 - RNA, 19 nt, Homo sapiens
cagacgaacuccaagauug

SEQ ID NO: 745485 - RNA, 19 nt, Homo sapiens
ggacagccuucucuuucaa

SEQ ID NO: 745486 - RNA, 19 nt, Homo sapiens
gcuggaugauuauucagua

SEQ ID NO: 745487 - RNA, 19 nt, Homo sapiens
aggcugugcuggaugauua

SEQ ID NO: 745488 - RNA, 19 nt, Homo sapiens
gccggaagcugacgguuga

SEQ ID NO: 745489 - RNA, 19 nt, Homo sapiens
gaaccuggcaccucaagga

SEQ ID NO: 745490 - RNA, 19 nt, Homo sapiens
cuucguuccuuguaaauaa

SEQ ID NO: 745491 - RNA, 19 nt, Homo sapiens
caaaggcugugcugagaca

SEQ ID NO: 745492 - RNA, 19 nt, Homo sapiens
ggaggacccuucucuuucg

SEQ ID NO: 745493 - RNA, 19 nt, Homo sapiens
gggacagccuucucuuuca

SEQ ID NO: 745494 - RNA, 19 nt, Homo sapiens
guagagcgacugcugaaga

SEQ ID NO: 745495 - RNA, 19 nt, Homo sapiens
gcagacgaacuccaagauu

SEQ ID NO: 745496 - RNA, 19 nt, Homo sapiens
gagcgacugcugaagauga

SEQ ID NO: 745497 - RNA, 19 nt, Homo sapiens
ugaaaucuguaagccauga

SEQ ID NO: 745498 - RNA, 19 nt, Homo sapiens
ggacuacucgcuguacuug

SEQ ID NO: 745499 - RNA, 19 nt, Homo sapiens
ggagggugaacucuacuuu

SEQ ID NO: 745500 - RNA, 19 nt, Homo sapiens
gcucucaguucaugaagca

SEQ ID NO: 745501 - RNA, 19 nt, Homo sapiens
ggaugauuauucaguaucu

SEQ ID NO: 745502 - RNA, 19 nt, Homo sapiens
ugagagaggccacgcagaa

SEQ ID NO: 745503 - RNA, 19 nt, Homo sapiens
gaugauccgcaacugauga

SEQ ID NO: 745504 - RNA, 19 nt, Homo sapiens
agagaggccacgcagaaua

SEQ ID NO: 745505 - RNA, 19 nt, Homo sapiens
gccuggagcugagcgauga

SEQ ID NO: 745506 - RNA, 19 nt, Homo sapiens
gcagaauagcucucaguuc

SEQ ID NO: 745507 - RNA, 19 nt, Homo sapiens
gccaugaccuggagcaacu

SEQ ID NO: 745508 - RNA, 19 nt, Homo sapiens
gcacuccugccuuacuuug

SEQ ID NO: 745509 - RNA, 19 nt, Homo sapiens
gagaggccacgcagaauag

SEQ ID NO: 745510 - RNA, 19 nt, Homo sapiens
cagcuuggccacacgcuuu

SEQ ID NO: 745511 - RNA, 19 nt, Homo sapiens
ccggaggacccuucucuuu

SEQ ID NO: 745512 - RNA, 19 nt, Homo sapiens
cacggagccuauuucguaa

SEQ ID NO: 745513 - RNA, 19 nt, Homo sapiens
cccaaaggcugugcugaga

SEQ ID NO: 745514 - RNA, 19 nt, Homo sapiens
uagagcgacugcugaagau

SEQ ID NO: 745515 - RNA, 19 nt, Homo sapiens
gcagaggacgugugcuauc

SEQ ID NO: 745516 - RNA, 19 nt, Homo sapiens
ugccuuacuuuguuuaugu

SEQ ID NO: 745517 - RNA, 19 nt, Homo sapiens
ccuuguaaguggccucuau

SEQ ID NO: 745518 - RNA, 19 nt, Homo sapiens
acccacaccuguccaccua

SEQ ID NO: 745519 - RNA, 19 nt, Homo sapiens
uggaggcugugugugguua

SEQ ID NO: 745520 - RNA, 19 nt, Homo sapiens
gcccagugcugugucuuca

SEQ ID NO: 745521 - RNA, 19 nt, Homo sapiens
cagggagggugaacucuac

SEQ ID NO: 745522 - RNA, 19 nt, Homo sapiens
ccagggagggugaacucua

SEQ ID NO: 745523 - RNA, 19 nt, Homo sapiens
ggugacucgugcugugcua

SEQ ID NO: 745524 - RNA, 19 nt, Homo sapiens
ugacagaugaccuucucaa

SEQ ID NO: 745525 - RNA, 19 nt, Homo sapiens
ucgcagaggacgugugcua

SEQ ID NO: 745526 - RNA, 19 nt, Homo sapiens
gagagaggccacgcagaau

SEQ ID NO: 745527 - RNA, 19 nt, Homo sapiens
ggagcucuacgccuucuuc

SEQ ID NO: 745528 - RNA, 19 nt, Homo sapiens
acuccugccuuacuuuguu

SEQ ID NO: 745529 - RNA, 19 nt, Homo sapiens
cgugugcuaucgucugaga

SEQ ID NO: 745530 - RNA, 19 nt, Homo sapiens
acagaugaccuucucaagu

SEQ ID NO: 745531 - RNA, 19 nt, Homo sapiens
gcugacggcaagcgccaua

SEQ ID NO: 745532 - RNA, 19 nt, Homo sapiens
guucaugaagcacaccaaa

SEQ ID NO: 745533 - RNA, 19 nt, Homo sapiens
cggaggacccuucucuuuc

SEQ ID NO: 745534 - RNA, 19 nt, Homo sapiens
cggagccuauuucguaauc

SEQ ID NO: 745535 - RNA, 19 nt, Homo sapiens
ucagaguucaugucuccua

SEQ ID NO: 745536 - RNA, 19 nt, Homo sapiens
ggcccuggcuaccaacauc

SEQ ID NO: 745537 - RNA, 19 nt, Homo sapiens
gagggugaacucuacuuuc

SEQ ID NO: 745538 - RNA, 19 nt, Homo sapiens
ugugcuggaugauuauuca

SEQ ID NO: 745539 - RNA, 19 nt, Homo sapiens
ggugggcaguguccucuac

SEQ ID NO: 745540 - RNA, 19 nt, Homo sapiens
cacaucuucuggacucaug

SEQ ID NO: 745541 - RNA, 19 nt, Homo sapiens
cagaggacgugugcuaucg

SEQ ID NO: 745542 - RNA, 19 nt, Homo sapiens
caguagaacgaguccugua

SEQ ID NO: 745543 - RNA, 19 nt, Homo sapiens
ucaacagggcccucagaug

SEQ ID NO: 745544 - RNA, 19 nt, Homo sapiens
gacccuggccgacaucuac

SEQ ID NO: 745545 - RNA, 19 nt, Homo sapiens
ugcaggcugugcuggauga

SEQ ID NO: 745546 - RNA, 19 nt, Homo sapiens
gcugacgguugaggacuuc

SEQ ID NO: 745547 - RNA, 19 nt, Homo sapiens
gugcagaacccagcuuugg

SEQ ID NO: 745548 - RNA, 19 nt, Homo sapiens
ugggacagccuucucuuuc

SEQ ID NO: 745549 - RNA, 19 nt, Homo sapiens
ccacaccuguccaccuacu

SEQ ID NO: 745550 - RNA, 19 nt, Homo sapiens
gcucugcugccacuaugga

SEQ ID NO: 745551 - RNA, 19 nt, Homo sapiens
cacuuucguuucaucauag

SEQ ID NO: 745552 - RNA, 19 nt, Homo sapiens
gguggcacggagccuauuu

SEQ ID NO: 745553 - RNA, 19 nt, Homo sapiens
uaucuaaugcccaggucaa

SEQ ID NO: 745554 - RNA, 19 nt, Homo sapiens
cuggaugauuauucaguau

SEQ ID NO: 745555 - RNA, 19 nt, Homo sapiens
ccgcucugcugccacuaug

SEQ ID NO: 745556 - RNA, 19 nt, Homo sapiens
uccaggacuugcagacgaa

SEQ ID NO: 745557 - RNA, 19 nt, Homo sapiens
cuaaagagcugaaggguua

SEQ ID NO: 745558 - RNA, 19 nt, Homo sapiens
gaaaguggauggagacaca

SEQ ID NO: 745559 - RNA, 19 nt, Homo sapiens
ugagaaagaugguuuguca

SEQ ID NO: 745560 - RNA, 19 nt, Homo sapiens
caacaagugucaacagugu

SEQ ID NO: 745561 - RNA, 19 nt, Homo sapiens
ggaagguacucgcccuaaa

SEQ ID NO: 745562 - RNA, 19 nt, Homo sapiens
ggaaucaucguugugguua

SEQ ID NO: 745563 - RNA, 19 nt, Homo sapiens
gaagaugacccguggaaca

SEQ ID NO: 745564 - RNA, 19 nt, Homo sapiens
gaaagaugguuugucaaca

SEQ ID NO: 745565 - RNA, 19 nt, Homo sapiens
gacccugguuggaaucaua

SEQ ID NO: 745566 - RNA, 19 nt, Homo sapiens
gcaaaacuguauaaacuga

SEQ ID NO: 745567 - RNA, 19 nt, Homo sapiens
gagcaaaacuguauaaacu

SEQ ID NO: 745568 - RNA, 19 nt, Homo sapiens
gaagaugacacugagacua

SEQ ID NO: 745569 - RNA, 19 nt, Homo sapiens
gcacaggccagccagaaga

SEQ ID NO: 745570 - RNA, 19 nt, Homo sapiens
acacugagacuacagguuu

SEQ ID NO: 745571 - RNA, 19 nt, Homo sapiens
agacuuggcuccucuaaac

SEQ ID NO: 745572 - RNA, 19 nt, Homo sapiens
gaugguuugucaacaguga

SEQ ID NO: 745573 - RNA, 19 nt, Homo sapiens
gaccauuggaucgauauua

SEQ ID NO: 745574 - RNA, 19 nt, Homo sapiens
gagaagaugacccguggaa

SEQ ID NO: 745575 - RNA, 19 nt, Homo sapiens
ucgaggaucugccaacuuc

SEQ ID NO: 745576 - RNA, 19 nt, Homo sapiens
gaagguacucgcccuaaag

SEQ ID NO: 745577 - RNA, 19 nt, Homo sapiens
ggugucagcucugcucuuc

SEQ ID NO: 745578 - RNA, 19 nt, Homo sapiens
gcgaagaccgcuauaaguc

SEQ ID NO: 745579 - RNA, 19 nt, Homo sapiens
caacgggaacgauguggaa

SEQ ID NO: 745580 - RNA, 19 nt, Homo sapiens
gaaaauggagcaaaacugu

SEQ ID NO: 745581 - RNA, 19 nt, Homo sapiens
cauagaaaauggagcaaaa

SEQ ID NO: 745582 - RNA, 19 nt, Homo sapiens
gcacaguccacgcgcaaga

SEQ ID NO: 745583 - RNA, 19 nt, Homo sapiens
gaaucaucguugugguuau

SEQ ID NO: 745584 - RNA, 19 nt, Homo sapiens
ggcaacaagugucaacagu

SEQ ID NO: 745585 - RNA, 19 nt, Homo sapiens
cuauaagucuggcuugaca

SEQ ID NO: 745586 - RNA, 19 nt, Homo sapiens
uaacuaacacuggaccauu

SEQ ID NO: 745587 - RNA, 19 nt, Homo sapiens
caaaauaaccgaaggaaag

SEQ ID NO: 745588 - RNA, 19 nt, Homo sapiens
aaagaugguuugucaacag

SEQ ID NO: 745589 - RNA, 19 nt, Homo sapiens
uauaugcuguaaccaugaa

SEQ ID NO: 745590 - RNA, 19 nt, Homo sapiens
uaacaggcauucgcaucga

SEQ ID NO: 745591 - RNA, 19 nt, Homo sapiens
caacucugguggcaacaag

SEQ ID NO: 745592 - RNA, 19 nt, Homo sapiens
aaucauaguuggggucuua

SEQ ID NO: 745593 - RNA, 19 nt, Homo sapiens
acaagugucaacaguguaa

SEQ ID NO: 745594 - RNA, 19 nt, Homo sapiens
ccauuggaucgauauuaua

SEQ ID NO: 745595 - RNA, 19 nt, Homo sapiens
accauuggaucgauauuau

SEQ ID NO: 745596 - RNA, 19 nt, Homo sapiens
aacuaacacuggaccauug

SEQ ID NO: 745597 - RNA, 19 nt, Homo sapiens
aaagaccguuucugacucu

SEQ ID NO: 745598 - RNA, 19 nt, Homo sapiens
aaucaucguugugguuaug

SEQ ID NO: 745599 - RNA, 19 nt, Homo sapiens
ggauggagacacacagaca

SEQ ID NO: 745600 - RNA, 19 nt, Homo sapiens
uggcuccucuaaacauuug

SEQ ID NO: 745601 - RNA, 19 nt, Homo sapiens
gggaagguacucgcccuaa

SEQ ID NO: 745602 - RNA, 19 nt, Homo sapiens
gauggagacacacagacaa

SEQ ID NO: 745603 - RNA, 19 nt, Homo sapiens
gcauucgcaucgaggaucu

SEQ ID NO: 745604 - RNA, 19 nt, Homo sapiens
caugccaggugccgaagau

SEQ ID NO: 745605 - RNA, 19 nt, Homo sapiens
cagugacccugguuggaau

SEQ ID NO: 745606 - RNA, 19 nt, Homo sapiens
gagaaagaugguuugucaa

SEQ ID NO: 745607 - RNA, 19 nt, Homo sapiens
gcgcaagaacaaaguccaa

SEQ ID NO: 745608 - RNA, 19 nt, Homo sapiens
caggagagcaacaacucaa

SEQ ID NO: 745609 - RNA, 19 nt, Homo sapiens
caaacguggccaccaguca

SEQ ID NO: 745610 - RNA, 19 nt, Homo sapiens
caacaguguaacaggcauu

SEQ ID NO: 745611 - RNA, 19 nt, Homo sapiens
gagacacacagacaacagu

SEQ ID NO: 745612 - RNA, 19 nt, Homo sapiens
agaaagaugguuugucaac

SEQ ID NO: 745613 - RNA, 19 nt, Homo sapiens
gauguggugacuccaggaa

SEQ ID NO: 745614 - RNA, 19 nt, Homo sapiens
ugucagcucugcucuucgu

SEQ ID NO: 745615 - RNA, 19 nt, Homo sapiens
cagcacaggccagccagaa

SEQ ID NO: 745616 - RNA, 19 nt, Homo sapiens
caguugagaaagaugguuu

SEQ ID NO: 745617 - RNA, 19 nt, Homo sapiens
ggagacacacagacaacag

SEQ ID NO: 745618 - RNA, 19 nt, Homo sapiens
caggccagccagaagauga

SEQ ID NO: 745619 - RNA, 19 nt, Homo sapiens
acagugacccugguuggaa

SEQ ID NO: 745620 - RNA, 19 nt, Homo sapiens
ggaccauuggaucgauauu

SEQ ID NO: 745621 - RNA, 19 nt, Homo sapiens
cagcucugcucuucguuuu

SEQ ID NO: 745622 - RNA, 19 nt, Homo sapiens
aagaugguuugucaacagu

SEQ ID NO: 745623 - RNA, 19 nt, Homo sapiens
cgaagaugauguggugacu

SEQ ID NO: 745624 - RNA, 19 nt, Homo sapiens
gacaacaaaugguguaauu

SEQ ID NO: 745625 - RNA, 19 nt, Homo sapiens
ggaaccagauugcaacaaa

SEQ ID NO: 745626 - RNA, 19 nt, Homo sapiens
ugaaagagcuccugacaca

SEQ ID NO: 745627 - RNA, 19 nt, Homo sapiens
ccgaagcucuuaugaagua

SEQ ID NO: 745628 - RNA, 19 nt, Homo sapiens
ucaauaaccugaccuuaga

SEQ ID NO: 745629 - RNA, 19 nt, Homo sapiens
gguagcaccuucaaagaaa

SEQ ID NO: 745630 - RNA, 19 nt, Homo sapiens
uaaauacucuccaguguuc

SEQ ID NO: 745631 - RNA, 19 nt, Homo sapiens
gaacuguuaucccauugaa

SEQ ID NO: 745632 - RNA, 19 nt, Homo sapiens
ucaccaaggucaccaaauu

SEQ ID NO: 745633 - RNA, 19 nt, Homo sapiens
caaagaagcaaucaucaaa

SEQ ID NO: 745634 - RNA, 19 nt, Homo sapiens
gggaaugacuagugaagaa

SEQ ID NO: 745635 - RNA, 19 nt, Homo sapiens
gcaaacagcucagagucuu

SEQ ID NO: 745636 - RNA, 19 nt, Homo sapiens
gaaauacaauugagauagg

SEQ ID NO: 745637 - RNA, 19 nt, Homo sapiens
caacuuggauucugauauc

SEQ ID NO: 745638 - RNA, 19 nt, Homo sapiens
gagggaaauuguggaguua

SEQ ID NO: 745639 - RNA, 19 nt, Homo sapiens
cgagaagaacgaaucauua

SEQ ID NO: 745640 - RNA, 19 nt, Homo sapiens
gggaggagaucgagggaaa

SEQ ID NO: 745641 - RNA, 19 nt, Homo sapiens
gcacaaagaagcaaucauc

SEQ ID NO: 745642 - RNA, 19 nt, Homo sapiens
gaagaaacucugaagaaau

SEQ ID NO: 745643 - RNA, 19 nt, Homo sapiens
agaagaaacucugaagaaa

SEQ ID NO: 745644 - RNA, 19 nt, Homo sapiens
gaccgagccuuguauguau

SEQ ID NO: 745645 - RNA, 19 nt, Homo sapiens
gaaggucguucucagugaa

SEQ ID NO: 745646 - RNA, 19 nt, Homo sapiens
ggaaggucguucucaguga

SEQ ID NO: 745647 - RNA, 19 nt, Homo sapiens
gcucagagucuucguauau

SEQ ID NO: 745648 - RNA, 19 nt, Homo sapiens
gagaauggaaggaaugaaa

SEQ ID NO: 745649 - RNA, 19 nt, Homo sapiens
gaguuagccuccuguggua

SEQ ID NO: 745650 - RNA, 19 nt, Homo sapiens
caacaaaugguguaauuca

SEQ ID NO: 745651 - RNA, 19 nt, Homo sapiens
gaaccagauugcaacaaau

SEQ ID NO: 745652 - RNA, 19 nt, Homo sapiens
caacgcagcgcuauucuga

SEQ ID NO: 745653 - RNA, 19 nt, Homo sapiens
agacacaccuguuggaaau

SEQ ID NO: 745654 - RNA, 19 nt, Homo sapiens
guacagcugucugcauuga

SEQ ID NO: 745655 - RNA, 19 nt, Homo sapiens
caaaugguguaauucaugu

SEQ ID NO: 745656 - RNA, 19 nt, Homo sapiens
ggaaggaaauacaauugag

SEQ ID NO: 745657 - RNA, 19 nt, Homo sapiens
gagaaaucccuccaugaaa

SEQ ID NO: 745658 - RNA, 19 nt, Homo sapiens
caacugcuggaaauacuua

SEQ ID NO: 745659 - RNA, 19 nt, Homo sapiens
ugaaguaccacaucuuaaa

SEQ ID NO: 745660 - RNA, 19 nt, Homo sapiens
gcacuuguaagaacuggua

SEQ ID NO: 745661 - RNA, 19 nt, Homo sapiens
ccaaaguuguggaaccaaa

SEQ ID NO: 745662 - RNA, 19 nt, Homo sapiens
caauucaaaucgaagaguu

SEQ ID NO: 745663 - RNA, 19 nt, Homo sapiens
cauggagagccaauuauua

SEQ ID NO: 745664 - RNA, 19 nt, Homo sapiens
caauugagauaggauguga

SEQ ID NO: 745665 - RNA, 19 nt, Homo sapiens
ucucuacuauugcugcuua

SEQ ID NO: 745666 - RNA, 19 nt, Homo sapiens
gaauguugcccugguuaua

SEQ ID NO: 745667 - RNA, 19 nt, Homo sapiens
ugagggaaauuguggaguu

SEQ ID NO: 745668 - RNA, 19 nt, Homo sapiens
aacaauaacugaagugauc

SEQ ID NO: 745669 - RNA, 19 nt, Homo sapiens
gaaacaauaacugaaguga

SEQ ID NO: 745670 - RNA, 19 nt, Homo sapiens
gaaggacccacacuaacaa

SEQ ID NO: 745671 - RNA, 19 nt, Homo sapiens
uuauugagcuggcuggaaa

SEQ ID NO: 745672 - RNA, 19 nt, Homo sapiens
gaaggaaauacaauugaga

SEQ ID NO: 745673 - RNA, 19 nt, Homo sapiens
caucacaucggacauauug

SEQ ID NO: 745674 - RNA, 19 nt, Homo sapiens
ugaaacaucagcacaaaga

SEQ ID NO: 745675 - RNA, 19 nt, Homo sapiens
auacaacccuaagucaaua

SEQ ID NO: 745676 - RNA, 19 nt, Homo sapiens
ggaaauacaauugagauag

SEQ ID NO: 745677 - RNA, 19 nt, Homo sapiens
gaaguaccacaucuuaaau

SEQ ID NO: 745678 - RNA, 19 nt, Homo sapiens
uaugaaguaccacaucuua

SEQ ID NO: 745679 - RNA, 19 nt, Homo sapiens
uuaagggaaugacuaguga

SEQ ID NO: 745680 - RNA, 19 nt, Homo sapiens
uaaacgccaacaaucauua

SEQ ID NO: 745681 - RNA, 19 nt, Homo sapiens
gggacaacuuggauucuga

SEQ ID NO: 745682 - RNA, 19 nt, Homo sapiens
gaauguuugucauaugcuu

SEQ ID NO: 745683 - RNA, 19 nt, Homo sapiens
caugggaagcuaaguuaua

SEQ ID NO: 745684 - RNA, 19 nt, Homo sapiens
gaaaagaccgagccuugua

SEQ ID NO: 745685 - RNA, 19 nt, Homo sapiens
ccagauucauuacaauuca

SEQ ID NO: 745686 - RNA, 19 nt, Homo sapiens
uggagugccuguggaaaua

SEQ ID NO: 745687 - RNA, 19 nt, Homo sapiens
aaaagaaucugacaucaug

SEQ ID NO: 745688 - RNA, 19 nt, Homo sapiens
agaaauacuucagcacuug

SEQ ID NO: 745689 - RNA, 19 nt, Homo sapiens
caaggucaccaaauucauu

SEQ ID NO: 745690 - RNA, 19 nt, Homo sapiens
aagaagaggucaccaaggu

SEQ ID NO: 745691 - RNA, 19 nt, Homo sapiens
caagauaagcgcuuuagca

SEQ ID NO: 745692 - RNA, 19 nt, Homo sapiens
gaagaacgaaucauuacag

SEQ ID NO: 745693 - RNA, 19 nt, Homo sapiens
gauuaaagaaggugaaaca

SEQ ID NO: 745694 - RNA, 19 nt, Homo sapiens
gugacugucuauacaacua

SEQ ID NO: 745695 - RNA, 19 nt, Homo sapiens
auacacuucuggugaauga

SEQ ID NO: 745696 - RNA, 19 nt, Homo sapiens
ggagaaacggugcgauuca

SEQ ID NO: 745697 - RNA, 19 nt, Homo sapiens
caaugaggcuuuugagaaa

SEQ ID NO: 745698 - RNA, 19 nt, Homo sapiens
guaccucaauucaagacuu

SEQ ID NO: 745699 - RNA, 19 nt, Homo sapiens
gagaagaacgaaucauuac

SEQ ID NO: 745700 - RNA, 19 nt, Homo sapiens
agagaaaucccuccaugaa

SEQ ID NO: 745701 - RNA, 19 nt, Homo sapiens
ggaguaagcaagggagaaa

SEQ ID NO: 745702 - RNA, 19 nt, Homo sapiens
uagagcagcugccaucaca

SEQ ID NO: 745703 - RNA, 19 nt, Homo sapiens
gguugucacuguuaauugu

SEQ ID NO: 745704 - RNA, 19 nt, Homo sapiens
ugagaaacaugagggaaau

SEQ ID NO: 745705 - RNA, 19 nt, Homo sapiens
ggauuugaaccugguguua

SEQ ID NO: 745706 - RNA, 19 nt, Homo sapiens
ggagaaagggaguaagcaa

SEQ ID NO: 745707 - RNA, 19 nt, Homo sapiens
ggugugauccauuugauug

SEQ ID NO: 745708 - RNA, 19 nt, Homo sapiens
uuaaagaccacacaaggaa

SEQ ID NO: 745709 - RNA, 19 nt, Homo sapiens
acagcugucugcauugaaa

SEQ ID NO: 745710 - RNA, 19 nt, Homo sapiens
gcagaaucacauauugaaa

SEQ ID NO: 745711 - RNA, 19 nt, Homo sapiens
gacaaauaauggugugauc

SEQ ID NO: 745712 - RNA, 19 nt, Homo sapiens
uaauugugcucgaaucauc

SEQ ID NO: 745713 - RNA, 19 nt, Homo sapiens
gcaugauuauuccuucaau

SEQ ID NO: 745714 - RNA, 19 nt, Homo sapiens
ucagaauguuugucauaug

SEQ ID NO: 745715 - RNA, 19 nt, Homo sapiens
gaccaaggcccaaaugucu

SEQ ID NO: 745716 - RNA, 19 nt, Homo sapiens
agaaaucccuccaugaaaa

SEQ ID NO: 745717 - RNA, 19 nt, Homo sapiens
gaggccagauggagaauac

SEQ ID NO: 745718 - RNA, 19 nt, Homo sapiens
ggugacaguauaacaguaa

SEQ ID NO: 745719 - RNA, 19 nt, Homo sapiens
guagagguuuggagagcaa

SEQ ID NO: 745720 - RNA, 19 nt, Homo sapiens
gguaaaggaauugaagaaa

SEQ ID NO: 745721 - RNA, 19 nt, Homo sapiens
ggucauuuauuugaagaug

SEQ ID NO: 745722 - RNA, 19 nt, Homo sapiens
acacaccuguuggaaauga

SEQ ID NO: 745723 - RNA, 19 nt, Homo sapiens
gaagcaaaaucuuucugaa

SEQ ID NO: 745724 - RNA, 19 nt, Homo sapiens
ucaaacagcucacaguuaa

SEQ ID NO: 745725 - RNA, 19 nt, Homo sapiens
gaacagggugguauucuaa

SEQ ID NO: 745726 - RNA, 19 nt, Homo sapiens
ggacagagccauacaugug

SEQ ID NO: 745727 - RNA, 19 nt, Homo sapiens
uguaacaucuuuagcagua

SEQ ID NO: 745728 - RNA, 19 nt, Homo sapiens
guacuugucaucuugaaua

SEQ ID NO: 745729 - RNA, 19 nt, Homo sapiens
ugaaucaugucaguaguua

SEQ ID NO: 745730 - RNA, 19 nt, Homo sapiens
uaagcuggguugucuuuaa

SEQ ID NO: 745731 - RNA, 19 nt, Homo sapiens
gaaagacccuauugacaac

SEQ ID NO: 745732 - RNA, 19 nt, Homo sapiens
ccacugagguguugaugug

SEQ ID NO: 745733 - RNA, 19 nt, Homo sapiens
uaaggaagcugugcugaau

SEQ ID NO: 745734 - RNA, 19 nt, Homo sapiens
caucuucccuggaucuaaa

SEQ ID NO: 745735 - RNA, 19 nt, Homo sapiens
ccauacaugugaaaucuga

SEQ ID NO: 745736 - RNA, 19 nt, Homo sapiens
gaaauaguaguaccauaug

SEQ ID NO: 745737 - RNA, 19 nt, Homo sapiens
ccagaaccauggcccaauu

SEQ ID NO: 745738 - RNA, 19 nt, Homo sapiens
ccaaagugauagagaugaa

SEQ ID NO: 745739 - RNA, 19 nt, Homo sapiens
caaaauaccccaaagauau

SEQ ID NO: 745740 - RNA, 19 nt, Homo sapiens
aaggauauauguggcaaua

SEQ ID NO: 745741 - RNA, 19 nt, Homo sapiens
uagaguacuugucaucuug

SEQ ID NO: 745742 - RNA, 19 nt, Homo sapiens
agaaagacccuauugacaa

SEQ ID NO: 745743 - RNA, 19 nt, Homo sapiens
auauuaaccugguacauga

SEQ ID NO: 745744 - RNA, 19 nt, Homo sapiens
gcaguaggacagagccaua

SEQ ID NO: 745745 - RNA, 19 nt, Homo sapiens
gaauauagccuccccaaga

SEQ ID NO: 745746 - RNA, 19 nt, Homo sapiens
agaccaaucuuuaacaucu

SEQ ID NO: 745747 - RNA, 19 nt, Homo sapiens
aagcugugcugaaugguuu

SEQ ID NO: 745748 - RNA, 19 nt, Homo sapiens
gucacaauuucucuugaua

SEQ ID NO: 745749 - RNA, 19 nt, Homo sapiens
guuauucguuugucugguu

SEQ ID NO: 745750 - RNA, 19 nt, Homo sapiens
ggugaacgcugcugugacu

SEQ ID NO: 745751 - RNA, 19 nt, Homo sapiens
ggucacaauuucucuugau

SEQ ID NO: 745752 - RNA, 19 nt, Homo sapiens
ucacagaaagacccuauug

SEQ ID NO: 745753 - RNA, 19 nt, Homo sapiens
gcaauuggaaaggauauau

SEQ ID NO: 745754 - RNA, 19 nt, Homo sapiens
ccaugaaaggucacaauuu

SEQ ID NO: 745755 - RNA, 19 nt, Homo sapiens
ccugguacaugaauauaug

SEQ ID NO: 745756 - RNA, 19 nt, Homo sapiens
aagcuggguugucuuuaaa

SEQ ID NO: 745757 - RNA, 19 nt, Homo sapiens
ugaacgcugcugugacuua

SEQ ID NO: 745758 - RNA, 19 nt, Homo sapiens
agacugcuaucugaauaaa

SEQ ID NO: 745759 - RNA, 19 nt, Homo sapiens
gagagaacagggugguauu

SEQ ID NO: 745760 - RNA, 19 nt, Homo sapiens
gaaccauggcccaauuugu

SEQ ID NO: 745761 - RNA, 19 nt, Homo sapiens
ugccaaaguagaagaaaua

SEQ ID NO: 745762 - RNA, 19 nt, Homo sapiens
gaacgcugcugugacuuac

SEQ ID NO: 745763 - RNA, 19 nt, Homo sapiens
gacagagccauacauguga

SEQ ID NO: 745764 - RNA, 19 nt, Homo sapiens
cuugucaucuugaauauag

SEQ ID NO: 745765 - RNA, 19 nt, Homo sapiens
gaagcugugcugaaugguu

SEQ ID NO: 745766 - RNA, 19 nt, Homo sapiens
cagaaagacccuauugaca

SEQ ID NO: 745767 - RNA, 19 nt, Homo sapiens
cauuggcuaugauguuuga

SEQ ID NO: 745768 - RNA, 19 nt, Homo sapiens
gaagaaauaguaguaccau

SEQ ID NO: 745769 - RNA, 19 nt, Homo sapiens
gaccaugugugaucagacu

SEQ ID NO: 745770 - RNA, 19 nt, Homo sapiens
uuagaguacuugucaucuu

SEQ ID NO: 745771 - RNA, 19 nt, Homo sapiens
aggguuaggucuugggaaa

SEQ ID NO: 745772 - RNA, 19 nt, Homo sapiens
uaaccugguacaugaauau

SEQ ID NO: 745773 - RNA, 19 nt, Homo sapiens
ggugguauucuaaguaugu

SEQ ID NO: 745774 - RNA, 19 nt, Homo sapiens
caugucaguaguuagaaua

SEQ ID NO: 745775 - RNA, 19 nt, Homo sapiens
ccuaaauacacgucuguuu

SEQ ID NO: 745776 - RNA, 19 nt, Homo sapiens
uccguaaccuuguggagaa

SEQ ID NO: 745777 - RNA, 19 nt, Homo sapiens
gaguacuugucaucuugaa

SEQ ID NO: 745778 - RNA, 19 nt, Homo sapiens
uggcuaugauguuugaaga

SEQ ID NO: 745779 - RNA, 19 nt, Homo sapiens
uaaacaacccuaaauacac

SEQ ID NO: 745780 - RNA, 19 nt, Homo sapiens
gcuggguugucuuuaaaca

SEQ ID NO: 745781 - RNA, 19 nt, Homo sapiens
aaucaugucaguaguuaga

SEQ ID NO: 745782 - RNA, 19 nt, Homo sapiens
uaugauguuugaagaccaa

SEQ ID NO: 745783 - RNA, 19 nt, Homo sapiens
gguacuacgccaagguuga

SEQ ID NO: 745784 - RNA, 19 nt, Homo sapiens
guuguuggaccauguguga

SEQ ID NO: 745785 - RNA, 19 nt, Homo sapiens
uuaaccugguacaugaaua

SEQ ID NO: 745786 - RNA, 19 nt, Homo sapiens
cccuggaucuaaauaguau

SEQ ID NO: 745787 - RNA, 19 nt, Homo sapiens
acagagccauacaugugaa

SEQ ID NO: 745788 - RNA, 19 nt, Homo sapiens
cagggugguauucuaagua

SEQ ID NO: 745789 - RNA, 19 nt, Homo sapiens
caacuguuuucuuugcuaa

SEQ ID NO: 745790 - RNA, 19 nt, Homo sapiens
aauauuaaccugguacaug

SEQ ID NO: 745791 - RNA, 19 nt, Homo sapiens
gaccaaucuuuaacaucug

SEQ ID NO: 745792 - RNA, 19 nt, Homo sapiens
gguggccacugagguguug

SEQ ID NO: 745793 - RNA, 19 nt, Homo sapiens
uucaaacagcucacaguua

SEQ ID NO: 745794 - RNA, 19 nt, Homo sapiens
ccagaacagugaggguuag

SEQ ID NO: 745795 - RNA, 19 nt, Homo sapiens
cacagaaagacccuauuga

SEQ ID NO: 745796 - RNA, 19 nt, Homo sapiens
gaguguuguuggaccaugu

SEQ ID NO: 745797 - RNA, 19 nt, Homo sapiens
aggaagcugugcugaaugg

SEQ ID NO: 745798 - RNA, 19 nt, Homo sapiens
cagaaccauggcccaauuu

SEQ ID NO: 745799 - RNA, 19 nt, Homo sapiens
acaaaauaccccaaagaua

SEQ ID NO: 745800 - RNA, 19 nt, Homo sapiens
gguauucuaaguauguuuc

SEQ ID NO: 745801 - RNA, 19 nt, Homo sapiens
cagugaggguuaggucuug

SEQ ID NO: 745802 - RNA, 19 nt, Homo sapiens
gauauuaagcuggguuguc

SEQ ID NO: 745803 - RNA, 19 nt, Homo sapiens
agggugguauucuaaguau

SEQ ID NO: 745804 - RNA, 19 nt, Homo sapiens
ucaugucaguaguuagaau

SEQ ID NO: 745805 - RNA, 19 nt, Homo sapiens
uuaaggaagcugugcugaa

SEQ ID NO: 745806 - RNA, 19 nt, Homo sapiens
caauuggaaaggauauaug

SEQ ID NO: 745807 - RNA, 19 nt, Homo sapiens
gggcgacggacucuccauu

SEQ ID NO: 745808 - RNA, 19 nt, Homo sapiens
aauguuagaguacuuguca

SEQ ID NO: 745809 - RNA, 19 nt, Homo sapiens
aguaguaccauaugccaaa

SEQ ID NO: 745810 - RNA, 19 nt, Homo sapiens
uggcaauauuaaccuggua

SEQ ID NO: 745811 - RNA, 19 nt, Homo sapiens
uuuagcaucuucccuggau

SEQ ID NO: 745812 - RNA, 19 nt, Homo sapiens
gagccauacaugugaaauc

SEQ ID NO: 745813 - RNA, 19 nt, Homo sapiens
auauuaagcuggguugucu

SEQ ID NO: 745814 - RNA, 19 nt, Homo sapiens
gcaucuucccuggaucuaa

SEQ ID NO: 745815 - RNA, 19 nt, Homo sapiens
ccccaaagauauuuaaaca

SEQ ID NO: 745816 - RNA, 19 nt, Homo sapiens
acagaaagacccuauugac

SEQ ID NO: 745817 - RNA, 19 nt, Homo sapiens
uccagaacagugaggguua

SEQ ID NO: 745818 - RNA, 19 nt, Homo sapiens
gcaauauuaaccugguaca

SEQ ID NO: 745819 - RNA, 19 nt, Homo sapiens
gauguuugaagaccaaucu

SEQ ID NO: 745820 - RNA, 19 nt, Homo sapiens
uaggacagagccauacaug

SEQ ID NO: 745821 - RNA, 19 nt, Homo sapiens
acagggugguauucuaagu

SEQ ID NO: 745822 - RNA, 19 nt, Homo sapiens
ccaauuuguccguaaccuu

SEQ ID NO: 745823 - RNA, 19 nt, Homo sapiens
guaguaccauaugccaaag

SEQ ID NO: 745824 - RNA, 19 nt, Homo sapiens
ggaaaggacuuggcuauga

SEQ ID NO: 745825 - RNA, 19 nt, Homo sapiens
gaaaggacuuggcuaugaa

SEQ ID NO: 745826 - RNA, 19 nt, Homo sapiens
gagcuucacuggacauauu

SEQ ID NO: 745827 - RNA, 19 nt, Homo sapiens
gcuaugaacuugacuggaa

SEQ ID NO: 745828 - RNA, 19 nt, Homo sapiens
ggacuuggcuaugaacuug

SEQ ID NO: 745829 - RNA, 19 nt, Homo sapiens
ggaagucuccgcccugauu

SEQ ID NO: 745830 - RNA, 19 nt, Homo sapiens
ucacuggacauauucuuua

SEQ ID NO: 745831 - RNA, 19 nt, Homo sapiens
ggagaugaccaguccuuuc

SEQ ID NO: 745832 - RNA, 19 nt, Homo sapiens
gagaugaccaguccuuucu

SEQ ID NO: 745833 - RNA, 19 nt, Homo sapiens
ccacaccuaccacgggaua

SEQ ID NO: 745834 - RNA, 19 nt, Homo sapiens
cuaugaacuugacuggaaa

SEQ ID NO: 745835 - RNA, 19 nt, Homo sapiens
gaagucuccgcccugauug

SEQ ID NO: 745836 - RNA, 19 nt, Homo sapiens
gcuccaacccagucuccua

SEQ ID NO: 745837 - RNA, 19 nt, Homo sapiens
ggacgggaucgcccaacuu

SEQ ID NO: 745838 - RNA, 19 nt, Homo sapiens
gcgcugcagccucauguga

SEQ ID NO: 745839 - RNA, 19 nt, Homo sapiens
cacuggacauauucuuuau

SEQ ID NO: 745840 - RNA, 19 nt, Homo sapiens
gggcaagacggccaucauc

SEQ ID NO: 745841 - RNA, 19 nt, Homo sapiens
gacgggaucgcccaacuuc

SEQ ID NO: 745842 - RNA, 19 nt, Homo sapiens
caccuaccacgggauaaua

SEQ ID NO: 745843 - RNA, 19 nt, Homo sapiens
gcacgugcugcgucucuuc

SEQ ID NO: 745844 - RNA, 19 nt, Homo sapiens
gcccggacaguuucgacua

SEQ ID NO: 745845 - RNA, 19 nt, Homo sapiens
cgagugcuccgccaaguac

SEQ ID NO: 745846 - RNA, 19 nt, Homo sapiens
ggaguggccagacgcuaag

SEQ ID NO: 745847 - RNA, 19 nt, Homo sapiens
gagcguugcuauuuaauua

SEQ ID NO: 745848 - RNA, 19 nt, Homo sapiens
gggacacgcuggagcauua

SEQ ID NO: 745849 - RNA, 19 nt, Homo sapiens
gaugagcguugcuauuuaa

SEQ ID NO: 745850 - RNA, 19 nt, Homo sapiens
ggaugagcguugcuauuua

SEQ ID NO: 745851 - RNA, 19 nt, Homo sapiens
gggaugagcguugcuauuu

SEQ ID NO: 745852 - RNA, 19 nt, Homo sapiens
ggaccucuguuguacauuc

SEQ ID NO: 745853 - RNA, 19 nt, Homo sapiens
caccugcccugaccaguuu

SEQ ID NO: 745854 - RNA, 19 nt, Homo sapiens
gaccguaaacccucacgua

SEQ ID NO: 745855 - RNA, 19 nt, Homo sapiens
cggaggugcucauguuuga

SEQ ID NO: 745856 - RNA, 19 nt, Homo sapiens
gaugacucccguuagcuua

SEQ ID NO: 745857 - RNA, 19 nt, Homo sapiens
caaugggaccucuguugua

SEQ ID NO: 745858 - RNA, 19 nt, Homo sapiens
acacacagccagaccguaa

SEQ ID NO: 745859 - RNA, 19 nt, Homo sapiens
gcaccugcccugaccaguu

SEQ ID NO: 745860 - RNA, 19 nt, Homo sapiens
caacguggccaccuucauc

SEQ ID NO: 745861 - RNA, 19 nt, Homo sapiens
cagcgauccugaacugugu

SEQ ID NO: 745862 - RNA, 19 nt, Homo sapiens
ccuuaacccuucugcauca

SEQ ID NO: 745863 - RNA, 19 nt, Homo sapiens
gggaccacauggcacaaug

SEQ ID NO: 745864 - RNA, 19 nt, Homo sapiens
gcgacaacguggccaccuu

SEQ ID NO: 745865 - RNA, 19 nt, Homo sapiens
gcuccugacucugccuauu

SEQ ID NO: 745866 - RNA, 19 nt, Homo sapiens
ggcaugcccugcacucagu

SEQ ID NO: 745867 - RNA, 19 nt, Homo sapiens
cguaaacccucacguaucc

SEQ ID NO: 745868 - RNA, 19 nt, Homo sapiens
ccugagaugacucccguua

SEQ ID NO: 745869 - RNA, 19 nt, Homo sapiens
cguccuggguggcaaaugu

SEQ ID NO: 745870 - RNA, 19 nt, Homo sapiens
gagacgggcagcacucaug

SEQ ID NO: 745871 - RNA, 19 nt, Homo sapiens
ccaagagcgugcggccauu

SEQ ID NO: 745872 - RNA, 19 nt, Homo sapiens
ugagaugacucccguuagc

SEQ ID NO: 745873 - RNA, 19 nt, Homo sapiens
ccugaccaguuucccauga

SEQ ID NO: 745874 - RNA, 19 nt, Homo sapiens
ugccggaggugcucauguu

SEQ ID NO: 745875 - RNA, 19 nt, Homo sapiens
caagagcgugcggccauuu

SEQ ID NO: 745876 - RNA, 19 nt, Homo sapiens
cacaaugggaccucuguug

SEQ ID NO: 745877 - RNA, 19 nt, Homo sapiens
gcacaaugggaccucuguu

SEQ ID NO: 745878 - RNA, 19 nt, Homo sapiens
agcauuaccuggacaagca

SEQ ID NO: 745879 - RNA, 19 nt, Homo sapiens
ggccuuaacccuucugcau

SEQ ID NO: 745880 - RNA, 19 nt, Homo sapiens
gcugaggagccacgugaug

SEQ ID NO: 745881 - RNA, 19 nt, Homo sapiens
gcaguuugagcaggagauu

SEQ ID NO: 745882 - RNA, 19 nt, Homo sapiens
ggccauuucgcuccaguga

SEQ ID NO: 745883 - RNA, 19 nt, Homo sapiens
gcguugcuauuuaauuacu

SEQ ID NO: 745884 - RNA, 19 nt, Homo sapiens
gaccuggugcugcgcaaga

SEQ ID NO: 745885 - RNA, 19 nt, Homo sapiens
ugaccaguuucccaugauc

SEQ ID NO: 745886 - RNA, 19 nt, Homo sapiens
aaugggaccucuguuguac

SEQ ID NO: 745887 - RNA, 19 nt, Homo sapiens
gccgagggucugcaccuuu

SEQ ID NO: 745888 - RNA, 19 nt, Homo sapiens
ugagcguugcuauuuaauu

SEQ ID NO: 745889 - RNA, 19 nt, Homo sapiens
ugggaccucuguuguacau

SEQ ID NO: 745890 - RNA, 19 nt, Homo sapiens
gccuauuguuccuccaguu

SEQ ID NO: 745891 - RNA, 19 nt, Homo sapiens
gggaggacaccacugaaac

SEQ ID NO: 745892 - RNA, 19 nt, Homo sapiens
ccccaucccuucuccuuuu

SEQ ID NO: 745893 - RNA, 19 nt, Homo sapiens
gagcguugcuauuuaauua

SEQ ID NO: 745894 - RNA, 19 nt, Homo sapiens
gggacacgcuggagcauua

SEQ ID NO: 745895 - RNA, 19 nt, Homo sapiens
gaugagcguugcuauuuaa

SEQ ID NO: 745896 - RNA, 19 nt, Homo sapiens
ggaugagcguugcuauuua

SEQ ID NO: 745897 - RNA, 19 nt, Homo sapiens
gggaugagcguugcuauuu

SEQ ID NO: 745898 - RNA, 19 nt, Homo sapiens
ggaccucuguuguacauuc

SEQ ID NO: 745899 - RNA, 19 nt, Homo sapiens
caccugcccugaccaguuu

SEQ ID NO: 745900 - RNA, 19 nt, Homo sapiens
gaccguaaacccucacgua

SEQ ID NO: 745901 - RNA, 19 nt, Homo sapiens
cggaggugcucauguuuga

SEQ ID NO: 745902 - RNA, 19 nt, Homo sapiens
gaugacucccguuagcuua

SEQ ID NO: 745903 - RNA, 19 nt, Homo sapiens
caaugggaccucuguugua

SEQ ID NO: 745904 - RNA, 19 nt, Homo sapiens
acacacagccagaccguaa

SEQ ID NO: 745905 - RNA, 19 nt, Homo sapiens
gcaccugcccugaccaguu

SEQ ID NO: 745906 - RNA, 19 nt, Homo sapiens
caacguggccaccuucauc

SEQ ID NO: 745907 - RNA, 19 nt, Homo sapiens
ccuuaacccuucugcauca

SEQ ID NO: 745908 - RNA, 19 nt, Homo sapiens
gggaccacauggcacaaug

SEQ ID NO: 745909 - RNA, 19 nt, Homo sapiens
gcgacaacguggccaccuu

SEQ ID NO: 745910 - RNA, 19 nt, Homo sapiens
gcuccugacucugccuauu

SEQ ID NO: 745911 - RNA, 19 nt, Homo sapiens
ggcaugcccugcacucagu

SEQ ID NO: 745912 - RNA, 19 nt, Homo sapiens
cguaaacccucacguaucc

SEQ ID NO: 745913 - RNA, 19 nt, Homo sapiens
ccugagaugacucccguua

SEQ ID NO: 745914 - RNA, 19 nt, Homo sapiens
cguccuggguggcaaaugu

SEQ ID NO: 745915 - RNA, 19 nt, Homo sapiens
gagacgggcagcacucaug

SEQ ID NO: 745916 - RNA, 19 nt, Homo sapiens
ccaagagcgugcggccauu

SEQ ID NO: 745917 - RNA, 19 nt, Homo sapiens
ugagaugacucccguuagc

SEQ ID NO: 745918 - RNA, 19 nt, Homo sapiens
ccugaccaguuucccauga

SEQ ID NO: 745919 - RNA, 19 nt, Homo sapiens
ugccggaggugcucauguu

SEQ ID NO: 745920 - RNA, 19 nt, Homo sapiens
caagagcgugcggccauuu

SEQ ID NO: 745921 - RNA, 19 nt, Homo sapiens
cacaaugggaccucuguug

SEQ ID NO: 745922 - RNA, 19 nt, Homo sapiens
gcacaaugggaccucuguu

SEQ ID NO: 745923 - RNA, 19 nt, Homo sapiens
agcauuaccuggacaagca

SEQ ID NO: 745924 - RNA, 19 nt, Homo sapiens
ggccuuaacccuucugcau

SEQ ID NO: 745925 - RNA, 19 nt, Homo sapiens
gcugaggagccacgugaug

SEQ ID NO: 745926 - RNA, 19 nt, Homo sapiens
ggccauuucgcuccaguga

SEQ ID NO: 745927 - RNA, 19 nt, Homo sapiens
gcaguuugagcaggagauu

SEQ ID NO: 745928 - RNA, 19 nt, Homo sapiens
gcguugcuauuuaauuacu

SEQ ID NO: 745929 - RNA, 19 nt, Homo sapiens
gaccuggugcugcgcaaga

SEQ ID NO: 745930 - RNA, 19 nt, Homo sapiens
cagcacucccugccuguga

SEQ ID NO: 745931 - RNA, 19 nt, Homo sapiens
ugaccaguuucccaugauc

SEQ ID NO: 745932 - RNA, 19 nt, Homo sapiens
aaugggaccucuguuguac

SEQ ID NO: 745933 - RNA, 19 nt, Homo sapiens
gccgagggucugcaccuuu

SEQ ID NO: 745934 - RNA, 19 nt, Homo sapiens
ugagcguugcuauuuaauu

SEQ ID NO: 745935 - RNA, 19 nt, Homo sapiens
ugggaccucuguuguacau

SEQ ID NO: 745936 - RNA, 19 nt, Homo sapiens
gccuauuguuccuccaguu

SEQ ID NO: 745937 - RNA, 19 nt, Homo sapiens
gggaggacaccacugaaac

SEQ ID NO: 745938 - RNA, 19 nt, Homo sapiens
ccccaucccuucuccuuuu

SEQ ID NO: 745939 - RNA, 19 nt, Homo sapiens
gagcguugcuauuuaauua

SEQ ID NO: 745940 - RNA, 19 nt, Homo sapiens
gggacacgcuggagcauua

SEQ ID NO: 745941 - RNA, 19 nt, Homo sapiens
gaugagcguugcuauuuaa

SEQ ID NO: 745942 - RNA, 19 nt, Homo sapiens
ggaugagcguugcuauuua

SEQ ID NO: 745943 - RNA, 19 nt, Homo sapiens
gggaugagcguugcuauuu

SEQ ID NO: 745944 - RNA, 19 nt, Homo sapiens
ggaccucuguuguacauuc

SEQ ID NO: 745945 - RNA, 19 nt, Homo sapiens
caccugcccugaccaguuu

SEQ ID NO: 745946 - RNA, 19 nt, Homo sapiens
gaccguaaacccucacgua

SEQ ID NO: 745947 - RNA, 19 nt, Homo sapiens
cggaggugcucauguuuga

SEQ ID NO: 745948 - RNA, 19 nt, Homo sapiens
gaugacucccguuagcuua

SEQ ID NO: 745949 - RNA, 19 nt, Homo sapiens
caaugggaccucuguugua

SEQ ID NO: 745950 - RNA, 19 nt, Homo sapiens
acacacagccagaccguaa

SEQ ID NO: 745951 - RNA, 19 nt, Homo sapiens
gcaccugcccugaccaguu

SEQ ID NO: 745952 - RNA, 19 nt, Homo sapiens
caacguggccaccuucauc

SEQ ID NO: 745953 - RNA, 19 nt, Homo sapiens
caaccaaaccaacaacaca

SEQ ID NO: 745954 - RNA, 19 nt, Homo sapiens
ccuuaacccuucugcauca

SEQ ID NO: 745955 - RNA, 19 nt, Homo sapiens
gcaggaggacgaggaguga

SEQ ID NO: 745956 - RNA, 19 nt, Homo sapiens
gggaccacauggcacaaug

SEQ ID NO: 745957 - RNA, 19 nt, Homo sapiens
gcgacaacguggccaccuu

SEQ ID NO: 745958 - RNA, 19 nt, Homo sapiens
gcuccugacucugccuauu

SEQ ID NO: 745959 - RNA, 19 nt, Homo sapiens
ggcaugcccugcacucagu

SEQ ID NO: 745960 - RNA, 19 nt, Homo sapiens
cguaaacccucacguaucc

SEQ ID NO: 745961 - RNA, 19 nt, Homo sapiens
ccugagaugacucccguua

SEQ ID NO: 745962 - RNA, 19 nt, Homo sapiens
cguccuggguggcaaaugu

SEQ ID NO: 745963 - RNA, 19 nt, Homo sapiens
gagacgggcagcacucaug

SEQ ID NO: 745964 - RNA, 19 nt, Homo sapiens
ugccaguccuuccguggua

SEQ ID NO: 745965 - RNA, 19 nt, Homo sapiens
ugagaugacucccguuagc

SEQ ID NO: 745966 - RNA, 19 nt, Homo sapiens
ccaagagcgugcggccauu

SEQ ID NO: 745967 - RNA, 19 nt, Homo sapiens
ccugaccaguuucccauga

SEQ ID NO: 745968 - RNA, 19 nt, Homo sapiens
ugccggaggugcucauguu

SEQ ID NO: 745969 - RNA, 19 nt, Homo sapiens
caagagcgugcggccauuu

SEQ ID NO: 745970 - RNA, 19 nt, Homo sapiens
cacaaugggaccucuguug

SEQ ID NO: 745971 - RNA, 19 nt, Homo sapiens
gcacaaugggaccucuguu

SEQ ID NO: 745972 - RNA, 19 nt, Homo sapiens
caacccaaccaaaccaaca

SEQ ID NO: 745973 - RNA, 19 nt, Homo sapiens
ugacucacacccugggaaa

SEQ ID NO: 745974 - RNA, 19 nt, Homo sapiens
agcauuaccuggacaagca

SEQ ID NO: 745975 - RNA, 19 nt, Homo sapiens
ggccauuucgcuccaguga

SEQ ID NO: 745976 - RNA, 19 nt, Homo sapiens
ggccuuaacccuucugcau

SEQ ID NO: 745977 - RNA, 19 nt, Homo sapiens
cuagagcccaggaaacuuc

SEQ ID NO: 745978 - RNA, 19 nt, Homo sapiens
gcugaggagccacgugaug

SEQ ID NO: 745979 - RNA, 19 nt, Homo sapiens
gcaguuugagcaggagauu

SEQ ID NO: 745980 - RNA, 19 nt, Homo sapiens
gcguugcuauuuaauuacu

SEQ ID NO: 745981 - RNA, 19 nt, Homo sapiens
gaccuggugcugcgcaaga

SEQ ID NO: 745982 - RNA, 19 nt, Homo sapiens
ugaccaguuucccaugauc

SEQ ID NO: 745983 - RNA, 19 nt, Homo sapiens
aaugggaccucuguuguac

SEQ ID NO: 745984 - RNA, 19 nt, Homo sapiens
gccgagggucugcaccuuu

SEQ ID NO: 745985 - RNA, 19 nt, Homo sapiens
ugagcguugcuauuuaauu

SEQ ID NO: 745986 - RNA, 19 nt, Homo sapiens
ugggaccucuguuguacau

SEQ ID NO: 745987 - RNA, 19 nt, Homo sapiens
gccuauuguuccuccaguu

SEQ ID NO: 745988 - RNA, 19 nt, Homo sapiens
gggaggacaccacugaaac

SEQ ID NO: 745989 - RNA, 19 nt, Homo sapiens
ccccaucccuucuccuuuu

SEQ ID NO: 745990 - RNA, 19 nt, Homo sapiens
gcagaacucucaagauaaa

SEQ ID NO: 745991 - RNA, 19 nt, Homo sapiens
gugcagaacucucaagaua

SEQ ID NO: 745992 - RNA, 19 nt, Homo sapiens
gaaaguaguugucaaguac

SEQ ID NO: 745993 - RNA, 19 nt, Homo sapiens
caaaucauguuagcuguua

SEQ ID NO: 745994 - RNA, 19 nt, Homo sapiens
gaauaagucuccucauauc

SEQ ID NO: 745995 - RNA, 19 nt, Homo sapiens
gaaagaagaaaucccagua

SEQ ID NO: 745996 - RNA, 19 nt, Homo sapiens
agaaagaagugaagguaaa

SEQ ID NO: 745997 - RNA, 19 nt, Homo sapiens
gaacagcaccaaaggaguu

SEQ ID NO: 745998 - RNA, 19 nt, Homo sapiens
ucaacuagcuucugaucaa

SEQ ID NO: 745999 - RNA, 19 nt, Homo sapiens
uaagcuacguugucaguuu

SEQ ID NO: 746000 - RNA, 19 nt, Homo sapiens
gagaagaaaucuaaaucca

SEQ ID NO: 746001 - RNA, 19 nt, Homo sapiens
agaaaguaguugucaagua

SEQ ID NO: 746002 - RNA, 19 nt, Homo sapiens
uggcauaugucuccgauuu

SEQ ID NO: 746003 - RNA, 19 nt, Homo sapiens
ccauuaccauguccuauaa

SEQ ID NO: 746004 - RNA, 19 nt, Homo sapiens
aaaccuaacuugaacaauc

SEQ ID NO: 746005 - RNA, 19 nt, Homo sapiens
caaggguguuuauauuuga

SEQ ID NO: 746006 - RNA, 19 nt, Homo sapiens
cagauuagcacgaguuaaa

SEQ ID NO: 746007 - RNA, 19 nt, Homo sapiens
gaagaaaucccaguacaag

SEQ ID NO: 746008 - RNA, 19 nt, Homo sapiens
ugaagagcguauucuguuu

SEQ ID NO: 746009 - RNA, 19 nt, Homo sapiens
acaaggguguuuauauuug

SEQ ID NO: 746010 - RNA, 19 nt, Homo sapiens
gagaaucacagcuuuacaa

SEQ ID NO: 746011 - RNA, 19 nt, Homo sapiens
ccucauaucucuaauugca

SEQ ID NO: 746012 - RNA, 19 nt, Homo sapiens
aaagugagcauuugucuau

SEQ ID NO: 746013 - RNA, 19 nt, Homo sapiens
gcauaugucuccgauuuag

SEQ ID NO: 746014 - RNA, 19 nt, Homo sapiens
ucucauaccuuuccuugug

SEQ ID NO: 746015 - RNA, 19 nt, Homo sapiens
ugaacaaucuccggaaaga

SEQ ID NO: 746016 - RNA, 19 nt, Homo sapiens
gcagagaauguuagccuuu

SEQ ID NO: 746017 - RNA, 19 nt, Homo sapiens
gaugugccuuucuagcuuu

SEQ ID NO: 746018 - RNA, 19 nt, Homo sapiens
ggagguagcagaaguagca

SEQ ID NO: 746019 - RNA, 19 nt, Homo sapiens
guaaugcuuuggugacuuc

SEQ ID NO: 746020 - RNA, 19 nt, Homo sapiens
gcuuagaucugaauuuacu

SEQ ID NO: 746021 - RNA, 19 nt, Homo sapiens
cuucaagacuucaaugaga

SEQ ID NO: 746022 - RNA, 19 nt, Homo sapiens
uguagccagugauuauuua

SEQ ID NO: 746023 - RNA, 19 nt, Homo sapiens
caacuguaccuuuaaacaa

SEQ ID NO: 746024 - RNA, 19 nt, Homo sapiens
uaccauguccuauaaauga

SEQ ID NO: 746025 - RNA, 19 nt, Homo sapiens
gaaagcaagaaaccuaaau

SEQ ID NO: 746026 - RNA, 19 nt, Homo sapiens
gcugaaagcaagaaaccua

SEQ ID NO: 746027 - RNA, 19 nt, Homo sapiens
ugaauaagucuccucauau

SEQ ID NO: 746028 - RNA, 19 nt, Homo sapiens
ccacuaaugugcagaacuc

SEQ ID NO: 746029 - RNA, 19 nt, Homo sapiens
ggaaggcagugauggugau

SEQ ID NO: 746030 - RNA, 19 nt, Homo sapiens
uagcacgaguuaaaccuuu

SEQ ID NO: 746031 - RNA, 19 nt, Homo sapiens
gaagcuuagaucugaauuu

SEQ ID NO: 746032 - RNA, 19 nt, Homo sapiens
aauguuagccuuucuguug

SEQ ID NO: 746033 - RNA, 19 nt, Homo sapiens
gugaagagcguauucuguu

SEQ ID NO: 746034 - RNA, 19 nt, Homo sapiens
ggauaagauuacuguggaa

SEQ ID NO: 746035 - RNA, 19 nt, Homo sapiens
caacaagaauuugagaacu

SEQ ID NO: 746036 - RNA, 19 nt, Homo sapiens
uaagaaaccagucaauuac

SEQ ID NO: 746037 - RNA, 19 nt, Homo sapiens
aaagaaagaagugaaggua

SEQ ID NO: 746038 - RNA, 19 nt, Homo sapiens
gcacagcagaggaagauuc

SEQ ID NO: 746039 - RNA, 19 nt, Homo sapiens
gugauuaaagugagcauuu

SEQ ID NO: 746040 - RNA, 19 nt, Homo sapiens
gaaauacgcaguccuucag

SEQ ID NO: 746041 - RNA, 19 nt, Homo sapiens
uaagauuacuguggaagau

SEQ ID NO: 746042 - RNA, 19 nt, Homo sapiens
caacagucaccacuaaugu

SEQ ID NO: 746043 - RNA, 19 nt, Homo sapiens
guacuuagucaucccuauu

SEQ ID NO: 746044 - RNA, 19 nt, Homo sapiens
cauaagaaaccagucaauu

SEQ ID NO: 746045 - RNA, 19 nt, Homo sapiens
guccacauuucaugauaaa

SEQ ID NO: 746046 - RNA, 19 nt, Homo sapiens
gagugaggauaaugacgaa

SEQ ID NO: 746047 - RNA, 19 nt, Homo sapiens
gaaguugcacuagcuuuau

SEQ ID NO: 746048 - RNA, 19 nt, Homo sapiens
agaaguugcacuagcuuua

SEQ ID NO: 746049 - RNA, 19 nt, Homo sapiens
gaaaucccaguacaagaga

SEQ ID NO: 746050 - RNA, 19 nt, Homo sapiens
gcaacuguaccuuuaaaca

SEQ ID NO: 746051 - RNA, 19 nt, Homo sapiens
ugacagugaugaugauuuu

SEQ ID NO: 746052 - RNA, 19 nt, Homo sapiens
gaaaccagucaauuacuca

SEQ ID NO: 746053 - RNA, 19 nt, Homo sapiens
gcagaggaaacauucuuau

SEQ ID NO: 746054 - RNA, 19 nt, Homo sapiens
gucaauuacucacaguuug

SEQ ID NO: 746055 - RNA, 19 nt, Homo sapiens
cgauuuagaugguuguucu

SEQ ID NO: 746056 - RNA, 19 nt, Homo sapiens
cagcugccgucaaaucaga

SEQ ID NO: 746057 - RNA, 19 nt, Homo sapiens
caaaggaguuaaaacaaga

SEQ ID NO: 746058 - RNA, 19 nt, Homo sapiens
caacuagcuucugaucaau

SEQ ID NO: 746059 - RNA, 19 nt, Homo sapiens
gguaaaauccccaguagaa

SEQ ID NO: 746060 - RNA, 19 nt, Homo sapiens
gugaagauucugaggauga

SEQ ID NO: 746061 - RNA, 19 nt, Homo sapiens
aaacauggcaguaguaaaa

SEQ ID NO: 746062 - RNA, 19 nt, Homo sapiens
gaacaaucuccggaaagaa

SEQ ID NO: 746063 - RNA, 19 nt, Homo sapiens
ugauuaaagugagcauuug

SEQ ID NO: 746064 - RNA, 19 nt, Homo sapiens
acuagcuucugaucaauuu

SEQ ID NO: 746065 - RNA, 19 nt, Homo sapiens
ugagaacuguaaauaccaa

SEQ ID NO: 746066 - RNA, 19 nt, Homo sapiens
guuuauagcaccuuaacuu

SEQ ID NO: 746067 - RNA, 19 nt, Homo sapiens
gcaguguagccagugauua

SEQ ID NO: 746068 - RNA, 19 nt, Homo sapiens
aagaagaaaucccaguaca

SEQ ID NO: 746069 - RNA, 19 nt, Homo sapiens
cagaggaaacauucuuauu

SEQ ID NO: 746070 - RNA, 19 nt, Homo sapiens
ggcagaggaaacauucuua

SEQ ID NO: 746071 - RNA, 19 nt, Homo sapiens
guuaaaccuuugcauccaa

SEQ ID NO: 746072 - RNA, 19 nt, Homo sapiens
uagccuuucuguuguaaau

SEQ ID NO: 746073 - RNA, 19 nt, Homo sapiens
agauuacuguggaagauga

SEQ ID NO: 746074 - RNA, 19 nt, Homo sapiens
gccagugauuauuuagauu

SEQ ID NO: 746075 - RNA, 19 nt, Homo sapiens
uaugagauaguacagcuuu

SEQ ID NO: 746076 - RNA, 19 nt, Homo sapiens
cagagaauguuagccuuuc

SEQ ID NO: 746077 - RNA, 19 nt, Homo sapiens
ggcauaugucuccgauuua

SEQ ID NO: 746078 - RNA, 19 nt, Homo sapiens
ugaugugccuuucuagcuu

SEQ ID NO: 746079 - RNA, 19 nt, Homo sapiens
gguagugucugugaagucu

SEQ ID NO: 746080 - RNA, 19 nt, Homo sapiens
caagauaaaccaaaaccua

SEQ ID NO: 746081 - RNA, 19 nt, Homo sapiens
cugcaacuguaccuuuaaa

SEQ ID NO: 746082 - RNA, 19 nt, Homo sapiens
ucuaucaguucgacaugaa

SEQ ID NO: 746083 - RNA, 19 nt, Homo sapiens
gaagguaaaauccccagua

SEQ ID NO: 746084 - RNA, 19 nt, Homo sapiens
gaaggcagugauggugaua

SEQ ID NO: 746085 - RNA, 19 nt, Homo sapiens
ucuaguuuauagcaccuua

SEQ ID NO: 746086 - RNA, 19 nt, Homo sapiens
cgacaugaaguccacauca

SEQ ID NO: 746087 - RNA, 19 nt, Homo sapiens
cuccucauaucucuaauug

SEQ ID NO: 746088 - RNA, 19 nt, Homo sapiens
acaagaauuugagaacugu

SEQ ID NO: 746089 - RNA, 19 nt, Homo sapiens
uguccacauuucaugauaa

SEQ ID NO: 746090 - RNA, 19 nt, Homo sapiens
ggaagaagccgaagcugaa

SEQ ID NO: 746091 - RNA, 19 nt, Homo sapiens
ucacugaguuccugaagaa

SEQ ID NO: 746092 - RNA, 19 nt, Homo sapiens
ggaacaggcuugcccaaca

SEQ ID NO: 746093 - RNA, 19 nt, Homo sapiens
gcacggagggugaaaguga

SEQ ID NO: 746094 - RNA, 19 nt, Homo sapiens
gaacaggcuugcccaacau

SEQ ID NO: 746095 - RNA, 19 nt, Homo sapiens
gaaagcggcagaccuguga

SEQ ID NO: 746096 - RNA, 19 nt, Homo sapiens
gaaacgaggccucucucua

SEQ ID NO: 746097 - RNA, 19 nt, Homo sapiens
ucaggaagcugguaugagu

SEQ ID NO: 746098 - RNA, 19 nt, Homo sapiens
gaggaaagaggaccuggua

SEQ ID NO: 746099 - RNA, 19 nt, Homo sapiens
gcagaccugugacaucgaa

SEQ ID NO: 746100 - RNA, 19 nt, Homo sapiens
gaaagaggaccugguacuu

SEQ ID NO: 746101 - RNA, 19 nt, Homo sapiens
gggaaguacugcugugugu

SEQ ID NO: 746102 - RNA, 19 nt, Homo sapiens
gcagggaucugugagaaac

SEQ ID NO: 746103 - RNA, 19 nt, Homo sapiens
gaaacagccucuggaucug

SEQ ID NO: 746104 - RNA, 19 nt, Homo sapiens
ccaccuagaacucaggaua

SEQ ID NO: 746105 - RNA, 19 nt, Homo sapiens
caaagcccgugacaaaucu

SEQ ID NO: 746106 - RNA, 19 nt, Homo sapiens
ugaugaaguucgacagcua

SEQ ID NO: 746107 - RNA, 19 nt, Homo sapiens
cacagcagcuucagaucuu

SEQ ID NO: 746108 - RNA, 19 nt, Homo sapiens
gcacagcagcuucagaucu

SEQ ID NO: 746109 - RNA, 19 nt, Homo sapiens
cagcuggguuuguccuuga

SEQ ID NO: 746110 - RNA, 19 nt, Homo sapiens
gaacuccaccaccgacuca

SEQ ID NO: 746111 - RNA, 19 nt, Homo sapiens
ccaaagcccgugacaaauc

SEQ ID NO: 746112 - RNA, 19 nt, Homo sapiens
gagcgguguuucaggaugu

SEQ ID NO: 746113 - RNA, 19 nt, Homo sapiens
ggaaagaggaccugguacu

SEQ ID NO: 746114 - RNA, 19 nt, Homo sapiens
cuccaaagcccgugacaaa

SEQ ID NO: 746115 - RNA, 19 nt, Homo sapiens
agaaacagccucuggaucu

SEQ ID NO: 746116 - RNA, 19 nt, Homo sapiens
aaacgaggccucucucuac

SEQ ID NO: 746117 - RNA, 19 nt, Homo sapiens
caacaucuaccaggaguuc

SEQ ID NO: 746118 - RNA, 19 nt, Homo sapiens
gggccuggcuuacuucacu

SEQ ID NO: 746119 - RNA, 19 nt, Homo sapiens
gggcacagcagcuucagau

SEQ ID NO: 746120 - RNA, 19 nt, Homo sapiens
guuuguccuugauguauga

SEQ ID NO: 746121 - RNA, 19 nt, Homo sapiens
ggaaaggggacucagauga

SEQ ID NO: 746122 - RNA, 19 nt, Homo sapiens
uggcuuacuucacugaguu

SEQ ID NO: 746123 - RNA, 19 nt, Homo sapiens
ggaaguacugcugugugua

SEQ ID NO: 746124 - RNA, 19 nt, Homo sapiens
caccuagaacucaggauaa

SEQ ID NO: 746125 - RNA, 19 nt, Homo sapiens
gaugaaguucgacagcuau

SEQ ID NO: 746126 - RNA, 19 nt, Homo sapiens
gcgcugagcccagugaaca

SEQ ID NO: 746127 - RNA, 19 nt, Homo sapiens
acauacagauuuugcagua

SEQ ID NO: 746128 - RNA, 19 nt, Homo sapiens
uggcagggaucugugagaa

SEQ ID NO: 746129 - RNA, 19 nt, Homo sapiens
gagcacggagggugaaagu

SEQ ID NO: 746130 - RNA, 19 nt, Homo sapiens
gguuuguccuugauguaug

SEQ ID NO: 746131 - RNA, 19 nt, Homo sapiens
aaagaggaccugguacuuc

SEQ ID NO: 746132 - RNA, 19 nt, Homo sapiens
gguagugagcgguguuuca

SEQ ID NO: 746133 - RNA, 19 nt, Homo sapiens
cacggagggugaaagugaa

SEQ ID NO: 746134 - RNA, 19 nt, Homo sapiens
ucugagagccaccggaaga

SEQ ID NO: 746135 - RNA, 19 nt, Homo sapiens
guaccgcgagugccugcua

SEQ ID NO: 746136 - RNA, 19 nt, Homo sapiens
gcuaugcgcgcuucgucaa

SEQ ID NO: 746137 - RNA, 19 nt, Homo sapiens
gugugaagaucuccaaagc

SEQ ID NO: 746138 - RNA, 19 nt, Homo sapiens
cgagaaacagccucuggau

SEQ ID NO: 746139 - RNA, 19 nt, Homo sapiens
gaagaagccgaagcugaag

SEQ ID NO: 746140 - RNA, 19 nt, Homo sapiens
gaggagaccccaccacaga

SEQ ID NO: 746141 - RNA, 19 nt, Homo sapiens
gugaaggugcccaguagug

SEQ ID NO: 746142 - RNA, 19 nt, Homo sapiens
gaagcugguaugaguaagg

SEQ ID NO: 746143 - RNA, 19 nt, Homo sapiens
aggaagcugguaugaguaa

SEQ ID NO: 746144 - RNA, 19 nt, Homo sapiens
uggugaaggugcccaguag

SEQ ID NO: 746145 - RNA, 19 nt, Homo sapiens
gcagcucucucagcaucca

SEQ ID NO: 746146 - RNA, 19 nt, Homo sapiens
caggaagugcggcuggaaa

SEQ ID NO: 746147 - RNA, 19 nt, Homo sapiens
caggaagcugguaugagua

SEQ ID NO: 746148 - RNA, 19 nt, Homo sapiens
ucugacagcuacccaacag

SEQ ID NO: 746149 - RNA, 19 nt, Homo sapiens
gcuggcggaucaggaagug

SEQ ID NO: 746150 - RNA, 19 nt, Homo sapiens
caaguuaccucaccuaauu

SEQ ID NO: 746151 - RNA, 19 nt, Homo sapiens
gcacuuacauguggagaua

SEQ ID NO: 746152 - RNA, 19 nt, Homo sapiens
ggacuugacuugugugugu

SEQ ID NO: 746153 - RNA, 19 nt, Homo sapiens
ucacugcacuauauucuaa

SEQ ID NO: 746154 - RNA, 19 nt, Homo sapiens
gccaggagauguacauuga

SEQ ID NO: 746155 - RNA, 19 nt, Homo sapiens
gcucugugcucucuaguga

SEQ ID NO: 746156 - RNA, 19 nt, Homo sapiens
ugacugaacugcugaugga

SEQ ID NO: 746157 - RNA, 19 nt, Homo sapiens
caaaugcucugugcucucu

SEQ ID NO: 746158 - RNA, 19 nt, Homo sapiens
gaauuugcuuccucugaca

SEQ ID NO: 746159 - RNA, 19 nt, Homo sapiens
caggagagcuggcgaugac

SEQ ID NO: 746160 - RNA, 19 nt, Homo sapiens
cgagggacuugacuugugu

SEQ ID NO: 746161 - RNA, 19 nt, Homo sapiens
gagcucagggcgacuguga

SEQ ID NO: 746162 - RNA, 19 nt, Homo sapiens
cuagugagcccugaauuug

SEQ ID NO: 746163 - RNA, 19 nt, Homo sapiens
gacaaguuaccucaccuaa

SEQ ID NO: 746164 - RNA, 19 nt, Homo sapiens
gggcgacugugacccugaa

SEQ ID NO: 746165 - RNA, 19 nt, Homo sapiens
gaacugcugauggacaaau

SEQ ID NO: 746166 - RNA, 19 nt, Homo sapiens
cagaaagcccaauguguca

SEQ ID NO: 746167 - RNA, 19 nt, Homo sapiens
ccaauccagauaauaaaga

SEQ ID NO: 746168 - RNA, 19 nt, Homo sapiens
ccaccacucuggaccuaag

SEQ ID NO: 746169 - RNA, 19 nt, Homo sapiens
ucuagugagcccugaauuu

SEQ ID NO: 746170 - RNA, 19 nt, Homo sapiens
cuuccuggcuuaugagugu

SEQ ID NO: 746171 - RNA, 19 nt, Homo sapiens
ucgagggacuugacuugug

SEQ ID NO: 746172 - RNA, 19 nt, Homo sapiens
ugaccgaggccgugaacuu

SEQ ID NO: 746173 - RNA, 19 nt, Homo sapiens
ugcuuccucugacaaguua

SEQ ID NO: 746174 - RNA, 19 nt, Homo sapiens
gagagcuggcgaugacuga

SEQ ID NO: 746175 - RNA, 19 nt, Homo sapiens
caucgagggacuugacuug

SEQ ID NO: 746176 - RNA, 19 nt, Homo sapiens
acaugagggugcagaagug

SEQ ID NO: 746177 - RNA, 19 nt, Homo sapiens
ggaugaagugggccgagaa

SEQ ID NO: 746178 - RNA, 19 nt, Homo sapiens
caaccgcaccucccucauc

SEQ ID NO: 746179 - RNA, 19 nt, Homo sapiens
caccaccacucuggaccua

SEQ ID NO: 746180 - RNA, 19 nt, Homo sapiens
ucaggaaugagaaucuuug

SEQ ID NO: 746181 - RNA, 19 nt, Homo sapiens
gaccgaggccgugaacuuc

SEQ ID NO: 746182 - RNA, 19 nt, Homo sapiens
ggcagaaagcccaaugugu

SEQ ID NO: 746183 - RNA, 19 nt, Homo sapiens
caauccagauaauaaagac

SEQ ID NO: 746184 - RNA, 19 nt, Homo sapiens
ugacaaguuaccucaccua

SEQ ID NO: 746185 - RNA, 19 nt, Homo sapiens
cugaacugcugauggacaa

SEQ ID NO: 746186 - RNA, 19 nt, Homo sapiens
cgggcuuccuggcuuauga

SEQ ID NO: 746187 - RNA, 19 nt, Homo sapiens
gcugggcacucuggguguu

SEQ ID NO: 746188 - RNA, 19 nt, Homo sapiens
guguguuucugaaguguuc

SEQ ID NO: 746189 - RNA, 19 nt, Homo sapiens
ugaagugggccgagaacug

SEQ ID NO: 746190 - RNA, 19 nt, Homo sapiens
gacccugaagcaccaauga

SEQ ID NO: 746191 - RNA, 19 nt, Homo sapiens
ugacuuguguguguuucug

SEQ ID NO: 746192 - RNA, 19 nt, Homo sapiens
gaccuaagaccugggguua

SEQ ID NO: 746193 - RNA, 19 nt, Homo sapiens
gucacuggaucugggcuaa

SEQ ID NO: 746194 - RNA, 19 nt, Homo sapiens
cgacugugacccugaagca

SEQ ID NO: 746195 - RNA, 19 nt, Homo sapiens
cugacucgcugcccaugau

SEQ ID NO: 746196 - RNA, 19 nt, Homo sapiens
gguggaaccuuucuuuaaa

SEQ ID NO: 746197 - RNA, 19 nt, Homo sapiens
gagcaugucuauucuaaca

SEQ ID NO: 746198 - RNA, 19 nt, Homo sapiens
agaccucacuguaagaaua

SEQ ID NO: 746199 - RNA, 19 nt, Homo sapiens
gaagaugccuacugcuuuu

SEQ ID NO: 746200 - RNA, 19 nt, Homo sapiens
ggaaaugacuaggauaaaa

SEQ ID NO: 746201 - RNA, 19 nt, Homo sapiens
uaacacaucagcuuauuca

SEQ ID NO: 746202 - RNA, 19 nt, Homo sapiens
gcaugucuauucuaacaca

SEQ ID NO: 746203 - RNA, 19 nt, Homo sapiens
agacugaacuacuucuuag

SEQ ID NO: 746204 - RNA, 19 nt, Homo sapiens
gagcacagagacacauaaa

SEQ ID NO: 746205 - RNA, 19 nt, Homo sapiens
acacaucagcuuauucaaa

SEQ ID NO: 746206 - RNA, 19 nt, Homo sapiens
cagacugaacuacuucuua

SEQ ID NO: 746207 - RNA, 19 nt, Homo sapiens
aauauaugguggaaccuuu

SEQ ID NO: 746208 - RNA, 19 nt, Homo sapiens
aggagcaugucuauucuaa

SEQ ID NO: 746209 - RNA, 19 nt, Homo sapiens
cacaucagcuuauucaaaa

SEQ ID NO: 746210 - RNA, 19 nt, Homo sapiens
agaagaugccuacugcuuu

SEQ ID NO: 746211 - RNA, 19 nt, Homo sapiens
ucuaacacaucagcuuauu

SEQ ID NO: 746212 - RNA, 19 nt, Homo sapiens
guucuuccacugugacuuu

SEQ ID NO: 746213 - RNA, 19 nt, Homo sapiens
aagcuuucuucaccuuaua

SEQ ID NO: 746214 - RNA, 19 nt, Homo sapiens
aaagcuuucuucaccuuau

SEQ ID NO: 746215 - RNA, 19 nt, Homo sapiens
gggaaaugacuaggauaaa

SEQ ID NO: 746216 - RNA, 19 nt, Homo sapiens
ugaagcaaauucucagacu

SEQ ID NO: 746217 - RNA, 19 nt, Homo sapiens
uaugauagauuugcaagcu

SEQ ID NO: 746218 - RNA, 19 nt, Homo sapiens
cuucuuagaccucacugua

SEQ ID NO: 746219 - RNA, 19 nt, Homo sapiens
ugguggaaccuuucuuuaa

SEQ ID NO: 746220 - RNA, 19 nt, Homo sapiens
uagaagaugccuacugcuu

SEQ ID NO: 746221 - RNA, 19 nt, Homo sapiens
ugggaaaugacuaggauaa

SEQ ID NO: 746222 - RNA, 19 nt, Homo sapiens
cuacugcuuuuguuguuua

SEQ ID NO: 746223 - RNA, 19 nt, Homo sapiens
aauaaaaguugcuggagaa

SEQ ID NO: 746224 - RNA, 19 nt, Homo sapiens
uaugguggaaccuuucuuu

SEQ ID NO: 746225 - RNA, 19 nt, Homo sapiens
caccuuauauauguucuuc

SEQ ID NO: 746226 - RNA, 19 nt, Homo sapiens
gaccucacuguaagaauau

SEQ ID NO: 746227 - RNA, 19 nt, Homo sapiens
cugcauccuuuggccaaua

SEQ ID NO: 746228 - RNA, 19 nt, Homo sapiens
ugucuauucuaacacauca

SEQ ID NO: 746229 - RNA, 19 nt, Homo sapiens
uaucugaagcaaauucuca

SEQ ID NO: 746230 - RNA, 19 nt, Homo sapiens
ucugggaaaugacuaggau

SEQ ID NO: 746231 - RNA, 19 nt, Homo sapiens
cagagcacagagacacaua

SEQ ID NO: 746232 - RNA, 19 nt, Homo sapiens
ugcauccuuuggccaauaa

SEQ ID NO: 746233 - RNA, 19 nt, Homo sapiens
ccuuauauauguucuucca

SEQ ID NO: 746234 - RNA, 19 nt, Homo sapiens
auucuaacacaucagcuua

SEQ ID NO: 746235 - RNA, 19 nt, Homo sapiens
gcuuucuucaccuuauaua

SEQ ID NO: 746236 - RNA, 19 nt, Homo sapiens
uuaaucagcagagcacaga

SEQ ID NO: 746237 - RNA, 19 nt, Homo sapiens
uuugcaagcugcucauuuu

SEQ ID NO: 746238 - RNA, 19 nt, Homo sapiens
gcagagcacagagacacau

SEQ ID NO: 746239 - RNA, 19 nt, Homo sapiens
gcagggaucuugccucuaa

SEQ ID NO: 746240 - RNA, 19 nt, Homo sapiens
ucaggaagauugagaaaua

SEQ ID NO: 746241 - RNA, 19 nt, Homo sapiens
ggcaaacacucuugagaua

SEQ ID NO: 746242 - RNA, 19 nt, Homo sapiens
caaacacucuugagauaaa

SEQ ID NO: 746243 - RNA, 19 nt, Homo sapiens
gaucuugccucuaaucaga

SEQ ID NO: 746244 - RNA, 19 nt, Homo sapiens
aaacaaaucaccaggauaa

SEQ ID NO: 746245 - RNA, 19 nt, Homo sapiens
cagagaaacugcaggguaa

SEQ ID NO: 746246 - RNA, 19 nt, Homo sapiens
agacugagcugauguggaa

SEQ ID NO: 746247 - RNA, 19 nt, Homo sapiens
ggaaacaaaucaccaggau

SEQ ID NO: 746248 - RNA, 19 nt, Homo sapiens
ggaaucaucaacaucuuua

SEQ ID NO: 746249 - RNA, 19 nt, Homo sapiens
uaagaaggcucagggagaa

SEQ ID NO: 746250 - RNA, 19 nt, Homo sapiens
ccacacagcaucagagaaa

SEQ ID NO: 746251 - RNA, 19 nt, Homo sapiens
ggaagaaaugcaaaugaaa

SEQ ID NO: 746252 - RNA, 19 nt, Homo sapiens
caaacaccaugaggcuuua

SEQ ID NO: 746253 - RNA, 19 nt, Homo sapiens
aaaguggaauguacaaaga

SEQ ID NO: 746254 - RNA, 19 nt, Homo sapiens
gaagagggagaaaguguga

SEQ ID NO: 746255 - RNA, 19 nt, Homo sapiens
gaaacaaaucaccaggaua

SEQ ID NO: 746256 - RNA, 19 nt, Homo sapiens
uggaagaaaugcaaaugaa

SEQ ID NO: 746257 - RNA, 19 nt, Homo sapiens
gcaaacacucuugagauaa

SEQ ID NO: 746258 - RNA, 19 nt, Homo sapiens
uauggcaguuguccaauuu

SEQ ID NO: 746259 - RNA, 19 nt, Homo sapiens
gaaaguggaauguacaaag

SEQ ID NO: 746260 - RNA, 19 nt, Homo sapiens
cacagagucucacaacauu

SEQ ID NO: 746261 - RNA, 19 nt, Homo sapiens
guacaaagaaugaccaagu

SEQ ID NO: 746262 - RNA, 19 nt, Homo sapiens
ccaaacaccaugaggcuuu

SEQ ID NO: 746263 - RNA, 19 nt, Homo sapiens
ggaauugcaccacuggaaa

SEQ ID NO: 746264 - RNA, 19 nt, Homo sapiens
gggagaaaguggaauguac

SEQ ID NO: 746265 - RNA, 19 nt, Homo sapiens
caggaagauugagaaauaa

SEQ ID NO: 746266 - RNA, 19 nt, Homo sapiens
gcaaauggacacucugauc

SEQ ID NO: 746267 - RNA, 19 nt, Homo sapiens
aaacaaaacuacagcauuc

SEQ ID NO: 746268 - RNA, 19 nt, Homo sapiens
caaauggacacucugauca

SEQ ID NO: 746269 - RNA, 19 nt, Homo sapiens
gagguagucucucccaucu

SEQ ID NO: 746270 - RNA, 19 nt, Homo sapiens
gguagucucucccaucucu

SEQ ID NO: 746271 - RNA, 19 nt, Homo sapiens
guaaugaggaacuuuggaa

SEQ ID NO: 746272 - RNA, 19 nt, Homo sapiens
caaggcagcccacacucua

SEQ ID NO: 746273 - RNA, 19 nt, Homo sapiens
cuccauaccacuuaaauaa

SEQ ID NO: 746274 - RNA, 19 nt, Homo sapiens
gaaagcaauccaucguguu

SEQ ID NO: 746275 - RNA, 19 nt, Homo sapiens
ggaagauugagaaauaaga

SEQ ID NO: 746276 - RNA, 19 nt, Homo sapiens
aauggacacucugaucaua

SEQ ID NO: 746277 - RNA, 19 nt, Homo sapiens
gcacugccaaggcugguuu

SEQ ID NO: 746278 - RNA, 19 nt, Homo sapiens
gugcugagaugacaaugag

SEQ ID NO: 746279 - RNA, 19 nt, Homo sapiens
cuaaucagauaagcuguga

SEQ ID NO: 746280 - RNA, 19 nt, Homo sapiens
uggacacucugaucauaaa

SEQ ID NO: 746281 - RNA, 19 nt, Homo sapiens
uacaaagaaugaccaagug

SEQ ID NO: 746282 - RNA, 19 nt, Homo sapiens
ggagaaaguggaauguaca

SEQ ID NO: 746283 - RNA, 19 nt, Homo sapiens
cauaagcauucuccagcaa

SEQ ID NO: 746284 - RNA, 19 nt, Homo sapiens
ccaugaggcuuuaaagacu

SEQ ID NO: 746285 - RNA, 19 nt, Homo sapiens
ccaaaccaguggaaauuuu

SEQ ID NO: 746286 - RNA, 19 nt, Homo sapiens
acaggagaauggaaaugaa

SEQ ID NO: 746287 - RNA, 19 nt, Homo sapiens
gcauucuccauaccacuua

SEQ ID NO: 746288 - RNA, 19 nt, Homo sapiens
caggacacaugcaaaugga

SEQ ID NO: 746289 - RNA, 19 nt, Homo sapiens
uugcaccacuggaaacaaa

SEQ ID NO: 746290 - RNA, 19 nt, Homo sapiens
gggaauugcaccacuggaa

SEQ ID NO: 746291 - RNA, 19 nt, Homo sapiens
gcagccuucugacuagaug

SEQ ID NO: 746292 - RNA, 19 nt, Homo sapiens
gagaaaguggaauguacaa

SEQ ID NO: 746293 - RNA, 19 nt, Homo sapiens
ugaaacacguggagaagcu

SEQ ID NO: 746294 - RNA, 19 nt, Homo sapiens
ggucgaagagggagaaagu

SEQ ID NO: 746295 - RNA, 19 nt, Homo sapiens
caccaaaccaguggaaauu

SEQ ID NO: 746296 - RNA, 19 nt, Homo sapiens
uggcaguuguccaauuuga

SEQ ID NO: 746297 - RNA, 19 nt, Homo sapiens
gagcugggcaugcauggau

SEQ ID NO: 746298 - RNA, 19 nt, Homo sapiens
ugagcaccgugacauaaug

SEQ ID NO: 746299 - RNA, 19 nt, Homo sapiens
gcaggguaaugaggaacuu

SEQ ID NO: 746300 - RNA, 19 nt, Homo sapiens
gagcaccgugacauaauga

SEQ ID NO: 746301 - RNA, 19 nt, Homo sapiens
aaagcaauccaucguguug

SEQ ID NO: 746302 - RNA, 19 nt, Homo sapiens
guggaagaaaugcaaauga

SEQ ID NO: 746303 - RNA, 19 nt, Homo sapiens
acacagagucucacaacau

SEQ ID NO: 746304 - RNA, 19 nt, Homo sapiens
gaaaagggaaagaguuguu

SEQ ID NO: 746305 - RNA, 19 nt, Homo sapiens
caggagaauggaaaugaaa

SEQ ID NO: 746306 - RNA, 19 nt, Homo sapiens
gccaacaggagaauggaaa

SEQ ID NO: 746307 - RNA, 19 nt, Homo sapiens
caaaucaccaggauaaagc

SEQ ID NO: 746308 - RNA, 19 nt, Homo sapiens
uggaauguacaaagaauga

SEQ ID NO: 746309 - RNA, 19 nt, Homo sapiens
gacacagagucucacaaca

SEQ ID NO: 746310 - RNA, 19 nt, Homo sapiens
gauggugacccucgaugga

SEQ ID NO: 746311 - RNA, 19 nt, Homo sapiens
ucuaaacccugccugaaac

SEQ ID NO: 746312 - RNA, 19 nt, Homo sapiens
uuauggcaguuguccaauu

SEQ ID NO: 746313 - RNA, 19 nt, Homo sapiens
gcucuaaacccugccugaa

SEQ ID NO: 746314 - RNA, 19 nt, Homo sapiens
guaauggcaaacacucuug

SEQ ID NO: 746315 - RNA, 19 nt, Homo sapiens
gcccaggacacaauccaaa

SEQ ID NO: 746316 - RNA, 19 nt, Homo sapiens
gagaaacugcaggguaaug

SEQ ID NO: 746317 - RNA, 19 nt, Homo sapiens
gaaacacguggagaagcua

SEQ ID NO: 746318 - RNA, 19 nt, Homo sapiens
gcaguuguccaauuugaac

SEQ ID NO: 746319 - RNA, 19 nt, Homo sapiens
gcucagggagaaaguggaa

SEQ ID NO: 746320 - RNA, 19 nt, Homo sapiens
uaagcauucuccagcaagu

SEQ ID NO: 746321 - RNA, 19 nt, Homo sapiens
uuuaaagacugagcugaug

SEQ ID NO: 746322 - RNA, 19 nt, Homo sapiens
gaagauugagaaauaagac

SEQ ID NO: 746323 - RNA, 19 nt, Homo sapiens
cagagucucacaacauuca

SEQ ID NO: 746324 - RNA, 19 nt, Homo sapiens
gacccucgauggaauagac

SEQ ID NO: 746325 - RNA, 19 nt, Homo sapiens
uaaugaggaacuuuggaaa

SEQ ID NO: 746326 - RNA, 19 nt, Homo sapiens
gaccacacagcaucagaga

SEQ ID NO: 746327 - RNA, 19 nt, Homo sapiens
ccacaggagccaccaugga

SEQ ID NO: 746328 - RNA, 19 nt, Homo sapiens
caacaggagaauggaaaug

SEQ ID NO: 746329 - RNA, 19 nt, Homo sapiens
gcaaguaauggcaaacacu

SEQ ID NO: 746330 - RNA, 19 nt, Homo sapiens
acaaugaggguuggaauca

SEQ ID NO: 746331 - RNA, 19 nt, Homo sapiens
ggugacccucgauggaaua

SEQ ID NO: 746332 - RNA, 19 nt, Homo sapiens
gaaugaccaagugggaauu

SEQ ID NO: 746333 - RNA, 19 nt, Homo sapiens
uccaucguguugucaguaa

SEQ ID NO: 746334 - RNA, 19 nt, Homo sapiens
caccaugaggcuuuaaaga

SEQ ID NO: 746335 - RNA, 19 nt, Homo sapiens
ugaccugcauacccaaaca

SEQ ID NO: 746336 - RNA, 19 nt, Homo sapiens
ucuugccucuaaucagaua

SEQ ID NO: 746337 - RNA, 19 nt, Homo sapiens
gaauugcaccacuggaaac

SEQ ID NO: 746338 - RNA, 19 nt, Homo sapiens
cauaagcccaaccacauca

SEQ ID NO: 746339 - RNA, 19 nt, Homo sapiens
ggagauaucuucaguaauc

SEQ ID NO: 746340 - RNA, 19 nt, Homo sapiens
ggaauucccucuucagauu

SEQ ID NO: 746341 - RNA, 19 nt, Homo sapiens
ggugaaaucuccagaauga

SEQ ID NO: 746342 - RNA, 19 nt, Homo sapiens
gaaagaagccaaggaauuu

SEQ ID NO: 746343 - RNA, 19 nt, Homo sapiens
gauaauggaugaaaggauu

SEQ ID NO: 746344 - RNA, 19 nt, Homo sapiens
gcaaguaaauaccaugauu

SEQ ID NO: 746345 - RNA, 19 nt, Homo sapiens
cuaauaagcucuucuccua

SEQ ID NO: 746346 - RNA, 19 nt, Homo sapiens
gaaauuggauacuggcauu

SEQ ID NO: 746347 - RNA, 19 nt, Homo sapiens
gagaacaacuugcuaaucu

SEQ ID NO: 746348 - RNA, 19 nt, Homo sapiens
ccaaugguauuacaucuuu

SEQ ID NO: 746349 - RNA, 19 nt, Homo sapiens
ggacagaugaagcauauuu

SEQ ID NO: 746350 - RNA, 19 nt, Homo sapiens
gcucagaaauugaugaaau

SEQ ID NO: 746351 - RNA, 19 nt, Homo sapiens
cuacagcgcuauuaugauu

SEQ ID NO: 746352 - RNA, 19 nt, Homo sapiens
ggaagaauguggauacagu

SEQ ID NO: 746353 - RNA, 19 nt, Homo sapiens
gcaagcugauggaguuuaa

SEQ ID NO: 746354 - RNA, 19 nt, Homo sapiens
ggagggugcuuauuugaga

SEQ ID NO: 746355 - RNA, 19 nt, Homo sapiens
gcaacaaugucagaaagaa

SEQ ID NO: 746356 - RNA, 19 nt, Homo sapiens
gaaacuagagcaacaaugu

SEQ ID NO: 746357 - RNA, 19 nt, Homo sapiens
aggaaugccuucagaauuu

SEQ ID NO: 746358 - RNA, 19 nt, Homo sapiens
ugucuaagcuuaucaaauc

SEQ ID NO: 746359 - RNA, 19 nt, Homo sapiens
ggaagcagcagacaucauu

SEQ ID NO: 746360 - RNA, 19 nt, Homo sapiens
cagcagacaucauucagaa

SEQ ID NO: 746361 - RNA, 19 nt, Homo sapiens
gcugauggaguuuaauuua

SEQ ID NO: 746362 - RNA, 19 nt, Homo sapiens
ccaaggaauuugccaagaa

SEQ ID NO: 746363 - RNA, 19 nt, Homo sapiens
ugaaagagcaguuagaaga

SEQ ID NO: 746364 - RNA, 19 nt, Homo sapiens
gccaaagacuucaagauuc

SEQ ID NO: 746365 - RNA, 19 nt, Homo sapiens
gaacaaauggagaugaaau

SEQ ID NO: 746366 - RNA, 19 nt, Homo sapiens
caggagguauucaagauuu

SEQ ID NO: 746367 - RNA, 19 nt, Homo sapiens
gaaagagcaguuagaagaa

SEQ ID NO: 746368 - RNA, 19 nt, Homo sapiens
gaacaaacaaguuggagau

SEQ ID NO: 746369 - RNA, 19 nt, Homo sapiens
aaacaggacuugcuggaau

SEQ ID NO: 746370 - RNA, 19 nt, Homo sapiens
gaaguggugguuaaucuuu

SEQ ID NO: 746371 - RNA, 19 nt, Homo sapiens
gaacuagaugagcacauua

SEQ ID NO: 746372 - RNA, 19 nt, Homo sapiens
gguggagacuggauauuug

SEQ ID NO: 746373 - RNA, 19 nt, Homo sapiens
cagaaacaguccuggcuaa

SEQ ID NO: 746374 - RNA, 19 nt, Homo sapiens
caaacaaguuggagauauc

SEQ ID NO: 746375 - RNA, 19 nt, Homo sapiens
gaggugaaaucuccagaau

SEQ ID NO: 746376 - RNA, 19 nt, Homo sapiens
ccuaauugcccaagaguua

SEQ ID NO: 746377 - RNA, 19 nt, Homo sapiens
gagcaacaaugucagaaag

SEQ ID NO: 746378 - RNA, 19 nt, Homo sapiens
ccaccaaucuuuccagcaa

SEQ ID NO: 746379 - RNA, 19 nt, Homo sapiens
gaaguccgaugcagagcaa

SEQ ID NO: 746380 - RNA, 19 nt, Homo sapiens
gagauugaauuuacaaagg

SEQ ID NO: 746381 - RNA, 19 nt, Homo sapiens
caacaauauuccuacaguu

SEQ ID NO: 746382 - RNA, 19 nt, Homo sapiens
ccaggagggugcuuauuug

SEQ ID NO: 746383 - RNA, 19 nt, Homo sapiens
gaaaacaaguggagaagau

SEQ ID NO: 746384 - RNA, 19 nt, Homo sapiens
gaagugcuaugauccuaca

SEQ ID NO: 746385 - RNA, 19 nt, Homo sapiens
gaaaguagagaaacuagag

SEQ ID NO: 746386 - RNA, 19 nt, Homo sapiens
gagaugaaauuggauacug

SEQ ID NO: 746387 - RNA, 19 nt, Homo sapiens
aaacaaguggagaagauua

SEQ ID NO: 746388 - RNA, 19 nt, Homo sapiens
aaauggagaugaaauugga

SEQ ID NO: 746389 - RNA, 19 nt, Homo sapiens
ugaagacgcuggaauacuc

SEQ ID NO: 746390 - RNA, 19 nt, Homo sapiens
uugcuaaucuggacaagaa

SEQ ID NO: 746391 - RNA, 19 nt, Homo sapiens
guacugauaaacagacuuu

SEQ ID NO: 746392 - RNA, 19 nt, Homo sapiens
uaaagucugucaccuugga

SEQ ID NO: 746393 - RNA, 19 nt, Homo sapiens
agaaagaagccaaggaauu

SEQ ID NO: 746394 - RNA, 19 nt, Homo sapiens
gcagaugaauauauugaac

SEQ ID NO: 746395 - RNA, 19 nt, Homo sapiens
cccaagaaguggugguuaa

SEQ ID NO: 746396 - RNA, 19 nt, Homo sapiens
gcacaggagguauucaaga

SEQ ID NO: 746397 - RNA, 19 nt, Homo sapiens
uuggagauaucuucaguaa

SEQ ID NO: 746398 - RNA, 19 nt, Homo sapiens
aagcucuucuccuaaguua

SEQ ID NO: 746399 - RNA, 19 nt, Homo sapiens
augagcaucuucaacaaua

SEQ ID NO: 746400 - RNA, 19 nt, Homo sapiens
gcauugauaggacauuaaa

SEQ ID NO: 746401 - RNA, 19 nt, Homo sapiens
ucuaugaucuguauacaag

SEQ ID NO: 746402 - RNA, 19 nt, Homo sapiens
gccaggagggugcuuauuu

SEQ ID NO: 746403 - RNA, 19 nt, Homo sapiens
cccauuguguugauguuua

SEQ ID NO: 746404 - RNA, 19 nt, Homo sapiens
uagaugagcacauuagcua

SEQ ID NO: 746405 - RNA, 19 nt, Homo sapiens
gcaagucugcucaggagaa

SEQ ID NO: 746406 - RNA, 19 nt, Homo sapiens
caagauuccaaugguauua

SEQ ID NO: 746407 - RNA, 19 nt, Homo sapiens
agaacuagaugagcacauu

SEQ ID NO: 746408 - RNA, 19 nt, Homo sapiens
ggaauuugccaagaaggua

SEQ ID NO: 746409 - RNA, 19 nt, Homo sapiens
caaggaauuugccaagaag

SEQ ID NO: 746410 - RNA, 19 nt, Homo sapiens
gaauauauugaacgucuug

SEQ ID NO: 746411 - RNA, 19 nt, Homo sapiens
acaaacaaguuggagauau

SEQ ID NO: 746412 - RNA, 19 nt, Homo sapiens
uaccagugcucaaagaaga

SEQ ID NO: 746413 - RNA, 19 nt, Homo sapiens
gcaccuaauugcccaagag

SEQ ID NO: 746414 - RNA, 19 nt, Homo sapiens
ucaacaauauuccuacagu

SEQ ID NO: 746415 - RNA, 19 nt, Homo sapiens
gcgcuauuaugauucgaaa

SEQ ID NO: 746416 - RNA, 19 nt, Homo sapiens
aaacaguccuggcuaaacu

SEQ ID NO: 746417 - RNA, 19 nt, Homo sapiens
uagagaaacuagagcaaca

SEQ ID NO: 746418 - RNA, 19 nt, Homo sapiens
gcucaaagaagaggugaaa

SEQ ID NO: 746419 - RNA, 19 nt, Homo sapiens
gcuaaucuggacaagaaua

SEQ ID NO: 746420 - RNA, 19 nt, Homo sapiens
gaacgucuuguauggagaa

SEQ ID NO: 746421 - RNA, 19 nt, Homo sapiens
gcagacaucauucagaagu

SEQ ID NO: 746422 - RNA, 19 nt, Homo sapiens
gaagaauguggauacaguu

SEQ ID NO: 746423 - RNA, 19 nt, Homo sapiens
gaaacaggacuugcuggaa

SEQ ID NO: 746424 - RNA, 19 nt, Homo sapiens
cguaccaacuuaccacuug

SEQ ID NO: 746425 - RNA, 19 nt, Homo sapiens
uagacagcguaccaacuua

SEQ ID NO: 746426 - RNA, 19 nt, Homo sapiens
uguggcagaugaauauauu

SEQ ID NO: 746427 - RNA, 19 nt, Homo sapiens
gcuggaauacucugucaaa

SEQ ID NO: 746428 - RNA, 19 nt, Homo sapiens
auucagaaguugcaccuaa

SEQ ID NO: 746429 - RNA, 19 nt, Homo sapiens
caacuucgugcugauuaua

SEQ ID NO: 746430 - RNA, 19 nt, Homo sapiens
gaggaaaguagagaaacua

SEQ ID NO: 746431 - RNA, 19 nt, Homo sapiens
gagcaucuucaacaauauu

SEQ ID NO: 746432 - RNA, 19 nt, Homo sapiens
cagaagugcuaugauccua

SEQ ID NO: 746433 - RNA, 19 nt, Homo sapiens
gauggagaauugaaaucug

SEQ ID NO: 746434 - RNA, 19 nt, Homo sapiens
agaauauacuucacuccuu

SEQ ID NO: 746435 - RNA, 19 nt, Homo sapiens
ggacaagaauauacuucac

SEQ ID NO: 746436 - RNA, 19 nt, Homo sapiens
gaacagaagaaaacagauu

SEQ ID NO: 746437 - RNA, 19 nt, Homo sapiens
cuaggaaugcaaaucuuua

SEQ ID NO: 746438 - RNA, 19 nt, Homo sapiens
gaaaggauucagaggaaag

SEQ ID NO: 746439 - RNA, 19 nt, Homo sapiens
gcaaugcucuccucuucaa

SEQ ID NO: 746440 - RNA, 19 nt, Homo sapiens
gacgagaucugcugcaaga

SEQ ID NO: 746441 - RNA, 19 nt, Homo sapiens
agaacaagcuuaucacugu

SEQ ID NO: 746442 - RNA, 19 nt, Homo sapiens
gacccaagaucaccuauca

SEQ ID NO: 746443 - RNA, 19 nt, Homo sapiens
gaagugaggcugguaguga

SEQ ID NO: 746444 - RNA, 19 nt, Homo sapiens
ggaccucacuacacaacaa

SEQ ID NO: 746445 - RNA, 19 nt, Homo sapiens
ccaaagacaaggaggauuu

SEQ ID NO: 746446 - RNA, 19 nt, Homo sapiens
caacaaauccugcccuaca

SEQ ID NO: 746447 - RNA, 19 nt, Homo sapiens
gcaucgaacacaagaagua

SEQ ID NO: 746448 - RNA, 19 nt, Homo sapiens
gcacucugcccauugauga

SEQ ID NO: 746449 - RNA, 19 nt, Homo sapiens
ccacagcuaugacgagauc

SEQ ID NO: 746450 - RNA, 19 nt, Homo sapiens
uccagaaccugcuguacua

SEQ ID NO: 746451 - RNA, 19 nt, Homo sapiens
gaaaaugaccccaacauca

SEQ ID NO: 746452 - RNA, 19 nt, Homo sapiens
gggauguguuccagcuaua

SEQ ID NO: 746453 - RNA, 19 nt, Homo sapiens
caaggaggauuucuucaac

SEQ ID NO: 746454 - RNA, 19 nt, Homo sapiens
agccagagcugcagaacaa

SEQ ID NO: 746455 - RNA, 19 nt, Homo sapiens
ucaggcgacuacagaagua

SEQ ID NO: 746456 - RNA, 19 nt, Homo sapiens
gagguugacucuuaguucu

SEQ ID NO: 746457 - RNA, 19 nt, Homo sapiens
ccgcaaugcucuccucuuc

SEQ ID NO: 746458 - RNA, 19 nt, Homo sapiens
gugacuggauggacacauu

SEQ ID NO: 746459 - RNA, 19 nt, Homo sapiens
ggugcacucugcccauuga

SEQ ID NO: 746460 - RNA, 19 nt, Homo sapiens
ccaacaccauccacuugaa

SEQ ID NO: 746461 - RNA, 19 nt, Homo sapiens
gcaagacaggcaugagcua

SEQ ID NO: 746462 - RNA, 19 nt, Homo sapiens
aacggaagcugauccaguu

SEQ ID NO: 746463 - RNA, 19 nt, Homo sapiens
caaauccugcccuacauug

SEQ ID NO: 746464 - RNA, 19 nt, Homo sapiens
cauacugucuagagguuga

SEQ ID NO: 746465 - RNA, 19 nt, Homo sapiens
gcagagggauuggcaagcu

SEQ ID NO: 746466 - RNA, 19 nt, Homo sapiens
gcaagaggcaugucuaucc

SEQ ID NO: 746467 - RNA, 19 nt, Homo sapiens
gaaguuggugcccaucaug

SEQ ID NO: 746468 - RNA, 19 nt, Homo sapiens
agacauccauuucaaacag

SEQ ID NO: 746469 - RNA, 19 nt, Homo sapiens
gaggagagcaagcagaagu

SEQ ID NO: 746470 - RNA, 19 nt, Homo sapiens
ucacagcuauggaaaagaa

SEQ ID NO: 746471 - RNA, 19 nt, Homo sapiens
guacuacggcguugugaca

SEQ ID NO: 746472 - RNA, 19 nt, Homo sapiens
gcgcauugcuauccagaac

SEQ ID NO: 746473 - RNA, 19 nt, Homo sapiens
cuaggaggcuugucauacu

SEQ ID NO: 746474 - RNA, 19 nt, Homo sapiens
agacaaggaggauuucuuc

SEQ ID NO: 746475 - RNA, 19 nt, Homo sapiens
aaagcuggcuggcuaucug

SEQ ID NO: 746476 - RNA, 19 nt, Homo sapiens
gucauacugucuagagguu

SEQ ID NO: 746477 - RNA, 19 nt, Homo sapiens
gcugcagcauguugaugaa

SEQ ID NO: 746478 - RNA, 19 nt, Homo sapiens
ggagagcaagcagaaguug

SEQ ID NO: 746479 - RNA, 19 nt, Homo sapiens
acaaggaggauuucuucaa

SEQ ID NO: 746480 - RNA, 19 nt, Homo sapiens
gguugacucuuaguucugu

SEQ ID NO: 746481 - RNA, 19 nt, Homo sapiens
cgggauguguuccagcuau

SEQ ID NO: 746482 - RNA, 19 nt, Homo sapiens
guccaaguguacaucauca

SEQ ID NO: 746483 - RNA, 19 nt, Homo sapiens
uaugauguaccugucuuua

SEQ ID NO: 746484 - RNA, 19 nt, Homo sapiens
gcccucgagcccauuguua

SEQ ID NO: 746485 - RNA, 19 nt, Homo sapiens
uauccuacgugaccaagca

SEQ ID NO: 746486 - RNA, 19 nt, Homo sapiens
caagaggcaugucuauccu

SEQ ID NO: 746487 - RNA, 19 nt, Homo sapiens
cgccacauccagaagauuu

SEQ ID NO: 746488 - RNA, 19 nt, Homo sapiens
cuccaguacuccaauguau

SEQ ID NO: 746489 - RNA, 19 nt, Homo sapiens
caucaucugcuggaaguga

SEQ ID NO: 746490 - RNA, 19 nt, Homo sapiens
ccaguacuccaauguauac

SEQ ID NO: 746491 - RNA, 19 nt, Homo sapiens
gcagcuucguguccaugga

SEQ ID NO: 746492 - RNA, 19 nt, Homo sapiens
gcauauucuucagcgaguu

SEQ ID NO: 746493 - RNA, 19 nt, Homo sapiens
gcagaacaagcuuaucacu

SEQ ID NO: 746494 - RNA, 19 nt, Homo sapiens
cugaucggcuguccugugu

SEQ ID NO: 746495 - RNA, 19 nt, Homo sapiens
cagagggauuggcaagcuu

SEQ ID NO: 746496 - RNA, 19 nt, Homo sapiens
aguucgggcuuaugaagaa

SEQ ID NO: 746497 - RNA, 19 nt, Homo sapiens
gcauugcuauccagaaccu

SEQ ID NO: 746498 - RNA, 19 nt, Homo sapiens
aggcagauguggagcucaa

SEQ ID NO: 746499 - RNA, 19 nt, Homo sapiens
cgagaucugcugcaagaca

SEQ ID NO: 746500 - RNA, 19 nt, Homo sapiens
cugcagaacaagcuuauca

SEQ ID NO: 746501 - RNA, 19 nt, Homo sapiens
guccaacaccauccacuug

SEQ ID NO: 746502 - RNA, 19 nt, Homo sapiens
ccucgagcccauuguuaaa

SEQ ID NO: 746503 - RNA, 19 nt, Homo sapiens
aaagacauccauuucaaac

SEQ ID NO: 746504 - RNA, 19 nt, Homo sapiens
caagaaguacagccgcaau

SEQ ID NO: 746505 - RNA, 19 nt, Homo sapiens
aaguguacaucaucaccaa

SEQ ID NO: 746506 - RNA, 19 nt, Homo sapiens
ggaggauuucuucaacuca

SEQ ID NO: 746507 - RNA, 19 nt, Homo sapiens
caaagacaaggaggauuuc

SEQ ID NO: 746508 - RNA, 19 nt, Homo sapiens
ggaagugaggcugguagug

SEQ ID NO: 746509 - RNA, 19 nt, Homo sapiens
acaaauccugcccuacauu

SEQ ID NO: 746510 - RNA, 19 nt, Homo sapiens
gaccucacuacacaacaaa

SEQ ID NO: 746511 - RNA, 19 nt, Homo sapiens
caacaccauccacuugaag

SEQ ID NO: 746512 - RNA, 19 nt, Homo sapiens
uaggaggcuugucauacug

SEQ ID NO: 746513 - RNA, 19 nt, Homo sapiens
gaaguacagccgcaaugcu

SEQ ID NO: 746514 - RNA, 19 nt, Homo sapiens
gacucuuaguucuguaaau

SEQ ID NO: 746515 - RNA, 19 nt, Homo sapiens
ugacaagucccugcaagag

SEQ ID NO: 746516 - RNA, 19 nt, Homo sapiens
aacaaauccugcccuacau

SEQ ID NO: 746517 - RNA, 19 nt, Homo sapiens
ugauguaccugucuuuacc

SEQ ID NO: 746518 - RNA, 19 nt, Homo sapiens
ccaggaguaugauguaccu

SEQ ID NO: 746519 - RNA, 19 nt, Homo sapiens
ggcccaggaguaugaugua

SEQ ID NO: 746520 - RNA, 19 nt, Homo sapiens
agaaguuggugcccaucau

SEQ ID NO: 746521 - RNA, 19 nt, Homo sapiens
gugcaucgaacacaagaag

SEQ ID NO: 746522 - RNA, 19 nt, Homo sapiens
ugguguccauccuccagua

SEQ ID NO: 746523 - RNA, 19 nt, Homo sapiens
guaugauguaccugucuuu

SEQ ID NO: 746524 - RNA, 19 nt, Homo sapiens
uggaggagagcaagcagaa

SEQ ID NO: 746525 - RNA, 19 nt, Homo sapiens
ugacuggauggacacauug

SEQ ID NO: 746526 - RNA, 19 nt, Homo sapiens
gcuaccaugagcuggauga

SEQ ID NO: 746527 - RNA, 19 nt, Homo sapiens
ggaccugguagaugacaag

SEQ ID NO: 746528 - RNA, 19 nt, Homo sapiens
gaaaguagaauuacaagga

SEQ ID NO: 746529 - RNA, 19 nt, Homo sapiens
ccaaacaccuacccaauug

SEQ ID NO: 746530 - RNA, 19 nt, Homo sapiens
cgaaacaccugacuccaaa

SEQ ID NO: 746531 - RNA, 19 nt, Homo sapiens
gaacgcaggugcagcugaa

SEQ ID NO: 746532 - RNA, 19 nt, Homo sapiens
ugaacgaguugcagaauuu

SEQ ID NO: 746533 - RNA, 19 nt, Homo sapiens
ugaagacccuggcccauaa

SEQ ID NO: 746534 - RNA, 19 nt, Homo sapiens
ugcaagaccuuacccuuua

SEQ ID NO: 746535 - RNA, 19 nt, Homo sapiens
gaggaacccugaucucuca

SEQ ID NO: 746536 - RNA, 19 nt, Homo sapiens
gcuuagagauugaacauuc

SEQ ID NO: 746537 - RNA, 19 nt, Homo sapiens
gggcagaaaucgagagugu

SEQ ID NO: 746538 - RNA, 19 nt, Homo sapiens
ggaaaacgcuuagagauug

SEQ ID NO: 746539 - RNA, 19 nt, Homo sapiens
ugaaggccaucgaaacuuu

SEQ ID NO: 746540 - RNA, 19 nt, Homo sapiens
gaucagguuugcccacuug

SEQ ID NO: 746541 - RNA, 19 nt, Homo sapiens
ugaagaagguagagcaaga

SEQ ID NO: 746542 - RNA, 19 nt, Homo sapiens
guaugugggugccauuauu

SEQ ID NO: 746543 - RNA, 19 nt, Homo sapiens
ggagaaccaugcccugaag

SEQ ID NO: 746544 - RNA, 19 nt, Homo sapiens
ggaagaaucuauggcaaac

SEQ ID NO: 746545 - RNA, 19 nt, Homo sapiens
aaacagacccaguccaaga

SEQ ID NO: 746546 - RNA, 19 nt, Homo sapiens
gacggcagcugagguggua

SEQ ID NO: 746547 - RNA, 19 nt, Homo sapiens
caaaggagccggaaaauuc

SEQ ID NO: 746548 - RNA, 19 nt, Homo sapiens
ggacaacaacgggcagaaa

SEQ ID NO: 746549 - RNA, 19 nt, Homo sapiens
gugaacgaguugcagaauu

SEQ ID NO: 746550 - RNA, 19 nt, Homo sapiens
caaaacggcugacgagguu

SEQ ID NO: 746551 - RNA, 19 nt, Homo sapiens
caucagaagggacagagua

SEQ ID NO: 746552 - RNA, 19 nt, Homo sapiens
gagcaggaaauaaugaaga

SEQ ID NO: 746553 - RNA, 19 nt, Homo sapiens
gaagcuggagacccacaua

SEQ ID NO: 746554 - RNA, 19 nt, Homo sapiens
gggaagaaucuauggcaaa

SEQ ID NO: 746555 - RNA, 19 nt, Homo sapiens
agauagacgugcauaggaa

SEQ ID NO: 746556 - RNA, 19 nt, Homo sapiens
gacgagcacugggcgauga

SEQ ID NO: 746557 - RNA, 19 nt, Homo sapiens
gagaaagauguuccaguga

SEQ ID NO: 746558 - RNA, 19 nt, Homo sapiens
acaccugacuccaaaguuc

SEQ ID NO: 746559 - RNA, 19 nt, Homo sapiens
agacggcaguggugaaugu

SEQ ID NO: 746560 - RNA, 19 nt, Homo sapiens
gcaagaccuuacccuuuac

SEQ ID NO: 746561 - RNA, 19 nt, Homo sapiens
gaaaacgcuuagagauuga

SEQ ID NO: 746562 - RNA, 19 nt, Homo sapiens
ggagauggugcagguguuu

SEQ ID NO: 746563 - RNA, 19 nt, Homo sapiens
gaaggacggaaccugaaga

SEQ ID NO: 746564 - RNA, 19 nt, Homo sapiens
gacaacaacgggcagaaau

SEQ ID NO: 746565 - RNA, 19 nt, Homo sapiens
gcaaggcacuuuuaaacgu

SEQ ID NO: 746566 - RNA, 19 nt, Homo sapiens
gaacgaguugcagaauuug

SEQ ID NO: 746567 - RNA, 19 nt, Homo sapiens
ccaaaguucguaugguuau

SEQ ID NO: 746568 - RNA, 19 nt, Homo sapiens
cuccaaaguucguaugguu

SEQ ID NO: 746569 - RNA, 19 nt, Homo sapiens
cccuauagcuccuuuaugc

SEQ ID NO: 746570 - RNA, 19 nt, Homo sapiens
gggccgagcaggaaauaau

SEQ ID NO: 746571 - RNA, 19 nt, Homo sapiens
gccagcgccuccaucaaga

SEQ ID NO: 746572 - RNA, 19 nt, Homo sapiens
gaagaagguagagcaagau

SEQ ID NO: 746573 - RNA, 19 nt, Homo sapiens
ccacuugauugagaaagau

SEQ ID NO: 746574 - RNA, 19 nt, Homo sapiens
ccaccaugaacaagcuuua

SEQ ID NO: 746575 - RNA, 19 nt, Homo sapiens
gcucagggaagaaucuaug

SEQ ID NO: 746576 - RNA, 19 nt, Homo sapiens
gagauggugcagguguuua

SEQ ID NO: 746577 - RNA, 19 nt, Homo sapiens
cccaaacaccuacccaauu

SEQ ID NO: 746578 - RNA, 19 nt, Homo sapiens
uuaagcagcagcaucagaa

SEQ ID NO: 746579 - RNA, 19 nt, Homo sapiens
aaucaucggacauuucuau

SEQ ID NO: 746580 - RNA, 19 nt, Homo sapiens
cagguuugcccacuugauu

SEQ ID NO: 746581 - RNA, 19 nt, Homo sapiens
aagaaucuauggcaaacuc

SEQ ID NO: 746582 - RNA, 19 nt, Homo sapiens
caagauagacgugcauagg

SEQ ID NO: 746583 - RNA, 19 nt, Homo sapiens
ggccaguucuuggucaaau

SEQ ID NO: 746584 - RNA, 19 nt, Homo sapiens
gcugaauggccaccaguug

SEQ ID NO: 746585 - RNA, 19 nt, Homo sapiens
gaacugugagcaagugaac

SEQ ID NO: 746586 - RNA, 19 nt, Homo sapiens
agcaggaaauaaugaagaa

SEQ ID NO: 746587 - RNA, 19 nt, Homo sapiens
gcaaacucaaggaggagaa

SEQ ID NO: 746588 - RNA, 19 nt, Homo sapiens
cuacagcggccaguucuug

SEQ ID NO: 746589 - RNA, 19 nt, Homo sapiens
guucguaugguuaucauca

SEQ ID NO: 746590 - RNA, 19 nt, Homo sapiens
uugcaagaccuuacccuuu

SEQ ID NO: 746591 - RNA, 19 nt, Homo sapiens
aaacaaaggagccggaaaa

SEQ ID NO: 746592 - RNA, 19 nt, Homo sapiens
auucaaggcucagggaaga

SEQ ID NO: 746593 - RNA, 19 nt, Homo sapiens
ccgaaacaccugacuccaa

SEQ ID NO: 746594 - RNA, 19 nt, Homo sapiens
ggcaagccaucaugaagcu

SEQ ID NO: 746595 - RNA, 19 nt, Homo sapiens
gcaagugaacaccgagagu

SEQ ID NO: 746596 - RNA, 19 nt, Homo sapiens
agagaacugugagcaagug

SEQ ID NO: 746597 - RNA, 19 nt, Homo sapiens
gccagaggcccaauucaag

SEQ ID NO: 746598 - RNA, 19 nt, Homo sapiens
ggaggccuaugagaaugau

SEQ ID NO: 746599 - RNA, 19 nt, Homo sapiens
gcaggaaauaaugaagaaa

SEQ ID NO: 746600 - RNA, 19 nt, Homo sapiens
ggaaggacggaaccugaag

SEQ ID NO: 746601 - RNA, 19 nt, Homo sapiens
cugaagacccuggcccaua

SEQ ID NO: 746602 - RNA, 19 nt, Homo sapiens
gaaucuauggcaaacucaa

SEQ ID NO: 746603 - RNA, 19 nt, Homo sapiens
gggaggccuaugagaauga

SEQ ID NO: 746604 - RNA, 19 nt, Homo sapiens
caggaaauaaugaagaaag

SEQ ID NO: 746605 - RNA, 19 nt, Homo sapiens
aagaagguagagcaagaua

SEQ ID NO: 746606 - RNA, 19 nt, Homo sapiens
ggcccauaauaacuuugua

SEQ ID NO: 746607 - RNA, 19 nt, Homo sapiens
acaccucagugggaagaaa

SEQ ID NO: 746608 - RNA, 19 nt, Homo sapiens
ccggcaggccugagaauga

SEQ ID NO: 746609 - RNA, 19 nt, Homo sapiens
cgggaaaguagaauuacaa

SEQ ID NO: 746610 - RNA, 19 nt, Homo sapiens
caaaguucguaugguuauc

SEQ ID NO: 746611 - RNA, 19 nt, Homo sapiens
gagcacaagaucuccuaca

SEQ ID NO: 746612 - RNA, 19 nt, Homo sapiens
aaaucaccaucuccucguu

SEQ ID NO: 746613 - RNA, 19 nt, Homo sapiens
agagcaagauaccgagaca

SEQ ID NO: 746614 - RNA, 19 nt, Homo sapiens
ccuggcccauaauaacuuu

SEQ ID NO: 746615 - RNA, 19 nt, Homo sapiens
caaaacagacccaguccaa

SEQ ID NO: 746616 - RNA, 19 nt, Homo sapiens
ccaggcaagccaucaugaa

SEQ ID NO: 746617 - RNA, 19 nt, Homo sapiens
ggcucaguaugguacagua

SEQ ID NO: 746618 - RNA, 19 nt, Homo sapiens
cccacuugauugagaaaga

SEQ ID NO: 746619 - RNA, 19 nt, Homo sapiens
gguuugcccacuugauuga

SEQ ID NO: 746620 - RNA, 19 nt, Homo sapiens
caacaacgggcagaaaucg

SEQ ID NO: 746621 - RNA, 19 nt, Homo sapiens
gggguggggugcaaagaaa

SEQ ID NO: 746622 - RNA, 19 nt, Homo sapiens
uccaaaguucguaugguua

SEQ ID NO: 746623 - RNA, 19 nt, Homo sapiens
gaacauucggugcccaaaa

SEQ ID NO: 746624 - RNA, 19 nt, Homo sapiens
gaagacccuggcccauaau

SEQ ID NO: 746625 - RNA, 19 nt, Homo sapiens
gaccaggcaagccaucaug

SEQ ID NO: 746626 - RNA, 19 nt, Homo sapiens
agcaagauaccgagacaaa

SEQ ID NO: 746627 - RNA, 19 nt, Homo sapiens
cuccuccgcuuguaagaug

SEQ ID NO: 746628 - RNA, 19 nt, Homo sapiens
uaaggaagcucaagauaua

SEQ ID NO: 746629 - RNA, 19 nt, Homo sapiens
gaucauuccucauguauaa

SEQ ID NO: 746630 - RNA, 19 nt, Homo sapiens
gcacuaccauuuauucuuu

SEQ ID NO: 746631 - RNA, 19 nt, Homo sapiens
ucaaauagauugcuccuaa

SEQ ID NO: 746632 - RNA, 19 nt, Homo sapiens
cacaggaacuuaaauguua

SEQ ID NO: 746633 - RNA, 19 nt, Homo sapiens
acacauaggugcugcauuu

SEQ ID NO: 746634 - RNA, 19 nt, Homo sapiens
caaccacucuucacaauga

SEQ ID NO: 746635 - RNA, 19 nt, Homo sapiens
gguacuagcuaagaaauaa

SEQ ID NO: 746636 - RNA, 19 nt, Homo sapiens
cauaggugcugcauuuaua

SEQ ID NO: 746637 - RNA, 19 nt, Homo sapiens
gcugagaagucgauuacua

SEQ ID NO: 746638 - RNA, 19 nt, Homo sapiens
gagcagcacuaccauuuau

SEQ ID NO: 746639 - RNA, 19 nt, Homo sapiens
caguaaagcuggaaaauua

SEQ ID NO: 746640 - RNA, 19 nt, Homo sapiens
ggaaacagcccaccacaga

SEQ ID NO: 746641 - RNA, 19 nt, Homo sapiens
gaaaacauaugaccuuuga

SEQ ID NO: 746642 - RNA, 19 nt, Homo sapiens
gcagaaaccaugugauuug

SEQ ID NO: 746643 - RNA, 19 nt, Homo sapiens
gaacgcacuauuacaguua

SEQ ID NO: 746644 - RNA, 19 nt, Homo sapiens
cgaaauaucccgccucauu

SEQ ID NO: 746645 - RNA, 19 nt, Homo sapiens
gggaggugcuggauaguuu

SEQ ID NO: 746646 - RNA, 19 nt, Homo sapiens
ggaccaagcuagacaagca

SEQ ID NO: 746647 - RNA, 19 nt, Homo sapiens
gaaagugcaucagugaaga

SEQ ID NO: 746648 - RNA, 19 nt, Homo sapiens
caaaauaacuggucacuuc

SEQ ID NO: 746649 - RNA, 19 nt, Homo sapiens
aaacacaucuagacaagga

SEQ ID NO: 746650 - RNA, 19 nt, Homo sapiens
aagaagaggugaaacuuga

SEQ ID NO: 746651 - RNA, 19 nt, Homo sapiens
gagagcagcacuaccauuu

SEQ ID NO: 746652 - RNA, 19 nt, Homo sapiens
gugaagagaugcaagacuu

SEQ ID NO: 746653 - RNA, 19 nt, Homo sapiens
gcacuucccuuuguuguag

SEQ ID NO: 746654 - RNA, 19 nt, Homo sapiens
ggagacuguucaucuguuu

SEQ ID NO: 746655 - RNA, 19 nt, Homo sapiens
cuacaugauugaaugcaua

SEQ ID NO: 746656 - RNA, 19 nt, Homo sapiens
caaauagauugcuccuaaa

SEQ ID NO: 746657 - RNA, 19 nt, Homo sapiens
aaacaagccucggaucuga

SEQ ID NO: 746658 - RNA, 19 nt, Homo sapiens
ccagacaccugaugagaau

SEQ ID NO: 746659 - RNA, 19 nt, Homo sapiens
ggaaacccauagaaguuga

SEQ ID NO: 746660 - RNA, 19 nt, Homo sapiens
caccuuaaguaguaaagua

SEQ ID NO: 746661 - RNA, 19 nt, Homo sapiens
gauagaaguccaaccguuu

SEQ ID NO: 746662 - RNA, 19 nt, Homo sapiens
ccacuacacuucagaccaa

SEQ ID NO: 746663 - RNA, 19 nt, Homo sapiens
guuguagucucacaguaua

SEQ ID NO: 746664 - RNA, 19 nt, Homo sapiens
aaauuagacuccaccuuaa

SEQ ID NO: 746665 - RNA, 19 nt, Homo sapiens
gagccucacuaagcuauuu

SEQ ID NO: 746666 - RNA, 19 nt, Homo sapiens
ucagcuaacaggcaaauua

SEQ ID NO: 746667 - RNA, 19 nt, Homo sapiens
cagcaaagcccaguacgua

SEQ ID NO: 746668 - RNA, 19 nt, Homo sapiens
uagacaaacugaauggauu

SEQ ID NO: 746669 - RNA, 19 nt, Homo sapiens
cuuauaggaugcuuaguuu

SEQ ID NO: 746670 - RNA, 19 nt, Homo sapiens
gcuccuaaauccaauuguu

SEQ ID NO: 746671 - RNA, 19 nt, Homo sapiens
gagaauguauacuuuaugc

SEQ ID NO: 746672 - RNA, 19 nt, Homo sapiens
gaaguaaaggcucaggaaa

SEQ ID NO: 746673 - RNA, 19 nt, Homo sapiens
gaagaaaacuuuguuaguc

SEQ ID NO: 746674 - RNA, 19 nt, Homo sapiens
cuauaucccugaugaaaug

SEQ ID NO: 746675 - RNA, 19 nt, Homo sapiens
gcaaaggauucggaaacuu

SEQ ID NO: 746676 - RNA, 19 nt, Homo sapiens
gaauuucuauacagacuag

SEQ ID NO: 746677 - RNA, 19 nt, Homo sapiens
ccacgcugcucucugaauu

SEQ ID NO: 746678 - RNA, 19 nt, Homo sapiens
gaaugacugugaaaacaua

SEQ ID NO: 746679 - RNA, 19 nt, Homo sapiens
gcaaucaguucuuugaaaa

SEQ ID NO: 746680 - RNA, 19 nt, Homo sapiens
gcucugcacuucccuuugu

SEQ ID NO: 746681 - RNA, 19 nt, Homo sapiens
gaauugacgcuguauaauc

SEQ ID NO: 746682 - RNA, 19 nt, Homo sapiens
gcaagacacagacacuaaa

SEQ ID NO: 746683 - RNA, 19 nt, Homo sapiens
uagaaaguaucuucaagga

SEQ ID NO: 746684 - RNA, 19 nt, Homo sapiens
uaagggaagugcugaaugg

SEQ ID NO: 746685 - RNA, 19 nt, Homo sapiens
guaagucuauucuggagau

SEQ ID NO: 746686 - RNA, 19 nt, Homo sapiens
aauguaaccuauuccagua

SEQ ID NO: 746687 - RNA, 19 nt, Homo sapiens
ucgaggcgcuuucagguaa

SEQ ID NO: 746688 - RNA, 19 nt, Homo sapiens
gcauuuauaucugcugguu

SEQ ID NO: 746689 - RNA, 19 nt, Homo sapiens
gcugcucucugaauugauu

SEQ ID NO: 746690 - RNA, 19 nt, Homo sapiens
uaacagcaaucagcuaaca

SEQ ID NO: 746691 - RNA, 19 nt, Homo sapiens
agaaucacaugcacaaguu

SEQ ID NO: 746692 - RNA, 19 nt, Homo sapiens
ggaaguaaaggcucaggaa

SEQ ID NO: 746693 - RNA, 19 nt, Homo sapiens
ccaagugguugucaaaaua

SEQ ID NO: 746694 - RNA, 19 nt, Homo sapiens
uaaaggcaauguugagaca

SEQ ID NO: 746695 - RNA, 19 nt, Homo sapiens
gacuccaccuuaaguagua

SEQ ID NO: 746696 - RNA, 19 nt, Homo sapiens
uggaacggcugguuuaaau

SEQ ID NO: 746697 - RNA, 19 nt, Homo sapiens
gcuaacaggcaaauuaaga

SEQ ID NO: 746698 - RNA, 19 nt, Homo sapiens
guucaaggcucagggaaga

SEQ ID NO: 746699 - RNA, 19 nt, Homo sapiens
gauauugcuucuaugaauc

SEQ ID NO: 746700 - RNA, 19 nt, Homo sapiens
aggaggagaucaugaagaa

SEQ ID NO: 746701 - RNA, 19 nt, Homo sapiens
ggauuucaguuagagaauu

SEQ ID NO: 746702 - RNA, 19 nt, Homo sapiens
gaagagauccccuugaaga

SEQ ID NO: 746703 - RNA, 19 nt, Homo sapiens
ccucggaccuagaaaguau

SEQ ID NO: 746704 - RNA, 19 nt, Homo sapiens
uaacaugaguaaccuaagg

SEQ ID NO: 746705 - RNA, 19 nt, Homo sapiens
gcagaugccaaaccaaaga

SEQ ID NO: 746706 - RNA, 19 nt, Homo sapiens
ggagagcugugagcaagug

SEQ ID NO: 746707 - RNA, 19 nt, Homo sapiens
aaucacugccucauucuua

SEQ ID NO: 746708 - RNA, 19 nt, Homo sapiens
ccagaaauuggcuuaauga

SEQ ID NO: 746709 - RNA, 19 nt, Homo sapiens
ccaaagacagauugcuuaa

SEQ ID NO: 746710 - RNA, 19 nt, Homo sapiens
aaagugaggauggugauua

SEQ ID NO: 746711 - RNA, 19 nt, Homo sapiens
cauaaggaagcucaagaua

SEQ ID NO: 746712 - RNA, 19 nt, Homo sapiens
gcaccucugcggcuuguaa

SEQ ID NO: 746713 - RNA, 19 nt, Homo sapiens
uagccuauaucccugauga

SEQ ID NO: 746714 - RNA, 19 nt, Homo sapiens
gacaagcacuagacaaacu

SEQ ID NO: 746715 - RNA, 19 nt, Homo sapiens
gcuuugugcuucugacuau

SEQ ID NO: 746716 - RNA, 19 nt, Homo sapiens
gaacggcugguuuaaaugg

SEQ ID NO: 746717 - RNA, 19 nt, Homo sapiens
acagauugcuuaaccaaca

SEQ ID NO: 746718 - RNA, 19 nt, Homo sapiens
uuagagaauuucaccuuga

SEQ ID NO: 746719 - RNA, 19 nt, Homo sapiens
caaaggauucggaaacuuc

SEQ ID NO: 746720 - RNA, 19 nt, Homo sapiens
caggauuucuguauacugu

SEQ ID NO: 746721 - RNA, 19 nt, Homo sapiens
aaaauuagacuccaccuua

SEQ ID NO: 746722 - RNA, 19 nt, Homo sapiens
aaagaaagugcaucaguga

SEQ ID NO: 746723 - RNA, 19 nt, Homo sapiens
cagcuaacaggcaaauuaa

SEQ ID NO: 746724 - RNA, 19 nt, Homo sapiens
gggaagaauuuauggaaaa

SEQ ID NO: 746725 - RNA, 19 nt, Homo sapiens
gagauccccuugaagauuu

SEQ ID NO: 746726 - RNA, 19 nt, Homo sapiens
augcaagacuuucaacuga

SEQ ID NO: 746727 - RNA, 19 nt, Homo sapiens
gacuaucaauaccuaaaga

SEQ ID NO: 746728 - RNA, 19 nt, Homo sapiens
gaagugaucgucagaauua

SEQ ID NO: 746729 - RNA, 19 nt, Homo sapiens
ggaggaaaguagaaauuua

SEQ ID NO: 746730 - RNA, 19 nt, Homo sapiens
gcuaaaggaugaacaugua

SEQ ID NO: 746731 - RNA, 19 nt, Homo sapiens
ucaaacagcuggcgagauu

SEQ ID NO: 746732 - RNA, 19 nt, Homo sapiens
gaacuacuccuucaagauu

SEQ ID NO: 746733 - RNA, 19 nt, Homo sapiens
gcaccuugcucuuguguuu

SEQ ID NO: 746734 - RNA, 19 nt, Homo sapiens
ggacaaaccuugaaaaugu

SEQ ID NO: 746735 - RNA, 19 nt, Homo sapiens
gcugauaguuggagcauuu

SEQ ID NO: 746736 - RNA, 19 nt, Homo sapiens
gggaagauguuaagauaug

SEQ ID NO: 746737 - RNA, 19 nt, Homo sapiens
gaacuuaaccagugcagaa

SEQ ID NO: 746738 - RNA, 19 nt, Homo sapiens
gaaccuauauggccuucuu

SEQ ID NO: 746739 - RNA, 19 nt, Homo sapiens
caaacuagccgaagagauu

SEQ ID NO: 746740 - RNA, 19 nt, Homo sapiens
aagggaagauguuaagaua

SEQ ID NO: 746741 - RNA, 19 nt, Homo sapiens
uaaagaacaucacuaagca

SEQ ID NO: 746742 - RNA, 19 nt, Homo sapiens
gaaacagggaccaagauaa

SEQ ID NO: 746743 - RNA, 19 nt, Homo sapiens
aaggagggcuugaccauaa

SEQ ID NO: 746744 - RNA, 19 nt, Homo sapiens
ggaugaacauguacugguu

SEQ ID NO: 746745 - RNA, 19 nt, Homo sapiens
gaacgaacugcagaacuua

SEQ ID NO: 746746 - RNA, 19 nt, Homo sapiens
gggaagagacggaugauga

SEQ ID NO: 746747 - RNA, 19 nt, Homo sapiens
ggguagauauccauagaaa

SEQ ID NO: 746748 - RNA, 19 nt, Homo sapiens
gcauacugcuauauaauuc

SEQ ID NO: 746749 - RNA, 19 nt, Homo sapiens
gaauguagcccuuccaaca

SEQ ID NO: 746750 - RNA, 19 nt, Homo sapiens
ggagauguccugaauuuua

SEQ ID NO: 746751 - RNA, 19 nt, Homo sapiens
ugaacgaacugcagaacuu

SEQ ID NO: 746752 - RNA, 19 nt, Homo sapiens
gagaacuacuccuucaaga

SEQ ID NO: 746753 - RNA, 19 nt, Homo sapiens
gagagaauauuggagaugu

SEQ ID NO: 746754 - RNA, 19 nt, Homo sapiens
guagaaauuuaccaagguu

SEQ ID NO: 746755 - RNA, 19 nt, Homo sapiens
ccauaaagaacaucacuaa

SEQ ID NO: 746756 - RNA, 19 nt, Homo sapiens
gaacauguacugguuuaug

SEQ ID NO: 746757 - RNA, 19 nt, Homo sapiens
aaacagagagagagaauau

SEQ ID NO: 746758 - RNA, 19 nt, Homo sapiens
cugcagcgguaauauauuu

SEQ ID NO: 746759 - RNA, 19 nt, Homo sapiens
gugcugagauagagauuau

SEQ ID NO: 746760 - RNA, 19 nt, Homo sapiens
aaagaaggcagaaauuuga

SEQ ID NO: 746761 - RNA, 19 nt, Homo sapiens
ccaaagaccaucugaggaa

SEQ ID NO: 746762 - RNA, 19 nt, Homo sapiens
ggacggaucuuugggaaac

SEQ ID NO: 746763 - RNA, 19 nt, Homo sapiens
ggcguuaaauucacagauu

SEQ ID NO: 746764 - RNA, 19 nt, Homo sapiens
uaacucaacuaacuccaau

SEQ ID NO: 746765 - RNA, 19 nt, Homo sapiens
uuggagauguccugaauuu

SEQ ID NO: 746766 - RNA, 19 nt, Homo sapiens
ggaagagacggaugaugaa

SEQ ID NO: 746767 - RNA, 19 nt, Homo sapiens
gaacaagucaacacagaca

SEQ ID NO: 746768 - RNA, 19 nt, Homo sapiens
caaaucgucucuguacaug

SEQ ID NO: 746769 - RNA, 19 nt, Homo sapiens
gaaaagaaggcagaaauuu

SEQ ID NO: 746770 - RNA, 19 nt, Homo sapiens
gauaccgucuccuugaaga

SEQ ID NO: 746771 - RNA, 19 nt, Homo sapiens
caagaucagggaaauugua

SEQ ID NO: 746772 - RNA, 19 nt, Homo sapiens
gcuaagcgggcaucaguuu

SEQ ID NO: 746773 - RNA, 19 nt, Homo sapiens
cauggaaguugauuacuca

SEQ ID NO: 746774 - RNA, 19 nt, Homo sapiens
gagauguccugaauuuuaa

SEQ ID NO: 746775 - RNA, 19 nt, Homo sapiens
gcaaaucgucucuguacau

SEQ ID NO: 746776 - RNA, 19 nt, Homo sapiens
ggaagugaucgucagaauu

SEQ ID NO: 746777 - RNA, 19 nt, Homo sapiens
gaaggugacaguccaagug

SEQ ID NO: 746778 - RNA, 19 nt, Homo sapiens
ccaaucaaccaaacaaaga

SEQ ID NO: 746779 - RNA, 19 nt, Homo sapiens
cacaauggcuugguuggaa

SEQ ID NO: 746780 - RNA, 19 nt, Homo sapiens
gaaaggagggcuugaccau

SEQ ID NO: 746781 - RNA, 19 nt, Homo sapiens
gggauaccgucuccuugaa

SEQ ID NO: 746782 - RNA, 19 nt, Homo sapiens
gauaacaaucucaucuuug

SEQ ID NO: 746783 - RNA, 19 nt, Homo sapiens
cgucacauaugcaacaaga

SEQ ID NO: 746784 - RNA, 19 nt, Homo sapiens
acaaaccagccucaacuua

SEQ ID NO: 746785 - RNA, 19 nt, Homo sapiens
gaucaccuguguaugucaa

SEQ ID NO: 746786 - RNA, 19 nt, Homo sapiens
ucagggaaauuguacaaca

SEQ ID NO: 746787 - RNA, 19 nt, Homo sapiens
gcaagaccgugaacgaacu

SEQ ID NO: 746788 - RNA, 19 nt, Homo sapiens
ucucaucuuugcaggauuu

SEQ ID NO: 746789 - RNA, 19 nt, Homo sapiens
ugaaacagggaccaagaua

SEQ ID NO: 746790 - RNA, 19 nt, Homo sapiens
gaaggcagaaauuugaaga

SEQ ID NO: 746791 - RNA, 19 nt, Homo sapiens
guauaagccaucaauauuc

SEQ ID NO: 746792 - RNA, 19 nt, Homo sapiens
gaagcugcgugaggccuuu

SEQ ID NO: 746793 - RNA, 19 nt, Homo sapiens
gagagagaauauuggagau

SEQ ID NO: 746794 - RNA, 19 nt, Homo sapiens
gcaaaaugauuccuuucuu

SEQ ID NO: 746795 - RNA, 19 nt, Homo sapiens
gaguaucacaucacacaaa

SEQ ID NO: 746796 - RNA, 19 nt, Homo sapiens
ggaaaucucgucggaagga

SEQ ID NO: 746797 - RNA, 19 nt, Homo sapiens
ggaagauguuaagauaugu

SEQ ID NO: 746798 - RNA, 19 nt, Homo sapiens
cagcgcacuuggcaucuuu

SEQ ID NO: 746799 - RNA, 19 nt, Homo sapiens
gaaguugauuacucagucu

SEQ ID NO: 746800 - RNA, 19 nt, Homo sapiens
aaaccagccucaacuuaca

SEQ ID NO: 746801 - RNA, 19 nt, Homo sapiens
gaucagggaaauuguacaa

SEQ ID NO: 746802 - RNA, 19 nt, Homo sapiens
gcuggaagcgcauaucaga

SEQ ID NO: 746803 - RNA, 19 nt, Homo sapiens
gcugagauagagauuauga

SEQ ID NO: 746804 - RNA, 19 nt, Homo sapiens
agagacggaugaugaacaa

SEQ ID NO: 746805 - RNA, 19 nt, Homo sapiens
ucacggcaguucuggauca

SEQ ID NO: 746806 - RNA, 19 nt, Homo sapiens
ggaugaugaacaagcuuua

SEQ ID NO: 746807 - RNA, 19 nt, Homo sapiens
gggaaggucagccagguuu

SEQ ID NO: 746808 - RNA, 19 nt, Homo sapiens
caucgugccucgugaccaa

SEQ ID NO: 746809 - RNA, 19 nt, Homo sapiens
aggcagaaauuugaagaaa

SEQ ID NO: 746810 - RNA, 19 nt, Homo sapiens
agaccaaacuagccgaaga

SEQ ID NO: 746811 - RNA, 19 nt, Homo sapiens
ucacauaugcaacaagaga

SEQ ID NO: 746812 - RNA, 19 nt, Homo sapiens
ggaaaaucauggaaguuga

SEQ ID NO: 746813 - RNA, 19 nt, Homo sapiens
acagagagagagaauauug

SEQ ID NO: 746814 - RNA, 19 nt, Homo sapiens
gcucuuguguuucccuuag

SEQ ID NO: 746815 - RNA, 19 nt, Homo sapiens
gaaauuuaccaagguuguu

SEQ ID NO: 746816 - RNA, 19 nt, Homo sapiens
caaccaaucaaccaaacaa

SEQ ID NO: 746817 - RNA, 19 nt, Homo sapiens
ccaccaaaccaaccaauca

SEQ ID NO: 746818 - RNA, 19 nt, Homo sapiens
caaagaccaucugaggaau

SEQ ID NO: 746819 - RNA, 19 nt, Homo sapiens
aaacaacggaugaauguag

SEQ ID NO: 746820 - RNA, 19 nt, Homo sapiens
gaccaaacgccagaugaaa

SEQ ID NO: 746821 - RNA, 19 nt, Homo sapiens
gagauagagauuaugaaga

SEQ ID NO: 746822 - RNA, 19 nt, Homo sapiens
gcagaaagaggcagaugag

SEQ ID NO: 746823 - RNA, 19 nt, Homo sapiens
uggaacaagucaacacaga

SEQ ID NO: 746824 - RNA, 19 nt, Homo sapiens
uauuggagauguccugaau

SEQ ID NO: 746825 - RNA, 19 nt, Homo sapiens
agaacaagagucaauggua

SEQ ID NO: 746826 - RNA, 19 nt, Homo sapiens
ucucuuugcuucacagguu

SEQ ID NO: 746827 - RNA, 19 nt, Homo sapiens
caacgucacauaugcaaca

SEQ ID NO: 746828 - RNA, 19 nt, Homo sapiens
agaaagggcuugaaauuua

SEQ ID NO: 746829 - RNA, 19 nt, Homo sapiens
gaaaggaggugcuguuaug

SEQ ID NO: 746830 - RNA, 19 nt, Homo sapiens
gaaagggcuugaaauuuaa

SEQ ID NO: 746831 - RNA, 19 nt, Homo sapiens
ggucaggaauucaagauua

SEQ ID NO: 746832 - RNA, 19 nt, Homo sapiens
gaacuuaagagacaacuaa

SEQ ID NO: 746833 - RNA, 19 nt, Homo sapiens
cgacauagcugaggacuug

SEQ ID NO: 746834 - RNA, 19 nt, Homo sapiens
gaaauaaacagacagcaaa

SEQ ID NO: 746835 - RNA, 19 nt, Homo sapiens
gcaaagaggacgcccauaa

SEQ ID NO: 746836 - RNA, 19 nt, Homo sapiens
caagauggcuguaaacaca

SEQ ID NO: 746837 - RNA, 19 nt, Homo sapiens
ggaggugguugcugcauuu

SEQ ID NO: 746838 - RNA, 19 nt, Homo sapiens
caacuaagccuuucguguu

SEQ ID NO: 746839 - RNA, 19 nt, Homo sapiens
gaucugagcuucccuagac

SEQ ID NO: 746840 - RNA, 19 nt, Homo sapiens
ucaaugaaauacccaguuu

SEQ ID NO: 746841 - RNA, 19 nt, Homo sapiens
gcucaaagcagguuucuga

SEQ ID NO: 746842 - RNA, 19 nt, Homo sapiens
gcagggagcuuugaugcaa

SEQ ID NO: 746843 - RNA, 19 nt, Homo sapiens
gacaauaccuacuaugcaa

SEQ ID NO: 746844 - RNA, 19 nt, Homo sapiens
ccuccuggcuuuauguuua

SEQ ID NO: 746845 - RNA, 19 nt, Homo sapiens
ucaggcaugugaucaguua

SEQ ID NO: 746846 - RNA, 19 nt, Homo sapiens
gggaaggccuuggauguuu

SEQ ID NO: 746847 - RNA, 19 nt, Homo sapiens
guucauaaccuguauauuc

SEQ ID NO: 746848 - RNA, 19 nt, Homo sapiens
caagaucgcugacuuuggu

SEQ ID NO: 746849 - RNA, 19 nt, Homo sapiens
gaagaaacaccaaagaaag

SEQ ID NO: 746850 - RNA, 19 nt, Homo sapiens
caaagcagguuucugagau

SEQ ID NO: 746851 - RNA, 19 nt, Homo sapiens
cgucaucucugguuauuug

SEQ ID NO: 746852 - RNA, 19 nt, Homo sapiens
gaaauugccauccucaaga

SEQ ID NO: 746853 - RNA, 19 nt, Homo sapiens
gcucuugacuguaguuuag

SEQ ID NO: 746854 - RNA, 19 nt, Homo sapiens
gaaguuugguugagguuca

SEQ ID NO: 746855 - RNA, 19 nt, Homo sapiens
ugaagaccaugauacguaa

SEQ ID NO: 746856 - RNA, 19 nt, Homo sapiens
gaagagcaaaggacaggua

SEQ ID NO: 746857 - RNA, 19 nt, Homo sapiens
gaacucagucaaacacauu

SEQ ID NO: 746858 - RNA, 19 nt, Homo sapiens
ucaaaccacucucugaaga

SEQ ID NO: 746859 - RNA, 19 nt, Homo sapiens
aaagaaagcuguggaaagg

SEQ ID NO: 746860 - RNA, 19 nt, Homo sapiens
gagcuuugaugcaacuuau

SEQ ID NO: 746861 - RNA, 19 nt, Homo sapiens
caaguuggccuacaaugaa

SEQ ID NO: 746862 - RNA, 19 nt, Homo sapiens
ggucuggccuuuccugaga

SEQ ID NO: 746863 - RNA, 19 nt, Homo sapiens
gcaaaggacagguagucua

SEQ ID NO: 746864 - RNA, 19 nt, Homo sapiens
gagcuuccaggauauauuu

SEQ ID NO: 746865 - RNA, 19 nt, Homo sapiens
acaguaagaucaagaguca

SEQ ID NO: 746866 - RNA, 19 nt, Homo sapiens
ggaaggccuuggauguuug

SEQ ID NO: 746867 - RNA, 19 nt, Homo sapiens
ucaaaggcaucgaguacuu

SEQ ID NO: 746868 - RNA, 19 nt, Homo sapiens
caaugaaggugcuguccaa

SEQ ID NO: 746869 - RNA, 19 nt, Homo sapiens
gcccauaauuucuuccauu

SEQ ID NO: 746870 - RNA, 19 nt, Homo sapiens
ugaagaaacaccaaagaaa

SEQ ID NO: 746871 - RNA, 19 nt, Homo sapiens
cgucagauauaccaaguga

SEQ ID NO: 746872 - RNA, 19 nt, Homo sapiens
gugaagaccaugauacgua

SEQ ID NO: 746873 - RNA, 19 nt, Homo sapiens
gagcagguguaccaggaaa

SEQ ID NO: 746874 - RNA, 19 nt, Homo sapiens
cagcgggucccuagucuua

SEQ ID NO: 746875 - RNA, 19 nt, Homo sapiens
ucuaaagacugcuaagguu

SEQ ID NO: 746876 - RNA, 19 nt, Homo sapiens
cagaaacuauuuagagcuu

SEQ ID NO: 746877 - RNA, 19 nt, Homo sapiens
aaagcagguuucugagaua

SEQ ID NO: 746878 - RNA, 19 nt, Homo sapiens
uacauuacauggcuuaaga

SEQ ID NO: 746879 - RNA, 19 nt, Homo sapiens
cagaaagggcuugaaauuu

SEQ ID NO: 746880 - RNA, 19 nt, Homo sapiens
aaacagaaagggcuugaaa

SEQ ID NO: 746881 - RNA, 19 nt, Homo sapiens
caucucugguuauuuguuu

SEQ ID NO: 746882 - RNA, 19 nt, Homo sapiens
aagcuucucuguacaguug

SEQ ID NO: 746883 - RNA, 19 nt, Homo sapiens
ccuaagcucuugacuguag

SEQ ID NO: 746884 - RNA, 19 nt, Homo sapiens
gaaagacggcaccgggaaa

SEQ ID NO: 746885 - RNA, 19 nt, Homo sapiens
ggaagugcccacccucaaa

SEQ ID NO: 746886 - RNA, 19 nt, Homo sapiens
acagaaagggcuugaaauu

SEQ ID NO: 746887 - RNA, 19 nt, Homo sapiens
ucaaacacauucccagcuu

SEQ ID NO: 746888 - RNA, 19 nt, Homo sapiens
gcagggcuucucuuguuua

SEQ ID NO: 746889 - RNA, 19 nt, Homo sapiens
uacaugaacuuaagagaca

SEQ ID NO: 746890 - RNA, 19 nt, Homo sapiens
gaaccaugaccuccacuug

SEQ ID NO: 746891 - RNA, 19 nt, Homo sapiens
ggacgcccauaauuucuuc

SEQ ID NO: 746892 - RNA, 19 nt, Homo sapiens
cugcagggcuucucuuguu

SEQ ID NO: 746893 - RNA, 19 nt, Homo sapiens
auuuagagcuuccaggaua

SEQ ID NO: 746894 - RNA, 19 nt, Homo sapiens
gagcacaguaguucagaaa

SEQ ID NO: 746895 - RNA, 19 nt, Homo sapiens
ggaggaagugcucuuguga

SEQ ID NO: 746896 - RNA, 19 nt, Homo sapiens
ccaaugaggaccaucugua

SEQ ID NO: 746897 - RNA, 19 nt, Homo sapiens
aaagaggacgcccauaauu

SEQ ID NO: 746898 - RNA, 19 nt, Homo sapiens
caaagaggacgcccauaau

SEQ ID NO: 746899 - RNA, 19 nt, Homo sapiens
gaacguguuucuucaugac

SEQ ID NO: 746900 - RNA, 19 nt, Homo sapiens
caaaggcaucgaguacuua

SEQ ID NO: 746901 - RNA, 19 nt, Homo sapiens
gaucaaaggcaucgaguac

SEQ ID NO: 746902 - RNA, 19 nt, Homo sapiens
ggaaaggaggugcuguuau

SEQ ID NO: 746903 - RNA, 19 nt, Homo sapiens
caaagaaagcuguggaaag

SEQ ID NO: 746904 - RNA, 19 nt, Homo sapiens
gacccacauugaugacuuu

SEQ ID NO: 746905 - RNA, 19 nt, Homo sapiens
ggaaauugccauccucaag

SEQ ID NO: 746906 - RNA, 19 nt, Homo sapiens
gaaaggaccugccccacau

SEQ ID NO: 746907 - RNA, 19 nt, Homo sapiens
cagaaccacgucagauaua

SEQ ID NO: 746908 - RNA, 19 nt, Homo sapiens
gcaccgcguuuccauagca

SEQ ID NO: 746909 - RNA, 19 nt, Homo sapiens
ggaggaacgcucacuguca

SEQ ID NO: 746910 - RNA, 19 nt, Homo sapiens
aguauacccugaaggauga

SEQ ID NO: 746911 - RNA, 19 nt, Homo sapiens
ggcauggaguccuucauug

SEQ ID NO: 746912 - RNA, 19 nt, Homo sapiens
aagaggacgcccauaauuu

SEQ ID NO: 746913 - RNA, 19 nt, Homo sapiens
cuucuuggcuuccauagau

SEQ ID NO: 746914 - RNA, 19 nt, Homo sapiens
caugacagcugcucaaagc

SEQ ID NO: 746915 - RNA, 19 nt, Homo sapiens
aaauugccauccucaagaa

SEQ ID NO: 746916 - RNA, 19 nt, Homo sapiens
gggcauggaguccuucauu

SEQ ID NO: 746917 - RNA, 19 nt, Homo sapiens
guagaauuguagucaggaa

SEQ ID NO: 746918 - RNA, 19 nt, Homo sapiens
gggauccaacgcacacuua

SEQ ID NO: 746919 - RNA, 19 nt, Homo sapiens
cauuugagcugccacucuu

SEQ ID NO: 746920 - RNA, 19 nt, Homo sapiens
guaaacacagagcauuuga

SEQ ID NO: 746921 - RNA, 19 nt, Homo sapiens
caaaggacagguagucuag

SEQ ID NO: 746922 - RNA, 19 nt, Homo sapiens
gcuuugaugcaacuuauuu

SEQ ID NO: 746923 - RNA, 19 nt, Homo sapiens
gaacugcacgcuggucgaa

SEQ ID NO: 746924 - RNA, 19 nt, Homo sapiens
guacuuacacuaccagaag

SEQ ID NO: 746925 - RNA, 19 nt, Homo sapiens
ucaaguuggccuacaauga

SEQ ID NO: 746926 - RNA, 19 nt, Homo sapiens
ccuauggugucgucaaguu

SEQ ID NO: 746927 - RNA, 19 nt, Homo sapiens
ccugaaggaugaaauugga

SEQ ID NO: 746928 - RNA, 19 nt, Homo sapiens
agaaagggcuugaaauuua

SEQ ID NO: 746929 - RNA, 19 nt, Homo sapiens
gaaaggaggugcuguuaug

SEQ ID NO: 746930 - RNA, 19 nt, Homo sapiens
gaaagggcuugaaauuuaa

SEQ ID NO: 746931 - RNA, 19 nt, Homo sapiens
ggucaggaauucaagauua

SEQ ID NO: 746932 - RNA, 19 nt, Homo sapiens
gaacuuaagagacaacuaa

SEQ ID NO: 746933 - RNA, 19 nt, Homo sapiens
cgacauagcugaggacuug

SEQ ID NO: 746934 - RNA, 19 nt, Homo sapiens
gaaauaaacagacagcaaa

SEQ ID NO: 746935 - RNA, 19 nt, Homo sapiens
gcaaagaggacgcccauaa

SEQ ID NO: 746936 - RNA, 19 nt, Homo sapiens
caagauggcuguaaacaca

SEQ ID NO: 746937 - RNA, 19 nt, Homo sapiens
ggaggugguugcugcauuu

SEQ ID NO: 746938 - RNA, 19 nt, Homo sapiens
caacuaagccuuucguguu

SEQ ID NO: 746939 - RNA, 19 nt, Homo sapiens
gaucugagcuucccuagac

SEQ ID NO: 746940 - RNA, 19 nt, Homo sapiens
ucaaugaaauacccaguuu

SEQ ID NO: 746941 - RNA, 19 nt, Homo sapiens
gcucaaagcagguuucuga

SEQ ID NO: 746942 - RNA, 19 nt, Homo sapiens
gcagggagcuuugaugcaa

SEQ ID NO: 746943 - RNA, 19 nt, Homo sapiens
gacaauaccuacuaugcaa

SEQ ID NO: 746944 - RNA, 19 nt, Homo sapiens
ccuccuggcuuuauguuua

SEQ ID NO: 746945 - RNA, 19 nt, Homo sapiens
ucaggcaugugaucaguua

SEQ ID NO: 746946 - RNA, 19 nt, Homo sapiens
gggaaggccuuggauguuu

SEQ ID NO: 746947 - RNA, 19 nt, Homo sapiens
guucauaaccuguauauuc

SEQ ID NO: 746948 - RNA, 19 nt, Homo sapiens
caagaucgcugacuuuggu

SEQ ID NO: 746949 - RNA, 19 nt, Homo sapiens
gaagaaacaccaaagaaag

SEQ ID NO: 746950 - RNA, 19 nt, Homo sapiens
caaagcagguuucugagau

SEQ ID NO: 746951 - RNA, 19 nt, Homo sapiens
cgucaucucugguuauuug

SEQ ID NO: 746952 - RNA, 19 nt, Homo sapiens
gaaauugccauccucaaga

SEQ ID NO: 746953 - RNA, 19 nt, Homo sapiens
gcucuugacuguaguuuag

SEQ ID NO: 746954 - RNA, 19 nt, Homo sapiens
gaaguuugguugagguuca

SEQ ID NO: 746955 - RNA, 19 nt, Homo sapiens
ugaagaccaugauacguaa

SEQ ID NO: 746956 - RNA, 19 nt, Homo sapiens
gaagagcaaaggacaggua

SEQ ID NO: 746957 - RNA, 19 nt, Homo sapiens
gaacucagucaaacacauu

SEQ ID NO: 746958 - RNA, 19 nt, Homo sapiens
ucaaaccacucucugaaga

SEQ ID NO: 746959 - RNA, 19 nt, Homo sapiens
aaagaaagcuguggaaagg

SEQ ID NO: 746960 - RNA, 19 nt, Homo sapiens
gagcuuugaugcaacuuau

SEQ ID NO: 746961 - RNA, 19 nt, Homo sapiens
caaguuggccuacaaugaa

SEQ ID NO: 746962 - RNA, 19 nt, Homo sapiens
ggucuggccuuuccugaga

SEQ ID NO: 746963 - RNA, 19 nt, Homo sapiens
gcaaaggacagguagucua

SEQ ID NO: 746964 - RNA, 19 nt, Homo sapiens
gagcuuccaggauauauuu

SEQ ID NO: 746965 - RNA, 19 nt, Homo sapiens
acaguaagaucaagaguca

SEQ ID NO: 746966 - RNA, 19 nt, Homo sapiens
ggaaggccuuggauguuug

SEQ ID NO: 746967 - RNA, 19 nt, Homo sapiens
ucaaaggcaucgaguacuu

SEQ ID NO: 746968 - RNA, 19 nt, Homo sapiens
caaugaaggugcuguccaa

SEQ ID NO: 746969 - RNA, 19 nt, Homo sapiens
gcccauaauuucuuccauu

SEQ ID NO: 746970 - RNA, 19 nt, Homo sapiens
ugaagaaacaccaaagaaa

SEQ ID NO: 746971 - RNA, 19 nt, Homo sapiens
cgucagauauaccaaguga

SEQ ID NO: 746972 - RNA, 19 nt, Homo sapiens
gugaagaccaugauacgua

SEQ ID NO: 746973 - RNA, 19 nt, Homo sapiens
gagcagguguaccaggaaa

SEQ ID NO: 746974 - RNA, 19 nt, Homo sapiens
cagcgggucccuagucuua

SEQ ID NO: 746975 - RNA, 19 nt, Homo sapiens
ucuaaagacugcuaagguu

SEQ ID NO: 746976 - RNA, 19 nt, Homo sapiens
cagaaacuauuuagagcuu

SEQ ID NO: 746977 - RNA, 19 nt, Homo sapiens
aaagcagguuucugagaua

SEQ ID NO: 746978 - RNA, 19 nt, Homo sapiens
uacauuacauggcuuaaga

SEQ ID NO: 746979 - RNA, 19 nt, Homo sapiens
cagaaagggcuugaaauuu

SEQ ID NO: 746980 - RNA, 19 nt, Homo sapiens
aaacagaaagggcuugaaa

SEQ ID NO: 746981 - RNA, 19 nt, Homo sapiens
caucucugguuauuuguuu

SEQ ID NO: 746982 - RNA, 19 nt, Homo sapiens
aagcuucucuguacaguug

SEQ ID NO: 746983 - RNA, 19 nt, Homo sapiens
ccuaagcucuugacuguag

SEQ ID NO: 746984 - RNA, 19 nt, Homo sapiens
gaaagacggcaccgggaaa

SEQ ID NO: 746985 - RNA, 19 nt, Homo sapiens
ggaagugcccacccucaaa

SEQ ID NO: 746986 - RNA, 19 nt, Homo sapiens
acagaaagggcuugaaauu

SEQ ID NO: 746987 - RNA, 19 nt, Homo sapiens
ucaaacacauucccagcuu

SEQ ID NO: 746988 - RNA, 19 nt, Homo sapiens
gcagggcuucucuuguuua

SEQ ID NO: 746989 - RNA, 19 nt, Homo sapiens
uacaugaacuuaagagaca

SEQ ID NO: 746990 - RNA, 19 nt, Homo sapiens
gaaccaugaccuccacuug

SEQ ID NO: 746991 - RNA, 19 nt, Homo sapiens
ggacgcccauaauuucuuc

SEQ ID NO: 746992 - RNA, 19 nt, Homo sapiens
cugcagggcuucucuuguu

SEQ ID NO: 746993 - RNA, 19 nt, Homo sapiens
auuuagagcuuccaggaua

SEQ ID NO: 746994 - RNA, 19 nt, Homo sapiens
gagcacaguaguucagaaa

SEQ ID NO: 746995 - RNA, 19 nt, Homo sapiens
ggaggaagugcucuuguga

SEQ ID NO: 746996 - RNA, 19 nt, Homo sapiens
ccaaugaggaccaucugua

SEQ ID NO: 746997 - RNA, 19 nt, Homo sapiens
aaagaggacgcccauaauu

SEQ ID NO: 746998 - RNA, 19 nt, Homo sapiens
caaagaggacgcccauaau

SEQ ID NO: 746999 - RNA, 19 nt, Homo sapiens
gaacguguuucuucaugac

SEQ ID NO: 747000 - RNA, 19 nt, Homo sapiens
caaaggcaucgaguacuua

SEQ ID NO: 747001 - RNA, 19 nt, Homo sapiens
gaucaaaggcaucgaguac

SEQ ID NO: 747002 - RNA, 19 nt, Homo sapiens
ggaaaggaggugcuguuau

SEQ ID NO: 747003 - RNA, 19 nt, Homo sapiens
caaagaaagcuguggaaag

SEQ ID NO: 747004 - RNA, 19 nt, Homo sapiens
gacccacauugaugacuuu

SEQ ID NO: 747005 - RNA, 19 nt, Homo sapiens
ggaaauugccauccucaag

SEQ ID NO: 747006 - RNA, 19 nt, Homo sapiens
gaaaggaccugccccacau

SEQ ID NO: 747007 - RNA, 19 nt, Homo sapiens
cagaaccacgucagauaua

SEQ ID NO: 747008 - RNA, 19 nt, Homo sapiens
gcaccgcguuuccauagca

SEQ ID NO: 747009 - RNA, 19 nt, Homo sapiens
ggaggaacgcucacuguca

SEQ ID NO: 747010 - RNA, 19 nt, Homo sapiens
aguauacccugaaggauga

SEQ ID NO: 747011 - RNA, 19 nt, Homo sapiens
ggcauggaguccuucauug

SEQ ID NO: 747012 - RNA, 19 nt, Homo sapiens
aagaggacgcccauaauuu

SEQ ID NO: 747013 - RNA, 19 nt, Homo sapiens
cuucuuggcuuccauagau

SEQ ID NO: 747014 - RNA, 19 nt, Homo sapiens
caugacagcugcucaaagc

SEQ ID NO: 747015 - RNA, 19 nt, Homo sapiens
aaauugccauccucaagaa

SEQ ID NO: 747016 - RNA, 19 nt, Homo sapiens
gggcauggaguccuucauu

SEQ ID NO: 747017 - RNA, 19 nt, Homo sapiens
guagaauuguagucaggaa

SEQ ID NO: 747018 - RNA, 19 nt, Homo sapiens
gggauccaacgcacacuua

SEQ ID NO: 747019 - RNA, 19 nt, Homo sapiens
cauuugagcugccacucuu

SEQ ID NO: 747020 - RNA, 19 nt, Homo sapiens
guaaacacagagcauuuga

SEQ ID NO: 747021 - RNA, 19 nt, Homo sapiens
caaaggacagguagucuag

SEQ ID NO: 747022 - RNA, 19 nt, Homo sapiens
gcuuugaugcaacuuauuu

SEQ ID NO: 747023 - RNA, 19 nt, Homo sapiens
gaacugcacgcuggucgaa

SEQ ID NO: 747024 - RNA, 19 nt, Homo sapiens
guacuuacacuaccagaag

SEQ ID NO: 747025 - RNA, 19 nt, Homo sapiens
ucaaguuggccuacaauga

SEQ ID NO: 747026 - RNA, 19 nt, Homo sapiens
ccuauggugucgucaaguu

SEQ ID NO: 747027 - RNA, 19 nt, Homo sapiens
ccugaaggaugaaauugga

SEQ ID NO: 747028 - RNA, 19 nt, Homo sapiens
agaaagggcuugaaauuua

SEQ ID NO: 747029 - RNA, 19 nt, Homo sapiens
gaaaggaggugcuguuaug

SEQ ID NO: 747030 - RNA, 19 nt, Homo sapiens
gaaagggcuugaaauuuaa

SEQ ID NO: 747031 - RNA, 19 nt, Homo sapiens
ggucaggaauucaagauua

SEQ ID NO: 747032 - RNA, 19 nt, Homo sapiens
gaacuuaagagacaacuaa

SEQ ID NO: 747033 - RNA, 19 nt, Homo sapiens
cgacauagcugaggacuug

SEQ ID NO: 747034 - RNA, 19 nt, Homo sapiens
gaaauaaacagacagcaaa

SEQ ID NO: 747035 - RNA, 19 nt, Homo sapiens
gcaaagaggacgcccauaa

SEQ ID NO: 747036 - RNA, 19 nt, Homo sapiens
caagauggcuguaaacaca

SEQ ID NO: 747037 - RNA, 19 nt, Homo sapiens
ggaggugguugcugcauuu

SEQ ID NO: 747038 - RNA, 19 nt, Homo sapiens
caacuaagccuuucguguu

SEQ ID NO: 747039 - RNA, 19 nt, Homo sapiens
gaucugagcuucccuagac

SEQ ID NO: 747040 - RNA, 19 nt, Homo sapiens
ucaaugaaauacccaguuu

SEQ ID NO: 747041 - RNA, 19 nt, Homo sapiens
gcucaaagcagguuucuga

SEQ ID NO: 747042 - RNA, 19 nt, Homo sapiens
gcagggagcuuugaugcaa

SEQ ID NO: 747043 - RNA, 19 nt, Homo sapiens
gacaauaccuacuaugcaa

SEQ ID NO: 747044 - RNA, 19 nt, Homo sapiens
ccuccuggcuuuauguuua

SEQ ID NO: 747045 - RNA, 19 nt, Homo sapiens
ucaggcaugugaucaguua

SEQ ID NO: 747046 - RNA, 19 nt, Homo sapiens
gggaaggccuuggauguuu

SEQ ID NO: 747047 - RNA, 19 nt, Homo sapiens
guucauaaccuguauauuc

SEQ ID NO: 747048 - RNA, 19 nt, Homo sapiens
caagaucgcugacuuuggu

SEQ ID NO: 747049 - RNA, 19 nt, Homo sapiens
gaagaaacaccaaagaaag

SEQ ID NO: 747050 - RNA, 19 nt, Homo sapiens
caaagcagguuucugagau

SEQ ID NO: 747051 - RNA, 19 nt, Homo sapiens
cgucaucucugguuauuug

SEQ ID NO: 747052 - RNA, 19 nt, Homo sapiens
gaaauugccauccucaaga

SEQ ID NO: 747053 - RNA, 19 nt, Homo sapiens
gcucuugacuguaguuuag

SEQ ID NO: 747054 - RNA, 19 nt, Homo sapiens
gaaguuugguugagguuca

SEQ ID NO: 747055 - RNA, 19 nt, Homo sapiens
ugaagaccaugauacguaa

SEQ ID NO: 747056 - RNA, 19 nt, Homo sapiens
gaagagcaaaggacaggua

SEQ ID NO: 747057 - RNA, 19 nt, Homo sapiens
ucaaaccacucucugaaga

SEQ ID NO: 747058 - RNA, 19 nt, Homo sapiens
aaagaaagcuguggaaagg

SEQ ID NO: 747059 - RNA, 19 nt, Homo sapiens
gagcuuugaugcaacuuau

SEQ ID NO: 747060 - RNA, 19 nt, Homo sapiens
caaguuggccuacaaugaa

SEQ ID NO: 747061 - RNA, 19 nt, Homo sapiens
ggucuggccuuuccugaga

SEQ ID NO: 747062 - RNA, 19 nt, Homo sapiens
gcaaaggacagguagucua

SEQ ID NO: 747063 - RNA, 19 nt, Homo sapiens
gagcuuccaggauauauuu

SEQ ID NO: 747064 - RNA, 19 nt, Homo sapiens
acaguaagaucaagaguca

SEQ ID NO: 747065 - RNA, 19 nt, Homo sapiens
ggaaggccuuggauguuug

SEQ ID NO: 747066 - RNA, 19 nt, Homo sapiens
ucaaaggcaucgaguacuu

SEQ ID NO: 747067 - RNA, 19 nt, Homo sapiens
caaugaaggugcuguccaa

SEQ ID NO: 747068 - RNA, 19 nt, Homo sapiens
gcccauaauuucuuccauu

SEQ ID NO: 747069 - RNA, 19 nt, Homo sapiens
ugaagaaacaccaaagaaa

SEQ ID NO: 747070 - RNA, 19 nt, Homo sapiens
cgucagauauaccaaguga

SEQ ID NO: 747071 - RNA, 19 nt, Homo sapiens
gugaagaccaugauacgua

SEQ ID NO: 747072 - RNA, 19 nt, Homo sapiens
gagcagguguaccaggaaa

SEQ ID NO: 747073 - RNA, 19 nt, Homo sapiens
cagcgggucccuagucuua

SEQ ID NO: 747074 - RNA, 19 nt, Homo sapiens
ucuaaagacugcuaagguu

SEQ ID NO: 747075 - RNA, 19 nt, Homo sapiens
cagaaacuauuuagagcuu

SEQ ID NO: 747076 - RNA, 19 nt, Homo sapiens
aaagcagguuucugagaua

SEQ ID NO: 747077 - RNA, 19 nt, Homo sapiens
uacauuacauggcuuaaga

SEQ ID NO: 747078 - RNA, 19 nt, Homo sapiens
cagaaagggcuugaaauuu

SEQ ID NO: 747079 - RNA, 19 nt, Homo sapiens
aaacagaaagggcuugaaa

SEQ ID NO: 747080 - RNA, 19 nt, Homo sapiens
caucucugguuauuuguuu

SEQ ID NO: 747081 - RNA, 19 nt, Homo sapiens
aagcuucucuguacaguug

SEQ ID NO: 747082 - RNA, 19 nt, Homo sapiens
ccuaagcucuugacuguag

SEQ ID NO: 747083 - RNA, 19 nt, Homo sapiens
gaaagacggcaccgggaaa

SEQ ID NO: 747084 - RNA, 19 nt, Homo sapiens
ggaagugcccacccucaaa

SEQ ID NO: 747085 - RNA, 19 nt, Homo sapiens
acagaaagggcuugaaauu

SEQ ID NO: 747086 - RNA, 19 nt, Homo sapiens
gcagggcuucucuuguuua

SEQ ID NO: 747087 - RNA, 19 nt, Homo sapiens
uacaugaacuuaagagaca

SEQ ID NO: 747088 - RNA, 19 nt, Homo sapiens
gaaccaugaccuccacuug

SEQ ID NO: 747089 - RNA, 19 nt, Homo sapiens
ggacgcccauaauuucuuc

SEQ ID NO: 747090 - RNA, 19 nt, Homo sapiens
cugcagggcuucucuuguu

SEQ ID NO: 747091 - RNA, 19 nt, Homo sapiens
auuuagagcuuccaggaua

SEQ ID NO: 747092 - RNA, 19 nt, Homo sapiens
gagcacaguaguucagaaa

SEQ ID NO: 747093 - RNA, 19 nt, Homo sapiens
ggaggaagugcucuuguga

SEQ ID NO: 747094 - RNA, 19 nt, Homo sapiens
ccaaugaggaccaucugua

SEQ ID NO: 747095 - RNA, 19 nt, Homo sapiens
aaagaggacgcccauaauu

SEQ ID NO: 747096 - RNA, 19 nt, Homo sapiens
caaagaggacgcccauaau

SEQ ID NO: 747097 - RNA, 19 nt, Homo sapiens
gaacguguuucuucaugac

SEQ ID NO: 747098 - RNA, 19 nt, Homo sapiens
caaaggcaucgaguacuua

SEQ ID NO: 747099 - RNA, 19 nt, Homo sapiens
gaucaaaggcaucgaguac

SEQ ID NO: 747100 - RNA, 19 nt, Homo sapiens
ggaaaggaggugcuguuau

SEQ ID NO: 747101 - RNA, 19 nt, Homo sapiens
caaagaaagcuguggaaag

SEQ ID NO: 747102 - RNA, 19 nt, Homo sapiens
gacccacauugaugacuuu

SEQ ID NO: 747103 - RNA, 19 nt, Homo sapiens
ggaaauugccauccucaag

SEQ ID NO: 747104 - RNA, 19 nt, Homo sapiens
gaaaggaccugccccacau

SEQ ID NO: 747105 - RNA, 19 nt, Homo sapiens
cagaaccacgucagauaua

SEQ ID NO: 747106 - RNA, 19 nt, Homo sapiens
gcaccgcguuuccauagca

SEQ ID NO: 747107 - RNA, 19 nt, Homo sapiens
ggaggaacgcucacuguca

SEQ ID NO: 747108 - RNA, 19 nt, Homo sapiens
aguauacccugaaggauga

SEQ ID NO: 747109 - RNA, 19 nt, Homo sapiens
ggcauggaguccuucauug

SEQ ID NO: 747110 - RNA, 19 nt, Homo sapiens
aagaggacgcccauaauuu

SEQ ID NO: 747111 - RNA, 19 nt, Homo sapiens
cuucuuggcuuccauagau

SEQ ID NO: 747112 - RNA, 19 nt, Homo sapiens
caugacagcugcucaaagc

SEQ ID NO: 747113 - RNA, 19 nt, Homo sapiens
aaauugccauccucaagaa

SEQ ID NO: 747114 - RNA, 19 nt, Homo sapiens
gggcauggaguccuucauu

SEQ ID NO: 747115 - RNA, 19 nt, Homo sapiens
guagaauuguagucaggaa

SEQ ID NO: 747116 - RNA, 19 nt, Homo sapiens
gggauccaacgcacacuua

SEQ ID NO: 747117 - RNA, 19 nt, Homo sapiens
cauuugagcugccacucuu

SEQ ID NO: 747118 - RNA, 19 nt, Homo sapiens
guaaacacagagcauuuga

SEQ ID NO: 747119 - RNA, 19 nt, Homo sapiens
caaaggacagguagucuag

SEQ ID NO: 747120 - RNA, 19 nt, Homo sapiens
gcuuugaugcaacuuauuu

SEQ ID NO: 747121 - RNA, 19 nt, Homo sapiens
guacuuacacuaccagaag

SEQ ID NO: 747122 - RNA, 19 nt, Homo sapiens
ucaaguuggccuacaauga

SEQ ID NO: 747123 - RNA, 19 nt, Homo sapiens
ccuauggugucgucaaguu

SEQ ID NO: 747124 - RNA, 19 nt, Homo sapiens
ccugaaggaugaaauugga

SEQ ID NO: 747125 - RNA, 19 nt, Homo sapiens
cuagagggcuuugaaccuu

SEQ ID NO: 747126 - RNA, 19 nt, Homo sapiens
aacuaagccuuucguguuu

SEQ ID NO: 747127 - RNA, 19 nt, Homo sapiens
ccaaggugcuagggaaguu

SEQ ID NO: 747128 - RNA, 19 nt, Homo sapiens
ggucaggaauucaagauua

SEQ ID NO: 747129 - RNA, 19 nt, Homo sapiens
cgacauagcugaggacuug

SEQ ID NO: 747130 - RNA, 19 nt, Homo sapiens
gacaauaccuacuaugcaa

SEQ ID NO: 747131 - RNA, 19 nt, Homo sapiens
gggaaggccuuggauguuu

SEQ ID NO: 747132 - RNA, 19 nt, Homo sapiens
uaaauggcgucauacacua

SEQ ID NO: 747133 - RNA, 19 nt, Homo sapiens
caagaucgcugacuuuggu

SEQ ID NO: 747134 - RNA, 19 nt, Homo sapiens
gaaauugccauccucaaga

SEQ ID NO: 747135 - RNA, 19 nt, Homo sapiens
caaaguaacguaagaguuc

SEQ ID NO: 747136 - RNA, 19 nt, Homo sapiens
ugaagaccaugauacguaa

SEQ ID NO: 747137 - RNA, 19 nt, Homo sapiens
gaacucagucaaacacauu

SEQ ID NO: 747138 - RNA, 19 nt, Homo sapiens
ucaaaccacucucugaaga

SEQ ID NO: 747139 - RNA, 19 nt, Homo sapiens
cagaauagguauggauuug

SEQ ID NO: 747140 - RNA, 19 nt, Homo sapiens
ccaguaaccacucagaaua

SEQ ID NO: 747141 - RNA, 19 nt, Homo sapiens
cagccacccuuccuucaua

SEQ ID NO: 747142 - RNA, 19 nt, Homo sapiens
caaguuggccuacaaugaa

SEQ ID NO: 747143 - RNA, 19 nt, Homo sapiens
acaguaagaucaagaguca

SEQ ID NO: 747144 - RNA, 19 nt, Homo sapiens
ggaaggccuuggauguuug

SEQ ID NO: 747145 - RNA, 19 nt, Homo sapiens
ucaaaggcaucgaguacuu

SEQ ID NO: 747146 - RNA, 19 nt, Homo sapiens
caaugaaggugcuguccaa

SEQ ID NO: 747147 - RNA, 19 nt, Homo sapiens
gugaagaccaugauacgua

SEQ ID NO: 747148 - RNA, 19 nt, Homo sapiens
gagcagguguaccaggaaa

SEQ ID NO: 747149 - RNA, 19 nt, Homo sapiens
ucguauaaauggcgucaua

SEQ ID NO: 747150 - RNA, 19 nt, Homo sapiens
gcaaaguaacguaagaguu

SEQ ID NO: 747151 - RNA, 19 nt, Homo sapiens
ggaagugcccacccucaaa

SEQ ID NO: 747152 - RNA, 19 nt, Homo sapiens
gguauggauuugccuauuc

SEQ ID NO: 747153 - RNA, 19 nt, Homo sapiens
ucaaacacauucccagcuu

SEQ ID NO: 747154 - RNA, 19 nt, Homo sapiens
ggacagaugaggcuuugug

SEQ ID NO: 747155 - RNA, 19 nt, Homo sapiens
ccaaugaggaccaucugua

SEQ ID NO: 747156 - RNA, 19 nt, Homo sapiens
caaaggcaucgaguacuua

SEQ ID NO: 747157 - RNA, 19 nt, Homo sapiens
gaucaaaggcaucgaguac

SEQ ID NO: 747158 - RNA, 19 nt, Homo sapiens
ggaaauugccauccucaag

SEQ ID NO: 747159 - RNA, 19 nt, Homo sapiens
uaaccacucagaauaggua

SEQ ID NO: 747160 - RNA, 19 nt, Homo sapiens
ggaggaacgcucacuguca

SEQ ID NO: 747161 - RNA, 19 nt, Homo sapiens
aguauacccugaaggauga

SEQ ID NO: 747162 - RNA, 19 nt, Homo sapiens
ggcauggaguccuucauug

SEQ ID NO: 747163 - RNA, 19 nt, Homo sapiens
caucguggcuaccugacuu

SEQ ID NO: 747164 - RNA, 19 nt, Homo sapiens
aaauugccauccucaagaa

SEQ ID NO: 747165 - RNA, 19 nt, Homo sapiens
gggcauggaguccuucauu

SEQ ID NO: 747166 - RNA, 19 nt, Homo sapiens
gaugaggcuuuguguccuu

SEQ ID NO: 747167 - RNA, 19 nt, Homo sapiens
gggauccaacgcacacuua

SEQ ID NO: 747168 - RNA, 19 nt, Homo sapiens
gaacugcacgcuggucgaa

SEQ ID NO: 747169 - RNA, 19 nt, Homo sapiens
guacuuacacuaccagaag

SEQ ID NO: 747170 - RNA, 19 nt, Homo sapiens
ucaaguuggccuacaauga

SEQ ID NO: 747171 - RNA, 19 nt, Homo sapiens
ccuauggugucgucaaguu

SEQ ID NO: 747172 - RNA, 19 nt, Homo sapiens
ccugaaggaugaaauugga

SEQ ID NO: 747173 - RNA, 19 nt, Homo sapiens
cuagagggcuuugaaccuu

SEQ ID NO: 747174 - RNA, 19 nt, Homo sapiens
ggacguuucguauaaaugg

SEQ ID NO: 747175 - RNA, 19 nt, Homo sapiens
gagcggaucauguguuuac

SEQ ID NO: 747176 - RNA, 19 nt, Homo sapiens
cauccaccgugacaucaaa

SEQ ID NO: 747177 - RNA, 19 nt, Homo sapiens
gcgagacuccguuucagaa

SEQ ID NO: 747178 - RNA, 19 nt, Homo sapiens
caaccgugauccuggugaa

SEQ ID NO: 747179 - RNA, 19 nt, Homo sapiens
caucaagaucgcugacuuu

SEQ ID NO: 747180 - RNA, 19 nt, Homo sapiens
gcagguguaccaggaaauu

SEQ ID NO: 747181 - RNA, 19 nt, Homo sapiens
ggaaauccacccaguuaac

SEQ ID NO: 747182 - RNA, 19 nt, Homo sapiens
ggucgagaacucagucaaa

SEQ ID NO: 747183 - RNA, 19 nt, Homo sapiens
gaucauccaccgugacauc

SEQ ID NO: 747184 - RNA, 19 nt, Homo sapiens
gcauggaguccuucauugu

SEQ ID NO: 747185 - RNA, 19 nt, Homo sapiens
uagagggcuuugaaccuuu

SEQ ID NO: 747186 - RNA, 19 nt, Homo sapiens
ggucuucguuucuccucuu

SEQ ID NO: 747187 - RNA, 19 nt, Homo sapiens
gauucagugguuucuaaua

SEQ ID NO: 747188 - RNA, 19 nt, Homo sapiens
cacgggaaguguaugauuc

SEQ ID NO: 747189 - RNA, 19 nt, Homo sapiens
agucacuucuguuucuuaa

SEQ ID NO: 747190 - RNA, 19 nt, Homo sapiens
caggacagaugaggcuuug

SEQ ID NO: 747191 - RNA, 19 nt, Homo sapiens
gcucaagaccuagaaaaua

SEQ ID NO: 747192 - RNA, 19 nt, Homo sapiens
gaucacgaggucaggaauu

SEQ ID NO: 747193 - RNA, 19 nt, Homo sapiens
augauucagugguuucuaa

SEQ ID NO: 747194 - RNA, 19 nt, Homo sapiens
guugcaaaguaacguaaga

SEQ ID NO: 747195 - RNA, 19 nt, Homo sapiens
gaaaauaaguccccuuccu

SEQ ID NO: 747196 - RNA, 19 nt, Homo sapiens
acgagcggaucauguguuu

SEQ ID NO: 747197 - RNA, 19 nt, Homo sapiens
gugacgcgcuccucuccaa

SEQ ID NO: 747198 - RNA, 19 nt, Homo sapiens
gaaauccacccaguuaacu

SEQ ID NO: 747199 - RNA, 19 nt, Homo sapiens
guauggauuugccuauucu

SEQ ID NO: 747200 - RNA, 19 nt, Homo sapiens
acacuauacugcuuugucu

SEQ ID NO: 747201 - RNA, 19 nt, Homo sapiens
ccacgggaaguguaugauu

SEQ ID NO: 747202 - RNA, 19 nt, Homo sapiens
cucaagaccuagaaaauaa

SEQ ID NO: 747203 - RNA, 19 nt, Homo sapiens
aagaggaggucgagaacuc

SEQ ID NO: 747204 - RNA, 19 nt, Homo sapiens
gucaggaauucaagauuag

SEQ ID NO: 747205 - RNA, 19 nt, Homo sapiens
caucggaacgggcuggaaa

SEQ ID NO: 747206 - RNA, 19 nt, Homo sapiens
cauuaccaccgucaacuuu

SEQ ID NO: 747207 - RNA, 19 nt, Homo sapiens
gucagcgccuggaaacuug

SEQ ID NO: 747208 - RNA, 19 nt, Homo sapiens
ggacuugaaggaccugauc

SEQ ID NO: 747209 - RNA, 19 nt, Homo sapiens
guacaugguguucgaacug

SEQ ID NO: 747210 - RNA, 19 nt, Homo sapiens
ugguggagguccuggauga

SEQ ID NO: 747211 - RNA, 19 nt, Homo sapiens
ggauccaacgcacacuuaa

SEQ ID NO: 747212 - RNA, 19 nt, Homo sapiens
ucccuacggccuagaaaua

SEQ ID NO: 747213 - RNA, 19 nt, Homo sapiens
ccucaaaccacucucugaa

SEQ ID NO: 747214 - RNA, 19 nt, Homo sapiens
ggccgacaguggagucuca

SEQ ID NO: 747215 - RNA, 19 nt, Homo sapiens
ucagaauagguauggauuu

SEQ ID NO: 747216 - RNA, 19 nt, Homo sapiens
cgucaacuuuacgacauuu

SEQ ID NO: 747217 - RNA, 19 nt, Homo sapiens
aggcagagguugcagugau

SEQ ID NO: 747218 - RNA, 19 nt, Homo sapiens
cccguaugcuggacaagaa

SEQ ID NO: 747219 - RNA, 19 nt, Homo sapiens
gcaucgaguacuuacacua

SEQ ID NO: 747220 - RNA, 19 nt, Homo sapiens
ccaggcccguuucuacuuc

SEQ ID NO: 747221 - RNA, 19 nt, Homo sapiens
gacccugucucaaaacaaa

SEQ ID NO: 747222 - RNA, 19 nt, Homo sapiens
cagcuacucgggagacuga

SEQ ID NO: 747223 - RNA, 19 nt, Homo sapiens
acauagcuuuacugaggua

SEQ ID NO: 747224 - RNA, 19 nt, Homo sapiens
uagcugaggacuugaagga

SEQ ID NO: 747225 - RNA, 19 nt, Homo sapiens
ccuguaaucccagcacuuu

SEQ ID NO: 747226 - RNA, 19 nt, Homo sapiens
gaagugcccacccucaaac

SEQ ID NO: 747227 - RNA, 19 nt, Homo sapiens
caauaccuacuaugcaaug

SEQ ID NO: 747228 - RNA, 19 nt, Homo sapiens
ggucaggaauucaagauua

SEQ ID NO: 747229 - RNA, 19 nt, Homo sapiens
cgacauagcugaggacuug

SEQ ID NO: 747230 - RNA, 19 nt, Homo sapiens
gacaauaccuacuaugcaa

SEQ ID NO: 747231 - RNA, 19 nt, Homo sapiens
gggaaggccuuggauguuu

SEQ ID NO: 747232 - RNA, 19 nt, Homo sapiens
uaaauggcgucauacacua

SEQ ID NO: 747233 - RNA, 19 nt, Homo sapiens
caagaucgcugacuuuggu

SEQ ID NO: 747234 - RNA, 19 nt, Homo sapiens
gaaauugccauccucaaga

SEQ ID NO: 747235 - RNA, 19 nt, Homo sapiens
caaaguaacguaagaguuc

SEQ ID NO: 747236 - RNA, 19 nt, Homo sapiens
ugaagaccaugauacguaa

SEQ ID NO: 747237 - RNA, 19 nt, Homo sapiens
ucaaaccacucucugaaga

SEQ ID NO: 747238 - RNA, 19 nt, Homo sapiens
cagaauagguauggauuug

SEQ ID NO: 747239 - RNA, 19 nt, Homo sapiens
ccaguaaccacucagaaua

SEQ ID NO: 747240 - RNA, 19 nt, Homo sapiens
cagccacccuuccuucaua

SEQ ID NO: 747241 - RNA, 19 nt, Homo sapiens
caaguuggccuacaaugaa

SEQ ID NO: 747242 - RNA, 19 nt, Homo sapiens
acaguaagaucaagaguca

SEQ ID NO: 747243 - RNA, 19 nt, Homo sapiens
ggaaggccuuggauguuug

SEQ ID NO: 747244 - RNA, 19 nt, Homo sapiens
ucaaaggcaucgaguacuu

SEQ ID NO: 747245 - RNA, 19 nt, Homo sapiens
caaugaaggugcuguccaa

SEQ ID NO: 747246 - RNA, 19 nt, Homo sapiens
gugaagaccaugauacgua

SEQ ID NO: 747247 - RNA, 19 nt, Homo sapiens
gagcagguguaccaggaaa

SEQ ID NO: 747248 - RNA, 19 nt, Homo sapiens
ucguauaaauggcgucaua

SEQ ID NO: 747249 - RNA, 19 nt, Homo sapiens
gcaaaguaacguaagaguu

SEQ ID NO: 747250 - RNA, 19 nt, Homo sapiens
ggaagugcccacccucaaa

SEQ ID NO: 747251 - RNA, 19 nt, Homo sapiens
gguauggauuugccuauuc

SEQ ID NO: 747252 - RNA, 19 nt, Homo sapiens
ggacagaugaggcuuugug

SEQ ID NO: 747253 - RNA, 19 nt, Homo sapiens
ccaaugaggaccaucugua

SEQ ID NO: 747254 - RNA, 19 nt, Homo sapiens
caaaggcaucgaguacuua

SEQ ID NO: 747255 - RNA, 19 nt, Homo sapiens
gaucaaaggcaucgaguac

SEQ ID NO: 747256 - RNA, 19 nt, Homo sapiens
ggaaauugccauccucaag

SEQ ID NO: 747257 - RNA, 19 nt, Homo sapiens
uaaccacucagaauaggua

SEQ ID NO: 747258 - RNA, 19 nt, Homo sapiens
ggaggaacgcucacuguca

SEQ ID NO: 747259 - RNA, 19 nt, Homo sapiens
aguauacccugaaggauga

SEQ ID NO: 747260 - RNA, 19 nt, Homo sapiens
ggcauggaguccuucauug

SEQ ID NO: 747261 - RNA, 19 nt, Homo sapiens
caucguggcuaccugacuu

SEQ ID NO: 747262 - RNA, 19 nt, Homo sapiens
aaauugccauccucaagaa

SEQ ID NO: 747263 - RNA, 19 nt, Homo sapiens
gggcauggaguccuucauu

SEQ ID NO: 747264 - RNA, 19 nt, Homo sapiens
gaugaggcuuuguguccuu

SEQ ID NO: 747265 - RNA, 19 nt, Homo sapiens
gggauccaacgcacacuua

SEQ ID NO: 747266 - RNA, 19 nt, Homo sapiens
guacuuacacuaccagaag

SEQ ID NO: 747267 - RNA, 19 nt, Homo sapiens
ucaaguuggccuacaauga

SEQ ID NO: 747268 - RNA, 19 nt, Homo sapiens
ccuauggugucgucaaguu

SEQ ID NO: 747269 - RNA, 19 nt, Homo sapiens
ccugaaggaugaaauugga

SEQ ID NO: 747270 - RNA, 19 nt, Homo sapiens
cuagagggcuuugaaccuu

SEQ ID NO: 747271 - RNA, 19 nt, Homo sapiens
ggacguuucguauaaaugg

SEQ ID NO: 747272 - RNA, 19 nt, Homo sapiens
gagcggaucauguguuuac

SEQ ID NO: 747273 - RNA, 19 nt, Homo sapiens
cauccaccgugacaucaaa

SEQ ID NO: 747274 - RNA, 19 nt, Homo sapiens
gcgagacuccguuucagaa

SEQ ID NO: 747275 - RNA, 19 nt, Homo sapiens
aaaucaagauccuggugaa

SEQ ID NO: 747276 - RNA, 19 nt, Homo sapiens
caucaagaucgcugacuuu

SEQ ID NO: 747277 - RNA, 19 nt, Homo sapiens
gcagguguaccaggaaauu

SEQ ID NO: 747278 - RNA, 19 nt, Homo sapiens
ggaaauccacccaguuaac

SEQ ID NO: 747279 - RNA, 19 nt, Homo sapiens
gaucauccaccgugacauc

SEQ ID NO: 747280 - RNA, 19 nt, Homo sapiens
gcauggaguccuucauugu

SEQ ID NO: 747281 - RNA, 19 nt, Homo sapiens
uagagggcuuugaaccuuu

SEQ ID NO: 747282 - RNA, 19 nt, Homo sapiens
ggucuucguuucuccucuu

SEQ ID NO: 747283 - RNA, 19 nt, Homo sapiens
gaucacgaggucaggaauu

SEQ ID NO: 747284 - RNA, 19 nt, Homo sapiens
gauucagugguuucuaaua

SEQ ID NO: 747285 - RNA, 19 nt, Homo sapiens
cacgggaaguguaugauuc

SEQ ID NO: 747286 - RNA, 19 nt, Homo sapiens
agucacuucuguuucuuaa

SEQ ID NO: 747287 - RNA, 19 nt, Homo sapiens
caggacagaugaggcuuug

SEQ ID NO: 747288 - RNA, 19 nt, Homo sapiens
gcucaagaccuagaaaaua

SEQ ID NO: 747289 - RNA, 19 nt, Homo sapiens
augauucagugguuucuaa

SEQ ID NO: 747290 - RNA, 19 nt, Homo sapiens
guugcaaaguaacguaaga

SEQ ID NO: 747291 - RNA, 19 nt, Homo sapiens
gaaaauaaguccccuuccu

SEQ ID NO: 747292 - RNA, 19 nt, Homo sapiens
acgagcggaucauguguuu

SEQ ID NO: 747293 - RNA, 19 nt, Homo sapiens
gugacgcgcuccucuccaa

SEQ ID NO: 747294 - RNA, 19 nt, Homo sapiens
gaaauccacccaguuaacu

SEQ ID NO: 747295 - RNA, 19 nt, Homo sapiens
guauggauuugccuauucu

SEQ ID NO: 747296 - RNA, 19 nt, Homo sapiens
acacuauacugcuuugucu

SEQ ID NO: 747297 - RNA, 19 nt, Homo sapiens
gucaggaauucaagauuag

SEQ ID NO: 747298 - RNA, 19 nt, Homo sapiens
ccacgggaaguguaugauu

SEQ ID NO: 747299 - RNA, 19 nt, Homo sapiens
cucaagaccuagaaaauaa

SEQ ID NO: 747300 - RNA, 19 nt, Homo sapiens
caucggaacgggcuggaaa

SEQ ID NO: 747301 - RNA, 19 nt, Homo sapiens
cauuaccaccgucaacuuu

SEQ ID NO: 747302 - RNA, 19 nt, Homo sapiens
gucagcgccuggaaacuug

SEQ ID NO: 747303 - RNA, 19 nt, Homo sapiens
ggacuugaaggaccugauc

SEQ ID NO: 747304 - RNA, 19 nt, Homo sapiens
guacaugguguucgaacug

SEQ ID NO: 747305 - RNA, 19 nt, Homo sapiens
ugguggagguccuggauga

SEQ ID NO: 747306 - RNA, 19 nt, Homo sapiens
ggauccaacgcacacuuaa

SEQ ID NO: 747307 - RNA, 19 nt, Homo sapiens
ucccuacggccuagaaaua

SEQ ID NO: 747308 - RNA, 19 nt, Homo sapiens
ccucaaaccacucucugaa

SEQ ID NO: 747309 - RNA, 19 nt, Homo sapiens
ggccgacaguggagucuca

SEQ ID NO: 747310 - RNA, 19 nt, Homo sapiens
ucagaauagguauggauuu

SEQ ID NO: 747311 - RNA, 19 nt, Homo sapiens
cgucaacuuuacgacauuu

SEQ ID NO: 747312 - RNA, 19 nt, Homo sapiens
aggcagagguugcagugau

SEQ ID NO: 747313 - RNA, 19 nt, Homo sapiens
cccguaugcuggacaagaa

SEQ ID NO: 747314 - RNA, 19 nt, Homo sapiens
gcaucgaguacuuacacua

SEQ ID NO: 747315 - RNA, 19 nt, Homo sapiens
ccaggcccguuucuacuuc

SEQ ID NO: 747316 - RNA, 19 nt, Homo sapiens
gacccugucucaaaacaaa

SEQ ID NO: 747317 - RNA, 19 nt, Homo sapiens
cagcuacucgggagacuga

SEQ ID NO: 747318 - RNA, 19 nt, Homo sapiens
acauagcuuuacugaggua

SEQ ID NO: 747319 - RNA, 19 nt, Homo sapiens
ucaagauccuggugaagac

SEQ ID NO: 747320 - RNA, 19 nt, Homo sapiens
uagcugaggacuugaagga

SEQ ID NO: 747321 - RNA, 19 nt, Homo sapiens
ccuguaaucccagcacuuu

SEQ ID NO: 747322 - RNA, 19 nt, Homo sapiens
gaagugcccacccucaaac

SEQ ID NO: 747323 - RNA, 19 nt, Homo sapiens
caauaccuacuaugcaaug

SEQ ID NO: 747324 - RNA, 19 nt, Homo sapiens
ugaaggaugaaauuggaaa

SEQ ID NO: 747325 - RNA, 19 nt, Homo sapiens
gguggcagccuggacauga

SEQ ID NO: 747326 - RNA, 19 nt, Homo sapiens
uuauuaacuuggagguuga

SEQ ID NO: 747327 - RNA, 19 nt, Homo sapiens
uagcuuuacugagguacaa

SEQ ID NO: 747328 - RNA, 19 nt, Homo sapiens
agaaagggcuugaaauuua

SEQ ID NO: 747329 - RNA, 19 nt, Homo sapiens
gaaaggaggugcuguuaug

SEQ ID NO: 747330 - RNA, 19 nt, Homo sapiens
gaaagggcuugaaauuuaa

SEQ ID NO: 747331 - RNA, 19 nt, Homo sapiens
ggucaggaauucaagauua

SEQ ID NO: 747332 - RNA, 19 nt, Homo sapiens
gaacuuaagagacaacuaa

SEQ ID NO: 747333 - RNA, 19 nt, Homo sapiens
cgacauagcugaggacuug

SEQ ID NO: 747334 - RNA, 19 nt, Homo sapiens
gaaauaaacagacagcaaa

SEQ ID NO: 747335 - RNA, 19 nt, Homo sapiens
gcaaagaggacgcccauaa

SEQ ID NO: 747336 - RNA, 19 nt, Homo sapiens
caagauggcuguaaacaca

SEQ ID NO: 747337 - RNA, 19 nt, Homo sapiens
ggaggugguugcugcauuu

SEQ ID NO: 747338 - RNA, 19 nt, Homo sapiens
caacuaagccuuucguguu

SEQ ID NO: 747339 - RNA, 19 nt, Homo sapiens
gaucugagcuucccuagac

SEQ ID NO: 747340 - RNA, 19 nt, Homo sapiens
ucaaugaaauacccaguuu

SEQ ID NO: 747341 - RNA, 19 nt, Homo sapiens
gcucaaagcagguuucuga

SEQ ID NO: 747342 - RNA, 19 nt, Homo sapiens
gcagggagcuuugaugcaa

SEQ ID NO: 747343 - RNA, 19 nt, Homo sapiens
gacaauaccuacuaugcaa

SEQ ID NO: 747344 - RNA, 19 nt, Homo sapiens
ccuccuggcuuuauguuua

SEQ ID NO: 747345 - RNA, 19 nt, Homo sapiens
ucaggcaugugaucaguua

SEQ ID NO: 747346 - RNA, 19 nt, Homo sapiens
gggaaggccuuggauguuu

SEQ ID NO: 747347 - RNA, 19 nt, Homo sapiens
guucauaaccuguauauuc

SEQ ID NO: 747348 - RNA, 19 nt, Homo sapiens
caagaucgcugacuuuggu

SEQ ID NO: 747349 - RNA, 19 nt, Homo sapiens
gaagaaacaccaaagaaag

SEQ ID NO: 747350 - RNA, 19 nt, Homo sapiens
caaagcagguuucugagau

SEQ ID NO: 747351 - RNA, 19 nt, Homo sapiens
cgucaucucugguuauuug

SEQ ID NO: 747352 - RNA, 19 nt, Homo sapiens
gaaauugccauccucaaga

SEQ ID NO: 747353 - RNA, 19 nt, Homo sapiens
gcucuugacuguaguuuag

SEQ ID NO: 747354 - RNA, 19 nt, Homo sapiens
gaaguuugguugagguuca

SEQ ID NO: 747355 - RNA, 19 nt, Homo sapiens
ugaagaccaugauacguaa

SEQ ID NO: 747356 - RNA, 19 nt, Homo sapiens
gaagagcaaaggacaggua

SEQ ID NO: 747357 - RNA, 19 nt, Homo sapiens
ucaaaccacucucugaaga

SEQ ID NO: 747358 - RNA, 19 nt, Homo sapiens
aaagaaagcuguggaaagg

SEQ ID NO: 747359 - RNA, 19 nt, Homo sapiens
gagcuuugaugcaacuuau

SEQ ID NO: 747360 - RNA, 19 nt, Homo sapiens
caaguuggccuacaaugaa

SEQ ID NO: 747361 - RNA, 19 nt, Homo sapiens
ggucuggccuuuccugaga

SEQ ID NO: 747362 - RNA, 19 nt, Homo sapiens
gcaaaggacagguagucua

SEQ ID NO: 747363 - RNA, 19 nt, Homo sapiens
gagcuuccaggauauauuu

SEQ ID NO: 747364 - RNA, 19 nt, Homo sapiens
acaguaagaucaagaguca

SEQ ID NO: 747365 - RNA, 19 nt, Homo sapiens
ggaaggccuuggauguuug

SEQ ID NO: 747366 - RNA, 19 nt, Homo sapiens
ucaaaggcaucgaguacuu

SEQ ID NO: 747367 - RNA, 19 nt, Homo sapiens
caaugaaggugcuguccaa

SEQ ID NO: 747368 - RNA, 19 nt, Homo sapiens
gcccauaauuucuuccauu

SEQ ID NO: 747369 - RNA, 19 nt, Homo sapiens
ugaagaaacaccaaagaaa

SEQ ID NO: 747370 - RNA, 19 nt, Homo sapiens
cgucagauauaccaaguga

SEQ ID NO: 747371 - RNA, 19 nt, Homo sapiens
gugaagaccaugauacgua

SEQ ID NO: 747372 - RNA, 19 nt, Homo sapiens
gagcagguguaccaggaaa

SEQ ID NO: 747373 - RNA, 19 nt, Homo sapiens
cagcgggucccuagucuua

SEQ ID NO: 747374 - RNA, 19 nt, Homo sapiens
ucuaaagacugcuaagguu

SEQ ID NO: 747375 - RNA, 19 nt, Homo sapiens
cagaaacuauuuagagcuu

SEQ ID NO: 747376 - RNA, 19 nt, Homo sapiens
aaagcagguuucugagaua

SEQ ID NO: 747377 - RNA, 19 nt, Homo sapiens
uacauuacauggcuuaaga

SEQ ID NO: 747378 - RNA, 19 nt, Homo sapiens
cagaaagggcuugaaauuu

SEQ ID NO: 747379 - RNA, 19 nt, Homo sapiens
aaacagaaagggcuugaaa

SEQ ID NO: 747380 - RNA, 19 nt, Homo sapiens
caucucugguuauuuguuu

SEQ ID NO: 747381 - RNA, 19 nt, Homo sapiens
aagcuucucuguacaguug

SEQ ID NO: 747382 - RNA, 19 nt, Homo sapiens
ccuaagcucuugacuguag

SEQ ID NO: 747383 - RNA, 19 nt, Homo sapiens
gaaagacggcaccgggaaa

SEQ ID NO: 747384 - RNA, 19 nt, Homo sapiens
ggaagugcccacccucaaa

SEQ ID NO: 747385 - RNA, 19 nt, Homo sapiens
acagaaagggcuugaaauu

SEQ ID NO: 747386 - RNA, 19 nt, Homo sapiens
gcagggcuucucuuguuua

SEQ ID NO: 747387 - RNA, 19 nt, Homo sapiens
uacaugaacuuaagagaca

SEQ ID NO: 747388 - RNA, 19 nt, Homo sapiens
gaaccaugaccuccacuug

SEQ ID NO: 747389 - RNA, 19 nt, Homo sapiens
ggacgcccauaauuucuuc

SEQ ID NO: 747390 - RNA, 19 nt, Homo sapiens
cugcagggcuucucuuguu

SEQ ID NO: 747391 - RNA, 19 nt, Homo sapiens
auuuagagcuuccaggaua

SEQ ID NO: 747392 - RNA, 19 nt, Homo sapiens
gagcacaguaguucagaaa

SEQ ID NO: 747393 - RNA, 19 nt, Homo sapiens
ggaggaagugcucuuguga

SEQ ID NO: 747394 - RNA, 19 nt, Homo sapiens
ccaaugaggaccaucugua

SEQ ID NO: 747395 - RNA, 19 nt, Homo sapiens
aaagaggacgcccauaauu

SEQ ID NO: 747396 - RNA, 19 nt, Homo sapiens
caaagaggacgcccauaau

SEQ ID NO: 747397 - RNA, 19 nt, Homo sapiens
gaacguguuucuucaugac

SEQ ID NO: 747398 - RNA, 19 nt, Homo sapiens
caaaggcaucgaguacuua

SEQ ID NO: 747399 - RNA, 19 nt, Homo sapiens
gaucaaaggcaucgaguac

SEQ ID NO: 747400 - RNA, 19 nt, Homo sapiens
ggaaaggaggugcuguuau

SEQ ID NO: 747401 - RNA, 19 nt, Homo sapiens
caaagaaagcuguggaaag

SEQ ID NO: 747402 - RNA, 19 nt, Homo sapiens
gacccacauugaugacuuu

SEQ ID NO: 747403 - RNA, 19 nt, Homo sapiens
ggaaauugccauccucaag

SEQ ID NO: 747404 - RNA, 19 nt, Homo sapiens
gaaaggaccugccccacau

SEQ ID NO: 747405 - RNA, 19 nt, Homo sapiens
cagaaccacgucagauaua

SEQ ID NO: 747406 - RNA, 19 nt, Homo sapiens
gcaccgcguuuccauagca

SEQ ID NO: 747407 - RNA, 19 nt, Homo sapiens
ggaggaacgcucacuguca

SEQ ID NO: 747408 - RNA, 19 nt, Homo sapiens
aguauacccugaaggauga

SEQ ID NO: 747409 - RNA, 19 nt, Homo sapiens
ggcauggaguccuucauug

SEQ ID NO: 747410 - RNA, 19 nt, Homo sapiens
aagaggacgcccauaauuu

SEQ ID NO: 747411 - RNA, 19 nt, Homo sapiens
cuucuuggcuuccauagau

SEQ ID NO: 747412 - RNA, 19 nt, Homo sapiens
caugacagcugcucaaagc

SEQ ID NO: 747413 - RNA, 19 nt, Homo sapiens
aaauugccauccucaagaa

SEQ ID NO: 747414 - RNA, 19 nt, Homo sapiens
gggcauggaguccuucauu

SEQ ID NO: 747415 - RNA, 19 nt, Homo sapiens
guagaauuguagucaggaa

SEQ ID NO: 747416 - RNA, 19 nt, Homo sapiens
gggauccaacgcacacuua

SEQ ID NO: 747417 - RNA, 19 nt, Homo sapiens
cauuugagcugccacucuu

SEQ ID NO: 747418 - RNA, 19 nt, Homo sapiens
guaaacacagagcauuuga

SEQ ID NO: 747419 - RNA, 19 nt, Homo sapiens
caaaggacagguagucuag

SEQ ID NO: 747420 - RNA, 19 nt, Homo sapiens
gcuuugaugcaacuuauuu

SEQ ID NO: 747421 - RNA, 19 nt, Homo sapiens
guacuuacacuaccagaag

SEQ ID NO: 747422 - RNA, 19 nt, Homo sapiens
ucaaguuggccuacaauga

SEQ ID NO: 747423 - RNA, 19 nt, Homo sapiens
ccuauggugucgucaaguu

SEQ ID NO: 747424 - RNA, 19 nt, Homo sapiens
ccugaaggaugaaauugga

SEQ ID NO: 747425 - RNA, 19 nt, Homo sapiens
cuagagggcuuugaaccuu

SEQ ID NO: 747426 - RNA, 19 nt, Homo sapiens
aacuaagccuuucguguuu

SEQ ID NO: 747427 - RNA, 19 nt, Homo sapiens
ccaaggugcuagggaaguu

SEQ ID NO: 747428 - RNA, 19 nt, Homo sapiens
agaaagggcuugaaauuua

SEQ ID NO: 747429 - RNA, 19 nt, Homo sapiens
gaaaggaggugcuguuaug

SEQ ID NO: 747430 - RNA, 19 nt, Homo sapiens
gaaagggcuugaaauuuaa

SEQ ID NO: 747431 - RNA, 19 nt, Homo sapiens
gaacuuaagagacaacuaa

SEQ ID NO: 747432 - RNA, 19 nt, Homo sapiens
cgacauagcugaggacuug

SEQ ID NO: 747433 - RNA, 19 nt, Homo sapiens
gaaauaaacagacagcaaa

SEQ ID NO: 747434 - RNA, 19 nt, Homo sapiens
gcaaagaggacgcccauaa

SEQ ID NO: 747435 - RNA, 19 nt, Homo sapiens
caagauggcuguaaacaca

SEQ ID NO: 747436 - RNA, 19 nt, Homo sapiens
ggaggugguugcugcauuu

SEQ ID NO: 747437 - RNA, 19 nt, Homo sapiens
caacuaagccuuucguguu

SEQ ID NO: 747438 - RNA, 19 nt, Homo sapiens
gaucugagcuucccuagac

SEQ ID NO: 747439 - RNA, 19 nt, Homo sapiens
ucaaugaaauacccaguuu

SEQ ID NO: 747440 - RNA, 19 nt, Homo sapiens
gcucaaagcagguuucuga

SEQ ID NO: 747441 - RNA, 19 nt, Homo sapiens
gcagggagcuuugaugcaa

SEQ ID NO: 747442 - RNA, 19 nt, Homo sapiens
gacaauaccuacuaugcaa

SEQ ID NO: 747443 - RNA, 19 nt, Homo sapiens
ccuccuggcuuuauguuua

SEQ ID NO: 747444 - RNA, 19 nt, Homo sapiens
ucaggcaugugaucaguua

SEQ ID NO: 747445 - RNA, 19 nt, Homo sapiens
gggaaggccuuggauguuu

SEQ ID NO: 747446 - RNA, 19 nt, Homo sapiens
guucauaaccuguauauuc

SEQ ID NO: 747447 - RNA, 19 nt, Homo sapiens
caagaucgcugacuuuggu

SEQ ID NO: 747448 - RNA, 19 nt, Homo sapiens
gaagaaacaccaaagaaag

SEQ ID NO: 747449 - RNA, 19 nt, Homo sapiens
caaagcagguuucugagau

SEQ ID NO: 747450 - RNA, 19 nt, Homo sapiens
cgucaucucugguuauuug

SEQ ID NO: 747451 - RNA, 19 nt, Homo sapiens
gaaauugccauccucaaga

SEQ ID NO: 747452 - RNA, 19 nt, Homo sapiens
gcucuugacuguaguuuag

SEQ ID NO: 747453 - RNA, 19 nt, Homo sapiens
gaaguuugguugagguuca

SEQ ID NO: 747454 - RNA, 19 nt, Homo sapiens
ugaagaccaugauacguaa

SEQ ID NO: 747455 - RNA, 19 nt, Homo sapiens
gaagagcaaaggacaggua

SEQ ID NO: 747456 - RNA, 19 nt, Homo sapiens
gaacucagucaaacacauu

SEQ ID NO: 747457 - RNA, 19 nt, Homo sapiens
ucaaaccacucucugaaga

SEQ ID NO: 747458 - RNA, 19 nt, Homo sapiens
aaagaaagcuguggaaagg

SEQ ID NO: 747459 - RNA, 19 nt, Homo sapiens
gagcuuugaugcaacuuau

SEQ ID NO: 747460 - RNA, 19 nt, Homo sapiens
caaguuggccuacaaugaa

SEQ ID NO: 747461 - RNA, 19 nt, Homo sapiens
ggucuggccuuuccugaga

SEQ ID NO: 747462 - RNA, 19 nt, Homo sapiens
gcaaaggacagguagucua

SEQ ID NO: 747463 - RNA, 19 nt, Homo sapiens
gagcuuccaggauauauuu

SEQ ID NO: 747464 - RNA, 19 nt, Homo sapiens
acaguaagaucaagaguca

SEQ ID NO: 747465 - RNA, 19 nt, Homo sapiens
ggaaggccuuggauguuug

SEQ ID NO: 747466 - RNA, 19 nt, Homo sapiens
ucaaaggcaucgaguacuu

SEQ ID NO: 747467 - RNA, 19 nt, Homo sapiens
caaugaaggugcuguccaa

SEQ ID NO: 747468 - RNA, 19 nt, Homo sapiens
gcccauaauuucuuccauu

SEQ ID NO: 747469 - RNA, 19 nt, Homo sapiens
ugaagaaacaccaaagaaa

SEQ ID NO: 747470 - RNA, 19 nt, Homo sapiens
cgucagauauaccaaguga

SEQ ID NO: 747471 - RNA, 19 nt, Homo sapiens
gugaagaccaugauacgua

SEQ ID NO: 747472 - RNA, 19 nt, Homo sapiens
gagcagguguaccaggaaa

SEQ ID NO: 747473 - RNA, 19 nt, Homo sapiens
cagcgggucccuagucuua

SEQ ID NO: 747474 - RNA, 19 nt, Homo sapiens
ucuaaagacugcuaagguu

SEQ ID NO: 747475 - RNA, 19 nt, Homo sapiens
cagaaacuauuuagagcuu

SEQ ID NO: 747476 - RNA, 19 nt, Homo sapiens
aaagcagguuucugagaua

SEQ ID NO: 747477 - RNA, 19 nt, Homo sapiens
uacauuacauggcuuaaga

SEQ ID NO: 747478 - RNA, 19 nt, Homo sapiens
cagaaagggcuugaaauuu

SEQ ID NO: 747479 - RNA, 19 nt, Homo sapiens
aaacagaaagggcuugaaa

SEQ ID NO: 747480 - RNA, 19 nt, Homo sapiens
caucucugguuauuuguuu

SEQ ID NO: 747481 - RNA, 19 nt, Homo sapiens
aagcuucucuguacaguug

SEQ ID NO: 747482 - RNA, 19 nt, Homo sapiens
ccuaagcucuugacuguag

SEQ ID NO: 747483 - RNA, 19 nt, Homo sapiens
gaaagacggcaccgggaaa

SEQ ID NO: 747484 - RNA, 19 nt, Homo sapiens
ggaagugcccacccucaaa

SEQ ID NO: 747485 - RNA, 19 nt, Homo sapiens
acagaaagggcuugaaauu

SEQ ID NO: 747486 - RNA, 19 nt, Homo sapiens
ucaaacacauucccagcuu

SEQ ID NO: 747487 - RNA, 19 nt, Homo sapiens
gcagggcuucucuuguuua

SEQ ID NO: 747488 - RNA, 19 nt, Homo sapiens
uacaugaacuuaagagaca

SEQ ID NO: 747489 - RNA, 19 nt, Homo sapiens
gaaccaugaccuccacuug

SEQ ID NO: 747490 - RNA, 19 nt, Homo sapiens
ggacgcccauaauuucuuc

SEQ ID NO: 747491 - RNA, 19 nt, Homo sapiens
cugcagggcuucucuuguu

SEQ ID NO: 747492 - RNA, 19 nt, Homo sapiens
auuuagagcuuccaggaua

SEQ ID NO: 747493 - RNA, 19 nt, Homo sapiens
gagcacaguaguucagaaa

SEQ ID NO: 747494 - RNA, 19 nt, Homo sapiens
ggaggaagugcucuuguga

SEQ ID NO: 747495 - RNA, 19 nt, Homo sapiens
ccaaugaggaccaucugua

SEQ ID NO: 747496 - RNA, 19 nt, Homo sapiens
aaagaggacgcccauaauu

SEQ ID NO: 747497 - RNA, 19 nt, Homo sapiens
caaagaggacgcccauaau

SEQ ID NO: 747498 - RNA, 19 nt, Homo sapiens
gaacguguuucuucaugac

SEQ ID NO: 747499 - RNA, 19 nt, Homo sapiens
caaaggcaucgaguacuua

SEQ ID NO: 747500 - RNA, 19 nt, Homo sapiens
gaucaaaggcaucgaguac

SEQ ID NO: 747501 - RNA, 19 nt, Homo sapiens
ggaaaggaggugcuguuau

SEQ ID NO: 747502 - RNA, 19 nt, Homo sapiens
caaagaaagcuguggaaag

SEQ ID NO: 747503 - RNA, 19 nt, Homo sapiens
gacccacauugaugacuuu

SEQ ID NO: 747504 - RNA, 19 nt, Homo sapiens
ggaaauugccauccucaag

SEQ ID NO: 747505 - RNA, 19 nt, Homo sapiens
gaaaggaccugccccacau

SEQ ID NO: 747506 - RNA, 19 nt, Homo sapiens
aguauacccugaaggauga

SEQ ID NO: 747507 - RNA, 19 nt, Homo sapiens
ggcauggaguccuucauug

SEQ ID NO: 747508 - RNA, 19 nt, Homo sapiens
cagaaccacgucagauaua

SEQ ID NO: 747509 - RNA, 19 nt, Homo sapiens
gcaccgcguuuccauagca

SEQ ID NO: 747510 - RNA, 19 nt, Homo sapiens
ggaggaacgcucacuguca

SEQ ID NO: 747511 - RNA, 19 nt, Homo sapiens
aagaggacgcccauaauuu

SEQ ID NO: 747512 - RNA, 19 nt, Homo sapiens
gggcauggaguccuucauu

SEQ ID NO: 747513 - RNA, 19 nt, Homo sapiens
cuucuuggcuuccauagau

SEQ ID NO: 747514 - RNA, 19 nt, Homo sapiens
caugacagcugcucaaagc

SEQ ID NO: 747515 - RNA, 19 nt, Homo sapiens
aaauugccauccucaagaa

SEQ ID NO: 747516 - RNA, 19 nt, Homo sapiens
guagaauuguagucaggaa

SEQ ID NO: 747517 - RNA, 19 nt, Homo sapiens
cauuugagcugccacucuu

SEQ ID NO: 747518 - RNA, 19 nt, Homo sapiens
guaaacacagagcauuuga

SEQ ID NO: 747519 - RNA, 19 nt, Homo sapiens
caaaggacagguagucuag

SEQ ID NO: 747520 - RNA, 19 nt, Homo sapiens
ccuauggugucgucaaguu

SEQ ID NO: 747521 - RNA, 19 nt, Homo sapiens
gcuuugaugcaacuuauuu

SEQ ID NO: 747522 - RNA, 19 nt, Homo sapiens
ccugaaggaugaaauugga

SEQ ID NO: 747523 - RNA, 19 nt, Homo sapiens
gaacugcacgcuggucgaa

SEQ ID NO: 747524 - RNA, 19 nt, Homo sapiens
guacuuacacuaccagaag

SEQ ID NO: 747525 - RNA, 19 nt, Homo sapiens
ucaaguuggccuacaauga

SEQ ID NO: 747526 - RNA, 19 nt, Homo sapiens
aacuaagccuuucguguuu

SEQ ID NO: 747527 - RNA, 19 nt, Homo sapiens
ccaaggugcuagggaaguu

SEQ ID NO: 747528 - RNA, 19 nt, Homo sapiens
gaagagggauggauugaaa

SEQ ID NO: 747529 - RNA, 19 nt, Homo sapiens
gaaacugccuacuuaauuu

SEQ ID NO: 747530 - RNA, 19 nt, Homo sapiens
gaaagaggagcaucagaua

SEQ ID NO: 747531 - RNA, 19 nt, Homo sapiens
aagaauagauguugggaua

SEQ ID NO: 747532 - RNA, 19 nt, Homo sapiens
ggaauauccugaaacagaa

SEQ ID NO: 747533 - RNA, 19 nt, Homo sapiens
gcaagaagaagacauuaaa

SEQ ID NO: 747534 - RNA, 19 nt, Homo sapiens
gcaguuaacuauaaugcaa

SEQ ID NO: 747535 - RNA, 19 nt, Homo sapiens
gcaaagagaagaacaugaa

SEQ ID NO: 747536 - RNA, 19 nt, Homo sapiens
ggcaugaucuaccugaaua

SEQ ID NO: 747537 - RNA, 19 nt, Homo sapiens
gggaauauccugaaacaga

SEQ ID NO: 747538 - RNA, 19 nt, Homo sapiens
ucaacagagugauacuuua

SEQ ID NO: 747539 - RNA, 19 nt, Homo sapiens
gaagcaagaagaagacauu

SEQ ID NO: 747540 - RNA, 19 nt, Homo sapiens
caaagaauaugccaaacag

SEQ ID NO: 747541 - RNA, 19 nt, Homo sapiens
gaauagauguugggauauc

SEQ ID NO: 747542 - RNA, 19 nt, Homo sapiens
ccaagaaaguuauggagau

SEQ ID NO: 747543 - RNA, 19 nt, Homo sapiens
uucagaaacugccuacuua

SEQ ID NO: 747544 - RNA, 19 nt, Homo sapiens
gagccaaccaagaaaguua

SEQ ID NO: 747545 - RNA, 19 nt, Homo sapiens
aaagaacaaugguaggaaa

SEQ ID NO: 747546 - RNA, 19 nt, Homo sapiens
ucgaagaacacacuaauaa

SEQ ID NO: 747547 - RNA, 19 nt, Homo sapiens
gauuguauguucaggagaa

SEQ ID NO: 747548 - RNA, 19 nt, Homo sapiens
gagaagaacaugaauuagu

SEQ ID NO: 747549 - RNA, 19 nt, Homo sapiens
gaagaacacacuaauaaac

SEQ ID NO: 747550 - RNA, 19 nt, Homo sapiens
gcucaaagaauaugccaaa

SEQ ID NO: 747551 - RNA, 19 nt, Homo sapiens
gaagagcuacuaagagcaa

SEQ ID NO: 747552 - RNA, 19 nt, Homo sapiens
ucacuuuccucuguugaua

SEQ ID NO: 747553 - RNA, 19 nt, Homo sapiens
caagaaaguuauggagaug

SEQ ID NO: 747554 - RNA, 19 nt, Homo sapiens
gaauacacguucuugaaaa

SEQ ID NO: 747555 - RNA, 19 nt, Homo sapiens
gaauauaacagucucuaag

SEQ ID NO: 747556 - RNA, 19 nt, Homo sapiens
uggagaagcugaaagcaau

SEQ ID NO: 747557 - RNA, 19 nt, Homo sapiens
gacaggaaccacauacaaa

SEQ ID NO: 747558 - RNA, 19 nt, Homo sapiens
cgaagaacacacuaauaaa

SEQ ID NO: 747559 - RNA, 19 nt, Homo sapiens
ccucagauccugcaaaugu

SEQ ID NO: 747560 - RNA, 19 nt, Homo sapiens
agaaacugccuacuuaauu

SEQ ID NO: 747561 - RNA, 19 nt, Homo sapiens
ggcagcagcuagaggaaga

SEQ ID NO: 747562 - RNA, 19 nt, Homo sapiens
ggagaagagggauggauug

SEQ ID NO: 747563 - RNA, 19 nt, Homo sapiens
gaggagcaucagauaauuu

SEQ ID NO: 747564 - RNA, 19 nt, Homo sapiens
ggccuacgcacccuuuaua

SEQ ID NO: 747565 - RNA, 19 nt, Homo sapiens
caacagagugauacuuuag

SEQ ID NO: 747566 - RNA, 19 nt, Homo sapiens
uaaauucucaacagaguga

SEQ ID NO: 747567 - RNA, 19 nt, Homo sapiens
aaggcuagaucuuccaauu

SEQ ID NO: 747568 - RNA, 19 nt, Homo sapiens
caguggaggugaagcaaga

SEQ ID NO: 747569 - RNA, 19 nt, Homo sapiens
gagaagagggauggauuga

SEQ ID NO: 747570 - RNA, 19 nt, Homo sapiens
gggauaucauagcaguuaa

SEQ ID NO: 747571 - RNA, 19 nt, Homo sapiens
ggaggugaagcaagaagaa

SEQ ID NO: 747572 - RNA, 19 nt, Homo sapiens
guagaccgcccuccucgaa

SEQ ID NO: 747573 - RNA, 19 nt, Homo sapiens
aaagaggagcaucagauaa

SEQ ID NO: 747574 - RNA, 19 nt, Homo sapiens
gagugauacuuuagagcaa

SEQ ID NO: 747575 - RNA, 19 nt, Homo sapiens
ggcuagaucuuccaauuuu

SEQ ID NO: 747576 - RNA, 19 nt, Homo sapiens
ugaaagaggagcaucagau

SEQ ID NO: 747577 - RNA, 19 nt, Homo sapiens
ccaguucacuacagguaau

SEQ ID NO: 747578 - RNA, 19 nt, Homo sapiens
gagcaaagagaagaacaug

SEQ ID NO: 747579 - RNA, 19 nt, Homo sapiens
ucaccauccuguugcuauu

SEQ ID NO: 747580 - RNA, 19 nt, Homo sapiens
ugggauaucauagcaguua

SEQ ID NO: 747581 - RNA, 19 nt, Homo sapiens
agaggagcaucagauaauu

SEQ ID NO: 747582 - RNA, 19 nt, Homo sapiens
agaaugacaucgucuccau

SEQ ID NO: 747583 - RNA, 19 nt, Homo sapiens
gaaaggcuagaucuuccaa

SEQ ID NO: 747584 - RNA, 19 nt, Homo sapiens
caugaucuaccugaauaua

SEQ ID NO: 747585 - RNA, 19 nt, Homo sapiens
gaagccauaugugaaaauu

SEQ ID NO: 747586 - RNA, 19 nt, Homo sapiens
ugacaucgucuccaucuuc

SEQ ID NO: 747587 - RNA, 19 nt, Homo sapiens
ggagaugauuccccagauu

SEQ ID NO: 747588 - RNA, 19 nt, Homo sapiens
agaggaagagcuacuaaga

SEQ ID NO: 747589 - RNA, 19 nt, Homo sapiens
aaagaaggcagcagcuaga

SEQ ID NO: 747590 - RNA, 19 nt, Homo sapiens
agaaaguuauggagaugau

SEQ ID NO: 747591 - RNA, 19 nt, Homo sapiens
ucaaagaauaugccaaaca

SEQ ID NO: 747592 - RNA, 19 nt, Homo sapiens
ucagaaacugccuacuuaa

SEQ ID NO: 747593 - RNA, 19 nt, Homo sapiens
aagaggagcaucagauaau

SEQ ID NO: 747594 - RNA, 19 nt, Homo sapiens
cagaaacugccuacuuaau

SEQ ID NO: 747595 - RNA, 19 nt, Homo sapiens
cgaaaagcuugauuugcua

SEQ ID NO: 747596 - RNA, 19 nt, Homo sapiens
agacaggaaccacauacaa

SEQ ID NO: 747597 - RNA, 19 nt, Homo sapiens
caaccaagaaaguuaugga

SEQ ID NO: 747598 - RNA, 19 nt, Homo sapiens
gcuagaucuuccaauuuua

SEQ ID NO: 747599 - RNA, 19 nt, Homo sapiens
ggagaagcugaaagcaauu

SEQ ID NO: 747600 - RNA, 19 nt, Homo sapiens
caucgucuccaucuucuau

SEQ ID NO: 747601 - RNA, 19 nt, Homo sapiens
gauaugagaaugacaucgu

SEQ ID NO: 747602 - RNA, 19 nt, Homo sapiens
ugaucuaccugaauauaac

SEQ ID NO: 747603 - RNA, 19 nt, Homo sapiens
gacaucgucuccaucuucu

SEQ ID NO: 747604 - RNA, 19 nt, Homo sapiens
cgccuucacuuuccucugu

SEQ ID NO: 747605 - RNA, 19 nt, Homo sapiens
gaaaagaacaaugguagga

SEQ ID NO: 747606 - RNA, 19 nt, Homo sapiens
gaggaagagcuacuaagag

SEQ ID NO: 747607 - RNA, 19 nt, Homo sapiens
gaagaacaugaauuaguac

SEQ ID NO: 747608 - RNA, 19 nt, Homo sapiens
caaagagaagaacaugaau

SEQ ID NO: 747609 - RNA, 19 nt, Homo sapiens
gaaaguuauggagaugauu

SEQ ID NO: 747610 - RNA, 19 nt, Homo sapiens
aaauugaaguggagaagcu

SEQ ID NO: 747611 - RNA, 19 nt, Homo sapiens
gcuagaggaagagcuacua

SEQ ID NO: 747612 - RNA, 19 nt, Homo sapiens
gaaaagaaggcagcagcua

SEQ ID NO: 747613 - RNA, 19 nt, Homo sapiens
guaggaaaggcuagaucuu

SEQ ID NO: 747614 - RNA, 19 nt, Homo sapiens
ccaaacaggagcuauugca

SEQ ID NO: 747615 - RNA, 19 nt, Homo sapiens
aaacugccuacuuaauuug

SEQ ID NO: 747616 - RNA, 19 nt, Homo sapiens
gagaugauuccccagauuu

SEQ ID NO: 747617 - RNA, 19 nt, Homo sapiens
ccuacgcacccuuuauaaa

SEQ ID NO: 747618 - RNA, 19 nt, Homo sapiens
gaauauccugaaacagaau

SEQ ID NO: 747619 - RNA, 19 nt, Homo sapiens
uaguacauguuauggaaag

SEQ ID NO: 747620 - RNA, 19 nt, Homo sapiens
uaggaaaggcuagaucuuc

SEQ ID NO: 747621 - RNA, 19 nt, Homo sapiens
gaaaagcuugauuugcuaa

SEQ ID NO: 747622 - RNA, 19 nt, Homo sapiens
guggagaagcugaaagcaa

SEQ ID NO: 747623 - RNA, 19 nt, Homo sapiens
ugugaagccauaugugaaa

SEQ ID NO: 747624 - RNA, 19 nt, Homo sapiens
agaagaagacauuaaacca

SEQ ID NO: 747625 - RNA, 19 nt, Homo sapiens
caccauccuguugcuauua

SEQ ID NO: 747626 - RNA, 19 nt, Homo sapiens
agaccgcccuccucgaaca

SEQ ID NO: 747627 - RNA, 19 nt, Homo sapiens
uugggaauauccugaaaca

SEQ ID NO: 747628 - RNA, 19 nt, Homo sapiens
gaagaaauguaguguguga

SEQ ID NO: 747629 - RNA, 19 nt, Homo sapiens
gaucagaugucccuucaga

SEQ ID NO: 747630 - RNA, 19 nt, Homo sapiens
gaucuucacugcagaaugu

SEQ ID NO: 747631 - RNA, 19 nt, Homo sapiens
gcccagcucuuguuucuga

SEQ ID NO: 747632 - RNA, 19 nt, Homo sapiens
caacgucuugcuuuaauaa

SEQ ID NO: 747633 - RNA, 19 nt, Homo sapiens
guuaagucuugccaaauuu

SEQ ID NO: 747634 - RNA, 19 nt, Homo sapiens
guaaagguuucaacgucuu

SEQ ID NO: 747635 - RNA, 19 nt, Homo sapiens
uguagugugugacauguaa

SEQ ID NO: 747636 - RNA, 19 nt, Homo sapiens
ucagaugucccuucagaaa

SEQ ID NO: 747637 - RNA, 19 nt, Homo sapiens
ucaacgucuugcuuuaaua

SEQ ID NO: 747638 - RNA, 19 nt, Homo sapiens
uuucugagcuguuagacuu

SEQ ID NO: 747639 - RNA, 19 nt, Homo sapiens
gcuguuagacuucuucuuc

SEQ ID NO: 747640 - RNA, 19 nt, Homo sapiens
guuucaacgucuugcuuua

SEQ ID NO: 747641 - RNA, 19 nt, Homo sapiens
aguuaagucuugccaaauu

SEQ ID NO: 747642 - RNA, 19 nt, Homo sapiens
gaaguccaaaucacucauu

SEQ ID NO: 747643 - RNA, 19 nt, Homo sapiens
uugaagaaauguagugugu

SEQ ID NO: 747644 - RNA, 19 nt, Homo sapiens
gcagccaaguuaggaguga

SEQ ID NO: 747645 - RNA, 19 nt, Homo sapiens
cagaaacgaagccucauug

SEQ ID NO: 747646 - RNA, 19 nt, Homo sapiens
gagaugcacggaucagaug

SEQ ID NO: 747647 - RNA, 19 nt, Homo sapiens
guccaaaucacucauuguu

SEQ ID NO: 747648 - RNA, 19 nt, Homo sapiens
caaguuaggagugaagaga

SEQ ID NO: 747649 - RNA, 19 nt, Homo sapiens
cggaucagaugucccuuca

SEQ ID NO: 747650 - RNA, 19 nt, Homo sapiens
ucaaugacacccugaucuu

SEQ ID NO: 747651 - RNA, 19 nt, Homo sapiens
gguuuccacugucuuucaa

SEQ ID NO: 747652 - RNA, 19 nt, Homo sapiens
gcaaaacaagccaccauga

SEQ ID NO: 747653 - RNA, 19 nt, Homo sapiens
ucagaaacgaagccucauu

SEQ ID NO: 747654 - RNA, 19 nt, Homo sapiens
gguuucaacgucuugcuuu

SEQ ID NO: 747655 - RNA, 19 nt, Homo sapiens
guuagacuucuucuucauu

SEQ ID NO: 747656 - RNA, 19 nt, Homo sapiens
ccaggccaaugccgaguuc

SEQ ID NO: 747657 - RNA, 19 nt, Homo sapiens
gacuucuucuucauuagug

SEQ ID NO: 747658 - RNA, 19 nt, Homo sapiens
ucuuguuucugagcuguua

SEQ ID NO: 747659 - RNA, 19 nt, Homo sapiens
gaagccucauugcggaagu

SEQ ID NO: 747660 - RNA, 19 nt, Homo sapiens
caaaacaagccaccaugaa

SEQ ID NO: 747661 - RNA, 19 nt, Homo sapiens
caaugacacccugaucuuc

SEQ ID NO: 747662 - RNA, 19 nt, Homo sapiens
uaagucuugccaaauuuga

SEQ ID NO: 747663 - RNA, 19 nt, Homo sapiens
uucaacgucuugcuuuaau

SEQ ID NO: 747664 - RNA, 19 nt, Homo sapiens
cugcagaauguaaagguuu

SEQ ID NO: 747665 - RNA, 19 nt, Homo sapiens
agaaauguagugugugaca

SEQ ID NO: 747666 - RNA, 19 nt, Homo sapiens
cugcccagcucuuguuucu

SEQ ID NO: 747667 - RNA, 19 nt, Homo sapiens
uugcggaaguccuggugaa

SEQ ID NO: 747668 - RNA, 19 nt, Homo sapiens
guucugcccagcucuuguu

SEQ ID NO: 747669 - RNA, 19 nt, Homo sapiens
uaaagguuucaacgucuug

SEQ ID NO: 747670 - RNA, 19 nt, Homo sapiens
ugcagaauguaaagguuuc

SEQ ID NO: 747671 - RNA, 19 nt, Homo sapiens
aaugacacccugaucuuca

SEQ ID NO: 747672 - RNA, 19 nt, Homo sapiens
uccaaaucacucauuguuu

SEQ ID NO: 747673 - RNA, 19 nt, Homo sapiens
gaucuucacugcagaaugu

SEQ ID NO: 747674 - RNA, 19 nt, Homo sapiens
gagaaaagagugcuaauua

SEQ ID NO: 747675 - RNA, 19 nt, Homo sapiens
aaucacaggcuucuuauua

SEQ ID NO: 747676 - RNA, 19 nt, Homo sapiens
ugaaaucacaggcuucuua

SEQ ID NO: 747677 - RNA, 19 nt, Homo sapiens
gaaaugugaucgcugagau

SEQ ID NO: 747678 - RNA, 19 nt, Homo sapiens
gugaagaaaugcguggaua

SEQ ID NO: 747679 - RNA, 19 nt, Homo sapiens
gaaaaccuguguucaaguu

SEQ ID NO: 747680 - RNA, 19 nt, Homo sapiens
guuccaacuugccaaauuu

SEQ ID NO: 747681 - RNA, 19 nt, Homo sapiens
caacgucuugcucuaauaa

SEQ ID NO: 747682 - RNA, 19 nt, Homo sapiens
ugugaucgcugagauguaa

SEQ ID NO: 747683 - RNA, 19 nt, Homo sapiens
uggauacgauggccuauga

SEQ ID NO: 747684 - RNA, 19 nt, Homo sapiens
gaaaucacaggcuucuuau

SEQ ID NO: 747685 - RNA, 19 nt, Homo sapiens
guaaagguuucaacgucuu

SEQ ID NO: 747686 - RNA, 19 nt, Homo sapiens
cagccaagauggaagugaa

SEQ ID NO: 747687 - RNA, 19 nt, Homo sapiens
ccaccaucuuucaaugaua

SEQ ID NO: 747688 - RNA, 19 nt, Homo sapiens
ucaacgucuugcucuaaua

SEQ ID NO: 747689 - RNA, 19 nt, Homo sapiens
agauggaagugaagaaaug

SEQ ID NO: 747690 - RNA, 19 nt, Homo sapiens
gcucuugguucugaaauca

SEQ ID NO: 747691 - RNA, 19 nt, Homo sapiens
agaaaugcguggauacgau

SEQ ID NO: 747692 - RNA, 19 nt, Homo sapiens
caagauggaagugaagaaa

SEQ ID NO: 747693 - RNA, 19 nt, Homo sapiens
cgagcucacagcagaauaa

SEQ ID NO: 747694 - RNA, 19 nt, Homo sapiens
gaaaagagugcuaauuaca

SEQ ID NO: 747695 - RNA, 19 nt, Homo sapiens
uacgauggccuaugagaaa

SEQ ID NO: 747696 - RNA, 19 nt, Homo sapiens
gcagaauaagccaccauga

SEQ ID NO: 747697 - RNA, 19 nt, Homo sapiens
gcuaguuuccaccaucuuu

SEQ ID NO: 747698 - RNA, 19 nt, Homo sapiens
ucaaugauacccugaucuu

SEQ ID NO: 747699 - RNA, 19 nt, Homo sapiens
gauacgauggccuaugaga

SEQ ID NO: 747700 - RNA, 19 nt, Homo sapiens
aaugauacccugaucuuca

SEQ ID NO: 747701 - RNA, 19 nt, Homo sapiens
caacuugccaaauuuaagg

SEQ ID NO: 747702 - RNA, 19 nt, Homo sapiens
caccaucuuucaaugauac

SEQ ID NO: 747703 - RNA, 19 nt, Homo sapiens
aaauagcagagaaauguga

SEQ ID NO: 747704 - RNA, 19 nt, Homo sapiens
gaagaaaugcguggauacg

SEQ ID NO: 747705 - RNA, 19 nt, Homo sapiens
gucuugcucuaauaaauca

SEQ ID NO: 747706 - RNA, 19 nt, Homo sapiens
gguuaaagccgagcucaca

SEQ ID NO: 747707 - RNA, 19 nt, Homo sapiens
cagaauaagccaccaugag

SEQ ID NO: 747708 - RNA, 19 nt, Homo sapiens
ucacaggcuucuuauuagc

SEQ ID NO: 747709 - RNA, 19 nt, Homo sapiens
ccaagauggaagugaagaa

SEQ ID NO: 747710 - RNA, 19 nt, Homo sapiens
guuucaacgucuugcucua

SEQ ID NO: 747711 - RNA, 19 nt, Homo sapiens
uaaggcaccucuggaagcu

SEQ ID NO: 747712 - RNA, 19 nt, Homo sapiens
cugcagaauguaaagguuu

SEQ ID NO: 747713 - RNA, 19 nt, Homo sapiens
uaaagguuucaacgucuug

SEQ ID NO: 747714 - RNA, 19 nt, Homo sapiens
ugcagaauguaaagguuuc

SEQ ID NO: 747715 - RNA, 19 nt, Homo sapiens
ccaacuugccaaauuuaag

SEQ ID NO: 747716 - RNA, 19 nt, Homo sapiens
ggaguccguugaaggguaa

SEQ ID NO: 747717 - RNA, 19 nt, Homo sapiens
ccauggaucccucauagua

SEQ ID NO: 747718 - RNA, 19 nt, Homo sapiens
ggccauggaucccucauag

SEQ ID NO: 747719 - RNA, 19 nt, Homo sapiens
ccucauaguauccaaguuu

SEQ ID NO: 747720 - RNA, 19 nt, Homo sapiens
ccaccaucuuuaaaucaaa

SEQ ID NO: 747721 - RNA, 19 nt, Homo sapiens
aagcguauguguggccuuu

SEQ ID NO: 747722 - RNA, 19 nt, Homo sapiens
gaucuggaguccguugaag

SEQ ID NO: 747723 - RNA, 19 nt, Homo sapiens
gaaguuuucugugcuuaug

SEQ ID NO: 747724 - RNA, 19 nt, Homo sapiens
gccuuucucuucccuucuu

SEQ ID NO: 747725 - RNA, 19 nt, Homo sapiens
cccaccaucuuuaaaucaa

SEQ ID NO: 747726 - RNA, 19 nt, Homo sapiens
gcguauguguggccuuucu

SEQ ID NO: 747727 - RNA, 19 nt, Homo sapiens
ucucuucccuucuuuuauu

SEQ ID NO: 747728 - RNA, 19 nt, Homo sapiens
cauggaucccucauaguau

SEQ ID NO: 747729 - RNA, 19 nt, Homo sapiens
ggaucuggaguccguugaa

SEQ ID NO: 747730 - RNA, 19 nt, Homo sapiens
gaauugaacagcacuauuu

SEQ ID NO: 747731 - RNA, 19 nt, Homo sapiens
gaaaucaaguaguaucaga

SEQ ID NO: 747732 - RNA, 19 nt, Homo sapiens
gaacacaaccguauuucuu

SEQ ID NO: 747733 - RNA, 19 nt, Homo sapiens
ccacacaauugacaaauga

SEQ ID NO: 747734 - RNA, 19 nt, Homo sapiens
aaugaaagcuuacauggaa

SEQ ID NO: 747735 - RNA, 19 nt, Homo sapiens
ccaauaguccaauuuguua

SEQ ID NO: 747736 - RNA, 19 nt, Homo sapiens
gaauauaugucuccaucug

SEQ ID NO: 747737 - RNA, 19 nt, Homo sapiens
gaagucaaacguaagauga

SEQ ID NO: 747738 - RNA, 19 nt, Homo sapiens
gcagaaccuuggccugaaa

SEQ ID NO: 747739 - RNA, 19 nt, Homo sapiens
gccaagggccauucucuua

SEQ ID NO: 747740 - RNA, 19 nt, Homo sapiens
gauauuggugucagaauuu

SEQ ID NO: 747741 - RNA, 19 nt, Homo sapiens
ucaauaagcagccuacuga

SEQ ID NO: 747742 - RNA, 19 nt, Homo sapiens
gaacuugacgcacugguau

SEQ ID NO: 747743 - RNA, 19 nt, Homo sapiens
gggcuaggcucguuaacug

SEQ ID NO: 747744 - RNA, 19 nt, Homo sapiens
ggaauuagucaacaauaug

SEQ ID NO: 747745 - RNA, 19 nt, Homo sapiens
gaaaggggagcaaauuuua

SEQ ID NO: 747746 - RNA, 19 nt, Homo sapiens
ucucaggagucuuaacuuu

SEQ ID NO: 747747 - RNA, 19 nt, Homo sapiens
guaaaggcaggcugucaua

SEQ ID NO: 747748 - RNA, 19 nt, Homo sapiens
cugcagagcuguaucuuca

SEQ ID NO: 747749 - RNA, 19 nt, Homo sapiens
gggcaaaugcagaauauau

SEQ ID NO: 747750 - RNA, 19 nt, Homo sapiens
ugugggaaaucaaguagua

SEQ ID NO: 747751 - RNA, 19 nt, Homo sapiens
gaacagcacuauuuugaag

SEQ ID NO: 747752 - RNA, 19 nt, Homo sapiens
gcaaaugcagaauauaugu

SEQ ID NO: 747753 - RNA, 19 nt, Homo sapiens
caaaugaugaacuuucuga

SEQ ID NO: 747754 - RNA, 19 nt, Homo sapiens
gaaagcuuacauggaauua

SEQ ID NO: 747755 - RNA, 19 nt, Homo sapiens
guuagucucaggagucuua

SEQ ID NO: 747756 - RNA, 19 nt, Homo sapiens
gacaaaugaugaacuuucu

SEQ ID NO: 747757 - RNA, 19 nt, Homo sapiens
gcagagcuguaucuucagu

SEQ ID NO: 747758 - RNA, 19 nt, Homo sapiens
caucuauacaccauucuua

SEQ ID NO: 747759 - RNA, 19 nt, Homo sapiens
gaucacucaugcuagguau

SEQ ID NO: 747760 - RNA, 19 nt, Homo sapiens
aaacguaagaugaaagcua

SEQ ID NO: 747761 - RNA, 19 nt, Homo sapiens
ggaagucaaacguaagaug

SEQ ID NO: 747762 - RNA, 19 nt, Homo sapiens
gugaugggcuggaggaagu

SEQ ID NO: 747763 - RNA, 19 nt, Homo sapiens
uagggcaaaugcagaauau

SEQ ID NO: 747764 - RNA, 19 nt, Homo sapiens
agauauuggugucagaauu

SEQ ID NO: 747765 - RNA, 19 nt, Homo sapiens
caagggccauucucuuagu

SEQ ID NO: 747766 - RNA, 19 nt, Homo sapiens
guagggcaaaugcagaaua

SEQ ID NO: 747767 - RNA, 19 nt, Homo sapiens
guuguauucuguaucuuga

SEQ ID NO: 747768 - RNA, 19 nt, Homo sapiens
caaccuccuugcuuucugu

SEQ ID NO: 747769 - RNA, 19 nt, Homo sapiens
uaagcagccuacugaacuu

SEQ ID NO: 747770 - RNA, 19 nt, Homo sapiens
uaucuucaguggugugaug

SEQ ID NO: 747771 - RNA, 19 nt, Homo sapiens
ugacaaaugaugaacuuuc

SEQ ID NO: 747772 - RNA, 19 nt, Homo sapiens
ggccaucuauacaccauuc

SEQ ID NO: 747773 - RNA, 19 nt, Homo sapiens
gucaagcucucucucaaag

SEQ ID NO: 747774 - RNA, 19 nt, Homo sapiens
aagcuuacauggaauuagu

SEQ ID NO: 747775 - RNA, 19 nt, Homo sapiens
ggcaggcugucauagaguu

SEQ ID NO: 747776 - RNA, 19 nt, Homo sapiens
caagcucucucucaaagac

SEQ ID NO: 747777 - RNA, 19 nt, Homo sapiens
aacguaagaugaaagcuau

SEQ ID NO: 747778 - RNA, 19 nt, Homo sapiens
acacaaccguauuucuuca

SEQ ID NO: 747779 - RNA, 19 nt, Homo sapiens
gacaaugcagcuucucuug

SEQ ID NO: 747780 - RNA, 19 nt, Homo sapiens
agugggaagucaaacguaa

SEQ ID NO: 747781 - RNA, 19 nt, Homo sapiens
guagaccagugcugucaag

SEQ ID NO: 747782 - RNA, 19 nt, Homo sapiens
ucugauauguuguauucug

SEQ ID NO: 747783 - RNA, 19 nt, Homo sapiens
gcaggcugucauagaguua

SEQ ID NO: 747784 - RNA, 19 nt, Homo sapiens
ggcaaaugcagaauauaug

SEQ ID NO: 747785 - RNA, 19 nt, Homo sapiens
agucaaacguaagaugaaa

SEQ ID NO: 747786 - RNA, 19 nt, Homo sapiens
ugaaagcuuacauggaauu

SEQ ID NO: 747787 - RNA, 19 nt, Homo sapiens
gguccaauaguccaauuug

SEQ ID NO: 747788 - RNA, 19 nt, Homo sapiens
gagcaaauuuuacuuucug

SEQ ID NO: 747789 - RNA, 19 nt, Homo sapiens
gucuccaucugguaaagua

SEQ ID NO: 747790 - RNA, 19 nt, Homo sapiens
ucaggagucuuaacuuuug

SEQ ID NO: 747791 - RNA, 19 nt, Homo sapiens
aaaggcaggcugucauaga

SEQ ID NO: 747792 - RNA, 19 nt, Homo sapiens
gagaauugaacagcacuau

SEQ ID NO: 747793 - RNA, 19 nt, Homo sapiens
gaauuagucaacaauaugc

SEQ ID NO: 747794 - RNA, 19 nt, Homo sapiens
ggaacacaaccguauuucu

SEQ ID NO: 747795 - RNA, 19 nt, Homo sapiens
uaagaugaaagcuauugga

SEQ ID NO: 747796 - RNA, 19 nt, Homo sapiens
agaaaugaaagcuuacaug

SEQ ID NO: 747797 - RNA, 19 nt, Homo sapiens
gggaaaucaaguaguauca

SEQ ID NO: 747798 - RNA, 19 nt, Homo sapiens
cuagguauggaucuccuua

SEQ ID NO: 747799 - RNA, 19 nt, Homo sapiens
guccaauaguccaauuugu

SEQ ID NO: 747800 - RNA, 19 nt, Homo sapiens
cacaauugacaaaugauga

SEQ ID NO: 747801 - RNA, 19 nt, Homo sapiens
auguguaacuugccuauca

SEQ ID NO: 747802 - RNA, 19 nt, Homo sapiens
ggagaauugaacagcacua

SEQ ID NO: 747803 - RNA, 19 nt, Homo sapiens
ugaacuugacgcacuggua

SEQ ID NO: 747804 - RNA, 19 nt, Homo sapiens
acaaccguauuucuucaau

SEQ ID NO: 747805 - RNA, 19 nt, Homo sapiens
ucaaagacugggaacacaa

SEQ ID NO: 747806 - RNA, 19 nt, Homo sapiens
uccaauaguccaauuuguu

SEQ ID NO: 747807 - RNA, 19 nt, Homo sapiens
gccuucgucucccagauug

SEQ ID NO: 747808 - RNA, 19 nt, Homo sapiens
acaccauucuuaccacaca

SEQ ID NO: 747809 - RNA, 19 nt, Homo sapiens
aaaugaaagcuuacaugga

SEQ ID NO: 747810 - RNA, 19 nt, Homo sapiens
cagccgacaugucucuagu

SEQ ID NO: 747811 - RNA, 19 nt, Homo sapiens
gguaaaggcaggcugucau

SEQ ID NO: 747812 - RNA, 19 nt, Homo sapiens
ugaaaggggagcaaauuuu

SEQ ID NO: 747813 - RNA, 19 nt, Homo sapiens
ugggaacacaaccguauuu

SEQ ID NO: 747814 - RNA, 19 nt, Homo sapiens
cuuggccucugaaucauau

SEQ ID NO: 747815 - RNA, 19 nt, Homo sapiens
ugacaaugcagcuucucuu

SEQ ID NO: 747816 - RNA, 19 nt, Homo sapiens
gcagaaaugaaagcuuaca

SEQ ID NO: 747817 - RNA, 19 nt, Homo sapiens
ccaagggccauucucuuag

SEQ ID NO: 747818 - RNA, 19 nt, Homo sapiens
gcuauuggauggggaaaga

SEQ ID NO: 747819 - RNA, 19 nt, Homo sapiens
acauggaauuagucaacaa

SEQ ID NO: 747820 - RNA, 19 nt, Homo sapiens
gggccauucucuuagugau

SEQ ID NO: 747821 - RNA, 19 nt, Homo sapiens
ucaugugggaaaucaagua

SEQ ID NO: 747822 - RNA, 19 nt, Homo sapiens
aaugaugaacuuucugaga

SEQ ID NO: 747823 - RNA, 19 nt, Homo sapiens
acugguauuuggccaucua

SEQ ID NO: 747824 - RNA, 19 nt, Homo sapiens
caauaagcagccuacugaa

SEQ ID NO: 747825 - RNA, 19 nt, Homo sapiens
uguguaacuugccuaucaa

SEQ ID NO: 747826 - RNA, 19 nt, Homo sapiens
auucuuaccacacaauuga

SEQ ID NO: 747827 - RNA, 19 nt, Homo sapiens
cguaagaugaaagcuauug

SEQ ID NO: 747828 - RNA, 19 nt, Homo sapiens
aaggcaggcugucauagag

SEQ ID NO: 747829 - RNA, 19 nt, Homo sapiens
agaauugaacagcacuauu

SEQ ID NO: 747830 - RNA, 19 nt, Homo sapiens
ggauaaaguugucuugaaa

SEQ ID NO: 747831 - RNA, 19 nt, Homo sapiens
caacuugccuugaacauca

SEQ ID NO: 747832 - RNA, 19 nt, Homo sapiens
ggagugagcccaccacaga

SEQ ID NO: 747833 - RNA, 19 nt, Homo sapiens
cacuagagcuucugucaaa

SEQ ID NO: 747834 - RNA, 19 nt, Homo sapiens
uaacuucccuguguucuau

SEQ ID NO: 747835 - RNA, 19 nt, Homo sapiens
gaaaggcacuagagcuucu

SEQ ID NO: 747836 - RNA, 19 nt, Homo sapiens
gaacugagcccaggaaagg

SEQ ID NO: 747837 - RNA, 19 nt, Homo sapiens
gcucaaagccgcauacgau

SEQ ID NO: 747838 - RNA, 19 nt, Homo sapiens
gugagaagcuagaugacuu

SEQ ID NO: 747839 - RNA, 19 nt, Homo sapiens
gaucuuugguauaucuuug

SEQ ID NO: 747840 - RNA, 19 nt, Homo sapiens
gauccagcguucaggaauu

SEQ ID NO: 747841 - RNA, 19 nt, Homo sapiens
gaacaucacgaucaaagca

SEQ ID NO: 747842 - RNA, 19 nt, Homo sapiens
gaagguacuagaugaauuc

SEQ ID NO: 747843 - RNA, 19 nt, Homo sapiens
cgaacuagaugagaccaaa

SEQ ID NO: 747844 - RNA, 19 nt, Homo sapiens
gaaaauggagguaugaauu

SEQ ID NO: 747845 - RNA, 19 nt, Homo sapiens
gaugcuaccucucccuuuc

SEQ ID NO: 747846 - RNA, 19 nt, Homo sapiens
caaguagacuaggaacuga

SEQ ID NO: 747847 - RNA, 19 nt, Homo sapiens
gcucuaagacugccuugaa

SEQ ID NO: 747848 - RNA, 19 nt, Homo sapiens
gaggugagaagcuagauga

SEQ ID NO: 747849 - RNA, 19 nt, Homo sapiens
aagcugaucccaugacuaa

SEQ ID NO: 747850 - RNA, 19 nt, Homo sapiens
gcggagccaugaagcugua

SEQ ID NO: 747851 - RNA, 19 nt, Homo sapiens
gguauaucuuuggaucuua

SEQ ID NO: 747852 - RNA, 19 nt, Homo sapiens
uggagaagguacuagauga

SEQ ID NO: 747853 - RNA, 19 nt, Homo sapiens
uggauaaaguugucuugaa

SEQ ID NO: 747854 - RNA, 19 nt, Homo sapiens
gcaaguagacuaggaacug

SEQ ID NO: 747855 - RNA, 19 nt, Homo sapiens
caaaugaaaccauaaacuc

SEQ ID NO: 747856 - RNA, 19 nt, Homo sapiens
gguggcgaauguucaaauu

SEQ ID NO: 747857 - RNA, 19 nt, Homo sapiens
caccauggagucucuguua

SEQ ID NO: 747858 - RNA, 19 nt, Homo sapiens
guggaaggguggcgaaugu

SEQ ID NO: 747859 - RNA, 19 nt, Homo sapiens
gucuaaagccuucuauaaa

SEQ ID NO: 747860 - RNA, 19 nt, Homo sapiens
caagcaagucgacaggaua

SEQ ID NO: 747861 - RNA, 19 nt, Homo sapiens
gcgccugucuggauaaagu

SEQ ID NO: 747862 - RNA, 19 nt, Homo sapiens
gcaaaugaaaccauaaacu

SEQ ID NO: 747863 - RNA, 19 nt, Homo sapiens
caaauucauauguguggua

SEQ ID NO: 747864 - RNA, 19 nt, Homo sapiens
agaagguacuagaugaauu

SEQ ID NO: 747865 - RNA, 19 nt, Homo sapiens
ggagaagguacuagaugaa

SEQ ID NO: 747866 - RNA, 19 nt, Homo sapiens
guggagcgcucaucgaaag

SEQ ID NO: 747867 - RNA, 19 nt, Homo sapiens
gggcaaaugaaaccauaaa

SEQ ID NO: 747868 - RNA, 19 nt, Homo sapiens
agucuaaagccuucuauaa

SEQ ID NO: 747869 - RNA, 19 nt, Homo sapiens
guuguguucuguuguaaau

SEQ ID NO: 747870 - RNA, 19 nt, Homo sapiens
gagaggcgccugucuggau

SEQ ID NO: 747871 - RNA, 19 nt, Homo sapiens
ccuguuguguucuguugua

SEQ ID NO: 747872 - RNA, 19 nt, Homo sapiens
ugaagagccuguccauguc

SEQ ID NO: 747873 - RNA, 19 nt, Homo sapiens
ccaagcaagucgacaggau

SEQ ID NO: 747874 - RNA, 19 nt, Homo sapiens
ucaaagaacaagacuaucu

SEQ ID NO: 747875 - RNA, 19 nt, Homo sapiens
ggacacuugccuugacuug

SEQ ID NO: 747876 - RNA, 19 nt, Homo sapiens
cauacgaugugucuuccuu

SEQ ID NO: 747877 - RNA, 19 nt, Homo sapiens
ugucaaagaacaagacuau

SEQ ID NO: 747878 - RNA, 19 nt, Homo sapiens
agaggcgccugucuggaua

SEQ ID NO: 747879 - RNA, 19 nt, Homo sapiens
cuaugcaucugaacaagug

SEQ ID NO: 747880 - RNA, 19 nt, Homo sapiens
gcuguggucucucaaaauu

SEQ ID NO: 747881 - RNA, 19 nt, Homo sapiens
ccgacuggcuucuguagau

SEQ ID NO: 747882 - RNA, 19 nt, Homo sapiens
gaaguuccugcgagaaaug

SEQ ID NO: 747883 - RNA, 19 nt, Homo sapiens
gauggucaccucaguagau

SEQ ID NO: 747884 - RNA, 19 nt, Homo sapiens
cugaagagccuguccaugu

SEQ ID NO: 747885 - RNA, 19 nt, Homo sapiens
auucugagacuguuguuua

SEQ ID NO: 747886 - RNA, 19 nt, Homo sapiens
uaaagugcaggccgaacua

SEQ ID NO: 747887 - RNA, 19 nt, Homo sapiens
gaagagccuguccauguca

SEQ ID NO: 747888 - RNA, 19 nt, Homo sapiens
ccacuguccugaccagagu

SEQ ID NO: 747889 - RNA, 19 nt, Homo sapiens
ugccuugacuugcaacuug

SEQ ID NO: 747890 - RNA, 19 nt, Homo sapiens
acacuugccuugacuugca

SEQ ID NO: 747891 - RNA, 19 nt, Homo sapiens
gagacuguuguuuagcuua

SEQ ID NO: 747892 - RNA, 19 nt, Homo sapiens
caccaucauucacaucaga

SEQ ID NO: 747893 - RNA, 19 nt, Homo sapiens
gcacuagagcuucugucaa

SEQ ID NO: 747894 - RNA, 19 nt, Homo sapiens
ggucggagccagcuguuuc

SEQ ID NO: 747895 - RNA, 19 nt, Homo sapiens
gaaggguggcgaauguuca

SEQ ID NO: 747896 - RNA, 19 nt, Homo sapiens
ggaaggguggcgaauguuc

SEQ ID NO: 747897 - RNA, 19 nt, Homo sapiens
uagaugaauucuccaagca

SEQ ID NO: 747898 - RNA, 19 nt, Homo sapiens
gagaagguacuagaugaau

SEQ ID NO: 747899 - RNA, 19 nt, Homo sapiens
caaagaacaagacuaucug

SEQ ID NO: 747900 - RNA, 19 nt, Homo sapiens
uguguucuguuguaaauca

SEQ ID NO: 747901 - RNA, 19 nt, Homo sapiens
gguagugauucuuggaaag

SEQ ID NO: 747902 - RNA, 19 nt, Homo sapiens
gaagcugaucccaugacua

SEQ ID NO: 747903 - RNA, 19 nt, Homo sapiens
gcgagacuguauuuuagua

SEQ ID NO: 747904 - RNA, 19 nt, Homo sapiens
caaagccgcauacgaugug

SEQ ID NO: 747905 - RNA, 19 nt, Homo sapiens
gguaagaggaagugagauc

SEQ ID NO: 747906 - RNA, 19 nt, Homo sapiens
gagaugggccuaaaauguu

SEQ ID NO: 747907 - RNA, 19 nt, Homo sapiens
ggagaugggccuaaaaugu

SEQ ID NO: 747908 - RNA, 19 nt, Homo sapiens
cuucacgagucaacugauu

SEQ ID NO: 747909 - RNA, 19 nt, Homo sapiens
aagaagagacagccauaga

SEQ ID NO: 747910 - RNA, 19 nt, Homo sapiens
ccaagguggugcugcucaa

SEQ ID NO: 747911 - RNA, 19 nt, Homo sapiens
aguaacugcugccuaacuu

SEQ ID NO: 747912 - RNA, 19 nt, Homo sapiens
uuaccuuucugcuaggauu

SEQ ID NO: 747913 - RNA, 19 nt, Homo sapiens
ugaaguuccugcgagaaau

SEQ ID NO: 747914 - RNA, 19 nt, Homo sapiens
cugccuaacuucccugugu

SEQ ID NO: 747915 - RNA, 19 nt, Homo sapiens
gagccuguccaugucauuu

SEQ ID NO: 747916 - RNA, 19 nt, Homo sapiens
gcacaacaccauggagucu

SEQ ID NO: 747917 - RNA, 19 nt, Homo sapiens
gcugaucccaugacuaaag

SEQ ID NO: 747918 - RNA, 19 nt, Homo sapiens
caggugcuguggucucuca

SEQ ID NO: 747919 - RNA, 19 nt, Homo sapiens
ccucagcguccucuacaaa

SEQ ID NO: 747920 - RNA, 19 nt, Homo sapiens
agagcgaggugagaagcua

SEQ ID NO: 747921 - RNA, 19 nt, Homo sapiens
gagauccagcguucaggaa

SEQ ID NO: 747922 - RNA, 19 nt, Homo sapiens
cgacuggcuucuguagaug

SEQ ID NO: 747923 - RNA, 19 nt, Homo sapiens
cuauaaaacugcccggaaa

SEQ ID NO: 747924 - RNA, 19 nt, Homo sapiens
ccuauggucuugccagcau

SEQ ID NO: 747925 - RNA, 19 nt, Homo sapiens
guucguaccagcaaguaga

SEQ ID NO: 747926 - RNA, 19 nt, Homo sapiens
gcagggcccauccuaagca

SEQ ID NO: 747927 - RNA, 19 nt, Homo sapiens
cuuuggaucuuauuuguac

SEQ ID NO: 747928 - RNA, 19 nt, Homo sapiens
ugguauaucuuuggaucuu

SEQ ID NO: 747929 - RNA, 19 nt, Homo sapiens
uugggcaaaugaaaccaua

SEQ ID NO: 747930 - RNA, 19 nt, Homo sapiens
gaagaccacuccagcgaua

SEQ ID NO: 747931 - RNA, 19 nt, Homo sapiens
gaauaaauuuccagcaugu

SEQ ID NO: 747932 - RNA, 19 nt, Homo sapiens
gcaauaacuucaucuaugg

SEQ ID NO: 747933 - RNA, 19 nt, Homo sapiens
gcgauauguucaacuauga

SEQ ID NO: 747934 - RNA, 19 nt, Homo sapiens
ccagcgauauguucaacua

SEQ ID NO: 747935 - RNA, 19 nt, Homo sapiens
auaauuaccugaccaagga

SEQ ID NO: 747936 - RNA, 19 nt, Homo sapiens
gcucaaagguggugguucu

SEQ ID NO: 747937 - RNA, 19 nt, Homo sapiens
gggauugacucggauuuga

SEQ ID NO: 747938 - RNA, 19 nt, Homo sapiens
gagacuaugugugagcuuu

SEQ ID NO: 747939 - RNA, 19 nt, Homo sapiens
ggauuugagugaucauuag

SEQ ID NO: 747940 - RNA, 19 nt, Homo sapiens
gacggaaacagcaauaauu

SEQ ID NO: 747941 - RNA, 19 nt, Homo sapiens
gaaggcaggauucugaaga

SEQ ID NO: 747942 - RNA, 19 nt, Homo sapiens
gaauuccauugccuccuuu

SEQ ID NO: 747943 - RNA, 19 nt, Homo sapiens
ugcaauaacuucaucuaug

SEQ ID NO: 747944 - RNA, 19 nt, Homo sapiens
gcagggauggguuugcuuu

SEQ ID NO: 747945 - RNA, 19 nt, Homo sapiens
aggagcagcuggugaagaa

SEQ ID NO: 747946 - RNA, 19 nt, Homo sapiens
acggaaacagcaauaauua

SEQ ID NO: 747947 - RNA, 19 nt, Homo sapiens
uuuccucgcugaucgauuu

SEQ ID NO: 747948 - RNA, 19 nt, Homo sapiens
ugaauuccauugccuccuu

SEQ ID NO: 747949 - RNA, 19 nt, Homo sapiens
ggauggguuugcuuuggaa

SEQ ID NO: 747950 - RNA, 19 nt, Homo sapiens
ggaaucguuucuuuuguuu

SEQ ID NO: 747951 - RNA, 19 nt, Homo sapiens
gggauggguuugcuuugga

SEQ ID NO: 747952 - RNA, 19 nt, Homo sapiens
gcaauaauuaccugaccaa

SEQ ID NO: 747953 - RNA, 19 nt, Homo sapiens
gaacuccugcaauaacuuc

SEQ ID NO: 747954 - RNA, 19 nt, Homo sapiens
gcugagggccguugagugu

SEQ ID NO: 747955 - RNA, 19 nt, Homo sapiens
aggagugccucaagaaaug

SEQ ID NO: 747956 - RNA, 19 nt, Homo sapiens
ggauuccucugucccaagu

SEQ ID NO: 747957 - RNA, 19 nt, Homo sapiens
ccugccagcuguuugugua

SEQ ID NO: 747958 - RNA, 19 nt, Homo sapiens
cggauuugagugaucauua

SEQ ID NO: 747959 - RNA, 19 nt, Homo sapiens
guagaguuuucuuugcuua

SEQ ID NO: 747960 - RNA, 19 nt, Homo sapiens
cauuagggcugaggucugu

SEQ ID NO: 747961 - RNA, 19 nt, Homo sapiens
acaaggagcagcuggugaa

SEQ ID NO: 747962 - RNA, 19 nt, Homo sapiens
ggugguacaaugucacuga

SEQ ID NO: 747963 - RNA, 19 nt, Homo sapiens
ggaaacagcaauaauuacc

SEQ ID NO: 747964 - RNA, 19 nt, Homo sapiens
gaacgcgaggcgcuccauu

SEQ ID NO: 747965 - RNA, 19 nt, Homo sapiens
gcugaucgauuucuuuccu

SEQ ID NO: 747966 - RNA, 19 nt, Homo sapiens
ccuagguggugguacaaug

SEQ ID NO: 747967 - RNA, 19 nt, Homo sapiens
gggcugaggucuguuucuc

SEQ ID NO: 747968 - RNA, 19 nt, Homo sapiens
gagcagcuggugaagaaca

SEQ ID NO: 747969 - RNA, 19 nt, Homo sapiens
ugacggaaacagcaauaau

SEQ ID NO: 747970 - RNA, 19 nt, Homo sapiens
uuaaauagagggauugacu

SEQ ID NO: 747971 - RNA, 19 nt, Homo sapiens
gaggggagacuauguguga

SEQ ID NO: 747972 - RNA, 19 nt, Homo sapiens
ggaacuccugcaauaacuu

SEQ ID NO: 747973 - RNA, 19 nt, Homo sapiens
gauccugccagcuguuugu

SEQ ID NO: 747974 - RNA, 19 nt, Homo sapiens
auaaauuuccagcauguug

SEQ ID NO: 747975 - RNA, 19 nt, Homo sapiens
gagggauugacucggauuu

SEQ ID NO: 747976 - RNA, 19 nt, Homo sapiens
ggagguaggacggcugcuu

SEQ ID NO: 747977 - RNA, 19 nt, Homo sapiens
agcgauauguucaacuaug

SEQ ID NO: 747978 - RNA, 19 nt, Homo sapiens
gaaacagcaauaauuaccu

SEQ ID NO: 747979 - RNA, 19 nt, Homo sapiens
ccacuccagcgauauguuc

SEQ ID NO: 747980 - RNA, 19 nt, Homo sapiens
ucaagaaaugugccacugu

SEQ ID NO: 747981 - RNA, 19 nt, Homo sapiens
ggccuuccccuuuagaaua

SEQ ID NO: 747982 - RNA, 19 nt, Homo sapiens
gucuggagcuccggagaug

SEQ ID NO: 747983 - RNA, 19 nt, Homo sapiens
uggagaaccugauagaauu

SEQ ID NO: 747984 - RNA, 19 nt, Homo sapiens
gggcuggacuguucuaagu

SEQ ID NO: 747985 - RNA, 19 nt, Homo sapiens
cgagaaccauggaguugaa

SEQ ID NO: 747986 - RNA, 19 nt, Homo sapiens
gcuggacuguucuaaguga

SEQ ID NO: 747987 - RNA, 19 nt, Homo sapiens
gcaguuggagaaccugaua

SEQ ID NO: 747988 - RNA, 19 nt, Homo sapiens
ggagaaccugauagaauuu

SEQ ID NO: 747989 - RNA, 19 nt, Homo sapiens
ccaucuggcuggugaguga

SEQ ID NO: 747990 - RNA, 19 nt, Homo sapiens
gagcagacuuggagcugau

SEQ ID NO: 747991 - RNA, 19 nt, Homo sapiens
gagaaccugauagaauuua

SEQ ID NO: 747992 - RNA, 19 nt, Homo sapiens
ggacuguucuaagugaguu

SEQ ID NO: 747993 - RNA, 19 nt, Homo sapiens
gcgaaacccugccauaucc

SEQ ID NO: 747994 - RNA, 19 nt, Homo sapiens
gguggacgaugcugaguca

SEQ ID NO: 747995 - RNA, 19 nt, Homo sapiens
uuuauccgcuccagacuuu

SEQ ID NO: 747996 - RNA, 19 nt, Homo sapiens
gcgcgauuguuccuuguug

SEQ ID NO: 747997 - RNA, 19 nt, Homo sapiens
ccaguguggauacuaauaa

SEQ ID NO: 747998 - RNA, 19 nt, Homo sapiens
gcagacgguccgcguugua

SEQ ID NO: 747999 - RNA, 19 nt, Homo sapiens
caguguggauacuaauaaa

SEQ ID NO: 748000 - RNA, 19 nt, Homo sapiens
ggaaauccgggaaggacuu

SEQ ID NO: 748001 - RNA, 19 nt, Homo sapiens
ugucuuggcugugcuugaa

SEQ ID NO: 748002 - RNA, 19 nt, Homo sapiens
aauguggccuggacaacuu

SEQ ID NO: 748003 - RNA, 19 nt, Homo sapiens
ccauaucuguuuggacaug

SEQ ID NO: 748004 - RNA, 19 nt, Homo sapiens
ggcaaaggagggugucuug

SEQ ID NO: 748005 - RNA, 19 nt, Homo sapiens
acuuggagcugaugucugu

SEQ ID NO: 748006 - RNA, 19 nt, Homo sapiens
ggagcacacucucaaaaca

SEQ ID NO: 748007 - RNA, 19 nt, Homo sapiens
ggcgaaacccugccauauc

SEQ ID NO: 748008 - RNA, 19 nt, Homo sapiens
uggaggagcaguuggagaa

SEQ ID NO: 748009 - RNA, 19 nt, Homo sapiens
gauacuaauaaaccucuug

SEQ ID NO: 748010 - RNA, 19 nt, Homo sapiens
caucgagaaccauggaguu

SEQ ID NO: 748011 - RNA, 19 nt, Homo sapiens
gaauguggccuggacaacu

SEQ ID NO: 748012 - RNA, 19 nt, Homo sapiens
ggauacuaauaaaccucuu

SEQ ID NO: 748013 - RNA, 19 nt, Homo sapiens
uuggagaaccugauagaau

SEQ ID NO: 748014 - RNA, 19 nt, Homo sapiens
ggucaucgagaaccaugga

SEQ ID NO: 748015 - RNA, 19 nt, Homo sapiens
ggacaccagcaccuacaag

SEQ ID NO: 748016 - RNA, 19 nt, Homo sapiens
gcucucugguccacucaag

SEQ ID NO: 748017 - RNA, 19 nt, Homo sapiens
cauaucuguuuggacauga

SEQ ID NO: 748018 - RNA, 19 nt, Homo sapiens
gaaccauggaguugaacag

SEQ ID NO: 748019 - RNA, 19 nt, Homo sapiens
ucaggagcauggcuugaac

SEQ ID NO: 748020 - RNA, 19 nt, Homo sapiens
aggcugcucugugaaggaa

SEQ ID NO: 748021 - RNA, 19 nt, Homo sapiens
gcaaacaaauccauaacaa

SEQ ID NO: 748022 - RNA, 19 nt, Homo sapiens
gaagagccuuugcugauaa

SEQ ID NO: 748023 - RNA, 19 nt, Homo sapiens
gacaucagcucuagguaua

SEQ ID NO: 748024 - RNA, 19 nt, Homo sapiens
gcaaggacuucuguaauuu

SEQ ID NO: 748025 - RNA, 19 nt, Homo sapiens
ggagagagaauauaaagaa

SEQ ID NO: 748026 - RNA, 19 nt, Homo sapiens
gaauuucucucccauuguu

SEQ ID NO: 748027 - RNA, 19 nt, Homo sapiens
gaacaaaacucucggugaa

SEQ ID NO: 748028 - RNA, 19 nt, Homo sapiens
uaacgaagaucagcaaaga

SEQ ID NO: 748029 - RNA, 19 nt, Homo sapiens
gcaaacacuuacugacaaa

SEQ ID NO: 748030 - RNA, 19 nt, Homo sapiens
gcuguuaccuucuggguuu

SEQ ID NO: 748031 - RNA, 19 nt, Homo sapiens
gugaaaggcugcuuaaaca

SEQ ID NO: 748032 - RNA, 19 nt, Homo sapiens
gagauggaacuguaaauaa

SEQ ID NO: 748033 - RNA, 19 nt, Homo sapiens
caaaucggguccugaguug

SEQ ID NO: 748034 - RNA, 19 nt, Homo sapiens
cacagagaguguuuaguua

SEQ ID NO: 748035 - RNA, 19 nt, Homo sapiens
ugacuacaauuccuacaaa

SEQ ID NO: 748036 - RNA, 19 nt, Homo sapiens
gaaaggcugcuuaaacaga

SEQ ID NO: 748037 - RNA, 19 nt, Homo sapiens
aaccagaaguacacauuua

SEQ ID NO: 748038 - RNA, 19 nt, Homo sapiens
gggaauauggaacuaauuu

SEQ ID NO: 748039 - RNA, 19 nt, Homo sapiens
ucaagcugcugcucuguuu

SEQ ID NO: 748040 - RNA, 19 nt, Homo sapiens
gagagaauauaaagaaagg

SEQ ID NO: 748041 - RNA, 19 nt, Homo sapiens
agaagagccuuugcugaua

SEQ ID NO: 748042 - RNA, 19 nt, Homo sapiens
gcaagcaaacaaauccaua

SEQ ID NO: 748043 - RNA, 19 nt, Homo sapiens
ggacgaagacgcggaagaa

SEQ ID NO: 748044 - RNA, 19 nt, Homo sapiens
gcaacaagaacaagaacaa

SEQ ID NO: 748045 - RNA, 19 nt, Homo sapiens
gaaguucuccuuggauuau

SEQ ID NO: 748046 - RNA, 19 nt, Homo sapiens
ucuguugagucuauucuua

SEQ ID NO: 748047 - RNA, 19 nt, Homo sapiens
gaagcaagcaagcaaacaa

SEQ ID NO: 748048 - RNA, 19 nt, Homo sapiens
gaaagggagauguuggaaa

SEQ ID NO: 748049 - RNA, 19 nt, Homo sapiens
caagcaaggacuucuguaa

SEQ ID NO: 748050 - RNA, 19 nt, Homo sapiens
gaacaagaacaacaacaag

SEQ ID NO: 748051 - RNA, 19 nt, Homo sapiens
gauaaauagucuugucucu

SEQ ID NO: 748052 - RNA, 19 nt, Homo sapiens
gauaaagaguuggagaaca

SEQ ID NO: 748053 - RNA, 19 nt, Homo sapiens
gaaguugcaguauggauau

SEQ ID NO: 748054 - RNA, 19 nt, Homo sapiens
agaagaaguugcaguaugg

SEQ ID NO: 748055 - RNA, 19 nt, Homo sapiens
cggaauuucucucccauug

SEQ ID NO: 748056 - RNA, 19 nt, Homo sapiens
agcaaggacuucuguaauu

SEQ ID NO: 748057 - RNA, 19 nt, Homo sapiens
caagcaaacaaauccauaa

SEQ ID NO: 748058 - RNA, 19 nt, Homo sapiens
uaaaguaugucuguugaag

SEQ ID NO: 748059 - RNA, 19 nt, Homo sapiens
caauaaaguaugucuguug

SEQ ID NO: 748060 - RNA, 19 nt, Homo sapiens
acaagaagaaguugcagua

SEQ ID NO: 748061 - RNA, 19 nt, Homo sapiens
caaacaaguuggaacaaaa

SEQ ID NO: 748062 - RNA, 19 nt, Homo sapiens
aagaagaaguugcaguaug

SEQ ID NO: 748063 - RNA, 19 nt, Homo sapiens
caacaagcaacaagaacaa

SEQ ID NO: 748064 - RNA, 19 nt, Homo sapiens
ggauuauucuacagcuauu

SEQ ID NO: 748065 - RNA, 19 nt, Homo sapiens
gagaguguuuaguuaagga

SEQ ID NO: 748066 - RNA, 19 nt, Homo sapiens
aaaggcugcuuaaacagaa

SEQ ID NO: 748067 - RNA, 19 nt, Homo sapiens
ccgggaaacagaauaauuu

SEQ ID NO: 748068 - RNA, 19 nt, Homo sapiens
aaagggagauguuggaaac

SEQ ID NO: 748069 - RNA, 19 nt, Homo sapiens
auaaagaguuggagaacau

SEQ ID NO: 748070 - RNA, 19 nt, Homo sapiens
cugcugaucuguagugguu

SEQ ID NO: 748071 - RNA, 19 nt, Homo sapiens
ugagauggaacuguaaaua

SEQ ID NO: 748072 - RNA, 19 nt, Homo sapiens
ccacaacaagcaacaagaa

SEQ ID NO: 748073 - RNA, 19 nt, Homo sapiens
caaccagaaguacacauuu

SEQ ID NO: 748074 - RNA, 19 nt, Homo sapiens
ggacugcgaggacgacgaa

SEQ ID NO: 748075 - RNA, 19 nt, Homo sapiens
gcacaacuuauagacagua

SEQ ID NO: 748076 - RNA, 19 nt, Homo sapiens
gauuuaaccaugcaguauu

SEQ ID NO: 748077 - RNA, 19 nt, Homo sapiens
gauguuaaucucuuucaug

SEQ ID NO: 748078 - RNA, 19 nt, Homo sapiens
gcaagcaagcaaacaaauc

SEQ ID NO: 748079 - RNA, 19 nt, Homo sapiens
gggccugggaagaauauua

SEQ ID NO: 748080 - RNA, 19 nt, Homo sapiens
uuaaggacaaccagaagua

SEQ ID NO: 748081 - RNA, 19 nt, Homo sapiens
cuucuggguuuccacauuu

SEQ ID NO: 748082 - RNA, 19 nt, Homo sapiens
acagagaguguuuaguuaa

SEQ ID NO: 748083 - RNA, 19 nt, Homo sapiens
gcccaccugccuugauuua

SEQ ID NO: 748084 - RNA, 19 nt, Homo sapiens
uaaacagaaagcuggauuu

SEQ ID NO: 748085 - RNA, 19 nt, Homo sapiens
cagagaguguuuaguuaag

SEQ ID NO: 748086 - RNA, 19 nt, Homo sapiens
gggagauguuggaaacuuc

SEQ ID NO: 748087 - RNA, 19 nt, Homo sapiens
acaagaacaacaacaagaa

SEQ ID NO: 748088 - RNA, 19 nt, Homo sapiens
caagcaacaagaacaagaa

SEQ ID NO: 748089 - RNA, 19 nt, Homo sapiens
cauaaugaaccaucuuuag

SEQ ID NO: 748090 - RNA, 19 nt, Homo sapiens
cagcaaacacuuacugaca

SEQ ID NO: 748091 - RNA, 19 nt, Homo sapiens
agaaguugcaguauggaua

SEQ ID NO: 748092 - RNA, 19 nt, Homo sapiens
gaacaacaacaagaagaag

SEQ ID NO: 748093 - RNA, 19 nt, Homo sapiens
ggccugggaagaauauuaa

SEQ ID NO: 748094 - RNA, 19 nt, Homo sapiens
acgaagaucagcaaagaaa

SEQ ID NO: 748095 - RNA, 19 nt, Homo sapiens
ccaccugccuugauuuaac

SEQ ID NO: 748096 - RNA, 19 nt, Homo sapiens
gccuggaccugacuacaau

SEQ ID NO: 748097 - RNA, 19 nt, Homo sapiens
guuggaaacuucucaagcu

SEQ ID NO: 748098 - RNA, 19 nt, Homo sapiens
aaagugacaucagcucuag

SEQ ID NO: 748099 - RNA, 19 nt, Homo sapiens
uaaagaaagggagauguug

SEQ ID NO: 748100 - RNA, 19 nt, Homo sapiens
ugacaucagcucuagguau

SEQ ID NO: 748101 - RNA, 19 nt, Homo sapiens
gugcagagcaggacaugau

SEQ ID NO: 748102 - RNA, 19 nt, Homo sapiens
ggaauauggaacuaauuuc

SEQ ID NO: 748103 - RNA, 19 nt, Homo sapiens
aagaagagccuuugcugau

SEQ ID NO: 748104 - RNA, 19 nt, Homo sapiens
gcgaggacgacgaagauga

SEQ ID NO: 748105 - RNA, 19 nt, Homo sapiens
acauuaugcuggagagaga

SEQ ID NO: 748106 - RNA, 19 nt, Homo sapiens
aaauaucagugagauggaa

SEQ ID NO: 748107 - RNA, 19 nt, Homo sapiens
caaaccuaaucuggacuuu

SEQ ID NO: 748108 - RNA, 19 nt, Homo sapiens
cauaauccauuccacucau

SEQ ID NO: 748109 - RNA, 19 nt, Homo sapiens
ccucugccacuuagacaua

SEQ ID NO: 748110 - RNA, 19 nt, Homo sapiens
gcaguauggauaucuuuca

SEQ ID NO: 748111 - RNA, 19 nt, Homo sapiens
uaacaaccacaacaagcaa

SEQ ID NO: 748112 - RNA, 19 nt, Homo sapiens
ccuaauaugcauguacuuu

SEQ ID NO: 748113 - RNA, 19 nt, Homo sapiens
ccacuuagacauaauccau

SEQ ID NO: 748114 - RNA, 19 nt, Homo sapiens
aaagaguuggagaacauua

SEQ ID NO: 748115 - RNA, 19 nt, Homo sapiens
ucuuucaugugcaaucuuu

SEQ ID NO: 748116 - RNA, 19 nt, Homo sapiens
ucagugaaaggcugcuuaa

SEQ ID NO: 748117 - RNA, 19 nt, Homo sapiens
cagaaguacacauuuacaa

SEQ ID NO: 748118 - RNA, 19 nt, Homo sapiens
gaagagaccccuaagaaac

SEQ ID NO: 748119 - RNA, 19 nt, Homo sapiens
agcaaacacuuacugacaa

SEQ ID NO: 748120 - RNA, 19 nt, Homo sapiens
gcucaagggcaugucuuaa

SEQ ID NO: 748121 - RNA, 19 nt, Homo sapiens
gaaauguucuguaguguua

SEQ ID NO: 748122 - RNA, 19 nt, Homo sapiens
gcaauucucugaagcguuu

SEQ ID NO: 748123 - RNA, 19 nt, Homo sapiens
ggacagaaaguguuaauuc

SEQ ID NO: 748124 - RNA, 19 nt, Homo sapiens
ugucugauguugugaaaua

SEQ ID NO: 748125 - RNA, 19 nt, Homo sapiens
uaacauaagccucaccuuu

SEQ ID NO: 748126 - RNA, 19 nt, Homo sapiens
gagaauaugacuaugauga

SEQ ID NO: 748127 - RNA, 19 nt, Homo sapiens
ggacaugcuuuggaagaaa

SEQ ID NO: 748128 - RNA, 19 nt, Homo sapiens
gaauaugacuaugaugaug

SEQ ID NO: 748129 - RNA, 19 nt, Homo sapiens
gaugggacaugcuuuggaa

SEQ ID NO: 748130 - RNA, 19 nt, Homo sapiens
caaagggcgucuacagaga

SEQ ID NO: 748131 - RNA, 19 nt, Homo sapiens
gaagaagaguugaggaaaa

SEQ ID NO: 748132 - RNA, 19 nt, Homo sapiens
acaagagacuuauggagaa

SEQ ID NO: 748133 - RNA, 19 nt, Homo sapiens
uaagcaaagucuccucuug

SEQ ID NO: 748134 - RNA, 19 nt, Homo sapiens
gauauggcacugcuuauga

SEQ ID NO: 748135 - RNA, 19 nt, Homo sapiens
ugacuaugaugauggauau

SEQ ID NO: 748136 - RNA, 19 nt, Homo sapiens
ccucaucccugauuauaau

SEQ ID NO: 748137 - RNA, 19 nt, Homo sapiens
cugaauggauggaacuuaa

SEQ ID NO: 748138 - RNA, 19 nt, Homo sapiens
ucgauguggugauuaauaa

SEQ ID NO: 748139 - RNA, 19 nt, Homo sapiens
ccaauuacaagugcaaaua

SEQ ID NO: 748140 - RNA, 19 nt, Homo sapiens
guacuuccaucucaaugau

SEQ ID NO: 748141 - RNA, 19 nt, Homo sapiens
caagaagaguggacuaacu

SEQ ID NO: 748142 - RNA, 19 nt, Homo sapiens
ggaagaagaguugaggaaa

SEQ ID NO: 748143 - RNA, 19 nt, Homo sapiens
aaacccaccuugcguacaa

SEQ ID NO: 748144 - RNA, 19 nt, Homo sapiens
ccaaaguggugcugauuac

SEQ ID NO: 748145 - RNA, 19 nt, Homo sapiens
uaaaacaguucccuaaguu

SEQ ID NO: 748146 - RNA, 19 nt, Homo sapiens
ucagugaggagacuuauga

SEQ ID NO: 748147 - RNA, 19 nt, Homo sapiens
uccaggaguuaacauauuu

SEQ ID NO: 748148 - RNA, 19 nt, Homo sapiens
gagacaaggccaaggaaga

SEQ ID NO: 748149 - RNA, 19 nt, Homo sapiens
gugcugauuacuaugauua

SEQ ID NO: 748150 - RNA, 19 nt, Homo sapiens
gaugaacagaguuaugauu

SEQ ID NO: 748151 - RNA, 19 nt, Homo sapiens
caaugaugaucuccauguu

SEQ ID NO: 748152 - RNA, 19 nt, Homo sapiens
aagaagaaaccuugacaaa

SEQ ID NO: 748153 - RNA, 19 nt, Homo sapiens
agucuccucuugcuugaua

SEQ ID NO: 748154 - RNA, 19 nt, Homo sapiens
gaacagaguuaugauuccu

SEQ ID NO: 748155 - RNA, 19 nt, Homo sapiens
acauaagccucaccuuuca

SEQ ID NO: 748156 - RNA, 19 nt, Homo sapiens
gugaggagacuuaugauuc

SEQ ID NO: 748157 - RNA, 19 nt, Homo sapiens
gacaugcuuuggaagaaau

SEQ ID NO: 748158 - RNA, 19 nt, Homo sapiens
gggacaugcuuuggaagaa

SEQ ID NO: 748159 - RNA, 19 nt, Homo sapiens
ucugaagcguuuacaagaa

SEQ ID NO: 748160 - RNA, 19 nt, Homo sapiens
cuugaaauguucuguagug

SEQ ID NO: 748161 - RNA, 19 nt, Homo sapiens
caagagacuuauggagaau

SEQ ID NO: 748162 - RNA, 19 nt, Homo sapiens
ccacguggcaauucucuga

SEQ ID NO: 748163 - RNA, 19 nt, Homo sapiens
cuacagagaccagccauau

SEQ ID NO: 748164 - RNA, 19 nt, Homo sapiens
gagaaggcaaggaugaaga

SEQ ID NO: 748165 - RNA, 19 nt, Homo sapiens
acaugaagcugggacagaa

SEQ ID NO: 748166 - RNA, 19 nt, Homo sapiens
gcugggacagaaaguguua

SEQ ID NO: 748167 - RNA, 19 nt, Homo sapiens
gauguggugauuaauaaga

SEQ ID NO: 748168 - RNA, 19 nt, Homo sapiens
gacagaaaguguuaauucc

SEQ ID NO: 748169 - RNA, 19 nt, Homo sapiens
aaagggaagccaauuacaa

SEQ ID NO: 748170 - RNA, 19 nt, Homo sapiens
ggauggaacuuaaaacuac

SEQ ID NO: 748171 - RNA, 19 nt, Homo sapiens
aaaguggugcugauuacua

SEQ ID NO: 748172 - RNA, 19 nt, Homo sapiens
agaguuaugauuccuauga

SEQ ID NO: 748173 - RNA, 19 nt, Homo sapiens
uggcacugcuuaugaugaa

SEQ ID NO: 748174 - RNA, 19 nt, Homo sapiens
guaaaacaguucccuaagu

SEQ ID NO: 748175 - RNA, 19 nt, Homo sapiens
uggagaauaugacuaugau

SEQ ID NO: 748176 - RNA, 19 nt, Homo sapiens
agacuuauggagaauauga

SEQ ID NO: 748177 - RNA, 19 nt, Homo sapiens
agagacuuauggagaauau

SEQ ID NO: 748178 - RNA, 19 nt, Homo sapiens
uuacggacauggacucagu

SEQ ID NO: 748179 - RNA, 19 nt, Homo sapiens
gaguuaugauuccuaugau

SEQ ID NO: 748180 - RNA, 19 nt, Homo sapiens
ggugaaccaagaaauagaa

SEQ ID NO: 748181 - RNA, 19 nt, Homo sapiens
ggauauggcacugcuuaug

SEQ ID NO: 748182 - RNA, 19 nt, Homo sapiens
uggacuaacucaagacaca

SEQ ID NO: 748183 - RNA, 19 nt, Homo sapiens
acagaguuaugauuccuau

SEQ ID NO: 748184 - RNA, 19 nt, Homo sapiens
aaacaguucccuaaguuca

SEQ ID NO: 748185 - RNA, 19 nt, Homo sapiens
aaagucuccucuugcuuga

SEQ ID NO: 748186 - RNA, 19 nt, Homo sapiens
gauacugauuguacugucu

SEQ ID NO: 748187 - RNA, 19 nt, Homo sapiens
gaauggugguucagaaaau

SEQ ID NO: 748188 - RNA, 19 nt, Homo sapiens
gcaaggaugaagaaaagua

SEQ ID NO: 748189 - RNA, 19 nt, Homo sapiens
ggccaaggaagaagaguug

SEQ ID NO: 748190 - RNA, 19 nt, Homo sapiens
ccucuugcuugauacuaaa

SEQ ID NO: 748191 - RNA, 19 nt, Homo sapiens
agacaaggccaaggaagaa

SEQ ID NO: 748192 - RNA, 19 nt, Homo sapiens
guugugaaauagccaaucu

SEQ ID NO: 748193 - RNA, 19 nt, Homo sapiens
ucaaugaugaucuccaugu

SEQ ID NO: 748194 - RNA, 19 nt, Homo sapiens
gggaagccaauuacaagug

SEQ ID NO: 748195 - RNA, 19 nt, Homo sapiens
ugauuguacugucugaugu

SEQ ID NO: 748196 - RNA, 19 nt, Homo sapiens
ggcaagaagaguggacuaa

SEQ ID NO: 748197 - RNA, 19 nt, Homo sapiens
cccaaaguggugcugauua

SEQ ID NO: 748198 - RNA, 19 nt, Homo sapiens
uaugauaacagcuauagca

SEQ ID NO: 748199 - RNA, 19 nt, Homo sapiens
cgacacaagagacuuaugg

SEQ ID NO: 748200 - RNA, 19 nt, Homo sapiens
ugaucuccauguucucauu

SEQ ID NO: 748201 - RNA, 19 nt, Homo sapiens
guuauuuccagucuguaua

SEQ ID NO: 748202 - RNA, 19 nt, Homo sapiens
uauggcagauacugauugu

SEQ ID NO: 748203 - RNA, 19 nt, Homo sapiens
aaguggugcugauuacuau

SEQ ID NO: 748204 - RNA, 19 nt, Homo sapiens
cuuaugaugaacagaguua

SEQ ID NO: 748205 - RNA, 19 nt, Homo sapiens
guggagaagcgaaguacuu

SEQ ID NO: 748206 - RNA, 19 nt, Homo sapiens
gagagacaaggccaaggaa

SEQ ID NO: 748207 - RNA, 19 nt, Homo sapiens
ugaaauguucuguaguguu

SEQ ID NO: 748208 - RNA, 19 nt, Homo sapiens
gcagauacugauuguacug

SEQ ID NO: 748209 - RNA, 19 nt, Homo sapiens
gaugaucuccauguucuca

SEQ ID NO: 748210 - RNA, 19 nt, Homo sapiens
guucuguaguguuaagcaa

SEQ ID NO: 748211 - RNA, 19 nt, Homo sapiens
cggcgagcauggaggagaa

SEQ ID NO: 748212 - RNA, 19 nt, Homo sapiens
aacauaagccucaccuuuc

SEQ ID NO: 748213 - RNA, 19 nt, Homo sapiens
uuuccagucuguauaugaa

SEQ ID NO: 748214 - RNA, 19 nt, Homo sapiens
acagagaccagccauaugg

SEQ ID NO: 748215 - RNA, 19 nt, Homo sapiens
gaaggcaaggaugaagaaa

SEQ ID NO: 748216 - RNA, 19 nt, Homo sapiens
ugaggagacuuaugauucc

SEQ ID NO: 748217 - RNA, 19 nt, Homo sapiens
gcacugcuuaugaugaaca

SEQ ID NO: 748218 - RNA, 19 nt, Homo sapiens
gccaguuggaguuguagua

SEQ ID NO: 748219 - RNA, 19 nt, Homo sapiens
ugagagacaaggccaagga

SEQ ID NO: 748220 - RNA, 19 nt, Homo sapiens
ugaauggauggaacuuaaa

SEQ ID NO: 748221 - RNA, 19 nt, Homo sapiens
gaaagauccucaugaauua

SEQ ID NO: 748222 - RNA, 19 nt, Homo sapiens
gcaaaguuguuacugauuu

SEQ ID NO: 748223 - RNA, 19 nt, Homo sapiens
gcuuaaagguucugaagua

SEQ ID NO: 748224 - RNA, 19 nt, Homo sapiens
guaaaggcuuguuaaguuu

SEQ ID NO: 748225 - RNA, 19 nt, Homo sapiens
gggaaggccuccugaauug

SEQ ID NO: 748226 - RNA, 19 nt, Homo sapiens
gcaaagaucucuguauugg

SEQ ID NO: 748227 - RNA, 19 nt, Homo sapiens
ugaaagauccucaugaauu

SEQ ID NO: 748228 - RNA, 19 nt, Homo sapiens
gugcaaagaucucuguauu

SEQ ID NO: 748229 - RNA, 19 nt, Homo sapiens
guguaagucugccuaaaua

SEQ ID NO: 748230 - RNA, 19 nt, Homo sapiens
ggaagagacuggugcaaag

SEQ ID NO: 748231 - RNA, 19 nt, Homo sapiens
aguaaaggcuuguuaaguu

SEQ ID NO: 748232 - RNA, 19 nt, Homo sapiens
gagcaaaguuguuacugau

SEQ ID NO: 748233 - RNA, 19 nt, Homo sapiens
ugacauugcuugcuuaaag

SEQ ID NO: 748234 - RNA, 19 nt, Homo sapiens
cauaagaacaugaaacuga

SEQ ID NO: 748235 - RNA, 19 nt, Homo sapiens
ucucaacacuagcaugaua

SEQ ID NO: 748236 - RNA, 19 nt, Homo sapiens
gcacauggcgguugaaucu

SEQ ID NO: 748237 - RNA, 19 nt, Homo sapiens
aaacuaggcuacauuucaa

SEQ ID NO: 748238 - RNA, 19 nt, Homo sapiens
acauggcgguugaaucuua

SEQ ID NO: 748239 - RNA, 19 nt, Homo sapiens
uaaagguucugaaguaaag

SEQ ID NO: 748240 - RNA, 19 nt, Homo sapiens
cuaaauagguagcuuaaac

SEQ ID NO: 748241 - RNA, 19 nt, Homo sapiens
ucagggcuguuuaagauuu

SEQ ID NO: 748242 - RNA, 19 nt, Homo sapiens
cauacuguguugagagaua

SEQ ID NO: 748243 - RNA, 19 nt, Homo sapiens
uggaggaagucaagaaauu

SEQ ID NO: 748244 - RNA, 19 nt, Homo sapiens
caaacuaggcuacauuuca

SEQ ID NO: 748245 - RNA, 19 nt, Homo sapiens
ccaaauaugcccacuugaa

SEQ ID NO: 748246 - RNA, 19 nt, Homo sapiens
ggagaauuacuuggauuua

SEQ ID NO: 748247 - RNA, 19 nt, Homo sapiens
gaggagaauuacuuggauu

SEQ ID NO: 748248 - RNA, 19 nt, Homo sapiens
gcacccauauggacguuau

SEQ ID NO: 748249 - RNA, 19 nt, Homo sapiens
gcagcaguuugucaauaaa

SEQ ID NO: 748250 - RNA, 19 nt, Homo sapiens
gacauacuguguugagaga

SEQ ID NO: 748251 - RNA, 19 nt, Homo sapiens
ccaccuuauuccauucuua

SEQ ID NO: 748252 - RNA, 19 nt, Homo sapiens
ugagcaaaguuguuacuga

SEQ ID NO: 748253 - RNA, 19 nt, Homo sapiens
ggaggaagucaagaaauuu

SEQ ID NO: 748254 - RNA, 19 nt, Homo sapiens
caaauaugcccacuugaau

SEQ ID NO: 748255 - RNA, 19 nt, Homo sapiens
cggcagaaauugagaagau

SEQ ID NO: 748256 - RNA, 19 nt, Homo sapiens
aaacagaaguguaccuuuu

SEQ ID NO: 748257 - RNA, 19 nt, Homo sapiens
ccacaacagacaaguaauu

SEQ ID NO: 748258 - RNA, 19 nt, Homo sapiens
uaugauggaugauaucugu

SEQ ID NO: 748259 - RNA, 19 nt, Homo sapiens
gaaagagcgagugcugaua

SEQ ID NO: 748260 - RNA, 19 nt, Homo sapiens
ccaaguuagucaaguaugu

SEQ ID NO: 748261 - RNA, 19 nt, Homo sapiens
gcuucuguauguaguauuu

SEQ ID NO: 748262 - RNA, 19 nt, Homo sapiens
guuaugagcaaaguuguua

SEQ ID NO: 748263 - RNA, 19 nt, Homo sapiens
gaauauggaucugcauguc

SEQ ID NO: 748264 - RNA, 19 nt, Homo sapiens
gucaauauaucgaacuguu

SEQ ID NO: 748265 - RNA, 19 nt, Homo sapiens
ggaucugcaugucuucauu

SEQ ID NO: 748266 - RNA, 19 nt, Homo sapiens
gagcucagacgucucuaaa

SEQ ID NO: 748267 - RNA, 19 nt, Homo sapiens
ccauauggacguuauuaaa

SEQ ID NO: 748268 - RNA, 19 nt, Homo sapiens
gaaauugagaagauucaga

SEQ ID NO: 748269 - RNA, 19 nt, Homo sapiens
caaaguuguuacugauuuc

SEQ ID NO: 748270 - RNA, 19 nt, Homo sapiens
gggaaaauaucaguuauga

SEQ ID NO: 748271 - RNA, 19 nt, Homo sapiens
gagcuguccuacuugaaug

SEQ ID NO: 748272 - RNA, 19 nt, Homo sapiens
uaccggauaugauggauga

SEQ ID NO: 748273 - RNA, 19 nt, Homo sapiens
gaaguaaaggcuuguuaag

SEQ ID NO: 748274 - RNA, 19 nt, Homo sapiens
aaauaugcccacuugaaua

SEQ ID NO: 748275 - RNA, 19 nt, Homo sapiens
acaagggaauacaaucaaa

SEQ ID NO: 748276 - RNA, 19 nt, Homo sapiens
gauuaaaugcuacaugugu

SEQ ID NO: 748277 - RNA, 19 nt, Homo sapiens
gaagauuaaaugcuacaug

SEQ ID NO: 748278 - RNA, 19 nt, Homo sapiens
gaaucuuucagucauagua

SEQ ID NO: 748279 - RNA, 19 nt, Homo sapiens
gcgguugaaucuuaagguu

SEQ ID NO: 748280 - RNA, 19 nt, Homo sapiens
ugaaguaaaggcuuguuaa

SEQ ID NO: 748281 - RNA, 19 nt, Homo sapiens
ugcagcaguuugucaauaa

SEQ ID NO: 748282 - RNA, 19 nt, Homo sapiens
ccagaaacauaugaagaau

SEQ ID NO: 748283 - RNA, 19 nt, Homo sapiens
ucaaguaugucucaacacu

SEQ ID NO: 748284 - RNA, 19 nt, Homo sapiens
gcaguaggcaccaccaugu

SEQ ID NO: 748285 - RNA, 19 nt, Homo sapiens
cuagagcuguccuacuuga

SEQ ID NO: 748286 - RNA, 19 nt, Homo sapiens
gaagagacuggugcaaaga

SEQ ID NO: 748287 - RNA, 19 nt, Homo sapiens
caagcaguaucccaaguuc

SEQ ID NO: 748288 - RNA, 19 nt, Homo sapiens
cagggcuguuuaagauuua

SEQ ID NO: 748289 - RNA, 19 nt, Homo sapiens
auucagggcuguuuaagau

SEQ ID NO: 748290 - RNA, 19 nt, Homo sapiens
cuuaaagguucugaaguaa

SEQ ID NO: 748291 - RNA, 19 nt, Homo sapiens
uuaaguguguagaugcuuu

SEQ ID NO: 748292 - RNA, 19 nt, Homo sapiens
cauucuggcuucuguaugu

SEQ ID NO: 748293 - RNA, 19 nt, Homo sapiens
aggaugaugaggagaauua

SEQ ID NO: 748294 - RNA, 19 nt, Homo sapiens
ccacaagggaauacaauca

SEQ ID NO: 748295 - RNA, 19 nt, Homo sapiens
ugauaccugucaagcagua

SEQ ID NO: 748296 - RNA, 19 nt, Homo sapiens
acaaguaccugcccgaacu

SEQ ID NO: 748297 - RNA, 19 nt, Homo sapiens
ggcagaaauugagaagauu

SEQ ID NO: 748298 - RNA, 19 nt, Homo sapiens
ucaaaagacugcaggaaga

SEQ ID NO: 748299 - RNA, 19 nt, Homo sapiens
guuaaaguccuaauuggau

SEQ ID NO: 748300 - RNA, 19 nt, Homo sapiens
gauuugaggcaucccguaa

SEQ ID NO: 748301 - RNA, 19 nt, Homo sapiens
gaacaugaaacugaaagag

SEQ ID NO: 748302 - RNA, 19 nt, Homo sapiens
gcagaaauugagaagauuc

SEQ ID NO: 748303 - RNA, 19 nt, Homo sapiens
gagauucugcacuccauga

SEQ ID NO: 748304 - RNA, 19 nt, Homo sapiens
ugaggcaucccguaaaguu

SEQ ID NO: 748305 - RNA, 19 nt, Homo sapiens
acagagagcacccauaugg

SEQ ID NO: 748306 - RNA, 19 nt, Homo sapiens
gaggaagucaagaaauuuc

SEQ ID NO: 748307 - RNA, 19 nt, Homo sapiens
agacaaagccaaggaggaa

SEQ ID NO: 748308 - RNA, 19 nt, Homo sapiens
cucggaagauuaaaugcua

SEQ ID NO: 748309 - RNA, 19 nt, Homo sapiens
ccuccugaauugaguuuga

SEQ ID NO: 748310 - RNA, 19 nt, Homo sapiens
cauggcgguugaaucuuaa

SEQ ID NO: 748311 - RNA, 19 nt, Homo sapiens
auacagagagcacccauau

SEQ ID NO: 748312 - RNA, 19 nt, Homo sapiens
gcaguuugucaauaaaguu

SEQ ID NO: 748313 - RNA, 19 nt, Homo sapiens
ucaacacuagcaugauaua

SEQ ID NO: 748314 - RNA, 19 nt, Homo sapiens
aaguaugucucaacacuag

SEQ ID NO: 748315 - RNA, 19 nt, Homo sapiens
ugaggagaauuacuuggau

SEQ ID NO: 748316 - RNA, 19 nt, Homo sapiens
guugcagaaucccaaacua

SEQ ID NO: 748317 - RNA, 19 nt, Homo sapiens
ucuuguaucucccaggauu

SEQ ID NO: 748318 - RNA, 19 nt, Homo sapiens
caacacuagcaugauauaa

SEQ ID NO: 748319 - RNA, 19 nt, Homo sapiens
uaaacagaaguguaccuuu

SEQ ID NO: 748320 - RNA, 19 nt, Homo sapiens
caaguaauugucuaagugu

SEQ ID NO: 748321 - RNA, 19 nt, Homo sapiens
gcaaugcaguuacagaauu

SEQ ID NO: 748322 - RNA, 19 nt, Homo sapiens
gaagaacaaugcaguggaa

SEQ ID NO: 748323 - RNA, 19 nt, Homo sapiens
gagccgagguugugcauuu

SEQ ID NO: 748324 - RNA, 19 nt, Homo sapiens
gagccaaccuguucaucua

SEQ ID NO: 748325 - RNA, 19 nt, Homo sapiens
gaugaaaccugcugacagu

SEQ ID NO: 748326 - RNA, 19 nt, Homo sapiens
ccguaaagcugcauuagaa

SEQ ID NO: 748327 - RNA, 19 nt, Homo sapiens
ccaaaucccugucucuuca

SEQ ID NO: 748328 - RNA, 19 nt, Homo sapiens
gcaguggccuuuccaaugg

SEQ ID NO: 748329 - RNA, 19 nt, Homo sapiens
caaugcaguuacagaauuu

SEQ ID NO: 748330 - RNA, 19 nt, Homo sapiens
gaauuuggcugcacuagcu

SEQ ID NO: 748331 - RNA, 19 nt, Homo sapiens
ucaaguacaucguccaaau

SEQ ID NO: 748332 - RNA, 19 nt, Homo sapiens
aggaauggcugcuuuaaau

SEQ ID NO: 748333 - RNA, 19 nt, Homo sapiens
gcacauaccgcgugguguu

SEQ ID NO: 748334 - RNA, 19 nt, Homo sapiens
ccaaugcucucacuacauc

SEQ ID NO: 748335 - RNA, 19 nt, Homo sapiens
ggacaaagaacagaagaga

SEQ ID NO: 748336 - RNA, 19 nt, Homo sapiens
cagcuucucugaugcuuga

SEQ ID NO: 748337 - RNA, 19 nt, Homo sapiens
agacaaaccugagcaagug

SEQ ID NO: 748338 - RNA, 19 nt, Homo sapiens
gugagagggucuucugauu

SEQ ID NO: 748339 - RNA, 19 nt, Homo sapiens
aaaccuugcuggucuaaau

SEQ ID NO: 748340 - RNA, 19 nt, Homo sapiens
gcucaaacguucgaagaau

SEQ ID NO: 748341 - RNA, 19 nt, Homo sapiens
aaccagaucuugaugcuau

SEQ ID NO: 748342 - RNA, 19 nt, Homo sapiens
ggaagcuguuuauugguau

SEQ ID NO: 748343 - RNA, 19 nt, Homo sapiens
gaccuuguguugaccuuug

SEQ ID NO: 748344 - RNA, 19 nt, Homo sapiens
gagcaaguguuuugguuuu

SEQ ID NO: 748345 - RNA, 19 nt, Homo sapiens
gcucagaacacaccaagug

SEQ ID NO: 748346 - RNA, 19 nt, Homo sapiens
gaagaaugccggauauugc

SEQ ID NO: 748347 - RNA, 19 nt, Homo sapiens
aaagggugcuguuuuguua

SEQ ID NO: 748348 - RNA, 19 nt, Homo sapiens
gguaugauuuccaagaagu

SEQ ID NO: 748349 - RNA, 19 nt, Homo sapiens
aggaagcuguuuauuggua

SEQ ID NO: 748350 - RNA, 19 nt, Homo sapiens
ggggaaauauuuaaacuug

SEQ ID NO: 748351 - RNA, 19 nt, Homo sapiens
acaaagaacagaagagaau

SEQ ID NO: 748352 - RNA, 19 nt, Homo sapiens
uccaagaagugcacugaaa

SEQ ID NO: 748353 - RNA, 19 nt, Homo sapiens
agaaugcucuucacaacau

SEQ ID NO: 748354 - RNA, 19 nt, Homo sapiens
cuugaacucucaccuuuga

SEQ ID NO: 748355 - RNA, 19 nt, Homo sapiens
gcagauguuuaugcccuuu

SEQ ID NO: 748356 - RNA, 19 nt, Homo sapiens
gauugaagaaugccggaua

SEQ ID NO: 748357 - RNA, 19 nt, Homo sapiens
acacacagccaguccguuu

SEQ ID NO: 748358 - RNA, 19 nt, Homo sapiens
gggaaaccuugcuggucua

SEQ ID NO: 748359 - RNA, 19 nt, Homo sapiens
gauaaccacuugauuuugu

SEQ ID NO: 748360 - RNA, 19 nt, Homo sapiens
gcaaaucagcgcagcaucu

SEQ ID NO: 748361 - RNA, 19 nt, Homo sapiens
cuucagagcagcccuacua

SEQ ID NO: 748362 - RNA, 19 nt, Homo sapiens
ggaauggcugcuuuaaaug

SEQ ID NO: 748363 - RNA, 19 nt, Homo sapiens
guugugcauuugugacuuu

SEQ ID NO: 748364 - RNA, 19 nt, Homo sapiens
gagagggucuucugauucc

SEQ ID NO: 748365 - RNA, 19 nt, Homo sapiens
cauggaggguugcucauca

SEQ ID NO: 748366 - RNA, 19 nt, Homo sapiens
ucagaaugcucuucacaac

SEQ ID NO: 748367 - RNA, 19 nt, Homo sapiens
acucggguauccagcaaua

SEQ ID NO: 748368 - RNA, 19 nt, Homo sapiens
gaauggcugcuuuaaaugg

SEQ ID NO: 748369 - RNA, 19 nt, Homo sapiens
ugaagaaugccggauauug

SEQ ID NO: 748370 - RNA, 19 nt, Homo sapiens
gaccuuugaugcugaugug

SEQ ID NO: 748371 - RNA, 19 nt, Homo sapiens
gggaacucuucgaacagua

SEQ ID NO: 748372 - RNA, 19 nt, Homo sapiens
gaagcuguuuauugguaug

SEQ ID NO: 748373 - RNA, 19 nt, Homo sapiens
cagcagaugcagcaaauca

SEQ ID NO: 748374 - RNA, 19 nt, Homo sapiens
ggaacucuucgaacaguau

SEQ ID NO: 748375 - RNA, 19 nt, Homo sapiens
ccuaaagcaugucgaugug

SEQ ID NO: 748376 - RNA, 19 nt, Homo sapiens
guucaucguugugccuaaa

SEQ ID NO: 748377 - RNA, 19 nt, Homo sapiens
ucaaacguucgaagaauga

SEQ ID NO: 748378 - RNA, 19 nt, Homo sapiens
ugucgugucugccaagguu

SEQ ID NO: 748379 - RNA, 19 nt, Homo sapiens
guauggugcuguguaugaa

SEQ ID NO: 748380 - RNA, 19 nt, Homo sapiens
gcuguuuauugguaugauu

SEQ ID NO: 748381 - RNA, 19 nt, Homo sapiens
ggacuugcgggaacucuuc

SEQ ID NO: 748382 - RNA, 19 nt, Homo sapiens
gacaaagaacagaagagaa

SEQ ID NO: 748383 - RNA, 19 nt, Homo sapiens
gcaaugcaccaagcacaga

SEQ ID NO: 748384 - RNA, 19 nt, Homo sapiens
ucagcgugcucacuaguuc

SEQ ID NO: 748385 - RNA, 19 nt, Homo sapiens
gaaggacaaagaacagaag

SEQ ID NO: 748386 - RNA, 19 nt, Homo sapiens
gaacaaugcaguggaagac

SEQ ID NO: 748387 - RNA, 19 nt, Homo sapiens
ugaaaccugcugacaguga

SEQ ID NO: 748388 - RNA, 19 nt, Homo sapiens
uucauaagauaaccacuug

SEQ ID NO: 748389 - RNA, 19 nt, Homo sapiens
ggagugagagggucuucug

SEQ ID NO: 748390 - RNA, 19 nt, Homo sapiens
ugacagcaagcccuacuga

SEQ ID NO: 748391 - RNA, 19 nt, Homo sapiens
ccaaugggaggguugaaug

SEQ ID NO: 748392 - RNA, 19 nt, Homo sapiens
uuggacagauugaagaaug

SEQ ID NO: 748393 - RNA, 19 nt, Homo sapiens
cauaagauaaccacuugau

SEQ ID NO: 748394 - RNA, 19 nt, Homo sapiens
ugcuugaacucucaccuuu

SEQ ID NO: 748395 - RNA, 19 nt, Homo sapiens
ucauagacaagcagacaaa

SEQ ID NO: 748396 - RNA, 19 nt, Homo sapiens
ccucaauguuggcucuuug

SEQ ID NO: 748397 - RNA, 19 nt, Homo sapiens
caacggcuggccucaaugu

SEQ ID NO: 748398 - RNA, 19 nt, Homo sapiens
uuggagcccugcagacauu

SEQ ID NO: 748399 - RNA, 19 nt, Homo sapiens
auacacagaaggacaaaga

SEQ ID NO: 748400 - RNA, 19 nt, Homo sapiens
gucauguucucuucguuug

SEQ ID NO: 748401 - RNA, 19 nt, Homo sapiens
cagagcagcccuacuagca

SEQ ID NO: 748402 - RNA, 19 nt, Homo sapiens
gugauuccaauucuuugua

SEQ ID NO: 748403 - RNA, 19 nt, Homo sapiens
caggaauggcugcuuuaaa

SEQ ID NO: 748404 - RNA, 19 nt, Homo sapiens
uaccaaugcucucacuaca

SEQ ID NO: 748405 - RNA, 19 nt, Homo sapiens
ggaaaccuugcuggucuaa

SEQ ID NO: 748406 - RNA, 19 nt, Homo sapiens
agacggcuaucaaggcaau

SEQ ID NO: 748407 - RNA, 19 nt, Homo sapiens
gaaugcucuucacaacaug

SEQ ID NO: 748408 - RNA, 19 nt, Homo sapiens
guuuguuucuuucuucguu

SEQ ID NO: 748409 - RNA, 19 nt, Homo sapiens
gccuaaagcaugucgaugu

SEQ ID NO: 748410 - RNA, 19 nt, Homo sapiens
gagcagccuccacccaaug

SEQ ID NO: 748411 - RNA, 19 nt, Homo sapiens
gaugcuaucaagauguuug

SEQ ID NO: 748412 - RNA, 19 nt, Homo sapiens
gguaaaauuugcugauaca

SEQ ID NO: 748413 - RNA, 19 nt, Homo sapiens
cauguucucuucguuugga

SEQ ID NO: 748414 - RNA, 19 nt, Homo sapiens
ugaaaucaacguccuaagg

SEQ ID NO: 748415 - RNA, 19 nt, Homo sapiens
guaccaaugcucucacuac

SEQ ID NO: 748416 - RNA, 19 nt, Homo sapiens
gaagugcacugaaaaugac

SEQ ID NO: 748417 - RNA, 19 nt, Homo sapiens
ccgcgugguguuuguauuu

SEQ ID NO: 748418 - RNA, 19 nt, Homo sapiens
caaguacaucguccaaauc

SEQ ID NO: 748419 - RNA, 19 nt, Homo sapiens
ugagagggucuucugauuc

SEQ ID NO: 748420 - RNA, 19 nt, Homo sapiens
guucgaagaaugacagcaa

SEQ ID NO: 748421 - RNA, 19 nt, Homo sapiens
gggcaaaccucuuuauuua

SEQ ID NO: 748422 - RNA, 19 nt, Homo sapiens
gcaaucagcuuaauaacaa

SEQ ID NO: 748423 - RNA, 19 nt, Homo sapiens
gaacauaaccguguaguug

SEQ ID NO: 748424 - RNA, 19 nt, Homo sapiens
gaaauguuaucucugcuaa

SEQ ID NO: 748425 - RNA, 19 nt, Homo sapiens
gaacacauuucaucuaagu

SEQ ID NO: 748426 - RNA, 19 nt, Homo sapiens
guagguaccucugaauaua

SEQ ID NO: 748427 - RNA, 19 nt, Homo sapiens
uaacaauccuguaugcuuu

SEQ ID NO: 748428 - RNA, 19 nt, Homo sapiens
ggacuagccucuacugaug

SEQ ID NO: 748429 - RNA, 19 nt, Homo sapiens
cacaaacguuuccuucuua

SEQ ID NO: 748430 - RNA, 19 nt, Homo sapiens
gaugaaaccugcagauagu

SEQ ID NO: 748431 - RNA, 19 nt, Homo sapiens
aaacauugcugcauucaug

SEQ ID NO: 748432 - RNA, 19 nt, Homo sapiens
gcuucugucuccaauauua

SEQ ID NO: 748433 - RNA, 19 nt, Homo sapiens
gcagcaaucagcuuaauaa

SEQ ID NO: 748434 - RNA, 19 nt, Homo sapiens
gacaauccaugguuuaaug

SEQ ID NO: 748435 - RNA, 19 nt, Homo sapiens
gaagaaauguaaugagaac

SEQ ID NO: 748436 - RNA, 19 nt, Homo sapiens
gcacaugaaauuaccuaua

SEQ ID NO: 748437 - RNA, 19 nt, Homo sapiens
ggacacagaauguugguuu

SEQ ID NO: 748438 - RNA, 19 nt, Homo sapiens
gcuaaagucuucauugaca

SEQ ID NO: 748439 - RNA, 19 nt, Homo sapiens
gagaauugauguuuguaga

SEQ ID NO: 748440 - RNA, 19 nt, Homo sapiens
ucauauaccuugcaguaaa

SEQ ID NO: 748441 - RNA, 19 nt, Homo sapiens
gaguaaagguuguuguuuc

SEQ ID NO: 748442 - RNA, 19 nt, Homo sapiens
gagaucacguuuagugcua

SEQ ID NO: 748443 - RNA, 19 nt, Homo sapiens
cuagaggucuguaauaguu

SEQ ID NO: 748444 - RNA, 19 nt, Homo sapiens
ggaaaggacuagccucuac

SEQ ID NO: 748445 - RNA, 19 nt, Homo sapiens
caugaaugcuuuacaguug

SEQ ID NO: 748446 - RNA, 19 nt, Homo sapiens
gacaaugacugauuucaag

SEQ ID NO: 748447 - RNA, 19 nt, Homo sapiens
gaucuaguuugaccuuuga

SEQ ID NO: 748448 - RNA, 19 nt, Homo sapiens
uaaagguuguuguuucgua

SEQ ID NO: 748449 - RNA, 19 nt, Homo sapiens
ccauaugacuuucuacgaa

SEQ ID NO: 748450 - RNA, 19 nt, Homo sapiens
gaauuaaguugugguuuca

SEQ ID NO: 748451 - RNA, 19 nt, Homo sapiens
uuucugaccucacaucaua

SEQ ID NO: 748452 - RNA, 19 nt, Homo sapiens
gcucaaaugcucucaggua

SEQ ID NO: 748453 - RNA, 19 nt, Homo sapiens
gugcuacucuggaaucauu

SEQ ID NO: 748454 - RNA, 19 nt, Homo sapiens
caucaugagucuuaauguu

SEQ ID NO: 748455 - RNA, 19 nt, Homo sapiens
guggcucacuuucucauua

SEQ ID NO: 748456 - RNA, 19 nt, Homo sapiens
gcaguuacacaauaaggua

SEQ ID NO: 748457 - RNA, 19 nt, Homo sapiens
gaacggagcuuuggaucac

SEQ ID NO: 748458 - RNA, 19 nt, Homo sapiens
ugaauuaaguugugguuuc

SEQ ID NO: 748459 - RNA, 19 nt, Homo sapiens
gaccuuugaucuaguuuga

SEQ ID NO: 748460 - RNA, 19 nt, Homo sapiens
uaagaccauuugaguauug

SEQ ID NO: 748461 - RNA, 19 nt, Homo sapiens
gcucaguucuuuaucacaa

SEQ ID NO: 748462 - RNA, 19 nt, Homo sapiens
gaaaagaauuccuaaugug

SEQ ID NO: 748463 - RNA, 19 nt, Homo sapiens
cuacuuuguucuuugguua

SEQ ID NO: 748464 - RNA, 19 nt, Homo sapiens
guaagacauuguauaagug

SEQ ID NO: 748465 - RNA, 19 nt, Homo sapiens
caugcaagacugaaauuua

SEQ ID NO: 748466 - RNA, 19 nt, Homo sapiens
acacaaacguuuccuucuu

SEQ ID NO: 748467 - RNA, 19 nt, Homo sapiens
ucgaagaaauguaaugaga

SEQ ID NO: 748468 - RNA, 19 nt, Homo sapiens
gcucguuccugacagaauu

SEQ ID NO: 748469 - RNA, 19 nt, Homo sapiens
cuaaugugcuacuagaauu

SEQ ID NO: 748470 - RNA, 19 nt, Homo sapiens
caaaugcucucagguaugg

SEQ ID NO: 748471 - RNA, 19 nt, Homo sapiens
gaaggcaaccucaccaugu

SEQ ID NO: 748472 - RNA, 19 nt, Homo sapiens
caaagggccugugccagaa

SEQ ID NO: 748473 - RNA, 19 nt, Homo sapiens
ucacauguguuuacuacug

SEQ ID NO: 748474 - RNA, 19 nt, Homo sapiens
agagcuaucuggaauguug

SEQ ID NO: 748475 - RNA, 19 nt, Homo sapiens
uaagaccauuucauucuga

SEQ ID NO: 748476 - RNA, 19 nt, Homo sapiens
gcaucuauccucuaaguug

SEQ ID NO: 748477 - RNA, 19 nt, Homo sapiens
uguaaacuguguuauguug

SEQ ID NO: 748478 - RNA, 19 nt, Homo sapiens
guuagacaauccaugguuu

SEQ ID NO: 748479 - RNA, 19 nt, Homo sapiens
gauuucggguugauugauu

SEQ ID NO: 748480 - RNA, 19 nt, Homo sapiens
guaagaccauuugaguauu

SEQ ID NO: 748481 - RNA, 19 nt, Homo sapiens
gaggcucccugcucucauu

SEQ ID NO: 748482 - RNA, 19 nt, Homo sapiens
caagggcaauggcacagaa

SEQ ID NO: 748483 - RNA, 19 nt, Homo sapiens
uacgcaggcuuuccuauuu

SEQ ID NO: 748484 - RNA, 19 nt, Homo sapiens
gaaacuguaagaccauuug

SEQ ID NO: 748485 - RNA, 19 nt, Homo sapiens
guaacgaguucaucuuucu

SEQ ID NO: 748486 - RNA, 19 nt, Homo sapiens
gagcccaccacuugaauuu

SEQ ID NO: 748487 - RNA, 19 nt, Homo sapiens
ggauagcccugggauggaa

SEQ ID NO: 748488 - RNA, 19 nt, Homo sapiens
gugaagcauugaugucauu

SEQ ID NO: 748489 - RNA, 19 nt, Homo sapiens
gcaaaccucuuuauuuacc

SEQ ID NO: 748490 - RNA, 19 nt, Homo sapiens
ccucuaaggugagaaaguu

SEQ ID NO: 748491 - RNA, 19 nt, Homo sapiens
cuacugaccuuugaucuag

SEQ ID NO: 748492 - RNA, 19 nt, Homo sapiens
ggaaauguuaucucugcua

SEQ ID NO: 748493 - RNA, 19 nt, Homo sapiens
cagaugccauuaagauguu

SEQ ID NO: 748494 - RNA, 19 nt, Homo sapiens
gcacaugcacuuccuuaca

SEQ ID NO: 748495 - RNA, 19 nt, Homo sapiens
gcacagccaacaagaugaa

SEQ ID NO: 748496 - RNA, 19 nt, Homo sapiens
cacaugcacuuccuuacaa

SEQ ID NO: 748497 - RNA, 19 nt, Homo sapiens
gcaccuaacaauccuguau

SEQ ID NO: 748498 - RNA, 19 nt, Homo sapiens
cagaauaaguuuuguguug

SEQ ID NO: 748499 - RNA, 19 nt, Homo sapiens
cugcuaaagucuucauuga

SEQ ID NO: 748500 - RNA, 19 nt, Homo sapiens
acucaggaauucaacagua

SEQ ID NO: 748501 - RNA, 19 nt, Homo sapiens
gcagcucgcucagcagaug

SEQ ID NO: 748502 - RNA, 19 nt, Homo sapiens
gugauguucucuccauuug

SEQ ID NO: 748503 - RNA, 19 nt, Homo sapiens
cauuguuucugaugucuuu

SEQ ID NO: 748504 - RNA, 19 nt, Homo sapiens
caacaaauggcaggcauga

SEQ ID NO: 748505 - RNA, 19 nt, Homo sapiens
gagggcugcucuucaccua

SEQ ID NO: 748506 - RNA, 19 nt, Homo sapiens
uaggaaugguuucgaagaa

SEQ ID NO: 748507 - RNA, 19 nt, Homo sapiens
guuauugugugaugcaguu

SEQ ID NO: 748508 - RNA, 19 nt, Homo sapiens
uuaccuaaaucucaacgaa

SEQ ID NO: 748509 - RNA, 19 nt, Homo sapiens
aaagguuguuguuucguaa

SEQ ID NO: 748510 - RNA, 19 nt, Homo sapiens
guuguuugauggaauuuga

SEQ ID NO: 748511 - RNA, 19 nt, Homo sapiens
ucaaaggcguaacgaguuc

SEQ ID NO: 748512 - RNA, 19 nt, Homo sapiens
gcacuuccuuacaaugaca

SEQ ID NO: 748513 - RNA, 19 nt, Homo sapiens
gugccaaauuccaaaggua

SEQ ID NO: 748514 - RNA, 19 nt, Homo sapiens
gccacaggcuugacgaaug

SEQ ID NO: 748515 - RNA, 19 nt, Homo sapiens
aaggcaaccucaccaugua

SEQ ID NO: 748516 - RNA, 19 nt, Homo sapiens
ccacaggcuugacgaaugg

SEQ ID NO: 748517 - RNA, 19 nt, Homo sapiens
gcacagaaugcaaucaaag

SEQ ID NO: 748518 - RNA, 19 nt, Homo sapiens
ucauaggaaugguuucgaa

SEQ ID NO: 748519 - RNA, 19 nt, Homo sapiens
caagaugaacggagcuuug

SEQ ID NO: 748520 - RNA, 19 nt, Homo sapiens
ccacuugaauuucuaagac

SEQ ID NO: 748521 - RNA, 19 nt, Homo sapiens
cuguauggcuucuauauaa

SEQ ID NO: 748522 - RNA, 19 nt, Homo sapiens
ccagaucuaugaauuggaa

SEQ ID NO: 748523 - RNA, 19 nt, Homo sapiens
gaacaaggccgagaugacu

SEQ ID NO: 748524 - RNA, 19 nt, Homo sapiens
uggaggagcucgccagcaa

SEQ ID NO: 748525 - RNA, 19 nt, Homo sapiens
ccaaccaccagaucuauga

SEQ ID NO: 748526 - RNA, 19 nt, Homo sapiens
ggaggacgaggaagacgaa

SEQ ID NO: 748527 - RNA, 19 nt, Homo sapiens
cgaggaagacgaagagauc

SEQ ID NO: 748528 - RNA, 19 nt, Homo sapiens
gcacggccuucaccaacca

SEQ ID NO: 748529 - RNA, 19 nt, Homo sapiens
gccgagcaauucuguaugg

SEQ ID NO: 748530 - RNA, 19 nt, Homo sapiens
uggccgaacucgagcagaa

SEQ ID NO: 748531 - RNA, 19 nt, Homo sapiens
gaggagcucgccagcaaga

SEQ ID NO: 748532 - RNA, 19 nt, Homo sapiens
ggacgaggaagacgaagag

SEQ ID NO: 748533 - RNA, 19 nt, Homo sapiens
ucaccaaccaccagaucua

SEQ ID NO: 748534 - RNA, 19 nt, Homo sapiens
caccagaucuaugaauugg

SEQ ID NO: 748535 - RNA, 19 nt, Homo sapiens
ccaccagaucuaugaauug

SEQ ID NO: 748536 - RNA, 19 nt, Homo sapiens
gcgacgguaugaccaucuu

SEQ ID NO: 748537 - RNA, 19 nt, Homo sapiens
gcaauucuguauggcuucu

SEQ ID NO: 748538 - RNA, 19 nt, Homo sapiens
ccuaagaagcggcgaaagu

SEQ ID NO: 748539 - RNA, 19 nt, Homo sapiens
ucuguauggcuucuauaua

SEQ ID NO: 748540 - RNA, 19 nt, Homo sapiens
accaccagaucuaugaauu

SEQ ID NO: 748541 - RNA, 19 nt, Homo sapiens
cgucugugcggagaaguua

SEQ ID NO: 748542 - RNA, 19 nt, Homo sapiens
aggccgagaugacuuccaa

SEQ ID NO: 748543 - RNA, 19 nt, Homo sapiens
gacgguaugaccaucuuug

SEQ ID NO: 748544 - RNA, 19 nt, Homo sapiens
caccaacgcgcaagucauc

SEQ ID NO: 748545 - RNA, 19 nt, Homo sapiens
cuaagaagcggcgaaaguc

SEQ ID NO: 748546 - RNA, 19 nt, Homo sapiens
cgcaagucaucaccugguu

SEQ ID NO: 748547 - RNA, 19 nt, Homo sapiens
gcuccuagcgcucgaaagc

SEQ ID NO: 748548 - RNA, 19 nt, Homo sapiens
caaccaccagaucuaugaa

SEQ ID NO: 748549 - RNA, 19 nt, Homo sapiens
ggcaagagcuacaccaaga

SEQ ID NO: 748550 - RNA, 19 nt, Homo sapiens
caccuggccuugcacauga

SEQ ID NO: 748551 - RNA, 19 nt, Homo sapiens
ggacacacaggaugacuuc

SEQ ID NO: 748552 - RNA, 19 nt, Homo sapiens
caagagcucccaccugaag

SEQ ID NO: 748553 - RNA, 19 nt, Homo sapiens
gcacaugaagcgccaccuu

SEQ ID NO: 748554 - RNA, 19 nt, Homo sapiens
ccgagacucugggcgcaua

SEQ ID NO: 748555 - RNA, 19 nt, Homo sapiens
gggaggaagaggacgauga

SEQ ID NO: 748556 - RNA, 19 nt, Homo sapiens
ucacgaggcagccgaggaa

SEQ ID NO: 748557 - RNA, 19 nt, Homo sapiens
ggaggaagaggacgaugag

SEQ ID NO: 748558 - RNA, 19 nt, Homo sapiens
caugaagcgccaccuuuga

SEQ ID NO: 748559 - RNA, 19 nt, Homo sapiens
cacaugaagcgccaccuuu

SEQ ID NO: 748560 - RNA, 19 nt, Homo sapiens
gcagaggauccagguguga

SEQ ID NO: 748561 - RNA, 19 nt, Homo sapiens
ccuccuuccugaguuguuu

SEQ ID NO: 748562 - RNA, 19 nt, Homo sapiens
cgaagaggcgcaggacaug

SEQ ID NO: 748563 - RNA, 19 nt, Homo sapiens
acaugaagcgccaccuuug

SEQ ID NO: 748564 - RNA, 19 nt, Homo sapiens
ccaccuggccuugcacaug

SEQ ID NO: 748565 - RNA, 19 nt, Homo sapiens
gaaggcugcggcuggagau

SEQ ID NO: 748566 - RNA, 19 nt, Homo sapiens
agaggauccaggugugaua

SEQ ID NO: 748567 - RNA, 19 nt, Homo sapiens
gcaagagcuacaccaagag

SEQ ID NO: 748568 - RNA, 19 nt, Homo sapiens
cgaggaagaggaggcuuga

SEQ ID NO: 748569 - RNA, 19 nt, Homo sapiens
gaucuccuccucaccaacu

SEQ ID NO: 748570 - RNA, 19 nt, Homo sapiens
ccgaagaggcgcaggacau

SEQ ID NO: 748571 - RNA, 19 nt, Homo sapiens
gggcaaaacugaauuauaa

SEQ ID NO: 748572 - RNA, 19 nt, Homo sapiens
gaucagagcagcagugaaa

SEQ ID NO: 748573 - RNA, 19 nt, Homo sapiens
ccacacacauacacacaua

SEQ ID NO: 748574 - RNA, 19 nt, Homo sapiens
ggaacaaacuggcaaagca

SEQ ID NO: 748575 - RNA, 19 nt, Homo sapiens
gaucucagguucuccuuga

SEQ ID NO: 748576 - RNA, 19 nt, Homo sapiens
caaauuaucuauggcaaug

SEQ ID NO: 748577 - RNA, 19 nt, Homo sapiens
gaggcaggcuuuguuuaua

SEQ ID NO: 748578 - RNA, 19 nt, Homo sapiens
guauauacccacacacaua

SEQ ID NO: 748579 - RNA, 19 nt, Homo sapiens
guacuguucucuucuugaa

SEQ ID NO: 748580 - RNA, 19 nt, Homo sapiens
guuuauagcuugcgcauuc

SEQ ID NO: 748581 - RNA, 19 nt, Homo sapiens
ugacagaggccaucgcaua

SEQ ID NO: 748582 - RNA, 19 nt, Homo sapiens
gcauguaccuggugguguu

SEQ ID NO: 748583 - RNA, 19 nt, Homo sapiens
aagcacagaucucuaaaga

SEQ ID NO: 748584 - RNA, 19 nt, Homo sapiens
uauaagaggcugauaauuc

SEQ ID NO: 748585 - RNA, 19 nt, Homo sapiens
gaugacaugugacuccuau

SEQ ID NO: 748586 - RNA, 19 nt, Homo sapiens
ggaggagcaucaagacuuc

SEQ ID NO: 748587 - RNA, 19 nt, Homo sapiens
ucgagaagcugcucuggaa

SEQ ID NO: 748588 - RNA, 19 nt, Homo sapiens
auagguagauguucagauu

SEQ ID NO: 748589 - RNA, 19 nt, Homo sapiens
ucacaucaauggaaaucuu

SEQ ID NO: 748590 - RNA, 19 nt, Homo sapiens
guucagauugcuuugauua

SEQ ID NO: 748591 - RNA, 19 nt, Homo sapiens
ggucucacaucaauggaaa

SEQ ID NO: 748592 - RNA, 19 nt, Homo sapiens
gagaagcugcucuggaauu

SEQ ID NO: 748593 - RNA, 19 nt, Homo sapiens
gaaaucuucugaggacaau

SEQ ID NO: 748594 - RNA, 19 nt, Homo sapiens
caucuacacuauuaacuuc

SEQ ID NO: 748595 - RNA, 19 nt, Homo sapiens
gcucaucucuggaacaaac

SEQ ID NO: 748596 - RNA, 19 nt, Homo sapiens
gcuauucagucauaaucaa

SEQ ID NO: 748597 - RNA, 19 nt, Homo sapiens
cagaagcacagaucucuaa

SEQ ID NO: 748598 - RNA, 19 nt, Homo sapiens
ugucugcuauucagucaua

SEQ ID NO: 748599 - RNA, 19 nt, Homo sapiens
gcacacacugggaauacua

SEQ ID NO: 748600 - RNA, 19 nt, Homo sapiens
cugggcaucuacacuauua

SEQ ID NO: 748601 - RNA, 19 nt, Homo sapiens
acacaaacguauguaaaug

SEQ ID NO: 748602 - RNA, 19 nt, Homo sapiens
ccaggcaccucacagaaau

SEQ ID NO: 748603 - RNA, 19 nt, Homo sapiens
gcaaagaguguagaucaga

SEQ ID NO: 748604 - RNA, 19 nt, Homo sapiens
gggcaaagaguguagauca

SEQ ID NO: 748605 - RNA, 19 nt, Homo sapiens
ccacacaaacguauguaaa

SEQ ID NO: 748606 - RNA, 19 nt, Homo sapiens
gcaucacuguggaucguuu

SEQ ID NO: 748607 - RNA, 19 nt, Homo sapiens
gacuauggguucagcaguu

SEQ ID NO: 748608 - RNA, 19 nt, Homo sapiens
uuucugaaguggacucuuu

SEQ ID NO: 748609 - RNA, 19 nt, Homo sapiens
agaagcugcucuggaauuu

SEQ ID NO: 748610 - RNA, 19 nt, Homo sapiens
gaacacucaugcugaaagc

SEQ ID NO: 748611 - RNA, 19 nt, Homo sapiens
gaggacaauuccaagacuu

SEQ ID NO: 748612 - RNA, 19 nt, Homo sapiens
ggaaaucuucugaggacaa

SEQ ID NO: 748613 - RNA, 19 nt, Homo sapiens
ucuggaaacuugugaagga

SEQ ID NO: 748614 - RNA, 19 nt, Homo sapiens
gaacaaacuggcaaagcau

SEQ ID NO: 748615 - RNA, 19 nt, Homo sapiens
ugacaugugacuccuauga

SEQ ID NO: 748616 - RNA, 19 nt, Homo sapiens
ggucauauccaucuucuac

SEQ ID NO: 748617 - RNA, 19 nt, Homo sapiens
ccagcauguuccaguuaua

SEQ ID NO: 748618 - RNA, 19 nt, Homo sapiens
uggcugaccugguguuugu

SEQ ID NO: 748619 - RNA, 19 nt, Homo sapiens
ccaagaaugcugaaaccaa

SEQ ID NO: 748620 - RNA, 19 nt, Homo sapiens
gcugugcccucuugaugug

SEQ ID NO: 748621 - RNA, 19 nt, Homo sapiens
ccaccagcauguuccaguu

SEQ ID NO: 748622 - RNA, 19 nt, Homo sapiens
ggaaacuugugaaggacau

SEQ ID NO: 748623 - RNA, 19 nt, Homo sapiens
ugauuaccaugaagacuau

SEQ ID NO: 748624 - RNA, 19 nt, Homo sapiens
ucaccaugauugucugcua

SEQ ID NO: 748625 - RNA, 19 nt, Homo sapiens
ccacugcucaccaugauug

SEQ ID NO: 748626 - RNA, 19 nt, Homo sapiens
ugauaucccugcugguuuc

SEQ ID NO: 748627 - RNA, 19 nt, Homo sapiens
guggaucguuucauuguag

SEQ ID NO: 748628 - RNA, 19 nt, Homo sapiens
gcaucuacacuauuaacuu

SEQ ID NO: 748629 - RNA, 19 nt, Homo sapiens
cuacugggcaucuacacua

SEQ ID NO: 748630 - RNA, 19 nt, Homo sapiens
gggcuugacuuuuguauag

SEQ ID NO: 748631 - RNA, 19 nt, Homo sapiens
caucuucuaccauaaguug

SEQ ID NO: 748632 - RNA, 19 nt, Homo sapiens
gcaccagggacuaugaaug

SEQ ID NO: 748633 - RNA, 19 nt, Homo sapiens
ggugagcacggccaacaaa

SEQ ID NO: 748634 - RNA, 19 nt, Homo sapiens
gaacuucuggaaacuugug

SEQ ID NO: 748635 - RNA, 19 nt, Homo sapiens
ugacccagaugcccuucaa

SEQ ID NO: 748636 - RNA, 19 nt, Homo sapiens
ggugauaucccugcugguu

SEQ ID NO: 748637 - RNA, 19 nt, Homo sapiens
cauguacuguucucuucuu

SEQ ID NO: 748638 - RNA, 19 nt, Homo sapiens
ugaggcaggcuuuguuuau

SEQ ID NO: 748639 - RNA, 19 nt, Homo sapiens
ggugaggcaggcuuuguuu

SEQ ID NO: 748640 - RNA, 19 nt, Homo sapiens
gcagcacacacugggaaua

SEQ ID NO: 748641 - RNA, 19 nt, Homo sapiens
cacuguggaucguuucauu

SEQ ID NO: 748642 - RNA, 19 nt, Homo sapiens
ugaguuucauagcuaagaa

SEQ ID NO: 748643 - RNA, 19 nt, Homo sapiens
aagcagcauuucugaagug

SEQ ID NO: 748644 - RNA, 19 nt, Homo sapiens
uaagcagcauuucugaagu

SEQ ID NO: 748645 - RNA, 19 nt, Homo sapiens
cuugaacacucaugcugaa

SEQ ID NO: 748646 - RNA, 19 nt, Homo sapiens
agccugaaguuucgaaaga

SEQ ID NO: 748647 - RNA, 19 nt, Homo sapiens
caccaugauugucugcuau

SEQ ID NO: 748648 - RNA, 19 nt, Homo sapiens
auauccaucuucuaccaua

SEQ ID NO: 748649 - RNA, 19 nt, Homo sapiens
aaauguauauacccacaca

SEQ ID NO: 748650 - RNA, 19 nt, Homo sapiens
uccaaugucugccacacaa

SEQ ID NO: 748651 - RNA, 19 nt, Homo sapiens
aagcucaucucuggaacaa

SEQ ID NO: 748652 - RNA, 19 nt, Homo sapiens
uaccugagggccugccuua

SEQ ID NO: 748653 - RNA, 19 nt, Homo sapiens
gcaguucagcaaggucuuu

SEQ ID NO: 748654 - RNA, 19 nt, Homo sapiens
auaagaggcugauaauucc

SEQ ID NO: 748655 - RNA, 19 nt, Homo sapiens
acaugugacuccuaugauc

SEQ ID NO: 748656 - RNA, 19 nt, Homo sapiens
gugaggcaggcuuuguuua

SEQ ID NO: 748657 - RNA, 19 nt, Homo sapiens
caccagcauguuccaguua

SEQ ID NO: 748658 - RNA, 19 nt, Homo sapiens
gaagcacagaucucuaaag

SEQ ID NO: 748659 - RNA, 19 nt, Homo sapiens
cagcaagccaagaggauga

SEQ ID NO: 748660 - RNA, 19 nt, Homo sapiens
cacacaaacguauguaaau

SEQ ID NO: 748661 - RNA, 19 nt, Homo sapiens
guccauggaaugcuugaaa

SEQ ID NO: 748662 - RNA, 19 nt, Homo sapiens
gccugaaguuucgaaagaa

SEQ ID NO: 748663 - RNA, 19 nt, Homo sapiens
uauccaucuucuaccauaa

SEQ ID NO: 748664 - RNA, 19 nt, Homo sapiens
cuauggcaaugucuuuaau

SEQ ID NO: 748665 - RNA, 19 nt, Homo sapiens
cuaagcagcauuucugaag

SEQ ID NO: 748666 - RNA, 19 nt, Homo sapiens
ccaccaggcaccucacaga

SEQ ID NO: 748667 - RNA, 19 nt, Homo sapiens
aggcaggcuuuguuuauag

SEQ ID NO: 748668 - RNA, 19 nt, Homo sapiens
guucuugccacccagauga

SEQ ID NO: 748669 - RNA, 19 nt, Homo sapiens
ucauauccaucuucuacca

SEQ ID NO: 748670 - RNA, 19 nt, Homo sapiens
guucagcaguuucaaugac

SEQ ID NO: 748671 - RNA, 19 nt, Homo sapiens
gaaaggagagaaagacuua

SEQ ID NO: 748672 - RNA, 19 nt, Homo sapiens
gaaaagaagugcaguguaa

SEQ ID NO: 748673 - RNA, 19 nt, Homo sapiens
gaaagcagcauuccuauau

SEQ ID NO: 748674 - RNA, 19 nt, Homo sapiens
caaauuaaguuaccacaga

SEQ ID NO: 748675 - RNA, 19 nt, Homo sapiens
gaaagugguugguaauaug

SEQ ID NO: 748676 - RNA, 19 nt, Homo sapiens
gaugaagacugaaguaaug

SEQ ID NO: 748677 - RNA, 19 nt, Homo sapiens
gagaaagacuuaccagaga

SEQ ID NO: 748678 - RNA, 19 nt, Homo sapiens
ggaaucaccuuaacacaca

SEQ ID NO: 748679 - RNA, 19 nt, Homo sapiens
uuagagagccucagucuua

SEQ ID NO: 748680 - RNA, 19 nt, Homo sapiens
aaagaaagaugcgcucuaa

SEQ ID NO: 748681 - RNA, 19 nt, Homo sapiens
gcgcggagcugcuucuuug

SEQ ID NO: 748682 - RNA, 19 nt, Homo sapiens
caacaugagaccuguaaua

SEQ ID NO: 748683 - RNA, 19 nt, Homo sapiens
gggcaaagauguagaugug

SEQ ID NO: 748684 - RNA, 19 nt, Homo sapiens
ggaggagccugccguagaa

SEQ ID NO: 748685 - RNA, 19 nt, Homo sapiens
caacagcaguguacagaug

SEQ ID NO: 748686 - RNA, 19 nt, Homo sapiens
gagaugauccucagcauga

SEQ ID NO: 748687 - RNA, 19 nt, Homo sapiens
gaaagaugcgcucuaagaa

SEQ ID NO: 748688 - RNA, 19 nt, Homo sapiens
gagaaacgaagaagaguaa

SEQ ID NO: 748689 - RNA, 19 nt, Homo sapiens
gaacagcccauaaacauag

SEQ ID NO: 748690 - RNA, 19 nt, Homo sapiens
gaagaugccugccacuuac

SEQ ID NO: 748691 - RNA, 19 nt, Homo sapiens
ggaaaagccuuaugaaugu

SEQ ID NO: 748692 - RNA, 19 nt, Homo sapiens
aaagaaagguguaaagaag

SEQ ID NO: 748693 - RNA, 19 nt, Homo sapiens
gaaagugaacccaugauau

SEQ ID NO: 748694 - RNA, 19 nt, Homo sapiens
gacgauacccagauuauaa

SEQ ID NO: 748695 - RNA, 19 nt, Homo sapiens
caucagaagucacacaaga

SEQ ID NO: 748696 - RNA, 19 nt, Homo sapiens
ggaaagugaacccaugaua

SEQ ID NO: 748697 - RNA, 19 nt, Homo sapiens
guaaaccacuccagaaugg

SEQ ID NO: 748698 - RNA, 19 nt, Homo sapiens
ggaaggugaugcagucgaa

SEQ ID NO: 748699 - RNA, 19 nt, Homo sapiens
gaaaugccguuacugugau

SEQ ID NO: 748700 - RNA, 19 nt, Homo sapiens
guagaagucagcaaauuaa

SEQ ID NO: 748701 - RNA, 19 nt, Homo sapiens
gagaagccauucaaguguu

SEQ ID NO: 748702 - RNA, 19 nt, Homo sapiens
gaauacaggugcaauugag

SEQ ID NO: 748703 - RNA, 19 nt, Homo sapiens
caagacaugcugauaauug

SEQ ID NO: 748704 - RNA, 19 nt, Homo sapiens
gcagaagggugauuaugag

SEQ ID NO: 748705 - RNA, 19 nt, Homo sapiens
gcauuugaaccuuguauaa

SEQ ID NO: 748706 - RNA, 19 nt, Homo sapiens
ggaauaccauggcaagaca

SEQ ID NO: 748707 - RNA, 19 nt, Homo sapiens
ggaacagcccauaaacaua

SEQ ID NO: 748708 - RNA, 19 nt, Homo sapiens
uggucaagcuuguaaauaa

SEQ ID NO: 748709 - RNA, 19 nt, Homo sapiens
ggaaggacuuagaguuuua

SEQ ID NO: 748710 - RNA, 19 nt, Homo sapiens
agugugagcuuugcaguua

SEQ ID NO: 748711 - RNA, 19 nt, Homo sapiens
uuacggaccugaagccaaa

SEQ ID NO: 748712 - RNA, 19 nt, Homo sapiens
cauaacggauuaacaagug

SEQ ID NO: 748713 - RNA, 19 nt, Homo sapiens
caugagaccuguaauaaaa

SEQ ID NO: 748714 - RNA, 19 nt, Homo sapiens
ggacuucucugggcugugu

SEQ ID NO: 748715 - RNA, 19 nt, Homo sapiens
ggcaagacaugcugauaau

SEQ ID NO: 748716 - RNA, 19 nt, Homo sapiens
guucacagcagcccuuaua

SEQ ID NO: 748717 - RNA, 19 nt, Homo sapiens
ccacggagccagcauuuga

SEQ ID NO: 748718 - RNA, 19 nt, Homo sapiens
gaaccaaccagcccaaaca

SEQ ID NO: 748719 - RNA, 19 nt, Homo sapiens
ggagaaacgaagaagagua

SEQ ID NO: 748720 - RNA, 19 nt, Homo sapiens
gagaaagugguugguaaua

SEQ ID NO: 748721 - RNA, 19 nt, Homo sapiens
gcuguacugugugauauuu

SEQ ID NO: 748722 - RNA, 19 nt, Homo sapiens
cggagaaagugguugguaa

SEQ ID NO: 748723 - RNA, 19 nt, Homo sapiens
ggacgauacccagauuaua

SEQ ID NO: 748724 - RNA, 19 nt, Homo sapiens
agaagaugccugccacuua

SEQ ID NO: 748725 - RNA, 19 nt, Homo sapiens
caagaaaugccguuacugu

SEQ ID NO: 748726 - RNA, 19 nt, Homo sapiens
gaagugcaguguaagaaaa

SEQ ID NO: 748727 - RNA, 19 nt, Homo sapiens
uuacugugaugcuguguuu

SEQ ID NO: 748728 - RNA, 19 nt, Homo sapiens
gcaaacugcguuauacaga

SEQ ID NO: 748729 - RNA, 19 nt, Homo sapiens
gugaugcuguguuucauga

SEQ ID NO: 748730 - RNA, 19 nt, Homo sapiens
uaggagaacuucagcuugu

SEQ ID NO: 748731 - RNA, 19 nt, Homo sapiens
ucacuaggucaguaauuua

SEQ ID NO: 748732 - RNA, 19 nt, Homo sapiens
guagcugauuguuguguuu

SEQ ID NO: 748733 - RNA, 19 nt, Homo sapiens
ucacaaucauguagcagaa

SEQ ID NO: 748734 - RNA, 19 nt, Homo sapiens
ccaguaguauggcaugcua

SEQ ID NO: 748735 - RNA, 19 nt, Homo sapiens
agaaagaugcgcucuaaga

SEQ ID NO: 748736 - RNA, 19 nt, Homo sapiens
cagaaaauguggccaaauu

SEQ ID NO: 748737 - RNA, 19 nt, Homo sapiens
agaaagugguugguaauau

SEQ ID NO: 748738 - RNA, 19 nt, Homo sapiens
uaagagagccaucaguuag

SEQ ID NO: 748739 - RNA, 19 nt, Homo sapiens
ggucaguaauuuaaaccuu

SEQ ID NO: 748740 - RNA, 19 nt, Homo sapiens
guucuguccugaaagcuuu

SEQ ID NO: 748741 - RNA, 19 nt, Homo sapiens
aagcagcauuccuauauug

SEQ ID NO: 748742 - RNA, 19 nt, Homo sapiens
uguagaagucagcaaauua

SEQ ID NO: 748743 - RNA, 19 nt, Homo sapiens
gaugagagaccacacaagu

SEQ ID NO: 748744 - RNA, 19 nt, Homo sapiens
guuuguagcugauuguugu

SEQ ID NO: 748745 - RNA, 19 nt, Homo sapiens
cuucaaggaugauguuaga

SEQ ID NO: 748746 - RNA, 19 nt, Homo sapiens
aaacauaccgagaacgaaa

SEQ ID NO: 748747 - RNA, 19 nt, Homo sapiens
aaagugaacccaugauaug

SEQ ID NO: 748748 - RNA, 19 nt, Homo sapiens
uuaagagagccaucaguua

SEQ ID NO: 748749 - RNA, 19 nt, Homo sapiens
ggcagaagggugauuauga

SEQ ID NO: 748750 - RNA, 19 nt, Homo sapiens
gcacguggcagaucaugau

SEQ ID NO: 748751 - RNA, 19 nt, Homo sapiens
guguaaauguugacaagga

SEQ ID NO: 748752 - RNA, 19 nt, Homo sapiens
cacauucgcucucauacug

SEQ ID NO: 748753 - RNA, 19 nt, Homo sapiens
ccacacaagugccaucucu

SEQ ID NO: 748754 - RNA, 19 nt, Homo sapiens
guuagcaaaucauggaaug

SEQ ID NO: 748755 - RNA, 19 nt, Homo sapiens
cgaaagcagcauuccuaua

SEQ ID NO: 748756 - RNA, 19 nt, Homo sapiens
aaauuuggaucgucacaug

SEQ ID NO: 748757 - RNA, 19 nt, Homo sapiens
ccaccaggcuucccagagu

SEQ ID NO: 748758 - RNA, 19 nt, Homo sapiens
ggaaaggagagaaagacuu

SEQ ID NO: 748759 - RNA, 19 nt, Homo sapiens
ucaaggaugauguuagaaa

SEQ ID NO: 748760 - RNA, 19 nt, Homo sapiens
agaaagaagauuccucuga

SEQ ID NO: 748761 - RNA, 19 nt, Homo sapiens
aaagcagcauuccuauauu

SEQ ID NO: 748762 - RNA, 19 nt, Homo sapiens
ugauuuggguguccacuug

SEQ ID NO: 748763 - RNA, 19 nt, Homo sapiens
ucucugggcuguguuuaaa

SEQ ID NO: 748764 - RNA, 19 nt, Homo sapiens
aagaugcgcucuaagaaag

SEQ ID NO: 748765 - RNA, 19 nt, Homo sapiens
agaagucacacaagaauga

SEQ ID NO: 748766 - RNA, 19 nt, Homo sapiens
agaaaugccguuacuguga

SEQ ID NO: 748767 - RNA, 19 nt, Homo sapiens
ggacacauacaagcugaaa

SEQ ID NO: 748768 - RNA, 19 nt, Homo sapiens
guguagaagucagcaaauu

SEQ ID NO: 748769 - RNA, 19 nt, Homo sapiens
ggagaaagugguugguaau

SEQ ID NO: 748770 - RNA, 19 nt, Homo sapiens
gaagauccuaguuggcaaa

SEQ ID NO: 748771 - RNA, 19 nt, Homo sapiens
ggagagagaugcagagaaa

SEQ ID NO: 748772 - RNA, 19 nt, Homo sapiens
ggaagcaacuaaagaauga

SEQ ID NO: 748773 - RNA, 19 nt, Homo sapiens
ggacagggagcccaaauaa

SEQ ID NO: 748774 - RNA, 19 nt, Homo sapiens
ggacaaaguuaaaggaaag

SEQ ID NO: 748775 - RNA, 19 nt, Homo sapiens
ggaccagaaucccaaguaa

SEQ ID NO: 748776 - RNA, 19 nt, Homo sapiens
gcacugauuuagagaaaga

SEQ ID NO: 748777 - RNA, 19 nt, Homo sapiens
ggaaagagagaaucagaaa

SEQ ID NO: 748778 - RNA, 19 nt, Homo sapiens
gaauggaggucaagguaga

SEQ ID NO: 748779 - RNA, 19 nt, Homo sapiens
gcagagaaagauccaaaua

SEQ ID NO: 748780 - RNA, 19 nt, Homo sapiens
gaaaucagcacacauaaag

SEQ ID NO: 748781 - RNA, 19 nt, Homo sapiens
gaagagggagucaguugua

SEQ ID NO: 748782 - RNA, 19 nt, Homo sapiens
gaaauaacuuuggcuguca

SEQ ID NO: 748783 - RNA, 19 nt, Homo sapiens
gaacaagagguccaagaaa

SEQ ID NO: 748784 - RNA, 19 nt, Homo sapiens
gaagaugaguauaccacaa

SEQ ID NO: 748785 - RNA, 19 nt, Homo sapiens
agacaggaaucccaaguaa

SEQ ID NO: 748786 - RNA, 19 nt, Homo sapiens
ggacaagaagcccaaguaa

SEQ ID NO: 748787 - RNA, 19 nt, Homo sapiens
ccacacaauuucucaguga

SEQ ID NO: 748788 - RNA, 19 nt, Homo sapiens
ccacaaaccucaguuccaa

SEQ ID NO: 748789 - RNA, 19 nt, Homo sapiens
gaucgcaucucacacaauc

SEQ ID NO: 748790 - RNA, 19 nt, Homo sapiens
ggaagaguaaggauaaauu

SEQ ID NO: 748791 - RNA, 19 nt, Homo sapiens
ggcagcaccuauaagaaua

SEQ ID NO: 748792 - RNA, 19 nt, Homo sapiens
uaaaggagccagaaagaga

SEQ ID NO: 748793 - RNA, 19 nt, Homo sapiens
gacaauacauggaaaauga

SEQ ID NO: 748794 - RNA, 19 nt, Homo sapiens
caaggaagcaacuaaagaa

SEQ ID NO: 748795 - RNA, 19 nt, Homo sapiens
acacuggaaucccaaguaa

SEQ ID NO: 748796 - RNA, 19 nt, Homo sapiens
ggaacaagagguccaagaa

SEQ ID NO: 748797 - RNA, 19 nt, Homo sapiens
gcaauucacagcccuauuc

SEQ ID NO: 748798 - RNA, 19 nt, Homo sapiens
guuaagacguauaugauuc

SEQ ID NO: 748799 - RNA, 19 nt, Homo sapiens
gagagaaucagaaaucaau

SEQ ID NO: 748800 - RNA, 19 nt, Homo sapiens
caaaggaaaggacaaaguu

SEQ ID NO: 748801 - RNA, 19 nt, Homo sapiens
gaggauaaaggaaauaaug

SEQ ID NO: 748802 - RNA, 19 nt, Homo sapiens
acaaagaaauccagaugau

SEQ ID NO: 748803 - RNA, 19 nt, Homo sapiens
cagagaaagauccaaauaa

SEQ ID NO: 748804 - RNA, 19 nt, Homo sapiens
ugaggcagguguacugaaa

SEQ ID NO: 748805 - RNA, 19 nt, Homo sapiens
uacaauaucuggauccaau

SEQ ID NO: 748806 - RNA, 19 nt, Homo sapiens
gugcuagacuucuggacua

SEQ ID NO: 748807 - RNA, 19 nt, Homo sapiens
ggacaggaagcccaagaaa

SEQ ID NO: 748808 - RNA, 19 nt, Homo sapiens
ucagauagccgagaagaaa

SEQ ID NO: 748809 - RNA, 19 nt, Homo sapiens
gguagaggaucccgacaug

SEQ ID NO: 748810 - RNA, 19 nt, Homo sapiens
caagaaagacuggauacuu

SEQ ID NO: 748811 - RNA, 19 nt, Homo sapiens
aaaccucaguuccaauauu

SEQ ID NO: 748812 - RNA, 19 nt, Homo sapiens
uaaaaucccuuucaucuuc

SEQ ID NO: 748813 - RNA, 19 nt, Homo sapiens
gcaaauacaggaaggaagu

SEQ ID NO: 748814 - RNA, 19 nt, Homo sapiens
ggaaggaaguacaacaaaa

SEQ ID NO: 748815 - RNA, 19 nt, Homo sapiens
ggacaggaagcccagguaa

SEQ ID NO: 748816 - RNA, 19 nt, Homo sapiens
gccauugccuaaacagauu

SEQ ID NO: 748817 - RNA, 19 nt, Homo sapiens
gaagagugagucaggugua

SEQ ID NO: 748818 - RNA, 19 nt, Homo sapiens
caggagccaugaugcaauu

SEQ ID NO: 748819 - RNA, 19 nt, Homo sapiens
guaagcaaagugaaaugua

SEQ ID NO: 748820 - RNA, 19 nt, Homo sapiens
gcuuaggucugaucaaucu

SEQ ID NO: 748821 - RNA, 19 nt, Homo sapiens
cuagacuucuggacuauga

SEQ ID NO: 748822 - RNA, 19 nt, Homo sapiens
aaagagagaaucagaaauc

SEQ ID NO: 748823 - RNA, 19 nt, Homo sapiens
gaagagugaggcaggugua

SEQ ID NO: 748824 - RNA, 19 nt, Homo sapiens
ugacuccugugguuauauu

SEQ ID NO: 748825 - RNA, 19 nt, Homo sapiens
gaaccuccuuccagaacug

SEQ ID NO: 748826 - RNA, 19 nt, Homo sapiens
aaaggaaaggacaaaguua

SEQ ID NO: 748827 - RNA, 19 nt, Homo sapiens
gaagagugaguugaaggua

SEQ ID NO: 748828 - RNA, 19 nt, Homo sapiens
guaaucccaucauuugcuu

SEQ ID NO: 748829 - RNA, 19 nt, Homo sapiens
aaacaaggaagcaacuaaa

SEQ ID NO: 748830 - RNA, 19 nt, Homo sapiens
cagguuacauggacgaaga

SEQ ID NO: 748831 - RNA, 19 nt, Homo sapiens
cgacaugcauaucaacaca

SEQ ID NO: 748832 - RNA, 19 nt, Homo sapiens
ugaagacaauacauggaaa

SEQ ID NO: 748833 - RNA, 19 nt, Homo sapiens
cacaaucacuggucaccuu

SEQ ID NO: 748834 - RNA, 19 nt, Homo sapiens
gcacugucucgaucaagua

SEQ ID NO: 748835 - RNA, 19 nt, Homo sapiens
acaaaccucaguuccaaua

SEQ ID NO: 748836 - RNA, 19 nt, Homo sapiens
gaaaggacaaaguuaaagg

SEQ ID NO: 748837 - RNA, 19 nt, Homo sapiens
caaggauccaugaguagua

SEQ ID NO: 748838 - RNA, 19 nt, Homo sapiens
ucgaucaaguauugcuuua

SEQ ID NO: 748839 - RNA, 19 nt, Homo sapiens
cgacguaagcaaagugaaa

SEQ ID NO: 748840 - RNA, 19 nt, Homo sapiens
gaaaaugacagucuuggaa

SEQ ID NO: 748841 - RNA, 19 nt, Homo sapiens
gaaagagagaaucagaaau

SEQ ID NO: 748842 - RNA, 19 nt, Homo sapiens
ggacaagaaggccaaguag

SEQ ID NO: 748843 - RNA, 19 nt, Homo sapiens
agacagugacgcuggaaua

SEQ ID NO: 748844 - RNA, 19 nt, Homo sapiens
cauaaaggagccagaaaga

SEQ ID NO: 748845 - RNA, 19 nt, Homo sapiens
ucaaucugcuccacacaau

SEQ ID NO: 748846 - RNA, 19 nt, Homo sapiens
gcauaucaacacaaaguga

SEQ ID NO: 748847 - RNA, 19 nt, Homo sapiens
cauccuggcuauuuuguua

SEQ ID NO: 748848 - RNA, 19 nt, Homo sapiens
gaagaguggguugguugua

SEQ ID NO: 748849 - RNA, 19 nt, Homo sapiens
gacaggaaacccaacuaaa

SEQ ID NO: 748850 - RNA, 19 nt, Homo sapiens
gacaaagaaauccagauga

SEQ ID NO: 748851 - RNA, 19 nt, Homo sapiens
gcucagaaacagugaacuu

SEQ ID NO: 748852 - RNA, 19 nt, Homo sapiens
uaaaggaaagagagaauca

SEQ ID NO: 748853 - RNA, 19 nt, Homo sapiens
gaccagaaucccaaguaaa

SEQ ID NO: 748854 - RNA, 19 nt, Homo sapiens
gaaaaggcacugauuuaga

SEQ ID NO: 748855 - RNA, 19 nt, Homo sapiens
ugacaaagaaauccagaug

SEQ ID NO: 748856 - RNA, 19 nt, Homo sapiens
gaggugaguguaccagaaa

SEQ ID NO: 748857 - RNA, 19 nt, Homo sapiens
ugaaaucagcacacauaaa

SEQ ID NO: 748858 - RNA, 19 nt, Homo sapiens
cuugaaaucagcacacaua

SEQ ID NO: 748859 - RNA, 19 nt, Homo sapiens
gaggaucccgacaugcaua

SEQ ID NO: 748860 - RNA, 19 nt, Homo sapiens
aaccucaguuccaauauug

SEQ ID NO: 748861 - RNA, 19 nt, Homo sapiens
gcccauaagacaagugauu

SEQ ID NO: 748862 - RNA, 19 nt, Homo sapiens
ugaggugaguguaccagaa

SEQ ID NO: 748863 - RNA, 19 nt, Homo sapiens
guacugaaaggaccagaau

SEQ ID NO: 748864 - RNA, 19 nt, Homo sapiens
caagaaggccaaguagaga

SEQ ID NO: 748865 - RNA, 19 nt, Homo sapiens
uaaagaagagggagucagu

SEQ ID NO: 748866 - RNA, 19 nt, Homo sapiens
ugagaugggugugccaaga

SEQ ID NO: 748867 - RNA, 19 nt, Homo sapiens
acagggagcccaaauaaag

SEQ ID NO: 748868 - RNA, 19 nt, Homo sapiens
acaaacaacugaagaaccu

SEQ ID NO: 748869 - RNA, 19 nt, Homo sapiens
gaucaaguauugcuuuacc

SEQ ID NO: 748870 - RNA, 19 nt, Homo sapiens
aaagaacacugaggugagu

SEQ ID NO: 748871 - RNA, 19 nt, Homo sapiens
gaagagaucuauuuacaga

SEQ ID NO: 748872 - RNA, 19 nt, Homo sapiens
gagaagagaucuauuuaca

SEQ ID NO: 748873 - RNA, 19 nt, Homo sapiens
ugacaugagugcauuagua

SEQ ID NO: 748874 - RNA, 19 nt, Homo sapiens
ucaaauagccacauuguuu

SEQ ID NO: 748875 - RNA, 19 nt, Homo sapiens
gaccauaccuaauauuguu

SEQ ID NO: 748876 - RNA, 19 nt, Homo sapiens
gauacuaguugucugaauu

SEQ ID NO: 748877 - RNA, 19 nt, Homo sapiens
gagcagcacucacaucuca

SEQ ID NO: 748878 - RNA, 19 nt, Homo sapiens
ggaaacuucugcuucacua

SEQ ID NO: 748879 - RNA, 19 nt, Homo sapiens
gagagaagagaucuauuua

SEQ ID NO: 748880 - RNA, 19 nt, Homo sapiens
uaacacagguggagugguu

SEQ ID NO: 748881 - RNA, 19 nt, Homo sapiens
gaaaggauggaauggcuua

SEQ ID NO: 748882 - RNA, 19 nt, Homo sapiens
gagcaaauguaguagauag

SEQ ID NO: 748883 - RNA, 19 nt, Homo sapiens
ggcauaaacuggcuucuga

SEQ ID NO: 748884 - RNA, 19 nt, Homo sapiens
gaagaggugcuuuggcaua

SEQ ID NO: 748885 - RNA, 19 nt, Homo sapiens
gcacaauacugggcaauuc

SEQ ID NO: 748886 - RNA, 19 nt, Homo sapiens
ucauagaacuguuucagaa

SEQ ID NO: 748887 - RNA, 19 nt, Homo sapiens
agacuagaguuuaagcuua

SEQ ID NO: 748888 - RNA, 19 nt, Homo sapiens
auacagagcucuaugugaa

SEQ ID NO: 748889 - RNA, 19 nt, Homo sapiens
gaauaaaacugucaugguu

SEQ ID NO: 748890 - RNA, 19 nt, Homo sapiens
gauguaggcuaacaaugaa

SEQ ID NO: 748891 - RNA, 19 nt, Homo sapiens
gggcaauccuuuacuauuc

SEQ ID NO: 748892 - RNA, 19 nt, Homo sapiens
uaaccaauauacccucuuu

SEQ ID NO: 748893 - RNA, 19 nt, Homo sapiens
gcagaaauuucaccuccaa

SEQ ID NO: 748894 - RNA, 19 nt, Homo sapiens
gaccaaagacuagaguuua

SEQ ID NO: 748895 - RNA, 19 nt, Homo sapiens
uaccagggcuuaaauguug

SEQ ID NO: 748896 - RNA, 19 nt, Homo sapiens
gagaggauauuuaugucaa

SEQ ID NO: 748897 - RNA, 19 nt, Homo sapiens
caagagaggauauuuaugu

SEQ ID NO: 748898 - RNA, 19 nt, Homo sapiens
uguaguagauagucgaaua

SEQ ID NO: 748899 - RNA, 19 nt, Homo sapiens
agaucgaccucuuaacuua

SEQ ID NO: 748900 - RNA, 19 nt, Homo sapiens
caacgauggcuuccaauaa

SEQ ID NO: 748901 - RNA, 19 nt, Homo sapiens
gcaauucagagcaugguua

SEQ ID NO: 748902 - RNA, 19 nt, Homo sapiens
gaaccagccuuucaaacag

SEQ ID NO: 748903 - RNA, 19 nt, Homo sapiens
gagaguuuaccaacaaaua

SEQ ID NO: 748904 - RNA, 19 nt, Homo sapiens
gacucuaacugguuuauau

SEQ ID NO: 748905 - RNA, 19 nt, Homo sapiens
gugaugagauugacuguag

SEQ ID NO: 748906 - RNA, 19 nt, Homo sapiens
caucccaggucuagccuua

SEQ ID NO: 748907 - RNA, 19 nt, Homo sapiens
gaaauuucaccuccaaguu

SEQ ID NO: 748908 - RNA, 19 nt, Homo sapiens
aagaauaccuggcaguaga

SEQ ID NO: 748909 - RNA, 19 nt, Homo sapiens
aauauugacugcagugauu

SEQ ID NO: 748910 - RNA, 19 nt, Homo sapiens
gaaggcacccaauaacuau

SEQ ID NO: 748911 - RNA, 19 nt, Homo sapiens
caaguucccaagacaaaua

SEQ ID NO: 748912 - RNA, 19 nt, Homo sapiens
ccugcucucuuuacacuua

SEQ ID NO: 748913 - RNA, 19 nt, Homo sapiens
gcagcugugccaucaaaua

SEQ ID NO: 748914 - RNA, 19 nt, Homo sapiens
gcuaggaggccacgauaaa

SEQ ID NO: 748915 - RNA, 19 nt, Homo sapiens
gaugguaggguagaaauuu

SEQ ID NO: 748916 - RNA, 19 nt, Homo sapiens
gauggaauggcuuaaguaa

SEQ ID NO: 748917 - RNA, 19 nt, Homo sapiens
caaauggagcaaacaaauu

SEQ ID NO: 748918 - RNA, 19 nt, Homo sapiens
gcuuaaauguugugucuag

SEQ ID NO: 748919 - RNA, 19 nt, Homo sapiens
acucaugcauggaucuuua

SEQ ID NO: 748920 - RNA, 19 nt, Homo sapiens
gacuagaguuuaagcuuau

SEQ ID NO: 748921 - RNA, 19 nt, Homo sapiens
ugaaagugguggcauagga

SEQ ID NO: 748922 - RNA, 19 nt, Homo sapiens
ggaaagaaugucacacuca

SEQ ID NO: 748923 - RNA, 19 nt, Homo sapiens
gauaaacaggauacgauaa

SEQ ID NO: 748924 - RNA, 19 nt, Homo sapiens
uggaauggcuuaaguaaac

SEQ ID NO: 748925 - RNA, 19 nt, Homo sapiens
gggcuuaaauguugugucu

SEQ ID NO: 748926 - RNA, 19 nt, Homo sapiens
gacaugagugcauuaguaa

SEQ ID NO: 748927 - RNA, 19 nt, Homo sapiens
caagacaaauagugagcaa

SEQ ID NO: 748928 - RNA, 19 nt, Homo sapiens
gaacuuggcagaaggugau

SEQ ID NO: 748929 - RNA, 19 nt, Homo sapiens
gaaugccucugaagaugau

SEQ ID NO: 748930 - RNA, 19 nt, Homo sapiens
gcauacaucaguucccuuu

SEQ ID NO: 748931 - RNA, 19 nt, Homo sapiens
gcacucacaucucaagaac

SEQ ID NO: 748932 - RNA, 19 nt, Homo sapiens
gggauggauucuagaaaug

SEQ ID NO: 748933 - RNA, 19 nt, Homo sapiens
agagagaagagaucuauuu

SEQ ID NO: 748934 - RNA, 19 nt, Homo sapiens
gcaguagaagaaaugaaua

SEQ ID NO: 748935 - RNA, 19 nt, Homo sapiens
caugcaggcuuuccucuug

SEQ ID NO: 748936 - RNA, 19 nt, Homo sapiens
ugaguuacuuugauaggaa

SEQ ID NO: 748937 - RNA, 19 nt, Homo sapiens
gagaccauaccuaauauug

SEQ ID NO: 748938 - RNA, 19 nt, Homo sapiens
acaaagacagcccuaauga

SEQ ID NO: 748939 - RNA, 19 nt, Homo sapiens
uaaacuggcuucugaaucc

SEQ ID NO: 748940 - RNA, 19 nt, Homo sapiens
acacagaaggcacccaaua

SEQ ID NO: 748941 - RNA, 19 nt, Homo sapiens
ggaaugccucugaagauga

SEQ ID NO: 748942 - RNA, 19 nt, Homo sapiens
ccaauaacaugacucuuuu

SEQ ID NO: 748943 - RNA, 19 nt, Homo sapiens
ucaggcaccuaguuauuau

SEQ ID NO: 748944 - RNA, 19 nt, Homo sapiens
gaguuuaagcuuauucuug

SEQ ID NO: 748945 - RNA, 19 nt, Homo sapiens
gaauguguguauccaucaa

SEQ ID NO: 748946 - RNA, 19 nt, Homo sapiens
gacaaagacagcccuaaug

SEQ ID NO: 748947 - RNA, 19 nt, Homo sapiens
agagggcaauccuuuacua

SEQ ID NO: 748948 - RNA, 19 nt, Homo sapiens
agaaggcacccaauaacua

SEQ ID NO: 748949 - RNA, 19 nt, Homo sapiens
uagagaccauaccuaauau

SEQ ID NO: 748950 - RNA, 19 nt, Homo sapiens
aaagacagcccuaaugaca

SEQ ID NO: 748951 - RNA, 19 nt, Homo sapiens
caagaaccagccuuucaaa

SEQ ID NO: 748952 - RNA, 19 nt, Homo sapiens
ggucaggcaccuaguuauu

SEQ ID NO: 748953 - RNA, 19 nt, Homo sapiens
gcgagagggcaauccuuua

SEQ ID NO: 748954 - RNA, 19 nt, Homo sapiens
uaaguaaacuaaggguuca

SEQ ID NO: 748955 - RNA, 19 nt, Homo sapiens
ggauggaauggcuuaagua

SEQ ID NO: 748956 - RNA, 19 nt, Homo sapiens
caacaugaccagaaaggau

SEQ ID NO: 748957 - RNA, 19 nt, Homo sapiens
ggucuuggccucacucuca

SEQ ID NO: 748958 - RNA, 19 nt, Homo sapiens
gauacaagagaggauauuu

SEQ ID NO: 748959 - RNA, 19 nt, Homo sapiens
gcuccugcagugcuaauua

SEQ ID NO: 748960 - RNA, 19 nt, Homo sapiens
ugaaauaugggauggauuc

SEQ ID NO: 748961 - RNA, 19 nt, Homo sapiens
accaaagacuagaguuuaa

SEQ ID NO: 748962 - RNA, 19 nt, Homo sapiens
gaugauacaagagaggaua

SEQ ID NO: 748963 - RNA, 19 nt, Homo sapiens
cccaauaacuauagaaguc

SEQ ID NO: 748964 - RNA, 19 nt, Homo sapiens
cacagaaggcacccaauaa

SEQ ID NO: 748965 - RNA, 19 nt, Homo sapiens
cgauaaacaggauacgaua

SEQ ID NO: 748966 - RNA, 19 nt, Homo sapiens
caaauagccacauuguuuc

SEQ ID NO: 748967 - RNA, 19 nt, Homo sapiens
agauguaggcuaacaauga

SEQ ID NO: 748968 - RNA, 19 nt, Homo sapiens
agacagcccuaaugacauc

SEQ ID NO: 748969 - RNA, 19 nt, Homo sapiens
aauaugggauggauucuag

SEQ ID NO: 748970 - RNA, 19 nt, Homo sapiens
cagaugggaagaagcguua

SEQ ID NO: 748971 - RNA, 19 nt, Homo sapiens
ggacaacuauuaccugaau

SEQ ID NO: 748972 - RNA, 19 nt, Homo sapiens
gagaugagcuggagauaag

SEQ ID NO: 748973 - RNA, 19 nt, Homo sapiens
ggaaaagguugaucucaua

SEQ ID NO: 748974 - RNA, 19 nt, Homo sapiens
gaucaacuuucauggagaa

SEQ ID NO: 748975 - RNA, 19 nt, Homo sapiens
gaacaacaacuggucaauu

SEQ ID NO: 748976 - RNA, 19 nt, Homo sapiens
gcaaauauccggcugugau

SEQ ID NO: 748977 - RNA, 19 nt, Homo sapiens
uaagauggguagacugcua

SEQ ID NO: 748978 - RNA, 19 nt, Homo sapiens
gagaaagccugcagcucuu

SEQ ID NO: 748979 - RNA, 19 nt, Homo sapiens
ugaguuauuugcugguaua

SEQ ID NO: 748980 - RNA, 19 nt, Homo sapiens
ggagaggugcccaugcaua

SEQ ID NO: 748981 - RNA, 19 nt, Homo sapiens
gaggagaccugguggaaaa

SEQ ID NO: 748982 - RNA, 19 nt, Homo sapiens
aacaacaacuggucaauuc

SEQ ID NO: 748983 - RNA, 19 nt, Homo sapiens
ggaagguccucaccagagu

SEQ ID NO: 748984 - RNA, 19 nt, Homo sapiens
caauucagcuggugcucaa

SEQ ID NO: 748985 - RNA, 19 nt, Homo sapiens
guucugaugucaccacuuc

SEQ ID NO: 748986 - RNA, 19 nt, Homo sapiens
caacuuucauggagaaugg

SEQ ID NO: 748987 - RNA, 19 nt, Homo sapiens
ggagaugagcuggagauaa

SEQ ID NO: 748988 - RNA, 19 nt, Homo sapiens
uuacacauccuuccuuuga

SEQ ID NO: 748989 - RNA, 19 nt, Homo sapiens
gagaggugcccaugcauau

SEQ ID NO: 748990 - RNA, 19 nt, Homo sapiens
gagauaagauggguagacu

SEQ ID NO: 748991 - RNA, 19 nt, Homo sapiens
ccgugaagcuuguagaguu

SEQ ID NO: 748992 - RNA, 19 nt, Homo sapiens
uagaaaggcuagccaugau

SEQ ID NO: 748993 - RNA, 19 nt, Homo sapiens
ggagaucaacuuucaugga

SEQ ID NO: 748994 - RNA, 19 nt, Homo sapiens
ucccagcacuacccuauuu

SEQ ID NO: 748995 - RNA, 19 nt, Homo sapiens
agauggagaucaacuuuca

SEQ ID NO: 748996 - RNA, 19 nt, Homo sapiens
acacauccuuccuuugaga

SEQ ID NO: 748997 - RNA, 19 nt, Homo sapiens
gcucugcgcauaaacaaga

SEQ ID NO: 748998 - RNA, 19 nt, Homo sapiens
gcuccaggauuugcugaaa

SEQ ID NO: 748999 - RNA, 19 nt, Homo sapiens
cgugaagcuuguagaguuu

SEQ ID NO: 749000 - RNA, 19 nt, Homo sapiens
uauaaaggauggagaaagc

SEQ ID NO: 749001 - RNA, 19 nt, Homo sapiens
gagggcagguucugauguc

SEQ ID NO: 749002 - RNA, 19 nt, Homo sapiens
cgaccuggcagaacuuuga

SEQ ID NO: 749003 - RNA, 19 nt, Homo sapiens
cugaagcaguucuguguau

SEQ ID NO: 749004 - RNA, 19 nt, Homo sapiens
caggagaggugcccaugca

SEQ ID NO: 749005 - RNA, 19 nt, Homo sapiens
gggcaucaaucaucuuuug

SEQ ID NO: 749006 - RNA, 19 nt, Homo sapiens
aggauuugcugaaagagaa

SEQ ID NO: 749007 - RNA, 19 nt, Homo sapiens
ugagauggagaucaacuuu

SEQ ID NO: 749008 - RNA, 19 nt, Homo sapiens
cuacaggcgugaccagauc

SEQ ID NO: 749009 - RNA, 19 nt, Homo sapiens
ucaaggagagggugaagga

SEQ ID NO: 749010 - RNA, 19 nt, Homo sapiens
cuuguagaguuugaucuua

SEQ ID NO: 749011 - RNA, 19 nt, Homo sapiens
gguggugggugaugucuac

SEQ ID NO: 749012 - RNA, 19 nt, Homo sapiens
ucuacgacaucccugauau

SEQ ID NO: 749013 - RNA, 19 nt, Homo sapiens
caugaguuauuugcuggua

SEQ ID NO: 749014 - RNA, 19 nt, Homo sapiens
ggaggagaccugguggaaa

SEQ ID NO: 749015 - RNA, 19 nt, Homo sapiens
gaggugcccaugcauaugu

SEQ ID NO: 749016 - RNA, 19 nt, Homo sapiens
cuccaagcaugaguuauuu

SEQ ID NO: 749017 - RNA, 19 nt, Homo sapiens
gaugucaccacuucacuca

SEQ ID NO: 749018 - RNA, 19 nt, Homo sapiens
uuagaaaggcuagccauga

SEQ ID NO: 749019 - RNA, 19 nt, Homo sapiens
agaguuugaucuuaagcaa

SEQ ID NO: 749020 - RNA, 19 nt, Homo sapiens
uuaaucagaaggugaaguu

SEQ ID NO: 749021 - RNA, 19 nt, Homo sapiens
gccugcagcucuuugaaca

SEQ ID NO: 749022 - RNA, 19 nt, Homo sapiens
ucuccaagcaugaguuauu

SEQ ID NO: 749023 - RNA, 19 nt, Homo sapiens
gcacuucuacaagcaguau

SEQ ID NO: 749024 - RNA, 19 nt, Homo sapiens
agauaugguuugugaacug

SEQ ID NO: 749025 - RNA, 19 nt, Homo sapiens
uccaggauuugcugaaaga

SEQ ID NO: 749026 - RNA, 19 nt, Homo sapiens
ggagaauggcuggaaguuc

SEQ ID NO: 749027 - RNA, 19 nt, Homo sapiens
gaguaaggccagucacauc

SEQ ID NO: 749028 - RNA, 19 nt, Homo sapiens
ucacguaccgccacaugga

SEQ ID NO: 749029 - RNA, 19 nt, Homo sapiens
gaucucauagacaaguuug

SEQ ID NO: 749030 - RNA, 19 nt, Homo sapiens
gaagguccucaccagaguu

SEQ ID NO: 749031 - RNA, 19 nt, Homo sapiens
ugaagcuuguagaguuuga

SEQ ID NO: 749032 - RNA, 19 nt, Homo sapiens
aaagguugaucucauagac

SEQ ID NO: 749033 - RNA, 19 nt, Homo sapiens
caaauauccggcugugauc

SEQ ID NO: 749034 - RNA, 19 nt, Homo sapiens
guuucagccucuuagcaaa

SEQ ID NO: 749035 - RNA, 19 nt, Homo sapiens
gagauggagaucaacuuuc

SEQ ID NO: 749036 - RNA, 19 nt, Homo sapiens
agagagaggucaggcacau

SEQ ID NO: 749037 - RNA, 19 nt, Homo sapiens
agguugaucucauagacaa

SEQ ID NO: 749038 - RNA, 19 nt, Homo sapiens
ggaacaacaacuggucaau

SEQ ID NO: 749039 - RNA, 19 nt, Homo sapiens
ggagggcagguucugaugu

SEQ ID NO: 749040 - RNA, 19 nt, Homo sapiens
gguugcccucugagaauua

SEQ ID NO: 749041 - RNA, 19 nt, Homo sapiens
ggcuagccaugauccucua

SEQ ID NO: 749042 - RNA, 19 nt, Homo sapiens
ggugauggaacaacaacug

SEQ ID NO: 749043 - RNA, 19 nt, Homo sapiens
gcagagugugccacccaaa

SEQ ID NO: 749044 - RNA, 19 nt, Homo sapiens
aaagauaugguuugugaac

SEQ ID NO: 749045 - RNA, 19 nt, Homo sapiens
uucagccucuuagcaaaua

SEQ ID NO: 749046 - RNA, 19 nt, Homo sapiens
guauccaacauuaaucaga

SEQ ID NO: 749047 - RNA, 19 nt, Homo sapiens
uucuguguauccaacauua

SEQ ID NO: 749048 - RNA, 19 nt, Homo sapiens
gcuuguagaguuugaucuu

SEQ ID NO: 749049 - RNA, 19 nt, Homo sapiens
gguauaaaggauggagaaa

SEQ ID NO: 749050 - RNA, 19 nt, Homo sapiens
augucuaccuggugaguaa

SEQ ID NO: 749051 - RNA, 19 nt, Homo sapiens
ugaagcaguucuguguauc

SEQ ID NO: 749052 - RNA, 19 nt, Homo sapiens
caacaacuggucaauucag

SEQ ID NO: 749053 - RNA, 19 nt, Homo sapiens
cauucugguugcccucuga

SEQ ID NO: 749054 - RNA, 19 nt, Homo sapiens
aaucagaaggugaaguuuc

SEQ ID NO: 749055 - RNA, 19 nt, Homo sapiens
gaugagcuggagauaagau

SEQ ID NO: 749056 - RNA, 19 nt, Homo sapiens
guauaaaggauggagaaag

SEQ ID NO: 749057 - RNA, 19 nt, Homo sapiens
gaucgacucccagcacuac

SEQ ID NO: 749058 - RNA, 19 nt, Homo sapiens
ucaccagaguuggcaggaa

SEQ ID NO: 749059 - RNA, 19 nt, Homo sapiens
cgaaucggcugggcuuuug

SEQ ID NO: 749060 - RNA, 19 nt, Homo sapiens
ggagauaagauggguagac

SEQ ID NO: 749061 - RNA, 19 nt, Homo sapiens
gaauuacgcagaaaaugau

SEQ ID NO: 749062 - RNA, 19 nt, Homo sapiens
acauuaaucagaaggugaa

SEQ ID NO: 749063 - RNA, 19 nt, Homo sapiens
ccugauauccgucucuucu

SEQ ID NO: 749064 - RNA, 19 nt, Homo sapiens
ggauuugcugaaagagaaa

SEQ ID NO: 749065 - RNA, 19 nt, Homo sapiens
ggucuacgacaaccuuucu

SEQ ID NO: 749066 - RNA, 19 nt, Homo sapiens
ccaugauccucuacgacau

SEQ ID NO: 749067 - RNA, 19 nt, Homo sapiens
uagccaugauccucuacga

SEQ ID NO: 749068 - RNA, 19 nt, Homo sapiens
uguagaguuugaucuuaag

SEQ ID NO: 749069 - RNA, 19 nt, Homo sapiens
gaagauagccuccuuacau

SEQ ID NO: 749070 - RNA, 19 nt, Homo sapiens
uaaacuauccugcagaaua

SEQ ID NO: 749071 - RNA, 19 nt, Homo sapiens
gaagacaucguaacacuga

SEQ ID NO: 749072 - RNA, 19 nt, Homo sapiens
gaauccaucuguguugaua

SEQ ID NO: 749073 - RNA, 19 nt, Homo sapiens
gaccuuagcugaugaggau

SEQ ID NO: 749074 - RNA, 19 nt, Homo sapiens
gacaacagauugccuugaa

SEQ ID NO: 749075 - RNA, 19 nt, Homo sapiens
gaucuuggaauucaucaua

SEQ ID NO: 749076 - RNA, 19 nt, Homo sapiens
aaacuauccugcagaauau

SEQ ID NO: 749077 - RNA, 19 nt, Homo sapiens
ugguaacgcuuuaugaaua

SEQ ID NO: 749078 - RNA, 19 nt, Homo sapiens
guacugaccaucaaugaaa

SEQ ID NO: 749079 - RNA, 19 nt, Homo sapiens
uaacauggaaucuacagua

SEQ ID NO: 749080 - RNA, 19 nt, Homo sapiens
ggauagcaaagaagaaaua

SEQ ID NO: 749081 - RNA, 19 nt, Homo sapiens
caucuguguugauacaaua

SEQ ID NO: 749082 - RNA, 19 nt, Homo sapiens
caacaauuccucuucagaa

SEQ ID NO: 749083 - RNA, 19 nt, Homo sapiens
gaggaugaccgggaaauuu

SEQ ID NO: 749084 - RNA, 19 nt, Homo sapiens
aagaugcucuguauaguga

SEQ ID NO: 749085 - RNA, 19 nt, Homo sapiens
uauaaacuauccugcagaa

SEQ ID NO: 749086 - RNA, 19 nt, Homo sapiens
ugaagacuuugguacagua

SEQ ID NO: 749087 - RNA, 19 nt, Homo sapiens
gcagaagcauguuuauugc

SEQ ID NO: 749088 - RNA, 19 nt, Homo sapiens
cagauugccuugaagauag

SEQ ID NO: 749089 - RNA, 19 nt, Homo sapiens
caagaauccuuuuggcuua

SEQ ID NO: 749090 - RNA, 19 nt, Homo sapiens
gcauaaccuugacaacaga

SEQ ID NO: 749091 - RNA, 19 nt, Homo sapiens
uaugguacuuggaugauaa

SEQ ID NO: 749092 - RNA, 19 nt, Homo sapiens
caaggucaauuucaugauc

SEQ ID NO: 749093 - RNA, 19 nt, Homo sapiens
gaagaugcucuguauagug

SEQ ID NO: 749094 - RNA, 19 nt, Homo sapiens
guauugggaugguuugguu

SEQ ID NO: 749095 - RNA, 19 nt, Homo sapiens
ccugauggcugcgguguuu

SEQ ID NO: 749096 - RNA, 19 nt, Homo sapiens
agaaauugaugaucuugga

SEQ ID NO: 749097 - RNA, 19 nt, Homo sapiens
guaugguacuuggaugaua

SEQ ID NO: 749098 - RNA, 19 nt, Homo sapiens
cuaaagaugcagaaauuga

SEQ ID NO: 749099 - RNA, 19 nt, Homo sapiens
agagcaagauaaagacaaa

SEQ ID NO: 749100 - RNA, 19 nt, Homo sapiens
gaaauauauugccaguuac

SEQ ID NO: 749101 - RNA, 19 nt, Homo sapiens
caacagauugccuugaaga

SEQ ID NO: 749102 - RNA, 19 nt, Homo sapiens
gauaaagacaaaccgaaga

SEQ ID NO: 749103 - RNA, 19 nt, Homo sapiens
uaugaauacucgccgcuuu

SEQ ID NO: 749104 - RNA, 19 nt, Homo sapiens
cuacaguacugaccaucaa

SEQ ID NO: 749105 - RNA, 19 nt, Homo sapiens
gggacucucugaaagugaa

SEQ ID NO: 749106 - RNA, 19 nt, Homo sapiens
gcauguuuauugcuucaga

SEQ ID NO: 749107 - RNA, 19 nt, Homo sapiens
gaauucaucauaacaugga

SEQ ID NO: 749108 - RNA, 19 nt, Homo sapiens
uagaagaugcucuguauag

SEQ ID NO: 749109 - RNA, 19 nt, Homo sapiens
aagauagccuccuuacaug

SEQ ID NO: 749110 - RNA, 19 nt, Homo sapiens
ggcauaaccuugacaacag

SEQ ID NO: 749111 - RNA, 19 nt, Homo sapiens
caaaugagacaagucaaga

SEQ ID NO: 749112 - RNA, 19 nt, Homo sapiens
gaccgggaaauuuaugaua

SEQ ID NO: 749113 - RNA, 19 nt, Homo sapiens
cauggaaucuacaguacug

SEQ ID NO: 749114 - RNA, 19 nt, Homo sapiens
caucauaacauggaaucua

SEQ ID NO: 749115 - RNA, 19 nt, Homo sapiens
gcaaggacuguguuguuug

SEQ ID NO: 749116 - RNA, 19 nt, Homo sapiens
ccgggaaauuuaugauauu

SEQ ID NO: 749117 - RNA, 19 nt, Homo sapiens
aggaugaccgggaaauuua

SEQ ID NO: 749118 - RNA, 19 nt, Homo sapiens
auuagaagaugcucuguau

SEQ ID NO: 749119 - RNA, 19 nt, Homo sapiens
gaucacuaauccaucuuca

SEQ ID NO: 749120 - RNA, 19 nt, Homo sapiens
gguaacgcuuuaugaauac

SEQ ID NO: 749121 - RNA, 19 nt, Homo sapiens
gcaaaugagacaagucaag

SEQ ID NO: 749122 - RNA, 19 nt, Homo sapiens
gaaauugaugaucuuggaa

SEQ ID NO: 749123 - RNA, 19 nt, Homo sapiens
cagcaaggacuguguuguu

SEQ ID NO: 749124 - RNA, 19 nt, Homo sapiens
guacccagaucucgcuauc

SEQ ID NO: 749125 - RNA, 19 nt, Homo sapiens
ugcagaagcauguuuauug

SEQ ID NO: 749126 - RNA, 19 nt, Homo sapiens
cuacaucgcgguggucuuu

SEQ ID NO: 749127 - RNA, 19 nt, Homo sapiens
acagauugccuugaagaua

SEQ ID NO: 749128 - RNA, 19 nt, Homo sapiens
ccagaucucgcuauccauu

SEQ ID NO: 749129 - RNA, 19 nt, Homo sapiens
gcugcgguguuucugguaa

SEQ ID NO: 749130 - RNA, 19 nt, Homo sapiens
gauguuccaguaauucuga

SEQ ID NO: 749131 - RNA, 19 nt, Homo sapiens
ucaauuacaacuggcauaa

SEQ ID NO: 749132 - RNA, 19 nt, Homo sapiens
gugaaugaauacuggaauc

SEQ ID NO: 749133 - RNA, 19 nt, Homo sapiens
caaggacuguguuguuugc

SEQ ID NO: 749134 - RNA, 19 nt, Homo sapiens
uaauccaucuucagcuuca

SEQ ID NO: 749135 - RNA, 19 nt, Homo sapiens
ugauucauauuccugauag

SEQ ID NO: 749136 - RNA, 19 nt, Homo sapiens
cuauugaccuuagcugaug

SEQ ID NO: 749137 - RNA, 19 nt, Homo sapiens
uauaugaagcucugcagaa

SEQ ID NO: 749138 - RNA, 19 nt, Homo sapiens
uggaauucaucauaacaug

SEQ ID NO: 749139 - RNA, 19 nt, Homo sapiens
agcaaggacuguguuguuu

SEQ ID NO: 749140 - RNA, 19 nt, Homo sapiens
guugggauguuccaguaau

SEQ ID NO: 749141 - RNA, 19 nt, Homo sapiens
caguucagcacaagaguuu

SEQ ID NO: 749142 - RNA, 19 nt, Homo sapiens
gcucaaggucaauuucaug

SEQ ID NO: 749143 - RNA, 19 nt, Homo sapiens
gaugcucuguauagugaau

SEQ ID NO: 749144 - RNA, 19 nt, Homo sapiens
uugaugaucuuggaauuca

SEQ ID NO: 749145 - RNA, 19 nt, Homo sapiens
gcagaaauugaugaucuug

SEQ ID NO: 749146 - RNA, 19 nt, Homo sapiens
gcaguuuguucaggaaucu

SEQ ID NO: 749147 - RNA, 19 nt, Homo sapiens
ugguugggauguuccagua

SEQ ID NO: 749148 - RNA, 19 nt, Homo sapiens
ccaaugugcaggcaguuug

SEQ ID NO: 749149 - RNA, 19 nt, Homo sapiens
ugagacaagucaagaaucc

SEQ ID NO: 749150 - RNA, 19 nt, Homo sapiens
cuacuaaagaugcagaaau

SEQ ID NO: 749151 - RNA, 19 nt, Homo sapiens
ccaacaauuccucuucaga

SEQ ID NO: 749152 - RNA, 19 nt, Homo sapiens
gagacccaguucagcacaa

SEQ ID NO: 749153 - RNA, 19 nt, Homo sapiens
guagcgcuauugaccuuag

SEQ ID NO: 749154 - RNA, 19 nt, Homo sapiens
agaagaugcucuguauagu

SEQ ID NO: 749155 - RNA, 19 nt, Homo sapiens
acuaauccaucuucagcuu

SEQ ID NO: 749156 - RNA, 19 nt, Homo sapiens
gacaagucaagaauccuuu

SEQ ID NO: 749157 - RNA, 19 nt, Homo sapiens
ucaggaaucuuuugcacuu

SEQ ID NO: 749158 - RNA, 19 nt, Homo sapiens
uuucagcagugcccaaugu

SEQ ID NO: 749159 - RNA, 19 nt, Homo sapiens
ugugaacuggguacucuua

SEQ ID NO: 749160 - RNA, 19 nt, Homo sapiens
gugauucauauuccugaua

SEQ ID NO: 749161 - RNA, 19 nt, Homo sapiens
ggaugaccgggaaauuuau

SEQ ID NO: 749162 - RNA, 19 nt, Homo sapiens
ccaucuguguugauacaau

SEQ ID NO: 749163 - RNA, 19 nt, Homo sapiens
ggucaauuucaugaucuua

SEQ ID NO: 749164 - RNA, 19 nt, Homo sapiens
ucuaucaggaacaguauuu

SEQ ID NO: 749165 - RNA, 19 nt, Homo sapiens
caacuggcauaaccuugac

SEQ ID NO: 749166 - RNA, 19 nt, Homo sapiens
augcagaaauugaugaucu

SEQ ID NO: 749167 - RNA, 19 nt, Homo sapiens
accgggaaauuuaugauau

SEQ ID NO: 749168 - RNA, 19 nt, Homo sapiens
acaacuggcauaaccuuga

SEQ ID NO: 749169 - RNA, 19 nt, Homo sapiens
gggaaacacuggagucuaa

SEQ ID NO: 749170 - RNA, 19 nt, Homo sapiens
gaacauaagcccugaagug

SEQ ID NO: 749171 - RNA, 19 nt, Homo sapiens
ggaaggcagucccuauuag

SEQ ID NO: 749172 - RNA, 19 nt, Homo sapiens
ggacaaggaccaucucugu

SEQ ID NO: 749173 - RNA, 19 nt, Homo sapiens
gagcugcuguccauguuga

SEQ ID NO: 749174 - RNA, 19 nt, Homo sapiens
gcagauuaccaauaaagaa

SEQ ID NO: 749175 - RNA, 19 nt, Homo sapiens
cugcugagcucaucaacuu

SEQ ID NO: 749176 - RNA, 19 nt, Homo sapiens
ggagaaugaugagaucuag

SEQ ID NO: 749177 - RNA, 19 nt, Homo sapiens
ggcagucccuauuagcuaa

SEQ ID NO: 749178 - RNA, 19 nt, Homo sapiens
ccaauaaagaacugaauga

SEQ ID NO: 749179 - RNA, 19 nt, Homo sapiens
ggcagaggcugauggagau

SEQ ID NO: 749180 - RNA, 19 nt, Homo sapiens
gaaacacuggagucuaaga

SEQ ID NO: 749181 - RNA, 19 nt, Homo sapiens
uggaaggcagucccuauua

SEQ ID NO: 749182 - RNA, 19 nt, Homo sapiens
cugcagagcuaccuaaagg

SEQ ID NO: 749183 - RNA, 19 nt, Homo sapiens
ggcagaggcuaaaggagau

SEQ ID NO: 749184 - RNA, 19 nt, Homo sapiens
ggacuaggaaggacagaag

SEQ ID NO: 749185 - RNA, 19 nt, Homo sapiens
caguagguaucaggucuuu

SEQ ID NO: 749186 - RNA, 19 nt, Homo sapiens
acacuggagucuaagaaca

SEQ ID NO: 749187 - RNA, 19 nt, Homo sapiens
gagaggaggccaaggaacu

SEQ ID NO: 749188 - RNA, 19 nt, Homo sapiens
guagguaucaggucuuucu

SEQ ID NO: 749189 - RNA, 19 nt, Homo sapiens
ucucagugccagaacauaa

SEQ ID NO: 749190 - RNA, 19 nt, Homo sapiens
cccaaaggauggagucaca

SEQ ID NO: 749191 - RNA, 19 nt, Homo sapiens
ccaacccggugauauugau

SEQ ID NO: 749192 - RNA, 19 nt, Homo sapiens
acucugaagugcagcauca

SEQ ID NO: 749193 - RNA, 19 nt, Homo sapiens
gauuaccaauaaagaacug

SEQ ID NO: 749194 - RNA, 19 nt, Homo sapiens
gggcagauuaccaauaaag

SEQ ID NO: 749195 - RNA, 19 nt, Homo sapiens
agauacagguacccacaga

SEQ ID NO: 749196 - RNA, 19 nt, Homo sapiens
guucuccucuaccucuuug

SEQ ID NO: 749197 - RNA, 19 nt, Homo sapiens
uaaguuaaggggcagauua

SEQ ID NO: 749198 - RNA, 19 nt, Homo sapiens
gaaauguacgcugggacaa

SEQ ID NO: 749199 - RNA, 19 nt, Homo sapiens
aaacacuggagucuaagaa

SEQ ID NO: 749200 - RNA, 19 nt, Homo sapiens
gcagaggccagggagaaug

SEQ ID NO: 749201 - RNA, 19 nt, Homo sapiens
agaaugaugagaucuagau

SEQ ID NO: 749202 - RNA, 19 nt, Homo sapiens
cuaaagggacuaggaagga

SEQ ID NO: 749203 - RNA, 19 nt, Homo sapiens
ugauauugauaguggacaa

SEQ ID NO: 749204 - RNA, 19 nt, Homo sapiens
ccaacucuccuaccaccaa

SEQ ID NO: 749205 - RNA, 19 nt, Homo sapiens
gaacacccaaaaugacuuu

SEQ ID NO: 749206 - RNA, 19 nt, Homo sapiens
ccagaagggagucuuugga

SEQ ID NO: 749207 - RNA, 19 nt, Homo sapiens
gcuaaaagcccauuaagac

SEQ ID NO: 749208 - RNA, 19 nt, Homo sapiens
ccaugacuaugaccagagu

SEQ ID NO: 749209 - RNA, 19 nt, Homo sapiens
ucuuugcccuccaugacua

SEQ ID NO: 749210 - RNA, 19 nt, Homo sapiens
gggagacccuaaguuaagg

SEQ ID NO: 749211 - RNA, 19 nt, Homo sapiens
caaaggauggagucacaag

SEQ ID NO: 749212 - RNA, 19 nt, Homo sapiens
caacccggugauauugaua

SEQ ID NO: 749213 - RNA, 19 nt, Homo sapiens
ggauguuaccuuugacgau

SEQ ID NO: 749214 - RNA, 19 nt, Homo sapiens
ggugcacauuguucaagug

SEQ ID NO: 749215 - RNA, 19 nt, Homo sapiens
cuaagaacacccaaaauga

SEQ ID NO: 749216 - RNA, 19 nt, Homo sapiens
cagaagggagucuuuggau

SEQ ID NO: 749217 - RNA, 19 nt, Homo sapiens
gauauugauaguggacaaa

SEQ ID NO: 749218 - RNA, 19 nt, Homo sapiens
ggcagauuaccaauaaaga

SEQ ID NO: 749219 - RNA, 19 nt, Homo sapiens
acuuugaggugcacauugu

SEQ ID NO: 749220 - RNA, 19 nt, Homo sapiens
ccaggcagaggcuaaagga

SEQ ID NO: 749221 - RNA, 19 nt, Homo sapiens
gaaggcagucccuauuagc

SEQ ID NO: 749222 - RNA, 19 nt, Homo sapiens
gcugccaacucuccuacca

SEQ ID NO: 749223 - RNA, 19 nt, Homo sapiens
gauacagguacccacagaa

SEQ ID NO: 749224 - RNA, 19 nt, Homo sapiens
aagcaaagggccagguaga

SEQ ID NO: 749225 - RNA, 19 nt, Homo sapiens
agaagcaaagggccaggua

SEQ ID NO: 749226 - RNA, 19 nt, Homo sapiens
gagaaugaugagaucuaga

SEQ ID NO: 749227 - RNA, 19 nt, Homo sapiens
uggagaaugaugagaucua

SEQ ID NO: 749228 - RNA, 19 nt, Homo sapiens
uuguucaaguggagaauga

SEQ ID NO: 749229 - RNA, 19 nt, Homo sapiens
gacgaugacaguguuaauc

SEQ ID NO: 749230 - RNA, 19 nt, Homo sapiens
ucggacuucugcagagcua

SEQ ID NO: 749231 - RNA, 19 nt, Homo sapiens
cagauuaccaauaaagaac

SEQ ID NO: 749232 - RNA, 19 nt, Homo sapiens
agaggcugauggagauguu

SEQ ID NO: 749233 - RNA, 19 nt, Homo sapiens
uaaaagcccauuaagacaa

SEQ ID NO: 749234 - RNA, 19 nt, Homo sapiens
caucaacuucccgggagua

SEQ ID NO: 749235 - RNA, 19 nt, Homo sapiens
gaauggggaugggcucaug

SEQ ID NO: 749236 - RNA, 19 nt, Homo sapiens
caacuucgcugcuuucauc

SEQ ID NO: 749237 - RNA, 19 nt, Homo sapiens
gagacaauaucuuccguaa

SEQ ID NO: 749238 - RNA, 19 nt, Homo sapiens
gagaugaaccucaggaauu

SEQ ID NO: 749239 - RNA, 19 nt, Homo sapiens
gaacucuccugacgccaaa

SEQ ID NO: 749240 - RNA, 19 nt, Homo sapiens
gagaagaucagcaacauca

SEQ ID NO: 749241 - RNA, 19 nt, Homo sapiens
gacaauaucuuccguaacg

SEQ ID NO: 749242 - RNA, 19 nt, Homo sapiens
aaacauuggacgcuauuua

SEQ ID NO: 749243 - RNA, 19 nt, Homo sapiens
agagcuacauucuugguua

SEQ ID NO: 749244 - RNA, 19 nt, Homo sapiens
uugcaaagacggaauguua

SEQ ID NO: 749245 - RNA, 19 nt, Homo sapiens
gcauggaaguuaggaauuc

SEQ ID NO: 749246 - RNA, 19 nt, Homo sapiens
caggacaccuucauggaaa

SEQ ID NO: 749247 - RNA, 19 nt, Homo sapiens
caaauacagccaugaagaa

SEQ ID NO: 749248 - RNA, 19 nt, Homo sapiens
agaugaaccucaggaauuu

SEQ ID NO: 749249 - RNA, 19 nt, Homo sapiens
gccaaaugcucuuucugaa

SEQ ID NO: 749250 - RNA, 19 nt, Homo sapiens
gcuacauucuugguuauuu

SEQ ID NO: 749251 - RNA, 19 nt, Homo sapiens
gaaguucugcuguucgaaa

SEQ ID NO: 749252 - RNA, 19 nt, Homo sapiens
gcaacaucaucaaacaguu

SEQ ID NO: 749253 - RNA, 19 nt, Homo sapiens
gaagcugaccuuucugaga

SEQ ID NO: 749254 - RNA, 19 nt, Homo sapiens
ggaaacacuuugagaagcu

SEQ ID NO: 749255 - RNA, 19 nt, Homo sapiens
gagcuacauucuugguuau

SEQ ID NO: 749256 - RNA, 19 nt, Homo sapiens
gaaaaggacaugcauuauu

SEQ ID NO: 749257 - RNA, 19 nt, Homo sapiens
gaucagcaacaucaucaaa

SEQ ID NO: 749258 - RNA, 19 nt, Homo sapiens
guucguguguguucucauu

SEQ ID NO: 749259 - RNA, 19 nt, Homo sapiens
gcuuacuccuuucaucuuu

SEQ ID NO: 749260 - RNA, 19 nt, Homo sapiens
cauaaugucgugugcuuaa

SEQ ID NO: 749261 - RNA, 19 nt, Homo sapiens
ccaaauacagccaugaaga

SEQ ID NO: 749262 - RNA, 19 nt, Homo sapiens
gggaugagacgcucuacaa

SEQ ID NO: 749263 - RNA, 19 nt, Homo sapiens
ucgauaaucuucgccaauu

SEQ ID NO: 749264 - RNA, 19 nt, Homo sapiens
ccuuaugcguugaauauug

SEQ ID NO: 749265 - RNA, 19 nt, Homo sapiens
guaggugguucgugugugu

SEQ ID NO: 749266 - RNA, 19 nt, Homo sapiens
gaagaucagcaacaucauc

SEQ ID NO: 749267 - RNA, 19 nt, Homo sapiens
agacggaauguuacuauuu

SEQ ID NO: 749268 - RNA, 19 nt, Homo sapiens
caagcacagucuccuuaug

SEQ ID NO: 749269 - RNA, 19 nt, Homo sapiens
gcaaugcccggaaacacuu

SEQ ID NO: 749270 - RNA, 19 nt, Homo sapiens
ucagcaacaucaucaaaca

SEQ ID NO: 749271 - RNA, 19 nt, Homo sapiens
gacggaauguuacuauuuu

SEQ ID NO: 749272 - RNA, 19 nt, Homo sapiens
ggaugagacgcucuacaaa

SEQ ID NO: 749273 - RNA, 19 nt, Homo sapiens
ggagagccgcgaacuggaa

SEQ ID NO: 749274 - RNA, 19 nt, Homo sapiens
gagcauggaaguuaggaau

SEQ ID NO: 749275 - RNA, 19 nt, Homo sapiens
uuaaagagcgagaggaaga

SEQ ID NO: 749276 - RNA, 19 nt, Homo sapiens
uagggaaccuggugcugaa

SEQ ID NO: 749277 - RNA, 19 nt, Homo sapiens
cguugaauauugccaaaug

SEQ ID NO: 749278 - RNA, 19 nt, Homo sapiens
ggagaugaaccucaggaau

SEQ ID NO: 749279 - RNA, 19 nt, Homo sapiens
gaugagacgcucuacaaag

SEQ ID NO: 749280 - RNA, 19 nt, Homo sapiens
accaguaucuuccuguauu

SEQ ID NO: 749281 - RNA, 19 nt, Homo sapiens
gacaucuucaccucaaaua

SEQ ID NO: 749282 - RNA, 19 nt, Homo sapiens
ccgaugaaguucugcuguu

SEQ ID NO: 749283 - RNA, 19 nt, Homo sapiens
uugagaagcuggagagagu

SEQ ID NO: 749284 - RNA, 19 nt, Homo sapiens
caacaucaucaaacaguuc

SEQ ID NO: 749285 - RNA, 19 nt, Homo sapiens
cuacauucuugguuauuuc

SEQ ID NO: 749286 - RNA, 19 nt, Homo sapiens
aaucuucgccaauuacauu

SEQ ID NO: 749287 - RNA, 19 nt, Homo sapiens
guaaauuggccgcuuccuu

SEQ ID NO: 749288 - RNA, 19 nt, Homo sapiens
uuaccaguaucuuccugua

SEQ ID NO: 749289 - RNA, 19 nt, Homo sapiens
caaagacggaauguuacua

SEQ ID NO: 749290 - RNA, 19 nt, Homo sapiens
gagaaguugguauggugua

SEQ ID NO: 749291 - RNA, 19 nt, Homo sapiens
gcugagcugcaguaaauug

SEQ ID NO: 749292 - RNA, 19 nt, Homo sapiens
ccaguaucuuccuguauuc

SEQ ID NO: 749293 - RNA, 19 nt, Homo sapiens
uaugauagauaugcacauc

SEQ ID NO: 749294 - RNA, 19 nt, Homo sapiens
agaaguugguaugguguaa

SEQ ID NO: 749295 - RNA, 19 nt, Homo sapiens
gcaaagacggaauguuacu

SEQ ID NO: 749296 - RNA, 19 nt, Homo sapiens
cauugaggccgaugaaguu

SEQ ID NO: 749297 - RNA, 19 nt, Homo sapiens
aaagacggaauguuacuau

SEQ ID NO: 749298 - RNA, 19 nt, Homo sapiens
uguauuccguaucagauug

SEQ ID NO: 749299 - RNA, 19 nt, Homo sapiens
cccaagcacagucuccuua

SEQ ID NO: 749300 - RNA, 19 nt, Homo sapiens
aaauacagccaugaagaaa

SEQ ID NO: 749301 - RNA, 19 nt, Homo sapiens
ucaggacaccuucauggaa

SEQ ID NO: 749302 - RNA, 19 nt, Homo sapiens
cgaugaaguucugcuguuc

SEQ ID NO: 749303 - RNA, 19 nt, Homo sapiens
cguaucagauugcaaagac

SEQ ID NO: 749304 - RNA, 19 nt, Homo sapiens
ugaagugugugcugcuuac

SEQ ID NO: 749305 - RNA, 19 nt, Homo sapiens
aagacggaauguuacuauu

SEQ ID NO: 749306 - RNA, 19 nt, Homo sapiens
gacgcuauuuacucagcua

SEQ ID NO: 749307 - RNA, 19 nt, Homo sapiens
ugccaaaugcucuuucuga

SEQ ID NO: 749308 - RNA, 19 nt, Homo sapiens
agcaugaggucgauaaucu

SEQ ID NO: 749309 - RNA, 19 nt, Homo sapiens
acaccuucauggaaaauua

SEQ ID NO: 749310 - RNA, 19 nt, Homo sapiens
uggaaaaggacaugcauua

SEQ ID NO: 749311 - RNA, 19 nt, Homo sapiens
gauagauaugcacaucaaa

SEQ ID NO: 749312 - RNA, 19 nt, Homo sapiens
gcaugaggucgauaaucuu

SEQ ID NO: 749313 - RNA, 19 nt, Homo sapiens
gugugcugcuuacuccuuu

SEQ ID NO: 749314 - RNA, 19 nt, Homo sapiens
ugaugguggucaugucaga

SEQ ID NO: 749315 - RNA, 19 nt, Homo sapiens
gagagccgcgaacuggaaa

SEQ ID NO: 749316 - RNA, 19 nt, Homo sapiens
ccagcgagacaauaucuuc

SEQ ID NO: 749317 - RNA, 19 nt, Homo sapiens
ggagugugcuuguuuucga

SEQ ID NO: 749318 - RNA, 19 nt, Homo sapiens
gcugcuuacuccuuucauc

SEQ ID NO: 749319 - RNA, 19 nt, Homo sapiens
ccagccagcgagacaauau

SEQ ID NO: 749320 - RNA, 19 nt, Homo sapiens
gcucccaucugaguaagag

SEQ ID NO: 749321 - RNA, 19 nt, Homo sapiens
guucgaaagagcuacauuc

SEQ ID NO: 749322 - RNA, 19 nt, Homo sapiens
ccagcugauucccaacguu

SEQ ID NO: 749323 - RNA, 19 nt, Homo sapiens
gcacaaaauggaucugguu

SEQ ID NO: 749324 - RNA, 19 nt, Homo sapiens
ucagcaagguauuaaaaug

SEQ ID NO: 749325 - RNA, 19 nt, Homo sapiens
cuuccuguauuccguauca

SEQ ID NO: 749326 - RNA, 19 nt, Homo sapiens
uuuaaacauuggacgcuau

SEQ ID NO: 749327 - RNA, 19 nt, Homo sapiens
ccaagcacagucuccuuau

SEQ ID NO: 749328 - RNA, 19 nt, Homo sapiens
cggccacucugaucaacau

SEQ ID NO: 749329 - RNA, 19 nt, Homo sapiens
cgacaucuucaccucaaau

SEQ ID NO: 749330 - RNA, 19 nt, Homo sapiens
ccacucugaucaacauucg

SEQ ID NO: 749331 - RNA, 19 nt, Homo sapiens
cuccuuaugcguugaauau

SEQ ID NO: 749332 - RNA, 19 nt, Homo sapiens
uaacguggaaguuuugauu

SEQ ID NO: 749333 - RNA, 19 nt, Homo sapiens
ccucaaauacguacgugau

SEQ ID NO: 749334 - RNA, 19 nt, Homo sapiens
caugaggucgauaaucuuc

SEQ ID NO: 749335 - RNA, 19 nt, Homo sapiens
gguuugagaagaucagcaa

SEQ ID NO: 749336 - RNA, 19 nt, Homo sapiens
ggacagugauccacccuaa

SEQ ID NO: 749337 - RNA, 19 nt, Homo sapiens
gaacuaagaacaguguaua

SEQ ID NO: 749338 - RNA, 19 nt, Homo sapiens
cuuaacaacucacagaaua

SEQ ID NO: 749339 - RNA, 19 nt, Homo sapiens
acaaguggcugcaucauug

SEQ ID NO: 749340 - RNA, 19 nt, Homo sapiens
gaagucaucccugagaaua

SEQ ID NO: 749341 - RNA, 19 nt, Homo sapiens
gaaaucagaggagauguaa

SEQ ID NO: 749342 - RNA, 19 nt, Homo sapiens
gcugauaacaggaccuuua

SEQ ID NO: 749343 - RNA, 19 nt, Homo sapiens
gaagggaaccuaauagaag

SEQ ID NO: 749344 - RNA, 19 nt, Homo sapiens
ccaaucgcauguggaauua

SEQ ID NO: 749345 - RNA, 19 nt, Homo sapiens
aggcagaaauguaauauug

SEQ ID NO: 749346 - RNA, 19 nt, Homo sapiens
ccaauaauguguuugaagu

SEQ ID NO: 749347 - RNA, 19 nt, Homo sapiens
guaaagaacuaagaacagu

SEQ ID NO: 749348 - RNA, 19 nt, Homo sapiens
gaagaugggagauaauaau

SEQ ID NO: 749349 - RNA, 19 nt, Homo sapiens
guaacuguccuuuguaauu

SEQ ID NO: 749350 - RNA, 19 nt, Homo sapiens
caaauuaccaccaccuaaa

SEQ ID NO: 749351 - RNA, 19 nt, Homo sapiens
gcaguuguauguguagaaa

SEQ ID NO: 749352 - RNA, 19 nt, Homo sapiens
caacuccaguaaagaacua

SEQ ID NO: 749353 - RNA, 19 nt, Homo sapiens
cauaaaugcuuacccagau

SEQ ID NO: 749354 - RNA, 19 nt, Homo sapiens
gaagaacaggcccuuauca

SEQ ID NO: 749355 - RNA, 19 nt, Homo sapiens
gaacaguguauaacaugaa

SEQ ID NO: 749356 - RNA, 19 nt, Homo sapiens
uaaagaagacuaugaaagg

SEQ ID NO: 749357 - RNA, 19 nt, Homo sapiens
gcagaaauguaauauugac

SEQ ID NO: 749358 - RNA, 19 nt, Homo sapiens
gcaccaauaauguguuuga

SEQ ID NO: 749359 - RNA, 19 nt, Homo sapiens
gaugggagauaauaauguc

SEQ ID NO: 749360 - RNA, 19 nt, Homo sapiens
agaacaggcccuuaucaua

SEQ ID NO: 749361 - RNA, 19 nt, Homo sapiens
cagaggagauguaacuauc

SEQ ID NO: 749362 - RNA, 19 nt, Homo sapiens
gaaugggcccacaguguuu

SEQ ID NO: 749363 - RNA, 19 nt, Homo sapiens
gcucaacuccaguaaagaa

SEQ ID NO: 749364 - RNA, 19 nt, Homo sapiens
gauccacccuaaagcaaga

SEQ ID NO: 749365 - RNA, 19 nt, Homo sapiens
agaauacggugaucuaugg

SEQ ID NO: 749366 - RNA, 19 nt, Homo sapiens
cauuguaacuguccuuugu

SEQ ID NO: 749367 - RNA, 19 nt, Homo sapiens
uguagaaagugaaaucaga

SEQ ID NO: 749368 - RNA, 19 nt, Homo sapiens
gcauagacuaaacugaaua

SEQ ID NO: 749369 - RNA, 19 nt, Homo sapiens
uagcauagacuaaacugaa

SEQ ID NO: 749370 - RNA, 19 nt, Homo sapiens
guugcaaccuaaauacauu

SEQ ID NO: 749371 - RNA, 19 nt, Homo sapiens
caguguuuauguacucuua

SEQ ID NO: 749372 - RNA, 19 nt, Homo sapiens
aaagaagacuaugaaagga

SEQ ID NO: 749373 - RNA, 19 nt, Homo sapiens
cagcuggauuucuugauga

SEQ ID NO: 749374 - RNA, 19 nt, Homo sapiens
gagaauacggugaucuaug

SEQ ID NO: 749375 - RNA, 19 nt, Homo sapiens
auaaaugcuuacccagaua

SEQ ID NO: 749376 - RNA, 19 nt, Homo sapiens
cgaagggaaccuaauagaa

SEQ ID NO: 749377 - RNA, 19 nt, Homo sapiens
uauguaggcagaaauguaa

SEQ ID NO: 749378 - RNA, 19 nt, Homo sapiens
gaagcucaacuccaguaaa

SEQ ID NO: 749379 - RNA, 19 nt, Homo sapiens
ccaaauuaccaccaccuaa

SEQ ID NO: 749380 - RNA, 19 nt, Homo sapiens
uaauaucacuccugacacu

SEQ ID NO: 749381 - RNA, 19 nt, Homo sapiens
cacccuaaagcaagaauua

SEQ ID NO: 749382 - RNA, 19 nt, Homo sapiens
ugaaaucagaggagaugua

SEQ ID NO: 749383 - RNA, 19 nt, Homo sapiens
ggcccacaguguuuaugua

SEQ ID NO: 749384 - RNA, 19 nt, Homo sapiens
aagcucaacuccaguaaag

SEQ ID NO: 749385 - RNA, 19 nt, Homo sapiens
gacaaguggcugcaucauu

SEQ ID NO: 749386 - RNA, 19 nt, Homo sapiens
gcauauguaggcagaaaug

SEQ ID NO: 749387 - RNA, 19 nt, Homo sapiens
uaaaugcuuacccagauaa

SEQ ID NO: 749388 - RNA, 19 nt, Homo sapiens
aagggaaccuaauagaaga

SEQ ID NO: 749389 - RNA, 19 nt, Homo sapiens
gauaacaggaccuuuaaaa

SEQ ID NO: 749390 - RNA, 19 nt, Homo sapiens
aaacugcuagccacaaauu

SEQ ID NO: 749391 - RNA, 19 nt, Homo sapiens
ccuauauccuugguucuuu

SEQ ID NO: 749392 - RNA, 19 nt, Homo sapiens
gcgaagggaaccuaauaga

SEQ ID NO: 749393 - RNA, 19 nt, Homo sapiens
auaaacugcuagccacaaa

SEQ ID NO: 749394 - RNA, 19 nt, Homo sapiens
ccacaguguuuauguacuc

SEQ ID NO: 749395 - RNA, 19 nt, Homo sapiens
cacuacagcuggauuucuu

SEQ ID NO: 749396 - RNA, 19 nt, Homo sapiens
ugaaugggcccacaguguu

SEQ ID NO: 749397 - RNA, 19 nt, Homo sapiens
agaacaguguauaacauga

SEQ ID NO: 749398 - RNA, 19 nt, Homo sapiens
aagcauauguaggcagaaa

SEQ ID NO: 749399 - RNA, 19 nt, Homo sapiens
ccuaaagcaagaauuauug

SEQ ID NO: 749400 - RNA, 19 nt, Homo sapiens
uguuugaaguuggcuguua

SEQ ID NO: 749401 - RNA, 19 nt, Homo sapiens
uagaagaacaggcccuuau

SEQ ID NO: 749402 - RNA, 19 nt, Homo sapiens
uggagcaguuguaugugua

SEQ ID NO: 749403 - RNA, 19 nt, Homo sapiens
caaaagagugugaagauug

SEQ ID NO: 749404 - RNA, 19 nt, Homo sapiens
ugaagaugggagauaauaa

SEQ ID NO: 749405 - RNA, 19 nt, Homo sapiens
uggcaccaauaauguguuu

SEQ ID NO: 749406 - RNA, 19 nt, Homo sapiens
aaaauuggguugagaggaa

SEQ ID NO: 749407 - RNA, 19 nt, Homo sapiens
uauguacucuuaacaacuc

SEQ ID NO: 749408 - RNA, 19 nt, Homo sapiens
acagcuggauuucuugaug

SEQ ID NO: 749409 - RNA, 19 nt, Homo sapiens
guuugaaguuggcuguuau

SEQ ID NO: 749410 - RNA, 19 nt, Homo sapiens
uggcgaagggaaccuaaua

SEQ ID NO: 749411 - RNA, 19 nt, Homo sapiens
cuaagaacaguguauaaca

SEQ ID NO: 749412 - RNA, 19 nt, Homo sapiens
ggaagcucaacuccaguaa

SEQ ID NO: 749413 - RNA, 19 nt, Homo sapiens
gaaccaaaaccuaugauca

SEQ ID NO: 749414 - RNA, 19 nt, Homo sapiens
cuaaagaagacuaugaaag

SEQ ID NO: 749415 - RNA, 19 nt, Homo sapiens
gcuuguugcaaccuaaaua

SEQ ID NO: 749416 - RNA, 19 nt, Homo sapiens
uuguaacuguccuuuguaa

SEQ ID NO: 749417 - RNA, 19 nt, Homo sapiens
ggcagaaauguaauauuga

SEQ ID NO: 749418 - RNA, 19 nt, Homo sapiens
uaucacuccugacacugaa

SEQ ID NO: 749419 - RNA, 19 nt, Homo sapiens
aaucgcauguggaauuauc

SEQ ID NO: 749420 - RNA, 19 nt, Homo sapiens
cugaagauccagaaccaaa

SEQ ID NO: 749421 - RNA, 19 nt, Homo sapiens
gaaccuaauagaagaacag

SEQ ID NO: 749422 - RNA, 19 nt, Homo sapiens
ucagaggagauguaacuau

SEQ ID NO: 749423 - RNA, 19 nt, Homo sapiens
gagcaguuguauguguaga

SEQ ID NO: 749424 - RNA, 19 nt, Homo sapiens
cugauaacaggaccuuuaa

SEQ ID NO: 749425 - RNA, 19 nt, Homo sapiens
aaagaacuaagaacagugu

SEQ ID NO: 749426 - RNA, 19 nt, Homo sapiens
caguaaagaacuaagaaca

SEQ ID NO: 749427 - RNA, 19 nt, Homo sapiens
caccuaaagaagacuauga

SEQ ID NO: 749428 - RNA, 19 nt, Homo sapiens
agacacuacagcuggauuu

SEQ ID NO: 749429 - RNA, 19 nt, Homo sapiens
ucaaaagagugugaagauu

SEQ ID NO: 749430 - RNA, 19 nt, Homo sapiens
caaaaccuaugaucauugg

SEQ ID NO: 749431 - RNA, 19 nt, Homo sapiens
cacagaauaauacauguuc

SEQ ID NO: 749432 - RNA, 19 nt, Homo sapiens
caacucacagaauaauaca

SEQ ID NO: 749433 - RNA, 19 nt, Homo sapiens
ggaaccuaauagaagaaca

SEQ ID NO: 749434 - RNA, 19 nt, Homo sapiens
gccguaccauggcggagaa

SEQ ID NO: 749435 - RNA, 19 nt, Homo sapiens
guaggcagaaauguaauau

SEQ ID NO: 749436 - RNA, 19 nt, Homo sapiens
gagauaagaugaugucguu

SEQ ID NO: 749437 - RNA, 19 nt, Homo sapiens
ccaaaggcauccaugaaua

SEQ ID NO: 749438 - RNA, 19 nt, Homo sapiens
ccaaggagaucgacaaaug

SEQ ID NO: 749439 - RNA, 19 nt, Homo sapiens
caaagacuauuuccuagaa

SEQ ID NO: 749440 - RNA, 19 nt, Homo sapiens
aagaugaugucguuugaua

SEQ ID NO: 749441 - RNA, 19 nt, Homo sapiens
gagagaagcuucauauucc

SEQ ID NO: 749442 - RNA, 19 nt, Homo sapiens
caucaaagacuauuuccua

SEQ ID NO: 749443 - RNA, 19 nt, Homo sapiens
ggucagagaucagaaagga

SEQ ID NO: 749444 - RNA, 19 nt, Homo sapiens
uacaauaucuuccugcuau

SEQ ID NO: 749445 - RNA, 19 nt, Homo sapiens
gaagaucgacugaccaauc

SEQ ID NO: 749446 - RNA, 19 nt, Homo sapiens
uaacuuggauaaacuugga

SEQ ID NO: 749447 - RNA, 19 nt, Homo sapiens
gcagacagcggcauacaga

SEQ ID NO: 749448 - RNA, 19 nt, Homo sapiens
caacauggagauaagauga

SEQ ID NO: 749449 - RNA, 19 nt, Homo sapiens
gcaacgugaucaaagguau

SEQ ID NO: 749450 - RNA, 19 nt, Homo sapiens
gaggagaaggugcaaauug

SEQ ID NO: 749451 - RNA, 19 nt, Homo sapiens
cagauuauauuccaucaca

SEQ ID NO: 749452 - RNA, 19 nt, Homo sapiens
gauaagaugaugucguuug

SEQ ID NO: 749453 - RNA, 19 nt, Homo sapiens
cgagagaagcuucauauuc

SEQ ID NO: 749454 - RNA, 19 nt, Homo sapiens
ucaacugggugaaucugua

SEQ ID NO: 749455 - RNA, 19 nt, Homo sapiens
ugaccggcgucgagaauuu

SEQ ID NO: 749456 - RNA, 19 nt, Homo sapiens
cgacugaccaaucgccuua

SEQ ID NO: 749457 - RNA, 19 nt, Homo sapiens
gagaaggugcaaauuguga

SEQ ID NO: 749458 - RNA, 19 nt, Homo sapiens
ugauguagguggucagaga

SEQ ID NO: 749459 - RNA, 19 nt, Homo sapiens
gaauuugaccaggugcuua

SEQ ID NO: 749460 - RNA, 19 nt, Homo sapiens
ggauaaacuuggagaacca

SEQ ID NO: 749461 - RNA, 19 nt, Homo sapiens
gaaggauacuauucugcau

SEQ ID NO: 749462 - RNA, 19 nt, Homo sapiens
agugugacaucaauacuuu

SEQ ID NO: 749463 - RNA, 19 nt, Homo sapiens
ucagagaucagaaaggaaa

SEQ ID NO: 749464 - RNA, 19 nt, Homo sapiens
guaugagggugcugguuga

SEQ ID NO: 749465 - RNA, 19 nt, Homo sapiens
ccaacaacauggagauaag

SEQ ID NO: 749466 - RNA, 19 nt, Homo sapiens
gagcaucaaagacuauuuc

SEQ ID NO: 749467 - RNA, 19 nt, Homo sapiens
agcaaugucuccauaauuc

SEQ ID NO: 749468 - RNA, 19 nt, Homo sapiens
ggagaaccagauuauauuc

SEQ ID NO: 749469 - RNA, 19 nt, Homo sapiens
cagacuugcuugaggagaa

SEQ ID NO: 749470 - RNA, 19 nt, Homo sapiens
cuccauaauucuguucuua

SEQ ID NO: 749471 - RNA, 19 nt, Homo sapiens
uuucagcaaugucuccaua

SEQ ID NO: 749472 - RNA, 19 nt, Homo sapiens
auaagaugaugucguuuga

SEQ ID NO: 749473 - RNA, 19 nt, Homo sapiens
acaacaagauauucugcuu

SEQ ID NO: 749474 - RNA, 19 nt, Homo sapiens
gggugaaucuguaaaauau

SEQ ID NO: 749475 - RNA, 19 nt, Homo sapiens
caacugggugaaucuguaa

SEQ ID NO: 749476 - RNA, 19 nt, Homo sapiens
gcaaauugugagcaucaaa

SEQ ID NO: 749477 - RNA, 19 nt, Homo sapiens
aggagaaggugcaaauugu

SEQ ID NO: 749478 - RNA, 19 nt, Homo sapiens
gaaacaaucgucaauaacc

SEQ ID NO: 749479 - RNA, 19 nt, Homo sapiens
gcaaguccaccuuccugaa

SEQ ID NO: 749480 - RNA, 19 nt, Homo sapiens
ucagcaaugucuccauaau

SEQ ID NO: 749481 - RNA, 19 nt, Homo sapiens
gaaccagauuauauuccau

SEQ ID NO: 749482 - RNA, 19 nt, Homo sapiens
cagcaaugucuccauaauu

SEQ ID NO: 749483 - RNA, 19 nt, Homo sapiens
caauaucuuccugcuauaa

SEQ ID NO: 749484 - RNA, 19 nt, Homo sapiens
acaauaucuuccugcuaua

SEQ ID NO: 749485 - RNA, 19 nt, Homo sapiens
caacucaaaccaacaacau

SEQ ID NO: 749486 - RNA, 19 nt, Homo sapiens
aggauacuauucugcauga

SEQ ID NO: 749487 - RNA, 19 nt, Homo sapiens
uauauuccaucacaacaag

SEQ ID NO: 749488 - RNA, 19 nt, Homo sapiens
uggagaaccagauuauauu

SEQ ID NO: 749489 - RNA, 19 nt, Homo sapiens
ggagaaggugcaaauugug

SEQ ID NO: 749490 - RNA, 19 nt, Homo sapiens
aacguugguuugaauguuu

SEQ ID NO: 749491 - RNA, 19 nt, Homo sapiens
cgacagugugacaucaaua

SEQ ID NO: 749492 - RNA, 19 nt, Homo sapiens
ccaugaauacgacuuugaa

SEQ ID NO: 749493 - RNA, 19 nt, Homo sapiens
caaaggcauccaugaauac

SEQ ID NO: 749494 - RNA, 19 nt, Homo sapiens
aaacuuggagaaccagauu

SEQ ID NO: 749495 - RNA, 19 nt, Homo sapiens
caacaacauggagauaaga

SEQ ID NO: 749496 - RNA, 19 nt, Homo sapiens
auacuauucugcaugacaa

SEQ ID NO: 749497 - RNA, 19 nt, Homo sapiens
ugaccaaucgccuuacaga

SEQ ID NO: 749498 - RNA, 19 nt, Homo sapiens
gaauguuucgacaguguga

SEQ ID NO: 749499 - RNA, 19 nt, Homo sapiens
ggaaaagaccuaugugaag

SEQ ID NO: 749500 - RNA, 19 nt, Homo sapiens
caccaaaggcauccaugaa

SEQ ID NO: 749501 - RNA, 19 nt, Homo sapiens
ccaccaaaggcauccauga

SEQ ID NO: 749502 - RNA, 19 nt, Homo sapiens
ucaaagacuauuuccuaga

SEQ ID NO: 749503 - RNA, 19 nt, Homo sapiens
ggauaacuuggauaaacuu

SEQ ID NO: 749504 - RNA, 19 nt, Homo sapiens
cauggcagcccaaggaaug

SEQ ID NO: 749505 - RNA, 19 nt, Homo sapiens
caaauugugagcaucaaag

SEQ ID NO: 749506 - RNA, 19 nt, Homo sapiens
ccagaagacccaccaaagg

SEQ ID NO: 749507 - RNA, 19 nt, Homo sapiens
gcucgagagaagcuucaua

SEQ ID NO: 749508 - RNA, 19 nt, Homo sapiens
gauacuauucugcaugaca

SEQ ID NO: 749509 - RNA, 19 nt, Homo sapiens
gcccuuauaccaccacuuc

SEQ ID NO: 749510 - RNA, 19 nt, Homo sapiens
caaggguuuucuuacaaua

SEQ ID NO: 749511 - RNA, 19 nt, Homo sapiens
caacagaagcccuuauacc

SEQ ID NO: 749512 - RNA, 19 nt, Homo sapiens
gcaacagaagcccuuauac

SEQ ID NO: 749513 - RNA, 19 nt, Homo sapiens
guuugaauguuucgacagu

SEQ ID NO: 749514 - RNA, 19 nt, Homo sapiens
gguugaugcucgagagaag

SEQ ID NO: 749515 - RNA, 19 nt, Homo sapiens
uuggagaaccagauuauau

SEQ ID NO: 749516 - RNA, 19 nt, Homo sapiens
cuacagcaacgugaucaaa

SEQ ID NO: 749517 - RNA, 19 nt, Homo sapiens
gacagcggcauacagaaug

SEQ ID NO: 749518 - RNA, 19 nt, Homo sapiens
agacaacucaaaccaacaa

SEQ ID NO: 749519 - RNA, 19 nt, Homo sapiens
agaaccagauuauauucca

SEQ ID NO: 749520 - RNA, 19 nt, Homo sapiens
cuggauaacuuggauaaac

SEQ ID NO: 749521 - RNA, 19 nt, Homo sapiens
gggagacaacucaaaccaa

SEQ ID NO: 749522 - RNA, 19 nt, Homo sapiens
gggaaaagaccuaugugaa

SEQ ID NO: 749523 - RNA, 19 nt, Homo sapiens
uggauaacuuggauaaacu

SEQ ID NO: 749524 - RNA, 19 nt, Homo sapiens
caaggaaugguggaaacaa

SEQ ID NO: 749525 - RNA, 19 nt, Homo sapiens
ugacgugaaggauacuauu

SEQ ID NO: 749526 - RNA, 19 nt, Homo sapiens
gcaaguccaaggagaucga

SEQ ID NO: 749527 - RNA, 19 nt, Homo sapiens
gccagaagacccaccaaag

SEQ ID NO: 749528 - RNA, 19 nt, Homo sapiens
agacagcggcauacagaau

SEQ ID NO: 749529 - RNA, 19 nt, Homo sapiens
cgugaaggauacuauucug

SEQ ID NO: 749530 - RNA, 19 nt, Homo sapiens
gugcaaauugugagcauca

SEQ ID NO: 749531 - RNA, 19 nt, Homo sapiens
acauggagauaagaugaug

SEQ ID NO: 749532 - RNA, 19 nt, Homo sapiens
gauaacuuggauaaacuug

SEQ ID NO: 749533 - RNA, 19 nt, Homo sapiens
ugaagcagaugcggaucau

SEQ ID NO: 749534 - RNA, 19 nt, Homo sapiens
gacgugaaggauacuauuc

SEQ ID NO: 749535 - RNA, 19 nt, Homo sapiens
acagcaacgugaucaaagg

SEQ ID NO: 749536 - RNA, 19 nt, Homo sapiens
gaagaaagaaucuaacuga

SEQ ID NO: 749537 - RNA, 19 nt, Homo sapiens
gagaagaaaugaaacugaa

SEQ ID NO: 749538 - RNA, 19 nt, Homo sapiens
gaaggcaacuccagucaga

SEQ ID NO: 749539 - RNA, 19 nt, Homo sapiens
gaaauaagcgugccguuca

SEQ ID NO: 749540 - RNA, 19 nt, Homo sapiens
gaaaugaggaagacagauu

SEQ ID NO: 749541 - RNA, 19 nt, Homo sapiens
gaaacacuacccaauaauu

SEQ ID NO: 749542 - RNA, 19 nt, Homo sapiens
aaacacagauaacaggaaa

SEQ ID NO: 749543 - RNA, 19 nt, Homo sapiens
aaauaugccugaaacacua

SEQ ID NO: 749544 - RNA, 19 nt, Homo sapiens
gaggguaaaugccagcaaa

SEQ ID NO: 749545 - RNA, 19 nt, Homo sapiens
cugaaacacuacccaauaa

SEQ ID NO: 749546 - RNA, 19 nt, Homo sapiens
gaaagugaaaugaggaaga

SEQ ID NO: 749547 - RNA, 19 nt, Homo sapiens
guaaaugccagcaaaccua

SEQ ID NO: 749548 - RNA, 19 nt, Homo sapiens
caccaugucuguagcuauu

SEQ ID NO: 749549 - RNA, 19 nt, Homo sapiens
gaaacaccaacuauacaaa

SEQ ID NO: 749550 - RNA, 19 nt, Homo sapiens
ggaagugcccuagaagaaa

SEQ ID NO: 749551 - RNA, 19 nt, Homo sapiens
gaagaaacagucacucaag

SEQ ID NO: 749552 - RNA, 19 nt, Homo sapiens
agucagaacagcagaaaua

SEQ ID NO: 749553 - RNA, 19 nt, Homo sapiens
gggaagugcccuagaagaa

SEQ ID NO: 749554 - RNA, 19 nt, Homo sapiens
ggacaucaacaaacacaga

SEQ ID NO: 749555 - RNA, 19 nt, Homo sapiens
aaacugcugugaccuacuu

SEQ ID NO: 749556 - RNA, 19 nt, Homo sapiens
gaagugcccuagaagaaaa

SEQ ID NO: 749557 - RNA, 19 nt, Homo sapiens
cuucaaaguucaaguagug

SEQ ID NO: 749558 - RNA, 19 nt, Homo sapiens
caaaguucaaguagugaua

SEQ ID NO: 749559 - RNA, 19 nt, Homo sapiens
gccaagcccugccauguag

SEQ ID NO: 749560 - RNA, 19 nt, Homo sapiens
ccugaaacacuacccaaua

SEQ ID NO: 749561 - RNA, 19 nt, Homo sapiens
ucacgguggugucuuucua

SEQ ID NO: 749562 - RNA, 19 nt, Homo sapiens
caucaacaaacacagauaa

SEQ ID NO: 749563 - RNA, 19 nt, Homo sapiens
gcacgcaggacaucaacaa

SEQ ID NO: 749564 - RNA, 19 nt, Homo sapiens
ggguagagaugcagaaagg

SEQ ID NO: 749565 - RNA, 19 nt, Homo sapiens
ggaagaaggagaugaacuc

SEQ ID NO: 749566 - RNA, 19 nt, Homo sapiens
cagcaaaccuacuguacag

SEQ ID NO: 749567 - RNA, 19 nt, Homo sapiens
aagaaacagucacucaaga

SEQ ID NO: 749568 - RNA, 19 nt, Homo sapiens
cgccuuacuucuugccuua

SEQ ID NO: 749569 - RNA, 19 nt, Homo sapiens
aaacacuacccaauaauuc

SEQ ID NO: 749570 - RNA, 19 nt, Homo sapiens
uguggucacuuauucuaaa

SEQ ID NO: 749571 - RNA, 19 nt, Homo sapiens
ucaaagaaacugguuacuu

SEQ ID NO: 749572 - RNA, 19 nt, Homo sapiens
caaguagugauauggauga

SEQ ID NO: 749573 - RNA, 19 nt, Homo sapiens
caacaaacacagauaacag

SEQ ID NO: 749574 - RNA, 19 nt, Homo sapiens
agucacgccuuacuucuug

SEQ ID NO: 749575 - RNA, 19 nt, Homo sapiens
gaugaacuccaacuugcaa

SEQ ID NO: 749576 - RNA, 19 nt, Homo sapiens
ugaaacaccaacuauacaa

SEQ ID NO: 749577 - RNA, 19 nt, Homo sapiens
cagugaaacaccaacuaua

SEQ ID NO: 749578 - RNA, 19 nt, Homo sapiens
cagaagaaacagucacuca

SEQ ID NO: 749579 - RNA, 19 nt, Homo sapiens
gagaaggcaacuccaguca

SEQ ID NO: 749580 - RNA, 19 nt, Homo sapiens
agggagcagucacgccuua

SEQ ID NO: 749581 - RNA, 19 nt, Homo sapiens
gaaaggcagaaaggagaaa

SEQ ID NO: 749582 - RNA, 19 nt, Homo sapiens
cuacuuacaccaugucugu

SEQ ID NO: 749583 - RNA, 19 nt, Homo sapiens
gugacuuuguuucgaugua

SEQ ID NO: 749584 - RNA, 19 nt, Homo sapiens
gacaucuaauucagaggaa

SEQ ID NO: 749585 - RNA, 19 nt, Homo sapiens
gacagugaaacaccaacua

SEQ ID NO: 749586 - RNA, 19 nt, Homo sapiens
cgcaggacaucaacaaaca

SEQ ID NO: 749587 - RNA, 19 nt, Homo sapiens
gcagaaaggagaaaauuca

SEQ ID NO: 749588 - RNA, 19 nt, Homo sapiens
gagccaagcccugccaugu

SEQ ID NO: 749589 - RNA, 19 nt, Homo sapiens
guaccucuaagaagaaaga

SEQ ID NO: 749590 - RNA, 19 nt, Homo sapiens
gaacuccaacuugcaauac

SEQ ID NO: 749591 - RNA, 19 nt, Homo sapiens
ugacuuuguuucgauguau

SEQ ID NO: 749592 - RNA, 19 nt, Homo sapiens
ugaacuccaacuugcaaua

SEQ ID NO: 749593 - RNA, 19 nt, Homo sapiens
ggaaagcugcuggcugcaa

SEQ ID NO: 749594 - RNA, 19 nt, Homo sapiens
gagcagucacgccuuacuu

SEQ ID NO: 749595 - RNA, 19 nt, Homo sapiens
acagauaacaggaaaugau

SEQ ID NO: 749596 - RNA, 19 nt, Homo sapiens
caaacacagauaacaggaa

SEQ ID NO: 749597 - RNA, 19 nt, Homo sapiens
cuauucagcuggcauugca

SEQ ID NO: 749598 - RNA, 19 nt, Homo sapiens
gacuuuguuucgauguauu

SEQ ID NO: 749599 - RNA, 19 nt, Homo sapiens
cagaacagcagaaauaagc

SEQ ID NO: 749600 - RNA, 19 nt, Homo sapiens
agagaagaaaugaaacuga

SEQ ID NO: 749601 - RNA, 19 nt, Homo sapiens
cauucccuguggucacuua

SEQ ID NO: 749602 - RNA, 19 nt, Homo sapiens
uuccauggcuucucagcuu

SEQ ID NO: 749603 - RNA, 19 nt, Homo sapiens
gccucacgguggugucuuu

SEQ ID NO: 749604 - RNA, 19 nt, Homo sapiens
acacagauaacaggaaaug

SEQ ID NO: 749605 - RNA, 19 nt, Homo sapiens
ugaccuacuuacaccaugu

SEQ ID NO: 749606 - RNA, 19 nt, Homo sapiens
acaaauaucacuggaugga

SEQ ID NO: 749607 - RNA, 19 nt, Homo sapiens
gccaugggacaucuaauuc

SEQ ID NO: 749608 - RNA, 19 nt, Homo sapiens
cgccaugggacaucuaauu

SEQ ID NO: 749609 - RNA, 19 nt, Homo sapiens
cauggcuucucagcuuuaa

SEQ ID NO: 749610 - RNA, 19 nt, Homo sapiens
gugaaacaccaacuauaca

SEQ ID NO: 749611 - RNA, 19 nt, Homo sapiens
agaagaaacagucacucaa

SEQ ID NO: 749612 - RNA, 19 nt, Homo sapiens
ccucuaagaagaaagaauc

SEQ ID NO: 749613 - RNA, 19 nt, Homo sapiens
uuuccucccuuucucugua

SEQ ID NO: 749614 - RNA, 19 nt, Homo sapiens
aggagaaaauucaggauaa

SEQ ID NO: 749615 - RNA, 19 nt, Homo sapiens
ggucaaagaaacugguuac

SEQ ID NO: 749616 - RNA, 19 nt, Homo sapiens
gcagacagugaaacaccaa

SEQ ID NO: 749617 - RNA, 19 nt, Homo sapiens
aaagugaaaugaggaagac

SEQ ID NO: 749618 - RNA, 19 nt, Homo sapiens
cagauaacaggaaaugauc

SEQ ID NO: 749619 - RNA, 19 nt, Homo sapiens
aaaugaggaagacagauug

SEQ ID NO: 749620 - RNA, 19 nt, Homo sapiens
caugggacaucuaauucag

SEQ ID NO: 749621 - RNA, 19 nt, Homo sapiens
ccauggcuucucagcuuua

SEQ ID NO: 749622 - RNA, 19 nt, Homo sapiens
aaaggaucuuacacauuug

SEQ ID NO: 749623 - RNA, 19 nt, Homo sapiens
gucagaacagcagaaauaa

SEQ ID NO: 749624 - RNA, 19 nt, Homo sapiens
aaacugaaagugaaaugag

SEQ ID NO: 749625 - RNA, 19 nt, Homo sapiens
caucuaauucagaggaaga

SEQ ID NO: 749626 - RNA, 19 nt, Homo sapiens
acagugaaacaccaacuau

SEQ ID NO: 749627 - RNA, 19 nt, Homo sapiens
ucaacaaacacagauaaca

SEQ ID NO: 749628 - RNA, 19 nt, Homo sapiens
ccagcaaaccuacuguaca

SEQ ID NO: 749629 - RNA, 19 nt, Homo sapiens
cucuguaccucuaagaaga

SEQ ID NO: 749630 - RNA, 19 nt, Homo sapiens
gugaaaugaggaagacaga

SEQ ID NO: 749631 - RNA, 19 nt, Homo sapiens
ugaaacacuacccaauaau

SEQ ID NO: 749632 - RNA, 19 nt, Homo sapiens
gauaacaggaaaugaucca

SEQ ID NO: 749633 - RNA, 19 nt, Homo sapiens
gauugcagacagugaaaca

SEQ ID NO: 749634 - RNA, 19 nt, Homo sapiens
ucccuguggucacuuauuc

SEQ ID NO: 749635 - RNA, 19 nt, Homo sapiens
guucaggguccagaagaaa

SEQ ID NO: 749636 - RNA, 19 nt, Homo sapiens
caucugagcuccacaauga

SEQ ID NO: 749637 - RNA, 19 nt, Homo sapiens
ugacaaagaugcaguagga

SEQ ID NO: 749638 - RNA, 19 nt, Homo sapiens
guacagagucuauuucuug

SEQ ID NO: 749639 - RNA, 19 nt, Homo sapiens
gaaacauuaucuccucuug

SEQ ID NO: 749640 - RNA, 19 nt, Homo sapiens
cagagucuauuucuuguaa

SEQ ID NO: 749641 - RNA, 19 nt, Homo sapiens
ggagccugcuugacuuaua

SEQ ID NO: 749642 - RNA, 19 nt, Homo sapiens
aacauuaucuccucuugua

SEQ ID NO: 749643 - RNA, 19 nt, Homo sapiens
gaaagaggaggagucauuu

SEQ ID NO: 749644 - RNA, 19 nt, Homo sapiens
gaggaggagucauuuaaca

SEQ ID NO: 749645 - RNA, 19 nt, Homo sapiens
guggagaccuagaagauga

SEQ ID NO: 749646 - RNA, 19 nt, Homo sapiens
ggacuuggccuccagugaa

SEQ ID NO: 749647 - RNA, 19 nt, Homo sapiens
ggaagaggaggaugacaaa

SEQ ID NO: 749648 - RNA, 19 nt, Homo sapiens
ccaaguuacugucacaaug

SEQ ID NO: 749649 - RNA, 19 nt, Homo sapiens
ugaaagaggaggagucauu

SEQ ID NO: 749650 - RNA, 19 nt, Homo sapiens
caucagauaucauugacau

SEQ ID NO: 749651 - RNA, 19 nt, Homo sapiens
agagcugacuuacccauuu

SEQ ID NO: 749652 - RNA, 19 nt, Homo sapiens
ggguagggaagaaacauua

SEQ ID NO: 749653 - RNA, 19 nt, Homo sapiens
gagcugacuuacccauuuc

SEQ ID NO: 749654 - RNA, 19 nt, Homo sapiens
gagcccagcuucugaacuc

SEQ ID NO: 749655 - RNA, 19 nt, Homo sapiens
cgagggcucucacccaaau

SEQ ID NO: 749656 - RNA, 19 nt, Homo sapiens
gaacugucuucagaauaau

SEQ ID NO: 749657 - RNA, 19 nt, Homo sapiens
gacuuggccuccagugaaa

SEQ ID NO: 749658 - RNA, 19 nt, Homo sapiens
ugacuuauacgaugauuuc

SEQ ID NO: 749659 - RNA, 19 nt, Homo sapiens
ugaccaggcugacuuggau

SEQ ID NO: 749660 - RNA, 19 nt, Homo sapiens
gcuccacaaugauaacuuc

SEQ ID NO: 749661 - RNA, 19 nt, Homo sapiens
ucauugacaucgacuacuu

SEQ ID NO: 749662 - RNA, 19 nt, Homo sapiens
caaccggcaucagauauca

SEQ ID NO: 749663 - RNA, 19 nt, Homo sapiens
ugacuuggaugugaacugu

SEQ ID NO: 749664 - RNA, 19 nt, Homo sapiens
aagaggaggagucauuuaa

SEQ ID NO: 749665 - RNA, 19 nt, Homo sapiens
aaagaggaggagucauuua

SEQ ID NO: 749666 - RNA, 19 nt, Homo sapiens
gcucucacccaaaugauga

SEQ ID NO: 749667 - RNA, 19 nt, Homo sapiens
agaggaggaugacaaagau

SEQ ID NO: 749668 - RNA, 19 nt, Homo sapiens
ggaggagucauuuaacauc

SEQ ID NO: 749669 - RNA, 19 nt, Homo sapiens
gcaacacgcaggacuacau

SEQ ID NO: 749670 - RNA, 19 nt, Homo sapiens
ggaugacaaagaugcagua

SEQ ID NO: 749671 - RNA, 19 nt, Homo sapiens
ucucaaguccugccugaaa

SEQ ID NO: 749672 - RNA, 19 nt, Homo sapiens
gagccugcuugacuuauac

SEQ ID NO: 749673 - RNA, 19 nt, Homo sapiens
ccaugucgcccaaacuuga

SEQ ID NO: 749674 - RNA, 19 nt, Homo sapiens
caacgacacgcgggaagaa

SEQ ID NO: 749675 - RNA, 19 nt, Homo sapiens
aagaggaggaugacaaaga

SEQ ID NO: 749676 - RNA, 19 nt, Homo sapiens
ucugagcuccacaaugaua

SEQ ID NO: 749677 - RNA, 19 nt, Homo sapiens
gcgaccucuucccaaguua

SEQ ID NO: 749678 - RNA, 19 nt, Homo sapiens
agaaccacccugauacuga

SEQ ID NO: 749679 - RNA, 19 nt, Homo sapiens
uaaagcagagcaagaagag

SEQ ID NO: 749680 - RNA, 19 nt, Homo sapiens
caugaugacgguguucuuu

SEQ ID NO: 749681 - RNA, 19 nt, Homo sapiens
uaugaugacuuggaugaag

SEQ ID NO: 749682 - RNA, 19 nt, Homo sapiens
gcguaggaccaacaaauuc

SEQ ID NO: 749683 - RNA, 19 nt, Homo sapiens
caggcugacuuggauguga

SEQ ID NO: 749684 - RNA, 19 nt, Homo sapiens
cauuuaacauccagaacuc

SEQ ID NO: 749685 - RNA, 19 nt, Homo sapiens
uccaggagguucucaaguc

SEQ ID NO: 749686 - RNA, 19 nt, Homo sapiens
caaguuacugucacaaugg

SEQ ID NO: 749687 - RNA, 19 nt, Homo sapiens
uacagagucuauuucuugu

SEQ ID NO: 749688 - RNA, 19 nt, Homo sapiens
cuaaagcagagcaagaaga

SEQ ID NO: 749689 - RNA, 19 nt, Homo sapiens
ggaugaagaggaggaggaa

SEQ ID NO: 749690 - RNA, 19 nt, Homo sapiens
cggcaucagauaucauuga

SEQ ID NO: 749691 - RNA, 19 nt, Homo sapiens
ccuggagccugcuugacuu

SEQ ID NO: 749692 - RNA, 19 nt, Homo sapiens
cagauaucauugacaucga

SEQ ID NO: 749693 - RNA, 19 nt, Homo sapiens
ucaagacggagaauaccaa

SEQ ID NO: 749694 - RNA, 19 nt, Homo sapiens
gagaaccacccugauacug

SEQ ID NO: 749695 - RNA, 19 nt, Homo sapiens
agugcuaccugguggagaa

SEQ ID NO: 749696 - RNA, 19 nt, Homo sapiens
cagagaaccacccugauac

SEQ ID NO: 749697 - RNA, 19 nt, Homo sapiens
caaacuugaggguggcaaa

SEQ ID NO: 749698 - RNA, 19 nt, Homo sapiens
caacacgcaggacuacauc

SEQ ID NO: 749699 - RNA, 19 nt, Homo sapiens
ugcgaccucuucccaaguu

SEQ ID NO: 749700 - RNA, 19 nt, Homo sapiens
gguagggaagaaacauuau

SEQ ID NO: 749701 - RNA, 19 nt, Homo sapiens
cagcacacccgacccucaa

SEQ ID NO: 749702 - RNA, 19 nt, Homo sapiens
ggugcaacacgcaggacua

SEQ ID NO: 749703 - RNA, 19 nt, Homo sapiens
ugaugacgguguucuuugc

SEQ ID NO: 749704 - RNA, 19 nt, Homo sapiens
caccaggaaccucagagaa

SEQ ID NO: 749705 - RNA, 19 nt, Homo sapiens
uguacagagucuauuucuu

SEQ ID NO: 749706 - RNA, 19 nt, Homo sapiens
guagggaagaaacauuauc

SEQ ID NO: 749707 - RNA, 19 nt, Homo sapiens
gcgcagaucuggggagcuu

SEQ ID NO: 749708 - RNA, 19 nt, Homo sapiens
gcacacccgacccucaagu

SEQ ID NO: 749709 - RNA, 19 nt, Homo sapiens
augaugacuuggaugaaga

SEQ ID NO: 749710 - RNA, 19 nt, Homo sapiens
ccaaaugaugauccuagug

SEQ ID NO: 749711 - RNA, 19 nt, Homo sapiens
ggcaucagauaucauugac

SEQ ID NO: 749712 - RNA, 19 nt, Homo sapiens
aggcugacuuggaugugaa

SEQ ID NO: 749713 - RNA, 19 nt, Homo sapiens
ucaaguccugccugaaaga

SEQ ID NO: 749714 - RNA, 19 nt, Homo sapiens
gggacuuggccuccaguga

SEQ ID NO: 749715 - RNA, 19 nt, Homo sapiens
ggagaccuagaagaugaaa

SEQ ID NO: 749716 - RNA, 19 nt, Homo sapiens
gguggagaccuagaagaug

SEQ ID NO: 749717 - RNA, 19 nt, Homo sapiens
ggaaacagcuccaaaugaa

SEQ ID NO: 749718 - RNA, 19 nt, Homo sapiens
gaaaugagcugggacaguu

SEQ ID NO: 749719 - RNA, 19 nt, Homo sapiens
ccacacagcuggacgacua

SEQ ID NO: 749720 - RNA, 19 nt, Homo sapiens
ugacaaaucuaacaccaaa

SEQ ID NO: 749721 - RNA, 19 nt, Homo sapiens
gcaagaaggccuauaccua

SEQ ID NO: 749722 - RNA, 19 nt, Homo sapiens
ggaccaaaguggaaccaaa

SEQ ID NO: 749723 - RNA, 19 nt, Homo sapiens
ucaagcagcuguuccagaa

SEQ ID NO: 749724 - RNA, 19 nt, Homo sapiens
ggaaagucaucauccaaug

SEQ ID NO: 749725 - RNA, 19 nt, Homo sapiens
caaccgaggugaugucuuc

SEQ ID NO: 749726 - RNA, 19 nt, Homo sapiens
gcgaaucacugcugacaug

SEQ ID NO: 749727 - RNA, 19 nt, Homo sapiens
gaagccacaucacaucuug

SEQ ID NO: 749728 - RNA, 19 nt, Homo sapiens
ucaaugguauggcuucuuu

SEQ ID NO: 749729 - RNA, 19 nt, Homo sapiens
gcgcugggcuucaucaaga

SEQ ID NO: 749730 - RNA, 19 nt, Homo sapiens
guugaggucuggagaauug

SEQ ID NO: 749731 - RNA, 19 nt, Homo sapiens
caagaaggccuauaccuau

SEQ ID NO: 749732 - RNA, 19 nt, Homo sapiens
gcaacccucucccugaauu

SEQ ID NO: 749733 - RNA, 19 nt, Homo sapiens
acaccaauccugaucauua

SEQ ID NO: 749734 - RNA, 19 nt, Homo sapiens
ggagguggaucggcaguuu

SEQ ID NO: 749735 - RNA, 19 nt, Homo sapiens
aagcagaaaucaacuauca

SEQ ID NO: 749736 - RNA, 19 nt, Homo sapiens
gcccagagcugaugaaggu

SEQ ID NO: 749737 - RNA, 19 nt, Homo sapiens
gagcagauagugccaauau

SEQ ID NO: 749738 - RNA, 19 nt, Homo sapiens
ucacugagaucacagacuu

SEQ ID NO: 749739 - RNA, 19 nt, Homo sapiens
caacgacccugggaucauu

SEQ ID NO: 749740 - RNA, 19 nt, Homo sapiens
aaacuccaaugaugucuuu

SEQ ID NO: 749741 - RNA, 19 nt, Homo sapiens
agaauuaccucucugaaca

SEQ ID NO: 749742 - RNA, 19 nt, Homo sapiens
caccaauccugaucauuaa

SEQ ID NO: 749743 - RNA, 19 nt, Homo sapiens
ggaagcuaguuaucuuuga

SEQ ID NO: 749744 - RNA, 19 nt, Homo sapiens
ggccgacgcuccauuauca

SEQ ID NO: 749745 - RNA, 19 nt, Homo sapiens
gaacucaggcagagcacua

SEQ ID NO: 749746 - RNA, 19 nt, Homo sapiens
agagguagcugcccaggaa

SEQ ID NO: 749747 - RNA, 19 nt, Homo sapiens
gcagaaaucaacuaucaug

SEQ ID NO: 749748 - RNA, 19 nt, Homo sapiens
ggaaaugacaaaucuaaca

SEQ ID NO: 749749 - RNA, 19 nt, Homo sapiens
caucacaucuuguacaucu

SEQ ID NO: 749750 - RNA, 19 nt, Homo sapiens
caggauaaauuugauguga

SEQ ID NO: 749751 - RNA, 19 nt, Homo sapiens
uugcauuccuugcuuguua

SEQ ID NO: 749752 - RNA, 19 nt, Homo sapiens
gugccaauaucaggaaaua

SEQ ID NO: 749753 - RNA, 19 nt, Homo sapiens
ucacagagguagcaacaag

SEQ ID NO: 749754 - RNA, 19 nt, Homo sapiens
gaacccuacugacgugaug

SEQ ID NO: 749755 - RNA, 19 nt, Homo sapiens
ggagcugccugaggaugua

SEQ ID NO: 749756 - RNA, 19 nt, Homo sapiens
gacauucagcuacuuaauu

SEQ ID NO: 749757 - RNA, 19 nt, Homo sapiens
ugaagcggcugcuacaugu

SEQ ID NO: 749758 - RNA, 19 nt, Homo sapiens
uaauagagucugcaaauca

SEQ ID NO: 749759 - RNA, 19 nt, Homo sapiens
caauaagaccggccaauuc

SEQ ID NO: 749760 - RNA, 19 nt, Homo sapiens
ggauaaauuugaugugacu

SEQ ID NO: 749761 - RNA, 19 nt, Homo sapiens
gacgugaugcuccuagaua

SEQ ID NO: 749762 - RNA, 19 nt, Homo sapiens
gagccugacccuccaguaa

SEQ ID NO: 749763 - RNA, 19 nt, Homo sapiens
gaaagaauggucgaugaug

SEQ ID NO: 749764 - RNA, 19 nt, Homo sapiens
gccaaaauauuacccuaua

SEQ ID NO: 749765 - RNA, 19 nt, Homo sapiens
gaagcuaguuaucuuugag

SEQ ID NO: 749766 - RNA, 19 nt, Homo sapiens
gaacggagccacgccacuu

SEQ ID NO: 749767 - RNA, 19 nt, Homo sapiens
gaucagaagcagaaaucaa

SEQ ID NO: 749768 - RNA, 19 nt, Homo sapiens
gccaauaucaggaaauaau

SEQ ID NO: 749769 - RNA, 19 nt, Homo sapiens
aaacagcuccaaaugaaga

SEQ ID NO: 749770 - RNA, 19 nt, Homo sapiens
ggacuuugugucuguguuu

SEQ ID NO: 749771 - RNA, 19 nt, Homo sapiens
ccaauaagaccggccaauu

SEQ ID NO: 749772 - RNA, 19 nt, Homo sapiens
gggaaaacguucagcauug

SEQ ID NO: 749773 - RNA, 19 nt, Homo sapiens
gaucauugucuggagaaua

SEQ ID NO: 749774 - RNA, 19 nt, Homo sapiens
aagaaggccuauaccuauu

SEQ ID NO: 749775 - RNA, 19 nt, Homo sapiens
gccaauucguugucacuga

SEQ ID NO: 749776 - RNA, 19 nt, Homo sapiens
cauguuguaucauaucuca

SEQ ID NO: 749777 - RNA, 19 nt, Homo sapiens
gggccgugcugaaauagga

SEQ ID NO: 749778 - RNA, 19 nt, Homo sapiens
ggauguaaacccugccaaa

SEQ ID NO: 749779 - RNA, 19 nt, Homo sapiens
acagugagccaaaauauua

SEQ ID NO: 749780 - RNA, 19 nt, Homo sapiens
uguccagucucgucucuuu

SEQ ID NO: 749781 - RNA, 19 nt, Homo sapiens
ucccuaaacuccaaugaug

SEQ ID NO: 749782 - RNA, 19 nt, Homo sapiens
ggaaagaauggucgaugau

SEQ ID NO: 749783 - RNA, 19 nt, Homo sapiens
uuccagaaguggucaguaa

SEQ ID NO: 749784 - RNA, 19 nt, Homo sapiens
gcaaaucacggcauguucu

SEQ ID NO: 749785 - RNA, 19 nt, Homo sapiens
cagguguucuuguggauug

SEQ ID NO: 749786 - RNA, 19 nt, Homo sapiens
aggaaagaauggucgauga

SEQ ID NO: 749787 - RNA, 19 nt, Homo sapiens
aagggaagcuaguuaucuu

SEQ ID NO: 749788 - RNA, 19 nt, Homo sapiens
cacggcauguucuccauuu

SEQ ID NO: 749789 - RNA, 19 nt, Homo sapiens
uauagcaguucuguugaaa

SEQ ID NO: 749790 - RNA, 19 nt, Homo sapiens
cuauagcaguucuguugaa

SEQ ID NO: 749791 - RNA, 19 nt, Homo sapiens
gggagaugcugcugcuauc

SEQ ID NO: 749792 - RNA, 19 nt, Homo sapiens
ggaauggcccagagagcaa

SEQ ID NO: 749793 - RNA, 19 nt, Homo sapiens
gaaagucaucauccaaugg

SEQ ID NO: 749794 - RNA, 19 nt, Homo sapiens
ucaaagggaagcuaguuau

SEQ ID NO: 749795 - RNA, 19 nt, Homo sapiens
uaaaugggaagccacauca

SEQ ID NO: 749796 - RNA, 19 nt, Homo sapiens
ugaagcacguggagaccaa

SEQ ID NO: 749797 - RNA, 19 nt, Homo sapiens
gggaccagguguucuugug

SEQ ID NO: 749798 - RNA, 19 nt, Homo sapiens
gcuggucccuguggaguau

SEQ ID NO: 749799 - RNA, 19 nt, Homo sapiens
gcuaaaguuuuccaggaua

SEQ ID NO: 749800 - RNA, 19 nt, Homo sapiens
ucauagaucagaagcagaa

SEQ ID NO: 749801 - RNA, 19 nt, Homo sapiens
ccgaggugaugucuucuug

SEQ ID NO: 749802 - RNA, 19 nt, Homo sapiens
ugaauucuaaugacaguga

SEQ ID NO: 749803 - RNA, 19 nt, Homo sapiens
gccuuugccuccucccuaa

SEQ ID NO: 749804 - RNA, 19 nt, Homo sapiens
caccaaagcaguggaaguu

SEQ ID NO: 749805 - RNA, 19 nt, Homo sapiens
acuguuaucugguccucua

SEQ ID NO: 749806 - RNA, 19 nt, Homo sapiens
gauauaauagagucugcaa

SEQ ID NO: 749807 - RNA, 19 nt, Homo sapiens
uaagaccggccaauucguu

SEQ ID NO: 749808 - RNA, 19 nt, Homo sapiens
gccugacccuccaguaaga

SEQ ID NO: 749809 - RNA, 19 nt, Homo sapiens
gggaagcuaguuaucuuug

SEQ ID NO: 749810 - RNA, 19 nt, Homo sapiens
gagagguccaguaccauga

SEQ ID NO: 749811 - RNA, 19 nt, Homo sapiens
gcaaaggauauucgagaca

SEQ ID NO: 749812 - RNA, 19 nt, Homo sapiens
gggaaagucaucauccaau

SEQ ID NO: 749813 - RNA, 19 nt, Homo sapiens
gaggugaugucuucuugcu

SEQ ID NO: 749814 - RNA, 19 nt, Homo sapiens
gaaaugacaaaucuaacac

SEQ ID NO: 749815 - RNA, 19 nt, Homo sapiens
cuucauggccaucuucaaa

SEQ ID NO: 749816 - RNA, 19 nt, Homo sapiens
ggaagccacaucacaucuu

SEQ ID NO: 749817 - RNA, 19 nt, Homo sapiens
gaauaaaguuguuggguau

SEQ ID NO: 749818 - RNA, 19 nt, Homo sapiens
ggagaaagaggguuuaauu

SEQ ID NO: 749819 - RNA, 19 nt, Homo sapiens
auaagaagcugaaguacua

SEQ ID NO: 749820 - RNA, 19 nt, Homo sapiens
gacaagauaugagaaauga

SEQ ID NO: 749821 - RNA, 19 nt, Homo sapiens
ggauaagugugcaaagaaa

SEQ ID NO: 749822 - RNA, 19 nt, Homo sapiens
ggcaggcucuccaauauaa

SEQ ID NO: 749823 - RNA, 19 nt, Homo sapiens
ggaaauaaagccacuguau

SEQ ID NO: 749824 - RNA, 19 nt, Homo sapiens
gagaaagaggguuuaauuu

SEQ ID NO: 749825 - RNA, 19 nt, Homo sapiens
cagauaugcugaaauuuga

SEQ ID NO: 749826 - RNA, 19 nt, Homo sapiens
gcagagugcucauuuaaaa

SEQ ID NO: 749827 - RNA, 19 nt, Homo sapiens
ccucuaaacccuucaauuu

SEQ ID NO: 749828 - RNA, 19 nt, Homo sapiens
cuauguagaucugauguua

SEQ ID NO: 749829 - RNA, 19 nt, Homo sapiens
caacuugucucugaaggaa

SEQ ID NO: 749830 - RNA, 19 nt, Homo sapiens
gggauaagaagcugaagua

SEQ ID NO: 749831 - RNA, 19 nt, Homo sapiens
caggaaggcauauguauuu

SEQ ID NO: 749832 - RNA, 19 nt, Homo sapiens
gaaugugccuucagaaacu

SEQ ID NO: 749833 - RNA, 19 nt, Homo sapiens
cccaucacauccugaauua

SEQ ID NO: 749834 - RNA, 19 nt, Homo sapiens
caagggcgaugacgauguu

SEQ ID NO: 749835 - RNA, 19 nt, Homo sapiens
caacuugccggacagauuu

SEQ ID NO: 749836 - RNA, 19 nt, Homo sapiens
guaauaauacccaaagaga

SEQ ID NO: 749837 - RNA, 19 nt, Homo sapiens
guaacauacuuucuugaga

SEQ ID NO: 749838 - RNA, 19 nt, Homo sapiens
gaauugaagguucuuauca

SEQ ID NO: 749839 - RNA, 19 nt, Homo sapiens
ggaaagcggaagaugguaa

SEQ ID NO: 749840 - RNA, 19 nt, Homo sapiens
gaaggcauauguauuuuga

SEQ ID NO: 749841 - RNA, 19 nt, Homo sapiens
uagaugguuugucaguuua

SEQ ID NO: 749842 - RNA, 19 nt, Homo sapiens
gaugauugguucugaucuu

SEQ ID NO: 749843 - RNA, 19 nt, Homo sapiens
gaacuugagugaaaagguu

SEQ ID NO: 749844 - RNA, 19 nt, Homo sapiens
ugaagguucuuaucagaug

SEQ ID NO: 749845 - RNA, 19 nt, Homo sapiens
gaucaaagaccaaaacauu

SEQ ID NO: 749846 - RNA, 19 nt, Homo sapiens
auagaugguuugucaguuu

SEQ ID NO: 749847 - RNA, 19 nt, Homo sapiens
gcaggaugauugguucuga

SEQ ID NO: 749848 - RNA, 19 nt, Homo sapiens
ggacaagauaugagaaaug

SEQ ID NO: 749849 - RNA, 19 nt, Homo sapiens
uugcauagaugguuuguca

SEQ ID NO: 749850 - RNA, 19 nt, Homo sapiens
uauuugagaugccgcaauu

SEQ ID NO: 749851 - RNA, 19 nt, Homo sapiens
gaaguaauaauacccaaag

SEQ ID NO: 749852 - RNA, 19 nt, Homo sapiens
cuacuucccauaauaauga

SEQ ID NO: 749853 - RNA, 19 nt, Homo sapiens
uugaauaguucccauguug

SEQ ID NO: 749854 - RNA, 19 nt, Homo sapiens
aauaacaucugcuccuaug

SEQ ID NO: 749855 - RNA, 19 nt, Homo sapiens
ggacgucgaagaauaaagu

SEQ ID NO: 749856 - RNA, 19 nt, Homo sapiens
ucagugugauuccuuaaug

SEQ ID NO: 749857 - RNA, 19 nt, Homo sapiens
uguuugcccucuucuauaa

SEQ ID NO: 749858 - RNA, 19 nt, Homo sapiens
guugcagagugcucauuua

SEQ ID NO: 749859 - RNA, 19 nt, Homo sapiens
cuucauaggugaugugauc

SEQ ID NO: 749860 - RNA, 19 nt, Homo sapiens
ggaacuacagagacacuuu

SEQ ID NO: 749861 - RNA, 19 nt, Homo sapiens
aagacuuucugcuguauuu

SEQ ID NO: 749862 - RNA, 19 nt, Homo sapiens
aaauuucaguugucaguug

SEQ ID NO: 749863 - RNA, 19 nt, Homo sapiens
ugaaggaagugcuguuucu

SEQ ID NO: 749864 - RNA, 19 nt, Homo sapiens
caguguuguugaugaaaua

SEQ ID NO: 749865 - RNA, 19 nt, Homo sapiens
cugcuucccugucuaugua

SEQ ID NO: 749866 - RNA, 19 nt, Homo sapiens
gaagagggaaagcggaaga

SEQ ID NO: 749867 - RNA, 19 nt, Homo sapiens
gcccugaggcuguaccaua

SEQ ID NO: 749868 - RNA, 19 nt, Homo sapiens
gcaauuauucacugcuuau

SEQ ID NO: 749869 - RNA, 19 nt, Homo sapiens
gaaccgagagcaagagaag

SEQ ID NO: 749870 - RNA, 19 nt, Homo sapiens
guacuauuguguaacauac

SEQ ID NO: 749871 - RNA, 19 nt, Homo sapiens
aagauugaauugccgcuaa

SEQ ID NO: 749872 - RNA, 19 nt, Homo sapiens
gugacacucaucuaauuua

SEQ ID NO: 749873 - RNA, 19 nt, Homo sapiens
cacaaaggcuucaggacau

SEQ ID NO: 749874 - RNA, 19 nt, Homo sapiens
gagacacuuucuucaacuu

SEQ ID NO: 749875 - RNA, 19 nt, Homo sapiens
gaacuacagagacacuuuc

SEQ ID NO: 749876 - RNA, 19 nt, Homo sapiens
uauacaguguuguugauga

SEQ ID NO: 749877 - RNA, 19 nt, Homo sapiens
gaugauggcaaaugucuuc

SEQ ID NO: 749878 - RNA, 19 nt, Homo sapiens
ucuaaacccuucaauuugg

SEQ ID NO: 749879 - RNA, 19 nt, Homo sapiens
gaaguacuacaucccagaa

SEQ ID NO: 749880 - RNA, 19 nt, Homo sapiens
cuacagagacacuuucuuc

SEQ ID NO: 749881 - RNA, 19 nt, Homo sapiens
uaagccaucugaacuacug

SEQ ID NO: 749882 - RNA, 19 nt, Homo sapiens
gggcaggcucuccaauaua

SEQ ID NO: 749883 - RNA, 19 nt, Homo sapiens
caagauaugagaaaugagu

SEQ ID NO: 749884 - RNA, 19 nt, Homo sapiens
gaaaauugccuuuaugagu

SEQ ID NO: 749885 - RNA, 19 nt, Homo sapiens
gaauaguucccauguugug

SEQ ID NO: 749886 - RNA, 19 nt, Homo sapiens
cauuugauaucgaggagaa

SEQ ID NO: 749887 - RNA, 19 nt, Homo sapiens
ccacaaugcuggaccucau

SEQ ID NO: 749888 - RNA, 19 nt, Homo sapiens
uagaaaaccucaagagaug

SEQ ID NO: 749889 - RNA, 19 nt, Homo sapiens
ggaaguaauaauacccaaa

SEQ ID NO: 749890 - RNA, 19 nt, Homo sapiens
uguuggacgucgaagaaua

SEQ ID NO: 749891 - RNA, 19 nt, Homo sapiens
ggaaugugccuucagaaac

SEQ ID NO: 749892 - RNA, 19 nt, Homo sapiens
cagagacacuuucuucaac

SEQ ID NO: 749893 - RNA, 19 nt, Homo sapiens
cgggcaggcucuccaauau

SEQ ID NO: 749894 - RNA, 19 nt, Homo sapiens
gcgggcaggcucuccaaua

SEQ ID NO: 749895 - RNA, 19 nt, Homo sapiens
gaugguuugucaguuuaaa

SEQ ID NO: 749896 - RNA, 19 nt, Homo sapiens
gaccaggaaggcauaugua

SEQ ID NO: 749897 - RNA, 19 nt, Homo sapiens
ggaccaggaaggcauaugu

SEQ ID NO: 749898 - RNA, 19 nt, Homo sapiens
gaaagcggaagaugguaau

SEQ ID NO: 749899 - RNA, 19 nt, Homo sapiens
caaaagcaguagccaagaa

SEQ ID NO: 749900 - RNA, 19 nt, Homo sapiens
gaccucaucgggauaagaa

SEQ ID NO: 749901 - RNA, 19 nt, Homo sapiens
ugagaugccgcaauuauuc

SEQ ID NO: 749902 - RNA, 19 nt, Homo sapiens
ggacuauaaacaauggaaa

SEQ ID NO: 749903 - RNA, 19 nt, Homo sapiens
cuuguacccucuuaucuga

SEQ ID NO: 749904 - RNA, 19 nt, Homo sapiens
ugauauggcaggaugauug

SEQ ID NO: 749905 - RNA, 19 nt, Homo sapiens
aaauugccuuuaugaguga

SEQ ID NO: 749906 - RNA, 19 nt, Homo sapiens
guacuacaucccagaaguu

SEQ ID NO: 749907 - RNA, 19 nt, Homo sapiens
cauccugaauuacuugaau

SEQ ID NO: 749908 - RNA, 19 nt, Homo sapiens
ccggauaagugugcaaaga

SEQ ID NO: 749909 - RNA, 19 nt, Homo sapiens
ccaggaaggcauauguauu

SEQ ID NO: 749910 - RNA, 19 nt, Homo sapiens
gauaagaagcugaaguacu

SEQ ID NO: 749911 - RNA, 19 nt, Homo sapiens
uagaucagccggauaagug

SEQ ID NO: 749912 - RNA, 19 nt, Homo sapiens
uguguaacauacuuucuug

SEQ ID NO: 749913 - RNA, 19 nt, Homo sapiens
aaccauaucguguuaguga

SEQ ID NO: 749914 - RNA, 19 nt, Homo sapiens
gaugacguuuauacuggaa

SEQ ID NO: 749915 - RNA, 19 nt, Homo sapiens
gaccaaagccaaagaucuc

SEQ ID NO: 749916 - RNA, 19 nt, Homo sapiens
ugagaagcaccaagacauu

SEQ ID NO: 749917 - RNA, 19 nt, Homo sapiens
gaauaaaguuguuggguau

SEQ ID NO: 749918 - RNA, 19 nt, Homo sapiens
ggagaaagaggguuuaauu

SEQ ID NO: 749919 - RNA, 19 nt, Homo sapiens
auaagaagcugaaguacua

SEQ ID NO: 749920 - RNA, 19 nt, Homo sapiens
gacaagauaugagaaauga

SEQ ID NO: 749921 - RNA, 19 nt, Homo sapiens
ggauaagugugcaaagaaa

SEQ ID NO: 749922 - RNA, 19 nt, Homo sapiens
ggcaggcucuccaauauaa

SEQ ID NO: 749923 - RNA, 19 nt, Homo sapiens
ggaaauaaagccacuguau

SEQ ID NO: 749924 - RNA, 19 nt, Homo sapiens
gagaaagaggguuuaauuu

SEQ ID NO: 749925 - RNA, 19 nt, Homo sapiens
cagauaugcugaaauuuga

SEQ ID NO: 749926 - RNA, 19 nt, Homo sapiens
gcagagugcucauuuaaaa

SEQ ID NO: 749927 - RNA, 19 nt, Homo sapiens
ccucuaaacccuucaauuu

SEQ ID NO: 749928 - RNA, 19 nt, Homo sapiens
cuauguagaucugauguua

SEQ ID NO: 749929 - RNA, 19 nt, Homo sapiens
caacuugucucugaaggaa

SEQ ID NO: 749930 - RNA, 19 nt, Homo sapiens
gggauaagaagcugaagua

SEQ ID NO: 749931 - RNA, 19 nt, Homo sapiens
caggaaggcauauguauuu

SEQ ID NO: 749932 - RNA, 19 nt, Homo sapiens
gaaugugccuucagaaacu

SEQ ID NO: 749933 - RNA, 19 nt, Homo sapiens
cccaucacauccugaauua

SEQ ID NO: 749934 - RNA, 19 nt, Homo sapiens
caagggcgaugacgauguu

SEQ ID NO: 749935 - RNA, 19 nt, Homo sapiens
caacuugccggacagauuu

SEQ ID NO: 749936 - RNA, 19 nt, Homo sapiens
guaauaauacccaaagaga

SEQ ID NO: 749937 - RNA, 19 nt, Homo sapiens
gaauugaagguucuuauca

SEQ ID NO: 749938 - RNA, 19 nt, Homo sapiens
ggaaagcggaagaugguaa

SEQ ID NO: 749939 - RNA, 19 nt, Homo sapiens
gaaggcauauguauuuuga

SEQ ID NO: 749940 - RNA, 19 nt, Homo sapiens
gaugauugguucugaucuu

SEQ ID NO: 749941 - RNA, 19 nt, Homo sapiens
gaacuugagugaaaagguu

SEQ ID NO: 749942 - RNA, 19 nt, Homo sapiens
ugaagguucuuaucagaug

SEQ ID NO: 749943 - RNA, 19 nt, Homo sapiens
gaucaaagaccaaaacauu

SEQ ID NO: 749944 - RNA, 19 nt, Homo sapiens
ggacaagauaugagaaaug

SEQ ID NO: 749945 - RNA, 19 nt, Homo sapiens
gcaggaugauugguucuga

SEQ ID NO: 749946 - RNA, 19 nt, Homo sapiens
uugcauagaugguuuguca

SEQ ID NO: 749947 - RNA, 19 nt, Homo sapiens
uauuugagaugccgcaauu

SEQ ID NO: 749948 - RNA, 19 nt, Homo sapiens
gaaguaauaauacccaaag

SEQ ID NO: 749949 - RNA, 19 nt, Homo sapiens
cuacuucccauaauaauga

SEQ ID NO: 749950 - RNA, 19 nt, Homo sapiens
uugaauaguucccauguug

SEQ ID NO: 749951 - RNA, 19 nt, Homo sapiens
aauaacaucugcuccuaug

SEQ ID NO: 749952 - RNA, 19 nt, Homo sapiens
ggacgucgaagaauaaagu

SEQ ID NO: 749953 - RNA, 19 nt, Homo sapiens
ucagugugauuccuuaaug

SEQ ID NO: 749954 - RNA, 19 nt, Homo sapiens
uguuugcccucuucuauaa

SEQ ID NO: 749955 - RNA, 19 nt, Homo sapiens
guugcagagugcucauuua

SEQ ID NO: 749956 - RNA, 19 nt, Homo sapiens
cuucauaggugaugugauc

SEQ ID NO: 749957 - RNA, 19 nt, Homo sapiens
ggaacuacagagacacuuu

SEQ ID NO: 749958 - RNA, 19 nt, Homo sapiens
aagacuuucugcuguauuu

SEQ ID NO: 749959 - RNA, 19 nt, Homo sapiens
aaauuucaguugucaguug

SEQ ID NO: 749960 - RNA, 19 nt, Homo sapiens
ugaaggaagugcuguuucu

SEQ ID NO: 749961 - RNA, 19 nt, Homo sapiens
caguguuguugaugaaaua

SEQ ID NO: 749962 - RNA, 19 nt, Homo sapiens
cugcuucccugucuaugua

SEQ ID NO: 749963 - RNA, 19 nt, Homo sapiens
gaagagggaaagcggaaga

SEQ ID NO: 749964 - RNA, 19 nt, Homo sapiens
gcccugaggcuguaccaua

SEQ ID NO: 749965 - RNA, 19 nt, Homo sapiens
gcaauuauucacugcuuau

SEQ ID NO: 749966 - RNA, 19 nt, Homo sapiens
gaaccgagagcaagagaag

SEQ ID NO: 749967 - RNA, 19 nt, Homo sapiens
guacuauuguguaacauac

SEQ ID NO: 749968 - RNA, 19 nt, Homo sapiens
aagauugaauugccgcuaa

SEQ ID NO: 749969 - RNA, 19 nt, Homo sapiens
gugacacucaucuaauuua

SEQ ID NO: 749970 - RNA, 19 nt, Homo sapiens
cacaaaggcuucaggacau

SEQ ID NO: 749971 - RNA, 19 nt, Homo sapiens
gagacacuuucuucaacuu

SEQ ID NO: 749972 - RNA, 19 nt, Homo sapiens
gaacuacagagacacuuuc

SEQ ID NO: 749973 - RNA, 19 nt, Homo sapiens
uauacaguguuguugauga

SEQ ID NO: 749974 - RNA, 19 nt, Homo sapiens
gcauagaugguuugucaau

SEQ ID NO: 749975 - RNA, 19 nt, Homo sapiens
gaugauggcaaaugucuuc

SEQ ID NO: 749976 - RNA, 19 nt, Homo sapiens
ucuaaacccuucaauuugg

SEQ ID NO: 749977 - RNA, 19 nt, Homo sapiens
gaaguacuacaucccagaa

SEQ ID NO: 749978 - RNA, 19 nt, Homo sapiens
cuacagagacacuuucuuc

SEQ ID NO: 749979 - RNA, 19 nt, Homo sapiens
uaagccaucugaacuacug

SEQ ID NO: 749980 - RNA, 19 nt, Homo sapiens
gggcaggcucuccaauaua

SEQ ID NO: 749981 - RNA, 19 nt, Homo sapiens
gaaaauugccuuuaugagu

SEQ ID NO: 749982 - RNA, 19 nt, Homo sapiens
gaauaguucccauguugug

SEQ ID NO: 749983 - RNA, 19 nt, Homo sapiens
cauuugauaucgaggagaa

SEQ ID NO: 749984 - RNA, 19 nt, Homo sapiens
ccacaaugcuggaccucau

SEQ ID NO: 749985 - RNA, 19 nt, Homo sapiens
caagauaugagaaaugagu

SEQ ID NO: 749986 - RNA, 19 nt, Homo sapiens
cauagaugguuugucaauu

SEQ ID NO: 749987 - RNA, 19 nt, Homo sapiens
uagaaaaccucaagagaug

SEQ ID NO: 749988 - RNA, 19 nt, Homo sapiens
ggaaguaauaauacccaaa

SEQ ID NO: 749989 - RNA, 19 nt, Homo sapiens
uguuggacgucgaagaaua

SEQ ID NO: 749990 - RNA, 19 nt, Homo sapiens
ggaaugugccuucagaaac

SEQ ID NO: 749991 - RNA, 19 nt, Homo sapiens
cagagacacuuucuucaac

SEQ ID NO: 749992 - RNA, 19 nt, Homo sapiens
cgggcaggcucuccaauau

SEQ ID NO: 749993 - RNA, 19 nt, Homo sapiens
gcgggcaggcucuccaaua

SEQ ID NO: 749994 - RNA, 19 nt, Homo sapiens
gaccaggaaggcauaugua

SEQ ID NO: 749995 - RNA, 19 nt, Homo sapiens
ggaccaggaaggcauaugu

SEQ ID NO: 749996 - RNA, 19 nt, Homo sapiens
caaaagcaguagccaagaa

SEQ ID NO: 749997 - RNA, 19 nt, Homo sapiens
gaaagcggaagaugguaau

SEQ ID NO: 749998 - RNA, 19 nt, Homo sapiens
gaccucaucgggauaagaa

SEQ ID NO: 749999 - RNA, 19 nt, Homo sapiens
ugagaugccgcaauuauuc

SEQ ID NO: 750000 - RNA, 19 nt, Homo sapiens
ggacuauaaacaauggaaa

SEQ ID NO: 750001 - RNA, 19 nt, Homo sapiens
cuuguacccucuuaucuga

SEQ ID NO: 750002 - RNA, 19 nt, Homo sapiens
ugauauggcaggaugauug

SEQ ID NO: 750003 - RNA, 19 nt, Homo sapiens
aaauugccuuuaugaguga

SEQ ID NO: 750004 - RNA, 19 nt, Homo sapiens
guacuacaucccagaaguu

SEQ ID NO: 750005 - RNA, 19 nt, Homo sapiens
cauccugaauuacuugaau

SEQ ID NO: 750006 - RNA, 19 nt, Homo sapiens
ccggauaagugugcaaaga

SEQ ID NO: 750007 - RNA, 19 nt, Homo sapiens
ccaggaaggcauauguauu

SEQ ID NO: 750008 - RNA, 19 nt, Homo sapiens
gauaagaagcugaaguacu

SEQ ID NO: 750009 - RNA, 19 nt, Homo sapiens
uagaucagccggauaagug

SEQ ID NO: 750010 - RNA, 19 nt, Homo sapiens
uguguaacauacuuucuug

SEQ ID NO: 750011 - RNA, 19 nt, Homo sapiens
aaccauaucguguuaguga

SEQ ID NO: 750012 - RNA, 19 nt, Homo sapiens
gaugacguuuauacuggaa

SEQ ID NO: 750013 - RNA, 19 nt, Homo sapiens
gaccaaagccaaagaucuc

SEQ ID NO: 750014 - RNA, 19 nt, Homo sapiens
ugagaagcaccaagacauu

SEQ ID NO: 750015 - RNA, 19 nt, Homo sapiens
cgcaauuauucacugcuua

SEQ ID NO: 750016 - RNA, 19 nt, Homo sapiens
guaacugcuucccugucua

SEQ ID NO: 750017 - RNA, 19 nt, Homo sapiens
gauaauaaguguucugugu

SEQ ID NO: 750018 - RNA, 19 nt, Homo sapiens
gagaauaccuucaaguaca

SEQ ID NO: 750019 - RNA, 19 nt, Homo sapiens
uagaggagcuuagaguuua

SEQ ID NO: 750020 - RNA, 19 nt, Homo sapiens
ucacuaagcgucuccaaua

SEQ ID NO: 750021 - RNA, 19 nt, Homo sapiens
gagccaagcugcacgaugu

SEQ ID NO: 750022 - RNA, 19 nt, Homo sapiens
gcgagaauaccuucaagua

SEQ ID NO: 750023 - RNA, 19 nt, Homo sapiens
cuaagcgucuccaauauga

SEQ ID NO: 750024 - RNA, 19 nt, Homo sapiens
ccaaagaaagcaucauauu

SEQ ID NO: 750025 - RNA, 19 nt, Homo sapiens
aaagaagucuguugcuaug

SEQ ID NO: 750026 - RNA, 19 nt, Homo sapiens
gaucauacccucagagucu

SEQ ID NO: 750027 - RNA, 19 nt, Homo sapiens
gagcggcgauggcacaugu

SEQ ID NO: 750028 - RNA, 19 nt, Homo sapiens
ugacuggucugugauagaa

SEQ ID NO: 750029 - RNA, 19 nt, Homo sapiens
cgucugggauguucucaaa

SEQ ID NO: 750030 - RNA, 19 nt, Homo sapiens
ggaacaaaguccugugcau

SEQ ID NO: 750031 - RNA, 19 nt, Homo sapiens
caguagaauucagcaguua

SEQ ID NO: 750032 - RNA, 19 nt, Homo sapiens
gauagaagcaaauuccaau

SEQ ID NO: 750033 - RNA, 19 nt, Homo sapiens
cuaaucaucuucugacagu

SEQ ID NO: 750034 - RNA, 19 nt, Homo sapiens
gcuguuugcuggauacaau

SEQ ID NO: 750035 - RNA, 19 nt, Homo sapiens
ccaguagaauucagcaguu

SEQ ID NO: 750036 - RNA, 19 nt, Homo sapiens
guggugguuuggauaauaa

SEQ ID NO: 750037 - RNA, 19 nt, Homo sapiens
gggauuccuucaccacaaa

SEQ ID NO: 750038 - RNA, 19 nt, Homo sapiens
cuucagcacugcgagaaua

SEQ ID NO: 750039 - RNA, 19 nt, Homo sapiens
auaguagccucaacucauu

SEQ ID NO: 750040 - RNA, 19 nt, Homo sapiens
gggcugacguccucugcuu

SEQ ID NO: 750041 - RNA, 19 nt, Homo sapiens
cauguauaccugagaauuu

SEQ ID NO: 750042 - RNA, 19 nt, Homo sapiens
auagggagguugccaucua

SEQ ID NO: 750043 - RNA, 19 nt, Homo sapiens
uaauaaguguucuguguac

SEQ ID NO: 750044 - RNA, 19 nt, Homo sapiens
acagugcacucauguauac

SEQ ID NO: 750045 - RNA, 19 nt, Homo sapiens
gacagugcacucauguaua

SEQ ID NO: 750046 - RNA, 19 nt, Homo sapiens
ggucugugauagaagcaaa

SEQ ID NO: 750047 - RNA, 19 nt, Homo sapiens
gagcuuagaguuuauugca

SEQ ID NO: 750048 - RNA, 19 nt, Homo sapiens
ugacagugcacucauguau

SEQ ID NO: 750049 - RNA, 19 nt, Homo sapiens
cuagaggagcuuagaguuu

SEQ ID NO: 750050 - RNA, 19 nt, Homo sapiens
ugccaucuauuccaaagaa

SEQ ID NO: 750051 - RNA, 19 nt, Homo sapiens
ggagaugccuuugcuucag

SEQ ID NO: 750052 - RNA, 19 nt, Homo sapiens
ggugauggcaugugcuuau

SEQ ID NO: 750053 - RNA, 19 nt, Homo sapiens
acugucaccucuggaaaua

SEQ ID NO: 750054 - RNA, 19 nt, Homo sapiens
uagaguuuauugcagugua

SEQ ID NO: 750055 - RNA, 19 nt, Homo sapiens
aagaaagcaucauauuugg

SEQ ID NO: 750056 - RNA, 19 nt, Homo sapiens
cuacgugucgccucuauga

SEQ ID NO: 750057 - RNA, 19 nt, Homo sapiens
gcaaagauaagaggaggau

SEQ ID NO: 750058 - RNA, 19 nt, Homo sapiens
cacuaagcgucuccaauau

SEQ ID NO: 750059 - RNA, 19 nt, Homo sapiens
uguggugguuuggauaaua

SEQ ID NO: 750060 - RNA, 19 nt, Homo sapiens
gaccagaaggacccucaaa

SEQ ID NO: 750061 - RNA, 19 nt, Homo sapiens
guagaauucagcaguuaau

SEQ ID NO: 750062 - RNA, 19 nt, Homo sapiens
caaaggccacgggaacaaa

SEQ ID NO: 750063 - RNA, 19 nt, Homo sapiens
ucaacaguguccgguacua

SEQ ID NO: 750064 - RNA, 19 nt, Homo sapiens
ugucaccucuggaaauaca

SEQ ID NO: 750065 - RNA, 19 nt, Homo sapiens
uagggagguugccaucuau

SEQ ID NO: 750066 - RNA, 19 nt, Homo sapiens
acuggugacuggucuguga

SEQ ID NO: 750067 - RNA, 19 nt, Homo sapiens
uauaguagccucaacucau

SEQ ID NO: 750068 - RNA, 19 nt, Homo sapiens
ucugauauuucucgaugug

SEQ ID NO: 750069 - RNA, 19 nt, Homo sapiens
ggacuggugcaaagauaag

SEQ ID NO: 750070 - RNA, 19 nt, Homo sapiens
agaagucuguugcuaugca

SEQ ID NO: 750071 - RNA, 19 nt, Homo sapiens
acaaaguccugugcaugga

SEQ ID NO: 750072 - RNA, 19 nt, Homo sapiens
cauccuguuuggacaugaa

SEQ ID NO: 750073 - RNA, 19 nt, Homo sapiens
ccagaaggacccucaaagg

SEQ ID NO: 750074 - RNA, 19 nt, Homo sapiens
cgagaauaccuucaaguac

SEQ ID NO: 750075 - RNA, 19 nt, Homo sapiens
ggacaugaaaaccgcguua

SEQ ID NO: 750076 - RNA, 19 nt, Homo sapiens
aaaccgcguuagcacucua

SEQ ID NO: 750077 - RNA, 19 nt, Homo sapiens
ggauacaaugauuacacua

SEQ ID NO: 750078 - RNA, 19 nt, Homo sapiens
gcaggccuuugaaacacau

SEQ ID NO: 750079 - RNA, 19 nt, Homo sapiens
gugauggcaugugcuuaug

SEQ ID NO: 750080 - RNA, 19 nt, Homo sapiens
gcagcuucaccaacucuga

SEQ ID NO: 750081 - RNA, 19 nt, Homo sapiens
auguauaccugagaauuug

SEQ ID NO: 750082 - RNA, 19 nt, Homo sapiens
uuccaaagaaagcaucaua

SEQ ID NO: 750083 - RNA, 19 nt, Homo sapiens
gccaucuauuccaaagaaa

SEQ ID NO: 750084 - RNA, 19 nt, Homo sapiens
gggagguugccaucuauuc

SEQ ID NO: 750085 - RNA, 19 nt, Homo sapiens
ccucuggaagugcugauuu

SEQ ID NO: 750086 - RNA, 19 nt, Homo sapiens
aaacugucaccucuggaaa

SEQ ID NO: 750087 - RNA, 19 nt, Homo sapiens
agaggagcuuagaguuuau

SEQ ID NO: 750088 - RNA, 19 nt, Homo sapiens
ugggauuccuucaccacaa

SEQ ID NO: 750089 - RNA, 19 nt, Homo sapiens
ugauagaagcaaauuccaa

SEQ ID NO: 750090 - RNA, 19 nt, Homo sapiens
ggacugaggacuggugacu

SEQ ID NO: 750091 - RNA, 19 nt, Homo sapiens
agaauaccuucaaguacag

SEQ ID NO: 750092 - RNA, 19 nt, Homo sapiens
ucaaaggccacgggaacaa

SEQ ID NO: 750093 - RNA, 19 nt, Homo sapiens
ucauguauaccugagaauu

SEQ ID NO: 750094 - RNA, 19 nt, Homo sapiens
gggccuaaucaucuucuga

SEQ ID NO: 750095 - RNA, 19 nt, Homo sapiens
ucugggauguucucaaagg

SEQ ID NO: 750096 - RNA, 19 nt, Homo sapiens
uggaagugcugauuuuaug

SEQ ID NO: 750097 - RNA, 19 nt, Homo sapiens
auggacuggugcaaagaua

SEQ ID NO: 750098 - RNA, 19 nt, Homo sapiens
gaggagcuuagaguuuauu

SEQ ID NO: 750099 - RNA, 19 nt, Homo sapiens
guauaccugagaauuugaa

SEQ ID NO: 750100 - RNA, 19 nt, Homo sapiens
gggaucauacccucagagu

SEQ ID NO: 750101 - RNA, 19 nt, Homo sapiens
uggauacaaugauuacacu

SEQ ID NO: 750102 - RNA, 19 nt, Homo sapiens
gcgggcagauagggagguu

SEQ ID NO: 750103 - RNA, 19 nt, Homo sapiens
ggugacuggucugugauag

SEQ ID NO: 750104 - RNA, 19 nt, Homo sapiens
ggacuggugacuggucugu

SEQ ID NO: 750105 - RNA, 19 nt, Homo sapiens
uuuauugcaguguagcuua

SEQ ID NO: 750106 - RNA, 19 nt, Homo sapiens
gugcaggccuuugaaacac

SEQ ID NO: 750107 - RNA, 19 nt, Homo sapiens
gcagagcuuccacggacau

SEQ ID NO: 750108 - RNA, 19 nt, Homo sapiens
gccugcagcuucaccaacu

SEQ ID NO: 750109 - RNA, 19 nt, Homo sapiens
gaucagaccuuucucguua

SEQ ID NO: 750110 - RNA, 19 nt, Homo sapiens
gauaauaaguguucugugu

SEQ ID NO: 750111 - RNA, 19 nt, Homo sapiens
gagaauaccuucaaguaca

SEQ ID NO: 750112 - RNA, 19 nt, Homo sapiens
uagaggagcuuagaguuua

SEQ ID NO: 750113 - RNA, 19 nt, Homo sapiens
ucacuaagcgucuccaaua

SEQ ID NO: 750114 - RNA, 19 nt, Homo sapiens
gagccaagcugcacgaugu

SEQ ID NO: 750115 - RNA, 19 nt, Homo sapiens
caacucagcuacuguucaa

SEQ ID NO: 750116 - RNA, 19 nt, Homo sapiens
gcgagaauaccuucaagua

SEQ ID NO: 750117 - RNA, 19 nt, Homo sapiens
caagaagucucaacaacuc

SEQ ID NO: 750118 - RNA, 19 nt, Homo sapiens
cuaagcgucuccaauauga

SEQ ID NO: 750119 - RNA, 19 nt, Homo sapiens
gaagcuuuaucuuggguaa

SEQ ID NO: 750120 - RNA, 19 nt, Homo sapiens
ccaaagaaagcaucauauu

SEQ ID NO: 750121 - RNA, 19 nt, Homo sapiens
aaagaagucuguugcuaug

SEQ ID NO: 750122 - RNA, 19 nt, Homo sapiens
gaucauacccucagagucu

SEQ ID NO: 750123 - RNA, 19 nt, Homo sapiens
gagcggcgauggcacaugu

SEQ ID NO: 750124 - RNA, 19 nt, Homo sapiens
guauuuggcucaugugaca

SEQ ID NO: 750125 - RNA, 19 nt, Homo sapiens
ugacuggucugugauagaa

SEQ ID NO: 750126 - RNA, 19 nt, Homo sapiens
cgucugggauguucucaaa

SEQ ID NO: 750127 - RNA, 19 nt, Homo sapiens
ggaacaaaguccugugcau

SEQ ID NO: 750128 - RNA, 19 nt, Homo sapiens
caacaugugcagaaauuau

SEQ ID NO: 750129 - RNA, 19 nt, Homo sapiens
caguagaauucagcaguua

SEQ ID NO: 750130 - RNA, 19 nt, Homo sapiens
gauagaagcaaauuccaau

SEQ ID NO: 750131 - RNA, 19 nt, Homo sapiens
cuaaucaucuucugacagu

SEQ ID NO: 750132 - RNA, 19 nt, Homo sapiens
gcuguuugcuggauacaau

SEQ ID NO: 750133 - RNA, 19 nt, Homo sapiens
gcucaugugacaaauguuu

SEQ ID NO: 750134 - RNA, 19 nt, Homo sapiens
ccaguagaauucagcaguu

SEQ ID NO: 750135 - RNA, 19 nt, Homo sapiens
guggugguuuggauaauaa

SEQ ID NO: 750136 - RNA, 19 nt, Homo sapiens
gggauuccuucaccacaaa

SEQ ID NO: 750137 - RNA, 19 nt, Homo sapiens
cuucagcacugcgagaaua

SEQ ID NO: 750138 - RNA, 19 nt, Homo sapiens
auaguagccucaacucauu

SEQ ID NO: 750139 - RNA, 19 nt, Homo sapiens
gggcugacguccucugcuu

SEQ ID NO: 750140 - RNA, 19 nt, Homo sapiens
gaugugugaucagaccuuu

SEQ ID NO: 750141 - RNA, 19 nt, Homo sapiens
cauguauaccugagaauuu

SEQ ID NO: 750142 - RNA, 19 nt, Homo sapiens
auagggagguugccaucua

SEQ ID NO: 750143 - RNA, 19 nt, Homo sapiens
uaauaaguguucuguguac

SEQ ID NO: 750144 - RNA, 19 nt, Homo sapiens
uaauguauuuggcucaugu

SEQ ID NO: 750145 - RNA, 19 nt, Homo sapiens
acagugcacucauguauac

SEQ ID NO: 750146 - RNA, 19 nt, Homo sapiens
gacagugcacucauguaua

SEQ ID NO: 750147 - RNA, 19 nt, Homo sapiens
ggucugugauagaagcaaa

SEQ ID NO: 750148 - RNA, 19 nt, Homo sapiens
gagcuuagaguuuauugca

SEQ ID NO: 750149 - RNA, 19 nt, Homo sapiens
ugacagugcacucauguau

SEQ ID NO: 750150 - RNA, 19 nt, Homo sapiens
cuagaggagcuuagaguuu

SEQ ID NO: 750151 - RNA, 19 nt, Homo sapiens
ugccaucuauuccaaagaa

SEQ ID NO: 750152 - RNA, 19 nt, Homo sapiens
gguaaaagaugugugauca

SEQ ID NO: 750153 - RNA, 19 nt, Homo sapiens
agaccuuucucguuaaugu

SEQ ID NO: 750154 - RNA, 19 nt, Homo sapiens
ggagaugccuuugcuucag

SEQ ID NO: 750155 - RNA, 19 nt, Homo sapiens
ggugauggcaugugcuuau

SEQ ID NO: 750156 - RNA, 19 nt, Homo sapiens
uaaaagaugugugaucaga

SEQ ID NO: 750157 - RNA, 19 nt, Homo sapiens
acugucaccucuggaaaua

SEQ ID NO: 750158 - RNA, 19 nt, Homo sapiens
uagaguuuauugcagugua

SEQ ID NO: 750159 - RNA, 19 nt, Homo sapiens
aagaaagcaucauauuugg

SEQ ID NO: 750160 - RNA, 19 nt, Homo sapiens
cuacgugucgccucuauga

SEQ ID NO: 750161 - RNA, 19 nt, Homo sapiens
gcaaagauaagaggaggau

SEQ ID NO: 750162 - RNA, 19 nt, Homo sapiens
uucaacaugugcagaaauu

SEQ ID NO: 750163 - RNA, 19 nt, Homo sapiens
cacuaagcgucuccaauau

SEQ ID NO: 750164 - RNA, 19 nt, Homo sapiens
uguggugguuuggauaaua

SEQ ID NO: 750165 - RNA, 19 nt, Homo sapiens
caaacaacgagcucugaga

SEQ ID NO: 750166 - RNA, 19 nt, Homo sapiens
uggcucaugugacaaaugu

SEQ ID NO: 750167 - RNA, 19 nt, Homo sapiens
gaccagaaggacccucaaa

SEQ ID NO: 750168 - RNA, 19 nt, Homo sapiens
guagaauucagcaguuaau

SEQ ID NO: 750169 - RNA, 19 nt, Homo sapiens
ucaacaguguccgguacua

SEQ ID NO: 750170 - RNA, 19 nt, Homo sapiens
caaaggccacgggaacaaa

SEQ ID NO: 750171 - RNA, 19 nt, Homo sapiens
ugucaccucuggaaauaca

SEQ ID NO: 750172 - RNA, 19 nt, Homo sapiens
uagggagguugccaucuau

SEQ ID NO: 750173 - RNA, 19 nt, Homo sapiens
acuggugacuggucuguga

SEQ ID NO: 750174 - RNA, 19 nt, Homo sapiens
uauaguagccucaacucau

SEQ ID NO: 750175 - RNA, 19 nt, Homo sapiens
ucugauauuucucgaugug

SEQ ID NO: 750176 - RNA, 19 nt, Homo sapiens
agaagucuguugcuaugca

SEQ ID NO: 750177 - RNA, 19 nt, Homo sapiens
ucagaccuuucucguuaau

SEQ ID NO: 750178 - RNA, 19 nt, Homo sapiens
ggacuggugcaaagauaag

SEQ ID NO: 750179 - RNA, 19 nt, Homo sapiens
cauccuguuuggacaugaa

SEQ ID NO: 750180 - RNA, 19 nt, Homo sapiens
acaaaguccugugcaugga

SEQ ID NO: 750181 - RNA, 19 nt, Homo sapiens
ccagaaggacccucaaagg

SEQ ID NO: 750182 - RNA, 19 nt, Homo sapiens
cgagaauaccuucaaguac

SEQ ID NO: 750183 - RNA, 19 nt, Homo sapiens
ggacaugaaaaccgcguua

SEQ ID NO: 750184 - RNA, 19 nt, Homo sapiens
aaaccgcguuagcacucua

SEQ ID NO: 750185 - RNA, 19 nt, Homo sapiens
ggauacaaugauuacacua

SEQ ID NO: 750186 - RNA, 19 nt, Homo sapiens
gcaggccuuugaaacacau

SEQ ID NO: 750187 - RNA, 19 nt, Homo sapiens
gaccuuucucguuaaugua

SEQ ID NO: 750188 - RNA, 19 nt, Homo sapiens
gcagcuucaccaacucuga

SEQ ID NO: 750189 - RNA, 19 nt, Homo sapiens
gugauggcaugugcuuaug

SEQ ID NO: 750190 - RNA, 19 nt, Homo sapiens
ucaagaagucucaacaacu

SEQ ID NO: 750191 - RNA, 19 nt, Homo sapiens
auguauaccugagaauuug

SEQ ID NO: 750192 - RNA, 19 nt, Homo sapiens
uuccaaagaaagcaucaua

SEQ ID NO: 750193 - RNA, 19 nt, Homo sapiens
gccaucuauuccaaagaaa

SEQ ID NO: 750194 - RNA, 19 nt, Homo sapiens
gggagguugccaucuauuc

SEQ ID NO: 750195 - RNA, 19 nt, Homo sapiens
ucaacaugugcagaaauua

SEQ ID NO: 750196 - RNA, 19 nt, Homo sapiens
ccucuggaagugcugauuu

SEQ ID NO: 750197 - RNA, 19 nt, Homo sapiens
aaacugucaccucuggaaa

SEQ ID NO: 750198 - RNA, 19 nt, Homo sapiens
agaggagcuuagaguuuau

SEQ ID NO: 750199 - RNA, 19 nt, Homo sapiens
ugggauuccuucaccacaa

SEQ ID NO: 750200 - RNA, 19 nt, Homo sapiens
ugauagaagcaaauuccaa

SEQ ID NO: 750201 - RNA, 19 nt, Homo sapiens
ggacugaggacuggugacu

SEQ ID NO: 750202 - RNA, 19 nt, Homo sapiens
agaauaccuucaaguacag

SEQ ID NO: 750203 - RNA, 19 nt, Homo sapiens
ucauguauaccugagaauu

SEQ ID NO: 750204 - RNA, 19 nt, Homo sapiens
gggccuaaucaucuucuga

SEQ ID NO: 750205 - RNA, 19 nt, Homo sapiens
ucugggauguucucaaagg

SEQ ID NO: 750206 - RNA, 19 nt, Homo sapiens
ucaaaggccacgggaacaa

SEQ ID NO: 750207 - RNA, 19 nt, Homo sapiens
uggaagugcugauuuuaug

SEQ ID NO: 750208 - RNA, 19 nt, Homo sapiens
ugagaccaguuuucaagaa

SEQ ID NO: 750209 - RNA, 19 nt, Homo sapiens
ggacaaagcuaauugaucu

SEQ ID NO: 750210 - RNA, 19 nt, Homo sapiens
gaagccaggaggucuauga

SEQ ID NO: 750211 - RNA, 19 nt, Homo sapiens
uaucucaacucuggaaaga

SEQ ID NO: 750212 - RNA, 19 nt, Homo sapiens
gaccaagccuucuuaucuc

SEQ ID NO: 750213 - RNA, 19 nt, Homo sapiens
gcacugcugggagccauua

SEQ ID NO: 750214 - RNA, 19 nt, Homo sapiens
ggagggacaaagcuaauug

SEQ ID NO: 750215 - RNA, 19 nt, Homo sapiens
uauacuggcuggccucuuc

SEQ ID NO: 750216 - RNA, 19 nt, Homo sapiens
gggccacccucucuacuuc

SEQ ID NO: 750217 - RNA, 19 nt, Homo sapiens
gugcugcgguugucccauu

SEQ ID NO: 750218 - RNA, 19 nt, Homo sapiens
gcugguucguucucuacua

SEQ ID NO: 750219 - RNA, 19 nt, Homo sapiens
aaagcuaauugaucuguca

SEQ ID NO: 750220 - RNA, 19 nt, Homo sapiens
cauccugggugacaacuuc

SEQ ID NO: 750221 - RNA, 19 nt, Homo sapiens
agaccaagccuucuuaucu

SEQ ID NO: 750222 - RNA, 19 nt, Homo sapiens
gaauaaaggggcuguguga

SEQ ID NO: 750223 - RNA, 19 nt, Homo sapiens
gcuggccucuucucuguca

SEQ ID NO: 750224 - RNA, 19 nt, Homo sapiens
gcagccaucagcccacaaa

SEQ ID NO: 750225 - RNA, 19 nt, Homo sapiens
ccuaagacuggacaacuuu

SEQ ID NO: 750226 - RNA, 19 nt, Homo sapiens
gagggacaaagcuaauuga

SEQ ID NO: 750227 - RNA, 19 nt, Homo sapiens
uggcuggccucuucucugu

SEQ ID NO: 750228 - RNA, 19 nt, Homo sapiens
uacuuugucuucaugaaug

SEQ ID NO: 750229 - RNA, 19 nt, Homo sapiens
gaucgagggcugguucguu

SEQ ID NO: 750230 - RNA, 19 nt, Homo sapiens
gggacaaagcuaauugauc

SEQ ID NO: 750231 - RNA, 19 nt, Homo sapiens
ggugcugccuggaguccuu

SEQ ID NO: 750232 - RNA, 19 nt, Homo sapiens
gauacauccugggugacaa

SEQ ID NO: 750233 - RNA, 19 nt, Homo sapiens
caagggagacagccgauac

SEQ ID NO: 750234 - RNA, 19 nt, Homo sapiens
ggagaccaagccuucuuau

SEQ ID NO: 750235 - RNA, 19 nt, Homo sapiens
auacuggccucagcaccua

SEQ ID NO: 750236 - RNA, 19 nt, Homo sapiens
gagaagccaggaggucuau

SEQ ID NO: 750237 - RNA, 19 nt, Homo sapiens
uggagaccaagccuucuua

SEQ ID NO: 750238 - RNA, 19 nt, Homo sapiens
gugcugguuugcagugugu

SEQ ID NO: 750239 - RNA, 19 nt, Homo sapiens
aagccaagagcaagaagaa

SEQ ID NO: 750240 - RNA, 19 nt, Homo sapiens
gggaugugcucuacuuccu

SEQ ID NO: 750241 - RNA, 19 nt, Homo sapiens
caagagcaagaagaacuga

SEQ ID NO: 750242 - RNA, 19 nt, Homo sapiens
gccaagagcaagaagaacu

SEQ ID NO: 750243 - RNA, 19 nt, Homo sapiens
cuggaguccuugugcuuga

SEQ ID NO: 750244 - RNA, 19 nt, Homo sapiens
gagaccaagccuucuuauc

SEQ ID NO: 750245 - RNA, 19 nt, Homo sapiens
gacugucccugugcugguu

SEQ ID NO: 750246 - RNA, 19 nt, Homo sapiens
ccgcuucauucuacagcuu

SEQ ID NO: 750247 - RNA, 19 nt, Homo sapiens
cuacgaagaccugcuugga

SEQ ID NO: 750248 - RNA, 19 nt, Homo sapiens
gccaucagcccacaaagac

SEQ ID NO: 750249 - RNA, 19 nt, Homo sapiens
ccaagagcaagaagaacug

SEQ ID NO: 750250 - RNA, 19 nt, Homo sapiens
gggagacagccgauacauc

SEQ ID NO: 750251 - RNA, 19 nt, Homo sapiens
caagccuucuuaucucaac

SEQ ID NO: 750252 - RNA, 19 nt, Homo sapiens
gcaguguguggguucauuc

SEQ ID NO: 750253 - RNA, 19 nt, Homo sapiens
agagaagccaggaggucua

SEQ ID NO: 750254 - RNA, 19 nt, Homo sapiens
caucagcccacaaagacau

SEQ ID NO: 750255 - RNA, 19 nt, Homo sapiens
ggaggcagcuguagugaga

SEQ ID NO: 750256 - RNA, 19 nt, Homo sapiens
gaaucgcccugaagaugua

SEQ ID NO: 750257 - RNA, 19 nt, Homo sapiens
gagcauggcuucugugaac

SEQ ID NO: 750258 - RNA, 19 nt, Homo sapiens
gaaaugaauuggguagagu

SEQ ID NO: 750259 - RNA, 19 nt, Homo sapiens
ggaguuaggagaccagauu

SEQ ID NO: 750260 - RNA, 19 nt, Homo sapiens
caucuacgcucgggaggua

SEQ ID NO: 750261 - RNA, 19 nt, Homo sapiens
ugagcuaccugccaucuuc

SEQ ID NO: 750262 - RNA, 19 nt, Homo sapiens
cuaacuuacuuucauccua

SEQ ID NO: 750263 - RNA, 19 nt, Homo sapiens
ggaaucgcccugaagaugu

SEQ ID NO: 750264 - RNA, 19 nt, Homo sapiens
gaacccgugugccaaugga

SEQ ID NO: 750265 - RNA, 19 nt, Homo sapiens
uaccugccaucuucucuuu

SEQ ID NO: 750266 - RNA, 19 nt, Homo sapiens
gcacucaacaaccuaagga

SEQ ID NO: 750267 - RNA, 19 nt, Homo sapiens
ggugacaugugcagaugga

SEQ ID NO: 750268 - RNA, 19 nt, Homo sapiens
caccuucucuuucaucauc

SEQ ID NO: 750269 - RNA, 19 nt, Homo sapiens
uugcaucccucuuaucguu

SEQ ID NO: 750270 - RNA, 19 nt, Homo sapiens
gcucguccguagauuggaa

SEQ ID NO: 750271 - RNA, 19 nt, Homo sapiens
ugaaaugaauuggguagag

SEQ ID NO: 750272 - RNA, 19 nt, Homo sapiens
acacccagguccuuugaau

SEQ ID NO: 750273 - RNA, 19 nt, Homo sapiens
uaucugcuccuuccaucua

SEQ ID NO: 750274 - RNA, 19 nt, Homo sapiens
ccuggcaccuucucuuuca

SEQ ID NO: 750275 - RNA, 19 nt, Homo sapiens
guucuaacuuacuuucauc

SEQ ID NO: 750276 - RNA, 19 nt, Homo sapiens
gaagauguagacccucaag

SEQ ID NO: 750277 - RNA, 19 nt, Homo sapiens
gccaauggaggcagcugua

SEQ ID NO: 750278 - RNA, 19 nt, Homo sapiens
gugaacagcccggugaaug

SEQ ID NO: 750279 - RNA, 19 nt, Homo sapiens
ggccuggcaccuucucuuu

SEQ ID NO: 750280 - RNA, 19 nt, Homo sapiens
ucccuacccuuccucgauu

SEQ ID NO: 750281 - RNA, 19 nt, Homo sapiens
ccucaagggauuuauguca

SEQ ID NO: 750282 - RNA, 19 nt, Homo sapiens
gauucuguccgugaaauga

SEQ ID NO: 750283 - RNA, 19 nt, Homo sapiens
ccucgauucuguccgugaa

SEQ ID NO: 750284 - RNA, 19 nt, Homo sapiens
gagacacccagguccuuug

SEQ ID NO: 750285 - RNA, 19 nt, Homo sapiens
gggaacccgugugccaaug

SEQ ID NO: 750286 - RNA, 19 nt, Homo sapiens
gagcucguccguagauugg

SEQ ID NO: 750287 - RNA, 19 nt, Homo sapiens
gaugcacucaacaaccuaa

SEQ ID NO: 750288 - RNA, 19 nt, Homo sapiens
cugcagccaugccgcaaug

SEQ ID NO: 750289 - RNA, 19 nt, Homo sapiens
ucuacgggcugcgguguga

SEQ ID NO: 750290 - RNA, 19 nt, Homo sapiens
gggagcugcgcuucucgua

SEQ ID NO: 750291 - RNA, 19 nt, Homo sapiens
gcaucccucuuaucguuuu

SEQ ID NO: 750292 - RNA, 19 nt, Homo sapiens
uggaaucgcccugaagaug

SEQ ID NO: 750293 - RNA, 19 nt, Homo sapiens
gacccucagcgcuaccuuu

SEQ ID NO: 750294 - RNA, 19 nt, Homo sapiens
ccacugcccaccugguuuc

SEQ ID NO: 750295 - RNA, 19 nt, Homo sapiens
gauccuagcgcucauuuuc

SEQ ID NO: 750296 - RNA, 19 nt, Homo sapiens
guuaggagaccagauugga

SEQ ID NO: 750297 - RNA, 19 nt, Homo sapiens
gaguuaggagaccagauug

SEQ ID NO: 750298 - RNA, 19 nt, Homo sapiens
ggcaccuucucuuucauca

SEQ ID NO: 750299 - RNA, 19 nt, Homo sapiens
ugagacacccagguccuuu

SEQ ID NO: 750300 - RNA, 19 nt, Homo sapiens
cgagcucguccguagauug

SEQ ID NO: 750301 - RNA, 19 nt, Homo sapiens
cggaugcacucaacaaccu

SEQ ID NO: 750302 - RNA, 19 nt, Homo sapiens
gcacugaccugccuucuga

SEQ ID NO: 750303 - RNA, 19 nt, Homo sapiens
gagagaaacuauccuuauu

SEQ ID NO: 750304 - RNA, 19 nt, Homo sapiens
ugagggaucuucuucaaua

SEQ ID NO: 750305 - RNA, 19 nt, Homo sapiens
gaagagaugaagaaacuua

SEQ ID NO: 750306 - RNA, 19 nt, Homo sapiens
gcacacacuuucccuauau

SEQ ID NO: 750307 - RNA, 19 nt, Homo sapiens
acaagugggugaauuauuu

SEQ ID NO: 750308 - RNA, 19 nt, Homo sapiens
auacaucgcuugcuucuuu

SEQ ID NO: 750309 - RNA, 19 nt, Homo sapiens
gaugauuacugcagauauu

SEQ ID NO: 750310 - RNA, 19 nt, Homo sapiens
gaaacuauccuuauuccuu

SEQ ID NO: 750311 - RNA, 19 nt, Homo sapiens
gcuaggauguagaaauauu

SEQ ID NO: 750312 - RNA, 19 nt, Homo sapiens
ugaaauuccucccugauga

SEQ ID NO: 750313 - RNA, 19 nt, Homo sapiens
cugcuaaccuuccaccuua

SEQ ID NO: 750314 - RNA, 19 nt, Homo sapiens
cugcuaggauguagaaaua

SEQ ID NO: 750315 - RNA, 19 nt, Homo sapiens
caggaacaguuauuuagaa

SEQ ID NO: 750316 - RNA, 19 nt, Homo sapiens
gugggugaauuauuugaua

SEQ ID NO: 750317 - RNA, 19 nt, Homo sapiens
uaagauaagucugcuagga

SEQ ID NO: 750318 - RNA, 19 nt, Homo sapiens
gguaugcuguugaugugua

SEQ ID NO: 750319 - RNA, 19 nt, Homo sapiens
ggagccacguuacuaauag

SEQ ID NO: 750320 - RNA, 19 nt, Homo sapiens
guaagucaauccaggaaca

SEQ ID NO: 750321 - RNA, 19 nt, Homo sapiens
cugaugagccguacauuaa

SEQ ID NO: 750322 - RNA, 19 nt, Homo sapiens
ggaacguucuacuuugguu

SEQ ID NO: 750323 - RNA, 19 nt, Homo sapiens
caguaugguuacauugaua

SEQ ID NO: 750324 - RNA, 19 nt, Homo sapiens
acucgagcguugaugauua

SEQ ID NO: 750325 - RNA, 19 nt, Homo sapiens
caaucaguaugguuacauu

SEQ ID NO: 750326 - RNA, 19 nt, Homo sapiens
uuaacaagugggugaauua

SEQ ID NO: 750327 - RNA, 19 nt, Homo sapiens
gaugagccguacauuaaag

SEQ ID NO: 750328 - RNA, 19 nt, Homo sapiens
gagaaacuauccuuauucc

SEQ ID NO: 750329 - RNA, 19 nt, Homo sapiens
guucucaccugcugcuuau

SEQ ID NO: 750330 - RNA, 19 nt, Homo sapiens
ggugaaugcugaugacucu

SEQ ID NO: 750331 - RNA, 19 nt, Homo sapiens
gcacagagacggccaaaau

SEQ ID NO: 750332 - RNA, 19 nt, Homo sapiens
gggaaugcgucacaaaugc

SEQ ID NO: 750333 - RNA, 19 nt, Homo sapiens
cagaaacacagaagacuga

SEQ ID NO: 750334 - RNA, 19 nt, Homo sapiens
guccgcaucugcuuuguug

SEQ ID NO: 750335 - RNA, 19 nt, Homo sapiens
ggucuugacugcgugaaau

SEQ ID NO: 750336 - RNA, 19 nt, Homo sapiens
ugagagaaacuauccuuau

SEQ ID NO: 750337 - RNA, 19 nt, Homo sapiens
uugaagagaugaagaaacu

SEQ ID NO: 750338 - RNA, 19 nt, Homo sapiens
gaacguucuacuuugguuu

SEQ ID NO: 750339 - RNA, 19 nt, Homo sapiens
ccugaugagccguacauua

SEQ ID NO: 750340 - RNA, 19 nt, Homo sapiens
gacugacacccgccacuua

SEQ ID NO: 750341 - RNA, 19 nt, Homo sapiens
gagaugaagaaacuuacuu

SEQ ID NO: 750342 - RNA, 19 nt, Homo sapiens
aaugagggaucuucuucaa

SEQ ID NO: 750343 - RNA, 19 nt, Homo sapiens
gucaauccaggaacaguua

SEQ ID NO: 750344 - RNA, 19 nt, Homo sapiens
guaacucgagcguugauga

SEQ ID NO: 750345 - RNA, 19 nt, Homo sapiens
cagccuguuuguauuauuc

SEQ ID NO: 750346 - RNA, 19 nt, Homo sapiens
gcuggagccacguuacuaa

SEQ ID NO: 750347 - RNA, 19 nt, Homo sapiens
gggauucgcaccugugaug

SEQ ID NO: 750348 - RNA, 19 nt, Homo sapiens
ccaggaacaguuauuuaga

SEQ ID NO: 750349 - RNA, 19 nt, Homo sapiens
ugaccugccuucugauugg

SEQ ID NO: 750350 - RNA, 19 nt, Homo sapiens
ccaccuggacugacuguug

SEQ ID NO: 750351 - RNA, 19 nt, Homo sapiens
gggaucuucuucaauacau

SEQ ID NO: 750352 - RNA, 19 nt, Homo sapiens
gcuauuagagauuaugaca

SEQ ID NO: 750353 - RNA, 19 nt, Homo sapiens
ucaguaugguuacauugau

SEQ ID NO: 750354 - RNA, 19 nt, Homo sapiens
uguggaacguucuacuuug

SEQ ID NO: 750355 - RNA, 19 nt, Homo sapiens
uaacaagugggugaauuau

SEQ ID NO: 750356 - RNA, 19 nt, Homo sapiens
ugcacacacuuucccuaua

SEQ ID NO: 750357 - RNA, 19 nt, Homo sapiens
gugguaugcuguugaugug

SEQ ID NO: 750358 - RNA, 19 nt, Homo sapiens
gcugguugcuucggauaau

SEQ ID NO: 750359 - RNA, 19 nt, Homo sapiens
gaaauuccucccugaugag

SEQ ID NO: 750360 - RNA, 19 nt, Homo sapiens
caccuuaugcacacacuuu

SEQ ID NO: 750361 - RNA, 19 nt, Homo sapiens
gauuacugcagauauucua

SEQ ID NO: 750362 - RNA, 19 nt, Homo sapiens
caaacuaguaugucaaugc

SEQ ID NO: 750363 - RNA, 19 nt, Homo sapiens
aaauuugguugguccuguu

SEQ ID NO: 750364 - RNA, 19 nt, Homo sapiens
guggaacguucuacuuugg

SEQ ID NO: 750365 - RNA, 19 nt, Homo sapiens
ggaaucauuggcucugugu

SEQ ID NO: 750366 - RNA, 19 nt, Homo sapiens
caagugggugaauuauuug

SEQ ID NO: 750367 - RNA, 19 nt, Homo sapiens
guuugauucuccuauacuu

SEQ ID NO: 750368 - RNA, 19 nt, Homo sapiens
aauguaugcuguagacaca

SEQ ID NO: 750369 - RNA, 19 nt, Homo sapiens
caaaauguaugcuguagac

SEQ ID NO: 750370 - RNA, 19 nt, Homo sapiens
agagaaacuauccuuauuc

SEQ ID NO: 750371 - RNA, 19 nt, Homo sapiens
uggagccacguuacuaaua

SEQ ID NO: 750372 - RNA, 19 nt, Homo sapiens
gagggaucuucuucaauac

SEQ ID NO: 750373 - RNA, 19 nt, Homo sapiens
gauguuggaccugagagaa

SEQ ID NO: 750374 - RNA, 19 nt, Homo sapiens
gugaaauuccucccugaug

SEQ ID NO: 750375 - RNA, 19 nt, Homo sapiens
gaaugcgucacaaaugcuu

SEQ ID NO: 750376 - RNA, 19 nt, Homo sapiens
cgaggccucuggugggaau

SEQ ID NO: 750377 - RNA, 19 nt, Homo sapiens
ggauggugaaugcugauga

SEQ ID NO: 750378 - RNA, 19 nt, Homo sapiens
uuuaacaagugggugaauu

SEQ ID NO: 750379 - RNA, 19 nt, Homo sapiens
acacacuuucccuauauuu

SEQ ID NO: 750380 - RNA, 19 nt, Homo sapiens
guaugcuguugauguguau

SEQ ID NO: 750381 - RNA, 19 nt, Homo sapiens
ugaugaguacgauuccaua

SEQ ID NO: 750382 - RNA, 19 nt, Homo sapiens
gauggugaaugcugaugac

SEQ ID NO: 750383 - RNA, 19 nt, Homo sapiens
guaugucaaugccuaccau

SEQ ID NO: 750384 - RNA, 19 nt, Homo sapiens
cacacacuuucccuauauu

SEQ ID NO: 750385 - RNA, 19 nt, Homo sapiens
acaaugagggaucuucuuc

SEQ ID NO: 750386 - RNA, 19 nt, Homo sapiens
ugaugagccguacauuaaa

SEQ ID NO: 750387 - RNA, 19 nt, Homo sapiens
uucaauacaucgcuugcuu

SEQ ID NO: 750388 - RNA, 19 nt, Homo sapiens
gaaacacagaagacugaca

SEQ ID NO: 750389 - RNA, 19 nt, Homo sapiens
guaccagaaacacagaaga

SEQ ID NO: 750390 - RNA, 19 nt, Homo sapiens
cauucucucugcuaaccuu

SEQ ID NO: 750391 - RNA, 19 nt, Homo sapiens
gggcugcuugccacaauga

SEQ ID NO: 750392 - RNA, 19 nt, Homo sapiens
uucaggguguguuugcaua

SEQ ID NO: 750393 - RNA, 19 nt, Homo sapiens
uauucuagcuggguuugga

SEQ ID NO: 750394 - RNA, 19 nt, Homo sapiens
gcaccugugaugaguacga

SEQ ID NO: 750395 - RNA, 19 nt, Homo sapiens
uaagucugcuaggauguag

SEQ ID NO: 750396 - RNA, 19 nt, Homo sapiens
caggguguguuugcauaug

SEQ ID NO: 750397 - RNA, 19 nt, Homo sapiens
cugagagaaacuauccuua

SEQ ID NO: 750398 - RNA, 19 nt, Homo sapiens
gauauucuagcuggguuug

SEQ ID NO: 750399 - RNA, 19 nt, Homo sapiens
ccuugaagcuggugguaac

SEQ ID NO: 750400 - RNA, 19 nt, Homo sapiens
ggugggaaugcgucacaaa

SEQ ID NO: 750401 - RNA, 19 nt, Homo sapiens
caauacaucgcuugcuucu

SEQ ID NO: 750402 - RNA, 19 nt, Homo sapiens
gaucagaccuguguauuua

SEQ ID NO: 750403 - RNA, 19 nt, Homo sapiens
gaaggaaucugaaacacuu

SEQ ID NO: 750404 - RNA, 19 nt, Homo sapiens
gaagaggccuccuuugaga

SEQ ID NO: 750405 - RNA, 19 nt, Homo sapiens
gcaaaguguuucauguaua

SEQ ID NO: 750406 - RNA, 19 nt, Homo sapiens
gagcugaucuagacaggua

SEQ ID NO: 750407 - RNA, 19 nt, Homo sapiens
uaacuaacccuuuguguaa

SEQ ID NO: 750408 - RNA, 19 nt, Homo sapiens
cagagugggucaauucuua

SEQ ID NO: 750409 - RNA, 19 nt, Homo sapiens
caaaugggcugauaaccaa

SEQ ID NO: 750410 - RNA, 19 nt, Homo sapiens
gacccuauguagauuauua

SEQ ID NO: 750411 - RNA, 19 nt, Homo sapiens
ggucucagccuauguguua

SEQ ID NO: 750412 - RNA, 19 nt, Homo sapiens
gaaugccaaugcugucuua

SEQ ID NO: 750413 - RNA, 19 nt, Homo sapiens
ugaagaauauccugagauu

SEQ ID NO: 750414 - RNA, 19 nt, Homo sapiens
agaaagcccucaauacauu

SEQ ID NO: 750415 - RNA, 19 nt, Homo sapiens
gaugagcaccauuuaguua

SEQ ID NO: 750416 - RNA, 19 nt, Homo sapiens
ccacggagauagucaaaga

SEQ ID NO: 750417 - RNA, 19 nt, Homo sapiens
gaaaaggaacucacauuua

SEQ ID NO: 750418 - RNA, 19 nt, Homo sapiens
cagaauuacuggcccauuu

SEQ ID NO: 750419 - RNA, 19 nt, Homo sapiens
cacgaugacuuucaaauug

SEQ ID NO: 750420 - RNA, 19 nt, Homo sapiens
uuacaagacuacagcuaua

SEQ ID NO: 750421 - RNA, 19 nt, Homo sapiens
gaaagaauuggcagucaaa

SEQ ID NO: 750422 - RNA, 19 nt, Homo sapiens
guaugggacugaaaucaaa

SEQ ID NO: 750423 - RNA, 19 nt, Homo sapiens
ucagagagguuccagucua

SEQ ID NO: 750424 - RNA, 19 nt, Homo sapiens
uaaagucucugggcaggua

SEQ ID NO: 750425 - RNA, 19 nt, Homo sapiens
cauugaagcucuuaggauu

SEQ ID NO: 750426 - RNA, 19 nt, Homo sapiens
gcaaaucuccaacacaguu

SEQ ID NO: 750427 - RNA, 19 nt, Homo sapiens
ugacucaaccuaagcuuua

SEQ ID NO: 750428 - RNA, 19 nt, Homo sapiens
ggacagcccaggugaggua

SEQ ID NO: 750429 - RNA, 19 nt, Homo sapiens
gauugaaccuguuucuaga

SEQ ID NO: 750430 - RNA, 19 nt, Homo sapiens
gcuaauaugcuuccaguug

SEQ ID NO: 750431 - RNA, 19 nt, Homo sapiens
ccagugagguccagggaaa

SEQ ID NO: 750432 - RNA, 19 nt, Homo sapiens
ccaaagugaugcagugguu

SEQ ID NO: 750433 - RNA, 19 nt, Homo sapiens
gacagaagcccagaacuuu

SEQ ID NO: 750434 - RNA, 19 nt, Homo sapiens
caccuuagccucccaagua

SEQ ID NO: 750435 - RNA, 19 nt, Homo sapiens
ucuggaaggugaucuuuaa

SEQ ID NO: 750436 - RNA, 19 nt, Homo sapiens
cuaauaugcuuccaguuga

SEQ ID NO: 750437 - RNA, 19 nt, Homo sapiens
caaaugaugugcccaacuc

SEQ ID NO: 750438 - RNA, 19 nt, Homo sapiens
aaaugcagcuagauucaaa

SEQ ID NO: 750439 - RNA, 19 nt, Homo sapiens
gcaccaccaugccuagcua

SEQ ID NO: 750440 - RNA, 19 nt, Homo sapiens
uuagggagcugaaggauca

SEQ ID NO: 750441 - RNA, 19 nt, Homo sapiens
gaggacuggugcaggauaa

SEQ ID NO: 750442 - RNA, 19 nt, Homo sapiens
gugcagaccuuagagcaaa

SEQ ID NO: 750443 - RNA, 19 nt, Homo sapiens
agaauuggcccauaccaua

SEQ ID NO: 750444 - RNA, 19 nt, Homo sapiens
gcuauaaccugcaguugag

SEQ ID NO: 750445 - RNA, 19 nt, Homo sapiens
ugagcaccauuuaguuaua

SEQ ID NO: 750446 - RNA, 19 nt, Homo sapiens
gaagaccuaucaggaggaa

SEQ ID NO: 750447 - RNA, 19 nt, Homo sapiens
gcagacaacccguccauca

SEQ ID NO: 750448 - RNA, 19 nt, Homo sapiens
gauguguagucuuguggua

SEQ ID NO: 750449 - RNA, 19 nt, Homo sapiens
uaugguaucuguguacgua

SEQ ID NO: 750450 - RNA, 19 nt, Homo sapiens
acacagaaagcccucaaua

SEQ ID NO: 750451 - RNA, 19 nt, Homo sapiens
gagcaccauuuaguuauau

SEQ ID NO: 750452 - RNA, 19 nt, Homo sapiens
gugagacacuguacaagga

SEQ ID NO: 750453 - RNA, 19 nt, Homo sapiens
gucaaagaguggccaguaa

SEQ ID NO: 750454 - RNA, 19 nt, Homo sapiens
gcauucaccaccagguuua

SEQ ID NO: 750455 - RNA, 19 nt, Homo sapiens
acaaggaguuacaagacua

SEQ ID NO: 750456 - RNA, 19 nt, Homo sapiens
ccaaugcugucuuacuaga

SEQ ID NO: 750457 - RNA, 19 nt, Homo sapiens
caauggcgcuggcacuguu

SEQ ID NO: 750458 - RNA, 19 nt, Homo sapiens
gaacaaaugacuuaaugcu

SEQ ID NO: 750459 - RNA, 19 nt, Homo sapiens
uagggcagguuuggauuua

SEQ ID NO: 750460 - RNA, 19 nt, Homo sapiens
acacuuguacuuccaauuu

SEQ ID NO: 750461 - RNA, 19 nt, Homo sapiens
ggagagcgguggagaaacg

SEQ ID NO: 750462 - RNA, 19 nt, Homo sapiens
gagaguacacgguuguuau

SEQ ID NO: 750463 - RNA, 19 nt, Homo sapiens
guagauuugugcauacugu

SEQ ID NO: 750464 - RNA, 19 nt, Homo sapiens
gcaguuauaaaccuacaaa

SEQ ID NO: 750465 - RNA, 19 nt, Homo sapiens
cugcaucucaccagaauua

SEQ ID NO: 750466 - RNA, 19 nt, Homo sapiens
ugauugugguucaguuuaa

SEQ ID NO: 750467 - RNA, 19 nt, Homo sapiens
cguuucaucucuuauugua

SEQ ID NO: 750468 - RNA, 19 nt, Homo sapiens
guacguauccaaacuucuu

SEQ ID NO: 750469 - RNA, 19 nt, Homo sapiens
ugccaaugcugucuuacua

SEQ ID NO: 750470 - RNA, 19 nt, Homo sapiens
guagucuugugguagauuu

SEQ ID NO: 750471 - RNA, 19 nt, Homo sapiens
ccaaagugcugggauuaca

SEQ ID NO: 750472 - RNA, 19 nt, Homo sapiens
gugcaaaguguuucaugua

SEQ ID NO: 750473 - RNA, 19 nt, Homo sapiens
ccaaagugcugggauuaca

SEQ ID NO: 750474 - RNA, 19 nt, Homo sapiens
ccucuccucuccucucuuu

SEQ ID NO: 750475 - RNA, 19 nt, Homo sapiens
gaaaucaaaccaugaaagc

SEQ ID NO: 750476 - RNA, 19 nt, Homo sapiens
ggaagaggccuccuuugag

SEQ ID NO: 750477 - RNA, 19 nt, Homo sapiens
ggaacaggccacggagaua

SEQ ID NO: 750478 - RNA, 19 nt, Homo sapiens
uuaauacuguuccaccaaa

SEQ ID NO: 750479 - RNA, 19 nt, Homo sapiens
aagaauauccugagauugu

SEQ ID NO: 750480 - RNA, 19 nt, Homo sapiens
acagaaagcccucaauaca

SEQ ID NO: 750481 - RNA, 19 nt, Homo sapiens
ggucaauucuuaggacaau

SEQ ID NO: 750482 - RNA, 19 nt, Homo sapiens
caguugauguguagucuug

SEQ ID NO: 750483 - RNA, 19 nt, Homo sapiens
caaauugugcucugcaguu

SEQ ID NO: 750484 - RNA, 19 nt, Homo sapiens
ucacgaugacuuucaaauu

SEQ ID NO: 750485 - RNA, 19 nt, Homo sapiens
ccagugggcuaagaccuuu

SEQ ID NO: 750486 - RNA, 19 nt, Homo sapiens
caggugagguaucugaaga

SEQ ID NO: 750487 - RNA, 19 nt, Homo sapiens
agaauauccugagauugua

SEQ ID NO: 750488 - RNA, 19 nt, Homo sapiens
ugacaauuguuagagguuu

SEQ ID NO: 750489 - RNA, 19 nt, Homo sapiens
agacaucaguuuccacauc

SEQ ID NO: 750490 - RNA, 19 nt, Homo sapiens
cuaacuaacccuuugugua

SEQ ID NO: 750491 - RNA, 19 nt, Homo sapiens
gaccagaauuggcccauac

SEQ ID NO: 750492 - RNA, 19 nt, Homo sapiens
aaagguggcuggcggaaag

SEQ ID NO: 750493 - RNA, 19 nt, Homo sapiens
gaacaggccacggagauag

SEQ ID NO: 750494 - RNA, 19 nt, Homo sapiens
gaauauccugagauuguaa

SEQ ID NO: 750495 - RNA, 19 nt, Homo sapiens
gcaguugagcaguuauaaa

SEQ ID NO: 750496 - RNA, 19 nt, Homo sapiens
uaccaugacacccuaauuu

SEQ ID NO: 750497 - RNA, 19 nt, Homo sapiens
gaacacagaaagcccucaa

SEQ ID NO: 750498 - RNA, 19 nt, Homo sapiens
ugugguagauuugugcaua

SEQ ID NO: 750499 - RNA, 19 nt, Homo sapiens
acaaauuggugccuguaga

SEQ ID NO: 750500 - RNA, 19 nt, Homo sapiens
gaucagaccuguguaucac

SEQ ID NO: 750501 - RNA, 19 nt, Homo sapiens
ucagaccuguguauuuaga

SEQ ID NO: 750502 - RNA, 19 nt, Homo sapiens
ccaaauaaaccuaccauua

SEQ ID NO: 750503 - RNA, 19 nt, Homo sapiens
ggaaguaaucccaauaaua

SEQ ID NO: 750504 - RNA, 19 nt, Homo sapiens
gaauauaagucuguuggua

SEQ ID NO: 750505 - RNA, 19 nt, Homo sapiens
ccagugagcuagcaaagua

SEQ ID NO: 750506 - RNA, 19 nt, Homo sapiens
ggaagaacauguugcgauu

SEQ ID NO: 750507 - RNA, 19 nt, Homo sapiens
gggcagaccuuugaccuua

SEQ ID NO: 750508 - RNA, 19 nt, Homo sapiens
gaucagcuguuuaaucuau

SEQ ID NO: 750509 - RNA, 19 nt, Homo sapiens
caaaguaucugaaggaagu

SEQ ID NO: 750510 - RNA, 19 nt, Homo sapiens
uggcaugucuucucauuua

SEQ ID NO: 750511 - RNA, 19 nt, Homo sapiens
gaaguaaucccaauaauac

SEQ ID NO: 750512 - RNA, 19 nt, Homo sapiens
ggaaggauuucacuguaaa

SEQ ID NO: 750513 - RNA, 19 nt, Homo sapiens
gaggaaggauuucacugua

SEQ ID NO: 750514 - RNA, 19 nt, Homo sapiens
gcaagcauuuggagaauau

SEQ ID NO: 750515 - RNA, 19 nt, Homo sapiens
caacaaaucccaugcaguu

SEQ ID NO: 750516 - RNA, 19 nt, Homo sapiens
gaagagaugcaacauacua

SEQ ID NO: 750517 - RNA, 19 nt, Homo sapiens
gcuauuagacuucucauuu

SEQ ID NO: 750518 - RNA, 19 nt, Homo sapiens
gaaaaggcaucaagaauau

SEQ ID NO: 750519 - RNA, 19 nt, Homo sapiens
gcacaaaucccuucguguu

SEQ ID NO: 750520 - RNA, 19 nt, Homo sapiens
gcauugagcacuuguuuaa

SEQ ID NO: 750521 - RNA, 19 nt, Homo sapiens
gcauugaaauccauaccua

SEQ ID NO: 750522 - RNA, 19 nt, Homo sapiens
agaaagauaugaagcagaa

SEQ ID NO: 750523 - RNA, 19 nt, Homo sapiens
ggagaguaauuuauucuuc

SEQ ID NO: 750524 - RNA, 19 nt, Homo sapiens
uaccauaucugcuuguaaa

SEQ ID NO: 750525 - RNA, 19 nt, Homo sapiens
gaaguaguauaacaacugu

SEQ ID NO: 750526 - RNA, 19 nt, Homo sapiens
guauaacugucucuauuga

SEQ ID NO: 750527 - RNA, 19 nt, Homo sapiens
gcagauucauucauucaug

SEQ ID NO: 750528 - RNA, 19 nt, Homo sapiens
gcugggaucugacuaacuu

SEQ ID NO: 750529 - RNA, 19 nt, Homo sapiens
caaauaaaccuaccauuac

SEQ ID NO: 750530 - RNA, 19 nt, Homo sapiens
ucauucauguggaagauua

SEQ ID NO: 750531 - RNA, 19 nt, Homo sapiens
ggauuuggaugaauuugga

SEQ ID NO: 750532 - RNA, 19 nt, Homo sapiens
guguauaacugucucuauu

SEQ ID NO: 750533 - RNA, 19 nt, Homo sapiens
ugaaugaaguguauaacug

SEQ ID NO: 750534 - RNA, 19 nt, Homo sapiens
aauguaagcuugugguuug

SEQ ID NO: 750535 - RNA, 19 nt, Homo sapiens
uaugugcacuggagaguaa

SEQ ID NO: 750536 - RNA, 19 nt, Homo sapiens
cugaagcccuaauauuuaa

SEQ ID NO: 750537 - RNA, 19 nt, Homo sapiens
guaguuguccauaauguaa

SEQ ID NO: 750538 - RNA, 19 nt, Homo sapiens
gagauaucauccaaguauu

SEQ ID NO: 750539 - RNA, 19 nt, Homo sapiens
aagaagagaugcaacauac

SEQ ID NO: 750540 - RNA, 19 nt, Homo sapiens
gcacauuuguuggaugaau

SEQ ID NO: 750541 - RNA, 19 nt, Homo sapiens
ucugaagcccuaauauuua

SEQ ID NO: 750542 - RNA, 19 nt, Homo sapiens
acacugaucagcuguuuaa

SEQ ID NO: 750543 - RNA, 19 nt, Homo sapiens
uaagaagagaugcaacaua

SEQ ID NO: 750544 - RNA, 19 nt, Homo sapiens
gaaauuauucauggaguga

SEQ ID NO: 750545 - RNA, 19 nt, Homo sapiens
aagaacauguugcgauuga

SEQ ID NO: 750546 - RNA, 19 nt, Homo sapiens
gcuugugguuugauuauug

SEQ ID NO: 750547 - RNA, 19 nt, Homo sapiens
ugagauaucauccaaguau

SEQ ID NO: 750548 - RNA, 19 nt, Homo sapiens
cuacgugcuucccaugaua

SEQ ID NO: 750549 - RNA, 19 nt, Homo sapiens
gaacauguugcgauugaau

SEQ ID NO: 750550 - RNA, 19 nt, Homo sapiens
uaggguaacguguauauuu

SEQ ID NO: 750551 - RNA, 19 nt, Homo sapiens
ggagugaauaagaaagaua

SEQ ID NO: 750552 - RNA, 19 nt, Homo sapiens
cuugcacacuugauaaaua

SEQ ID NO: 750553 - RNA, 19 nt, Homo sapiens
gauauaagauuuggcucau

SEQ ID NO: 750554 - RNA, 19 nt, Homo sapiens
gcauuauccugggcuguuu

SEQ ID NO: 750555 - RNA, 19 nt, Homo sapiens
guauuacaaugucuaguuc

SEQ ID NO: 750556 - RNA, 19 nt, Homo sapiens
gcacuggagaguaauuuau

SEQ ID NO: 750557 - RNA, 19 nt, Homo sapiens
gagaaaugguuuuggaauu

SEQ ID NO: 750558 - RNA, 19 nt, Homo sapiens
ggaggaaggauuucacugu

SEQ ID NO: 750559 - RNA, 19 nt, Homo sapiens
cacauuuguuggaugaaua

SEQ ID NO: 750560 - RNA, 19 nt, Homo sapiens
gaaugaaguguauaacugu

SEQ ID NO: 750561 - RNA, 19 nt, Homo sapiens
ccacacugaucagcuguuu

SEQ ID NO: 750562 - RNA, 19 nt, Homo sapiens
guaagcuugugguuugauu

SEQ ID NO: 750563 - RNA, 19 nt, Homo sapiens
uaacagaggaagaacaugu

SEQ ID NO: 750564 - RNA, 19 nt, Homo sapiens
guuccaacuuugcauacua

SEQ ID NO: 750565 - RNA, 19 nt, Homo sapiens
gauaagaagagaugcaaca

SEQ ID NO: 750566 - RNA, 19 nt, Homo sapiens
ggagaauaugucaaugaua

SEQ ID NO: 750567 - RNA, 19 nt, Homo sapiens
ggcaagcauuuggagaaua

SEQ ID NO: 750568 - RNA, 19 nt, Homo sapiens
uaacuuaccucagcaagcu

SEQ ID NO: 750569 - RNA, 19 nt, Homo sapiens
gcagcuacuuauucucaug

SEQ ID NO: 750570 - RNA, 19 nt, Homo sapiens
cccaugauauguucucuau

SEQ ID NO: 750571 - RNA, 19 nt, Homo sapiens
cugaucagcuguuuaaucu

SEQ ID NO: 750572 - RNA, 19 nt, Homo sapiens
agaguaagaucucaaugca

SEQ ID NO: 750573 - RNA, 19 nt, Homo sapiens
gauaucauccaaguauuga

SEQ ID NO: 750574 - RNA, 19 nt, Homo sapiens
ugaaaaggcaucaagaaua

SEQ ID NO: 750575 - RNA, 19 nt, Homo sapiens
aggaaggauuucacuguaa

SEQ ID NO: 750576 - RNA, 19 nt, Homo sapiens
gaagugccaagcaaagaga

SEQ ID NO: 750577 - RNA, 19 nt, Homo sapiens
gauaauacagugaaguagu

SEQ ID NO: 750578 - RNA, 19 nt, Homo sapiens
aaaccuaccauuacaugaa

SEQ ID NO: 750579 - RNA, 19 nt, Homo sapiens
ucaaggaagugacaguucu

SEQ ID NO: 750580 - RNA, 19 nt, Homo sapiens
cagauucauucauucaugu

SEQ ID NO: 750581 - RNA, 19 nt, Homo sapiens
gggaaaacuaugagaauua

SEQ ID NO: 750582 - RNA, 19 nt, Homo sapiens
gggcaagcauuuggagaau

SEQ ID NO: 750583 - RNA, 19 nt, Homo sapiens
gcagaccuuugaccuuaca

SEQ ID NO: 750584 - RNA, 19 nt, Homo sapiens
uagcacauaugaccaugau

SEQ ID NO: 750585 - RNA, 19 nt, Homo sapiens
acagugaaguaguauaaca

SEQ ID NO: 750586 - RNA, 19 nt, Homo sapiens
uccagcagauucauucauu

SEQ ID NO: 750587 - RNA, 19 nt, Homo sapiens
gcacagaguaagaucucaa

SEQ ID NO: 750588 - RNA, 19 nt, Homo sapiens
gauaugaagcagaacuguu

SEQ ID NO: 750589 - RNA, 19 nt, Homo sapiens
ggcuugcgaucaugugaaa

SEQ ID NO: 750590 - RNA, 19 nt, Homo sapiens
ucacuugcacacuugauaa

SEQ ID NO: 750591 - RNA, 19 nt, Homo sapiens
augccagagucaaguauua

SEQ ID NO: 750592 - RNA, 19 nt, Homo sapiens
cacaaaucccuucguguuu

SEQ ID NO: 750593 - RNA, 19 nt, Homo sapiens
caaaucccaugcaguucug

SEQ ID NO: 750594 - RNA, 19 nt, Homo sapiens
aaccuaccauuacaugaaa

SEQ ID NO: 750595 - RNA, 19 nt, Homo sapiens
ggagaugacuuuuauaucc

SEQ ID NO: 750596 - RNA, 19 nt, Homo sapiens
gaagaacauguugcgauug

SEQ ID NO: 750597 - RNA, 19 nt, Homo sapiens
uguggaagauuauaacucu

SEQ ID NO: 750598 - RNA, 19 nt, Homo sapiens
uggagaauaugucaaugau

SEQ ID NO: 750599 - RNA, 19 nt, Homo sapiens
gacaucaacauccaaagga

SEQ ID NO: 750600 - RNA, 19 nt, Homo sapiens
uuucaucacuugcacacuu

SEQ ID NO: 750601 - RNA, 19 nt, Homo sapiens
gagucaaguauuacaauga

SEQ ID NO: 750602 - RNA, 19 nt, Homo sapiens
gaauaaacgugaagugugu

SEQ ID NO: 750603 - RNA, 19 nt, Homo sapiens
ggaggaggguguaaagaaa

SEQ ID NO: 750604 - RNA, 19 nt, Homo sapiens
gcaaagcagucaucuugga

SEQ ID NO: 750605 - RNA, 19 nt, Homo sapiens
gcacacacauuuggccuaa

SEQ ID NO: 750606 - RNA, 19 nt, Homo sapiens
agacagagcugaggacuga

SEQ ID NO: 750607 - RNA, 19 nt, Homo sapiens
ggaaauugcuuaccccaua

SEQ ID NO: 750608 - RNA, 19 nt, Homo sapiens
ggaaaggaauagcugaugu

SEQ ID NO: 750609 - RNA, 19 nt, Homo sapiens
caaguucaaugaucaguug

SEQ ID NO: 750610 - RNA, 19 nt, Homo sapiens
gaaaggaauagcugaugua

SEQ ID NO: 750611 - RNA, 19 nt, Homo sapiens
aaagauggcuaaugcagaa

SEQ ID NO: 750612 - RNA, 19 nt, Homo sapiens
gggcaaagcagucaucuug

SEQ ID NO: 750613 - RNA, 19 nt, Homo sapiens
gcagggagaagaacaguuu

SEQ ID NO: 750614 - RNA, 19 nt, Homo sapiens
gaauggaacucagcucuca

SEQ ID NO: 750615 - RNA, 19 nt, Homo sapiens
gaaagacucagaggaaauu

SEQ ID NO: 750616 - RNA, 19 nt, Homo sapiens
caacagaaggaaccaagua

SEQ ID NO: 750617 - RNA, 19 nt, Homo sapiens
gagguugucugcaauauac

SEQ ID NO: 750618 - RNA, 19 nt, Homo sapiens
gaagagguugucugcaaua

SEQ ID NO: 750619 - RNA, 19 nt, Homo sapiens
aguagaaacucacacgaua

SEQ ID NO: 750620 - RNA, 19 nt, Homo sapiens
gcagaagcaccaaauuuga

SEQ ID NO: 750621 - RNA, 19 nt, Homo sapiens
ggaagagguugucugcaau

SEQ ID NO: 750622 - RNA, 19 nt, Homo sapiens
caaaugaggauauggaaau

SEQ ID NO: 750623 - RNA, 19 nt, Homo sapiens
guuuaucgauggacacuuu

SEQ ID NO: 750624 - RNA, 19 nt, Homo sapiens
ccagcuaucugacuucaug

SEQ ID NO: 750625 - RNA, 19 nt, Homo sapiens
ggaguuauguuuugauuug

SEQ ID NO: 750626 - RNA, 19 nt, Homo sapiens
aaagaaagacucagaggaa

SEQ ID NO: 750627 - RNA, 19 nt, Homo sapiens
guuuguauguccaggaaua

SEQ ID NO: 750628 - RNA, 19 nt, Homo sapiens
gcugaggacugaggagaaa

SEQ ID NO: 750629 - RNA, 19 nt, Homo sapiens
uuaccaacaugacaaaguu

SEQ ID NO: 750630 - RNA, 19 nt, Homo sapiens
ggacugaggagaaaguugu

SEQ ID NO: 750631 - RNA, 19 nt, Homo sapiens
gggcagaccaucauugaga

SEQ ID NO: 750632 - RNA, 19 nt, Homo sapiens
uggaagagguugucugcaa

SEQ ID NO: 750633 - RNA, 19 nt, Homo sapiens
gaagaacaccagcaucaag

SEQ ID NO: 750634 - RNA, 19 nt, Homo sapiens
ggagaauccugaagacacu

SEQ ID NO: 750635 - RNA, 19 nt, Homo sapiens
ggccuaaccucggcaauuc

SEQ ID NO: 750636 - RNA, 19 nt, Homo sapiens
gguuagcccuguggaauug

SEQ ID NO: 750637 - RNA, 19 nt, Homo sapiens
gcaaguccacucugaagga

SEQ ID NO: 750638 - RNA, 19 nt, Homo sapiens
gaaauugcuuaccccauaa

SEQ ID NO: 750639 - RNA, 19 nt, Homo sapiens
caacaggauuuaugaagcu

SEQ ID NO: 750640 - RNA, 19 nt, Homo sapiens
gcaccaaauuugaucuucu

SEQ ID NO: 750641 - RNA, 19 nt, Homo sapiens
gcaaaugaggauauggaaa

SEQ ID NO: 750642 - RNA, 19 nt, Homo sapiens
aggcagggcuggaauggaa

SEQ ID NO: 750643 - RNA, 19 nt, Homo sapiens
gauggacuccggacagauu

SEQ ID NO: 750644 - RNA, 19 nt, Homo sapiens
gcaauauacagaaggaaau

SEQ ID NO: 750645 - RNA, 19 nt, Homo sapiens
acacuuugauguucuggaa

SEQ ID NO: 750646 - RNA, 19 nt, Homo sapiens
cagaagagagcauggaaga

SEQ ID NO: 750647 - RNA, 19 nt, Homo sapiens
gcuggcaaguccacucuga

SEQ ID NO: 750648 - RNA, 19 nt, Homo sapiens
gaaacucacacgauacaca

SEQ ID NO: 750649 - RNA, 19 nt, Homo sapiens
ggaguacacugggcaacau

SEQ ID NO: 750650 - RNA, 19 nt, Homo sapiens
acagucaucucacccauca

SEQ ID NO: 750651 - RNA, 19 nt, Homo sapiens
aagaaagacucagaggaaa

SEQ ID NO: 750652 - RNA, 19 nt, Homo sapiens
ccucagcucuuccgcuaug

SEQ ID NO: 750653 - RNA, 19 nt, Homo sapiens
cauccaggcucccuuccaa

SEQ ID NO: 750654 - RNA, 19 nt, Homo sapiens
gaaauagaggagcuacuca

SEQ ID NO: 750655 - RNA, 19 nt, Homo sapiens
caguuucucuauacucuga

SEQ ID NO: 750656 - RNA, 19 nt, Homo sapiens
ggaaauagaggagcuacuc

SEQ ID NO: 750657 - RNA, 19 nt, Homo sapiens
ugugaaagauggcuaaugc

SEQ ID NO: 750658 - RNA, 19 nt, Homo sapiens
uggcugagauggaagaaca

SEQ ID NO: 750659 - RNA, 19 nt, Homo sapiens
gagacgcagucccagcuau

SEQ ID NO: 750660 - RNA, 19 nt, Homo sapiens
uccaauaccugcagaagca

SEQ ID NO: 750661 - RNA, 19 nt, Homo sapiens
gaagcugggucggagaaca

SEQ ID NO: 750662 - RNA, 19 nt, Homo sapiens
ggucuuagaggauuaacug

SEQ ID NO: 750663 - RNA, 19 nt, Homo sapiens
ggaagaacaccagcaucaa

SEQ ID NO: 750664 - RNA, 19 nt, Homo sapiens
ucaagaagguuuuagacaa

SEQ ID NO: 750665 - RNA, 19 nt, Homo sapiens
ggaagaggcagggcuggaa

SEQ ID NO: 750666 - RNA, 19 nt, Homo sapiens
gcacuauagaagcaaauga

SEQ ID NO: 750667 - RNA, 19 nt, Homo sapiens
gaaaguuguggcugagaug

SEQ ID NO: 750668 - RNA, 19 nt, Homo sapiens
gguagcaucacgcagauug

SEQ ID NO: 750669 - RNA, 19 nt, Homo sapiens
gaacaguuucucuauacuc

SEQ ID NO: 750670 - RNA, 19 nt, Homo sapiens
gauguucuggaaaggaaua

SEQ ID NO: 750671 - RNA, 19 nt, Homo sapiens
cagaggacacuuugauguu

SEQ ID NO: 750672 - RNA, 19 nt, Homo sapiens
ugaagauacugagggcaaa

SEQ ID NO: 750673 - RNA, 19 nt, Homo sapiens
cccagaagcugaagauacu

SEQ ID NO: 750674 - RNA, 19 nt, Homo sapiens
gaucacaggcugaaaucuc

SEQ ID NO: 750675 - RNA, 19 nt, Homo sapiens
gaagaagcaaggccaggau

SEQ ID NO: 750676 - RNA, 19 nt, Homo sapiens
cugcagaagcaccaaauuu

SEQ ID NO: 750677 - RNA, 19 nt, Homo sapiens
ccaagcacuuuguucaucu

SEQ ID NO: 750678 - RNA, 19 nt, Homo sapiens
cgugaagugugucaaguuc

SEQ ID NO: 750679 - RNA, 19 nt, Homo sapiens
gaucucagggccaggaguu

SEQ ID NO: 750680 - RNA, 19 nt, Homo sapiens
gaaggaaauagaggagcua

SEQ ID NO: 750681 - RNA, 19 nt, Homo sapiens
caccaaauuugaucuucug

SEQ ID NO: 750682 - RNA, 19 nt, Homo sapiens
ggacacagucaagaagguu

SEQ ID NO: 750683 - RNA, 19 nt, Homo sapiens
gaggacacuuugauguucu

SEQ ID NO: 750684 - RNA, 19 nt, Homo sapiens
gaagaggcagggcuggaau

SEQ ID NO: 750685 - RNA, 19 nt, Homo sapiens
gauacaggcacuauagaag

SEQ ID NO: 750686 - RNA, 19 nt, Homo sapiens
cacggcaguuguagcagua

SEQ ID NO: 750687 - RNA, 19 nt, Homo sapiens
ggacccagaagcugaagau

SEQ ID NO: 750688 - RNA, 19 nt, Homo sapiens
ugugguaccuacugaagga

SEQ ID NO: 750689 - RNA, 19 nt, Homo sapiens
agaggacacuuugauguuc

SEQ ID NO: 750690 - RNA, 19 nt, Homo sapiens
agaccaucauugagauuga

SEQ ID NO: 750691 - RNA, 19 nt, Homo sapiens
cggaggaggguguaaagaa

SEQ ID NO: 750692 - RNA, 19 nt, Homo sapiens
agaagcaaaugaggauaug

SEQ ID NO: 750693 - RNA, 19 nt, Homo sapiens
ccaagugauuuugcaguua

SEQ ID NO: 750694 - RNA, 19 nt, Homo sapiens
ggcagaccaucauugagau

SEQ ID NO: 750695 - RNA, 19 nt, Homo sapiens
uaauggacacagucaagaa

SEQ ID NO: 750696 - RNA, 19 nt, Homo sapiens
ggacuggaagagagcuauu

SEQ ID NO: 750697 - RNA, 19 nt, Homo sapiens
gaggauauggaaauugcuu

SEQ ID NO: 750698 - RNA, 19 nt, Homo sapiens
agaaaguuguggcugagau

SEQ ID NO: 750699 - RNA, 19 nt, Homo sapiens
gcagaccaucauugagauu

SEQ ID NO: 750700 - RNA, 19 nt, Homo sapiens
gcaguuguagcaguagaaa

SEQ ID NO: 750701 - RNA, 19 nt, Homo sapiens
cagccucaguucacaguca

SEQ ID NO: 750702 - RNA, 19 nt, Homo sapiens
gaauaaacgugaagugugu

SEQ ID NO: 750703 - RNA, 19 nt, Homo sapiens
ggaggaggguguaaagaaa

SEQ ID NO: 750704 - RNA, 19 nt, Homo sapiens
gcaaagcagucaucuugga

SEQ ID NO: 750705 - RNA, 19 nt, Homo sapiens
gcacacacauuuggccuaa

SEQ ID NO: 750706 - RNA, 19 nt, Homo sapiens
agacagagcugaggacuga

SEQ ID NO: 750707 - RNA, 19 nt, Homo sapiens
ggaaauugcuuaccccaua

SEQ ID NO: 750708 - RNA, 19 nt, Homo sapiens
ggaaaggaauagcugaugu

SEQ ID NO: 750709 - RNA, 19 nt, Homo sapiens
caaguucaaugaucaguug

SEQ ID NO: 750710 - RNA, 19 nt, Homo sapiens
gaaaggaauagcugaugua

SEQ ID NO: 750711 - RNA, 19 nt, Homo sapiens
aaagauggcuaaugcagaa

SEQ ID NO: 750712 - RNA, 19 nt, Homo sapiens
gggcaaagcagucaucuug

SEQ ID NO: 750713 - RNA, 19 nt, Homo sapiens
gcagggagaagaacaguuu

SEQ ID NO: 750714 - RNA, 19 nt, Homo sapiens
gaauggaacucagcucuca

SEQ ID NO: 750715 - RNA, 19 nt, Homo sapiens
gaaagacucagaggaaauu

SEQ ID NO: 750716 - RNA, 19 nt, Homo sapiens
caacagaaggaaccaagua

SEQ ID NO: 750717 - RNA, 19 nt, Homo sapiens
gagguugucugcaauauac

SEQ ID NO: 750718 - RNA, 19 nt, Homo sapiens
gaagagguugucugcaaua

SEQ ID NO: 750719 - RNA, 19 nt, Homo sapiens
aguagaaacucacacgaua

SEQ ID NO: 750720 - RNA, 19 nt, Homo sapiens
gcagaagcaccaaauuuga

SEQ ID NO: 750721 - RNA, 19 nt, Homo sapiens
ggaagagguugucugcaau

SEQ ID NO: 750722 - RNA, 19 nt, Homo sapiens
caaaugaggauauggaaau

SEQ ID NO: 750723 - RNA, 19 nt, Homo sapiens
ccagcuaucugacuucaug

SEQ ID NO: 750724 - RNA, 19 nt, Homo sapiens
ggaguuauguuuugauuug

SEQ ID NO: 750725 - RNA, 19 nt, Homo sapiens
aaagaaagacucagaggaa

SEQ ID NO: 750726 - RNA, 19 nt, Homo sapiens
guuuguauguccaggaaua

SEQ ID NO: 750727 - RNA, 19 nt, Homo sapiens
gcugaggacugaggagaaa

SEQ ID NO: 750728 - RNA, 19 nt, Homo sapiens
uuaccaacaugacaaaguu

SEQ ID NO: 750729 - RNA, 19 nt, Homo sapiens
ggacugaggagaaaguugu

SEQ ID NO: 750730 - RNA, 19 nt, Homo sapiens
gggcagaccaucauugaga

SEQ ID NO: 750731 - RNA, 19 nt, Homo sapiens
uggaagagguugucugcaa

SEQ ID NO: 750732 - RNA, 19 nt, Homo sapiens
gaagaacaccagcaucaag

SEQ ID NO: 750733 - RNA, 19 nt, Homo sapiens
ggagaauccugaagacacu

SEQ ID NO: 750734 - RNA, 19 nt, Homo sapiens
ggccuaaccucggcaauuc

SEQ ID NO: 750735 - RNA, 19 nt, Homo sapiens
gguuagcccuguggaauug

SEQ ID NO: 750736 - RNA, 19 nt, Homo sapiens
gcaaguccacucugaagga

SEQ ID NO: 750737 - RNA, 19 nt, Homo sapiens
gaaauugcuuaccccauaa

SEQ ID NO: 750738 - RNA, 19 nt, Homo sapiens
gcaccaaauuugaucuucu

SEQ ID NO: 750739 - RNA, 19 nt, Homo sapiens
gcaaaugaggauauggaaa

SEQ ID NO: 750740 - RNA, 19 nt, Homo sapiens
caacaagggauuuaugaag

SEQ ID NO: 750741 - RNA, 19 nt, Homo sapiens
gcaacaagggauuuaugaa

SEQ ID NO: 750742 - RNA, 19 nt, Homo sapiens
aggcagggcuggaauggaa

SEQ ID NO: 750743 - RNA, 19 nt, Homo sapiens
gauggacuccggacagauu

SEQ ID NO: 750744 - RNA, 19 nt, Homo sapiens
gcaauauacagaaggaaau

SEQ ID NO: 750745 - RNA, 19 nt, Homo sapiens
acacuuugauguucuggaa

SEQ ID NO: 750746 - RNA, 19 nt, Homo sapiens
cagaagagagcauggaaga

SEQ ID NO: 750747 - RNA, 19 nt, Homo sapiens
gcuggcaaguccacucuga

SEQ ID NO: 750748 - RNA, 19 nt, Homo sapiens
gaaacucacacgauacaca

SEQ ID NO: 750749 - RNA, 19 nt, Homo sapiens
ggaguacacugggcaacau

SEQ ID NO: 750750 - RNA, 19 nt, Homo sapiens
acagucaucucacccauca

SEQ ID NO: 750751 - RNA, 19 nt, Homo sapiens
aagaaagacucagaggaaa

SEQ ID NO: 750752 - RNA, 19 nt, Homo sapiens
ccucagcucuuccgcuaug

SEQ ID NO: 750753 - RNA, 19 nt, Homo sapiens
cauccaggcucccuuccaa

SEQ ID NO: 750754 - RNA, 19 nt, Homo sapiens
gaaauagaggagcuacuca

SEQ ID NO: 750755 - RNA, 19 nt, Homo sapiens
caguuucucuauacucuga

SEQ ID NO: 750756 - RNA, 19 nt, Homo sapiens
ggaaauagaggagcuacuc

SEQ ID NO: 750757 - RNA, 19 nt, Homo sapiens
ugugaaagauggcuaaugc

SEQ ID NO: 750758 - RNA, 19 nt, Homo sapiens
uggcugagauggaagaaca

SEQ ID NO: 750759 - RNA, 19 nt, Homo sapiens
uccaauaccugcagaagca

SEQ ID NO: 750760 - RNA, 19 nt, Homo sapiens
gaagcugggucggagaaca

SEQ ID NO: 750761 - RNA, 19 nt, Homo sapiens
ggucuuagaggauuaacug

SEQ ID NO: 750762 - RNA, 19 nt, Homo sapiens
ggaagaacaccagcaucaa

SEQ ID NO: 750763 - RNA, 19 nt, Homo sapiens
ucaagaagguuuuagacaa

SEQ ID NO: 750764 - RNA, 19 nt, Homo sapiens
ggaagaggcagggcuggaa

SEQ ID NO: 750765 - RNA, 19 nt, Homo sapiens
gcacuauagaagcaaauga

SEQ ID NO: 750766 - RNA, 19 nt, Homo sapiens
gaaaguuguggcugagaug

SEQ ID NO: 750767 - RNA, 19 nt, Homo sapiens
gguagcaucacgcagauug

SEQ ID NO: 750768 - RNA, 19 nt, Homo sapiens
gaacaguuucucuauacuc

SEQ ID NO: 750769 - RNA, 19 nt, Homo sapiens
gauguucuggaaaggaaua

SEQ ID NO: 750770 - RNA, 19 nt, Homo sapiens
cagaggacacuuugauguu

SEQ ID NO: 750771 - RNA, 19 nt, Homo sapiens
ugaagauacugagggcaaa

SEQ ID NO: 750772 - RNA, 19 nt, Homo sapiens
cccagaagcugaagauacu

SEQ ID NO: 750773 - RNA, 19 nt, Homo sapiens
gaucacaggcugaaaucuc

SEQ ID NO: 750774 - RNA, 19 nt, Homo sapiens
gaagaagcaaggccaggau

SEQ ID NO: 750775 - RNA, 19 nt, Homo sapiens
cugcagaagcaccaaauuu

SEQ ID NO: 750776 - RNA, 19 nt, Homo sapiens
ccaagcacuuuguucaucu

SEQ ID NO: 750777 - RNA, 19 nt, Homo sapiens
cgugaagugugucaaguuc

SEQ ID NO: 750778 - RNA, 19 nt, Homo sapiens
gaucucagggccaggaguu

SEQ ID NO: 750779 - RNA, 19 nt, Homo sapiens
gaaggaaauagaggagcua

SEQ ID NO: 750780 - RNA, 19 nt, Homo sapiens
caccaaauuugaucuucug

SEQ ID NO: 750781 - RNA, 19 nt, Homo sapiens
ggacacagucaagaagguu

SEQ ID NO: 750782 - RNA, 19 nt, Homo sapiens
gaggacacuuugauguucu

SEQ ID NO: 750783 - RNA, 19 nt, Homo sapiens
gaagaggcagggcuggaau

SEQ ID NO: 750784 - RNA, 19 nt, Homo sapiens
gauacaggcacuauagaag

SEQ ID NO: 750785 - RNA, 19 nt, Homo sapiens
cacggcaguuguagcagua

SEQ ID NO: 750786 - RNA, 19 nt, Homo sapiens
ggacccagaagcugaagau

SEQ ID NO: 750787 - RNA, 19 nt, Homo sapiens
ugugguaccuacugaagga

SEQ ID NO: 750788 - RNA, 19 nt, Homo sapiens
agaggacacuuugauguuc

SEQ ID NO: 750789 - RNA, 19 nt, Homo sapiens
agaccaucauugagauuga

SEQ ID NO: 750790 - RNA, 19 nt, Homo sapiens
cggaggaggguguaaagaa

SEQ ID NO: 750791 - RNA, 19 nt, Homo sapiens
agaagcaaaugaggauaug

SEQ ID NO: 750792 - RNA, 19 nt, Homo sapiens
ggcagaccaucauugagau

SEQ ID NO: 750793 - RNA, 19 nt, Homo sapiens
uaauggacacagucaagaa

SEQ ID NO: 750794 - RNA, 19 nt, Homo sapiens
ccaagugauuuugcaguua

SEQ ID NO: 750795 - RNA, 19 nt, Homo sapiens
ggacuggaagagagcuauu

SEQ ID NO: 750796 - RNA, 19 nt, Homo sapiens
gaggauauggaaauugcuu

SEQ ID NO: 750797 - RNA, 19 nt, Homo sapiens
agaaaguuguggcugagau

SEQ ID NO: 750798 - RNA, 19 nt, Homo sapiens
gcaguuguagcaguagaaa

SEQ ID NO: 750799 - RNA, 19 nt, Homo sapiens
gcagaccaucauugagauu

SEQ ID NO: 750800 - RNA, 19 nt, Homo sapiens
cagccucaguucacaguca

SEQ ID NO: 750801 - RNA, 19 nt, Homo sapiens
aaacucacacgauacacaa

SEQ ID NO: 750802 - RNA, 19 nt, Homo sapiens
ggaagaaucugaaauaaga

SEQ ID NO: 750803 - RNA, 19 nt, Homo sapiens
caucauagcuccacuguuu

SEQ ID NO: 750804 - RNA, 19 nt, Homo sapiens
gcagguaugauaaguauua

SEQ ID NO: 750805 - RNA, 19 nt, Homo sapiens
gcauuuaugugguugcuaa

SEQ ID NO: 750806 - RNA, 19 nt, Homo sapiens
uaacaaagaugucugugau

SEQ ID NO: 750807 - RNA, 19 nt, Homo sapiens
gaaugaccaccaacacuua

SEQ ID NO: 750808 - RNA, 19 nt, Homo sapiens
gugcagacauggaucauug

SEQ ID NO: 750809 - RNA, 19 nt, Homo sapiens
ucagauagauguaacaaag

SEQ ID NO: 750810 - RNA, 19 nt, Homo sapiens
guauggaaguuggaaauuu

SEQ ID NO: 750811 - RNA, 19 nt, Homo sapiens
gauuauggcagguaugaua

SEQ ID NO: 750812 - RNA, 19 nt, Homo sapiens
ggagaagaaugaccaccaa

SEQ ID NO: 750813 - RNA, 19 nt, Homo sapiens
gcaacuuacuugauuaugg

SEQ ID NO: 750814 - RNA, 19 nt, Homo sapiens
gaaguuggaaauuuggaua

SEQ ID NO: 750815 - RNA, 19 nt, Homo sapiens
guucugggcaucuucauua

SEQ ID NO: 750816 - RNA, 19 nt, Homo sapiens
ggugcuacguguaccauaa

SEQ ID NO: 750817 - RNA, 19 nt, Homo sapiens
gaauuaggcaucagagguu

SEQ ID NO: 750818 - RNA, 19 nt, Homo sapiens
uauggaaguuggaaauuug

SEQ ID NO: 750819 - RNA, 19 nt, Homo sapiens
aaagaugucugugaucaug

SEQ ID NO: 750820 - RNA, 19 nt, Homo sapiens
ggucagaucagauagaugu

SEQ ID NO: 750821 - RNA, 19 nt, Homo sapiens
caugacaguuauugcgaua

SEQ ID NO: 750822 - RNA, 19 nt, Homo sapiens
acaaagaugucugugauca

SEQ ID NO: 750823 - RNA, 19 nt, Homo sapiens
ccuauuauggcaugcauua

SEQ ID NO: 750824 - RNA, 19 nt, Homo sapiens
gaacuucggacacccacaa

SEQ ID NO: 750825 - RNA, 19 nt, Homo sapiens
aauaugagcccauuuagau

SEQ ID NO: 750826 - RNA, 19 nt, Homo sapiens
caacaguucagacucuaaa

SEQ ID NO: 750827 - RNA, 19 nt, Homo sapiens
caacagagacuggucagau

SEQ ID NO: 750828 - RNA, 19 nt, Homo sapiens
uggcagguaugauaaguau

SEQ ID NO: 750829 - RNA, 19 nt, Homo sapiens
guugcaacuuacuugauua

SEQ ID NO: 750830 - RNA, 19 nt, Homo sapiens
ucuggaagaaucugaaaua

SEQ ID NO: 750831 - RNA, 19 nt, Homo sapiens
guaacaaagaugucuguga

SEQ ID NO: 750832 - RNA, 19 nt, Homo sapiens
agacuggucagaucagaua

SEQ ID NO: 750833 - RNA, 19 nt, Homo sapiens
caugucacgcuauccauua

SEQ ID NO: 750834 - RNA, 19 nt, Homo sapiens
caucugccuuccugacgua

SEQ ID NO: 750835 - RNA, 19 nt, Homo sapiens
gguuuaugcuggauugaau

SEQ ID NO: 750836 - RNA, 19 nt, Homo sapiens
uagcuccacuguuugcaaa

SEQ ID NO: 750837 - RNA, 19 nt, Homo sapiens
ucacagacugaacacaaua

SEQ ID NO: 750838 - RNA, 19 nt, Homo sapiens
gcuucucuguguccugaua

SEQ ID NO: 750839 - RNA, 19 nt, Homo sapiens
uagaucaagugcagacaug

SEQ ID NO: 750840 - RNA, 19 nt, Homo sapiens
cuggaagaaucugaaauaa

SEQ ID NO: 750841 - RNA, 19 nt, Homo sapiens
caaugccugugacaaguau

SEQ ID NO: 750842 - RNA, 19 nt, Homo sapiens
aaacaaugccugugacaag

SEQ ID NO: 750843 - RNA, 19 nt, Homo sapiens
cuggaucaauggccuguuu

SEQ ID NO: 750844 - RNA, 19 nt, Homo sapiens
gcaacaguucagacucuaa

SEQ ID NO: 750845 - RNA, 19 nt, Homo sapiens
gcaucuucauuaaguacaa

SEQ ID NO: 750846 - RNA, 19 nt, Homo sapiens
aguguaagcuccucaagca

SEQ ID NO: 750847 - RNA, 19 nt, Homo sapiens
ucagguuuaugcuggauug

SEQ ID NO: 750848 - RNA, 19 nt, Homo sapiens
gaaggguguuucgguaucu

SEQ ID NO: 750849 - RNA, 19 nt, Homo sapiens
uguugcaacuuacuugauu

SEQ ID NO: 750850 - RNA, 19 nt, Homo sapiens
acacuguacugaugaccuu

SEQ ID NO: 750851 - RNA, 19 nt, Homo sapiens
gacguagggagaagaauga

SEQ ID NO: 750852 - RNA, 19 nt, Homo sapiens
gaucagauagauguaacaa

SEQ ID NO: 750853 - RNA, 19 nt, Homo sapiens
gcaagcauuggauuacuca

SEQ ID NO: 750854 - RNA, 19 nt, Homo sapiens
ucagaucuguauggaaguu

SEQ ID NO: 750855 - RNA, 19 nt, Homo sapiens
acccacaaaugcaauuauu

SEQ ID NO: 750856 - RNA, 19 nt, Homo sapiens
gaaaaggacacgcuaucaa

SEQ ID NO: 750857 - RNA, 19 nt, Homo sapiens
ucauagggugggcuaguua

SEQ ID NO: 750858 - RNA, 19 nt, Homo sapiens
guacugaugaccuuuaacu

SEQ ID NO: 750859 - RNA, 19 nt, Homo sapiens
ugaaggguguuucgguauc

SEQ ID NO: 750860 - RNA, 19 nt, Homo sapiens
uacgcaggcugucagguuu

SEQ ID NO: 750861 - RNA, 19 nt, Homo sapiens
gaucaagugcagacaugga

SEQ ID NO: 750862 - RNA, 19 nt, Homo sapiens
caccaaacaaugccuguga

SEQ ID NO: 750863 - RNA, 19 nt, Homo sapiens
ggcaacaguucagacucua

SEQ ID NO: 750864 - RNA, 19 nt, Homo sapiens
ucuuacaccaugacaguua

SEQ ID NO: 750865 - RNA, 19 nt, Homo sapiens
caauauuguugcaacuuac

SEQ ID NO: 750866 - RNA, 19 nt, Homo sapiens
aauuaggcaucagagguua

SEQ ID NO: 750867 - RNA, 19 nt, Homo sapiens
gaagaaugaccaccaacac

SEQ ID NO: 750868 - RNA, 19 nt, Homo sapiens
agaaugaccaccaacacuu

SEQ ID NO: 750869 - RNA, 19 nt, Homo sapiens
acacuuacaucggcuugau

SEQ ID NO: 750870 - RNA, 19 nt, Homo sapiens
ugacguagggagaagaaug

SEQ ID NO: 750871 - RNA, 19 nt, Homo sapiens
cccacaaaugcaauuauua

SEQ ID NO: 750872 - RNA, 19 nt, Homo sapiens
acugaugaccuuuaacuug

SEQ ID NO: 750873 - RNA, 19 nt, Homo sapiens
uaauuuaggcaacaguuca

SEQ ID NO: 750874 - RNA, 19 nt, Homo sapiens
ucagaucagauagauguaa

SEQ ID NO: 750875 - RNA, 19 nt, Homo sapiens
uuacugcuauuaccauguc

SEQ ID NO: 750876 - RNA, 19 nt, Homo sapiens
uaauaguucugggcaucuu

SEQ ID NO: 750877 - RNA, 19 nt, Homo sapiens
ggacacccacaaaugcaau

SEQ ID NO: 750878 - RNA, 19 nt, Homo sapiens
ugcaaaaucuucuacauuc

SEQ ID NO: 750879 - RNA, 19 nt, Homo sapiens
cugggcaucuucauuaagu

SEQ ID NO: 750880 - RNA, 19 nt, Homo sapiens
caaacaaugccugugacaa

SEQ ID NO: 750881 - RNA, 19 nt, Homo sapiens
ggcaagcauuggauuacuc

SEQ ID NO: 750882 - RNA, 19 nt, Homo sapiens
caagugcagacauggauca

SEQ ID NO: 750883 - RNA, 19 nt, Homo sapiens
uaugagcccauuuagauca

SEQ ID NO: 750884 - RNA, 19 nt, Homo sapiens
acaaugccugugacaagua

SEQ ID NO: 750885 - RNA, 19 nt, Homo sapiens
cagaucagauagauguaac

SEQ ID NO: 750886 - RNA, 19 nt, Homo sapiens
aacagagacuggucagauc

SEQ ID NO: 750887 - RNA, 19 nt, Homo sapiens
ccauuaaacaucacacuac

SEQ ID NO: 750888 - RNA, 19 nt, Homo sapiens
ugauagaucuuuugugucu

SEQ ID NO: 750889 - RNA, 19 nt, Homo sapiens
cagauagauguaacaaaga

SEQ ID NO: 750890 - RNA, 19 nt, Homo sapiens
cagacugaacacaauauug

SEQ ID NO: 750891 - RNA, 19 nt, Homo sapiens
ggaaguuggaaauuuggau

SEQ ID NO: 750892 - RNA, 19 nt, Homo sapiens
aguguaugcuucucugugu

SEQ ID NO: 750893 - RNA, 19 nt, Homo sapiens
gagcccauuuagaucaagu

SEQ ID NO: 750894 - RNA, 19 nt, Homo sapiens
aaaaggacacgcuaucaaa

SEQ ID NO: 750895 - RNA, 19 nt, Homo sapiens
gcccuugacagugauguuu

SEQ ID NO: 750896 - RNA, 19 nt, Homo sapiens
auugugcccuugacaguga

SEQ ID NO: 750897 - RNA, 19 nt, Homo sapiens
ucuggcugcuguaguguau

SEQ ID NO: 750898 - RNA, 19 nt, Homo sapiens
gcaaaaucuucuacauucu

SEQ ID NO: 750899 - RNA, 19 nt, Homo sapiens
gugcuacguguaccauaaa

SEQ ID NO: 750900 - RNA, 19 nt, Homo sapiens
cugggagccuggaucaaug

SEQ ID NO: 750901 - RNA, 19 nt, Homo sapiens
cuguacugaugaccuuuaa

SEQ ID NO: 750902 - RNA, 19 nt, Homo sapiens
gaagaugcauuuauccuua

SEQ ID NO: 750903 - RNA, 19 nt, Homo sapiens
gcugaugccuuacucauua

SEQ ID NO: 750904 - RNA, 19 nt, Homo sapiens
ugaacuggcugaugucuua

SEQ ID NO: 750905 - RNA, 19 nt, Homo sapiens
gcaaugugcugcucgauga

SEQ ID NO: 750906 - RNA, 19 nt, Homo sapiens
ggagaugaagcauaaauua

SEQ ID NO: 750907 - RNA, 19 nt, Homo sapiens
uaauggagaugaagcauaa

SEQ ID NO: 750908 - RNA, 19 nt, Homo sapiens
gaagaaauauggaaagacu

SEQ ID NO: 750909 - RNA, 19 nt, Homo sapiens
gcuagaacaucauuacaaa

SEQ ID NO: 750910 - RNA, 19 nt, Homo sapiens
gguaaaagcugaaagaaaa

SEQ ID NO: 750911 - RNA, 19 nt, Homo sapiens
uaaaggauuugucgucauu

SEQ ID NO: 750912 - RNA, 19 nt, Homo sapiens
cugaagcucuuguuacaua

SEQ ID NO: 750913 - RNA, 19 nt, Homo sapiens
caaaggagaugaaaagaaa

SEQ ID NO: 750914 - RNA, 19 nt, Homo sapiens
uccaacagcuuccuugaua

SEQ ID NO: 750915 - RNA, 19 nt, Homo sapiens
ucuguuaccuuguugguua

SEQ ID NO: 750916 - RNA, 19 nt, Homo sapiens
uaauagaccugaaggacaa

SEQ ID NO: 750917 - RNA, 19 nt, Homo sapiens
gcacagugauugccaccaa

SEQ ID NO: 750918 - RNA, 19 nt, Homo sapiens
gagcugggaugucuucuca

SEQ ID NO: 750919 - RNA, 19 nt, Homo sapiens
aaagggaauugauccauuu

SEQ ID NO: 750920 - RNA, 19 nt, Homo sapiens
gaacagauacaaaguugau

SEQ ID NO: 750921 - RNA, 19 nt, Homo sapiens
gaauacaggugagccaaug

SEQ ID NO: 750922 - RNA, 19 nt, Homo sapiens
caaagucugugcucaguca

SEQ ID NO: 750923 - RNA, 19 nt, Homo sapiens
gcugggaugucuucucaaa

SEQ ID NO: 750924 - RNA, 19 nt, Homo sapiens
gaugaagcauaaauuagga

SEQ ID NO: 750925 - RNA, 19 nt, Homo sapiens
gcgaguagaagaugcauuu

SEQ ID NO: 750926 - RNA, 19 nt, Homo sapiens
gaagaccaccuuacccuau

SEQ ID NO: 750927 - RNA, 19 nt, Homo sapiens
ggaggaaguuaaagugaca

SEQ ID NO: 750928 - RNA, 19 nt, Homo sapiens
ccacaggaaacauuaguaa

SEQ ID NO: 750929 - RNA, 19 nt, Homo sapiens
cagaagagaaagagaaauu

SEQ ID NO: 750930 - RNA, 19 nt, Homo sapiens
aagcugaccuguacauuuc

SEQ ID NO: 750931 - RNA, 19 nt, Homo sapiens
caccaaagauggcaaugug

SEQ ID NO: 750932 - RNA, 19 nt, Homo sapiens
gcaggaguuugggauaauu

SEQ ID NO: 750933 - RNA, 19 nt, Homo sapiens
gagauggacuucgugcuau

SEQ ID NO: 750934 - RNA, 19 nt, Homo sapiens
gagaugguacuacaacaaa

SEQ ID NO: 750935 - RNA, 19 nt, Homo sapiens
ggcaauggcugaagcucuu

SEQ ID NO: 750936 - RNA, 19 nt, Homo sapiens
guagauugcuugggacaug

SEQ ID NO: 750937 - RNA, 19 nt, Homo sapiens
ccucuuagauguagcuaga

SEQ ID NO: 750938 - RNA, 19 nt, Homo sapiens
caagcugaccuguacauuu

SEQ ID NO: 750939 - RNA, 19 nt, Homo sapiens
ucgaugagaugcaaauuca

SEQ ID NO: 750940 - RNA, 19 nt, Homo sapiens
gggcguagauuugaauaca

SEQ ID NO: 750941 - RNA, 19 nt, Homo sapiens
ugaagaugguuguaugguu

SEQ ID NO: 750942 - RNA, 19 nt, Homo sapiens
cauaagagauggacuucgu

SEQ ID NO: 750943 - RNA, 19 nt, Homo sapiens
agucaaggaugccauaaga

SEQ ID NO: 750944 - RNA, 19 nt, Homo sapiens
ggccugcacccuagaauaa

SEQ ID NO: 750945 - RNA, 19 nt, Homo sapiens
ugggaugucuucucaaaug

SEQ ID NO: 750946 - RNA, 19 nt, Homo sapiens
uaaaggccgucaacuccaa

SEQ ID NO: 750947 - RNA, 19 nt, Homo sapiens
gaagcucuuguuacauaua

SEQ ID NO: 750948 - RNA, 19 nt, Homo sapiens
ccaaauaagcauacucuca

SEQ ID NO: 750949 - RNA, 19 nt, Homo sapiens
gaagaagcgaguagaagau

SEQ ID NO: 750950 - RNA, 19 nt, Homo sapiens
gaaguuaaagugacaaagg

SEQ ID NO: 750951 - RNA, 19 nt, Homo sapiens
gggaugucuucucaaauga

SEQ ID NO: 750952 - RNA, 19 nt, Homo sapiens
acaucaaacucaccaaaga

SEQ ID NO: 750953 - RNA, 19 nt, Homo sapiens
uugaagaucucacuguaga

SEQ ID NO: 750954 - RNA, 19 nt, Homo sapiens
gcauuuauccuuauuugca

SEQ ID NO: 750955 - RNA, 19 nt, Homo sapiens
gaugucuucucaaaugaug

SEQ ID NO: 750956 - RNA, 19 nt, Homo sapiens
gagaaagagaaauugguaa

SEQ ID NO: 750957 - RNA, 19 nt, Homo sapiens
gaagagaaagagaaauugg

SEQ ID NO: 750958 - RNA, 19 nt, Homo sapiens
gagaugaagcauaaauuag

SEQ ID NO: 750959 - RNA, 19 nt, Homo sapiens
gaauaauagcugaaggauu

SEQ ID NO: 750960 - RNA, 19 nt, Homo sapiens
ccugcacccuagaauaaua

SEQ ID NO: 750961 - RNA, 19 nt, Homo sapiens
gaguuugggauaauuauug

SEQ ID NO: 750962 - RNA, 19 nt, Homo sapiens
ggcugaagcucuuguuaca

SEQ ID NO: 750963 - RNA, 19 nt, Homo sapiens
cauugaagaugguuguaug

SEQ ID NO: 750964 - RNA, 19 nt, Homo sapiens
gacaaagucugugcucagu

SEQ ID NO: 750965 - RNA, 19 nt, Homo sapiens
ugaagaagcgaguagaaga

SEQ ID NO: 750966 - RNA, 19 nt, Homo sapiens
ggagaugguacuacaacaa

SEQ ID NO: 750967 - RNA, 19 nt, Homo sapiens
gcaggugacaucaaacuca

SEQ ID NO: 750968 - RNA, 19 nt, Homo sapiens
ggucuuguguaugaguaua

SEQ ID NO: 750969 - RNA, 19 nt, Homo sapiens
agagaaagagaaauuggua

SEQ ID NO: 750970 - RNA, 19 nt, Homo sapiens
aguagaagaugcauuuauc

SEQ ID NO: 750971 - RNA, 19 nt, Homo sapiens
aggaacagauacaaaguug

SEQ ID NO: 750972 - RNA, 19 nt, Homo sapiens
guagaaauaauggagauga

SEQ ID NO: 750973 - RNA, 19 nt, Homo sapiens
uggcugaugucuuaacaga

SEQ ID NO: 750974 - RNA, 19 nt, Homo sapiens
ucaaggaugccauaagaga

SEQ ID NO: 750975 - RNA, 19 nt, Homo sapiens
gaguagaagaugcauuuau

SEQ ID NO: 750976 - RNA, 19 nt, Homo sapiens
gaguauacauuaggugaag

SEQ ID NO: 750977 - RNA, 19 nt, Homo sapiens
aaggauuugucgucauuaa

SEQ ID NO: 750978 - RNA, 19 nt, Homo sapiens
augcuggucuuguguauga

SEQ ID NO: 750979 - RNA, 19 nt, Homo sapiens
cagcuuccuugauagcaaa

SEQ ID NO: 750980 - RNA, 19 nt, Homo sapiens
uuacaucugacuacuauug

SEQ ID NO: 750981 - RNA, 19 nt, Homo sapiens
cuuuacaucugacuacuau

SEQ ID NO: 750982 - RNA, 19 nt, Homo sapiens
uaagacugcagaagagaaa

SEQ ID NO: 750983 - RNA, 19 nt, Homo sapiens
cacaggagaugguacuaca

SEQ ID NO: 750984 - RNA, 19 nt, Homo sapiens
agcuuuggcugucaauaua

SEQ ID NO: 750985 - RNA, 19 nt, Homo sapiens
ucuccugguugaugaaauu

SEQ ID NO: 750986 - RNA, 19 nt, Homo sapiens
ugacccacaggaaacauua

SEQ ID NO: 750987 - RNA, 19 nt, Homo sapiens
uaagcauacucucacacaa

SEQ ID NO: 750988 - RNA, 19 nt, Homo sapiens
gggacaugcuggucuugug

SEQ ID NO: 750989 - RNA, 19 nt, Homo sapiens
acguuucacuggaauauga

SEQ ID NO: 750990 - RNA, 19 nt, Homo sapiens
gaugguacuacaacaaaug

SEQ ID NO: 750991 - RNA, 19 nt, Homo sapiens
uaguacacuuuacaucuga

SEQ ID NO: 750992 - RNA, 19 nt, Homo sapiens
ggaguuugggauaauuauu

SEQ ID NO: 750993 - RNA, 19 nt, Homo sapiens
agagauggacuucgugcua

SEQ ID NO: 750994 - RNA, 19 nt, Homo sapiens
ggacaugcuggucuugugu

SEQ ID NO: 750995 - RNA, 19 nt, Homo sapiens
gcaaauucaacauccaaca

SEQ ID NO: 750996 - RNA, 19 nt, Homo sapiens
cuauugaucucuucauggu

SEQ ID NO: 750997 - RNA, 19 nt, Homo sapiens
uuaguacacuuuacaucug

SEQ ID NO: 750998 - RNA, 19 nt, Homo sapiens
gaugcaggaguuugggaua

SEQ ID NO: 750999 - RNA, 19 nt, Homo sapiens
gguuaugacccacaggaaa

SEQ ID NO: 751000 - RNA, 19 nt, Homo sapiens
ucagaaugcugguuaugac

SEQ ID NO: 751001 - RNA, 19 nt, Homo sapiens
uccuggagcuggugcaauu

SEQ ID NO: 751002 - RNA, 19 nt, Homo sapiens
ggaauuagcugaagaacuu

SEQ ID NO: 751003 - RNA, 19 nt, Homo sapiens
ccaaacagaucacaucaua

SEQ ID NO: 751004 - RNA, 19 nt, Homo sapiens
gauaaagacugcugaagaa

SEQ ID NO: 751005 - RNA, 19 nt, Homo sapiens
ggugaaggcuguauuugua

SEQ ID NO: 751006 - RNA, 19 nt, Homo sapiens
gaaguuugcugaggcauuu

SEQ ID NO: 751007 - RNA, 19 nt, Homo sapiens
ccaaugaaguaaucucuaa

SEQ ID NO: 751008 - RNA, 19 nt, Homo sapiens
agacauggcucuucauuau

SEQ ID NO: 751009 - RNA, 19 nt, Homo sapiens
gcuggaagcugguauucua

SEQ ID NO: 751010 - RNA, 19 nt, Homo sapiens
cuacagcucuuccuagauu

SEQ ID NO: 751011 - RNA, 19 nt, Homo sapiens
aaagacugcugaagaauug

SEQ ID NO: 751012 - RNA, 19 nt, Homo sapiens
cagaaaagcucaugagauu

SEQ ID NO: 751013 - RNA, 19 nt, Homo sapiens
ggagggagcgaaacacuuu

SEQ ID NO: 751014 - RNA, 19 nt, Homo sapiens
cuucguaccuccauaauga

SEQ ID NO: 751015 - RNA, 19 nt, Homo sapiens
uguaauggcuucucauaug

SEQ ID NO: 751016 - RNA, 19 nt, Homo sapiens
uaagagaacuagaaguaca

SEQ ID NO: 751017 - RNA, 19 nt, Homo sapiens
aaacagaucacaucauaug

SEQ ID NO: 751018 - RNA, 19 nt, Homo sapiens
ggaaaccgaaggugaugua

SEQ ID NO: 751019 - RNA, 19 nt, Homo sapiens
guaccuccauaaugaguaa

SEQ ID NO: 751020 - RNA, 19 nt, Homo sapiens
gaaauagccugcagaaaag

SEQ ID NO: 751021 - RNA, 19 nt, Homo sapiens
cuaucaaacucgcuacuaa

SEQ ID NO: 751022 - RNA, 19 nt, Homo sapiens
gaagaaagacugggaugau

SEQ ID NO: 751023 - RNA, 19 nt, Homo sapiens
gauaacaucagaguuugua

SEQ ID NO: 751024 - RNA, 19 nt, Homo sapiens
gaagcugguauucuagaua

SEQ ID NO: 751025 - RNA, 19 nt, Homo sapiens
ugaagucccugcuguaaag

SEQ ID NO: 751026 - RNA, 19 nt, Homo sapiens
gaaggaaaccgaaggugau

SEQ ID NO: 751027 - RNA, 19 nt, Homo sapiens
gaacaguaugcuauuaaga

SEQ ID NO: 751028 - RNA, 19 nt, Homo sapiens
gcaguguacucuuguccuu

SEQ ID NO: 751029 - RNA, 19 nt, Homo sapiens
gcacaagucaaagcuauug

SEQ ID NO: 751030 - RNA, 19 nt, Homo sapiens
aaauagcaguguacucuug

SEQ ID NO: 751031 - RNA, 19 nt, Homo sapiens
ggauuggccugucaguuuc

SEQ ID NO: 751032 - RNA, 19 nt, Homo sapiens
uagaagaggcuguguauag

SEQ ID NO: 751033 - RNA, 19 nt, Homo sapiens
ucugauggaugacauagaa

SEQ ID NO: 751034 - RNA, 19 nt, Homo sapiens
ucaaagcuauugcugauac

SEQ ID NO: 751035 - RNA, 19 nt, Homo sapiens
uaaagacugcugaagaauu

SEQ ID NO: 751036 - RNA, 19 nt, Homo sapiens
gaagaggcuguguauagaa

SEQ ID NO: 751037 - RNA, 19 nt, Homo sapiens
agaagaggcuguguauaga

SEQ ID NO: 751038 - RNA, 19 nt, Homo sapiens
gcucuucauuaugcaaaua

SEQ ID NO: 751039 - RNA, 19 nt, Homo sapiens
gaaacuaagggaacagugu

SEQ ID NO: 751040 - RNA, 19 nt, Homo sapiens
gaaaugggacacugugaca

SEQ ID NO: 751041 - RNA, 19 nt, Homo sapiens
ugaaauagccugcagaaaa

SEQ ID NO: 751042 - RNA, 19 nt, Homo sapiens
ggaaugaacaaaaugguua

SEQ ID NO: 751043 - RNA, 19 nt, Homo sapiens
gcagacauggcucuucauu

SEQ ID NO: 751044 - RNA, 19 nt, Homo sapiens
cucaugagauucuuccuaa

SEQ ID NO: 751045 - RNA, 19 nt, Homo sapiens
ggcuguauuuguaguagua

SEQ ID NO: 751046 - RNA, 19 nt, Homo sapiens
guacaucaagaaggaaaua

SEQ ID NO: 751047 - RNA, 19 nt, Homo sapiens
ggacuugaacaguaugcua

SEQ ID NO: 751048 - RNA, 19 nt, Homo sapiens
ugaauuagccaaacagauc

SEQ ID NO: 751049 - RNA, 19 nt, Homo sapiens
ggagguggagcaacagaaa

SEQ ID NO: 751050 - RNA, 19 nt, Homo sapiens
caugagauucuuccuaauu

SEQ ID NO: 751051 - RNA, 19 nt, Homo sapiens
gacaaacgaugcagcaacu

SEQ ID NO: 751052 - RNA, 19 nt, Homo sapiens
guaggugaaggcuguauuu

SEQ ID NO: 751053 - RNA, 19 nt, Homo sapiens
ggaagaaagacugggauga

SEQ ID NO: 751054 - RNA, 19 nt, Homo sapiens
ggaagcugguauucuagau

SEQ ID NO: 751055 - RNA, 19 nt, Homo sapiens
acgaugguguuaauacuuu

SEQ ID NO: 751056 - RNA, 19 nt, Homo sapiens
ugacauagaaaggguagua

SEQ ID NO: 751057 - RNA, 19 nt, Homo sapiens
ugacaguguuuaccucuca

SEQ ID NO: 751058 - RNA, 19 nt, Homo sapiens
gcucaggcaugcguaucua

SEQ ID NO: 751059 - RNA, 19 nt, Homo sapiens
agacugggaugaugaccaa

SEQ ID NO: 751060 - RNA, 19 nt, Homo sapiens
aagaggcuguguauagaaa

SEQ ID NO: 751061 - RNA, 19 nt, Homo sapiens
gguaguagacgaugguguu

SEQ ID NO: 751062 - RNA, 19 nt, Homo sapiens
ugauaaagacugcugaaga

SEQ ID NO: 751063 - RNA, 19 nt, Homo sapiens
cgccauuucuaccauagua

SEQ ID NO: 751064 - RNA, 19 nt, Homo sapiens
gaucuccgaagacuuugua

SEQ ID NO: 751065 - RNA, 19 nt, Homo sapiens
ccucauggaugcacaaguc

SEQ ID NO: 751066 - RNA, 19 nt, Homo sapiens
caguuccucuucaguauug

SEQ ID NO: 751067 - RNA, 19 nt, Homo sapiens
cagaggucauagaagguua

SEQ ID NO: 751068 - RNA, 19 nt, Homo sapiens
gaaggcuguauuuguagua

SEQ ID NO: 751069 - RNA, 19 nt, Homo sapiens
uuggagaaguuguuuguga

SEQ ID NO: 751070 - RNA, 19 nt, Homo sapiens
uaaggccaaugaaguaauc

SEQ ID NO: 751071 - RNA, 19 nt, Homo sapiens
uaucaguuccucuucagua

SEQ ID NO: 751072 - RNA, 19 nt, Homo sapiens
guaauggcuucucauaugc

SEQ ID NO: 751073 - RNA, 19 nt, Homo sapiens
uuggcuggauguuauaaua

SEQ ID NO: 751074 - RNA, 19 nt, Homo sapiens
gcugaggcauuugaagcua

SEQ ID NO: 751075 - RNA, 19 nt, Homo sapiens
aaccgaaggugauguaaca

SEQ ID NO: 751076 - RNA, 19 nt, Homo sapiens
ugagauucuuccuaauuug

SEQ ID NO: 751077 - RNA, 19 nt, Homo sapiens
guacuuagaguggaucaga

SEQ ID NO: 751078 - RNA, 19 nt, Homo sapiens
gcugaagucccugcuguaa

SEQ ID NO: 751079 - RNA, 19 nt, Homo sapiens
cuugaacaguaugcuauua

SEQ ID NO: 751080 - RNA, 19 nt, Homo sapiens
aguaacagguggcaaagug

SEQ ID NO: 751081 - RNA, 19 nt, Homo sapiens
agucaaagcuauugcugau

SEQ ID NO: 751082 - RNA, 19 nt, Homo sapiens
gauucuuccuaauuuggua

SEQ ID NO: 751083 - RNA, 19 nt, Homo sapiens
aagaaagacugggaugaug

SEQ ID NO: 751084 - RNA, 19 nt, Homo sapiens
caaacucgcuacuaaugcu

SEQ ID NO: 751085 - RNA, 19 nt, Homo sapiens
auacuuaccugggaaaaua

SEQ ID NO: 751086 - RNA, 19 nt, Homo sapiens
caaacgaugcagcaacuau

SEQ ID NO: 751087 - RNA, 19 nt, Homo sapiens
cagacauggcucuucauua

SEQ ID NO: 751088 - RNA, 19 nt, Homo sapiens
gauuagaagaggcugugua

SEQ ID NO: 751089 - RNA, 19 nt, Homo sapiens
gcucaugagauucuuccua

SEQ ID NO: 751090 - RNA, 19 nt, Homo sapiens
gaauuagccaaacagauca

SEQ ID NO: 751091 - RNA, 19 nt, Homo sapiens
guaguagacgaugguguua

SEQ ID NO: 751092 - RNA, 19 nt, Homo sapiens
aaaccacucguacagcaua

SEQ ID NO: 751093 - RNA, 19 nt, Homo sapiens
gugcaaaugucguaguaac

SEQ ID NO: 751094 - RNA, 19 nt, Homo sapiens
aggauuggccugucaguuu

SEQ ID NO: 751095 - RNA, 19 nt, Homo sapiens
guguuuaccucucagaagu

SEQ ID NO: 751096 - RNA, 19 nt, Homo sapiens
uggcagacauggcucuuca

SEQ ID NO: 751097 - RNA, 19 nt, Homo sapiens
gauggcaugauaacagaaa

SEQ ID NO: 751098 - RNA, 19 nt, Homo sapiens
agauauugaugaagucuca

SEQ ID NO: 751099 - RNA, 19 nt, Homo sapiens
ggcuguguauagaaacaua

SEQ ID NO: 751100 - RNA, 19 nt, Homo sapiens
ugaggcauuugaagcuauu

SEQ ID NO: 751101 - RNA, 19 nt, Homo sapiens
ugaacaguaugcuauuaag

SEQ ID NO: 751102 - RNA, 19 nt, Homo sapiens
gcaagaggcuccugauuau

SEQ ID NO: 751103 - RNA, 19 nt, Homo sapiens
gaaggccucuggagucaaa

SEQ ID NO: 751104 - RNA, 19 nt, Homo sapiens
gaagucagccuuugaggaa

SEQ ID NO: 751105 - RNA, 19 nt, Homo sapiens
gccaccaucugcucucuua

SEQ ID NO: 751106 - RNA, 19 nt, Homo sapiens
aggaagaccugacugaauu

SEQ ID NO: 751107 - RNA, 19 nt, Homo sapiens
gcaaaugcgaaguguguaa

SEQ ID NO: 751108 - RNA, 19 nt, Homo sapiens
cgaaguguguaaauauguu

SEQ ID NO: 751109 - RNA, 19 nt, Homo sapiens
ugcaagaggcuccugauua

SEQ ID NO: 751110 - RNA, 19 nt, Homo sapiens
cgaagucacugagaccauu

SEQ ID NO: 751111 - RNA, 19 nt, Homo sapiens
gaggaagaccugacugaau

SEQ ID NO: 751112 - RNA, 19 nt, Homo sapiens
gugaugugcugguggaaga

SEQ ID NO: 751113 - RNA, 19 nt, Homo sapiens
gacauuacacaaccuggua

SEQ ID NO: 751114 - RNA, 19 nt, Homo sapiens
cagagaccuuugagacauu

SEQ ID NO: 751115 - RNA, 19 nt, Homo sapiens
ucacugagaccauuugcaa

SEQ ID NO: 751116 - RNA, 19 nt, Homo sapiens
ggagucaaauacaccaagu

SEQ ID NO: 751117 - RNA, 19 nt, Homo sapiens
ccuaugagcuguggaacga

SEQ ID NO: 751118 - RNA, 19 nt, Homo sapiens
ggacuugcgguuaaucgaa

SEQ ID NO: 751119 - RNA, 19 nt, Homo sapiens
ggagaggaccggcagcaau

SEQ ID NO: 751120 - RNA, 19 nt, Homo sapiens
aaugcgaaguguguaaaua

SEQ ID NO: 751121 - RNA, 19 nt, Homo sapiens
ucagagaccuuugagacau

SEQ ID NO: 751122 - RNA, 19 nt, Homo sapiens
cagcaaaugcgaagugugu

SEQ ID NO: 751123 - RNA, 19 nt, Homo sapiens
cccauuagcuagagagcaa

SEQ ID NO: 751124 - RNA, 19 nt, Homo sapiens
caagaggcuccugauuaua

SEQ ID NO: 751125 - RNA, 19 nt, Homo sapiens
gaagucacugagaccauuu

SEQ ID NO: 751126 - RNA, 19 nt, Homo sapiens
ggaggaagaccugacugaa

SEQ ID NO: 751127 - RNA, 19 nt, Homo sapiens
agagaccuuugagacauua

SEQ ID NO: 751128 - RNA, 19 nt, Homo sapiens
ggaaccaccaggaggaaga

SEQ ID NO: 751129 - RNA, 19 nt, Homo sapiens
gagaggaccggcagcaauc

SEQ ID NO: 751130 - RNA, 19 nt, Homo sapiens
gccaagggcaugucagaga

SEQ ID NO: 751131 - RNA, 19 nt, Homo sapiens
uacacaaccugguacacaa

SEQ ID NO: 751132 - RNA, 19 nt, Homo sapiens
gaaguguguaaauauguug

SEQ ID NO: 751133 - RNA, 19 nt, Homo sapiens
caaaugcgaaguguguaaa

SEQ ID NO: 751134 - RNA, 19 nt, Homo sapiens
gcgggaggcuagcuguugu

SEQ ID NO: 751135 - RNA, 19 nt, Homo sapiens
gggcaugucagagaccuuu

SEQ ID NO: 751136 - RNA, 19 nt, Homo sapiens
gcaugucagagaccuuuga

SEQ ID NO: 751137 - RNA, 19 nt, Homo sapiens
gaccggcagcaaucgauuu

SEQ ID NO: 751138 - RNA, 19 nt, Homo sapiens
ggaagaccugacugaauuc

SEQ ID NO: 751139 - RNA, 19 nt, Homo sapiens
aagaggcuccugauuauag

SEQ ID NO: 751140 - RNA, 19 nt, Homo sapiens
gcgaaguguguaaauaugu

SEQ ID NO: 751141 - RNA, 19 nt, Homo sapiens
auuauagccugcacaagga

SEQ ID NO: 751142 - RNA, 19 nt, Homo sapiens
ggaccggcagcaaucgauu

SEQ ID NO: 751143 - RNA, 19 nt, Homo sapiens
gcuagcuguugucgugguu

SEQ ID NO: 751144 - RNA, 19 nt, Homo sapiens
ugcgaaguguguaaauaug

SEQ ID NO: 751145 - RNA, 19 nt, Homo sapiens
gguccugcauccucucucu

SEQ ID NO: 751146 - RNA, 19 nt, Homo sapiens
acacaaccugguacacaaa

SEQ ID NO: 751147 - RNA, 19 nt, Homo sapiens
gggccuugguccgcuuuga

SEQ ID NO: 751148 - RNA, 19 nt, Homo sapiens
gcaagaccaaggaggugau

SEQ ID NO: 751149 - RNA, 19 nt, Homo sapiens
acugagaccauuugcaaga

SEQ ID NO: 751150 - RNA, 19 nt, Homo sapiens
gcaaagaacuggauauuaa

SEQ ID NO: 751151 - RNA, 19 nt, Homo sapiens
ucacagagcugccacagaa

SEQ ID NO: 751152 - RNA, 19 nt, Homo sapiens
ggagagguccgcauuauuu

SEQ ID NO: 751153 - RNA, 19 nt, Homo sapiens
gcagauggguuuaggagaa

SEQ ID NO: 751154 - RNA, 19 nt, Homo sapiens
gaagaaugcucaccuaguc

SEQ ID NO: 751155 - RNA, 19 nt, Homo sapiens
cuauagaacuguccucaua

SEQ ID NO: 751156 - RNA, 19 nt, Homo sapiens
ggacagaaaugcucaaucg

SEQ ID NO: 751157 - RNA, 19 nt, Homo sapiens
gagcagugguggacuauga

SEQ ID NO: 751158 - RNA, 19 nt, Homo sapiens
caacuuaggcucagugaaa

SEQ ID NO: 751159 - RNA, 19 nt, Homo sapiens
gauacuaccugcaauuuua

SEQ ID NO: 751160 - RNA, 19 nt, Homo sapiens
ggaggacgguggacauuau

SEQ ID NO: 751161 - RNA, 19 nt, Homo sapiens
gaugauaugugcuggcuau

SEQ ID NO: 751162 - RNA, 19 nt, Homo sapiens
gaauaacuguagucaaugu

SEQ ID NO: 751163 - RNA, 19 nt, Homo sapiens
gugguaaauuucaguguua

SEQ ID NO: 751164 - RNA, 19 nt, Homo sapiens
gcaagugccuuaauuacag

SEQ ID NO: 751165 - RNA, 19 nt, Homo sapiens
caagacauauugaaugcaa

SEQ ID NO: 751166 - RNA, 19 nt, Homo sapiens
gaacuccucuuccuuucug

SEQ ID NO: 751167 - RNA, 19 nt, Homo sapiens
gggaauguccauccaauaa

SEQ ID NO: 751168 - RNA, 19 nt, Homo sapiens
ggcaauggcugcucucaga

SEQ ID NO: 751169 - RNA, 19 nt, Homo sapiens
ccgggaaacugcaauguaa

SEQ ID NO: 751170 - RNA, 19 nt, Homo sapiens
uuacuuauguggcaaagaa

SEQ ID NO: 751171 - RNA, 19 nt, Homo sapiens
gaccaaagaugccucuaca

SEQ ID NO: 751172 - RNA, 19 nt, Homo sapiens
uauaugaguuggcugauug

SEQ ID NO: 751173 - RNA, 19 nt, Homo sapiens
ccucauagcuggguuuguu

SEQ ID NO: 751174 - RNA, 19 nt, Homo sapiens
guuauggaauggucucuuu

SEQ ID NO: 751175 - RNA, 19 nt, Homo sapiens
gagagagaaugcugcaguu

SEQ ID NO: 751176 - RNA, 19 nt, Homo sapiens
ccugaugccugaugaauau

SEQ ID NO: 751177 - RNA, 19 nt, Homo sapiens
cugaauaacuguagucaau

SEQ ID NO: 751178 - RNA, 19 nt, Homo sapiens
gaacaacagucugaauaac

SEQ ID NO: 751179 - RNA, 19 nt, Homo sapiens
ggaccaaagucacaggaau

SEQ ID NO: 751180 - RNA, 19 nt, Homo sapiens
gcagguuaguuacauaugu

SEQ ID NO: 751181 - RNA, 19 nt, Homo sapiens
uaaaugggcagucuuguga

SEQ ID NO: 751182 - RNA, 19 nt, Homo sapiens
gaccaaagucacaggaaua

SEQ ID NO: 751183 - RNA, 19 nt, Homo sapiens
gaaaagcgaccaagauaaa

SEQ ID NO: 751184 - RNA, 19 nt, Homo sapiens
gaagaauaagcgagacuuu

SEQ ID NO: 751185 - RNA, 19 nt, Homo sapiens
ucagaaacauggaaaugga

SEQ ID NO: 751186 - RNA, 19 nt, Homo sapiens
gaacauaugucaguuuugu

SEQ ID NO: 751187 - RNA, 19 nt, Homo sapiens
guucaaaccaacuguuaua

SEQ ID NO: 751188 - RNA, 19 nt, Homo sapiens
gaauuguggucacgauugu

SEQ ID NO: 751189 - RNA, 19 nt, Homo sapiens
uugcaucccucguuuaauu

SEQ ID NO: 751190 - RNA, 19 nt, Homo sapiens
ggccuggcguuuauaguaa

SEQ ID NO: 751191 - RNA, 19 nt, Homo sapiens
gaaguggguucugacaguu

SEQ ID NO: 751192 - RNA, 19 nt, Homo sapiens
gcaugaauuugcccuacaa

SEQ ID NO: 751193 - RNA, 19 nt, Homo sapiens
gcugacaccucuccucuca

SEQ ID NO: 751194 - RNA, 19 nt, Homo sapiens
uaucgacucuggcgagauu

SEQ ID NO: 751195 - RNA, 19 nt, Homo sapiens
gaauguccauccaauaaac

SEQ ID NO: 751196 - RNA, 19 nt, Homo sapiens
cuugagagcugaugacaau

SEQ ID NO: 751197 - RNA, 19 nt, Homo sapiens
caaaugggagugaaccuuu

SEQ ID NO: 751198 - RNA, 19 nt, Homo sapiens
aaaguggacagaagaauaa

SEQ ID NO: 751199 - RNA, 19 nt, Homo sapiens
cauauugaaugcaaaguuc

SEQ ID NO: 751200 - RNA, 19 nt, Homo sapiens
cccaguaacucgucauuug

SEQ ID NO: 751201 - RNA, 19 nt, Homo sapiens
ggaaaacugugguuguaaa

SEQ ID NO: 751202 - RNA, 19 nt, Homo sapiens
cgaacaacagucugaauaa

SEQ ID NO: 751203 - RNA, 19 nt, Homo sapiens
ggcaaagaacuggauauua

SEQ ID NO: 751204 - RNA, 19 nt, Homo sapiens
ggauguauaucaagaucau

SEQ ID NO: 751205 - RNA, 19 nt, Homo sapiens
agacugcccugauuacaug

SEQ ID NO: 751206 - RNA, 19 nt, Homo sapiens
ggaauguccauccaauaaa

SEQ ID NO: 751207 - RNA, 19 nt, Homo sapiens
ccaaagaugccucuacaau

SEQ ID NO: 751208 - RNA, 19 nt, Homo sapiens
caacucaauuucugaagca

SEQ ID NO: 751209 - RNA, 19 nt, Homo sapiens
guucauccauaccaacaaa

SEQ ID NO: 751210 - RNA, 19 nt, Homo sapiens
agagagaucuuugggaaug

SEQ ID NO: 751211 - RNA, 19 nt, Homo sapiens
gagcauaucccuccuugca

SEQ ID NO: 751212 - RNA, 19 nt, Homo sapiens
gcagaaauggacaauguau

SEQ ID NO: 751213 - RNA, 19 nt, Homo sapiens
caaagucacaggaauacaa

SEQ ID NO: 751214 - RNA, 19 nt, Homo sapiens
ccaaggguccgauguuauu

SEQ ID NO: 751215 - RNA, 19 nt, Homo sapiens
gaaauccagcaacugaauu

SEQ ID NO: 751216 - RNA, 19 nt, Homo sapiens
gagaaaagcgaccaagaua

SEQ ID NO: 751217 - RNA, 19 nt, Homo sapiens
ccaacaaagucauaaagag

SEQ ID NO: 751218 - RNA, 19 nt, Homo sapiens
uaauuugcaucccucguuu

SEQ ID NO: 751219 - RNA, 19 nt, Homo sapiens
gcaacaacuacaucuauau

SEQ ID NO: 751220 - RNA, 19 nt, Homo sapiens
gauaugugcuggcuaugag

SEQ ID NO: 751221 - RNA, 19 nt, Homo sapiens
gagagaaugcugcaguuug

SEQ ID NO: 751222 - RNA, 19 nt, Homo sapiens
gcucagacaguucagauga

SEQ ID NO: 751223 - RNA, 19 nt, Homo sapiens
ggcaggagauauugaguca

SEQ ID NO: 751224 - RNA, 19 nt, Homo sapiens
gaggaaaacugugguugua

SEQ ID NO: 751225 - RNA, 19 nt, Homo sapiens
gggccuggcguuuauagua

SEQ ID NO: 751226 - RNA, 19 nt, Homo sapiens
agacacagauugcagucaa

SEQ ID NO: 751227 - RNA, 19 nt, Homo sapiens
ucaagaaggagaccaaaga

SEQ ID NO: 751228 - RNA, 19 nt, Homo sapiens
ggauuugagugaugagcaa

SEQ ID NO: 751229 - RNA, 19 nt, Homo sapiens
caagaacauaugucaguuu

SEQ ID NO: 751230 - RNA, 19 nt, Homo sapiens
ugcaacaacuacaucuaua

SEQ ID NO: 751231 - RNA, 19 nt, Homo sapiens
agaccagugucauccauuu

SEQ ID NO: 751232 - RNA, 19 nt, Homo sapiens
ccaaauugauacaggaaca

SEQ ID NO: 751233 - RNA, 19 nt, Homo sapiens
aaccaucugugaccaaauu

SEQ ID NO: 751234 - RNA, 19 nt, Homo sapiens
ugagucagcuggccugcaa

SEQ ID NO: 751235 - RNA, 19 nt, Homo sapiens
ccgaacaacagucugaaua

SEQ ID NO: 751236 - RNA, 19 nt, Homo sapiens
caaagaugccucuacaauc

SEQ ID NO: 751237 - RNA, 19 nt, Homo sapiens
acaagugccuguaugaaca

SEQ ID NO: 751238 - RNA, 19 nt, Homo sapiens
agaccuuucuccuaaacua

SEQ ID NO: 751239 - RNA, 19 nt, Homo sapiens
gacacguacugcuauauca

SEQ ID NO: 751240 - RNA, 19 nt, Homo sapiens
ugugugacccucucuauaa

SEQ ID NO: 751241 - RNA, 19 nt, Homo sapiens
gaagccgacugcucagaca

SEQ ID NO: 751242 - RNA, 19 nt, Homo sapiens
cuacaacaguacaaguuau

SEQ ID NO: 751243 - RNA, 19 nt, Homo sapiens
uaacuguagucaaugugaa

SEQ ID NO: 751244 - RNA, 19 nt, Homo sapiens
aaaaucaggugcuacagua

SEQ ID NO: 751245 - RNA, 19 nt, Homo sapiens
ugagagcugaugacaauaa

SEQ ID NO: 751246 - RNA, 19 nt, Homo sapiens
uuauaaggaugaucagaga

SEQ ID NO: 751247 - RNA, 19 nt, Homo sapiens
aaagacagauuuacaucca

SEQ ID NO: 751248 - RNA, 19 nt, Homo sapiens
uuauuucucuggaacauug

SEQ ID NO: 751249 - RNA, 19 nt, Homo sapiens
ccucagaugcucccaguuu

SEQ ID NO: 751250 - RNA, 19 nt, Homo sapiens
guaaagcucuuaacaguau

SEQ ID NO: 751251 - RNA, 19 nt, Homo sapiens
ccaauugccugcuccauua

SEQ ID NO: 751252 - RNA, 19 nt, Homo sapiens
gaagguagaauguuuguaa

SEQ ID NO: 751253 - RNA, 19 nt, Homo sapiens
aaagaaaccugcuguauac

SEQ ID NO: 751254 - RNA, 19 nt, Homo sapiens
ccaaagugcuugaggaaga

SEQ ID NO: 751255 - RNA, 19 nt, Homo sapiens
gaguggcucuuucugauuu

SEQ ID NO: 751256 - RNA, 19 nt, Homo sapiens
gcuauaaucuguacacucu

SEQ ID NO: 751257 - RNA, 19 nt, Homo sapiens
gcucuguucucuccuguaa

SEQ ID NO: 751258 - RNA, 19 nt, Homo sapiens
gcacagagcaucacguaca

SEQ ID NO: 751259 - RNA, 19 nt, Homo sapiens
guauguaagccuucaauaa

SEQ ID NO: 751260 - RNA, 19 nt, Homo sapiens
ucagggaccuuuauaccaa

SEQ ID NO: 751261 - RNA, 19 nt, Homo sapiens
uaaagacugugaagguaga

SEQ ID NO: 751262 - RNA, 19 nt, Homo sapiens
uagcauggcuggcucuguu

SEQ ID NO: 751263 - RNA, 19 nt, Homo sapiens
gcauggguauuuagacugu

SEQ ID NO: 751264 - RNA, 19 nt, Homo sapiens
gaacgaguggccuccauug

SEQ ID NO: 751265 - RNA, 19 nt, Homo sapiens
gcacuauggucagggcaaa

SEQ ID NO: 751266 - RNA, 19 nt, Homo sapiens
gcggagaucugagcucuag

SEQ ID NO: 751267 - RNA, 19 nt, Homo sapiens
auacagggcucugcucuga

SEQ ID NO: 751268 - RNA, 19 nt, Homo sapiens
caaagugcuugaggaagaa

SEQ ID NO: 751269 - RNA, 19 nt, Homo sapiens
gaaggaaaggucugugugu

SEQ ID NO: 751270 - RNA, 19 nt, Homo sapiens
ccucuucucuagacuuauu

SEQ ID NO: 751271 - RNA, 19 nt, Homo sapiens
cgaguggccuccauuguag

SEQ ID NO: 751272 - RNA, 19 nt, Homo sapiens
ggagaugccccuucuuaua

SEQ ID NO: 751273 - RNA, 19 nt, Homo sapiens
uggcccagguguuuaagua

SEQ ID NO: 751274 - RNA, 19 nt, Homo sapiens
gcauggcccagguguuuaa

SEQ ID NO: 751275 - RNA, 19 nt, Homo sapiens
ucugugggcucaccauuug

SEQ ID NO: 751276 - RNA, 19 nt, Homo sapiens
ucuguucucuccuguaaga

SEQ ID NO: 751277 - RNA, 19 nt, Homo sapiens
gacuggagcucauggacau

SEQ ID NO: 751278 - RNA, 19 nt, Homo sapiens
aaaagaaaccugcuguaua

SEQ ID NO: 751279 - RNA, 19 nt, Homo sapiens
caccauuugugccgcuaua

SEQ ID NO: 751280 - RNA, 19 nt, Homo sapiens
uaacuccaccugugaugaa

SEQ ID NO: 751281 - RNA, 19 nt, Homo sapiens
cuagugaucuccuucuucu

SEQ ID NO: 751282 - RNA, 19 nt, Homo sapiens
aaaucuagguggccucuca

SEQ ID NO: 751283 - RNA, 19 nt, Homo sapiens
uuguaaagcucuuaacagu

SEQ ID NO: 751284 - RNA, 19 nt, Homo sapiens
auuaaagacugugaaggua

SEQ ID NO: 751285 - RNA, 19 nt, Homo sapiens
gcucugaccuaggcuucuu

SEQ ID NO: 751286 - RNA, 19 nt, Homo sapiens
gagacugggcucugaccua

SEQ ID NO: 751287 - RNA, 19 nt, Homo sapiens
guagaauguuuguaaagcu

SEQ ID NO: 751288 - RNA, 19 nt, Homo sapiens
gguagaauguuuguaaagc

SEQ ID NO: 751289 - RNA, 19 nt, Homo sapiens
gcccgagacuuccaacagu

SEQ ID NO: 751290 - RNA, 19 nt, Homo sapiens
gaagcggccauucacucua

SEQ ID NO: 751291 - RNA, 19 nt, Homo sapiens
cugugaagguagaauguuu

SEQ ID NO: 751292 - RNA, 19 nt, Homo sapiens
gcccagguguuuaaguaca

SEQ ID NO: 751293 - RNA, 19 nt, Homo sapiens
cacagagcaucacguacaa

SEQ ID NO: 751294 - RNA, 19 nt, Homo sapiens
gaauguuuguaaagcucuu

SEQ ID NO: 751295 - RNA, 19 nt, Homo sapiens
ucucuagacuuauuuccau

SEQ ID NO: 751296 - RNA, 19 nt, Homo sapiens
cagccaggccacucucuuu

SEQ ID NO: 751297 - RNA, 19 nt, Homo sapiens
uguacacucucugcuauug

SEQ ID NO: 751298 - RNA, 19 nt, Homo sapiens
ucuguacacucucugcuau

SEQ ID NO: 751299 - RNA, 19 nt, Homo sapiens
uauaaucuguacacucucu

SEQ ID NO: 751300 - RNA, 19 nt, Homo sapiens
ucaacuggcccgagacuuc

SEQ ID NO: 751301 - RNA, 19 nt, Homo sapiens
ggaagcggccauucacucu

SEQ ID NO: 751302 - RNA, 19 nt, Homo sapiens
cagggaccuuuauaccaaa

SEQ ID NO: 751303 - RNA, 19 nt, Homo sapiens
acgaguggccuccauugua

SEQ ID NO: 751304 - RNA, 19 nt, Homo sapiens
cauuaaagacugugaaggu

SEQ ID NO: 751305 - RNA, 19 nt, Homo sapiens
uguaaagcucuuaacagua

SEQ ID NO: 751306 - RNA, 19 nt, Homo sapiens
acagggcucugcucugaag

SEQ ID NO: 751307 - RNA, 19 nt, Homo sapiens
acagugcucucuggaagga

SEQ ID NO: 751308 - RNA, 19 nt, Homo sapiens
gguaaggcaggcacgaaga

SEQ ID NO: 751309 - RNA, 19 nt, Homo sapiens
gacgugugccuaugcaaug

SEQ ID NO: 751310 - RNA, 19 nt, Homo sapiens
cagagcaucacguacaaug

SEQ ID NO: 751311 - RNA, 19 nt, Homo sapiens
aggcauggcccagguguuu

SEQ ID NO: 751312 - RNA, 19 nt, Homo sapiens
ggaggaaaacaaauucuug

SEQ ID NO: 751313 - RNA, 19 nt, Homo sapiens
ugacuucagggaccuuuau

SEQ ID NO: 751314 - RNA, 19 nt, Homo sapiens
ugcuggaccuggaggaauu

SEQ ID NO: 751315 - RNA, 19 nt, Homo sapiens
aagcggccauucacucuag

SEQ ID NO: 751316 - RNA, 19 nt, Homo sapiens
caauugccugcuccauuaa

SEQ ID NO: 751317 - RNA, 19 nt, Homo sapiens
gagaugccccuucuuauag

SEQ ID NO: 751318 - RNA, 19 nt, Homo sapiens
ccuuguacccuaccgauug

SEQ ID NO: 751319 - RNA, 19 nt, Homo sapiens
ggaccuggaggaauuuguc

SEQ ID NO: 751320 - RNA, 19 nt, Homo sapiens
ugugcugcauggguauuua

SEQ ID NO: 751321 - RNA, 19 nt, Homo sapiens
cuccagauauccaggaaag

SEQ ID NO: 751322 - RNA, 19 nt, Homo sapiens
gccaggccacucucuuuga

SEQ ID NO: 751323 - RNA, 19 nt, Homo sapiens
ccaacagugcucucuggaa

SEQ ID NO: 751324 - RNA, 19 nt, Homo sapiens
ggugcucugugucaugcuu

SEQ ID NO: 751325 - RNA, 19 nt, Homo sapiens
uaccaaagugcuugaggaa

SEQ ID NO: 751326 - RNA, 19 nt, Homo sapiens
gacuucagggaccuuuaua

SEQ ID NO: 751327 - RNA, 19 nt, Homo sapiens
cguggacuacguucucuuu

SEQ ID NO: 751328 - RNA, 19 nt, Homo sapiens
ucagcaugguggccucuuc

SEQ ID NO: 751329 - RNA, 19 nt, Homo sapiens
cccaauugccugcuccauu

SEQ ID NO: 751330 - RNA, 19 nt, Homo sapiens
ggugacgugugccuaugca

SEQ ID NO: 751331 - RNA, 19 nt, Homo sapiens
ggcauggcccagguguuua

SEQ ID NO: 751332 - RNA, 19 nt, Homo sapiens
ccaccgagagcaucaagag

SEQ ID NO: 751333 - RNA, 19 nt, Homo sapiens
ugacgugugccuaugcaau

SEQ ID NO: 751334 - RNA, 19 nt, Homo sapiens
ucacucguuuccuccagau

SEQ ID NO: 751335 - RNA, 19 nt, Homo sapiens
gaucaucgauuccucauug

SEQ ID NO: 751336 - RNA, 19 nt, Homo sapiens
ucacucagcuguucuuuga

SEQ ID NO: 751337 - RNA, 19 nt, Homo sapiens
gcauugagcucccaucuag

SEQ ID NO: 751338 - RNA, 19 nt, Homo sapiens
gagaauacuugucugaaga

SEQ ID NO: 751339 - RNA, 19 nt, Homo sapiens
gaagaaguacacaagaaua

SEQ ID NO: 751340 - RNA, 19 nt, Homo sapiens
caaguugccuccauaucua

SEQ ID NO: 751341 - RNA, 19 nt, Homo sapiens
gcagaaagccaguaacuuc

SEQ ID NO: 751342 - RNA, 19 nt, Homo sapiens
ucacugagaaggaauauaa

SEQ ID NO: 751343 - RNA, 19 nt, Homo sapiens
ggaagaggcgagauaauga

SEQ ID NO: 751344 - RNA, 19 nt, Homo sapiens
gauaauuccuuccaaacau

SEQ ID NO: 751345 - RNA, 19 nt, Homo sapiens
ggaacuacuuucuggaaga

SEQ ID NO: 751346 - RNA, 19 nt, Homo sapiens
acauaaaggccaaugauua

SEQ ID NO: 751347 - RNA, 19 nt, Homo sapiens
guugucaauuucccuauua

SEQ ID NO: 751348 - RNA, 19 nt, Homo sapiens
ccaugaggaucuucacuaa

SEQ ID NO: 751349 - RNA, 19 nt, Homo sapiens
ggacaagcaagccaaauug

SEQ ID NO: 751350 - RNA, 19 nt, Homo sapiens
ggauaucacguauguguuu

SEQ ID NO: 751351 - RNA, 19 nt, Homo sapiens
gagaagaauccaacuaguu

SEQ ID NO: 751352 - RNA, 19 nt, Homo sapiens
ucucacacaucaaugcuua

SEQ ID NO: 751353 - RNA, 19 nt, Homo sapiens
ggacuuugacuuugagaaa

SEQ ID NO: 751354 - RNA, 19 nt, Homo sapiens
gagaaggaauauaagacuu

SEQ ID NO: 751355 - RNA, 19 nt, Homo sapiens
uuggagagcugaugagaaa

SEQ ID NO: 751356 - RNA, 19 nt, Homo sapiens
guguguaacuuaugucuga

SEQ ID NO: 751357 - RNA, 19 nt, Homo sapiens
ggaagaagacaauuauaag

SEQ ID NO: 751358 - RNA, 19 nt, Homo sapiens
cauaugaugguaccacuua

SEQ ID NO: 751359 - RNA, 19 nt, Homo sapiens
ccagauguguguaacuuau

SEQ ID NO: 751360 - RNA, 19 nt, Homo sapiens
caagggcuguggcugauga

SEQ ID NO: 751361 - RNA, 19 nt, Homo sapiens
agaagacuauugugacuga

SEQ ID NO: 751362 - RNA, 19 nt, Homo sapiens
uguuagagguggaggauuu

SEQ ID NO: 751363 - RNA, 19 nt, Homo sapiens
gcaagcagaaagccaguaa

SEQ ID NO: 751364 - RNA, 19 nt, Homo sapiens
gaggcgagauaaugaugaa

SEQ ID NO: 751365 - RNA, 19 nt, Homo sapiens
aggcaaaugguaugaauua

SEQ ID NO: 751366 - RNA, 19 nt, Homo sapiens
acagauaauuccuuccaaa

SEQ ID NO: 751367 - RNA, 19 nt, Homo sapiens
acaagaauaccaccuauga

SEQ ID NO: 751368 - RNA, 19 nt, Homo sapiens
gaggauaucacguaugugu

SEQ ID NO: 751369 - RNA, 19 nt, Homo sapiens
gaacagauaauuccuucca

SEQ ID NO: 751370 - RNA, 19 nt, Homo sapiens
gaagaacagauaauuccuu

SEQ ID NO: 751371 - RNA, 19 nt, Homo sapiens
ucaauggcaucacugagaa

SEQ ID NO: 751372 - RNA, 19 nt, Homo sapiens
uuaccaaguugccuccaua

SEQ ID NO: 751373 - RNA, 19 nt, Homo sapiens
gcaaaugguaugaauuaca

SEQ ID NO: 751374 - RNA, 19 nt, Homo sapiens
gcuuccagcuuaccaaguu

SEQ ID NO: 751375 - RNA, 19 nt, Homo sapiens
ccaggugacugacauccuu

SEQ ID NO: 751376 - RNA, 19 nt, Homo sapiens
gaacccuucuccagaugug

SEQ ID NO: 751377 - RNA, 19 nt, Homo sapiens
ggcugaugaugguaaauaa

SEQ ID NO: 751378 - RNA, 19 nt, Homo sapiens
cugaagaaguacacaagaa

SEQ ID NO: 751379 - RNA, 19 nt, Homo sapiens
gagauggcguugacuuucu

SEQ ID NO: 751380 - RNA, 19 nt, Homo sapiens
aggcuuacauucagauuug

SEQ ID NO: 751381 - RNA, 19 nt, Homo sapiens
ucaacauccuggcuaaguu

SEQ ID NO: 751382 - RNA, 19 nt, Homo sapiens
uggaggauaucacguaugu

SEQ ID NO: 751383 - RNA, 19 nt, Homo sapiens
gggaguaguugaagaacag

SEQ ID NO: 751384 - RNA, 19 nt, Homo sapiens
gagauaaugaugaaaccaa

SEQ ID NO: 751385 - RNA, 19 nt, Homo sapiens
gggauaucauguucuuguu

SEQ ID NO: 751386 - RNA, 19 nt, Homo sapiens
uaacauaaaggccaaugau

SEQ ID NO: 751387 - RNA, 19 nt, Homo sapiens
ccagacaacuaugagauca

SEQ ID NO: 751388 - RNA, 19 nt, Homo sapiens
caguuuagccaccauguuu

SEQ ID NO: 751389 - RNA, 19 nt, Homo sapiens
gccaguaacuucgcucugu

SEQ ID NO: 751390 - RNA, 19 nt, Homo sapiens
acacaagaauaccaccuau

SEQ ID NO: 751391 - RNA, 19 nt, Homo sapiens
cagcuguucuuugaucauu

SEQ ID NO: 751392 - RNA, 19 nt, Homo sapiens
gaagaggcgagauaaugau

SEQ ID NO: 751393 - RNA, 19 nt, Homo sapiens
gcguugacuuucugucuug

SEQ ID NO: 751394 - RNA, 19 nt, Homo sapiens
gauaucacguauguguuug

SEQ ID NO: 751395 - RNA, 19 nt, Homo sapiens
ccaguaacuucgcucuguu

SEQ ID NO: 751396 - RNA, 19 nt, Homo sapiens
aaagaagacuauugugacu

SEQ ID NO: 751397 - RNA, 19 nt, Homo sapiens
gaaauuucaaggcacaugu

SEQ ID NO: 751398 - RNA, 19 nt, Homo sapiens
ggacaggcaaaugguauga

SEQ ID NO: 751399 - RNA, 19 nt, Homo sapiens
aggaguugcuggacuuuga

SEQ ID NO: 751400 - RNA, 19 nt, Homo sapiens
gaugguaaauaagaacaca

SEQ ID NO: 751401 - RNA, 19 nt, Homo sapiens
ugucagaggcuuacauuca

SEQ ID NO: 751402 - RNA, 19 nt, Homo sapiens
ggagauggcguugacuuuc

SEQ ID NO: 751403 - RNA, 19 nt, Homo sapiens
uaagaagacuuuucagauc

SEQ ID NO: 751404 - RNA, 19 nt, Homo sapiens
guaaauaagaacacagaag

SEQ ID NO: 751405 - RNA, 19 nt, Homo sapiens
gaucugagagaauacuugu

SEQ ID NO: 751406 - RNA, 19 nt, Homo sapiens
ccaaguugccuccauaucu

SEQ ID NO: 751407 - RNA, 19 nt, Homo sapiens
guaguugaagaacagauaa

SEQ ID NO: 751408 - RNA, 19 nt, Homo sapiens
gcccguaccuggacaccau

SEQ ID NO: 751409 - RNA, 19 nt, Homo sapiens
cuagauugaugcuccuuuc

SEQ ID NO: 751410 - RNA, 19 nt, Homo sapiens
agagaauacuugucugaag

SEQ ID NO: 751411 - RNA, 19 nt, Homo sapiens
gagagaauacuugucugaa

SEQ ID NO: 751412 - RNA, 19 nt, Homo sapiens
ugagaagaauccaacuagu

SEQ ID NO: 751413 - RNA, 19 nt, Homo sapiens
ggauaucauguucuuguug

SEQ ID NO: 751414 - RNA, 19 nt, Homo sapiens
gcgggaagcgagagucuga

SEQ ID NO: 751415 - RNA, 19 nt, Homo sapiens
acaggcaaaugguaugaau

SEQ ID NO: 751416 - RNA, 19 nt, Homo sapiens
caaauguggaucugagaga

SEQ ID NO: 751417 - RNA, 19 nt, Homo sapiens
uggcaucacugagaaggaa

SEQ ID NO: 751418 - RNA, 19 nt, Homo sapiens
cuggaacccucgaaauuuc

SEQ ID NO: 751419 - RNA, 19 nt, Homo sapiens
gauuaaauagucuccuguu

SEQ ID NO: 751420 - RNA, 19 nt, Homo sapiens
cccauuuccugauuuguau

SEQ ID NO: 751421 - RNA, 19 nt, Homo sapiens
gaagucucacgccuacauu

SEQ ID NO: 751422 - RNA, 19 nt, Homo sapiens
ugaagaaguacacaagaau

SEQ ID NO: 751423 - RNA, 19 nt, Homo sapiens
ugagagaauacuugucuga

SEQ ID NO: 751424 - RNA, 19 nt, Homo sapiens
uaaguucaauggcaucacu

SEQ ID NO: 751425 - RNA, 19 nt, Homo sapiens
caacauccuggcuaaguuc

SEQ ID NO: 751426 - RNA, 19 nt, Homo sapiens
gaaguacacaagaauacca

SEQ ID NO: 751427 - RNA, 19 nt, Homo sapiens
aaauguggaucugagagaa

SEQ ID NO: 751428 - RNA, 19 nt, Homo sapiens
gcaucacugagaaggaaua

SEQ ID NO: 751429 - RNA, 19 nt, Homo sapiens
acaaggagauggcguugac

SEQ ID NO: 751430 - RNA, 19 nt, Homo sapiens
ucagaucaccaaacaagga

SEQ ID NO: 751431 - RNA, 19 nt, Homo sapiens
gggacugaauaacauaaag

SEQ ID NO: 751432 - RNA, 19 nt, Homo sapiens
ucagaggcuuacauucaga

SEQ ID NO: 751433 - RNA, 19 nt, Homo sapiens
cauucacaguguccaguuu

SEQ ID NO: 751434 - RNA, 19 nt, Homo sapiens
gccuccauaucuaaucuuu

SEQ ID NO: 751435 - RNA, 19 nt, Homo sapiens
ucaccaagcucaacauuua

SEQ ID NO: 751436 - RNA, 19 nt, Homo sapiens
cgagagcgcuuggaaguuu

SEQ ID NO: 751437 - RNA, 19 nt, Homo sapiens
ggaacggccuggugaagga

SEQ ID NO: 751438 - RNA, 19 nt, Homo sapiens
ugaaggaccugcgggagua

SEQ ID NO: 751439 - RNA, 19 nt, Homo sapiens
ucagugacgugcagcuuga

SEQ ID NO: 751440 - RNA, 19 nt, Homo sapiens
gcucaacauuuacuucaag

SEQ ID NO: 751441 - RNA, 19 nt, Homo sapiens
ggucauguggcgccuguuu

SEQ ID NO: 751442 - RNA, 19 nt, Homo sapiens
ggucaucgccugggaggaa

SEQ ID NO: 751443 - RNA, 19 nt, Homo sapiens
caucuacgcuacgcuauac

SEQ ID NO: 751444 - RNA, 19 nt, Homo sapiens
caccaucugucuucuacga

SEQ ID NO: 751445 - RNA, 19 nt, Homo sapiens
ccagagaugccgccaagau

SEQ ID NO: 751446 - RNA, 19 nt, Homo sapiens
gugccuaccugcuguuugg

SEQ ID NO: 751447 - RNA, 19 nt, Homo sapiens
ucuccgugcucuucuuuga

SEQ ID NO: 751448 - RNA, 19 nt, Homo sapiens
gcggcuuccuggccaacua

SEQ ID NO: 751449 - RNA, 19 nt, Homo sapiens
ccgagaagccacugaggaa

SEQ ID NO: 751450 - RNA, 19 nt, Homo sapiens
gagagcgcuuggaaguuuc

SEQ ID NO: 751451 - RNA, 19 nt, Homo sapiens
gggcauccuugugcucuuc

SEQ ID NO: 751452 - RNA, 19 nt, Homo sapiens
cuccaacucugcuccucua

SEQ ID NO: 751453 - RNA, 19 nt, Homo sapiens
cagagaugccgccaagaug

SEQ ID NO: 751454 - RNA, 19 nt, Homo sapiens
acgcuacgcuauacaugga

SEQ ID NO: 751455 - RNA, 19 nt, Homo sapiens
ccaucuacgcuacgcuaua

SEQ ID NO: 751456 - RNA, 19 nt, Homo sapiens
gcagugccacgggacauug

SEQ ID NO: 751457 - RNA, 19 nt, Homo sapiens
gaaacaucgugcgccacau

SEQ ID NO: 751458 - RNA, 19 nt, Homo sapiens
caagcucaacauuuacuuc

SEQ ID NO: 751459 - RNA, 19 nt, Homo sapiens
gcaaggacucgguggucau

SEQ ID NO: 751460 - RNA, 19 nt, Homo sapiens
caucuccgugcucuucuuu

SEQ ID NO: 751461 - RNA, 19 nt, Homo sapiens
aaacaucgugcgccacauc

SEQ ID NO: 751462 - RNA, 19 nt, Homo sapiens
guucaccaagcucaacauu

SEQ ID NO: 751463 - RNA, 19 nt, Homo sapiens
ugaguggacagucgucuuc

SEQ ID NO: 751464 - RNA, 19 nt, Homo sapiens
cugcugcucacccuuauga

SEQ ID NO: 751465 - RNA, 19 nt, Homo sapiens
gcccaucuccgugcucuuc

SEQ ID NO: 751466 - RNA, 19 nt, Homo sapiens
ccucauccugccuccauuu

SEQ ID NO: 751467 - RNA, 19 nt, Homo sapiens
gcgcuuggaaguuucucuu

SEQ ID NO: 751468 - RNA, 19 nt, Homo sapiens
cugcugcugcucacccuua

SEQ ID NO: 751469 - RNA, 19 nt, Homo sapiens
gguuccgccucuacugguu

SEQ ID NO: 751470 - RNA, 19 nt, Homo sapiens
caaggacucgguggucaug

SEQ ID NO: 751471 - RNA, 19 nt, Homo sapiens
gaacaaagccugugaaaug

SEQ ID NO: 751472 - RNA, 19 nt, Homo sapiens
caaaggagcuucaaauaac

SEQ ID NO: 751473 - RNA, 19 nt, Homo sapiens
gagagaaguucaccuuuga

SEQ ID NO: 751474 - RNA, 19 nt, Homo sapiens
ggagagaaguucaccuuug

SEQ ID NO: 751475 - RNA, 19 nt, Homo sapiens
cuacuucucuuucuuguaa

SEQ ID NO: 751476 - RNA, 19 nt, Homo sapiens
gaacacggauauuacacaa

SEQ ID NO: 751477 - RNA, 19 nt, Homo sapiens
gcacacaaauagcuaagga

SEQ ID NO: 751478 - RNA, 19 nt, Homo sapiens
gcaaaaggauuucgggaua

SEQ ID NO: 751479 - RNA, 19 nt, Homo sapiens
caacuuugcuguaaaccuu

SEQ ID NO: 751480 - RNA, 19 nt, Homo sapiens
gcaaggaaaucgggucuau

SEQ ID NO: 751481 - RNA, 19 nt, Homo sapiens
ccgcaacgcugguuuguga

SEQ ID NO: 751482 - RNA, 19 nt, Homo sapiens
uaaacucucuccugucuug

SEQ ID NO: 751483 - RNA, 19 nt, Homo sapiens
caaagccugugaaaugauu

SEQ ID NO: 751484 - RNA, 19 nt, Homo sapiens
gaaaucgggucuauaugca

SEQ ID NO: 751485 - RNA, 19 nt, Homo sapiens
caacaaaggagcuucaaau

SEQ ID NO: 751486 - RNA, 19 nt, Homo sapiens
cggccacgcugcucucuua

SEQ ID NO: 751487 - RNA, 19 nt, Homo sapiens
gauccgagcuugucuugca

SEQ ID NO: 751488 - RNA, 19 nt, Homo sapiens
acaaauagcuaaggagaau

SEQ ID NO: 751489 - RNA, 19 nt, Homo sapiens
gaaaugauuguacauagug

SEQ ID NO: 751490 - RNA, 19 nt, Homo sapiens
acaaaggagcuucaaauaa

SEQ ID NO: 751491 - RNA, 19 nt, Homo sapiens
ucaccgaccuucaacuuug

SEQ ID NO: 751492 - RNA, 19 nt, Homo sapiens
gcaaagcggacaccaaugu

SEQ ID NO: 751493 - RNA, 19 nt, Homo sapiens
uaacauuucuggucucgau

SEQ ID NO: 751494 - RNA, 19 nt, Homo sapiens
gaacugcgccaaggacauu

SEQ ID NO: 751495 - RNA, 19 nt, Homo sapiens
gcucuagaaacaugaaaua

SEQ ID NO: 751496 - RNA, 19 nt, Homo sapiens
caaaaccaguucaugcuua

SEQ ID NO: 751497 - RNA, 19 nt, Homo sapiens
cauaggauguugacucuag

SEQ ID NO: 751498 - RNA, 19 nt, Homo sapiens
ccaaggagcuccguucuac

SEQ ID NO: 751499 - RNA, 19 nt, Homo sapiens
gaguuauccuccuacaauu

SEQ ID NO: 751500 - RNA, 19 nt, Homo sapiens
gaacaacaaaggagcuuca

SEQ ID NO: 751501 - RNA, 19 nt, Homo sapiens
guggauuucuaguuuauga

SEQ ID NO: 751502 - RNA, 19 nt, Homo sapiens
uaaggagaauccacccaaa

SEQ ID NO: 751503 - RNA, 19 nt, Homo sapiens
gcagcaagaucaaaaguga

SEQ ID NO: 751504 - RNA, 19 nt, Homo sapiens
gugaaaugauuguacauag

SEQ ID NO: 751505 - RNA, 19 nt, Homo sapiens
ggacaccaaugugcaagga

SEQ ID NO: 751506 - RNA, 19 nt, Homo sapiens
gagacgcccuccucgauca

SEQ ID NO: 751507 - RNA, 19 nt, Homo sapiens
uaccagaacacggauauua

SEQ ID NO: 751508 - RNA, 19 nt, Homo sapiens
ggaaaucgggucuauaugc

SEQ ID NO: 751509 - RNA, 19 nt, Homo sapiens
ccacggcucauuacaauau

SEQ ID NO: 751510 - RNA, 19 nt, Homo sapiens
gcacgaucaucccauuauc

SEQ ID NO: 751511 - RNA, 19 nt, Homo sapiens
gcccuaaugcacacaaaua

SEQ ID NO: 751512 - RNA, 19 nt, Homo sapiens
cuagaaacaugaaauacuc

SEQ ID NO: 751513 - RNA, 19 nt, Homo sapiens
aaauagaucacaacccuuu

SEQ ID NO: 751514 - RNA, 19 nt, Homo sapiens
uguaacgaauggcuaguuu

SEQ ID NO: 751515 - RNA, 19 nt, Homo sapiens
aacaaagccugugaaauga

SEQ ID NO: 751516 - RNA, 19 nt, Homo sapiens
ggauauuacacaacugaaa

SEQ ID NO: 751517 - RNA, 19 nt, Homo sapiens
gagcuccguucuaccaguu

SEQ ID NO: 751518 - RNA, 19 nt, Homo sapiens
acaccaaugugcaaggaaa

SEQ ID NO: 751519 - RNA, 19 nt, Homo sapiens
gcacaagcagcaagaucaa

SEQ ID NO: 751520 - RNA, 19 nt, Homo sapiens
aacaaaggagcuucaaaua

SEQ ID NO: 751521 - RNA, 19 nt, Homo sapiens
aaggauuucgggauaauua

SEQ ID NO: 751522 - RNA, 19 nt, Homo sapiens
uaauuacuaugugcccuaa

SEQ ID NO: 751523 - RNA, 19 nt, Homo sapiens
aaggaaaucgggucuauau

SEQ ID NO: 751524 - RNA, 19 nt, Homo sapiens
agucagauacagacaauuu

SEQ ID NO: 751525 - RNA, 19 nt, Homo sapiens
ucagucagauacagacaau

SEQ ID NO: 751526 - RNA, 19 nt, Homo sapiens
gucuguggauuucuaguuu

SEQ ID NO: 751527 - RNA, 19 nt, Homo sapiens
ucaauccguugcaugaaau

SEQ ID NO: 751528 - RNA, 19 nt, Homo sapiens
gauguugacucuagaaccu

SEQ ID NO: 751529 - RNA, 19 nt, Homo sapiens
aaaggagcuucaaauaaca

SEQ ID NO: 751530 - RNA, 19 nt, Homo sapiens
acacggauauuacacaacu

SEQ ID NO: 751531 - RNA, 19 nt, Homo sapiens
ugaagugcuuucugucuag

SEQ ID NO: 751532 - RNA, 19 nt, Homo sapiens
ucuguggauuucuaguuua

SEQ ID NO: 751533 - RNA, 19 nt, Homo sapiens
gcacugccuuucuccuucu

SEQ ID NO: 751534 - RNA, 19 nt, Homo sapiens
uugaagugcuuucugucua

SEQ ID NO: 751535 - RNA, 19 nt, Homo sapiens
gaccuucaacuuugcugua

SEQ ID NO: 751536 - RNA, 19 nt, Homo sapiens
caaaaggauuucgggauaa

SEQ ID NO: 751537 - RNA, 19 nt, Homo sapiens
ucugauugcugcauagugu

SEQ ID NO: 751538 - RNA, 19 nt, Homo sapiens
ggaggcaaauggguuccuu

SEQ ID NO: 751539 - RNA, 19 nt, Homo sapiens
gagcacugccuuucuccuu

SEQ ID NO: 751540 - RNA, 19 nt, Homo sapiens
ggaacaaagccugugaaau

SEQ ID NO: 751541 - RNA, 19 nt, Homo sapiens
agucucggccuccacauua

SEQ ID NO: 751542 - RNA, 19 nt, Homo sapiens
gcucaccgaccuucaacuu

SEQ ID NO: 751543 - RNA, 19 nt, Homo sapiens
gauuucgggauaauuauga

SEQ ID NO: 751544 - RNA, 19 nt, Homo sapiens
gagggcgaguguucagguu

SEQ ID NO: 751545 - RNA, 19 nt, Homo sapiens
caaggaaaucgggucuaua

SEQ ID NO: 751546 - RNA, 19 nt, Homo sapiens
cccaaucacuggagguuuc

SEQ ID NO: 751547 - RNA, 19 nt, Homo sapiens
cccagcgcguccuuucuua

SEQ ID NO: 751548 - RNA, 19 nt, Homo sapiens
ucucuuaccuccuacuucu

SEQ ID NO: 751549 - RNA, 19 nt, Homo sapiens
gucagcagcuaaccaaugg

SEQ ID NO: 751550 - RNA, 19 nt, Homo sapiens
gagcuucaaauaacaaugg

SEQ ID NO: 751551 - RNA, 19 nt, Homo sapiens
cucaauccguugcaugaaa

SEQ ID NO: 751552 - RNA, 19 nt, Homo sapiens
gagcgugauuuuaaccuuu

SEQ ID NO: 751553 - RNA, 19 nt, Homo sapiens
cagcgggacugcgagaaga

SEQ ID NO: 751554 - RNA, 19 nt, Homo sapiens
gcgugcagacguucacuuu

SEQ ID NO: 751555 - RNA, 19 nt, Homo sapiens
ucccacggcucauuacaau

SEQ ID NO: 751556 - RNA, 19 nt, Homo sapiens
aguaaacucucuccugucu

SEQ ID NO: 751557 - RNA, 19 nt, Homo sapiens
cuaucaugcucuccaagaa

SEQ ID NO: 751558 - RNA, 19 nt, Homo sapiens
uccguugcaugaaauaauu

SEQ ID NO: 751559 - RNA, 19 nt, Homo sapiens
ucucuucucucucuuuuaa

SEQ ID NO: 751560 - RNA, 19 nt, Homo sapiens
ccagaacacggauauuaca

SEQ ID NO: 751561 - RNA, 19 nt, Homo sapiens
aaacagggaaggcgcaugu

SEQ ID NO: 751562 - RNA, 19 nt, Homo sapiens
ggacguccagagaaguaaa

SEQ ID NO: 751563 - RNA, 19 nt, Homo sapiens
gaagugcuuucugucuagu

SEQ ID NO: 751564 - RNA, 19 nt, Homo sapiens
gaccugggcaguccuguca

SEQ ID NO: 751565 - RNA, 19 nt, Homo sapiens
aaauaacaaugggcagaug

SEQ ID NO: 751566 - RNA, 19 nt, Homo sapiens
cggcaaagcggacaccaau

SEQ ID NO: 751567 - RNA, 19 nt, Homo sapiens
gucuuucucuuaccuccua

SEQ ID NO: 751568 - RNA, 19 nt, Homo sapiens
uaucaugcucuccaagaaa

SEQ ID NO: 751569 - RNA, 19 nt, Homo sapiens
acucaguagugauggguuu

SEQ ID NO: 751570 - RNA, 19 nt, Homo sapiens
ccugugaaaugauuguaca

SEQ ID NO: 751571 - RNA, 19 nt, Homo sapiens
gaagagaacauucaagaua

SEQ ID NO: 751572 - RNA, 19 nt, Homo sapiens
ccagauggcucuucaagua

SEQ ID NO: 751573 - RNA, 19 nt, Homo sapiens
uaacagaacugcuauugga

SEQ ID NO: 751574 - RNA, 19 nt, Homo sapiens
gcacuuauuuggcuacuug

SEQ ID NO: 751575 - RNA, 19 nt, Homo sapiens
gaacggagacgcugaauag

SEQ ID NO: 751576 - RNA, 19 nt, Homo sapiens
gcagaaagaccugugaaua

SEQ ID NO: 751577 - RNA, 19 nt, Homo sapiens
gaagaaggcucugugcaau

SEQ ID NO: 751578 - RNA, 19 nt, Homo sapiens
agaaggagcccucgaguua

SEQ ID NO: 751579 - RNA, 19 nt, Homo sapiens
gaagaacuauuugacauuc

SEQ ID NO: 751580 - RNA, 19 nt, Homo sapiens
gaugggagcuaccaaacuu

SEQ ID NO: 751581 - RNA, 19 nt, Homo sapiens
cggagacgcugaauaguuu

SEQ ID NO: 751582 - RNA, 19 nt, Homo sapiens
gggcaacuaucucuaaaug

SEQ ID NO: 751583 - RNA, 19 nt, Homo sapiens
gggccaggcugaaguauug

SEQ ID NO: 751584 - RNA, 19 nt, Homo sapiens
ggauaaggcuucauauguc

SEQ ID NO: 751585 - RNA, 19 nt, Homo sapiens
gaaguugguuuaucuguac

SEQ ID NO: 751586 - RNA, 19 nt, Homo sapiens
gauaaggcuucauauguca

SEQ ID NO: 751587 - RNA, 19 nt, Homo sapiens
ucaauacgcugugcaaaga

SEQ ID NO: 751588 - RNA, 19 nt, Homo sapiens
cgccagaucuugcauaguu

SEQ ID NO: 751589 - RNA, 19 nt, Homo sapiens
gaaguuaagcggauucugu

SEQ ID NO: 751590 - RNA, 19 nt, Homo sapiens
caccaucucuuaaaucgaa

SEQ ID NO: 751591 - RNA, 19 nt, Homo sapiens
uacaagaacucccugauuc

SEQ ID NO: 751592 - RNA, 19 nt, Homo sapiens
uaaugcuccuuauguguua

SEQ ID NO: 751593 - RNA, 19 nt, Homo sapiens
ugaccaggauccaauugua

SEQ ID NO: 751594 - RNA, 19 nt, Homo sapiens
ggaugugucugcggacuuu

SEQ ID NO: 751595 - RNA, 19 nt, Homo sapiens
ucaauggucugcgggauaa

SEQ ID NO: 751596 - RNA, 19 nt, Homo sapiens
gaaacaaaaugaagcaaga

SEQ ID NO: 751597 - RNA, 19 nt, Homo sapiens
accgaggucucuucuauua

SEQ ID NO: 751598 - RNA, 19 nt, Homo sapiens
uaggacguuuguuguauua

SEQ ID NO: 751599 - RNA, 19 nt, Homo sapiens
ggaagaacuauuugacauu

SEQ ID NO: 751600 - RNA, 19 nt, Homo sapiens
gggauaaggcuucauaugu

SEQ ID NO: 751601 - RNA, 19 nt, Homo sapiens
guacaagaacucccugauu

SEQ ID NO: 751602 - RNA, 19 nt, Homo sapiens
ggaaggaggcguugucauc

SEQ ID NO: 751603 - RNA, 19 nt, Homo sapiens
gaagcaagcacuuauuugg

SEQ ID NO: 751604 - RNA, 19 nt, Homo sapiens
gggaagcaagcacuuauuu

SEQ ID NO: 751605 - RNA, 19 nt, Homo sapiens
uagaggaaauucugaaaca

SEQ ID NO: 751606 - RNA, 19 nt, Homo sapiens
agaagaaguugguuuaucu

SEQ ID NO: 751607 - RNA, 19 nt, Homo sapiens
gcuaggacguuuguuguau

SEQ ID NO: 751608 - RNA, 19 nt, Homo sapiens
ggacuuacacagaucaaug

SEQ ID NO: 751609 - RNA, 19 nt, Homo sapiens
cgaggucucuucuauuauc

SEQ ID NO: 751610 - RNA, 19 nt, Homo sapiens
gaggcguugucaucaauaa

SEQ ID NO: 751611 - RNA, 19 nt, Homo sapiens
guacugaagcuguauguca

SEQ ID NO: 751612 - RNA, 19 nt, Homo sapiens
agaaguugguuuaucugua

SEQ ID NO: 751613 - RNA, 19 nt, Homo sapiens
gauacuggcugucuguucu

SEQ ID NO: 751614 - RNA, 19 nt, Homo sapiens
cagaaagaccugugaauag

SEQ ID NO: 751615 - RNA, 19 nt, Homo sapiens
gaucaauguguucagauuu

SEQ ID NO: 751616 - RNA, 19 nt, Homo sapiens
ugugggagcugcccuguga

SEQ ID NO: 751617 - RNA, 19 nt, Homo sapiens
ggaagcaagcacuuauuug

SEQ ID NO: 751618 - RNA, 19 nt, Homo sapiens
ucauggagacucugaagua

SEQ ID NO: 751619 - RNA, 19 nt, Homo sapiens
aagagaacauucaagauag

SEQ ID NO: 751620 - RNA, 19 nt, Homo sapiens
ucaaucuguuggauaguuu

SEQ ID NO: 751621 - RNA, 19 nt, Homo sapiens
ucucuuaaaucgaauguca

SEQ ID NO: 751622 - RNA, 19 nt, Homo sapiens
cagaagaaguugguuuauc

SEQ ID NO: 751623 - RNA, 19 nt, Homo sapiens
uagaggacuuuguugagaa

SEQ ID NO: 751624 - RNA, 19 nt, Homo sapiens
gaauuccuaaugcuccuua

SEQ ID NO: 751625 - RNA, 19 nt, Homo sapiens
gcagugaggaagaacuauu

SEQ ID NO: 751626 - RNA, 19 nt, Homo sapiens
gaaggaggcguugucauca

SEQ ID NO: 751627 - RNA, 19 nt, Homo sapiens
gaacaaggagaggguacaa

SEQ ID NO: 751628 - RNA, 19 nt, Homo sapiens
gugcaauccucacauucaa

SEQ ID NO: 751629 - RNA, 19 nt, Homo sapiens
ggacguuuguuguauuacu

SEQ ID NO: 751630 - RNA, 19 nt, Homo sapiens
gugaacuggugaacgauga

SEQ ID NO: 751631 - RNA, 19 nt, Homo sapiens
cguacaaacugauguccuu

SEQ ID NO: 751632 - RNA, 19 nt, Homo sapiens
ccugguaaaugaauuauac

SEQ ID NO: 751633 - RNA, 19 nt, Homo sapiens
gagaaggagcccucgaguu

SEQ ID NO: 751634 - RNA, 19 nt, Homo sapiens
ugaagaaggcucugugcaa

SEQ ID NO: 751635 - RNA, 19 nt, Homo sapiens
ccagaucuugcauaguuua

SEQ ID NO: 751636 - RNA, 19 nt, Homo sapiens
uagauauuguccagaagaa

SEQ ID NO: 751637 - RNA, 19 nt, Homo sapiens
cuaggacguuuguuguauu

SEQ ID NO: 751638 - RNA, 19 nt, Homo sapiens
uuagaggacuuuguugaga

SEQ ID NO: 751639 - RNA, 19 nt, Homo sapiens
gaucuugcauaguuuacca

SEQ ID NO: 751640 - RNA, 19 nt, Homo sapiens
gaugugccaagaugcauaa

SEQ ID NO: 751641 - RNA, 19 nt, Homo sapiens
ggacuuuguugagaaugug

SEQ ID NO: 751642 - RNA, 19 nt, Homo sapiens
ugcacaggcugccaucuuu

SEQ ID NO: 751643 - RNA, 19 nt, Homo sapiens
ggugaacgaugagaaugug

SEQ ID NO: 751644 - RNA, 19 nt, Homo sapiens
gaaaguggaggugcugugu

SEQ ID NO: 751645 - RNA, 19 nt, Homo sapiens
cuacaucaaacuacagaaa

SEQ ID NO: 751646 - RNA, 19 nt, Homo sapiens
ugaggucucuagaggaaau

SEQ ID NO: 751647 - RNA, 19 nt, Homo sapiens
uggagacucugaaguagau

SEQ ID NO: 751648 - RNA, 19 nt, Homo sapiens
guagauauuguccagaaga

SEQ ID NO: 751649 - RNA, 19 nt, Homo sapiens
ccucuuaguuggcauugau

SEQ ID NO: 751650 - RNA, 19 nt, Homo sapiens
ccgaggacguggugaagga

SEQ ID NO: 751651 - RNA, 19 nt, Homo sapiens
agaucaauguguucagauu

SEQ ID NO: 751652 - RNA, 19 nt, Homo sapiens
gaggaagaacuauuugaca

SEQ ID NO: 751653 - RNA, 19 nt, Homo sapiens
gacccuugauuccugaaga

SEQ ID NO: 751654 - RNA, 19 nt, Homo sapiens
ggacaugcuaggacguuug

SEQ ID NO: 751655 - RNA, 19 nt, Homo sapiens
uccgagaccugguuugguu

SEQ ID NO: 751656 - RNA, 19 nt, Homo sapiens
aaguggaggugcuguguga

SEQ ID NO: 751657 - RNA, 19 nt, Homo sapiens
gauauuguccagaagaagu

SEQ ID NO: 751658 - RNA, 19 nt, Homo sapiens
cuugaggucucuagaggaa

SEQ ID NO: 751659 - RNA, 19 nt, Homo sapiens
gcaggaguauauacaacag

SEQ ID NO: 751660 - RNA, 19 nt, Homo sapiens
guuaagcggauucugugua

SEQ ID NO: 751661 - RNA, 19 nt, Homo sapiens
ugugugaacuggugaacga

SEQ ID NO: 751662 - RNA, 19 nt, Homo sapiens
gccagaucuugcauaguuu

SEQ ID NO: 751663 - RNA, 19 nt, Homo sapiens
gagcugcccugugacucuu

SEQ ID NO: 751664 - RNA, 19 nt, Homo sapiens
guagauggugcccugguaa

SEQ ID NO: 751665 - RNA, 19 nt, Homo sapiens
caacagccuauucucaaug

SEQ ID NO: 751666 - RNA, 19 nt, Homo sapiens
gccuuaaaguugcucauca

SEQ ID NO: 751667 - RNA, 19 nt, Homo sapiens
agaaagaccugugaauagc

SEQ ID NO: 751668 - RNA, 19 nt, Homo sapiens
uuaagcggauucuguguag

SEQ ID NO: 751669 - RNA, 19 nt, Homo sapiens
gcacaggcugccaucuuug

SEQ ID NO: 751670 - RNA, 19 nt, Homo sapiens
uuggauaguuuccucaaga

SEQ ID NO: 751671 - RNA, 19 nt, Homo sapiens
gaaauggacuucaguucuu

SEQ ID NO: 751672 - RNA, 19 nt, Homo sapiens
gaauaaaccagaugccuua

SEQ ID NO: 751673 - RNA, 19 nt, Homo sapiens
gggagcagcuguuagauug

SEQ ID NO: 751674 - RNA, 19 nt, Homo sapiens
gcagaaagggccaauguaa

SEQ ID NO: 751675 - RNA, 19 nt, Homo sapiens
guacagaccugcugaaugc

SEQ ID NO: 751676 - RNA, 19 nt, Homo sapiens
gaaagagcuuguucagaga

SEQ ID NO: 751677 - RNA, 19 nt, Homo sapiens
caucucaguuguuacuuua

SEQ ID NO: 751678 - RNA, 19 nt, Homo sapiens
ccaaaugucugauaugaag

SEQ ID NO: 751679 - RNA, 19 nt, Homo sapiens
gaauacagccauuggauga

SEQ ID NO: 751680 - RNA, 19 nt, Homo sapiens
uaacauugcucacaugaag

SEQ ID NO: 751681 - RNA, 19 nt, Homo sapiens
ugauacaucucaguuguua

SEQ ID NO: 751682 - RNA, 19 nt, Homo sapiens
gaagaagugggaucaguuu

SEQ ID NO: 751683 - RNA, 19 nt, Homo sapiens
ggaugaauaugaagacaau

SEQ ID NO: 751684 - RNA, 19 nt, Homo sapiens
cuacaagagucaagauuug

SEQ ID NO: 751685 - RNA, 19 nt, Homo sapiens
guuaagagauggucagaca

SEQ ID NO: 751686 - RNA, 19 nt, Homo sapiens
gaaauccugugggaauuau

SEQ ID NO: 751687 - RNA, 19 nt, Homo sapiens
cauccacucuuaaauuuga

SEQ ID NO: 751688 - RNA, 19 nt, Homo sapiens
aaugaugcauccacucuua

SEQ ID NO: 751689 - RNA, 19 nt, Homo sapiens
ugaagacaauccugaaaga

SEQ ID NO: 751690 - RNA, 19 nt, Homo sapiens
agaaagggccaauguaauu

SEQ ID NO: 751691 - RNA, 19 nt, Homo sapiens
ggaaauggaggaguuugua

SEQ ID NO: 751692 - RNA, 19 nt, Homo sapiens
caagaaauccugugggaau

SEQ ID NO: 751693 - RNA, 19 nt, Homo sapiens
cuaaggaaauggaggaguu

SEQ ID NO: 751694 - RNA, 19 nt, Homo sapiens
gggaaaagcugacauaugg

SEQ ID NO: 751695 - RNA, 19 nt, Homo sapiens
gaagacccacuaccuuauu

SEQ ID NO: 751696 - RNA, 19 nt, Homo sapiens
gccauuggaugaauaugaa

SEQ ID NO: 751697 - RNA, 19 nt, Homo sapiens
caagggagcagcuguuaga

SEQ ID NO: 751698 - RNA, 19 nt, Homo sapiens
caacaugaucaaccaguaa

SEQ ID NO: 751699 - RNA, 19 nt, Homo sapiens
ucaauuuccucauccauuc

SEQ ID NO: 751700 - RNA, 19 nt, Homo sapiens
cgagcagucuucuggauug

SEQ ID NO: 751701 - RNA, 19 nt, Homo sapiens
ucaacaugaucaaccagua

SEQ ID NO: 751702 - RNA, 19 nt, Homo sapiens
guacuggcaucuucagcuu

SEQ ID NO: 751703 - RNA, 19 nt, Homo sapiens
uaagagauggucagacauu

SEQ ID NO: 751704 - RNA, 19 nt, Homo sapiens
gcagucuucuggauugaau

SEQ ID NO: 751705 - RNA, 19 nt, Homo sapiens
uggcaacugugauauuuau

SEQ ID NO: 751706 - RNA, 19 nt, Homo sapiens
ggaagacccacuaccuuau

SEQ ID NO: 751707 - RNA, 19 nt, Homo sapiens
ugcauccacucuuaaauuu

SEQ ID NO: 751708 - RNA, 19 nt, Homo sapiens
gagcagcuguuagauugga

SEQ ID NO: 751709 - RNA, 19 nt, Homo sapiens
ggugggcauuccauuguuu

SEQ ID NO: 751710 - RNA, 19 nt, Homo sapiens
ccagaugccuuaggucuca

SEQ ID NO: 751711 - RNA, 19 nt, Homo sapiens
uaaaccagaugccuuaggu

SEQ ID NO: 751712 - RNA, 19 nt, Homo sapiens
agagauuaguuaugucuga

SEQ ID NO: 751713 - RNA, 19 nt, Homo sapiens
ugacuguacuggcaucuuc

SEQ ID NO: 751714 - RNA, 19 nt, Homo sapiens
gccaaacaccuucgaguug

SEQ ID NO: 751715 - RNA, 19 nt, Homo sapiens
gauaacauugcucacauga

SEQ ID NO: 751716 - RNA, 19 nt, Homo sapiens
ugucugauaugaagaagug

SEQ ID NO: 751717 - RNA, 19 nt, Homo sapiens
ucuggaaguuugcuagaaa

SEQ ID NO: 751718 - RNA, 19 nt, Homo sapiens
uguggcaacugugauauuu

SEQ ID NO: 751719 - RNA, 19 nt, Homo sapiens
gcuguuagauuggacuuca

SEQ ID NO: 751720 - RNA, 19 nt, Homo sapiens
uaacauacgguuuguguac

SEQ ID NO: 751721 - RNA, 19 nt, Homo sapiens
cuacuuaacauacgguuug

SEQ ID NO: 751722 - RNA, 19 nt, Homo sapiens
cccaugaccucaccugguu

SEQ ID NO: 751723 - RNA, 19 nt, Homo sapiens
ccucauccauucuuaccaa

SEQ ID NO: 751724 - RNA, 19 nt, Homo sapiens
cccacuaccuuauuugaga

SEQ ID NO: 751725 - RNA, 19 nt, Homo sapiens
aggaagacccacuaccuua

SEQ ID NO: 751726 - RNA, 19 nt, Homo sapiens
cuguaaagauguaguuuca

SEQ ID NO: 751727 - RNA, 19 nt, Homo sapiens
gaaaagggaagaagggaaa

SEQ ID NO: 751728 - RNA, 19 nt, Homo sapiens
auacucggcuguacaagug

SEQ ID NO: 751729 - RNA, 19 nt, Homo sapiens
gagcagucuucuggauuga

SEQ ID NO: 751730 - RNA, 19 nt, Homo sapiens
uaacaugacagcagaaagg

SEQ ID NO: 751731 - RNA, 19 nt, Homo sapiens
ugcaacagguuaagagaug

SEQ ID NO: 751732 - RNA, 19 nt, Homo sapiens
guaccacucuuuggaugug

SEQ ID NO: 751733 - RNA, 19 nt, Homo sapiens
ggagauuugacgggaauaa

SEQ ID NO: 751734 - RNA, 19 nt, Homo sapiens
caggaugacucugaaaugg

SEQ ID NO: 751735 - RNA, 19 nt, Homo sapiens
ucagugauaaguaacauga

SEQ ID NO: 751736 - RNA, 19 nt, Homo sapiens
aagacccacuaccuuauuu

SEQ ID NO: 751737 - RNA, 19 nt, Homo sapiens
acuccuggcuacacaauug

SEQ ID NO: 751738 - RNA, 19 nt, Homo sapiens
aagaaauccugugggaauu

SEQ ID NO: 751739 - RNA, 19 nt, Homo sapiens
gccaagggagcagcuguua

SEQ ID NO: 751740 - RNA, 19 nt, Homo sapiens
gagauuugacgggaauaaa

SEQ ID NO: 751741 - RNA, 19 nt, Homo sapiens
cagcagaaagggccaaugu

SEQ ID NO: 751742 - RNA, 19 nt, Homo sapiens
uuccaaaugucugauauga

SEQ ID NO: 751743 - RNA, 19 nt, Homo sapiens
agaaauccugugggaauua

SEQ ID NO: 751744 - RNA, 19 nt, Homo sapiens
acaucucaguuguuacuuu

SEQ ID NO: 751745 - RNA, 19 nt, Homo sapiens
ggucagacauucgaaaaga

SEQ ID NO: 751746 - RNA, 19 nt, Homo sapiens
agauuggacuucaacacaa

SEQ ID NO: 751747 - RNA, 19 nt, Homo sapiens
ugauaacauugcucacaug

SEQ ID NO: 751748 - RNA, 19 nt, Homo sapiens
ucaauacucggcuguacaa

SEQ ID NO: 751749 - RNA, 19 nt, Homo sapiens
gcagaauacagccauugga

SEQ ID NO: 751750 - RNA, 19 nt, Homo sapiens
cagaaagggccaauguaau

SEQ ID NO: 751751 - RNA, 19 nt, Homo sapiens
ccagauagauaggacaacu

SEQ ID NO: 751752 - RNA, 19 nt, Homo sapiens
gaaauggaggaguuuguac

SEQ ID NO: 751753 - RNA, 19 nt, Homo sapiens
ugaagaagugggaucaguu

SEQ ID NO: 751754 - RNA, 19 nt, Homo sapiens
ggacugauuuucccuccuu

SEQ ID NO: 751755 - RNA, 19 nt, Homo sapiens
aagguucuguggagauuug

SEQ ID NO: 751756 - RNA, 19 nt, Homo sapiens
gggaucaguuuuacaguga

SEQ ID NO: 751757 - RNA, 19 nt, Homo sapiens
gguuccaaaugucugauau

SEQ ID NO: 751758 - RNA, 19 nt, Homo sapiens
ugaaguuuauccuacaucu

SEQ ID NO: 751759 - RNA, 19 nt, Homo sapiens
caagaauucaacaugauca

SEQ ID NO: 751760 - RNA, 19 nt, Homo sapiens
cugaagacaguaauuaaug

SEQ ID NO: 751761 - RNA, 19 nt, Homo sapiens
uacagccauuggaugaaua

SEQ ID NO: 751762 - RNA, 19 nt, Homo sapiens
guggagauuugacgggaau

SEQ ID NO: 751763 - RNA, 19 nt, Homo sapiens
ucaacacaaugucgaguac

SEQ ID NO: 751764 - RNA, 19 nt, Homo sapiens
ccaggaugacucugaaaug

SEQ ID NO: 751765 - RNA, 19 nt, Homo sapiens
ugacgggaauaaaccagau

SEQ ID NO: 751766 - RNA, 19 nt, Homo sapiens
gacccacuaccuuauuuga

SEQ ID NO: 751767 - RNA, 19 nt, Homo sapiens
agaauaucaucaugcaaca

SEQ ID NO: 751768 - RNA, 19 nt, Homo sapiens
gaaguuuauccuacaucuu

SEQ ID NO: 751769 - RNA, 19 nt, Homo sapiens
gcaucuaugaggcaaucua

SEQ ID NO: 751770 - RNA, 19 nt, Homo sapiens
gcugcuggcugcgcuacuu

SEQ ID NO: 751771 - RNA, 19 nt, Homo sapiens
gaacagacaagcacuauua

SEQ ID NO: 751772 - RNA, 19 nt, Homo sapiens
gcaaguacaucacaagaua

SEQ ID NO: 751773 - RNA, 19 nt, Homo sapiens
gaacagagauuacccuuuc

SEQ ID NO: 751774 - RNA, 19 nt, Homo sapiens
gaaagaaucuauccuguau

SEQ ID NO: 751775 - RNA, 19 nt, Homo sapiens
ggauaaagcuuaauacaga

SEQ ID NO: 751776 - RNA, 19 nt, Homo sapiens
caacacagaugcauuacua

SEQ ID NO: 751777 - RNA, 19 nt, Homo sapiens
ggagagagcugcagacaga

SEQ ID NO: 751778 - RNA, 19 nt, Homo sapiens
gggaguaucuuaauuugua

SEQ ID NO: 751779 - RNA, 19 nt, Homo sapiens
gaaguaacaucaaaccauu

SEQ ID NO: 751780 - RNA, 19 nt, Homo sapiens
gaaaguuuguccauaauug

SEQ ID NO: 751781 - RNA, 19 nt, Homo sapiens
ggacaacacagaugcauua

SEQ ID NO: 751782 - RNA, 19 nt, Homo sapiens
ugaaucagcucaacucuuu

SEQ ID NO: 751783 - RNA, 19 nt, Homo sapiens
ggacuacuauugauuggua

SEQ ID NO: 751784 - RNA, 19 nt, Homo sapiens
ggaauuggcuuuaguacug

SEQ ID NO: 751785 - RNA, 19 nt, Homo sapiens
gaagggaugccuauuauuu

SEQ ID NO: 751786 - RNA, 19 nt, Homo sapiens
cgacuaagauagaucauuu

SEQ ID NO: 751787 - RNA, 19 nt, Homo sapiens
cacaagauaugcauacuua

SEQ ID NO: 751788 - RNA, 19 nt, Homo sapiens
ggaaguagaauaccaagua

SEQ ID NO: 751789 - RNA, 19 nt, Homo sapiens
caucagacauguuccauuu

SEQ ID NO: 751790 - RNA, 19 nt, Homo sapiens
gaacagaugcuugaaauau

SEQ ID NO: 751791 - RNA, 19 nt, Homo sapiens
gaacaggauugucacgaaa

SEQ ID NO: 751792 - RNA, 19 nt, Homo sapiens
ucagaaaguuuguccauaa

SEQ ID NO: 751793 - RNA, 19 nt, Homo sapiens
aaacgggccucuuuagaua

SEQ ID NO: 751794 - RNA, 19 nt, Homo sapiens
gagaagaguuugccaugaa

SEQ ID NO: 751795 - RNA, 19 nt, Homo sapiens
ggaagaagccagaaugauu

SEQ ID NO: 751796 - RNA, 19 nt, Homo sapiens
caacagaacucaaugaacu

SEQ ID NO: 751797 - RNA, 19 nt, Homo sapiens
caaagagcaucuaugaauu

SEQ ID NO: 751798 - RNA, 19 nt, Homo sapiens
gaaauggguucaaagacaa

SEQ ID NO: 751799 - RNA, 19 nt, Homo sapiens
gauauaagcagaacuguga

SEQ ID NO: 751800 - RNA, 19 nt, Homo sapiens
ggaagcagcagcccuuaua

SEQ ID NO: 751801 - RNA, 19 nt, Homo sapiens
acacagggauuaaucaauu

SEQ ID NO: 751802 - RNA, 19 nt, Homo sapiens
ggaagacaguucagcacua

SEQ ID NO: 751803 - RNA, 19 nt, Homo sapiens
gaauccaugugcccuguua

SEQ ID NO: 751804 - RNA, 19 nt, Homo sapiens
gugagaagcuggcagauau

SEQ ID NO: 751805 - RNA, 19 nt, Homo sapiens
gugcuacccuuccuaauuu

SEQ ID NO: 751806 - RNA, 19 nt, Homo sapiens
cauauucucuaucugguua

SEQ ID NO: 751807 - RNA, 19 nt, Homo sapiens
uaucauugcucgagaguuu

SEQ ID NO: 751808 - RNA, 19 nt, Homo sapiens
ucaaagaaauggugugaga

SEQ ID NO: 751809 - RNA, 19 nt, Homo sapiens
gaaaggaguggacacagua

SEQ ID NO: 751810 - RNA, 19 nt, Homo sapiens
ggagagggauaucauugaa

SEQ ID NO: 751811 - RNA, 19 nt, Homo sapiens
ggaagaaagcuuuguuuau

SEQ ID NO: 751812 - RNA, 19 nt, Homo sapiens
ggaccauguuguuaguuua

SEQ ID NO: 751813 - RNA, 19 nt, Homo sapiens
uaacugugcuguugaugaa

SEQ ID NO: 751814 - RNA, 19 nt, Homo sapiens
ggaaagaaucuauccugua

SEQ ID NO: 751815 - RNA, 19 nt, Homo sapiens
gagauuacccuuucaccua

SEQ ID NO: 751816 - RNA, 19 nt, Homo sapiens
aaagacaacagcccuauua

SEQ ID NO: 751817 - RNA, 19 nt, Homo sapiens
gcaaugaagggcuuuguuu

SEQ ID NO: 751818 - RNA, 19 nt, Homo sapiens
ggagaaaggaggaaauuau

SEQ ID NO: 751819 - RNA, 19 nt, Homo sapiens
gagguauccuguucuguaa

SEQ ID NO: 751820 - RNA, 19 nt, Homo sapiens
gagagcagaugggcauuaa

SEQ ID NO: 751821 - RNA, 19 nt, Homo sapiens
gauccaagccugacuuuga

SEQ ID NO: 751822 - RNA, 19 nt, Homo sapiens
gcaaaucguuggcaugagu

SEQ ID NO: 751823 - RNA, 19 nt, Homo sapiens
agacuuagccuaguaauuu

SEQ ID NO: 751824 - RNA, 19 nt, Homo sapiens
caggauggauuacaguuaa

SEQ ID NO: 751825 - RNA, 19 nt, Homo sapiens
ggacaauguggauauauuu

SEQ ID NO: 751826 - RNA, 19 nt, Homo sapiens
uaagaacucugagaaauca

SEQ ID NO: 751827 - RNA, 19 nt, Homo sapiens
gcaguugacuuguuccaau

SEQ ID NO: 751828 - RNA, 19 nt, Homo sapiens
acaauuaccugauaugcaa

SEQ ID NO: 751829 - RNA, 19 nt, Homo sapiens
gacaagcacuauuaccaaa

SEQ ID NO: 751830 - RNA, 19 nt, Homo sapiens
uaaaugaagugcugauaca

SEQ ID NO: 751831 - RNA, 19 nt, Homo sapiens
gaacagaaggaaaggugua

SEQ ID NO: 751832 - RNA, 19 nt, Homo sapiens
cgaauaaccuuuacagaac

SEQ ID NO: 751833 - RNA, 19 nt, Homo sapiens
ggaaagguguaucauccaa

SEQ ID NO: 751834 - RNA, 19 nt, Homo sapiens
ggaaaggaguggacacagu

SEQ ID NO: 751835 - RNA, 19 nt, Homo sapiens
ggaguagcauuucaucaug

SEQ ID NO: 751836 - RNA, 19 nt, Homo sapiens
gaauggugguuguggauga

SEQ ID NO: 751837 - RNA, 19 nt, Homo sapiens
gaauaaaaguagacgguua

SEQ ID NO: 751838 - RNA, 19 nt, Homo sapiens
cagaacagaugcuugaaau

SEQ ID NO: 751839 - RNA, 19 nt, Homo sapiens
gaucuuggcucauuuaucc

SEQ ID NO: 751840 - RNA, 19 nt, Homo sapiens
ggagcaaaguuaugaagau

SEQ ID NO: 751841 - RNA, 19 nt, Homo sapiens
caacagauggcaacugaaa

SEQ ID NO: 751842 - RNA, 19 nt, Homo sapiens
gugaaaggauaaagcuuaa

SEQ ID NO: 751843 - RNA, 19 nt, Homo sapiens
gcauacaaguuccuuuaau

SEQ ID NO: 751844 - RNA, 19 nt, Homo sapiens
ucaaagagcaucuaugaau

SEQ ID NO: 751845 - RNA, 19 nt, Homo sapiens
ggagaagaaucacuaaugc

SEQ ID NO: 751846 - RNA, 19 nt, Homo sapiens
gaaaugcccucucaguacu

SEQ ID NO: 751847 - RNA, 19 nt, Homo sapiens
caugacauccauccaauua

SEQ ID NO: 751848 - RNA, 19 nt, Homo sapiens
gaccaagauuugcuauauu

SEQ ID NO: 751849 - RNA, 19 nt, Homo sapiens
gugaagcagucaguaguua

SEQ ID NO: 751850 - RNA, 19 nt, Homo sapiens
gcucuuggcucauaacgau

SEQ ID NO: 751851 - RNA, 19 nt, Homo sapiens
gcuaugggaucauuuaugg

SEQ ID NO: 751852 - RNA, 19 nt, Homo sapiens
gaauggagaagaaucacua

SEQ ID NO: 751853 - RNA, 19 nt, Homo sapiens
gaagacaguucagcacuag

SEQ ID NO: 751854 - RNA, 19 nt, Homo sapiens
ggauauauuuccuguccaa

SEQ ID NO: 751855 - RNA, 19 nt, Homo sapiens
gcaaagacgagaaggagaa

SEQ ID NO: 751856 - RNA, 19 nt, Homo sapiens
guagggaguaucuuaauuu

SEQ ID NO: 751857 - RNA, 19 nt, Homo sapiens
gaagcuggcagauaucauu

SEQ ID NO: 751858 - RNA, 19 nt, Homo sapiens
ugaccaagauuugcuauau

SEQ ID NO: 751859 - RNA, 19 nt, Homo sapiens
uagcucagauugucaagaa

SEQ ID NO: 751860 - RNA, 19 nt, Homo sapiens
gcagaugggcauuaaagaa

SEQ ID NO: 751861 - RNA, 19 nt, Homo sapiens
gaaugggagcuaaaucuuu

SEQ ID NO: 751862 - RNA, 19 nt, Homo sapiens
cagcaggacuuaguugaaa

SEQ ID NO: 751863 - RNA, 19 nt, Homo sapiens
ugaagaacgucgcaauaug

SEQ ID NO: 751864 - RNA, 19 nt, Homo sapiens
gagcuauucuggagauaau

SEQ ID NO: 751865 - RNA, 19 nt, Homo sapiens
gaagauguccgcagcuguu

SEQ ID NO: 751866 - RNA, 19 nt, Homo sapiens
gcagauaaagauuugguuu

SEQ ID NO: 751867 - RNA, 19 nt, Homo sapiens
ggaaucugauaaagaaugu

SEQ ID NO: 751868 - RNA, 19 nt, Homo sapiens
gacaacagcccuauuagug

SEQ ID NO: 751869 - RNA, 19 nt, Homo sapiens
gaguagaaauggguucaaa

SEQ ID NO: 751870 - RNA, 19 nt, Homo sapiens
agaacuaagugauccagua

SEQ ID NO: 751871 - RNA, 19 nt, Homo sapiens
ucaacaagcuggccaacua

SEQ ID NO: 751872 - RNA, 19 nt, Homo sapiens
ggacguaccuggacaagca

SEQ ID NO: 751873 - RNA, 19 nt, Homo sapiens
gggcguggcuggacgauuu

SEQ ID NO: 751874 - RNA, 19 nt, Homo sapiens
uaaagagguugcuucuaua

SEQ ID NO: 751875 - RNA, 19 nt, Homo sapiens
gaacauacggucccuaaug

SEQ ID NO: 751876 - RNA, 19 nt, Homo sapiens
cuacagccauuuacaauug

SEQ ID NO: 751877 - RNA, 19 nt, Homo sapiens
auaaagagguugcuucuau

SEQ ID NO: 751878 - RNA, 19 nt, Homo sapiens
gcaggcaaaugcacugaaa

SEQ ID NO: 751879 - RNA, 19 nt, Homo sapiens
gaaaaccagucacuucuuu

SEQ ID NO: 751880 - RNA, 19 nt, Homo sapiens
gcaaaacgcuccuccaugu

SEQ ID NO: 751881 - RNA, 19 nt, Homo sapiens
gcacugaagagauagcuuu

SEQ ID NO: 751882 - RNA, 19 nt, Homo sapiens
agaaggaccugcagauguu

SEQ ID NO: 751883 - RNA, 19 nt, Homo sapiens
gaacucggcuuuuccagaa

SEQ ID NO: 751884 - RNA, 19 nt, Homo sapiens
ggcguggucuuacgagaua

SEQ ID NO: 751885 - RNA, 19 nt, Homo sapiens
ggaagaacauggcacuuuu

SEQ ID NO: 751886 - RNA, 19 nt, Homo sapiens
gcucuccuguucagccuua

SEQ ID NO: 751887 - RNA, 19 nt, Homo sapiens
gagaacauacggucccuaa

SEQ ID NO: 751888 - RNA, 19 nt, Homo sapiens
aggaggagauggacaguaa

SEQ ID NO: 751889 - RNA, 19 nt, Homo sapiens
gaacaacgucaccgaaauc

SEQ ID NO: 751890 - RNA, 19 nt, Homo sapiens
uggcauugcuguagaguga

SEQ ID NO: 751891 - RNA, 19 nt, Homo sapiens
gcugugaguuucugcuuug

SEQ ID NO: 751892 - RNA, 19 nt, Homo sapiens
gggaagaacauggcacuuu

SEQ ID NO: 751893 - RNA, 19 nt, Homo sapiens
agaugcagcuguccaagaa

SEQ ID NO: 751894 - RNA, 19 nt, Homo sapiens
gaagaaggaccugcagaug

SEQ ID NO: 751895 - RNA, 19 nt, Homo sapiens
gagucuccauccaccuuua

SEQ ID NO: 751896 - RNA, 19 nt, Homo sapiens
gaucaucugucgggugugu

SEQ ID NO: 751897 - RNA, 19 nt, Homo sapiens
aacauacggucccuaauga

SEQ ID NO: 751898 - RNA, 19 nt, Homo sapiens
gcaagggccugaccaucgu

SEQ ID NO: 751899 - RNA, 19 nt, Homo sapiens
uaacuacagccauuuacaa

SEQ ID NO: 751900 - RNA, 19 nt, Homo sapiens
gcacuucggcuggcuguga

SEQ ID NO: 751901 - RNA, 19 nt, Homo sapiens
gcugaucgcugagaaguac

SEQ ID NO: 751902 - RNA, 19 nt, Homo sapiens
ggaagugccggaugcguau

SEQ ID NO: 751903 - RNA, 19 nt, Homo sapiens
ucaaguaugucaacaagcu

SEQ ID NO: 751904 - RNA, 19 nt, Homo sapiens
agagguugcuucuauauac

SEQ ID NO: 751905 - RNA, 19 nt, Homo sapiens
gcccaacacuuugcacuuc

SEQ ID NO: 751906 - RNA, 19 nt, Homo sapiens
cgguggcacugaagagaua

SEQ ID NO: 751907 - RNA, 19 nt, Homo sapiens
cagccuauccgguuucaaa

SEQ ID NO: 751908 - RNA, 19 nt, Homo sapiens
gggcguuuguggagaagaa

SEQ ID NO: 751909 - RNA, 19 nt, Homo sapiens
ccaggcauccuuuguguug

SEQ ID NO: 751910 - RNA, 19 nt, Homo sapiens
uggaagaacuuuguagaca

SEQ ID NO: 751911 - RNA, 19 nt, Homo sapiens
cgacgucuuucaucuaucu

SEQ ID NO: 751912 - RNA, 19 nt, Homo sapiens
gugguuagguugcauuucu

SEQ ID NO: 751913 - RNA, 19 nt, Homo sapiens
ggaccauccuggccauagu

SEQ ID NO: 751914 - RNA, 19 nt, Homo sapiens
gauuagggcuggcauugcu

SEQ ID NO: 751915 - RNA, 19 nt, Homo sapiens
gcagguccacauuucauga

SEQ ID NO: 751916 - RNA, 19 nt, Homo sapiens
gaucaccaucuacuccuaa

SEQ ID NO: 751917 - RNA, 19 nt, Homo sapiens
ccucaaggaugcacagaag

SEQ ID NO: 751918 - RNA, 19 nt, Homo sapiens
agaacaacgucaccgaaau

SEQ ID NO: 751919 - RNA, 19 nt, Homo sapiens
gcaagcaccaggcauccuu

SEQ ID NO: 751920 - RNA, 19 nt, Homo sapiens
gggcuggcauugcuguaga

SEQ ID NO: 751921 - RNA, 19 nt, Homo sapiens
gggccucccuuucuaugug

SEQ ID NO: 751922 - RNA, 19 nt, Homo sapiens
gugaguuucugcuuuguag

SEQ ID NO: 751923 - RNA, 19 nt, Homo sapiens
cuacauggaguuucuugaa

SEQ ID NO: 751924 - RNA, 19 nt, Homo sapiens
ugagugcgaucgcuaccaa

SEQ ID NO: 751925 - RNA, 19 nt, Homo sapiens
gcaccaggcauccuuugug

SEQ ID NO: 751926 - RNA, 19 nt, Homo sapiens
cugaagcugucccugauga

SEQ ID NO: 751927 - RNA, 19 nt, Homo sapiens
gaaccagacggcagacaca

SEQ ID NO: 751928 - RNA, 19 nt, Homo sapiens
cgagaggacacuaaugaug

SEQ ID NO: 751929 - RNA, 19 nt, Homo sapiens
gagaaccuguggaguacgu

SEQ ID NO: 751930 - RNA, 19 nt, Homo sapiens
cagaacaacgucaccgaaa

SEQ ID NO: 751931 - RNA, 19 nt, Homo sapiens
cgucaaguaugucaacaag

SEQ ID NO: 751932 - RNA, 19 nt, Homo sapiens
caacuccguguaaccagua

SEQ ID NO: 751933 - RNA, 19 nt, Homo sapiens
caccaggcauccuuugugu

SEQ ID NO: 751934 - RNA, 19 nt, Homo sapiens
uguccucgcugcucaacaa

SEQ ID NO: 751935 - RNA, 19 nt, Homo sapiens
acaccagccuauccgguuu

SEQ ID NO: 751936 - RNA, 19 nt, Homo sapiens
cauugaaggcguggucuua

SEQ ID NO: 751937 - RNA, 19 nt, Homo sapiens
gaacauccugggcgucauc

SEQ ID NO: 751938 - RNA, 19 nt, Homo sapiens
gagcacggcacacaguuca

SEQ ID NO: 751939 - RNA, 19 nt, Homo sapiens
ggacguggccagaucuucu

SEQ ID NO: 751940 - RNA, 19 nt, Homo sapiens
uacgagaggacacuaauga

SEQ ID NO: 751941 - RNA, 19 nt, Homo sapiens
cuaaugagcacagagaaga

SEQ ID NO: 751942 - RNA, 19 nt, Homo sapiens
cuggagaaccuguggagua

SEQ ID NO: 751943 - RNA, 19 nt, Homo sapiens
caguaacuacagccauuua

SEQ ID NO: 751944 - RNA, 19 nt, Homo sapiens
gaagcugucccugaugaug

SEQ ID NO: 751945 - RNA, 19 nt, Homo sapiens
gcuggacgauuuccuugca

SEQ ID NO: 751946 - RNA, 19 nt, Homo sapiens
uuaacaggcucagcaaauc

SEQ ID NO: 751947 - RNA, 19 nt, Homo sapiens
gagacgagaacuacaugga

SEQ ID NO: 751948 - RNA, 19 nt, Homo sapiens
ggugcuggcucugaacguu

SEQ ID NO: 751949 - RNA, 19 nt, Homo sapiens
gaacgugguggaucaucug

SEQ ID NO: 751950 - RNA, 19 nt, Homo sapiens
ggauuuacccagugguuag

SEQ ID NO: 751951 - RNA, 19 nt, Homo sapiens
acgauuuccuugcaucuga

SEQ ID NO: 751952 - RNA, 19 nt, Homo sapiens
uaacaggcucagcaaauca

SEQ ID NO: 751953 - RNA, 19 nt, Homo sapiens
gcaggggccauguauauuu

SEQ ID NO: 751954 - RNA, 19 nt, Homo sapiens
caucaacaaaguucaaauc

SEQ ID NO: 751955 - RNA, 19 nt, Homo sapiens
ccagacaaggugcagauga

SEQ ID NO: 751956 - RNA, 19 nt, Homo sapiens
cugcagauguucuuguauc

SEQ ID NO: 751957 - RNA, 19 nt, Homo sapiens
aaagagguugcuucuauau

SEQ ID NO: 751958 - RNA, 19 nt, Homo sapiens
cccagggaguuacguggua

SEQ ID NO: 751959 - RNA, 19 nt, Homo sapiens
gcucggcagguccacauuu

SEQ ID NO: 751960 - RNA, 19 nt, Homo sapiens
gcagggagacgagaacuac

SEQ ID NO: 751961 - RNA, 19 nt, Homo sapiens
ucaauggcgucguccucaa

SEQ ID NO: 751962 - RNA, 19 nt, Homo sapiens
agaggacacuaaugaugga

SEQ ID NO: 751963 - RNA, 19 nt, Homo sapiens
ggcugugaguuucugcuuu

SEQ ID NO: 751964 - RNA, 19 nt, Homo sapiens
uucaagggcccaacacuuu

SEQ ID NO: 751965 - RNA, 19 nt, Homo sapiens
ccagucacuucuuuucaua

SEQ ID NO: 751966 - RNA, 19 nt, Homo sapiens
caugccagguccucccaaa

SEQ ID NO: 751967 - RNA, 19 nt, Homo sapiens
cagauguucuuguaucacu

SEQ ID NO: 751968 - RNA, 19 nt, Homo sapiens
acauggaguuucuugaagu

SEQ ID NO: 751969 - RNA, 19 nt, Homo sapiens
agaagcugaucgcugagaa

SEQ ID NO: 751970 - RNA, 19 nt, Homo sapiens
gagguugcuucuauauacu

SEQ ID NO: 751971 - RNA, 19 nt, Homo sapiens
gaagagguuucuaagauua

SEQ ID NO: 751972 - RNA, 19 nt, Homo sapiens
gaaacagccugaugaagaa

SEQ ID NO: 751973 - RNA, 19 nt, Homo sapiens
uaagagagcuccaguaauc

SEQ ID NO: 751974 - RNA, 19 nt, Homo sapiens
gcaagaagauuguauuagu

SEQ ID NO: 751975 - RNA, 19 nt, Homo sapiens
gauaacaucugucaucuuc

SEQ ID NO: 751976 - RNA, 19 nt, Homo sapiens
ucacagaacuccaccauug

SEQ ID NO: 751977 - RNA, 19 nt, Homo sapiens
gagagagucuucaauaaau

SEQ ID NO: 751978 - RNA, 19 nt, Homo sapiens
gagcauagcugaaucaaaa

SEQ ID NO: 751979 - RNA, 19 nt, Homo sapiens
gcacagauguuacgggaau

SEQ ID NO: 751980 - RNA, 19 nt, Homo sapiens
caaaggagcacagauguua

SEQ ID NO: 751981 - RNA, 19 nt, Homo sapiens
gaaaugccucucagucuua

SEQ ID NO: 751982 - RNA, 19 nt, Homo sapiens
gaacucaucccacgguuaa

SEQ ID NO: 751983 - RNA, 19 nt, Homo sapiens
gcaugaagcuggcagauag

SEQ ID NO: 751984 - RNA, 19 nt, Homo sapiens
gaacgaaugagcacacuuu

SEQ ID NO: 751985 - RNA, 19 nt, Homo sapiens
gaagugagaccagaugaua

SEQ ID NO: 751986 - RNA, 19 nt, Homo sapiens
gggauaacauucaugcuaa

SEQ ID NO: 751987 - RNA, 19 nt, Homo sapiens
gaguuaaccucauggaauu

SEQ ID NO: 751988 - RNA, 19 nt, Homo sapiens
ccaauugucuccuguaaug

SEQ ID NO: 751989 - RNA, 19 nt, Homo sapiens
gggagagagucuucaauaa

SEQ ID NO: 751990 - RNA, 19 nt, Homo sapiens
uaauuucccuucucugaua

SEQ ID NO: 751991 - RNA, 19 nt, Homo sapiens
ggaaguauccacauugaaa

SEQ ID NO: 751992 - RNA, 19 nt, Homo sapiens
caagaacccugggccuuua

SEQ ID NO: 751993 - RNA, 19 nt, Homo sapiens
ggaggaagcugagcaacuu

SEQ ID NO: 751994 - RNA, 19 nt, Homo sapiens
cuaaauaggugagaagaaa

SEQ ID NO: 751995 - RNA, 19 nt, Homo sapiens
ggagagagucuucaauaaa

SEQ ID NO: 751996 - RNA, 19 nt, Homo sapiens
gaagauggcauaugugguu

SEQ ID NO: 751997 - RNA, 19 nt, Homo sapiens
ggaccagguuucucaguuu

SEQ ID NO: 751998 - RNA, 19 nt, Homo sapiens
ggaaacagcggaagaccua

SEQ ID NO: 751999 - RNA, 19 nt, Homo sapiens
gaagagauguguggacuag

SEQ ID NO: 752000 - RNA, 19 nt, Homo sapiens
ggacaauucuuuaugacau

SEQ ID NO: 752001 - RNA, 19 nt, Homo sapiens
gcaguuacuugcugaucua

SEQ ID NO: 752002 - RNA, 19 nt, Homo sapiens
gcagcacccucuuuaaaug

SEQ ID NO: 752003 - RNA, 19 nt, Homo sapiens
acagauggcucuaaagcua

SEQ ID NO: 752004 - RNA, 19 nt, Homo sapiens
cagaauggcacuuugaaua

SEQ ID NO: 752005 - RNA, 19 nt, Homo sapiens
cagcaaauccuguaugaaa

SEQ ID NO: 752006 - RNA, 19 nt, Homo sapiens
ucacucggcucuccaauug

SEQ ID NO: 752007 - RNA, 19 nt, Homo sapiens
gagcucaguuccuguagaa

SEQ ID NO: 752008 - RNA, 19 nt, Homo sapiens
gcaguuacuucuggaaauu

SEQ ID NO: 752009 - RNA, 19 nt, Homo sapiens
gcagaggaauugaaaccaa

SEQ ID NO: 752010 - RNA, 19 nt, Homo sapiens
cgaagagguuucuaagauu

SEQ ID NO: 752011 - RNA, 19 nt, Homo sapiens
ccaaaguuguuucuaaaga

SEQ ID NO: 752012 - RNA, 19 nt, Homo sapiens
uuagaaggcuccagaaaug

SEQ ID NO: 752013 - RNA, 19 nt, Homo sapiens
gcaggaggauggugcagaa

SEQ ID NO: 752014 - RNA, 19 nt, Homo sapiens
gauaugguauguuguaaag

SEQ ID NO: 752015 - RNA, 19 nt, Homo sapiens
agaaggauaugguauguug

SEQ ID NO: 752016 - RNA, 19 nt, Homo sapiens
gaaaggguguugguucaga

SEQ ID NO: 752017 - RNA, 19 nt, Homo sapiens
guacaagauuugcagagaa

SEQ ID NO: 752018 - RNA, 19 nt, Homo sapiens
aaacaugaauggagugaga

SEQ ID NO: 752019 - RNA, 19 nt, Homo sapiens
cuaaagaaauuccaguaga

SEQ ID NO: 752020 - RNA, 19 nt, Homo sapiens
acaaagagguauucaguuc

SEQ ID NO: 752021 - RNA, 19 nt, Homo sapiens
caagaccuguuacuacuga

SEQ ID NO: 752022 - RNA, 19 nt, Homo sapiens
ugauaaagauggacauuca

SEQ ID NO: 752023 - RNA, 19 nt, Homo sapiens
cagccucgcucuccgcuua

SEQ ID NO: 752024 - RNA, 19 nt, Homo sapiens
ccaaggaaguauccacauu

SEQ ID NO: 752025 - RNA, 19 nt, Homo sapiens
gcugauuucuccauagauu

SEQ ID NO: 752026 - RNA, 19 nt, Homo sapiens
ggacauggcagagaugaaa

SEQ ID NO: 752027 - RNA, 19 nt, Homo sapiens
ggucggagccugugacauu

SEQ ID NO: 752028 - RNA, 19 nt, Homo sapiens
caagaagauuguauuagug

SEQ ID NO: 752029 - RNA, 19 nt, Homo sapiens
gagaaaagauguagugaug

SEQ ID NO: 752030 - RNA, 19 nt, Homo sapiens
gagcacacuuuaaccaguu

SEQ ID NO: 752031 - RNA, 19 nt, Homo sapiens
gaaugacaaucaaauacug

SEQ ID NO: 752032 - RNA, 19 nt, Homo sapiens
ccacaagaaugacaaucaa

SEQ ID NO: 752033 - RNA, 19 nt, Homo sapiens
aaacugauguacucuauag

SEQ ID NO: 752034 - RNA, 19 nt, Homo sapiens
gaauggcacuuugaauaau

SEQ ID NO: 752035 - RNA, 19 nt, Homo sapiens
gaucucaccuggauuggau

SEQ ID NO: 752036 - RNA, 19 nt, Homo sapiens
gcaaacugaugaacagaca

SEQ ID NO: 752037 - RNA, 19 nt, Homo sapiens
aaacggaccacaagaauga

SEQ ID NO: 752038 - RNA, 19 nt, Homo sapiens
caucagcuguuuaacuuug

SEQ ID NO: 752039 - RNA, 19 nt, Homo sapiens
ugacuauccuuuguguuua

SEQ ID NO: 752040 - RNA, 19 nt, Homo sapiens
caaaggaugugguuauacu

SEQ ID NO: 752041 - RNA, 19 nt, Homo sapiens
caggagaguuccagcguuu

SEQ ID NO: 752042 - RNA, 19 nt, Homo sapiens
ucgaagagguuucuaagau

SEQ ID NO: 752043 - RNA, 19 nt, Homo sapiens
gagaauaugagauagaguu

SEQ ID NO: 752044 - RNA, 19 nt, Homo sapiens
gaagaaaggagagaagguu

SEQ ID NO: 752045 - RNA, 19 nt, Homo sapiens
gguaacaaaucagccaauu

SEQ ID NO: 752046 - RNA, 19 nt, Homo sapiens
gcuauuuccugguuaugaa

SEQ ID NO: 752047 - RNA, 19 nt, Homo sapiens
uagaaaccuuuaaccgaua

SEQ ID NO: 752048 - RNA, 19 nt, Homo sapiens
acaggacaauucuuuauga

SEQ ID NO: 752049 - RNA, 19 nt, Homo sapiens
ugaaaccaauggacacuga

SEQ ID NO: 752050 - RNA, 19 nt, Homo sapiens
ugaaaugccucucagucuu

SEQ ID NO: 752051 - RNA, 19 nt, Homo sapiens
ccaauuggauucgaaacaa

SEQ ID NO: 752052 - RNA, 19 nt, Homo sapiens
cuacuacucugaccaagga

SEQ ID NO: 752053 - RNA, 19 nt, Homo sapiens
cagaaugguugcaagaguu

SEQ ID NO: 752054 - RNA, 19 nt, Homo sapiens
uaaagaaauuccaguagag

SEQ ID NO: 752055 - RNA, 19 nt, Homo sapiens
gcuaugcuauuuccugguu

SEQ ID NO: 752056 - RNA, 19 nt, Homo sapiens
caucuuccuugguuuauug

SEQ ID NO: 752057 - RNA, 19 nt, Homo sapiens
gcaaauccuguaugaaaga

SEQ ID NO: 752058 - RNA, 19 nt, Homo sapiens
caacaggacaauucuuuau

SEQ ID NO: 752059 - RNA, 19 nt, Homo sapiens
agaaacagccugaugaaga

SEQ ID NO: 752060 - RNA, 19 nt, Homo sapiens
ugaaacugauguacucuau

SEQ ID NO: 752061 - RNA, 19 nt, Homo sapiens
uaggagagccagaaacuuu

SEQ ID NO: 752062 - RNA, 19 nt, Homo sapiens
ugaaaucuaucaguaccua

SEQ ID NO: 752063 - RNA, 19 nt, Homo sapiens
uaacacuaguggacaauuc

SEQ ID NO: 752064 - RNA, 19 nt, Homo sapiens
ggaggauggugcagaagga

SEQ ID NO: 752065 - RNA, 19 nt, Homo sapiens
ugaaauuguugaagcgaaa

SEQ ID NO: 752066 - RNA, 19 nt, Homo sapiens
uaaagcaaguguaguugau

SEQ ID NO: 752067 - RNA, 19 nt, Homo sapiens
ggucaguuguuuaaucuca

SEQ ID NO: 752068 - RNA, 19 nt, Homo sapiens
uaacaaaucagccaauugg

SEQ ID NO: 752069 - RNA, 19 nt, Homo sapiens
uacaagauuugcagagaaa

SEQ ID NO: 752070 - RNA, 19 nt, Homo sapiens
gagagagcccuaaagcauu

SEQ ID NO: 752071 - RNA, 19 nt, Homo sapiens
gcaaguaacucucuucuua

SEQ ID NO: 752072 - RNA, 19 nt, Homo sapiens
gaacuaagcuaucaguaua

SEQ ID NO: 752073 - RNA, 19 nt, Homo sapiens
gaagaaagaccauagguua

SEQ ID NO: 752074 - RNA, 19 nt, Homo sapiens
gaaaggagcugaagauagu

SEQ ID NO: 752075 - RNA, 19 nt, Homo sapiens
gcaaagaaguggacauuga

SEQ ID NO: 752076 - RNA, 19 nt, Homo sapiens
guaaacagcugcagucaaa

SEQ ID NO: 752077 - RNA, 19 nt, Homo sapiens
caacagcgaugcacuauug

SEQ ID NO: 752078 - RNA, 19 nt, Homo sapiens
caacagaaccagucaauuu

SEQ ID NO: 752079 - RNA, 19 nt, Homo sapiens
caagauagguagauugauu

SEQ ID NO: 752080 - RNA, 19 nt, Homo sapiens
caagaaugcuguauaguga

SEQ ID NO: 752081 - RNA, 19 nt, Homo sapiens
gcaguuaucuucaguuuua

SEQ ID NO: 752082 - RNA, 19 nt, Homo sapiens
guacaagggucaccuaguu

SEQ ID NO: 752083 - RNA, 19 nt, Homo sapiens
caacuugacuggcuccuuu

SEQ ID NO: 752084 - RNA, 19 nt, Homo sapiens
gcuuggagcuuaucucuuu

SEQ ID NO: 752085 - RNA, 19 nt, Homo sapiens
ggaacuaguuagaaaugua

SEQ ID NO: 752086 - RNA, 19 nt, Homo sapiens
gaugauuccuuccuaauga

SEQ ID NO: 752087 - RNA, 19 nt, Homo sapiens
cuaagacucuguugagaua

SEQ ID NO: 752088 - RNA, 19 nt, Homo sapiens
ggucuuaucugaauacuca

SEQ ID NO: 752089 - RNA, 19 nt, Homo sapiens
caacaugggugacgauaau

SEQ ID NO: 752090 - RNA, 19 nt, Homo sapiens
caacaugccuggaauucaa

SEQ ID NO: 752091 - RNA, 19 nt, Homo sapiens
ucacagcacucaauaguug

SEQ ID NO: 752092 - RNA, 19 nt, Homo sapiens
guagggauauugaaauuga

SEQ ID NO: 752093 - RNA, 19 nt, Homo sapiens
gaacugccuucuuccauug

SEQ ID NO: 752094 - RNA, 19 nt, Homo sapiens
gcaacagucuccucuuuau

SEQ ID NO: 752095 - RNA, 19 nt, Homo sapiens
uaaugaaugugucugcuua

SEQ ID NO: 752096 - RNA, 19 nt, Homo sapiens
gaccuaagauaauuccuuu

SEQ ID NO: 752097 - RNA, 19 nt, Homo sapiens
gggcaaaguuguuuauguu

SEQ ID NO: 752098 - RNA, 19 nt, Homo sapiens
gcaagagguuuauuguuau

SEQ ID NO: 752099 - RNA, 19 nt, Homo sapiens
ccacuggcauccucuauaa

SEQ ID NO: 752100 - RNA, 19 nt, Homo sapiens
uuacauuccucccuucuua

SEQ ID NO: 752101 - RNA, 19 nt, Homo sapiens
caaaggaaaugagaaaguu

SEQ ID NO: 752102 - RNA, 19 nt, Homo sapiens
ggaccuaaauaaacuguga

SEQ ID NO: 752103 - RNA, 19 nt, Homo sapiens
agcaagagguuuauuguua

SEQ ID NO: 752104 - RNA, 19 nt, Homo sapiens
ccacugaacugccuucuuc

SEQ ID NO: 752105 - RNA, 19 nt, Homo sapiens
ccacugcugucuuuccuua

SEQ ID NO: 752106 - RNA, 19 nt, Homo sapiens
guacauugcuagaauuguu

SEQ ID NO: 752107 - RNA, 19 nt, Homo sapiens
ggaaugagaugaugucacu

SEQ ID NO: 752108 - RNA, 19 nt, Homo sapiens
gaaaacaucucaaacauag

SEQ ID NO: 752109 - RNA, 19 nt, Homo sapiens
gcaguaugauuaagaguga

SEQ ID NO: 752110 - RNA, 19 nt, Homo sapiens
gaaaagcaguuaaccagua

SEQ ID NO: 752111 - RNA, 19 nt, Homo sapiens
gcacugauaccagauauuu

SEQ ID NO: 752112 - RNA, 19 nt, Homo sapiens
gcagaaggaccuaaauaaa

SEQ ID NO: 752113 - RNA, 19 nt, Homo sapiens
gcaauuuccugauuacugu

SEQ ID NO: 752114 - RNA, 19 nt, Homo sapiens
gcaguuaguuccuugaugu

SEQ ID NO: 752115 - RNA, 19 nt, Homo sapiens
ugacaacacuucuuucuca

SEQ ID NO: 752116 - RNA, 19 nt, Homo sapiens
gagaugaugucacuucaau

SEQ ID NO: 752117 - RNA, 19 nt, Homo sapiens
gaaacucagucuagagaga

SEQ ID NO: 752118 - RNA, 19 nt, Homo sapiens
gcagcaggcuacacaguuu

SEQ ID NO: 752119 - RNA, 19 nt, Homo sapiens
gaaaggagaagaagaagug

SEQ ID NO: 752120 - RNA, 19 nt, Homo sapiens
uaaugaaccuguaguguug

SEQ ID NO: 752121 - RNA, 19 nt, Homo sapiens
gcaaggcuuuccuacagua

SEQ ID NO: 752122 - RNA, 19 nt, Homo sapiens
cauaguauauacccuagua

SEQ ID NO: 752123 - RNA, 19 nt, Homo sapiens
gauauaaauuccacgaaga

SEQ ID NO: 752124 - RNA, 19 nt, Homo sapiens
ugaaggcacuacuguuaua

SEQ ID NO: 752125 - RNA, 19 nt, Homo sapiens
uaucaggccugcagaguaa

SEQ ID NO: 752126 - RNA, 19 nt, Homo sapiens
gagcuuauguuucagacaa

SEQ ID NO: 752127 - RNA, 19 nt, Homo sapiens
caaaugguguuucacaaga

SEQ ID NO: 752128 - RNA, 19 nt, Homo sapiens
gggaacagcuggaaugcuu

SEQ ID NO: 752129 - RNA, 19 nt, Homo sapiens
ccucagugcuuuacaguuu

SEQ ID NO: 752130 - RNA, 19 nt, Homo sapiens
gcagucaaccaacauauuu

SEQ ID NO: 752131 - RNA, 19 nt, Homo sapiens
gacaaucaaccucaaguua

SEQ ID NO: 752132 - RNA, 19 nt, Homo sapiens
gaggaaugcugaugucgaa

SEQ ID NO: 752133 - RNA, 19 nt, Homo sapiens
gcacuuuaaucauuccaaa

SEQ ID NO: 752134 - RNA, 19 nt, Homo sapiens
gaacucaauuucuccacuu

SEQ ID NO: 752135 - RNA, 19 nt, Homo sapiens
gggaauauauguagugaca

SEQ ID NO: 752136 - RNA, 19 nt, Homo sapiens
uugcauagcuguucaguga

SEQ ID NO: 752137 - RNA, 19 nt, Homo sapiens
gaaugugucugcuuaccuu

SEQ ID NO: 752138 - RNA, 19 nt, Homo sapiens
gugcuaaagucuccuguuu

SEQ ID NO: 752139 - RNA, 19 nt, Homo sapiens
gaaagaccauagguuagaa

SEQ ID NO: 752140 - RNA, 19 nt, Homo sapiens
ccucuaagcuugaucaugu

SEQ ID NO: 752141 - RNA, 19 nt, Homo sapiens
ucuaagagauuacauagga

SEQ ID NO: 752142 - RNA, 19 nt, Homo sapiens
gugaugaucuuccuuuguu

SEQ ID NO: 752143 - RNA, 19 nt, Homo sapiens
caucaggaauguucuuauu

SEQ ID NO: 752144 - RNA, 19 nt, Homo sapiens
acaacaagguaaugguuua

SEQ ID NO: 752145 - RNA, 19 nt, Homo sapiens
gcaaaugcagugugaauug

SEQ ID NO: 752146 - RNA, 19 nt, Homo sapiens
caaagcaccucacuaugug

SEQ ID NO: 752147 - RNA, 19 nt, Homo sapiens
guaauucaguaccuccaua

SEQ ID NO: 752148 - RNA, 19 nt, Homo sapiens
gaaaggaucaucagcaaca

SEQ ID NO: 752149 - RNA, 19 nt, Homo sapiens
ggaagaaaguguugaaagc

SEQ ID NO: 752150 - RNA, 19 nt, Homo sapiens
gcucagugguugauauuug

SEQ ID NO: 752151 - RNA, 19 nt, Homo sapiens
gaagcucagugguugauau

SEQ ID NO: 752152 - RNA, 19 nt, Homo sapiens
caacaagucagucaaauuc

SEQ ID NO: 752153 - RNA, 19 nt, Homo sapiens
ggaacuauuucaucagaau

SEQ ID NO: 752154 - RNA, 19 nt, Homo sapiens
gcacuacuguuauagaagu

SEQ ID NO: 752155 - RNA, 19 nt, Homo sapiens
agaaacaucuguagcauca

SEQ ID NO: 752156 - RNA, 19 nt, Homo sapiens
caacauggcaccuuaacuu

SEQ ID NO: 752157 - RNA, 19 nt, Homo sapiens
gcaaaguuguuuauguuag

SEQ ID NO: 752158 - RNA, 19 nt, Homo sapiens
gagcaaaauuguagagaua

SEQ ID NO: 752159 - RNA, 19 nt, Homo sapiens
gcaguuguagcauuaguua

SEQ ID NO: 752160 - RNA, 19 nt, Homo sapiens
ucaggaauguucuuauuug

SEQ ID NO: 752161 - RNA, 19 nt, Homo sapiens
uuacagggcucuucaguuc

SEQ ID NO: 752162 - RNA, 19 nt, Homo sapiens
uguaagcccuggaauguuu

SEQ ID NO: 752163 - RNA, 19 nt, Homo sapiens
cagaguaacuggacgaaau

SEQ ID NO: 752164 - RNA, 19 nt, Homo sapiens
gcgagaaucugucuaugau

SEQ ID NO: 752165 - RNA, 19 nt, Homo sapiens
ccagugcucuaguuacuuu

SEQ ID NO: 752166 - RNA, 19 nt, Homo sapiens
guagagauaaugcucauaa

SEQ ID NO: 752167 - RNA, 19 nt, Homo sapiens
gaaaacacguuaucuaauc

SEQ ID NO: 752168 - RNA, 19 nt, Homo sapiens
uggaagagcugaaaguguu

SEQ ID NO: 752169 - RNA, 19 nt, Homo sapiens
ccagagacccugacaacua

SEQ ID NO: 752170 - RNA, 19 nt, Homo sapiens
uggaagaucucaugauguu

SEQ ID NO: 752171 - RNA, 19 nt, Homo sapiens
gcaaguaacucucuucuua

SEQ ID NO: 752172 - RNA, 19 nt, Homo sapiens
gaacuaagcuaucaguaua

SEQ ID NO: 752173 - RNA, 19 nt, Homo sapiens
gaagaaagaccauagguua

SEQ ID NO: 752174 - RNA, 19 nt, Homo sapiens
gaaaggagcugaagauagu

SEQ ID NO: 752175 - RNA, 19 nt, Homo sapiens
gcaaagaaguggacauuga

SEQ ID NO: 752176 - RNA, 19 nt, Homo sapiens
guaaacagcugcagucaaa

SEQ ID NO: 752177 - RNA, 19 nt, Homo sapiens
caacagcgaugcacuauug

SEQ ID NO: 752178 - RNA, 19 nt, Homo sapiens
caacagaaccagucaauuu

SEQ ID NO: 752179 - RNA, 19 nt, Homo sapiens
caagauagguagauugauu

SEQ ID NO: 752180 - RNA, 19 nt, Homo sapiens
ggaagaaucugucuaugau

SEQ ID NO: 752181 - RNA, 19 nt, Homo sapiens
caagaaugcuguauaguga

SEQ ID NO: 752182 - RNA, 19 nt, Homo sapiens
gcaguuaucuucaguuuua

SEQ ID NO: 752183 - RNA, 19 nt, Homo sapiens
guacaagggucaccuaguu

SEQ ID NO: 752184 - RNA, 19 nt, Homo sapiens
caacuugacuggcuccuuu

SEQ ID NO: 752185 - RNA, 19 nt, Homo sapiens
gcuuggagcuuaucucuuu

SEQ ID NO: 752186 - RNA, 19 nt, Homo sapiens
ggaacuaguuagaaaugua

SEQ ID NO: 752187 - RNA, 19 nt, Homo sapiens
gaugauuccuuccuaauga

SEQ ID NO: 752188 - RNA, 19 nt, Homo sapiens
cuaagacucuguugagaua

SEQ ID NO: 752189 - RNA, 19 nt, Homo sapiens
ggucuuaucugaauacuca

SEQ ID NO: 752190 - RNA, 19 nt, Homo sapiens
caacaugggugacgauaau

SEQ ID NO: 752191 - RNA, 19 nt, Homo sapiens
caacaugccuggaauucaa

SEQ ID NO: 752192 - RNA, 19 nt, Homo sapiens
ucacagcacucaauaguug

SEQ ID NO: 752193 - RNA, 19 nt, Homo sapiens
guagggauauugaaauuga

SEQ ID NO: 752194 - RNA, 19 nt, Homo sapiens
gaacugccuucuuccauug

SEQ ID NO: 752195 - RNA, 19 nt, Homo sapiens
gcaacagucuccucuuuau

SEQ ID NO: 752196 - RNA, 19 nt, Homo sapiens
uaaugaaugugucugcuua

SEQ ID NO: 752197 - RNA, 19 nt, Homo sapiens
gaccuaagauaauuccuuu

SEQ ID NO: 752198 - RNA, 19 nt, Homo sapiens
gggcaaaguuguuuauguu

SEQ ID NO: 752199 - RNA, 19 nt, Homo sapiens
gcaagagguuuauuguuau

SEQ ID NO: 752200 - RNA, 19 nt, Homo sapiens
ccacuggcauccucuauaa

SEQ ID NO: 752201 - RNA, 19 nt, Homo sapiens
uuacauuccucccuucuua

SEQ ID NO: 752202 - RNA, 19 nt, Homo sapiens
caaaggaaaugagaaaguu

SEQ ID NO: 752203 - RNA, 19 nt, Homo sapiens
ggaccuaaauaaacuguga

SEQ ID NO: 752204 - RNA, 19 nt, Homo sapiens
agcaagagguuuauuguua

SEQ ID NO: 752205 - RNA, 19 nt, Homo sapiens
ccacugaacugccuucuuc

SEQ ID NO: 752206 - RNA, 19 nt, Homo sapiens
ccacugcugucuuuccuua

SEQ ID NO: 752207 - RNA, 19 nt, Homo sapiens
guacauugcuagaauuguu

SEQ ID NO: 752208 - RNA, 19 nt, Homo sapiens
ggaaugagaugaugucacu

SEQ ID NO: 752209 - RNA, 19 nt, Homo sapiens
gaaaacaucucaaacauag

SEQ ID NO: 752210 - RNA, 19 nt, Homo sapiens
gcaguaugauuaagaguga

SEQ ID NO: 752211 - RNA, 19 nt, Homo sapiens
gaaaagcaguuaaccagua

SEQ ID NO: 752212 - RNA, 19 nt, Homo sapiens
gcacugauaccagauauuu

SEQ ID NO: 752213 - RNA, 19 nt, Homo sapiens
gcagaaggaccuaaauaaa

SEQ ID NO: 752214 - RNA, 19 nt, Homo sapiens
gcaauuuccugauuacugu

SEQ ID NO: 752215 - RNA, 19 nt, Homo sapiens
gcaguuaguuccuugaugu

SEQ ID NO: 752216 - RNA, 19 nt, Homo sapiens
ugacaacacuucuuucuca

SEQ ID NO: 752217 - RNA, 19 nt, Homo sapiens
gagaugaugucacuucaau

SEQ ID NO: 752218 - RNA, 19 nt, Homo sapiens
gaaacucagucuagagaga

SEQ ID NO: 752219 - RNA, 19 nt, Homo sapiens
gcagcaggcuacacaguuu

SEQ ID NO: 752220 - RNA, 19 nt, Homo sapiens
gaaaggagaagaagaagug

SEQ ID NO: 752221 - RNA, 19 nt, Homo sapiens
uaaugaaccuguaguguug

SEQ ID NO: 752222 - RNA, 19 nt, Homo sapiens
gcaaggcuuuccuacagua

SEQ ID NO: 752223 - RNA, 19 nt, Homo sapiens
cauaguauauacccuagua

SEQ ID NO: 752224 - RNA, 19 nt, Homo sapiens
gauauaaauuccacgaaga

SEQ ID NO: 752225 - RNA, 19 nt, Homo sapiens
ugaaggcacuacuguuaua

SEQ ID NO: 752226 - RNA, 19 nt, Homo sapiens
uaucaggccugcagaguaa

SEQ ID NO: 752227 - RNA, 19 nt, Homo sapiens
gagcuuauguuucagacaa

SEQ ID NO: 752228 - RNA, 19 nt, Homo sapiens
caaaugguguuucacaaga

SEQ ID NO: 752229 - RNA, 19 nt, Homo sapiens
gggaacagcuggaaugcuu

SEQ ID NO: 752230 - RNA, 19 nt, Homo sapiens
ccucagugcuuuacaguuu

SEQ ID NO: 752231 - RNA, 19 nt, Homo sapiens
gcagucaaccaacauauuu

SEQ ID NO: 752232 - RNA, 19 nt, Homo sapiens
gacaaucaaccucaaguua

SEQ ID NO: 752233 - RNA, 19 nt, Homo sapiens
gaggaaugcugaugucgaa

SEQ ID NO: 752234 - RNA, 19 nt, Homo sapiens
gcacuuuaaucauuccaaa

SEQ ID NO: 752235 - RNA, 19 nt, Homo sapiens
gaacucaauuucuccacuu

SEQ ID NO: 752236 - RNA, 19 nt, Homo sapiens
gggaauauauguagugaca

SEQ ID NO: 752237 - RNA, 19 nt, Homo sapiens
uugcauagcuguucaguga

SEQ ID NO: 752238 - RNA, 19 nt, Homo sapiens
gaaugugucugcuuaccuu

SEQ ID NO: 752239 - RNA, 19 nt, Homo sapiens
gugcuaaagucuccuguuu

SEQ ID NO: 752240 - RNA, 19 nt, Homo sapiens
gaaagaccauagguuagaa

SEQ ID NO: 752241 - RNA, 19 nt, Homo sapiens
ccucuaagcuugaucaugu

SEQ ID NO: 752242 - RNA, 19 nt, Homo sapiens
ucuaagagauuacauagga

SEQ ID NO: 752243 - RNA, 19 nt, Homo sapiens
gugaugaucuuccuuuguu

SEQ ID NO: 752244 - RNA, 19 nt, Homo sapiens
caucaggaauguucuuauu

SEQ ID NO: 752245 - RNA, 19 nt, Homo sapiens
acaacaagguaaugguuua

SEQ ID NO: 752246 - RNA, 19 nt, Homo sapiens
gcaaaugcagugugaauug

SEQ ID NO: 752247 - RNA, 19 nt, Homo sapiens
caaagcaccucacuaugug

SEQ ID NO: 752248 - RNA, 19 nt, Homo sapiens
guaauucaguaccuccaua

SEQ ID NO: 752249 - RNA, 19 nt, Homo sapiens
gaaaggaucaucagcaaca

SEQ ID NO: 752250 - RNA, 19 nt, Homo sapiens
ggaagaaaguguugaaagc

SEQ ID NO: 752251 - RNA, 19 nt, Homo sapiens
gcucagugguugauauuug

SEQ ID NO: 752252 - RNA, 19 nt, Homo sapiens
gaagcucagugguugauau

SEQ ID NO: 752253 - RNA, 19 nt, Homo sapiens
caacaagucagucaaauuc

SEQ ID NO: 752254 - RNA, 19 nt, Homo sapiens
ggaacuauuucaucagaau

SEQ ID NO: 752255 - RNA, 19 nt, Homo sapiens
gcacuacuguuauagaagu

SEQ ID NO: 752256 - RNA, 19 nt, Homo sapiens
agaaacaucuguagcauca

SEQ ID NO: 752257 - RNA, 19 nt, Homo sapiens
caacauggcaccuuaacuu

SEQ ID NO: 752258 - RNA, 19 nt, Homo sapiens
gcaaaguuguuuauguuag

SEQ ID NO: 752259 - RNA, 19 nt, Homo sapiens
gagcaaaauuguagagaua

SEQ ID NO: 752260 - RNA, 19 nt, Homo sapiens
gcaguuguagcauuaguua

SEQ ID NO: 752261 - RNA, 19 nt, Homo sapiens
ucaggaauguucuuauuug

SEQ ID NO: 752262 - RNA, 19 nt, Homo sapiens
uuacagggcucuucaguuc

SEQ ID NO: 752263 - RNA, 19 nt, Homo sapiens
uguaagcccuggaauguuu

SEQ ID NO: 752264 - RNA, 19 nt, Homo sapiens
cagaguaacuggacgaaau

SEQ ID NO: 752265 - RNA, 19 nt, Homo sapiens
ccagugcucuaguuacuuu

SEQ ID NO: 752266 - RNA, 19 nt, Homo sapiens
guagagauaaugcucauaa

SEQ ID NO: 752267 - RNA, 19 nt, Homo sapiens
gaaaacacguuaucuaauc

SEQ ID NO: 752268 - RNA, 19 nt, Homo sapiens
uggaagagcugaaaguguu

SEQ ID NO: 752269 - RNA, 19 nt, Homo sapiens
ccagagacccugacaacua

SEQ ID NO: 752270 - RNA, 19 nt, Homo sapiens
uggaagaucucaugauguu

SEQ ID NO: 752271 - RNA, 19 nt, Homo sapiens
gcaaguaacucucuucuua

SEQ ID NO: 752272 - RNA, 19 nt, Homo sapiens
gaacuaagcuaucaguaua

SEQ ID NO: 752273 - RNA, 19 nt, Homo sapiens
gaagaaagaccauagguua

SEQ ID NO: 752274 - RNA, 19 nt, Homo sapiens
gaaaggagcugaagauagu

SEQ ID NO: 752275 - RNA, 19 nt, Homo sapiens
gcaaagaaguggacauuga

SEQ ID NO: 752276 - RNA, 19 nt, Homo sapiens
guaaacagcugcagucaaa

SEQ ID NO: 752277 - RNA, 19 nt, Homo sapiens
caacagcgaugcacuauug

SEQ ID NO: 752278 - RNA, 19 nt, Homo sapiens
caacagaaccagucaauuu

SEQ ID NO: 752279 - RNA, 19 nt, Homo sapiens
caagauagguagauugauu

SEQ ID NO: 752280 - RNA, 19 nt, Homo sapiens
ggaagaaucugucuaugau

SEQ ID NO: 752281 - RNA, 19 nt, Homo sapiens
caagaaugcuguauaguga

SEQ ID NO: 752282 - RNA, 19 nt, Homo sapiens
gcaguuaucuucaguuuua

SEQ ID NO: 752283 - RNA, 19 nt, Homo sapiens
guacaagggucaccuaguu

SEQ ID NO: 752284 - RNA, 19 nt, Homo sapiens
caacuugacuggcuccuuu

SEQ ID NO: 752285 - RNA, 19 nt, Homo sapiens
gcuuggagcuuaucucuuu

SEQ ID NO: 752286 - RNA, 19 nt, Homo sapiens
ggaacuaguuagaaaugua

SEQ ID NO: 752287 - RNA, 19 nt, Homo sapiens
gaugauuccuuccuaauga

SEQ ID NO: 752288 - RNA, 19 nt, Homo sapiens
cuaagacucuguugagaua

SEQ ID NO: 752289 - RNA, 19 nt, Homo sapiens
ggucuuaucugaauacuca

SEQ ID NO: 752290 - RNA, 19 nt, Homo sapiens
caacaugggugacgauaau

SEQ ID NO: 752291 - RNA, 19 nt, Homo sapiens
caacaugccuggaauucaa

SEQ ID NO: 752292 - RNA, 19 nt, Homo sapiens
ucacagcacucaauaguug

SEQ ID NO: 752293 - RNA, 19 nt, Homo sapiens
guagggauauugaaauuga

SEQ ID NO: 752294 - RNA, 19 nt, Homo sapiens
gaacugccuucuuccauug

SEQ ID NO: 752295 - RNA, 19 nt, Homo sapiens
gcaacagucuccucuuuau

SEQ ID NO: 752296 - RNA, 19 nt, Homo sapiens
uaaugaaugugucugcuua

SEQ ID NO: 752297 - RNA, 19 nt, Homo sapiens
gaccuaagauaauuccuuu

SEQ ID NO: 752298 - RNA, 19 nt, Homo sapiens
gggcaaaguuguuuauguu

SEQ ID NO: 752299 - RNA, 19 nt, Homo sapiens
gcaagagguuuauuguuau

SEQ ID NO: 752300 - RNA, 19 nt, Homo sapiens
ccacuggcauccucuauaa

SEQ ID NO: 752301 - RNA, 19 nt, Homo sapiens
uuacauuccucccuucuua

SEQ ID NO: 752302 - RNA, 19 nt, Homo sapiens
caaaggaaaugagaaaguu

SEQ ID NO: 752303 - RNA, 19 nt, Homo sapiens
ggaccuaaauaaacuguga

SEQ ID NO: 752304 - RNA, 19 nt, Homo sapiens
agcaagagguuuauuguua

SEQ ID NO: 752305 - RNA, 19 nt, Homo sapiens
ccacugaacugccuucuuc

SEQ ID NO: 752306 - RNA, 19 nt, Homo sapiens
ccacugcugucuuuccuua

SEQ ID NO: 752307 - RNA, 19 nt, Homo sapiens
guacauugcuagaauuguu

SEQ ID NO: 752308 - RNA, 19 nt, Homo sapiens
ggaaugagaugaugucacu

SEQ ID NO: 752309 - RNA, 19 nt, Homo sapiens
gaaaacaucucaaacauag

SEQ ID NO: 752310 - RNA, 19 nt, Homo sapiens
gcaguaugauuaagaguga

SEQ ID NO: 752311 - RNA, 19 nt, Homo sapiens
gaaaagcaguuaaccagua

SEQ ID NO: 752312 - RNA, 19 nt, Homo sapiens
gcacugauaccagauauuu

SEQ ID NO: 752313 - RNA, 19 nt, Homo sapiens
gcagaaggaccuaaauaaa

SEQ ID NO: 752314 - RNA, 19 nt, Homo sapiens
gcaauuuccugauuacugu

SEQ ID NO: 752315 - RNA, 19 nt, Homo sapiens
gcaguuaguuccuugaugu

SEQ ID NO: 752316 - RNA, 19 nt, Homo sapiens
ugacaacacuucuuucuca

SEQ ID NO: 752317 - RNA, 19 nt, Homo sapiens
gagaugaugucacuucaau

SEQ ID NO: 752318 - RNA, 19 nt, Homo sapiens
gaaacucagucuagagaga

SEQ ID NO: 752319 - RNA, 19 nt, Homo sapiens
gcagcaggcuacacaguuu

SEQ ID NO: 752320 - RNA, 19 nt, Homo sapiens
gaaaggagaagaagaagug

SEQ ID NO: 752321 - RNA, 19 nt, Homo sapiens
uaaugaaccuguaguguug

SEQ ID NO: 752322 - RNA, 19 nt, Homo sapiens
gcaaggcuuuccuacagua

SEQ ID NO: 752323 - RNA, 19 nt, Homo sapiens
cauaguauauacccuagua

SEQ ID NO: 752324 - RNA, 19 nt, Homo sapiens
gauauaaauuccacgaaga

SEQ ID NO: 752325 - RNA, 19 nt, Homo sapiens
ugaaggcacuacuguuaua

SEQ ID NO: 752326 - RNA, 19 nt, Homo sapiens
uaucaggccugcagaguaa

SEQ ID NO: 752327 - RNA, 19 nt, Homo sapiens
gagcuuauguuucagacaa

SEQ ID NO: 752328 - RNA, 19 nt, Homo sapiens
caaaugguguuucacaaga

SEQ ID NO: 752329 - RNA, 19 nt, Homo sapiens
gggaacagcuggaaugcuu

SEQ ID NO: 752330 - RNA, 19 nt, Homo sapiens
ccucagugcuuuacaguuu

SEQ ID NO: 752331 - RNA, 19 nt, Homo sapiens
gcagucaaccaacauauuu

SEQ ID NO: 752332 - RNA, 19 nt, Homo sapiens
gacaaucaaccucaaguua

SEQ ID NO: 752333 - RNA, 19 nt, Homo sapiens
gaggaaugcugaugucgaa

SEQ ID NO: 752334 - RNA, 19 nt, Homo sapiens
gcacuuuaaucauuccaaa

SEQ ID NO: 752335 - RNA, 19 nt, Homo sapiens
gaacucaauuucuccacuu

SEQ ID NO: 752336 - RNA, 19 nt, Homo sapiens
gggaauauauguagugaca

SEQ ID NO: 752337 - RNA, 19 nt, Homo sapiens
uugcauagcuguucaguga

SEQ ID NO: 752338 - RNA, 19 nt, Homo sapiens
gaaugugucugcuuaccuu

SEQ ID NO: 752339 - RNA, 19 nt, Homo sapiens
gugcuaaagucuccuguuu

SEQ ID NO: 752340 - RNA, 19 nt, Homo sapiens
gaaagaccauagguuagaa

SEQ ID NO: 752341 - RNA, 19 nt, Homo sapiens
ccucuaagcuugaucaugu

SEQ ID NO: 752342 - RNA, 19 nt, Homo sapiens
ucuaagagauuacauagga

SEQ ID NO: 752343 - RNA, 19 nt, Homo sapiens
gugaugaucuuccuuuguu

SEQ ID NO: 752344 - RNA, 19 nt, Homo sapiens
caucaggaauguucuuauu

SEQ ID NO: 752345 - RNA, 19 nt, Homo sapiens
acaacaagguaaugguuua

SEQ ID NO: 752346 - RNA, 19 nt, Homo sapiens
gcaaaugcagugugaauug

SEQ ID NO: 752347 - RNA, 19 nt, Homo sapiens
caaagcaccucacuaugug

SEQ ID NO: 752348 - RNA, 19 nt, Homo sapiens
guaauucaguaccuccaua

SEQ ID NO: 752349 - RNA, 19 nt, Homo sapiens
gaaaggaucaucagcaaca

SEQ ID NO: 752350 - RNA, 19 nt, Homo sapiens
ggaagaaaguguugaaagc

SEQ ID NO: 752351 - RNA, 19 nt, Homo sapiens
gcucagugguugauauuug

SEQ ID NO: 752352 - RNA, 19 nt, Homo sapiens
gaagcucagugguugauau

SEQ ID NO: 752353 - RNA, 19 nt, Homo sapiens
caacaagucagucaaauuc

SEQ ID NO: 752354 - RNA, 19 nt, Homo sapiens
ggaacuauuucaucagaau

SEQ ID NO: 752355 - RNA, 19 nt, Homo sapiens
gcacuacuguuauagaagu

SEQ ID NO: 752356 - RNA, 19 nt, Homo sapiens
agaaacaucuguagcauca

SEQ ID NO: 752357 - RNA, 19 nt, Homo sapiens
caacauggcaccuuaacuu

SEQ ID NO: 752358 - RNA, 19 nt, Homo sapiens
gcaaaguuguuuauguuag

SEQ ID NO: 752359 - RNA, 19 nt, Homo sapiens
gagcaaaauuguagagaua

SEQ ID NO: 752360 - RNA, 19 nt, Homo sapiens
gcaguuguagcauuaguua

SEQ ID NO: 752361 - RNA, 19 nt, Homo sapiens
ucaggaauguucuuauuug

SEQ ID NO: 752362 - RNA, 19 nt, Homo sapiens
uuacagggcucuucaguuc

SEQ ID NO: 752363 - RNA, 19 nt, Homo sapiens
uguaagcccuggaauguuu

SEQ ID NO: 752364 - RNA, 19 nt, Homo sapiens
cagaguaacuggacgaaau

SEQ ID NO: 752365 - RNA, 19 nt, Homo sapiens
ccagugcucuaguuacuuu

SEQ ID NO: 752366 - RNA, 19 nt, Homo sapiens
guagagauaaugcucauaa

SEQ ID NO: 752367 - RNA, 19 nt, Homo sapiens
gaaaacacguuaucuaauc

SEQ ID NO: 752368 - RNA, 19 nt, Homo sapiens
uggaagagcugaaaguguu

SEQ ID NO: 752369 - RNA, 19 nt, Homo sapiens
ccagagacccugacaacua

SEQ ID NO: 752370 - RNA, 19 nt, Homo sapiens
uggaagaucucaugauguu

SEQ ID NO: 752371 - RNA, 19 nt, Homo sapiens
gcaaguaacucucuucuua

SEQ ID NO: 752372 - RNA, 19 nt, Homo sapiens
gaacuaagcuaucaguaua

SEQ ID NO: 752373 - RNA, 19 nt, Homo sapiens
gaagaaagaccauagguua

SEQ ID NO: 752374 - RNA, 19 nt, Homo sapiens
gaaaggagcugaagauagu

SEQ ID NO: 752375 - RNA, 19 nt, Homo sapiens
gcaaagaaguggacauuga

SEQ ID NO: 752376 - RNA, 19 nt, Homo sapiens
guaaacagcugcagucaaa

SEQ ID NO: 752377 - RNA, 19 nt, Homo sapiens
caacagcgaugcacuauug

SEQ ID NO: 752378 - RNA, 19 nt, Homo sapiens
caacagaaccagucaauuu

SEQ ID NO: 752379 - RNA, 19 nt, Homo sapiens
caagauagguagauugauu

SEQ ID NO: 752380 - RNA, 19 nt, Homo sapiens
caagaaugcuguauaguga

SEQ ID NO: 752381 - RNA, 19 nt, Homo sapiens
gcaguuaucuucaguuuua

SEQ ID NO: 752382 - RNA, 19 nt, Homo sapiens
guacaagggucaccuaguu

SEQ ID NO: 752383 - RNA, 19 nt, Homo sapiens
caacuugacuggcuccuuu

SEQ ID NO: 752384 - RNA, 19 nt, Homo sapiens
gcuuggagcuuaucucuuu

SEQ ID NO: 752385 - RNA, 19 nt, Homo sapiens
ggaacuaguuagaaaugua

SEQ ID NO: 752386 - RNA, 19 nt, Homo sapiens
gaugauuccuuccuaauga

SEQ ID NO: 752387 - RNA, 19 nt, Homo sapiens
cuaagacucuguugagaua

SEQ ID NO: 752388 - RNA, 19 nt, Homo sapiens
ggucuuaucugaauacuca

SEQ ID NO: 752389 - RNA, 19 nt, Homo sapiens
caacaugggugacgauaau

SEQ ID NO: 752390 - RNA, 19 nt, Homo sapiens
caacaugccuggaauucaa

SEQ ID NO: 752391 - RNA, 19 nt, Homo sapiens
ucacagcacucaauaguug

SEQ ID NO: 752392 - RNA, 19 nt, Homo sapiens
guagggauauugaaauuga

SEQ ID NO: 752393 - RNA, 19 nt, Homo sapiens
gaacugccuucuuccauug

SEQ ID NO: 752394 - RNA, 19 nt, Homo sapiens
gcaacagucuccucuuuau

SEQ ID NO: 752395 - RNA, 19 nt, Homo sapiens
uaaugaaugugucugcuua

SEQ ID NO: 752396 - RNA, 19 nt, Homo sapiens
gaccuaagauaauuccuuu

SEQ ID NO: 752397 - RNA, 19 nt, Homo sapiens
gggcaaaguuguuuauguu

SEQ ID NO: 752398 - RNA, 19 nt, Homo sapiens
gcaagagguuuauuguuau

SEQ ID NO: 752399 - RNA, 19 nt, Homo sapiens
ccacuggcauccucuauaa

SEQ ID NO: 752400 - RNA, 19 nt, Homo sapiens
uuacauuccucccuucuua

SEQ ID NO: 752401 - RNA, 19 nt, Homo sapiens
caaaggaaaugagaaaguu

SEQ ID NO: 752402 - RNA, 19 nt, Homo sapiens
ggaccuaaauaaacuguga

SEQ ID NO: 752403 - RNA, 19 nt, Homo sapiens
agcaagagguuuauuguua

SEQ ID NO: 752404 - RNA, 19 nt, Homo sapiens
ccacugaacugccuucuuc

SEQ ID NO: 752405 - RNA, 19 nt, Homo sapiens
ccacugcugucuuuccuua

SEQ ID NO: 752406 - RNA, 19 nt, Homo sapiens
guacauugcuagaauuguu

SEQ ID NO: 752407 - RNA, 19 nt, Homo sapiens
ggaaugagaugaugucacu

SEQ ID NO: 752408 - RNA, 19 nt, Homo sapiens
gaaaacaucucaaacauag

SEQ ID NO: 752409 - RNA, 19 nt, Homo sapiens
gcaguaugauuaagaguga

SEQ ID NO: 752410 - RNA, 19 nt, Homo sapiens
gaaaagcaguuaaccagua

SEQ ID NO: 752411 - RNA, 19 nt, Homo sapiens
gcacugauaccagauauuu

SEQ ID NO: 752412 - RNA, 19 nt, Homo sapiens
gcagaaggaccuaaauaaa

SEQ ID NO: 752413 - RNA, 19 nt, Homo sapiens
gcaauuuccugauuacugu

SEQ ID NO: 752414 - RNA, 19 nt, Homo sapiens
gcaguuaguuccuugaugu

SEQ ID NO: 752415 - RNA, 19 nt, Homo sapiens
ugacaacacuucuuucuca

SEQ ID NO: 752416 - RNA, 19 nt, Homo sapiens
gagaugaugucacuucaau

SEQ ID NO: 752417 - RNA, 19 nt, Homo sapiens
gaaacucagucuagagaga

SEQ ID NO: 752418 - RNA, 19 nt, Homo sapiens
gcagcaggcuacacaguuu

SEQ ID NO: 752419 - RNA, 19 nt, Homo sapiens
gaaaggagaagaagaagug

SEQ ID NO: 752420 - RNA, 19 nt, Homo sapiens
uaaugaaccuguaguguug

SEQ ID NO: 752421 - RNA, 19 nt, Homo sapiens
gcaaggcuuuccuacagua

SEQ ID NO: 752422 - RNA, 19 nt, Homo sapiens
cauaguauauacccuagua

SEQ ID NO: 752423 - RNA, 19 nt, Homo sapiens
gauauaaauuccacgaaga

SEQ ID NO: 752424 - RNA, 19 nt, Homo sapiens
ugaaggcacuacuguuaua

SEQ ID NO: 752425 - RNA, 19 nt, Homo sapiens
uaucaggccugcagaguaa

SEQ ID NO: 752426 - RNA, 19 nt, Homo sapiens
gagcuuauguuucagacaa

SEQ ID NO: 752427 - RNA, 19 nt, Homo sapiens
caaaugguguuucacaaga

SEQ ID NO: 752428 - RNA, 19 nt, Homo sapiens
gggaacagcuggaaugcuu

SEQ ID NO: 752429 - RNA, 19 nt, Homo sapiens
ccucagugcuuuacaguuu

SEQ ID NO: 752430 - RNA, 19 nt, Homo sapiens
gcagucaaccaacauauuu

SEQ ID NO: 752431 - RNA, 19 nt, Homo sapiens
gacaaucaaccucaaguua

SEQ ID NO: 752432 - RNA, 19 nt, Homo sapiens
gaggaaugcugaugucgaa

SEQ ID NO: 752433 - RNA, 19 nt, Homo sapiens
gcacuuuaaucauuccaaa

SEQ ID NO: 752434 - RNA, 19 nt, Homo sapiens
gaacucaauuucuccacuu

SEQ ID NO: 752435 - RNA, 19 nt, Homo sapiens
gggaauauauguagugaca

SEQ ID NO: 752436 - RNA, 19 nt, Homo sapiens
uugcauagcuguucaguga

SEQ ID NO: 752437 - RNA, 19 nt, Homo sapiens
gaaugugucugcuuaccuu

SEQ ID NO: 752438 - RNA, 19 nt, Homo sapiens
gugcuaaagucuccuguuu

SEQ ID NO: 752439 - RNA, 19 nt, Homo sapiens
gaaagaccauagguuagaa

SEQ ID NO: 752440 - RNA, 19 nt, Homo sapiens
ccucuaagcuugaucaugu

SEQ ID NO: 752441 - RNA, 19 nt, Homo sapiens
ucuaagagauuacauagga

SEQ ID NO: 752442 - RNA, 19 nt, Homo sapiens
gugaugaucuuccuuuguu

SEQ ID NO: 752443 - RNA, 19 nt, Homo sapiens
caucaggaauguucuuauu

SEQ ID NO: 752444 - RNA, 19 nt, Homo sapiens
acaacaagguaaugguuua

SEQ ID NO: 752445 - RNA, 19 nt, Homo sapiens
gcaaaugcagugugaauug

SEQ ID NO: 752446 - RNA, 19 nt, Homo sapiens
caaagcaccucacuaugug

SEQ ID NO: 752447 - RNA, 19 nt, Homo sapiens
guaauucaguaccuccaua

SEQ ID NO: 752448 - RNA, 19 nt, Homo sapiens
gaaaggaucaucagcaaca

SEQ ID NO: 752449 - RNA, 19 nt, Homo sapiens
ggaagaaaguguugaaagc

SEQ ID NO: 752450 - RNA, 19 nt, Homo sapiens
gcucagugguugauauuug

SEQ ID NO: 752451 - RNA, 19 nt, Homo sapiens
gaagcucagugguugauau

SEQ ID NO: 752452 - RNA, 19 nt, Homo sapiens
caacaagucagucaaauuc

SEQ ID NO: 752453 - RNA, 19 nt, Homo sapiens
ggaacuauuucaucagaau

SEQ ID NO: 752454 - RNA, 19 nt, Homo sapiens
gcacuacuguuauagaagu

SEQ ID NO: 752455 - RNA, 19 nt, Homo sapiens
agaaacaucuguagcauca

SEQ ID NO: 752456 - RNA, 19 nt, Homo sapiens
caacauggcaccuuaacuu

SEQ ID NO: 752457 - RNA, 19 nt, Homo sapiens
gcaaaguuguuuauguuag

SEQ ID NO: 752458 - RNA, 19 nt, Homo sapiens
gagcaaaauuguagagaua

SEQ ID NO: 752459 - RNA, 19 nt, Homo sapiens
gcaguuguagcauuaguua

SEQ ID NO: 752460 - RNA, 19 nt, Homo sapiens
ucaggaauguucuuauuug

SEQ ID NO: 752461 - RNA, 19 nt, Homo sapiens
uuacagggcucuucaguuc

SEQ ID NO: 752462 - RNA, 19 nt, Homo sapiens
uguaagcccuggaauguuu

SEQ ID NO: 752463 - RNA, 19 nt, Homo sapiens
cagaguaacuggacgaaau

SEQ ID NO: 752464 - RNA, 19 nt, Homo sapiens
gcgagaaucugucuaugau

SEQ ID NO: 752465 - RNA, 19 nt, Homo sapiens
ccagugcucuaguuacuuu

SEQ ID NO: 752466 - RNA, 19 nt, Homo sapiens
guagagauaaugcucauaa

SEQ ID NO: 752467 - RNA, 19 nt, Homo sapiens
gaaaacacguuaucuaauc

SEQ ID NO: 752468 - RNA, 19 nt, Homo sapiens
uggaagagcugaaaguguu

SEQ ID NO: 752469 - RNA, 19 nt, Homo sapiens
ccagagacccugacaacua

SEQ ID NO: 752470 - RNA, 19 nt, Homo sapiens
uggaagaucucaugauguu

SEQ ID NO: 752471 - RNA, 19 nt, Homo sapiens
gcaaguaacucucuucuua

SEQ ID NO: 752472 - RNA, 19 nt, Homo sapiens
gaaaggagcugaagauagu

SEQ ID NO: 752473 - RNA, 19 nt, Homo sapiens
gcaaagaaguggacauuga

SEQ ID NO: 752474 - RNA, 19 nt, Homo sapiens
caacagcgaugcacuauug

SEQ ID NO: 752475 - RNA, 19 nt, Homo sapiens
caacagaaccagucaauuu

SEQ ID NO: 752476 - RNA, 19 nt, Homo sapiens
gcaguuaucuucaguuuua

SEQ ID NO: 752477 - RNA, 19 nt, Homo sapiens
guacaagggucaccuaguu

SEQ ID NO: 752478 - RNA, 19 nt, Homo sapiens
caacuugacuggcuccuuu

SEQ ID NO: 752479 - RNA, 19 nt, Homo sapiens
caacaugccuggaauucaa

SEQ ID NO: 752480 - RNA, 19 nt, Homo sapiens
ucacagcacucaauaguug

SEQ ID NO: 752481 - RNA, 19 nt, Homo sapiens
guagggauauugaaauuga

SEQ ID NO: 752482 - RNA, 19 nt, Homo sapiens
gcaacagucuccucuuuau

SEQ ID NO: 752483 - RNA, 19 nt, Homo sapiens
ccacuggcauccucuauaa

SEQ ID NO: 752484 - RNA, 19 nt, Homo sapiens
ggaaugagaugaugucacu

SEQ ID NO: 752485 - RNA, 19 nt, Homo sapiens
gaaaacaucucaaacauag

SEQ ID NO: 752486 - RNA, 19 nt, Homo sapiens
gcaguaugauuaagaguga

SEQ ID NO: 752487 - RNA, 19 nt, Homo sapiens
gaaaagcaguuaaccagua

SEQ ID NO: 752488 - RNA, 19 nt, Homo sapiens
ugacaacacuucuuucuca

SEQ ID NO: 752489 - RNA, 19 nt, Homo sapiens
gagaugaugucacuucaau

SEQ ID NO: 752490 - RNA, 19 nt, Homo sapiens
gaaacucagucuagagaga

SEQ ID NO: 752491 - RNA, 19 nt, Homo sapiens
gcagcaggcuacacaguuu

SEQ ID NO: 752492 - RNA, 19 nt, Homo sapiens
gaaaggagaagaagaagug

SEQ ID NO: 752493 - RNA, 19 nt, Homo sapiens
uaaugaaccuguaguguug

SEQ ID NO: 752494 - RNA, 19 nt, Homo sapiens
gcaaggcuuuccuacagua

SEQ ID NO: 752495 - RNA, 19 nt, Homo sapiens
ugaaggcacuacuguuaua

SEQ ID NO: 752496 - RNA, 19 nt, Homo sapiens
uaucaggccugcagaguaa

SEQ ID NO: 752497 - RNA, 19 nt, Homo sapiens
gcagucaaccaacauauuu

SEQ ID NO: 752498 - RNA, 19 nt, Homo sapiens
gacaaucaaccucaaguua

SEQ ID NO: 752499 - RNA, 19 nt, Homo sapiens
gaggaaugcugaugucgaa

SEQ ID NO: 752500 - RNA, 19 nt, Homo sapiens
gaacucaauuucuccacuu

SEQ ID NO: 752501 - RNA, 19 nt, Homo sapiens
gggaauauauguagugaca

SEQ ID NO: 752502 - RNA, 19 nt, Homo sapiens
uugcauagcuguucaguga

SEQ ID NO: 752503 - RNA, 19 nt, Homo sapiens
caucaggaauguucuuauu

SEQ ID NO: 752504 - RNA, 19 nt, Homo sapiens
acaacaagguaaugguuua

SEQ ID NO: 752505 - RNA, 19 nt, Homo sapiens
gcaaaugcagugugaauug

SEQ ID NO: 752506 - RNA, 19 nt, Homo sapiens
caaagcaccucacuaugug

SEQ ID NO: 752507 - RNA, 19 nt, Homo sapiens
caacaagucagucaaauuc

SEQ ID NO: 752508 - RNA, 19 nt, Homo sapiens
ggaacuauuucaucagaau

SEQ ID NO: 752509 - RNA, 19 nt, Homo sapiens
gcacuacuguuauagaagu

SEQ ID NO: 752510 - RNA, 19 nt, Homo sapiens
agaaacaucuguagcauca

SEQ ID NO: 752511 - RNA, 19 nt, Homo sapiens
ucaggaauguucuuauuug

SEQ ID NO: 752512 - RNA, 19 nt, Homo sapiens
uuacagggcucuucaguuc

SEQ ID NO: 752513 - RNA, 19 nt, Homo sapiens
uguaagcccuggaauguuu

SEQ ID NO: 752514 - RNA, 19 nt, Homo sapiens
cagaguaacuggacgaaau

SEQ ID NO: 752515 - RNA, 19 nt, Homo sapiens
gcgagaaucugucuaugau

SEQ ID NO: 752516 - RNA, 19 nt, Homo sapiens
gaaaacacguuaucuaauc

SEQ ID NO: 752517 - RNA, 19 nt, Homo sapiens
uggaagagcugaaaguguu

SEQ ID NO: 752518 - RNA, 19 nt, Homo sapiens
ccagagacccugacaacua

SEQ ID NO: 752519 - RNA, 19 nt, Homo sapiens
uggaagaucucaugauguu

SEQ ID NO: 752520 - RNA, 19 nt, Homo sapiens
agaagaaacuggaacacaa

SEQ ID NO: 752521 - RNA, 19 nt, Homo sapiens
gaucaacucagcaaacauu

SEQ ID NO: 752522 - RNA, 19 nt, Homo sapiens
gcuggaagaucucaugaug

SEQ ID NO: 752523 - RNA, 19 nt, Homo sapiens
ccauagcucuccucagauu

SEQ ID NO: 752524 - RNA, 19 nt, Homo sapiens
acagcaagcuccaauauca

SEQ ID NO: 752525 - RNA, 19 nt, Homo sapiens
cagcagacuucucacauga

SEQ ID NO: 752526 - RNA, 19 nt, Homo sapiens
gaguuaauaucaugaggaa

SEQ ID NO: 752527 - RNA, 19 nt, Homo sapiens
gaagagcccuauguugugu

SEQ ID NO: 752528 - RNA, 19 nt, Homo sapiens
guaguucucugcuucauag

SEQ ID NO: 752529 - RNA, 19 nt, Homo sapiens
gagaaucugucuaugaucu

SEQ ID NO: 752530 - RNA, 19 nt, Homo sapiens
caacaacaacagagcauuu

SEQ ID NO: 752531 - RNA, 19 nt, Homo sapiens
gaacaaaugcagccuccaa

SEQ ID NO: 752532 - RNA, 19 nt, Homo sapiens
gcagcagucuucucauuca

SEQ ID NO: 752533 - RNA, 19 nt, Homo sapiens
gaaaugaaacuucuacaac

SEQ ID NO: 752534 - RNA, 19 nt, Homo sapiens
uaccagaccagauaauuua

SEQ ID NO: 752535 - RNA, 19 nt, Homo sapiens
aaauacaacuccuugcaaa

SEQ ID NO: 752536 - RNA, 19 nt, Homo sapiens
gaacuggaguaaagaagag

SEQ ID NO: 752537 - RNA, 19 nt, Homo sapiens
gcaccgaacucaauuucuc

SEQ ID NO: 752538 - RNA, 19 nt, Homo sapiens
guaaugagaauguucaaga

SEQ ID NO: 752539 - RNA, 19 nt, Homo sapiens
cagcaguuaucuucaguuu

SEQ ID NO: 752540 - RNA, 19 nt, Homo sapiens
gaacaacaugccuggaauu

SEQ ID NO: 752541 - RNA, 19 nt, Homo sapiens
ggaaaugaaacuucuacaa

SEQ ID NO: 752542 - RNA, 19 nt, Homo sapiens
gcagacuucucacaugaug

SEQ ID NO: 752543 - RNA, 19 nt, Homo sapiens
ugagucagcuucagaauac

SEQ ID NO: 752544 - RNA, 19 nt, Homo sapiens
cagagacccugacaacuau

SEQ ID NO: 752545 - RNA, 19 nt, Homo sapiens
gaagaucucaugauguuca

SEQ ID NO: 752546 - RNA, 19 nt, Homo sapiens
gcguagggauauugaaauu

SEQ ID NO: 752547 - RNA, 19 nt, Homo sapiens
gaaauacaacuccuugcaa

SEQ ID NO: 752548 - RNA, 19 nt, Homo sapiens
ugaaccaacugcagaauuc

SEQ ID NO: 752549 - RNA, 19 nt, Homo sapiens
cagagucaguccacaguuu

SEQ ID NO: 752550 - RNA, 19 nt, Homo sapiens
ucuaugaucuucucccaaa

SEQ ID NO: 752551 - RNA, 19 nt, Homo sapiens
gaauagugguacccaacaa

SEQ ID NO: 752552 - RNA, 19 nt, Homo sapiens
gauuaagagugaagauguu

SEQ ID NO: 752553 - RNA, 19 nt, Homo sapiens
caaacacccucuucuccaa

SEQ ID NO: 752554 - RNA, 19 nt, Homo sapiens
ccaaagcaccucacuaugu

SEQ ID NO: 752555 - RNA, 19 nt, Homo sapiens
gacaaaugcuggaagaucu

SEQ ID NO: 752556 - RNA, 19 nt, Homo sapiens
caacagcaagcuccaauau

SEQ ID NO: 752557 - RNA, 19 nt, Homo sapiens
gcaagggaaugagaugaug

SEQ ID NO: 752558 - RNA, 19 nt, Homo sapiens
guacagugguuaauuuguc

SEQ ID NO: 752559 - RNA, 19 nt, Homo sapiens
ggaaaggagcugaagauag

SEQ ID NO: 752560 - RNA, 19 nt, Homo sapiens
ccugaggacuugcuggaua

SEQ ID NO: 752561 - RNA, 19 nt, Homo sapiens
caccaaacaugauauucaa

SEQ ID NO: 752562 - RNA, 19 nt, Homo sapiens
caaccaacauauuucuuuc

SEQ ID NO: 752563 - RNA, 19 nt, Homo sapiens
ucacuucaaucuggaaauu

SEQ ID NO: 752564 - RNA, 19 nt, Homo sapiens
gagaaacucagucuagaga

SEQ ID NO: 752565 - RNA, 19 nt, Homo sapiens
gugaagauguuacuccaau

SEQ ID NO: 752566 - RNA, 19 nt, Homo sapiens
gaagaggccaugaaagcaa

SEQ ID NO: 752567 - RNA, 19 nt, Homo sapiens
gaauguaaaugugaagaag

SEQ ID NO: 752568 - RNA, 19 nt, Homo sapiens
guaaagaagagcccuaugu

SEQ ID NO: 752569 - RNA, 19 nt, Homo sapiens
caagagaaacucagucuag

SEQ ID NO: 752570 - RNA, 19 nt, Homo sapiens
gagcaccaguuccuacaau

SEQ ID NO: 752571 - RNA, 19 nt, Homo sapiens
ucaaggagcuaacugauga

SEQ ID NO: 752572 - RNA, 19 nt, Homo sapiens
cagagaagcuuaucacaca

SEQ ID NO: 752573 - RNA, 19 nt, Homo sapiens
ggccuacuguuacacauua

SEQ ID NO: 752574 - RNA, 19 nt, Homo sapiens
ggagcuaacugaugaagag

SEQ ID NO: 752575 - RNA, 19 nt, Homo sapiens
acaaucagcuggcacagaa

SEQ ID NO: 752576 - RNA, 19 nt, Homo sapiens
gaagcaggauacugaggaa

SEQ ID NO: 752577 - RNA, 19 nt, Homo sapiens
ggagaaaggcugggucuug

SEQ ID NO: 752578 - RNA, 19 nt, Homo sapiens
uggagaagaucaauaagau

SEQ ID NO: 752579 - RNA, 19 nt, Homo sapiens
gcuagagauugaccagaaa

SEQ ID NO: 752580 - RNA, 19 nt, Homo sapiens
cagagaggcugcagcuaga

SEQ ID NO: 752581 - RNA, 19 nt, Homo sapiens
aagaagggauggcagagaa

SEQ ID NO: 752582 - RNA, 19 nt, Homo sapiens
gaagauuaacccugagaau

SEQ ID NO: 752583 - RNA, 19 nt, Homo sapiens
gaucaacaccaagaagauu

SEQ ID NO: 752584 - RNA, 19 nt, Homo sapiens
gagaucaacaccaagaaga

SEQ ID NO: 752585 - RNA, 19 nt, Homo sapiens
ugaggaagaugaggaggaa

SEQ ID NO: 752586 - RNA, 19 nt, Homo sapiens
gcucuacaaugaagugaag

SEQ ID NO: 752587 - RNA, 19 nt, Homo sapiens
cagggaagcaggauacuga

SEQ ID NO: 752588 - RNA, 19 nt, Homo sapiens
ccaaggaagccaagucaga

SEQ ID NO: 752589 - RNA, 19 nt, Homo sapiens
gcugccaacuucagacgaa

SEQ ID NO: 752590 - RNA, 19 nt, Homo sapiens
gcaggauacugaggaagau

SEQ ID NO: 752591 - RNA, 19 nt, Homo sapiens
gaagaagggauggcagaga

SEQ ID NO: 752592 - RNA, 19 nt, Homo sapiens
caaccacccaacuuucuuu

SEQ ID NO: 752593 - RNA, 19 nt, Homo sapiens
caacuucagacgaacagaa

SEQ ID NO: 752594 - RNA, 19 nt, Homo sapiens
ccagugacccugagaucaa

SEQ ID NO: 752595 - RNA, 19 nt, Homo sapiens
agauuaacccugagaauuc

SEQ ID NO: 752596 - RNA, 19 nt, Homo sapiens
ggagaagaucaauaagaug

SEQ ID NO: 752597 - RNA, 19 nt, Homo sapiens
ggcugcagcuagagauuga

SEQ ID NO: 752598 - RNA, 19 nt, Homo sapiens
gcugcaaccacccaacuuu

SEQ ID NO: 752599 - RNA, 19 nt, Homo sapiens
gaugagaaggacaaaggaa

SEQ ID NO: 752600 - RNA, 19 nt, Homo sapiens
aagauuaacccugagaauu

SEQ ID NO: 752601 - RNA, 19 nt, Homo sapiens
gagaagcuuaucacacaga

SEQ ID NO: 752602 - RNA, 19 nt, Homo sapiens
gcaaccacccaacuuucuu

SEQ ID NO: 752603 - RNA, 19 nt, Homo sapiens
aagaugaggaggaagauga

SEQ ID NO: 752604 - RNA, 19 nt, Homo sapiens
cagcuuccuucgacgcaaa

SEQ ID NO: 752605 - RNA, 19 nt, Homo sapiens
caacuuucuuucccacucu

SEQ ID NO: 752606 - RNA, 19 nt, Homo sapiens
ccaaggcuaaauucaacua

SEQ ID NO: 752607 - RNA, 19 nt, Homo sapiens
ucaacaccaagaagauuaa

SEQ ID NO: 752608 - RNA, 19 nt, Homo sapiens
gcgguucgacggcauguug

SEQ ID NO: 752609 - RNA, 19 nt, Homo sapiens
gggcagccagcgaucauug

SEQ ID NO: 752610 - RNA, 19 nt, Homo sapiens
gggauggcagagaagcuua

SEQ ID NO: 752611 - RNA, 19 nt, Homo sapiens
gaaguucauggaucaacau

SEQ ID NO: 752612 - RNA, 19 nt, Homo sapiens
cagacgaacagaagaaaca

SEQ ID NO: 752613 - RNA, 19 nt, Homo sapiens
ugacugugcaucuggagaa

SEQ ID NO: 752614 - RNA, 19 nt, Homo sapiens
agaaguucauggaucaaca

SEQ ID NO: 752615 - RNA, 19 nt, Homo sapiens
uuuccucccugaacucuug

SEQ ID NO: 752616 - RNA, 19 nt, Homo sapiens
acccugagaucaacaccaa

SEQ ID NO: 752617 - RNA, 19 nt, Homo sapiens
gcggucccuuucuguguga

SEQ ID NO: 752618 - RNA, 19 nt, Homo sapiens
gaagaugaggaggaagaug

SEQ ID NO: 752619 - RNA, 19 nt, Homo sapiens
agcuagagauugaccagaa

SEQ ID NO: 752620 - RNA, 19 nt, Homo sapiens
ggaagaugagaaggacaaa

SEQ ID NO: 752621 - RNA, 19 nt, Homo sapiens
gagaggcugcagcuagaga

SEQ ID NO: 752622 - RNA, 19 nt, Homo sapiens
gaagaaguucauggaucaa

SEQ ID NO: 752623 - RNA, 19 nt, Homo sapiens
gauuaacccugagaauucc

SEQ ID NO: 752624 - RNA, 19 nt, Homo sapiens
aagcuuaucacacagacuu

SEQ ID NO: 752625 - RNA, 19 nt, Homo sapiens
ggacauggugguggacauc

SEQ ID NO: 752626 - RNA, 19 nt, Homo sapiens
ggccaaggaagccaaguca

SEQ ID NO: 752627 - RNA, 19 nt, Homo sapiens
ugcaggagcuugugaacac

SEQ ID NO: 752628 - RNA, 19 nt, Homo sapiens
ggagcucuacaaugaagug

SEQ ID NO: 752629 - RNA, 19 nt, Homo sapiens
ggacaaaggaaaacugaag

SEQ ID NO: 752630 - RNA, 19 nt, Homo sapiens
ggaagaugaggaggaagau

SEQ ID NO: 752631 - RNA, 19 nt, Homo sapiens
ccugagaucaacaccaaga

SEQ ID NO: 752632 - RNA, 19 nt, Homo sapiens
cuggagaagaucaauaaga

SEQ ID NO: 752633 - RNA, 19 nt, Homo sapiens
gguggugacugugcaucug

SEQ ID NO: 752634 - RNA, 19 nt, Homo sapiens
ccacucuucucugggacuu

SEQ ID NO: 752635 - RNA, 19 nt, Homo sapiens
gccgcuugguguccaguga

SEQ ID NO: 752636 - RNA, 19 nt, Homo sapiens
ugaaagggaaggacauggu

SEQ ID NO: 752637 - RNA, 19 nt, Homo sapiens
ggauggcagagaagcuuau

SEQ ID NO: 752638 - RNA, 19 nt, Homo sapiens
gccuacuguuacacauuaa

SEQ ID NO: 752639 - RNA, 19 nt, Homo sapiens
auggggagcucuacaauga

SEQ ID NO: 752640 - RNA, 19 nt, Homo sapiens
gaagaugagaaggacaaag

SEQ ID NO: 752641 - RNA, 19 nt, Homo sapiens
gaagaaagcuguacauugu

SEQ ID NO: 752642 - RNA, 19 nt, Homo sapiens
caaauuggcugacaccuua

SEQ ID NO: 752643 - RNA, 19 nt, Homo sapiens
uaacuucucugcaagauuu

SEQ ID NO: 752644 - RNA, 19 nt, Homo sapiens
uaacauagauacugacaug

SEQ ID NO: 752645 - RNA, 19 nt, Homo sapiens
ggauguagauuuaccagaa

SEQ ID NO: 752646 - RNA, 19 nt, Homo sapiens
gagaauuccugaguugaua

SEQ ID NO: 752647 - RNA, 19 nt, Homo sapiens
cuaauaaacuguuggaaga

SEQ ID NO: 752648 - RNA, 19 nt, Homo sapiens
gaacauggauucaaaagug

SEQ ID NO: 752649 - RNA, 19 nt, Homo sapiens
ugaugaggauguagauuua

SEQ ID NO: 752650 - RNA, 19 nt, Homo sapiens
ccaaaugauuccaagcaua

SEQ ID NO: 752651 - RNA, 19 nt, Homo sapiens
cauagauacugacaugaua

SEQ ID NO: 752652 - RNA, 19 nt, Homo sapiens
caaaugauuccaagcauaa

SEQ ID NO: 752653 - RNA, 19 nt, Homo sapiens
uaagucagcuaaggcaaua

SEQ ID NO: 752654 - RNA, 19 nt, Homo sapiens
aggcagauaugcuguauuu

SEQ ID NO: 752655 - RNA, 19 nt, Homo sapiens
aaagaaagggcaaagcuua

SEQ ID NO: 752656 - RNA, 19 nt, Homo sapiens
caguaaggauguuaaugua

SEQ ID NO: 752657 - RNA, 19 nt, Homo sapiens
uugagagucuguacauuua

SEQ ID NO: 752658 - RNA, 19 nt, Homo sapiens
gggacuaugucuucauuga

SEQ ID NO: 752659 - RNA, 19 nt, Homo sapiens
guugauauguaccauugua

SEQ ID NO: 752660 - RNA, 19 nt, Homo sapiens
caacauggguggugaugag

SEQ ID NO: 752661 - RNA, 19 nt, Homo sapiens
ggaaagacugggaagauga

SEQ ID NO: 752662 - RNA, 19 nt, Homo sapiens
uagagaaugcccuaacuua

SEQ ID NO: 752663 - RNA, 19 nt, Homo sapiens
ugagagaauuccugaguug

SEQ ID NO: 752664 - RNA, 19 nt, Homo sapiens
ccagguguaucuuagcuaa

SEQ ID NO: 752665 - RNA, 19 nt, Homo sapiens
gaaagggcaaagcuuaauu

SEQ ID NO: 752666 - RNA, 19 nt, Homo sapiens
cgaagaaagcuguacauug

SEQ ID NO: 752667 - RNA, 19 nt, Homo sapiens
gguauuguuugacccuuaa

SEQ ID NO: 752668 - RNA, 19 nt, Homo sapiens
gaagacaguaaggauguua

SEQ ID NO: 752669 - RNA, 19 nt, Homo sapiens
ggguugauauguaccauug

SEQ ID NO: 752670 - RNA, 19 nt, Homo sapiens
agaaguagauggagcagau

SEQ ID NO: 752671 - RNA, 19 nt, Homo sapiens
agaaagcuguacauuguug

SEQ ID NO: 752672 - RNA, 19 nt, Homo sapiens
gggaagaugauucagauga

SEQ ID NO: 752673 - RNA, 19 nt, Homo sapiens
gcaaagugguacgaucgaa

SEQ ID NO: 752674 - RNA, 19 nt, Homo sapiens
gaucuggaguaaggaauau

SEQ ID NO: 752675 - RNA, 19 nt, Homo sapiens
gugaugaggauguagauuu

SEQ ID NO: 752676 - RNA, 19 nt, Homo sapiens
guacauuuaguccagauuu

SEQ ID NO: 752677 - RNA, 19 nt, Homo sapiens
gauuauagaacauggauuc

SEQ ID NO: 752678 - RNA, 19 nt, Homo sapiens
cacuaaggguugauaugua

SEQ ID NO: 752679 - RNA, 19 nt, Homo sapiens
gaugaugauucacaagaca

SEQ ID NO: 752680 - RNA, 19 nt, Homo sapiens
cagcaguugcgauaaauaa

SEQ ID NO: 752681 - RNA, 19 nt, Homo sapiens
gaacauuucccagacuuuc

SEQ ID NO: 752682 - RNA, 19 nt, Homo sapiens
ggaguaaggaauauuguca

SEQ ID NO: 752683 - RNA, 19 nt, Homo sapiens
acaagacagugaugaugaa

SEQ ID NO: 752684 - RNA, 19 nt, Homo sapiens
gcagauaugcuguauuugc

SEQ ID NO: 752685 - RNA, 19 nt, Homo sapiens
cugcaagauuucauaauug

SEQ ID NO: 752686 - RNA, 19 nt, Homo sapiens
gagagucuguacauuuagu

SEQ ID NO: 752687 - RNA, 19 nt, Homo sapiens
gcucucagcuuagggaaag

SEQ ID NO: 752688 - RNA, 19 nt, Homo sapiens
gagcagaugaugauucaca

SEQ ID NO: 752689 - RNA, 19 nt, Homo sapiens
uaaugcagcaguugcgaua

SEQ ID NO: 752690 - RNA, 19 nt, Homo sapiens
uaaacuguuggaagacuua

SEQ ID NO: 752691 - RNA, 19 nt, Homo sapiens
gaaagacugggaagaugau

SEQ ID NO: 752692 - RNA, 19 nt, Homo sapiens
ggacagaucaauuuuaugu

SEQ ID NO: 752693 - RNA, 19 nt, Homo sapiens
uuacaucucuuagcaugga

SEQ ID NO: 752694 - RNA, 19 nt, Homo sapiens
uuugaagccuauacaauug

SEQ ID NO: 752695 - RNA, 19 nt, Homo sapiens
gcagcaguugcgauaaaua

SEQ ID NO: 752696 - RNA, 19 nt, Homo sapiens
guauugauccaaaugauuc

SEQ ID NO: 752697 - RNA, 19 nt, Homo sapiens
ggcaauuaaugcagcaguu

SEQ ID NO: 752698 - RNA, 19 nt, Homo sapiens
aggagaaucuggccaguca

SEQ ID NO: 752699 - RNA, 19 nt, Homo sapiens
gauacugacaugauaggaa

SEQ ID NO: 752700 - RNA, 19 nt, Homo sapiens
gcaauuaaugcagcaguug

SEQ ID NO: 752701 - RNA, 19 nt, Homo sapiens
uggagcagaugaugauuca

SEQ ID NO: 752702 - RNA, 19 nt, Homo sapiens
agaacggacagaucaauuu

SEQ ID NO: 752703 - RNA, 19 nt, Homo sapiens
gcuguacauuguugcuuga

SEQ ID NO: 752704 - RNA, 19 nt, Homo sapiens
gcuuagggaaagagaauaa

SEQ ID NO: 752705 - RNA, 19 nt, Homo sapiens
gauguagauuuaccagaag

SEQ ID NO: 752706 - RNA, 19 nt, Homo sapiens
gaacggacagaucaauuuu

SEQ ID NO: 752707 - RNA, 19 nt, Homo sapiens
uaaaggcagauaugcugua

SEQ ID NO: 752708 - RNA, 19 nt, Homo sapiens
agugucgacuucaauaauu

SEQ ID NO: 752709 - RNA, 19 nt, Homo sapiens
gagaaucuggccagucaug

SEQ ID NO: 752710 - RNA, 19 nt, Homo sapiens
aaagugacuggaacaaauu

SEQ ID NO: 752711 - RNA, 19 nt, Homo sapiens
ggaggaagugauaauuuua

SEQ ID NO: 752712 - RNA, 19 nt, Homo sapiens
acaguaaggauguuaaugu

SEQ ID NO: 752713 - RNA, 19 nt, Homo sapiens
cacaagacagugaugauga

SEQ ID NO: 752714 - RNA, 19 nt, Homo sapiens
cuugagagucuguacauuu

SEQ ID NO: 752715 - RNA, 19 nt, Homo sapiens
ggacgaagaaagcuguaca

SEQ ID NO: 752716 - RNA, 19 nt, Homo sapiens
aagggacuaugucuucauu

SEQ ID NO: 752717 - RNA, 19 nt, Homo sapiens
aaaagugacuggaacaaau

SEQ ID NO: 752718 - RNA, 19 nt, Homo sapiens
aaaggcagauaugcuguau

SEQ ID NO: 752719 - RNA, 19 nt, Homo sapiens
uaaggaauauugucaucac

SEQ ID NO: 752720 - RNA, 19 nt, Homo sapiens
gcugaaaaccucaauuuau

SEQ ID NO: 752721 - RNA, 19 nt, Homo sapiens
uagcauggaggacgaagaa

SEQ ID NO: 752722 - RNA, 19 nt, Homo sapiens
aaacaucucaccuaagucu

SEQ ID NO: 752723 - RNA, 19 nt, Homo sapiens
ucacuaaggguugauaugu

SEQ ID NO: 752724 - RNA, 19 nt, Homo sapiens
uggaaagacugggaagaug

SEQ ID NO: 752725 - RNA, 19 nt, Homo sapiens
ccagucauggccaagguua

SEQ ID NO: 752726 - RNA, 19 nt, Homo sapiens
cggaggaagugauaauuuu

SEQ ID NO: 752727 - RNA, 19 nt, Homo sapiens
ucaggauuguuccacuaaa

SEQ ID NO: 752728 - RNA, 19 nt, Homo sapiens
cugguaaccugcuauucuu

SEQ ID NO: 752729 - RNA, 19 nt, Homo sapiens
cagaugaugauucacaaga

SEQ ID NO: 752730 - RNA, 19 nt, Homo sapiens
cugaaaaccucaauuuaug

SEQ ID NO: 752731 - RNA, 19 nt, Homo sapiens
uaaaagaacggacagauca

SEQ ID NO: 752732 - RNA, 19 nt, Homo sapiens
gaacaacauggguggugau

SEQ ID NO: 752733 - RNA, 19 nt, Homo sapiens
aaagggcaaagcuuaauug

SEQ ID NO: 752734 - RNA, 19 nt, Homo sapiens
aagaaagggcaaagcuuaa

SEQ ID NO: 752735 - RNA, 19 nt, Homo sapiens
ugguauuguuugacccuua

SEQ ID NO: 752736 - RNA, 19 nt, Homo sapiens
cuucaggauuguuccacua

SEQ ID NO: 752737 - RNA, 19 nt, Homo sapiens
ccuuaugcaugaacauuuc

SEQ ID NO: 752738 - RNA, 19 nt, Homo sapiens
gagagaauuccugaguuga

SEQ ID NO: 752739 - RNA, 19 nt, Homo sapiens
ucacuguauugauccaaau

SEQ ID NO: 752740 - RNA, 19 nt, Homo sapiens
guccagauuuguauuugca

SEQ ID NO: 752741 - RNA, 19 nt, Homo sapiens
gaugauaacucucuugaua

SEQ ID NO: 752742 - RNA, 19 nt, Homo sapiens
caacaaagcuacaaucaug

SEQ ID NO: 752743 - RNA, 19 nt, Homo sapiens
gaucagauguugagaguuu

SEQ ID NO: 752744 - RNA, 19 nt, Homo sapiens
ggaggaagcuaaacaagaa

SEQ ID NO: 752745 - RNA, 19 nt, Homo sapiens
gaagaaguguggaaauuga

SEQ ID NO: 752746 - RNA, 19 nt, Homo sapiens
gcacaauccuucuuugaaa

SEQ ID NO: 752747 - RNA, 19 nt, Homo sapiens
ccaaagagauucaaauugu

SEQ ID NO: 752748 - RNA, 19 nt, Homo sapiens
gaaacgcugucucuacuaa

SEQ ID NO: 752749 - RNA, 19 nt, Homo sapiens
guaauuauguuccagauug

SEQ ID NO: 752750 - RNA, 19 nt, Homo sapiens
ugacaccuauugcaaauua

SEQ ID NO: 752751 - RNA, 19 nt, Homo sapiens
gaagugagaugauaacucu

SEQ ID NO: 752752 - RNA, 19 nt, Homo sapiens
gaaauuauagcucgaggua

SEQ ID NO: 752753 - RNA, 19 nt, Homo sapiens
gcagugagcugagaucaug

SEQ ID NO: 752754 - RNA, 19 nt, Homo sapiens
guuaugaccuacagugaua

SEQ ID NO: 752755 - RNA, 19 nt, Homo sapiens
guagagaaguugggauuaa

SEQ ID NO: 752756 - RNA, 19 nt, Homo sapiens
gaaccaggcugcauuaaaa

SEQ ID NO: 752757 - RNA, 19 nt, Homo sapiens
auacaucaguggaaacuua

SEQ ID NO: 752758 - RNA, 19 nt, Homo sapiens
gagcagaguuggagaaucu

SEQ ID NO: 752759 - RNA, 19 nt, Homo sapiens
ucaccaagaugcauuuaaa

SEQ ID NO: 752760 - RNA, 19 nt, Homo sapiens
gaaugcuccuuguguuaua

SEQ ID NO: 752761 - RNA, 19 nt, Homo sapiens
ggaaguuguugaauucuug

SEQ ID NO: 752762 - RNA, 19 nt, Homo sapiens
gaaaugccaaguuguguuu

SEQ ID NO: 752763 - RNA, 19 nt, Homo sapiens
gaccauaaaucaacuucuu

SEQ ID NO: 752764 - RNA, 19 nt, Homo sapiens
cagaggagcuuauauuugg

SEQ ID NO: 752765 - RNA, 19 nt, Homo sapiens
ggacagaggaucagauguu

SEQ ID NO: 752766 - RNA, 19 nt, Homo sapiens
guucagaucuucaguacug

SEQ ID NO: 752767 - RNA, 19 nt, Homo sapiens
ugaggaaugucaauuaguu

SEQ ID NO: 752768 - RNA, 19 nt, Homo sapiens
caaaggagcauaagaaucu

SEQ ID NO: 752769 - RNA, 19 nt, Homo sapiens
gcauaagaaucucgcagaa

SEQ ID NO: 752770 - RNA, 19 nt, Homo sapiens
cgucagaaaugccaaguug

SEQ ID NO: 752771 - RNA, 19 nt, Homo sapiens
gaaucucgcagaagcuuua

SEQ ID NO: 752772 - RNA, 19 nt, Homo sapiens
gaaagaagaaguguggaaa

SEQ ID NO: 752773 - RNA, 19 nt, Homo sapiens
gagaagcaguauuuuguua

SEQ ID NO: 752774 - RNA, 19 nt, Homo sapiens
ugaaaugcuuugucaauca

SEQ ID NO: 752775 - RNA, 19 nt, Homo sapiens
acaaauggauguuaguaug

SEQ ID NO: 752776 - RNA, 19 nt, Homo sapiens
aaacacagagccaggaaua

SEQ ID NO: 752777 - RNA, 19 nt, Homo sapiens
gaaaugcuuugucaaucau

SEQ ID NO: 752778 - RNA, 19 nt, Homo sapiens
gcagaggagcuuauauuug

SEQ ID NO: 752779 - RNA, 19 nt, Homo sapiens
gcacaaauggauguuagua

SEQ ID NO: 752780 - RNA, 19 nt, Homo sapiens
cgaauuugaugagauguuu

SEQ ID NO: 752781 - RNA, 19 nt, Homo sapiens
ccagauugaccaugaauaa

SEQ ID NO: 752782 - RNA, 19 nt, Homo sapiens
ggaagcuaaacaagaauua

SEQ ID NO: 752783 - RNA, 19 nt, Homo sapiens
auacauaaccucauucuga

SEQ ID NO: 752784 - RNA, 19 nt, Homo sapiens
gcaagacucugccucaaaa

SEQ ID NO: 752785 - RNA, 19 nt, Homo sapiens
gccuuuagccuucuauaua

SEQ ID NO: 752786 - RNA, 19 nt, Homo sapiens
ugauaacucucuugauaug

SEQ ID NO: 752787 - RNA, 19 nt, Homo sapiens
caacaggugcuuccaguga

SEQ ID NO: 752788 - RNA, 19 nt, Homo sapiens
aaugacagauggaaugaaa

SEQ ID NO: 752789 - RNA, 19 nt, Homo sapiens
aagaagaaguguggaaauu

SEQ ID NO: 752790 - RNA, 19 nt, Homo sapiens
gaacacauuguauugguau

SEQ ID NO: 752791 - RNA, 19 nt, Homo sapiens
acacagagccaggaauaua

SEQ ID NO: 752792 - RNA, 19 nt, Homo sapiens
ggugugaaaugcuuuguca

SEQ ID NO: 752793 - RNA, 19 nt, Homo sapiens
gcgaaugcuccuuguguua

SEQ ID NO: 752794 - RNA, 19 nt, Homo sapiens
acaggaaguuguugaauuc

SEQ ID NO: 752795 - RNA, 19 nt, Homo sapiens
gaaacuaaguccagaaacc

SEQ ID NO: 752796 - RNA, 19 nt, Homo sapiens
gaacccgucugauucucuu

SEQ ID NO: 752797 - RNA, 19 nt, Homo sapiens
gagaaugacagauggaaug

SEQ ID NO: 752798 - RNA, 19 nt, Homo sapiens
gcacgagaauugcuugaac

SEQ ID NO: 752799 - RNA, 19 nt, Homo sapiens
caaggcagaccauaaauca

SEQ ID NO: 752800 - RNA, 19 nt, Homo sapiens
uacaggaaguuguugaauu

SEQ ID NO: 752801 - RNA, 19 nt, Homo sapiens
aaacauuucuucccauugg

SEQ ID NO: 752802 - RNA, 19 nt, Homo sapiens
uacauaaccucauucugaa

SEQ ID NO: 752803 - RNA, 19 nt, Homo sapiens
gaggaaugucaauuaguua

SEQ ID NO: 752804 - RNA, 19 nt, Homo sapiens
aaagaacuaucaggauuga

SEQ ID NO: 752805 - RNA, 19 nt, Homo sapiens
gaaguguggaaauugauaa

SEQ ID NO: 752806 - RNA, 19 nt, Homo sapiens
gacagaggaucagauguug

SEQ ID NO: 752807 - RNA, 19 nt, Homo sapiens
caucacagcauaucaugaa

SEQ ID NO: 752808 - RNA, 19 nt, Homo sapiens
caaccagauuauauucuug

SEQ ID NO: 752809 - RNA, 19 nt, Homo sapiens
gagaagcugauguuccuuu

SEQ ID NO: 752810 - RNA, 19 nt, Homo sapiens
uaacugugcuugguuucaa

SEQ ID NO: 752811 - RNA, 19 nt, Homo sapiens
gagcaagacucugccucaa

SEQ ID NO: 752812 - RNA, 19 nt, Homo sapiens
ggccaaggcaggagaauug

SEQ ID NO: 752813 - RNA, 19 nt, Homo sapiens
uagagaaguugggauuaaa

SEQ ID NO: 752814 - RNA, 19 nt, Homo sapiens
guacauuacguuccucuug

SEQ ID NO: 752815 - RNA, 19 nt, Homo sapiens
gguggcaggugcuuauaau

SEQ ID NO: 752816 - RNA, 19 nt, Homo sapiens
uauggaugcuugcugguuu

SEQ ID NO: 752817 - RNA, 19 nt, Homo sapiens
gaacaagaaauaagaaucc

SEQ ID NO: 752818 - RNA, 19 nt, Homo sapiens
ggagccagccguaucagaa

SEQ ID NO: 752819 - RNA, 19 nt, Homo sapiens
gcucaagcacucacacaaa

SEQ ID NO: 752820 - RNA, 19 nt, Homo sapiens
guaucgacaucauucaaga

SEQ ID NO: 752821 - RNA, 19 nt, Homo sapiens
cuauaacugugcuugguuu

SEQ ID NO: 752822 - RNA, 19 nt, Homo sapiens
gaagcuuuauugaccuaug

SEQ ID NO: 752823 - RNA, 19 nt, Homo sapiens
gaaccgaccauauuacaac

SEQ ID NO: 752824 - RNA, 19 nt, Homo sapiens
ugaaggagcuggaguuuuc

SEQ ID NO: 752825 - RNA, 19 nt, Homo sapiens
ggacagaggggcacaguuu

SEQ ID NO: 752826 - RNA, 19 nt, Homo sapiens
gauccgaauuugaugagau

SEQ ID NO: 752827 - RNA, 19 nt, Homo sapiens
aaacagcucuuuugaggaa

SEQ ID NO: 752828 - RNA, 19 nt, Homo sapiens
ggcagaggagcuuauauuu

SEQ ID NO: 752829 - RNA, 19 nt, Homo sapiens
aaacuucccagaggcauua

SEQ ID NO: 752830 - RNA, 19 nt, Homo sapiens
gggagaagcugauguuccu

SEQ ID NO: 752831 - RNA, 19 nt, Homo sapiens
gacguugacuucauuaaaa

SEQ ID NO: 752832 - RNA, 19 nt, Homo sapiens
gguauuacaaccagauuau

SEQ ID NO: 752833 - RNA, 19 nt, Homo sapiens
gaccuuggauuaucugaac

SEQ ID NO: 752834 - RNA, 19 nt, Homo sapiens
gaaaccccaucucuacuaa

SEQ ID NO: 752835 - RNA, 19 nt, Homo sapiens
ggaaacuuaagaugcagua

SEQ ID NO: 752836 - RNA, 19 nt, Homo sapiens
uaaagaacuaucaggauug

SEQ ID NO: 752837 - RNA, 19 nt, Homo sapiens
gucaaucauuugucacauu

SEQ ID NO: 752838 - RNA, 19 nt, Homo sapiens
guaauugaagggugugaaa

SEQ ID NO: 752839 - RNA, 19 nt, Homo sapiens
gcaaaggagcauaagaauc

SEQ ID NO: 752840 - RNA, 19 nt, Homo sapiens
cagauggaaugaaacuaga

SEQ ID NO: 752841 - RNA, 19 nt, Homo sapiens
gaugauaacucucuugaua

SEQ ID NO: 752842 - RNA, 19 nt, Homo sapiens
caacaaagcuacaaucaug

SEQ ID NO: 752843 - RNA, 19 nt, Homo sapiens
gaucagauguugagaguuu

SEQ ID NO: 752844 - RNA, 19 nt, Homo sapiens
ggaggaagcuaaacaagaa

SEQ ID NO: 752845 - RNA, 19 nt, Homo sapiens
gaagaaguguggaaauuga

SEQ ID NO: 752846 - RNA, 19 nt, Homo sapiens
gcacaauccuucuuugaaa

SEQ ID NO: 752847 - RNA, 19 nt, Homo sapiens
ccaaagagauucaaauugu

SEQ ID NO: 752848 - RNA, 19 nt, Homo sapiens
gaaacgcugucucuacuaa

SEQ ID NO: 752849 - RNA, 19 nt, Homo sapiens
guaauuauguuccagauug

SEQ ID NO: 752850 - RNA, 19 nt, Homo sapiens
ugacaccuauugcaaauua

SEQ ID NO: 752851 - RNA, 19 nt, Homo sapiens
gaagugagaugauaacucu

SEQ ID NO: 752852 - RNA, 19 nt, Homo sapiens
ugacgaagcuuaacauugu

SEQ ID NO: 752853 - RNA, 19 nt, Homo sapiens
gaaauuauagcucgaggua

SEQ ID NO: 752854 - RNA, 19 nt, Homo sapiens
gcagugagcugagaucaug

SEQ ID NO: 752855 - RNA, 19 nt, Homo sapiens
guuaugaccuacagugaua

SEQ ID NO: 752856 - RNA, 19 nt, Homo sapiens
guagagaaguugggauuaa

SEQ ID NO: 752857 - RNA, 19 nt, Homo sapiens
gaaccaggcugcauuaaaa

SEQ ID NO: 752858 - RNA, 19 nt, Homo sapiens
auacaucaguggaaacuua

SEQ ID NO: 752859 - RNA, 19 nt, Homo sapiens
gagcagaguuggagaaucu

SEQ ID NO: 752860 - RNA, 19 nt, Homo sapiens
ucaccaagaugcauuuaaa

SEQ ID NO: 752861 - RNA, 19 nt, Homo sapiens
gaaugcuccuuguguuaua

SEQ ID NO: 752862 - RNA, 19 nt, Homo sapiens
ggaaguuguugaauucuug

SEQ ID NO: 752863 - RNA, 19 nt, Homo sapiens
gaaaugccaaguuguguuu

SEQ ID NO: 752864 - RNA, 19 nt, Homo sapiens
gaccauaaaucaacuucuu

SEQ ID NO: 752865 - RNA, 19 nt, Homo sapiens
cagaggagcuuauauuugg

SEQ ID NO: 752866 - RNA, 19 nt, Homo sapiens
ggacagaggaucagauguu

SEQ ID NO: 752867 - RNA, 19 nt, Homo sapiens
guucagaucuucaguacug

SEQ ID NO: 752868 - RNA, 19 nt, Homo sapiens
ugaggaaugucaauuaguu

SEQ ID NO: 752869 - RNA, 19 nt, Homo sapiens
caaaggagcauaagaaucu

SEQ ID NO: 752870 - RNA, 19 nt, Homo sapiens
gcauaagaaucucgcagaa

SEQ ID NO: 752871 - RNA, 19 nt, Homo sapiens
cgucagaaaugccaaguug

SEQ ID NO: 752872 - RNA, 19 nt, Homo sapiens
gaaucucgcagaagcuuua

SEQ ID NO: 752873 - RNA, 19 nt, Homo sapiens
gaaagaagaaguguggaaa

SEQ ID NO: 752874 - RNA, 19 nt, Homo sapiens
gagaagcaguauuuuguua

SEQ ID NO: 752875 - RNA, 19 nt, Homo sapiens
ugaaaugcuuugucaauca

SEQ ID NO: 752876 - RNA, 19 nt, Homo sapiens
acaaauggauguuaguaug

SEQ ID NO: 752877 - RNA, 19 nt, Homo sapiens
aaacacagagccaggaaua

SEQ ID NO: 752878 - RNA, 19 nt, Homo sapiens
gaaaugcuuugucaaucau

SEQ ID NO: 752879 - RNA, 19 nt, Homo sapiens
gcagaggagcuuauauuug

SEQ ID NO: 752880 - RNA, 19 nt, Homo sapiens
gcacaaauggauguuagua

SEQ ID NO: 752881 - RNA, 19 nt, Homo sapiens
cgaauuugaugagauguuu

SEQ ID NO: 752882 - RNA, 19 nt, Homo sapiens
ccagauugaccaugaauaa

SEQ ID NO: 752883 - RNA, 19 nt, Homo sapiens
ggaagcuaaacaagaauua

SEQ ID NO: 752884 - RNA, 19 nt, Homo sapiens
auacauaaccucauucuga

SEQ ID NO: 752885 - RNA, 19 nt, Homo sapiens
gcaagacucugccucaaaa

SEQ ID NO: 752886 - RNA, 19 nt, Homo sapiens
gccuuuagccuucuauaua

SEQ ID NO: 752887 - RNA, 19 nt, Homo sapiens
ugauaacucucuugauaug

SEQ ID NO: 752888 - RNA, 19 nt, Homo sapiens
caacaggugcuuccaguga

SEQ ID NO: 752889 - RNA, 19 nt, Homo sapiens
aaugacagauggaaugaaa

SEQ ID NO: 752890 - RNA, 19 nt, Homo sapiens
aagaagaaguguggaaauu

SEQ ID NO: 752891 - RNA, 19 nt, Homo sapiens
gaacacauuguauugguau

SEQ ID NO: 752892 - RNA, 19 nt, Homo sapiens
acacagagccaggaauaua

SEQ ID NO: 752893 - RNA, 19 nt, Homo sapiens
ggugugaaaugcuuuguca

SEQ ID NO: 752894 - RNA, 19 nt, Homo sapiens
gcgaaugcuccuuguguua

SEQ ID NO: 752895 - RNA, 19 nt, Homo sapiens
acaggaaguuguugaauuc

SEQ ID NO: 752896 - RNA, 19 nt, Homo sapiens
gaaacuaaguccagaaacc

SEQ ID NO: 752897 - RNA, 19 nt, Homo sapiens
gaacccgucugauucucuu

SEQ ID NO: 752898 - RNA, 19 nt, Homo sapiens
gagaaugacagauggaaug

SEQ ID NO: 752899 - RNA, 19 nt, Homo sapiens
gcacgagaauugcuugaac

SEQ ID NO: 752900 - RNA, 19 nt, Homo sapiens
caaggcagaccauaaauca

SEQ ID NO: 752901 - RNA, 19 nt, Homo sapiens
uacaggaaguuguugaauu

SEQ ID NO: 752902 - RNA, 19 nt, Homo sapiens
aaacauuucuucccauugg

SEQ ID NO: 752903 - RNA, 19 nt, Homo sapiens
aagaagagcuuggacacaa

SEQ ID NO: 752904 - RNA, 19 nt, Homo sapiens
uacauaaccucauucugaa

SEQ ID NO: 752905 - RNA, 19 nt, Homo sapiens
gaggaaugucaauuaguua

SEQ ID NO: 752906 - RNA, 19 nt, Homo sapiens
aaagaacuaucaggauuga

SEQ ID NO: 752907 - RNA, 19 nt, Homo sapiens
gaaguguggaaauugauaa

SEQ ID NO: 752908 - RNA, 19 nt, Homo sapiens
gacagaggaucagauguug

SEQ ID NO: 752909 - RNA, 19 nt, Homo sapiens
gugaguguauguucaguga

SEQ ID NO: 752910 - RNA, 19 nt, Homo sapiens
caucacagcauaucaugaa

SEQ ID NO: 752911 - RNA, 19 nt, Homo sapiens
caaccagauuauauucuug

SEQ ID NO: 752912 - RNA, 19 nt, Homo sapiens
gagaagcugauguuccuuu

SEQ ID NO: 752913 - RNA, 19 nt, Homo sapiens
uaacugugcuugguuucaa

SEQ ID NO: 752914 - RNA, 19 nt, Homo sapiens
gagcaagacucugccucaa

SEQ ID NO: 752915 - RNA, 19 nt, Homo sapiens
ggccaaggcaggagaauug

SEQ ID NO: 752916 - RNA, 19 nt, Homo sapiens
uagagaaguugggauuaaa

SEQ ID NO: 752917 - RNA, 19 nt, Homo sapiens
guacauuacguuccucuug

SEQ ID NO: 752918 - RNA, 19 nt, Homo sapiens
gguggcaggugcuuauaau

SEQ ID NO: 752919 - RNA, 19 nt, Homo sapiens
uauggaugcuugcugguuu

SEQ ID NO: 752920 - RNA, 19 nt, Homo sapiens
gaacaagaaauaagaaucc

SEQ ID NO: 752921 - RNA, 19 nt, Homo sapiens
ggagccagccguaucagaa

SEQ ID NO: 752922 - RNA, 19 nt, Homo sapiens
gcucaagcacucacacaaa

SEQ ID NO: 752923 - RNA, 19 nt, Homo sapiens
guaucgacaucauucaaga

SEQ ID NO: 752924 - RNA, 19 nt, Homo sapiens
ggacagaggggcacaguuu

SEQ ID NO: 752925 - RNA, 19 nt, Homo sapiens
cuauaacugugcuugguuu

SEQ ID NO: 752926 - RNA, 19 nt, Homo sapiens
gaagcuuuauugaccuaug

SEQ ID NO: 752927 - RNA, 19 nt, Homo sapiens
gaaccgaccauauuacaac

SEQ ID NO: 752928 - RNA, 19 nt, Homo sapiens
ugaaggagcuggaguuuuc

SEQ ID NO: 752929 - RNA, 19 nt, Homo sapiens
gauccgaauuugaugagau

SEQ ID NO: 752930 - RNA, 19 nt, Homo sapiens
aaacagcucuuuugaggaa

SEQ ID NO: 752931 - RNA, 19 nt, Homo sapiens
ggcagaggagcuuauauuu

SEQ ID NO: 752932 - RNA, 19 nt, Homo sapiens
aaacuucccagaggcauua

SEQ ID NO: 752933 - RNA, 19 nt, Homo sapiens
gggagaagcugauguuccu

SEQ ID NO: 752934 - RNA, 19 nt, Homo sapiens
gacguugacuucauuaaaa

SEQ ID NO: 752935 - RNA, 19 nt, Homo sapiens
gguauuacaaccagauuau

SEQ ID NO: 752936 - RNA, 19 nt, Homo sapiens
gaaaccccaucucuacuaa

SEQ ID NO: 752937 - RNA, 19 nt, Homo sapiens
ggaaacuuaagaugcagua

SEQ ID NO: 752938 - RNA, 19 nt, Homo sapiens
uaaagaacuaucaggauug

SEQ ID NO: 752939 - RNA, 19 nt, Homo sapiens
gucaaucauuugucacauu

SEQ ID NO: 752940 - RNA, 19 nt, Homo sapiens
guaauugaagggugugaaa

SEQ ID NO: 752941 - RNA, 19 nt, Homo sapiens
caacaaagcuacaaucaug

SEQ ID NO: 752942 - RNA, 19 nt, Homo sapiens
gaucagauguugagaguuu

SEQ ID NO: 752943 - RNA, 19 nt, Homo sapiens
ggaggaagcuaaacaagaa

SEQ ID NO: 752944 - RNA, 19 nt, Homo sapiens
gaagaaguguggaaauuga

SEQ ID NO: 752945 - RNA, 19 nt, Homo sapiens
gcacaauccuucuuugaaa

SEQ ID NO: 752946 - RNA, 19 nt, Homo sapiens
ugacaccuauugcaaauua

SEQ ID NO: 752947 - RNA, 19 nt, Homo sapiens
ugacgaagcuuaacauugu

SEQ ID NO: 752948 - RNA, 19 nt, Homo sapiens
gaaauuauagcucgaggua

SEQ ID NO: 752949 - RNA, 19 nt, Homo sapiens
guuaugaccuacagugaua

SEQ ID NO: 752950 - RNA, 19 nt, Homo sapiens
gaaccaggcugcauuaaaa

SEQ ID NO: 752951 - RNA, 19 nt, Homo sapiens
gagcagaguuggagaaucu

SEQ ID NO: 752952 - RNA, 19 nt, Homo sapiens
ucaccaagaugcauuuaaa

SEQ ID NO: 752953 - RNA, 19 nt, Homo sapiens
gaaugcuccuuguguuaua

SEQ ID NO: 752954 - RNA, 19 nt, Homo sapiens
ggaaguuguugaauucuug

SEQ ID NO: 752955 - RNA, 19 nt, Homo sapiens
gaccauaaaucaacuucuu

SEQ ID NO: 752956 - RNA, 19 nt, Homo sapiens
cagaggagcuuauauuugg

SEQ ID NO: 752957 - RNA, 19 nt, Homo sapiens
ggacagaggaucagauguu

SEQ ID NO: 752958 - RNA, 19 nt, Homo sapiens
guucagaucuucaguacug

SEQ ID NO: 752959 - RNA, 19 nt, Homo sapiens
gaaagaagaaguguggaaa

SEQ ID NO: 752960 - RNA, 19 nt, Homo sapiens
ugaaaugcuuugucaauca

SEQ ID NO: 752961 - RNA, 19 nt, Homo sapiens
acaaauggauguuaguaug

SEQ ID NO: 752962 - RNA, 19 nt, Homo sapiens
gaaaugcuuugucaaucau

SEQ ID NO: 752963 - RNA, 19 nt, Homo sapiens
gcagaggagcuuauauuug

SEQ ID NO: 752964 - RNA, 19 nt, Homo sapiens
gcacaaauggauguuagua

SEQ ID NO: 752965 - RNA, 19 nt, Homo sapiens
cgaauuugaugagauguuu

SEQ ID NO: 752966 - RNA, 19 nt, Homo sapiens
ggaagcuaaacaagaauua

SEQ ID NO: 752967 - RNA, 19 nt, Homo sapiens
caacaggugcuuccaguga

SEQ ID NO: 752968 - RNA, 19 nt, Homo sapiens
aaugacagauggaaugaaa

SEQ ID NO: 752969 - RNA, 19 nt, Homo sapiens
aagaagaaguguggaaauu

SEQ ID NO: 752970 - RNA, 19 nt, Homo sapiens
ggugugaaaugcuuuguca

SEQ ID NO: 752971 - RNA, 19 nt, Homo sapiens
gcgaaugcuccuuguguua

SEQ ID NO: 752972 - RNA, 19 nt, Homo sapiens
acaggaaguuguugaauuc

SEQ ID NO: 752973 - RNA, 19 nt, Homo sapiens
gaaacuaaguccagaaacc

SEQ ID NO: 752974 - RNA, 19 nt, Homo sapiens
gaacccgucugauucucuu

SEQ ID NO: 752975 - RNA, 19 nt, Homo sapiens
gagaaugacagauggaaug

SEQ ID NO: 752976 - RNA, 19 nt, Homo sapiens
caaggcagaccauaaauca

SEQ ID NO: 752977 - RNA, 19 nt, Homo sapiens
uacaggaaguuguugaauu

SEQ ID NO: 752978 - RNA, 19 nt, Homo sapiens
aaacauuucuucccauugg

SEQ ID NO: 752979 - RNA, 19 nt, Homo sapiens
aagaagagcuuggacacaa

SEQ ID NO: 752980 - RNA, 19 nt, Homo sapiens
aaagaacuaucaggauuga

SEQ ID NO: 752981 - RNA, 19 nt, Homo sapiens
gaaguguggaaauugauaa

SEQ ID NO: 752982 - RNA, 19 nt, Homo sapiens
gacagaggaucagauguug

SEQ ID NO: 752983 - RNA, 19 nt, Homo sapiens
gugaguguauguucaguga

SEQ ID NO: 752984 - RNA, 19 nt, Homo sapiens
caucacagcauaucaugaa

SEQ ID NO: 752985 - RNA, 19 nt, Homo sapiens
gagaagcugauguuccuuu

SEQ ID NO: 752986 - RNA, 19 nt, Homo sapiens
guacauuacguuccucuug

SEQ ID NO: 752987 - RNA, 19 nt, Homo sapiens
gaacaagaaauaagaaucc

SEQ ID NO: 752988 - RNA, 19 nt, Homo sapiens
ggagccagccguaucagaa

SEQ ID NO: 752989 - RNA, 19 nt, Homo sapiens
gcucaagcacucacacaaa

SEQ ID NO: 752990 - RNA, 19 nt, Homo sapiens
guaucgacaucauucaaga

SEQ ID NO: 752991 - RNA, 19 nt, Homo sapiens
gaaccgaccauauuacaac

SEQ ID NO: 752992 - RNA, 19 nt, Homo sapiens
ggacagaggggcacaguuu

SEQ ID NO: 752993 - RNA, 19 nt, Homo sapiens
ugaaggagcuggaguuuuc

SEQ ID NO: 752994 - RNA, 19 nt, Homo sapiens
gauccgaauuugaugagau

SEQ ID NO: 752995 - RNA, 19 nt, Homo sapiens
ggcagaggagcuuauauuu

SEQ ID NO: 752996 - RNA, 19 nt, Homo sapiens
aaacuucccagaggcauua

SEQ ID NO: 752997 - RNA, 19 nt, Homo sapiens
gggagaagcugauguuccu

SEQ ID NO: 752998 - RNA, 19 nt, Homo sapiens
uaaagaacuaucaggauug

SEQ ID NO: 752999 - RNA, 19 nt, Homo sapiens
gucaaucauuugucacauu

SEQ ID NO: 753000 - RNA, 19 nt, Homo sapiens
guaauugaagggugugaaa

SEQ ID NO: 753001 - RNA, 19 nt, Homo sapiens
cagauggaaugaaacuaga

SEQ ID NO: 753002 - RNA, 19 nt, Homo sapiens
gaccuuggauuaucugaac

SEQ ID NO: 753003 - RNA, 19 nt, Homo sapiens
uaugacaccuauugcaaau

SEQ ID NO: 753004 - RNA, 19 nt, Homo sapiens
ugaagggugugaaaugcuu

SEQ ID NO: 753005 - RNA, 19 nt, Homo sapiens
aagcagcuguugauggaaa

SEQ ID NO: 753006 - RNA, 19 nt, Homo sapiens
caacaacagggcuugauuc

SEQ ID NO: 753007 - RNA, 19 nt, Homo sapiens
caucgaacaagaaauaaga

SEQ ID NO: 753008 - RNA, 19 nt, Homo sapiens
cuacagugauacagggaaa

SEQ ID NO: 753009 - RNA, 19 nt, Homo sapiens
ggguacagauccauguuca

SEQ ID NO: 753010 - RNA, 19 nt, Homo sapiens
gugaaaugcuuugucaauc

SEQ ID NO: 753011 - RNA, 19 nt, Homo sapiens
gggaaacuaaguccagaaa

SEQ ID NO: 753012 - RNA, 19 nt, Homo sapiens
ugcaaugccuaucaacaaa

SEQ ID NO: 753013 - RNA, 19 nt, Homo sapiens
guguggaaauugauaacaa

SEQ ID NO: 753014 - RNA, 19 nt, Homo sapiens
uaaacccaaugaaggaguu

SEQ ID NO: 753015 - RNA, 19 nt, Homo sapiens
uugcugaaauggaugguuu

SEQ ID NO: 753016 - RNA, 19 nt, Homo sapiens
gcugaaacacagaauauag

SEQ ID NO: 753017 - RNA, 19 nt, Homo sapiens
agaacuaucaggauugaaa

SEQ ID NO: 753018 - RNA, 19 nt, Homo sapiens
uagcaucccauggcaaaua

SEQ ID NO: 753019 - RNA, 19 nt, Homo sapiens
ugucacauuuauccaguuu

SEQ ID NO: 753020 - RNA, 19 nt, Homo sapiens
cuaagggacucauaugaac

SEQ ID NO: 753021 - RNA, 19 nt, Homo sapiens
gaacccuucucccucucaa

SEQ ID NO: 753022 - RNA, 19 nt, Homo sapiens
ucacauuuauccaguuugg

SEQ ID NO: 753023 - RNA, 19 nt, Homo sapiens
gaaaacucauucuugaugu

SEQ ID NO: 753024 - RNA, 19 nt, Homo sapiens
gagcaaaacauaucuugaa

SEQ ID NO: 753025 - RNA, 19 nt, Homo sapiens
ggcgaaugcuccuuguguu

SEQ ID NO: 753026 - RNA, 19 nt, Homo sapiens
uggagaaucuugugaacca

SEQ ID NO: 753027 - RNA, 19 nt, Homo sapiens
aaucuccaaugcauccaua

SEQ ID NO: 753028 - RNA, 19 nt, Homo sapiens
cggcauuuauggacuucua

SEQ ID NO: 753029 - RNA, 19 nt, Homo sapiens
acagauugaucagcuggua

SEQ ID NO: 753030 - RNA, 19 nt, Homo sapiens
ugccaucgaacaagaaaua

SEQ ID NO: 753031 - RNA, 19 nt, Homo sapiens
ugaaucuggucaugccauu

SEQ ID NO: 753032 - RNA, 19 nt, Homo sapiens
gagccagccguaucagaaa

SEQ ID NO: 753033 - RNA, 19 nt, Homo sapiens
gaaggguacagauccaugu

SEQ ID NO: 753034 - RNA, 19 nt, Homo sapiens
gugaaaagcuuggaguuau

SEQ ID NO: 753035 - RNA, 19 nt, Homo sapiens
uggcagaggagcuuauauu

SEQ ID NO: 753036 - RNA, 19 nt, Homo sapiens
acaaaaccaucacagcaua

SEQ ID NO: 753037 - RNA, 19 nt, Homo sapiens
aaaagcagcuguugaugga

SEQ ID NO: 753038 - RNA, 19 nt, Homo sapiens
ugaaccaggcugcauuaaa

SEQ ID NO: 753039 - RNA, 19 nt, Homo sapiens
aaaggucgaacagaaauuu

SEQ ID NO: 753040 - RNA, 19 nt, Homo sapiens
uagcugaaacacagaauau

SEQ ID NO: 753041 - RNA, 19 nt, Homo sapiens
ggaggaaggucucaacgua

SEQ ID NO: 753042 - RNA, 19 nt, Homo sapiens
ccacagcauuccugaaaua

SEQ ID NO: 753043 - RNA, 19 nt, Homo sapiens
ggaaagacauggagauucu

SEQ ID NO: 753044 - RNA, 19 nt, Homo sapiens
aaacagacguuagguagua

SEQ ID NO: 753045 - RNA, 19 nt, Homo sapiens
gaaauugaauccacuaaac

SEQ ID NO: 753046 - RNA, 19 nt, Homo sapiens
uaccaagagucauucauua

SEQ ID NO: 753047 - RNA, 19 nt, Homo sapiens
caucugaacuaaugaaugu

SEQ ID NO: 753048 - RNA, 19 nt, Homo sapiens
caaagucacccucaauaaa

SEQ ID NO: 753049 - RNA, 19 nt, Homo sapiens
gcaauuggaacaaguuaaa

SEQ ID NO: 753050 - RNA, 19 nt, Homo sapiens
gcaccaggauauuggauug

SEQ ID NO: 753051 - RNA, 19 nt, Homo sapiens
cgacauccaucugaacuaa

SEQ ID NO: 753052 - RNA, 19 nt, Homo sapiens
gcaaaugcuuauccaugaa

SEQ ID NO: 753053 - RNA, 19 nt, Homo sapiens
caaaugaaauacugucaca

SEQ ID NO: 753054 - RNA, 19 nt, Homo sapiens
uaacucauguucuguacuu

SEQ ID NO: 753055 - RNA, 19 nt, Homo sapiens
ggagagaauuuacuguaca

SEQ ID NO: 753056 - RNA, 19 nt, Homo sapiens
ugaaauacauccaggaaag

SEQ ID NO: 753057 - RNA, 19 nt, Homo sapiens
gaagagcccuuggagagau

SEQ ID NO: 753058 - RNA, 19 nt, Homo sapiens
gauauuggauugccuagag

SEQ ID NO: 753059 - RNA, 19 nt, Homo sapiens
gagcaaguuuggauuaaag

SEQ ID NO: 753060 - RNA, 19 nt, Homo sapiens
caagagucauucauuacuu

SEQ ID NO: 753061 - RNA, 19 nt, Homo sapiens
gguaauagcaauagacguu

SEQ ID NO: 753062 - RNA, 19 nt, Homo sapiens
ccagauacuugcuuuaaag

SEQ ID NO: 753063 - RNA, 19 nt, Homo sapiens
gaagaggaaucggaguaga

SEQ ID NO: 753064 - RNA, 19 nt, Homo sapiens
gaccacagcauuccugaaa

SEQ ID NO: 753065 - RNA, 19 nt, Homo sapiens
ggagaggcauaaccgaaug

SEQ ID NO: 753066 - RNA, 19 nt, Homo sapiens
acaaaugcuugcucuacua

SEQ ID NO: 753067 - RNA, 19 nt, Homo sapiens
caacuacugcuuugcaauu

SEQ ID NO: 753068 - RNA, 19 nt, Homo sapiens
gaauguuccucuucagcaa

SEQ ID NO: 753069 - RNA, 19 nt, Homo sapiens
ggaauuugagagcguauuu

SEQ ID NO: 753070 - RNA, 19 nt, Homo sapiens
cgcaaaugcuuauccauga

SEQ ID NO: 753071 - RNA, 19 nt, Homo sapiens
caacguagggagaggcaua

SEQ ID NO: 753072 - RNA, 19 nt, Homo sapiens
agacacagaguucuaguaa

SEQ ID NO: 753073 - RNA, 19 nt, Homo sapiens
gcaauagacguuagugcaa

SEQ ID NO: 753074 - RNA, 19 nt, Homo sapiens
ccaugaauguccucuuaga

SEQ ID NO: 753075 - RNA, 19 nt, Homo sapiens
gagagaauuuacuguacau

SEQ ID NO: 753076 - RNA, 19 nt, Homo sapiens
gaaauacauccaggaaaga

SEQ ID NO: 753077 - RNA, 19 nt, Homo sapiens
aauagacguuagugcaaua

SEQ ID NO: 753078 - RNA, 19 nt, Homo sapiens
caaugaguggcuuuacuua

SEQ ID NO: 753079 - RNA, 19 nt, Homo sapiens
ggaguagaaugcgucaguu

SEQ ID NO: 753080 - RNA, 19 nt, Homo sapiens
caauuuacauacccacugu

SEQ ID NO: 753081 - RNA, 19 nt, Homo sapiens
aagucacccucaauaaaua

SEQ ID NO: 753082 - RNA, 19 nt, Homo sapiens
cagcauuccugaaauacau

SEQ ID NO: 753083 - RNA, 19 nt, Homo sapiens
uggauugccuagagcauuu

SEQ ID NO: 753084 - RNA, 19 nt, Homo sapiens
ugacauccuuuguacuuuc

SEQ ID NO: 753085 - RNA, 19 nt, Homo sapiens
ggacuuugagagcacauuu

SEQ ID NO: 753086 - RNA, 19 nt, Homo sapiens
ggacuccaguagggacuuu

SEQ ID NO: 753087 - RNA, 19 nt, Homo sapiens
ugaguugaaucucuuagug

SEQ ID NO: 753088 - RNA, 19 nt, Homo sapiens
gggagagaauuuacuguac

SEQ ID NO: 753089 - RNA, 19 nt, Homo sapiens
aaagucacccucaauaaau

SEQ ID NO: 753090 - RNA, 19 nt, Homo sapiens
acaaagucacccucaauaa

SEQ ID NO: 753091 - RNA, 19 nt, Homo sapiens
caauagacguuagugcaau

SEQ ID NO: 753092 - RNA, 19 nt, Homo sapiens
aacaagcacugaagaggaa

SEQ ID NO: 753093 - RNA, 19 nt, Homo sapiens
guaauagcaauagacguua

SEQ ID NO: 753094 - RNA, 19 nt, Homo sapiens
acgcuuaaaugccacguuu

SEQ ID NO: 753095 - RNA, 19 nt, Homo sapiens
cacaguagacgcuuaaaug

SEQ ID NO: 753096 - RNA, 19 nt, Homo sapiens
uggcuuuacuuaucaauca

SEQ ID NO: 753097 - RNA, 19 nt, Homo sapiens
gugaugaguugaaucucuu

SEQ ID NO: 753098 - RNA, 19 nt, Homo sapiens
ucuaguaacucauguucug

SEQ ID NO: 753099 - RNA, 19 nt, Homo sapiens
ucacagacacagaguucua

SEQ ID NO: 753100 - RNA, 19 nt, Homo sapiens
uacaaagucacccucaaua

SEQ ID NO: 753101 - RNA, 19 nt, Homo sapiens
ugaguggcuuuacuuauca

SEQ ID NO: 753102 - RNA, 19 nt, Homo sapiens
ugagucacgugcugcugua

SEQ ID NO: 753103 - RNA, 19 nt, Homo sapiens
aaauugacauccuuuguac

SEQ ID NO: 753104 - RNA, 19 nt, Homo sapiens
auccaugaauguccucuua

SEQ ID NO: 753105 - RNA, 19 nt, Homo sapiens
caagugaucggacugaaca

SEQ ID NO: 753106 - RNA, 19 nt, Homo sapiens
ugagcaaguuuggauuaaa

SEQ ID NO: 753107 - RNA, 19 nt, Homo sapiens
gagaagcagcgcuaugcaa

SEQ ID NO: 753108 - RNA, 19 nt, Homo sapiens
caagaaauugaauccacua

SEQ ID NO: 753109 - RNA, 19 nt, Homo sapiens
gucacgugcugcuguauug

SEQ ID NO: 753110 - RNA, 19 nt, Homo sapiens
acacgcagcugcagcacau

SEQ ID NO: 753111 - RNA, 19 nt, Homo sapiens
gcucaacaauuugguaacu

SEQ ID NO: 753112 - RNA, 19 nt, Homo sapiens
gcaaacaagcacugaagag

SEQ ID NO: 753113 - RNA, 19 nt, Homo sapiens
gcagcgcuaugcaaacaag

SEQ ID NO: 753114 - RNA, 19 nt, Homo sapiens
guuaucagcaagaaauuga

SEQ ID NO: 753115 - RNA, 19 nt, Homo sapiens
gacguuagugcaauacaaa

SEQ ID NO: 753116 - RNA, 19 nt, Homo sapiens
caacagguaauagcaauag

SEQ ID NO: 753117 - RNA, 19 nt, Homo sapiens
cacaacagguaauagcaau

SEQ ID NO: 753118 - RNA, 19 nt, Homo sapiens
ucaaucacaacagguaaua

SEQ ID NO: 753119 - RNA, 19 nt, Homo sapiens
guccacaaaugaaauacug

SEQ ID NO: 753120 - RNA, 19 nt, Homo sapiens
gauagaaggcgcagaaucc

SEQ ID NO: 753121 - RNA, 19 nt, Homo sapiens
aggcauaaccgaauggaaa

SEQ ID NO: 753122 - RNA, 19 nt, Homo sapiens
ugacggagguggaguacac

SEQ ID NO: 753123 - RNA, 19 nt, Homo sapiens
cauuugcugugaugaguug

SEQ ID NO: 753124 - RNA, 19 nt, Homo sapiens
ccugagcaaguuuggauua

SEQ ID NO: 753125 - RNA, 19 nt, Homo sapiens
gacguuagguaguagaaac

SEQ ID NO: 753126 - RNA, 19 nt, Homo sapiens
acauccaucugaacuaaug

SEQ ID NO: 753127 - RNA, 19 nt, Homo sapiens
acuacugcuuugcaauuua

SEQ ID NO: 753128 - RNA, 19 nt, Homo sapiens
agacguuagugcaauacaa

SEQ ID NO: 753129 - RNA, 19 nt, Homo sapiens
ucaacaauuugguaacucu

SEQ ID NO: 753130 - RNA, 19 nt, Homo sapiens
ucaaugaguggcuuuacuu

SEQ ID NO: 753131 - RNA, 19 nt, Homo sapiens
gcgcucaacaauuugguaa

SEQ ID NO: 753132 - RNA, 19 nt, Homo sapiens
gaaaagggcgugacucaag

SEQ ID NO: 753133 - RNA, 19 nt, Homo sapiens
ucaguuggacacaaaugua

SEQ ID NO: 753134 - RNA, 19 nt, Homo sapiens
agaagcagcgcuaugcaaa

SEQ ID NO: 753135 - RNA, 19 nt, Homo sapiens
uaauagcaauagacguuag

SEQ ID NO: 753136 - RNA, 19 nt, Homo sapiens
cauccuuuguacuuucuuu

SEQ ID NO: 753137 - RNA, 19 nt, Homo sapiens
guuagguaguagaaacaaa

SEQ ID NO: 753138 - RNA, 19 nt, Homo sapiens
agacuagaccuuuguaugg

SEQ ID NO: 753139 - RNA, 19 nt, Homo sapiens
uccagauacuugcuuuaaa

SEQ ID NO: 753140 - RNA, 19 nt, Homo sapiens
gagcguauuuugcgguaaa

SEQ ID NO: 753141 - RNA, 19 nt, Homo sapiens
gaacagacaucucuucuaa

SEQ ID NO: 753142 - RNA, 19 nt, Homo sapiens
gaaaugaacagguaucuaa

SEQ ID NO: 753143 - RNA, 19 nt, Homo sapiens
gaacagguaucuaaagaau

SEQ ID NO: 753144 - RNA, 19 nt, Homo sapiens
guacagcuuugacaauuua

SEQ ID NO: 753145 - RNA, 19 nt, Homo sapiens
acagacaucucuucuaaua

SEQ ID NO: 753146 - RNA, 19 nt, Homo sapiens
gggagaagaucgaggauuu

SEQ ID NO: 753147 - RNA, 19 nt, Homo sapiens
guacaaagcaggaauggua

SEQ ID NO: 753148 - RNA, 19 nt, Homo sapiens
ugaaagaccugauaacaau

SEQ ID NO: 753149 - RNA, 19 nt, Homo sapiens
gaaacauccuucuaucuug

SEQ ID NO: 753150 - RNA, 19 nt, Homo sapiens
gaaaagacauccaguaguu

SEQ ID NO: 753151 - RNA, 19 nt, Homo sapiens
gaagauagcaauuaugugu

SEQ ID NO: 753152 - RNA, 19 nt, Homo sapiens
guggaagacucaauugaua

SEQ ID NO: 753153 - RNA, 19 nt, Homo sapiens
caguauaagugguaguuua

SEQ ID NO: 753154 - RNA, 19 nt, Homo sapiens
guaugcaucucaagaauau

SEQ ID NO: 753155 - RNA, 19 nt, Homo sapiens
aaacuugagucacuuacua

SEQ ID NO: 753156 - RNA, 19 nt, Homo sapiens
cuuaaucccucuaugguua

SEQ ID NO: 753157 - RNA, 19 nt, Homo sapiens
ucaauaugcuuccagguuu

SEQ ID NO: 753158 - RNA, 19 nt, Homo sapiens
gaaugaaacuugagucacu

SEQ ID NO: 753159 - RNA, 19 nt, Homo sapiens
cuacagagcugaguccauu

SEQ ID NO: 753160 - RNA, 19 nt, Homo sapiens
gcaggagugucuucuauca

SEQ ID NO: 753161 - RNA, 19 nt, Homo sapiens
ggaccuuauucaccaguua

SEQ ID NO: 753162 - RNA, 19 nt, Homo sapiens
ggacuuggucuuacaacua

SEQ ID NO: 753163 - RNA, 19 nt, Homo sapiens
gaaaucaagaaaccaguaa

SEQ ID NO: 753164 - RNA, 19 nt, Homo sapiens
caagaaaccaguaauagug

SEQ ID NO: 753165 - RNA, 19 nt, Homo sapiens
gcuggcaacucaacugaaa

SEQ ID NO: 753166 - RNA, 19 nt, Homo sapiens
ucacagggauguuguaucu

SEQ ID NO: 753167 - RNA, 19 nt, Homo sapiens
uuagaaaugugccauaaug

SEQ ID NO: 753168 - RNA, 19 nt, Homo sapiens
gagcaucuuucaacagaau

SEQ ID NO: 753169 - RNA, 19 nt, Homo sapiens
ggucagccacucccaaaua

SEQ ID NO: 753170 - RNA, 19 nt, Homo sapiens
ucuuggagcuuuauaacua

SEQ ID NO: 753171 - RNA, 19 nt, Homo sapiens
agacaucucuucuaauagu

SEQ ID NO: 753172 - RNA, 19 nt, Homo sapiens
gaauggucaugcauaguga

SEQ ID NO: 753173 - RNA, 19 nt, Homo sapiens
caaauuacccaacgagaga

SEQ ID NO: 753174 - RNA, 19 nt, Homo sapiens
ucagauaucuagugaugga

SEQ ID NO: 753175 - RNA, 19 nt, Homo sapiens
guugguugcucacagguua

SEQ ID NO: 753176 - RNA, 19 nt, Homo sapiens
uaagaaagccauguacaaa

SEQ ID NO: 753177 - RNA, 19 nt, Homo sapiens
uaacaaagcagaaugaaac

SEQ ID NO: 753178 - RNA, 19 nt, Homo sapiens
gauagagcaucuuucaaca

SEQ ID NO: 753179 - RNA, 19 nt, Homo sapiens
gguacagcuuugacaauuu

SEQ ID NO: 753180 - RNA, 19 nt, Homo sapiens
ggaaaucaagaaaccagua

SEQ ID NO: 753181 - RNA, 19 nt, Homo sapiens
caaagcagaaugaaacuug

SEQ ID NO: 753182 - RNA, 19 nt, Homo sapiens
gagauaauccaacaagaau

SEQ ID NO: 753183 - RNA, 19 nt, Homo sapiens
uaacuacauuucaccagaa

SEQ ID NO: 753184 - RNA, 19 nt, Homo sapiens
acagguaucuaaagaauag

SEQ ID NO: 753185 - RNA, 19 nt, Homo sapiens
ggccagagccugaaauaug

SEQ ID NO: 753186 - RNA, 19 nt, Homo sapiens
acaccugacuuugcucuua

SEQ ID NO: 753187 - RNA, 19 nt, Homo sapiens
uagagcaucuuucaacaga

SEQ ID NO: 753188 - RNA, 19 nt, Homo sapiens
aaauagaacaccugacuuu

SEQ ID NO: 753189 - RNA, 19 nt, Homo sapiens
gaaaucugcuugguaaagg

SEQ ID NO: 753190 - RNA, 19 nt, Homo sapiens
gaucgaggauuuuaaaguu

SEQ ID NO: 753191 - RNA, 19 nt, Homo sapiens
ccucuaugguuacaaauga

SEQ ID NO: 753192 - RNA, 19 nt, Homo sapiens
guguggagcuuguaaagga

SEQ ID NO: 753193 - RNA, 19 nt, Homo sapiens
ggagaacuuuccgugguuu

SEQ ID NO: 753194 - RNA, 19 nt, Homo sapiens
cacauggccuugaaucuga

SEQ ID NO: 753195 - RNA, 19 nt, Homo sapiens
uuggaaaucugcuugguaa

SEQ ID NO: 753196 - RNA, 19 nt, Homo sapiens
cauaaagucuucagaaagc

SEQ ID NO: 753197 - RNA, 19 nt, Homo sapiens
cagacuacaucaaacagaa

SEQ ID NO: 753198 - RNA, 19 nt, Homo sapiens
gaguaugcaucucaagaau

SEQ ID NO: 753199 - RNA, 19 nt, Homo sapiens
ggaguaugcaucucaagaa

SEQ ID NO: 753200 - RNA, 19 nt, Homo sapiens
gauaauccaacaagaaugu

SEQ ID NO: 753201 - RNA, 19 nt, Homo sapiens
gucagccacucccaaauaa

SEQ ID NO: 753202 - RNA, 19 nt, Homo sapiens
gauuaaaacuccuuucaga

SEQ ID NO: 753203 - RNA, 19 nt, Homo sapiens
gaacucugaugcuucugau

SEQ ID NO: 753204 - RNA, 19 nt, Homo sapiens
ccaaauggucaaacaacua

SEQ ID NO: 753205 - RNA, 19 nt, Homo sapiens
ccaauaaucauaggaagaa

SEQ ID NO: 753206 - RNA, 19 nt, Homo sapiens
cuucagauaucuagugaug

SEQ ID NO: 753207 - RNA, 19 nt, Homo sapiens
ccaguuacuucguagaaau

SEQ ID NO: 753208 - RNA, 19 nt, Homo sapiens
gggagaacuuuccgugguu

SEQ ID NO: 753209 - RNA, 19 nt, Homo sapiens
cuaauccgacuccuaauuu

SEQ ID NO: 753210 - RNA, 19 nt, Homo sapiens
ggaacagacaucucuucua

SEQ ID NO: 753211 - RNA, 19 nt, Homo sapiens
acacaggcaccaauccuua

SEQ ID NO: 753212 - RNA, 19 nt, Homo sapiens
caagcacucuccaaucauc

SEQ ID NO: 753213 - RNA, 19 nt, Homo sapiens
uuaagucugucuucaguau

SEQ ID NO: 753214 - RNA, 19 nt, Homo sapiens
gaaauccagcagaucguuu

SEQ ID NO: 753215 - RNA, 19 nt, Homo sapiens
uaucuucauucucauggua

SEQ ID NO: 753216 - RNA, 19 nt, Homo sapiens
ugaaacauccuucuaucuu

SEQ ID NO: 753217 - RNA, 19 nt, Homo sapiens
guacagcuucuaagaucua

SEQ ID NO: 753218 - RNA, 19 nt, Homo sapiens
gcagaagaaaggccacauu

SEQ ID NO: 753219 - RNA, 19 nt, Homo sapiens
ggaagaguaauucaagaug

SEQ ID NO: 753220 - RNA, 19 nt, Homo sapiens
gcacauggccuugaaucug

SEQ ID NO: 753221 - RNA, 19 nt, Homo sapiens
gauguuguaucuucauucu

SEQ ID NO: 753222 - RNA, 19 nt, Homo sapiens
ucacagugguuuggaaguu

SEQ ID NO: 753223 - RNA, 19 nt, Homo sapiens
aguuauaccucaccaaaug

SEQ ID NO: 753224 - RNA, 19 nt, Homo sapiens
cgaagggacugcguaagga

SEQ ID NO: 753225 - RNA, 19 nt, Homo sapiens
gccagagccugaaauaugg

SEQ ID NO: 753226 - RNA, 19 nt, Homo sapiens
caauaugcuuccagguuug

SEQ ID NO: 753227 - RNA, 19 nt, Homo sapiens
caguaaaccugagauaauc

SEQ ID NO: 753228 - RNA, 19 nt, Homo sapiens
ccagggccauccagauuug

SEQ ID NO: 753229 - RNA, 19 nt, Homo sapiens
uugggaaucugcaaauaaa

SEQ ID NO: 753230 - RNA, 19 nt, Homo sapiens
caacagugguuugggaauc

SEQ ID NO: 753231 - RNA, 19 nt, Homo sapiens
gaucuggcacuucuaauag

SEQ ID NO: 753232 - RNA, 19 nt, Homo sapiens
acagggauguuguaucuuc

SEQ ID NO: 753233 - RNA, 19 nt, Homo sapiens
ugguugggcuacacaguua

SEQ ID NO: 753234 - RNA, 19 nt, Homo sapiens
ugagauaauccaacaagaa

SEQ ID NO: 753235 - RNA, 19 nt, Homo sapiens
gggcaugccacaauuucua

SEQ ID NO: 753236 - RNA, 19 nt, Homo sapiens
cuacugacucguaauauga

SEQ ID NO: 753237 - RNA, 19 nt, Homo sapiens
gcuacacaguuaacuagug

SEQ ID NO: 753238 - RNA, 19 nt, Homo sapiens
uacaagauaugcuaaaugc

SEQ ID NO: 753239 - RNA, 19 nt, Homo sapiens
gaacuccuaacuacauuuc

SEQ ID NO: 753240 - RNA, 19 nt, Homo sapiens
gagugaaacccuucucaga

SEQ ID NO: 753241 - RNA, 19 nt, Homo sapiens
cuacagagcuggauauuga

SEQ ID NO: 753242 - RNA, 19 nt, Homo sapiens
uaacagagcaguuuaauga

SEQ ID NO: 753243 - RNA, 19 nt, Homo sapiens
ugaaagggcuguacgguaa

SEQ ID NO: 753244 - RNA, 19 nt, Homo sapiens
ugaccacgcugcuuacuua

SEQ ID NO: 753245 - RNA, 19 nt, Homo sapiens
ugaaagagauggaggaaga

SEQ ID NO: 753246 - RNA, 19 nt, Homo sapiens
gaauggcgacucuuuguua

SEQ ID NO: 753247 - RNA, 19 nt, Homo sapiens
ggacgaggaagaagaguua

SEQ ID NO: 753248 - RNA, 19 nt, Homo sapiens
agaagcagcugucgaguuu

SEQ ID NO: 753249 - RNA, 19 nt, Homo sapiens
gcagccagcuaguagauuu

SEQ ID NO: 753250 - RNA, 19 nt, Homo sapiens
gaaagggucccgaguggua

SEQ ID NO: 753251 - RNA, 19 nt, Homo sapiens
ggaggaucauuuacagaua

SEQ ID NO: 753252 - RNA, 19 nt, Homo sapiens
gacagggacucaaaccaua

SEQ ID NO: 753253 - RNA, 19 nt, Homo sapiens
guagaugaguggcuggaua

SEQ ID NO: 753254 - RNA, 19 nt, Homo sapiens
ggaagaagaguuagaaauc

SEQ ID NO: 753255 - RNA, 19 nt, Homo sapiens
ggagcaggcuuuugucuua

SEQ ID NO: 753256 - RNA, 19 nt, Homo sapiens
acaacaaguucuacaauga

SEQ ID NO: 753257 - RNA, 19 nt, Homo sapiens
ggaagggcuuaaccucuaa

SEQ ID NO: 753258 - RNA, 19 nt, Homo sapiens
ugaagacacugacuuugaa

SEQ ID NO: 753259 - RNA, 19 nt, Homo sapiens
gcgaauuucuguacuggaa

SEQ ID NO: 753260 - RNA, 19 nt, Homo sapiens
guucuuggguccacaauau

SEQ ID NO: 753261 - RNA, 19 nt, Homo sapiens
guuggacucugcaugauaa

SEQ ID NO: 753262 - RNA, 19 nt, Homo sapiens
gaugaugaaugcccucuuc

SEQ ID NO: 753263 - RNA, 19 nt, Homo sapiens
ccuaaugauucgcucaaua

SEQ ID NO: 753264 - RNA, 19 nt, Homo sapiens
gggcagcaccucuguguuu

SEQ ID NO: 753265 - RNA, 19 nt, Homo sapiens
ggacuacccucucauagcu

SEQ ID NO: 753266 - RNA, 19 nt, Homo sapiens
gaucuacuucucaucuuua

SEQ ID NO: 753267 - RNA, 19 nt, Homo sapiens
gcuuugaccuccacaucua

SEQ ID NO: 753268 - RNA, 19 nt, Homo sapiens
gcaccucuguguuuaaugg

SEQ ID NO: 753269 - RNA, 19 nt, Homo sapiens
gguguuggaugcaaagcua

SEQ ID NO: 753270 - RNA, 19 nt, Homo sapiens
ggagcuccuuucagaguuu

SEQ ID NO: 753271 - RNA, 19 nt, Homo sapiens
ucaagaagauguccaacuc

SEQ ID NO: 753272 - RNA, 19 nt, Homo sapiens
cuaaugauucgcucaauaa

SEQ ID NO: 753273 - RNA, 19 nt, Homo sapiens
ccuugacucuugucuauuu

SEQ ID NO: 753274 - RNA, 19 nt, Homo sapiens
gcacugggcgcuuggagaa

SEQ ID NO: 753275 - RNA, 19 nt, Homo sapiens
uaugauggcuucccuaugg

SEQ ID NO: 753276 - RNA, 19 nt, Homo sapiens
gaggaucauuuacagauag

SEQ ID NO: 753277 - RNA, 19 nt, Homo sapiens
agaccaggaugcaggauuu

SEQ ID NO: 753278 - RNA, 19 nt, Homo sapiens
ggcagcaccucuguguuua

SEQ ID NO: 753279 - RNA, 19 nt, Homo sapiens
gaugcagccucagauguuu

SEQ ID NO: 753280 - RNA, 19 nt, Homo sapiens
acaaucagcgucaguauga

SEQ ID NO: 753281 - RNA, 19 nt, Homo sapiens
cugaugaccucccugguaa

SEQ ID NO: 753282 - RNA, 19 nt, Homo sapiens
gcaccuaacagagcaguuu

SEQ ID NO: 753283 - RNA, 19 nt, Homo sapiens
cccauagucuccuggauuu

SEQ ID NO: 753284 - RNA, 19 nt, Homo sapiens
gaagaagaguuagaaaucc

SEQ ID NO: 753285 - RNA, 19 nt, Homo sapiens
caaggaaacauuaacuaga

SEQ ID NO: 753286 - RNA, 19 nt, Homo sapiens
aagcuacucuccagucuga

SEQ ID NO: 753287 - RNA, 19 nt, Homo sapiens
gagagcacacugauagaaa

SEQ ID NO: 753288 - RNA, 19 nt, Homo sapiens
gggcagcuucugugaauuu

SEQ ID NO: 753289 - RNA, 19 nt, Homo sapiens
ccugagauguucaagaaga

SEQ ID NO: 753290 - RNA, 19 nt, Homo sapiens
aaacaacaccgguggcaaa

SEQ ID NO: 753291 - RNA, 19 nt, Homo sapiens
ggaagaggacgaggaagaa

SEQ ID NO: 753292 - RNA, 19 nt, Homo sapiens
ccaaucagccuccaaaucu

SEQ ID NO: 753293 - RNA, 19 nt, Homo sapiens
cagggcagcuucugugaau

SEQ ID NO: 753294 - RNA, 19 nt, Homo sapiens
gagaucauccagcaccuaa

SEQ ID NO: 753295 - RNA, 19 nt, Homo sapiens
gagaaaaggagcaaaauga

SEQ ID NO: 753296 - RNA, 19 nt, Homo sapiens
ggaugcagccucagauguu

SEQ ID NO: 753297 - RNA, 19 nt, Homo sapiens
aggaagggcuuaaccucua

SEQ ID NO: 753298 - RNA, 19 nt, Homo sapiens
cacccuggcugcuaugaaa

SEQ ID NO: 753299 - RNA, 19 nt, Homo sapiens
aagaaagucugcagcugaa

SEQ ID NO: 753300 - RNA, 19 nt, Homo sapiens
gauccgugcuaucugcauu

SEQ ID NO: 753301 - RNA, 19 nt, Homo sapiens
gggcuggaccucuuagauu

SEQ ID NO: 753302 - RNA, 19 nt, Homo sapiens
aagcagcugucgaguuuga

SEQ ID NO: 753303 - RNA, 19 nt, Homo sapiens
gcaggagagcacacugaua

SEQ ID NO: 753304 - RNA, 19 nt, Homo sapiens
guaugaggcugaaagaaac

SEQ ID NO: 753305 - RNA, 19 nt, Homo sapiens
gcaccgagaggucaagguu

SEQ ID NO: 753306 - RNA, 19 nt, Homo sapiens
gcucuguaaucccgaauuc

SEQ ID NO: 753307 - RNA, 19 nt, Homo sapiens
ggagagcacacugauagaa

SEQ ID NO: 753308 - RNA, 19 nt, Homo sapiens
ggauguaaaggcauuguga

SEQ ID NO: 753309 - RNA, 19 nt, Homo sapiens
uacaacaaguucuacaaug

SEQ ID NO: 753310 - RNA, 19 nt, Homo sapiens
uagaugaggaugagguaua

SEQ ID NO: 753311 - RNA, 19 nt, Homo sapiens
gcaagacccaagccgauga

SEQ ID NO: 753312 - RNA, 19 nt, Homo sapiens
gcaaaacgaccaccgaaaa

SEQ ID NO: 753313 - RNA, 19 nt, Homo sapiens
ggauauugaggauuucuga

SEQ ID NO: 753314 - RNA, 19 nt, Homo sapiens
ggagguuugccuugaguuu

SEQ ID NO: 753315 - RNA, 19 nt, Homo sapiens
gaagagagcagcaaaacga

SEQ ID NO: 753316 - RNA, 19 nt, Homo sapiens
ugacuauggugacauuauc

SEQ ID NO: 753317 - RNA, 19 nt, Homo sapiens
ugaucuacuucucaucuuu

SEQ ID NO: 753318 - RNA, 19 nt, Homo sapiens
gaaugguggccuucuguga

SEQ ID NO: 753319 - RNA, 19 nt, Homo sapiens
acacuaacccacauuucua

SEQ ID NO: 753320 - RNA, 19 nt, Homo sapiens
uaguagauuugcugacuga

SEQ ID NO: 753321 - RNA, 19 nt, Homo sapiens
agaagcaccuggagcuguu

SEQ ID NO: 753322 - RNA, 19 nt, Homo sapiens
gaugacagggugaaguuga

SEQ ID NO: 753323 - RNA, 19 nt, Homo sapiens
ugacaugcagucuuuggua

SEQ ID NO: 753324 - RNA, 19 nt, Homo sapiens
cgucauagccggaaacagu

SEQ ID NO: 753325 - RNA, 19 nt, Homo sapiens
ggcaaaacauccaaagaaa

SEQ ID NO: 753326 - RNA, 19 nt, Homo sapiens
ggcuggaccucuuagauuc

SEQ ID NO: 753327 - RNA, 19 nt, Homo sapiens
caaggaaggcauccaguuc

SEQ ID NO: 753328 - RNA, 19 nt, Homo sapiens
ggauuucuggagcuuguua

SEQ ID NO: 753329 - RNA, 19 nt, Homo sapiens
ccaaugaucuuuucaaugc

SEQ ID NO: 753330 - RNA, 19 nt, Homo sapiens
ggaauggcgacucuuuguu

SEQ ID NO: 753331 - RNA, 19 nt, Homo sapiens
gaaagucugcagcugaaca

SEQ ID NO: 753332 - RNA, 19 nt, Homo sapiens
ccagcuggcuccuccaauc

SEQ ID NO: 753333 - RNA, 19 nt, Homo sapiens
aaggaaacauuaacuagag

SEQ ID NO: 753334 - RNA, 19 nt, Homo sapiens
gcuaguagauuugcugacu

SEQ ID NO: 753335 - RNA, 19 nt, Homo sapiens
caggagagcacacugauag

SEQ ID NO: 753336 - RNA, 19 nt, Homo sapiens
ugacggacgcggauuguga

SEQ ID NO: 753337 - RNA, 19 nt, Homo sapiens
cagcuucugugaauuugug

SEQ ID NO: 753338 - RNA, 19 nt, Homo sapiens
augauucgcucaauaaaca

SEQ ID NO: 753339 - RNA, 19 nt, Homo sapiens
guacagggauguccuuccu

SEQ ID NO: 753340 - RNA, 19 nt, Homo sapiens
gcccggagguuugccuuga

SEQ ID NO: 753341 - RNA, 19 nt, Homo sapiens
caacucaccuccacuauua

SEQ ID NO: 753342 - RNA, 19 nt, Homo sapiens
gauagcagcuccagaaaua

SEQ ID NO: 753343 - RNA, 19 nt, Homo sapiens
gaacaggccuucacuauuc

SEQ ID NO: 753344 - RNA, 19 nt, Homo sapiens
gaagucaacugauagauga

SEQ ID NO: 753345 - RNA, 19 nt, Homo sapiens
gaaagcagcucuacaaagg

SEQ ID NO: 753346 - RNA, 19 nt, Homo sapiens
ggaaagagcuucaggaaaa

SEQ ID NO: 753347 - RNA, 19 nt, Homo sapiens
gcagauaucuucaaacagu

SEQ ID NO: 753348 - RNA, 19 nt, Homo sapiens
gaaauuuacuugcagcauu

SEQ ID NO: 753349 - RNA, 19 nt, Homo sapiens
ggaugaagauguauaguga

SEQ ID NO: 753350 - RNA, 19 nt, Homo sapiens
ggagagccauccaccuuua

SEQ ID NO: 753351 - RNA, 19 nt, Homo sapiens
gaauacagcugcagauauc

SEQ ID NO: 753352 - RNA, 19 nt, Homo sapiens
acaaagagcuuaauuccaa

SEQ ID NO: 753353 - RNA, 19 nt, Homo sapiens
acacaaagauggcauagaa

SEQ ID NO: 753354 - RNA, 19 nt, Homo sapiens
cuacugagcugcugaaaga

SEQ ID NO: 753355 - RNA, 19 nt, Homo sapiens
guacggcaaugucaauaua

SEQ ID NO: 753356 - RNA, 19 nt, Homo sapiens
gcacaagccuaauggaaga

SEQ ID NO: 753357 - RNA, 19 nt, Homo sapiens
ggagauaucaucaaagaaa

SEQ ID NO: 753358 - RNA, 19 nt, Homo sapiens
gcacacagauacagauguu

SEQ ID NO: 753359 - RNA, 19 nt, Homo sapiens
guacauagauaccgugaug

SEQ ID NO: 753360 - RNA, 19 nt, Homo sapiens
cgacagauccggaauauug

SEQ ID NO: 753361 - RNA, 19 nt, Homo sapiens
gcauuuggaugaagaugua

SEQ ID NO: 753362 - RNA, 19 nt, Homo sapiens
ggugguagaugauuggaua

SEQ ID NO: 753363 - RNA, 19 nt, Homo sapiens
gagaagaaauuuacuugca

SEQ ID NO: 753364 - RNA, 19 nt, Homo sapiens
gcacaagagaagaaauuua

SEQ ID NO: 753365 - RNA, 19 nt, Homo sapiens
gcaguugccucaguacuuu

SEQ ID NO: 753366 - RNA, 19 nt, Homo sapiens
gaauaaacguaaaggacaa

SEQ ID NO: 753367 - RNA, 19 nt, Homo sapiens
ugaagaaccugaugaagau

SEQ ID NO: 753368 - RNA, 19 nt, Homo sapiens
cagcauaccuuguggauag

SEQ ID NO: 753369 - RNA, 19 nt, Homo sapiens
uaagcaaggugaaguaaga

SEQ ID NO: 753370 - RNA, 19 nt, Homo sapiens
gggcaaagguggaaaugga

SEQ ID NO: 753371 - RNA, 19 nt, Homo sapiens
ugaauucauuggcguguua

SEQ ID NO: 753372 - RNA, 19 nt, Homo sapiens
gaauacuacuguuaaggaa

SEQ ID NO: 753373 - RNA, 19 nt, Homo sapiens
ugaagaggaucacugcuuu

SEQ ID NO: 753374 - RNA, 19 nt, Homo sapiens
caaagaauaugauguugca

SEQ ID NO: 753375 - RNA, 19 nt, Homo sapiens
cuacaagggcuuuauuaua

SEQ ID NO: 753376 - RNA, 19 nt, Homo sapiens
gaagaaaguaguaguagug

SEQ ID NO: 753377 - RNA, 19 nt, Homo sapiens
aguagcagcuggagaauuu

SEQ ID NO: 753378 - RNA, 19 nt, Homo sapiens
gaugacagcuuuggugaau

SEQ ID NO: 753379 - RNA, 19 nt, Homo sapiens
cagaguagauauuucaaga

SEQ ID NO: 753380 - RNA, 19 nt, Homo sapiens
ggauugaggaucuuaauga

SEQ ID NO: 753381 - RNA, 19 nt, Homo sapiens
gaaauaaugcuuuguacca

SEQ ID NO: 753382 - RNA, 19 nt, Homo sapiens
ccaaaugccaaccuuguua

SEQ ID NO: 753383 - RNA, 19 nt, Homo sapiens
gagauuggcauuuggauga

SEQ ID NO: 753384 - RNA, 19 nt, Homo sapiens
uagaugaauuggcagauaa

SEQ ID NO: 753385 - RNA, 19 nt, Homo sapiens
guagauauuucaagaaguc

SEQ ID NO: 753386 - RNA, 19 nt, Homo sapiens
gaaguaagacucaaauguc

SEQ ID NO: 753387 - RNA, 19 nt, Homo sapiens
ugaugaagaugaugcauau

SEQ ID NO: 753388 - RNA, 19 nt, Homo sapiens
gaggaagcacuaacagaua

SEQ ID NO: 753389 - RNA, 19 nt, Homo sapiens
cagcagaaauguuuagaca

SEQ ID NO: 753390 - RNA, 19 nt, Homo sapiens
ggaacaggccuucacuauu

SEQ ID NO: 753391 - RNA, 19 nt, Homo sapiens
caacagaguagauauuuca

SEQ ID NO: 753392 - RNA, 19 nt, Homo sapiens
guagagaagcacacagaua

SEQ ID NO: 753393 - RNA, 19 nt, Homo sapiens
cagcuucaauuauggauga

SEQ ID NO: 753394 - RNA, 19 nt, Homo sapiens
caaagauggcauagaauuu

SEQ ID NO: 753395 - RNA, 19 nt, Homo sapiens
gaguagauauuucaagaag

SEQ ID NO: 753396 - RNA, 19 nt, Homo sapiens
gggaauguaugaauagcuu

SEQ ID NO: 753397 - RNA, 19 nt, Homo sapiens
agaauaugauguugcagua

SEQ ID NO: 753398 - RNA, 19 nt, Homo sapiens
gaaaguaguaguagugaca

SEQ ID NO: 753399 - RNA, 19 nt, Homo sapiens
gaacaggaugaugauaaua

SEQ ID NO: 753400 - RNA, 19 nt, Homo sapiens
ccagaaauaccaacugauu

SEQ ID NO: 753401 - RNA, 19 nt, Homo sapiens
ugaaguugaugacagcuuu

SEQ ID NO: 753402 - RNA, 19 nt, Homo sapiens
acagucauuucacuucuua

SEQ ID NO: 753403 - RNA, 19 nt, Homo sapiens
gagaguauuuugucagaua

SEQ ID NO: 753404 - RNA, 19 nt, Homo sapiens
ggacaaguaaacaauuuga

SEQ ID NO: 753405 - RNA, 19 nt, Homo sapiens
aaacguaaaggacaaguaa

SEQ ID NO: 753406 - RNA, 19 nt, Homo sapiens
aaaggugacuaacuuguug

SEQ ID NO: 753407 - RNA, 19 nt, Homo sapiens
ucuaucaucugguuuauuc

SEQ ID NO: 753408 - RNA, 19 nt, Homo sapiens
gagaauaugacaugcuuau

SEQ ID NO: 753409 - RNA, 19 nt, Homo sapiens
gacaguaugugguuaagca

SEQ ID NO: 753410 - RNA, 19 nt, Homo sapiens
uccagaagaugauaaagaa

SEQ ID NO: 753411 - RNA, 19 nt, Homo sapiens
gugaagaaccugaugaaga

SEQ ID NO: 753412 - RNA, 19 nt, Homo sapiens
gacugggaauguaugaaua

SEQ ID NO: 753413 - RNA, 19 nt, Homo sapiens
guagaugauuggauagaau

SEQ ID NO: 753414 - RNA, 19 nt, Homo sapiens
acugaagccugauuucuuu

SEQ ID NO: 753415 - RNA, 19 nt, Homo sapiens
caccauggauauagauuug

SEQ ID NO: 753416 - RNA, 19 nt, Homo sapiens
gggauuuauuugcuuguaa

SEQ ID NO: 753417 - RNA, 19 nt, Homo sapiens
caaagagcuuaauuccaaa

SEQ ID NO: 753418 - RNA, 19 nt, Homo sapiens
aaaggaguguuuguacaua

SEQ ID NO: 753419 - RNA, 19 nt, Homo sapiens
ucaaagaacagacgagaga

SEQ ID NO: 753420 - RNA, 19 nt, Homo sapiens
cgacuucggaauugucuua

SEQ ID NO: 753421 - RNA, 19 nt, Homo sapiens
agacaugccugagcagauu

SEQ ID NO: 753422 - RNA, 19 nt, Homo sapiens
uucaagaagucaacugaua

SEQ ID NO: 753423 - RNA, 19 nt, Homo sapiens
guuggacuaugcaugauaa

SEQ ID NO: 753424 - RNA, 19 nt, Homo sapiens
gauguauagugaugccuuu

SEQ ID NO: 753425 - RNA, 19 nt, Homo sapiens
ugacagcuuuggugaaugu

SEQ ID NO: 753426 - RNA, 19 nt, Homo sapiens
caacgugaauacuacuguu

SEQ ID NO: 753427 - RNA, 19 nt, Homo sapiens
auauaccacuggacgauua

SEQ ID NO: 753428 - RNA, 19 nt, Homo sapiens
gugaugccuuucuuaauga

SEQ ID NO: 753429 - RNA, 19 nt, Homo sapiens
uagauaccgugaugcgaua

SEQ ID NO: 753430 - RNA, 19 nt, Homo sapiens
cuauggagauaucaucaaa

SEQ ID NO: 753431 - RNA, 19 nt, Homo sapiens
ugaacaggaugaugauaau

SEQ ID NO: 753432 - RNA, 19 nt, Homo sapiens
gucagagcauuucgacaua

SEQ ID NO: 753433 - RNA, 19 nt, Homo sapiens
gauguuguuugaaguuguu

SEQ ID NO: 753434 - RNA, 19 nt, Homo sapiens
ggucaacaguacggaguaa

SEQ ID NO: 753435 - RNA, 19 nt, Homo sapiens
uuaccgaaauucuuugcua

SEQ ID NO: 753436 - RNA, 19 nt, Homo sapiens
ccauccaccuuuaaauuug

SEQ ID NO: 753437 - RNA, 19 nt, Homo sapiens
aaacaaggcagauagacaa

SEQ ID NO: 753438 - RNA, 19 nt, Homo sapiens
gaguugcucagcuuuauuu

SEQ ID NO: 753439 - RNA, 19 nt, Homo sapiens
guaauccuuuggcaacuug

SEQ ID NO: 753440 - RNA, 19 nt, Homo sapiens
gcaagagggugaagaaccu

SEQ ID NO: 753441 - RNA, 19 nt, Homo sapiens
guaaugcccucaugugaau

SEQ ID NO: 753442 - RNA, 19 nt, Homo sapiens
gcgagcaccuucacaagaa

SEQ ID NO: 753443 - RNA, 19 nt, Homo sapiens
ccacagaagggaauaaauu

SEQ ID NO: 753444 - RNA, 19 nt, Homo sapiens
uaacuuaagugagagagaa

SEQ ID NO: 753445 - RNA, 19 nt, Homo sapiens
ucuaguaacuuaagugaga

SEQ ID NO: 753446 - RNA, 19 nt, Homo sapiens
gaacccauuugccuugaug

SEQ ID NO: 753447 - RNA, 19 nt, Homo sapiens
cacagaagggaauaaauua

SEQ ID NO: 753448 - RNA, 19 nt, Homo sapiens
gaauguucuucgggaaaua

SEQ ID NO: 753449 - RNA, 19 nt, Homo sapiens
gaacaacgagaacuccaau

SEQ ID NO: 753450 - RNA, 19 nt, Homo sapiens
gagaccagcuacugcuuca

SEQ ID NO: 753451 - RNA, 19 nt, Homo sapiens
ccacacaggucagcaacug

SEQ ID NO: 753452 - RNA, 19 nt, Homo sapiens
gaaagggcagcgccacaga

SEQ ID NO: 753453 - RNA, 19 nt, Homo sapiens
gucagcaacugguucaaga

SEQ ID NO: 753454 - RNA, 19 nt, Homo sapiens
gcucaaggcacacuacauc

SEQ ID NO: 753455 - RNA, 19 nt, Homo sapiens
uugcuuuccuucuagauuu

SEQ ID NO: 753456 - RNA, 19 nt, Homo sapiens
gaaccacagaagggaauaa

SEQ ID NO: 753457 - RNA, 19 nt, Homo sapiens
ccaaggaaagggagaacaa

SEQ ID NO: 753458 - RNA, 19 nt, Homo sapiens
aaagggagaacaacgagaa

SEQ ID NO: 753459 - RNA, 19 nt, Homo sapiens
ugaauguucuucgggaaau

SEQ ID NO: 753460 - RNA, 19 nt, Homo sapiens
ucucucuccuucucuguuu

SEQ ID NO: 753461 - RNA, 19 nt, Homo sapiens
gagcggacccacugcaaca

SEQ ID NO: 753462 - RNA, 19 nt, Homo sapiens
ggagagggaagaggagaga

SEQ ID NO: 753463 - RNA, 19 nt, Homo sapiens
guauugcuuuccuucuaga

SEQ ID NO: 753464 - RNA, 19 nt, Homo sapiens
acaacgagaacuccaauuc

SEQ ID NO: 753465 - RNA, 19 nt, Homo sapiens
cguaaugcccucaugugaa

SEQ ID NO: 753466 - RNA, 19 nt, Homo sapiens
ggugucagcuuuucgucua

SEQ ID NO: 753467 - RNA, 19 nt, Homo sapiens
ccacugucauucucucucu

SEQ ID NO: 753468 - RNA, 19 nt, Homo sapiens
ccagaccacucaucaucca

SEQ ID NO: 753469 - RNA, 19 nt, Homo sapiens
ccuggucccuccguaugua

SEQ ID NO: 753470 - RNA, 19 nt, Homo sapiens
ccuccugacugguggucua

SEQ ID NO: 753471 - RNA, 19 nt, Homo sapiens
uuguauugcuuuccuucua

SEQ ID NO: 753472 - RNA, 19 nt, Homo sapiens
guucuuguuugggauuuau

SEQ ID NO: 753473 - RNA, 19 nt, Homo sapiens
cuauguugguucuuguuug

SEQ ID NO: 753474 - RNA, 19 nt, Homo sapiens
uugaugagcuugccuuuug

SEQ ID NO: 753475 - RNA, 19 nt, Homo sapiens
gcagcucggaggaugagaa

SEQ ID NO: 753476 - RNA, 19 nt, Homo sapiens
gaaugaaagcgugcucaag

SEQ ID NO: 753477 - RNA, 19 nt, Homo sapiens
gguucuuguuugggauuua

SEQ ID NO: 753478 - RNA, 19 nt, Homo sapiens
cagcuacugcuucaaggaa

SEQ ID NO: 753479 - RNA, 19 nt, Homo sapiens
uauguugguucuuguuugg

SEQ ID NO: 753480 - RNA, 19 nt, Homo sapiens
uagggcagauagcugucua

SEQ ID NO: 753481 - RNA, 19 nt, Homo sapiens
uagaacccauuugccuuga

SEQ ID NO: 753482 - RNA, 19 nt, Homo sapiens
gcacaaccccuacccuuca

SEQ ID NO: 753483 - RNA, 19 nt, Homo sapiens
gaccagcuacugcuucaag

SEQ ID NO: 753484 - RNA, 19 nt, Homo sapiens
gugaauguucuucgggaaa

SEQ ID NO: 753485 - RNA, 19 nt, Homo sapiens
uccgcgagcucuacaagau

SEQ ID NO: 753486 - RNA, 19 nt, Homo sapiens
uguauugcuuuccuucuag

SEQ ID NO: 753487 - RNA, 19 nt, Homo sapiens
cgagcaccuucacaagaau

SEQ ID NO: 753488 - RNA, 19 nt, Homo sapiens
ggaccugggcuccuagaac

SEQ ID NO: 753489 - RNA, 19 nt, Homo sapiens
gcccucaugugaauguucu

SEQ ID NO: 753490 - RNA, 19 nt, Homo sapiens
cgucuaguaacuuaaguga

SEQ ID NO: 753491 - RNA, 19 nt, Homo sapiens
agagggaagaggagagaaa

SEQ ID NO: 753492 - RNA, 19 nt, Homo sapiens
gcaacuuccgcgagcucua

SEQ ID NO: 753493 - RNA, 19 nt, Homo sapiens
gcgaggagaccagcuacug

SEQ ID NO: 753494 - RNA, 19 nt, Homo sapiens
ccucucuugucuugccuuu

SEQ ID NO: 753495 - RNA, 19 nt, Homo sapiens
auacaccacugucauucuc

SEQ ID NO: 753496 - RNA, 19 nt, Homo sapiens
gagcuugccuuuugugacu

SEQ ID NO: 753497 - RNA, 19 nt, Homo sapiens
cagcggcaagucgguguua

SEQ ID NO: 753498 - RNA, 19 nt, Homo sapiens
gccacaacccgcugaaugg

SEQ ID NO: 753499 - RNA, 19 nt, Homo sapiens
ccguaaugcccucauguga

SEQ ID NO: 753500 - RNA, 19 nt, Homo sapiens
uuuacccucucuugucuug

SEQ ID NO: 753501 - RNA, 19 nt, Homo sapiens
cccaccagguacugaaaga

SEQ ID NO: 753502 - RNA, 19 nt, Homo sapiens
gcucggaggaugagaagac

SEQ ID NO: 753503 - RNA, 19 nt, Homo sapiens
gagcaccuucacaagaaug

SEQ ID NO: 753504 - RNA, 19 nt, Homo sapiens
cuuucucccucuccuugua

SEQ ID NO: 753505 - RNA, 19 nt, Homo sapiens
ggacauggcugcacucuuc

SEQ ID NO: 753506 - RNA, 19 nt, Homo sapiens
ugacaaagcuggaacacaa

SEQ ID NO: 753507 - RNA, 19 nt, Homo sapiens
gaagugggcucaucacaca

SEQ ID NO: 753508 - RNA, 19 nt, Homo sapiens
gggaugugcuugaguguuu

SEQ ID NO: 753509 - RNA, 19 nt, Homo sapiens
guucacaucuuguuuccua

SEQ ID NO: 753510 - RNA, 19 nt, Homo sapiens
ucaauucgcugcagaagga

SEQ ID NO: 753511 - RNA, 19 nt, Homo sapiens
agaaagauaugggacauuu

SEQ ID NO: 753512 - RNA, 19 nt, Homo sapiens
gaaagugguucccaugucu

SEQ ID NO: 753513 - RNA, 19 nt, Homo sapiens
gagaaucuguucacugcaa

SEQ ID NO: 753514 - RNA, 19 nt, Homo sapiens
caauagaacuucaaaucuc

SEQ ID NO: 753515 - RNA, 19 nt, Homo sapiens
gauaugggacauuucuaua

SEQ ID NO: 753516 - RNA, 19 nt, Homo sapiens
gccgcugacuuuccucuua

SEQ ID NO: 753517 - RNA, 19 nt, Homo sapiens
cuuaguagaccgcaaguua

SEQ ID NO: 753518 - RNA, 19 nt, Homo sapiens
caucuuguuuccuauagaa

SEQ ID NO: 753519 - RNA, 19 nt, Homo sapiens
gauuugacguguccguuug

SEQ ID NO: 753520 - RNA, 19 nt, Homo sapiens
caacaacuuccuccucauu

SEQ ID NO: 753521 - RNA, 19 nt, Homo sapiens
ggagaaagauaugggacau

SEQ ID NO: 753522 - RNA, 19 nt, Homo sapiens
cgacacagccaacaacuuc

SEQ ID NO: 753523 - RNA, 19 nt, Homo sapiens
ugacuuuccucuuaguaga

SEQ ID NO: 753524 - RNA, 19 nt, Homo sapiens
auucgugacuuucccaaua

SEQ ID NO: 753525 - RNA, 19 nt, Homo sapiens
ggaauuuucuacuugguaa

SEQ ID NO: 753526 - RNA, 19 nt, Homo sapiens
ggaacacaauaccucuaug

SEQ ID NO: 753527 - RNA, 19 nt, Homo sapiens
gaccuuggaugccgacaca

SEQ ID NO: 753528 - RNA, 19 nt, Homo sapiens
uaacaggcuuucaccucaa

SEQ ID NO: 753529 - RNA, 19 nt, Homo sapiens
uggguagacuuaggaauuu

SEQ ID NO: 753530 - RNA, 19 nt, Homo sapiens
uguauucucggaucaauuu

SEQ ID NO: 753531 - RNA, 19 nt, Homo sapiens
guggguagacuuaggaauu

SEQ ID NO: 753532 - RNA, 19 nt, Homo sapiens
gaacacaauaccucuaugc

SEQ ID NO: 753533 - RNA, 19 nt, Homo sapiens
uugagcaucuguccuuuga

SEQ ID NO: 753534 - RNA, 19 nt, Homo sapiens
gcuguuccauggucucuca

SEQ ID NO: 753535 - RNA, 19 nt, Homo sapiens
ucacaucuuguuuccuaua

SEQ ID NO: 753536 - RNA, 19 nt, Homo sapiens
ugaaagugguucccauguc

SEQ ID NO: 753537 - RNA, 19 nt, Homo sapiens
ccaauagaacuucaaaucu

SEQ ID NO: 753538 - RNA, 19 nt, Homo sapiens
aaacagggucagaaaauua

SEQ ID NO: 753539 - RNA, 19 nt, Homo sapiens
gauucuggacugugaguuu

SEQ ID NO: 753540 - RNA, 19 nt, Homo sapiens
gaccacagagcuuggauuc

SEQ ID NO: 753541 - RNA, 19 nt, Homo sapiens
cauugagucuuaugguuca

SEQ ID NO: 753542 - RNA, 19 nt, Homo sapiens
caauaccucuaugcaugaa

SEQ ID NO: 753543 - RNA, 19 nt, Homo sapiens
acaaagcuggaacacaaua

SEQ ID NO: 753544 - RNA, 19 nt, Homo sapiens
agucauaggagaaagauau

SEQ ID NO: 753545 - RNA, 19 nt, Homo sapiens
uuucuucccuuguguacuu

SEQ ID NO: 753546 - RNA, 19 nt, Homo sapiens
agugaugauucgugacuuu

SEQ ID NO: 753547 - RNA, 19 nt, Homo sapiens
gaggaucugcuuugcuguu

SEQ ID NO: 753548 - RNA, 19 nt, Homo sapiens
ucuuaugguucacaucuug

SEQ ID NO: 753549 - RNA, 19 nt, Homo sapiens
uugaugaacucaggcacua

SEQ ID NO: 753550 - RNA, 19 nt, Homo sapiens
acaacuuccuccucauuuc

SEQ ID NO: 753551 - RNA, 19 nt, Homo sapiens
gauuauugagucguaagua

SEQ ID NO: 753552 - RNA, 19 nt, Homo sapiens
agauccagcugaccacaga

SEQ ID NO: 753553 - RNA, 19 nt, Homo sapiens
cccaauagaacuucaaauc

SEQ ID NO: 753554 - RNA, 19 nt, Homo sapiens
agcccaagcugaagaagau

SEQ ID NO: 753555 - RNA, 19 nt, Homo sapiens
aaagauaugggacauuucu

SEQ ID NO: 753556 - RNA, 19 nt, Homo sapiens
gagaaagauaugggacauu

SEQ ID NO: 753557 - RNA, 19 nt, Homo sapiens
gagcccaagcugaagaaga

SEQ ID NO: 753558 - RNA, 19 nt, Homo sapiens
gaggcugguuucccacauc

SEQ ID NO: 753559 - RNA, 19 nt, Homo sapiens
ugccucaagugcaucaauu

SEQ ID NO: 753560 - RNA, 19 nt, Homo sapiens
ggaugugcuugaguguuug

SEQ ID NO: 753561 - RNA, 19 nt, Homo sapiens
acaauaccucuaugcauga

SEQ ID NO: 753562 - RNA, 19 nt, Homo sapiens
cuccuucaauuccaccuaa

SEQ ID NO: 753563 - RNA, 19 nt, Homo sapiens
agaaucuguucacugcaaa

SEQ ID NO: 753564 - RNA, 19 nt, Homo sapiens
gaccuugccgagagauuug

SEQ ID NO: 753565 - RNA, 19 nt, Homo sapiens
cugcuuugcuguugcuguu

SEQ ID NO: 753566 - RNA, 19 nt, Homo sapiens
ucagagcacagugaugauu

SEQ ID NO: 753567 - RNA, 19 nt, Homo sapiens
aaaacagggucagaaaauu

SEQ ID NO: 753568 - RNA, 19 nt, Homo sapiens
gcaugcagaacguuuccuu

SEQ ID NO: 753569 - RNA, 19 nt, Homo sapiens
agauaugggacauuucuau

SEQ ID NO: 753570 - RNA, 19 nt, Homo sapiens
ccgcugacuuuccucuuag

SEQ ID NO: 753571 - RNA, 19 nt, Homo sapiens
cuuggauucuggacuguga

SEQ ID NO: 753572 - RNA, 19 nt, Homo sapiens
gggaacaagcacagaaugg

SEQ ID NO: 753573 - RNA, 19 nt, Homo sapiens
gggcucaucacacagaauc

SEQ ID NO: 753574 - RNA, 19 nt, Homo sapiens
caacuuccuccucauuucu

SEQ ID NO: 753575 - RNA, 19 nt, Homo sapiens
cuacagaugaacccaagga

SEQ ID NO: 753576 - RNA, 19 nt, Homo sapiens
gaucugcuuugcuguugcu

SEQ ID NO: 753577 - RNA, 19 nt, Homo sapiens
gcaucaauucgcugcagaa

SEQ ID NO: 753578 - RNA, 19 nt, Homo sapiens
ugggacauuucuauaaucu

SEQ ID NO: 753579 - RNA, 19 nt, Homo sapiens
ucacacagaaucggcaaga

SEQ ID NO: 753580 - RNA, 19 nt, Homo sapiens
augaaaagguugucacuug

SEQ ID NO: 753581 - RNA, 19 nt, Homo sapiens
guucuguauucucggauca

SEQ ID NO: 753582 - RNA, 19 nt, Homo sapiens
cacaucuuguuuccuauag

SEQ ID NO: 753583 - RNA, 19 nt, Homo sapiens
aauaagccgccacugcaaa

SEQ ID NO: 753584 - RNA, 19 nt, Homo sapiens
gcugacuuuccucuuagua

SEQ ID NO: 753585 - RNA, 19 nt, Homo sapiens
ugaaaagguugucacuugu

SEQ ID NO: 753586 - RNA, 19 nt, Homo sapiens
ggauggaagccgccucucu

SEQ ID NO: 753587 - RNA, 19 nt, Homo sapiens
cugggagucugcagagaau

SEQ ID NO: 753588 - RNA, 19 nt, Homo sapiens
ccaacaacuuccuccucau

SEQ ID NO: 753589 - RNA, 19 nt, Homo sapiens
auucgauuauugagucgua

SEQ ID NO: 753590 - RNA, 19 nt, Homo sapiens
ggagguggacgugggaaca

SEQ ID NO: 753591 - RNA, 19 nt, Homo sapiens
aaguggauaugaccuugga

SEQ ID NO: 753592 - RNA, 19 nt, Homo sapiens
gacaaagcuggaacacaau

SEQ ID NO: 753593 - RNA, 19 nt, Homo sapiens
ucucggaucaauuuccaaa

SEQ ID NO: 753594 - RNA, 19 nt, Homo sapiens
ggagccacugcgcccauuu

SEQ ID NO: 753595 - RNA, 19 nt, Homo sapiens
gaaugggaccugggagucu

SEQ ID NO: 753596 - RNA, 19 nt, Homo sapiens
agaccuugccgagagauuu

SEQ ID NO: 753597 - RNA, 19 nt, Homo sapiens
acccaaggaugcggaaguu

SEQ ID NO: 753598 - RNA, 19 nt, Homo sapiens
acacaauaccucuaugcau

SEQ ID NO: 753599 - RNA, 19 nt, Homo sapiens
aacaacuuccuccucauuu

SEQ ID NO: 753600 - RNA, 19 nt, Homo sapiens
uggaacacaauaccucuau

SEQ ID NO: 753601 - RNA, 19 nt, Homo sapiens
ggacauggcugcacucuuc

SEQ ID NO: 753602 - RNA, 19 nt, Homo sapiens
ugacaaagcuggaacacaa

SEQ ID NO: 753603 - RNA, 19 nt, Homo sapiens
ggacauuucuugauuauac

SEQ ID NO: 753604 - RNA, 19 nt, Homo sapiens
gggaugugcuugaguguuu

SEQ ID NO: 753605 - RNA, 19 nt, Homo sapiens
guucacaucuuguuuccua

SEQ ID NO: 753606 - RNA, 19 nt, Homo sapiens
ggaacgcucuacuucguaa

SEQ ID NO: 753607 - RNA, 19 nt, Homo sapiens
gauuauagaguccuaagua

SEQ ID NO: 753608 - RNA, 19 nt, Homo sapiens
caacacagccaacaacuuc

SEQ ID NO: 753609 - RNA, 19 nt, Homo sapiens
caauagaacuucaaaucuc

SEQ ID NO: 753610 - RNA, 19 nt, Homo sapiens
ggauccagcugaccacaga

SEQ ID NO: 753611 - RNA, 19 nt, Homo sapiens
auagaaauguccuguauuc

SEQ ID NO: 753612 - RNA, 19 nt, Homo sapiens
cuauagaaauguccuguau

SEQ ID NO: 753613 - RNA, 19 nt, Homo sapiens
uaugggacauuucuugauu

SEQ ID NO: 753614 - RNA, 19 nt, Homo sapiens
aauaagcccucacuccaaa

SEQ ID NO: 753615 - RNA, 19 nt, Homo sapiens
gaaggugguucccaugucu

SEQ ID NO: 753616 - RNA, 19 nt, Homo sapiens
uuaauucacugcagaagga

SEQ ID NO: 753617 - RNA, 19 nt, Homo sapiens
caucuuguuuccuauagaa

SEQ ID NO: 753618 - RNA, 19 nt, Homo sapiens
gauuugacguguccguuug

SEQ ID NO: 753619 - RNA, 19 nt, Homo sapiens
caacaacuuccuccucauu

SEQ ID NO: 753620 - RNA, 19 nt, Homo sapiens
cuucguagaccgcaaguua

SEQ ID NO: 753621 - RNA, 19 nt, Homo sapiens
gaagugggcgcaucagaca

SEQ ID NO: 753622 - RNA, 19 nt, Homo sapiens
auucgugacuuucccaaua

SEQ ID NO: 753623 - RNA, 19 nt, Homo sapiens
gaggcuggcuucccacauc

SEQ ID NO: 753624 - RNA, 19 nt, Homo sapiens
ggaacacaauaccucuaug

SEQ ID NO: 753625 - RNA, 19 nt, Homo sapiens
ugacuuuccucuucguaga

SEQ ID NO: 753626 - RNA, 19 nt, Homo sapiens
gaacacaauaccucuaugc

SEQ ID NO: 753627 - RNA, 19 nt, Homo sapiens
uugagcaucuguccuuuga

SEQ ID NO: 753628 - RNA, 19 nt, Homo sapiens
ucacaucuuguuuccuaua

SEQ ID NO: 753629 - RNA, 19 nt, Homo sapiens
ccaauagaacuucaaaucu

SEQ ID NO: 753630 - RNA, 19 nt, Homo sapiens
gauucuggacugugaguuu

SEQ ID NO: 753631 - RNA, 19 nt, Homo sapiens
ugccucaagugcauuaauu

SEQ ID NO: 753632 - RNA, 19 nt, Homo sapiens
gaccacagagcuuggauuc

SEQ ID NO: 753633 - RNA, 19 nt, Homo sapiens
caauaccucuaugcaugaa

SEQ ID NO: 753634 - RNA, 19 nt, Homo sapiens
acaaagcuggaacacaaua

SEQ ID NO: 753635 - RNA, 19 nt, Homo sapiens
aggaucugcuuugcuguua

SEQ ID NO: 753636 - RNA, 19 nt, Homo sapiens
agugaugauucgugacuuu

SEQ ID NO: 753637 - RNA, 19 nt, Homo sapiens
uaggaacgcucuacuucgu

SEQ ID NO: 753638 - RNA, 19 nt, Homo sapiens
gaucugcuuugcuguuacu

SEQ ID NO: 753639 - RNA, 19 nt, Homo sapiens
gaggaucugcuuugcuguu

SEQ ID NO: 753640 - RNA, 19 nt, Homo sapiens
uaacaggcuuucaccucau

SEQ ID NO: 753641 - RNA, 19 nt, Homo sapiens
uugaugaacucaggcacua

SEQ ID NO: 753642 - RNA, 19 nt, Homo sapiens
acaacuuccuccucauuuc

SEQ ID NO: 753643 - RNA, 19 nt, Homo sapiens
ugggacauuucuugauuau

SEQ ID NO: 753644 - RNA, 19 nt, Homo sapiens
uguauucugggaucaauuu

SEQ ID NO: 753645 - RNA, 19 nt, Homo sapiens
cccaauagaacuucaaauc

SEQ ID NO: 753646 - RNA, 19 nt, Homo sapiens
gcauuaauucacugcagaa

SEQ ID NO: 753647 - RNA, 19 nt, Homo sapiens
agcccaagcugaagaagau

SEQ ID NO: 753648 - RNA, 19 nt, Homo sapiens
augggacauuucuugauua

SEQ ID NO: 753649 - RNA, 19 nt, Homo sapiens
aaauaagcccucacuccaa

SEQ ID NO: 753650 - RNA, 19 nt, Homo sapiens
gagccacugugcccauuuu

SEQ ID NO: 753651 - RNA, 19 nt, Homo sapiens
gccgcugacuuuccucuuc

SEQ ID NO: 753652 - RNA, 19 nt, Homo sapiens
gagcccaagcugaagaaga

SEQ ID NO: 753653 - RNA, 19 nt, Homo sapiens
uccauggucucucggaaga

SEQ ID NO: 753654 - RNA, 19 nt, Homo sapiens
ggaugugcuugaguguuug

SEQ ID NO: 753655 - RNA, 19 nt, Homo sapiens
ggucuuauucucggaguga

SEQ ID NO: 753656 - RNA, 19 nt, Homo sapiens
ugaaggugguucccauguc

SEQ ID NO: 753657 - RNA, 19 nt, Homo sapiens
acaauaccucuaugcauga

SEQ ID NO: 753658 - RNA, 19 nt, Homo sapiens
cuccuucaauuccaccuaa

SEQ ID NO: 753659 - RNA, 19 nt, Homo sapiens
gaccuugccgagagauuug

SEQ ID NO: 753660 - RNA, 19 nt, Homo sapiens
ucagagcacagugaugauu

SEQ ID NO: 753661 - RNA, 19 nt, Homo sapiens
gcaugcagaacguuuccuu

SEQ ID NO: 753662 - RNA, 19 nt, Homo sapiens
guacucauggucuuauucu

SEQ ID NO: 753663 - RNA, 19 nt, Homo sapiens
cuuggauucuggacuguga

SEQ ID NO: 753664 - RNA, 19 nt, Homo sapiens
gggaacaagcacagaaugg

SEQ ID NO: 753665 - RNA, 19 nt, Homo sapiens
caacuuccuccucauuucu

SEQ ID NO: 753666 - RNA, 19 nt, Homo sapiens
ccaacacagccaacaacuu

SEQ ID NO: 753667 - RNA, 19 nt, Homo sapiens
agaaucuguucaccgcaaa

SEQ ID NO: 753668 - RNA, 19 nt, Homo sapiens
guccuaugguucacaucuu

SEQ ID NO: 753669 - RNA, 19 nt, Homo sapiens
ggagccacugugcccauuu

SEQ ID NO: 753670 - RNA, 19 nt, Homo sapiens
cugcuuugcuguuacucuu

SEQ ID NO: 753671 - RNA, 19 nt, Homo sapiens
augaaaagguugucacuug

SEQ ID NO: 753672 - RNA, 19 nt, Homo sapiens
cacaucuuguuuccuauag

SEQ ID NO: 753673 - RNA, 19 nt, Homo sapiens
aauaugggacauuucuuga

SEQ ID NO: 753674 - RNA, 19 nt, Homo sapiens
gaacgcucuacuucguaaa

SEQ ID NO: 753675 - RNA, 19 nt, Homo sapiens
cugggagucugcagagaau

SEQ ID NO: 753676 - RNA, 19 nt, Homo sapiens
gggcgcaucagacagaauc

SEQ ID NO: 753677 - RNA, 19 nt, Homo sapiens
ccaacaacuuccuccucau

SEQ ID NO: 753678 - RNA, 19 nt, Homo sapiens
ugaaaagguugucacuugu

SEQ ID NO: 753679 - RNA, 19 nt, Homo sapiens
gacaaagcuggaacacaau

SEQ ID NO: 753680 - RNA, 19 nt, Homo sapiens
ggagguggacgugggaaca

SEQ ID NO: 753681 - RNA, 19 nt, Homo sapiens
aaguggauaugaccuugga

SEQ ID NO: 753682 - RNA, 19 nt, Homo sapiens
uccuaugguucacaucuug

SEQ ID NO: 753683 - RNA, 19 nt, Homo sapiens
cuuaggaacgcucuacuuc

SEQ ID NO: 753684 - RNA, 19 nt, Homo sapiens
gaaugggaccugggagucu

SEQ ID NO: 753685 - RNA, 19 nt, Homo sapiens
agaccuugccgagagauuu

SEQ ID NO: 753686 - RNA, 19 nt, Homo sapiens
acccaaggaugcggaaguu

SEQ ID NO: 753687 - RNA, 19 nt, Homo sapiens
ccucaagugcauuaauuca

SEQ ID NO: 753688 - RNA, 19 nt, Homo sapiens
ccuauagaaauguccugua

SEQ ID NO: 753689 - RNA, 19 nt, Homo sapiens
uuaauuauugccaccauca

SEQ ID NO: 753690 - RNA, 19 nt, Homo sapiens
uggaacacaauaccucuau

SEQ ID NO: 753691 - RNA, 19 nt, Homo sapiens
acacaauaccucuaugcau

SEQ ID NO: 753692 - RNA, 19 nt, Homo sapiens
aacaacuuccuccucauuu

SEQ ID NO: 753693 - RNA, 19 nt, Homo sapiens
gaauggaaaucaacuguaa

SEQ ID NO: 753694 - RNA, 19 nt, Homo sapiens
uaaguuugcugcagaaaua

SEQ ID NO: 753695 - RNA, 19 nt, Homo sapiens
caucagaggugcuguaauu

SEQ ID NO: 753696 - RNA, 19 nt, Homo sapiens
gaccaaaucuauagucaaa

SEQ ID NO: 753697 - RNA, 19 nt, Homo sapiens
uaaaggagauucagagcua

SEQ ID NO: 753698 - RNA, 19 nt, Homo sapiens
gaucauacuuccucagaaa

SEQ ID NO: 753699 - RNA, 19 nt, Homo sapiens
ggacugucauuucugauuu

SEQ ID NO: 753700 - RNA, 19 nt, Homo sapiens
gcuaugaacuaccacagua

SEQ ID NO: 753701 - RNA, 19 nt, Homo sapiens
uaacuuccauggcccuuua

SEQ ID NO: 753702 - RNA, 19 nt, Homo sapiens
gaacacagaguuucaugaa

SEQ ID NO: 753703 - RNA, 19 nt, Homo sapiens
gaaaccaaauugcacaaau

SEQ ID NO: 753704 - RNA, 19 nt, Homo sapiens
gcacagcaauauacauuca

SEQ ID NO: 753705 - RNA, 19 nt, Homo sapiens
ggaaaucaacuguaaguau

SEQ ID NO: 753706 - RNA, 19 nt, Homo sapiens
ggacaacauuggucuagga

SEQ ID NO: 753707 - RNA, 19 nt, Homo sapiens
agaaacacaucgaguauau

SEQ ID NO: 753708 - RNA, 19 nt, Homo sapiens
caacugcccuuacauugug

SEQ ID NO: 753709 - RNA, 19 nt, Homo sapiens
ccaaauauaguaaccagua

SEQ ID NO: 753710 - RNA, 19 nt, Homo sapiens
gcacaaaucucagcucacu

SEQ ID NO: 753711 - RNA, 19 nt, Homo sapiens
guauguaaguuggcaauaa

SEQ ID NO: 753712 - RNA, 19 nt, Homo sapiens
ggacguccuuauuauuauu

SEQ ID NO: 753713 - RNA, 19 nt, Homo sapiens
caacagcaaucaucuuugg

SEQ ID NO: 753714 - RNA, 19 nt, Homo sapiens
gcugauuacuagacacaua

SEQ ID NO: 753715 - RNA, 19 nt, Homo sapiens
ugagaagacuaucaucauu

SEQ ID NO: 753716 - RNA, 19 nt, Homo sapiens
guucuguucuauagaguua

SEQ ID NO: 753717 - RNA, 19 nt, Homo sapiens
gcucauggccugucuaaau

SEQ ID NO: 753718 - RNA, 19 nt, Homo sapiens
gaaagguacccuaaucguu

SEQ ID NO: 753719 - RNA, 19 nt, Homo sapiens
gugcacaccuguaguccua

SEQ ID NO: 753720 - RNA, 19 nt, Homo sapiens
gcaauaacaguauacauca

SEQ ID NO: 753721 - RNA, 19 nt, Homo sapiens
gaucaccaccaacaucaua

SEQ ID NO: 753722 - RNA, 19 nt, Homo sapiens
aaacuuuguugaccucuuu

SEQ ID NO: 753723 - RNA, 19 nt, Homo sapiens
caccacgccuggcuaauuu

SEQ ID NO: 753724 - RNA, 19 nt, Homo sapiens
caucucagccucccaagua

SEQ ID NO: 753725 - RNA, 19 nt, Homo sapiens
ggagaagcacagcaauaua

SEQ ID NO: 753726 - RNA, 19 nt, Homo sapiens
gcuguuguauuacuuauuc

SEQ ID NO: 753727 - RNA, 19 nt, Homo sapiens
guggacguccuuauuauua

SEQ ID NO: 753728 - RNA, 19 nt, Homo sapiens
ucgaguauaugcuauugua

SEQ ID NO: 753729 - RNA, 19 nt, Homo sapiens
ccaaaucuauagucaaagu

SEQ ID NO: 753730 - RNA, 19 nt, Homo sapiens
caacugacuagauuuguuu

SEQ ID NO: 753731 - RNA, 19 nt, Homo sapiens
gcagaaacacaucgaguau

SEQ ID NO: 753732 - RNA, 19 nt, Homo sapiens
agacuaagauaaccaagau

SEQ ID NO: 753733 - RNA, 19 nt, Homo sapiens
aaacaugcccgacccaauu

SEQ ID NO: 753734 - RNA, 19 nt, Homo sapiens
aauacuagcugcuguuuca

SEQ ID NO: 753735 - RNA, 19 nt, Homo sapiens
ccaguuaaguuccguaagu

SEQ ID NO: 753736 - RNA, 19 nt, Homo sapiens
ggaaauuugcuguuguauu

SEQ ID NO: 753737 - RNA, 19 nt, Homo sapiens
ggaggucaguggcacaaau

SEQ ID NO: 753738 - RNA, 19 nt, Homo sapiens
gaagugagucagaaacaga

SEQ ID NO: 753739 - RNA, 19 nt, Homo sapiens
gaaaguaccagcauagacu

SEQ ID NO: 753740 - RNA, 19 nt, Homo sapiens
gaaggaacaacaagaagug

SEQ ID NO: 753741 - RNA, 19 nt, Homo sapiens
gagcugcacugugaugaga

SEQ ID NO: 753742 - RNA, 19 nt, Homo sapiens
ugaaauuacuucuguuugg

SEQ ID NO: 753743 - RNA, 19 nt, Homo sapiens
caacauuggucuaggacau

SEQ ID NO: 753744 - RNA, 19 nt, Homo sapiens
gagaagacuaucaucauug

SEQ ID NO: 753745 - RNA, 19 nt, Homo sapiens
caggaaagguacccuaauc

SEQ ID NO: 753746 - RNA, 19 nt, Homo sapiens
cagaggugcuguaauuuua

SEQ ID NO: 753747 - RNA, 19 nt, Homo sapiens
uuacugaccagccaauaua

SEQ ID NO: 753748 - RNA, 19 nt, Homo sapiens
ggaaggagaagcacagcaa

SEQ ID NO: 753749 - RNA, 19 nt, Homo sapiens
ucagacauguugagagaga

SEQ ID NO: 753750 - RNA, 19 nt, Homo sapiens
gcccuuacauugugcaguu

SEQ ID NO: 753751 - RNA, 19 nt, Homo sapiens
ggucaucauugaauauaca

SEQ ID NO: 753752 - RNA, 19 nt, Homo sapiens
agaaagcucuauuggacaa

SEQ ID NO: 753753 - RNA, 19 nt, Homo sapiens
guacaacugacuagauuug

SEQ ID NO: 753754 - RNA, 19 nt, Homo sapiens
uaacuacccuucucuaucc

SEQ ID NO: 753755 - RNA, 19 nt, Homo sapiens
cuauaaaucacccaacuaa

SEQ ID NO: 753756 - RNA, 19 nt, Homo sapiens
aaacacugcaagacaaaua

SEQ ID NO: 753757 - RNA, 19 nt, Homo sapiens
uaaguuggcaauaacagua

SEQ ID NO: 753758 - RNA, 19 nt, Homo sapiens
gagaagcacagcaauauac

SEQ ID NO: 753759 - RNA, 19 nt, Homo sapiens
cauagaacauccaguuaag

SEQ ID NO: 753760 - RNA, 19 nt, Homo sapiens
gcacaaauucacugacugu

SEQ ID NO: 753761 - RNA, 19 nt, Homo sapiens
ugaguaauagcacaaagua

SEQ ID NO: 753762 - RNA, 19 nt, Homo sapiens
guugaccucuuucucugua

SEQ ID NO: 753763 - RNA, 19 nt, Homo sapiens
aaaaggagcuggagaagau

SEQ ID NO: 753764 - RNA, 19 nt, Homo sapiens
uggagaagauaccugguuu

SEQ ID NO: 753765 - RNA, 19 nt, Homo sapiens
ugacuagauuuguuugaga

SEQ ID NO: 753766 - RNA, 19 nt, Homo sapiens
cauggacugucauuucuga

SEQ ID NO: 753767 - RNA, 19 nt, Homo sapiens
cuucagacauguugagaga

SEQ ID NO: 753768 - RNA, 19 nt, Homo sapiens
acacaaguuucaacauuca

SEQ ID NO: 753769 - RNA, 19 nt, Homo sapiens
auaaaucacccaacuaaga

SEQ ID NO: 753770 - RNA, 19 nt, Homo sapiens
cugauacucuucauuccua

SEQ ID NO: 753771 - RNA, 19 nt, Homo sapiens
agacaggguuucaccaugu

SEQ ID NO: 753772 - RNA, 19 nt, Homo sapiens
gugguggacguccuuauua

SEQ ID NO: 753773 - RNA, 19 nt, Homo sapiens
uacaaacacugcaagacaa

SEQ ID NO: 753774 - RNA, 19 nt, Homo sapiens
acacauagaacauccaguu

SEQ ID NO: 753775 - RNA, 19 nt, Homo sapiens
caugagguaugcagaaaca

SEQ ID NO: 753776 - RNA, 19 nt, Homo sapiens
gccaggggcuuuuagauaa

SEQ ID NO: 753777 - RNA, 19 nt, Homo sapiens
cauaauauacguacaacug

SEQ ID NO: 753778 - RNA, 19 nt, Homo sapiens
ggaaggaacaacaagaagu

SEQ ID NO: 753779 - RNA, 19 nt, Homo sapiens
uacuuuauccuccugauua

SEQ ID NO: 753780 - RNA, 19 nt, Homo sapiens
guaccagcauagacuguau

SEQ ID NO: 753781 - RNA, 19 nt, Homo sapiens
ucucuugucuccuucaguu

SEQ ID NO: 753782 - RNA, 19 nt, Homo sapiens
ucaagugauucucaucuca

SEQ ID NO: 753783 - RNA, 19 nt, Homo sapiens
gcacucauggcuucuccua

SEQ ID NO: 753784 - RNA, 19 nt, Homo sapiens
acacacacacauacacaua

SEQ ID NO: 753785 - RNA, 19 nt, Homo sapiens
gagcucauggccugucuaa

SEQ ID NO: 753786 - RNA, 19 nt, Homo sapiens
caagaguggugggaucaga

SEQ ID NO: 753787 - RNA, 19 nt, Homo sapiens
ccuaaguccuucagacaug

SEQ ID NO: 753788 - RNA, 19 nt, Homo sapiens
gacauuaaacucagacuag

SEQ ID NO: 753789 - RNA, 19 nt, Homo sapiens
ggaaagaaaacaugacuga

SEQ ID NO: 753790 - RNA, 19 nt, Homo sapiens
gccaugagguaugcagaaa

SEQ ID NO: 753791 - RNA, 19 nt, Homo sapiens
ggacuucauaugcaacuug

SEQ ID NO: 753792 - RNA, 19 nt, Homo sapiens
ugucauuucugauuucugu

SEQ ID NO: 753793 - RNA, 19 nt, Homo sapiens
gaauggaaaucaacuguaa

SEQ ID NO: 753794 - RNA, 19 nt, Homo sapiens
caucagaggugcuguaauu

SEQ ID NO: 753795 - RNA, 19 nt, Homo sapiens
gaccaaaucuauagucaaa

SEQ ID NO: 753796 - RNA, 19 nt, Homo sapiens
ggacugucauuucugauuu

SEQ ID NO: 753797 - RNA, 19 nt, Homo sapiens
gcuaugaacuaccacagua

SEQ ID NO: 753798 - RNA, 19 nt, Homo sapiens
gaacacagaguuucaugaa

SEQ ID NO: 753799 - RNA, 19 nt, Homo sapiens
gaaaccaaauugcacaaau

SEQ ID NO: 753800 - RNA, 19 nt, Homo sapiens
gcacagcaauauacauuca

SEQ ID NO: 753801 - RNA, 19 nt, Homo sapiens
ggaaaucaacuguaaguau

SEQ ID NO: 753802 - RNA, 19 nt, Homo sapiens
ggacaacauuggucuagga

SEQ ID NO: 753803 - RNA, 19 nt, Homo sapiens
agaaacacaucgaguauau

SEQ ID NO: 753804 - RNA, 19 nt, Homo sapiens
caacugcccuuacauugug

SEQ ID NO: 753805 - RNA, 19 nt, Homo sapiens
ccaaauauaguaaccagua

SEQ ID NO: 753806 - RNA, 19 nt, Homo sapiens
guauguaaguuggcaauaa

SEQ ID NO: 753807 - RNA, 19 nt, Homo sapiens
gcugauuacuagacacaua

SEQ ID NO: 753808 - RNA, 19 nt, Homo sapiens
ugagaagacuaucaucauu

SEQ ID NO: 753809 - RNA, 19 nt, Homo sapiens
guucuguucuauagaguua

SEQ ID NO: 753810 - RNA, 19 nt, Homo sapiens
gcucauggccugucuaaau

SEQ ID NO: 753811 - RNA, 19 nt, Homo sapiens
gcaauaacaguauacauca

SEQ ID NO: 753812 - RNA, 19 nt, Homo sapiens
gaucaccaccaacaucaua

SEQ ID NO: 753813 - RNA, 19 nt, Homo sapiens
aaacuuuguugaccucuuu

SEQ ID NO: 753814 - RNA, 19 nt, Homo sapiens
ggagaagcacagcaauaua

SEQ ID NO: 753815 - RNA, 19 nt, Homo sapiens
gcuguuguauuacuuauuc

SEQ ID NO: 753816 - RNA, 19 nt, Homo sapiens
ucgaguauaugcuauugua

SEQ ID NO: 753817 - RNA, 19 nt, Homo sapiens
ccaaaucuauagucaaagu

SEQ ID NO: 753818 - RNA, 19 nt, Homo sapiens
caacugacuagauuuguuu

SEQ ID NO: 753819 - RNA, 19 nt, Homo sapiens
gcagaaacacaucgaguau

SEQ ID NO: 753820 - RNA, 19 nt, Homo sapiens
agacuaagauaaccaagau

SEQ ID NO: 753821 - RNA, 19 nt, Homo sapiens
aauacuagcugcuguuuca

SEQ ID NO: 753822 - RNA, 19 nt, Homo sapiens
ccaguuaaguuccguaagu

SEQ ID NO: 753823 - RNA, 19 nt, Homo sapiens
aaacaugcccgacccaauu

SEQ ID NO: 753824 - RNA, 19 nt, Homo sapiens
ggaaauuugcuguuguauu

SEQ ID NO: 753825 - RNA, 19 nt, Homo sapiens
gaagugagucagaaacaga

SEQ ID NO: 753826 - RNA, 19 nt, Homo sapiens
gaaaguaccagcauagacu

SEQ ID NO: 753827 - RNA, 19 nt, Homo sapiens
gaaggaacaacaagaagug

SEQ ID NO: 753828 - RNA, 19 nt, Homo sapiens
gagcugcacugugaugaga

SEQ ID NO: 753829 - RNA, 19 nt, Homo sapiens
ugaaauuacuucuguuugg

SEQ ID NO: 753830 - RNA, 19 nt, Homo sapiens
caacauuggucuaggacau

SEQ ID NO: 753831 - RNA, 19 nt, Homo sapiens
gagaagacuaucaucauug

SEQ ID NO: 753832 - RNA, 19 nt, Homo sapiens
cagaggugcuguaauuuua

SEQ ID NO: 753833 - RNA, 19 nt, Homo sapiens
uuacugaccagccaauaua

SEQ ID NO: 753834 - RNA, 19 nt, Homo sapiens
ggaaggagaagcacagcaa

SEQ ID NO: 753835 - RNA, 19 nt, Homo sapiens
ucagacauguugagagaga

SEQ ID NO: 753836 - RNA, 19 nt, Homo sapiens
gcccuuacauugugcaguu

SEQ ID NO: 753837 - RNA, 19 nt, Homo sapiens
ggucaucauugaauauaca

SEQ ID NO: 753838 - RNA, 19 nt, Homo sapiens
agaaagcucuauuggacaa

SEQ ID NO: 753839 - RNA, 19 nt, Homo sapiens
guacaacugacuagauuug

SEQ ID NO: 753840 - RNA, 19 nt, Homo sapiens
uaacuacccuucucuaucc

SEQ ID NO: 753841 - RNA, 19 nt, Homo sapiens
cuauaaaucacccaacuaa

SEQ ID NO: 753842 - RNA, 19 nt, Homo sapiens
aaacacugcaagacaaaua

SEQ ID NO: 753843 - RNA, 19 nt, Homo sapiens
uaaguuggcaauaacagua

SEQ ID NO: 753844 - RNA, 19 nt, Homo sapiens
gagaagcacagcaauauac

SEQ ID NO: 753845 - RNA, 19 nt, Homo sapiens
cauagaacauccaguuaag

SEQ ID NO: 753846 - RNA, 19 nt, Homo sapiens
gcacaaauucacugacugu

SEQ ID NO: 753847 - RNA, 19 nt, Homo sapiens
ugaguaauagcacaaagua

SEQ ID NO: 753848 - RNA, 19 nt, Homo sapiens
guugaccucuuucucugua

SEQ ID NO: 753849 - RNA, 19 nt, Homo sapiens
uggagaagauaccugguuu

SEQ ID NO: 753850 - RNA, 19 nt, Homo sapiens
aaaaggagcuggagaagau

SEQ ID NO: 753851 - RNA, 19 nt, Homo sapiens
ugacuagauuuguuugaga

SEQ ID NO: 753852 - RNA, 19 nt, Homo sapiens
cauggacugucauuucuga

SEQ ID NO: 753853 - RNA, 19 nt, Homo sapiens
cuucagacauguugagaga

SEQ ID NO: 753854 - RNA, 19 nt, Homo sapiens
acacaaguuucaacauuca

SEQ ID NO: 753855 - RNA, 19 nt, Homo sapiens
auaaaucacccaacuaaga

SEQ ID NO: 753856 - RNA, 19 nt, Homo sapiens
cugauacucuucauuccua

SEQ ID NO: 753857 - RNA, 19 nt, Homo sapiens
uacaaacacugcaagacaa

SEQ ID NO: 753858 - RNA, 19 nt, Homo sapiens
acacauagaacauccaguu

SEQ ID NO: 753859 - RNA, 19 nt, Homo sapiens
gccaggggcuuuuagauaa

SEQ ID NO: 753860 - RNA, 19 nt, Homo sapiens
cauaauauacguacaacug

SEQ ID NO: 753861 - RNA, 19 nt, Homo sapiens
ggaaggaacaacaagaagu

SEQ ID NO: 753862 - RNA, 19 nt, Homo sapiens
caugagguaugcagaaaca

SEQ ID NO: 753863 - RNA, 19 nt, Homo sapiens
uacuuuauccuccugauua

SEQ ID NO: 753864 - RNA, 19 nt, Homo sapiens
guaccagcauagacuguau

SEQ ID NO: 753865 - RNA, 19 nt, Homo sapiens
ucucuugucuccuucaguu

SEQ ID NO: 753866 - RNA, 19 nt, Homo sapiens
acacacacacauacacaua

SEQ ID NO: 753867 - RNA, 19 nt, Homo sapiens
gagcucauggccugucuaa

SEQ ID NO: 753868 - RNA, 19 nt, Homo sapiens
caagaguggugggaucaga

SEQ ID NO: 753869 - RNA, 19 nt, Homo sapiens
gccaugagguaugcagaaa

SEQ ID NO: 753870 - RNA, 19 nt, Homo sapiens
ccuaaguccuucagacaug

SEQ ID NO: 753871 - RNA, 19 nt, Homo sapiens
gacauuaaacucagacuag

SEQ ID NO: 753872 - RNA, 19 nt, Homo sapiens
ggaaagaaaacaugacuga

SEQ ID NO: 753873 - RNA, 19 nt, Homo sapiens
gcacucauggcuucuccua

SEQ ID NO: 753874 - RNA, 19 nt, Homo sapiens
ggacuucauaugcaacuug

SEQ ID NO: 753875 - RNA, 19 nt, Homo sapiens
ugucauuucugauuucugu

SEQ ID NO: 753876 - RNA, 19 nt, Homo sapiens
uaaaucacccaacuaagau

SEQ ID NO: 753877 - RNA, 19 nt, Homo sapiens
gcagaguguugccaauuuu

SEQ ID NO: 753878 - RNA, 19 nt, Homo sapiens
cugaaaguccagaguguua

SEQ ID NO: 753879 - RNA, 19 nt, Homo sapiens
ccaaauugcuaugaacuac

SEQ ID NO: 753880 - RNA, 19 nt, Homo sapiens
uagaacauccaguuaaguu

SEQ ID NO: 753881 - RNA, 19 nt, Homo sapiens
gcaaaauaccgaauacuga

SEQ ID NO: 753882 - RNA, 19 nt, Homo sapiens
acacaucgaguauaugcua

SEQ ID NO: 753883 - RNA, 19 nt, Homo sapiens
ggcaauaacaguauacauc

SEQ ID NO: 753884 - RNA, 19 nt, Homo sapiens
cucauggccugucuaaauu

SEQ ID NO: 753885 - RNA, 19 nt, Homo sapiens
acacacacacacacacaua

SEQ ID NO: 753886 - RNA, 19 nt, Homo sapiens
acauagaacauccaguuaa

SEQ ID NO: 753887 - RNA, 19 nt, Homo sapiens
caacaagaaguggccgaua

SEQ ID NO: 753888 - RNA, 19 nt, Homo sapiens
gccauggacugucauuucu

SEQ ID NO: 753889 - RNA, 19 nt, Homo sapiens
caucgaguauaugcuauug

SEQ ID NO: 753890 - RNA, 19 nt, Homo sapiens
gcacuuccauuuuccauag

SEQ ID NO: 753891 - RNA, 19 nt, Homo sapiens
gacuucauaugcaacuuga

SEQ ID NO: 753892 - RNA, 19 nt, Homo sapiens
ccaauuacagcacgagaga

SEQ ID NO: 753893 - RNA, 19 nt, Homo sapiens
ccacugaccugguaaagaa

SEQ ID NO: 753894 - RNA, 19 nt, Homo sapiens
gaacauauacauagagaga

SEQ ID NO: 753895 - RNA, 19 nt, Homo sapiens
ucaagcagauugcacauuu

SEQ ID NO: 753896 - RNA, 19 nt, Homo sapiens
caacuccacugaccuggua

SEQ ID NO: 753897 - RNA, 19 nt, Homo sapiens
ucacuuggcuauuuacuga

SEQ ID NO: 753898 - RNA, 19 nt, Homo sapiens
gugcuuugaugauguaaua

SEQ ID NO: 753899 - RNA, 19 nt, Homo sapiens
gaaauggaaaggugaauug

SEQ ID NO: 753900 - RNA, 19 nt, Homo sapiens
uaaccucacuuggcuauuu

SEQ ID NO: 753901 - RNA, 19 nt, Homo sapiens
aaagugaacucccaggaaa

SEQ ID NO: 753902 - RNA, 19 nt, Homo sapiens
gcucaaggcuggugaaguc

SEQ ID NO: 753903 - RNA, 19 nt, Homo sapiens
cauauaagcugagaauuag

SEQ ID NO: 753904 - RNA, 19 nt, Homo sapiens
gcucuuaaggcaauuauaa

SEQ ID NO: 753905 - RNA, 19 nt, Homo sapiens
caucugcauuuauagcuua

SEQ ID NO: 753906 - RNA, 19 nt, Homo sapiens
aagcugugcuccagaauuu

SEQ ID NO: 753907 - RNA, 19 nt, Homo sapiens
gaacugaagcccuuugaca

SEQ ID NO: 753908 - RNA, 19 nt, Homo sapiens
gaaagugaacucccaggaa

SEQ ID NO: 753909 - RNA, 19 nt, Homo sapiens
ggguuaugcucccugguua

SEQ ID NO: 753910 - RNA, 19 nt, Homo sapiens
caacuuggacugaaacuuc

SEQ ID NO: 753911 - RNA, 19 nt, Homo sapiens
cagcuuuaauggaauauug

SEQ ID NO: 753912 - RNA, 19 nt, Homo sapiens
guaaauaagagcaaccuau

SEQ ID NO: 753913 - RNA, 19 nt, Homo sapiens
gauuacaucaucugcauuu

SEQ ID NO: 753914 - RNA, 19 nt, Homo sapiens
guugaaggccaaacauaua

SEQ ID NO: 753915 - RNA, 19 nt, Homo sapiens
gcuauuuacugauuacauc

SEQ ID NO: 753916 - RNA, 19 nt, Homo sapiens
uggaauauugggugaauua

SEQ ID NO: 753917 - RNA, 19 nt, Homo sapiens
gggaagaguccaugggaaa

SEQ ID NO: 753918 - RNA, 19 nt, Homo sapiens
ucauuaagaugggaaguga

SEQ ID NO: 753919 - RNA, 19 nt, Homo sapiens
ggagcccacuuugccauuu

SEQ ID NO: 753920 - RNA, 19 nt, Homo sapiens
uaaaggguaggaugaauau

SEQ ID NO: 753921 - RNA, 19 nt, Homo sapiens
gaauauugggugaauuaga

SEQ ID NO: 753922 - RNA, 19 nt, Homo sapiens
ggaaauggaaaggugaauu

SEQ ID NO: 753923 - RNA, 19 nt, Homo sapiens
ggacagcucaggucacaca

SEQ ID NO: 753924 - RNA, 19 nt, Homo sapiens
gaagcugugcuccagaauu

SEQ ID NO: 753925 - RNA, 19 nt, Homo sapiens
ccaguaccauccacaacaa

SEQ ID NO: 753926 - RNA, 19 nt, Homo sapiens
ccaguggcauggaaauuuc

SEQ ID NO: 753927 - RNA, 19 nt, Homo sapiens
ccaaacauauaagcugaga

SEQ ID NO: 753928 - RNA, 19 nt, Homo sapiens
gagcccacuuugccauuug

SEQ ID NO: 753929 - RNA, 19 nt, Homo sapiens
ccuccugccuuggcuaaua

SEQ ID NO: 753930 - RNA, 19 nt, Homo sapiens
uaugcucccugguuaacua

SEQ ID NO: 753931 - RNA, 19 nt, Homo sapiens
gugguuguguuuguauaua

SEQ ID NO: 753932 - RNA, 19 nt, Homo sapiens
aaggguaggaugaauauuu

SEQ ID NO: 753933 - RNA, 19 nt, Homo sapiens
gaaaggugcauugguuuua

SEQ ID NO: 753934 - RNA, 19 nt, Homo sapiens
gggaguaguugggaaaugg

SEQ ID NO: 753935 - RNA, 19 nt, Homo sapiens
aaccucacuuggcuauuua

SEQ ID NO: 753936 - RNA, 19 nt, Homo sapiens
cuaauaaaggguaggauga

SEQ ID NO: 753937 - RNA, 19 nt, Homo sapiens
gcugagaauuaggcuuaaa

SEQ ID NO: 753938 - RNA, 19 nt, Homo sapiens
aaaccggagcauaaaguua

SEQ ID NO: 753939 - RNA, 19 nt, Homo sapiens
gaagaguccaugggaaaug

SEQ ID NO: 753940 - RNA, 19 nt, Homo sapiens
cauauucuguggcaagauc

SEQ ID NO: 753941 - RNA, 19 nt, Homo sapiens
acauauacauagagagaug

SEQ ID NO: 753942 - RNA, 19 nt, Homo sapiens
aauauugggugaauuagag

SEQ ID NO: 753943 - RNA, 19 nt, Homo sapiens
gggaaaggugcauugguuu

SEQ ID NO: 753944 - RNA, 19 nt, Homo sapiens
ccaaggucauugucucugu

SEQ ID NO: 753945 - RNA, 19 nt, Homo sapiens
guaugacaguggugcauca

SEQ ID NO: 753946 - RNA, 19 nt, Homo sapiens
ccuguaugcuaguaucauu

SEQ ID NO: 753947 - RNA, 19 nt, Homo sapiens
cauagcaacuuggacugaa

SEQ ID NO: 753948 - RNA, 19 nt, Homo sapiens
ggggaaaggugcauugguu

SEQ ID NO: 753949 - RNA, 19 nt, Homo sapiens
auaaaggguaggaugaaua

SEQ ID NO: 753950 - RNA, 19 nt, Homo sapiens
cuagaggcccuguaugcua

SEQ ID NO: 753951 - RNA, 19 nt, Homo sapiens
aaccggagcauaaaguuaa

SEQ ID NO: 753952 - RNA, 19 nt, Homo sapiens
cauugucucugucgaagau

SEQ ID NO: 753953 - RNA, 19 nt, Homo sapiens
acacagugauggagaaacu

SEQ ID NO: 753954 - RNA, 19 nt, Homo sapiens
gccacacggucauuaagau

SEQ ID NO: 753955 - RNA, 19 nt, Homo sapiens
aaauacacaugcucccaau

SEQ ID NO: 753956 - RNA, 19 nt, Homo sapiens
cccagaaccucuccaugga

SEQ ID NO: 753957 - RNA, 19 nt, Homo sapiens
gaacgaggcccuggaucuc

SEQ ID NO: 753958 - RNA, 19 nt, Homo sapiens
uugcagcuuuaauggaaua

SEQ ID NO: 753959 - RNA, 19 nt, Homo sapiens
ggaagaguccaugggaaau

SEQ ID NO: 753960 - RNA, 19 nt, Homo sapiens
caagaucaaaggccucuca

SEQ ID NO: 753961 - RNA, 19 nt, Homo sapiens
ugccuuggcuaauaacaga

SEQ ID NO: 753962 - RNA, 19 nt, Homo sapiens
acuaaaacguggaaacuuu

SEQ ID NO: 753963 - RNA, 19 nt, Homo sapiens
cugaacauauacauagaga

SEQ ID NO: 753964 - RNA, 19 nt, Homo sapiens
uaauaaaggguaggaugaa

SEQ ID NO: 753965 - RNA, 19 nt, Homo sapiens
gaaaggugaauuggcucua

SEQ ID NO: 753966 - RNA, 19 nt, Homo sapiens
guggacagcucaggucaca

SEQ ID NO: 753967 - RNA, 19 nt, Homo sapiens
ucaugugguuguguuugua

SEQ ID NO: 753968 - RNA, 19 nt, Homo sapiens
acacaugcucccaaucaaa

SEQ ID NO: 753969 - RNA, 19 nt, Homo sapiens
auaacagacuggagaaugg

SEQ ID NO: 753970 - RNA, 19 nt, Homo sapiens
uggcauggcucagcugauc

SEQ ID NO: 753971 - RNA, 19 nt, Homo sapiens
uaggagauaucuauaaccu

SEQ ID NO: 753972 - RNA, 19 nt, Homo sapiens
aggguaggaugaauauuuc

SEQ ID NO: 753973 - RNA, 19 nt, Homo sapiens
aauaaaggguaggaugaau

SEQ ID NO: 753974 - RNA, 19 nt, Homo sapiens
gaucaugugguuguguuug

SEQ ID NO: 753975 - RNA, 19 nt, Homo sapiens
ggucauugucucugucgaa

SEQ ID NO: 753976 - RNA, 19 nt, Homo sapiens
ggagagcccaguggugaug

SEQ ID NO: 753977 - RNA, 19 nt, Homo sapiens
auagagagauggguuaugc

SEQ ID NO: 753978 - RNA, 19 nt, Homo sapiens
cuucagggcuaugacauca

SEQ ID NO: 753979 - RNA, 19 nt, Homo sapiens
caaggcuggugaagucagu

SEQ ID NO: 753980 - RNA, 19 nt, Homo sapiens
caaguucagcuccaguuuc

SEQ ID NO: 753981 - RNA, 19 nt, Homo sapiens
ccaaguucagcuccaguuu

SEQ ID NO: 753982 - RNA, 19 nt, Homo sapiens
uugaaggccaaacauauaa

SEQ ID NO: 753983 - RNA, 19 nt, Homo sapiens
aaaggugaauuggcucuag

SEQ ID NO: 753984 - RNA, 19 nt, Homo sapiens
ggaaaggugcauugguuuu

SEQ ID NO: 753985 - RNA, 19 nt, Homo sapiens
auacacaugcucccaauca

SEQ ID NO: 753986 - RNA, 19 nt, Homo sapiens
agugaacucccaggaaaua

SEQ ID NO: 753987 - RNA, 19 nt, Homo sapiens
ggagcauaaaguuaaagaa

SEQ ID NO: 753988 - RNA, 19 nt, Homo sapiens
aaacuucuccuucaaaaga

SEQ ID NO: 753989 - RNA, 19 nt, Homo sapiens
gaagucaaggcugaaaaua

SEQ ID NO: 753990 - RNA, 19 nt, Homo sapiens
uugaagcugugcuccagaa

SEQ ID NO: 753991 - RNA, 19 nt, Homo sapiens
ggaacaucaacuccacuga

SEQ ID NO: 753992 - RNA, 19 nt, Homo sapiens
auagcaacuuggacugaaa

SEQ ID NO: 753993 - RNA, 19 nt, Homo sapiens
gaagaaaggugucaagaac

SEQ ID NO: 753994 - RNA, 19 nt, Homo sapiens
ucaagaaguucgcauguaa

SEQ ID NO: 753995 - RNA, 19 nt, Homo sapiens
caucacgccuagagaauua

SEQ ID NO: 753996 - RNA, 19 nt, Homo sapiens
gcaaacucaugaacaguaa

SEQ ID NO: 753997 - RNA, 19 nt, Homo sapiens
ccaagaagcuccucgacaa

SEQ ID NO: 753998 - RNA, 19 nt, Homo sapiens
guauauugcuucacacuga

SEQ ID NO: 753999 - RNA, 19 nt, Homo sapiens
uaucuggccucguuauaua

SEQ ID NO: 754000 - RNA, 19 nt, Homo sapiens
gaagaaggccugguaaaug

SEQ ID NO: 754001 - RNA, 19 nt, Homo sapiens
cgacaaagcuugggcugaa

SEQ ID NO: 754002 - RNA, 19 nt, Homo sapiens
cagcagaccucgcaggaaa

SEQ ID NO: 754003 - RNA, 19 nt, Homo sapiens
guaucgagcuguuucuaaa

SEQ ID NO: 754004 - RNA, 19 nt, Homo sapiens
gaugagaacuugaugaaaa

SEQ ID NO: 754005 - RNA, 19 nt, Homo sapiens
gcaagaagccaaagaugga

SEQ ID NO: 754006 - RNA, 19 nt, Homo sapiens
gggagaagguggccucguu

SEQ ID NO: 754007 - RNA, 19 nt, Homo sapiens
gcaacuuccuguacauaug

SEQ ID NO: 754008 - RNA, 19 nt, Homo sapiens
ggacagcgcuagauuucgu

SEQ ID NO: 754009 - RNA, 19 nt, Homo sapiens
gguccucucuccuuuggua

SEQ ID NO: 754010 - RNA, 19 nt, Homo sapiens
gguaaacguguguauuaua

SEQ ID NO: 754011 - RNA, 19 nt, Homo sapiens
ggaagaaggccugguaaau

SEQ ID NO: 754012 - RNA, 19 nt, Homo sapiens
cgacuaguguucuuauuag

SEQ ID NO: 754013 - RNA, 19 nt, Homo sapiens
aagaaggccugguaaaugu

SEQ ID NO: 754014 - RNA, 19 nt, Homo sapiens
uauuauaucuggccucguu

SEQ ID NO: 754015 - RNA, 19 nt, Homo sapiens
gaaauccgccucaaguaca

SEQ ID NO: 754016 - RNA, 19 nt, Homo sapiens
gcugauccguuaugcagaa

SEQ ID NO: 754017 - RNA, 19 nt, Homo sapiens
caccagugcugcccaaaga

SEQ ID NO: 754018 - RNA, 19 nt, Homo sapiens
ucacggcgcugaccucaca

SEQ ID NO: 754019 - RNA, 19 nt, Homo sapiens
gcccaucccuuuccgacaa

SEQ ID NO: 754020 - RNA, 19 nt, Homo sapiens
ccucugagcccaucccuuu

SEQ ID NO: 754021 - RNA, 19 nt, Homo sapiens
gcaaacaacagaacuacca

SEQ ID NO: 754022 - RNA, 19 nt, Homo sapiens
gagcgcagcuuccucuacu

SEQ ID NO: 754023 - RNA, 19 nt, Homo sapiens
ugccaaaccuggagaacuu

SEQ ID NO: 754024 - RNA, 19 nt, Homo sapiens
ggaaacaucacgccuagag

SEQ ID NO: 754025 - RNA, 19 nt, Homo sapiens
caacuuccuguacauauga

SEQ ID NO: 754026 - RNA, 19 nt, Homo sapiens
ggcaaacucaugaacagua

SEQ ID NO: 754027 - RNA, 19 nt, Homo sapiens
gacgacauguccaccaaau

SEQ ID NO: 754028 - RNA, 19 nt, Homo sapiens
aaacaucacgccuagagaa

SEQ ID NO: 754029 - RNA, 19 nt, Homo sapiens
cacugaagauuguguguau

SEQ ID NO: 754030 - RNA, 19 nt, Homo sapiens
gcagggacagcgcuagauu

SEQ ID NO: 754031 - RNA, 19 nt, Homo sapiens
gaaauccaaccaacagauc

SEQ ID NO: 754032 - RNA, 19 nt, Homo sapiens
gcagaaauccaaccaacag

SEQ ID NO: 754033 - RNA, 19 nt, Homo sapiens
caacugguccucucuccuu

SEQ ID NO: 754034 - RNA, 19 nt, Homo sapiens
gggcagaagcucccaacuu
